United States Patent 7,250,289 (METHODS OF GENETIC ANALYSIS OF MOUSE) - sequence listing, part 17

SEQ ID NO: 643683 - DNA, 25 bp, Mus musculus
gggtttctgtacgatcagaggctca

SEQ ID NO: 643684 - DNA, 25 bp, Mus musculus
gggtttctgtcacagaccatgcttt

SEQ ID NO: 643685 - DNA, 25 bp, Mus musculus
gggtttctgtcagagaccatgcttt

SEQ ID NO: 643686 - DNA, 25 bp, Mus musculus
gggtttctgtccatctaaggcttag

SEQ ID NO: 643687 - DNA, 25 bp, Mus musculus
gggtttctgtcccagagctctgttg

SEQ ID NO: 643688 - DNA, 25 bp, Mus musculus
gggtttctgtccgagagctctgttg

SEQ ID NO: 643689 - DNA, 25 bp, Mus musculus
gggtttctgtccttctaaggcttag

SEQ ID NO: 643690 - DNA, 25 bp, Mus musculus
gggtttctgtctccattgtttttga

SEQ ID NO: 643691 - DNA, 25 bp, Mus musculus
gggtttctgtctgcattgtttttga

SEQ ID NO: 643692 - DNA, 25 bp, Mus musculus
gggtttctgttgacacaacctgatt

SEQ ID NO: 643693 - DNA, 25 bp, Mus musculus
gggtttctgttgtcacaacctgatt

SEQ ID NO: 643694 - DNA, 25 bp, Mus musculus
gggtttctgtttacatgatgctgta

SEQ ID NO: 643695 - DNA, 25 bp, Mus musculus
gggtttctgttttcatgatgctgta

SEQ ID NO: 643696 - DNA, 25 bp, Mus musculus
gggtttcttaccagttgctgtactt

SEQ ID NO: 643697 - DNA, 25 bp, Mus musculus
gggtttcttacctgttgctgtactt

SEQ ID NO: 643698 - DNA, 25 bp, Mus musculus
gggtttcttataccagcgactggta

SEQ ID NO: 643699 - DNA, 25 bp, Mus musculus
gggtttcttatagcagcgactggta

SEQ ID NO: 643700 - DNA, 25 bp, Mus musculus
gggtttcttatgaacctacagccaa

SEQ ID NO: 643701 - DNA, 25 bp, Mus musculus
gggtttcttatgtacctacagccaa

SEQ ID NO: 643702 - DNA, 25 bp, Mus musculus
gggtttcttcaaaacaccagactag

SEQ ID NO: 643703 - DNA, 25 bp, Mus musculus
gggtttcttcaatacaccagactag

SEQ ID NO: 643704 - DNA, 25 bp, Mus musculus
gggtttcttcagctcattacactaa

SEQ ID NO: 643705 - DNA, 25 bp, Mus musculus
gggtttcttcaggtcattacactaa

SEQ ID NO: 643706 - DNA, 25 bp, Mus musculus
gggtttcttcatatgatccaaatac

SEQ ID NO: 643707 - DNA, 25 bp, Mus musculus
gggtttcttcatttgatccaaatac

SEQ ID NO: 643708 - DNA, 25 bp, Mus musculus
gggtttcttcttacatgatgccgag

SEQ ID NO: 643709 - DNA, 25 bp, Mus musculus
gggtttcttctttcatgatgccgag

SEQ ID NO: 643710 - DNA, 25 bp, Mus musculus
gggtttcttgctcgcatctttttaa

SEQ ID NO: 643711 - DNA, 25 bp, Mus musculus
gggtttcttgctggcatctttttaa

SEQ ID NO: 643712 - DNA, 25 bp, Mus musculus
gggtttcttttcaatctatgcagat

SEQ ID NO: 643713 - DNA, 25 bp, Mus musculus
gggtttcttttcaatgatccatatt

SEQ ID NO: 643714 - DNA, 25 bp, Mus musculus
gggtttcttttctatctatgcagat

SEQ ID NO: 643715 - DNA, 25 bp, Mus musculus
gggtttcttttctatgatccatatt

SEQ ID NO: 643716 - DNA, 25 bp, Mus musculus
gggtttgaactcagctctttttact

SEQ ID NO: 643717 - DNA, 25 bp, Mus musculus
gggtttgaactctgctctttttact

SEQ ID NO: 643718 - DNA, 25 bp, Mus musculus
gggtttgaattactgcccagggtca

SEQ ID NO: 643719 - DNA, 25 bp, Mus musculus
gggtttgaattagtgcccagggtca

SEQ ID NO: 643720 - DNA, 25 bp, Mus musculus
gggtttgacactaaattgaattgct

SEQ ID NO: 643721 - DNA, 25 bp, Mus musculus
gggtttgacacttaattgaattgct

SEQ ID NO: 643722 - DNA, 25 bp, Mus musculus
gggtttgaccctcattaatcacacc

SEQ ID NO: 643723 - DNA, 25 bp, Mus musculus
gggtttgaccctgattaatcacacc

SEQ ID NO: 643724 - DNA, 25 bp, Mus musculus
gggtttgagatcacgtttagttgaa

SEQ ID NO: 643725 - DNA, 25 bp, Mus musculus
gggtttgagatctcgtttagttgaa

SEQ ID NO: 643726 - DNA, 25 bp, Mus musculus
gggtttgaggacagcttaggctaca

SEQ ID NO: 643727 - DNA, 25 bp, Mus musculus
gggtttgaggactgcttaggctaca

SEQ ID NO: 643728 - DNA, 25 bp, Mus musculus
gggtttgaggctagcactcttgctc

SEQ ID NO: 643729 - DNA, 25 bp, Mus musculus
gggtttgaggctcacttgatctagt

SEQ ID NO: 643730 - DNA, 25 bp, Mus musculus
gggtttgaggctgacttgatctagt

SEQ ID NO: 643731 - DNA, 25 bp, Mus musculus
gggtttgaggcttgcactcttgctc

SEQ ID NO: 643732 - DNA, 25 bp, Mus musculus
gggtttgagtctcagaacctccaaa

SEQ ID NO: 643733 - DNA, 25 bp, Mus musculus
gggtttgagtctcatccttttaaat

SEQ ID NO: 643734 - DNA, 25 bp, Mus musculus
gggtttgagtctgagaacctccaaa

SEQ ID NO: 643735 - DNA, 25 bp, Mus musculus
gggtttgagtctgatccttttaaat

SEQ ID NO: 643736 - DNA, 25 bp, Mus musculus
gggtttgataccatagcaccacgta

SEQ ID NO: 643737 - DNA, 25 bp, Mus musculus
gggtttgataccttagcaccacgta

SEQ ID NO: 643738 - DNA, 25 bp, Mus musculus
gggtttgatccactcacaaagaaat

SEQ ID NO: 643739 - DNA, 25 bp, Mus musculus
gggtttgatccagtcacaaagaaat

SEQ ID NO: 643740 - DNA, 25 bp, Mus musculus
gggtttgatcccaggagtcactact

SEQ ID NO: 643741 - DNA, 25 bp, Mus musculus
gggtttgatccctggagtcactact

SEQ ID NO: 643742 - DNA, 25 bp, Mus musculus
gggtttgatcctaagtactgcacaa

SEQ ID NO: 643743 - DNA, 25 bp, Mus musculus
gggtttgatccttagtactgcacaa

SEQ ID NO: 643744 - DNA, 25 bp, Mus musculus
gggtttgatggcaacagccccatca

SEQ ID NO: 643745 - DNA, 25 bp, Mus musculus
gggtttgatggctacagccccatca

SEQ ID NO: 643746 - DNA, 25 bp, Mus musculus
gggtttgatgtacattccacgcaga

SEQ ID NO: 643747 - DNA, 25 bp, Mus musculus
gggtttgatgtagattccacgcaga

SEQ ID NO: 643748 - DNA, 25 bp, Mus musculus
gggtttgattccacacatggttaag

SEQ ID NO: 643749 - DNA, 25 bp, Mus musculus
gggtttgattcctcacatggttaag

SEQ ID NO: 643750 - DNA, 25 bp, Mus musculus
gggtttgcaaacattccatggtcaa

SEQ ID NO: 643751 - DNA, 25 bp, Mus musculus
gggtttgcaaactttccatggtcaa

SEQ ID NO: 643752 - DNA, 25 bp, Mus musculus
gggtttgcaacaatttacagcattg

SEQ ID NO: 643753 - DNA, 25 bp, Mus musculus
gggtttgcaacattttacagcattg

SEQ ID NO: 643754 - DNA, 25 bp, Mus musculus
gggtttgcaccaatgacatgttcag

SEQ ID NO: 643755 - DNA, 25 bp, Mus musculus
gggtttgcaccattgacatgttcag

SEQ ID NO: 643756 - DNA, 25 bp, Mus musculus
gggtttgcacttattatctcatttg

SEQ ID NO: 643757 - DNA, 25 bp, Mus musculus
gggtttgcactttttatctcatttg

SEQ ID NO: 643758 - DNA, 25 bp, Mus musculus
gggtttgcagcaacaagtaccttgc

SEQ ID NO: 643759 - DNA, 25 bp, Mus musculus
gggtttgcagcatcaagtaccttgc

SEQ ID NO: 643760 - DNA, 25 bp, Mus musculus
gggtttgcagggagaacacaccagc

SEQ ID NO: 643761 - DNA, 25 bp, Mus musculus
gggtttgcagggtgaacacaccagc

SEQ ID NO: 643762 - DNA, 25 bp, Mus musculus
gggtttgcatgtatacaggctccac

SEQ ID NO: 643763 - DNA, 25 bp, Mus musculus
gggtttgcatgtttacaggctccac

SEQ ID NO: 643764 - DNA, 25 bp, Mus musculus
gggtttgccagcacagcagaactag

SEQ ID NO: 643765 - DNA, 25 bp, Mus musculus
gggtttgccagctcagcagaactag

SEQ ID NO: 643766 - DNA, 25 bp, Mus musculus
gggtttgccccacatgatcagtgac

SEQ ID NO: 643767 - DNA, 25 bp, Mus musculus
gggtttgccccagatgatcagtgac

SEQ ID NO: 643768 - DNA, 25 bp, Mus musculus
gggtttgccttgagtaccttgcctc

SEQ ID NO: 643769 - DNA, 25 bp, Mus musculus
gggtttgccttgtgtaccttgcctc

SEQ ID NO: 643770 - DNA, 25 bp, Mus musculus
gggtttgcggccaggcttgcttctt

SEQ ID NO: 643771 - DNA, 25 bp, Mus musculus
gggtttgcggcctggcttgcttctt

SEQ ID NO: 643772 - DNA, 25 bp, Mus musculus
gggtttgctaccagtaccctggata

SEQ ID NO: 643773 - DNA, 25 bp, Mus musculus
gggtttgctacctgtaccctggata

SEQ ID NO: 643774 - DNA, 25 bp, Mus musculus
gggtttgctccaaaacatctacacc

SEQ ID NO: 643775 - DNA, 25 bp, Mus musculus
gggtttgctccaagcatgagctctt

SEQ ID NO: 643776 - DNA, 25 bp, Mus musculus
gggtttgctccataacatctacacc

SEQ ID NO: 643777 - DNA, 25 bp, Mus musculus
gggtttgctccatgcatgagctctt

SEQ ID NO: 643778 - DNA, 25 bp, Mus musculus
gggtttgctgaccagccagtctagc

SEQ ID NO: 643779 - DNA, 25 bp, Mus musculus
gggtttgctgacgagccagtctagc

SEQ ID NO: 643780 - DNA, 25 bp, Mus musculus
gggtttgcttaaacagtaagtttct

SEQ ID NO: 643781 - DNA, 25 bp, Mus musculus
gggtttgcttaatcagtaagtttct

SEQ ID NO: 643782 - DNA, 25 bp, Mus musculus
gggtttgcttacacaagcccttttg

SEQ ID NO: 643783 - DNA, 25 bp, Mus musculus
gggtttgcttactcaagcccttttg

SEQ ID NO: 643784 - DNA, 25 bp, Mus musculus
gggtttgctttaagtctcgaaaatc

SEQ ID NO: 643785 - DNA, 25 bp, Mus musculus
gggtttgctttatgtctcgaaaatc

SEQ ID NO: 643786 - DNA, 25 bp, Mus musculus
gggtttgctttgaccacatgttcat

SEQ ID NO: 643787 - DNA, 25 bp, Mus musculus
gggtttgctttgtccacatgttcat

SEQ ID NO: 643788 - DNA, 25 bp, Mus musculus
gggtttggaacacacactacttcaa

SEQ ID NO: 643789 - DNA, 25 bp, Mus musculus
gggtttggaacagacactacttcaa

SEQ ID NO: 643790 - DNA, 25 bp, Mus musculus
gggtttggagcccatcgcttctacc

SEQ ID NO: 643791 - DNA, 25 bp, Mus musculus
gggtttggagccgatcgcttctacc

SEQ ID NO: 643792 - DNA, 25 bp, Mus musculus
gggtttggatccctaactgaacagc

SEQ ID NO: 643793 - DNA, 25 bp, Mus musculus
gggtttggatccgtaactgaacagc

SEQ ID NO: 643794 - DNA, 25 bp, Mus musculus
gggtttggatgcagatctctttctg

SEQ ID NO: 643795 - DNA, 25 bp, Mus musculus
gggtttggatgctgatctctttctg

SEQ ID NO: 643796 - DNA, 25 bp, Mus musculus
gggtttggattgcttcacctctgtc

SEQ ID NO: 643797 - DNA, 25 bp, Mus musculus
gggtttggattggttcacctctgtc

SEQ ID NO: 643798 - DNA, 25 bp, Mus musculus
gggtttggcatccagtagctgatcc

SEQ ID NO: 643799 - DNA, 25 bp, Mus musculus
gggtttggcatcgagtagctgatcc

SEQ ID NO: 643800 - DNA, 25 bp, Mus musculus
gggtttggccccagcaccacacatg

SEQ ID NO: 643801 - DNA, 25 bp, Mus musculus
gggtttggcccctgcaccacacatg

SEQ ID NO: 643802 - DNA, 25 bp, Mus musculus
gggtttggcctcaaagtcttgtaga

SEQ ID NO: 643803 - DNA, 25 bp, Mus musculus
gggtttggcctctaagtcttgtaga

SEQ ID NO: 643804 - DNA, 25 bp, Mus musculus
gggtttggctagcttgttttcatct

SEQ ID NO: 643805 - DNA, 25 bp, Mus musculus
gggtttggctaggttgttttcatct

SEQ ID NO: 643806 - DNA, 25 bp, Mus musculus
gggtttggctttccaagaggctcca

SEQ ID NO: 643807 - DNA, 25 bp, Mus musculus
gggtttggctttgcaagaggctcca

SEQ ID NO: 643808 - DNA, 25 bp, Mus musculus
gggtttgggcttctcagtcagaaca

SEQ ID NO: 643809 - DNA, 25 bp, Mus musculus
gggtttgggcttgtcagtcagaaca

SEQ ID NO: 643810 - DNA, 25 bp, Mus musculus
gggtttggtagcagtggctctcacc

SEQ ID NO: 643811 - DNA, 25 bp, Mus musculus
gggtttggtagctgtggctctcacc

SEQ ID NO: 643812 - DNA, 25 bp, Mus musculus
gggtttggtctcatataaaacttat

SEQ ID NO: 643813 - DNA, 25 bp, Mus musculus
gggtttggtctcttataaaacttat

SEQ ID NO: 643814 - DNA, 25 bp, Mus musculus
gggtttggttgcagccacattgagc

SEQ ID NO: 643815 - DNA, 25 bp, Mus musculus
gggtttggttgctgccacattgagc

SEQ ID NO: 643816 - DNA, 25 bp, Mus musculus
gggtttgtacatatcaacttagtgc

SEQ ID NO: 643817 - DNA, 25 bp, Mus musculus
gggtttgtacatttcaacttagtgc

SEQ ID NO: 643818 - DNA, 25 bp, Mus musculus
gggtttgtccagcaagcctgaactt

SEQ ID NO: 643819 - DNA, 25 bp, Mus musculus
gggtttgtccaggaagcctgaactt

SEQ ID NO: 643820 - DNA, 25 bp, Mus musculus
gggtttgtccatcagagtttctttc

SEQ ID NO: 643821 - DNA, 25 bp, Mus musculus
gggtttgtccatgagagtttctttc

SEQ ID NO: 643822 - DNA, 25 bp, Mus musculus
gggtttgtctcacaggattgtcact

SEQ ID NO: 643823 - DNA, 25 bp, Mus musculus
gggtttgtctcagaggattgtcact

SEQ ID NO: 643824 - DNA, 25 bp, Mus musculus
gggtttgtctccactcacaggccac

SEQ ID NO: 643825 - DNA, 25 bp, Mus musculus
gggtttgtctcctctcacaggccac

SEQ ID NO: 643826 - DNA, 25 bp, Mus musculus
gggtttgtctctagcaatatttcat

SEQ ID NO: 643827 - DNA, 25 bp, Mus musculus
gggtttgtctcttgcaatatttcat

SEQ ID NO: 643828 - DNA, 25 bp, Mus musculus
gggtttgtctgcaggatgtcaggca

SEQ ID NO: 643829 - DNA, 25 bp, Mus musculus
gggtttgtctgctggatgtcaggca

SEQ ID NO: 643830 - DNA, 25 bp, Mus musculus
gggtttgtgactatactgtacctgt

SEQ ID NO: 643831 - DNA, 25 bp, Mus musculus
gggtttgtgactttactgtacctgt

SEQ ID NO: 643832 - DNA, 25 bp, Mus musculus
gggtttgtgattagagagcacccac

SEQ ID NO: 643833 - DNA, 25 bp, Mus musculus
gggtttgtgatttgagagcacccac

SEQ ID NO: 643834 - DNA, 25 bp, Mus musculus
gggtttgtggctacttttctgcgac

SEQ ID NO: 643835 - DNA, 25 bp, Mus musculus
gggtttgtggcttcttttctgcgac

SEQ ID NO: 643836 - DNA, 25 bp, Mus musculus
gggtttgttattcctacttactgta

SEQ ID NO: 643837 - DNA, 25 bp, Mus musculus
gggtttgttattgctacttactgta

SEQ ID NO: 643838 - DNA, 25 bp, Mus musculus
gggtttgtttctagatgttccatag

SEQ ID NO: 643839 - DNA, 25 bp, Mus musculus
gggtttgtttcttgatgttccatag

SEQ ID NO: 643840 - DNA, 25 bp, Mus musculus
gggtttgtttgactgctcatttgtt

SEQ ID NO: 643841 - DNA, 25 bp, Mus musculus
gggtttgtttgagtgctcatttgtt

SEQ ID NO: 643842 - DNA, 25 bp, Mus musculus
gggtttgttttcaccgtgcagatcc

SEQ ID NO: 643843 - DNA, 25 bp, Mus musculus
gggtttgttttcagcaggccaagaa

SEQ ID NO: 643844 - DNA, 25 bp, Mus musculus
gggtttgttttctccgtgcagatcc

SEQ ID NO: 643845 - DNA, 25 bp, Mus musculus
gggtttgttttctgcaggccaagaa

SEQ ID NO: 643846 - DNA, 25 bp, Mus musculus
gggttttaaacaaccacctgacagc

SEQ ID NO: 643847 - DNA, 25 bp, Mus musculus
gggttttaaacatccacctgacagc

SEQ ID NO: 643848 - DNA, 25 bp, Mus musculus
gggttttaaattcacatcctcacac

SEQ ID NO: 643849 - DNA, 25 bp, Mus musculus
gggttttaaattgacatcctcacac

SEQ ID NO: 643850 - DNA, 25 bp, Mus musculus
gggttttaatccagttgtgccacag

SEQ ID NO: 643851 - DNA, 25 bp, Mus musculus
gggttttaatccatcttctggcctt

SEQ ID NO: 643852 - DNA, 25 bp, Mus musculus
gggttttaatcctgttgtgccacag

SEQ ID NO: 643853 - DNA, 25 bp, Mus musculus
gggttttaatccttcttctggcctt

SEQ ID NO: 643854 - DNA, 25 bp, Mus musculus
gggttttacaatcctggcatagctt

SEQ ID NO: 643855 - DNA, 25 bp, Mus musculus
gggttttacaatgctggcatagctt

SEQ ID NO: 643856 - DNA, 25 bp, Mus musculus
gggttttacacacgcagtgctcatt

SEQ ID NO: 643857 - DNA, 25 bp, Mus musculus
gggttttacacaggcagtgctcatt

SEQ ID NO: 643858 - DNA, 25 bp, Mus musculus
gggttttacactatcacaatcaaca

SEQ ID NO: 643859 - DNA, 25 bp, Mus musculus
gggttttacactttcacaatcaaca

SEQ ID NO: 643860 - DNA, 25 bp, Mus musculus
gggttttacagaacgtggccaagct

SEQ ID NO: 643861 - DNA, 25 bp, Mus musculus
gggttttacagatcgtggccaagct

SEQ ID NO: 643862 - DNA, 25 bp, Mus musculus
gggttttacataagtggctccatct

SEQ ID NO: 643863 - DNA, 25 bp, Mus musculus
gggttttacatatgtggctccatct

SEQ ID NO: 643864 - DNA, 25 bp, Mus musculus
gggttttaccacatcaaatgatctg

SEQ ID NO: 643865 - DNA, 25 bp, Mus musculus
gggttttaccacttcaaatgatctg

SEQ ID NO: 643866 - DNA, 25 bp, Mus musculus
gggttttagcagagactccaagagc

SEQ ID NO: 643867 - DNA, 25 bp, Mus musculus
gggttttagcagtgactccaagagc

SEQ ID NO: 643868 - DNA, 25 bp, Mus musculus
gggttttatacaatccactcgtgtt

SEQ ID NO: 643869 - DNA, 25 bp, Mus musculus
gggttttatacattccactcgtgtt

SEQ ID NO: 643870 - DNA, 25 bp, Mus musculus
gggttttatccaatcactcatagca

SEQ ID NO: 643871 - DNA, 25 bp, Mus musculus
gggttttatccattcactcatagca

SEQ ID NO: 643872 - DNA, 25 bp, Mus musculus
gggttttatgtcaagcctcagacca

SEQ ID NO: 643873 - DNA, 25 bp, Mus musculus
gggttttatgtctagcctcagacca

SEQ ID NO: 643874 - DNA, 25 bp, Mus musculus
gggttttattggctgattatcccaa

SEQ ID NO: 643875 - DNA, 25 bp, Mus musculus
gggttttattgggtgattatcccaa

SEQ ID NO: 643876 - DNA, 25 bp, Mus musculus
gggttttattgtctctgtcacctgg

SEQ ID NO: 643877 - DNA, 25 bp, Mus musculus
gggttttattgtgtctgtcacctgg

SEQ ID NO: 643878 - DNA, 25 bp, Mus musculus
gggttttcaaggagggccatcccag

SEQ ID NO: 643879 - DNA, 25 bp, Mus musculus
gggttttcaaggtgggccatcccag

SEQ ID NO: 643880 - DNA, 25 bp, Mus musculus
gggttttcaattctactcatgggat

SEQ ID NO: 643881 - DNA, 25 bp, Mus musculus
gggttttcaattgtactcatgggat

SEQ ID NO: 643882 - DNA, 25 bp, Mus musculus
gggttttcaccacaatccagcatgt

SEQ ID NO: 643883 - DNA, 25 bp, Mus musculus
gggttttcaccagaatccagcatgt

SEQ ID NO: 643884 - DNA, 25 bp, Mus musculus
gggttttcactgacatcccagattt

SEQ ID NO: 643885 - DNA, 25 bp, Mus musculus
gggttttcactgtcatcccagattt

SEQ ID NO: 643886 - DNA, 25 bp, Mus musculus
gggttttcagatctgctgaccacta

SEQ ID NO: 643887 - DNA, 25 bp, Mus musculus
gggttttcagatgtgctgaccacta

SEQ ID NO: 643888 - DNA, 25 bp, Mus musculus
gggttttcatgcagcaccaagatct

SEQ ID NO: 643889 - DNA, 25 bp, Mus musculus
gggttttcatgctgcaccaagatct

SEQ ID NO: 643890 - DNA, 25 bp, Mus musculus
gggttttcatgtagtctggcagaga

SEQ ID NO: 643891 - DNA, 25 bp, Mus musculus
gggttttcatgttgtctggcagaga

SEQ ID NO: 643892 - DNA, 25 bp, Mus musculus
gggttttccatgatctattcttgca

SEQ ID NO: 643893 - DNA, 25 bp, Mus musculus
gggttttccatgttctattcttgca

SEQ ID NO: 643894 - DNA, 25 bp, Mus musculus
gggttttcccagcatgaccactgca

SEQ ID NO: 643895 - DNA, 25 bp, Mus musculus
gggttttcccaggatgaccactgca

SEQ ID NO: 643896 - DNA, 25 bp, Mus musculus
gggttttcctacagtagatactatt

SEQ ID NO: 643897 - DNA, 25 bp, Mus musculus
gggttttcctactgtagatactatt

SEQ ID NO: 643898 - DNA, 25 bp, Mus musculus
gggttttcctagctacatctgggac

SEQ ID NO: 643899 - DNA, 25 bp, Mus musculus
gggttttcctaggtacatctgggac

SEQ ID NO: 643900 - DNA, 25 bp, Mus musculus
gggttttcctatccaaaggcaataa

SEQ ID NO: 643901 - DNA, 25 bp, Mus musculus
gggttttcctatgcaaaggcaataa

SEQ ID NO: 643902 - DNA, 25 bp, Mus musculus
gggttttcctgtaggcatttgtgtt

SEQ ID NO: 643903 - DNA, 25 bp, Mus musculus
gggttttcctgttggcatttgtgtt

SEQ ID NO: 643904 - DNA, 25 bp, Mus musculus
gggttttcgacacttcttgcgcgcg

SEQ ID NO: 643905 - DNA, 25 bp, Mus musculus
gggttttcgacagttcttgcgcgcg

SEQ ID NO: 643906 - DNA, 25 bp, Mus musculus
gggttttctaagaacctgcctctga

SEQ ID NO: 643907 - DNA, 25 bp, Mus musculus
gggttttctaagtacctgcctctga

SEQ ID NO: 643908 - DNA, 25 bp, Mus musculus
gggttttctatgctgtgtgacacaa

SEQ ID NO: 643909 - DNA, 25 bp, Mus musculus
gggttttctatggtgtgtgacacaa

SEQ ID NO: 643910 - DNA, 25 bp, Mus musculus
gggttttctctaccagacttaaggt

SEQ ID NO: 643911 - DNA, 25 bp, Mus musculus
gggttttctctagcagacttaaggt

SEQ ID NO: 643912 - DNA, 25 bp, Mus musculus
gggttttctctgcatgccagagtca

SEQ ID NO: 643913 - DNA, 25 bp, Mus musculus
gggttttctctggatgccagagtca

SEQ ID NO: 643914 - DNA, 25 bp, Mus musculus
gggttttctgatagaacctcaaaag

SEQ ID NO: 643915 - DNA, 25 bp, Mus musculus
gggttttctgattgaacctcaaaag

SEQ ID NO: 643916 - DNA, 25 bp, Mus musculus
gggttttctgtacactttacttgag

SEQ ID NO: 643917 - DNA, 25 bp, Mus musculus
gggttttctgtagactttacttgag

SEQ ID NO: 643918 - DNA, 25 bp, Mus musculus
gggttttctgtcacggttcgataat

SEQ ID NO: 643919 - DNA, 25 bp, Mus musculus
gggttttctgtctcggttcgataat

SEQ ID NO: 643920 - DNA, 25 bp, Mus musculus
gggttttgccatacgctcctcttct

SEQ ID NO: 643921 - DNA, 25 bp, Mus musculus
gggttttgccattcgctcctcttct

SEQ ID NO: 643922 - DNA, 25 bp, Mus musculus
gggttttgccttatatctcatttaa

SEQ ID NO: 643923 - DNA, 25 bp, Mus musculus
gggttttgccttttatctcatttaa

SEQ ID NO: 643924 - DNA, 25 bp, Mus musculus
gggttttgcttaatccagttcttca

SEQ ID NO: 643925 - DNA, 25 bp, Mus musculus
gggttttgcttattccagttcttca

SEQ ID NO: 643926 - DNA, 25 bp, Mus musculus
gggttttggatcacaccagggtcat

SEQ ID NO: 643927 - DNA, 25 bp, Mus musculus
gggttttggatctcaccagggtcat

SEQ ID NO: 643928 - DNA, 25 bp, Mus musculus
gggttttggctacatgcattctaag

SEQ ID NO: 643929 - DNA, 25 bp, Mus musculus
gggttttggctagatgcattctaag

SEQ ID NO: 643930 - DNA, 25 bp, Mus musculus
gggttttggtgcatcaccattcggt

SEQ ID NO: 643931 - DNA, 25 bp, Mus musculus
gggttttggtgcttcaccattcggt

SEQ ID NO: 643932 - DNA, 25 bp, Mus musculus
gggttttgtaagcagcgatctagtt

SEQ ID NO: 643933 - DNA, 25 bp, Mus musculus
gggttttgtaaggagcgatctagtt

SEQ ID NO: 643934 - DNA, 25 bp, Mus musculus
gggttttgtccgctctatccattga

SEQ ID NO: 643935 - DNA, 25 bp, Mus musculus
gggttttgtccggtctatccattga

SEQ ID NO: 643936 - DNA, 25 bp, Mus musculus
gggttttgttcaagtcagatacgtg

SEQ ID NO: 643937 - DNA, 25 bp, Mus musculus
gggttttgttcatgtcagatacgtg

SEQ ID NO: 643938 - DNA, 25 bp, Mus musculus
gggttttgttccagatgcctgcaaa

SEQ ID NO: 643939 - DNA, 25 bp, Mus musculus
gggttttgttcctgatgcctgcaaa

SEQ ID NO: 643940 - DNA, 25 bp, Mus musculus
gggtttttaagtactgacagcctga

SEQ ID NO: 643941 - DNA, 25 bp, Mus musculus
gggtttttaagttctgacagcctga

SEQ ID NO: 643942 - DNA, 25 bp, Mus musculus
gggtttttacctctcacattgcatt

SEQ ID NO: 643943 - DNA, 25 bp, Mus musculus
gggtttttacctgtcacattgcatt

SEQ ID NO: 643944 - DNA, 25 bp, Mus musculus
gggtttttactcaatatcacagcag

SEQ ID NO: 643945 - DNA, 25 bp, Mus musculus
gggtttttactcacacagtaccaag

SEQ ID NO: 643946 - DNA, 25 bp, Mus musculus
gggtttttactctatatcacagcag

SEQ ID NO: 643947 - DNA, 25 bp, Mus musculus
gggtttttactctcacagtaccaag

SEQ ID NO: 643948 - DNA, 25 bp, Mus musculus
gggtttttagatacttgttactcat

SEQ ID NO: 643949 - DNA, 25 bp, Mus musculus
gggtttttagatcagtcttgctctt

SEQ ID NO: 643950 - DNA, 25 bp, Mus musculus
gggtttttagatgagtcttgctctt

SEQ ID NO: 643951 - DNA, 25 bp, Mus musculus
gggtttttagattcttgttactcat

SEQ ID NO: 643952 - DNA, 25 bp, Mus musculus
gggtttttatacctgtgtagtcagt

SEQ ID NO: 643953 - DNA, 25 bp, Mus musculus
gggtttttatacgtgtgtagtcagt

SEQ ID NO: 643954 - DNA, 25 bp, Mus musculus
gggtttttcagacttgtgcattttc

SEQ ID NO: 643955 - DNA, 25 bp, Mus musculus
gggtttttcagagttgtgcattttc

SEQ ID NO: 643956 - DNA, 25 bp, Mus musculus
gggtttttcccactgatccacggag

SEQ ID NO: 643957 - DNA, 25 bp, Mus musculus
gggtttttcccagtgatccacggag

SEQ ID NO: 643958 - DNA, 25 bp, Mus musculus
gggtttttccgaacttgctagcccg

SEQ ID NO: 643959 - DNA, 25 bp, Mus musculus
gggtttttccgatcttgctagcccg

SEQ ID NO: 643960 - DNA, 25 bp, Mus musculus
gggttttttgcacgtgggtctcatc

SEQ ID NO: 643961 - DNA, 25 bp, Mus musculus
gggttttttgcaggtgggtctcatc

SEQ ID NO: 643962 - DNA, 25 bp, Mus musculus
ggtaaaaacttactcatagaacaat

SEQ ID NO: 643963 - DNA, 25 bp, Mus musculus
ggtaaaaacttagtcatagaacaat

SEQ ID NO: 643964 - DNA, 25 bp, Mus musculus
ggtaaaaagcgacgcccgccaggca

SEQ ID NO: 643965 - DNA, 25 bp, Mus musculus
ggtaaaaagcgaggcccgccaggca

SEQ ID NO: 643966 - DNA, 25 bp, Mus musculus
ggtaaaaatgtccattccctgccaa

SEQ ID NO: 643967 - DNA, 25 bp, Mus musculus
ggtaaaaatgtcgattccctgccaa

SEQ ID NO: 643968 - DNA, 25 bp, Mus musculus
ggtaaaacacatcccaatgagaatt

SEQ ID NO: 643969 - DNA, 25 bp, Mus musculus
ggtaaaacacatgccaatgagaatt

SEQ ID NO: 643970 - DNA, 25 bp, Mus musculus
ggtaaaacagatccattctcacagg

SEQ ID NO: 643971 - DNA, 25 bp, Mus musculus
ggtaaaacagatgcattctcacagg

SEQ ID NO: 643972 - DNA, 25 bp, Mus musculus
ggtaaaacccagcaggccatggaag

SEQ ID NO: 643973 - DNA, 25 bp, Mus musculus
ggtaaaacccaggaggccatggaag

SEQ ID NO: 643974 - DNA, 25 bp, Mus musculus
ggtaaaacctagctctcccattgag

SEQ ID NO: 643975 - DNA, 25 bp, Mus musculus
ggtaaaacctaggtctcccattgag

SEQ ID NO: 643976 - DNA, 25 bp, Mus musculus
ggtaaaacgcgaccacattccatgc

SEQ ID NO: 643977 - DNA, 25 bp, Mus musculus
ggtaaaacgcgagcacattccatgc

SEQ ID NO: 643978 - DNA, 25 bp, Mus musculus
ggtaaaactacgagtcaaaggactg

SEQ ID NO: 643979 - DNA, 25 bp, Mus musculus
ggtaaaactacgtgtcaaaggactg

SEQ ID NO: 643980 - DNA, 25 bp, Mus musculus
ggtaaaagccaacggttatccagca

SEQ ID NO: 643981 - DNA, 25 bp, Mus musculus
ggtaaaagccaagggttatccagca

SEQ ID NO: 643982 - DNA, 25 bp, Mus musculus
ggtaaaagcctgaaagcctcaagag

SEQ ID NO: 643983 - DNA, 25 bp, Mus musculus
ggtaaaagcctgatgtgataaataa

SEQ ID NO: 643984 - DNA, 25 bp, Mus musculus
ggtaaaagcctgtaagcctcaagag

SEQ ID NO: 643985 - DNA, 25 bp, Mus musculus
ggtaaaagcctgttgtgataaataa

SEQ ID NO: 643986 - DNA, 25 bp, Mus musculus
ggtaaaagctgcagctccatgatcc

SEQ ID NO: 643987 - DNA, 25 bp, Mus musculus
ggtaaaagctgctgctccatgatcc

SEQ ID NO: 643988 - DNA, 25 bp, Mus musculus
ggtaaaaggagtctcccctgatctc

SEQ ID NO: 643989 - DNA, 25 bp, Mus musculus
ggtaaaaggagtgtcccctgatctc

SEQ ID NO: 643990 - DNA, 25 bp, Mus musculus
ggtaaaagtctcactgatgctatag

SEQ ID NO: 643991 - DNA, 25 bp, Mus musculus
ggtaaaagtctctctgatgctatag

SEQ ID NO: 643992 - DNA, 25 bp, Mus musculus
ggtaaaagtctgcagtttcctctcc

SEQ ID NO: 643993 - DNA, 25 bp, Mus musculus
ggtaaaagtctggagtttcctctcc

SEQ ID NO: 643994 - DNA, 25 bp, Mus musculus
ggtaaaatcccgatgctttctgaag

SEQ ID NO: 643995 - DNA, 25 bp, Mus musculus
ggtaaaatcccgttgctttctgaag

SEQ ID NO: 643996 - DNA, 25 bp, Mus musculus
ggtaaaatgaacagtctcttgaaga

SEQ ID NO: 643997 - DNA, 25 bp, Mus musculus
ggtaaaatgaactgtctcttgaaga

SEQ ID NO: 643998 - DNA, 25 bp, Mus musculus
ggtaaaatgtagcttttgatagtta

SEQ ID NO: 643999 - DNA, 25 bp, Mus musculus
ggtaaaatgtaggttttgatagtta

SEQ ID NO: 644000 - DNA, 25 bp, Mus musculus
ggtaaaattatgaaacgcagtgttc

SEQ ID NO: 644001 - DNA, 25 bp, Mus musculus
ggtaaaattatgtaacgcagtgttc

SEQ ID NO: 644002 - DNA, 25 bp, Mus musculus
ggtaaacacagcacatgcaggcata

SEQ ID NO: 644003 - DNA, 25 bp, Mus musculus
ggtaaacacagctcatgcaggcata

SEQ ID NO: 644004 - DNA, 25 bp, Mus musculus
ggtaaacacatgatgctatgcctga

SEQ ID NO: 644005 - DNA, 25 bp, Mus musculus
ggtaaacacatgttgctatgcctga

SEQ ID NO: 644006 - DNA, 25 bp, Mus musculus
ggtaaacactgtcaatccaatcaag

SEQ ID NO: 644007 - DNA, 25 bp, Mus musculus
ggtaaacactgtgaatccaatcaag

SEQ ID NO: 644008 - DNA, 25 bp, Mus musculus
ggtaaacaggcgcttccgcacattc

SEQ ID NO: 644009 - DNA, 25 bp, Mus musculus
ggtaaacaggcggttccgcacattc

SEQ ID NO: 644010 - DNA, 25 bp, Mus musculus
ggtaaacagtagctcgtctccagta

SEQ ID NO: 644011 - DNA, 25 bp, Mus musculus
ggtaaacagtaggtcgtctccagta

SEQ ID NO: 644012 - DNA, 25 bp, Mus musculus
ggtaaacagtctaccagtcatctca

SEQ ID NO: 644013 - DNA, 25 bp, Mus musculus
ggtaaacagtcttccagtcatctca

SEQ ID NO: 644014 - DNA, 25 bp, Mus musculus
ggtaaacatgcccatcttttagcct

SEQ ID NO: 644015 - DNA, 25 bp, Mus musculus
ggtaaacatgccgatcttttagcct

SEQ ID NO: 644016 - DNA, 25 bp, Mus musculus
ggtaaaccaggacccatctactgct

SEQ ID NO: 644017 - DNA, 25 bp, Mus musculus
ggtaaaccaggagccatctactgct

SEQ ID NO: 644018 - DNA, 25 bp, Mus musculus
ggtaaaccctaaacacacaagccct

SEQ ID NO: 644019 - DNA, 25 bp, Mus musculus
ggtaaaccctaacccctgtatgagt

SEQ ID NO: 644020 - DNA, 25 bp, Mus musculus
ggtaaaccctaagccctgtatgagt

SEQ ID NO: 644021 - DNA, 25 bp, Mus musculus
ggtaaaccctaatcacacaagccct

SEQ ID NO: 644022 - DNA, 25 bp, Mus musculus
ggtaaaccggatcttatcatcgaga

SEQ ID NO: 644023 - DNA, 25 bp, Mus musculus
ggtaaaccggatgttatcatcgaga

SEQ ID NO: 644024 - DNA, 25 bp, Mus musculus
ggtaaacctgaaagtgatggtgctt

SEQ ID NO: 644025 - DNA, 25 bp, Mus musculus
ggtaaacctgaatgtgatggtgctt

SEQ ID NO: 644026 - DNA, 25 bp, Mus musculus
ggtaaacctgctaattctttagttg

SEQ ID NO: 644027 - DNA, 25 bp, Mus musculus
ggtaaacctgcttattctttagttg

SEQ ID NO: 644028 - DNA, 25 bp, Mus musculus
ggtaaacctgtcaacttgatccagc

SEQ ID NO: 644029 - DNA, 25 bp, Mus musculus
ggtaaacctgtctacttgatccagc

SEQ ID NO: 644030 - DNA, 25 bp, Mus musculus
ggtaaactatagacagccatctagg

SEQ ID NO: 644031 - DNA, 25 bp, Mus musculus
ggtaaactatagtcagccatctagg

SEQ ID NO: 644032 - DNA, 25 bp, Mus musculus
ggtaaactcaacagttctctcatgt

SEQ ID NO: 644033 - DNA, 25 bp, Mus musculus
ggtaaactcaactgttctctcatgt

SEQ ID NO: 644034 - DNA, 25 bp, Mus musculus
ggtaaactgcaaagtccaagtggac

SEQ ID NO: 644035 - DNA, 25 bp, Mus musculus
ggtaaactgcaatgtccaagtggac

SEQ ID NO: 644036 - DNA, 25 bp, Mus musculus
ggtaaactgctaatctaaactcctg

SEQ ID NO: 644037 - DNA, 25 bp, Mus musculus
ggtaaactgctattctaaactcctg

SEQ ID NO: 644038 - DNA, 25 bp, Mus musculus
ggtaaactgctgacttttcaatata

SEQ ID NO: 644039 - DNA, 25 bp, Mus musculus
ggtaaactgctgtcttttcaatata

SEQ ID NO: 644040 - DNA, 25 bp, Mus musculus
ggtaaactggtcctgcattactgca

SEQ ID NO: 644041 - DNA, 25 bp, Mus musculus
ggtaaactggtcgtgcattactgca

SEQ ID NO: 644042 - DNA, 25 bp, Mus musculus
ggtaaactgtttcctgcatgctata

SEQ ID NO: 644043 - DNA, 25 bp, Mus musculus
ggtaaactgtttgctgcatgctata

SEQ ID NO: 644044 - DNA, 25 bp, Mus musculus
ggtaaacttatcatcttgacatctg

SEQ ID NO: 644045 - DNA, 25 bp, Mus musculus
ggtaaacttatcttcttgacatctg

SEQ ID NO: 644046 - DNA, 25 bp, Mus musculus
ggtaaacttcagaggaccgtctcct

SEQ ID NO: 644047 - DNA, 25 bp, Mus musculus
ggtaaacttcagtggaccgtctcct

SEQ ID NO: 644048 - DNA, 25 bp, Mus musculus
ggtaaacttcttatttgcctatttg

SEQ ID NO: 644049 - DNA, 25 bp, Mus musculus
ggtaaacttcttttttgcctatttg

SEQ ID NO: 644050 - DNA, 25 bp, Mus musculus
ggtaaacttttcagcttagtctgag

SEQ ID NO: 644051 - DNA, 25 bp, Mus musculus
ggtaaacttttctgcttagtctgag

SEQ ID NO: 644052 - DNA, 25 bp, Mus musculus
ggtaaacttttgatgtctcttgttg

SEQ ID NO: 644053 - DNA, 25 bp, Mus musculus
ggtaaacttttgttgtctcttgttg

SEQ ID NO: 644054 - DNA, 25 bp, Mus musculus
ggtaaagaactgataggaactgtga

SEQ ID NO: 644055 - DNA, 25 bp, Mus musculus
ggtaaagaactgttaggaactgtga

SEQ ID NO: 644056 - DNA, 25 bp, Mus musculus
ggtaaagacagtagattcctcaagc

SEQ ID NO: 644057 - DNA, 25 bp, Mus musculus
ggtaaagacagttgattcctcaagc

SEQ ID NO: 644058 - DNA, 25 bp, Mus musculus
ggtaaagactggatggctactcaat

SEQ ID NO: 644059 - DNA, 25 bp, Mus musculus
ggtaaagactggttggctactcaat

SEQ ID NO: 644060 - DNA, 25 bp, Mus musculus
ggtaaagagtcaactattgcagtct

SEQ ID NO: 644061 - DNA, 25 bp, Mus musculus
ggtaaagagtcatctattgcagtct

SEQ ID NO: 644062 - DNA, 25 bp, Mus musculus
ggtaaagagtccctcactaagagta

SEQ ID NO: 644063 - DNA, 25 bp, Mus musculus
ggtaaagagtccgtcactaagagta

SEQ ID NO: 644064 - DNA, 25 bp, Mus musculus
ggtaaagagtgcaccctactgttct

SEQ ID NO: 644065 - DNA, 25 bp, Mus musculus
ggtaaagagtgctccctactgttct

SEQ ID NO: 644066 - DNA, 25 bp, Mus musculus
ggtaaagatgacagactctggagac

SEQ ID NO: 644067 - DNA, 25 bp, Mus musculus
ggtaaagatgactgactctggagac

SEQ ID NO: 644068 - DNA, 25 bp, Mus musculus
ggtaaagcaatacgaccctgccata

SEQ ID NO: 644069 - DNA, 25 bp, Mus musculus
ggtaaagcaataggaccctgccata

SEQ ID NO: 644070 - DNA, 25 bp, Mus musculus
ggtaaagcagttcgcctcaggtatc

SEQ ID NO: 644071 - DNA, 25 bp, Mus musculus
ggtaaagcagttggcctcaggtatc

SEQ ID NO: 644072 - DNA, 25 bp, Mus musculus
ggtaaagcatcccaggctgcttgcg

SEQ ID NO: 644073 - DNA, 25 bp, Mus musculus
ggtaaagcatccgaggctgcttgcg

SEQ ID NO: 644074 - DNA, 25 bp, Mus musculus
ggtaaagcatttcgaccgttccctg

SEQ ID NO: 644075 - DNA, 25 bp, Mus musculus
ggtaaagcatttggaccgttccctg

SEQ ID NO: 644076 - DNA, 25 bp, Mus musculus
ggtaaagccacaattccatgcaatg

SEQ ID NO: 644077 - DNA, 25 bp, Mus musculus
ggtaaagccacatttccatgcaatg

SEQ ID NO: 644078 - DNA, 25 bp, Mus musculus
ggtaaagccttacagtgatcttgaa

SEQ ID NO: 644079 - DNA, 25 bp, Mus musculus
ggtaaagccttagagtgatcttgaa

SEQ ID NO: 644080 - DNA, 25 bp, Mus musculus
ggtaaagcctttccatatgatagta

SEQ ID NO: 644081 - DNA, 25 bp, Mus musculus
ggtaaagcctttgcatatgatagta

SEQ ID NO: 644082 - DNA, 25 bp, Mus musculus
ggtaaagctatgcactcattcgtca

SEQ ID NO: 644083 - DNA, 25 bp, Mus musculus
ggtaaagctatggactcattcgtca

SEQ ID NO: 644084 - DNA, 25 bp, Mus musculus
ggtaaagctcacaactccatgttta

SEQ ID NO: 644085 - DNA, 25 bp, Mus musculus
ggtaaagctcacagtgatcagtatt

SEQ ID NO: 644086 - DNA, 25 bp, Mus musculus
ggtaaagctcactactccatgttta

SEQ ID NO: 644087 - DNA, 25 bp, Mus musculus
ggtaaagctcactgtgatcagtatt

SEQ ID NO: 644088 - DNA, 25 bp, Mus musculus
ggtaaagctgccagtgtttcacttc

SEQ ID NO: 644089 - DNA, 25 bp, Mus musculus
ggtaaagctgcctgtgtttcacttc

SEQ ID NO: 644090 - DNA, 25 bp, Mus musculus
ggtaaagcttttcctcatcacagtt

SEQ ID NO: 644091 - DNA, 25 bp, Mus musculus
ggtaaagcttttgctcatcacagtt

SEQ ID NO: 644092 - DNA, 25 bp, Mus musculus
ggtaaaggcaaactctgtaaagcag

SEQ ID NO: 644093 - DNA, 25 bp, Mus musculus
ggtaaaggcaaagtctgtaaagcag

SEQ ID NO: 644094 - DNA, 25 bp, Mus musculus
ggtaaaggcattcccattcttccta

SEQ ID NO: 644095 - DNA, 25 bp, Mus musculus
ggtaaaggcattgccattcttccta

SEQ ID NO: 644096 - DNA, 25 bp, Mus musculus
ggtaaaggcttgactccaactctaa

SEQ ID NO: 644097 - DNA, 25 bp, Mus musculus
ggtaaaggcttgtctccaactctaa

SEQ ID NO: 644098 - DNA, 25 bp, Mus musculus
ggtaaaggtcttcgcaaaggcggcg

SEQ ID NO: 644099 - DNA, 25 bp, Mus musculus
ggtaaaggtcttggcaaaggcggcg

SEQ ID NO: 644100 - DNA, 25 bp, Mus musculus
ggtaaagtcggtcgtgcatcgcttc

SEQ ID NO: 644101 - DNA, 25 bp, Mus musculus
ggtaaagtcggtggtgcatcgcttc

SEQ ID NO: 644102 - DNA, 25 bp, Mus musculus
ggtaaagtctgtcccagagcaccct

SEQ ID NO: 644103 - DNA, 25 bp, Mus musculus
ggtaaagtctgtgccagagcaccct

SEQ ID NO: 644104 - DNA, 25 bp, Mus musculus
ggtaaagtggttcctactgaagcct

SEQ ID NO: 644105 - DNA, 25 bp, Mus musculus
ggtaaagtggttgctactgaagcct

SEQ ID NO: 644106 - DNA, 25 bp, Mus musculus
ggtaaagttcctaatcttagacttg

SEQ ID NO: 644107 - DNA, 25 bp, Mus musculus
ggtaaagttccttatcttagacttg

SEQ ID NO: 644108 - DNA, 25 bp, Mus musculus
ggtaaatacctaagtgaaatctcag

SEQ ID NO: 644109 - DNA, 25 bp, Mus musculus
ggtaaatacctatgtgaaatctcag

SEQ ID NO: 644110 - DNA, 25 bp, Mus musculus
ggtaaataccttaaattctgatgtt

SEQ ID NO: 644111 - DNA, 25 bp, Mus musculus
ggtaaatacctttaattctgatgtt

SEQ ID NO: 644112 - DNA, 25 bp, Mus musculus
ggtaaatagaggaccagctgtggct

SEQ ID NO: 644113 - DNA, 25 bp, Mus musculus
ggtaaatagaggtccagctgtggct

SEQ ID NO: 644114 - DNA, 25 bp, Mus musculus
ggtaaatatatcctaatactatgtg

SEQ ID NO: 644115 - DNA, 25 bp, Mus musculus
ggtaaatatatcgtaatactatgtg

SEQ ID NO: 644116 - DNA, 25 bp, Mus musculus
ggtaaatatcagaagattcctgttg

SEQ ID NO: 644117 - DNA, 25 bp, Mus musculus
ggtaaatatcagtagattcctgttg

SEQ ID NO: 644118 - DNA, 25 bp, Mus musculus
ggtaaatcaacaatcccgaggcgga

SEQ ID NO: 644119 - DNA, 25 bp, Mus musculus
ggtaaatcaacattcccgaggcgga

SEQ ID NO: 644120 - DNA, 25 bp, Mus musculus
ggtaaatcagacacttaattccaag

SEQ ID NO: 644121 - DNA, 25 bp, Mus musculus
ggtaaatcagactcttaattccaag

SEQ ID NO: 644122 - DNA, 25 bp, Mus musculus
ggtaaatcattccaacctactagat

SEQ ID NO: 644123 - DNA, 25 bp, Mus musculus
ggtaaatcattcgaacctactagat

SEQ ID NO: 644124 - DNA, 25 bp, Mus musculus
ggtaaatccaaaacagtttcatcga

SEQ ID NO: 644125 - DNA, 25 bp, Mus musculus
ggtaaatccaaatcagtttcatcga

SEQ ID NO: 644126 - DNA, 25 bp, Mus musculus
ggtaaatccattcagcccattatag

SEQ ID NO: 644127 - DNA, 25 bp, Mus musculus
ggtaaatccattgagcccattatag

SEQ ID NO: 644128 - DNA, 25 bp, Mus musculus
ggtaaatccctaagtgcctcaactg

SEQ ID NO: 644129 - DNA, 25 bp, Mus musculus
ggtaaatccctatgtgcctcaactg

SEQ ID NO: 644130 - DNA, 25 bp, Mus musculus
ggtaaatcttttccctacttcatgg

SEQ ID NO: 644131 - DNA, 25 bp, Mus musculus
ggtaaatcttttgcctacttcatgg

SEQ ID NO: 644132 - DNA, 25 bp, Mus musculus
ggtaaatgatcccagtgtccttgga

SEQ ID NO: 644133 - DNA, 25 bp, Mus musculus
ggtaaatgatccgagtgtccttgga

SEQ ID NO: 644134 - DNA, 25 bp, Mus musculus
ggtaaatggaacaactgtctctcaa

SEQ ID NO: 644135 - DNA, 25 bp, Mus musculus
ggtaaatggaactactgtctctcaa

SEQ ID NO: 644136 - DNA, 25 bp, Mus musculus
ggtaaatgtttcagcttgctttgcc

SEQ ID NO: 644137 - DNA, 25 bp, Mus musculus
ggtaaatgtttctgcttgctttgcc

SEQ ID NO: 644138 - DNA, 25 bp, Mus musculus
ggtaaatgtttgaaataccttcact

SEQ ID NO: 644139 - DNA, 25 bp, Mus musculus
ggtaaatgtttgtaataccttcact

SEQ ID NO: 644140 - DNA, 25 bp, Mus musculus
ggtaaattatttcatcccaactcac

SEQ ID NO: 644141 - DNA, 25 bp, Mus musculus
ggtaaattatttgatcccaactcac

SEQ ID NO: 644142 - DNA, 25 bp, Mus musculus
ggtaaattcgagaacttccaggaca

SEQ ID NO: 644143 - DNA, 25 bp, Mus musculus
ggtaaattcgagtacttccaggaca

SEQ ID NO: 644144 - DNA, 25 bp, Mus musculus
ggtaaattctatatcaggctcggtg

SEQ ID NO: 644145 - DNA, 25 bp, Mus musculus
ggtaaattctatttcaggctcggtg

SEQ ID NO: 644146 - DNA, 25 bp, Mus musculus
ggtaaattgccaattggtcactaca

SEQ ID NO: 644147 - DNA, 25 bp, Mus musculus
ggtaaattgccatttggtcactaca

SEQ ID NO: 644148 - DNA, 25 bp, Mus musculus
ggtaaatttcttctttgtgctctga

SEQ ID NO: 644149 - DNA, 25 bp, Mus musculus
ggtaaatttcttgtttgtgctctga

SEQ ID NO: 644150 - DNA, 25 bp, Mus musculus
ggtaaattttcaatcattcccttag

SEQ ID NO: 644151 - DNA, 25 bp, Mus musculus
ggtaaattttcattcattcccttag

SEQ ID NO: 644152 - DNA, 25 bp, Mus musculus
ggtaaattttctatctcttgcgtat

SEQ ID NO: 644153 - DNA, 25 bp, Mus musculus
ggtaaattttctcgtacatttctat

SEQ ID NO: 644154 - DNA, 25 bp, Mus musculus
ggtaaattttctggtacatttctat

SEQ ID NO: 644155 - DNA, 25 bp, Mus musculus
ggtaaattttctttctcttgcgtat

SEQ ID NO: 644156 - DNA, 25 bp, Mus musculus
ggtaacaaatgtcttgcctcaaaat

SEQ ID NO: 644157 - DNA, 25 bp, Mus musculus
ggtaacaaatgtgttgcctcaaaat

SEQ ID NO: 644158 - DNA, 25 bp, Mus musculus
ggtaacaacagtccctgtggctgta

SEQ ID NO: 644159 - DNA, 25 bp, Mus musculus
ggtaacaacagtgcctgtggctgta

SEQ ID NO: 644160 - DNA, 25 bp, Mus musculus
ggtaacaacataaccttggtgacaa

SEQ ID NO: 644161 - DNA, 25 bp, Mus musculus
ggtaacaacatatccttggtgacaa

SEQ ID NO: 644162 - DNA, 25 bp, Mus musculus
ggtaacaactatacctcttcaagca

SEQ ID NO: 644163 - DNA, 25 bp, Mus musculus
ggtaacaactatcattttagacctg

SEQ ID NO: 644164 - DNA, 25 bp, Mus musculus
ggtaacaactatgattttagacctg

SEQ ID NO: 644165 - DNA, 25 bp, Mus musculus
ggtaacaactattcctcttcaagca

SEQ ID NO: 644166 - DNA, 25 bp, Mus musculus
ggtaacaagacgcatctggctgata

SEQ ID NO: 644167 - DNA, 25 bp, Mus musculus
ggtaacaagacggatctggctgata

SEQ ID NO: 644168 - DNA, 25 bp, Mus musculus
ggtaacaagactctggaccaggtct

SEQ ID NO: 644169 - DNA, 25 bp, Mus musculus
ggtaacaagactgtggaccaggtct

SEQ ID NO: 644170 - DNA, 25 bp, Mus musculus
ggtaacaagagacgtgcagcacaat

SEQ ID NO: 644171 - DNA, 25 bp, Mus musculus
ggtaacaagagaggtgcagcacaat

SEQ ID NO: 644172 - DNA, 25 bp, Mus musculus
ggtaacaatcccactttatgttctg

SEQ ID NO: 644173 - DNA, 25 bp, Mus musculus
ggtaacaatccctctttatgttctg

SEQ ID NO: 644174 - DNA, 25 bp, Mus musculus
ggtaacacaccaagtttactctccg

SEQ ID NO: 644175 - DNA, 25 bp, Mus musculus
ggtaacacaccatgtttactctccg

SEQ ID NO: 644176 - DNA, 25 bp, Mus musculus
ggtaacaccagaacttgccacatgt

SEQ ID NO: 644177 - DNA, 25 bp, Mus musculus
ggtaacaccagatcttgccacatgt

SEQ ID NO: 644178 - DNA, 25 bp, Mus musculus
ggtaacacctatctctacttctagc

SEQ ID NO: 644179 - DNA, 25 bp, Mus musculus
ggtaacacctatgtctacttctagc

SEQ ID NO: 644180 - DNA, 25 bp, Mus musculus
ggtaacactagtatgtctggcttta

SEQ ID NO: 644181 - DNA, 25 bp, Mus musculus
ggtaacactagtttgtctggcttta

SEQ ID NO: 644182 - DNA, 25 bp, Mus musculus
ggtaacactatcaagtcttcagaag

SEQ ID NO: 644183 - DNA, 25 bp, Mus musculus
ggtaacactatctagtcttcagaag

SEQ ID NO: 644184 - DNA, 25 bp, Mus musculus
ggtaacactcacctcacagggttgt

SEQ ID NO: 644185 - DNA, 25 bp, Mus musculus
ggtaacactcacgtcacagggttgt

SEQ ID NO: 644186 - DNA, 25 bp, Mus musculus
ggtaacactggcctaggccctagta

SEQ ID NO: 644187 - DNA, 25 bp, Mus musculus
ggtaacactggcgtaggccctagta

SEQ ID NO: 644188 - DNA, 25 bp, Mus musculus
ggtaacagacacagctttccaaagc

SEQ ID NO: 644189 - DNA, 25 bp, Mus musculus
ggtaacagacactgctttccaaagc

SEQ ID NO: 644190 - DNA, 25 bp, Mus musculus
ggtaacagactcatcttaaagtgct

SEQ ID NO: 644191 - DNA, 25 bp, Mus musculus
ggtaacagactcattgctcatgaac

SEQ ID NO: 644192 - DNA, 25 bp, Mus musculus
ggtaacagactcttcttaaagtgct

SEQ ID NO: 644193 - DNA, 25 bp, Mus musculus
ggtaacagactctttgctcatgaac

SEQ ID NO: 644194 - DNA, 25 bp, Mus musculus
ggtaacagagaacaccacttccctt

SEQ ID NO: 644195 - DNA, 25 bp, Mus musculus
ggtaacagagaagaccacttccctt

SEQ ID NO: 644196 - DNA, 25 bp, Mus musculus
ggtaacagcaccaaacttcgcttta

SEQ ID NO: 644197 - DNA, 25 bp, Mus musculus
ggtaacagcacctaacttcgcttta

SEQ ID NO: 644198 - DNA, 25 bp, Mus musculus
ggtaacagcattatgcatgctcatt

SEQ ID NO: 644199 - DNA, 25 bp, Mus musculus
ggtaacagcattttgcatgctcatt

SEQ ID NO: 644200 - DNA, 25 bp, Mus musculus
ggtaacagcttcactctagcctggc

SEQ ID NO: 644201 - DNA, 25 bp, Mus musculus
ggtaacagcttctctctagcctggc

SEQ ID NO: 644202 - DNA, 25 bp, Mus musculus
ggtaacaggcttactttccatgcca

SEQ ID NO: 644203 - DNA, 25 bp, Mus musculus
ggtaacaggctttctttccatgcca

SEQ ID NO: 644204 - DNA, 25 bp, Mus musculus
ggtaacaggtatccatgtggtatac

SEQ ID NO: 644205 - DNA, 25 bp, Mus musculus
ggtaacaggtatgcatgtggtatac

SEQ ID NO: 644206 - DNA, 25 bp, Mus musculus
ggtaacagttcaacaatccgtggct

SEQ ID NO: 644207 - DNA, 25 bp, Mus musculus
ggtaacagttcatcaatccgtggct

SEQ ID NO: 644208 - DNA, 25 bp, Mus musculus
ggtaacatacaacattccagtcact

SEQ ID NO: 644209 - DNA, 25 bp, Mus musculus
ggtaacatacaagattccagtcact

SEQ ID NO: 644210 - DNA, 25 bp, Mus musculus
ggtaacatagatattactgttggaa

SEQ ID NO: 644211 - DNA, 25 bp, Mus musculus
ggtaacatagattttactgttggaa

SEQ ID NO: 644212 - DNA, 25 bp, Mus musculus
ggtaacatagctcggtcggtctgat

SEQ ID NO: 644213 - DNA, 25 bp, Mus musculus
ggtaacatagctgggtcggtctgat

SEQ ID NO: 644214 - DNA, 25 bp, Mus musculus
ggtaacatatatagccccaacacag

SEQ ID NO: 644215 - DNA, 25 bp, Mus musculus
ggtaacatatattgccccaacacag

SEQ ID NO: 644216 - DNA, 25 bp, Mus musculus
ggtaacatcttgctttagccagcca

SEQ ID NO: 644217 - DNA, 25 bp, Mus musculus
ggtaacatcttggtttagccagcca

SEQ ID NO: 644218 - DNA, 25 bp, Mus musculus
ggtaacatgtccaaaataatacttt

SEQ ID NO: 644219 - DNA, 25 bp, Mus musculus
ggtaacatgtcctaaataatacttt

SEQ ID NO: 644220 - DNA, 25 bp, Mus musculus
ggtaacatgtgtattgttcactaca

SEQ ID NO: 644221 - DNA, 25 bp, Mus musculus
ggtaacatgtgttttgttcactaca

SEQ ID NO: 644222 - DNA, 25 bp, Mus musculus
ggtaacattaggcttttagttgcac

SEQ ID NO: 644223 - DNA, 25 bp, Mus musculus
ggtaacattagggttttagttgcac

SEQ ID NO: 644224 - DNA, 25 bp, Mus musculus
ggtaacattcctatcttctatggca

SEQ ID NO: 644225 - DNA, 25 bp, Mus musculus
ggtaacattcctttcttctatggca

SEQ ID NO: 644226 - DNA, 25 bp, Mus musculus
ggtaacatttttaagctgagtcatc

SEQ ID NO: 644227 - DNA, 25 bp, Mus musculus
ggtaacattttttagctgagtcatc

SEQ ID NO: 644228 - DNA, 25 bp, Mus musculus
ggtaaccaaccccaagaggattgct

SEQ ID NO: 644229 - DNA, 25 bp, Mus musculus
ggtaaccaacccgaagaggattgct

SEQ ID NO: 644230 - DNA, 25 bp, Mus musculus
ggtaaccaagatcttcaaatgaaca

SEQ ID NO: 644231 - DNA, 25 bp, Mus musculus
ggtaaccaagatgttcaaatgaaca

SEQ ID NO: 644232 - DNA, 25 bp, Mus musculus
ggtaaccacacactcttaaatccct

SEQ ID NO: 644233 - DNA, 25 bp, Mus musculus
ggtaaccacacagtcttaaatccct

SEQ ID NO: 644234 - DNA, 25 bp, Mus musculus
ggtaaccagttacaatctcccagct

SEQ ID NO: 644235 - DNA, 25 bp, Mus musculus
ggtaaccagttagaatctcccagct

SEQ ID NO: 644236 - DNA, 25 bp, Mus musculus
ggtaaccataaccacttagaagtag

SEQ ID NO: 644237 - DNA, 25 bp, Mus musculus
ggtaaccataacgacttagaagtag

SEQ ID NO: 644238 - DNA, 25 bp, Mus musculus
ggtaaccatactaaaagtggatcaa

SEQ ID NO: 644239 - DNA, 25 bp, Mus musculus
ggtaaccatacttaaagtggatcaa

SEQ ID NO: 644240 - DNA, 25 bp, Mus musculus
ggtaaccatgagagcttgccagagg

SEQ ID NO: 644241 - DNA, 25 bp, Mus musculus
ggtaaccatgagtgcttgccagagg

SEQ ID NO: 644242 - DNA, 25 bp, Mus musculus
ggtaaccatgttagctgtccatcgt

SEQ ID NO: 644243 - DNA, 25 bp, Mus musculus
ggtaaccatgtttgctgtccatcgt

SEQ ID NO: 644244 - DNA, 25 bp, Mus musculus
ggtaaccatttgcacacttggctat

SEQ ID NO: 644245 - DNA, 25 bp, Mus musculus
ggtaaccatttggacacttggctat

SEQ ID NO: 644246 - DNA, 25 bp, Mus musculus
ggtaacccactgagatagcctacag

SEQ ID NO: 644247 - DNA, 25 bp, Mus musculus
ggtaacccactgtgatagcctacag

SEQ ID NO: 644248 - DNA, 25 bp, Mus musculus
ggtaacccagccactttgccatttt

SEQ ID NO: 644249 - DNA, 25 bp, Mus musculus
ggtaacccagcctctttgccatttt

SEQ ID NO: 644250 - DNA, 25 bp, Mus musculus
ggtaacccttgccttgaagacaagt

SEQ ID NO: 644251 - DNA, 25 bp, Mus musculus
ggtaacccttgcgttgaagacaagt

SEQ ID NO: 644252 - DNA, 25 bp, Mus musculus
ggtaacctgaggagccccagagaaa

SEQ ID NO: 644253 - DNA, 25 bp, Mus musculus
ggtaacctgaggtgccccagagaaa

SEQ ID NO: 644254 - DNA, 25 bp, Mus musculus
ggtaacctgcacagatctctgatgc

SEQ ID NO: 644255 - DNA, 25 bp, Mus musculus
ggtaacctgcactgatctctgatgc

SEQ ID NO: 644256 - DNA, 25 bp, Mus musculus
ggtaaccttgacacccaattagcag

SEQ ID NO: 644257 - DNA, 25 bp, Mus musculus
ggtaaccttgactcccaattagcag

SEQ ID NO: 644258 - DNA, 25 bp, Mus musculus
ggtaacctttagcaggtagatcgtt

SEQ ID NO: 644259 - DNA, 25 bp, Mus musculus
ggtaacctttaggaggtagatcgtt

SEQ ID NO: 644260 - DNA, 25 bp, Mus musculus
ggtaacgtaccaactcatttcttat

SEQ ID NO: 644261 - DNA, 25 bp, Mus musculus
ggtaacgtaccatctcatttcttat

SEQ ID NO: 644262 - DNA, 25 bp, Mus musculus
ggtaactacagtatgagcatctcct

SEQ ID NO: 644263 - DNA, 25 bp, Mus musculus
ggtaactacagtttgagcatctcct

SEQ ID NO: 644264 - DNA, 25 bp, Mus musculus
ggtaactacctcctcgtggcttaag

SEQ ID NO: 644265 - DNA, 25 bp, Mus musculus
ggtaactacctcgtcgtggcttaag

SEQ ID NO: 644266 - DNA, 25 bp, Mus musculus
ggtaactagatgacccacttttgga

SEQ ID NO: 644267 - DNA, 25 bp, Mus musculus
ggtaactagatgtcccacttttgga

SEQ ID NO: 644268 - DNA, 25 bp, Mus musculus
ggtaactaggtgcatatttccctaa

SEQ ID NO: 644269 - DNA, 25 bp, Mus musculus
ggtaactaggtggatatttccctaa

SEQ ID NO: 644270 - DNA, 25 bp, Mus musculus
ggtaactatagtctagtctagtgaa

SEQ ID NO: 644271 - DNA, 25 bp, Mus musculus
ggtaactatagtgtagtctagtgaa

SEQ ID NO: 644272 - DNA, 25 bp, Mus musculus
ggtaactatcccacagtggccatta

SEQ ID NO: 644273 - DNA, 25 bp, Mus musculus
ggtaactatccctcagtggccatta

SEQ ID NO: 644274 - DNA, 25 bp, Mus musculus
ggtaactattacagcgcattttcat

SEQ ID NO: 644275 - DNA, 25 bp, Mus musculus
ggtaactattactgcgcattttcat

SEQ ID NO: 644276 - DNA, 25 bp, Mus musculus
ggtaactcagggatcatctgtccaa

SEQ ID NO: 644277 - DNA, 25 bp, Mus musculus
ggtaactcagggttcatctgtccaa

SEQ ID NO: 644278 - DNA, 25 bp, Mus musculus
ggtaactccaaaatgatcccttgca

SEQ ID NO: 644279 - DNA, 25 bp, Mus musculus
ggtaactccaaattgatcccttgca

SEQ ID NO: 644280 - DNA, 25 bp, Mus musculus
ggtaactccagacatggcaaccatg

SEQ ID NO: 644281 - DNA, 25 bp, Mus musculus
ggtaactccagagatggcaaccatg

SEQ ID NO: 644282 - DNA, 25 bp, Mus musculus
ggtaactccagcaagtcatgtgtga

SEQ ID NO: 644283 - DNA, 25 bp, Mus musculus
ggtaactccagctagtcatgtgtga

SEQ ID NO: 644284 - DNA, 25 bp, Mus musculus
ggtaactccgctcaggtgctccgga

SEQ ID NO: 644285 - DNA, 25 bp, Mus musculus
ggtaactccgctgaggtgctccgga

SEQ ID NO: 644286 - DNA, 25 bp, Mus musculus
ggtaactcctcacaaagacaatttt

SEQ ID NO: 644287 - DNA, 25 bp, Mus musculus
ggtaactcctcagaaagacaatttt

SEQ ID NO: 644288 - DNA, 25 bp, Mus musculus
ggtaactctaaaacccatgaagttg

SEQ ID NO: 644289 - DNA, 25 bp, Mus musculus
ggtaactctaaatcccatgaagttg

SEQ ID NO: 644290 - DNA, 25 bp, Mus musculus
ggtaactgaggcaccggaagcttgc

SEQ ID NO: 644291 - DNA, 25 bp, Mus musculus
ggtaactgaggctccggaagcttgc

SEQ ID NO: 644292 - DNA, 25 bp, Mus musculus
ggtaactgcaccactatgagacatt

SEQ ID NO: 644293 - DNA, 25 bp, Mus musculus
ggtaactgcacctctatgagacatt

SEQ ID NO: 644294 - DNA, 25 bp, Mus musculus
ggtaactgcatcctgttcaaacact

SEQ ID NO: 644295 - DNA, 25 bp, Mus musculus
ggtaactgcatcgtgttcaaacact

SEQ ID NO: 644296 - DNA, 25 bp, Mus musculus
ggtaactgccaccatagactcagag

SEQ ID NO: 644297 - DNA, 25 bp, Mus musculus
ggtaactgccacgatagactcagag

SEQ ID NO: 644298 - DNA, 25 bp, Mus musculus
ggtaactgctaaccttcaagggtca

SEQ ID NO: 644299 - DNA, 25 bp, Mus musculus
ggtaactgctaagcttcaagggtca

SEQ ID NO: 644300 - DNA, 25 bp, Mus musculus
ggtaactggcataacaccactaaga

SEQ ID NO: 644301 - DNA, 25 bp, Mus musculus
ggtaactggcattacaccactaaga

SEQ ID NO: 644302 - DNA, 25 bp, Mus musculus
ggtaactgtagactcagagcccagt

SEQ ID NO: 644303 - DNA, 25 bp, Mus musculus
ggtaactgtagagtcagagcccagt

SEQ ID NO: 644304 - DNA, 25 bp, Mus musculus
ggtaactgtggaccttttgccctgc

SEQ ID NO: 644305 - DNA, 25 bp, Mus musculus
ggtaactgtggagcttttgccctgc

SEQ ID NO: 644306 - DNA, 25 bp, Mus musculus
ggtaactgttacaatcgtcatcata

SEQ ID NO: 644307 - DNA, 25 bp, Mus musculus
ggtaactgttactatcgtcatcata

SEQ ID NO: 644308 - DNA, 25 bp, Mus musculus
ggtaacttacagcaggtgcccttca

SEQ ID NO: 644309 - DNA, 25 bp, Mus musculus
ggtaacttacaggaggtgcccttca

SEQ ID NO: 644310 - DNA, 25 bp, Mus musculus
ggtaacttacctccagacctgttga

SEQ ID NO: 644311 - DNA, 25 bp, Mus musculus
ggtaacttacctgcagacctgttga

SEQ ID NO: 644312 - DNA, 25 bp, Mus musculus
ggtaacttacgtccctgttaccaca

SEQ ID NO: 644313 - DNA, 25 bp, Mus musculus
ggtaacttacgtgcctgttaccaca

SEQ ID NO: 644314 - DNA, 25 bp, Mus musculus
ggtaacttagcaacatcatgaactc

SEQ ID NO: 644315 - DNA, 25 bp, Mus musculus
ggtaacttagcatcatcatgaactc

SEQ ID NO: 644316 - DNA, 25 bp, Mus musculus
ggtaacttagcccttaaccaagcat

SEQ ID NO: 644317 - DNA, 25 bp, Mus musculus
ggtaacttagccgttaaccaagcat

SEQ ID NO: 644318 - DNA, 25 bp, Mus musculus
ggtaacttagtacaggcctgcccat

SEQ ID NO: 644319 - DNA, 25 bp, Mus musculus
ggtaacttagtagaggcctgcccat

SEQ ID NO: 644320 - DNA, 25 bp, Mus musculus
ggtaacttgaatccagcgtggcata

SEQ ID NO: 644321 - DNA, 25 bp, Mus musculus
ggtaacttgaatgcagcgtggcata

SEQ ID NO: 644322 - DNA, 25 bp, Mus musculus
ggtaacttgactctgtcccaagcag

SEQ ID NO: 644323 - DNA, 25 bp, Mus musculus
ggtaacttgactgtgtcccaagcag

SEQ ID NO: 644324 - DNA, 25 bp, Mus musculus
ggtaacttgagaacttttatcctaa

SEQ ID NO: 644325 - DNA, 25 bp, Mus musculus
ggtaacttgagatcttttatcctaa

SEQ ID NO: 644326 - DNA, 25 bp, Mus musculus
ggtaacttgcttcagttcccatgaa

SEQ ID NO: 644327 - DNA, 25 bp, Mus musculus
ggtaacttgcttgagttcccatgaa

SEQ ID NO: 644328 - DNA, 25 bp, Mus musculus
ggtaacttgtgtccttaatgctgcc

SEQ ID NO: 644329 - DNA, 25 bp, Mus musculus
ggtaacttgtgtgcttaatgctgcc

SEQ ID NO: 644330 - DNA, 25 bp, Mus musculus
ggtaactttatcaaactgccctcac

SEQ ID NO: 644331 - DNA, 25 bp, Mus musculus
ggtaactttatctaactgccctcac

SEQ ID NO: 644332 - DNA, 25 bp, Mus musculus
ggtaactttgcacttgtgctgcatg

SEQ ID NO: 644333 - DNA, 25 bp, Mus musculus
ggtaactttgcagttgtgctgcatg

SEQ ID NO: 644334 - DNA, 25 bp, Mus musculus
ggtaactttgtacgccgactaggct

SEQ ID NO: 644335 - DNA, 25 bp, Mus musculus
ggtaactttgtaggccgactaggct

SEQ ID NO: 644336 - DNA, 25 bp, Mus musculus
ggtaagaaacataggcaggtcaatg

SEQ ID NO: 644337 - DNA, 25 bp, Mus musculus
ggtaagaaacattggcaggtcaatg

SEQ ID NO: 644338 - DNA, 25 bp, Mus musculus
ggtaagaaaccacttagcctgtatt

SEQ ID NO: 644339 - DNA, 25 bp, Mus musculus
ggtaagaaaccagttagcctgtatt

SEQ ID NO: 644340 - DNA, 25 bp, Mus musculus
ggtaagaacagcaaaagggaccaca

SEQ ID NO: 644341 - DNA, 25 bp, Mus musculus
ggtaagaacagctaaagggaccaca

SEQ ID NO: 644342 - DNA, 25 bp, Mus musculus
ggtaagaagcccaggaccaaagcac

SEQ ID NO: 644343 - DNA, 25 bp, Mus musculus
ggtaagaagccctggaccaaagcac

SEQ ID NO: 644344 - DNA, 25 bp, Mus musculus
ggtaagaatttaacattttggtcac

SEQ ID NO: 644345 - DNA, 25 bp, Mus musculus
ggtaagaatttatcattttggtcac

SEQ ID NO: 644346 - DNA, 25 bp, Mus musculus
ggtaagaccttgattcctacatgtg

SEQ ID NO: 644347 - DNA, 25 bp, Mus musculus
ggtaagaccttgtttcctacatgtg

SEQ ID NO: 644348 - DNA, 25 bp, Mus musculus
ggtaagacgttaatctcccagccca

SEQ ID NO: 644349 - DNA, 25 bp, Mus musculus
ggtaagacgttattctcccagccca

SEQ ID NO: 644350 - DNA, 25 bp, Mus musculus
ggtaagaggagacccatcaccagca

SEQ ID NO: 644351 - DNA, 25 bp, Mus musculus
ggtaagaggagagccatcaccagca

SEQ ID NO: 644352 - DNA, 25 bp, Mus musculus
ggtaagagtaccatgcatgctgtat

SEQ ID NO: 644353 - DNA, 25 bp, Mus musculus
ggtaagagtaccttgcatgctgtat

SEQ ID NO: 644354 - DNA, 25 bp, Mus musculus
ggtaagagtcggacacagctcttaa

SEQ ID NO: 644355 - DNA, 25 bp, Mus musculus
ggtaagagtcggtcacagctcttaa

SEQ ID NO: 644356 - DNA, 25 bp, Mus musculus
ggtaagatcctacctgttctagcaa

SEQ ID NO: 644357 - DNA, 25 bp, Mus musculus
ggtaagatcctagctgttctagcaa

SEQ ID NO: 644358 - DNA, 25 bp, Mus musculus
ggtaagatctttcaccattaatggg

SEQ ID NO: 644359 - DNA, 25 bp, Mus musculus
ggtaagatctttgaccattaatggg

SEQ ID NO: 644360 - DNA, 25 bp, Mus musculus
ggtaagatgtagagatgttcccaga

SEQ ID NO: 644361 - DNA, 25 bp, Mus musculus
ggtaagatgtagtgatgttcccaga

SEQ ID NO: 644362 - DNA, 25 bp, Mus musculus
ggtaagatgtcccattatccttaaa

SEQ ID NO: 644363 - DNA, 25 bp, Mus musculus
ggtaagatgtccgattatccttaaa

SEQ ID NO: 644364 - DNA, 25 bp, Mus musculus
ggtaagattcttagtgtcattttaa

SEQ ID NO: 644365 - DNA, 25 bp, Mus musculus
ggtaagattctttgtgtcattttaa

SEQ ID NO: 644366 - DNA, 25 bp, Mus musculus
ggtaagattgacagccacactgatt

SEQ ID NO: 644367 - DNA, 25 bp, Mus musculus
ggtaagattgactgccacactgatt

SEQ ID NO: 644368 - DNA, 25 bp, Mus musculus
ggtaagcaacttaagtctcagcaca

SEQ ID NO: 644369 - DNA, 25 bp, Mus musculus
ggtaagcaactttagtctcagcaca

SEQ ID NO: 644370 - DNA, 25 bp, Mus musculus
ggtaagcacactcataattatgaag

SEQ ID NO: 644371 - DNA, 25 bp, Mus musculus
ggtaagcacactgataattatgaag

SEQ ID NO: 644372 - DNA, 25 bp, Mus musculus
ggtaagcactatctactctctgcat

SEQ ID NO: 644373 - DNA, 25 bp, Mus musculus
ggtaagcactatgtactctctgcat

SEQ ID NO: 644374 - DNA, 25 bp, Mus musculus
ggtaagcagcttattggtttcttgt

SEQ ID NO: 644375 - DNA, 25 bp, Mus musculus
ggtaagcagctttttggtttcttgt

SEQ ID NO: 644376 - DNA, 25 bp, Mus musculus
ggtaagcatcatctatctgacaata

SEQ ID NO: 644377 - DNA, 25 bp, Mus musculus
ggtaagcatcatgtatctgacaata

SEQ ID NO: 644378 - DNA, 25 bp, Mus musculus
ggtaagcattctcttaatcataatt

SEQ ID NO: 644379 - DNA, 25 bp, Mus musculus
ggtaagcattctgttaatcataatt

SEQ ID NO: 644380 - DNA, 25 bp, Mus musculus
ggtaagcatttgatacttaagcatg

SEQ ID NO: 644381 - DNA, 25 bp, Mus musculus
ggtaagcatttgttacttaagcatg

SEQ ID NO: 644382 - DNA, 25 bp, Mus musculus
ggtaagccacataacaatcaagcca

SEQ ID NO: 644383 - DNA, 25 bp, Mus musculus
ggtaagccacattacaatcaagcca

SEQ ID NO: 644384 - DNA, 25 bp, Mus musculus
ggtaagccactcagctttagatcaa

SEQ ID NO: 644385 - DNA, 25 bp, Mus musculus
ggtaagccactctgctttagatcaa

SEQ ID NO: 644386 - DNA, 25 bp, Mus musculus
ggtaagccagagattatgccagtag

SEQ ID NO: 644387 - DNA, 25 bp, Mus musculus
ggtaagccagagtttatgccagtag

SEQ ID NO: 644388 - DNA, 25 bp, Mus musculus
ggtaagccccacatttagctagatg

SEQ ID NO: 644389 - DNA, 25 bp, Mus musculus
ggtaagccccacttttagctagatg

SEQ ID NO: 644390 - DNA, 25 bp, Mus musculus
ggtaagctcaccatcctaagggtag

SEQ ID NO: 644391 - DNA, 25 bp, Mus musculus
ggtaagctcaccttcctaagggtag

SEQ ID NO: 644392 - DNA, 25 bp, Mus musculus
ggtaagctcagtactagccatgcga

SEQ ID NO: 644393 - DNA, 25 bp, Mus musculus
ggtaagctcagttctagccatgcga

SEQ ID NO: 644394 - DNA, 25 bp, Mus musculus
ggtaagctccagcttcattgagaaa

SEQ ID NO: 644395 - DNA, 25 bp, Mus musculus
ggtaagctccaggttcattgagaaa

SEQ ID NO: 644396 - DNA, 25 bp, Mus musculus
ggtaagctctctcgaatctttcact

SEQ ID NO: 644397 - DNA, 25 bp, Mus musculus
ggtaagctctctggaatctttcact

SEQ ID NO: 644398 - DNA, 25 bp, Mus musculus
ggtaagctctgaaaattcgcaatga

SEQ ID NO: 644399 - DNA, 25 bp, Mus musculus
ggtaagctctgataattcgcaatga

SEQ ID NO: 644400 - DNA, 25 bp, Mus musculus
ggtaagcttggcaatgttcaatatg

SEQ ID NO: 644401 - DNA, 25 bp, Mus musculus
ggtaagcttggctatgttcaatatg

SEQ ID NO: 644402 - DNA, 25 bp, Mus musculus
ggtaaggaacctacttgctgttctc

SEQ ID NO: 644403 - DNA, 25 bp, Mus musculus
ggtaaggaaccttcttgctgttctc

SEQ ID NO: 644404 - DNA, 25 bp, Mus musculus
ggtaaggacataccggtaaccagat

SEQ ID NO: 644405 - DNA, 25 bp, Mus musculus
ggtaaggacatagcggtaaccagat

SEQ ID NO: 644406 - DNA, 25 bp, Mus musculus
ggtaaggaggtgactcttcttgcag

SEQ ID NO: 644407 - DNA, 25 bp, Mus musculus
ggtaaggaggtgtctcttcttgcag

SEQ ID NO: 644408 - DNA, 25 bp, Mus musculus
ggtaaggcagataattgtccacaat

SEQ ID NO: 644409 - DNA, 25 bp, Mus musculus
ggtaaggcagattattgtccacaat

SEQ ID NO: 644410 - DNA, 25 bp, Mus musculus
ggtaaggcccaacagttactggcgt

SEQ ID NO: 644411 - DNA, 25 bp, Mus musculus
ggtaaggcccaagagttactggcgt

SEQ ID NO: 644412 - DNA, 25 bp, Mus musculus
ggtaaggctataactccgtgtgttc

SEQ ID NO: 644413 - DNA, 25 bp, Mus musculus
ggtaaggctatatctccgtgtgttc

SEQ ID NO: 644414 - DNA, 25 bp, Mus musculus
ggtaaggctgtactcatctcacttt

SEQ ID NO: 644415 - DNA, 25 bp, Mus musculus
ggtaaggctgtagtcatctcacttt

SEQ ID NO: 644416 - DNA, 25 bp, Mus musculus
ggtaagggaaggacgtagctcatat

SEQ ID NO: 644417 - DNA, 25 bp, Mus musculus
ggtaagggaaggtcgtagctcatat

SEQ ID NO: 644418 - DNA, 25 bp, Mus musculus
ggtaaggtaactagcttaatatatt

SEQ ID NO: 644419 - DNA, 25 bp, Mus musculus
ggtaaggtaacttgcttaatatatt

SEQ ID NO: 644420 - DNA, 25 bp, Mus musculus
ggtaaggtaggaactgtcacaaaca

SEQ ID NO: 644421 - DNA, 25 bp, Mus musculus
ggtaaggtaggatctgtcacaaaca

SEQ ID NO: 644422 - DNA, 25 bp, Mus musculus
ggtaaggttgcgaccacatgaccac

SEQ ID NO: 644423 - DNA, 25 bp, Mus musculus
ggtaaggttgcgtccacatgaccac

SEQ ID NO: 644424 - DNA, 25 bp, Mus musculus
ggtaagtaacttatgtagagattgt

SEQ ID NO: 644425 - DNA, 25 bp, Mus musculus
ggtaagtaacttttgtagagattgt

SEQ ID NO: 644426 - DNA, 25 bp, Mus musculus
ggtaagtacaaacgccagcaaggac

SEQ ID NO: 644427 - DNA, 25 bp, Mus musculus
ggtaagtacaaaggccagcaaggac

SEQ ID NO: 644428 - DNA, 25 bp, Mus musculus
ggtaagtacctgctatatataacga

SEQ ID NO: 644429 - DNA, 25 bp, Mus musculus
ggtaagtacctggtatatataacga

SEQ ID NO: 644430 - DNA, 25 bp, Mus musculus
ggtaagtatcttagcacatgctcta

SEQ ID NO: 644431 - DNA, 25 bp, Mus musculus
ggtaagtatctttgcacatgctcta

SEQ ID NO: 644432 - DNA, 25 bp, Mus musculus
ggtaagtatgctagtaacacacaca

SEQ ID NO: 644433 - DNA, 25 bp, Mus musculus
ggtaagtatgcttgtaacacacaca

SEQ ID NO: 644434 - DNA, 25 bp, Mus musculus
ggtaagtccaacctgtcaggcctca

SEQ ID NO: 644435 - DNA, 25 bp, Mus musculus
ggtaagtccaacgtgtcaggcctca

SEQ ID NO: 644436 - DNA, 25 bp, Mus musculus
ggtaagtcccaacaggctgcccaac

SEQ ID NO: 644437 - DNA, 25 bp, Mus musculus
ggtaagtcccaagaggctgcccaac

SEQ ID NO: 644438 - DNA, 25 bp, Mus musculus
ggtaagtgtcatcgttttcctgttg

SEQ ID NO: 644439 - DNA, 25 bp, Mus musculus
ggtaagtgtcatggttttcctgttg

SEQ ID NO: 644440 - DNA, 25 bp, Mus musculus
ggtaagttccagatactattcaaat

SEQ ID NO: 644441 - DNA, 25 bp, Mus musculus
ggtaagttccagttactattcaaat

SEQ ID NO: 644442 - DNA, 25 bp, Mus musculus
ggtaagttctagcactctccaagtc

SEQ ID NO: 644443 - DNA, 25 bp, Mus musculus
ggtaagttctaggactctccaagtc

SEQ ID NO: 644444 - DNA, 25 bp, Mus musculus
ggtaagttgagtagctcctttccca

SEQ ID NO: 644445 - DNA, 25 bp, Mus musculus
ggtaagttgagttgctcctttccca

SEQ ID NO: 644446 - DNA, 25 bp, Mus musculus
ggtaagttgctgaatcctcacagtt

SEQ ID NO: 644447 - DNA, 25 bp, Mus musculus
ggtaagttgctgtatcctcacagtt

SEQ ID NO: 644448 - DNA, 25 bp, Mus musculus
ggtaagttgtaaactttcctgaaag

SEQ ID NO: 644449 - DNA, 25 bp, Mus musculus
ggtaagttgtaatctttcctgaaag

SEQ ID NO: 644450 - DNA, 25 bp, Mus musculus
ggtaagtttactagttgcaatgaca

SEQ ID NO: 644451 - DNA, 25 bp, Mus musculus
ggtaagtttacttgttgcaatgaca

SEQ ID NO: 644452 - DNA, 25 bp, Mus musculus
ggtaagttttgcactgggtactact

SEQ ID NO: 644453 - DNA, 25 bp, Mus musculus
ggtaagttttgctctgggtactact

SEQ ID NO: 644454 - DNA, 25 bp, Mus musculus
ggtaataaatttcatcccaccctat

SEQ ID NO: 644455 - DNA, 25 bp, Mus musculus
ggtaataaatttgatcccaccctat

SEQ ID NO: 644456 - DNA, 25 bp, Mus musculus
ggtaataatattcatcttctgcaca

SEQ ID NO: 644457 - DNA, 25 bp, Mus musculus
ggtaataatattgatcttctgcaca

SEQ ID NO: 644458 - DNA, 25 bp, Mus musculus
ggtaataatcttatctacacaggac

SEQ ID NO: 644459 - DNA, 25 bp, Mus musculus
ggtaataatcttttctacacaggac

SEQ ID NO: 644460 - DNA, 25 bp, Mus musculus
ggtaataatttgctccctcgagcga

SEQ ID NO: 644461 - DNA, 25 bp, Mus musculus
ggtaataatttggtccctcgagcga

SEQ ID NO: 644462 - DNA, 25 bp, Mus musculus
ggtaataccaggctcgaggcgtagg

SEQ ID NO: 644463 - DNA, 25 bp, Mus musculus
ggtaataccagggtcgaggcgtagg

SEQ ID NO: 644464 - DNA, 25 bp, Mus musculus
ggtaatacctagatagccatcctcc

SEQ ID NO: 644465 - DNA, 25 bp, Mus musculus
ggtaatacctagttagccatcctcc

SEQ ID NO: 644466 - DNA, 25 bp, Mus musculus
ggtaatacctatcctcttattggca

SEQ ID NO: 644467 - DNA, 25 bp, Mus musculus
ggtaatacctatgctcttattggca

SEQ ID NO: 644468 - DNA, 25 bp, Mus musculus
ggtaatactactatggcatactgaa

SEQ ID NO: 644469 - DNA, 25 bp, Mus musculus
ggtaatactactttggcatactgaa

SEQ ID NO: 644470 - DNA, 25 bp, Mus musculus
ggtaatactgccagtccagtcgtca

SEQ ID NO: 644471 - DNA, 25 bp, Mus musculus
ggtaatactgcctgtccagtcgtca

SEQ ID NO: 644472 - DNA, 25 bp, Mus musculus
ggtaatactgtaacaagtggctatt

SEQ ID NO: 644473 - DNA, 25 bp, Mus musculus
ggtaatactgtatcaagtggctatt

SEQ ID NO: 644474 - DNA, 25 bp, Mus musculus
ggtaatagaataccgccaccacgcc

SEQ ID NO: 644475 - DNA, 25 bp, Mus musculus
ggtaatagaatagcgccaccacgcc

SEQ ID NO: 644476 - DNA, 25 bp, Mus musculus
ggtaatagcaggattatgagtaact

SEQ ID NO: 644477 - DNA, 25 bp, Mus musculus
ggtaatagcaggtttatgagtaact

SEQ ID NO: 644478 - DNA, 25 bp, Mus musculus
ggtaatagcctcagctacaacgaaa

SEQ ID NO: 644479 - DNA, 25 bp, Mus musculus
ggtaatagcctctgctacaacgaaa

SEQ ID NO: 644480 - DNA, 25 bp, Mus musculus
ggtaatagggtcaggttgtcagcat

SEQ ID NO: 644481 - DNA, 25 bp, Mus musculus
ggtaatagggtctggttgtcagcat

SEQ ID NO: 644482 - DNA, 25 bp, Mus musculus
ggtaatagtattacctatgtaaaca

SEQ ID NO: 644483 - DNA, 25 bp, Mus musculus
ggtaatagtatttcctatgtaaaca

SEQ ID NO: 644484 - DNA, 25 bp, Mus musculus
ggtaatagtggcagtcccggccgtc

SEQ ID NO: 644485 - DNA, 25 bp, Mus musculus
ggtaatagtggctgtcccggccgtc

SEQ ID NO: 644486 - DNA, 25 bp, Mus musculus
ggtaatatcctcactaattcccttc

SEQ ID NO: 644487 - DNA, 25 bp, Mus musculus
ggtaatatcctctctaattcccttc

SEQ ID NO: 644488 - DNA, 25 bp, Mus musculus
ggtaatatgagtcgtctccccatct

SEQ ID NO: 644489 - DNA, 25 bp, Mus musculus
ggtaatatgagtggtctccccatct

SEQ ID NO: 644490 - DNA, 25 bp, Mus musculus
ggtaatattctaaccttatgacact

SEQ ID NO: 644491 - DNA, 25 bp, Mus musculus
ggtaatattctatccttatgacact

SEQ ID NO: 644492 - DNA, 25 bp, Mus musculus
ggtaatattgttactcagctctgaa

SEQ ID NO: 644493 - DNA, 25 bp, Mus musculus
ggtaatattgtttctcagctctgaa

SEQ ID NO: 644494 - DNA, 25 bp, Mus musculus
ggtaatatttggacaggcgacacat

SEQ ID NO: 644495 - DNA, 25 bp, Mus musculus
ggtaatatttggtcaggcgacacat

SEQ ID NO: 644496 - DNA, 25 bp, Mus musculus
ggtaatcaaagaagcctacagtggc

SEQ ID NO: 644497 - DNA, 25 bp, Mus musculus
ggtaatcaaagatgcctacagtggc

SEQ ID NO: 644498 - DNA, 25 bp, Mus musculus
ggtaatcacacaataacacagctaa

SEQ ID NO: 644499 - DNA, 25 bp, Mus musculus
ggtaatcacacattaacacagctaa

SEQ ID NO: 644500 - DNA, 25 bp, Mus musculus
ggtaatcagcaacgcgacccaggtg

SEQ ID NO: 644501 - DNA, 25 bp, Mus musculus
ggtaatcagcaaggcgacccaggtg

SEQ ID NO: 644502 - DNA, 25 bp, Mus musculus
ggtaatccaccacttggaccaattg

SEQ ID NO: 644503 - DNA, 25 bp, Mus musculus
ggtaatccaccagttggaccaattg

SEQ ID NO: 644504 - DNA, 25 bp, Mus musculus
ggtaatcccatcactaaactggcag

SEQ ID NO: 644505 - DNA, 25 bp, Mus musculus
ggtaatcccatctctaaactggcag

SEQ ID NO: 644506 - DNA, 25 bp, Mus musculus
ggtaatcgtattaggtcctctttga

SEQ ID NO: 644507 - DNA, 25 bp, Mus musculus
ggtaatcgtatttggtcctctttga

SEQ ID NO: 644508 - DNA, 25 bp, Mus musculus
ggtaatctagttatcctgggaatca

SEQ ID NO: 644509 - DNA, 25 bp, Mus musculus
ggtaatctagttttcctgggaatca

SEQ ID NO: 644510 - DNA, 25 bp, Mus musculus
ggtaatctatggctccctggagttt

SEQ ID NO: 644511 - DNA, 25 bp, Mus musculus
ggtaatctatgggtccctggagttt

SEQ ID NO: 644512 - DNA, 25 bp, Mus musculus
ggtaatctgataatatgagccagga

SEQ ID NO: 644513 - DNA, 25 bp, Mus musculus
ggtaatctgatattatgagccagga

SEQ ID NO: 644514 - DNA, 25 bp, Mus musculus
ggtaatctgtgaacttctcttcctg

SEQ ID NO: 644515 - DNA, 25 bp, Mus musculus
ggtaatctgtgatcttctcttcctg

SEQ ID NO: 644516 - DNA, 25 bp, Mus musculus
ggtaatctgttacacatctctgaga

SEQ ID NO: 644517 - DNA, 25 bp, Mus musculus
ggtaatctgttagacatctctgaga

SEQ ID NO: 644518 - DNA, 25 bp, Mus musculus
ggtaatctttgacccttgagagagg

SEQ ID NO: 644519 - DNA, 25 bp, Mus musculus
ggtaatctttgagccttgagagagg

SEQ ID NO: 644520 - DNA, 25 bp, Mus musculus
ggtaatctttgcaactctaagtcta

SEQ ID NO: 644521 - DNA, 25 bp, Mus musculus
ggtaatctttgctactctaagtcta

SEQ ID NO: 644522 - DNA, 25 bp, Mus musculus
ggtaatcttttactgagctggatct

SEQ ID NO: 644523 - DNA, 25 bp, Mus musculus
ggtaatcttttagtgagctggatct

SEQ ID NO: 644524 - DNA, 25 bp, Mus musculus
ggtaatgaaccactatatactgtac

SEQ ID NO: 644525 - DNA, 25 bp, Mus musculus
ggtaatgaaccagtatatactgtac

SEQ ID NO: 644526 - DNA, 25 bp, Mus musculus
ggtaatgacaggacacagggcccag

SEQ ID NO: 644527 - DNA, 25 bp, Mus musculus
ggtaatgacaggtcacagggcccag

SEQ ID NO: 644528 - DNA, 25 bp, Mus musculus
ggtaatgaccgaatataatgcaact

SEQ ID NO: 644529 - DNA, 25 bp, Mus musculus
ggtaatgaccgattataatgcaact

SEQ ID NO: 644530 - DNA, 25 bp, Mus musculus
ggtaatgagccccagcaactgtcct

SEQ ID NO: 644531 - DNA, 25 bp, Mus musculus
ggtaatgagcccgagcaactgtcct

SEQ ID NO: 644532 - DNA, 25 bp, Mus musculus
ggtaatgagcttccctagcacgatg

SEQ ID NO: 644533 - DNA, 25 bp, Mus musculus
ggtaatgagcttgcctagcacgatg

SEQ ID NO: 644534 - DNA, 25 bp, Mus musculus
ggtaatgccactacagtatttcctg

SEQ ID NO: 644535 - DNA, 25 bp, Mus musculus
ggtaatgccacttcagtatttcctg

SEQ ID NO: 644536 - DNA, 25 bp, Mus musculus
ggtaatgcctcccttgtaattaatg

SEQ ID NO: 644537 - DNA, 25 bp, Mus musculus
ggtaatgcctccgttgtaattaatg

SEQ ID NO: 644538 - DNA, 25 bp, Mus musculus
ggtaatgcgcacacaaatctcttgg

SEQ ID NO: 644539 - DNA, 25 bp, Mus musculus
ggtaatgcgcactcaaatctcttgg

SEQ ID NO: 644540 - DNA, 25 bp, Mus musculus
ggtaatggcaatatgtgacacacta

SEQ ID NO: 644541 - DNA, 25 bp, Mus musculus
ggtaatggcaatttgtgacacacta

SEQ ID NO: 644542 - DNA, 25 bp, Mus musculus
ggtaatggcaccatctgcagggcat

SEQ ID NO: 644543 - DNA, 25 bp, Mus musculus
ggtaatggcaccttctgcagggcat

SEQ ID NO: 644544 - DNA, 25 bp, Mus musculus
ggtaatggtatgctgtatccttaat

SEQ ID NO: 644545 - DNA, 25 bp, Mus musculus
ggtaatggtatggtgtatccttaat

SEQ ID NO: 644546 - DNA, 25 bp, Mus musculus
ggtaatggtgcgcttgcctaacacg

SEQ ID NO: 644547 - DNA, 25 bp, Mus musculus
ggtaatggtgcggttgcctaacacg

SEQ ID NO: 644548 - DNA, 25 bp, Mus musculus
ggtaatgtaacaccatcctgttgag

SEQ ID NO: 644549 - DNA, 25 bp, Mus musculus
ggtaatgtaacagcatcctgttgag

SEQ ID NO: 644550 - DNA, 25 bp, Mus musculus
ggtaatgtatttcaaatctagcttt

SEQ ID NO: 644551 - DNA, 25 bp, Mus musculus
ggtaatgtatttgaaatctagcttt

SEQ ID NO: 644552 - DNA, 25 bp, Mus musculus
ggtaatgtcaatcttatccagcctg

SEQ ID NO: 644553 - DNA, 25 bp, Mus musculus
ggtaatgtcaatgttatccagcctg

SEQ ID NO: 644554 - DNA, 25 bp, Mus musculus
ggtaatgtcatcacggcagcttgaa

SEQ ID NO: 644555 - DNA, 25 bp, Mus musculus
ggtaatgtcatctcggcagcttgaa

SEQ ID NO: 644556 - DNA, 25 bp, Mus musculus
ggtaatgtctaacttgccaccaact

SEQ ID NO: 644557 - DNA, 25 bp, Mus musculus
ggtaatgtctaagttgccaccaact

SEQ ID NO: 644558 - DNA, 25 bp, Mus musculus
ggtaatgtctgacttcatctaagct

SEQ ID NO: 644559 - DNA, 25 bp, Mus musculus
ggtaatgtctgagttcatctaagct

SEQ ID NO: 644560 - DNA, 25 bp, Mus musculus
ggtaatgtctgtctacactatatac

SEQ ID NO: 644561 - DNA, 25 bp, Mus musculus
ggtaatgtctgtgtacactatatac

SEQ ID NO: 644562 - DNA, 25 bp, Mus musculus
ggtaatgtgacaacttctgttctgt

SEQ ID NO: 644563 - DNA, 25 bp, Mus musculus
ggtaatgtgacatcttctgttctgt

SEQ ID NO: 644564 - DNA, 25 bp, Mus musculus
ggtaatgtgagccactacgtttatt

SEQ ID NO: 644565 - DNA, 25 bp, Mus musculus
ggtaatgtgagcgactacgtttatt

SEQ ID NO: 644566 - DNA, 25 bp, Mus musculus
ggtaatgtgggactttcttccatcc

SEQ ID NO: 644567 - DNA, 25 bp, Mus musculus
ggtaatgtgggagtttcttccatcc

SEQ ID NO: 644568 - DNA, 25 bp, Mus musculus
ggtaatgttcccactgcaaagatga

SEQ ID NO: 644569 - DNA, 25 bp, Mus musculus
ggtaatgttccctctgcaaagatga

SEQ ID NO: 644570 - DNA, 25 bp, Mus musculus
ggtaatgtttgtaaagcgctttgta

SEQ ID NO: 644571 - DNA, 25 bp, Mus musculus
ggtaatgtttgttaagcgctttgta

SEQ ID NO: 644572 - DNA, 25 bp, Mus musculus
ggtaattaaggcatcacagcttcaa

SEQ ID NO: 644573 - DNA, 25 bp, Mus musculus
ggtaattaaggcttcacagcttcaa

SEQ ID NO: 644574 - DNA, 25 bp, Mus musculus
ggtaattagcctctgggtccttcaa

SEQ ID NO: 644575 - DNA, 25 bp, Mus musculus
ggtaattagcctgtgggtccttcaa

SEQ ID NO: 644576 - DNA, 25 bp, Mus musculus
ggtaattagtcacatttctcatcat

SEQ ID NO: 644577 - DNA, 25 bp, Mus musculus
ggtaattagtcagatttctcatcat

SEQ ID NO: 644578 - DNA, 25 bp, Mus musculus
ggtaattagtgtacctatccattca

SEQ ID NO: 644579 - DNA, 25 bp, Mus musculus
ggtaattagtgttcctatccattca

SEQ ID NO: 644580 - DNA, 25 bp, Mus musculus
ggtaattataacacacatggacgaa

SEQ ID NO: 644581 - DNA, 25 bp, Mus musculus
ggtaattataactcacatggacgaa

SEQ ID NO: 644582 - DNA, 25 bp, Mus musculus
ggtaattatctgaaaaccagtgcat

SEQ ID NO: 644583 - DNA, 25 bp, Mus musculus
ggtaattatctgtaaaccagtgcat

SEQ ID NO: 644584 - DNA, 25 bp, Mus musculus
ggtaattcagccattaagccgagca

SEQ ID NO: 644585 - DNA, 25 bp, Mus musculus
ggtaattcagcctttaagccgagca

SEQ ID NO: 644586 - DNA, 25 bp, Mus musculus
ggtaattcataccattgcattgtgg

SEQ ID NO: 644587 - DNA, 25 bp, Mus musculus
ggtaattcatacgattgcattgtgg

SEQ ID NO: 644588 - DNA, 25 bp, Mus musculus
ggtaattctaacactctaactgtat

SEQ ID NO: 644589 - DNA, 25 bp, Mus musculus
ggtaattctaactctctaactgtat

SEQ ID NO: 644590 - DNA, 25 bp, Mus musculus
ggtaattctattaatctgacatggt

SEQ ID NO: 644591 - DNA, 25 bp, Mus musculus
ggtaattctatttatctgacatggt

SEQ ID NO: 644592 - DNA, 25 bp, Mus musculus
ggtaattgacctagttccctgaaat

SEQ ID NO: 644593 - DNA, 25 bp, Mus musculus
ggtaattgaccttgttccctgaaat

SEQ ID NO: 644594 - DNA, 25 bp, Mus musculus
ggtaattgacttagcatttgtcccc

SEQ ID NO: 644595 - DNA, 25 bp, Mus musculus
ggtaattgacttcttcatcttcaca

SEQ ID NO: 644596 - DNA, 25 bp, Mus musculus
ggtaattgacttgttcatcttcaca

SEQ ID NO: 644597 - DNA, 25 bp, Mus musculus
ggtaattgactttgcatttgtcccc

SEQ ID NO: 644598 - DNA, 25 bp, Mus musculus
ggtaattgagttagcagtagcagga

SEQ ID NO: 644599 - DNA, 25 bp, Mus musculus
ggtaattgagtttgcagtagcagga

SEQ ID NO: 644600 - DNA, 25 bp, Mus musculus
ggtaattgatgtagcgctccacttg

SEQ ID NO: 644601 - DNA, 25 bp, Mus musculus
ggtaattgatgttgcgctccacttg

SEQ ID NO: 644602 - DNA, 25 bp, Mus musculus
ggtaattgctgtccgtgtatcgtca

SEQ ID NO: 644603 - DNA, 25 bp, Mus musculus
ggtaattgctgtgcgtgtatcgtca

SEQ ID NO: 644604 - DNA, 25 bp, Mus musculus
ggtaattggaatcccctgagttcag

SEQ ID NO: 644605 - DNA, 25 bp, Mus musculus
ggtaattggaatgccctgagttcag

SEQ ID NO: 644606 - DNA, 25 bp, Mus musculus
ggtaattgtgtaatcagctccttcc

SEQ ID NO: 644607 - DNA, 25 bp, Mus musculus
ggtaattgtgtattcagctccttcc

SEQ ID NO: 644608 - DNA, 25 bp, Mus musculus
ggtaatttattcactcgttccttag

SEQ ID NO: 644609 - DNA, 25 bp, Mus musculus
ggtaatttattctctcgttccttag

SEQ ID NO: 644610 - DNA, 25 bp, Mus musculus
ggtaatttccatcttgaagcgtctc

SEQ ID NO: 644611 - DNA, 25 bp, Mus musculus
ggtaatttccatgttgaagcgtctc

SEQ ID NO: 644612 - DNA, 25 bp, Mus musculus
ggtaatttcccaatagcataatttt

SEQ ID NO: 644613 - DNA, 25 bp, Mus musculus
ggtaatttcccattagcataatttt

SEQ ID NO: 644614 - DNA, 25 bp, Mus musculus
ggtaatttctacagctgtctccatc

SEQ ID NO: 644615 - DNA, 25 bp, Mus musculus
ggtaatttctactgctgtctccatc

SEQ ID NO: 644616 - DNA, 25 bp, Mus musculus
ggtaatttctccatcctatgttatg

SEQ ID NO: 644617 - DNA, 25 bp, Mus musculus
ggtaatttctccttcctatgttatg

SEQ ID NO: 644618 - DNA, 25 bp, Mus musculus
ggtaatttgctgcagccacacactg

SEQ ID NO: 644619 - DNA, 25 bp, Mus musculus
ggtaatttgctggagccacacactg

SEQ ID NO: 644620 - DNA, 25 bp, Mus musculus
ggtaattttcggctgggcagctcca

SEQ ID NO: 644621 - DNA, 25 bp, Mus musculus
ggtaattttcgggtgggcagctcca

SEQ ID NO: 644622 - DNA, 25 bp, Mus musculus
ggtaattttgatcgttcgacttgct

SEQ ID NO: 644623 - DNA, 25 bp, Mus musculus
ggtaattttgatggttcgacttgct

SEQ ID NO: 644624 - DNA, 25 bp, Mus musculus
ggtaattttgctatgtgcagagaat

SEQ ID NO: 644625 - DNA, 25 bp, Mus musculus
ggtaattttgctttgtgcagagaat

SEQ ID NO: 644626 - DNA, 25 bp, Mus musculus
ggtacaaacacaataactccttata

SEQ ID NO: 644627 - DNA, 25 bp, Mus musculus
ggtacaaacacattaactccttata

SEQ ID NO: 644628 - DNA, 25 bp, Mus musculus
ggtacaaacatcaggttcactaaca

SEQ ID NO: 644629 - DNA, 25 bp, Mus musculus
ggtacaaacatctggttcactaaca

SEQ ID NO: 644630 - DNA, 25 bp, Mus musculus
ggtacaaactgacgctgctgtgctg

SEQ ID NO: 644631 - DNA, 25 bp, Mus musculus
ggtacaaactgaggctgctgtgctg

SEQ ID NO: 644632 - DNA, 25 bp, Mus musculus
ggtacaaagagaacattgaagctga

SEQ ID NO: 644633 - DNA, 25 bp, Mus musculus
ggtacaaagagatcattgaagctga

SEQ ID NO: 644634 - DNA, 25 bp, Mus musculus
ggtacaaagccgagtctgctcactc

SEQ ID NO: 644635 - DNA, 25 bp, Mus musculus
ggtacaaagccgtgtctgctcactc

SEQ ID NO: 644636 - DNA, 25 bp, Mus musculus
ggtacaaatcctaaaacctctcagg

SEQ ID NO: 644637 - DNA, 25 bp, Mus musculus
ggtacaaatccttaaacctctcagg

SEQ ID NO: 644638 - DNA, 25 bp, Mus musculus
ggtacaaatttgctggtctcttagt

SEQ ID NO: 644639 - DNA, 25 bp, Mus musculus
ggtacaaatttggtggtctcttagt

SEQ ID NO: 644640 - DNA, 25 bp, Mus musculus
ggtacaacactgaatgtttaaggtt

SEQ ID NO: 644641 - DNA, 25 bp, Mus musculus
ggtacaacactgtatgtttaaggtt

SEQ ID NO: 644642 - DNA, 25 bp, Mus musculus
ggtacaaccaacagcttcttctaga

SEQ ID NO: 644643 - DNA, 25 bp, Mus musculus
ggtacaaccaactgcttcttctaga

SEQ ID NO: 644644 - DNA, 25 bp, Mus musculus
ggtacaaccaccctggaaatcagac

SEQ ID NO: 644645 - DNA, 25 bp, Mus musculus
ggtacaaccaccgtggaaatcagac

SEQ ID NO: 644646 - DNA, 25 bp, Mus musculus
ggtacaacgagcatccagggaggca

SEQ ID NO: 644647 - DNA, 25 bp, Mus musculus
ggtacaacgagcttccagggaggca

SEQ ID NO: 644648 - DNA, 25 bp, Mus musculus
ggtacaacgtgcaaagcctggctaa

SEQ ID NO: 644649 - DNA, 25 bp, Mus musculus
ggtacaacgtgctaagcctggctaa

SEQ ID NO: 644650 - DNA, 25 bp, Mus musculus
ggtacaactgtacacaatgcttttc

SEQ ID NO: 644651 - DNA, 25 bp, Mus musculus
ggtacaactgtagacaatgcttttc

SEQ ID NO: 644652 - DNA, 25 bp, Mus musculus
ggtacaagaaggcattcgatctctc

SEQ ID NO: 644653 - DNA, 25 bp, Mus musculus
ggtacaagaagggattcgatctctc

SEQ ID NO: 644654 - DNA, 25 bp, Mus musculus
ggtacaagacgaactactcacccgg

SEQ ID NO: 644655 - DNA, 25 bp, Mus musculus
ggtacaagacgatctactcacccgg

SEQ ID NO: 644656 - DNA, 25 bp, Mus musculus
ggtacaagagaaccaacctcaactg

SEQ ID NO: 644657 - DNA, 25 bp, Mus musculus
ggtacaagagaagcaacctcaactg

SEQ ID NO: 644658 - DNA, 25 bp, Mus musculus
ggtacaagcaataccctgtagctcc

SEQ ID NO: 644659 - DNA, 25 bp, Mus musculus
ggtacaagcaattccctgtagctcc

SEQ ID NO: 644660 - DNA, 25 bp, Mus musculus
ggtacaagcccaaactcgagaaagc

SEQ ID NO: 644661 - DNA, 25 bp, Mus musculus
ggtacaagcccatactcgagaaagc

SEQ ID NO: 644662 - DNA, 25 bp, Mus musculus
ggtacaaggatgagaccgtctacat

SEQ ID NO: 644663 - DNA, 25 bp, Mus musculus
ggtacaaggatgtgaccgtctacat

SEQ ID NO: 644664 - DNA, 25 bp, Mus musculus
ggtacaaggctcacaaatccaaggt

SEQ ID NO: 644665 - DNA, 25 bp, Mus musculus
ggtacaaggctctcaaatccaaggt

SEQ ID NO: 644666 - DNA, 25 bp, Mus musculus
ggtacaaggtagagcgcccttagca

SEQ ID NO: 644667 - DNA, 25 bp, Mus musculus
ggtacaaggtagtgcgcccttagca

SEQ ID NO: 644668 - DNA, 25 bp, Mus musculus
ggtacaaggttgcagttggcaatat

SEQ ID NO: 644669 - DNA, 25 bp, Mus musculus
ggtacaaggttggagttggcaatat

SEQ ID NO: 644670 - DNA, 25 bp, Mus musculus
ggtacaagtagccatgtacagctca

SEQ ID NO: 644671 - DNA, 25 bp, Mus musculus
ggtacaagtagcgatgtacagctca

SEQ ID NO: 644672 - DNA, 25 bp, Mus musculus
ggtacaatacctcggccaattatat

SEQ ID NO: 644673 - DNA, 25 bp, Mus musculus
ggtacaatacctgggccaattatat

SEQ ID NO: 644674 - DNA, 25 bp, Mus musculus
ggtacaatatgtaatccctatggtg

SEQ ID NO: 644675 - DNA, 25 bp, Mus musculus
ggtacaatatgttatccctatggtg

SEQ ID NO: 644676 - DNA, 25 bp, Mus musculus
ggtacaatcaaaagctccaagtgtg

SEQ ID NO: 644677 - DNA, 25 bp, Mus musculus
ggtacaatcaaatgctccaagtgtg

SEQ ID NO: 644678 - DNA, 25 bp, Mus musculus
ggtacaatcaccctagacccaaggc

SEQ ID NO: 644679 - DNA, 25 bp, Mus musculus
ggtacaatcaccgtagacccaaggc

SEQ ID NO: 644680 - DNA, 25 bp, Mus musculus
ggtacaatctgtaacgcggcggaca

SEQ ID NO: 644681 - DNA, 25 bp, Mus musculus
ggtacaatctgttacgcggcggaca

SEQ ID NO: 644682 - DNA, 25 bp, Mus musculus
ggtacaatgcggagagctggctaca

SEQ ID NO: 644683 - DNA, 25 bp, Mus musculus
ggtacaatgcggtgagctggctaca

SEQ ID NO: 644684 - DNA, 25 bp, Mus musculus
ggtacaatggctctttggtccctgc

SEQ ID NO: 644685 - DNA, 25 bp, Mus musculus
ggtacaatggctgtttggtccctgc

SEQ ID NO: 644686 - DNA, 25 bp, Mus musculus
ggtacaatgtatccgaccaggcaga

SEQ ID NO: 644687 - DNA, 25 bp, Mus musculus
ggtacaatgtatcctgaacccggaa

SEQ ID NO: 644688 - DNA, 25 bp, Mus musculus
ggtacaatgtatgcgaccaggcaga

SEQ ID NO: 644689 - DNA, 25 bp, Mus musculus
ggtacaatgtatgctgaacccggaa

SEQ ID NO: 644690 - DNA, 25 bp, Mus musculus
ggtacaatttatacaggcgacatat

SEQ ID NO: 644691 - DNA, 25 bp, Mus musculus
ggtacaatttattcaggcgacatat

SEQ ID NO: 644692 - DNA, 25 bp, Mus musculus
ggtacacaaagcattaaccttatct

SEQ ID NO: 644693 - DNA, 25 bp, Mus musculus
ggtacacaaagctttaaccttatct

SEQ ID NO: 644694 - DNA, 25 bp, Mus musculus
ggtacacaaatacacactggcccac

SEQ ID NO: 644695 - DNA, 25 bp, Mus musculus
ggtacacaaatagacactggcccac

SEQ ID NO: 644696 - DNA, 25 bp, Mus musculus
ggtacacaacttcgctgacgggctc

SEQ ID NO: 644697 - DNA, 25 bp, Mus musculus
ggtacacaacttggctgacgggctc

SEQ ID NO: 644698 - DNA, 25 bp, Mus musculus
ggtacacaaggaattttaggtcagc

SEQ ID NO: 644699 - DNA, 25 bp, Mus musculus
ggtacacaaggatttttaggtcagc

SEQ ID NO: 644700 - DNA, 25 bp, Mus musculus
ggtacacacatgctagaaacacagt

SEQ ID NO: 644701 - DNA, 25 bp, Mus musculus
ggtacacacatggtagaaacacagt

SEQ ID NO: 644702 - DNA, 25 bp, Mus musculus
ggtacacacgacaccagctctgcat

SEQ ID NO: 644703 - DNA, 25 bp, Mus musculus
ggtacacacgactccagctctgcat

SEQ ID NO: 644704 - DNA, 25 bp, Mus musculus
ggtacacacgcacgtgtgtttccca

SEQ ID NO: 644705 - DNA, 25 bp, Mus musculus
ggtacacacgcaggtgtgtttccca

SEQ ID NO: 644706 - DNA, 25 bp, Mus musculus
ggtacacacgtgaacacctccatag

SEQ ID NO: 644707 - DNA, 25 bp, Mus musculus
ggtacacacgtgtacacctccatag

SEQ ID NO: 644708 - DNA, 25 bp, Mus musculus
ggtacacactacatattaaggttgg

SEQ ID NO: 644709 - DNA, 25 bp, Mus musculus
ggtacacactacttattaaggttgg

SEQ ID NO: 644710 - DNA, 25 bp, Mus musculus
ggtacacactcaccttaggcattaa

SEQ ID NO: 644711 - DNA, 25 bp, Mus musculus
ggtacacactcagcttaggcattaa

SEQ ID NO: 644712 - DNA, 25 bp, Mus musculus
ggtacacacttcagatcccagcagt

SEQ ID NO: 644713 - DNA, 25 bp, Mus musculus
ggtacacacttctgatcccagcagt

SEQ ID NO: 644714 - DNA, 25 bp, Mus musculus
ggtacacagaatcaaggctctagct

SEQ ID NO: 644715 - DNA, 25 bp, Mus musculus
ggtacacagaatgaaggctctagct

SEQ ID NO: 644716 - DNA, 25 bp, Mus musculus
ggtacacagacgacacagaccttgt

SEQ ID NO: 644717 - DNA, 25 bp, Mus musculus
ggtacacagacgtcacagaccttgt

SEQ ID NO: 644718 - DNA, 25 bp, Mus musculus
ggtacacagagtattttgcacttgg

SEQ ID NO: 644719 - DNA, 25 bp, Mus musculus
ggtacacagagttttttgcacttgg

SEQ ID NO: 644720 - DNA, 25 bp, Mus musculus
ggtacacagataagtctttcaacat

SEQ ID NO: 644721 - DNA, 25 bp, Mus musculus
ggtacacagatatgtctttcaacat

SEQ ID NO: 644722 - DNA, 25 bp, Mus musculus
ggtacacagcaacgatttccctcta

SEQ ID NO: 644723 - DNA, 25 bp, Mus musculus
ggtacacagcaacgcccaagcagag

SEQ ID NO: 644724 - DNA, 25 bp, Mus musculus
ggtacacagcaaggatttccctcta

SEQ ID NO: 644725 - DNA, 25 bp, Mus musculus
ggtacacagcaaggcccaagcagag

SEQ ID NO: 644726 - DNA, 25 bp, Mus musculus
ggtacacagcctactaaactgcccg

SEQ ID NO: 644727 - DNA, 25 bp, Mus musculus
ggtacacagccttctaaactgcccg

SEQ ID NO: 644728 - DNA, 25 bp, Mus musculus
ggtacacagtttctaatgcgggtaa

SEQ ID NO: 644729 - DNA, 25 bp, Mus musculus
ggtacacagtttgtaatgcgggtaa

SEQ ID NO: 644730 - DNA, 25 bp, Mus musculus
ggtacacatagtactttggcatata

SEQ ID NO: 644731 - DNA, 25 bp, Mus musculus
ggtacacatagttctttggcatata

SEQ ID NO: 644732 - DNA, 25 bp, Mus musculus
ggtacacatatgacagctcggtcta

SEQ ID NO: 644733 - DNA, 25 bp, Mus musculus
ggtacacatatgtcagctcggtcta

SEQ ID NO: 644734 - DNA, 25 bp, Mus musculus
ggtacacatgcaagcctataggcaa

SEQ ID NO: 644735 - DNA, 25 bp, Mus musculus
ggtacacatgcatgcctataggcaa

SEQ ID NO: 644736 - DNA, 25 bp, Mus musculus
ggtacacattacactacagttgact

SEQ ID NO: 644737 - DNA, 25 bp, Mus musculus
ggtacacattactctacagttgact

SEQ ID NO: 644738 - DNA, 25 bp, Mus musculus
ggtacacattctcagcacatatatt

SEQ ID NO: 644739 - DNA, 25 bp, Mus musculus
ggtacacattctgagcacatatatt

SEQ ID NO: 644740 - DNA, 25 bp, Mus musculus
ggtacaccacccctcttaatatggg

SEQ ID NO: 644741 - DNA, 25 bp, Mus musculus
ggtacaccacccgtcttaatatggg

SEQ ID NO: 644742 - DNA, 25 bp, Mus musculus
ggtacaccaggaatagacgatgata

SEQ ID NO: 644743 - DNA, 25 bp, Mus musculus
ggtacaccaggattagacgatgata

SEQ ID NO: 644744 - DNA, 25 bp, Mus musculus
ggtacaccatttcctgataacacag

SEQ ID NO: 644745 - DNA, 25 bp, Mus musculus
ggtacaccatttgctgataacacag

SEQ ID NO: 644746 - DNA, 25 bp, Mus musculus
ggtacaccctgcaggtcaaccagag

SEQ ID NO: 644747 - DNA, 25 bp, Mus musculus
ggtacaccctgctggtcaaccagag

SEQ ID NO: 644748 - DNA, 25 bp, Mus musculus
ggtacaccgggacacacggcacaga

SEQ ID NO: 644749 - DNA, 25 bp, Mus musculus
ggtacaccgggagacacggcacaga

SEQ ID NO: 644750 - DNA, 25 bp, Mus musculus
ggtacacgtcaccataggagttggc

SEQ ID NO: 644751 - DNA, 25 bp, Mus musculus
ggtacacgtcacgataggagttggc

SEQ ID NO: 644752 - DNA, 25 bp, Mus musculus
ggtacactaaacacccagggcaggt

SEQ ID NO: 644753 - DNA, 25 bp, Mus musculus
ggtacactaaactcccagggcaggt

SEQ ID NO: 644754 - DNA, 25 bp, Mus musculus
ggtacactagaacgcattcctactt

SEQ ID NO: 644755 - DNA, 25 bp, Mus musculus
ggtacactagaaggcattcctactt

SEQ ID NO: 644756 - DNA, 25 bp, Mus musculus
ggtacactcctaaccactggaagca

SEQ ID NO: 644757 - DNA, 25 bp, Mus musculus
ggtacactcctatccactggaagca

SEQ ID NO: 644758 - DNA, 25 bp, Mus musculus
ggtacactctttaggcttggacaag

SEQ ID NO: 644759 - DNA, 25 bp, Mus musculus
ggtacactcttttggcttggacaag

SEQ ID NO: 644760 - DNA, 25 bp, Mus musculus
ggtacactgaagacatgtcctctaa

SEQ ID NO: 644761 - DNA, 25 bp, Mus musculus
ggtacactgaagtcatgtcctctaa

SEQ ID NO: 644762 - DNA, 25 bp, Mus musculus
ggtacactggacatcagggcgcttt

SEQ ID NO: 644763 - DNA, 25 bp, Mus musculus
ggtacactggacttcagggcgcttt

SEQ ID NO: 644764 - DNA, 25 bp, Mus musculus
ggtacactgtggacatctgttgatt

SEQ ID NO: 644765 - DNA, 25 bp, Mus musculus
ggtacactgtggcagcatccggcaa

SEQ ID NO: 644766 - DNA, 25 bp, Mus musculus
ggtacactgtgggagcatccggcaa

SEQ ID NO: 644767 - DNA, 25 bp, Mus musculus
ggtacactgtggtcatctgttgatt

SEQ ID NO: 644768 - DNA, 25 bp, Mus musculus
ggtacacttcttactcagagttgca

SEQ ID NO: 644769 - DNA, 25 bp, Mus musculus
ggtacacttctttctcagagttgca

SEQ ID NO: 644770 - DNA, 25 bp, Mus musculus
ggtacacttgatagcgtgggcctcg

SEQ ID NO: 644771 - DNA, 25 bp, Mus musculus
ggtacacttgattgcgtgggcctcg

SEQ ID NO: 644772 - DNA, 25 bp, Mus musculus
ggtacacttgccaggtccgaagccc

SEQ ID NO: 644773 - DNA, 25 bp, Mus musculus
ggtacacttgcctggtccgaagccc

SEQ ID NO: 644774 - DNA, 25 bp, Mus musculus
ggtacacttggtaatctttcaggat

SEQ ID NO: 644775 - DNA, 25 bp, Mus musculus
ggtacacttggttatctttcaggat

SEQ ID NO: 644776 - DNA, 25 bp, Mus musculus
ggtacacttgttcacatgggaaagt

SEQ ID NO: 644777 - DNA, 25 bp, Mus musculus
ggtacacttgttgacatgggaaagt

SEQ ID NO: 644778 - DNA, 25 bp, Mus musculus
ggtacactttgactaaatctctgga

SEQ ID NO: 644779 - DNA, 25 bp, Mus musculus
ggtacactttgagtaaatctctgga

SEQ ID NO: 644780 - DNA, 25 bp, Mus musculus
ggtacacttttaaattggcccagaa

SEQ ID NO: 644781 - DNA, 25 bp, Mus musculus
ggtacacttttatattggcccagaa

SEQ ID NO: 644782 - DNA, 25 bp, Mus musculus
ggtacactttttcagatctgtccga

SEQ ID NO: 644783 - DNA, 25 bp, Mus musculus
ggtacactttttgagatctgtccga

SEQ ID NO: 644784 - DNA, 25 bp, Mus musculus
ggtacagaaacactgggagcctcca

SEQ ID NO: 644785 - DNA, 25 bp, Mus musculus
ggtacagaaacagtgggagcctcca

SEQ ID NO: 644786 - DNA, 25 bp, Mus musculus
ggtacagaaagtctctcacctactt

SEQ ID NO: 644787 - DNA, 25 bp, Mus musculus
ggtacagaaagtgtctcacctactt

SEQ ID NO: 644788 - DNA, 25 bp, Mus musculus
ggtacagaacctctctctaggtcat

SEQ ID NO: 644789 - DNA, 25 bp, Mus musculus
ggtacagaacctgtctctaggtcat

SEQ ID NO: 644790 - DNA, 25 bp, Mus musculus
ggtacagaagcaccctatatgtcaa

SEQ ID NO: 644791 - DNA, 25 bp, Mus musculus
ggtacagaagcagcctatatgtcaa

SEQ ID NO: 644792 - DNA, 25 bp, Mus musculus
ggtacagaagctacctggagccagt

SEQ ID NO: 644793 - DNA, 25 bp, Mus musculus
ggtacagaagcttcctggagccagt

SEQ ID NO: 644794 - DNA, 25 bp, Mus musculus
ggtacagacagaatcactcgggcaa

SEQ ID NO: 644795 - DNA, 25 bp, Mus musculus
ggtacagacagattcactcgggcaa

SEQ ID NO: 644796 - DNA, 25 bp, Mus musculus
ggtacagaccacactcggcaagaag

SEQ ID NO: 644797 - DNA, 25 bp, Mus musculus
ggtacagaccactctcggcaagaag

SEQ ID NO: 644798 - DNA, 25 bp, Mus musculus
ggtacagaccatattgatcagttga

SEQ ID NO: 644799 - DNA, 25 bp, Mus musculus
ggtacagaccattttgatcagttga

SEQ ID NO: 644800 - DNA, 25 bp, Mus musculus
ggtacagacccaagcaggccctatg

SEQ ID NO: 644801 - DNA, 25 bp, Mus musculus
ggtacagacccatgcaggccctatg

SEQ ID NO: 644802 - DNA, 25 bp, Mus musculus
ggtacagaccctagccagatggagt

SEQ ID NO: 644803 - DNA, 25 bp, Mus musculus
ggtacagacccttgccagatggagt

SEQ ID NO: 644804 - DNA, 25 bp, Mus musculus
ggtacagaccgaaggatcctcctgg

SEQ ID NO: 644805 - DNA, 25 bp, Mus musculus
ggtacagaccgatggatcctcctgg

SEQ ID NO: 644806 - DNA, 25 bp, Mus musculus
ggtacagactctagtgattggcaga

SEQ ID NO: 644807 - DNA, 25 bp, Mus musculus
ggtacagactcttgtgattggcaga

SEQ ID NO: 644808 - DNA, 25 bp, Mus musculus
ggtacagagcccaagctagacctga

SEQ ID NO: 644809 - DNA, 25 bp, Mus musculus
ggtacagagccctagctagacctga

SEQ ID NO: 644810 - DNA, 25 bp, Mus musculus
ggtacagagcctaagcacctgtcat

SEQ ID NO: 644811 - DNA, 25 bp, Mus musculus
ggtacagagccttagcacctgtcat

SEQ ID NO: 644812 - DNA, 25 bp, Mus musculus
ggtacagagctcacaaaacccttgg

SEQ ID NO: 644813 - DNA, 25 bp, Mus musculus
ggtacagagctctcaaaacccttgg

SEQ ID NO: 644814 - DNA, 25 bp, Mus musculus
ggtacagaggtgagctgctgtgctt

SEQ ID NO: 644815 - DNA, 25 bp, Mus musculus
ggtacagaggtgtgctgctgtgctt

SEQ ID NO: 644816 - DNA, 25 bp, Mus musculus
ggtacagagtgcaaggctgctgaca

SEQ ID NO: 644817 - DNA, 25 bp, Mus musculus
ggtacagagtgctaggctgctgaca

SEQ ID NO: 644818 - DNA, 25 bp, Mus musculus
ggtacagagtttaggtatctctact

SEQ ID NO: 644819 - DNA, 25 bp, Mus musculus
ggtacagagttttggtatctctact

SEQ ID NO: 644820 - DNA, 25 bp, Mus musculus
ggtacagattccacattttcttaaa

SEQ ID NO: 644821 - DNA, 25 bp, Mus musculus
ggtacagattcctcattttcttaaa

SEQ ID NO: 644822 - DNA, 25 bp, Mus musculus
ggtacagcatccatagtaacccgag

SEQ ID NO: 644823 - DNA, 25 bp, Mus musculus
ggtacagcatccttagtaacccgag

SEQ ID NO: 644824 - DNA, 25 bp, Mus musculus
ggtacagcatgcaacagcgtgccac

SEQ ID NO: 644825 - DNA, 25 bp, Mus musculus
ggtacagcatgctacagcgtgccac

SEQ ID NO: 644826 - DNA, 25 bp, Mus musculus
ggtacagccattattgttcctattt

SEQ ID NO: 644827 - DNA, 25 bp, Mus musculus
ggtacagccatttttgttcctattt

SEQ ID NO: 644828 - DNA, 25 bp, Mus musculus
ggtacagccgacaatcgccaggtaa

SEQ ID NO: 644829 - DNA, 25 bp, Mus musculus
ggtacagccgactatcgccaggtaa

SEQ ID NO: 644830 - DNA, 25 bp, Mus musculus
ggtacagcctaactatagtcccgcc

SEQ ID NO: 644831 - DNA, 25 bp, Mus musculus
ggtacagcctaagtatagtcccgcc

SEQ ID NO: 644832 - DNA, 25 bp, Mus musculus
ggtacaggaactcaccgtttcagtg

SEQ ID NO: 644833 - DNA, 25 bp, Mus musculus
ggtacaggaactgaccgtttcagtg

SEQ ID NO: 644834 - DNA, 25 bp, Mus musculus
ggtacaggaccaactggttttacat

SEQ ID NO: 644835 - DNA, 25 bp, Mus musculus
ggtacaggaccatctggttttacat

SEQ ID NO: 644836 - DNA, 25 bp, Mus musculus
ggtacaggatagaattggagacccc

SEQ ID NO: 644837 - DNA, 25 bp, Mus musculus
ggtacaggatagtattggagacccc

SEQ ID NO: 644838 - DNA, 25 bp, Mus musculus
ggtacaggccaaaagtgaagtttct

SEQ ID NO: 644839 - DNA, 25 bp, Mus musculus
ggtacaggccaatagtgaagtttct

SEQ ID NO: 644840 - DNA, 25 bp, Mus musculus
ggtacaggccacagggcggaacttt

SEQ ID NO: 644841 - DNA, 25 bp, Mus musculus
ggtacaggccactgggcggaacttt

SEQ ID NO: 644842 - DNA, 25 bp, Mus musculus
ggtacaggccttcataccaagagcc

SEQ ID NO: 644843 - DNA, 25 bp, Mus musculus
ggtacaggccttgataccaagagcc

SEQ ID NO: 644844 - DNA, 25 bp, Mus musculus
ggtacagggatgaaccttggcttaa

SEQ ID NO: 644845 - DNA, 25 bp, Mus musculus
ggtacagggatgtaccttggcttaa

SEQ ID NO: 644846 - DNA, 25 bp, Mus musculus
ggtacagggtgcagctcaccaatcc

SEQ ID NO: 644847 - DNA, 25 bp, Mus musculus
ggtacagggtgctgctcaccaatcc

SEQ ID NO: 644848 - DNA, 25 bp, Mus musculus
ggtacaggtgcaacttcatgacttt

SEQ ID NO: 644849 - DNA, 25 bp, Mus musculus
ggtacaggtgcatcttcatgacttt

SEQ ID NO: 644850 - DNA, 25 bp, Mus musculus
ggtacaggttgtatttcatccacag

SEQ ID NO: 644851 - DNA, 25 bp, Mus musculus
ggtacaggttgtttttcatccacag

SEQ ID NO: 644852 - DNA, 25 bp, Mus musculus
ggtacagtatggctccagcttagtg

SEQ ID NO: 644853 - DNA, 25 bp, Mus musculus
ggtacagtatgggtccagcttagtg

SEQ ID NO: 644854 - DNA, 25 bp, Mus musculus
ggtacagtctccattgcaaatcatg

SEQ ID NO: 644855 - DNA, 25 bp, Mus musculus
ggtacagtctcctttgcaaatcatg

SEQ ID NO: 644856 - DNA, 25 bp, Mus musculus
ggtacagtctgaatttactctgggt

SEQ ID NO: 644857 - DNA, 25 bp, Mus musculus
ggtacagtctgattttactctgggt

SEQ ID NO: 644858 - DNA, 25 bp, Mus musculus
ggtacagtgacccaacagccagagg

SEQ ID NO: 644859 - DNA, 25 bp, Mus musculus
ggtacagtgaccgaacagccagagg

SEQ ID NO: 644860 - DNA, 25 bp, Mus musculus
ggtacagtgcacaggctttagttga

SEQ ID NO: 644861 - DNA, 25 bp, Mus musculus
ggtacagtgcactggctttagttga

SEQ ID NO: 644862 - DNA, 25 bp, Mus musculus
ggtacagtggagagtccctagcctg

SEQ ID NO: 644863 - DNA, 25 bp, Mus musculus
ggtacagtggagtgtccctagcctg

SEQ ID NO: 644864 - DNA, 25 bp, Mus musculus
ggtacagtgttccatgtgtttgata

SEQ ID NO: 644865 - DNA, 25 bp, Mus musculus
ggtacagtgttcgatgtgtttgata

SEQ ID NO: 644866 - DNA, 25 bp, Mus musculus
ggtacagttacaaggaggtcatcat

SEQ ID NO: 644867 - DNA, 25 bp, Mus musculus
ggtacagttacatggaggtcatcat

SEQ ID NO: 644868 - DNA, 25 bp, Mus musculus
ggtacagttatgacccaaaccaggg

SEQ ID NO: 644869 - DNA, 25 bp, Mus musculus
ggtacagttatgtcccaaaccaggg

SEQ ID NO: 644870 - DNA, 25 bp, Mus musculus
ggtacagttattcctgctgaaccca

SEQ ID NO: 644871 - DNA, 25 bp, Mus musculus
ggtacagttattgctgctgaaccca

SEQ ID NO: 644872 - DNA, 25 bp, Mus musculus
ggtacatacacgcacaccgacagat

SEQ ID NO: 644873 - DNA, 25 bp, Mus musculus
ggtacatacacggacaccgacagat

SEQ ID NO: 644874 - DNA, 25 bp, Mus musculus
ggtacataccaacatactctacaat

SEQ ID NO: 644875 - DNA, 25 bp, Mus musculus
ggtacataccaagatactctacaat

SEQ ID NO: 644876 - DNA, 25 bp, Mus musculus
ggtacataccatctttcttagcttt

SEQ ID NO: 644877 - DNA, 25 bp, Mus musculus
ggtacataccatgtttcttagcttt

SEQ ID NO: 644878 - DNA, 25 bp, Mus musculus
ggtacatactaaactgaatcagcct

SEQ ID NO: 644879 - DNA, 25 bp, Mus musculus
ggtacatactaatctgaatcagcct

SEQ ID NO: 644880 - DNA, 25 bp, Mus musculus
ggtacatagacaatcacagtccccg

SEQ ID NO: 644881 - DNA, 25 bp, Mus musculus
ggtacatagacattcacagtccccg

SEQ ID NO: 644882 - DNA, 25 bp, Mus musculus
ggtacatagacgaacatgccgacaa

SEQ ID NO: 644883 - DNA, 25 bp, Mus musculus
ggtacatagacgtacatgccgacaa

SEQ ID NO: 644884 - DNA, 25 bp, Mus musculus
ggtacatatgagaccacctccgtga

SEQ ID NO: 644885 - DNA, 25 bp, Mus musculus
ggtacatatgagtccacctccgtga

SEQ ID NO: 644886 - DNA, 25 bp, Mus musculus
ggtacatatgctacttctgcactta

SEQ ID NO: 644887 - DNA, 25 bp, Mus musculus
ggtacatatgcttcttctgcactta

SEQ ID NO: 644888 - DNA, 25 bp, Mus musculus
ggtacatattctctgaacacccagt

SEQ ID NO: 644889 - DNA, 25 bp, Mus musculus
ggtacatattctgtgaacacccagt

SEQ ID NO: 644890 - DNA, 25 bp, Mus musculus
ggtacatcaaacactgtctgtataa

SEQ ID NO: 644891 - DNA, 25 bp, Mus musculus
ggtacatcaaactctgtctgtataa

SEQ ID NO: 644892 - DNA, 25 bp, Mus musculus
ggtacatcaaatcaaactcctttaa

SEQ ID NO: 644893 - DNA, 25 bp, Mus musculus
ggtacatcaaatcaaggcagccttc

SEQ ID NO: 644894 - DNA, 25 bp, Mus musculus
ggtacatcaaatgaaactcctttaa

SEQ ID NO: 644895 - DNA, 25 bp, Mus musculus
ggtacatcaaatgaaggcagccttc

SEQ ID NO: 644896 - DNA, 25 bp, Mus musculus
ggtacatcaccaaagaggccagtga

SEQ ID NO: 644897 - DNA, 25 bp, Mus musculus
ggtacatcaccatagaggccagtga

SEQ ID NO: 644898 - DNA, 25 bp, Mus musculus
ggtacatcacctccaattaccgagc

SEQ ID NO: 644899 - DNA, 25 bp, Mus musculus
ggtacatcacctgcaattaccgagc

SEQ ID NO: 644900 - DNA, 25 bp, Mus musculus
ggtacatcagaccttttccaatcta

SEQ ID NO: 644901 - DNA, 25 bp, Mus musculus
ggtacatcagacgttttccaatcta

SEQ ID NO: 644902 - DNA, 25 bp, Mus musculus
ggtacatcccagatcttagtggctc

SEQ ID NO: 644903 - DNA, 25 bp, Mus musculus
ggtacatcccagttcttagtggctc

SEQ ID NO: 644904 - DNA, 25 bp, Mus musculus
ggtacatccttgaattcagtagcag

SEQ ID NO: 644905 - DNA, 25 bp, Mus musculus
ggtacatccttgtattcagtagcag

SEQ ID NO: 644906 - DNA, 25 bp, Mus musculus
ggtacatcctttataactatccatg

SEQ ID NO: 644907 - DNA, 25 bp, Mus musculus
ggtacatcctttttaactatccatg

SEQ ID NO: 644908 - DNA, 25 bp, Mus musculus
ggtacatcgacaataatccatgcat

SEQ ID NO: 644909 - DNA, 25 bp, Mus musculus
ggtacatcgacattaatccatgcat

SEQ ID NO: 644910 - DNA, 25 bp, Mus musculus
ggtacatcgcaccagatgactctat

SEQ ID NO: 644911 - DNA, 25 bp, Mus musculus
ggtacatcgcacgagatgactctat

SEQ ID NO: 644912 - DNA, 25 bp, Mus musculus
ggtacatctaaaactcttcgttggc

SEQ ID NO: 644913 - DNA, 25 bp, Mus musculus
ggtacatctaaatctcttcgttggc

SEQ ID NO: 644914 - DNA, 25 bp, Mus musculus
ggtacatcttggaaaaggcacccag

SEQ ID NO: 644915 - DNA, 25 bp, Mus musculus
ggtacatcttggtaaaggcacccag

SEQ ID NO: 644916 - DNA, 25 bp, Mus musculus
ggtacatgaccgagctgtggtatat

SEQ ID NO: 644917 - DNA, 25 bp, Mus musculus
ggtacatgaccgtgctgtggtatat

SEQ ID NO: 644918 - DNA, 25 bp, Mus musculus
ggtacatgatacacgagcatacaat

SEQ ID NO: 644919 - DNA, 25 bp, Mus musculus
ggtacatgatactcgagcatacaat

SEQ ID NO: 644920 - DNA, 25 bp, Mus musculus
ggtacatgccagaatctgtctagtc

SEQ ID NO: 644921 - DNA, 25 bp, Mus musculus
ggtacatgccagtatctgtctagtc

SEQ ID NO: 644922 - DNA, 25 bp, Mus musculus
ggtacatggcagcagttctaataat

SEQ ID NO: 644923 - DNA, 25 bp, Mus musculus
ggtacatggcaggagttctaataat

SEQ ID NO: 644924 - DNA, 25 bp, Mus musculus
ggtacatggtacactggagatggct

SEQ ID NO: 644925 - DNA, 25 bp, Mus musculus
ggtacatggtactctggagatggct

SEQ ID NO: 644926 - DNA, 25 bp, Mus musculus
ggtacatggtttaaaatccccactg

SEQ ID NO: 644927 - DNA, 25 bp, Mus musculus
ggtacatggttttaaatccccactg

SEQ ID NO: 644928 - DNA, 25 bp, Mus musculus
ggtacatgtcagagtagtgttcaca

SEQ ID NO: 644929 - DNA, 25 bp, Mus musculus
ggtacatgtcagtgtagtgttcaca

SEQ ID NO: 644930 - DNA, 25 bp, Mus musculus
ggtacatgtgaccagtcttggctct

SEQ ID NO: 644931 - DNA, 25 bp, Mus musculus
ggtacatgtgacgagtcttggctct

SEQ ID NO: 644932 - DNA, 25 bp, Mus musculus
ggtacatgttgaatgcacacacgca

SEQ ID NO: 644933 - DNA, 25 bp, Mus musculus
ggtacatgttgattgcacacacgca

SEQ ID NO: 644934 - DNA, 25 bp, Mus musculus
ggtacattacttaatttgaggtgaa

SEQ ID NO: 644935 - DNA, 25 bp, Mus musculus
ggtacattactttatttgaggtgaa

SEQ ID NO: 644936 - DNA, 25 bp, Mus musculus
ggtacattatacaatacttcattat

SEQ ID NO: 644937 - DNA, 25 bp, Mus musculus
ggtacattatactatacttcattat

SEQ ID NO: 644938 - DNA, 25 bp, Mus musculus
ggtacattcaggaactatctgggag

SEQ ID NO: 644939 - DNA, 25 bp, Mus musculus
ggtacattcaggtactatctgggag

SEQ ID NO: 644940 - DNA, 25 bp, Mus musculus
ggtacattccttatataactgttgg

SEQ ID NO: 644941 - DNA, 25 bp, Mus musculus
ggtacattccttttataactgttgg

SEQ ID NO: 644942 - DNA, 25 bp, Mus musculus
ggtacattctgaaagcctcacacgc

SEQ ID NO: 644943 - DNA, 25 bp, Mus musculus
ggtacattctgatagcctcacacgc

SEQ ID NO: 644944 - DNA, 25 bp, Mus musculus
ggtacattctggaagcactggccat

SEQ ID NO: 644945 - DNA, 25 bp, Mus musculus
ggtacattctggtagcactggccat

SEQ ID NO: 644946 - DNA, 25 bp, Mus musculus
ggtacattgcttcgctacacggaag

SEQ ID NO: 644947 - DNA, 25 bp, Mus musculus
ggtacattgcttggctacacggaag

SEQ ID NO: 644948 - DNA, 25 bp, Mus musculus
ggtacatttcgactgcagactgact

SEQ ID NO: 644949 - DNA, 25 bp, Mus musculus
ggtacatttcgagtgcagactgact

SEQ ID NO: 644950 - DNA, 25 bp, Mus musculus
ggtacattttctctgttgcttctcg

SEQ ID NO: 644951 - DNA, 25 bp, Mus musculus
ggtacattttctgtgttgcttctcg

SEQ ID NO: 644952 - DNA, 25 bp, Mus musculus
ggtacattttgtaactttctcagat

SEQ ID NO: 644953 - DNA, 25 bp, Mus musculus
ggtacattttgttactttctcagat

SEQ ID NO: 644954 - DNA, 25 bp, Mus musculus
ggtacatttttgcactgaaacctaa

SEQ ID NO: 644955 - DNA, 25 bp, Mus musculus
ggtacatttttggactgaaacctaa

SEQ ID NO: 644956 - DNA, 25 bp, Mus musculus
ggtaccaaaccaacatgttctcttt

SEQ ID NO: 644957 - DNA, 25 bp, Mus musculus
ggtaccaaaccatcatgttctcttt

SEQ ID NO: 644958 - DNA, 25 bp, Mus musculus
ggtaccaacagaaaagaatcaaaga

SEQ ID NO: 644959 - DNA, 25 bp, Mus musculus
ggtaccaacagataagaatcaaaga

SEQ ID NO: 644960 - DNA, 25 bp, Mus musculus
ggtaccaagagacatacacgcgtgt

SEQ ID NO: 644961 - DNA, 25 bp, Mus musculus
ggtaccaagagagatacacgcgtgt

SEQ ID NO: 644962 - DNA, 25 bp, Mus musculus
ggtaccaagcagcatttgttcccaa

SEQ ID NO: 644963 - DNA, 25 bp, Mus musculus
ggtaccaagcaggatttgttcccaa

SEQ ID NO: 644964 - DNA, 25 bp, Mus musculus
ggtaccaagtacatagtgctcatta

SEQ ID NO: 644965 - DNA, 25 bp, Mus musculus
ggtaccaagtacttagtgctcatta

SEQ ID NO: 644966 - DNA, 25 bp, Mus musculus
ggtaccacaaatccctatatagact

SEQ ID NO: 644967 - DNA, 25 bp, Mus musculus
ggtaccacaaatgcctatatagact

SEQ ID NO: 644968 - DNA, 25 bp, Mus musculus
ggtaccacaggcagaaagtccttga

SEQ ID NO: 644969 - DNA, 25 bp, Mus musculus
ggtaccacaggctgaaagtccttga

SEQ ID NO: 644970 - DNA, 25 bp, Mus musculus
ggtaccacatcaatcagtattttta

SEQ ID NO: 644971 - DNA, 25 bp, Mus musculus
ggtaccacatcattcagtattttta

SEQ ID NO: 644972 - DNA, 25 bp, Mus musculus
ggtaccaccataaacagcatattgt

SEQ ID NO: 644973 - DNA, 25 bp, Mus musculus
ggtaccaccatatacagcatattgt

SEQ ID NO: 644974 - DNA, 25 bp, Mus musculus
ggtaccacctcgagtcctagggatg

SEQ ID NO: 644975 - DNA, 25 bp, Mus musculus
ggtaccacctcgtgtcctagggatg

SEQ ID NO: 644976 - DNA, 25 bp, Mus musculus
ggtaccacctgacgctttcctcaag

SEQ ID NO: 644977 - DNA, 25 bp, Mus musculus
ggtaccacctgaggctttcctcaag

SEQ ID NO: 644978 - DNA, 25 bp, Mus musculus
ggtaccacctggacaagggctcggt

SEQ ID NO: 644979 - DNA, 25 bp, Mus musculus
ggtaccacctggtcaagggctcggt

SEQ ID NO: 644980 - DNA, 25 bp, Mus musculus
ggtaccaccttcctatgagccagtt

SEQ ID NO: 644981 - DNA, 25 bp, Mus musculus
ggtaccaccttcgtatgagccagtt

SEQ ID NO: 644982 - DNA, 25 bp, Mus musculus
ggtaccacgatccaggctgggccaa

SEQ ID NO: 644983 - DNA, 25 bp, Mus musculus
ggtaccacgatcgaggctgggccaa

SEQ ID NO: 644984 - DNA, 25 bp, Mus musculus
ggtaccacggtacaacactgcagct

SEQ ID NO: 644985 - DNA, 25 bp, Mus musculus
ggtaccacggtagaacactgcagct

SEQ ID NO: 644986 - DNA, 25 bp, Mus musculus
ggtaccactgctatgatccagatgc

SEQ ID NO: 644987 - DNA, 25 bp, Mus musculus
ggtaccactgctttgatccagatgc

SEQ ID NO: 644988 - DNA, 25 bp, Mus musculus
ggtaccacttaaaggcatgtgttct

SEQ ID NO: 644989 - DNA, 25 bp, Mus musculus
ggtaccacttaatggcatgtgttct

SEQ ID NO: 644990 - DNA, 25 bp, Mus musculus
ggtaccagaattctctttcaggttc

SEQ ID NO: 644991 - DNA, 25 bp, Mus musculus
ggtaccagaattgtctttcaggttc

SEQ ID NO: 644992 - DNA, 25 bp, Mus musculus
ggtaccagagctacgtggtttgaat

SEQ ID NO: 644993 - DNA, 25 bp, Mus musculus
ggtaccagagcttcgtggtttgaat

SEQ ID NO: 644994 - DNA, 25 bp, Mus musculus
ggtaccagcatgcaagggccatctt

SEQ ID NO: 644995 - DNA, 25 bp, Mus musculus
ggtaccagcatggaagggccatctt

SEQ ID NO: 644996 - DNA, 25 bp, Mus musculus
ggtaccagctatatgactgcctttc

SEQ ID NO: 644997 - DNA, 25 bp, Mus musculus
ggtaccagctatttgactgcctttc

SEQ ID NO: 644998 - DNA, 25 bp, Mus musculus
ggtaccaggaaactcttcattttat

SEQ ID NO: 644999 - DNA, 25 bp, Mus musculus
ggtaccaggaaagtcttcattttat

SEQ ID NO: 645000 - DNA, 25 bp, Mus musculus
ggtaccaggcagcttagctgtcgtt

SEQ ID NO: 645001 - DNA, 25 bp, Mus musculus
ggtaccaggcaggttagctgtcgtt

SEQ ID NO: 645002 - DNA, 25 bp, Mus musculus
ggtaccagtactcctgtgagttcat

SEQ ID NO: 645003 - DNA, 25 bp, Mus musculus
ggtaccagtactgctgtgagttcat

SEQ ID NO: 645004 - DNA, 25 bp, Mus musculus
ggtaccagtagcatcttaattccaa

SEQ ID NO: 645005 - DNA, 25 bp, Mus musculus
ggtaccagtagcttcttaattccaa

SEQ ID NO: 645006 - DNA, 25 bp, Mus musculus
ggtaccagtgacatgcactgcctaa

SEQ ID NO: 645007 - DNA, 25 bp, Mus musculus
ggtaccagtgacttgcactgcctaa

SEQ ID NO: 645008 - DNA, 25 bp, Mus musculus
ggtaccagtgataaaacaggccgtt

SEQ ID NO: 645009 - DNA, 25 bp, Mus musculus
ggtaccagtgattaaacaggccgtt

SEQ ID NO: 645010 - DNA, 25 bp, Mus musculus
ggtaccagttaactcactggcctta

SEQ ID NO: 645011 - DNA, 25 bp, Mus musculus
ggtaccagttaagtcactggcctta

SEQ ID NO: 645012 - DNA, 25 bp, Mus musculus
ggtaccagttctctttgcgttttct

SEQ ID NO: 645013 - DNA, 25 bp, Mus musculus
ggtaccagttctgtttgcgttttct

SEQ ID NO: 645014 - DNA, 25 bp, Mus musculus
ggtaccatactcaggcttttgtatt

SEQ ID NO: 645015 - DNA, 25 bp, Mus musculus
ggtaccatactctggcttttgtatt

SEQ ID NO: 645016 - DNA, 25 bp, Mus musculus
ggtaccatactgaatttccactgga

SEQ ID NO: 645017 - DNA, 25 bp, Mus musculus
ggtaccatactgtatttccactgga

SEQ ID NO: 645018 - DNA, 25 bp, Mus musculus
ggtaccatcaacatagacgcagcag

SEQ ID NO: 645019 - DNA, 25 bp, Mus musculus
ggtaccatcaacttagacgcagcag

SEQ ID NO: 645020 - DNA, 25 bp, Mus musculus
ggtaccatcagaacctgtcagaagt

SEQ ID NO: 645021 - DNA, 25 bp, Mus musculus
ggtaccatcagatcctgtcagaagt

SEQ ID NO: 645022 - DNA, 25 bp, Mus musculus
ggtaccatccggcaactgaagtgtc

SEQ ID NO: 645023 - DNA, 25 bp, Mus musculus
ggtaccatccgggaactgaagtgtc

SEQ ID NO: 645024 - DNA, 25 bp, Mus musculus
ggtaccatgaacaccttgaggtcaa

SEQ ID NO: 645025 - DNA, 25 bp, Mus musculus
ggtaccatgaactccttgaggtcaa

SEQ ID NO: 645026 - DNA, 25 bp, Mus musculus
ggtaccatgatgcactgtcaaagct

SEQ ID NO: 645027 - DNA, 25 bp, Mus musculus
ggtaccatgatggactgtcaaagct

SEQ ID NO: 645028 - DNA, 25 bp, Mus musculus
ggtaccatgcatctgtctcatcaca

SEQ ID NO: 645029 - DNA, 25 bp, Mus musculus
ggtaccatgcatgtgtctcatcaca

SEQ ID NO: 645030 - DNA, 25 bp, Mus musculus
ggtaccatggtcagattcttcccag

SEQ ID NO: 645031 - DNA, 25 bp, Mus musculus
ggtaccatggtctgattcttcccag

SEQ ID NO: 645032 - DNA, 25 bp, Mus musculus
ggtaccattattacttatgttcatg

SEQ ID NO: 645033 - DNA, 25 bp, Mus musculus
ggtaccattatttcttatgttcatg

SEQ ID NO: 645034 - DNA, 25 bp, Mus musculus
ggtaccattcacatttttgcttcaa

SEQ ID NO: 645035 - DNA, 25 bp, Mus musculus
ggtaccattcacttttttgcttcaa

SEQ ID NO: 645036 - DNA, 25 bp, Mus musculus
ggtaccattgttcgctattaaaaag

SEQ ID NO: 645037 - DNA, 25 bp, Mus musculus
ggtaccattgttggctattaaaaag

SEQ ID NO: 645038 - DNA, 25 bp, Mus musculus
ggtacccaaagacccatccaaggaa

SEQ ID NO: 645039 - DNA, 25 bp, Mus musculus
ggtacccaaagagccatccaaggaa

SEQ ID NO: 645040 - DNA, 25 bp, Mus musculus
ggtacccaagatagcctcagttgta

SEQ ID NO: 645041 - DNA, 25 bp, Mus musculus
ggtacccaagattgcctcagttgta

SEQ ID NO: 645042 - DNA, 25 bp, Mus musculus
ggtacccaaggaattccaatttctg

SEQ ID NO: 645043 - DNA, 25 bp, Mus musculus
ggtacccaaggatttccaatttctg

SEQ ID NO: 645044 - DNA, 25 bp, Mus musculus
ggtacccaaggtcgcaaggcgccaa

SEQ ID NO: 645045 - DNA, 25 bp, Mus musculus
ggtacccaaggtggcaaggcgccaa

SEQ ID NO: 645046 - DNA, 25 bp, Mus musculus
ggtacccaccatctggacaggagtt

SEQ ID NO: 645047 - DNA, 25 bp, Mus musculus
ggtacccaccatgtggacaggagtt

SEQ ID NO: 645048 - DNA, 25 bp, Mus musculus
ggtacccaccttcgcttatgagaag

SEQ ID NO: 645049 - DNA, 25 bp, Mus musculus
ggtacccaccttggcttatgagaag

SEQ ID NO: 645050 - DNA, 25 bp, Mus musculus
ggtacccactctatgaagggcaaga

SEQ ID NO: 645051 - DNA, 25 bp, Mus musculus
ggtacccactctttgaagggcaaga

SEQ ID NO: 645052 - DNA, 25 bp, Mus musculus
ggtacccagagactccgaaggcgaa

SEQ ID NO: 645053 - DNA, 25 bp, Mus musculus
ggtacccagagagtccgaaggcgaa

SEQ ID NO: 645054 - DNA, 25 bp, Mus musculus
ggtacccaggatcactctaattcag

SEQ ID NO: 645055 - DNA, 25 bp, Mus musculus
ggtacccaggatgactctaattcag

SEQ ID NO: 645056 - DNA, 25 bp, Mus musculus
ggtacccagtacctcttgtatatag

SEQ ID NO: 645057 - DNA, 25 bp, Mus musculus
ggtacccagtacgtcttgtatatag

SEQ ID NO: 645058 - DNA, 25 bp, Mus musculus
ggtacccagtgacgctcaagcagga

SEQ ID NO: 645059 - DNA, 25 bp, Mus musculus
ggtacccagtgaggctcaagcagga

SEQ ID NO: 645060 - DNA, 25 bp, Mus musculus
ggtacccagtgtcagtagatccaga

SEQ ID NO: 645061 - DNA, 25 bp, Mus musculus
ggtacccagtgtgagtagatccaga

SEQ ID NO: 645062 - DNA, 25 bp, Mus musculus
ggtacccatacaatctttctgaaca

SEQ ID NO: 645063 - DNA, 25 bp, Mus musculus
ggtacccatacattctttctgaaca

SEQ ID NO: 645064 - DNA, 25 bp, Mus musculus
ggtacccattaccttagcaagtatg

SEQ ID NO: 645065 - DNA, 25 bp, Mus musculus
ggtacccattacgttagcaagtatg

SEQ ID NO: 645066 - DNA, 25 bp, Mus musculus
ggtacccattgtagctggctttttc

SEQ ID NO: 645067 - DNA, 25 bp, Mus musculus
ggtacccattgttgctggctttttc

SEQ ID NO: 645068 - DNA, 25 bp, Mus musculus
ggtaccccactgagagcgggacgat

SEQ ID NO: 645069 - DNA, 25 bp, Mus musculus
ggtaccccactgtgagcgggacgat

SEQ ID NO: 645070 - DNA, 25 bp, Mus musculus
ggtaccccagccctaaggatgtctc

SEQ ID NO: 645071 - DNA, 25 bp, Mus musculus
ggtaccccagccgtaaggatgtctc

SEQ ID NO: 645072 - DNA, 25 bp, Mus musculus
ggtaccccagggatctgcgacactt

SEQ ID NO: 645073 - DNA, 25 bp, Mus musculus
ggtaccccagggttctgcgacactt

SEQ ID NO: 645074 - DNA, 25 bp, Mus musculus
ggtaccccagtcagctcagattctt

SEQ ID NO: 645075 - DNA, 25 bp, Mus musculus
ggtaccccagtcattatcaacacat

SEQ ID NO: 645076 - DNA, 25 bp, Mus musculus
ggtaccccagtctgctcagattctt

SEQ ID NO: 645077 - DNA, 25 bp, Mus musculus
ggtaccccagtctttatcaacacat

SEQ ID NO: 645078 - DNA, 25 bp, Mus musculus
ggtacccctcccagatatgtttgga

SEQ ID NO: 645079 - DNA, 25 bp, Mus musculus
ggtacccctccctgatatgtttgga

SEQ ID NO: 645080 - DNA, 25 bp, Mus musculus
ggtacccggtgtacattcttgggat

SEQ ID NO: 645081 - DNA, 25 bp, Mus musculus
ggtacccggtgttcattcttgggat

SEQ ID NO: 645082 - DNA, 25 bp, Mus musculus
ggtacccgtggcagagctgagcttc

SEQ ID NO: 645083 - DNA, 25 bp, Mus musculus
ggtacccgtggctgagctgagcttc

SEQ ID NO: 645084 - DNA, 25 bp, Mus musculus
ggtaccctaattataacatggcatg

SEQ ID NO: 645085 - DNA, 25 bp, Mus musculus
ggtaccctaattttaacatggcatg

SEQ ID NO: 645086 - DNA, 25 bp, Mus musculus
ggtaccctcctaacagatttggcag

SEQ ID NO: 645087 - DNA, 25 bp, Mus musculus
ggtaccctcctatcagatttggcag

SEQ ID NO: 645088 - DNA, 25 bp, Mus musculus
ggtaccctcttcagaaaaatctctc

SEQ ID NO: 645089 - DNA, 25 bp, Mus musculus
ggtaccctcttcataatggctttat

SEQ ID NO: 645090 - DNA, 25 bp, Mus musculus
ggtaccctcttctgaaaaatctctc

SEQ ID NO: 645091 - DNA, 25 bp, Mus musculus
ggtaccctcttcttaatggctttat

SEQ ID NO: 645092 - DNA, 25 bp, Mus musculus
ggtaccctgaggaccaagccttcaa

SEQ ID NO: 645093 - DNA, 25 bp, Mus musculus
ggtaccctgaggactcgtcgtgtag

SEQ ID NO: 645094 - DNA, 25 bp, Mus musculus
ggtaccctgaggtccaagccttcaa

SEQ ID NO: 645095 - DNA, 25 bp, Mus musculus
ggtaccctgaggtctcgtcgtgtag

SEQ ID NO: 645096 - DNA, 25 bp, Mus musculus
ggtaccctggcaagttgtccaccat

SEQ ID NO: 645097 - DNA, 25 bp, Mus musculus
ggtaccctggcatgttgtccaccat

SEQ ID NO: 645098 - DNA, 25 bp, Mus musculus
ggtaccctggctcgctgttagagaa

SEQ ID NO: 645099 - DNA, 25 bp, Mus musculus
ggtaccctggctggctgttagagaa

SEQ ID NO: 645100 - DNA, 25 bp, Mus musculus
ggtaccctggttaagatgccctgca

SEQ ID NO: 645101 - DNA, 25 bp, Mus musculus
ggtaccctggtttagatgccctgca

SEQ ID NO: 645102 - DNA, 25 bp, Mus musculus
ggtaccctgtccacagagtgtgtga

SEQ ID NO: 645103 - DNA, 25 bp, Mus musculus
ggtaccctgtcctcagagtgtgtga

SEQ ID NO: 645104 - DNA, 25 bp, Mus musculus
ggtacccttgtcaggcatgtacaat

SEQ ID NO: 645105 - DNA, 25 bp, Mus musculus
ggtacccttgtctggcatgtacaat

SEQ ID NO: 645106 - DNA, 25 bp, Mus musculus
ggtaccctttacatctacaccattt

SEQ ID NO: 645107 - DNA, 25 bp, Mus musculus
ggtaccctttacttctacaccattt

SEQ ID NO: 645108 - DNA, 25 bp, Mus musculus
ggtaccgagcctctaaagggttcag

SEQ ID NO: 645109 - DNA, 25 bp, Mus musculus
ggtaccgagcctgtaaagggttcag

SEQ ID NO: 645110 - DNA, 25 bp, Mus musculus
ggtaccggcctcatacacagatgag

SEQ ID NO: 645111 - DNA, 25 bp, Mus musculus
ggtaccggcctcttacacagatgag

SEQ ID NO: 645112 - DNA, 25 bp, Mus musculus
ggtaccggcgtgagtacaagtccct

SEQ ID NO: 645113 - DNA, 25 bp, Mus musculus
ggtaccggcgtgtgtacaagtccct

SEQ ID NO: 645114 - DNA, 25 bp, Mus musculus
ggtaccggtcttctgtgaagccaaa

SEQ ID NO: 645115 - DNA, 25 bp, Mus musculus
ggtaccggtcttgtgtgaagccaaa

SEQ ID NO: 645116 - DNA, 25 bp, Mus musculus
ggtaccgtatgcctcgaccagataa

SEQ ID NO: 645117 - DNA, 25 bp, Mus musculus
ggtaccgtatgcgtcgaccagataa

SEQ ID NO: 645118 - DNA, 25 bp, Mus musculus
ggtaccgttggaatcatcctaccta

SEQ ID NO: 645119 - DNA, 25 bp, Mus musculus
ggtaccgttggattcatcctaccta

SEQ ID NO: 645120 - DNA, 25 bp, Mus musculus
ggtacctaactcatcgtgtttgcat

SEQ ID NO: 645121 - DNA, 25 bp, Mus musculus
ggtacctaactcttcgtgtttgcat

SEQ ID NO: 645122 - DNA, 25 bp, Mus musculus
ggtacctacactcctgtgtacataa

SEQ ID NO: 645123 - DNA, 25 bp, Mus musculus
ggtacctacactgctgtgtacataa

SEQ ID NO: 645124 - DNA, 25 bp, Mus musculus
ggtacctacttgacagatggagctg

SEQ ID NO: 645125 - DNA, 25 bp, Mus musculus
ggtacctacttgtcagatggagctg

SEQ ID NO: 645126 - DNA, 25 bp, Mus musculus
ggtacctagggtaatgaagcacgaa

SEQ ID NO: 645127 - DNA, 25 bp, Mus musculus
ggtacctagggttatgaagcacgaa

SEQ ID NO: 645128 - DNA, 25 bp, Mus musculus
ggtacctatccaaagatactcacat

SEQ ID NO: 645129 - DNA, 25 bp, Mus musculus
ggtacctatccatagatactcacat

SEQ ID NO: 645130 - DNA, 25 bp, Mus musculus
ggtacctcagatatgtttttactat

SEQ ID NO: 645131 - DNA, 25 bp, Mus musculus
ggtacctcagatttgtttttactat

SEQ ID NO: 645132 - DNA, 25 bp, Mus musculus
ggtacctccctgagatatctgacat

SEQ ID NO: 645133 - DNA, 25 bp, Mus musculus
ggtacctccctgtgatatctgacat

SEQ ID NO: 645134 - DNA, 25 bp, Mus musculus
ggtacctcctttctacaatgccaaa

SEQ ID NO: 645135 - DNA, 25 bp, Mus musculus
ggtacctcctttgtacaatgccaaa

SEQ ID NO: 645136 - DNA, 25 bp, Mus musculus
ggtacctcgatcaataggacccaat

SEQ ID NO: 645137 - DNA, 25 bp, Mus musculus
ggtacctcgatctataggacccaat

SEQ ID NO: 645138 - DNA, 25 bp, Mus musculus
ggtacctcggtaccgaatgtggctt

SEQ ID NO: 645139 - DNA, 25 bp, Mus musculus
ggtacctcggtagcgaatgtggctt

SEQ ID NO: 645140 - DNA, 25 bp, Mus musculus
ggtacctctggcctatgtgacattg

SEQ ID NO: 645141 - DNA, 25 bp, Mus musculus
ggtacctctggcgtatgtgacattg

SEQ ID NO: 645142 - DNA, 25 bp, Mus musculus
ggtacctctggtacattctgtcctg

SEQ ID NO: 645143 - DNA, 25 bp, Mus musculus
ggtacctctggttcattctgtcctg

SEQ ID NO: 645144 - DNA, 25 bp, Mus musculus
ggtacctctgtaacgtgcagatact

SEQ ID NO: 645145 - DNA, 25 bp, Mus musculus
ggtacctctgtatcgtgcagatact

SEQ ID NO: 645146 - DNA, 25 bp, Mus musculus
ggtacctctttgaagggcagattta

SEQ ID NO: 645147 - DNA, 25 bp, Mus musculus
ggtacctctttgtagggcagattta

SEQ ID NO: 645148 - DNA, 25 bp, Mus musculus
ggtacctgaagcaaccatgtatttt

SEQ ID NO: 645149 - DNA, 25 bp, Mus musculus
ggtacctgaagctaccatgtatttt

SEQ ID NO: 645150 - DNA, 25 bp, Mus musculus
ggtacctgaaggactaggcctgtga

SEQ ID NO: 645151 - DNA, 25 bp, Mus musculus
ggtacctgaaggtctaggcctgtga

SEQ ID NO: 645152 - DNA, 25 bp, Mus musculus
ggtacctgataccaacctctggtct

SEQ ID NO: 645153 - DNA, 25 bp, Mus musculus
ggtacctgatacgaacctctggtct

SEQ ID NO: 645154 - DNA, 25 bp, Mus musculus
ggtacctgcaaaagccaatggtgtt

SEQ ID NO: 645155 - DNA, 25 bp, Mus musculus
ggtacctgcaaatgccaatggtgtt

SEQ ID NO: 645156 - DNA, 25 bp, Mus musculus
ggtacctgcaatccccttggtactt

SEQ ID NO: 645157 - DNA, 25 bp, Mus musculus
ggtacctgcaatgcccttggtactt

SEQ ID NO: 645158 - DNA, 25 bp, Mus musculus
ggtacctgctagatcttaggaagat

SEQ ID NO: 645159 - DNA, 25 bp, Mus musculus
ggtacctgctagttcttaggaagat

SEQ ID NO: 645160 - DNA, 25 bp, Mus musculus
ggtacctgctgccataactatcatc

SEQ ID NO: 645161 - DNA, 25 bp, Mus musculus
ggtacctgctgcgataactatcatc

SEQ ID NO: 645162 - DNA, 25 bp, Mus musculus
ggtacctgctgtccagtttgggtca

SEQ ID NO: 645163 - DNA, 25 bp, Mus musculus
ggtacctgctgtgcagtttgggtca

SEQ ID NO: 645164 - DNA, 25 bp, Mus musculus
ggtacctggaggacccatgccaagc

SEQ ID NO: 645165 - DNA, 25 bp, Mus musculus
ggtacctggaggtcccatgccaagc

SEQ ID NO: 645166 - DNA, 25 bp, Mus musculus
ggtacctggatgatcacagagcatc

SEQ ID NO: 645167 - DNA, 25 bp, Mus musculus
ggtacctggatgttcacagagcatc

SEQ ID NO: 645168 - DNA, 25 bp, Mus musculus
ggtacctggcaacacgactcagcat

SEQ ID NO: 645169 - DNA, 25 bp, Mus musculus
ggtacctggcaagacgactcagcat

SEQ ID NO: 645170 - DNA, 25 bp, Mus musculus
ggtacctgggttagagaagaagata

SEQ ID NO: 645171 - DNA, 25 bp, Mus musculus
ggtacctgggtttgagaagaagata

SEQ ID NO: 645172 - DNA, 25 bp, Mus musculus
ggtacctggtacctgaagcaccaaa

SEQ ID NO: 645173 - DNA, 25 bp, Mus musculus
ggtacctggtacgtgaagcaccaaa

SEQ ID NO: 645174 - DNA, 25 bp, Mus musculus
ggtacctgtaggatagcagaccctc

SEQ ID NO: 645175 - DNA, 25 bp, Mus musculus
ggtacctgtaggttagcagaccctc

SEQ ID NO: 645176 - DNA, 25 bp, Mus musculus
ggtacctgtccccaatcctatgaaa

SEQ ID NO: 645177 - DNA, 25 bp, Mus musculus
ggtacctgtcccgaatcctatgaaa

SEQ ID NO: 645178 - DNA, 25 bp, Mus musculus
ggtaccttacacagaagaaatatag

SEQ ID NO: 645179 - DNA, 25 bp, Mus musculus
ggtaccttacactgaagaaatatag

SEQ ID NO: 645180 - DNA, 25 bp, Mus musculus
ggtaccttacgaacgagggcatcca

SEQ ID NO: 645181 - DNA, 25 bp, Mus musculus
ggtaccttacgatcgagggcatcca

SEQ ID NO: 645182 - DNA, 25 bp, Mus musculus
ggtaccttagtcctgatgatactca

SEQ ID NO: 645183 - DNA, 25 bp, Mus musculus
ggtaccttagtcgtgatgatactca

SEQ ID NO: 645184 - DNA, 25 bp, Mus musculus
ggtaccttatacaagcagggagacc

SEQ ID NO: 645185 - DNA, 25 bp, Mus musculus
ggtaccttatactagcagggagacc

SEQ ID NO: 645186 - DNA, 25 bp, Mus musculus
ggtaccttattaatcactttgctgt

SEQ ID NO: 645187 - DNA, 25 bp, Mus musculus
ggtaccttattattcactttgctgt

SEQ ID NO: 645188 - DNA, 25 bp, Mus musculus
ggtaccttcactcgttttccagtag

SEQ ID NO: 645189 - DNA, 25 bp, Mus musculus
ggtaccttcactggttttccagtag

SEQ ID NO: 645190 - DNA, 25 bp, Mus musculus
ggtaccttccccaaatcatgtatct

SEQ ID NO: 645191 - DNA, 25 bp, Mus musculus
ggtaccttcccctaatcatgtatct

SEQ ID NO: 645192 - DNA, 25 bp, Mus musculus
ggtaccttcctgattaatactacat

SEQ ID NO: 645193 - DNA, 25 bp, Mus musculus
ggtaccttcctgtttaatactacat

SEQ ID NO: 645194 - DNA, 25 bp, Mus musculus
ggtaccttccttcccagaggagagt

SEQ ID NO: 645195 - DNA, 25 bp, Mus musculus
ggtaccttccttgccagaggagagt

SEQ ID NO: 645196 - DNA, 25 bp, Mus musculus
ggtaccttctcaagccagatttcat

SEQ ID NO: 645197 - DNA, 25 bp, Mus musculus
ggtaccttctcatgccagatttcat

SEQ ID NO: 645198 - DNA, 25 bp, Mus musculus
ggtaccttcttgagtatggctcttt

SEQ ID NO: 645199 - DNA, 25 bp, Mus musculus
ggtaccttcttgtgtatggctcttt

SEQ ID NO: 645200 - DNA, 25 bp, Mus musculus
ggtaccttgaggatcatgcagcttc

SEQ ID NO: 645201 - DNA, 25 bp, Mus musculus
ggtaccttgaggttcatgcagcttc

SEQ ID NO: 645202 - DNA, 25 bp, Mus musculus
ggtaccttgattcaggagtccccta

SEQ ID NO: 645203 - DNA, 25 bp, Mus musculus
ggtaccttgattgaggagtccccta

SEQ ID NO: 645204 - DNA, 25 bp, Mus musculus
ggtaccttgcacacatcatctgtaa

SEQ ID NO: 645205 - DNA, 25 bp, Mus musculus
ggtaccttgcactcatcatctgtaa

SEQ ID NO: 645206 - DNA, 25 bp, Mus musculus
ggtaccttgggcagttaccatagaa

SEQ ID NO: 645207 - DNA, 25 bp, Mus musculus
ggtaccttgggctgttaccatagaa

SEQ ID NO: 645208 - DNA, 25 bp, Mus musculus
ggtaccttggtcacttgagtcccaa

SEQ ID NO: 645209 - DNA, 25 bp, Mus musculus
ggtaccttggtctcttgagtcccaa

SEQ ID NO: 645210 - DNA, 25 bp, Mus musculus
ggtacgaccccaaaacagtgactgt

SEQ ID NO: 645211 - DNA, 25 bp, Mus musculus
ggtacgaccccataacagtgactgt

SEQ ID NO: 645212 - DNA, 25 bp, Mus musculus
ggtacgactatcaggtggactttct

SEQ ID NO: 645213 - DNA, 25 bp, Mus musculus
ggtacgactatctggtggactttct

SEQ ID NO: 645214 - DNA, 25 bp, Mus musculus
ggtacgagaccaaggacactaattc

SEQ ID NO: 645215 - DNA, 25 bp, Mus musculus
ggtacgagaccatggacactaattc

SEQ ID NO: 645216 - DNA, 25 bp, Mus musculus
ggtacgagcacaccgctccggcatg

SEQ ID NO: 645217 - DNA, 25 bp, Mus musculus
ggtacgagcacagcgctccggcatg

SEQ ID NO: 645218 - DNA, 25 bp, Mus musculus
ggtacgagctctactgtaacctctt

SEQ ID NO: 645219 - DNA, 25 bp, Mus musculus
ggtacgagctcttctgtaacctctt

SEQ ID NO: 645220 - DNA, 25 bp, Mus musculus
ggtacgcacttgaacctagtacatg

SEQ ID NO: 645221 - DNA, 25 bp, Mus musculus
ggtacgcacttgtacctagtacatg

SEQ ID NO: 645222 - DNA, 25 bp, Mus musculus
ggtacgcagaatagaggccacttaa

SEQ ID NO: 645223 - DNA, 25 bp, Mus musculus
ggtacgcagaattgaggccacttaa

SEQ ID NO: 645224 - DNA, 25 bp, Mus musculus
ggtacgcatgtgagccctgtctgta

SEQ ID NO: 645225 - DNA, 25 bp, Mus musculus
ggtacgcatgtgtgccctgtctgta

SEQ ID NO: 645226 - DNA, 25 bp, Mus musculus
ggtacgcctggaccaggtcatggct

SEQ ID NO: 645227 - DNA, 25 bp, Mus musculus
ggtacgcctggagcaggtcatggct

SEQ ID NO: 645228 - DNA, 25 bp, Mus musculus
ggtacgcgaggacgcaccatgttcc

SEQ ID NO: 645229 - DNA, 25 bp, Mus musculus
ggtacgcgaggaggcaccatgttcc

SEQ ID NO: 645230 - DNA, 25 bp, Mus musculus
ggtacgcgatgcaatacagaatcac

SEQ ID NO: 645231 - DNA, 25 bp, Mus musculus
ggtacgcgatgctatacagaatcac

SEQ ID NO: 645232 - DNA, 25 bp, Mus musculus
ggtacgctaaaaatatttcacctgg

SEQ ID NO: 645233 - DNA, 25 bp, Mus musculus
ggtacgctaaaattatttcacctgg

SEQ ID NO: 645234 - DNA, 25 bp, Mus musculus
ggtacgctacgaagtctgtgacatt

SEQ ID NO: 645235 - DNA, 25 bp, Mus musculus
ggtacgctacgatgtctgtgacatt

SEQ ID NO: 645236 - DNA, 25 bp, Mus musculus
ggtacgctatttacattatttgctt

SEQ ID NO: 645237 - DNA, 25 bp, Mus musculus
ggtacgctattttcattatttgctt

SEQ ID NO: 645238 - DNA, 25 bp, Mus musculus
ggtacgctccatcctgaataagctg

SEQ ID NO: 645239 - DNA, 25 bp, Mus musculus
ggtacgctccatgctgaataagctg

SEQ ID NO: 645240 - DNA, 25 bp, Mus musculus
ggtacgcttcatactgtggtcctgt

SEQ ID NO: 645241 - DNA, 25 bp, Mus musculus
ggtacgcttcattctgtggtcctgt

SEQ ID NO: 645242 - DNA, 25 bp, Mus musculus
ggtacggagctgctgagccacacac

SEQ ID NO: 645243 - DNA, 25 bp, Mus musculus
ggtacggagctggtgagccacacac

SEQ ID NO: 645244 - DNA, 25 bp, Mus musculus
ggtacggcaacaattccatgatgct

SEQ ID NO: 645245 - DNA, 25 bp, Mus musculus
ggtacggcaacatttccatgatgct

SEQ ID NO: 645246 - DNA, 25 bp, Mus musculus
ggtacggcatcaagaccgacggtta

SEQ ID NO: 645247 - DNA, 25 bp, Mus musculus
ggtacggcatcatgaccgacggtta

SEQ ID NO: 645248 - DNA, 25 bp, Mus musculus
ggtacgggacacacgaggctttgaa

SEQ ID NO: 645249 - DNA, 25 bp, Mus musculus
ggtacgggacactcgaggctttgaa

SEQ ID NO: 645250 - DNA, 25 bp, Mus musculus
ggtacggtaggcagtgtatcacttt

SEQ ID NO: 645251 - DNA, 25 bp, Mus musculus
ggtacggtaggctgtgtatcacttt

SEQ ID NO: 645252 - DNA, 25 bp, Mus musculus
ggtacggttgctattccatatgggc

SEQ ID NO: 645253 - DNA, 25 bp, Mus musculus
ggtacggttgcttttccatatgggc

SEQ ID NO: 645254 - DNA, 25 bp, Mus musculus
ggtacgtacaagatctctatctaga

SEQ ID NO: 645255 - DNA, 25 bp, Mus musculus
ggtacgtacaagttctctatctaga

SEQ ID NO: 645256 - DNA, 25 bp, Mus musculus
ggtacgtcagtacttattcatgaga

SEQ ID NO: 645257 - DNA, 25 bp, Mus musculus
ggtacgtcagtagttattcatgaga

SEQ ID NO: 645258 - DNA, 25 bp, Mus musculus
ggtacgtcagttagattcctagctc

SEQ ID NO: 645259 - DNA, 25 bp, Mus musculus
ggtacgtcagtttgattcctagctc

SEQ ID NO: 645260 - DNA, 25 bp, Mus musculus
ggtacgtcggctagtctgcatgaac

SEQ ID NO: 645261 - DNA, 25 bp, Mus musculus
ggtacgtcggcttgtctgcatgaac

SEQ ID NO: 645262 - DNA, 25 bp, Mus musculus
ggtacgtcgtatataaactgtatta

SEQ ID NO: 645263 - DNA, 25 bp, Mus musculus
ggtacgtcgtatttaaactgtatta

SEQ ID NO: 645264 - DNA, 25 bp, Mus musculus
ggtacgtgcaacaatctgttgttcc

SEQ ID NO: 645265 - DNA, 25 bp, Mus musculus
ggtacgtgcaactatctgttgttcc

SEQ ID NO: 645266 - DNA, 25 bp, Mus musculus
ggtacgtgccagcaacttggctcaa

SEQ ID NO: 645267 - DNA, 25 bp, Mus musculus
ggtacgtgccaggaacttggctcaa

SEQ ID NO: 645268 - DNA, 25 bp, Mus musculus
ggtacgtggagtactgttccattct

SEQ ID NO: 645269 - DNA, 25 bp, Mus musculus
ggtacgtggagttctgttccattct

SEQ ID NO: 645270 - DNA, 25 bp, Mus musculus
ggtacgttgatgctgttgttgccaa

SEQ ID NO: 645271 - DNA, 25 bp, Mus musculus
ggtacgttgatggtgttgttgccaa

SEQ ID NO: 645272 - DNA, 25 bp, Mus musculus
ggtactaacccacgacagcatgact

SEQ ID NO: 645273 - DNA, 25 bp, Mus musculus
ggtactaacccaggacagcatgact

SEQ ID NO: 645274 - DNA, 25 bp, Mus musculus
ggtactaagacaacgaaggcagcat

SEQ ID NO: 645275 - DNA, 25 bp, Mus musculus
ggtactaagacatcgaaggcagcat

SEQ ID NO: 645276 - DNA, 25 bp, Mus musculus
ggtactaagcaaagccaggcaatgg

SEQ ID NO: 645277 - DNA, 25 bp, Mus musculus
ggtactaagcaatgccaggcaatgg

SEQ ID NO: 645278 - DNA, 25 bp, Mus musculus
ggtactacaagcctggcattctgct

SEQ ID NO: 645279 - DNA, 25 bp, Mus musculus
ggtactacaagcgtggcattctgct

SEQ ID NO: 645280 - DNA, 25 bp, Mus musculus
ggtactacaatcacatttgcagact

SEQ ID NO: 645281 - DNA, 25 bp, Mus musculus
ggtactacaatctcatttgcagact

SEQ ID NO: 645282 - DNA, 25 bp, Mus musculus
ggtactacaatgacctgagctttgt

SEQ ID NO: 645283 - DNA, 25 bp, Mus musculus
ggtactacaatgtcctgagctttgt

SEQ ID NO: 645284 - DNA, 25 bp, Mus musculus
ggtactacagaactttgtggacaaa

SEQ ID NO: 645285 - DNA, 25 bp, Mus musculus
ggtactacagaagtttgtggacaaa

SEQ ID NO: 645286 - DNA, 25 bp, Mus musculus
ggtactacatcgcttctgcattaat

SEQ ID NO: 645287 - DNA, 25 bp, Mus musculus
ggtactacatcggttctgcattaat

SEQ ID NO: 645288 - DNA, 25 bp, Mus musculus
ggtactaccactcctggtcttatgt

SEQ ID NO: 645289 - DNA, 25 bp, Mus musculus
ggtactaccactgctggtcttatgt

SEQ ID NO: 645290 - DNA, 25 bp, Mus musculus
ggtactacccagaacgcgcgagaaa

SEQ ID NO: 645291 - DNA, 25 bp, Mus musculus
ggtactacccagtacgcgcgagaaa

SEQ ID NO: 645292 - DNA, 25 bp, Mus musculus
ggtactacgtttactaactccatca

SEQ ID NO: 645293 - DNA, 25 bp, Mus musculus
ggtactacgttttctaactccatca

SEQ ID NO: 645294 - DNA, 25 bp, Mus musculus
ggtactactgttcagacctgtttgt

SEQ ID NO: 645295 - DNA, 25 bp, Mus musculus
ggtactactgttgagacctgtttgt

SEQ ID NO: 645296 - DNA, 25 bp, Mus musculus
ggtactagattcagggagcagccat

SEQ ID NO: 645297 - DNA, 25 bp, Mus musculus
ggtactagattctgggagcagccat

SEQ ID NO: 645298 - DNA, 25 bp, Mus musculus
ggtactagttaaagaagcccagcat

SEQ ID NO: 645299 - DNA, 25 bp, Mus musculus
ggtactagttaatgaagcccagcat

SEQ ID NO: 645300 - DNA, 25 bp, Mus musculus
ggtactagttggatcatgctgttgg

SEQ ID NO: 645301 - DNA, 25 bp, Mus musculus
ggtactagttggttcatgctgttgg

SEQ ID NO: 645302 - DNA, 25 bp, Mus musculus
ggtactatacttataatactgtgcg

SEQ ID NO: 645303 - DNA, 25 bp, Mus musculus
ggtactatacttttaatactgtgcg

SEQ ID NO: 645304 - DNA, 25 bp, Mus musculus
ggtactatatacagttgcaaattcc

SEQ ID NO: 645305 - DNA, 25 bp, Mus musculus
ggtactatatactgttgcaaattcc

SEQ ID NO: 645306 - DNA, 25 bp, Mus musculus
ggtactatccaacattgacagcatc

SEQ ID NO: 645307 - DNA, 25 bp, Mus musculus
ggtactatccaagattgacagcatc

SEQ ID NO: 645308 - DNA, 25 bp, Mus musculus
ggtactatctatccagttgagtcac

SEQ ID NO: 645309 - DNA, 25 bp, Mus musculus
ggtactatctatgcagttgagtcac

SEQ ID NO: 645310 - DNA, 25 bp, Mus musculus
ggtactatgcataagccatcacatt

SEQ ID NO: 645311 - DNA, 25 bp, Mus musculus
ggtactatgcattagccatcacatt

SEQ ID NO: 645312 - DNA, 25 bp, Mus musculus
ggtactatggcaacgtgacacggca

SEQ ID NO: 645313 - DNA, 25 bp, Mus musculus
ggtactatggcatcgtgacacggca

SEQ ID NO: 645314 - DNA, 25 bp, Mus musculus
ggtactatgtacctacgctggtttt

SEQ ID NO: 645315 - DNA, 25 bp, Mus musculus
ggtactatgtacgtacgctggtttt

SEQ ID NO: 645316 - DNA, 25 bp, Mus musculus
ggtactatgtctattaaggctactt

SEQ ID NO: 645317 - DNA, 25 bp, Mus musculus
ggtactatgtcttttaaggctactt

SEQ ID NO: 645318 - DNA, 25 bp, Mus musculus
ggtactatgtttacactcaaaccac

SEQ ID NO: 645319 - DNA, 25 bp, Mus musculus
ggtactatgttttcactcaaaccac

SEQ ID NO: 645320 - DNA, 25 bp, Mus musculus
ggtactattgtgacttgtcttcata

SEQ ID NO: 645321 - DNA, 25 bp, Mus musculus
ggtactattgtgtcttgtcttcata

SEQ ID NO: 645322 - DNA, 25 bp, Mus musculus
ggtactcaaaaacatagctgcctca

SEQ ID NO: 645323 - DNA, 25 bp, Mus musculus
ggtactcaaaaagatagctgcctca

SEQ ID NO: 645324 - DNA, 25 bp, Mus musculus
ggtactcaagtaatcatcttttaag

SEQ ID NO: 645325 - DNA, 25 bp, Mus musculus
ggtactcaagtattcatcttttaag

SEQ ID NO: 645326 - DNA, 25 bp, Mus musculus
ggtactcacattcctttaagctatg

SEQ ID NO: 645327 - DNA, 25 bp, Mus musculus
ggtactcacattgctttaagctatg

SEQ ID NO: 645328 - DNA, 25 bp, Mus musculus
ggtactcaccaactaggcttctcat

SEQ ID NO: 645329 - DNA, 25 bp, Mus musculus
ggtactcaccaagtaggcttctcat

SEQ ID NO: 645330 - DNA, 25 bp, Mus musculus
ggtactcactatcctgatgatgttg

SEQ ID NO: 645331 - DNA, 25 bp, Mus musculus
ggtactcactatgctgatgatgttg

SEQ ID NO: 645332 - DNA, 25 bp, Mus musculus
ggtactcaggaaccttgtcatcacc

SEQ ID NO: 645333 - DNA, 25 bp, Mus musculus
ggtactcaggaagcttgtcatcacc

SEQ ID NO: 645334 - DNA, 25 bp, Mus musculus
ggtactcaggccatagtctgtgaca

SEQ ID NO: 645335 - DNA, 25 bp, Mus musculus
ggtactcaggccttagtctgtgaca

SEQ ID NO: 645336 - DNA, 25 bp, Mus musculus
ggtactcagtatcacgcatctcagt

SEQ ID NO: 645337 - DNA, 25 bp, Mus musculus
ggtactcagtatgacgcatctcagt

SEQ ID NO: 645338 - DNA, 25 bp, Mus musculus
ggtactcatagacccagtatttctg

SEQ ID NO: 645339 - DNA, 25 bp, Mus musculus
ggtactcatagagccagtatttctg

SEQ ID NO: 645340 - DNA, 25 bp, Mus musculus
ggtactccatagctcaacctcagat

SEQ ID NO: 645341 - DNA, 25 bp, Mus musculus
ggtactccataggtcaacctcagat

SEQ ID NO: 645342 - DNA, 25 bp, Mus musculus
ggtactccgctcagatcatcggcat

SEQ ID NO: 645343 - DNA, 25 bp, Mus musculus
ggtactccgctctgatcatcggcat

SEQ ID NO: 645344 - DNA, 25 bp, Mus musculus
ggtactcgatacatcatggtgtcct

SEQ ID NO: 645345 - DNA, 25 bp, Mus musculus
ggtactcgatacttcatggtgtcct

SEQ ID NO: 645346 - DNA, 25 bp, Mus musculus
ggtactcggattagattaaggcaca

SEQ ID NO: 645347 - DNA, 25 bp, Mus musculus
ggtactcggatttgattaaggcaca

SEQ ID NO: 645348 - DNA, 25 bp, Mus musculus
ggtactctaagacaacatgcctggg

SEQ ID NO: 645349 - DNA, 25 bp, Mus musculus
ggtactctaagagaacatgcctggg

SEQ ID NO: 645350 - DNA, 25 bp, Mus musculus
ggtactctaggcattcagaattcaa

SEQ ID NO: 645351 - DNA, 25 bp, Mus musculus
ggtactctaggctttcagaattcaa

SEQ ID NO: 645352 - DNA, 25 bp, Mus musculus
ggtactctccctcttacagaggaga

SEQ ID NO: 645353 - DNA, 25 bp, Mus musculus
ggtactctccctgttacagaggaga

SEQ ID NO: 645354 - DNA, 25 bp, Mus musculus
ggtactctgatcctgactttgccag

SEQ ID NO: 645355 - DNA, 25 bp, Mus musculus
ggtactctgatcgtgactttgccag

SEQ ID NO: 645356 - DNA, 25 bp, Mus musculus
ggtactcttaacatcatttcctatg

SEQ ID NO: 645357 - DNA, 25 bp, Mus musculus
ggtactcttaacttcatttcctatg

SEQ ID NO: 645358 - DNA, 25 bp, Mus musculus
ggtactcttgccactttgataatag

SEQ ID NO: 645359 - DNA, 25 bp, Mus musculus
ggtactcttgcctctttgataatag

SEQ ID NO: 645360 - DNA, 25 bp, Mus musculus
ggtactcttggtagcagggactgaa

SEQ ID NO: 645361 - DNA, 25 bp, Mus musculus
ggtactcttggttgcagggactgaa

SEQ ID NO: 645362 - DNA, 25 bp, Mus musculus
ggtactcttgtgacttggagcacca

SEQ ID NO: 645363 - DNA, 25 bp, Mus musculus
ggtactcttgtgtcttggagcacca

SEQ ID NO: 645364 - DNA, 25 bp, Mus musculus
ggtactctttgccatatcttaaaaa

SEQ ID NO: 645365 - DNA, 25 bp, Mus musculus
ggtactctttgcgatatcttaaaaa

SEQ ID NO: 645366 - DNA, 25 bp, Mus musculus
ggtactgaaattcctcttgagtgct

SEQ ID NO: 645367 - DNA, 25 bp, Mus musculus
ggtactgaaattgctcttgagtgct

SEQ ID NO: 645368 - DNA, 25 bp, Mus musculus
ggtactgacaccagacactacagaa

SEQ ID NO: 645369 - DNA, 25 bp, Mus musculus
ggtactgacacctgacactacagaa

SEQ ID NO: 645370 - DNA, 25 bp, Mus musculus
ggtactgacactacacaggctaagt

SEQ ID NO: 645371 - DNA, 25 bp, Mus musculus
ggtactgacacttcacaggctaagt

SEQ ID NO: 645372 - DNA, 25 bp, Mus musculus
ggtactgacccaaagacatctgtaa

SEQ ID NO: 645373 - DNA, 25 bp, Mus musculus
ggtactgacccatagacatctgtaa

SEQ ID NO: 645374 - DNA, 25 bp, Mus musculus
ggtactgactaccaccttgctcagt

SEQ ID NO: 645375 - DNA, 25 bp, Mus musculus
ggtactgactacgaccttgctcagt

SEQ ID NO: 645376 - DNA, 25 bp, Mus musculus
ggtactgactcactgctggaatcca

SEQ ID NO: 645377 - DNA, 25 bp, Mus musculus
ggtactgactcagtgctggaatcca

SEQ ID NO: 645378 - DNA, 25 bp, Mus musculus
ggtactgacttcagctccgccagaa

SEQ ID NO: 645379 - DNA, 25 bp, Mus musculus
ggtactgacttctgctccgccagaa

SEQ ID NO: 645380 - DNA, 25 bp, Mus musculus
ggtactgactttcaacttgttggca

SEQ ID NO: 645381 - DNA, 25 bp, Mus musculus
ggtactgactttgaacttgttggca

SEQ ID NO: 645382 - DNA, 25 bp, Mus musculus
ggtactgagattatgtaagcccttt

SEQ ID NO: 645383 - DNA, 25 bp, Mus musculus
ggtactgagattttgtaagcccttt

SEQ ID NO: 645384 - DNA, 25 bp, Mus musculus
ggtactgaggaccttgtctaaccat

SEQ ID NO: 645385 - DNA, 25 bp, Mus musculus
ggtactgaggacgttgtctaaccat

SEQ ID NO: 645386 - DNA, 25 bp, Mus musculus
ggtactgaggagacatttaacactg

SEQ ID NO: 645387 - DNA, 25 bp, Mus musculus
ggtactgaggagtcatttaacactg

SEQ ID NO: 645388 - DNA, 25 bp, Mus musculus
ggtactgatccgcatcgaggactca

SEQ ID NO: 645389 - DNA, 25 bp, Mus musculus
ggtactgatccggatcgaggactca

SEQ ID NO: 645390 - DNA, 25 bp, Mus musculus
ggtactgattacactgtatgcctaa

SEQ ID NO: 645391 - DNA, 25 bp, Mus musculus
ggtactgattactctgtatgcctaa

SEQ ID NO: 645392 - DNA, 25 bp, Mus musculus
ggtactgccatgaaggaaactgcct

SEQ ID NO: 645393 - DNA, 25 bp, Mus musculus
ggtactgccatgtaggaaactgcct

SEQ ID NO: 645394 - DNA, 25 bp, Mus musculus
ggtactgcctcgcaaagttctgaat

SEQ ID NO: 645395 - DNA, 25 bp, Mus musculus
ggtactgcctcggaaagttctgaat

SEQ ID NO: 645396 - DNA, 25 bp, Mus musculus
ggtactgctaggcatgtttgttctt

SEQ ID NO: 645397 - DNA, 25 bp, Mus musculus
ggtactgctagggatgtttgttctt

SEQ ID NO: 645398 - DNA, 25 bp, Mus musculus
ggtactgctattcctgcgaattgac

SEQ ID NO: 645399 - DNA, 25 bp, Mus musculus
ggtactgctattgctgcgaattgac

SEQ ID NO: 645400 - DNA, 25 bp, Mus musculus
ggtactgcttagacgggaccccttg

SEQ ID NO: 645401 - DNA, 25 bp, Mus musculus
ggtactgcttagtcgggaccccttg

SEQ ID NO: 645402 - DNA, 25 bp, Mus musculus
ggtactggaacaagtgcctttatca

SEQ ID NO: 645403 - DNA, 25 bp, Mus musculus
ggtactggaacatgtgcctttatca

SEQ ID NO: 645404 - DNA, 25 bp, Mus musculus
ggtactggatcccaattttgcatta

SEQ ID NO: 645405 - DNA, 25 bp, Mus musculus
ggtactggatccgaattttgcatta

SEQ ID NO: 645406 - DNA, 25 bp, Mus musculus
ggtactggcacgcagcgttaaccac

SEQ ID NO: 645407 - DNA, 25 bp, Mus musculus
ggtactggcacggagcgttaaccac

SEQ ID NO: 645408 - DNA, 25 bp, Mus musculus
ggtactggccaaaagtctcttgtgc

SEQ ID NO: 645409 - DNA, 25 bp, Mus musculus
ggtactggccaatagtctcttgtgc

SEQ ID NO: 645410 - DNA, 25 bp, Mus musculus
ggtactggccagaatatgcccttag

SEQ ID NO: 645411 - DNA, 25 bp, Mus musculus
ggtactggccagtatatgcccttag

SEQ ID NO: 645412 - DNA, 25 bp, Mus musculus
ggtactggcctccagatcctagtgg

SEQ ID NO: 645413 - DNA, 25 bp, Mus musculus
ggtactggcctcgagatcctagtgg

SEQ ID NO: 645414 - DNA, 25 bp, Mus musculus
ggtactggcgcaacctggtgctgct

SEQ ID NO: 645415 - DNA, 25 bp, Mus musculus
ggtactggcgcatcctggtgctgct

SEQ ID NO: 645416 - DNA, 25 bp, Mus musculus
ggtactggctaaagcttcctccgag

SEQ ID NO: 645417 - DNA, 25 bp, Mus musculus
ggtactggctaaataaatctgtaat

SEQ ID NO: 645418 - DNA, 25 bp, Mus musculus
ggtactggctaatgcttcctccgag

SEQ ID NO: 645419 - DNA, 25 bp, Mus musculus
ggtactggctaattaaatctgtaat

SEQ ID NO: 645420 - DNA, 25 bp, Mus musculus
ggtactgggatgatagtctgagaca

SEQ ID NO: 645421 - DNA, 25 bp, Mus musculus
ggtactgggatgttagtctgagaca

SEQ ID NO: 645422 - DNA, 25 bp, Mus musculus
ggtactgggcagacagaagctcaca

SEQ ID NO: 645423 - DNA, 25 bp, Mus musculus
ggtactgggcagtcagaagctcaca

SEQ ID NO: 645424 - DNA, 25 bp, Mus musculus
ggtactgggctacagtttaatcttt

SEQ ID NO: 645425 - DNA, 25 bp, Mus musculus
ggtactgggctagagtttaatcttt

SEQ ID NO: 645426 - DNA, 25 bp, Mus musculus
ggtactgggtagcacctttgaagat

SEQ ID NO: 645427 - DNA, 25 bp, Mus musculus
ggtactgggtaggacctttgaagat

SEQ ID NO: 645428 - DNA, 25 bp, Mus musculus
ggtactggtcataaggtgtcctcac

SEQ ID NO: 645429 - DNA, 25 bp, Mus musculus
ggtactggtcattaggtgtcctcac

SEQ ID NO: 645430 - DNA, 25 bp, Mus musculus
ggtactggtccaagaaagtgcagga

SEQ ID NO: 645431 - DNA, 25 bp, Mus musculus
ggtactggtccatgaaagtgcagga

SEQ ID NO: 645432 - DNA, 25 bp, Mus musculus
ggtactggttatcttaagtgcctca

SEQ ID NO: 645433 - DNA, 25 bp, Mus musculus
ggtactggttatgttaagtgcctca

SEQ ID NO: 645434 - DNA, 25 bp, Mus musculus
ggtactggttgtcggcgccgggcta

SEQ ID NO: 645435 - DNA, 25 bp, Mus musculus
ggtactggttgtgggcgccgggcta

SEQ ID NO: 645436 - DNA, 25 bp, Mus musculus
ggtactgtaattcagcatccagaat

SEQ ID NO: 645437 - DNA, 25 bp, Mus musculus
ggtactgtaattgagcatccagaat

SEQ ID NO: 645438 - DNA, 25 bp, Mus musculus
ggtactgtactcagttcactaagat

SEQ ID NO: 645439 - DNA, 25 bp, Mus musculus
ggtactgtactctgttcactaagat

SEQ ID NO: 645440 - DNA, 25 bp, Mus musculus
ggtactgtagtgcttgagatcgtct

SEQ ID NO: 645441 - DNA, 25 bp, Mus musculus
ggtactgtagtggttgagatcgtct

SEQ ID NO: 645442 - DNA, 25 bp, Mus musculus
ggtactgtatctagcttttctcact

SEQ ID NO: 645443 - DNA, 25 bp, Mus musculus
ggtactgtatcttgcttttctcact

SEQ ID NO: 645444 - DNA, 25 bp, Mus musculus
ggtactgtatggaagcactgctgta

SEQ ID NO: 645445 - DNA, 25 bp, Mus musculus
ggtactgtatggtagcactgctgta

SEQ ID NO: 645446 - DNA, 25 bp, Mus musculus
ggtactgtcactatcaggatgcttc

SEQ ID NO: 645447 - DNA, 25 bp, Mus musculus
ggtactgtcactttcaggatgcttc

SEQ ID NO: 645448 - DNA, 25 bp, Mus musculus
ggtactgtccagcagacagacaatg

SEQ ID NO: 645449 - DNA, 25 bp, Mus musculus
ggtactgtccaggagacagacaatg

SEQ ID NO: 645450 - DNA, 25 bp, Mus musculus
ggtactgtcctcaggagaactgtca

SEQ ID NO: 645451 - DNA, 25 bp, Mus musculus
ggtactgtcctctggagaactgtca

SEQ ID NO: 645452 - DNA, 25 bp, Mus musculus
ggtactgtccttagtttgttgggca

SEQ ID NO: 645453 - DNA, 25 bp, Mus musculus
ggtactgtcctttgtttgttgggca

SEQ ID NO: 645454 - DNA, 25 bp, Mus musculus
ggtactgtctccctaatagcaatgt

SEQ ID NO: 645455 - DNA, 25 bp, Mus musculus
ggtactgtctccgtaatagcaatgt

SEQ ID NO: 645456 - DNA, 25 bp, Mus musculus
ggtactgtgagtaccttgagaaata

SEQ ID NO: 645457 - DNA, 25 bp, Mus musculus
ggtactgtgagttccttgagaaata

SEQ ID NO: 645458 - DNA, 25 bp, Mus musculus
ggtactgtgcatccattcataaaac

SEQ ID NO: 645459 - DNA, 25 bp, Mus musculus
ggtactgtgcatgcattcataaaac

SEQ ID NO: 645460 - DNA, 25 bp, Mus musculus
ggtactgtgtgcatatatggttcac

SEQ ID NO: 645461 - DNA, 25 bp, Mus musculus
ggtactgtgtgcttatatggttcac

SEQ ID NO: 645462 - DNA, 25 bp, Mus musculus
ggtactgttagtatttggcaatttg

SEQ ID NO: 645463 - DNA, 25 bp, Mus musculus
ggtactgttagtttttggcaatttg

SEQ ID NO: 645464 - DNA, 25 bp, Mus musculus
ggtactgttgcaaacaccttctgaa

SEQ ID NO: 645465 - DNA, 25 bp, Mus musculus
ggtactgttgcatacaccttctgaa

SEQ ID NO: 645466 - DNA, 25 bp, Mus musculus
ggtacttaaaatcactggttcactt

SEQ ID NO: 645467 - DNA, 25 bp, Mus musculus
ggtacttaaaatgactggttcactt

SEQ ID NO: 645468 - DNA, 25 bp, Mus musculus
ggtacttaacaaccagctgtaactc

SEQ ID NO: 645469 - DNA, 25 bp, Mus musculus
ggtacttaacaagcagctgtaactc

SEQ ID NO: 645470 - DNA, 25 bp, Mus musculus
ggtacttaaggcacagccagtggtg

SEQ ID NO: 645471 - DNA, 25 bp, Mus musculus
ggtacttaaggctcagccagtggtg

SEQ ID NO: 645472 - DNA, 25 bp, Mus musculus
ggtacttaagtaatggagggttgct

SEQ ID NO: 645473 - DNA, 25 bp, Mus musculus
ggtacttaagtattggagggttgct

SEQ ID NO: 645474 - DNA, 25 bp, Mus musculus
ggtacttacagcataggttgagggc

SEQ ID NO: 645475 - DNA, 25 bp, Mus musculus
ggtacttacagcttaggttgagggc

SEQ ID NO: 645476 - DNA, 25 bp, Mus musculus
ggtacttaccagactactactgctt

SEQ ID NO: 645477 - DNA, 25 bp, Mus musculus
ggtacttaccagtctactactgctt

SEQ ID NO: 645478 - DNA, 25 bp, Mus musculus
ggtacttatacacacaggtcacaca

SEQ ID NO: 645479 - DNA, 25 bp, Mus musculus
ggtacttatacagacaggtcacaca

SEQ ID NO: 645480 - DNA, 25 bp, Mus musculus
ggtacttatacgatttgttctccat

SEQ ID NO: 645481 - DNA, 25 bp, Mus musculus
ggtacttatacgttttgttctccat

SEQ ID NO: 645482 - DNA, 25 bp, Mus musculus
ggtacttattctcacagcactaaag

SEQ ID NO: 645483 - DNA, 25 bp, Mus musculus
ggtacttattctgacagcactaaag

SEQ ID NO: 645484 - DNA, 25 bp, Mus musculus
ggtacttcatctagcagtttggccc

SEQ ID NO: 645485 - DNA, 25 bp, Mus musculus
ggtacttcatcttgcagtttggccc

SEQ ID NO: 645486 - DNA, 25 bp, Mus musculus
ggtacttccaaaagagcactcctat

SEQ ID NO: 645487 - DNA, 25 bp, Mus musculus
ggtacttccaaatgagcactcctat

SEQ ID NO: 645488 - DNA, 25 bp, Mus musculus
ggtacttcctgccagtggtgacctg

SEQ ID NO: 645489 - DNA, 25 bp, Mus musculus
ggtacttcctgcgagtggtgacctg

SEQ ID NO: 645490 - DNA, 25 bp, Mus musculus
ggtacttctgaactactaatgccat

SEQ ID NO: 645491 - DNA, 25 bp, Mus musculus
ggtacttctgaagtactaatgccat

SEQ ID NO: 645492 - DNA, 25 bp, Mus musculus
ggtacttctgataaaccagctatac

SEQ ID NO: 645493 - DNA, 25 bp, Mus musculus
ggtacttctgattaaccagctatac

SEQ ID NO: 645494 - DNA, 25 bp, Mus musculus
ggtacttcttggaaacaatgacatt

SEQ ID NO: 645495 - DNA, 25 bp, Mus musculus
ggtacttcttggtaacaatgacatt

SEQ ID NO: 645496 - DNA, 25 bp, Mus musculus
ggtacttctttaactaagtcagctt

SEQ ID NO: 645497 - DNA, 25 bp, Mus musculus
ggtacttctttatctaagtcagctt

SEQ ID NO: 645498 - DNA, 25 bp, Mus musculus
ggtacttgaacaatgctcttttctt

SEQ ID NO: 645499 - DNA, 25 bp, Mus musculus
ggtacttgaacattgctcttttctt

SEQ ID NO: 645500 - DNA, 25 bp, Mus musculus
ggtacttgaaggcatgattgagaat

SEQ ID NO: 645501 - DNA, 25 bp, Mus musculus
ggtacttgaagggatgattgagaat

SEQ ID NO: 645502 - DNA, 25 bp, Mus musculus
ggtacttgaagtaaatcctgctcct

SEQ ID NO: 645503 - DNA, 25 bp, Mus musculus
ggtacttgaagttaatcctgctcct

SEQ ID NO: 645504 - DNA, 25 bp, Mus musculus
ggtacttgataacaccttccctggt

SEQ ID NO: 645505 - DNA, 25 bp, Mus musculus
ggtacttgataagaccttccctggt

SEQ ID NO: 645506 - DNA, 25 bp, Mus musculus
ggtacttgatagcacatggcatctg

SEQ ID NO: 645507 - DNA, 25 bp, Mus musculus
ggtacttgataggacatggcatctg

SEQ ID NO: 645508 - DNA, 25 bp, Mus musculus
ggtacttgctagagactgtctccag

SEQ ID NO: 645509 - DNA, 25 bp, Mus musculus
ggtacttgctagtgactgtctccag

SEQ ID NO: 645510 - DNA, 25 bp, Mus musculus
ggtacttgctttacttggagaggct

SEQ ID NO: 645511 - DNA, 25 bp, Mus musculus
ggtacttgcttttcttggagaggct

SEQ ID NO: 645512 - DNA, 25 bp, Mus musculus
ggtacttggtgtacggtcagcatga

SEQ ID NO: 645513 - DNA, 25 bp, Mus musculus
ggtacttggtgttcggtcagcatga

SEQ ID NO: 645514 - DNA, 25 bp, Mus musculus
ggtacttgtaaaactgagttgcact

SEQ ID NO: 645515 - DNA, 25 bp, Mus musculus
ggtacttgtaaatctgagttgcact

SEQ ID NO: 645516 - DNA, 25 bp, Mus musculus
ggtacttgtccacgcaagtctatgg

SEQ ID NO: 645517 - DNA, 25 bp, Mus musculus
ggtacttgtccaggcaagtctatgg

SEQ ID NO: 645518 - DNA, 25 bp, Mus musculus
ggtacttgtcctctaacacagaaaa

SEQ ID NO: 645519 - DNA, 25 bp, Mus musculus
ggtacttgtcctgtaacacagaaaa

SEQ ID NO: 645520 - DNA, 25 bp, Mus musculus
ggtacttgtctgcagttggtagaat

SEQ ID NO: 645521 - DNA, 25 bp, Mus musculus
ggtacttgtctggagttggtagaat

SEQ ID NO: 645522 - DNA, 25 bp, Mus musculus
ggtactttacctctctttcaagtgt

SEQ ID NO: 645523 - DNA, 25 bp, Mus musculus
ggtactttacctgtctttcaagtgt

SEQ ID NO: 645524 - DNA, 25 bp, Mus musculus
ggtactttatttactatgttgtact

SEQ ID NO: 645525 - DNA, 25 bp, Mus musculus
ggtactttattttctatgttgtact

SEQ ID NO: 645526 - DNA, 25 bp, Mus musculus
ggtactttcaagcagcaatatagct

SEQ ID NO: 645527 - DNA, 25 bp, Mus musculus
ggtactttcaaggagcaatatagct

SEQ ID NO: 645528 - DNA, 25 bp, Mus musculus
ggtactttccaaatctacccgagat

SEQ ID NO: 645529 - DNA, 25 bp, Mus musculus
ggtactttccaattctacccgagat

SEQ ID NO: 645530 - DNA, 25 bp, Mus musculus
ggtactttctgaactgcacagctgc

SEQ ID NO: 645531 - DNA, 25 bp, Mus musculus
ggtactttctgatctgcacagctgc

SEQ ID NO: 645532 - DNA, 25 bp, Mus musculus
ggtactttcttccagcttatatttt

SEQ ID NO: 645533 - DNA, 25 bp, Mus musculus
ggtactttcttcgagcttatatttt

SEQ ID NO: 645534 - DNA, 25 bp, Mus musculus
ggtactttgacaagccagtgtgcat

SEQ ID NO: 645535 - DNA, 25 bp, Mus musculus
ggtactttgacatgccagtgtgcat

SEQ ID NO: 645536 - DNA, 25 bp, Mus musculus
ggtactttgctcatggagtcagttc

SEQ ID NO: 645537 - DNA, 25 bp, Mus musculus
ggtactttgctcttggagtcagttc

SEQ ID NO: 645538 - DNA, 25 bp, Mus musculus
ggtactttgggcaccagttcaatat

SEQ ID NO: 645539 - DNA, 25 bp, Mus musculus
ggtactttgggctccagttcaatat

SEQ ID NO: 645540 - DNA, 25 bp, Mus musculus
ggtactttgtaacccctcatatgag

SEQ ID NO: 645541 - DNA, 25 bp, Mus musculus
ggtactttgtaagccctcatatgag

SEQ ID NO: 645542 - DNA, 25 bp, Mus musculus
ggtacttttataaatcccgtgtctt

SEQ ID NO: 645543 - DNA, 25 bp, Mus musculus
ggtacttttatatatcccgtgtctt

SEQ ID NO: 645544 - DNA, 25 bp, Mus musculus
ggtacttttctgagctccagtgtgt

SEQ ID NO: 645545 - DNA, 25 bp, Mus musculus
ggtacttttctgtgctccagtgtgt

SEQ ID NO: 645546 - DNA, 25 bp, Mus musculus
ggtacttttggaagttgcctgtgca

SEQ ID NO: 645547 - DNA, 25 bp, Mus musculus
ggtacttttggatgttgcctgtgca

SEQ ID NO: 645548 - DNA, 25 bp, Mus musculus
ggtactttttgaccaatttcctcaa

SEQ ID NO: 645549 - DNA, 25 bp, Mus musculus
ggtactttttgagcaatttcctcaa

SEQ ID NO: 645550 - DNA, 25 bp, Mus musculus
ggtagaaaaatgacttgcctcagat

SEQ ID NO: 645551 - DNA, 25 bp, Mus musculus
ggtagaaaaatgtcttgcctcagat

SEQ ID NO: 645552 - DNA, 25 bp, Mus musculus
ggtagaaaacatccctgctgacaag

SEQ ID NO: 645553 - DNA, 25 bp, Mus musculus
ggtagaaaacatgcctgctgacaag

SEQ ID NO: 645554 - DNA, 25 bp, Mus musculus
ggtagaaaaccacacacatgtgcac

SEQ ID NO: 645555 - DNA, 25 bp, Mus musculus
ggtagaaaaccagacacatgtgcac

SEQ ID NO: 645556 - DNA, 25 bp, Mus musculus
ggtagaaaacccaggctgctgctta

SEQ ID NO: 645557 - DNA, 25 bp, Mus musculus
ggtagaaaaccctggctgctgctta

SEQ ID NO: 645558 - DNA, 25 bp, Mus musculus
ggtagaaaaccgagcagaccttcaa

SEQ ID NO: 645559 - DNA, 25 bp, Mus musculus
ggtagaaaaccgtgcagaccttcaa

SEQ ID NO: 645560 - DNA, 25 bp, Mus musculus
ggtagaaacagaactcatcataatg

SEQ ID NO: 645561 - DNA, 25 bp, Mus musculus
ggtagaaacagatctcatcataatg

SEQ ID NO: 645562 - DNA, 25 bp, Mus musculus
ggtagaaacattcgaccctggctga

SEQ ID NO: 645563 - DNA, 25 bp, Mus musculus
ggtagaaacattggaccctggctga

SEQ ID NO: 645564 - DNA, 25 bp, Mus musculus
ggtagaaactaaaatccagcagata

SEQ ID NO: 645565 - DNA, 25 bp, Mus musculus
ggtagaaactaatatccagcagata

SEQ ID NO: 645566 - DNA, 25 bp, Mus musculus
ggtagaaacttaatccgcctattgt

SEQ ID NO: 645567 - DNA, 25 bp, Mus musculus
ggtagaaacttattccgcctattgt

SEQ ID NO: 645568 - DNA, 25 bp, Mus musculus
ggtagaaatactagcccatcacaaa

SEQ ID NO: 645569 - DNA, 25 bp, Mus musculus
ggtagaaatacttgcccatcacaaa

SEQ ID NO: 645570 - DNA, 25 bp, Mus musculus
ggtagaaatgttaccagtttcaact

SEQ ID NO: 645571 - DNA, 25 bp, Mus musculus
ggtagaaatgtttccagtttcaact

SEQ ID NO: 645572 - DNA, 25 bp, Mus musculus
ggtagaacacttccccagtaggtac

SEQ ID NO: 645573 - DNA, 25 bp, Mus musculus
ggtagaacacttcctttatatgcac

SEQ ID NO: 645574 - DNA, 25 bp, Mus musculus
ggtagaacacttctcaaaccatact

SEQ ID NO: 645575 - DNA, 25 bp, Mus musculus
ggtagaacacttgcccagtaggtac

SEQ ID NO: 645576 - DNA, 25 bp, Mus musculus
ggtagaacacttgctttatatgcac

SEQ ID NO: 645577 - DNA, 25 bp, Mus musculus
ggtagaacacttgtcaaaccatact

SEQ ID NO: 645578 - DNA, 25 bp, Mus musculus
ggtagaacccttcgcttgcaagcaa

SEQ ID NO: 645579 - DNA, 25 bp, Mus musculus
ggtagaacccttggcttgcaagcaa

SEQ ID NO: 645580 - DNA, 25 bp, Mus musculus
ggtagaacctgacactttttgtggt

SEQ ID NO: 645581 - DNA, 25 bp, Mus musculus
ggtagaacctgagactttttgtggt

SEQ ID NO: 645582 - DNA, 25 bp, Mus musculus
ggtagaacctgcattttgttgattt

SEQ ID NO: 645583 - DNA, 25 bp, Mus musculus
ggtagaacctgctttttgttgattt

SEQ ID NO: 645584 - DNA, 25 bp, Mus musculus
ggtagaacggctagccagcggcata

SEQ ID NO: 645585 - DNA, 25 bp, Mus musculus
ggtagaacggcttgccagcggcata

SEQ ID NO: 645586 - DNA, 25 bp, Mus musculus
ggtagaactaatcccttactgtaga

SEQ ID NO: 645587 - DNA, 25 bp, Mus musculus
ggtagaactaatgccttactgtaga

SEQ ID NO: 645588 - DNA, 25 bp, Mus musculus
ggtagaactcccactagattgctag

SEQ ID NO: 645589 - DNA, 25 bp, Mus musculus
ggtagaactccctctagattgctag

SEQ ID NO: 645590 - DNA, 25 bp, Mus musculus
ggtagaacttgaccatgggcttgtt

SEQ ID NO: 645591 - DNA, 25 bp, Mus musculus
ggtagaacttgagcatgggcttgtt

SEQ ID NO: 645592 - DNA, 25 bp, Mus musculus
ggtagaagcaagcttcctgcagccc

SEQ ID NO: 645593 - DNA, 25 bp, Mus musculus
ggtagaagcaaggttcctgcagccc

SEQ ID NO: 645594 - DNA, 25 bp, Mus musculus
ggtagaagcctaatgctcgggcatc

SEQ ID NO: 645595 - DNA, 25 bp, Mus musculus
ggtagaagcctattgctcgggcatc

SEQ ID NO: 645596 - DNA, 25 bp, Mus musculus
ggtagaagctagacatgaaggtaaa

SEQ ID NO: 645597 - DNA, 25 bp, Mus musculus
ggtagaagctagtcatgaaggtaaa

SEQ ID NO: 645598 - DNA, 25 bp, Mus musculus
ggtagaagctccactagattgggta

SEQ ID NO: 645599 - DNA, 25 bp, Mus musculus
ggtagaagctcctctagattgggta

SEQ ID NO: 645600 - DNA, 25 bp, Mus musculus
ggtagaaggcaacaggagtgggctc

SEQ ID NO: 645601 - DNA, 25 bp, Mus musculus
ggtagaaggcaagaggagtgggctc

SEQ ID NO: 645602 - DNA, 25 bp, Mus musculus
ggtagaagtcacactcagcattgtt

SEQ ID NO: 645603 - DNA, 25 bp, Mus musculus
ggtagaagtcactctcagcattgtt

SEQ ID NO: 645604 - DNA, 25 bp, Mus musculus
ggtagaagtccacctttgagtccgt

SEQ ID NO: 645605 - DNA, 25 bp, Mus musculus
ggtagaagtccagctttgagtccgt

SEQ ID NO: 645606 - DNA, 25 bp, Mus musculus
ggtagaagtgctcattgcttctccc

SEQ ID NO: 645607 - DNA, 25 bp, Mus musculus
ggtagaagtgctgattgcttctccc

SEQ ID NO: 645608 - DNA, 25 bp, Mus musculus
ggtagaataaatctgcccacaccct

SEQ ID NO: 645609 - DNA, 25 bp, Mus musculus
ggtagaataaatgtgcccacaccct

SEQ ID NO: 645610 - DNA, 25 bp, Mus musculus
ggtagaatcatacctctgatcctgt

SEQ ID NO: 645611 - DNA, 25 bp, Mus musculus
ggtagaatcatagctctgatcctgt

SEQ ID NO: 645612 - DNA, 25 bp, Mus musculus
ggtagaatcccacccttgggtgaca

SEQ ID NO: 645613 - DNA, 25 bp, Mus musculus
ggtagaatcccagccttgggtgaca

SEQ ID NO: 645614 - DNA, 25 bp, Mus musculus
ggtagaatctggaactttggtctca

SEQ ID NO: 645615 - DNA, 25 bp, Mus musculus
ggtagaatctggtactttggtctca

SEQ ID NO: 645616 - DNA, 25 bp, Mus musculus
ggtagaatgattccctagtttgtgt

SEQ ID NO: 645617 - DNA, 25 bp, Mus musculus
ggtagaatgattgcctagtttgtgt

SEQ ID NO: 645618 - DNA, 25 bp, Mus musculus
ggtagacaaaatcgctgtggtttca

SEQ ID NO: 645619 - DNA, 25 bp, Mus musculus
ggtagacaaaatggctgtggtttca

SEQ ID NO: 645620 - DNA, 25 bp, Mus musculus
ggtagacaacttcctagacttagaa

SEQ ID NO: 645621 - DNA, 25 bp, Mus musculus
ggtagacaacttgctagacttagaa

SEQ ID NO: 645622 - DNA, 25 bp, Mus musculus
ggtagacaccagagaataagacgct

SEQ ID NO: 645623 - DNA, 25 bp, Mus musculus
ggtagacaccagtgaataagacgct

SEQ ID NO: 645624 - DNA, 25 bp, Mus musculus
ggtagacactaaactgctttccctt

SEQ ID NO: 645625 - DNA, 25 bp, Mus musculus
ggtagacactaatctgctttccctt

SEQ ID NO: 645626 - DNA, 25 bp, Mus musculus
ggtagacagaccatcgttcttgttc

SEQ ID NO: 645627 - DNA, 25 bp, Mus musculus
ggtagacagaccttcgttcttgttc

SEQ ID NO: 645628 - DNA, 25 bp, Mus musculus
ggtagacaggcacgcacctcacaca

SEQ ID NO: 645629 - DNA, 25 bp, Mus musculus
ggtagacaggcaggcacctcacaca

SEQ ID NO: 645630 - DNA, 25 bp, Mus musculus
ggtagacaggccatctgtgtcgcag

SEQ ID NO: 645631 - DNA, 25 bp, Mus musculus
ggtagacaggccttctgtgtcgcag

SEQ ID NO: 645632 - DNA, 25 bp, Mus musculus
ggtagacagggcagcagtttcagct

SEQ ID NO: 645633 - DNA, 25 bp, Mus musculus
ggtagacagggctgcagtttcagct

SEQ ID NO: 645634 - DNA, 25 bp, Mus musculus
ggtagacataggcagatcagaaatt

SEQ ID NO: 645635 - DNA, 25 bp, Mus musculus
ggtagacatagggagatcagaaatt

SEQ ID NO: 645636 - DNA, 25 bp, Mus musculus
ggtagacattttaagagctcctcaa

SEQ ID NO: 645637 - DNA, 25 bp, Mus musculus
ggtagacatttttagagctcctcaa

SEQ ID NO: 645638 - DNA, 25 bp, Mus musculus
ggtagaccaaagaggaaccagcata

SEQ ID NO: 645639 - DNA, 25 bp, Mus musculus
ggtagaccaaagtggaaccagcata

SEQ ID NO: 645640 - DNA, 25 bp, Mus musculus
ggtagaccagagatccatccatcag

SEQ ID NO: 645641 - DNA, 25 bp, Mus musculus
ggtagaccagagttccatccatcag

SEQ ID NO: 645642 - DNA, 25 bp, Mus musculus
ggtagaccccgaagttggttcccat

SEQ ID NO: 645643 - DNA, 25 bp, Mus musculus
ggtagaccccgatgttggttcccat

SEQ ID NO: 645644 - DNA, 25 bp, Mus musculus
ggtagacctcctcgcttacacagag

SEQ ID NO: 645645 - DNA, 25 bp, Mus musculus
ggtagacctcctggcttacacagag

SEQ ID NO: 645646 - DNA, 25 bp, Mus musculus
ggtagacctctcagtaggtatcctc

SEQ ID NO: 645647 - DNA, 25 bp, Mus musculus
ggtagacctctctgtaggtatcctc

SEQ ID NO: 645648 - DNA, 25 bp, Mus musculus
ggtagacgagaccatccagactctg

SEQ ID NO: 645649 - DNA, 25 bp, Mus musculus
ggtagacgagacgatccagactctg

SEQ ID NO: 645650 - DNA, 25 bp, Mus musculus
ggtagacggctcagtaaatgcctat

SEQ ID NO: 645651 - DNA, 25 bp, Mus musculus
ggtagacggctctgtaaatgcctat

SEQ ID NO: 645652 - DNA, 25 bp, Mus musculus
ggtagactaccaactaaccagcatg

SEQ ID NO: 645653 - DNA, 25 bp, Mus musculus
ggtagactaccatctaaccagcatg

SEQ ID NO: 645654 - DNA, 25 bp, Mus musculus
ggtagactacttaaaagctgtgctt

SEQ ID NO: 645655 - DNA, 25 bp, Mus musculus
ggtagactacttattggccatatct

SEQ ID NO: 645656 - DNA, 25 bp, Mus musculus
ggtagactactttaaagctgtgctt

SEQ ID NO: 645657 - DNA, 25 bp, Mus musculus
ggtagactactttttggccatatct

SEQ ID NO: 645658 - DNA, 25 bp, Mus musculus
ggtagactcagaccagttcagtgct

SEQ ID NO: 645659 - DNA, 25 bp, Mus musculus
ggtagactcagagcagttcagtgct

SEQ ID NO: 645660 - DNA, 25 bp, Mus musculus
ggtagactcaggcagctaccctctc

SEQ ID NO: 645661 - DNA, 25 bp, Mus musculus
ggtagactcagggagctaccctctc

SEQ ID NO: 645662 - DNA, 25 bp, Mus musculus
ggtagactgcaactccaatgctcca

SEQ ID NO: 645663 - DNA, 25 bp, Mus musculus
ggtagactgcaagtccaatgctcca

SEQ ID NO: 645664 - DNA, 25 bp, Mus musculus
ggtagactggttcctcacatggaca

SEQ ID NO: 645665 - DNA, 25 bp, Mus musculus
ggtagactggttgctcacatggaca

SEQ ID NO: 645666 - DNA, 25 bp, Mus musculus
ggtagactgttacaaggctccttca

SEQ ID NO: 645667 - DNA, 25 bp, Mus musculus
ggtagactgttagaaggctccttca

SEQ ID NO: 645668 - DNA, 25 bp, Mus musculus
ggtagactttgtatagctttctcat

SEQ ID NO: 645669 - DNA, 25 bp, Mus musculus
ggtagactttgtttagctttctcat

SEQ ID NO: 645670 - DNA, 25 bp, Mus musculus
ggtagacttttgactcaacactccc

SEQ ID NO: 645671 - DNA, 25 bp, Mus musculus
ggtagacttttgtctcaacactccc

SEQ ID NO: 645672 - DNA, 25 bp, Mus musculus
ggtagagaaagcagcgcctcaacta

SEQ ID NO: 645673 - DNA, 25 bp, Mus musculus
ggtagagaaagctgcgcctcaacta

SEQ ID NO: 645674 - DNA, 25 bp, Mus musculus
ggtagagacagtctaacggtttcaa

SEQ ID NO: 645675 - DNA, 25 bp, Mus musculus
ggtagagacagtgtaacggtttcaa

SEQ ID NO: 645676 - DNA, 25 bp, Mus musculus
ggtagagacgatcgccacccaagga

SEQ ID NO: 645677 - DNA, 25 bp, Mus musculus
ggtagagacgatggccacccaagga

SEQ ID NO: 645678 - DNA, 25 bp, Mus musculus
ggtagagagagtatttccatctttc

SEQ ID NO: 645679 - DNA, 25 bp, Mus musculus
ggtagagagagtttttccatctttc

SEQ ID NO: 645680 - DNA, 25 bp, Mus musculus
ggtagagaggtgagcatgtctatta

SEQ ID NO: 645681 - DNA, 25 bp, Mus musculus
ggtagagaggtgtgcatgtctatta

SEQ ID NO: 645682 - DNA, 25 bp, Mus musculus
ggtagagagtcaccatggctagcca

SEQ ID NO: 645683 - DNA, 25 bp, Mus musculus
ggtagagagtcagcatggctagcca

SEQ ID NO: 645684 - DNA, 25 bp, Mus musculus
ggtagagatgaaacacctcctgctc

SEQ ID NO: 645685 - DNA, 25 bp, Mus musculus
ggtagagatgaatcacctcctgctc

SEQ ID NO: 645686 - DNA, 25 bp, Mus musculus
ggtagagatgccagactatcacgtc

SEQ ID NO: 645687 - DNA, 25 bp, Mus musculus
ggtagagatgcctgactatcacgtc

SEQ ID NO: 645688 - DNA, 25 bp, Mus musculus
ggtagagatgtgacaagccggccaa

SEQ ID NO: 645689 - DNA, 25 bp, Mus musculus
ggtagagatgtgtcaagccggccaa

SEQ ID NO: 645690 - DNA, 25 bp, Mus musculus
ggtagagattccacagctcctttac

SEQ ID NO: 645691 - DNA, 25 bp, Mus musculus
ggtagagattcctcagctcctttac

SEQ ID NO: 645692 - DNA, 25 bp, Mus musculus
ggtagagcaattaaagaacctaaag

SEQ ID NO: 645693 - DNA, 25 bp, Mus musculus
ggtagagcaatttaagaacctaaag

SEQ ID NO: 645694 - DNA, 25 bp, Mus musculus
ggtagagcacagacatgcactgacc

SEQ ID NO: 645695 - DNA, 25 bp, Mus musculus
ggtagagcacagtcatgcactgacc

SEQ ID NO: 645696 - DNA, 25 bp, Mus musculus
ggtagagcacatcttcaatcccaga

SEQ ID NO: 645697 - DNA, 25 bp, Mus musculus
ggtagagcacatgttcaatcccaga

SEQ ID NO: 645698 - DNA, 25 bp, Mus musculus
ggtagagcactaatggcggcctgta

SEQ ID NO: 645699 - DNA, 25 bp, Mus musculus
ggtagagcactattggcggcctgta

SEQ ID NO: 645700 - DNA, 25 bp, Mus musculus
ggtagagccataacaccaatcccaa

SEQ ID NO: 645701 - DNA, 25 bp, Mus musculus
ggtagagccatatcaccaatcccaa

SEQ ID NO: 645702 - DNA, 25 bp, Mus musculus
ggtagagccatgaagcttagcctaa

SEQ ID NO: 645703 - DNA, 25 bp, Mus musculus
ggtagagccatgtagcttagcctaa

SEQ ID NO: 645704 - DNA, 25 bp, Mus musculus
ggtagagcccagctccatcagctgt

SEQ ID NO: 645705 - DNA, 25 bp, Mus musculus
ggtagagcccaggtccatcagctgt

SEQ ID NO: 645706 - DNA, 25 bp, Mus musculus
ggtagagccctcaaaagtgcaaaaa

SEQ ID NO: 645707 - DNA, 25 bp, Mus musculus
ggtagagccctctaaagtgcaaaaa

SEQ ID NO: 645708 - DNA, 25 bp, Mus musculus
ggtagagcgaagaccgtccagccag

SEQ ID NO: 645709 - DNA, 25 bp, Mus musculus
ggtagagcgaagtccgtccagccag

SEQ ID NO: 645710 - DNA, 25 bp, Mus musculus
ggtagagcgcttccctagcaagcgc

SEQ ID NO: 645711 - DNA, 25 bp, Mus musculus
ggtagagcgcttgcctagcaagcgc

SEQ ID NO: 645712 - DNA, 25 bp, Mus musculus
ggtagagctactcaaagcagcccaa

SEQ ID NO: 645713 - DNA, 25 bp, Mus musculus
ggtagagctactgaaagcagcccaa

SEQ ID NO: 645714 - DNA, 25 bp, Mus musculus
ggtagagctgctatgtaaactttgt

SEQ ID NO: 645715 - DNA, 25 bp, Mus musculus
ggtagagctgctttgtaaactttgt

SEQ ID NO: 645716 - DNA, 25 bp, Mus musculus
ggtagagtacgactatcttcagttt

SEQ ID NO: 645717 - DNA, 25 bp, Mus musculus
ggtagagtacgagtatcttcagttt

SEQ ID NO: 645718 - DNA, 25 bp, Mus musculus
ggtagagtatctagttcccagtttt

SEQ ID NO: 645719 - DNA, 25 bp, Mus musculus
ggtagagtatcttgttcccagtttt

SEQ ID NO: 645720 - DNA, 25 bp, Mus musculus
ggtagagtatgtctacagccctgaa

SEQ ID NO: 645721 - DNA, 25 bp, Mus musculus
ggtagagtatgtgtacagccctgaa

SEQ ID NO: 645722 - DNA, 25 bp, Mus musculus
ggtagagtcataactgttcccaaca

SEQ ID NO: 645723 - DNA, 25 bp, Mus musculus
ggtagagtcatatctgttcccaaca

SEQ ID NO: 645724 - DNA, 25 bp, Mus musculus
ggtagagtccaccttgaactcacct

SEQ ID NO: 645725 - DNA, 25 bp, Mus musculus
ggtagagtccacgttgaactcacct

SEQ ID NO: 645726 - DNA, 25 bp, Mus musculus
ggtagagtcctaacaataagccagt

SEQ ID NO: 645727 - DNA, 25 bp, Mus musculus
ggtagagtcctatcaataagccagt

SEQ ID NO: 645728 - DNA, 25 bp, Mus musculus
ggtagagttttcacctgaggtctcc

SEQ ID NO: 645729 - DNA, 25 bp, Mus musculus
ggtagagttttctcctgaggtctcc

SEQ ID NO: 645730 - DNA, 25 bp, Mus musculus
ggtagataacttcaaccgtacgatt

SEQ ID NO: 645731 - DNA, 25 bp, Mus musculus
ggtagataacttgaaccgtacgatt

SEQ ID NO: 645732 - DNA, 25 bp, Mus musculus
ggtagatacgcaagtgtccatcagt

SEQ ID NO: 645733 - DNA, 25 bp, Mus musculus
ggtagatacgcatgtgtccatcagt

SEQ ID NO: 645734 - DNA, 25 bp, Mus musculus
ggtagatactatctttatgatccaa

SEQ ID NO: 645735 - DNA, 25 bp, Mus musculus
ggtagatactatgtttatgatccaa

SEQ ID NO: 645736 - DNA, 25 bp, Mus musculus
ggtagatagagcaggacccaaaccc

SEQ ID NO: 645737 - DNA, 25 bp, Mus musculus
ggtagatagagctggacccaaaccc

SEQ ID NO: 645738 - DNA, 25 bp, Mus musculus
ggtagatatagcacacctatgcctt

SEQ ID NO: 645739 - DNA, 25 bp, Mus musculus
ggtagatatagctcacctatgcctt

SEQ ID NO: 645740 - DNA, 25 bp, Mus musculus
ggtagatatcttccagactgtcaaa

SEQ ID NO: 645741 - DNA, 25 bp, Mus musculus
ggtagatatcttgcagactgtcaaa

SEQ ID NO: 645742 - DNA, 25 bp, Mus musculus
ggtagatcacatccaagttctcaac

SEQ ID NO: 645743 - DNA, 25 bp, Mus musculus
ggtagatcacatgcaagttctcaac

SEQ ID NO: 645744 - DNA, 25 bp, Mus musculus
ggtagatcaggacaattccagtcaa

SEQ ID NO: 645745 - DNA, 25 bp, Mus musculus
ggtagatcaggagaattccagtcaa

SEQ ID NO: 645746 - DNA, 25 bp, Mus musculus
ggtagatcatatcgaagctctgtta

SEQ ID NO: 645747 - DNA, 25 bp, Mus musculus
ggtagatcatatggaagctctgtta

SEQ ID NO: 645748 - DNA, 25 bp, Mus musculus
ggtagatccattctctgttctattt

SEQ ID NO: 645749 - DNA, 25 bp, Mus musculus
ggtagatccattgtctgttctattt

SEQ ID NO: 645750 - DNA, 25 bp, Mus musculus
ggtagatcccttccttagtttgtat

SEQ ID NO: 645751 - DNA, 25 bp, Mus musculus
ggtagatcccttgcttagtttgtat

SEQ ID NO: 645752 - DNA, 25 bp, Mus musculus
ggtagatcctggcttgatttacaaa

SEQ ID NO: 645753 - DNA, 25 bp, Mus musculus
ggtagatcctgggttgatttacaaa

SEQ ID NO: 645754 - DNA, 25 bp, Mus musculus
ggtagatctcctcacactagagtgt

SEQ ID NO: 645755 - DNA, 25 bp, Mus musculus
ggtagatctcctgacactagagtgt

SEQ ID NO: 645756 - DNA, 25 bp, Mus musculus
ggtagatgacacacgaactctttca

SEQ ID NO: 645757 - DNA, 25 bp, Mus musculus
ggtagatgacactcgaactctttca

SEQ ID NO: 645758 - DNA, 25 bp, Mus musculus
ggtagatgacatcaaggccaccaca

SEQ ID NO: 645759 - DNA, 25 bp, Mus musculus
ggtagatgacatgaaggccaccaca

SEQ ID NO: 645760 - DNA, 25 bp, Mus musculus
ggtagatgccacacttcaagaggag

SEQ ID NO: 645761 - DNA, 25 bp, Mus musculus
ggtagatgccactcttcaagaggag

SEQ ID NO: 645762 - DNA, 25 bp, Mus musculus
ggtagatggcatcaccaggaagtcc

SEQ ID NO: 645763 - DNA, 25 bp, Mus musculus
ggtagatggcatgaccaggaagtcc

SEQ ID NO: 645764 - DNA, 25 bp, Mus musculus
ggtagatgttctagccacctaacta

SEQ ID NO: 645765 - DNA, 25 bp, Mus musculus
ggtagatgttcttgccacctaacta

SEQ ID NO: 645766 - DNA, 25 bp, Mus musculus
ggtagattacaccagctgtgctcag

SEQ ID NO: 645767 - DNA, 25 bp, Mus musculus
ggtagattacacgagctgtgctcag

SEQ ID NO: 645768 - DNA, 25 bp, Mus musculus
ggtagattactcattcatgtgctag

SEQ ID NO: 645769 - DNA, 25 bp, Mus musculus
ggtagattactctttcatgtgctag

SEQ ID NO: 645770 - DNA, 25 bp, Mus musculus
ggtagattatgacagctccgaagct

SEQ ID NO: 645771 - DNA, 25 bp, Mus musculus
ggtagattatgagagctccgaagct

SEQ ID NO: 645772 - DNA, 25 bp, Mus musculus
ggtagattctacaggctctctcatt

SEQ ID NO: 645773 - DNA, 25 bp, Mus musculus
ggtagattctactggctctctcatt

SEQ ID NO: 645774 - DNA, 25 bp, Mus musculus
ggtagatttcaacttactgttattt

SEQ ID NO: 645775 - DNA, 25 bp, Mus musculus
ggtagatttcaagttactgttattt

SEQ ID NO: 645776 - DNA, 25 bp, Mus musculus
ggtagatttccgcactttatataga

SEQ ID NO: 645777 - DNA, 25 bp, Mus musculus
ggtagatttccggactttatataga

SEQ ID NO: 645778 - DNA, 25 bp, Mus musculus
ggtagatttttgcagtgagtccatc

SEQ ID NO: 645779 - DNA, 25 bp, Mus musculus
ggtagatttttggagtgagtccatc

SEQ ID NO: 645780 - DNA, 25 bp, Mus musculus
ggtagcaaaaggactcaccctgacc

SEQ ID NO: 645781 - DNA, 25 bp, Mus musculus
ggtagcaaaaggtctcaccctgacc

SEQ ID NO: 645782 - DNA, 25 bp, Mus musculus
ggtagcaaatttctcatacctctgg

SEQ ID NO: 645783 - DNA, 25 bp, Mus musculus
ggtagcaaatttgtcatacctctgg

SEQ ID NO: 645784 - DNA, 25 bp, Mus musculus
ggtagcaaccaaagattccagtgtt

SEQ ID NO: 645785 - DNA, 25 bp, Mus musculus
ggtagcaaccaatgattccagtgtt

SEQ ID NO: 645786 - DNA, 25 bp, Mus musculus
ggtagcaaccagaaagtcccaaatg

SEQ ID NO: 645787 - DNA, 25 bp, Mus musculus
ggtagcaaccagagaccctttcttg

SEQ ID NO: 645788 - DNA, 25 bp, Mus musculus
ggtagcaaccagtaagtcccaaatg

SEQ ID NO: 645789 - DNA, 25 bp, Mus musculus
ggtagcaaccagtgaccctttcttg

SEQ ID NO: 645790 - DNA, 25 bp, Mus musculus
ggtagcaataccaatcaccacacag

SEQ ID NO: 645791 - DNA, 25 bp, Mus musculus
ggtagcaatacctatcaccacacag

SEQ ID NO: 645792 - DNA, 25 bp, Mus musculus
ggtagcaatggccaacttttcatgt

SEQ ID NO: 645793 - DNA, 25 bp, Mus musculus
ggtagcaatggcgaacttttcatgt

SEQ ID NO: 645794 - DNA, 25 bp, Mus musculus
ggtagcacacaacatactactattt

SEQ ID NO: 645795 - DNA, 25 bp, Mus musculus
ggtagcacacaagatactactattt

SEQ ID NO: 645796 - DNA, 25 bp, Mus musculus
ggtagcacaggaaccagtggcttta

SEQ ID NO: 645797 - DNA, 25 bp, Mus musculus
ggtagcacaggatccagtggcttta

SEQ ID NO: 645798 - DNA, 25 bp, Mus musculus
ggtagcacagttacctctaactcca

SEQ ID NO: 645799 - DNA, 25 bp, Mus musculus
ggtagcacagtttcctctaactcca

SEQ ID NO: 645800 - DNA, 25 bp, Mus musculus
ggtagcacatacataacatccaaga

SEQ ID NO: 645801 - DNA, 25 bp, Mus musculus
ggtagcacatacttaacatccaaga

SEQ ID NO: 645802 - DNA, 25 bp, Mus musculus
ggtagcacctatattgtactgattc

SEQ ID NO: 645803 - DNA, 25 bp, Mus musculus
ggtagcacctattttgtactgattc

SEQ ID NO: 645804 - DNA, 25 bp, Mus musculus
ggtagcacctgaaaacgctgcacgt

SEQ ID NO: 645805 - DNA, 25 bp, Mus musculus
ggtagcacctgataacgctgcacgt

SEQ ID NO: 645806 - DNA, 25 bp, Mus musculus
ggtagcaccttcattgggagcccat

SEQ ID NO: 645807 - DNA, 25 bp, Mus musculus
ggtagcaccttctttgggagcccat

SEQ ID NO: 645808 - DNA, 25 bp, Mus musculus
ggtagcacctttactaattaatctg

SEQ ID NO: 645809 - DNA, 25 bp, Mus musculus
ggtagcaccttttctaattaatctg

SEQ ID NO: 645810 - DNA, 25 bp, Mus musculus
ggtagcactcagaccaagcactcag

SEQ ID NO: 645811 - DNA, 25 bp, Mus musculus
ggtagcactcagtccaagcactcag

SEQ ID NO: 645812 - DNA, 25 bp, Mus musculus
ggtagcactctgaatttgttctgta

SEQ ID NO: 645813 - DNA, 25 bp, Mus musculus
ggtagcactctgtatttgttctgta

SEQ ID NO: 645814 - DNA, 25 bp, Mus musculus
ggtagcactgaacgcctgtcaagga

SEQ ID NO: 645815 - DNA, 25 bp, Mus musculus
ggtagcactgaaggcctgtcaagga

SEQ ID NO: 645816 - DNA, 25 bp, Mus musculus
ggtagcactgtgacttatttattta

SEQ ID NO: 645817 - DNA, 25 bp, Mus musculus
ggtagcactgtgtcttatttattta

SEQ ID NO: 645818 - DNA, 25 bp, Mus musculus
ggtagcactgttatcttagtgggtt

SEQ ID NO: 645819 - DNA, 25 bp, Mus musculus
ggtagcactgttttcttagtgggtt

SEQ ID NO: 645820 - DNA, 25 bp, Mus musculus
ggtagcagactgagcctctgaagca

SEQ ID NO: 645821 - DNA, 25 bp, Mus musculus
ggtagcagactgtgcctctgaagca

SEQ ID NO: 645822 - DNA, 25 bp, Mus musculus
ggtagcagagccagctggaacctat

SEQ ID NO: 645823 - DNA, 25 bp, Mus musculus
ggtagcagagcctgctggaacctat

SEQ ID NO: 645824 - DNA, 25 bp, Mus musculus
ggtagcagcacaaatggcggcctct

SEQ ID NO: 645825 - DNA, 25 bp, Mus musculus
ggtagcagcacatatggcggcctct

SEQ ID NO: 645826 - DNA, 25 bp, Mus musculus
ggtagcagccgtaaatgtcttctta

SEQ ID NO: 645827 - DNA, 25 bp, Mus musculus
ggtagcagccgttaatgtcttctta

SEQ ID NO: 645828 - DNA, 25 bp, Mus musculus
ggtagcagcgaactagagccttccc

SEQ ID NO: 645829 - DNA, 25 bp, Mus musculus
ggtagcagcgaagtagagccttccc

SEQ ID NO: 645830 - DNA, 25 bp, Mus musculus
ggtagcagcttcagtttcagcagca

SEQ ID NO: 645831 - DNA, 25 bp, Mus musculus
ggtagcagcttctgtttcagcagca

SEQ ID NO: 645832 - DNA, 25 bp, Mus musculus
ggtagcaggctactcaagtgatttc

SEQ ID NO: 645833 - DNA, 25 bp, Mus musculus
ggtagcaggctagtcaagtgatttc

SEQ ID NO: 645834 - DNA, 25 bp, Mus musculus
ggtagcaggtctcccacaggtcata

SEQ ID NO: 645835 - DNA, 25 bp, Mus musculus
ggtagcaggtctgccacaggtcata

SEQ ID NO: 645836 - DNA, 25 bp, Mus musculus
ggtagcagttatctgagccagtctt

SEQ ID NO: 645837 - DNA, 25 bp, Mus musculus
ggtagcagttatgtgagccagtctt

SEQ ID NO: 645838 - DNA, 25 bp, Mus musculus
ggtagcagttctaaatttgaacact

SEQ ID NO: 645839 - DNA, 25 bp, Mus musculus
ggtagcagttcttaatttgaacact

SEQ ID NO: 645840 - DNA, 25 bp, Mus musculus
ggtagcatccgtaggatcctcttat

SEQ ID NO: 645841 - DNA, 25 bp, Mus musculus
ggtagcatccgttggatcctcttat

SEQ ID NO: 645842 - DNA, 25 bp, Mus musculus
ggtagcatctccaatcaaaaagctt

SEQ ID NO: 645843 - DNA, 25 bp, Mus musculus
ggtagcatctcctatcaaaaagctt

SEQ ID NO: 645844 - DNA, 25 bp, Mus musculus
ggtagcatgaggctcctgaacgctc

SEQ ID NO: 645845 - DNA, 25 bp, Mus musculus
ggtagcatgagggtcctgaacgctc

SEQ ID NO: 645846 - DNA, 25 bp, Mus musculus
ggtagcatggatacatgttttctca

SEQ ID NO: 645847 - DNA, 25 bp, Mus musculus
ggtagcatggattcatgttttctca

SEQ ID NO: 645848 - DNA, 25 bp, Mus musculus
ggtagcatggctatgtagtttgcat

SEQ ID NO: 645849 - DNA, 25 bp, Mus musculus
ggtagcatggctttgtagtttgcat

SEQ ID NO: 645850 - DNA, 25 bp, Mus musculus
ggtagcattacaaattaacatgtgt

SEQ ID NO: 645851 - DNA, 25 bp, Mus musculus
ggtagcattacatattaacatgtgt

SEQ ID NO: 645852 - DNA, 25 bp, Mus musculus
ggtagcattaggagttctgtgccct

SEQ ID NO: 645853 - DNA, 25 bp, Mus musculus
ggtagcattaggtgttctgtgccct

SEQ ID NO: 645854 - DNA, 25 bp, Mus musculus
ggtagcattcaaactctcatgtctg

SEQ ID NO: 645855 - DNA, 25 bp, Mus musculus
ggtagcattcaatctctcatgtctg

SEQ ID NO: 645856 - DNA, 25 bp, Mus musculus
ggtagcattcagaaaggtgccttgt

SEQ ID NO: 645857 - DNA, 25 bp, Mus musculus
ggtagcattcagtaaggtgccttgt

SEQ ID NO: 645858 - DNA, 25 bp, Mus musculus
ggtagcattgaaaccttcctaggca

SEQ ID NO: 645859 - DNA, 25 bp, Mus musculus
ggtagcattgaatccttcctaggca

SEQ ID NO: 645860 - DNA, 25 bp, Mus musculus
ggtagcatttatcaaatgtattcca

SEQ ID NO: 645861 - DNA, 25 bp, Mus musculus
ggtagcatttatgaaatgtattcca

SEQ ID NO: 645862 - DNA, 25 bp, Mus musculus
ggtagccaaaggagcacatgccaat

SEQ ID NO: 645863 - DNA, 25 bp, Mus musculus
ggtagccaaaggtgcacatgccaat

SEQ ID NO: 645864 - DNA, 25 bp, Mus musculus
ggtagccaaataaactctgactttt

SEQ ID NO: 645865 - DNA, 25 bp, Mus musculus
ggtagccaaatatactctgactttt

SEQ ID NO: 645866 - DNA, 25 bp, Mus musculus
ggtagccaactgaccctgtcaagga

SEQ ID NO: 645867 - DNA, 25 bp, Mus musculus
ggtagccaactgtccctgtcaagga

SEQ ID NO: 645868 - DNA, 25 bp, Mus musculus
ggtagccaacttcctccagtaatgg

SEQ ID NO: 645869 - DNA, 25 bp, Mus musculus
ggtagccaacttgctccagtaatgg

SEQ ID NO: 645870 - DNA, 25 bp, Mus musculus
ggtagccacactccaatcagcaggg

SEQ ID NO: 645871 - DNA, 25 bp, Mus musculus
ggtagccacactgcaatcagcaggg

SEQ ID NO: 645872 - DNA, 25 bp, Mus musculus
ggtagccacagccacgtactgcgaa

SEQ ID NO: 645873 - DNA, 25 bp, Mus musculus
ggtagccacagcgacgtactgcgaa

SEQ ID NO: 645874 - DNA, 25 bp, Mus musculus
ggtagccactgaccagcatccttga

SEQ ID NO: 645875 - DNA, 25 bp, Mus musculus
ggtagccactgagcagcatccttga

SEQ ID NO: 645876 - DNA, 25 bp, Mus musculus
ggtagccagaccatgaatgtatgaa

SEQ ID NO: 645877 - DNA, 25 bp, Mus musculus
ggtagccagaccttgaatgtatgaa

SEQ ID NO: 645878 - DNA, 25 bp, Mus musculus
ggtagccagcaacttcatccatact

SEQ ID NO: 645879 - DNA, 25 bp, Mus musculus
ggtagccagcaagttcatccatact

SEQ ID NO: 645880 - DNA, 25 bp, Mus musculus
ggtagccaggctcaacacaggagca

SEQ ID NO: 645881 - DNA, 25 bp, Mus musculus
ggtagccaggctgaacacaggagca

SEQ ID NO: 645882 - DNA, 25 bp, Mus musculus
ggtagccatagcagggcaaacattt

SEQ ID NO: 645883 - DNA, 25 bp, Mus musculus
ggtagccatagctgggcaaacattt

SEQ ID NO: 645884 - DNA, 25 bp, Mus musculus
ggtagccatggacatgttcagacaa

SEQ ID NO: 645885 - DNA, 25 bp, Mus musculus
ggtagccatggagatgttcagacaa

SEQ ID NO: 645886 - DNA, 25 bp, Mus musculus
ggtagccatggcacgaaaactccag

SEQ ID NO: 645887 - DNA, 25 bp, Mus musculus
ggtagccatggctcgaaaactccag

SEQ ID NO: 645888 - DNA, 25 bp, Mus musculus
ggtagcccaaacaccaagtcaagtg

SEQ ID NO: 645889 - DNA, 25 bp, Mus musculus
ggtagcccaaactccaagtcaagtg

SEQ ID NO: 645890 - DNA, 25 bp, Mus musculus
ggtagcccaaggaatccaacagaaa

SEQ ID NO: 645891 - DNA, 25 bp, Mus musculus
ggtagcccaaggtatccaacagaaa

SEQ ID NO: 645892 - DNA, 25 bp, Mus musculus
ggtagcccaatacaaatacacctgt

SEQ ID NO: 645893 - DNA, 25 bp, Mus musculus
ggtagcccaatagaaatacacctgt

SEQ ID NO: 645894 - DNA, 25 bp, Mus musculus
ggtagcccagcgagagttcaggcat

SEQ ID NO: 645895 - DNA, 25 bp, Mus musculus
ggtagcccagcgtgagttcaggcat

SEQ ID NO: 645896 - DNA, 25 bp, Mus musculus
ggtagcccaggcagttgcctactga

SEQ ID NO: 645897 - DNA, 25 bp, Mus musculus
ggtagcccaggctgttgcctactga

SEQ ID NO: 645898 - DNA, 25 bp, Mus musculus
ggtagcccagggaacgaatcgcaaa

SEQ ID NO: 645899 - DNA, 25 bp, Mus musculus
ggtagcccagggtacgaatcgcaaa

SEQ ID NO: 645900 - DNA, 25 bp, Mus musculus
ggtagccccatgacaaaggccagca

SEQ ID NO: 645901 - DNA, 25 bp, Mus musculus
ggtagccccatgtcaaaggccagca

SEQ ID NO: 645902 - DNA, 25 bp, Mus musculus
ggtagccctaagacatcacatcagt

SEQ ID NO: 645903 - DNA, 25 bp, Mus musculus
ggtagccctaagtcatcacatcagt

SEQ ID NO: 645904 - DNA, 25 bp, Mus musculus
ggtagccctcttaagcatgcacagg

SEQ ID NO: 645905 - DNA, 25 bp, Mus musculus
ggtagccctctttagcatgcacagg

SEQ ID NO: 645906 - DNA, 25 bp, Mus musculus
ggtagccctgatcagtacttagcag

SEQ ID NO: 645907 - DNA, 25 bp, Mus musculus
ggtagccctgatgagtacttagcag

SEQ ID NO: 645908 - DNA, 25 bp, Mus musculus
ggtagccgaagaccttgccgcacaa

SEQ ID NO: 645909 - DNA, 25 bp, Mus musculus
ggtagccgaagagcttgccgcacaa

SEQ ID NO: 645910 - DNA, 25 bp, Mus musculus
ggtagccgctttcgattcttgtgga

SEQ ID NO: 645911 - DNA, 25 bp, Mus musculus
ggtagccgctttggattcttgtgga

SEQ ID NO: 645912 - DNA, 25 bp, Mus musculus
ggtagcctagatcccttcatataca

SEQ ID NO: 645913 - DNA, 25 bp, Mus musculus
ggtagcctagatgccttcatataca

SEQ ID NO: 645914 - DNA, 25 bp, Mus musculus
ggtagcctagctagttcttgtaaaa

SEQ ID NO: 645915 - DNA, 25 bp, Mus musculus
ggtagcctagcttgttcttgtaaaa

SEQ ID NO: 645916 - DNA, 25 bp, Mus musculus
ggtagcctatataaatttaatccgc

SEQ ID NO: 645917 - DNA, 25 bp, Mus musculus
ggtagcctatattaatttaatccgc

SEQ ID NO: 645918 - DNA, 25 bp, Mus musculus
ggtagcctcaggatagatacacgga

SEQ ID NO: 645919 - DNA, 25 bp, Mus musculus
ggtagcctcaggttagatacacgga

SEQ ID NO: 645920 - DNA, 25 bp, Mus musculus
ggtagcctcattacctgtatagtaa

SEQ ID NO: 645921 - DNA, 25 bp, Mus musculus
ggtagcctcattcagttttagttta

SEQ ID NO: 645922 - DNA, 25 bp, Mus musculus
ggtagcctcattgagttttagttta

SEQ ID NO: 645923 - DNA, 25 bp, Mus musculus
ggtagcctcatttcctgtatagtaa

SEQ ID NO: 645924 - DNA, 25 bp, Mus musculus
ggtagcctgatgacagactccctgt

SEQ ID NO: 645925 - DNA, 25 bp, Mus musculus
ggtagcctgatgtcagactccctgt

SEQ ID NO: 645926 - DNA, 25 bp, Mus musculus
ggtagcctgcgcctgttgcatcttc

SEQ ID NO: 645927 - DNA, 25 bp, Mus musculus
ggtagcctgcgcgtgttgcatcttc

SEQ ID NO: 645928 - DNA, 25 bp, Mus musculus
ggtagcctgctacagccagttcaga

SEQ ID NO: 645929 - DNA, 25 bp, Mus musculus
ggtagcctgctagagccagttcaga

SEQ ID NO: 645930 - DNA, 25 bp, Mus musculus
ggtagccttcagatctttgtgtttt

SEQ ID NO: 645931 - DNA, 25 bp, Mus musculus
ggtagccttcagttctttgtgtttt

SEQ ID NO: 645932 - DNA, 25 bp, Mus musculus
ggtagccttgaaactgcctgtgtta

SEQ ID NO: 645933 - DNA, 25 bp, Mus musculus
ggtagccttgaatctgcctgtgtta

SEQ ID NO: 645934 - DNA, 25 bp, Mus musculus
ggtagcctttacagatgtgtatgga

SEQ ID NO: 645935 - DNA, 25 bp, Mus musculus
ggtagcctttactgatgtgtatgga

SEQ ID NO: 645936 - DNA, 25 bp, Mus musculus
ggtagccttttaaactatttgacag

SEQ ID NO: 645937 - DNA, 25 bp, Mus musculus
ggtagccttttatactatttgacag

SEQ ID NO: 645938 - DNA, 25 bp, Mus musculus
ggtagcgaacctcagcctgagtaca

SEQ ID NO: 645939 - DNA, 25 bp, Mus musculus
ggtagcgaacctgagcctgagtaca

SEQ ID NO: 645940 - DNA, 25 bp, Mus musculus
ggtagcgaccagaccccagctggtg

SEQ ID NO: 645941 - DNA, 25 bp, Mus musculus
ggtagcgaccagtccccagctggtg

SEQ ID NO: 645942 - DNA, 25 bp, Mus musculus
ggtagcgatgttctctctctctgca

SEQ ID NO: 645943 - DNA, 25 bp, Mus musculus
ggtagcgatgttgtctctctctgca

SEQ ID NO: 645944 - DNA, 25 bp, Mus musculus
ggtagcgcatgactctaattccagc

SEQ ID NO: 645945 - DNA, 25 bp, Mus musculus
ggtagcgcatgagtctaattccagc

SEQ ID NO: 645946 - DNA, 25 bp, Mus musculus
ggtagcgccaatacactgaaacctt

SEQ ID NO: 645947 - DNA, 25 bp, Mus musculus
ggtagcgccaattcactgaaacctt

SEQ ID NO: 645948 - DNA, 25 bp, Mus musculus
ggtagcgctcaaagccctaatggaa

SEQ ID NO: 645949 - DNA, 25 bp, Mus musculus
ggtagcgctcaatgccctaatggaa

SEQ ID NO: 645950 - DNA, 25 bp, Mus musculus
ggtagcgctcccctcagtatgatag

SEQ ID NO: 645951 - DNA, 25 bp, Mus musculus
ggtagcgctcccgtcagtatgatag

SEQ ID NO: 645952 - DNA, 25 bp, Mus musculus
ggtagcggcagccagtcagaccaca

SEQ ID NO: 645953 - DNA, 25 bp, Mus musculus
ggtagcggcagcgagtcagaccaca

SEQ ID NO: 645954 - DNA, 25 bp, Mus musculus
ggtagcggtaccatctggacacgca

SEQ ID NO: 645955 - DNA, 25 bp, Mus musculus
ggtagcggtaccttctggacacgca

SEQ ID NO: 645956 - DNA, 25 bp, Mus musculus
ggtagcgtgtctcgaggacttcatt

SEQ ID NO: 645957 - DNA, 25 bp, Mus musculus
ggtagcgtgtctggaggacttcatt

SEQ ID NO: 645958 - DNA, 25 bp, Mus musculus
ggtagcgtgtttaacctttcgctat

SEQ ID NO: 645959 - DNA, 25 bp, Mus musculus
ggtagcgtgttttacctttcgctat

SEQ ID NO: 645960 - DNA, 25 bp, Mus musculus
ggtagctacctcagagagtgaacta

SEQ ID NO: 645961 - DNA, 25 bp, Mus musculus
ggtagctacctctgagagtgaacta

SEQ ID NO: 645962 - DNA, 25 bp, Mus musculus
ggtagctacgagaccgagtcggtca

SEQ ID NO: 645963 - DNA, 25 bp, Mus musculus
ggtagctacgagtccgagtcggtca

SEQ ID NO: 645964 - DNA, 25 bp, Mus musculus
ggtagctagagcaccaagtgagttt

SEQ ID NO: 645965 - DNA, 25 bp, Mus musculus
ggtagctagagctccaagtgagttt

SEQ ID NO: 645966 - DNA, 25 bp, Mus musculus
ggtagctagctcatcctaacgtaag

SEQ ID NO: 645967 - DNA, 25 bp, Mus musculus
ggtagctagctcatgaatttctgtt

SEQ ID NO: 645968 - DNA, 25 bp, Mus musculus
ggtagctagctcttcctaacgtaag

SEQ ID NO: 645969 - DNA, 25 bp, Mus musculus
ggtagctagctcttgaatttctgtt

SEQ ID NO: 645970 - DNA, 25 bp, Mus musculus
ggtagctaggaactggtgtctcctt

SEQ ID NO: 645971 - DNA, 25 bp, Mus musculus
ggtagctaggaagtggtgtctcctt

SEQ ID NO: 645972 - DNA, 25 bp, Mus musculus
ggtagctagggaatctcaaagattt

SEQ ID NO: 645973 - DNA, 25 bp, Mus musculus
ggtagctagggattctcaaagattt

SEQ ID NO: 645974 - DNA, 25 bp, Mus musculus
ggtagctatcacaggtttcaccttg

SEQ ID NO: 645975 - DNA, 25 bp, Mus musculus
ggtagctatcactggtttcaccttg

SEQ ID NO: 645976 - DNA, 25 bp, Mus musculus
ggtagctattggattctcagattct

SEQ ID NO: 645977 - DNA, 25 bp, Mus musculus
ggtagctattggtttctcagattct

SEQ ID NO: 645978 - DNA, 25 bp, Mus musculus
ggtagctcactaatatgacctcagt

SEQ ID NO: 645979 - DNA, 25 bp, Mus musculus
ggtagctcactattatgacctcagt

SEQ ID NO: 645980 - DNA, 25 bp, Mus musculus
ggtagctcatatatgtaatctcagt

SEQ ID NO: 645981 - DNA, 25 bp, Mus musculus
ggtagctcatatttgtaatctcagt

SEQ ID NO: 645982 - DNA, 25 bp, Mus musculus
ggtagctcctttcctttggacacaa

SEQ ID NO: 645983 - DNA, 25 bp, Mus musculus
ggtagctcctttgctttggacacaa

SEQ ID NO: 645984 - DNA, 25 bp, Mus musculus
ggtagctctcttaagacctagctct

SEQ ID NO: 645985 - DNA, 25 bp, Mus musculus
ggtagctctcttaggagttcacatt

SEQ ID NO: 645986 - DNA, 25 bp, Mus musculus
ggtagctctctttagacctagctct

SEQ ID NO: 645987 - DNA, 25 bp, Mus musculus
ggtagctctctttggagttcacatt

SEQ ID NO: 645988 - DNA, 25 bp, Mus musculus
ggtagctgaactaaaatgacatttt

SEQ ID NO: 645989 - DNA, 25 bp, Mus musculus
ggtagctgaacttaaatgacatttt

SEQ ID NO: 645990 - DNA, 25 bp, Mus musculus
ggtagctgcagacatgcacggctct

SEQ ID NO: 645991 - DNA, 25 bp, Mus musculus
ggtagctgcagagatgcacggctct

SEQ ID NO: 645992 - DNA, 25 bp, Mus musculus
ggtagctgcagcacacagtgtgtct

SEQ ID NO: 645993 - DNA, 25 bp, Mus musculus
ggtagctgcagctcacagtgtgtct

SEQ ID NO: 645994 - DNA, 25 bp, Mus musculus
ggtagctgcctcataattaattgcc

SEQ ID NO: 645995 - DNA, 25 bp, Mus musculus
ggtagctgcctcttaattaattgcc

SEQ ID NO: 645996 - DNA, 25 bp, Mus musculus
ggtagctgctgccttagatgtaagt

SEQ ID NO: 645997 - DNA, 25 bp, Mus musculus
ggtagctgctgcgttagatgtaagt

SEQ ID NO: 645998 - DNA, 25 bp, Mus musculus
ggtagctggcctcagcctactgtgc

SEQ ID NO: 645999 - DNA, 25 bp, Mus musculus
ggtagctggcctgagcctactgtgc

SEQ ID NO: 646000 - DNA, 25 bp, Mus musculus
ggtagctgggtactcacgtgtatat

SEQ ID NO: 646001 - DNA, 25 bp, Mus musculus
ggtagctgggtagtcacgtgtatat

SEQ ID NO: 646002 - DNA, 25 bp, Mus musculus
ggtagctggttcataaacacttcac

SEQ ID NO: 646003 - DNA, 25 bp, Mus musculus
ggtagctggttcctatatcgaccat

SEQ ID NO: 646004 - DNA, 25 bp, Mus musculus
ggtagctggttcgtatatcgaccat

SEQ ID NO: 646005 - DNA, 25 bp, Mus musculus
ggtagctggttcttaaacacttcac

SEQ ID NO: 646006 - DNA, 25 bp, Mus musculus
ggtagctgtaatctgccaaaacgtt

SEQ ID NO: 646007 - DNA, 25 bp, Mus musculus
ggtagctgtaatgtgccaaaacgtt

SEQ ID NO: 646008 - DNA, 25 bp, Mus musculus
ggtagctgtgtaagacactgcttta

SEQ ID NO: 646009 - DNA, 25 bp, Mus musculus
ggtagctgtgtatgacactgcttta

SEQ ID NO: 646010 - DNA, 25 bp, Mus musculus
ggtagctgtttaagggagccctcct

SEQ ID NO: 646011 - DNA, 25 bp, Mus musculus
ggtagctgtttatgggagccctcct

SEQ ID NO: 646012 - DNA, 25 bp, Mus musculus
ggtagcttcaaaaaagattcagcat

SEQ ID NO: 646013 - DNA, 25 bp, Mus musculus
ggtagcttcaaaagtactgtgtagc

SEQ ID NO: 646014 - DNA, 25 bp, Mus musculus
ggtagcttcaaataagattcagcat

SEQ ID NO: 646015 - DNA, 25 bp, Mus musculus
ggtagcttcaaatgtactgtgtagc

SEQ ID NO: 646016 - DNA, 25 bp, Mus musculus
ggtagcttcaacaaccatctcgtaa

SEQ ID NO: 646017 - DNA, 25 bp, Mus musculus
ggtagcttcaactaccatctcgtaa

SEQ ID NO: 646018 - DNA, 25 bp, Mus musculus
ggtagcttctctcgcttgacaaaga

SEQ ID NO: 646019 - DNA, 25 bp, Mus musculus
ggtagcttctctggcttgacaaaga

SEQ ID NO: 646020 - DNA, 25 bp, Mus musculus
ggtagcttctgtattagttgcctat

SEQ ID NO: 646021 - DNA, 25 bp, Mus musculus
ggtagcttctgttttagttgcctat

SEQ ID NO: 646022 - DNA, 25 bp, Mus musculus
ggtagcttgaacatggaccctccag

SEQ ID NO: 646023 - DNA, 25 bp, Mus musculus
ggtagcttgaacttggaccctccag

SEQ ID NO: 646024 - DNA, 25 bp, Mus musculus
ggtagcttgcctacaatcaatctat

SEQ ID NO: 646025 - DNA, 25 bp, Mus musculus
ggtagcttgcctactctgcctgagg

SEQ ID NO: 646026 - DNA, 25 bp, Mus musculus
ggtagcttgccttcaatcaatctat

SEQ ID NO: 646027 - DNA, 25 bp, Mus musculus
ggtagcttgccttctctgcctgagg

SEQ ID NO: 646028 - DNA, 25 bp, Mus musculus
ggtagcttggagatttatactcagt

SEQ ID NO: 646029 - DNA, 25 bp, Mus musculus
ggtagcttggagttttatactcagt

SEQ ID NO: 646030 - DNA, 25 bp, Mus musculus
ggtagctttaggctccagaactgct

SEQ ID NO: 646031 - DNA, 25 bp, Mus musculus
ggtagctttagggtccagaactgct

SEQ ID NO: 646032 - DNA, 25 bp, Mus musculus
ggtagctttccactccatgttctct

SEQ ID NO: 646033 - DNA, 25 bp, Mus musculus
ggtagctttccagtccatgttctct

SEQ ID NO: 646034 - DNA, 25 bp, Mus musculus
ggtaggaaaccaagtctctcgtcag

SEQ ID NO: 646035 - DNA, 25 bp, Mus musculus
ggtaggaaaccatgtctctcgtcag

SEQ ID NO: 646036 - DNA, 25 bp, Mus musculus
ggtaggaaagccctctctccagtgc

SEQ ID NO: 646037 - DNA, 25 bp, Mus musculus
ggtaggaaagccgtctctccagtgc

SEQ ID NO: 646038 - DNA, 25 bp, Mus musculus
ggtaggaaagctcgcctcactctgt

SEQ ID NO: 646039 - DNA, 25 bp, Mus musculus
ggtaggaaagctggcctcactctgt

SEQ ID NO: 646040 - DNA, 25 bp, Mus musculus
ggtaggaacaaacagatcataatca

SEQ ID NO: 646041 - DNA, 25 bp, Mus musculus
ggtaggaacaaagagatcataatca

SEQ ID NO: 646042 - DNA, 25 bp, Mus musculus
ggtaggaacgctccaacctgggtat

SEQ ID NO: 646043 - DNA, 25 bp, Mus musculus
ggtaggaacgctgcaacctgggtat

SEQ ID NO: 646044 - DNA, 25 bp, Mus musculus
ggtaggaactctcttctactgcaaa

SEQ ID NO: 646045 - DNA, 25 bp, Mus musculus
ggtaggaactctgttctactgcaaa

SEQ ID NO: 646046 - DNA, 25 bp, Mus musculus
ggtaggaagcccatgcaactggctc

SEQ ID NO: 646047 - DNA, 25 bp, Mus musculus
ggtaggaagcccttgcaactggctc

SEQ ID NO: 646048 - DNA, 25 bp, Mus musculus
ggtaggacaaaaacttctcagcaaa

SEQ ID NO: 646049 - DNA, 25 bp, Mus musculus
ggtaggacaaaatcttctcagcaaa

SEQ ID NO: 646050 - DNA, 25 bp, Mus musculus
ggtaggaccactcacgtctgaaatt

SEQ ID NO: 646051 - DNA, 25 bp, Mus musculus
ggtaggaccactgacgtctgaaatt

SEQ ID NO: 646052 - DNA, 25 bp, Mus musculus
ggtaggactcatcttagctcatagc

SEQ ID NO: 646053 - DNA, 25 bp, Mus musculus
ggtaggactcatgttagctcatagc

SEQ ID NO: 646054 - DNA, 25 bp, Mus musculus
ggtaggactcgcctaagtgaaactt

SEQ ID NO: 646055 - DNA, 25 bp, Mus musculus
ggtaggactcgcgtaagtgaaactt

SEQ ID NO: 646056 - DNA, 25 bp, Mus musculus
ggtaggactgtcctgaagcacccag

SEQ ID NO: 646057 - DNA, 25 bp, Mus musculus
ggtaggactgtcgtgaagcacccag

SEQ ID NO: 646058 - DNA, 25 bp, Mus musculus
ggtaggagagcgccctcagaacaca

SEQ ID NO: 646059 - DNA, 25 bp, Mus musculus
ggtaggagagcggcctcagaacaca

SEQ ID NO: 646060 - DNA, 25 bp, Mus musculus
ggtaggagatttacagattgcccaa

SEQ ID NO: 646061 - DNA, 25 bp, Mus musculus
ggtaggagattttcagattgcccaa

SEQ ID NO: 646062 - DNA, 25 bp, Mus musculus
ggtaggagcgaacatgttgccttcc

SEQ ID NO: 646063 - DNA, 25 bp, Mus musculus
ggtaggagcgaagatgttgccttcc

SEQ ID NO: 646064 - DNA, 25 bp, Mus musculus
ggtaggagtccgagttgtcattgcc

SEQ ID NO: 646065 - DNA, 25 bp, Mus musculus
ggtaggagtccgtgttgtcattgcc

SEQ ID NO: 646066 - DNA, 25 bp, Mus musculus
ggtaggatcttaactggtgacttta

SEQ ID NO: 646067 - DNA, 25 bp, Mus musculus
ggtaggatcttatctggtgacttta

SEQ ID NO: 646068 - DNA, 25 bp, Mus musculus
ggtaggatgaacacagccatgcatt

SEQ ID NO: 646069 - DNA, 25 bp, Mus musculus
ggtaggatgaactcagccatgcatt

SEQ ID NO: 646070 - DNA, 25 bp, Mus musculus
ggtaggatgccaccgcctagcatga

SEQ ID NO: 646071 - DNA, 25 bp, Mus musculus
ggtaggatgccagcgcctagcatga

SEQ ID NO: 646072 - DNA, 25 bp, Mus musculus
ggtaggattgttcccgcatctagtt

SEQ ID NO: 646073 - DNA, 25 bp, Mus musculus
ggtaggattgttgccgcatctagtt

SEQ ID NO: 646074 - DNA, 25 bp, Mus musculus
ggtaggcaagcactcaccagtgagt

SEQ ID NO: 646075 - DNA, 25 bp, Mus musculus
ggtaggcaagcagtcaccagtgagt

SEQ ID NO: 646076 - DNA, 25 bp, Mus musculus
ggtaggcaattcatccacacacttg

SEQ ID NO: 646077 - DNA, 25 bp, Mus musculus
ggtaggcaattcttccacacacttg

SEQ ID NO: 646078 - DNA, 25 bp, Mus musculus
ggtaggcacagaccactcccacgag

SEQ ID NO: 646079 - DNA, 25 bp, Mus musculus
ggtaggcacagagcactcccacgag

SEQ ID NO: 646080 - DNA, 25 bp, Mus musculus
ggtaggcagacaaccattgactcta

SEQ ID NO: 646081 - DNA, 25 bp, Mus musculus
ggtaggcagacatccattgactcta

SEQ ID NO: 646082 - DNA, 25 bp, Mus musculus
ggtaggcagatgaccactgactgtg

SEQ ID NO: 646083 - DNA, 25 bp, Mus musculus
ggtaggcagatgtccactgactgtg

SEQ ID NO: 646084 - DNA, 25 bp, Mus musculus
ggtaggcaggtacagtaatttcttt

SEQ ID NO: 646085 - DNA, 25 bp, Mus musculus
ggtaggcaggtagagtaatttcttt

SEQ ID NO: 646086 - DNA, 25 bp, Mus musculus
ggtaggcatcagatacttccattaa

SEQ ID NO: 646087 - DNA, 25 bp, Mus musculus
ggtaggcatcagttacttccattaa

SEQ ID NO: 646088 - DNA, 25 bp, Mus musculus
ggtaggcctgctagagaatggtcca

SEQ ID NO: 646089 - DNA, 25 bp, Mus musculus
ggtaggcctgcttgagaatggtcca

SEQ ID NO: 646090 - DNA, 25 bp, Mus musculus
ggtaggcgtgatacagagctctgca

SEQ ID NO: 646091 - DNA, 25 bp, Mus musculus
ggtaggcgtgattcagagctctgca

SEQ ID NO: 646092 - DNA, 25 bp, Mus musculus
ggtaggctacagcagtgtgcttcac

SEQ ID NO: 646093 - DNA, 25 bp, Mus musculus
ggtaggctacaggagtgtgcttcac

SEQ ID NO: 646094 - DNA, 25 bp, Mus musculus
ggtaggctaggaaaacccgctcgct

SEQ ID NO: 646095 - DNA, 25 bp, Mus musculus
ggtaggctaggataacccgctcgct

SEQ ID NO: 646096 - DNA, 25 bp, Mus musculus
ggtaggctattcatggctaaccagt

SEQ ID NO: 646097 - DNA, 25 bp, Mus musculus
ggtaggctattcttggctaaccagt

SEQ ID NO: 646098 - DNA, 25 bp, Mus musculus
ggtaggctcgccctgctttatccat

SEQ ID NO: 646099 - DNA, 25 bp, Mus musculus
ggtaggctcgccgtgctttatccat

SEQ ID NO: 646100 - DNA, 25 bp, Mus musculus
ggtaggctgcgaacccagcagaatc

SEQ ID NO: 646101 - DNA, 25 bp, Mus musculus
ggtaggctgcgatcccagcagaatc

SEQ ID NO: 646102 - DNA, 25 bp, Mus musculus
ggtaggctgtcactcacatgccagt

SEQ ID NO: 646103 - DNA, 25 bp, Mus musculus
ggtaggctgtcagtcacatgccagt

SEQ ID NO: 646104 - DNA, 25 bp, Mus musculus
ggtaggcttgtgctttccatgaaac

SEQ ID NO: 646105 - DNA, 25 bp, Mus musculus
ggtaggcttgtggtttccatgaaac

SEQ ID NO: 646106 - DNA, 25 bp, Mus musculus
ggtaggctttgaccacgccggcttc

SEQ ID NO: 646107 - DNA, 25 bp, Mus musculus
ggtaggctttgagcacgccggcttc

SEQ ID NO: 646108 - DNA, 25 bp, Mus musculus
ggtagggaaaccatctcagcttact

SEQ ID NO: 646109 - DNA, 25 bp, Mus musculus
ggtagggaaaccttctcagcttact

SEQ ID NO: 646110 - DNA, 25 bp, Mus musculus
ggtagggacgctatgtatccttgta

SEQ ID NO: 646111 - DNA, 25 bp, Mus musculus
ggtagggacgctttgtatccttgta

SEQ ID NO: 646112 - DNA, 25 bp, Mus musculus
ggtagggatctaaactctggtcttc

SEQ ID NO: 646113 - DNA, 25 bp, Mus musculus
ggtagggatctatactctggtcttc

SEQ ID NO: 646114 - DNA, 25 bp, Mus musculus
ggtagggcaaatctctccaatctga

SEQ ID NO: 646115 - DNA, 25 bp, Mus musculus
ggtagggcaaatgtctccaatctga

SEQ ID NO: 646116 - DNA, 25 bp, Mus musculus
ggtagggcggtgctggctgcagcgg

SEQ ID NO: 646117 - DNA, 25 bp, Mus musculus
ggtagggcggtggtggctgcagcgg

SEQ ID NO: 646118 - DNA, 25 bp, Mus musculus
ggtagggctcatctgtattatttct

SEQ ID NO: 646119 - DNA, 25 bp, Mus musculus
ggtagggctcatgtgtattatttct

SEQ ID NO: 646120 - DNA, 25 bp, Mus musculus
ggtagggcttctccagtacctgtta

SEQ ID NO: 646121 - DNA, 25 bp, Mus musculus
ggtagggcttctgcagtacctgtta

SEQ ID NO: 646122 - DNA, 25 bp, Mus musculus
ggtagggtaggaaacactgaagcat

SEQ ID NO: 646123 - DNA, 25 bp, Mus musculus
ggtagggtaggatacactgaagcat

SEQ ID NO: 646124 - DNA, 25 bp, Mus musculus
ggtagggtatctactgcgagacaga

SEQ ID NO: 646125 - DNA, 25 bp, Mus musculus
ggtagggtatcttctgcgagacaga

SEQ ID NO: 646126 - DNA, 25 bp, Mus musculus
ggtagggttctcaggagtaacagaa

SEQ ID NO: 646127 - DNA, 25 bp, Mus musculus
ggtagggttctctggagtaacagaa

SEQ ID NO: 646128 - DNA, 25 bp, Mus musculus
ggtaggtaatgtccagaagaccagc

SEQ ID NO: 646129 - DNA, 25 bp, Mus musculus
ggtaggtaatgtgcagaagaccagc

SEQ ID NO: 646130 - DNA, 25 bp, Mus musculus
ggtaggtagaacactgagctacaca

SEQ ID NO: 646131 - DNA, 25 bp, Mus musculus
ggtaggtagaactctgagctacaca

SEQ ID NO: 646132 - DNA, 25 bp, Mus musculus
ggtaggtaggtcaggcttctccatg

SEQ ID NO: 646133 - DNA, 25 bp, Mus musculus
ggtaggtaggtctggcttctccatg

SEQ ID NO: 646134 - DNA, 25 bp, Mus musculus
ggtaggtataaaagtcgctctataa

SEQ ID NO: 646135 - DNA, 25 bp, Mus musculus
ggtaggtataaatgtcgctctataa

SEQ ID NO: 646136 - DNA, 25 bp, Mus musculus
ggtaggtcacacagggccaaagcct

SEQ ID NO: 646137 - DNA, 25 bp, Mus musculus
ggtaggtcacacattcaagatcatc

SEQ ID NO: 646138 - DNA, 25 bp, Mus musculus
ggtaggtcacactgggccaaagcct

SEQ ID NO: 646139 - DNA, 25 bp, Mus musculus
ggtaggtcacactttcaagatcatc

SEQ ID NO: 646140 - DNA, 25 bp, Mus musculus
ggtaggtcgagtacttatcacccac

SEQ ID NO: 646141 - DNA, 25 bp, Mus musculus
ggtaggtcgagttcttatcacccac

SEQ ID NO: 646142 - DNA, 25 bp, Mus musculus
ggtaggtctgacagtgtttgcattc

SEQ ID NO: 646143 - DNA, 25 bp, Mus musculus
ggtaggtctgactgtgtttgcattc

SEQ ID NO: 646144 - DNA, 25 bp, Mus musculus
ggtaggtctgatagttttggtcttg

SEQ ID NO: 646145 - DNA, 25 bp, Mus musculus
ggtaggtctgattgttttggtcttg

SEQ ID NO: 646146 - DNA, 25 bp, Mus musculus
ggtaggtctgtgaattgcatgtttt

SEQ ID NO: 646147 - DNA, 25 bp, Mus musculus
ggtaggtctgtgtattgcatgtttt

SEQ ID NO: 646148 - DNA, 25 bp, Mus musculus
ggtaggtctttaagcctcattctta

SEQ ID NO: 646149 - DNA, 25 bp, Mus musculus
ggtaggtctttatgcctcattctta

SEQ ID NO: 646150 - DNA, 25 bp, Mus musculus
ggtaggtgcgcccaggccaaacagt

SEQ ID NO: 646151 - DNA, 25 bp, Mus musculus
ggtaggtgcgccgaggccaaacagt

SEQ ID NO: 646152 - DNA, 25 bp, Mus musculus
ggtaggtgctttactcagagcctgc

SEQ ID NO: 646153 - DNA, 25 bp, Mus musculus
ggtaggtgcttttctcagagcctgc

SEQ ID NO: 646154 - DNA, 25 bp, Mus musculus
ggtaggtgtctcaagccaaatccaa

SEQ ID NO: 646155 - DNA, 25 bp, Mus musculus
ggtaggtgtctctagccaaatccaa

SEQ ID NO: 646156 - DNA, 25 bp, Mus musculus
ggtaggttactaattcatttgcttt

SEQ ID NO: 646157 - DNA, 25 bp, Mus musculus
ggtaggttactatttcatttgcttt

SEQ ID NO: 646158 - DNA, 25 bp, Mus musculus
ggtaggttagggaggtcagtgccga

SEQ ID NO: 646159 - DNA, 25 bp, Mus musculus
ggtaggttagggtggtcagtgccga

SEQ ID NO: 646160 - DNA, 25 bp, Mus musculus
ggtaggttccatctcatttcacatt

SEQ ID NO: 646161 - DNA, 25 bp, Mus musculus
ggtaggttccatgtcatttcacatt

SEQ ID NO: 646162 - DNA, 25 bp, Mus musculus
ggtaggttgtgtatgcatgtgctaa

SEQ ID NO: 646163 - DNA, 25 bp, Mus musculus
ggtaggttgtgtttgcatgtgctaa

SEQ ID NO: 646164 - DNA, 25 bp, Mus musculus
ggtaggtttaccatggacttcatga

SEQ ID NO: 646165 - DNA, 25 bp, Mus musculus
ggtaggtttaccttggacttcatga

SEQ ID NO: 646166 - DNA, 25 bp, Mus musculus
ggtagtaaaaccaattctgcatgta

SEQ ID NO: 646167 - DNA, 25 bp, Mus musculus
ggtagtaaaacctattctgcatgta

SEQ ID NO: 646168 - DNA, 25 bp, Mus musculus
ggtagtaagctgaagcttcaagctt

SEQ ID NO: 646169 - DNA, 25 bp, Mus musculus
ggtagtaagctgtagcttcaagctt

SEQ ID NO: 646170 - DNA, 25 bp, Mus musculus
ggtagtaagtcaacaactcttgcta

SEQ ID NO: 646171 - DNA, 25 bp, Mus musculus
ggtagtaagtcatcaactcttgcta

SEQ ID NO: 646172 - DNA, 25 bp, Mus musculus
ggtagtaataaaccatgactctgac

SEQ ID NO: 646173 - DNA, 25 bp, Mus musculus
ggtagtaataaagcatgactctgac

SEQ ID NO: 646174 - DNA, 25 bp, Mus musculus
ggtagtaatagtacacatgtgccca

SEQ ID NO: 646175 - DNA, 25 bp, Mus musculus
ggtagtaatagttcacatgtgccca

SEQ ID NO: 646176 - DNA, 25 bp, Mus musculus
ggtagtacactgacttgatttctat

SEQ ID NO: 646177 - DNA, 25 bp, Mus musculus
ggtagtacactgtcttgatttctat

SEQ ID NO: 646178 - DNA, 25 bp, Mus musculus
ggtagtagcactccacctcaagaag

SEQ ID NO: 646179 - DNA, 25 bp, Mus musculus
ggtagtagcactgcacctcaagaag

SEQ ID NO: 646180 - DNA, 25 bp, Mus musculus
ggtagtagctcgattgcttactggg

SEQ ID NO: 646181 - DNA, 25 bp, Mus musculus
ggtagtagctcgtttgcttactggg

SEQ ID NO: 646182 - DNA, 25 bp, Mus musculus
ggtagtataagtagcagtgctgtct

SEQ ID NO: 646183 - DNA, 25 bp, Mus musculus
ggtagtataagttgcagtgctgtct

SEQ ID NO: 646184 - DNA, 25 bp, Mus musculus
ggtagtatctatattcctttagcaa

SEQ ID NO: 646185 - DNA, 25 bp, Mus musculus
ggtagtatctattttcctttagcaa

SEQ ID NO: 646186 - DNA, 25 bp, Mus musculus
ggtagtatgcacagctctaatcctc

SEQ ID NO: 646187 - DNA, 25 bp, Mus musculus
ggtagtatgcactgctctaatcctc

SEQ ID NO: 646188 - DNA, 25 bp, Mus musculus
ggtagtcacccaccttaatatctag

SEQ ID NO: 646189 - DNA, 25 bp, Mus musculus
ggtagtcacccagcttaatatctag

SEQ ID NO: 646190 - DNA, 25 bp, Mus musculus
ggtagtcactttcagaggacctcag

SEQ ID NO: 646191 - DNA, 25 bp, Mus musculus
ggtagtcactttgagaggacctcag

SEQ ID NO: 646192 - DNA, 25 bp, Mus musculus
ggtagtcagctccataggcaatgtt

SEQ ID NO: 646193 - DNA, 25 bp, Mus musculus
ggtagtcagctcgataggcaatgtt

SEQ ID NO: 646194 - DNA, 25 bp, Mus musculus
ggtagtcagtccagcttgacagcaa

SEQ ID NO: 646195 - DNA, 25 bp, Mus musculus
ggtagtcagtcctgcttgacagcaa

SEQ ID NO: 646196 - DNA, 25 bp, Mus musculus
ggtagtccacacatttaatttgagc

SEQ ID NO: 646197 - DNA, 25 bp, Mus musculus
ggtagtccacacttttaatttgagc

SEQ ID NO: 646198 - DNA, 25 bp, Mus musculus
ggtagtccagagcagcaacaccaac

SEQ ID NO: 646199 - DNA, 25 bp, Mus musculus
ggtagtccagaggagcaacaccaac

SEQ ID NO: 646200 - DNA, 25 bp, Mus musculus
ggtagtccgtccatgcttggtattt

SEQ ID NO: 646201 - DNA, 25 bp, Mus musculus
ggtagtccgtccttgcttggtattt

SEQ ID NO: 646202 - DNA, 25 bp, Mus musculus
ggtagtcctagacggccaggatatg

SEQ ID NO: 646203 - DNA, 25 bp, Mus musculus
ggtagtcctagagggccaggatatg

SEQ ID NO: 646204 - DNA, 25 bp, Mus musculus
ggtagtcctggcctgccaacaccag

SEQ ID NO: 646205 - DNA, 25 bp, Mus musculus
ggtagtcctggcgtgccaacaccag

SEQ ID NO: 646206 - DNA, 25 bp, Mus musculus
ggtagtccttgcacatgctataagt

SEQ ID NO: 646207 - DNA, 25 bp, Mus musculus
ggtagtccttgctcatgctataagt

SEQ ID NO: 646208 - DNA, 25 bp, Mus musculus
ggtagtcgctaaatgtactggttta

SEQ ID NO: 646209 - DNA, 25 bp, Mus musculus
ggtagtcgctaattgtactggttta

SEQ ID NO: 646210 - DNA, 25 bp, Mus musculus
ggtagtctacatccaaggactctgg

SEQ ID NO: 646211 - DNA, 25 bp, Mus musculus
ggtagtctacatgcaaggactctgg

SEQ ID NO: 646212 - DNA, 25 bp, Mus musculus
ggtagtctacgcacacagcaaggag

SEQ ID NO: 646213 - DNA, 25 bp, Mus musculus
ggtagtctacgctcacagcaaggag

SEQ ID NO: 646214 - DNA, 25 bp, Mus musculus
ggtagtctgattcctgctatggaaa

SEQ ID NO: 646215 - DNA, 25 bp, Mus musculus
ggtagtctgattgctgctatggaaa

SEQ ID NO: 646216 - DNA, 25 bp, Mus musculus
ggtagtctgcagatttagtcttttt

SEQ ID NO: 646217 - DNA, 25 bp, Mus musculus
ggtagtctgcagttttagtcttttt

SEQ ID NO: 646218 - DNA, 25 bp, Mus musculus
ggtagtctgtgcaacaccagatgtt

SEQ ID NO: 646219 - DNA, 25 bp, Mus musculus
ggtagtctgtgctacaccagatgtt

SEQ ID NO: 646220 - DNA, 25 bp, Mus musculus
ggtagtcttaatcacagaggcactg

SEQ ID NO: 646221 - DNA, 25 bp, Mus musculus
ggtagtcttaatgacagaggcactg

SEQ ID NO: 646222 - DNA, 25 bp, Mus musculus
ggtagtcttaggcagctcacaggct

SEQ ID NO: 646223 - DNA, 25 bp, Mus musculus
ggtagtcttagggagctcacaggct

SEQ ID NO: 646224 - DNA, 25 bp, Mus musculus
ggtagtcttggcagcagaactctca

SEQ ID NO: 646225 - DNA, 25 bp, Mus musculus
ggtagtcttggctgcagaactctca

SEQ ID NO: 646226 - DNA, 25 bp, Mus musculus
ggtagtctttcactcttttgcacaa

SEQ ID NO: 646227 - DNA, 25 bp, Mus musculus
ggtagtctttcagtcttttgcacaa

SEQ ID NO: 646228 - DNA, 25 bp, Mus musculus
ggtagtgaaccaatgtaggcttctt

SEQ ID NO: 646229 - DNA, 25 bp, Mus musculus
ggtagtgaaccattgtaggcttctt

SEQ ID NO: 646230 - DNA, 25 bp, Mus musculus
ggtagtgacgttccaggccttcatc

SEQ ID NO: 646231 - DNA, 25 bp, Mus musculus
ggtagtgacgttgcaggccttcatc

SEQ ID NO: 646232 - DNA, 25 bp, Mus musculus
ggtagtgagcctcaacccatgagcc

SEQ ID NO: 646233 - DNA, 25 bp, Mus musculus
ggtagtgagcctgaacccatgagcc

SEQ ID NO: 646234 - DNA, 25 bp, Mus musculus
ggtagtgataccagagccaccagat

SEQ ID NO: 646235 - DNA, 25 bp, Mus musculus
ggtagtgatacccacgctgtattct

SEQ ID NO: 646236 - DNA, 25 bp, Mus musculus
ggtagtgataccgacgctgtattct

SEQ ID NO: 646237 - DNA, 25 bp, Mus musculus
ggtagtgatacctgagccaccagat

SEQ ID NO: 646238 - DNA, 25 bp, Mus musculus
ggtagtgatcccactgtgtctgaag

SEQ ID NO: 646239 - DNA, 25 bp, Mus musculus
ggtagtgatccctctgtgtctgaag

SEQ ID NO: 646240 - DNA, 25 bp, Mus musculus
ggtagtgattataactgtcctacta

SEQ ID NO: 646241 - DNA, 25 bp, Mus musculus
ggtagtgattattactgtcctacta

SEQ ID NO: 646242 - DNA, 25 bp, Mus musculus
ggtagtgccctaccctgaaagccag

SEQ ID NO: 646243 - DNA, 25 bp, Mus musculus
ggtagtgccctagcctgaaagccag

SEQ ID NO: 646244 - DNA, 25 bp, Mus musculus
ggtagtgctactcctaacataaaca

SEQ ID NO: 646245 - DNA, 25 bp, Mus musculus
ggtagtgctactgctaacataaaca

SEQ ID NO: 646246 - DNA, 25 bp, Mus musculus
ggtagtggacacatgtttacataag

SEQ ID NO: 646247 - DNA, 25 bp, Mus musculus
ggtagtggacacttgtttacataag

SEQ ID NO: 646248 - DNA, 25 bp, Mus musculus
ggtagtggatgcaagccagcagcac

SEQ ID NO: 646249 - DNA, 25 bp, Mus musculus
ggtagtggatgctagccagcagcac

SEQ ID NO: 646250 - DNA, 25 bp, Mus musculus
ggtagtggattcaggacctacagaa

SEQ ID NO: 646251 - DNA, 25 bp, Mus musculus
ggtagtggattctggacctacagaa

SEQ ID NO: 646252 - DNA, 25 bp, Mus musculus
ggtagtggcacaaatgagcccagca

SEQ ID NO: 646253 - DNA, 25 bp, Mus musculus
ggtagtggcacatatgagcccagca

SEQ ID NO: 646254 - DNA, 25 bp, Mus musculus
ggtagtgtaaataagcttttctgct

SEQ ID NO: 646255 - DNA, 25 bp, Mus musculus
ggtagtgtaaattagcttttctgct

SEQ ID NO: 646256 - DNA, 25 bp, Mus musculus
ggtagtgtacaaaaatgaatctcaa

SEQ ID NO: 646257 - DNA, 25 bp, Mus musculus
ggtagtgtacaataatgaatctcaa

SEQ ID NO: 646258 - DNA, 25 bp, Mus musculus
ggtagtgtacatattagttcctcat

SEQ ID NO: 646259 - DNA, 25 bp, Mus musculus
ggtagtgtacattttagttcctcat

SEQ ID NO: 646260 - DNA, 25 bp, Mus musculus
ggtagtgtacttcagtgctgccaac

SEQ ID NO: 646261 - DNA, 25 bp, Mus musculus
ggtagtgtacttgagtgctgccaac

SEQ ID NO: 646262 - DNA, 25 bp, Mus musculus
ggtagtgtagcaagattttaaaaca

SEQ ID NO: 646263 - DNA, 25 bp, Mus musculus
ggtagtgtagcatgattttaaaaca

SEQ ID NO: 646264 - DNA, 25 bp, Mus musculus
ggtagtgtatagctagccagtttct

SEQ ID NO: 646265 - DNA, 25 bp, Mus musculus
ggtagtgtataggtagccagtttct

SEQ ID NO: 646266 - DNA, 25 bp, Mus musculus
ggtagtgtatttaaccttctgtaat

SEQ ID NO: 646267 - DNA, 25 bp, Mus musculus
ggtagtgtattttaccttctgtaat

SEQ ID NO: 646268 - DNA, 25 bp, Mus musculus
ggtagtgtccagaattatcctgatt

SEQ ID NO: 646269 - DNA, 25 bp, Mus musculus
ggtagtgtccagtattatcctgatt

SEQ ID NO: 646270 - DNA, 25 bp, Mus musculus
ggtagtgtctgaaagagttgtcctt

SEQ ID NO: 646271 - DNA, 25 bp, Mus musculus
ggtagtgtctgatagagttgtcctt

SEQ ID NO: 646272 - DNA, 25 bp, Mus musculus
ggtagtgtgaatctgctttgcagat

SEQ ID NO: 646273 - DNA, 25 bp, Mus musculus
ggtagtgtgaatgtgctttgcagat

SEQ ID NO: 646274 - DNA, 25 bp, Mus musculus
ggtagtgtgtatagttagccagttt

SEQ ID NO: 646275 - DNA, 25 bp, Mus musculus
ggtagtgtgtattgttagccagttt

SEQ ID NO: 646276 - DNA, 25 bp, Mus musculus
ggtagtgttattacatcgtttacaa

SEQ ID NO: 646277 - DNA, 25 bp, Mus musculus
ggtagtgttatttcatcgtttacaa

SEQ ID NO: 646278 - DNA, 25 bp, Mus musculus
ggtagtgtttgcagctgtaacccaa

SEQ ID NO: 646279 - DNA, 25 bp, Mus musculus
ggtagtgtttgcctgctgtgaaaat

SEQ ID NO: 646280 - DNA, 25 bp, Mus musculus
ggtagtgtttgcgtgctgtgaaaat

SEQ ID NO: 646281 - DNA, 25 bp, Mus musculus
ggtagtgtttgctgctgtaacccaa

SEQ ID NO: 646282 - DNA, 25 bp, Mus musculus
ggtagtgtttgtcttaagtcagttt

SEQ ID NO: 646283 - DNA, 25 bp, Mus musculus
ggtagtgtttgtgttaagtcagttt

SEQ ID NO: 646284 - DNA, 25 bp, Mus musculus
ggtagttaagtcagtcatgcctgaa

SEQ ID NO: 646285 - DNA, 25 bp, Mus musculus
ggtagttaagtctgtcatgcctgaa

SEQ ID NO: 646286 - DNA, 25 bp, Mus musculus
ggtagttaatgtagccacctacaga

SEQ ID NO: 646287 - DNA, 25 bp, Mus musculus
ggtagttaatgttgccacctacaga

SEQ ID NO: 646288 - DNA, 25 bp, Mus musculus
ggtagttactaaacgcctctgagcc

SEQ ID NO: 646289 - DNA, 25 bp, Mus musculus
ggtagttactaatcgcctctgagcc

SEQ ID NO: 646290 - DNA, 25 bp, Mus musculus
ggtagttacttcacctacatctgcc

SEQ ID NO: 646291 - DNA, 25 bp, Mus musculus
ggtagttacttctcctacatctgcc

SEQ ID NO: 646292 - DNA, 25 bp, Mus musculus
ggtagttagactcaaactcttctca

SEQ ID NO: 646293 - DNA, 25 bp, Mus musculus
ggtagttagactgaaactcttctca

SEQ ID NO: 646294 - DNA, 25 bp, Mus musculus
ggtagttagtatataaatgctgctg

SEQ ID NO: 646295 - DNA, 25 bp, Mus musculus
ggtagttagtatttaaatgctgctg

SEQ ID NO: 646296 - DNA, 25 bp, Mus musculus
ggtagttatcccaggaagcaagcat

SEQ ID NO: 646297 - DNA, 25 bp, Mus musculus
ggtagttatccctggaagcaagcat

SEQ ID NO: 646298 - DNA, 25 bp, Mus musculus
ggtagttcacaacggatcctgccct

SEQ ID NO: 646299 - DNA, 25 bp, Mus musculus
ggtagttcacaagggatcctgccct

SEQ ID NO: 646300 - DNA, 25 bp, Mus musculus
ggtagttcagctaattgatgacttc

SEQ ID NO: 646301 - DNA, 25 bp, Mus musculus
ggtagttcagcttattgatgacttc

SEQ ID NO: 646302 - DNA, 25 bp, Mus musculus
ggtagttccgagcaccacagagcaa

SEQ ID NO: 646303 - DNA, 25 bp, Mus musculus
ggtagttccgaggaccacagagcaa

SEQ ID NO: 646304 - DNA, 25 bp, Mus musculus
ggtagttccgtgatctagtcacgta

SEQ ID NO: 646305 - DNA, 25 bp, Mus musculus
ggtagttccgtgttctagtcacgta

SEQ ID NO: 646306 - DNA, 25 bp, Mus musculus
ggtagttctaacctgcaggtacttg

SEQ ID NO: 646307 - DNA, 25 bp, Mus musculus
ggtagttctaacgtgcaggtacttg

SEQ ID NO: 646308 - DNA, 25 bp, Mus musculus
ggtagttctcacaggatgctagact

SEQ ID NO: 646309 - DNA, 25 bp, Mus musculus
ggtagttctcactggatgctagact

SEQ ID NO: 646310 - DNA, 25 bp, Mus musculus
ggtagttctgatatttactctgtga

SEQ ID NO: 646311 - DNA, 25 bp, Mus musculus
ggtagttctgatttttactctgtga

SEQ ID NO: 646312 - DNA, 25 bp, Mus musculus
ggtagttctggacttgtgtgctaca

SEQ ID NO: 646313 - DNA, 25 bp, Mus musculus
ggtagttctggagttgtgtgctaca

SEQ ID NO: 646314 - DNA, 25 bp, Mus musculus
ggtagttgaacactgaccgtctgct

SEQ ID NO: 646315 - DNA, 25 bp, Mus musculus
ggtagttgaacagtgaccgtctgct

SEQ ID NO: 646316 - DNA, 25 bp, Mus musculus
ggtagttgacatagagctgcttctg

SEQ ID NO: 646317 - DNA, 25 bp, Mus musculus
ggtagttgacattgagctgcttctg

SEQ ID NO: 646318 - DNA, 25 bp, Mus musculus
ggtagttgatgaccatttccgtaca

SEQ ID NO: 646319 - DNA, 25 bp, Mus musculus
ggtagttgatgagcatttccgtaca

SEQ ID NO: 646320 - DNA, 25 bp, Mus musculus
ggtagttgctgactcctgagtttta

SEQ ID NO: 646321 - DNA, 25 bp, Mus musculus
ggtagttgctgagtcctgagtttta

SEQ ID NO: 646322 - DNA, 25 bp, Mus musculus
ggtagttgtaatcaccactcccata

SEQ ID NO: 646323 - DNA, 25 bp, Mus musculus
ggtagttgtaatgaccactcccata

SEQ ID NO: 646324 - DNA, 25 bp, Mus musculus
ggtagtttatgacagctggccacaa

SEQ ID NO: 646325 - DNA, 25 bp, Mus musculus
ggtagtttatgagagctggccacaa

SEQ ID NO: 646326 - DNA, 25 bp, Mus musculus
ggtagtttctaaccaggaagactga

SEQ ID NO: 646327 - DNA, 25 bp, Mus musculus
ggtagtttctaagcaggaagactga

SEQ ID NO: 646328 - DNA, 25 bp, Mus musculus
ggtagtttggctaagatcctccagt

SEQ ID NO: 646329 - DNA, 25 bp, Mus musculus
ggtagtttggcttagatcctccagt

SEQ ID NO: 646330 - DNA, 25 bp, Mus musculus
ggtagtttgtgaacttcacccctca

SEQ ID NO: 646331 - DNA, 25 bp, Mus musculus
ggtagtttgtgatcttcacccctca

SEQ ID NO: 646332 - DNA, 25 bp, Mus musculus
ggtagttttagaatcccaggtatgt

SEQ ID NO: 646333 - DNA, 25 bp, Mus musculus
ggtagttttagattcccaggtatgt

SEQ ID NO: 646334 - DNA, 25 bp, Mus musculus
ggtagttttgatacacatttctttc

SEQ ID NO: 646335 - DNA, 25 bp, Mus musculus
ggtagttttgattcacatttctttc

SEQ ID NO: 646336 - DNA, 25 bp, Mus musculus
ggtagttttgcaattgtcttctcaa

SEQ ID NO: 646337 - DNA, 25 bp, Mus musculus
ggtagttttgcatttgtcttctcaa

SEQ ID NO: 646338 - DNA, 25 bp, Mus musculus
ggtataaaagtgagtgtccccaagt

SEQ ID NO: 646339 - DNA, 25 bp, Mus musculus
ggtataaaagtgtgtgtccccaagt

SEQ ID NO: 646340 - DNA, 25 bp, Mus musculus
ggtataaaatacaacagtctctact

SEQ ID NO: 646341 - DNA, 25 bp, Mus musculus
ggtataaaatactacagtctctact

SEQ ID NO: 646342 - DNA, 25 bp, Mus musculus
ggtataaaattgcacgttgcctatt

SEQ ID NO: 646343 - DNA, 25 bp, Mus musculus
ggtataaaattggacgttgcctatt

SEQ ID NO: 646344 - DNA, 25 bp, Mus musculus
ggtataaacagtcgtctggccactc

SEQ ID NO: 646345 - DNA, 25 bp, Mus musculus
ggtataaacagtggtctggccactc

SEQ ID NO: 646346 - DNA, 25 bp, Mus musculus
ggtataaacctacccctcagctgac

SEQ ID NO: 646347 - DNA, 25 bp, Mus musculus
ggtataaacctagccctcagctgac

SEQ ID NO: 646348 - DNA, 25 bp, Mus musculus
ggtataaactttcttccttatgctg

SEQ ID NO: 646349 - DNA, 25 bp, Mus musculus
ggtataaactttgttccttatgctg

SEQ ID NO: 646350 - DNA, 25 bp, Mus musculus
ggtataaataccacgaaacgcttct

SEQ ID NO: 646351 - DNA, 25 bp, Mus musculus
ggtataaatacctcgaaacgcttct

SEQ ID NO: 646352 - DNA, 25 bp, Mus musculus
ggtataaatatcactccttttgctc

SEQ ID NO: 646353 - DNA, 25 bp, Mus musculus
ggtataaatatctctccttttgctc

SEQ ID NO: 646354 - DNA, 25 bp, Mus musculus
ggtataaccatgaagatattcctta

SEQ ID NO: 646355 - DNA, 25 bp, Mus musculus
ggtataaccatgtagatattcctta

SEQ ID NO: 646356 - DNA, 25 bp, Mus musculus
ggtataagaccccagcagagcttgt

SEQ ID NO: 646357 - DNA, 25 bp, Mus musculus
ggtataagacccgagcagagcttgt

SEQ ID NO: 646358 - DNA, 25 bp, Mus musculus
ggtataagatgtcccctccaggaac

SEQ ID NO: 646359 - DNA, 25 bp, Mus musculus
ggtataagatgtgccctccaggaac

SEQ ID NO: 646360 - DNA, 25 bp, Mus musculus
ggtataagccaaacatcccaggaca

SEQ ID NO: 646361 - DNA, 25 bp, Mus musculus
ggtataagccaatcatcccaggaca

SEQ ID NO: 646362 - DNA, 25 bp, Mus musculus
ggtataagttaacccatcttcagat

SEQ ID NO: 646363 - DNA, 25 bp, Mus musculus
ggtataagttaagccatcttcagat

SEQ ID NO: 646364 - DNA, 25 bp, Mus musculus
ggtataatacctattcgtccaacat

SEQ ID NO: 646365 - DNA, 25 bp, Mus musculus
ggtataataccttttcgtccaacat

SEQ ID NO: 646366 - DNA, 25 bp, Mus musculus
ggtataatagtgaatgcctgtccca

SEQ ID NO: 646367 - DNA, 25 bp, Mus musculus
ggtataatagtgtatgcctgtccca

SEQ ID NO: 646368 - DNA, 25 bp, Mus musculus
ggtataatgtagaatcttcttctct

SEQ ID NO: 646369 - DNA, 25 bp, Mus musculus
ggtataatgtagtatcttcttctct

SEQ ID NO: 646370 - DNA, 25 bp, Mus musculus
ggtataattgtgattcctaagctct

SEQ ID NO: 646371 - DNA, 25 bp, Mus musculus
ggtataattgtgtttcctaagctct

SEQ ID NO: 646372 - DNA, 25 bp, Mus musculus
ggtatacaaagaccgtaaatattag

SEQ ID NO: 646373 - DNA, 25 bp, Mus musculus
ggtatacaaagagcgtaaatattag

SEQ ID NO: 646374 - DNA, 25 bp, Mus musculus
ggtatacaagccatcaacatttagt

SEQ ID NO: 646375 - DNA, 25 bp, Mus musculus
ggtatacaagccttcaacatttagt

SEQ ID NO: 646376 - DNA, 25 bp, Mus musculus
ggtatacaccttaatttcagcactt

SEQ ID NO: 646377 - DNA, 25 bp, Mus musculus
ggtatacacctttatttcagcactt

SEQ ID NO: 646378 - DNA, 25 bp, Mus musculus
ggtatacactaacaggccaatgtct

SEQ ID NO: 646379 - DNA, 25 bp, Mus musculus
ggtatacactaagaggccaatgtct

SEQ ID NO: 646380 - DNA, 25 bp, Mus musculus
ggtatacagcatctcagcccttgta

SEQ ID NO: 646381 - DNA, 25 bp, Mus musculus
ggtatacagcatgtcagcccttgta

SEQ ID NO: 646382 - DNA, 25 bp, Mus musculus
ggtatacatctgcaattgcagcatt

SEQ ID NO: 646383 - DNA, 25 bp, Mus musculus
ggtatacatctggaattgcagcatt

SEQ ID NO: 646384 - DNA, 25 bp, Mus musculus
ggtataccatgcctcgtctgagagg

SEQ ID NO: 646385 - DNA, 25 bp, Mus musculus
ggtataccatgcgtcgtctgagagg

SEQ ID NO: 646386 - DNA, 25 bp, Mus musculus
ggtatacccagacaccaacttgagc

SEQ ID NO: 646387 - DNA, 25 bp, Mus musculus
ggtatacccagagaccaacttgagc

SEQ ID NO: 646388 - DNA, 25 bp, Mus musculus
ggtatacccgagacttgagcataca

SEQ ID NO: 646389 - DNA, 25 bp, Mus musculus
ggtatacccgagtcttgagcataca

SEQ ID NO: 646390 - DNA, 25 bp, Mus musculus
ggtatacctgccagtcagtcagcca

SEQ ID NO: 646391 - DNA, 25 bp, Mus musculus
ggtatacctgcctgtcagtcagcca

SEQ ID NO: 646392 - DNA, 25 bp, Mus musculus
ggtatacgacctcagcgaaaccact

SEQ ID NO: 646393 - DNA, 25 bp, Mus musculus
ggtatacgacctgagcgaaaccact

SEQ ID NO: 646394 - DNA, 25 bp, Mus musculus
ggtatacgcccactgtgcttagaca

SEQ ID NO: 646395 - DNA, 25 bp, Mus musculus
ggtatacgcccagtgtgcttagaca

SEQ ID NO: 646396 - DNA, 25 bp, Mus musculus
ggtatacgtaatagaccctatctct

SEQ ID NO: 646397 - DNA, 25 bp, Mus musculus
ggtatacgtaattgaccctatctct

SEQ ID NO: 646398 - DNA, 25 bp, Mus musculus
ggtatacgtattactccaggagtgc

SEQ ID NO: 646399 - DNA, 25 bp, Mus musculus
ggtatacgtattcggattgacatct

SEQ ID NO: 646400 - DNA, 25 bp, Mus musculus
ggtatacgtattgggattgacatct

SEQ ID NO: 646401 - DNA, 25 bp, Mus musculus
ggtatacgtatttctccaggagtgc

SEQ ID NO: 646402 - DNA, 25 bp, Mus musculus
ggtatactatgtaagggctttaaat

SEQ ID NO: 646403 - DNA, 25 bp, Mus musculus
ggtatactatgttagggctttaaat

SEQ ID NO: 646404 - DNA, 25 bp, Mus musculus
ggtatactccacagttgccaaattg

SEQ ID NO: 646405 - DNA, 25 bp, Mus musculus
ggtatactccactgttgccaaattg

SEQ ID NO: 646406 - DNA, 25 bp, Mus musculus
ggtatactctgtaactctaagctgc

SEQ ID NO: 646407 - DNA, 25 bp, Mus musculus
ggtatactctgttactctaagctgc

SEQ ID NO: 646408 - DNA, 25 bp, Mus musculus
ggtatactcttgcagactgccttca

SEQ ID NO: 646409 - DNA, 25 bp, Mus musculus
ggtatactcttggagactgccttca

SEQ ID NO: 646410 - DNA, 25 bp, Mus musculus
ggtatactggcgatgcagccacaaa

SEQ ID NO: 646411 - DNA, 25 bp, Mus musculus
ggtatactggcgttgcagccacaaa

SEQ ID NO: 646412 - DNA, 25 bp, Mus musculus
ggtatacttaccagagtgctaggga

SEQ ID NO: 646413 - DNA, 25 bp, Mus musculus
ggtatacttacctgagtgctaggga

SEQ ID NO: 646414 - DNA, 25 bp, Mus musculus
ggtatacttatgactcttgtcttga

SEQ ID NO: 646415 - DNA, 25 bp, Mus musculus
ggtatacttatgtctcttgtcttga

SEQ ID NO: 646416 - DNA, 25 bp, Mus musculus
ggtatagaacccatgtataagtgag

SEQ ID NO: 646417 - DNA, 25 bp, Mus musculus
ggtatagaacccttgtataagtgag

SEQ ID NO: 646418 - DNA, 25 bp, Mus musculus
ggtatagaccacaaacatttccaca

SEQ ID NO: 646419 - DNA, 25 bp, Mus musculus
ggtatagaccactaacatttccaca

SEQ ID NO: 646420 - DNA, 25 bp, Mus musculus
ggtatagagatcagggtcccatgag

SEQ ID NO: 646421 - DNA, 25 bp, Mus musculus
ggtatagagatctgggtcccatgag

SEQ ID NO: 646422 - DNA, 25 bp, Mus musculus
ggtatagagtggaagctcagctgtt

SEQ ID NO: 646423 - DNA, 25 bp, Mus musculus
ggtatagagtggtagctcagctgtt

SEQ ID NO: 646424 - DNA, 25 bp, Mus musculus
ggtatagattccctgctttatgaga

SEQ ID NO: 646425 - DNA, 25 bp, Mus musculus
ggtatagattccgtgctttatgaga

SEQ ID NO: 646426 - DNA, 25 bp, Mus musculus
ggtatagcagaacaagccagtaatc

SEQ ID NO: 646427 - DNA, 25 bp, Mus musculus
ggtatagcagaagaagccagtaatc

SEQ ID NO: 646428 - DNA, 25 bp, Mus musculus
ggtatagcattcactggatagccca

SEQ ID NO: 646429 - DNA, 25 bp, Mus musculus
ggtatagcattctctggatagccca

SEQ ID NO: 646430 - DNA, 25 bp, Mus musculus
ggtatagctcagagctcgacctggt

SEQ ID NO: 646431 - DNA, 25 bp, Mus musculus
ggtatagctcagtgctcgacctggt

SEQ ID NO: 646432 - DNA, 25 bp, Mus musculus
ggtatagcttcgatgtaaagatatt

SEQ ID NO: 646433 - DNA, 25 bp, Mus musculus
ggtatagcttcgttgtaaagatatt

SEQ ID NO: 646434 - DNA, 25 bp, Mus musculus
ggtatagctttacgtctctctgtaa

SEQ ID NO: 646435 - DNA, 25 bp, Mus musculus
ggtatagctttaggtctctctgtaa

SEQ ID NO: 646436 - DNA, 25 bp, Mus musculus
ggtataggtcgtacagagtctcaaa

SEQ ID NO: 646437 - DNA, 25 bp, Mus musculus
ggtataggtcgttcagagtctcaaa

SEQ ID NO: 646438 - DNA, 25 bp, Mus musculus
ggtatagtacgaatgctgcccttca

SEQ ID NO: 646439 - DNA, 25 bp, Mus musculus
ggtatagtacgattgctgcccttca

SEQ ID NO: 646440 - DNA, 25 bp, Mus musculus
ggtatagtcatgaccatggctcagt

SEQ ID NO: 646441 - DNA, 25 bp, Mus musculus
ggtatagtcatgtccatggctcagt

SEQ ID NO: 646442 - DNA, 25 bp, Mus musculus
ggtatagtctaaaatgccatgtgta

SEQ ID NO: 646443 - DNA, 25 bp, Mus musculus
ggtatagtctaatatgccatgtgta

SEQ ID NO: 646444 - DNA, 25 bp, Mus musculus
ggtatagtgctacatatctttaatc

SEQ ID NO: 646445 - DNA, 25 bp, Mus musculus
ggtatagtgctagatatctttaatc

SEQ ID NO: 646446 - DNA, 25 bp, Mus musculus
ggtatagttcaacctattccgtaga

SEQ ID NO: 646447 - DNA, 25 bp, Mus musculus
ggtatagttcaagctattccgtaga

SEQ ID NO: 646448 - DNA, 25 bp, Mus musculus
ggtatatacttgagtgcttgcacac

SEQ ID NO: 646449 - DNA, 25 bp, Mus musculus
ggtatatacttgtgtgcttgcacac

SEQ ID NO: 646450 - DNA, 25 bp, Mus musculus
ggtatatatcagacagttcatctgt

SEQ ID NO: 646451 - DNA, 25 bp, Mus musculus
ggtatatatcagtcagttcatctgt

SEQ ID NO: 646452 - DNA, 25 bp, Mus musculus
ggtatatatcctattcactttccta

SEQ ID NO: 646453 - DNA, 25 bp, Mus musculus
ggtatatatccttttcactttccta

SEQ ID NO: 646454 - DNA, 25 bp, Mus musculus
ggtatatatcttaagctcctgtgct

SEQ ID NO: 646455 - DNA, 25 bp, Mus musculus
ggtatatatctttagctcctgtgct

SEQ ID NO: 646456 - DNA, 25 bp, Mus musculus
ggtatatcagctatagttcacatct

SEQ ID NO: 646457 - DNA, 25 bp, Mus musculus
ggtatatcagctttagttcacatct

SEQ ID NO: 646458 - DNA, 25 bp, Mus musculus
ggtatatccatgcagattgtagatt

SEQ ID NO: 646459 - DNA, 25 bp, Mus musculus
ggtatatccatggagattgtagatt

SEQ ID NO: 646460 - DNA, 25 bp, Mus musculus
ggtatatctactccattgcatttat

SEQ ID NO: 646461 - DNA, 25 bp, Mus musculus
ggtatatctactgcattgcatttat

SEQ ID NO: 646462 - DNA, 25 bp, Mus musculus
ggtatatctatgaaccacctgcata

SEQ ID NO: 646463 - DNA, 25 bp, Mus musculus
ggtatatctatgtaccacctgcata

SEQ ID NO: 646464 - DNA, 25 bp, Mus musculus
ggtatatctcaacgcatggcttaac

SEQ ID NO: 646465 - DNA, 25 bp, Mus musculus
ggtatatctcaaggcatggcttaac

SEQ ID NO: 646466 - DNA, 25 bp, Mus musculus
ggtatatctcctctaggttttgctt

SEQ ID NO: 646467 - DNA, 25 bp, Mus musculus
ggtatatctcctgtaggttttgctt

SEQ ID NO: 646468 - DNA, 25 bp, Mus musculus
ggtatatctgcaaatggcacaaact

SEQ ID NO: 646469 - DNA, 25 bp, Mus musculus
ggtatatctgcatatggcacaaact

SEQ ID NO: 646470 - DNA, 25 bp, Mus musculus
ggtatatctgtaaagtttccctaat

SEQ ID NO: 646471 - DNA, 25 bp, Mus musculus
ggtatatctgtatagtttccctaat

SEQ ID NO: 646472 - DNA, 25 bp, Mus musculus
ggtatatgaataactcatgcactaa

SEQ ID NO: 646473 - DNA, 25 bp, Mus musculus
ggtatatgaatatctcatgcactaa

SEQ ID NO: 646474 - DNA, 25 bp, Mus musculus
ggtatatgacttatggccttctggc

SEQ ID NO: 646475 - DNA, 25 bp, Mus musculus
ggtatatgacttttggccttctggc

SEQ ID NO: 646476 - DNA, 25 bp, Mus musculus
ggtatatgagtccttcctctacaga

SEQ ID NO: 646477 - DNA, 25 bp, Mus musculus
ggtatatgagtcgttcctctacaga

SEQ ID NO: 646478 - DNA, 25 bp, Mus musculus
ggtatatgccagcacacctgattta

SEQ ID NO: 646479 - DNA, 25 bp, Mus musculus
ggtatatgccaggacacctgattta

SEQ ID NO: 646480 - DNA, 25 bp, Mus musculus
ggtatatgctgtagactggagtcca

SEQ ID NO: 646481 - DNA, 25 bp, Mus musculus
ggtatatgctgttgactggagtcca

SEQ ID NO: 646482 - DNA, 25 bp, Mus musculus
ggtatatgctttaagtcccagtact

SEQ ID NO: 646483 - DNA, 25 bp, Mus musculus
ggtatatgcttttagtcccagtact

SEQ ID NO: 646484 - DNA, 25 bp, Mus musculus
ggtatatgtcaccatactcaacaat

SEQ ID NO: 646485 - DNA, 25 bp, Mus musculus
ggtatatgtcacgatactcaacaat

SEQ ID NO: 646486 - DNA, 25 bp, Mus musculus
ggtatatgtgatagacttttcttca

SEQ ID NO: 646487 - DNA, 25 bp, Mus musculus
ggtatatgtgattgacttttcttca

SEQ ID NO: 646488 - DNA, 25 bp, Mus musculus
ggtatatgttaaactctcctctgac

SEQ ID NO: 646489 - DNA, 25 bp, Mus musculus
ggtatatgttaatctctcctctgac

SEQ ID NO: 646490 - DNA, 25 bp, Mus musculus
ggtatattcagacatcacatttttt

SEQ ID NO: 646491 - DNA, 25 bp, Mus musculus
ggtatattcagagatcacatttttt

SEQ ID NO: 646492 - DNA, 25 bp, Mus musculus
ggtatattccacactcatgaagatt

SEQ ID NO: 646493 - DNA, 25 bp, Mus musculus
ggtatattccactctcatgaagatt

SEQ ID NO: 646494 - DNA, 25 bp, Mus musculus
ggtatattgaaaacgttgaagcgag

SEQ ID NO: 646495 - DNA, 25 bp, Mus musculus
ggtatattgaaatcgttgaagcgag

SEQ ID NO: 646496 - DNA, 25 bp, Mus musculus
ggtatatttacacggtatttagagt

SEQ ID NO: 646497 - DNA, 25 bp, Mus musculus
ggtatatttacagggtatttagagt

SEQ ID NO: 646498 - DNA, 25 bp, Mus musculus
ggtatcaaaaccacttcctgggatt

SEQ ID NO: 646499 - DNA, 25 bp, Mus musculus
ggtatcaaaacctcttcctgggatt

SEQ ID NO: 646500 - DNA, 25 bp, Mus musculus
ggtatcaaacatccctaaccccatg

SEQ ID NO: 646501 - DNA, 25 bp, Mus musculus
ggtatcaaacatgcctaaccccatg

SEQ ID NO: 646502 - DNA, 25 bp, Mus musculus
ggtatcaaatgccagtgttttcctt

SEQ ID NO: 646503 - DNA, 25 bp, Mus musculus
ggtatcaaatgcgagtgttttcctt

SEQ ID NO: 646504 - DNA, 25 bp, Mus musculus
ggtatcaacaacaatttaaccttag

SEQ ID NO: 646505 - DNA, 25 bp, Mus musculus
ggtatcaacaactatttaaccttag

SEQ ID NO: 646506 - DNA, 25 bp, Mus musculus
ggtatcaacattccaacactcattt

SEQ ID NO: 646507 - DNA, 25 bp, Mus musculus
ggtatcaacattgcaacactcattt

SEQ ID NO: 646508 - DNA, 25 bp, Mus musculus
ggtatcaaccttcatttgggtttca

SEQ ID NO: 646509 - DNA, 25 bp, Mus musculus
ggtatcaaccttgatttgggtttca

SEQ ID NO: 646510 - DNA, 25 bp, Mus musculus
ggtatcaagtctattacagtctgtt

SEQ ID NO: 646511 - DNA, 25 bp, Mus musculus
ggtatcaagtcttttacagtctgtt

SEQ ID NO: 646512 - DNA, 25 bp, Mus musculus
ggtatcacatacaaggtctacaggt

SEQ ID NO: 646513 - DNA, 25 bp, Mus musculus
ggtatcacatactaggtctacaggt

SEQ ID NO: 646514 - DNA, 25 bp, Mus musculus
ggtatcacatcacatgcgaagcgtt

SEQ ID NO: 646515 - DNA, 25 bp, Mus musculus
ggtatcacatcagatgcgaagcgtt

SEQ ID NO: 646516 - DNA, 25 bp, Mus musculus
ggtatcaccaaacgtcatttctctc

SEQ ID NO: 646517 - DNA, 25 bp, Mus musculus
ggtatcaccaaaggtcatttctctc

SEQ ID NO: 646518 - DNA, 25 bp, Mus musculus
ggtatcaccaataccagtgacaaag

SEQ ID NO: 646519 - DNA, 25 bp, Mus musculus
ggtatcaccaattccagtgacaaag

SEQ ID NO: 646520 - DNA, 25 bp, Mus musculus
ggtatcaccattcttgatttcaagt

SEQ ID NO: 646521 - DNA, 25 bp, Mus musculus
ggtatcaccattgttgatttcaagt

SEQ ID NO: 646522 - DNA, 25 bp, Mus musculus
ggtatcacgaaaacaggttcctgac

SEQ ID NO: 646523 - DNA, 25 bp, Mus musculus
ggtatcacgaaatcaggttcctgac

SEQ ID NO: 646524 - DNA, 25 bp, Mus musculus
ggtatcacgtggctatttatcagta

SEQ ID NO: 646525 - DNA, 25 bp, Mus musculus
ggtatcacgtgggtatttatcagta

SEQ ID NO: 646526 - DNA, 25 bp, Mus musculus
ggtatcactattaaggacctgtgct

SEQ ID NO: 646527 - DNA, 25 bp, Mus musculus
ggtatcactatttaggacctgtgct

SEQ ID NO: 646528 - DNA, 25 bp, Mus musculus
ggtatcactcaaacagccttttttc

SEQ ID NO: 646529 - DNA, 25 bp, Mus musculus
ggtatcactcaatcagccttttttc

SEQ ID NO: 646530 - DNA, 25 bp, Mus musculus
ggtatcactcctcagcaattaggtc

SEQ ID NO: 646531 - DNA, 25 bp, Mus musculus
ggtatcactcctgagcaattaggtc

SEQ ID NO: 646532 - DNA, 25 bp, Mus musculus
ggtatcactctaaatttccagccca

SEQ ID NO: 646533 - DNA, 25 bp, Mus musculus
ggtatcactctatatttccagccca

SEQ ID NO: 646534 - DNA, 25 bp, Mus musculus
ggtatcactgttattggcaacaaat

SEQ ID NO: 646535 - DNA, 25 bp, Mus musculus
ggtatcactgtttttggcaacaaat

SEQ ID NO: 646536 - DNA, 25 bp, Mus musculus
ggtatcactttacgcagtttgccaa

SEQ ID NO: 646537 - DNA, 25 bp, Mus musculus
ggtatcactttaggcagtttgccaa

SEQ ID NO: 646538 - DNA, 25 bp, Mus musculus
ggtatcagcactccagatcagctct

SEQ ID NO: 646539 - DNA, 25 bp, Mus musculus
ggtatcagcactgcagatcagctct

SEQ ID NO: 646540 - DNA, 25 bp, Mus musculus
ggtatcagccccagacttagaacat

SEQ ID NO: 646541 - DNA, 25 bp, Mus musculus
ggtatcagcccctgacttagaacat

SEQ ID NO: 646542 - DNA, 25 bp, Mus musculus
ggtatcaggcaaaaagcagcaattt

SEQ ID NO: 646543 - DNA, 25 bp, Mus musculus
ggtatcaggcaataagcagcaattt

SEQ ID NO: 646544 - DNA, 25 bp, Mus musculus
ggtatcaggttcactgtaacccaag

SEQ ID NO: 646545 - DNA, 25 bp, Mus musculus
ggtatcaggttctctgtaacccaag

SEQ ID NO: 646546 - DNA, 25 bp, Mus musculus
ggtatcagtaaaagtcccctacaga

SEQ ID NO: 646547 - DNA, 25 bp, Mus musculus
ggtatcagtaaatgtcccctacaga

SEQ ID NO: 646548 - DNA, 25 bp, Mus musculus
ggtatcatagcccagtgaatttaaa

SEQ ID NO: 646549 - DNA, 25 bp, Mus musculus
ggtatcatagccgagtgaatttaaa

SEQ ID NO: 646550 - DNA, 25 bp, Mus musculus
ggtatcatctagcatctctcattta

SEQ ID NO: 646551 - DNA, 25 bp, Mus musculus
ggtatcatctaggatctctcattta

SEQ ID NO: 646552 - DNA, 25 bp, Mus musculus
ggtatcatctcaaatgcttcataac

SEQ ID NO: 646553 - DNA, 25 bp, Mus musculus
ggtatcatctcaccgggaaaatgga

SEQ ID NO: 646554 - DNA, 25 bp, Mus musculus
ggtatcatctcagcgggaaaatgga

SEQ ID NO: 646555 - DNA, 25 bp, Mus musculus
ggtatcatctcatatgcttcataac

SEQ ID NO: 646556 - DNA, 25 bp, Mus musculus
ggtatcatctgaacagtgcacccac

SEQ ID NO: 646557 - DNA, 25 bp, Mus musculus
ggtatcatctgatcagtgcacccac

SEQ ID NO: 646558 - DNA, 25 bp, Mus musculus
ggtatcatgaacaggatccttacaa

SEQ ID NO: 646559 - DNA, 25 bp, Mus musculus
ggtatcatgaactggatccttacaa

SEQ ID NO: 646560 - DNA, 25 bp, Mus musculus
ggtatcatggcacatcctcaggatc

SEQ ID NO: 646561 - DNA, 25 bp, Mus musculus
ggtatcatggcagatcctcaggatc

SEQ ID NO: 646562 - DNA, 25 bp, Mus musculus
ggtatcatgtgcactattgctggaa

SEQ ID NO: 646563 - DNA, 25 bp, Mus musculus
ggtatcatgtgctctattgctggaa

SEQ ID NO: 646564 - DNA, 25 bp, Mus musculus
ggtatcattcacagcccttaggcta

SEQ ID NO: 646565 - DNA, 25 bp, Mus musculus
ggtatcattcactgcccttaggcta

SEQ ID NO: 646566 - DNA, 25 bp, Mus musculus
ggtatcattgatctcctcatcgcca

SEQ ID NO: 646567 - DNA, 25 bp, Mus musculus
ggtatcattgatgtcctcatcgcca

SEQ ID NO: 646568 - DNA, 25 bp, Mus musculus
ggtatcattggtctttaccacaact

SEQ ID NO: 646569 - DNA, 25 bp, Mus musculus
ggtatcattggtgtttaccacaact

SEQ ID NO: 646570 - DNA, 25 bp, Mus musculus
ggtatccaaaacaacatcagtgctg

SEQ ID NO: 646571 - DNA, 25 bp, Mus musculus
ggtatccaaaactacatcagtgctg

SEQ ID NO: 646572 - DNA, 25 bp, Mus musculus
ggtatccaaggacaaccttgaattt

SEQ ID NO: 646573 - DNA, 25 bp, Mus musculus
ggtatccaaggagaaccttgaattt

SEQ ID NO: 646574 - DNA, 25 bp, Mus musculus
ggtatccagaccacagagaagccga

SEQ ID NO: 646575 - DNA, 25 bp, Mus musculus
ggtatccagacctcagagaagccga

SEQ ID NO: 646576 - DNA, 25 bp, Mus musculus
ggtatccagtggacttgcctaccag

SEQ ID NO: 646577 - DNA, 25 bp, Mus musculus
ggtatccagtggtcttgcctaccag

SEQ ID NO: 646578 - DNA, 25 bp, Mus musculus
ggtatccataacacctatttgaaac

SEQ ID NO: 646579 - DNA, 25 bp, Mus musculus
ggtatccataactcctatttgaaac

SEQ ID NO: 646580 - DNA, 25 bp, Mus musculus
ggtatcccaacaaaaccatctggag

SEQ ID NO: 646581 - DNA, 25 bp, Mus musculus
ggtatcccaacataaccatctggag

SEQ ID NO: 646582 - DNA, 25 bp, Mus musculus
ggtatcccaaccacagatagttcca

SEQ ID NO: 646583 - DNA, 25 bp, Mus musculus
ggtatcccaacctcagatagttcca

SEQ ID NO: 646584 - DNA, 25 bp, Mus musculus
ggtatcccagaaccgcagaggtaca

SEQ ID NO: 646585 - DNA, 25 bp, Mus musculus
ggtatcccagaagcgcagaggtaca

SEQ ID NO: 646586 - DNA, 25 bp, Mus musculus
ggtatcccataaccaattcataagt

SEQ ID NO: 646587 - DNA, 25 bp, Mus musculus
ggtatcccataagcaattcataagt

SEQ ID NO: 646588 - DNA, 25 bp, Mus musculus
ggtatcccgctgagaagtaagcttt

SEQ ID NO: 646589 - DNA, 25 bp, Mus musculus
ggtatcccgctgtgaagtaagcttt

SEQ ID NO: 646590 - DNA, 25 bp, Mus musculus
ggtatccctgggcgtgtgaaccaat

SEQ ID NO: 646591 - DNA, 25 bp, Mus musculus
ggtatccctgggggtgtgaaccaat

SEQ ID NO: 646592 - DNA, 25 bp, Mus musculus
ggtatccctgttattcctagagatc

SEQ ID NO: 646593 - DNA, 25 bp, Mus musculus
ggtatccctgtttttcctagagatc

SEQ ID NO: 646594 - DNA, 25 bp, Mus musculus
ggtatccgattgagcttcatggcat

SEQ ID NO: 646595 - DNA, 25 bp, Mus musculus
ggtatccgattgtgcttcatggcat

SEQ ID NO: 646596 - DNA, 25 bp, Mus musculus
ggtatccgtaccacagtgtcagtta

SEQ ID NO: 646597 - DNA, 25 bp, Mus musculus
ggtatccgtacctcagtgtcagtta

SEQ ID NO: 646598 - DNA, 25 bp, Mus musculus
ggtatcctaaccagtggccaatgca

SEQ ID NO: 646599 - DNA, 25 bp, Mus musculus
ggtatcctaacctgtggccaatgca

SEQ ID NO: 646600 - DNA, 25 bp, Mus musculus
ggtatcctacacaggcaggactgga

SEQ ID NO: 646601 - DNA, 25 bp, Mus musculus
ggtatcctacactggcaggactgga

SEQ ID NO: 646602 - DNA, 25 bp, Mus musculus
ggtatcctatgtacaggcggcacat

SEQ ID NO: 646603 - DNA, 25 bp, Mus musculus
ggtatcctatgttcaggcggcacat

SEQ ID NO: 646604 - DNA, 25 bp, Mus musculus
ggtatcctcatgctggctcattgga

SEQ ID NO: 646605 - DNA, 25 bp, Mus musculus
ggtatcctcatggtggctcattgga

SEQ ID NO: 646606 - DNA, 25 bp, Mus musculus
ggtatcctctcacacacatgactaa

SEQ ID NO: 646607 - DNA, 25 bp, Mus musculus
ggtatcctctcagacacatgactaa

SEQ ID NO: 646608 - DNA, 25 bp, Mus musculus
ggtatcctcttgctcaacagcaaat

SEQ ID NO: 646609 - DNA, 25 bp, Mus musculus
ggtatcctcttggtcaacagcaaat

SEQ ID NO: 646610 - DNA, 25 bp, Mus musculus
ggtatcctggccataggagccttta

SEQ ID NO: 646611 - DNA, 25 bp, Mus musculus
ggtatcctggccttaggagccttta

SEQ ID NO: 646612 - DNA, 25 bp, Mus musculus
ggtatcctgtatcgactacacctaa

SEQ ID NO: 646613 - DNA, 25 bp, Mus musculus
ggtatcctgtatggactacacctaa

SEQ ID NO: 646614 - DNA, 25 bp, Mus musculus
ggtatccttaggactgggctggctt

SEQ ID NO: 646615 - DNA, 25 bp, Mus musculus
ggtatccttaggtctgggctggctt

SEQ ID NO: 646616 - DNA, 25 bp, Mus musculus
ggtatcgagtacactggaccctgac

SEQ ID NO: 646617 - DNA, 25 bp, Mus musculus
ggtatcgagtactctggaccctgac

SEQ ID NO: 646618 - DNA, 25 bp, Mus musculus
ggtatcgcacatactctaaactgtc

SEQ ID NO: 646619 - DNA, 25 bp, Mus musculus
ggtatcgcacattctctaaactgtc

SEQ ID NO: 646620 - DNA, 25 bp, Mus musculus
ggtatcgctaccatcgtgaaagtcc

SEQ ID NO: 646621 - DNA, 25 bp, Mus musculus
ggtatcgctaccttcgtgaaagtcc

SEQ ID NO: 646622 - DNA, 25 bp, Mus musculus
ggtatcgctggaccacggatcgcaa

SEQ ID NO: 646623 - DNA, 25 bp, Mus musculus
ggtatcgctggagcacggatcgcaa

SEQ ID NO: 646624 - DNA, 25 bp, Mus musculus
ggtatcgcttggcaggccaccgcct

SEQ ID NO: 646625 - DNA, 25 bp, Mus musculus
ggtatcgcttgggaggccaccgcct

SEQ ID NO: 646626 - DNA, 25 bp, Mus musculus
ggtatcggcctcaaggactgaagca

SEQ ID NO: 646627 - DNA, 25 bp, Mus musculus
ggtatcggcctctaggactgaagca

SEQ ID NO: 646628 - DNA, 25 bp, Mus musculus
ggtatcggcgacatgatttatttca

SEQ ID NO: 646629 - DNA, 25 bp, Mus musculus
ggtatcggcgacttgatttatttca

SEQ ID NO: 646630 - DNA, 25 bp, Mus musculus
ggtatctacagaatggagccactac

SEQ ID NO: 646631 - DNA, 25 bp, Mus musculus
ggtatctacagattggagccactac

SEQ ID NO: 646632 - DNA, 25 bp, Mus musculus
ggtatctacccaacatttgtactgt

SEQ ID NO: 646633 - DNA, 25 bp, Mus musculus
ggtatctacccatcatttgtactgt

SEQ ID NO: 646634 - DNA, 25 bp, Mus musculus
ggtatctattttcacagaacagagt

SEQ ID NO: 646635 - DNA, 25 bp, Mus musculus
ggtatctattttgacagaacagagt

SEQ ID NO: 646636 - DNA, 25 bp, Mus musculus
ggtatctcaataactctaggcacta

SEQ ID NO: 646637 - DNA, 25 bp, Mus musculus
ggtatctcaatatctctaggcacta

SEQ ID NO: 646638 - DNA, 25 bp, Mus musculus
ggtatctcaatgcatgccacccctt

SEQ ID NO: 646639 - DNA, 25 bp, Mus musculus
ggtatctcaatggatgccacccctt

SEQ ID NO: 646640 - DNA, 25 bp, Mus musculus
ggtatctcaccacgcagcttactta

SEQ ID NO: 646641 - DNA, 25 bp, Mus musculus
ggtatctcaccaggcagcttactta

SEQ ID NO: 646642 - DNA, 25 bp, Mus musculus
ggtatctcagaaaaactttcccttt

SEQ ID NO: 646643 - DNA, 25 bp, Mus musculus
ggtatctcagaataactttcccttt

SEQ ID NO: 646644 - DNA, 25 bp, Mus musculus
ggtatctcatgtatgtaatcccaac

SEQ ID NO: 646645 - DNA, 25 bp, Mus musculus
ggtatctcatgtttgtaatcccaac

SEQ ID NO: 646646 - DNA, 25 bp, Mus musculus
ggtatctcattaatgcttatgaatt

SEQ ID NO: 646647 - DNA, 25 bp, Mus musculus
ggtatctcattattgcttatgaatt

SEQ ID NO: 646648 - DNA, 25 bp, Mus musculus
ggtatctccagtccagagtctggat

SEQ ID NO: 646649 - DNA, 25 bp, Mus musculus
ggtatctccagtgcagagtctggat

SEQ ID NO: 646650 - DNA, 25 bp, Mus musculus
ggtatctccccaatctacacagaga

SEQ ID NO: 646651 - DNA, 25 bp, Mus musculus
ggtatctccccattctacacagaga

SEQ ID NO: 646652 - DNA, 25 bp, Mus musculus
ggtatctcggtactctttctccact

SEQ ID NO: 646653 - DNA, 25 bp, Mus musculus
ggtatctcggtagtctttctccact

SEQ ID NO: 646654 - DNA, 25 bp, Mus musculus
ggtatctctcgtattatgtatgtat

SEQ ID NO: 646655 - DNA, 25 bp, Mus musculus
ggtatctctcgttttatgtatgtat

SEQ ID NO: 646656 - DNA, 25 bp, Mus musculus
ggtatctctctcaaaggcacagtgg

SEQ ID NO: 646657 - DNA, 25 bp, Mus musculus
ggtatctctctctaaggcacagtgg

SEQ ID NO: 646658 - DNA, 25 bp, Mus musculus
ggtatctctgaaaactctgtactca

SEQ ID NO: 646659 - DNA, 25 bp, Mus musculus
ggtatctctgaatactctgtactca

SEQ ID NO: 646660 - DNA, 25 bp, Mus musculus
ggtatctcttcacagcgatggaatc

SEQ ID NO: 646661 - DNA, 25 bp, Mus musculus
ggtatctcttcagagcgatggaatc

SEQ ID NO: 646662 - DNA, 25 bp, Mus musculus
ggtatctgaactccagctcaaaggg

SEQ ID NO: 646663 - DNA, 25 bp, Mus musculus
ggtatctgaactgcagctcaaaggg

SEQ ID NO: 646664 - DNA, 25 bp, Mus musculus
ggtatctgaattcaccatttgccca

SEQ ID NO: 646665 - DNA, 25 bp, Mus musculus
ggtatctgaattgaccatttgccca

SEQ ID NO: 646666 - DNA, 25 bp, Mus musculus
ggtatctgacataggagccaccaaa

SEQ ID NO: 646667 - DNA, 25 bp, Mus musculus
ggtatctgacattggagccaccaaa

SEQ ID NO: 646668 - DNA, 25 bp, Mus musculus
ggtatctgactactgccaacatccc

SEQ ID NO: 646669 - DNA, 25 bp, Mus musculus
ggtatctgactagtgccaacatccc

SEQ ID NO: 646670 - DNA, 25 bp, Mus musculus
ggtatctgagatacgggagtcccag

SEQ ID NO: 646671 - DNA, 25 bp, Mus musculus
ggtatctgagattcgggagtcccag

SEQ ID NO: 646672 - DNA, 25 bp, Mus musculus
ggtatctggaccagactggctctgg

SEQ ID NO: 646673 - DNA, 25 bp, Mus musculus
ggtatctggacctgactggctctgg

SEQ ID NO: 646674 - DNA, 25 bp, Mus musculus
ggtatctggatgatcactttcccac

SEQ ID NO: 646675 - DNA, 25 bp, Mus musculus
ggtatctggatgttcactttcccac

SEQ ID NO: 646676 - DNA, 25 bp, Mus musculus
ggtatctgtaacaatctgtaaactc

SEQ ID NO: 646677 - DNA, 25 bp, Mus musculus
ggtatctgtaactatctgtaaactc

SEQ ID NO: 646678 - DNA, 25 bp, Mus musculus
ggtatctgtatactgtccaagtctt

SEQ ID NO: 646679 - DNA, 25 bp, Mus musculus
ggtatctgtatagtgtccaagtctt

SEQ ID NO: 646680 - DNA, 25 bp, Mus musculus
ggtatctgtcacaatcacctcttgt

SEQ ID NO: 646681 - DNA, 25 bp, Mus musculus
ggtatctgtcactatcacctcttgt

SEQ ID NO: 646682 - DNA, 25 bp, Mus musculus
ggtatctgtcggattgcaaaagtaa

SEQ ID NO: 646683 - DNA, 25 bp, Mus musculus
ggtatctgtcggtttgcaaaagtaa

SEQ ID NO: 646684 - DNA, 25 bp, Mus musculus
ggtatctgttgacaccaggacaggt

SEQ ID NO: 646685 - DNA, 25 bp, Mus musculus
ggtatctgttgagaccaggacaggt

SEQ ID NO: 646686 - DNA, 25 bp, Mus musculus
ggtatcttactaacagttccaccgc

SEQ ID NO: 646687 - DNA, 25 bp, Mus musculus
ggtatcttactatcagttccaccgc

SEQ ID NO: 646688 - DNA, 25 bp, Mus musculus
ggtatcttcattcgccaagtgacag

SEQ ID NO: 646689 - DNA, 25 bp, Mus musculus
ggtatcttcattggccaagtgacag

SEQ ID NO: 646690 - DNA, 25 bp, Mus musculus
ggtatcttgtacattagttcctcct

SEQ ID NO: 646691 - DNA, 25 bp, Mus musculus
ggtatcttgtactttagttcctcct

SEQ ID NO: 646692 - DNA, 25 bp, Mus musculus
ggtatctttaaaaagacattagaca

SEQ ID NO: 646693 - DNA, 25 bp, Mus musculus
ggtatctttaaatagacattagaca

SEQ ID NO: 646694 - DNA, 25 bp, Mus musculus
ggtatctttcagagtgccaagtgat

SEQ ID NO: 646695 - DNA, 25 bp, Mus musculus
ggtatctttcagtgtgccaagtgat

SEQ ID NO: 646696 - DNA, 25 bp, Mus musculus
ggtatctttgccactagttctatag

SEQ ID NO: 646697 - DNA, 25 bp, Mus musculus
ggtatctttgcctctagttctatag

SEQ ID NO: 646698 - DNA, 25 bp, Mus musculus
ggtatcttttgtaccactgtgttac

SEQ ID NO: 646699 - DNA, 25 bp, Mus musculus
ggtatcttttgttccactgtgttac

SEQ ID NO: 646700 - DNA, 25 bp, Mus musculus
ggtatgaaatccaggcacttgaaca

SEQ ID NO: 646701 - DNA, 25 bp, Mus musculus
ggtatgaaatcctggcacttgaaca

SEQ ID NO: 646702 - DNA, 25 bp, Mus musculus
ggtatgaacagcaatctctaaaaca

SEQ ID NO: 646703 - DNA, 25 bp, Mus musculus
ggtatgaacagctatctctaaaaca

SEQ ID NO: 646704 - DNA, 25 bp, Mus musculus
ggtatgaaccaacaggcatatgcat

SEQ ID NO: 646705 - DNA, 25 bp, Mus musculus
ggtatgaaccaagaggcatatgcat

SEQ ID NO: 646706 - DNA, 25 bp, Mus musculus
ggtatgaacctaagtttgcccaatc

SEQ ID NO: 646707 - DNA, 25 bp, Mus musculus
ggtatgaacctatgtttgcccaatc

SEQ ID NO: 646708 - DNA, 25 bp, Mus musculus
ggtatgaactaaccctgggctgtcc

SEQ ID NO: 646709 - DNA, 25 bp, Mus musculus
ggtatgaactaagcctgggctgtcc

SEQ ID NO: 646710 - DNA, 25 bp, Mus musculus
ggtatgaatagcaagttgtttgtta

SEQ ID NO: 646711 - DNA, 25 bp, Mus musculus
ggtatgaatagctagttgtttgtta

SEQ ID NO: 646712 - DNA, 25 bp, Mus musculus
ggtatgaatcctatactcttggcct

SEQ ID NO: 646713 - DNA, 25 bp, Mus musculus
ggtatgaatcctttactcttggcct

SEQ ID NO: 646714 - DNA, 25 bp, Mus musculus
ggtatgaatcttacccaggaggtgt

SEQ ID NO: 646715 - DNA, 25 bp, Mus musculus
ggtatgaatctttcccaggaggtgt

SEQ ID NO: 646716 - DNA, 25 bp, Mus musculus
ggtatgacacagaggtaggtctcac

SEQ ID NO: 646717 - DNA, 25 bp, Mus musculus
ggtatgacacagtggtaggtctcac

SEQ ID NO: 646718 - DNA, 25 bp, Mus musculus
ggtatgaccataccactggttttgt

SEQ ID NO: 646719 - DNA, 25 bp, Mus musculus
ggtatgaccatagcactggttttgt

SEQ ID NO: 646720 - DNA, 25 bp, Mus musculus
ggtatgaccatgagagccttttcag

SEQ ID NO: 646721 - DNA, 25 bp, Mus musculus
ggtatgaccatgtgagccttttcag

SEQ ID NO: 646722 - DNA, 25 bp, Mus musculus
ggtatgaccccgctgaagcagaagc

SEQ ID NO: 646723 - DNA, 25 bp, Mus musculus
ggtatgaccccggtgaagcagaagc

SEQ ID NO: 646724 - DNA, 25 bp, Mus musculus
ggtatgaccctaatggagtagctgt

SEQ ID NO: 646725 - DNA, 25 bp, Mus musculus
ggtatgaccctattggagtagctgt

SEQ ID NO: 646726 - DNA, 25 bp, Mus musculus
ggtatgactagacttccgaacctca

SEQ ID NO: 646727 - DNA, 25 bp, Mus musculus
ggtatgactagagttccgaacctca

SEQ ID NO: 646728 - DNA, 25 bp, Mus musculus
ggtatgactgatatatctgtacatc

SEQ ID NO: 646729 - DNA, 25 bp, Mus musculus
ggtatgactgatttatctgtacatc

SEQ ID NO: 646730 - DNA, 25 bp, Mus musculus
ggtatgacttgcctgtgttgttata

SEQ ID NO: 646731 - DNA, 25 bp, Mus musculus
ggtatgacttgcgtgtgttgttata

SEQ ID NO: 646732 - DNA, 25 bp, Mus musculus
ggtatgacttggaatctttgccatt

SEQ ID NO: 646733 - DNA, 25 bp, Mus musculus
ggtatgacttggtatctttgccatt

SEQ ID NO: 646734 - DNA, 25 bp, Mus musculus
ggtatgagcaccaaacttcttatga

SEQ ID NO: 646735 - DNA, 25 bp, Mus musculus
ggtatgagcacctaacttcttatga

SEQ ID NO: 646736 - DNA, 25 bp, Mus musculus
ggtatgagcagtctacctgaccaat

SEQ ID NO: 646737 - DNA, 25 bp, Mus musculus
ggtatgagcagtgtacctgaccaat

SEQ ID NO: 646738 - DNA, 25 bp, Mus musculus
ggtatgagccaaaccctcttgaaca

SEQ ID NO: 646739 - DNA, 25 bp, Mus musculus
ggtatgagccaatccctcttgaaca

SEQ ID NO: 646740 - DNA, 25 bp, Mus musculus
ggtatgagccacagcagaaattcct

SEQ ID NO: 646741 - DNA, 25 bp, Mus musculus
ggtatgagccactgcagaaattcct

SEQ ID NO: 646742 - DNA, 25 bp, Mus musculus
ggtatgagctataccaagatgcaca

SEQ ID NO: 646743 - DNA, 25 bp, Mus musculus
ggtatgagctattccaagatgcaca

SEQ ID NO: 646744 - DNA, 25 bp, Mus musculus
ggtatgagctctcactgaaggcgct

SEQ ID NO: 646745 - DNA, 25 bp, Mus musculus
ggtatgagctctgactgaaggcgct

SEQ ID NO: 646746 - DNA, 25 bp, Mus musculus
ggtatgatcaagactccgaggctcc

SEQ ID NO: 646747 - DNA, 25 bp, Mus musculus
ggtatgatcaagtctccgaggctcc

SEQ ID NO: 646748 - DNA, 25 bp, Mus musculus
ggtatgattggaccccatccgaggt

SEQ ID NO: 646749 - DNA, 25 bp, Mus musculus
ggtatgattggagcccatccgaggt

SEQ ID NO: 646750 - DNA, 25 bp, Mus musculus
ggtatgcaaaaaactagcctcaaag

SEQ ID NO: 646751 - DNA, 25 bp, Mus musculus
ggtatgcaaaaatctagcctcaaag

SEQ ID NO: 646752 - DNA, 25 bp, Mus musculus
ggtatgcaaggtataatcccaacac

SEQ ID NO: 646753 - DNA, 25 bp, Mus musculus
ggtatgcaaggtttaatcccaacac

SEQ ID NO: 646754 - DNA, 25 bp, Mus musculus
ggtatgcaataccatgcctgtgcgt

SEQ ID NO: 646755 - DNA, 25 bp, Mus musculus
ggtatgcaatacgatgcctgtgcgt

SEQ ID NO: 646756 - DNA, 25 bp, Mus musculus
ggtatgcacaggaatttaccctctc

SEQ ID NO: 646757 - DNA, 25 bp, Mus musculus
ggtatgcacaggtatttaccctctc

SEQ ID NO: 646758 - DNA, 25 bp, Mus musculus
ggtatgcaccacaacattaactaca

SEQ ID NO: 646759 - DNA, 25 bp, Mus musculus
ggtatgcaccactacattaactaca

SEQ ID NO: 646760 - DNA, 25 bp, Mus musculus
ggtatgcacctaacaacttgggagt

SEQ ID NO: 646761 - DNA, 25 bp, Mus musculus
ggtatgcacctatcaacttgggagt

SEQ ID NO: 646762 - DNA, 25 bp, Mus musculus
ggtatgcatttaacctagtgctagc

SEQ ID NO: 646763 - DNA, 25 bp, Mus musculus
ggtatgcatttaatttccagactaa

SEQ ID NO: 646764 - DNA, 25 bp, Mus musculus
ggtatgcatttatcctagtgctagc

SEQ ID NO: 646765 - DNA, 25 bp, Mus musculus
ggtatgcatttattttccagactaa

SEQ ID NO: 646766 - DNA, 25 bp, Mus musculus
ggtatgccaataaagcgtttttatg

SEQ ID NO: 646767 - DNA, 25 bp, Mus musculus
ggtatgccaatacccattgctgtgc

SEQ ID NO: 646768 - DNA, 25 bp, Mus musculus
ggtatgccaatagccattgctgtgc

SEQ ID NO: 646769 - DNA, 25 bp, Mus musculus
ggtatgccaatatagcgtttttatg

SEQ ID NO: 646770 - DNA, 25 bp, Mus musculus
ggtatgccaatgaatccggctccac

SEQ ID NO: 646771 - DNA, 25 bp, Mus musculus
ggtatgccaatgtatccggctccac

SEQ ID NO: 646772 - DNA, 25 bp, Mus musculus
ggtatgccacatagtgcatgtctgc

SEQ ID NO: 646773 - DNA, 25 bp, Mus musculus
ggtatgccacattgtgcatgtctgc

SEQ ID NO: 646774 - DNA, 25 bp, Mus musculus
ggtatgcgagcgaatcccaactata

SEQ ID NO: 646775 - DNA, 25 bp, Mus musculus
ggtatgcgagcgtatcccaactata

SEQ ID NO: 646776 - DNA, 25 bp, Mus musculus
ggtatgcgccacatctgtgaaaaca

SEQ ID NO: 646777 - DNA, 25 bp, Mus musculus
ggtatgcgccacttctgtgaaaaca

SEQ ID NO: 646778 - DNA, 25 bp, Mus musculus
ggtatgctacatacttgtttcctcc

SEQ ID NO: 646779 - DNA, 25 bp, Mus musculus
ggtatgctacattcttgtttcctcc

SEQ ID NO: 646780 - DNA, 25 bp, Mus musculus
ggtatgctcattacaacattcttta

SEQ ID NO: 646781 - DNA, 25 bp, Mus musculus
ggtatgctcatttcaacattcttta

SEQ ID NO: 646782 - DNA, 25 bp, Mus musculus
ggtatgctccccatataaccatcga

SEQ ID NO: 646783 - DNA, 25 bp, Mus musculus
ggtatgctccccttataaccatcga

SEQ ID NO: 646784 - DNA, 25 bp, Mus musculus
ggtatgctgaatattgcttacacat

SEQ ID NO: 646785 - DNA, 25 bp, Mus musculus
ggtatgctgaattttgcttacacat

SEQ ID NO: 646786 - DNA, 25 bp, Mus musculus
ggtatgctgcaaacacaaagtggtg

SEQ ID NO: 646787 - DNA, 25 bp, Mus musculus
ggtatgctgcaatcacaaagtggtg

SEQ ID NO: 646788 - DNA, 25 bp, Mus musculus
ggtatgctggtaatcactcttgtat

SEQ ID NO: 646789 - DNA, 25 bp, Mus musculus
ggtatgctggtattcactcttgtat

SEQ ID NO: 646790 - DNA, 25 bp, Mus musculus
ggtatgcttaccagctacagaagta

SEQ ID NO: 646791 - DNA, 25 bp, Mus musculus
ggtatgcttacctgctacagaagta

SEQ ID NO: 646792 - DNA, 25 bp, Mus musculus
ggtatgcttagtatactccagccta

SEQ ID NO: 646793 - DNA, 25 bp, Mus musculus
ggtatgcttagtttactccagccta

SEQ ID NO: 646794 - DNA, 25 bp, Mus musculus
ggtatgcttttaacacccaggtgag

SEQ ID NO: 646795 - DNA, 25 bp, Mus musculus
ggtatgcttttatcacccaggtgag

SEQ ID NO: 646796 - DNA, 25 bp, Mus musculus
ggtatgcttttcacaaagctgctat

SEQ ID NO: 646797 - DNA, 25 bp, Mus musculus
ggtatgcttttcacgtgttatttaa

SEQ ID NO: 646798 - DNA, 25 bp, Mus musculus
ggtatgcttttctcaaagctgctat

SEQ ID NO: 646799 - DNA, 25 bp, Mus musculus
ggtatgcttttctcgtgttatttaa

SEQ ID NO: 646800 - DNA, 25 bp, Mus musculus
ggtatggacccaacatttctagtct

SEQ ID NO: 646801 - DNA, 25 bp, Mus musculus
ggtatggacccatcatttctagtct

SEQ ID NO: 646802 - DNA, 25 bp, Mus musculus
ggtatggatcagatttgctcagttt

SEQ ID NO: 646803 - DNA, 25 bp, Mus musculus
ggtatggatcagttttgctcagttt

SEQ ID NO: 646804 - DNA, 25 bp, Mus musculus
ggtatggcccaaacactgaatcaga

SEQ ID NO: 646805 - DNA, 25 bp, Mus musculus
ggtatggcccaatcactgaatcaga

SEQ ID NO: 646806 - DNA, 25 bp, Mus musculus
ggtatggctaacatagctttacaat

SEQ ID NO: 646807 - DNA, 25 bp, Mus musculus
ggtatggctaacttagctttacaat

SEQ ID NO: 646808 - DNA, 25 bp, Mus musculus
ggtatggctcagagcccaggcaaac

SEQ ID NO: 646809 - DNA, 25 bp, Mus musculus
ggtatggctcagtgcccaggcaaac

SEQ ID NO: 646810 - DNA, 25 bp, Mus musculus
ggtatggctcataaagctcctattt

SEQ ID NO: 646811 - DNA, 25 bp, Mus musculus
ggtatggctcattaagctcctattt

SEQ ID NO: 646812 - DNA, 25 bp, Mus musculus
ggtatggctgtacactggctcacac

SEQ ID NO: 646813 - DNA, 25 bp, Mus musculus
ggtatggctgtagactggctcacac

SEQ ID NO: 646814 - DNA, 25 bp, Mus musculus
ggtatggcttaaaggcaggtagact

SEQ ID NO: 646815 - DNA, 25 bp, Mus musculus
ggtatggcttaatggcaggtagact

SEQ ID NO: 646816 - DNA, 25 bp, Mus musculus
ggtatggcttagaatacttcccaaa

SEQ ID NO: 646817 - DNA, 25 bp, Mus musculus
ggtatggcttagtatacttcccaaa

SEQ ID NO: 646818 - DNA, 25 bp, Mus musculus
ggtatggcttgtcttcctgaggaat

SEQ ID NO: 646819 - DNA, 25 bp, Mus musculus
ggtatggcttgtgttcctgaggaat

SEQ ID NO: 646820 - DNA, 25 bp, Mus musculus
ggtatgggctaaatctttcctgtcc

SEQ ID NO: 646821 - DNA, 25 bp, Mus musculus
ggtatgggctaattctttcctgtcc

SEQ ID NO: 646822 - DNA, 25 bp, Mus musculus
ggtatgggtgctaatgagtcatcat

SEQ ID NO: 646823 - DNA, 25 bp, Mus musculus
ggtatgggtgcttatgagtcatcat

SEQ ID NO: 646824 - DNA, 25 bp, Mus musculus
ggtatggtaccgaacgacttatccg

SEQ ID NO: 646825 - DNA, 25 bp, Mus musculus
ggtatggtaccgtacgacttatccg

SEQ ID NO: 646826 - DNA, 25 bp, Mus musculus
ggtatggtatcaaacatccctaacc

SEQ ID NO: 646827 - DNA, 25 bp, Mus musculus
ggtatggtatcatacatccctaacc

SEQ ID NO: 646828 - DNA, 25 bp, Mus musculus
ggtatggtttaccttatcccagcca

SEQ ID NO: 646829 - DNA, 25 bp, Mus musculus
ggtatggtttacgttatcccagcca

SEQ ID NO: 646830 - DNA, 25 bp, Mus musculus
ggtatgtaagtactcctcaaaatta

SEQ ID NO: 646831 - DNA, 25 bp, Mus musculus
ggtatgtaagtagtcctcaaaatta

SEQ ID NO: 646832 - DNA, 25 bp, Mus musculus
ggtatgtaagtgatagagcccctac

SEQ ID NO: 646833 - DNA, 25 bp, Mus musculus
ggtatgtaagtgttagagcccctac

SEQ ID NO: 646834 - DNA, 25 bp, Mus musculus
ggtatgtaattcagtttatatgcaa

SEQ ID NO: 646835 - DNA, 25 bp, Mus musculus
ggtatgtaattctgtttatatgcaa

SEQ ID NO: 646836 - DNA, 25 bp, Mus musculus
ggtatgtacctaaagtcacagctac

SEQ ID NO: 646837 - DNA, 25 bp, Mus musculus
ggtatgtacctatagtcacagctac

SEQ ID NO: 646838 - DNA, 25 bp, Mus musculus
ggtatgtagcgtcatctgtaatcca

SEQ ID NO: 646839 - DNA, 25 bp, Mus musculus
ggtatgtagcgtgatctgtaatcca

SEQ ID NO: 646840 - DNA, 25 bp, Mus musculus
ggtatgtagtaacctcctgtctcac

SEQ ID NO: 646841 - DNA, 25 bp, Mus musculus
ggtatgtagtaagctcctgtctcac

SEQ ID NO: 646842 - DNA, 25 bp, Mus musculus
ggtatgtagtgcagagatggacccc

SEQ ID NO: 646843 - DNA, 25 bp, Mus musculus
ggtatgtagtgctgagatggacccc

SEQ ID NO: 646844 - DNA, 25 bp, Mus musculus
ggtatgtagttcatggctctgccat

SEQ ID NO: 646845 - DNA, 25 bp, Mus musculus
ggtatgtagttcttggctctgccat

SEQ ID NO: 646846 - DNA, 25 bp, Mus musculus
ggtatgtatcagctaaggcccaaga

SEQ ID NO: 646847 - DNA, 25 bp, Mus musculus
ggtatgtatcaggtaaggcccaaga

SEQ ID NO: 646848 - DNA, 25 bp, Mus musculus
ggtatgtcagacctaaaggctgctg

SEQ ID NO: 646849 - DNA, 25 bp, Mus musculus
ggtatgtcagacgtaaaggctgctg

SEQ ID NO: 646850 - DNA, 25 bp, Mus musculus
ggtatgtcagcacttttgtcctgta

SEQ ID NO: 646851 - DNA, 25 bp, Mus musculus
ggtatgtcagcagttttgtcctgta

SEQ ID NO: 646852 - DNA, 25 bp, Mus musculus
ggtatgtcagccatggagtgcccac

SEQ ID NO: 646853 - DNA, 25 bp, Mus musculus
ggtatgtcagccttggagtgcccac

SEQ ID NO: 646854 - DNA, 25 bp, Mus musculus
ggtatgtccactaccatcaccagat

SEQ ID NO: 646855 - DNA, 25 bp, Mus musculus
ggtatgtccacttccatcaccagat

SEQ ID NO: 646856 - DNA, 25 bp, Mus musculus
ggtatgtctcacacaggaggtcggc

SEQ ID NO: 646857 - DNA, 25 bp, Mus musculus
ggtatgtctcactcaggaggtcggc

SEQ ID NO: 646858 - DNA, 25 bp, Mus musculus
ggtatgtctcatatactaggccaga

SEQ ID NO: 646859 - DNA, 25 bp, Mus musculus
ggtatgtctcatttactaggccaga

SEQ ID NO: 646860 - DNA, 25 bp, Mus musculus
ggtatgtctgtaccagctggtttgt

SEQ ID NO: 646861 - DNA, 25 bp, Mus musculus
ggtatgtctgtagcagctggtttgt

SEQ ID NO: 646862 - DNA, 25 bp, Mus musculus
ggtatgtctttacaccatgtctgtt

SEQ ID NO: 646863 - DNA, 25 bp, Mus musculus
ggtatgtctttagaccatgtctgtt

SEQ ID NO: 646864 - DNA, 25 bp, Mus musculus
ggtatgtgccaccaacctagctgca

SEQ ID NO: 646865 - DNA, 25 bp, Mus musculus
ggtatgtgccacgaacctagctgca

SEQ ID NO: 646866 - DNA, 25 bp, Mus musculus
ggtatgtgcctaagtgcctgtctcc

SEQ ID NO: 646867 - DNA, 25 bp, Mus musculus
ggtatgtgcctatgtgcctgtctcc

SEQ ID NO: 646868 - DNA, 25 bp, Mus musculus
ggtatgtgctgcctaacttactaca

SEQ ID NO: 646869 - DNA, 25 bp, Mus musculus
ggtatgtgctgcgtaacttactaca

SEQ ID NO: 646870 - DNA, 25 bp, Mus musculus
ggtatgtgtgtgaatccaacttaaa

SEQ ID NO: 646871 - DNA, 25 bp, Mus musculus
ggtatgtgtgtgtatccaacttaaa

SEQ ID NO: 646872 - DNA, 25 bp, Mus musculus
ggtatgtgttctacgtgggccctca

SEQ ID NO: 646873 - DNA, 25 bp, Mus musculus
ggtatgtgttcttcgtgggccctca

SEQ ID NO: 646874 - DNA, 25 bp, Mus musculus
ggtatgttacctactgaaaccgatg

SEQ ID NO: 646875 - DNA, 25 bp, Mus musculus
ggtatgttaccttctgaaaccgatg

SEQ ID NO: 646876 - DNA, 25 bp, Mus musculus
ggtatgttagcccacactcatgatc

SEQ ID NO: 646877 - DNA, 25 bp, Mus musculus
ggtatgttagccgacactcatgatc

SEQ ID NO: 646878 - DNA, 25 bp, Mus musculus
ggtatgttcaggcttccatgccagc

SEQ ID NO: 646879 - DNA, 25 bp, Mus musculus
ggtatgttcagggttccatgccagc

SEQ ID NO: 646880 - DNA, 25 bp, Mus musculus
ggtatgttcagtccggccttggcct

SEQ ID NO: 646881 - DNA, 25 bp, Mus musculus
ggtatgttcagtgcggccttggcct

SEQ ID NO: 646882 - DNA, 25 bp, Mus musculus
ggtattaaaggacctcgtcaccata

SEQ ID NO: 646883 - DNA, 25 bp, Mus musculus
ggtattaaaggagctcgtcaccata

SEQ ID NO: 646884 - DNA, 25 bp, Mus musculus
ggtattaactctaccatcatttcat

SEQ ID NO: 646885 - DNA, 25 bp, Mus musculus
ggtattaactcttccatcatttcat

SEQ ID NO: 646886 - DNA, 25 bp, Mus musculus
ggtattacagcaaattggctccctc

SEQ ID NO: 646887 - DNA, 25 bp, Mus musculus
ggtattacagcatattggctccctc

SEQ ID NO: 646888 - DNA, 25 bp, Mus musculus
ggtattacagccattgcctttacag

SEQ ID NO: 646889 - DNA, 25 bp, Mus musculus
ggtattacagcctttgcctttacag

SEQ ID NO: 646890 - DNA, 25 bp, Mus musculus
ggtattacaggaagctctgcaccac

SEQ ID NO: 646891 - DNA, 25 bp, Mus musculus
ggtattacaggatgctctgcaccac

SEQ ID NO: 646892 - DNA, 25 bp, Mus musculus
ggtattaccaaaccacacatttgta

SEQ ID NO: 646893 - DNA, 25 bp, Mus musculus
ggtattaccaaagcacacatttgta

SEQ ID NO: 646894 - DNA, 25 bp, Mus musculus
ggtattacctcactattcatgcact

SEQ ID NO: 646895 - DNA, 25 bp, Mus musculus
ggtattacctcagtattcatgcact

SEQ ID NO: 646896 - DNA, 25 bp, Mus musculus
ggtattacctctatacaactgtaca

SEQ ID NO: 646897 - DNA, 25 bp, Mus musculus
ggtattacctctttacaactgtaca

SEQ ID NO: 646898 - DNA, 25 bp, Mus musculus
ggtattaccttcagctacatgcaga

SEQ ID NO: 646899 - DNA, 25 bp, Mus musculus
ggtattaccttctgctacatgcaga

SEQ ID NO: 646900 - DNA, 25 bp, Mus musculus
ggtattacgcatcggtcacctcaag

SEQ ID NO: 646901 - DNA, 25 bp, Mus musculus
ggtattacgcatgggtcacctcaag

SEQ ID NO: 646902 - DNA, 25 bp, Mus musculus
ggtattactactagaaattctcttc

SEQ ID NO: 646903 - DNA, 25 bp, Mus musculus
ggtattactacttgaaattctcttc

SEQ ID NO: 646904 - DNA, 25 bp, Mus musculus
ggtattactcatatgctttgcttgc

SEQ ID NO: 646905 - DNA, 25 bp, Mus musculus
ggtattactcatttgctttgcttgc

SEQ ID NO: 646906 - DNA, 25 bp, Mus musculus
ggtattagacctatccttacacaga

SEQ ID NO: 646907 - DNA, 25 bp, Mus musculus
ggtattagacctttccttacacaga

SEQ ID NO: 646908 - DNA, 25 bp, Mus musculus
ggtattagactaagaacagctcaga

SEQ ID NO: 646909 - DNA, 25 bp, Mus musculus
ggtattagactatgaacagctcaga

SEQ ID NO: 646910 - DNA, 25 bp, Mus musculus
ggtattagcagtcttatcaacatct

SEQ ID NO: 646911 - DNA, 25 bp, Mus musculus
ggtattagcagtgttatcaacatct

SEQ ID NO: 646912 - DNA, 25 bp, Mus musculus
ggtattaggcctatagtcttcttca

SEQ ID NO: 646913 - DNA, 25 bp, Mus musculus
ggtattaggcctttagtcttcttca

SEQ ID NO: 646914 - DNA, 25 bp, Mus musculus
ggtattagttcacaggcaggcctag

SEQ ID NO: 646915 - DNA, 25 bp, Mus musculus
ggtattagttcagaggcaggcctag

SEQ ID NO: 646916 - DNA, 25 bp, Mus musculus
ggtattatacaacactctgagctgg

SEQ ID NO: 646917 - DNA, 25 bp, Mus musculus
ggtattatacaagactctgagctgg

SEQ ID NO: 646918 - DNA, 25 bp, Mus musculus
ggtattatattcatttgtttcacta

SEQ ID NO: 646919 - DNA, 25 bp, Mus musculus
ggtattatattcttttgtttcacta

SEQ ID NO: 646920 - DNA, 25 bp, Mus musculus
ggtattatcagtctgatccctctct

SEQ ID NO: 646921 - DNA, 25 bp, Mus musculus
ggtattatcagtgtgatccctctct

SEQ ID NO: 646922 - DNA, 25 bp, Mus musculus
ggtattatccctcatgatcctttga

SEQ ID NO: 646923 - DNA, 25 bp, Mus musculus
ggtattatccctgatgatcctttga

SEQ ID NO: 646924 - DNA, 25 bp, Mus musculus
ggtattatctgtacaatttttcaat

SEQ ID NO: 646925 - DNA, 25 bp, Mus musculus
ggtattatctgttcaatttttcaat

SEQ ID NO: 646926 - DNA, 25 bp, Mus musculus
ggtattatgatccttttcattaacc

SEQ ID NO: 646927 - DNA, 25 bp, Mus musculus
ggtattatgatcgttttcattaacc

SEQ ID NO: 646928 - DNA, 25 bp, Mus musculus
ggtattattgatctacagacttgtc

SEQ ID NO: 646929 - DNA, 25 bp, Mus musculus
ggtattattgatgtacagacttgtc

SEQ ID NO: 646930 - DNA, 25 bp, Mus musculus
ggtattatttctcaatgccagcaag

SEQ ID NO: 646931 - DNA, 25 bp, Mus musculus
ggtattatttctgaatgccagcaag

SEQ ID NO: 646932 - DNA, 25 bp, Mus musculus
ggtattcaaagacctgtccacggag

SEQ ID NO: 646933 - DNA, 25 bp, Mus musculus
ggtattcaaagagctgtccacggag

SEQ ID NO: 646934 - DNA, 25 bp, Mus musculus
ggtattcaaggtacctactgctagc

SEQ ID NO: 646935 - DNA, 25 bp, Mus musculus
ggtattcaaggttcctactgctagc

SEQ ID NO: 646936 - DNA, 25 bp, Mus musculus
ggtattcacgaacccctgtgggtaa

SEQ ID NO: 646937 - DNA, 25 bp, Mus musculus
ggtattcacgaagccctgtgggtaa

SEQ ID NO: 646938 - DNA, 25 bp, Mus musculus
ggtattcagaacatggtgacgattt

SEQ ID NO: 646939 - DNA, 25 bp, Mus musculus
ggtattcagaacttggtgacgattt

SEQ ID NO: 646940 - DNA, 25 bp, Mus musculus
ggtattcagattccttttagccatt

SEQ ID NO: 646941 - DNA, 25 bp, Mus musculus
ggtattcagattgcttttagccatt

SEQ ID NO: 646942 - DNA, 25 bp, Mus musculus
ggtattcatcacaatccatcagtct

SEQ ID NO: 646943 - DNA, 25 bp, Mus musculus
ggtattcatcactatccatcagtct

SEQ ID NO: 646944 - DNA, 25 bp, Mus musculus
ggtattcatggtacacttgactctt

SEQ ID NO: 646945 - DNA, 25 bp, Mus musculus
ggtattcatggttcacttgactctt

SEQ ID NO: 646946 - DNA, 25 bp, Mus musculus
ggtattcatttacccatgattctat

SEQ ID NO: 646947 - DNA, 25 bp, Mus musculus
ggtattcatttagccatgattctat

SEQ ID NO: 646948 - DNA, 25 bp, Mus musculus
ggtattccacagacaatgtgtagtt

SEQ ID NO: 646949 - DNA, 25 bp, Mus musculus
ggtattccacagcagttgtccattc

SEQ ID NO: 646950 - DNA, 25 bp, Mus musculus
ggtattccacaggagttgtccattc

SEQ ID NO: 646951 - DNA, 25 bp, Mus musculus
ggtattccacagtcaatgtgtagtt

SEQ ID NO: 646952 - DNA, 25 bp, Mus musculus
ggtattcccagtaccattgagacat

SEQ ID NO: 646953 - DNA, 25 bp, Mus musculus
ggtattcccagttccattgagacat

SEQ ID NO: 646954 - DNA, 25 bp, Mus musculus
ggtattcccatgacacaagtgagtg

SEQ ID NO: 646955 - DNA, 25 bp, Mus musculus
ggtattcccatgtcacaagtgagtg

SEQ ID NO: 646956 - DNA, 25 bp, Mus musculus
ggtattccccaaacactcaggtgga

SEQ ID NO: 646957 - DNA, 25 bp, Mus musculus
ggtattccccaatcactcaggtgga

SEQ ID NO: 646958 - DNA, 25 bp, Mus musculus
ggtattcctcatcactcttgtaact

SEQ ID NO: 646959 - DNA, 25 bp, Mus musculus
ggtattcctcatgactcttgtaact

SEQ ID NO: 646960 - DNA, 25 bp, Mus musculus
ggtattctagacacctgttcagctg

SEQ ID NO: 646961 - DNA, 25 bp, Mus musculus
ggtattctagaccttggctcagagc

SEQ ID NO: 646962 - DNA, 25 bp, Mus musculus
ggtattctagacgttggctcagagc

SEQ ID NO: 646963 - DNA, 25 bp, Mus musculus
ggtattctagactcctgttcagctg

SEQ ID NO: 646964 - DNA, 25 bp, Mus musculus
ggtattctcactcccacatttttgg

SEQ ID NO: 646965 - DNA, 25 bp, Mus musculus
ggtattctcactgccacatttttgg

SEQ ID NO: 646966 - DNA, 25 bp, Mus musculus
ggtattctcattagagcctcttggc

SEQ ID NO: 646967 - DNA, 25 bp, Mus musculus
ggtattctcatttgagcctcttggc

SEQ ID NO: 646968 - DNA, 25 bp, Mus musculus
ggtattctccaacgaaccacatcaa

SEQ ID NO: 646969 - DNA, 25 bp, Mus musculus
ggtattctccaaggaaccacatcaa

SEQ ID NO: 646970 - DNA, 25 bp, Mus musculus
ggtattctctgaacgaagtctgtta

SEQ ID NO: 646971 - DNA, 25 bp, Mus musculus
ggtattctctgatcgaagtctgtta

SEQ ID NO: 646972 - DNA, 25 bp, Mus musculus
ggtattctgagacatttgcctgagg

SEQ ID NO: 646973 - DNA, 25 bp, Mus musculus
ggtattctgagagatttgcctgagg

SEQ ID NO: 646974 - DNA, 25 bp, Mus musculus
ggtattgaaattctgtttggcccag

SEQ ID NO: 646975 - DNA, 25 bp, Mus musculus
ggtattgaaattgtgtttggcccag

SEQ ID NO: 646976 - DNA, 25 bp, Mus musculus
ggtattgacaagcacgccattgtgc

SEQ ID NO: 646977 - DNA, 25 bp, Mus musculus
ggtattgacaaggacgccattgtgc

SEQ ID NO: 646978 - DNA, 25 bp, Mus musculus
ggtattgactgcactaactgggctc

SEQ ID NO: 646979 - DNA, 25 bp, Mus musculus
ggtattgactgctctaactgggctc

SEQ ID NO: 646980 - DNA, 25 bp, Mus musculus
ggtattgcatttagccttccctgtc

SEQ ID NO: 646981 - DNA, 25 bp, Mus musculus
ggtattgcattttgccttccctgtc

SEQ ID NO: 646982 - DNA, 25 bp, Mus musculus
ggtattgccaccaagttctttagtt

SEQ ID NO: 646983 - DNA, 25 bp, Mus musculus
ggtattgccacctagttctttagtt

SEQ ID NO: 646984 - DNA, 25 bp, Mus musculus
ggtattgccgtacgtgttcatttat

SEQ ID NO: 646985 - DNA, 25 bp, Mus musculus
ggtattgccgtaggtgttcatttat

SEQ ID NO: 646986 - DNA, 25 bp, Mus musculus
ggtattgctatgatctccactgtta

SEQ ID NO: 646987 - DNA, 25 bp, Mus musculus
ggtattgctatgttctccactgtta

SEQ ID NO: 646988 - DNA, 25 bp, Mus musculus
ggtattgctcccaggctgagaagga

SEQ ID NO: 646989 - DNA, 25 bp, Mus musculus
ggtattgctccctggctgagaagga

SEQ ID NO: 646990 - DNA, 25 bp, Mus musculus
ggtattgcttataatgccctcattt

SEQ ID NO: 646991 - DNA, 25 bp, Mus musculus
ggtattgcttatcaacgtccatagt

SEQ ID NO: 646992 - DNA, 25 bp, Mus musculus
ggtattgcttatgaacgtccatagt

SEQ ID NO: 646993 - DNA, 25 bp, Mus musculus
ggtattgcttattatgccctcattt

SEQ ID NO: 646994 - DNA, 25 bp, Mus musculus
ggtattggacaccatcccttaagaa

SEQ ID NO: 646995 - DNA, 25 bp, Mus musculus
ggtattggacacgatcccttaagaa

SEQ ID NO: 646996 - DNA, 25 bp, Mus musculus
ggtattggagaacacattgcttttt

SEQ ID NO: 646997 - DNA, 25 bp, Mus musculus
ggtattggagaagacattgcttttt

SEQ ID NO: 646998 - DNA, 25 bp, Mus musculus
ggtattggcactcgcttgcaatcaa

SEQ ID NO: 646999 - DNA, 25 bp, Mus musculus
ggtattggcactggcttgcaatcaa

SEQ ID NO: 647000 - DNA, 25 bp, Mus musculus
ggtattggccttcgtgtttgctctc

SEQ ID NO: 647001 - DNA, 25 bp, Mus musculus
ggtattggccttggtgtttgctctc

SEQ ID NO: 647002 - DNA, 25 bp, Mus musculus
ggtattgggcccacagctgtaactt

SEQ ID NO: 647003 - DNA, 25 bp, Mus musculus
ggtattgggccctcagctgtaactt

SEQ ID NO: 647004 - DNA, 25 bp, Mus musculus
ggtattggtcttactatctttgcat

SEQ ID NO: 647005 - DNA, 25 bp, Mus musculus
ggtattggtctttctatctttgcat

SEQ ID NO: 647006 - DNA, 25 bp, Mus musculus
ggtattgtgactacaaatcttccta

SEQ ID NO: 647007 - DNA, 25 bp, Mus musculus
ggtattgtgacttcaaatcttccta

SEQ ID NO: 647008 - DNA, 25 bp, Mus musculus
ggtattgtgatcatattctctgtac

SEQ ID NO: 647009 - DNA, 25 bp, Mus musculus
ggtattgtgatcttattctctgtac

SEQ ID NO: 647010 - DNA, 25 bp, Mus musculus
ggtattgtgcatatgtggcattatg

SEQ ID NO: 647011 - DNA, 25 bp, Mus musculus
ggtattgtgcatttgtggcattatg

SEQ ID NO: 647012 - DNA, 25 bp, Mus musculus
ggtattgtgcctctgttgtgtgttt

SEQ ID NO: 647013 - DNA, 25 bp, Mus musculus
ggtattgtgcctgtgttgtgtgttt

SEQ ID NO: 647014 - DNA, 25 bp, Mus musculus
ggtattgtggataacccatcccata

SEQ ID NO: 647015 - DNA, 25 bp, Mus musculus
ggtattgtggattacccatcccata

SEQ ID NO: 647016 - DNA, 25 bp, Mus musculus
ggtattgtggcaactagtttcccct

SEQ ID NO: 647017 - DNA, 25 bp, Mus musculus
ggtattgtggcatctagtttcccct

SEQ ID NO: 647018 - DNA, 25 bp, Mus musculus
ggtattgttacaagttttggccaag

SEQ ID NO: 647019 - DNA, 25 bp, Mus musculus
ggtattgttacatgttttggccaag

SEQ ID NO: 647020 - DNA, 25 bp, Mus musculus
ggtattgttcatagttcaatcttca

SEQ ID NO: 647021 - DNA, 25 bp, Mus musculus
ggtattgttcattgttcaatcttca

SEQ ID NO: 647022 - DNA, 25 bp, Mus musculus
ggtattgttcctcagaagccgtgca

SEQ ID NO: 647023 - DNA, 25 bp, Mus musculus
ggtattgttcctgagaagccgtgca

SEQ ID NO: 647024 - DNA, 25 bp, Mus musculus
ggtattgtttacactgaagctccac

SEQ ID NO: 647025 - DNA, 25 bp, Mus musculus
ggtattgtttactctgaagctccac

SEQ ID NO: 647026 - DNA, 25 bp, Mus musculus
ggtatttaatgtcctaggcagaaag

SEQ ID NO: 647027 - DNA, 25 bp, Mus musculus
ggtatttaatgtgctaggcagaaag

SEQ ID NO: 647028 - DNA, 25 bp, Mus musculus
ggtatttacagcctggaaaaggaga

SEQ ID NO: 647029 - DNA, 25 bp, Mus musculus
ggtatttacagcgtggaaaaggaga

SEQ ID NO: 647030 - DNA, 25 bp, Mus musculus
ggtatttagagaaccatcccgcaaa

SEQ ID NO: 647031 - DNA, 25 bp, Mus musculus
ggtatttagagatccatcccgcaaa

SEQ ID NO: 647032 - DNA, 25 bp, Mus musculus
ggtatttagtacaccacatcccaac

SEQ ID NO: 647033 - DNA, 25 bp, Mus musculus
ggtatttagtactccacatcccaac

SEQ ID NO: 647034 - DNA, 25 bp, Mus musculus
ggtatttagtcccagccatagtcac

SEQ ID NO: 647035 - DNA, 25 bp, Mus musculus
ggtatttagtccgagccatagtcac

SEQ ID NO: 647036 - DNA, 25 bp, Mus musculus
ggtatttatcatcccattttttaca

SEQ ID NO: 647037 - DNA, 25 bp, Mus musculus
ggtatttatcatgccattttttaca

SEQ ID NO: 647038 - DNA, 25 bp, Mus musculus
ggtatttatccccatagtcaggatt

SEQ ID NO: 647039 - DNA, 25 bp, Mus musculus
ggtatttatcccgatagtcaggatt

SEQ ID NO: 647040 - DNA, 25 bp, Mus musculus
ggtatttatcttcctcatgacgttg

SEQ ID NO: 647041 - DNA, 25 bp, Mus musculus
ggtatttatcttgctcatgacgttg

SEQ ID NO: 647042 - DNA, 25 bp, Mus musculus
ggtatttatgttccattcagtacta

SEQ ID NO: 647043 - DNA, 25 bp, Mus musculus
ggtatttatgttgcattcagtacta

SEQ ID NO: 647044 - DNA, 25 bp, Mus musculus
ggtatttattgcacacatcatttat

SEQ ID NO: 647045 - DNA, 25 bp, Mus musculus
ggtatttattgctcacatcatttat

SEQ ID NO: 647046 - DNA, 25 bp, Mus musculus
ggtatttcaaagaacgccctggagc

SEQ ID NO: 647047 - DNA, 25 bp, Mus musculus
ggtatttcaaagtacgccctggagc

SEQ ID NO: 647048 - DNA, 25 bp, Mus musculus
ggtatttcaagcactacgacgtcga

SEQ ID NO: 647049 - DNA, 25 bp, Mus musculus
ggtatttcaagctctacgacgtcga

SEQ ID NO: 647050 - DNA, 25 bp, Mus musculus
ggtatttcacatctatgctttcctt

SEQ ID NO: 647051 - DNA, 25 bp, Mus musculus
ggtatttcacatgtatgctttcctt

SEQ ID NO: 647052 - DNA, 25 bp, Mus musculus
ggtatttcacctatgagatcatgtc

SEQ ID NO: 647053 - DNA, 25 bp, Mus musculus
ggtatttcacctttgagatcatgtc

SEQ ID NO: 647054 - DNA, 25 bp, Mus musculus
ggtatttcactgcttacgtcatcaa

SEQ ID NO: 647055 - DNA, 25 bp, Mus musculus
ggtatttcactggttacgtcatcaa

SEQ ID NO: 647056 - DNA, 25 bp, Mus musculus
ggtatttcagatacctcagtccaag

SEQ ID NO: 647057 - DNA, 25 bp, Mus musculus
ggtatttcagattcctcagtccaag

SEQ ID NO: 647058 - DNA, 25 bp, Mus musculus
ggtatttcagtgacaggttccatag

SEQ ID NO: 647059 - DNA, 25 bp, Mus musculus
ggtatttcagtgtcaggttccatag

SEQ ID NO: 647060 - DNA, 25 bp, Mus musculus
ggtatttcattgatactaagatcta

SEQ ID NO: 647061 - DNA, 25 bp, Mus musculus
ggtatttcattgttactaagatcta

SEQ ID NO: 647062 - DNA, 25 bp, Mus musculus
ggtatttccaatccacatgtgcatg

SEQ ID NO: 647063 - DNA, 25 bp, Mus musculus
ggtatttccaatgcacatgtgcatg

SEQ ID NO: 647064 - DNA, 25 bp, Mus musculus
ggtatttccagtagaccattttaag

SEQ ID NO: 647065 - DNA, 25 bp, Mus musculus
ggtatttccagttgaccattttaag

SEQ ID NO: 647066 - DNA, 25 bp, Mus musculus
ggtatttcctgactagactgcattt

SEQ ID NO: 647067 - DNA, 25 bp, Mus musculus
ggtatttcctgagtagactgcattt

SEQ ID NO: 647068 - DNA, 25 bp, Mus musculus
ggtatttcgaccacaagttgtgaca

SEQ ID NO: 647069 - DNA, 25 bp, Mus musculus
ggtatttcgacctcaagttgtgaca

SEQ ID NO: 647070 - DNA, 25 bp, Mus musculus
ggtatttcgcagatcatatgcccca

SEQ ID NO: 647071 - DNA, 25 bp, Mus musculus
ggtatttcgcagttcatatgcccca

SEQ ID NO: 647072 - DNA, 25 bp, Mus musculus
ggtatttctaaaagtccaatgtcct

SEQ ID NO: 647073 - DNA, 25 bp, Mus musculus
ggtatttctaaatgtccaatgtcct

SEQ ID NO: 647074 - DNA, 25 bp, Mus musculus
ggtatttctataatcactgcttagc

SEQ ID NO: 647075 - DNA, 25 bp, Mus musculus
ggtatttctatattcactgcttagc

SEQ ID NO: 647076 - DNA, 25 bp, Mus musculus
ggtatttctctgatgatgactgaac

SEQ ID NO: 647077 - DNA, 25 bp, Mus musculus
ggtatttctctgttgatgactgaac

SEQ ID NO: 647078 - DNA, 25 bp, Mus musculus
ggtatttctgccatattctagggat

SEQ ID NO: 647079 - DNA, 25 bp, Mus musculus
ggtatttctgccttattctagggat

SEQ ID NO: 647080 - DNA, 25 bp, Mus musculus
ggtatttctgctcaaacttttatca

SEQ ID NO: 647081 - DNA, 25 bp, Mus musculus
ggtatttctgctgaaacttttatca

SEQ ID NO: 647082 - DNA, 25 bp, Mus musculus
ggtatttcttgacttcagagcaact

SEQ ID NO: 647083 - DNA, 25 bp, Mus musculus
ggtatttcttgagttcagagcaact

SEQ ID NO: 647084 - DNA, 25 bp, Mus musculus
ggtatttcttttccatgtcttaggt

SEQ ID NO: 647085 - DNA, 25 bp, Mus musculus
ggtatttcttttgcatgtcttaggt

SEQ ID NO: 647086 - DNA, 25 bp, Mus musculus
ggtatttgaattcagcatcccagaa

SEQ ID NO: 647087 - DNA, 25 bp, Mus musculus
ggtatttgaattgagcatcccagaa

SEQ ID NO: 647088 - DNA, 25 bp, Mus musculus
ggtatttgaccaacaagtgggcatt

SEQ ID NO: 647089 - DNA, 25 bp, Mus musculus
ggtatttgaccatcaagtgggcatt

SEQ ID NO: 647090 - DNA, 25 bp, Mus musculus
ggtatttgaggcagtcttgggacat

SEQ ID NO: 647091 - DNA, 25 bp, Mus musculus
ggtatttgaggctgtcttgggacat

SEQ ID NO: 647092 - DNA, 25 bp, Mus musculus
ggtatttgataaaattcaccatcta

SEQ ID NO: 647093 - DNA, 25 bp, Mus musculus
ggtatttgataatattcaccatcta

SEQ ID NO: 647094 - DNA, 25 bp, Mus musculus
ggtatttgatcccagtggactctat

SEQ ID NO: 647095 - DNA, 25 bp, Mus musculus
ggtatttgatccgagtggactctat

SEQ ID NO: 647096 - DNA, 25 bp, Mus musculus
ggtatttgcagacaaggcttcgaga

SEQ ID NO: 647097 - DNA, 25 bp, Mus musculus
ggtatttgcagagaaggcttcgaga

SEQ ID NO: 647098 - DNA, 25 bp, Mus musculus
ggtatttgctctatttactagtcat

SEQ ID NO: 647099 - DNA, 25 bp, Mus musculus
ggtatttgctctttttactagtcat

SEQ ID NO: 647100 - DNA, 25 bp, Mus musculus
ggtatttgctgtactcctgaagacc

SEQ ID NO: 647101 - DNA, 25 bp, Mus musculus
ggtatttgctgttctcctgaagacc

SEQ ID NO: 647102 - DNA, 25 bp, Mus musculus
ggtatttggacacttggacacgttc

SEQ ID NO: 647103 - DNA, 25 bp, Mus musculus
ggtatttggacagttggacacgttc

SEQ ID NO: 647104 - DNA, 25 bp, Mus musculus
ggtatttggcataccttattaacaa

SEQ ID NO: 647105 - DNA, 25 bp, Mus musculus
ggtatttggcattccttattaacaa

SEQ ID NO: 647106 - DNA, 25 bp, Mus musculus
ggtatttggccaaaggaggcttatt

SEQ ID NO: 647107 - DNA, 25 bp, Mus musculus
ggtatttggccataggaggcttatt

SEQ ID NO: 647108 - DNA, 25 bp, Mus musculus
ggtatttgggtcaagggccttactg

SEQ ID NO: 647109 - DNA, 25 bp, Mus musculus
ggtatttgggtctagggccttactg

SEQ ID NO: 647110 - DNA, 25 bp, Mus musculus
ggtatttgtaatcttatcttgccaa

SEQ ID NO: 647111 - DNA, 25 bp, Mus musculus
ggtatttgtaatgttatcttgccaa

SEQ ID NO: 647112 - DNA, 25 bp, Mus musculus
ggtatttgtacactatcccttggtt

SEQ ID NO: 647113 - DNA, 25 bp, Mus musculus
ggtatttgtacagtatcccttggtt

SEQ ID NO: 647114 - DNA, 25 bp, Mus musculus
ggtatttgtcctctgggttcttata

SEQ ID NO: 647115 - DNA, 25 bp, Mus musculus
ggtatttgtcctgtgggttcttata

SEQ ID NO: 647116 - DNA, 25 bp, Mus musculus
ggtatttgtctaaatttttctgttt

SEQ ID NO: 647117 - DNA, 25 bp, Mus musculus
ggtatttgtctatatttttctgttt

SEQ ID NO: 647118 - DNA, 25 bp, Mus musculus
ggtatttgtgaccagtgctaattgt

SEQ ID NO: 647119 - DNA, 25 bp, Mus musculus
ggtatttgtgacgagtgctaattgt

SEQ ID NO: 647120 - DNA, 25 bp, Mus musculus
ggtatttgtgtcagtcctcataggc

SEQ ID NO: 647121 - DNA, 25 bp, Mus musculus
ggtatttgtgtctgtcctcataggc

SEQ ID NO: 647122 - DNA, 25 bp, Mus musculus
ggtattttaccccagacacagaaca

SEQ ID NO: 647123 - DNA, 25 bp, Mus musculus
ggtattttacccgagacacagaaca

SEQ ID NO: 647124 - DNA, 25 bp, Mus musculus
ggtattttacctacatgcgtatata

SEQ ID NO: 647125 - DNA, 25 bp, Mus musculus
ggtattttaccttcatgcgtatata

SEQ ID NO: 647126 - DNA, 25 bp, Mus musculus
ggtattttagcccacattgaggaga

SEQ ID NO: 647127 - DNA, 25 bp, Mus musculus
ggtattttagccgacattgaggaga

SEQ ID NO: 647128 - DNA, 25 bp, Mus musculus
ggtattttatacacgggctctgggc

SEQ ID NO: 647129 - DNA, 25 bp, Mus musculus
ggtattttatactcgggctctgggc

SEQ ID NO: 647130 - DNA, 25 bp, Mus musculus
ggtattttatatatgcgctcttctg

SEQ ID NO: 647131 - DNA, 25 bp, Mus musculus
ggtattttatatttgcgctcttctg

SEQ ID NO: 647132 - DNA, 25 bp, Mus musculus
ggtattttcacaaacttgacttcaa

SEQ ID NO: 647133 - DNA, 25 bp, Mus musculus
ggtattttcacatacttgacttcaa

SEQ ID NO: 647134 - DNA, 25 bp, Mus musculus
ggtattttcatccatggtgtttcta

SEQ ID NO: 647135 - DNA, 25 bp, Mus musculus
ggtattttcatcgatggtgtttcta

SEQ ID NO: 647136 - DNA, 25 bp, Mus musculus
ggtattttccatcgcacttgaggct

SEQ ID NO: 647137 - DNA, 25 bp, Mus musculus
ggtattttccatggcacttgaggct

SEQ ID NO: 647138 - DNA, 25 bp, Mus musculus
ggtattttcctccttgatatcatgg

SEQ ID NO: 647139 - DNA, 25 bp, Mus musculus
ggtattttcctcgttgatatcatgg

SEQ ID NO: 647140 - DNA, 25 bp, Mus musculus
ggtattttctaaattgtctgtccag

SEQ ID NO: 647141 - DNA, 25 bp, Mus musculus
ggtattttctaatttgtctgtccag

SEQ ID NO: 647142 - DNA, 25 bp, Mus musculus
ggtattttcttcctgcaaagttgta

SEQ ID NO: 647143 - DNA, 25 bp, Mus musculus
ggtattttcttcgtgcaaagttgta

SEQ ID NO: 647144 - DNA, 25 bp, Mus musculus
ggtattttgaatactccttgtaaca

SEQ ID NO: 647145 - DNA, 25 bp, Mus musculus
ggtattttgaattctccttgtaaca

SEQ ID NO: 647146 - DNA, 25 bp, Mus musculus
ggtattttggtgactacacctctta

SEQ ID NO: 647147 - DNA, 25 bp, Mus musculus
ggtattttggtgtctacacctctta

SEQ ID NO: 647148 - DNA, 25 bp, Mus musculus
ggtattttgtaactgatagactcac

SEQ ID NO: 647149 - DNA, 25 bp, Mus musculus
ggtattttgtaagtgatagactcac

SEQ ID NO: 647150 - DNA, 25 bp, Mus musculus
ggtattttgtctagtctgttgagca

SEQ ID NO: 647151 - DNA, 25 bp, Mus musculus
ggtattttgtcttgtctgttgagca

SEQ ID NO: 647152 - DNA, 25 bp, Mus musculus
ggtattttgtgacgctatattcgca

SEQ ID NO: 647153 - DNA, 25 bp, Mus musculus
ggtattttgtgaggctatattcgca

SEQ ID NO: 647154 - DNA, 25 bp, Mus musculus
ggtatttttacaatgcccacagtag

SEQ ID NO: 647155 - DNA, 25 bp, Mus musculus
ggtatttttacattgcccacagtag

SEQ ID NO: 647156 - DNA, 25 bp, Mus musculus
ggtatttttccaattcagggtctgt

SEQ ID NO: 647157 - DNA, 25 bp, Mus musculus
ggtatttttccatttcagggtctgt

SEQ ID NO: 647158 - DNA, 25 bp, Mus musculus
ggtatttttctgaccactctaaggt

SEQ ID NO: 647159 - DNA, 25 bp, Mus musculus
ggtatttttctgtccactctaaggt

SEQ ID NO: 647160 - DNA, 25 bp, Mus musculus
ggtatttttcttctcattctctaca

SEQ ID NO: 647161 - DNA, 25 bp, Mus musculus
ggtatttttcttgtcattctctaca

SEQ ID NO: 647162 - DNA, 25 bp, Mus musculus
ggtattttttgtcgagcctcaccct

SEQ ID NO: 647163 - DNA, 25 bp, Mus musculus
ggtattttttgtggagcctcaccct

SEQ ID NO: 647164 - DNA, 25 bp, Mus musculus
ggtcaaaaatttcgcatctgctgaa

SEQ ID NO: 647165 - DNA, 25 bp, Mus musculus
ggtcaaaaatttggcatctgctgaa

SEQ ID NO: 647166 - DNA, 25 bp, Mus musculus
ggtcaaaactgtcaagtactccttt

SEQ ID NO: 647167 - DNA, 25 bp, Mus musculus
ggtcaaaactgtgaagtactccttt

SEQ ID NO: 647168 - DNA, 25 bp, Mus musculus
ggtcaaaatcgcaggcctgtaccta

SEQ ID NO: 647169 - DNA, 25 bp, Mus musculus
ggtcaaaatcgctggcctgtaccta

SEQ ID NO: 647170 - DNA, 25 bp, Mus musculus
ggtcaaaatcggctttctggcattt

SEQ ID NO: 647171 - DNA, 25 bp, Mus musculus
ggtcaaaatcgggtttctggcattt

SEQ ID NO: 647172 - DNA, 25 bp, Mus musculus
ggtcaaaattcaatccacatgccct

SEQ ID NO: 647173 - DNA, 25 bp, Mus musculus
ggtcaaaattcactacttgctgagc

SEQ ID NO: 647174 - DNA, 25 bp, Mus musculus
ggtcaaaattcagtacttgctgagc

SEQ ID NO: 647175 - DNA, 25 bp, Mus musculus
ggtcaaaattcattccacatgccct

SEQ ID NO: 647176 - DNA, 25 bp, Mus musculus
ggtcaaacctcaaagcctagaatga

SEQ ID NO: 647177 - DNA, 25 bp, Mus musculus
ggtcaaacctcatagcctagaatga

SEQ ID NO: 647178 - DNA, 25 bp, Mus musculus
ggtcaaacgttcctaatggtgcctg

SEQ ID NO: 647179 - DNA, 25 bp, Mus musculus
ggtcaaacgttcgtaatggtgcctg

SEQ ID NO: 647180 - DNA, 25 bp, Mus musculus
ggtcaaactgtcatactgttgcttt

SEQ ID NO: 647181 - DNA, 25 bp, Mus musculus
ggtcaaactgtccaggactctccat

SEQ ID NO: 647182 - DNA, 25 bp, Mus musculus
ggtcaaactgtcgaggactctccat

SEQ ID NO: 647183 - DNA, 25 bp, Mus musculus
ggtcaaactgtcttactgttgcttt

SEQ ID NO: 647184 - DNA, 25 bp, Mus musculus
ggtcaaacttccaagggtcagcaga

SEQ ID NO: 647185 - DNA, 25 bp, Mus musculus
ggtcaaacttcctagggtcagcaga

SEQ ID NO: 647186 - DNA, 25 bp, Mus musculus
ggtcaaacttggcattgtttccctg

SEQ ID NO: 647187 - DNA, 25 bp, Mus musculus
ggtcaaacttgggattgtttccctg

SEQ ID NO: 647188 - DNA, 25 bp, Mus musculus
ggtcaaagacctcaacatgaaacca

SEQ ID NO: 647189 - DNA, 25 bp, Mus musculus
ggtcaaagacctgaacatgaaacca

SEQ ID NO: 647190 - DNA, 25 bp, Mus musculus
ggtcaaagagatagtggcccagcac

SEQ ID NO: 647191 - DNA, 25 bp, Mus musculus
ggtcaaagagattgtggcccagcac

SEQ ID NO: 647192 - DNA, 25 bp, Mus musculus
ggtcaaagataaccctgcttctctg

SEQ ID NO: 647193 - DNA, 25 bp, Mus musculus
ggtcaaagataagcctgcttctctg

SEQ ID NO: 647194 - DNA, 25 bp, Mus musculus
ggtcaaagccacaaatccaatgggt

SEQ ID NO: 647195 - DNA, 25 bp, Mus musculus
ggtcaaagccactaatccaatgggt

SEQ ID NO: 647196 - DNA, 25 bp, Mus musculus
ggtcaaaggcagctatccattaact

SEQ ID NO: 647197 - DNA, 25 bp, Mus musculus
ggtcaaaggcaggtatccattaact

SEQ ID NO: 647198 - DNA, 25 bp, Mus musculus
ggtcaaaggctgcttctatctgatt

SEQ ID NO: 647199 - DNA, 25 bp, Mus musculus
ggtcaaaggctggttctatctgatt

SEQ ID NO: 647200 - DNA, 25 bp, Mus musculus
ggtcaaagtcagagtggactacata

SEQ ID NO: 647201 - DNA, 25 bp, Mus musculus
ggtcaaagtcagtgtggactacata

SEQ ID NO: 647202 - DNA, 25 bp, Mus musculus
ggtcaaagtcataagctacacacag

SEQ ID NO: 647203 - DNA, 25 bp, Mus musculus
ggtcaaagtcattagctacacacag

SEQ ID NO: 647204 - DNA, 25 bp, Mus musculus
ggtcaaagtcccagttatatgtaag

SEQ ID NO: 647205 - DNA, 25 bp, Mus musculus
ggtcaaagtccctgttatatgtaag

SEQ ID NO: 647206 - DNA, 25 bp, Mus musculus
ggtcaaagtgtgaacctgtccatca

SEQ ID NO: 647207 - DNA, 25 bp, Mus musculus
ggtcaaagtgtgtacctgtccatca

SEQ ID NO: 647208 - DNA, 25 bp, Mus musculus
ggtcaaatacgactgcccgcagcgg

SEQ ID NO: 647209 - DNA, 25 bp, Mus musculus
ggtcaaatacgagtgcccgcagcgg

SEQ ID NO: 647210 - DNA, 25 bp, Mus musculus
ggtcaaatagggatcttatggttca

SEQ ID NO: 647211 - DNA, 25 bp, Mus musculus
ggtcaaatagggttcttatggttca

SEQ ID NO: 647212 - DNA, 25 bp, Mus musculus
ggtcaaatctctaggaaggtctttc

SEQ ID NO: 647213 - DNA, 25 bp, Mus musculus
ggtcaaatctcttggaaggtctttc

SEQ ID NO: 647214 - DNA, 25 bp, Mus musculus
ggtcaaatggccacgattttatgac

SEQ ID NO: 647215 - DNA, 25 bp, Mus musculus
ggtcaaatggcctcgattttatgac

SEQ ID NO: 647216 - DNA, 25 bp, Mus musculus
ggtcaaatggttatctatttttcat

SEQ ID NO: 647217 - DNA, 25 bp, Mus musculus
ggtcaaatggttttctatttttcat

SEQ ID NO: 647218 - DNA, 25 bp, Mus musculus
ggtcaaatgttgatcctattctcca

SEQ ID NO: 647219 - DNA, 25 bp, Mus musculus
ggtcaaatgttgttcctattctcca

SEQ ID NO: 647220 - DNA, 25 bp, Mus musculus
ggtcaaattacacctatccaacacc

SEQ ID NO: 647221 - DNA, 25 bp, Mus musculus
ggtcaaattacagctatccaacacc

SEQ ID NO: 647222 - DNA, 25 bp, Mus musculus
ggtcaacaacaaactcacttcaatc

SEQ ID NO: 647223 - DNA, 25 bp, Mus musculus
ggtcaacaacaatctcacttcaatc

SEQ ID NO: 647224 - DNA, 25 bp, Mus musculus
ggtcaacaacacatcaacatattat

SEQ ID NO: 647225 - DNA, 25 bp, Mus musculus
ggtcaacaacacttcaacatattat

SEQ ID NO: 647226 - DNA, 25 bp, Mus musculus
ggtcaacaaccaatttcacatttct

SEQ ID NO: 647227 - DNA, 25 bp, Mus musculus
ggtcaacaaccattttcacatttct

SEQ ID NO: 647228 - DNA, 25 bp, Mus musculus
ggtcaacaagccatttatcaacttc

SEQ ID NO: 647229 - DNA, 25 bp, Mus musculus
ggtcaacaagccttttatcaacttc

SEQ ID NO: 647230 - DNA, 25 bp, Mus musculus
ggtcaacaatacatactagtctaat

SEQ ID NO: 647231 - DNA, 25 bp, Mus musculus
ggtcaacaatacttactagtctaat

SEQ ID NO: 647232 - DNA, 25 bp, Mus musculus
ggtcaacagaccacatattagctta

SEQ ID NO: 647233 - DNA, 25 bp, Mus musculus
ggtcaacagacctcatattagctta

SEQ ID NO: 647234 - DNA, 25 bp, Mus musculus
ggtcaacagctactctgtgccaatt

SEQ ID NO: 647235 - DNA, 25 bp, Mus musculus
ggtcaacagctagtctgtgccaatt

SEQ ID NO: 647236 - DNA, 25 bp, Mus musculus
ggtcaacagggcaggaggtctcatt

SEQ ID NO: 647237 - DNA, 25 bp, Mus musculus
ggtcaacagggctggaggtctcatt

SEQ ID NO: 647238 - DNA, 25 bp, Mus musculus
ggtcaacatcatagccgtgctcaac

SEQ ID NO: 647239 - DNA, 25 bp, Mus musculus
ggtcaacatcattgccgtgctcaac

SEQ ID NO: 647240 - DNA, 25 bp, Mus musculus
ggtcaacatcgccaagatcggcctg

SEQ ID NO: 647241 - DNA, 25 bp, Mus musculus
ggtcaacatcgcgaagatcggcctg

SEQ ID NO: 647242 - DNA, 25 bp, Mus musculus
ggtcaacatcgtcaagcacttacag

SEQ ID NO: 647243 - DNA, 25 bp, Mus musculus
ggtcaacatcgtgaagcacttacag

SEQ ID NO: 647244 - DNA, 25 bp, Mus musculus
ggtcaacattgtacttgtatctatt

SEQ ID NO: 647245 - DNA, 25 bp, Mus musculus
ggtcaacattgttcttgtatctatt

SEQ ID NO: 647246 - DNA, 25 bp, Mus musculus
ggtcaaccaacccagcaaggaggcc

SEQ ID NO: 647247 - DNA, 25 bp, Mus musculus
ggtcaaccaaccgagcaaggaggcc

SEQ ID NO: 647248 - DNA, 25 bp, Mus musculus
ggtcaaccaactcaacattgttctt

SEQ ID NO: 647249 - DNA, 25 bp, Mus musculus
ggtcaaccaactgaacattgttctt

SEQ ID NO: 647250 - DNA, 25 bp, Mus musculus
ggtcaaccaagaccaactttgcctt

SEQ ID NO: 647251 - DNA, 25 bp, Mus musculus
ggtcaaccaagagcaactttgcctt

SEQ ID NO: 647252 - DNA, 25 bp, Mus musculus
ggtcaaccaatacccttacatataa

SEQ ID NO: 647253 - DNA, 25 bp, Mus musculus
ggtcaaccaatagccttacatataa

SEQ ID NO: 647254 - DNA, 25 bp, Mus musculus
ggtcaaccaccaatactatttagga

SEQ ID NO: 647255 - DNA, 25 bp, Mus musculus
ggtcaaccaccattactatttagga

SEQ ID NO: 647256 - DNA, 25 bp, Mus musculus
ggtcaaccaggtagcagggtttcct

SEQ ID NO: 647257 - DNA, 25 bp, Mus musculus
ggtcaaccaggttgcagggtttcct

SEQ ID NO: 647258 - DNA, 25 bp, Mus musculus
ggtcaaccctatcagtcttttttct

SEQ ID NO: 647259 - DNA, 25 bp, Mus musculus
ggtcaaccctatgagtcttttttct

SEQ ID NO: 647260 - DNA, 25 bp, Mus musculus
ggtcaaccctggaggtcaacagtat

SEQ ID NO: 647261 - DNA, 25 bp, Mus musculus
ggtcaaccctggtggtcaacagtat

SEQ ID NO: 647262 - DNA, 25 bp, Mus musculus
ggtcaaccgcataatcccagagggt

SEQ ID NO: 647263 - DNA, 25 bp, Mus musculus
ggtcaaccgcattatcccagagggt

SEQ ID NO: 647264 - DNA, 25 bp, Mus musculus
ggtcaacctaaacagttccatgtta

SEQ ID NO: 647265 - DNA, 25 bp, Mus musculus
ggtcaacctaaagagttccatgtta

SEQ ID NO: 647266 - DNA, 25 bp, Mus musculus
ggtcaacctcacagtagatccttta

SEQ ID NO: 647267 - DNA, 25 bp, Mus musculus
ggtcaacctcactgtagatccttta

SEQ ID NO: 647268 - DNA, 25 bp, Mus musculus
ggtcaacctcagatatcagtccttg

SEQ ID NO: 647269 - DNA, 25 bp, Mus musculus
ggtcaacctcagttatcagtccttg

SEQ ID NO: 647270 - DNA, 25 bp, Mus musculus
ggtcaaccttggaccaaagttgcct

SEQ ID NO: 647271 - DNA, 25 bp, Mus musculus
ggtcaaccttggtccaaagttgcct

SEQ ID NO: 647272 - DNA, 25 bp, Mus musculus
ggtcaacgccgcctgcaagaaatat

SEQ ID NO: 647273 - DNA, 25 bp, Mus musculus
ggtcaacgccgcgtgcaagaaatat

SEQ ID NO: 647274 - DNA, 25 bp, Mus musculus
ggtcaacgcggtccctagtacaagg

SEQ ID NO: 647275 - DNA, 25 bp, Mus musculus
ggtcaacgcggtgcctagtacaagg

SEQ ID NO: 647276 - DNA, 25 bp, Mus musculus
ggtcaacgtttactggcctggatca

SEQ ID NO: 647277 - DNA, 25 bp, Mus musculus
ggtcaacgtttagtggcctggatca

SEQ ID NO: 647278 - DNA, 25 bp, Mus musculus
ggtcaactaaacaactgtgatgctt

SEQ ID NO: 647279 - DNA, 25 bp, Mus musculus
ggtcaactaaactactgtgatgctt

SEQ ID NO: 647280 - DNA, 25 bp, Mus musculus
ggtcaactattcctcttatttgtgg

SEQ ID NO: 647281 - DNA, 25 bp, Mus musculus
ggtcaactattcgtcttatttgtgg

SEQ ID NO: 647282 - DNA, 25 bp, Mus musculus
ggtcaactatttacaggtaatgcta

SEQ ID NO: 647283 - DNA, 25 bp, Mus musculus
ggtcaactattttcaggtaatgcta

SEQ ID NO: 647284 - DNA, 25 bp, Mus musculus
ggtcaactccaacccttcagaagag

SEQ ID NO: 647285 - DNA, 25 bp, Mus musculus
ggtcaactccaagccttcagaagag

SEQ ID NO: 647286 - DNA, 25 bp, Mus musculus
ggtcaactgccccaagggtgtccag

SEQ ID NO: 647287 - DNA, 25 bp, Mus musculus
ggtcaactgcccgaagggtgtccag

SEQ ID NO: 647288 - DNA, 25 bp, Mus musculus
ggtcaacttcgtcaaaacaccgctc

SEQ ID NO: 647289 - DNA, 25 bp, Mus musculus
ggtcaacttcgtgaaaacaccgctc

SEQ ID NO: 647290 - DNA, 25 bp, Mus musculus
ggtcaacttggactcactagtcaag

SEQ ID NO: 647291 - DNA, 25 bp, Mus musculus
ggtcaacttggagtcactagtcaag

SEQ ID NO: 647292 - DNA, 25 bp, Mus musculus
ggtcaactttatccaaacactggca

SEQ ID NO: 647293 - DNA, 25 bp, Mus musculus
ggtcaactttatgcaaacactggca

SEQ ID NO: 647294 - DNA, 25 bp, Mus musculus
ggtcaacttttcaaatatttccact

SEQ ID NO: 647295 - DNA, 25 bp, Mus musculus
ggtcaacttttctaatatttccact

SEQ ID NO: 647296 - DNA, 25 bp, Mus musculus
ggtcaagaacaaaactgctatgcat

SEQ ID NO: 647297 - DNA, 25 bp, Mus musculus
ggtcaagaacaatactgctatgcat

SEQ ID NO: 647298 - DNA, 25 bp, Mus musculus
ggtcaagacaccaatctggaaagca

SEQ ID NO: 647299 - DNA, 25 bp, Mus musculus
ggtcaagacacctatctggaaagca

SEQ ID NO: 647300 - DNA, 25 bp, Mus musculus
ggtcaagactaaactatccattcag

SEQ ID NO: 647301 - DNA, 25 bp, Mus musculus
ggtcaagactaatctatccattcag

SEQ ID NO: 647302 - DNA, 25 bp, Mus musculus
ggtcaagactcaaggctgaacctct

SEQ ID NO: 647303 - DNA, 25 bp, Mus musculus
ggtcaagactcatggctgaacctct

SEQ ID NO: 647304 - DNA, 25 bp, Mus musculus
ggtcaagagagactacctcctcctc

SEQ ID NO: 647305 - DNA, 25 bp, Mus musculus
ggtcaagagagagtacctcctcctc

SEQ ID NO: 647306 - DNA, 25 bp, Mus musculus
ggtcaagagctacaagcgtcagttt

SEQ ID NO: 647307 - DNA, 25 bp, Mus musculus
ggtcaagagctagaagcgtcagttt

SEQ ID NO: 647308 - DNA, 25 bp, Mus musculus
ggtcaagaggacaccaacggctgca

SEQ ID NO: 647309 - DNA, 25 bp, Mus musculus
ggtcaagaggactccaacggctgca

SEQ ID NO: 647310 - DNA, 25 bp, Mus musculus
ggtcaagatgttcacccgccgcggt

SEQ ID NO: 647311 - DNA, 25 bp, Mus musculus
ggtcaagatgttgacccgccgcggt

SEQ ID NO: 647312 - DNA, 25 bp, Mus musculus
ggtcaagcagttctcacctgggtgt

SEQ ID NO: 647313 - DNA, 25 bp, Mus musculus
ggtcaagcagttgtcacctgggtgt

SEQ ID NO: 647314 - DNA, 25 bp, Mus musculus
ggtcaagctatacccaagggccaat

SEQ ID NO: 647315 - DNA, 25 bp, Mus musculus
ggtcaagctatagccaagggccaat

SEQ ID NO: 647316 - DNA, 25 bp, Mus musculus
ggtcaagctccgatttgcagaacat

SEQ ID NO: 647317 - DNA, 25 bp, Mus musculus
ggtcaagctccgttttgcagaacat

SEQ ID NO: 647318 - DNA, 25 bp, Mus musculus
ggtcaagctctcaagaagtgcccag

SEQ ID NO: 647319 - DNA, 25 bp, Mus musculus
ggtcaagctctctagaagtgcccag

SEQ ID NO: 647320 - DNA, 25 bp, Mus musculus
ggtcaaggaaatctcaagccaacag

SEQ ID NO: 647321 - DNA, 25 bp, Mus musculus
ggtcaaggaaatgtcaagccaacag

SEQ ID NO: 647322 - DNA, 25 bp, Mus musculus
ggtcaaggacctatcatttctgttt

SEQ ID NO: 647323 - DNA, 25 bp, Mus musculus
ggtcaaggacctatgtatgtgtgtc

SEQ ID NO: 647324 - DNA, 25 bp, Mus musculus
ggtcaaggacctttcatttctgttt

SEQ ID NO: 647325 - DNA, 25 bp, Mus musculus
ggtcaaggacctttgtatgtgtgtc

SEQ ID NO: 647326 - DNA, 25 bp, Mus musculus
ggtcaaggagctaggccacagcact

SEQ ID NO: 647327 - DNA, 25 bp, Mus musculus
ggtcaaggagcttggccacagcact

SEQ ID NO: 647328 - DNA, 25 bp, Mus musculus
ggtcaaggatggcaacagatcattt

SEQ ID NO: 647329 - DNA, 25 bp, Mus musculus
ggtcaaggatgggaacagatcattt

SEQ ID NO: 647330 - DNA, 25 bp, Mus musculus
ggtcaaggccacactcttggctata

SEQ ID NO: 647331 - DNA, 25 bp, Mus musculus
ggtcaaggccactctcttggctata

SEQ ID NO: 647332 - DNA, 25 bp, Mus musculus
ggtcaaggccagaaagcacccaggt

SEQ ID NO: 647333 - DNA, 25 bp, Mus musculus
ggtcaaggccagtaagcacccaggt

SEQ ID NO: 647334 - DNA, 25 bp, Mus musculus
ggtcaagggcttaccatacttctag

SEQ ID NO: 647335 - DNA, 25 bp, Mus musculus
ggtcaagggctttccatacttctag

SEQ ID NO: 647336 - DNA, 25 bp, Mus musculus
ggtcaaggtcaacacagcggtccat

SEQ ID NO: 647337 - DNA, 25 bp, Mus musculus
ggtcaaggtcaagacagcggtccat

SEQ ID NO: 647338 - DNA, 25 bp, Mus musculus
ggtcaaggtcacaagcattcagcag

SEQ ID NO: 647339 - DNA, 25 bp, Mus musculus
ggtcaaggtcactagcattcagcag

SEQ ID NO: 647340 - DNA, 25 bp, Mus musculus
ggtcaaggtcgtcgagagttcccct

SEQ ID NO: 647341 - DNA, 25 bp, Mus musculus
ggtcaaggtcgtggagagttcccct

SEQ ID NO: 647342 - DNA, 25 bp, Mus musculus
ggtcaaggttgtacctacatgtctt

SEQ ID NO: 647343 - DNA, 25 bp, Mus musculus
ggtcaaggttgttcctacatgtctt

SEQ ID NO: 647344 - DNA, 25 bp, Mus musculus
ggtcaagtagctctgggttattcat

SEQ ID NO: 647345 - DNA, 25 bp, Mus musculus
ggtcaagtagctgtgggttattcat

SEQ ID NO: 647346 - DNA, 25 bp, Mus musculus
ggtcaagtatctcttttagtggcaa

SEQ ID NO: 647347 - DNA, 25 bp, Mus musculus
ggtcaagtatctgttttagtggcaa

SEQ ID NO: 647348 - DNA, 25 bp, Mus musculus
ggtcaagtcaacacttagttcagtt

SEQ ID NO: 647349 - DNA, 25 bp, Mus musculus
ggtcaagtcaactcttagttcagtt

SEQ ID NO: 647350 - DNA, 25 bp, Mus musculus
ggtcaagtccggctaagtggaatca

SEQ ID NO: 647351 - DNA, 25 bp, Mus musculus
ggtcaagtccgggtaagtggaatca

SEQ ID NO: 647352 - DNA, 25 bp, Mus musculus
ggtcaagtcgagctattcgtttctt

SEQ ID NO: 647353 - DNA, 25 bp, Mus musculus
ggtcaagtcgaggtattcgtttctt

SEQ ID NO: 647354 - DNA, 25 bp, Mus musculus
ggtcaagtcggacagggactcttca

SEQ ID NO: 647355 - DNA, 25 bp, Mus musculus
ggtcaagtcggagagggactcttca

SEQ ID NO: 647356 - DNA, 25 bp, Mus musculus
ggtcaagtctgaccagtgcattcct

SEQ ID NO: 647357 - DNA, 25 bp, Mus musculus
ggtcaagtctgagcagtgcattcct

SEQ ID NO: 647358 - DNA, 25 bp, Mus musculus
ggtcaagttaatcgtttgcgagttc

SEQ ID NO: 647359 - DNA, 25 bp, Mus musculus
ggtcaagttaatggtttgcgagttc

SEQ ID NO: 647360 - DNA, 25 bp, Mus musculus
ggtcaagttctaaacgcctgatgcg

SEQ ID NO: 647361 - DNA, 25 bp, Mus musculus
ggtcaagttctatacgcctgatgcg

SEQ ID NO: 647362 - DNA, 25 bp, Mus musculus
ggtcaagtttgtactgtgcatgcat

SEQ ID NO: 647363 - DNA, 25 bp, Mus musculus
ggtcaagtttgttctgtgcatgcat

SEQ ID NO: 647364 - DNA, 25 bp, Mus musculus
ggtcaagtttttacgtcaatgggct

SEQ ID NO: 647365 - DNA, 25 bp, Mus musculus
ggtcaagttttttcgtcaatgggct

SEQ ID NO: 647366 - DNA, 25 bp, Mus musculus
ggtcaataaactaatggtgtgctac

SEQ ID NO: 647367 - DNA, 25 bp, Mus musculus
ggtcaataaacttatggtgtgctac

SEQ ID NO: 647368 - DNA, 25 bp, Mus musculus
ggtcaataaggtagcccagccacgg

SEQ ID NO: 647369 - DNA, 25 bp, Mus musculus
ggtcaataaggttgcccagccacgg

SEQ ID NO: 647370 - DNA, 25 bp, Mus musculus
ggtcaatacaacctccatgtccaga

SEQ ID NO: 647371 - DNA, 25 bp, Mus musculus
ggtcaatacaacgtccatgtccaga

SEQ ID NO: 647372 - DNA, 25 bp, Mus musculus
ggtcaatacacgcatgcctacacta

SEQ ID NO: 647373 - DNA, 25 bp, Mus musculus
ggtcaatacacggatgcctacacta

SEQ ID NO: 647374 - DNA, 25 bp, Mus musculus
ggtcaatactcgagatgtacaataa

SEQ ID NO: 647375 - DNA, 25 bp, Mus musculus
ggtcaatactcgtgatgtacaataa

SEQ ID NO: 647376 - DNA, 25 bp, Mus musculus
ggtcaatatcatcttccccgagaag

SEQ ID NO: 647377 - DNA, 25 bp, Mus musculus
ggtcaatatcatgttccccgagaag

SEQ ID NO: 647378 - DNA, 25 bp, Mus musculus
ggtcaatcagaacctaggcccgagg

SEQ ID NO: 647379 - DNA, 25 bp, Mus musculus
ggtcaatcagaagctaggcccgagg

SEQ ID NO: 647380 - DNA, 25 bp, Mus musculus
ggtcaatcattcatgcttccagtga

SEQ ID NO: 647381 - DNA, 25 bp, Mus musculus
ggtcaatcattcttgcttccagtga

SEQ ID NO: 647382 - DNA, 25 bp, Mus musculus
ggtcaatctcctacaggcggtggcc

SEQ ID NO: 647383 - DNA, 25 bp, Mus musculus
ggtcaatctccttcaggcggtggcc

SEQ ID NO: 647384 - DNA, 25 bp, Mus musculus
ggtcaatcttgcagcatttgtgctt

SEQ ID NO: 647385 - DNA, 25 bp, Mus musculus
ggtcaatcttgctgcatttgtgctt

SEQ ID NO: 647386 - DNA, 25 bp, Mus musculus
ggtcaatgccttcagaaccatgtct

SEQ ID NO: 647387 - DNA, 25 bp, Mus musculus
ggtcaatgccttgagaaccatgtct

SEQ ID NO: 647388 - DNA, 25 bp, Mus musculus
ggtcaatgctgaccagattctggtc

SEQ ID NO: 647389 - DNA, 25 bp, Mus musculus
ggtcaatgctgagcagattctggtc

SEQ ID NO: 647390 - DNA, 25 bp, Mus musculus
ggtcaatgctgccttctatcaggcc

SEQ ID NO: 647391 - DNA, 25 bp, Mus musculus
ggtcaatgctgcgttctatcaggcc

SEQ ID NO: 647392 - DNA, 25 bp, Mus musculus
ggtcaatgggctagactgttttccc

SEQ ID NO: 647393 - DNA, 25 bp, Mus musculus
ggtcaatgggcttgactgttttccc

SEQ ID NO: 647394 - DNA, 25 bp, Mus musculus
ggtcaatgtaccatagttgcctgga

SEQ ID NO: 647395 - DNA, 25 bp, Mus musculus
ggtcaatgtaccttagttgcctgga

SEQ ID NO: 647396 - DNA, 25 bp, Mus musculus
ggtcaatgtgtgcatggccacgctc

SEQ ID NO: 647397 - DNA, 25 bp, Mus musculus
ggtcaatgtgtggatggccacgctc

SEQ ID NO: 647398 - DNA, 25 bp, Mus musculus
ggtcaatgtgttccattggctctaa

SEQ ID NO: 647399 - DNA, 25 bp, Mus musculus
ggtcaatgtgttgcattggctctaa

SEQ ID NO: 647400 - DNA, 25 bp, Mus musculus
ggtcaatgttggcagaatataaata

SEQ ID NO: 647401 - DNA, 25 bp, Mus musculus
ggtcaatgttgggagaatataaata

SEQ ID NO: 647402 - DNA, 25 bp, Mus musculus
ggtcaattacctcttcattaccatt

SEQ ID NO: 647403 - DNA, 25 bp, Mus musculus
ggtcaattacctgttcattaccatt

SEQ ID NO: 647404 - DNA, 25 bp, Mus musculus
ggtcaattagcccatctaccataga

SEQ ID NO: 647405 - DNA, 25 bp, Mus musculus
ggtcaattagccgatctaccataga

SEQ ID NO: 647406 - DNA, 25 bp, Mus musculus
ggtcaattctgtaactatgactcga

SEQ ID NO: 647407 - DNA, 25 bp, Mus musculus
ggtcaattctgttactatgactcga

SEQ ID NO: 647408 - DNA, 25 bp, Mus musculus
ggtcaattgaataactcagcctgaa

SEQ ID NO: 647409 - DNA, 25 bp, Mus musculus
ggtcaattgaattactcagcctgaa

SEQ ID NO: 647410 - DNA, 25 bp, Mus musculus
ggtcaatttggtcataccttagctg

SEQ ID NO: 647411 - DNA, 25 bp, Mus musculus
ggtcaatttggtgataccttagctg

SEQ ID NO: 647412 - DNA, 25 bp, Mus musculus
ggtcaattttcgcattcttagtaga

SEQ ID NO: 647413 - DNA, 25 bp, Mus musculus
ggtcaattttcggattcttagtaga

SEQ ID NO: 647414 - DNA, 25 bp, Mus musculus
ggtcacaaatgtcagcctgcagcca

SEQ ID NO: 647415 - DNA, 25 bp, Mus musculus
ggtcacaaatgtgagcctgcagcca

SEQ ID NO: 647416 - DNA, 25 bp, Mus musculus
ggtcacaacccacaaggtgagagct

SEQ ID NO: 647417 - DNA, 25 bp, Mus musculus
ggtcacaacccagaaggtgagagct

SEQ ID NO: 647418 - DNA, 25 bp, Mus musculus
ggtcacaactgcaaaccctggattg

SEQ ID NO: 647419 - DNA, 25 bp, Mus musculus
ggtcacaactgctaaccctggattg

SEQ ID NO: 647420 - DNA, 25 bp, Mus musculus
ggtcacaagactatcctattcctgg

SEQ ID NO: 647421 - DNA, 25 bp, Mus musculus
ggtcacaagactttcctattcctgg

SEQ ID NO: 647422 - DNA, 25 bp, Mus musculus
ggtcacaagatactggtctggcatc

SEQ ID NO: 647423 - DNA, 25 bp, Mus musculus
ggtcacaagatagtggtctggcatc

SEQ ID NO: 647424 - DNA, 25 bp, Mus musculus
ggtcacaagtatagccccgagaact

SEQ ID NO: 647425 - DNA, 25 bp, Mus musculus
ggtcacaagtattgccccgagaact

SEQ ID NO: 647426 - DNA, 25 bp, Mus musculus
ggtcacaatatacctatctcgttaa

SEQ ID NO: 647427 - DNA, 25 bp, Mus musculus
ggtcacaatatagctatctcgttaa

SEQ ID NO: 647428 - DNA, 25 bp, Mus musculus
ggtcacaatcaaactcaacaagaca

SEQ ID NO: 647429 - DNA, 25 bp, Mus musculus
ggtcacaatcaatctcaacaagaca

SEQ ID NO: 647430 - DNA, 25 bp, Mus musculus
ggtcacaatgacaggttttggcgaa

SEQ ID NO: 647431 - DNA, 25 bp, Mus musculus
ggtcacaatgactggttttggcgaa

SEQ ID NO: 647432 - DNA, 25 bp, Mus musculus
ggtcacacacctacctaatttacta

SEQ ID NO: 647433 - DNA, 25 bp, Mus musculus
ggtcacacaccttcctaatttacta

SEQ ID NO: 647434 - DNA, 25 bp, Mus musculus
ggtcacacaggtacatatgctactt

SEQ ID NO: 647435 - DNA, 25 bp, Mus musculus
ggtcacacaggttcatatgctactt

SEQ ID NO: 647436 - DNA, 25 bp, Mus musculus
ggtcacacctatacatcgggaaaag

SEQ ID NO: 647437 - DNA, 25 bp, Mus musculus
ggtcacacctattcatcgggaaaag

SEQ ID NO: 647438 - DNA, 25 bp, Mus musculus
ggtcacacgtggcaggatttgttcc

SEQ ID NO: 647439 - DNA, 25 bp, Mus musculus
ggtcacacgtgggaggatttgttcc

SEQ ID NO: 647440 - DNA, 25 bp, Mus musculus
ggtcacactaccactgttgtcaagt

SEQ ID NO: 647441 - DNA, 25 bp, Mus musculus
ggtcacactacctctgttgtcaagt

SEQ ID NO: 647442 - DNA, 25 bp, Mus musculus
ggtcacactgtgacactccgcagaa

SEQ ID NO: 647443 - DNA, 25 bp, Mus musculus
ggtcacactgtgtcactccgcagaa

SEQ ID NO: 647444 - DNA, 25 bp, Mus musculus
ggtcacagaatgacagcactgctat

SEQ ID NO: 647445 - DNA, 25 bp, Mus musculus
ggtcacagaatgtcagcactgctat

SEQ ID NO: 647446 - DNA, 25 bp, Mus musculus
ggtcacagacgaacctgagagaatc

SEQ ID NO: 647447 - DNA, 25 bp, Mus musculus
ggtcacagacgatcctgagagaatc

SEQ ID NO: 647448 - DNA, 25 bp, Mus musculus
ggtcacagagccacgcccactttct

SEQ ID NO: 647449 - DNA, 25 bp, Mus musculus
ggtcacagagcctcgcccactttct

SEQ ID NO: 647450 - DNA, 25 bp, Mus musculus
ggtcacagagctaggaggactcaga

SEQ ID NO: 647451 - DNA, 25 bp, Mus musculus
ggtcacagagcttggaggactcaga

SEQ ID NO: 647452 - DNA, 25 bp, Mus musculus
ggtcacagatctaactcacctagtg

SEQ ID NO: 647453 - DNA, 25 bp, Mus musculus
ggtcacagatcttactcacctagtg

SEQ ID NO: 647454 - DNA, 25 bp, Mus musculus
ggtcacagatgaataaggcaggatt

SEQ ID NO: 647455 - DNA, 25 bp, Mus musculus
ggtcacagatgattaaggcaggatt

SEQ ID NO: 647456 - DNA, 25 bp, Mus musculus
ggtcacagattaagcaagccagtgt

SEQ ID NO: 647457 - DNA, 25 bp, Mus musculus
ggtcacagattatgcaagccagtgt

SEQ ID NO: 647458 - DNA, 25 bp, Mus musculus
ggtcacagcaggcttacactaggaa

SEQ ID NO: 647459 - DNA, 25 bp, Mus musculus
ggtcacagcagggttacactaggaa

SEQ ID NO: 647460 - DNA, 25 bp, Mus musculus
ggtcacagcatacatgtctatacta

SEQ ID NO: 647461 - DNA, 25 bp, Mus musculus
ggtcacagcatagatgtctatacta

SEQ ID NO: 647462 - DNA, 25 bp, Mus musculus
ggtcacagctctaaatccacatata

SEQ ID NO: 647463 - DNA, 25 bp, Mus musculus
ggtcacagctcttaatccacatata

SEQ ID NO: 647464 - DNA, 25 bp, Mus musculus
ggtcacaggacccttctgatataaa

SEQ ID NO: 647465 - DNA, 25 bp, Mus musculus
ggtcacaggaccgttctgatataaa

SEQ ID NO: 647466 - DNA, 25 bp, Mus musculus
ggtcacaggcaaacctaggtacata

SEQ ID NO: 647467 - DNA, 25 bp, Mus musculus
ggtcacaggcaatcctaggtacata

SEQ ID NO: 647468 - DNA, 25 bp, Mus musculus
ggtcacaggctcattggtgctggaa

SEQ ID NO: 647469 - DNA, 25 bp, Mus musculus
ggtcacaggctctttggtgctggaa

SEQ ID NO: 647470 - DNA, 25 bp, Mus musculus
ggtcacaggttgatttccaccacag

SEQ ID NO: 647471 - DNA, 25 bp, Mus musculus
ggtcacaggttgttttccaccacag

SEQ ID NO: 647472 - DNA, 25 bp, Mus musculus
ggtcacagtcatataagcgctacag

SEQ ID NO: 647473 - DNA, 25 bp, Mus musculus
ggtcacagtcatttaagcgctacag

SEQ ID NO: 647474 - DNA, 25 bp, Mus musculus
ggtcacagtccactttttcgtaatg

SEQ ID NO: 647475 - DNA, 25 bp, Mus musculus
ggtcacagtccagtttttcgtaatg

SEQ ID NO: 647476 - DNA, 25 bp, Mus musculus
ggtcacagtgaacctagtgccccga

SEQ ID NO: 647477 - DNA, 25 bp, Mus musculus
ggtcacagtgaagctagtgccccga

SEQ ID NO: 647478 - DNA, 25 bp, Mus musculus
ggtcacagtgccacggtccttgccc

SEQ ID NO: 647479 - DNA, 25 bp, Mus musculus
ggtcacagtgcctcggtccttgccc

SEQ ID NO: 647480 - DNA, 25 bp, Mus musculus
ggtcacagttggcaatgtcagtatt

SEQ ID NO: 647481 - DNA, 25 bp, Mus musculus
ggtcacagttgggaatgtcagtatt

SEQ ID NO: 647482 - DNA, 25 bp, Mus musculus
ggtcacataaacataccatgctgaa

SEQ ID NO: 647483 - DNA, 25 bp, Mus musculus
ggtcacataaacttaccatgctgaa

SEQ ID NO: 647484 - DNA, 25 bp, Mus musculus
ggtcacataactagctttacactca

SEQ ID NO: 647485 - DNA, 25 bp, Mus musculus
ggtcacataacttgctttacactca

SEQ ID NO: 647486 - DNA, 25 bp, Mus musculus
ggtcacatataacaccctggtcact

SEQ ID NO: 647487 - DNA, 25 bp, Mus musculus
ggtcacatataagaccctggtcact

SEQ ID NO: 647488 - DNA, 25 bp, Mus musculus
ggtcacatatccataggccttgagt

SEQ ID NO: 647489 - DNA, 25 bp, Mus musculus
ggtcacatatccttaggccttgagt

SEQ ID NO: 647490 - DNA, 25 bp, Mus musculus
ggtcacatcaacaactgtcgaattg

SEQ ID NO: 647491 - DNA, 25 bp, Mus musculus
ggtcacatcaactactgtcgaattg

SEQ ID NO: 647492 - DNA, 25 bp, Mus musculus
ggtcacatcaagcaacaaaggcttt

SEQ ID NO: 647493 - DNA, 25 bp, Mus musculus
ggtcacatcaaggaacaaaggcttt

SEQ ID NO: 647494 - DNA, 25 bp, Mus musculus
ggtcacatctgtatacccattcctt

SEQ ID NO: 647495 - DNA, 25 bp, Mus musculus
ggtcacatctgtttacccattcctt

SEQ ID NO: 647496 - DNA, 25 bp, Mus musculus
ggtcacatgattagggaaaaaatag

SEQ ID NO: 647497 - DNA, 25 bp, Mus musculus
ggtcacatgatttgggaaaaaatag

SEQ ID NO: 647498 - DNA, 25 bp, Mus musculus
ggtcacatgcatacacacggtagtt

SEQ ID NO: 647499 - DNA, 25 bp, Mus musculus
ggtcacatgcattcacacggtagtt

SEQ ID NO: 647500 - DNA, 25 bp, Mus musculus
ggtcacatggatattagccctgctg

SEQ ID NO: 647501 - DNA, 25 bp, Mus musculus
ggtcacatggattttagccctgctg

SEQ ID NO: 647502 - DNA, 25 bp, Mus musculus
ggtcacatgtagaactttcccataa

SEQ ID NO: 647503 - DNA, 25 bp, Mus musculus
ggtcacatgtagtactttcccataa

SEQ ID NO: 647504 - DNA, 25 bp, Mus musculus
ggtcacatgtttactatttcagagt

SEQ ID NO: 647505 - DNA, 25 bp, Mus musculus
ggtcacatgttttctatttcagagt

SEQ ID NO: 647506 - DNA, 25 bp, Mus musculus
ggtcacattaacacaggcatttctt

SEQ ID NO: 647507 - DNA, 25 bp, Mus musculus
ggtcacattaactcaggcatttctt

SEQ ID NO: 647508 - DNA, 25 bp, Mus musculus
ggtcacattctcatgctaaattact

SEQ ID NO: 647509 - DNA, 25 bp, Mus musculus
ggtcacattctcttgctaaattact

SEQ ID NO: 647510 - DNA, 25 bp, Mus musculus
ggtcacattgctcacatctttttaa

SEQ ID NO: 647511 - DNA, 25 bp, Mus musculus
ggtcacattgctgacatctttttaa

SEQ ID NO: 647512 - DNA, 25 bp, Mus musculus
ggtcaccaaactagctttcatggca

SEQ ID NO: 647513 - DNA, 25 bp, Mus musculus
ggtcaccaaacttgctttcatggca

SEQ ID NO: 647514 - DNA, 25 bp, Mus musculus
ggtcaccaacacaattactgtaaat

SEQ ID NO: 647515 - DNA, 25 bp, Mus musculus
ggtcaccaacaccaacagtcttgaa

SEQ ID NO: 647516 - DNA, 25 bp, Mus musculus
ggtcaccaacacgaacagtcttgaa

SEQ ID NO: 647517 - DNA, 25 bp, Mus musculus
ggtcaccaacactattactgtaaat

SEQ ID NO: 647518 - DNA, 25 bp, Mus musculus
ggtcaccacaaaccccttcaaagag

SEQ ID NO: 647519 - DNA, 25 bp, Mus musculus
ggtcaccacaaagcccttcaaagag

SEQ ID NO: 647520 - DNA, 25 bp, Mus musculus
ggtcaccaccacattcagtttggtt

SEQ ID NO: 647521 - DNA, 25 bp, Mus musculus
ggtcaccaccactttcagtttggtt

SEQ ID NO: 647522 - DNA, 25 bp, Mus musculus
ggtcaccagctgatttgatgctgca

SEQ ID NO: 647523 - DNA, 25 bp, Mus musculus
ggtcaccagctgttttgatgctgca

SEQ ID NO: 647524 - DNA, 25 bp, Mus musculus
ggtcaccagtgccaagaacatccgt

SEQ ID NO: 647525 - DNA, 25 bp, Mus musculus
ggtcaccagtgcgaagaacatccgt

SEQ ID NO: 647526 - DNA, 25 bp, Mus musculus
ggtcaccagttaaccaggcatctat

SEQ ID NO: 647527 - DNA, 25 bp, Mus musculus
ggtcaccagttatccaggcatctat

SEQ ID NO: 647528 - DNA, 25 bp, Mus musculus
ggtcaccagttgatatgttttcttt

SEQ ID NO: 647529 - DNA, 25 bp, Mus musculus
ggtcaccagttgttatgttttcttt

SEQ ID NO: 647530 - DNA, 25 bp, Mus musculus
ggtcaccataaaccacacagctgca

SEQ ID NO: 647531 - DNA, 25 bp, Mus musculus
ggtcaccataaagcacacagctgca

SEQ ID NO: 647532 - DNA, 25 bp, Mus musculus
ggtcaccatcataaaatatcccaac

SEQ ID NO: 647533 - DNA, 25 bp, Mus musculus
ggtcaccatcattaaatatcccaac

SEQ ID NO: 647534 - DNA, 25 bp, Mus musculus
ggtcaccatctcctcaaatggatca

SEQ ID NO: 647535 - DNA, 25 bp, Mus musculus
ggtcaccatctcgtcaaatggatca

SEQ ID NO: 647536 - DNA, 25 bp, Mus musculus
ggtcaccatctgaagcctggaagga

SEQ ID NO: 647537 - DNA, 25 bp, Mus musculus
ggtcaccatctgtagcctggaagga

SEQ ID NO: 647538 - DNA, 25 bp, Mus musculus
ggtcaccatgttcgatttgtgcaga

SEQ ID NO: 647539 - DNA, 25 bp, Mus musculus
ggtcaccatgttggatttgtgcaga

SEQ ID NO: 647540 - DNA, 25 bp, Mus musculus
ggtcaccattgcaaaggactttctt

SEQ ID NO: 647541 - DNA, 25 bp, Mus musculus
ggtcaccattgctaaggactttctt

SEQ ID NO: 647542 - DNA, 25 bp, Mus musculus
ggtcacccaccgacagatttacaga

SEQ ID NO: 647543 - DNA, 25 bp, Mus musculus
ggtcacccaccgtcagatttacaga

SEQ ID NO: 647544 - DNA, 25 bp, Mus musculus
ggtcacccatcaaatgcttcatggt

SEQ ID NO: 647545 - DNA, 25 bp, Mus musculus
ggtcacccatcatatgcttcatggt

SEQ ID NO: 647546 - DNA, 25 bp, Mus musculus
ggtcaccctggcactggacagttaa

SEQ ID NO: 647547 - DNA, 25 bp, Mus musculus
ggtcaccctggctctggacagttaa

SEQ ID NO: 647548 - DNA, 25 bp, Mus musculus
ggtcaccgaaccagcagagatcatg

SEQ ID NO: 647549 - DNA, 25 bp, Mus musculus
ggtcaccgaacctgcagagatcatg

SEQ ID NO: 647550 - DNA, 25 bp, Mus musculus
ggtcaccgaagcctcttgtggacag

SEQ ID NO: 647551 - DNA, 25 bp, Mus musculus
ggtcaccgaagcgtcttgtggacag

SEQ ID NO: 647552 - DNA, 25 bp, Mus musculus
ggtcaccgcctcattgcagctaaga

SEQ ID NO: 647553 - DNA, 25 bp, Mus musculus
ggtcaccgcctctttgcagctaaga

SEQ ID NO: 647554 - DNA, 25 bp, Mus musculus
ggtcaccgcgacagcctgggagcac

SEQ ID NO: 647555 - DNA, 25 bp, Mus musculus
ggtcaccgcgactgcctgggagcac

SEQ ID NO: 647556 - DNA, 25 bp, Mus musculus
ggtcaccgtagaacctacatattag

SEQ ID NO: 647557 - DNA, 25 bp, Mus musculus
ggtcaccgtagatcctacatattag

SEQ ID NO: 647558 - DNA, 25 bp, Mus musculus
ggtcacctatgaaatcaagctcttg

SEQ ID NO: 647559 - DNA, 25 bp, Mus musculus
ggtcacctatgatatcaagctcttg

SEQ ID NO: 647560 - DNA, 25 bp, Mus musculus
ggtcacctcaacagaatcctataag

SEQ ID NO: 647561 - DNA, 25 bp, Mus musculus
ggtcacctcaactgaatcctataag

SEQ ID NO: 647562 - DNA, 25 bp, Mus musculus
ggtcacctcagaacctactgaggat

SEQ ID NO: 647563 - DNA, 25 bp, Mus musculus
ggtcacctcagatcctactgaggat

SEQ ID NO: 647564 - DNA, 25 bp, Mus musculus
ggtcacctcattctctgaagctgtg

SEQ ID NO: 647565 - DNA, 25 bp, Mus musculus
ggtcacctcattgtctgaagctgtg

SEQ ID NO: 647566 - DNA, 25 bp, Mus musculus
ggtcacctccaacgcaaatgtccaa

SEQ ID NO: 647567 - DNA, 25 bp, Mus musculus
ggtcacctccaacggccttagtaag

SEQ ID NO: 647568 - DNA, 25 bp, Mus musculus
ggtcacctccaaggcaaatgtccaa

SEQ ID NO: 647569 - DNA, 25 bp, Mus musculus
ggtcacctccaagggccttagtaag

SEQ ID NO: 647570 - DNA, 25 bp, Mus musculus
ggtcacctcctacagcagattgcta

SEQ ID NO: 647571 - DNA, 25 bp, Mus musculus
ggtcacctcctagagcagattgcta

SEQ ID NO: 647572 - DNA, 25 bp, Mus musculus
ggtcacctctggaactttagatgcc

SEQ ID NO: 647573 - DNA, 25 bp, Mus musculus
ggtcacctctggcaatgtgggctac

SEQ ID NO: 647574 - DNA, 25 bp, Mus musculus
ggtcacctctgggaatgtgggctac

SEQ ID NO: 647575 - DNA, 25 bp, Mus musculus
ggtcacctctggtactttagatgcc

SEQ ID NO: 647576 - DNA, 25 bp, Mus musculus
ggtcacctcttgaagctaggcagga

SEQ ID NO: 647577 - DNA, 25 bp, Mus musculus
ggtcacctcttgtagctaggcagga

SEQ ID NO: 647578 - DNA, 25 bp, Mus musculus
ggtcacctgccaccaaattagacaa

SEQ ID NO: 647579 - DNA, 25 bp, Mus musculus
ggtcacctgccagcaaattagacaa

SEQ ID NO: 647580 - DNA, 25 bp, Mus musculus
ggtcacctggtgaactgtattaaag

SEQ ID NO: 647581 - DNA, 25 bp, Mus musculus
ggtcacctggtgtactgtattaaag

SEQ ID NO: 647582 - DNA, 25 bp, Mus musculus
ggtcaccttctcactaaaatggatc

SEQ ID NO: 647583 - DNA, 25 bp, Mus musculus
ggtcaccttctctctaaaatggatc

SEQ ID NO: 647584 - DNA, 25 bp, Mus musculus
ggtcaccttgaaattgattccccag

SEQ ID NO: 647585 - DNA, 25 bp, Mus musculus
ggtcaccttgaatttgattccccag

SEQ ID NO: 647586 - DNA, 25 bp, Mus musculus
ggtcacctttttctaatcgccatag

SEQ ID NO: 647587 - DNA, 25 bp, Mus musculus
ggtcacctttttgtaatcgccatag

SEQ ID NO: 647588 - DNA, 25 bp, Mus musculus
ggtcacgaagtcaaccgtgccactg

SEQ ID NO: 647589 - DNA, 25 bp, Mus musculus
ggtcacgaagtctaccgtgccactg

SEQ ID NO: 647590 - DNA, 25 bp, Mus musculus
ggtcacgataagaccggaactttca

SEQ ID NO: 647591 - DNA, 25 bp, Mus musculus
ggtcacgataagtccggaactttca

SEQ ID NO: 647592 - DNA, 25 bp, Mus musculus
ggtcacgatagccaaaattcccaga

SEQ ID NO: 647593 - DNA, 25 bp, Mus musculus
ggtcacgatagcgaaaattcccaga

SEQ ID NO: 647594 - DNA, 25 bp, Mus musculus
ggtcacgcagtcctcattccagtat

SEQ ID NO: 647595 - DNA, 25 bp, Mus musculus
ggtcacgcagtcgtcattccagtat

SEQ ID NO: 647596 - DNA, 25 bp, Mus musculus
ggtcacgccaaacaggctagatctt

SEQ ID NO: 647597 - DNA, 25 bp, Mus musculus
ggtcacgccaaagaggctagatctt

SEQ ID NO: 647598 - DNA, 25 bp, Mus musculus
ggtcacgctgatctttcttcatgaa

SEQ ID NO: 647599 - DNA, 25 bp, Mus musculus
ggtcacgctgatgtttcttcatgaa

SEQ ID NO: 647600 - DNA, 25 bp, Mus musculus
ggtcacggatttaatacgactgctt

SEQ ID NO: 647601 - DNA, 25 bp, Mus musculus
ggtcacggattttatacgactgctt

SEQ ID NO: 647602 - DNA, 25 bp, Mus musculus
ggtcacggcagcagtcataacagag

SEQ ID NO: 647603 - DNA, 25 bp, Mus musculus
ggtcacggcagctgtcataacagag

SEQ ID NO: 647604 - DNA, 25 bp, Mus musculus
ggtcacgggactcgattcttagaga

SEQ ID NO: 647605 - DNA, 25 bp, Mus musculus
ggtcacgggactggattcttagaga

SEQ ID NO: 647606 - DNA, 25 bp, Mus musculus
ggtcacggtccacggcactgcagtc

SEQ ID NO: 647607 - DNA, 25 bp, Mus musculus
ggtcacggtccagggcactgcagtc

SEQ ID NO: 647608 - DNA, 25 bp, Mus musculus
ggtcacgtcatgcacaattccaatt

SEQ ID NO: 647609 - DNA, 25 bp, Mus musculus
ggtcacgtcatggacaattccaatt

SEQ ID NO: 647610 - DNA, 25 bp, Mus musculus
ggtcacgtcccaccagggcatgcaa

SEQ ID NO: 647611 - DNA, 25 bp, Mus musculus
ggtcacgtcccagcagggcatgcaa

SEQ ID NO: 647612 - DNA, 25 bp, Mus musculus
ggtcacgtgattaccatgcttcagt

SEQ ID NO: 647613 - DNA, 25 bp, Mus musculus
ggtcacgtgatttccatgcttcagt

SEQ ID NO: 647614 - DNA, 25 bp, Mus musculus
ggtcacgtggttccctcctatggag

SEQ ID NO: 647615 - DNA, 25 bp, Mus musculus
ggtcacgtggttgcctcctatggag

SEQ ID NO: 647616 - DNA, 25 bp, Mus musculus
ggtcacgtgttcatttagttctgga

SEQ ID NO: 647617 - DNA, 25 bp, Mus musculus
ggtcacgtgttcttttagttctgga

SEQ ID NO: 647618 - DNA, 25 bp, Mus musculus
ggtcactaaaacctttagcacttag

SEQ ID NO: 647619 - DNA, 25 bp, Mus musculus
ggtcactaaaacgtttagcacttag

SEQ ID NO: 647620 - DNA, 25 bp, Mus musculus
ggtcactaacagctcacttttattt

SEQ ID NO: 647621 - DNA, 25 bp, Mus musculus
ggtcactaacaggtcacttttattt

SEQ ID NO: 647622 - DNA, 25 bp, Mus musculus
ggtcactaagatccacaattaatta

SEQ ID NO: 647623 - DNA, 25 bp, Mus musculus
ggtcactaagatgcacaattaatta

SEQ ID NO: 647624 - DNA, 25 bp, Mus musculus
ggtcactaagcactttctctggaag

SEQ ID NO: 647625 - DNA, 25 bp, Mus musculus
ggtcactaagcagtttctctggaag

SEQ ID NO: 647626 - DNA, 25 bp, Mus musculus
ggtcactaagctccctgcaagagga

SEQ ID NO: 647627 - DNA, 25 bp, Mus musculus
ggtcactaagctgcctgcaagagga

SEQ ID NO: 647628 - DNA, 25 bp, Mus musculus
ggtcactaatacaactgcgcaggca

SEQ ID NO: 647629 - DNA, 25 bp, Mus musculus
ggtcactaatactactgcgcaggca

SEQ ID NO: 647630 - DNA, 25 bp, Mus musculus
ggtcactacaacacaagtaactgca

SEQ ID NO: 647631 - DNA, 25 bp, Mus musculus
ggtcactacaactcaagtaactgca

SEQ ID NO: 647632 - DNA, 25 bp, Mus musculus
ggtcactaccaacacacatcagaga

SEQ ID NO: 647633 - DNA, 25 bp, Mus musculus
ggtcactaccaagacacatcagaga

SEQ ID NO: 647634 - DNA, 25 bp, Mus musculus
ggtcactacgttcacgctggcaaca

SEQ ID NO: 647635 - DNA, 25 bp, Mus musculus
ggtcactacgttgacgctggcaaca

SEQ ID NO: 647636 - DNA, 25 bp, Mus musculus
ggtcactactaccactttgtgaggg

SEQ ID NO: 647637 - DNA, 25 bp, Mus musculus
ggtcactactacgactttgtgaggg

SEQ ID NO: 647638 - DNA, 25 bp, Mus musculus
ggtcactactgtagagtttctgcaa

SEQ ID NO: 647639 - DNA, 25 bp, Mus musculus
ggtcactactgttgagtttctgcaa

SEQ ID NO: 647640 - DNA, 25 bp, Mus musculus
ggtcactaggcaagccaactgcggg

SEQ ID NO: 647641 - DNA, 25 bp, Mus musculus
ggtcactaggcatgccaactgcggg

SEQ ID NO: 647642 - DNA, 25 bp, Mus musculus
ggtcactagggcctgggtatccaaa

SEQ ID NO: 647643 - DNA, 25 bp, Mus musculus
ggtcactagggcgtgggtatccaaa

SEQ ID NO: 647644 - DNA, 25 bp, Mus musculus
ggtcactatcatcaccatggacaaa

SEQ ID NO: 647645 - DNA, 25 bp, Mus musculus
ggtcactatcatcatgtgtctgtgt

SEQ ID NO: 647646 - DNA, 25 bp, Mus musculus
ggtcactatcatgaccatggacaaa

SEQ ID NO: 647647 - DNA, 25 bp, Mus musculus
ggtcactatcatgatgtgtctgtgt

SEQ ID NO: 647648 - DNA, 25 bp, Mus musculus
ggtcactatgcccaggttcagatgt

SEQ ID NO: 647649 - DNA, 25 bp, Mus musculus
ggtcactatgccgaggttcagatgt

SEQ ID NO: 647650 - DNA, 25 bp, Mus musculus
ggtcactatttaatcttggtccctt

SEQ ID NO: 647651 - DNA, 25 bp, Mus musculus
ggtcactatttattcttggtccctt

SEQ ID NO: 647652 - DNA, 25 bp, Mus musculus
ggtcactcaataactgaaagtcctc

SEQ ID NO: 647653 - DNA, 25 bp, Mus musculus
ggtcactcaatatctgaaagtcctc

SEQ ID NO: 647654 - DNA, 25 bp, Mus musculus
ggtcactcagacaacattttactca

SEQ ID NO: 647655 - DNA, 25 bp, Mus musculus
ggtcactcagactacattttactca

SEQ ID NO: 647656 - DNA, 25 bp, Mus musculus
ggtcactccaacactctggaagggt

SEQ ID NO: 647657 - DNA, 25 bp, Mus musculus
ggtcactccaactctctggaagggt

SEQ ID NO: 647658 - DNA, 25 bp, Mus musculus
ggtcactccactctcggaggcagag

SEQ ID NO: 647659 - DNA, 25 bp, Mus musculus
ggtcactccactgtcggaggcagag

SEQ ID NO: 647660 - DNA, 25 bp, Mus musculus
ggtcactcctaacatatgcatgcca

SEQ ID NO: 647661 - DNA, 25 bp, Mus musculus
ggtcactcctaagatatgcatgcca

SEQ ID NO: 647662 - DNA, 25 bp, Mus musculus
ggtcactcgcaacgatatcccaggg

SEQ ID NO: 647663 - DNA, 25 bp, Mus musculus
ggtcactcgcaaggatatcccaggg

SEQ ID NO: 647664 - DNA, 25 bp, Mus musculus
ggtcactcgtcaaacctagggatta

SEQ ID NO: 647665 - DNA, 25 bp, Mus musculus
ggtcactcgtcatacctagggatta

SEQ ID NO: 647666 - DNA, 25 bp, Mus musculus
ggtcactctagccaggtcccaaagg

SEQ ID NO: 647667 - DNA, 25 bp, Mus musculus
ggtcactctagcgaggtcccaaagg

SEQ ID NO: 647668 - DNA, 25 bp, Mus musculus
ggtcactctcagacatttagtaagg

SEQ ID NO: 647669 - DNA, 25 bp, Mus musculus
ggtcactctcagtcatttagtaagg

SEQ ID NO: 647670 - DNA, 25 bp, Mus musculus
ggtcactctccaattatgatggaag

SEQ ID NO: 647671 - DNA, 25 bp, Mus musculus
ggtcactctccatttatgatggaag

SEQ ID NO: 647672 - DNA, 25 bp, Mus musculus
ggtcactctgacacttttaaagact

SEQ ID NO: 647673 - DNA, 25 bp, Mus musculus
ggtcactctgactcttttaaagact

SEQ ID NO: 647674 - DNA, 25 bp, Mus musculus
ggtcactctggacaaccaagatgtt

SEQ ID NO: 647675 - DNA, 25 bp, Mus musculus
ggtcactctggagaaccaagatgtt

SEQ ID NO: 647676 - DNA, 25 bp, Mus musculus
ggtcactgagtgagcaatctcaagg

SEQ ID NO: 647677 - DNA, 25 bp, Mus musculus
ggtcactgagtgtgcaatctcaagg

SEQ ID NO: 647678 - DNA, 25 bp, Mus musculus
ggtcactgctacatctagcttttta

SEQ ID NO: 647679 - DNA, 25 bp, Mus musculus
ggtcactgctacttctagcttttta

SEQ ID NO: 647680 - DNA, 25 bp, Mus musculus
ggtcactggaagctcatcttgtttt

SEQ ID NO: 647681 - DNA, 25 bp, Mus musculus
ggtcactggaaggtcatcttgtttt

SEQ ID NO: 647682 - DNA, 25 bp, Mus musculus
ggtcactggacacaacagtttatca

SEQ ID NO: 647683 - DNA, 25 bp, Mus musculus
ggtcactggacagaacagtttatca

SEQ ID NO: 647684 - DNA, 25 bp, Mus musculus
ggtcactggattccaggcagctaaa

SEQ ID NO: 647685 - DNA, 25 bp, Mus musculus
ggtcactggattgcaggcagctaaa

SEQ ID NO: 647686 - DNA, 25 bp, Mus musculus
ggtcactggcctcctaaacaaaagc

SEQ ID NO: 647687 - DNA, 25 bp, Mus musculus
ggtcactggcctgctaaacaaaagc

SEQ ID NO: 647688 - DNA, 25 bp, Mus musculus
ggtcactggctcaccaggaacctaa

SEQ ID NO: 647689 - DNA, 25 bp, Mus musculus
ggtcactggctctccaggaacctaa

SEQ ID NO: 647690 - DNA, 25 bp, Mus musculus
ggtcactgtcacagaagggttgcct

SEQ ID NO: 647691 - DNA, 25 bp, Mus musculus
ggtcactgtcactgaagggttgcct

SEQ ID NO: 647692 - DNA, 25 bp, Mus musculus
ggtcactgtccactctggagttcta

SEQ ID NO: 647693 - DNA, 25 bp, Mus musculus
ggtcactgtccagtctggagttcta

SEQ ID NO: 647694 - DNA, 25 bp, Mus musculus
ggtcactgtgaaccatttcaaagaa

SEQ ID NO: 647695 - DNA, 25 bp, Mus musculus
ggtcactgtgaagcatttcaaagaa

SEQ ID NO: 647696 - DNA, 25 bp, Mus musculus
ggtcactgtgccctaatgggttgtc

SEQ ID NO: 647697 - DNA, 25 bp, Mus musculus
ggtcactgtgccgtaatgggttgtc

SEQ ID NO: 647698 - DNA, 25 bp, Mus musculus
ggtcactgtgctacgttctccttta

SEQ ID NO: 647699 - DNA, 25 bp, Mus musculus
ggtcactgtgcttcgttctccttta

SEQ ID NO: 647700 - DNA, 25 bp, Mus musculus
ggtcacttaaccaatatcacatacg

SEQ ID NO: 647701 - DNA, 25 bp, Mus musculus
ggtcacttaacctatatcacatacg

SEQ ID NO: 647702 - DNA, 25 bp, Mus musculus
ggtcacttatagatgtattagctgt

SEQ ID NO: 647703 - DNA, 25 bp, Mus musculus
ggtcacttatagattgctgtatatg

SEQ ID NO: 647704 - DNA, 25 bp, Mus musculus
ggtcacttatagttgtattagctgt

SEQ ID NO: 647705 - DNA, 25 bp, Mus musculus
ggtcacttatagtttgctgtatatg

SEQ ID NO: 647706 - DNA, 25 bp, Mus musculus
ggtcacttcacccatacatgaaaaa

SEQ ID NO: 647707 - DNA, 25 bp, Mus musculus
ggtcacttcaccgatacatgaaaaa

SEQ ID NO: 647708 - DNA, 25 bp, Mus musculus
ggtcacttcataatagaggtcacta

SEQ ID NO: 647709 - DNA, 25 bp, Mus musculus
ggtcacttcatattagaggtcacta

SEQ ID NO: 647710 - DNA, 25 bp, Mus musculus
ggtcacttcctactcctcaaattga

SEQ ID NO: 647711 - DNA, 25 bp, Mus musculus
ggtcacttcctagtcctcaaattga

SEQ ID NO: 647712 - DNA, 25 bp, Mus musculus
ggtcacttctgaatactcgtttggt

SEQ ID NO: 647713 - DNA, 25 bp, Mus musculus
ggtcacttctgattactcgtttggt

SEQ ID NO: 647714 - DNA, 25 bp, Mus musculus
ggtcacttgagcctagaaggtttga

SEQ ID NO: 647715 - DNA, 25 bp, Mus musculus
ggtcacttgagcgtagaaggtttga

SEQ ID NO: 647716 - DNA, 25 bp, Mus musculus
ggtcacttgaggacatcttagcggt

SEQ ID NO: 647717 - DNA, 25 bp, Mus musculus
ggtcacttgaggtcatcttagcggt

SEQ ID NO: 647718 - DNA, 25 bp, Mus musculus
ggtcacttgctgattctcagatctt

SEQ ID NO: 647719 - DNA, 25 bp, Mus musculus
ggtcacttgctgtttctcagatctt

SEQ ID NO: 647720 - DNA, 25 bp, Mus musculus
ggtcacttggtgatagctctatgcc

SEQ ID NO: 647721 - DNA, 25 bp, Mus musculus
ggtcacttggtgcactatactatga

SEQ ID NO: 647722 - DNA, 25 bp, Mus musculus
ggtcacttggtggactatactatga

SEQ ID NO: 647723 - DNA, 25 bp, Mus musculus
ggtcacttggtgttagctctatgcc

SEQ ID NO: 647724 - DNA, 25 bp, Mus musculus
ggtcacttgtgacggtttacacctt

SEQ ID NO: 647725 - DNA, 25 bp, Mus musculus
ggtcacttgtgagggtttacacctt

SEQ ID NO: 647726 - DNA, 25 bp, Mus musculus
ggtcactttaacaacctccaaattg

SEQ ID NO: 647727 - DNA, 25 bp, Mus musculus
ggtcactttaactacctccaaattg

SEQ ID NO: 647728 - DNA, 25 bp, Mus musculus
ggtcactttaggcactatgctatag

SEQ ID NO: 647729 - DNA, 25 bp, Mus musculus
ggtcactttagggactatgctatag

SEQ ID NO: 647730 - DNA, 25 bp, Mus musculus
ggtcactttcctccacttggatcaa

SEQ ID NO: 647731 - DNA, 25 bp, Mus musculus
ggtcactttcctctagcatattgct

SEQ ID NO: 647732 - DNA, 25 bp, Mus musculus
ggtcactttcctgcacttggatcaa

SEQ ID NO: 647733 - DNA, 25 bp, Mus musculus
ggtcactttcctgtagcatattgct

SEQ ID NO: 647734 - DNA, 25 bp, Mus musculus
ggtcactttctgaccttgacatttt

SEQ ID NO: 647735 - DNA, 25 bp, Mus musculus
ggtcactttctgtccttgacatttt

SEQ ID NO: 647736 - DNA, 25 bp, Mus musculus
ggtcactttgggagctttagcagat

SEQ ID NO: 647737 - DNA, 25 bp, Mus musculus
ggtcactttgggtgctttagcagat

SEQ ID NO: 647738 - DNA, 25 bp, Mus musculus
ggtcactttgtaaatagaacttcat

SEQ ID NO: 647739 - DNA, 25 bp, Mus musculus
ggtcactttgtacaatgtagatttg

SEQ ID NO: 647740 - DNA, 25 bp, Mus musculus
ggtcactttgtagaatgtagatttg

SEQ ID NO: 647741 - DNA, 25 bp, Mus musculus
ggtcactttgtatatagaacttcat

SEQ ID NO: 647742 - DNA, 25 bp, Mus musculus
ggtcacttttatcggagcggctgca

SEQ ID NO: 647743 - DNA, 25 bp, Mus musculus
ggtcacttttatgggagcggctgca

SEQ ID NO: 647744 - DNA, 25 bp, Mus musculus
ggtcacttttgccataagcgaactt

SEQ ID NO: 647745 - DNA, 25 bp, Mus musculus
ggtcacttttgcgataagcgaactt

SEQ ID NO: 647746 - DNA, 25 bp, Mus musculus
ggtcagaaacaacgcatccaccagc

SEQ ID NO: 647747 - DNA, 25 bp, Mus musculus
ggtcagaaacaaggcatccaccagc

SEQ ID NO: 647748 - DNA, 25 bp, Mus musculus
ggtcagaaatgcctgattcagtgat

SEQ ID NO: 647749 - DNA, 25 bp, Mus musculus
ggtcagaaatgcgtgattcagtgat

SEQ ID NO: 647750 - DNA, 25 bp, Mus musculus
ggtcagaacacccagtccaggagta

SEQ ID NO: 647751 - DNA, 25 bp, Mus musculus
ggtcagaacaccgagtccaggagta

SEQ ID NO: 647752 - DNA, 25 bp, Mus musculus
ggtcagaagaaacgtgcagcctcca

SEQ ID NO: 647753 - DNA, 25 bp, Mus musculus
ggtcagaagaaaggtgcagcctcca

SEQ ID NO: 647754 - DNA, 25 bp, Mus musculus
ggtcagaagacactccactgtggct

SEQ ID NO: 647755 - DNA, 25 bp, Mus musculus
ggtcagaagacagtccactgtggct

SEQ ID NO: 647756 - DNA, 25 bp, Mus musculus
ggtcagaagaggctaccacattctc

SEQ ID NO: 647757 - DNA, 25 bp, Mus musculus
ggtcagaagagggtaccacattctc

SEQ ID NO: 647758 - DNA, 25 bp, Mus musculus
ggtcagaaggatcgtcgcccaactg

SEQ ID NO: 647759 - DNA, 25 bp, Mus musculus
ggtcagaaggatggtcgcccaactg

SEQ ID NO: 647760 - DNA, 25 bp, Mus musculus
ggtcagaatttcacaatggagccct

SEQ ID NO: 647761 - DNA, 25 bp, Mus musculus
ggtcagaatttccacatgttcacaa

SEQ ID NO: 647762 - DNA, 25 bp, Mus musculus
ggtcagaatttcgacatgttcacaa

SEQ ID NO: 647763 - DNA, 25 bp, Mus musculus
ggtcagaatttctcaatggagccct

SEQ ID NO: 647764 - DNA, 25 bp, Mus musculus
ggtcagacaattctgcaggccagat

SEQ ID NO: 647765 - DNA, 25 bp, Mus musculus
ggtcagacaattgtgcaggccagat

SEQ ID NO: 647766 - DNA, 25 bp, Mus musculus
ggtcagacacccatgaccgtcaatc

SEQ ID NO: 647767 - DNA, 25 bp, Mus musculus
ggtcagacacccttgaccgtcaatc

SEQ ID NO: 647768 - DNA, 25 bp, Mus musculus
ggtcagacactcagtggcctgcaag

SEQ ID NO: 647769 - DNA, 25 bp, Mus musculus
ggtcagacactctgtggcctgcaag

SEQ ID NO: 647770 - DNA, 25 bp, Mus musculus
ggtcagacagctcttcattatgccg

SEQ ID NO: 647771 - DNA, 25 bp, Mus musculus
ggtcagacagctgttcattatgccg

SEQ ID NO: 647772 - DNA, 25 bp, Mus musculus
ggtcagacaggcacacacgttggaa

SEQ ID NO: 647773 - DNA, 25 bp, Mus musculus
ggtcagacaggctcacacgttggaa

SEQ ID NO: 647774 - DNA, 25 bp, Mus musculus
ggtcagacagtgcagcagagccctt

SEQ ID NO: 647775 - DNA, 25 bp, Mus musculus
ggtcagacagtggagcagagccctt

SEQ ID NO: 647776 - DNA, 25 bp, Mus musculus
ggtcagaccacacaaggtgccacat

SEQ ID NO: 647777 - DNA, 25 bp, Mus musculus
ggtcagaccacagaaggtgccacat

SEQ ID NO: 647778 - DNA, 25 bp, Mus musculus
ggtcagaccagaatccaattagcaa

SEQ ID NO: 647779 - DNA, 25 bp, Mus musculus
ggtcagaccagattccaattagcaa

SEQ ID NO: 647780 - DNA, 25 bp, Mus musculus
ggtcagacctcaccttgaagcaaaa

SEQ ID NO: 647781 - DNA, 25 bp, Mus musculus
ggtcagacctcagcttgaagcaaaa

SEQ ID NO: 647782 - DNA, 25 bp, Mus musculus
ggtcagactacactttacagatcac

SEQ ID NO: 647783 - DNA, 25 bp, Mus musculus
ggtcagactacagtttacagatcac

SEQ ID NO: 647784 - DNA, 25 bp, Mus musculus
ggtcagactttaagtaagctttata

SEQ ID NO: 647785 - DNA, 25 bp, Mus musculus
ggtcagactttatgtaagctttata

SEQ ID NO: 647786 - DNA, 25 bp, Mus musculus
ggtcagagacacaaagctgggccca

SEQ ID NO: 647787 - DNA, 25 bp, Mus musculus
ggtcagagacactaagctgggccca

SEQ ID NO: 647788 - DNA, 25 bp, Mus musculus
ggtcagagaccaaagggccatctct

SEQ ID NO: 647789 - DNA, 25 bp, Mus musculus
ggtcagagaccatagggccatctct

SEQ ID NO: 647790 - DNA, 25 bp, Mus musculus
ggtcagagactaacacctttgtgag

SEQ ID NO: 647791 - DNA, 25 bp, Mus musculus
ggtcagagactatcacctttgtgag

SEQ ID NO: 647792 - DNA, 25 bp, Mus musculus
ggtcagagactcaaacagtatttga

SEQ ID NO: 647793 - DNA, 25 bp, Mus musculus
ggtcagagactctaacagtatttga

SEQ ID NO: 647794 - DNA, 25 bp, Mus musculus
ggtcagagattgattcctttggttt

SEQ ID NO: 647795 - DNA, 25 bp, Mus musculus
ggtcagagattgtttcctttggttt

SEQ ID NO: 647796 - DNA, 25 bp, Mus musculus
ggtcagagccagagcgtcagtcgtc

SEQ ID NO: 647797 - DNA, 25 bp, Mus musculus
ggtcagagccagtgcgtcagtcgtc

SEQ ID NO: 647798 - DNA, 25 bp, Mus musculus
ggtcagagccctagacttggagaat

SEQ ID NO: 647799 - DNA, 25 bp, Mus musculus
ggtcagagccctcctagaacagact

SEQ ID NO: 647800 - DNA, 25 bp, Mus musculus
ggtcagagccctgctagaacagact

SEQ ID NO: 647801 - DNA, 25 bp, Mus musculus
ggtcagagcccttgacttggagaat

SEQ ID NO: 647802 - DNA, 25 bp, Mus musculus
ggtcagaggtcaacaatttgccata

SEQ ID NO: 647803 - DNA, 25 bp, Mus musculus
ggtcagaggtcatcaatttgccata

SEQ ID NO: 647804 - DNA, 25 bp, Mus musculus
ggtcagagtaccacataaagcaatt

SEQ ID NO: 647805 - DNA, 25 bp, Mus musculus
ggtcagagtacctcataaagcaatt

SEQ ID NO: 647806 - DNA, 25 bp, Mus musculus
ggtcagagtgacatgcagtttcaga

SEQ ID NO: 647807 - DNA, 25 bp, Mus musculus
ggtcagagtgacttgcagtttcaga

SEQ ID NO: 647808 - DNA, 25 bp, Mus musculus
ggtcagagttagaacccattcctca

SEQ ID NO: 647809 - DNA, 25 bp, Mus musculus
ggtcagagttagtacccattcctca

SEQ ID NO: 647810 - DNA, 25 bp, Mus musculus
ggtcagagttctccttcgaagcact

SEQ ID NO: 647811 - DNA, 25 bp, Mus musculus
ggtcagagttctcgatcactaattt

SEQ ID NO: 647812 - DNA, 25 bp, Mus musculus
ggtcagagttctgcttcgaagcact

SEQ ID NO: 647813 - DNA, 25 bp, Mus musculus
ggtcagagttctggatcactaattt

SEQ ID NO: 647814 - DNA, 25 bp, Mus musculus
ggtcagagtttacagccagatcatg

SEQ ID NO: 647815 - DNA, 25 bp, Mus musculus
ggtcagagtttagagccagatcatg

SEQ ID NO: 647816 - DNA, 25 bp, Mus musculus
ggtcagagttttctgctgcagtcac

SEQ ID NO: 647817 - DNA, 25 bp, Mus musculus
ggtcagagttttgtgctgcagtcac

SEQ ID NO: 647818 - DNA, 25 bp, Mus musculus
ggtcagatagccaagccaccacggg

SEQ ID NO: 647819 - DNA, 25 bp, Mus musculus
ggtcagatagcctagccaccacggg

SEQ ID NO: 647820 - DNA, 25 bp, Mus musculus
ggtcagatatacacctggaacccaa

SEQ ID NO: 647821 - DNA, 25 bp, Mus musculus
ggtcagatatactcctggaacccaa

SEQ ID NO: 647822 - DNA, 25 bp, Mus musculus
ggtcagatatgaattcactcactca

SEQ ID NO: 647823 - DNA, 25 bp, Mus musculus
ggtcagatatgatttcactcactca

SEQ ID NO: 647824 - DNA, 25 bp, Mus musculus
ggtcagatattcagcacccatgcta

SEQ ID NO: 647825 - DNA, 25 bp, Mus musculus
ggtcagatattctgcacccatgcta

SEQ ID NO: 647826 - DNA, 25 bp, Mus musculus
ggtcagatcaccacaatcagcatca

SEQ ID NO: 647827 - DNA, 25 bp, Mus musculus
ggtcagatcaccatgtgaggcctat

SEQ ID NO: 647828 - DNA, 25 bp, Mus musculus
ggtcagatcacctcaatcagcatca

SEQ ID NO: 647829 - DNA, 25 bp, Mus musculus
ggtcagatcaccttgtgaggcctat

SEQ ID NO: 647830 - DNA, 25 bp, Mus musculus
ggtcagatcattacgtatgctctga

SEQ ID NO: 647831 - DNA, 25 bp, Mus musculus
ggtcagatcatttcgtatgctctga

SEQ ID NO: 647832 - DNA, 25 bp, Mus musculus
ggtcagatgacaaagcatggcagtt

SEQ ID NO: 647833 - DNA, 25 bp, Mus musculus
ggtcagatgacatagcatggcagtt

SEQ ID NO: 647834 - DNA, 25 bp, Mus musculus
ggtcagatggcaccttaaactcatt

SEQ ID NO: 647835 - DNA, 25 bp, Mus musculus
ggtcagatggcagcttaaactcatt

SEQ ID NO: 647836 - DNA, 25 bp, Mus musculus
ggtcagatggccctttctaatccta

SEQ ID NO: 647837 - DNA, 25 bp, Mus musculus
ggtcagatggccgtttctaatccta

SEQ ID NO: 647838 - DNA, 25 bp, Mus musculus
ggtcagatgtctctacaactagtct

SEQ ID NO: 647839 - DNA, 25 bp, Mus musculus
ggtcagatgtctgtacaactagtct

SEQ ID NO: 647840 - DNA, 25 bp, Mus musculus
ggtcagatgtgaaagcaggcttcct

SEQ ID NO: 647841 - DNA, 25 bp, Mus musculus
ggtcagatgtgatagcaggcttcct

SEQ ID NO: 647842 - DNA, 25 bp, Mus musculus
ggtcagattctcataagctgtgcca

SEQ ID NO: 647843 - DNA, 25 bp, Mus musculus
ggtcagattctcttaagctgtgcca

SEQ ID NO: 647844 - DNA, 25 bp, Mus musculus
ggtcagcaacaccagcagtgtggtt

SEQ ID NO: 647845 - DNA, 25 bp, Mus musculus
ggtcagcaacacgagcagtgtggtt

SEQ ID NO: 647846 - DNA, 25 bp, Mus musculus
ggtcagcaacagattccagacttcc

SEQ ID NO: 647847 - DNA, 25 bp, Mus musculus
ggtcagcaacagtttccagacttcc

SEQ ID NO: 647848 - DNA, 25 bp, Mus musculus
ggtcagcaatcccatggcgtataaa

SEQ ID NO: 647849 - DNA, 25 bp, Mus musculus
ggtcagcaatccgatggcgtataaa

SEQ ID NO: 647850 - DNA, 25 bp, Mus musculus
ggtcagcacactcaagctggcttga

SEQ ID NO: 647851 - DNA, 25 bp, Mus musculus
ggtcagcacactgaagctggcttga

SEQ ID NO: 647852 - DNA, 25 bp, Mus musculus
ggtcagcacatcagtgattccagaa

SEQ ID NO: 647853 - DNA, 25 bp, Mus musculus
ggtcagcacatctgtgattccagaa

SEQ ID NO: 647854 - DNA, 25 bp, Mus musculus
ggtcagcacatgcttgctcccagga

SEQ ID NO: 647855 - DNA, 25 bp, Mus musculus
ggtcagcacatggttgctcccagga

SEQ ID NO: 647856 - DNA, 25 bp, Mus musculus
ggtcagcactggcatttggtaccat

SEQ ID NO: 647857 - DNA, 25 bp, Mus musculus
ggtcagcactgggatttggtaccat

SEQ ID NO: 647858 - DNA, 25 bp, Mus musculus
ggtcagcactttagtttgtctgccc

SEQ ID NO: 647859 - DNA, 25 bp, Mus musculus
ggtcagcacttttgtttgtctgccc

SEQ ID NO: 647860 - DNA, 25 bp, Mus musculus
ggtcagcagagcacttacggcaagg

SEQ ID NO: 647861 - DNA, 25 bp, Mus musculus
ggtcagcagagctcttacggcaagg

SEQ ID NO: 647862 - DNA, 25 bp, Mus musculus
ggtcagcagctacccgacactgata

SEQ ID NO: 647863 - DNA, 25 bp, Mus musculus
ggtcagcagctagccgacactgata

SEQ ID NO: 647864 - DNA, 25 bp, Mus musculus
ggtcagcagctcaagagaccctgca

SEQ ID NO: 647865 - DNA, 25 bp, Mus musculus
ggtcagcagctctagagaccctgca

SEQ ID NO: 647866 - DNA, 25 bp, Mus musculus
ggtcagcaggtcaggcacatctagt

SEQ ID NO: 647867 - DNA, 25 bp, Mus musculus
ggtcagcaggtctggcacatctagt

SEQ ID NO: 647868 - DNA, 25 bp, Mus musculus
ggtcagcagtagatcagtttctaat

SEQ ID NO: 647869 - DNA, 25 bp, Mus musculus
ggtcagcagtagttcagtttctaat

SEQ ID NO: 647870 - DNA, 25 bp, Mus musculus
ggtcagcatatcagcaacgctctgt

SEQ ID NO: 647871 - DNA, 25 bp, Mus musculus
ggtcagcatatctgcaacgctctgt

SEQ ID NO: 647872 - DNA, 25 bp, Mus musculus
ggtcagcatcaaagggactggtgaa

SEQ ID NO: 647873 - DNA, 25 bp, Mus musculus
ggtcagcatcaatgggactggtgaa

SEQ ID NO: 647874 - DNA, 25 bp, Mus musculus
ggtcagcatcgcctgtggtttcact

SEQ ID NO: 647875 - DNA, 25 bp, Mus musculus
ggtcagcatcgcgtgtggtttcact

SEQ ID NO: 647876 - DNA, 25 bp, Mus musculus
ggtcagcatgagctatacagactgt

SEQ ID NO: 647877 - DNA, 25 bp, Mus musculus
ggtcagcatgaggtatacagactgt

SEQ ID NO: 647878 - DNA, 25 bp, Mus musculus
ggtcagcatgctcagcagtgctaat

SEQ ID NO: 647879 - DNA, 25 bp, Mus musculus
ggtcagcatgctgagcagtgctaat

SEQ ID NO: 647880 - DNA, 25 bp, Mus musculus
ggtcagcattttctgctttcacaga

SEQ ID NO: 647881 - DNA, 25 bp, Mus musculus
ggtcagcattttgtgctttcacaga

SEQ ID NO: 647882 - DNA, 25 bp, Mus musculus
ggtcagccacagatagaagccttga

SEQ ID NO: 647883 - DNA, 25 bp, Mus musculus
ggtcagccacagttagaagccttga

SEQ ID NO: 647884 - DNA, 25 bp, Mus musculus
ggtcagccacctcggtacacaagaa

SEQ ID NO: 647885 - DNA, 25 bp, Mus musculus
ggtcagccacctgggtacacaagaa

SEQ ID NO: 647886 - DNA, 25 bp, Mus musculus
ggtcagccatccaggtcagggatat

SEQ ID NO: 647887 - DNA, 25 bp, Mus musculus
ggtcagccatcctggtcagggatat

SEQ ID NO: 647888 - DNA, 25 bp, Mus musculus
ggtcagcccctgaagagaattcgcg

SEQ ID NO: 647889 - DNA, 25 bp, Mus musculus
ggtcagcccctgaatttttattcct

SEQ ID NO: 647890 - DNA, 25 bp, Mus musculus
ggtcagcccctgtagagaattcgcg

SEQ ID NO: 647891 - DNA, 25 bp, Mus musculus
ggtcagcccctgtatttttattcct

SEQ ID NO: 647892 - DNA, 25 bp, Mus musculus
ggtcagccgcgtcttccaagataag

SEQ ID NO: 647893 - DNA, 25 bp, Mus musculus
ggtcagccgcgtgttccaagataag

SEQ ID NO: 647894 - DNA, 25 bp, Mus musculus
ggtcagccggctctcagagtcctaa

SEQ ID NO: 647895 - DNA, 25 bp, Mus musculus
ggtcagccggctgtcagagtcctaa

SEQ ID NO: 647896 - DNA, 25 bp, Mus musculus
ggtcagcctagtaggtatctcagtg

SEQ ID NO: 647897 - DNA, 25 bp, Mus musculus
ggtcagcctagttggtatctcagtg

SEQ ID NO: 647898 - DNA, 25 bp, Mus musculus
ggtcagcctctaagtaatcattcct

SEQ ID NO: 647899 - DNA, 25 bp, Mus musculus
ggtcagcctctatgtaatcattcct

SEQ ID NO: 647900 - DNA, 25 bp, Mus musculus
ggtcagcctctcaaatcgtggttag

SEQ ID NO: 647901 - DNA, 25 bp, Mus musculus
ggtcagcctctctaatcgtggttag

SEQ ID NO: 647902 - DNA, 25 bp, Mus musculus
ggtcagcctgcaccaagcatgaaca

SEQ ID NO: 647903 - DNA, 25 bp, Mus musculus
ggtcagcctgcagcaagcatgaaca

SEQ ID NO: 647904 - DNA, 25 bp, Mus musculus
ggtcagcgagctacaggttcagtaa

SEQ ID NO: 647905 - DNA, 25 bp, Mus musculus
ggtcagcgagcttcaggttcagtaa

SEQ ID NO: 647906 - DNA, 25 bp, Mus musculus
ggtcagcgccagcagctagaagaat

SEQ ID NO: 647907 - DNA, 25 bp, Mus musculus
ggtcagcgccaggagctagaagaat

SEQ ID NO: 647908 - DNA, 25 bp, Mus musculus
ggtcagcggcagagcctcacagcct

SEQ ID NO: 647909 - DNA, 25 bp, Mus musculus
ggtcagcggcagtgcctcacagcct

SEQ ID NO: 647910 - DNA, 25 bp, Mus musculus
ggtcagctacgtcagccaagtgtct

SEQ ID NO: 647911 - DNA, 25 bp, Mus musculus
ggtcagctacgtgagccaagtgtct

SEQ ID NO: 647912 - DNA, 25 bp, Mus musculus
ggtcagctgacacccgactattagt

SEQ ID NO: 647913 - DNA, 25 bp, Mus musculus
ggtcagctgacagccgactattagt

SEQ ID NO: 647914 - DNA, 25 bp, Mus musculus
ggtcagctgaccattgtaagttatt

SEQ ID NO: 647915 - DNA, 25 bp, Mus musculus
ggtcagctgacccttgagtctatga

SEQ ID NO: 647916 - DNA, 25 bp, Mus musculus
ggtcagctgaccgttgagtctatga

SEQ ID NO: 647917 - DNA, 25 bp, Mus musculus
ggtcagctgacctttgtaagttatt

SEQ ID NO: 647918 - DNA, 25 bp, Mus musculus
ggtcagctgagcctatagttcaacg

SEQ ID NO: 647919 - DNA, 25 bp, Mus musculus
ggtcagctgagcgtatagttcaacg

SEQ ID NO: 647920 - DNA, 25 bp, Mus musculus
ggtcagcttcaacacctgttatatt

SEQ ID NO: 647921 - DNA, 25 bp, Mus musculus
ggtcagcttcaagacctgttatatt

SEQ ID NO: 647922 - DNA, 25 bp, Mus musculus
ggtcagcttccacagaagcgaggca

SEQ ID NO: 647923 - DNA, 25 bp, Mus musculus
ggtcagcttccagagaagcgaggca

SEQ ID NO: 647924 - DNA, 25 bp, Mus musculus
ggtcagcttcccaaatattaacaca

SEQ ID NO: 647925 - DNA, 25 bp, Mus musculus
ggtcagcttccctaatattaacaca

SEQ ID NO: 647926 - DNA, 25 bp, Mus musculus
ggtcagcttcttagttctgcatcaa

SEQ ID NO: 647927 - DNA, 25 bp, Mus musculus
ggtcagcttctttgttctgcatcaa

SEQ ID NO: 647928 - DNA, 25 bp, Mus musculus
ggtcagctttacaccctaaattcaa

SEQ ID NO: 647929 - DNA, 25 bp, Mus musculus
ggtcagctttactccctaaattcaa

SEQ ID NO: 647930 - DNA, 25 bp, Mus musculus
ggtcaggaaaatcgctcacaggata

SEQ ID NO: 647931 - DNA, 25 bp, Mus musculus
ggtcaggaaaatggctcacaggata

SEQ ID NO: 647932 - DNA, 25 bp, Mus musculus
ggtcaggaaacactgcctgtggtaa

SEQ ID NO: 647933 - DNA, 25 bp, Mus musculus
ggtcaggaaacagtgcctgtggtaa

SEQ ID NO: 647934 - DNA, 25 bp, Mus musculus
ggtcaggaaatacttctcttctctc

SEQ ID NO: 647935 - DNA, 25 bp, Mus musculus
ggtcaggaaatagttctcttctctc

SEQ ID NO: 647936 - DNA, 25 bp, Mus musculus
ggtcaggaagccacagatgtcacca

SEQ ID NO: 647937 - DNA, 25 bp, Mus musculus
ggtcaggaagcctcagatgtcacca

SEQ ID NO: 647938 - DNA, 25 bp, Mus musculus
ggtcaggaagctaagctcgtacttc

SEQ ID NO: 647939 - DNA, 25 bp, Mus musculus
ggtcaggaagcttagctcgtacttc

SEQ ID NO: 647940 - DNA, 25 bp, Mus musculus
ggtcaggagcatcacaagctgttaa

SEQ ID NO: 647941 - DNA, 25 bp, Mus musculus
ggtcaggagcatgacaagctgttaa

SEQ ID NO: 647942 - DNA, 25 bp, Mus musculus
ggtcaggagccacatttgtcagccc

SEQ ID NO: 647943 - DNA, 25 bp, Mus musculus
ggtcaggagccagatttgtcagccc

SEQ ID NO: 647944 - DNA, 25 bp, Mus musculus
ggtcaggagcctattgtacatagtt

SEQ ID NO: 647945 - DNA, 25 bp, Mus musculus
ggtcaggagccttttgtacatagtt

SEQ ID NO: 647946 - DNA, 25 bp, Mus musculus
ggtcaggagcggagctctgaaaacc

SEQ ID NO: 647947 - DNA, 25 bp, Mus musculus
ggtcaggagcggtgctctgaaaacc

SEQ ID NO: 647948 - DNA, 25 bp, Mus musculus
ggtcaggagggcagattctgtcccc

SEQ ID NO: 647949 - DNA, 25 bp, Mus musculus
ggtcaggagggctgattctgtcccc

SEQ ID NO: 647950 - DNA, 25 bp, Mus musculus
ggtcaggatctgaaatccctcttta

SEQ ID NO: 647951 - DNA, 25 bp, Mus musculus
ggtcaggatctgtaatccctcttta

SEQ ID NO: 647952 - DNA, 25 bp, Mus musculus
ggtcaggattgtcgtcactcgaagt

SEQ ID NO: 647953 - DNA, 25 bp, Mus musculus
ggtcaggattgtggtcactcgaagt

SEQ ID NO: 647954 - DNA, 25 bp, Mus musculus
ggtcaggcaccactatctgcataca

SEQ ID NO: 647955 - DNA, 25 bp, Mus musculus
ggtcaggcaccagtatctgcataca

SEQ ID NO: 647956 - DNA, 25 bp, Mus musculus
ggtcaggcaggacattttcatttga

SEQ ID NO: 647957 - DNA, 25 bp, Mus musculus
ggtcaggcaggagattttcatttga

SEQ ID NO: 647958 - DNA, 25 bp, Mus musculus
ggtcaggccgcccagtctgaaaagc

SEQ ID NO: 647959 - DNA, 25 bp, Mus musculus
ggtcaggccgccgagtctgaaaagc

SEQ ID NO: 647960 - DNA, 25 bp, Mus musculus
ggtcaggcctgtagttttgttcaaa

SEQ ID NO: 647961 - DNA, 25 bp, Mus musculus
ggtcaggcctgttgttttgttcaaa

SEQ ID NO: 647962 - DNA, 25 bp, Mus musculus
ggtcaggctgacacttagaaagggt

SEQ ID NO: 647963 - DNA, 25 bp, Mus musculus
ggtcaggctgactcttagaaagggt

SEQ ID NO: 647964 - DNA, 25 bp, Mus musculus
ggtcaggcttggaataccttgtaat

SEQ ID NO: 647965 - DNA, 25 bp, Mus musculus
ggtcaggcttggtataccttgtaat

SEQ ID NO: 647966 - DNA, 25 bp, Mus musculus
ggtcagggactgagccactaataac

SEQ ID NO: 647967 - DNA, 25 bp, Mus musculus
ggtcagggactgtgccactaataac

SEQ ID NO: 647968 - DNA, 25 bp, Mus musculus
ggtcagggcaccagcactgagcagt

SEQ ID NO: 647969 - DNA, 25 bp, Mus musculus
ggtcagggcacctgcactgagcagt

SEQ ID NO: 647970 - DNA, 25 bp, Mus musculus
ggtcagggcagaacactgatcagta

SEQ ID NO: 647971 - DNA, 25 bp, Mus musculus
ggtcagggcagatcactgatcagta

SEQ ID NO: 647972 - DNA, 25 bp, Mus musculus
ggtcagggtattcggtcatccgaca

SEQ ID NO: 647973 - DNA, 25 bp, Mus musculus
ggtcagggtattgggtcatccgaca

SEQ ID NO: 647974 - DNA, 25 bp, Mus musculus
ggtcagggtgtaacagtgactcctt

SEQ ID NO: 647975 - DNA, 25 bp, Mus musculus
ggtcagggtgtatcagtgactcctt

SEQ ID NO: 647976 - DNA, 25 bp, Mus musculus
ggtcagggtgttagaatgtcttcat

SEQ ID NO: 647977 - DNA, 25 bp, Mus musculus
ggtcagggtgtttgaatgtcttcat

SEQ ID NO: 647978 - DNA, 25 bp, Mus musculus
ggtcaggtatcaagtccacacacac

SEQ ID NO: 647979 - DNA, 25 bp, Mus musculus
ggtcaggtatcatgtccacacacac

SEQ ID NO: 647980 - DNA, 25 bp, Mus musculus
ggtcaggtatttatccaagagaact

SEQ ID NO: 647981 - DNA, 25 bp, Mus musculus
ggtcaggtatttttccaagagaact

SEQ ID NO: 647982 - DNA, 25 bp, Mus musculus
ggtcaggtcaaactagctatggcat

SEQ ID NO: 647983 - DNA, 25 bp, Mus musculus
ggtcaggtcaaagtagctatggcat

SEQ ID NO: 647984 - DNA, 25 bp, Mus musculus
ggtcaggtcaacctcacactgatat

SEQ ID NO: 647985 - DNA, 25 bp, Mus musculus
ggtcaggtcaacgtcacactgatat

SEQ ID NO: 647986 - DNA, 25 bp, Mus musculus
ggtcaggtcagacctccgggattaa

SEQ ID NO: 647987 - DNA, 25 bp, Mus musculus
ggtcaggtcagagctccgggattaa

SEQ ID NO: 647988 - DNA, 25 bp, Mus musculus
ggtcaggtcatcaatgccctaagca

SEQ ID NO: 647989 - DNA, 25 bp, Mus musculus
ggtcaggtcatctatgccctaagca

SEQ ID NO: 647990 - DNA, 25 bp, Mus musculus
ggtcaggtcgaaatacctccagcag

SEQ ID NO: 647991 - DNA, 25 bp, Mus musculus
ggtcaggtcgaattacctccagcag

SEQ ID NO: 647992 - DNA, 25 bp, Mus musculus
ggtcaggtctttacaagggcttcaa

SEQ ID NO: 647993 - DNA, 25 bp, Mus musculus
ggtcaggtcttttcaagggcttcaa

SEQ ID NO: 647994 - DNA, 25 bp, Mus musculus
ggtcaggtgacaactgagcctcaat

SEQ ID NO: 647995 - DNA, 25 bp, Mus musculus
ggtcaggtgacatctgagcctcaat

SEQ ID NO: 647996 - DNA, 25 bp, Mus musculus
ggtcaggtgagcatacctggctctg

SEQ ID NO: 647997 - DNA, 25 bp, Mus musculus
ggtcaggtgagcttacctggctctg

SEQ ID NO: 647998 - DNA, 25 bp, Mus musculus
ggtcaggtggcacggatttccatat

SEQ ID NO: 647999 - DNA, 25 bp, Mus musculus
ggtcaggtggcagggatttccatat

SEQ ID NO: 648000 - DNA, 25 bp, Mus musculus
ggtcaggtggccacatgtagttctg

SEQ ID NO: 648001 - DNA, 25 bp, Mus musculus
ggtcaggtggcctcatgtagttctg

SEQ ID NO: 648002 - DNA, 25 bp, Mus musculus
ggtcaggttaccacagacctgtttg

SEQ ID NO: 648003 - DNA, 25 bp, Mus musculus
ggtcaggttacccttctagataaca

SEQ ID NO: 648004 - DNA, 25 bp, Mus musculus
ggtcaggttaccgttctagataaca

SEQ ID NO: 648005 - DNA, 25 bp, Mus musculus
ggtcaggttacctcagacctgtttg

SEQ ID NO: 648006 - DNA, 25 bp, Mus musculus
ggtcaggtttataggtgcagctctt

SEQ ID NO: 648007 - DNA, 25 bp, Mus musculus
ggtcaggtttattggtgcagctctt

SEQ ID NO: 648008 - DNA, 25 bp, Mus musculus
ggtcaggttttcagtagcggtgaaa

SEQ ID NO: 648009 - DNA, 25 bp, Mus musculus
ggtcaggttttctgtagcggtgaaa

SEQ ID NO: 648010 - DNA, 25 bp, Mus musculus
ggtcagtaccaaagaagaatcacga

SEQ ID NO: 648011 - DNA, 25 bp, Mus musculus
ggtcagtaccaatgaagaatcacga

SEQ ID NO: 648012 - DNA, 25 bp, Mus musculus
ggtcagtaccacctgtctttagaat

SEQ ID NO: 648013 - DNA, 25 bp, Mus musculus
ggtcagtaccacgtgtctttagaat

SEQ ID NO: 648014 - DNA, 25 bp, Mus musculus
ggtcagtactatactgctgtgctac

SEQ ID NO: 648015 - DNA, 25 bp, Mus musculus
ggtcagtactatatttataccttat

SEQ ID NO: 648016 - DNA, 25 bp, Mus musculus
ggtcagtactattctgctgtgctac

SEQ ID NO: 648017 - DNA, 25 bp, Mus musculus
ggtcagtactatttttataccttat

SEQ ID NO: 648018 - DNA, 25 bp, Mus musculus
ggtcagtactgtccttgtgctaaaa

SEQ ID NO: 648019 - DNA, 25 bp, Mus musculus
ggtcagtactgtgcttgtgctaaaa

SEQ ID NO: 648020 - DNA, 25 bp, Mus musculus
ggtcagtacttgatgatcacccttg

SEQ ID NO: 648021 - DNA, 25 bp, Mus musculus
ggtcagtacttgttgatcacccttg

SEQ ID NO: 648022 - DNA, 25 bp, Mus musculus
ggtcagtattgtcctggtttaccca

SEQ ID NO: 648023 - DNA, 25 bp, Mus musculus
ggtcagtattgtgctggtttaccca

SEQ ID NO: 648024 - DNA, 25 bp, Mus musculus
ggtcagtatttacccaatcaccctc

SEQ ID NO: 648025 - DNA, 25 bp, Mus musculus
ggtcagtatttagccaatcaccctc

SEQ ID NO: 648026 - DNA, 25 bp, Mus musculus
ggtcagtcactgacaagctctccgt

SEQ ID NO: 648027 - DNA, 25 bp, Mus musculus
ggtcagtcactgtcaagctctccgt

SEQ ID NO: 648028 - DNA, 25 bp, Mus musculus
ggtcagtcattcatctgactgtgaa

SEQ ID NO: 648029 - DNA, 25 bp, Mus musculus
ggtcagtcattcttctgactgtgaa

SEQ ID NO: 648030 - DNA, 25 bp, Mus musculus
ggtcagtccagcaggccttagagga

SEQ ID NO: 648031 - DNA, 25 bp, Mus musculus
ggtcagtccagctggccttagagga

SEQ ID NO: 648032 - DNA, 25 bp, Mus musculus
ggtcagtcctcaaacccagctcaga

SEQ ID NO: 648033 - DNA, 25 bp, Mus musculus
ggtcagtcctcatacccagctcaga

SEQ ID NO: 648034 - DNA, 25 bp, Mus musculus
ggtcagtcctggatactaccatgag

SEQ ID NO: 648035 - DNA, 25 bp, Mus musculus
ggtcagtcctggttactaccatgag

SEQ ID NO: 648036 - DNA, 25 bp, Mus musculus
ggtcagtcctgtcccgggtgactta

SEQ ID NO: 648037 - DNA, 25 bp, Mus musculus
ggtcagtcctgtgccgggtgactta

SEQ ID NO: 648038 - DNA, 25 bp, Mus musculus
ggtcagtcgtagcatcttacagtat

SEQ ID NO: 648039 - DNA, 25 bp, Mus musculus
ggtcagtcgtaggatcttacagtat

SEQ ID NO: 648040 - DNA, 25 bp, Mus musculus
ggtcagtctcatcctttatattatt

SEQ ID NO: 648041 - DNA, 25 bp, Mus musculus
ggtcagtctcatgctttatattatt

SEQ ID NO: 648042 - DNA, 25 bp, Mus musculus
ggtcagtctgatatggtagcgtcct

SEQ ID NO: 648043 - DNA, 25 bp, Mus musculus
ggtcagtctgatttggtagcgtcct

SEQ ID NO: 648044 - DNA, 25 bp, Mus musculus
ggtcagtgaagccatccatatccag

SEQ ID NO: 648045 - DNA, 25 bp, Mus musculus
ggtcagtgaagcgatccatatccag

SEQ ID NO: 648046 - DNA, 25 bp, Mus musculus
ggtcagtgacacaactaagcagaaa

SEQ ID NO: 648047 - DNA, 25 bp, Mus musculus
ggtcagtgacactactaagcagaaa

SEQ ID NO: 648048 - DNA, 25 bp, Mus musculus
ggtcagtgagatacttggcatggtc

SEQ ID NO: 648049 - DNA, 25 bp, Mus musculus
ggtcagtgagattcttggcatggtc

SEQ ID NO: 648050 - DNA, 25 bp, Mus musculus
ggtcagtgaggcagccacggtccac

SEQ ID NO: 648051 - DNA, 25 bp, Mus musculus
ggtcagtgaggctgccacggtccac

SEQ ID NO: 648052 - DNA, 25 bp, Mus musculus
ggtcagtgcatcaacctagtcattt

SEQ ID NO: 648053 - DNA, 25 bp, Mus musculus
ggtcagtgcatccagttctgtttct

SEQ ID NO: 648054 - DNA, 25 bp, Mus musculus
ggtcagtgcatcgagttctgtttct

SEQ ID NO: 648055 - DNA, 25 bp, Mus musculus
ggtcagtgcatctacctagtcattt

SEQ ID NO: 648056 - DNA, 25 bp, Mus musculus
ggtcagtgccaccacattgattgga

SEQ ID NO: 648057 - DNA, 25 bp, Mus musculus
ggtcagtgccacgacattgattgga

SEQ ID NO: 648058 - DNA, 25 bp, Mus musculus
ggtcagtgcctaatgctttattctt

SEQ ID NO: 648059 - DNA, 25 bp, Mus musculus
ggtcagtgcctattgctttattctt

SEQ ID NO: 648060 - DNA, 25 bp, Mus musculus
ggtcagtggagcaaggatatcctaa

SEQ ID NO: 648061 - DNA, 25 bp, Mus musculus
ggtcagtggagctaggatatcctaa

SEQ ID NO: 648062 - DNA, 25 bp, Mus musculus
ggtcagtggtagagacttacccaac

SEQ ID NO: 648063 - DNA, 25 bp, Mus musculus
ggtcagtggtagtgacttacccaac

SEQ ID NO: 648064 - DNA, 25 bp, Mus musculus
ggtcagtgtgctccgcgttaagttt

SEQ ID NO: 648065 - DNA, 25 bp, Mus musculus
ggtcagtgtgctgcgcgttaagttt

SEQ ID NO: 648066 - DNA, 25 bp, Mus musculus
ggtcagtgtgtacctccagtgagta

SEQ ID NO: 648067 - DNA, 25 bp, Mus musculus
ggtcagtgtgtagctccagtgagta

SEQ ID NO: 648068 - DNA, 25 bp, Mus musculus
ggtcagtgttgccatgtcaacttca

SEQ ID NO: 648069 - DNA, 25 bp, Mus musculus
ggtcagtgttgcgatgtcaacttca

SEQ ID NO: 648070 - DNA, 25 bp, Mus musculus
ggtcagttactgaggttttagccaa

SEQ ID NO: 648071 - DNA, 25 bp, Mus musculus
ggtcagttactgtggttttagccaa

SEQ ID NO: 648072 - DNA, 25 bp, Mus musculus
ggtcagttatgcacgggtctttttt

SEQ ID NO: 648073 - DNA, 25 bp, Mus musculus
ggtcagttatgctcgggtctttttt

SEQ ID NO: 648074 - DNA, 25 bp, Mus musculus
ggtcagttattacctgagacacctt

SEQ ID NO: 648075 - DNA, 25 bp, Mus musculus
ggtcagttattagctgagacacctt

SEQ ID NO: 648076 - DNA, 25 bp, Mus musculus
ggtcagttctggactgctcaccaga

SEQ ID NO: 648077 - DNA, 25 bp, Mus musculus
ggtcagttctggtctgctcaccaga

SEQ ID NO: 648078 - DNA, 25 bp, Mus musculus
ggtcagttgctacaatcagaacctg

SEQ ID NO: 648079 - DNA, 25 bp, Mus musculus
ggtcagttgctagaatcagaacctg

SEQ ID NO: 648080 - DNA, 25 bp, Mus musculus
ggtcagttgttacttgagggtcaat

SEQ ID NO: 648081 - DNA, 25 bp, Mus musculus
ggtcagttgttagttgagggtcaat

SEQ ID NO: 648082 - DNA, 25 bp, Mus musculus
ggtcagtttagcattgtaaccaaca

SEQ ID NO: 648083 - DNA, 25 bp, Mus musculus
ggtcagtttagctttgtaaccaaca

SEQ ID NO: 648084 - DNA, 25 bp, Mus musculus
ggtcagtttccaagataaccctgag

SEQ ID NO: 648085 - DNA, 25 bp, Mus musculus
ggtcagtttccatgataaccctgag

SEQ ID NO: 648086 - DNA, 25 bp, Mus musculus
ggtcagtttcctaaaatgccaaaat

SEQ ID NO: 648087 - DNA, 25 bp, Mus musculus
ggtcagtttccttaaatgccaaaat

SEQ ID NO: 648088 - DNA, 25 bp, Mus musculus
ggtcagtttgagctatatgtggtaa

SEQ ID NO: 648089 - DNA, 25 bp, Mus musculus
ggtcagtttgaggtatatgtggtaa

SEQ ID NO: 648090 - DNA, 25 bp, Mus musculus
ggtcataaacccactgttcttctaa

SEQ ID NO: 648091 - DNA, 25 bp, Mus musculus
ggtcataaaccctctgttcttctaa

SEQ ID NO: 648092 - DNA, 25 bp, Mus musculus
ggtcataaacgtcgagcagagctct

SEQ ID NO: 648093 - DNA, 25 bp, Mus musculus
ggtcataaacgtggagcagagctct

SEQ ID NO: 648094 - DNA, 25 bp, Mus musculus
ggtcataaactacatcccagtcaca

SEQ ID NO: 648095 - DNA, 25 bp, Mus musculus
ggtcataaactagatcccagtcaca

SEQ ID NO: 648096 - DNA, 25 bp, Mus musculus
ggtcataaaggactcacctgattct

SEQ ID NO: 648097 - DNA, 25 bp, Mus musculus
ggtcataaaggagtcacctgattct

SEQ ID NO: 648098 - DNA, 25 bp, Mus musculus
ggtcataaaggccttcaacagagtt

SEQ ID NO: 648099 - DNA, 25 bp, Mus musculus
ggtcataaaggcgttcaacagagtt

SEQ ID NO: 648100 - DNA, 25 bp, Mus musculus
ggtcataaatcaccttttttcgtaa

SEQ ID NO: 648101 - DNA, 25 bp, Mus musculus
ggtcataaatcagcttttttcgtaa

SEQ ID NO: 648102 - DNA, 25 bp, Mus musculus
ggtcataaccccatctttcaggaag

SEQ ID NO: 648103 - DNA, 25 bp, Mus musculus
ggtcataaccccttctttcaggaag

SEQ ID NO: 648104 - DNA, 25 bp, Mus musculus
ggtcataataagctttcccatcata

SEQ ID NO: 648105 - DNA, 25 bp, Mus musculus
ggtcataataaggtttcccatcata

SEQ ID NO: 648106 - DNA, 25 bp, Mus musculus
ggtcatacacacatcagttttctat

SEQ ID NO: 648107 - DNA, 25 bp, Mus musculus
ggtcatacacacttcagttttctat

SEQ ID NO: 648108 - DNA, 25 bp, Mus musculus
ggtcatacagctacacaattcaggt

SEQ ID NO: 648109 - DNA, 25 bp, Mus musculus
ggtcatacagcttcacaattcaggt

SEQ ID NO: 648110 - DNA, 25 bp, Mus musculus
ggtcatacccagagcatgatgcagt

SEQ ID NO: 648111 - DNA, 25 bp, Mus musculus
ggtcatacccagtgcatgatgcagt

SEQ ID NO: 648112 - DNA, 25 bp, Mus musculus
ggtcatacgaaactgtcatatcccc

SEQ ID NO: 648113 - DNA, 25 bp, Mus musculus
ggtcatacgaaagtgtcatatcccc

SEQ ID NO: 648114 - DNA, 25 bp, Mus musculus
ggtcatacgcacatgccatatgcat

SEQ ID NO: 648115 - DNA, 25 bp, Mus musculus
ggtcatacgcacttgccatatgcat

SEQ ID NO: 648116 - DNA, 25 bp, Mus musculus
ggtcatactttaaccactgtcagga

SEQ ID NO: 648117 - DNA, 25 bp, Mus musculus
ggtcatactttatccactgtcagga

SEQ ID NO: 648118 - DNA, 25 bp, Mus musculus
ggtcatagacatcaaggtggcagca

SEQ ID NO: 648119 - DNA, 25 bp, Mus musculus
ggtcatagacatgaaggtggcagca

SEQ ID NO: 648120 - DNA, 25 bp, Mus musculus
ggtcatagagtaagtggcctgtcac

SEQ ID NO: 648121 - DNA, 25 bp, Mus musculus
ggtcatagagtatgtggcctgtcac

SEQ ID NO: 648122 - DNA, 25 bp, Mus musculus
ggtcatagccgaagtccacagaagg

SEQ ID NO: 648123 - DNA, 25 bp, Mus musculus
ggtcatagccgatgtccacagaagg

SEQ ID NO: 648124 - DNA, 25 bp, Mus musculus
ggtcatagctccagctgttgcttga

SEQ ID NO: 648125 - DNA, 25 bp, Mus musculus
ggtcatagctcctgctgttgcttga

SEQ ID NO: 648126 - DNA, 25 bp, Mus musculus
ggtcataggctaaactattcttaca

SEQ ID NO: 648127 - DNA, 25 bp, Mus musculus
ggtcataggctatactattcttaca

SEQ ID NO: 648128 - DNA, 25 bp, Mus musculus
ggtcatagtcacagattccattgct

SEQ ID NO: 648129 - DNA, 25 bp, Mus musculus
ggtcatagtcactgattccattgct

SEQ ID NO: 648130 - DNA, 25 bp, Mus musculus
ggtcatataagacttgcacctcttg

SEQ ID NO: 648131 - DNA, 25 bp, Mus musculus
ggtcatataagagttgcacctcttg

SEQ ID NO: 648132 - DNA, 25 bp, Mus musculus
ggtcatatactgagaaggtctcctt

SEQ ID NO: 648133 - DNA, 25 bp, Mus musculus
ggtcatatactgtgaaggtctcctt

SEQ ID NO: 648134 - DNA, 25 bp, Mus musculus
ggtcatatcacaactgtccctaatg

SEQ ID NO: 648135 - DNA, 25 bp, Mus musculus
ggtcatatcacatctgtccctaatg

SEQ ID NO: 648136 - DNA, 25 bp, Mus musculus
ggtcatatggagaacgaacacctat

SEQ ID NO: 648137 - DNA, 25 bp, Mus musculus
ggtcatatggagtacgaacacctat

SEQ ID NO: 648138 - DNA, 25 bp, Mus musculus
ggtcatatggctatccagaatgtgc

SEQ ID NO: 648139 - DNA, 25 bp, Mus musculus
ggtcatatggctttccagaatgtgc

SEQ ID NO: 648140 - DNA, 25 bp, Mus musculus
ggtcatatgttcaaatctcacccct

SEQ ID NO: 648141 - DNA, 25 bp, Mus musculus
ggtcatatgttctaatctcacccct

SEQ ID NO: 648142 - DNA, 25 bp, Mus musculus
ggtcatatgtttccaatacccatgt

SEQ ID NO: 648143 - DNA, 25 bp, Mus musculus
ggtcatatgtttgcaatacccatgt

SEQ ID NO: 648144 - DNA, 25 bp, Mus musculus
ggtcatattattaatccctcattag

SEQ ID NO: 648145 - DNA, 25 bp, Mus musculus
ggtcatattatttatccctcattag

SEQ ID NO: 648146 - DNA, 25 bp, Mus musculus
ggtcatcaagccaagcagcaagtgt

SEQ ID NO: 648147 - DNA, 25 bp, Mus musculus
ggtcatcaagcctagcagcaagtgt

SEQ ID NO: 648148 - DNA, 25 bp, Mus musculus
ggtcatcaaggacggttgcatcata

SEQ ID NO: 648149 - DNA, 25 bp, Mus musculus
ggtcatcaaggagggttgcatcata

SEQ ID NO: 648150 - DNA, 25 bp, Mus musculus
ggtcatcaccatcggcaatgagcgt

SEQ ID NO: 648151 - DNA, 25 bp, Mus musculus
ggtcatcaccatgggcaatgagcgt

SEQ ID NO: 648152 - DNA, 25 bp, Mus musculus
ggtcatcacctgagccatcaaagaa

SEQ ID NO: 648153 - DNA, 25 bp, Mus musculus
ggtcatcacctgtgccatcaaagaa

SEQ ID NO: 648154 - DNA, 25 bp, Mus musculus
ggtcatcaccttatattcagttctt

SEQ ID NO: 648155 - DNA, 25 bp, Mus musculus
ggtcatcaccttttattcagttctt

SEQ ID NO: 648156 - DNA, 25 bp, Mus musculus
ggtcatcactgcagcgtacgtgaaa

SEQ ID NO: 648157 - DNA, 25 bp, Mus musculus
ggtcatcactgctgcgtacgtgaaa

SEQ ID NO: 648158 - DNA, 25 bp, Mus musculus
ggtcatcagcagcttatatcctctt

SEQ ID NO: 648159 - DNA, 25 bp, Mus musculus
ggtcatcagcaggttatatcctctt

SEQ ID NO: 648160 - DNA, 25 bp, Mus musculus
ggtcatcaggatcatcagctctgca

SEQ ID NO: 648161 - DNA, 25 bp, Mus musculus
ggtcatcaggatgatcagctctgca

SEQ ID NO: 648162 - DNA, 25 bp, Mus musculus
ggtcatcagtcaacacctgagatcg

SEQ ID NO: 648163 - DNA, 25 bp, Mus musculus
ggtcatcagtcatcacctgagatcg

SEQ ID NO: 648164 - DNA, 25 bp, Mus musculus
ggtcatcagttaccacacagttata

SEQ ID NO: 648165 - DNA, 25 bp, Mus musculus
ggtcatcagttagcacacagttata

SEQ ID NO: 648166 - DNA, 25 bp, Mus musculus
ggtcatcagtttacagaagtcccga

SEQ ID NO: 648167 - DNA, 25 bp, Mus musculus
ggtcatcagttttcagaagtcccga

SEQ ID NO: 648168 - DNA, 25 bp, Mus musculus
ggtcatcataacctcaatgtcaccc

SEQ ID NO: 648169 - DNA, 25 bp, Mus musculus
ggtcatcataacgtcaatgtcaccc

SEQ ID NO: 648170 - DNA, 25 bp, Mus musculus
ggtcatcatggacgtagtcccctgt

SEQ ID NO: 648171 - DNA, 25 bp, Mus musculus
ggtcatcatggaggtagtcccctgt

SEQ ID NO: 648172 - DNA, 25 bp, Mus musculus
ggtcatcatgttatactaccatata

SEQ ID NO: 648173 - DNA, 25 bp, Mus musculus
ggtcatcatgttttactaccatata

SEQ ID NO: 648174 - DNA, 25 bp, Mus musculus
ggtcatcatttgctacaaagccata

SEQ ID NO: 648175 - DNA, 25 bp, Mus musculus
ggtcatcatttggtacaaagccata

SEQ ID NO: 648176 - DNA, 25 bp, Mus musculus
ggtcatccaagcactgttcctagga

SEQ ID NO: 648177 - DNA, 25 bp, Mus musculus
ggtcatccaagctctgttcctagga

SEQ ID NO: 648178 - DNA, 25 bp, Mus musculus
ggtcatccactgaccgagtcacatc

SEQ ID NO: 648179 - DNA, 25 bp, Mus musculus
ggtcatccactgtccgagtcacatc

SEQ ID NO: 648180 - DNA, 25 bp, Mus musculus
ggtcatccagacaacaaggctctgt

SEQ ID NO: 648181 - DNA, 25 bp, Mus musculus
ggtcatccagactacaaggctctgt

SEQ ID NO: 648182 - DNA, 25 bp, Mus musculus
ggtcatcccatcatacaaacataca

SEQ ID NO: 648183 - DNA, 25 bp, Mus musculus
ggtcatcccatcttacaaacataca

SEQ ID NO: 648184 - DNA, 25 bp, Mus musculus
ggtcatccctaaaggtgtcataagc

SEQ ID NO: 648185 - DNA, 25 bp, Mus musculus
ggtcatccctaatggtgtcataagc

SEQ ID NO: 648186 - DNA, 25 bp, Mus musculus
ggtcatccctacaagaaagttcaca

SEQ ID NO: 648187 - DNA, 25 bp, Mus musculus
ggtcatccctactagaaagttcaca

SEQ ID NO: 648188 - DNA, 25 bp, Mus musculus
ggtcatccctgtcaggacagagcaa

SEQ ID NO: 648189 - DNA, 25 bp, Mus musculus
ggtcatccctgtgaggacagagcaa

SEQ ID NO: 648190 - DNA, 25 bp, Mus musculus
ggtcatccgattccaaaagattcat

SEQ ID NO: 648191 - DNA, 25 bp, Mus musculus
ggtcatccgattgcaaaagattcat

SEQ ID NO: 648192 - DNA, 25 bp, Mus musculus
ggtcatcctaggcagtagtcctcaa

SEQ ID NO: 648193 - DNA, 25 bp, Mus musculus
ggtcatcctagggagtagtcctcaa

SEQ ID NO: 648194 - DNA, 25 bp, Mus musculus
ggtcatcctataaatgagacgcact

SEQ ID NO: 648195 - DNA, 25 bp, Mus musculus
ggtcatcctatatatgagacgcact

SEQ ID NO: 648196 - DNA, 25 bp, Mus musculus
ggtcatcctgatctgtttagtttgt

SEQ ID NO: 648197 - DNA, 25 bp, Mus musculus
ggtcatcctgatgtgtttagtttgt

SEQ ID NO: 648198 - DNA, 25 bp, Mus musculus
ggtcatccttgacaacatacataca

SEQ ID NO: 648199 - DNA, 25 bp, Mus musculus
ggtcatccttgagaacatacataca

SEQ ID NO: 648200 - DNA, 25 bp, Mus musculus
ggtcatcggtggaaccagtctttga

SEQ ID NO: 648201 - DNA, 25 bp, Mus musculus
ggtcatcggtggtaccagtctttga

SEQ ID NO: 648202 - DNA, 25 bp, Mus musculus
ggtcatcgtgcccatagtggtaata

SEQ ID NO: 648203 - DNA, 25 bp, Mus musculus
ggtcatcgtgccgatagtggtaata

SEQ ID NO: 648204 - DNA, 25 bp, Mus musculus
ggtcatctaccaacagcacgggcag

SEQ ID NO: 648205 - DNA, 25 bp, Mus musculus
ggtcatctaccatcagcacgggcag

SEQ ID NO: 648206 - DNA, 25 bp, Mus musculus
ggtcatctacgaagtccacattcaa

SEQ ID NO: 648207 - DNA, 25 bp, Mus musculus
ggtcatctacgatgtccacattcaa

SEQ ID NO: 648208 - DNA, 25 bp, Mus musculus
ggtcatctcaaaccaaagcaatcac

SEQ ID NO: 648209 - DNA, 25 bp, Mus musculus
ggtcatctcaaagcaaagcaatcac

SEQ ID NO: 648210 - DNA, 25 bp, Mus musculus
ggtcatctcaatcttttgcccttat

SEQ ID NO: 648211 - DNA, 25 bp, Mus musculus
ggtcatctcaatgttttgcccttat

SEQ ID NO: 648212 - DNA, 25 bp, Mus musculus
ggtcatctcagtatatgcagctatt

SEQ ID NO: 648213 - DNA, 25 bp, Mus musculus
ggtcatctcagtttatgcagctatt

SEQ ID NO: 648214 - DNA, 25 bp, Mus musculus
ggtcatctcatccatcctttaaatg

SEQ ID NO: 648215 - DNA, 25 bp, Mus musculus
ggtcatctcatcgatcctttaaatg

SEQ ID NO: 648216 - DNA, 25 bp, Mus musculus
ggtcatctctgtcttggtgtttttc

SEQ ID NO: 648217 - DNA, 25 bp, Mus musculus
ggtcatctctgtgttggtgtttttc

SEQ ID NO: 648218 - DNA, 25 bp, Mus musculus
ggtcatctgggtaatcttctgttta

SEQ ID NO: 648219 - DNA, 25 bp, Mus musculus
ggtcatctgggttatcttctgttta

SEQ ID NO: 648220 - DNA, 25 bp, Mus musculus
ggtcatctgtacaacatgttactaa

SEQ ID NO: 648221 - DNA, 25 bp, Mus musculus
ggtcatctgtactacatgttactaa

SEQ ID NO: 648222 - DNA, 25 bp, Mus musculus
ggtcatcttagacacttcctgacag

SEQ ID NO: 648223 - DNA, 25 bp, Mus musculus
ggtcatcttagagacttcctgacag

SEQ ID NO: 648224 - DNA, 25 bp, Mus musculus
ggtcatcttcaacaagactcgtgga

SEQ ID NO: 648225 - DNA, 25 bp, Mus musculus
ggtcatcttcaagaagactcgtgga

SEQ ID NO: 648226 - DNA, 25 bp, Mus musculus
ggtcatcttgacactcgcgtggaat

SEQ ID NO: 648227 - DNA, 25 bp, Mus musculus
ggtcatcttgactctcgcgtggaat

SEQ ID NO: 648228 - DNA, 25 bp, Mus musculus
ggtcatcttgtaaccagccacttca

SEQ ID NO: 648229 - DNA, 25 bp, Mus musculus
ggtcatcttgtatccagccacttca

SEQ ID NO: 648230 - DNA, 25 bp, Mus musculus
ggtcatctttacacagttaaactac

SEQ ID NO: 648231 - DNA, 25 bp, Mus musculus
ggtcatctttactcagttaaactac

SEQ ID NO: 648232 - DNA, 25 bp, Mus musculus
ggtcatcttttgatacactgccaat

SEQ ID NO: 648233 - DNA, 25 bp, Mus musculus
ggtcatcttttgttacactgccaat

SEQ ID NO: 648234 - DNA, 25 bp, Mus musculus
ggtcatgaaaaacttcttagggact

SEQ ID NO: 648235 - DNA, 25 bp, Mus musculus
ggtcatgaaaaagttcttagggact

SEQ ID NO: 648236 - DNA, 25 bp, Mus musculus
ggtcatgaaatgatcccaagcctct

SEQ ID NO: 648237 - DNA, 25 bp, Mus musculus
ggtcatgaaatgttcccaagcctct

SEQ ID NO: 648238 - DNA, 25 bp, Mus musculus
ggtcatgaacaactgatctgcttta

SEQ ID NO: 648239 - DNA, 25 bp, Mus musculus
ggtcatgaacaagtgatctgcttta

SEQ ID NO: 648240 - DNA, 25 bp, Mus musculus
ggtcatgaaccccaagtttgctgaa

SEQ ID NO: 648241 - DNA, 25 bp, Mus musculus
ggtcatgaacccgaagtttgctgaa

SEQ ID NO: 648242 - DNA, 25 bp, Mus musculus
ggtcatgaagacattcttatttctc

SEQ ID NO: 648243 - DNA, 25 bp, Mus musculus
ggtcatgaagactttcttatttctc

SEQ ID NO: 648244 - DNA, 25 bp, Mus musculus
ggtcatgacggtaaactctagagat

SEQ ID NO: 648245 - DNA, 25 bp, Mus musculus
ggtcatgacggttaactctagagat

SEQ ID NO: 648246 - DNA, 25 bp, Mus musculus
ggtcatgactcgatacatatttgaa

SEQ ID NO: 648247 - DNA, 25 bp, Mus musculus
ggtcatgactcgttacatatttgaa

SEQ ID NO: 648248 - DNA, 25 bp, Mus musculus
ggtcatgagccaacttttcacattg

SEQ ID NO: 648249 - DNA, 25 bp, Mus musculus
ggtcatgagccatcttttcacattg

SEQ ID NO: 648250 - DNA, 25 bp, Mus musculus
ggtcatgaggaaaccactcctgcag

SEQ ID NO: 648251 - DNA, 25 bp, Mus musculus
ggtcatgaggaatccactcctgcag

SEQ ID NO: 648252 - DNA, 25 bp, Mus musculus
ggtcatgagtgacccttgctttgga

SEQ ID NO: 648253 - DNA, 25 bp, Mus musculus
ggtcatgagtgagccttgctttgga

SEQ ID NO: 648254 - DNA, 25 bp, Mus musculus
ggtcatgatgtgaatagacatgctt

SEQ ID NO: 648255 - DNA, 25 bp, Mus musculus
ggtcatgatgtgtatagacatgctt

SEQ ID NO: 648256 - DNA, 25 bp, Mus musculus
ggtcatgatgttacatttcagcgat

SEQ ID NO: 648257 - DNA, 25 bp, Mus musculus
ggtcatgatgtttcatttcagcgat

SEQ ID NO: 648258 - DNA, 25 bp, Mus musculus
ggtcatgccagccacaagccaacag

SEQ ID NO: 648259 - DNA, 25 bp, Mus musculus
ggtcatgccagcgacaagccaacag

SEQ ID NO: 648260 - DNA, 25 bp, Mus musculus
ggtcatgcctcacataaatgcctat

SEQ ID NO: 648261 - DNA, 25 bp, Mus musculus
ggtcatgcctcagataaatgcctat

SEQ ID NO: 648262 - DNA, 25 bp, Mus musculus
ggtcatgcctgtctaacacttttaa

SEQ ID NO: 648263 - DNA, 25 bp, Mus musculus
ggtcatgcctgtgtaacacttttaa

SEQ ID NO: 648264 - DNA, 25 bp, Mus musculus
ggtcatgcgcctctgtgattctatt

SEQ ID NO: 648265 - DNA, 25 bp, Mus musculus
ggtcatgcgcctgtgtgattctatt

SEQ ID NO: 648266 - DNA, 25 bp, Mus musculus
ggtcatgcggttcgacactgaactt

SEQ ID NO: 648267 - DNA, 25 bp, Mus musculus
ggtcatgcggttggacactgaactt

SEQ ID NO: 648268 - DNA, 25 bp, Mus musculus
ggtcatgctatgagattcactcttc

SEQ ID NO: 648269 - DNA, 25 bp, Mus musculus
ggtcatgctatgtgattcactcttc

SEQ ID NO: 648270 - DNA, 25 bp, Mus musculus
ggtcatgctcttagaatccgtggaa

SEQ ID NO: 648271 - DNA, 25 bp, Mus musculus
ggtcatgctctttgaatccgtggaa

SEQ ID NO: 648272 - DNA, 25 bp, Mus musculus
ggtcatgctgcacatctctaggatc

SEQ ID NO: 648273 - DNA, 25 bp, Mus musculus
ggtcatgctgcagatctctaggatc

SEQ ID NO: 648274 - DNA, 25 bp, Mus musculus
ggtcatgctggtacttcctgccagt

SEQ ID NO: 648275 - DNA, 25 bp, Mus musculus
ggtcatgctggttcttcctgccagt

SEQ ID NO: 648276 - DNA, 25 bp, Mus musculus
ggtcatgcttagatagcctttttat

SEQ ID NO: 648277 - DNA, 25 bp, Mus musculus
ggtcatgcttagttagcctttttat

SEQ ID NO: 648278 - DNA, 25 bp, Mus musculus
ggtcatgcttccatcacagcagata

SEQ ID NO: 648279 - DNA, 25 bp, Mus musculus
ggtcatgcttccttcacagcagata

SEQ ID NO: 648280 - DNA, 25 bp, Mus musculus
ggtcatgcttcgaatactacaggtg

SEQ ID NO: 648281 - DNA, 25 bp, Mus musculus
ggtcatgcttcgtatactacaggtg

SEQ ID NO: 648282 - DNA, 25 bp, Mus musculus
ggtcatggaattacaactgcttgtg

SEQ ID NO: 648283 - DNA, 25 bp, Mus musculus
ggtcatggaatttcaactgcttgtg

SEQ ID NO: 648284 - DNA, 25 bp, Mus musculus
ggtcatggacaacctgaacttgccc

SEQ ID NO: 648285 - DNA, 25 bp, Mus musculus
ggtcatggacaagctgaacttgccc

SEQ ID NO: 648286 - DNA, 25 bp, Mus musculus
ggtcatggctgtcagattcatttct

SEQ ID NO: 648287 - DNA, 25 bp, Mus musculus
ggtcatggctgtgagattcatttct

SEQ ID NO: 648288 - DNA, 25 bp, Mus musculus
ggtcatggcttactcatgctcacca

SEQ ID NO: 648289 - DNA, 25 bp, Mus musculus
ggtcatggcttagtcatgctcacca

SEQ ID NO: 648290 - DNA, 25 bp, Mus musculus
ggtcatgggagtcttggttaccatt

SEQ ID NO: 648291 - DNA, 25 bp, Mus musculus
ggtcatgggagtgttggttaccatt

SEQ ID NO: 648292 - DNA, 25 bp, Mus musculus
ggtcatgggtggcacacattaaaag

SEQ ID NO: 648293 - DNA, 25 bp, Mus musculus
ggtcatgggtgggacacattaaaag

SEQ ID NO: 648294 - DNA, 25 bp, Mus musculus
ggtcatgggttccaggtcatctata

SEQ ID NO: 648295 - DNA, 25 bp, Mus musculus
ggtcatgggttcgaggtcatctata

SEQ ID NO: 648296 - DNA, 25 bp, Mus musculus
ggtcatggtcaaagccagggactac

SEQ ID NO: 648297 - DNA, 25 bp, Mus musculus
ggtcatggtcaatgccagggactac

SEQ ID NO: 648298 - DNA, 25 bp, Mus musculus
ggtcatggtgagactttttctagga

SEQ ID NO: 648299 - DNA, 25 bp, Mus musculus
ggtcatggtgagtctttttctagga

SEQ ID NO: 648300 - DNA, 25 bp, Mus musculus
ggtcatggtgatcagcagcctacga

SEQ ID NO: 648301 - DNA, 25 bp, Mus musculus
ggtcatggtgatgagcagcctacga

SEQ ID NO: 648302 - DNA, 25 bp, Mus musculus
ggtcatggtggcctcagcagcattc

SEQ ID NO: 648303 - DNA, 25 bp, Mus musculus
ggtcatggtggcgtcagcagcattc

SEQ ID NO: 648304 - DNA, 25 bp, Mus musculus
ggtcatggtgtgatctatcactata

SEQ ID NO: 648305 - DNA, 25 bp, Mus musculus
ggtcatggtgtgttctatcactata

SEQ ID NO: 648306 - DNA, 25 bp, Mus musculus
ggtcatgtacgtcgttagctgtcta

SEQ ID NO: 648307 - DNA, 25 bp, Mus musculus
ggtcatgtacgtggttagctgtcta

SEQ ID NO: 648308 - DNA, 25 bp, Mus musculus
ggtcatgtagccctttcaaatccat

SEQ ID NO: 648309 - DNA, 25 bp, Mus musculus
ggtcatgtagccgtttcaaatccat

SEQ ID NO: 648310 - DNA, 25 bp, Mus musculus
ggtcatgtagctctcagggctgagt

SEQ ID NO: 648311 - DNA, 25 bp, Mus musculus
ggtcatgtagctgtcagggctgagt

SEQ ID NO: 648312 - DNA, 25 bp, Mus musculus
ggtcatgtatataatcagttttctt

SEQ ID NO: 648313 - DNA, 25 bp, Mus musculus
ggtcatgtatattatcagttttctt

SEQ ID NO: 648314 - DNA, 25 bp, Mus musculus
ggtcatgtcacacccagaacgatgt

SEQ ID NO: 648315 - DNA, 25 bp, Mus musculus
ggtcatgtcacagccagaacgatgt

SEQ ID NO: 648316 - DNA, 25 bp, Mus musculus
ggtcatgtcagcatgtgtgttcagg

SEQ ID NO: 648317 - DNA, 25 bp, Mus musculus
ggtcatgtcagcttgtgtgttcagg

SEQ ID NO: 648318 - DNA, 25 bp, Mus musculus
ggtcatgtcataagcaaagggcctt

SEQ ID NO: 648319 - DNA, 25 bp, Mus musculus
ggtcatgtcatatgcaaagggcctt

SEQ ID NO: 648320 - DNA, 25 bp, Mus musculus
ggtcatgtctgacccacctgaagaa

SEQ ID NO: 648321 - DNA, 25 bp, Mus musculus
ggtcatgtctgagccacctgaagaa

SEQ ID NO: 648322 - DNA, 25 bp, Mus musculus
ggtcatgtctgtacctcaactggga

SEQ ID NO: 648323 - DNA, 25 bp, Mus musculus
ggtcatgtctgttcctcaactggga

SEQ ID NO: 648324 - DNA, 25 bp, Mus musculus
ggtcatgtgattcggattctgcctc

SEQ ID NO: 648325 - DNA, 25 bp, Mus musculus
ggtcatgtgattgggattctgcctc

SEQ ID NO: 648326 - DNA, 25 bp, Mus musculus
ggtcatgtgcttcccaactgctgag

SEQ ID NO: 648327 - DNA, 25 bp, Mus musculus
ggtcatgtgcttgccaactgctgag

SEQ ID NO: 648328 - DNA, 25 bp, Mus musculus
ggtcatgtggcccattaaggtcctt

SEQ ID NO: 648329 - DNA, 25 bp, Mus musculus
ggtcatgtggccgattaaggtcctt

SEQ ID NO: 648330 - DNA, 25 bp, Mus musculus
ggtcatgtggctctgtgtctagcta

SEQ ID NO: 648331 - DNA, 25 bp, Mus musculus
ggtcatgtggctgtgtgtctagcta

SEQ ID NO: 648332 - DNA, 25 bp, Mus musculus
ggtcatgttactcaaattgctggag

SEQ ID NO: 648333 - DNA, 25 bp, Mus musculus
ggtcatgttactgaaattgctggag

SEQ ID NO: 648334 - DNA, 25 bp, Mus musculus
ggtcatgtttacagtttccactaac

SEQ ID NO: 648335 - DNA, 25 bp, Mus musculus
ggtcatgtttactgtttccactaac

SEQ ID NO: 648336 - DNA, 25 bp, Mus musculus
ggtcatgtttgcattgtattacttt

SEQ ID NO: 648337 - DNA, 25 bp, Mus musculus
ggtcatgtttgctttgtattacttt

SEQ ID NO: 648338 - DNA, 25 bp, Mus musculus
ggtcattaaacaccgccttactgct

SEQ ID NO: 648339 - DNA, 25 bp, Mus musculus
ggtcattaaacagcgccttactgct

SEQ ID NO: 648340 - DNA, 25 bp, Mus musculus
ggtcattaatgtctgctacctcatg

SEQ ID NO: 648341 - DNA, 25 bp, Mus musculus
ggtcattaatgtgtgctacctcatg

SEQ ID NO: 648342 - DNA, 25 bp, Mus musculus
ggtcattacacacggcccagtagag

SEQ ID NO: 648343 - DNA, 25 bp, Mus musculus
ggtcattacacagggcccagtagag

SEQ ID NO: 648344 - DNA, 25 bp, Mus musculus
ggtcattaccagaagtaggacttgt

SEQ ID NO: 648345 - DNA, 25 bp, Mus musculus
ggtcattaccagtagtaggacttgt

SEQ ID NO: 648346 - DNA, 25 bp, Mus musculus
ggtcattacctgagcaatgcatgcg

SEQ ID NO: 648347 - DNA, 25 bp, Mus musculus
ggtcattacctgtgcaatgcatgcg

SEQ ID NO: 648348 - DNA, 25 bp, Mus musculus
ggtcattactacaaacagcacgaag

SEQ ID NO: 648349 - DNA, 25 bp, Mus musculus
ggtcattactactaacagcacgaag

SEQ ID NO: 648350 - DNA, 25 bp, Mus musculus
ggtcattagactaagcacatgccac

SEQ ID NO: 648351 - DNA, 25 bp, Mus musculus
ggtcattagacttagcacatgccac

SEQ ID NO: 648352 - DNA, 25 bp, Mus musculus
ggtcattagcaaacactgttacccc

SEQ ID NO: 648353 - DNA, 25 bp, Mus musculus
ggtcattagcaatcactgttacccc

SEQ ID NO: 648354 - DNA, 25 bp, Mus musculus
ggtcattaggatcctgcccgactga

SEQ ID NO: 648355 - DNA, 25 bp, Mus musculus
ggtcattaggatgctgcccgactga

SEQ ID NO: 648356 - DNA, 25 bp, Mus musculus
ggtcattagtcacgtcagtatctct

SEQ ID NO: 648357 - DNA, 25 bp, Mus musculus
ggtcattagtcaggtcagtatctct

SEQ ID NO: 648358 - DNA, 25 bp, Mus musculus
ggtcattattagcaagtccttccaa

SEQ ID NO: 648359 - DNA, 25 bp, Mus musculus
ggtcattattaggaagtccttccaa

SEQ ID NO: 648360 - DNA, 25 bp, Mus musculus
ggtcattattttacctctactaaga

SEQ ID NO: 648361 - DNA, 25 bp, Mus musculus
ggtcattatttttcctctactaaga

SEQ ID NO: 648362 - DNA, 25 bp, Mus musculus
ggtcattcaaccaaaagtagccctg

SEQ ID NO: 648363 - DNA, 25 bp, Mus musculus
ggtcattcaacctaaagtagccctg

SEQ ID NO: 648364 - DNA, 25 bp, Mus musculus
ggtcattcacagagagcagccacat

SEQ ID NO: 648365 - DNA, 25 bp, Mus musculus
ggtcattcacagtgagcagccacat

SEQ ID NO: 648366 - DNA, 25 bp, Mus musculus
ggtcattcacatcatatgtcagtct

SEQ ID NO: 648367 - DNA, 25 bp, Mus musculus
ggtcattcacatgatatgtcagtct

SEQ ID NO: 648368 - DNA, 25 bp, Mus musculus
ggtcattcagctcggaaccttagtg

SEQ ID NO: 648369 - DNA, 25 bp, Mus musculus
ggtcattcagctgggaaccttagtg

SEQ ID NO: 648370 - DNA, 25 bp, Mus musculus
ggtcattccaacattcttgatttgt

SEQ ID NO: 648371 - DNA, 25 bp, Mus musculus
ggtcattccaactttcttgatttgt

SEQ ID NO: 648372 - DNA, 25 bp, Mus musculus
ggtcattccatcctggagtctatca

SEQ ID NO: 648373 - DNA, 25 bp, Mus musculus
ggtcattccatcgtggagtctatca

SEQ ID NO: 648374 - DNA, 25 bp, Mus musculus
ggtcattcctagagtttttggtcat

SEQ ID NO: 648375 - DNA, 25 bp, Mus musculus
ggtcattcctagtgtttttggtcat

SEQ ID NO: 648376 - DNA, 25 bp, Mus musculus
ggtcattcctgtcgtgatgggcatc

SEQ ID NO: 648377 - DNA, 25 bp, Mus musculus
ggtcattcctgtggtgatgggcatc

SEQ ID NO: 648378 - DNA, 25 bp, Mus musculus
ggtcattctaggctccactgcagaa

SEQ ID NO: 648379 - DNA, 25 bp, Mus musculus
ggtcattctagggtccactgcagaa

SEQ ID NO: 648380 - DNA, 25 bp, Mus musculus
ggtcattgacagattcatttgcttt

SEQ ID NO: 648381 - DNA, 25 bp, Mus musculus
ggtcattgacagtttcatttgcttt

SEQ ID NO: 648382 - DNA, 25 bp, Mus musculus
ggtcattgatgcatccattgttatt

SEQ ID NO: 648383 - DNA, 25 bp, Mus musculus
ggtcattgatgcttccattgttatt

SEQ ID NO: 648384 - DNA, 25 bp, Mus musculus
ggtcattgatgtccttcatcctggg

SEQ ID NO: 648385 - DNA, 25 bp, Mus musculus
ggtcattgatgtgcttcatcctggg

SEQ ID NO: 648386 - DNA, 25 bp, Mus musculus
ggtcattgccaacctgctccatggg

SEQ ID NO: 648387 - DNA, 25 bp, Mus musculus
ggtcattgccaagctgctccatggg

SEQ ID NO: 648388 - DNA, 25 bp, Mus musculus
ggtcattgctgtatcactccaataa

SEQ ID NO: 648389 - DNA, 25 bp, Mus musculus
ggtcattgctgtttcactccaataa

SEQ ID NO: 648390 - DNA, 25 bp, Mus musculus
ggtcattggaatcctcaagtctcac

SEQ ID NO: 648391 - DNA, 25 bp, Mus musculus
ggtcattggaatgctcaagtctcac

SEQ ID NO: 648392 - DNA, 25 bp, Mus musculus
ggtcattgggagacatccctttcta

SEQ ID NO: 648393 - DNA, 25 bp, Mus musculus
ggtcattgggagtcatccctttcta

SEQ ID NO: 648394 - DNA, 25 bp, Mus musculus
ggtcattgtgacctgcaggcagctt

SEQ ID NO: 648395 - DNA, 25 bp, Mus musculus
ggtcattgtgacgtgcaggcagctt

SEQ ID NO: 648396 - DNA, 25 bp, Mus musculus
ggtcattgtgagagattgctctttc

SEQ ID NO: 648397 - DNA, 25 bp, Mus musculus
ggtcattgtgagtgattgctctttc

SEQ ID NO: 648398 - DNA, 25 bp, Mus musculus
ggtcattgtttaagtcacacagctg

SEQ ID NO: 648399 - DNA, 25 bp, Mus musculus
ggtcattgtttatgtcacacagctg

SEQ ID NO: 648400 - DNA, 25 bp, Mus musculus
ggtcatttactaatgctgtggcctt

SEQ ID NO: 648401 - DNA, 25 bp, Mus musculus
ggtcatttactattgctgtggcctt

SEQ ID NO: 648402 - DNA, 25 bp, Mus musculus
ggtcatttacttctctctggaggag

SEQ ID NO: 648403 - DNA, 25 bp, Mus musculus
ggtcatttacttgtctctggaggag

SEQ ID NO: 648404 - DNA, 25 bp, Mus musculus
ggtcatttctaaaagtgttccagtc

SEQ ID NO: 648405 - DNA, 25 bp, Mus musculus
ggtcatttctaatagtgttccagtc

SEQ ID NO: 648406 - DNA, 25 bp, Mus musculus
ggtcatttctctcattgtgcatgtc

SEQ ID NO: 648407 - DNA, 25 bp, Mus musculus
ggtcatttctctgattgtgcatgtc

SEQ ID NO: 648408 - DNA, 25 bp, Mus musculus
ggtcatttcttaatacaatctttta

SEQ ID NO: 648409 - DNA, 25 bp, Mus musculus
ggtcatttcttattacaatctttta

SEQ ID NO: 648410 - DNA, 25 bp, Mus musculus
ggtcatttgacccaactgaagtggt

SEQ ID NO: 648411 - DNA, 25 bp, Mus musculus
ggtcatttgaccgaactgaagtggt

SEQ ID NO: 648412 - DNA, 25 bp, Mus musculus
ggtcatttgcctatgaatggcttta

SEQ ID NO: 648413 - DNA, 25 bp, Mus musculus
ggtcatttgcctttgaatggcttta

SEQ ID NO: 648414 - DNA, 25 bp, Mus musculus
ggtcattttacacactctgcattag

SEQ ID NO: 648415 - DNA, 25 bp, Mus musculus
ggtcattttacagactctgcattag

SEQ ID NO: 648416 - DNA, 25 bp, Mus musculus
ggtcattttagccactcaccgaggt

SEQ ID NO: 648417 - DNA, 25 bp, Mus musculus
ggtcattttagcgactcaccgaggt

SEQ ID NO: 648418 - DNA, 25 bp, Mus musculus
ggtcattttctaaacttcacgttgc

SEQ ID NO: 648419 - DNA, 25 bp, Mus musculus
ggtcattttctatacttcacgttgc

SEQ ID NO: 648420 - DNA, 25 bp, Mus musculus
ggtcattttgtgattattatagcca

SEQ ID NO: 648421 - DNA, 25 bp, Mus musculus
ggtcattttgtgtttattatagcca

SEQ ID NO: 648422 - DNA, 25 bp, Mus musculus
ggtccaaaagaactggtatccgtat

SEQ ID NO: 648423 - DNA, 25 bp, Mus musculus
ggtccaaaagaagtggtatccgtat

SEQ ID NO: 648424 - DNA, 25 bp, Mus musculus
ggtccaaacacaattctaactcaag

SEQ ID NO: 648425 - DNA, 25 bp, Mus musculus
ggtccaaacacatttctaactcaag

SEQ ID NO: 648426 - DNA, 25 bp, Mus musculus
ggtccaaacttgctaacctgcgaag

SEQ ID NO: 648427 - DNA, 25 bp, Mus musculus
ggtccaaacttggtaacctgcgaag

SEQ ID NO: 648428 - DNA, 25 bp, Mus musculus
ggtccaaagaacattccctgtacat

SEQ ID NO: 648429 - DNA, 25 bp, Mus musculus
ggtccaaagaactttccctgtacat

SEQ ID NO: 648430 - DNA, 25 bp, Mus musculus
ggtccaaagactcacagctgttctg

SEQ ID NO: 648431 - DNA, 25 bp, Mus musculus
ggtccaaagactgacagctgttctg

SEQ ID NO: 648432 - DNA, 25 bp, Mus musculus
ggtccaaatccgcttccaatctggg

SEQ ID NO: 648433 - DNA, 25 bp, Mus musculus
ggtccaaatccggttccaatctggg

SEQ ID NO: 648434 - DNA, 25 bp, Mus musculus
ggtccaaatggaagtcagaactcta

SEQ ID NO: 648435 - DNA, 25 bp, Mus musculus
ggtccaaatggatgtcagaactcta

SEQ ID NO: 648436 - DNA, 25 bp, Mus musculus
ggtccaacaccgactaagcagatca

SEQ ID NO: 648437 - DNA, 25 bp, Mus musculus
ggtccaacaccgtctaagcagatca

SEQ ID NO: 648438 - DNA, 25 bp, Mus musculus
ggtccaacaggaccatgatgtccaa

SEQ ID NO: 648439 - DNA, 25 bp, Mus musculus
ggtccaacaggagcatgatgtccaa

SEQ ID NO: 648440 - DNA, 25 bp, Mus musculus
ggtccaacagttcatccaagctctt

SEQ ID NO: 648441 - DNA, 25 bp, Mus musculus
ggtccaacagttgatccaagctctt

SEQ ID NO: 648442 - DNA, 25 bp, Mus musculus
ggtccaaccctgctaccgctgggat

SEQ ID NO: 648443 - DNA, 25 bp, Mus musculus
ggtccaaccctggtaccgctgggat

SEQ ID NO: 648444 - DNA, 25 bp, Mus musculus
ggtccaactatgatcctgtactggc

SEQ ID NO: 648445 - DNA, 25 bp, Mus musculus
ggtccaactatgttcctgtactggc

SEQ ID NO: 648446 - DNA, 25 bp, Mus musculus
ggtccaactgagctggcccaagtcg

SEQ ID NO: 648447 - DNA, 25 bp, Mus musculus
ggtccaactgaggtggcccaagtcg

SEQ ID NO: 648448 - DNA, 25 bp, Mus musculus
ggtccaacttgaagggaattttcag

SEQ ID NO: 648449 - DNA, 25 bp, Mus musculus
ggtccaacttgatgggaattttcag

SEQ ID NO: 648450 - DNA, 25 bp, Mus musculus
ggtccaagaactaaccaaagtgatg

SEQ ID NO: 648451 - DNA, 25 bp, Mus musculus
ggtccaagaactccctgagacgact

SEQ ID NO: 648452 - DNA, 25 bp, Mus musculus
ggtccaagaactgcctgagacgact

SEQ ID NO: 648453 - DNA, 25 bp, Mus musculus
ggtccaagaacttaccaaagtgatg

SEQ ID NO: 648454 - DNA, 25 bp, Mus musculus
ggtccaagagccaacagccttggtt

SEQ ID NO: 648455 - DNA, 25 bp, Mus musculus
ggtccaagagcctacagccttggtt

SEQ ID NO: 648456 - DNA, 25 bp, Mus musculus
ggtccaagcaataagggcctcatat

SEQ ID NO: 648457 - DNA, 25 bp, Mus musculus
ggtccaagcaattagggcctcatat

SEQ ID NO: 648458 - DNA, 25 bp, Mus musculus
ggtccaagctttcatctttgccaga

SEQ ID NO: 648459 - DNA, 25 bp, Mus musculus
ggtccaagctttgatctttgccaga

SEQ ID NO: 648460 - DNA, 25 bp, Mus musculus
ggtccaaggaccagcgtatcagcat

SEQ ID NO: 648461 - DNA, 25 bp, Mus musculus
ggtccaaggacctgcgtatcagcat

SEQ ID NO: 648462 - DNA, 25 bp, Mus musculus
ggtccaaggactccgtaaatcatgt

SEQ ID NO: 648463 - DNA, 25 bp, Mus musculus
ggtccaaggactgcgtaaatcatgt

SEQ ID NO: 648464 - DNA, 25 bp, Mus musculus
ggtccaaggatcacggttcagtgct

SEQ ID NO: 648465 - DNA, 25 bp, Mus musculus
ggtccaaggatctcggttcagtgct

SEQ ID NO: 648466 - DNA, 25 bp, Mus musculus
ggtccaaggcgaaccagagaatccc

SEQ ID NO: 648467 - DNA, 25 bp, Mus musculus
ggtccaaggcgatccagagaatccc

SEQ ID NO: 648468 - DNA, 25 bp, Mus musculus
ggtccaaggctcatggcagtgacca

SEQ ID NO: 648469 - DNA, 25 bp, Mus musculus
ggtccaaggctcttggcagtgacca

SEQ ID NO: 648470 - DNA, 25 bp, Mus musculus
ggtccaagggaacattgcgcagttt

SEQ ID NO: 648471 - DNA, 25 bp, Mus musculus
ggtccaagggaagattgcgcagttt

SEQ ID NO: 648472 - DNA, 25 bp, Mus musculus
ggtccaagtgcgaaaagtcccacct

SEQ ID NO: 648473 - DNA, 25 bp, Mus musculus
ggtccaagtgcgtaaagtcccacct

SEQ ID NO: 648474 - DNA, 25 bp, Mus musculus
ggtccaataaacctgaggagaccca

SEQ ID NO: 648475 - DNA, 25 bp, Mus musculus
ggtccaataaacgtgaggagaccca

SEQ ID NO: 648476 - DNA, 25 bp, Mus musculus
ggtccaatcagaatcactgtgcatt

SEQ ID NO: 648477 - DNA, 25 bp, Mus musculus
ggtccaatcagattcactgtgcatt

SEQ ID NO: 648478 - DNA, 25 bp, Mus musculus
ggtccaatcccgagcctgttacctt

SEQ ID NO: 648479 - DNA, 25 bp, Mus musculus
ggtccaatcccgtgcctgttacctt

SEQ ID NO: 648480 - DNA, 25 bp, Mus musculus
ggtccaattaaccattatcgaaaca

SEQ ID NO: 648481 - DNA, 25 bp, Mus musculus
ggtccaattaacgattatcgaaaca

SEQ ID NO: 648482 - DNA, 25 bp, Mus musculus
ggtccacaacgcacgctaatgaggg

SEQ ID NO: 648483 - DNA, 25 bp, Mus musculus
ggtccacaacgctcgctaatgaggg

SEQ ID NO: 648484 - DNA, 25 bp, Mus musculus
ggtccacaaggccaatcccgaacgg

SEQ ID NO: 648485 - DNA, 25 bp, Mus musculus
ggtccacaaggcgaatcccgaacgg

SEQ ID NO: 648486 - DNA, 25 bp, Mus musculus
ggtccacacatcaatctgtagccaa

SEQ ID NO: 648487 - DNA, 25 bp, Mus musculus
ggtccacacatctatctgtagccaa

SEQ ID NO: 648488 - DNA, 25 bp, Mus musculus
ggtccacaccgacagtcacgaggag

SEQ ID NO: 648489 - DNA, 25 bp, Mus musculus
ggtccacaccgagagtcacgaggag

SEQ ID NO: 648490 - DNA, 25 bp, Mus musculus
ggtccacacctcattgagttgtaat

SEQ ID NO: 648491 - DNA, 25 bp, Mus musculus
ggtccacacctctttgagttgtaat

SEQ ID NO: 648492 - DNA, 25 bp, Mus musculus
ggtccacagcagagcagatcgttta

SEQ ID NO: 648493 - DNA, 25 bp, Mus musculus
ggtccacagcagtgcagatcgttta

SEQ ID NO: 648494 - DNA, 25 bp, Mus musculus
ggtccacagtagcatttcttcttag

SEQ ID NO: 648495 - DNA, 25 bp, Mus musculus
ggtccacagtaggatttcttcttag

SEQ ID NO: 648496 - DNA, 25 bp, Mus musculus
ggtccacatcccatgttttctagta

SEQ ID NO: 648497 - DNA, 25 bp, Mus musculus
ggtccacatcccttgttttctagta

SEQ ID NO: 648498 - DNA, 25 bp, Mus musculus
ggtccacatggacatcccaggagag

SEQ ID NO: 648499 - DNA, 25 bp, Mus musculus
ggtccacatggagatcccaggagag

SEQ ID NO: 648500 - DNA, 25 bp, Mus musculus
ggtccacatgtacatttgtaacact

SEQ ID NO: 648501 - DNA, 25 bp, Mus musculus
ggtccacatgtagatttgtaacact

SEQ ID NO: 648502 - DNA, 25 bp, Mus musculus
ggtccacatgtgacatctattcata

SEQ ID NO: 648503 - DNA, 25 bp, Mus musculus
ggtccacatgtgtcatctattcata

SEQ ID NO: 648504 - DNA, 25 bp, Mus musculus
ggtccacattcaccgagacctcgag

SEQ ID NO: 648505 - DNA, 25 bp, Mus musculus
ggtccacattcagcgagacctcgag

SEQ ID NO: 648506 - DNA, 25 bp, Mus musculus
ggtccacattgaatgccgttttctt

SEQ ID NO: 648507 - DNA, 25 bp, Mus musculus
ggtccacattgattgccgttttctt

SEQ ID NO: 648508 - DNA, 25 bp, Mus musculus
ggtccaccaattacagaggcatacg

SEQ ID NO: 648509 - DNA, 25 bp, Mus musculus
ggtccaccaatttcagaggcatacg

SEQ ID NO: 648510 - DNA, 25 bp, Mus musculus
ggtccaccagggactacaggttcaa

SEQ ID NO: 648511 - DNA, 25 bp, Mus musculus
ggtccaccagggtctacaggttcaa

SEQ ID NO: 648512 - DNA, 25 bp, Mus musculus
ggtccaccaggtcagagcctaagca

SEQ ID NO: 648513 - DNA, 25 bp, Mus musculus
ggtccaccaggtgagagcctaagca

SEQ ID NO: 648514 - DNA, 25 bp, Mus musculus
ggtccaccctaaaaaacagccagct

SEQ ID NO: 648515 - DNA, 25 bp, Mus musculus
ggtccaccctaataaacagccagct

SEQ ID NO: 648516 - DNA, 25 bp, Mus musculus
ggtccaccggaaactcttcttaagg

SEQ ID NO: 648517 - DNA, 25 bp, Mus musculus
ggtccaccggaatctcttcttaagg

SEQ ID NO: 648518 - DNA, 25 bp, Mus musculus
ggtccacctgaacacaccaagttca

SEQ ID NO: 648519 - DNA, 25 bp, Mus musculus
ggtccacctgaagacaccaagttca

SEQ ID NO: 648520 - DNA, 25 bp, Mus musculus
ggtccacggtgtcacatcttttgag

SEQ ID NO: 648521 - DNA, 25 bp, Mus musculus
ggtccacggtgtgacatcttttgag

SEQ ID NO: 648522 - DNA, 25 bp, Mus musculus
ggtccactgggcagcaggttttcct

SEQ ID NO: 648523 - DNA, 25 bp, Mus musculus
ggtccactgggctgcaggttttcct

SEQ ID NO: 648524 - DNA, 25 bp, Mus musculus
ggtccactgtggatcctattaacat

SEQ ID NO: 648525 - DNA, 25 bp, Mus musculus
ggtccactgtggttcctattaacat

SEQ ID NO: 648526 - DNA, 25 bp, Mus musculus
ggtccacttctaagcctgactcagg

SEQ ID NO: 648527 - DNA, 25 bp, Mus musculus
ggtccacttctatgcctgactcagg

SEQ ID NO: 648528 - DNA, 25 bp, Mus musculus
ggtccacttgagaacacaaaccctg

SEQ ID NO: 648529 - DNA, 25 bp, Mus musculus
ggtccacttgagtacacaaaccctg

SEQ ID NO: 648530 - DNA, 25 bp, Mus musculus
ggtccacttggtatcattgcgaaga

SEQ ID NO: 648531 - DNA, 25 bp, Mus musculus
ggtccacttggtttcattgcgaaga

SEQ ID NO: 648532 - DNA, 25 bp, Mus musculus
ggtccagaaaaactagagtcgcttt

SEQ ID NO: 648533 - DNA, 25 bp, Mus musculus
ggtccagaaaaagtagagtcgcttt

SEQ ID NO: 648534 - DNA, 25 bp, Mus musculus
ggtccagaaaccacaactactgttc

SEQ ID NO: 648535 - DNA, 25 bp, Mus musculus
ggtccagaaacctcaactactgttc

SEQ ID NO: 648536 - DNA, 25 bp, Mus musculus
ggtccagaatccacagctagagccg

SEQ ID NO: 648537 - DNA, 25 bp, Mus musculus
ggtccagaatcctcagctagagccg

SEQ ID NO: 648538 - DNA, 25 bp, Mus musculus
ggtccagaattcattgcatcatact

SEQ ID NO: 648539 - DNA, 25 bp, Mus musculus
ggtccagaattctttgcatcatact

SEQ ID NO: 648540 - DNA, 25 bp, Mus musculus
ggtccagaattgcatcttgtttgaa

SEQ ID NO: 648541 - DNA, 25 bp, Mus musculus
ggtccagaattggatcttgtttgaa

SEQ ID NO: 648542 - DNA, 25 bp, Mus musculus
ggtccagacatacagtgccattgaa

SEQ ID NO: 648543 - DNA, 25 bp, Mus musculus
ggtccagacatagagtgccattgaa

SEQ ID NO: 648544 - DNA, 25 bp, Mus musculus
ggtccagactatatatgtgttcaca

SEQ ID NO: 648545 - DNA, 25 bp, Mus musculus
ggtccagactatttatgtgttcaca

SEQ ID NO: 648546 - DNA, 25 bp, Mus musculus
ggtccagaggcaagaacaccaccat

SEQ ID NO: 648547 - DNA, 25 bp, Mus musculus
ggtccagaggcatgaacaccaccat

SEQ ID NO: 648548 - DNA, 25 bp, Mus musculus
ggtccagagttcaaatcccagcaac

SEQ ID NO: 648549 - DNA, 25 bp, Mus musculus
ggtccagagttctaatcccagcaac

SEQ ID NO: 648550 - DNA, 25 bp, Mus musculus
ggtccagatcacctgtggccatcag

SEQ ID NO: 648551 - DNA, 25 bp, Mus musculus
ggtccagatcacgtgtggccatcag

SEQ ID NO: 648552 - DNA, 25 bp, Mus musculus
ggtccagatgccaaagtgcataggg

SEQ ID NO: 648553 - DNA, 25 bp, Mus musculus
ggtccagatgcctaagtgcataggg

SEQ ID NO: 648554 - DNA, 25 bp, Mus musculus
ggtccagatggccatattgctttca

SEQ ID NO: 648555 - DNA, 25 bp, Mus musculus
ggtccagatggcgatattgctttca

SEQ ID NO: 648556 - DNA, 25 bp, Mus musculus
ggtccagatgtaaatcaggtctcag

SEQ ID NO: 648557 - DNA, 25 bp, Mus musculus
ggtccagatgtatatcaggtctcag

SEQ ID NO: 648558 - DNA, 25 bp, Mus musculus
ggtccagattctactacccagtgta

SEQ ID NO: 648559 - DNA, 25 bp, Mus musculus
ggtccagattcttctacccagtgta

SEQ ID NO: 648560 - DNA, 25 bp, Mus musculus
ggtccagcaaacactccagcgtgtt

SEQ ID NO: 648561 - DNA, 25 bp, Mus musculus
ggtccagcaaactctccagcgtgtt

SEQ ID NO: 648562 - DNA, 25 bp, Mus musculus
ggtccagcaagactgcctgttgaag

SEQ ID NO: 648563 - DNA, 25 bp, Mus musculus
ggtccagcaagagtgcctgttgaag

SEQ ID NO: 648564 - DNA, 25 bp, Mus musculus
ggtccagcaaggcagcgatctcgac

SEQ ID NO: 648565 - DNA, 25 bp, Mus musculus
ggtccagcaagggagcgatctcgac

SEQ ID NO: 648566 - DNA, 25 bp, Mus musculus
ggtccagcaggcactaagggatcat

SEQ ID NO: 648567 - DNA, 25 bp, Mus musculus
ggtccagcaggctctaagggatcat

SEQ ID NO: 648568 - DNA, 25 bp, Mus musculus
ggtccagcatcacatcacttgaata

SEQ ID NO: 648569 - DNA, 25 bp, Mus musculus
ggtccagcatcagatcacttgaata

SEQ ID NO: 648570 - DNA, 25 bp, Mus musculus
ggtccagcatgcatgcaatgtccac

SEQ ID NO: 648571 - DNA, 25 bp, Mus musculus
ggtccagcatgcttgcaatgtccac

SEQ ID NO: 648572 - DNA, 25 bp, Mus musculus
ggtccagcattcactgtggagtttc

SEQ ID NO: 648573 - DNA, 25 bp, Mus musculus
ggtccagcattctctgtggagtttc

SEQ ID NO: 648574 - DNA, 25 bp, Mus musculus
ggtccagccagtatctccagaagag

SEQ ID NO: 648575 - DNA, 25 bp, Mus musculus
ggtccagccagtttctccagaagag

SEQ ID NO: 648576 - DNA, 25 bp, Mus musculus
ggtccaggaaagatgctgtttttca

SEQ ID NO: 648577 - DNA, 25 bp, Mus musculus
ggtccaggaaagttgctgtttttca

SEQ ID NO: 648578 - DNA, 25 bp, Mus musculus
ggtccaggacataatcacagccaat

SEQ ID NO: 648579 - DNA, 25 bp, Mus musculus
ggtccaggacattatcacagccaat

SEQ ID NO: 648580 - DNA, 25 bp, Mus musculus
ggtccaggatcccaatctgcgatgg

SEQ ID NO: 648581 - DNA, 25 bp, Mus musculus
ggtccaggatccgaatctgcgatgg

SEQ ID NO: 648582 - DNA, 25 bp, Mus musculus
ggtccaggcaaacgactctttcctt

SEQ ID NO: 648583 - DNA, 25 bp, Mus musculus
ggtccaggcaaaggactctttcctt

SEQ ID NO: 648584 - DNA, 25 bp, Mus musculus
ggtccaggcaatcttcagtggcgac

SEQ ID NO: 648585 - DNA, 25 bp, Mus musculus
ggtccaggcaatgttcagtggcgac

SEQ ID NO: 648586 - DNA, 25 bp, Mus musculus
ggtccaggcactcgagctttgccct

SEQ ID NO: 648587 - DNA, 25 bp, Mus musculus
ggtccaggcactggagctttgccct

SEQ ID NO: 648588 - DNA, 25 bp, Mus musculus
ggtccaggccaaactgaacaacgat

SEQ ID NO: 648589 - DNA, 25 bp, Mus musculus
ggtccaggccaatctgaacaacgat

SEQ ID NO: 648590 - DNA, 25 bp, Mus musculus
ggtccaggcccaaatgaattactat

SEQ ID NO: 648591 - DNA, 25 bp, Mus musculus
ggtccaggcccatatgaattactat

SEQ ID NO: 648592 - DNA, 25 bp, Mus musculus
ggtccaggctaactgtagtctattc

SEQ ID NO: 648593 - DNA, 25 bp, Mus musculus
ggtccaggctaagtgtagtctattc

SEQ ID NO: 648594 - DNA, 25 bp, Mus musculus
ggtccagggatccataggtgccaaa

SEQ ID NO: 648595 - DNA, 25 bp, Mus musculus
ggtccagggatcgataggtgccaaa

SEQ ID NO: 648596 - DNA, 25 bp, Mus musculus
ggtccagggccaaagtccagcaaga

SEQ ID NO: 648597 - DNA, 25 bp, Mus musculus
ggtccagggccacaaacatctcaat

SEQ ID NO: 648598 - DNA, 25 bp, Mus musculus
ggtccagggccagaaacatctcaat

SEQ ID NO: 648599 - DNA, 25 bp, Mus musculus
ggtccagggccatagtccagcaaga

SEQ ID NO: 648600 - DNA, 25 bp, Mus musculus
ggtccagggcctagcctaacttgta

SEQ ID NO: 648601 - DNA, 25 bp, Mus musculus
ggtccagggccttgcctaacttgta

SEQ ID NO: 648602 - DNA, 25 bp, Mus musculus
ggtccaggtaacaacatccactttg

SEQ ID NO: 648603 - DNA, 25 bp, Mus musculus
ggtccaggtaactacatccactttg

SEQ ID NO: 648604 - DNA, 25 bp, Mus musculus
ggtccaggtcgccatcgagaagccc

SEQ ID NO: 648605 - DNA, 25 bp, Mus musculus
ggtccaggtcgcgatcgagaagccc

SEQ ID NO: 648606 - DNA, 25 bp, Mus musculus
ggtccaggtgacatgtggaatgtca

SEQ ID NO: 648607 - DNA, 25 bp, Mus musculus
ggtccaggtgacttgtggaatgtca

SEQ ID NO: 648608 - DNA, 25 bp, Mus musculus
ggtccaggtgtgagccggtcttcac

SEQ ID NO: 648609 - DNA, 25 bp, Mus musculus
ggtccaggtgtgtgccggtcttcac

SEQ ID NO: 648610 - DNA, 25 bp, Mus musculus
ggtccaggttacaaagttctcctca

SEQ ID NO: 648611 - DNA, 25 bp, Mus musculus
ggtccaggttactaagttctcctca

SEQ ID NO: 648612 - DNA, 25 bp, Mus musculus
ggtccagtagaccaggttacccagt

SEQ ID NO: 648613 - DNA, 25 bp, Mus musculus
ggtccagtagacgaggttacccagt

SEQ ID NO: 648614 - DNA, 25 bp, Mus musculus
ggtccagtccctcctatcaatggag

SEQ ID NO: 648615 - DNA, 25 bp, Mus musculus
ggtccagtccctgctatcaatggag

SEQ ID NO: 648616 - DNA, 25 bp, Mus musculus
ggtccagtctaccaaagttcctaga

SEQ ID NO: 648617 - DNA, 25 bp, Mus musculus
ggtccagtctacgaaagttcctaga

SEQ ID NO: 648618 - DNA, 25 bp, Mus musculus
ggtccagtctgactcttgttttatg

SEQ ID NO: 648619 - DNA, 25 bp, Mus musculus
ggtccagtctgagtcttgttttatg

SEQ ID NO: 648620 - DNA, 25 bp, Mus musculus
ggtccagtgacacgctctaattagc

SEQ ID NO: 648621 - DNA, 25 bp, Mus musculus
ggtccagtgacaggctctaattagc

SEQ ID NO: 648622 - DNA, 25 bp, Mus musculus
ggtccagtgattaggagcctgaacc

SEQ ID NO: 648623 - DNA, 25 bp, Mus musculus
ggtccagtgatttggagcctgaacc

SEQ ID NO: 648624 - DNA, 25 bp, Mus musculus
ggtccagtggccacatttgcagcgt

SEQ ID NO: 648625 - DNA, 25 bp, Mus musculus
ggtccagtggcctcatttgcagcgt

SEQ ID NO: 648626 - DNA, 25 bp, Mus musculus
ggtccagtgggtaattacatcgttt

SEQ ID NO: 648627 - DNA, 25 bp, Mus musculus
ggtccagtgggttattacatcgttt

SEQ ID NO: 648628 - DNA, 25 bp, Mus musculus
ggtccagtgtagaatccagttgtgt

SEQ ID NO: 648629 - DNA, 25 bp, Mus musculus
ggtccagtgtagtatccagttgtgt

SEQ ID NO: 648630 - DNA, 25 bp, Mus musculus
ggtccagtgtccacttgtgtgtttc

SEQ ID NO: 648631 - DNA, 25 bp, Mus musculus
ggtccagtgtcctcttgtgtgtttc

SEQ ID NO: 648632 - DNA, 25 bp, Mus musculus
ggtccagtgtgaaggcagctgcaat

SEQ ID NO: 648633 - DNA, 25 bp, Mus musculus
ggtccagtgtgatggcagctgcaat

SEQ ID NO: 648634 - DNA, 25 bp, Mus musculus
ggtccagtgtggattaggtcagtca

SEQ ID NO: 648635 - DNA, 25 bp, Mus musculus
ggtccagtgtggcaggtaccttctc

SEQ ID NO: 648636 - DNA, 25 bp, Mus musculus
ggtccagtgtgggaggtaccttctc

SEQ ID NO: 648637 - DNA, 25 bp, Mus musculus
ggtccagtgtggtttaggtcagtca

SEQ ID NO: 648638 - DNA, 25 bp, Mus musculus
ggtccagtgtttaactgagactcat

SEQ ID NO: 648639 - DNA, 25 bp, Mus musculus
ggtccagtgttttactgagactcat

SEQ ID NO: 648640 - DNA, 25 bp, Mus musculus
ggtccagttccactgtaaagtcctg

SEQ ID NO: 648641 - DNA, 25 bp, Mus musculus
ggtccagttccagtgtaaagtcctg

SEQ ID NO: 648642 - DNA, 25 bp, Mus musculus
ggtccagttcctcccgagatgtcct

SEQ ID NO: 648643 - DNA, 25 bp, Mus musculus
ggtccagttcctgccgagatgtcct

SEQ ID NO: 648644 - DNA, 25 bp, Mus musculus
ggtccatagatccttctgagatagt

SEQ ID NO: 648645 - DNA, 25 bp, Mus musculus
ggtccatagatcgttctgagatagt

SEQ ID NO: 648646 - DNA, 25 bp, Mus musculus
ggtccatagcccatggttgaattgt

SEQ ID NO: 648647 - DNA, 25 bp, Mus musculus
ggtccatagcccttggttgaattgt

SEQ ID NO: 648648 - DNA, 25 bp, Mus musculus
ggtccataggcccagccatccaggg

SEQ ID NO: 648649 - DNA, 25 bp, Mus musculus
ggtccataggccgagccatccaggg

SEQ ID NO: 648650 - DNA, 25 bp, Mus musculus
ggtccataggttcttaagtgagtct

SEQ ID NO: 648651 - DNA, 25 bp, Mus musculus
ggtccataggttgttaagtgagtct

SEQ ID NO: 648652 - DNA, 25 bp, Mus musculus
ggtccatatcaaccactagactata

SEQ ID NO: 648653 - DNA, 25 bp, Mus musculus
ggtccatatcaagcactagactata

SEQ ID NO: 648654 - DNA, 25 bp, Mus musculus
ggtccatatgcccagatagcactat

SEQ ID NO: 648655 - DNA, 25 bp, Mus musculus
ggtccatatgccgagatagcactat

SEQ ID NO: 648656 - DNA, 25 bp, Mus musculus
ggtccatcaaccagcaacctgaaat

SEQ ID NO: 648657 - DNA, 25 bp, Mus musculus
ggtccatcaacctgcaacctgaaat

SEQ ID NO: 648658 - DNA, 25 bp, Mus musculus
ggtccatcaacgacccttgtagagg

SEQ ID NO: 648659 - DNA, 25 bp, Mus musculus
ggtccatcaacgtcccttgtagagg

SEQ ID NO: 648660 - DNA, 25 bp, Mus musculus
ggtccatccacacagtgctgtgata

SEQ ID NO: 648661 - DNA, 25 bp, Mus musculus
ggtccatccacagagtgctgtgata

SEQ ID NO: 648662 - DNA, 25 bp, Mus musculus
ggtccatccttgagtggatcttagt

SEQ ID NO: 648663 - DNA, 25 bp, Mus musculus
ggtccatccttgtgtggatcttagt

SEQ ID NO: 648664 - DNA, 25 bp, Mus musculus
ggtccatcgagccaaagcattcctc

SEQ ID NO: 648665 - DNA, 25 bp, Mus musculus
ggtccatcgagcgaaagcattcctc

SEQ ID NO: 648666 - DNA, 25 bp, Mus musculus
ggtccatctctaccctattgatgat

SEQ ID NO: 648667 - DNA, 25 bp, Mus musculus
ggtccatctctaccctgtcaaaatt

SEQ ID NO: 648668 - DNA, 25 bp, Mus musculus
ggtccatctctagcctattgatgat

SEQ ID NO: 648669 - DNA, 25 bp, Mus musculus
ggtccatctctagcctgtcaaaatt

SEQ ID NO: 648670 - DNA, 25 bp, Mus musculus
ggtccatctctgagtgagacgctac

SEQ ID NO: 648671 - DNA, 25 bp, Mus musculus
ggtccatctctgtgtgagacgctac

SEQ ID NO: 648672 - DNA, 25 bp, Mus musculus
ggtccatctggcaggtgtagttcag

SEQ ID NO: 648673 - DNA, 25 bp, Mus musculus
ggtccatctggctggtgtagttcag

SEQ ID NO: 648674 - DNA, 25 bp, Mus musculus
ggtccatcttctacaaggctaatgg

SEQ ID NO: 648675 - DNA, 25 bp, Mus musculus
ggtccatcttcttcaaggctaatgg

SEQ ID NO: 648676 - DNA, 25 bp, Mus musculus
ggtccatgagaacgcaccttggaaa

SEQ ID NO: 648677 - DNA, 25 bp, Mus musculus
ggtccatgagaaggcaccttggaaa

SEQ ID NO: 648678 - DNA, 25 bp, Mus musculus
ggtccatgcacacctttttcagtat

SEQ ID NO: 648679 - DNA, 25 bp, Mus musculus
ggtccatgcacagctttttcagtat

SEQ ID NO: 648680 - DNA, 25 bp, Mus musculus
ggtccatgcaggcatcgactcagac

SEQ ID NO: 648681 - DNA, 25 bp, Mus musculus
ggtccatgcagggatcgactcagac

SEQ ID NO: 648682 - DNA, 25 bp, Mus musculus
ggtccatgctaaatttggcactaaa

SEQ ID NO: 648683 - DNA, 25 bp, Mus musculus
ggtccatgctaattttggcactaaa

SEQ ID NO: 648684 - DNA, 25 bp, Mus musculus
ggtccatgctggcacacagctttgt

SEQ ID NO: 648685 - DNA, 25 bp, Mus musculus
ggtccatgctgggacacagctttgt

SEQ ID NO: 648686 - DNA, 25 bp, Mus musculus
ggtccatgcttacgatttgggccct

SEQ ID NO: 648687 - DNA, 25 bp, Mus musculus
ggtccatgcttaggatttgggccct

SEQ ID NO: 648688 - DNA, 25 bp, Mus musculus
ggtccatgctttaggcttatataaa

SEQ ID NO: 648689 - DNA, 25 bp, Mus musculus
ggtccatgcttttggcttatataaa

SEQ ID NO: 648690 - DNA, 25 bp, Mus musculus
ggtccatgggatcccgagcagacta

SEQ ID NO: 648691 - DNA, 25 bp, Mus musculus
ggtccatgggatgccgagcagacta

SEQ ID NO: 648692 - DNA, 25 bp, Mus musculus
ggtccatggtgtcctgtatctatat

SEQ ID NO: 648693 - DNA, 25 bp, Mus musculus
ggtccatggtgtgctgtatctatat

SEQ ID NO: 648694 - DNA, 25 bp, Mus musculus
ggtccatgtaagaactttccatgtt

SEQ ID NO: 648695 - DNA, 25 bp, Mus musculus
ggtccatgtaagtactttccatgtt

SEQ ID NO: 648696 - DNA, 25 bp, Mus musculus
ggtccatgtcttctagctattaagc

SEQ ID NO: 648697 - DNA, 25 bp, Mus musculus
ggtccatgtcttgtagctattaagc

SEQ ID NO: 648698 - DNA, 25 bp, Mus musculus
ggtccatgtgcaacatcagagccta

SEQ ID NO: 648699 - DNA, 25 bp, Mus musculus
ggtccatgtgcatcatcagagccta

SEQ ID NO: 648700 - DNA, 25 bp, Mus musculus
ggtccatgttaaatacaaaggcgta

SEQ ID NO: 648701 - DNA, 25 bp, Mus musculus
ggtccatgttaattacaaaggcgta

SEQ ID NO: 648702 - DNA, 25 bp, Mus musculus
ggtccattcacaacaggtaaatctt

SEQ ID NO: 648703 - DNA, 25 bp, Mus musculus
ggtccattcacatcaggtaaatctt

SEQ ID NO: 648704 - DNA, 25 bp, Mus musculus
ggtccattcggaccataactgagtt

SEQ ID NO: 648705 - DNA, 25 bp, Mus musculus
ggtccattcggagcataactgagtt

SEQ ID NO: 648706 - DNA, 25 bp, Mus musculus
ggtccattgataagtcaaactccag

SEQ ID NO: 648707 - DNA, 25 bp, Mus musculus
ggtccattgatatgtcaaactccag

SEQ ID NO: 648708 - DNA, 25 bp, Mus musculus
ggtccattgcagacagcgaggagtc

SEQ ID NO: 648709 - DNA, 25 bp, Mus musculus
ggtccattgcagtcagcgaggagtc

SEQ ID NO: 648710 - DNA, 25 bp, Mus musculus
ggtccattgtgcagaggtttctgct

SEQ ID NO: 648711 - DNA, 25 bp, Mus musculus
ggtccattgtgctgaggtttctgct

SEQ ID NO: 648712 - DNA, 25 bp, Mus musculus
ggtccatttgcaacccttgaatcta

SEQ ID NO: 648713 - DNA, 25 bp, Mus musculus
ggtccatttgcatcccttgaatcta

SEQ ID NO: 648714 - DNA, 25 bp, Mus musculus
ggtccattttatctatacccagaaa

SEQ ID NO: 648715 - DNA, 25 bp, Mus musculus
ggtccattttatgtatacccagaaa

SEQ ID NO: 648716 - DNA, 25 bp, Mus musculus
ggtcccaaatatctaattgactctg

SEQ ID NO: 648717 - DNA, 25 bp, Mus musculus
ggtcccaaatatgtaattgactctg

SEQ ID NO: 648718 - DNA, 25 bp, Mus musculus
ggtcccaaattacttctatactgat

SEQ ID NO: 648719 - DNA, 25 bp, Mus musculus
ggtcccaaattagttctatactgat

SEQ ID NO: 648720 - DNA, 25 bp, Mus musculus
ggtcccaaggacacctgaacttaca

SEQ ID NO: 648721 - DNA, 25 bp, Mus musculus
ggtcccaaggactcctgaacttaca

SEQ ID NO: 648722 - DNA, 25 bp, Mus musculus
ggtcccaagtcccattaagtgactg

SEQ ID NO: 648723 - DNA, 25 bp, Mus musculus
ggtcccaagtccgattaagtgactg

SEQ ID NO: 648724 - DNA, 25 bp, Mus musculus
ggtcccaagtgtacatttggatgtc

SEQ ID NO: 648725 - DNA, 25 bp, Mus musculus
ggtcccaagtgttcatttggatgtc

SEQ ID NO: 648726 - DNA, 25 bp, Mus musculus
ggtcccaagtttagtgcaatctgaa

SEQ ID NO: 648727 - DNA, 25 bp, Mus musculus
ggtcccaagttttgtgcaatctgaa

SEQ ID NO: 648728 - DNA, 25 bp, Mus musculus
ggtcccacagatccaggcgcaggag

SEQ ID NO: 648729 - DNA, 25 bp, Mus musculus
ggtcccacagatgcaggcgcaggag

SEQ ID NO: 648730 - DNA, 25 bp, Mus musculus
ggtcccacagttcagcctgggaata

SEQ ID NO: 648731 - DNA, 25 bp, Mus musculus
ggtcccacagttgagcctgggaata

SEQ ID NO: 648732 - DNA, 25 bp, Mus musculus
ggtcccacatcgacaagacagtgct

SEQ ID NO: 648733 - DNA, 25 bp, Mus musculus
ggtcccacatcgtcaagacagtgct

SEQ ID NO: 648734 - DNA, 25 bp, Mus musculus
ggtcccacgcacaggagaacacgat

SEQ ID NO: 648735 - DNA, 25 bp, Mus musculus
ggtcccacgcactggagaacacgat

SEQ ID NO: 648736 - DNA, 25 bp, Mus musculus
ggtcccacggaccttatgtgatgcg

SEQ ID NO: 648737 - DNA, 25 bp, Mus musculus
ggtcccacggacgttatgtgatgcg

SEQ ID NO: 648738 - DNA, 25 bp, Mus musculus
ggtcccacgggcagttttgaatggt

SEQ ID NO: 648739 - DNA, 25 bp, Mus musculus
ggtcccacgggctgttttgaatggt

SEQ ID NO: 648740 - DNA, 25 bp, Mus musculus
ggtcccactcgccaatagaagaaaa

SEQ ID NO: 648741 - DNA, 25 bp, Mus musculus
ggtcccactcgcgaatagaagaaaa

SEQ ID NO: 648742 - DNA, 25 bp, Mus musculus
ggtcccactggcaagttttcagttt

SEQ ID NO: 648743 - DNA, 25 bp, Mus musculus
ggtcccactggctagttttcagttt

SEQ ID NO: 648744 - DNA, 25 bp, Mus musculus
ggtcccactgtgaagctttttaaca

SEQ ID NO: 648745 - DNA, 25 bp, Mus musculus
ggtcccactgtgtagctttttaaca

SEQ ID NO: 648746 - DNA, 25 bp, Mus musculus
ggtcccacttgactggtcttgaact

SEQ ID NO: 648747 - DNA, 25 bp, Mus musculus
ggtcccacttgagtggtcttgaact

SEQ ID NO: 648748 - DNA, 25 bp, Mus musculus
ggtcccagaaacagaggagtctagc

SEQ ID NO: 648749 - DNA, 25 bp, Mus musculus
ggtcccagaaactgaggagtctagc

SEQ ID NO: 648750 - DNA, 25 bp, Mus musculus
ggtcccagaacacgagagcaccgaa

SEQ ID NO: 648751 - DNA, 25 bp, Mus musculus
ggtcccagaacaggagagcaccgaa

SEQ ID NO: 648752 - DNA, 25 bp, Mus musculus
ggtcccagaagcagttggccagtat

SEQ ID NO: 648753 - DNA, 25 bp, Mus musculus
ggtcccagaagctgttggccagtat

SEQ ID NO: 648754 - DNA, 25 bp, Mus musculus
ggtcccagagtgctcatccatggca

SEQ ID NO: 648755 - DNA, 25 bp, Mus musculus
ggtcccagagtggtcatccatggca

SEQ ID NO: 648756 - DNA, 25 bp, Mus musculus
ggtcccaggtacagacgttctgaga

SEQ ID NO: 648757 - DNA, 25 bp, Mus musculus
ggtcccaggtactgacgttctgaga

SEQ ID NO: 648758 - DNA, 25 bp, Mus musculus
ggtcccaggtttcgatctgtttgga

SEQ ID NO: 648759 - DNA, 25 bp, Mus musculus
ggtcccaggtttggatctgtttgga

SEQ ID NO: 648760 - DNA, 25 bp, Mus musculus
ggtcccagtaatacaattgtgtttc

SEQ ID NO: 648761 - DNA, 25 bp, Mus musculus
ggtcccagtaattcaattgtgtttc

SEQ ID NO: 648762 - DNA, 25 bp, Mus musculus
ggtcccagttgtacacatttggcta

SEQ ID NO: 648763 - DNA, 25 bp, Mus musculus
ggtcccagttgttcacatttggcta

SEQ ID NO: 648764 - DNA, 25 bp, Mus musculus
ggtcccatagtgagcaacagatccc

SEQ ID NO: 648765 - DNA, 25 bp, Mus musculus
ggtcccatagtgtgcaacagatccc

SEQ ID NO: 648766 - DNA, 25 bp, Mus musculus
ggtcccatccaaccaaaagtcttca

SEQ ID NO: 648767 - DNA, 25 bp, Mus musculus
ggtcccatccaagcaaaagtcttca

SEQ ID NO: 648768 - DNA, 25 bp, Mus musculus
ggtcccatccccagtactagataaa

SEQ ID NO: 648769 - DNA, 25 bp, Mus musculus
ggtcccatcccctgtactagataaa

SEQ ID NO: 648770 - DNA, 25 bp, Mus musculus
ggtcccatctggcttcaagaaaagc

SEQ ID NO: 648771 - DNA, 25 bp, Mus musculus
ggtcccatctgggttcaagaaaagc

SEQ ID NO: 648772 - DNA, 25 bp, Mus musculus
ggtcccatgcctactcagaggaaga

SEQ ID NO: 648773 - DNA, 25 bp, Mus musculus
ggtcccatgccttctcagaggaaga

SEQ ID NO: 648774 - DNA, 25 bp, Mus musculus
ggtcccatgtccatggcagtgtccc

SEQ ID NO: 648775 - DNA, 25 bp, Mus musculus
ggtcccatgtccttggcagtgtccc

SEQ ID NO: 648776 - DNA, 25 bp, Mus musculus
ggtcccattactactgttcacaagg

SEQ ID NO: 648777 - DNA, 25 bp, Mus musculus
ggtcccattacttctgttcacaagg

SEQ ID NO: 648778 - DNA, 25 bp, Mus musculus
ggtcccattattaacagatctccca

SEQ ID NO: 648779 - DNA, 25 bp, Mus musculus
ggtcccattatttacagatctccca

SEQ ID NO: 648780 - DNA, 25 bp, Mus musculus
ggtcccatttagaagggtgtaatca

SEQ ID NO: 648781 - DNA, 25 bp, Mus musculus
ggtcccatttagtagggtgtaatca

SEQ ID NO: 648782 - DNA, 25 bp, Mus musculus
ggtcccatttatctgttctcttctt

SEQ ID NO: 648783 - DNA, 25 bp, Mus musculus
ggtcccatttatgtgttctcttctt

SEQ ID NO: 648784 - DNA, 25 bp, Mus musculus
ggtccccaatatcctttgagtttga

SEQ ID NO: 648785 - DNA, 25 bp, Mus musculus
ggtccccaatatgctttgagtttga

SEQ ID NO: 648786 - DNA, 25 bp, Mus musculus
ggtccccactagaggatcgaggcta

SEQ ID NO: 648787 - DNA, 25 bp, Mus musculus
ggtccccactagtggatcgaggcta

SEQ ID NO: 648788 - DNA, 25 bp, Mus musculus
ggtccccagacacctgcagatttga

SEQ ID NO: 648789 - DNA, 25 bp, Mus musculus
ggtccccagacagctgcagatttga

SEQ ID NO: 648790 - DNA, 25 bp, Mus musculus
ggtccccagctgaccatcggagtgt

SEQ ID NO: 648791 - DNA, 25 bp, Mus musculus
ggtccccagctgtccatcggagtgt

SEQ ID NO: 648792 - DNA, 25 bp, Mus musculus
ggtccccagcttataggagctgtca

SEQ ID NO: 648793 - DNA, 25 bp, Mus musculus
ggtccccagcttttaggagctgtca

SEQ ID NO: 648794 - DNA, 25 bp, Mus musculus
ggtccccagggtattcttccagagg

SEQ ID NO: 648795 - DNA, 25 bp, Mus musculus
ggtccccagggttttcttccagagg

SEQ ID NO: 648796 - DNA, 25 bp, Mus musculus
ggtccccagtataaaaattccaatg

SEQ ID NO: 648797 - DNA, 25 bp, Mus musculus
ggtccccagtattaaaattccaatg

SEQ ID NO: 648798 - DNA, 25 bp, Mus musculus
ggtccccagtcaacaaggatgtgat

SEQ ID NO: 648799 - DNA, 25 bp, Mus musculus
ggtccccagtcatcaaggatgtgat

SEQ ID NO: 648800 - DNA, 25 bp, Mus musculus
ggtccccagttacatgtttgaagct

SEQ ID NO: 648801 - DNA, 25 bp, Mus musculus
ggtccccagttagatgtttgaagct

SEQ ID NO: 648802 - DNA, 25 bp, Mus musculus
ggtccccatgacatggaatttcctg

SEQ ID NO: 648803 - DNA, 25 bp, Mus musculus
ggtccccatgacttggaatttcctg

SEQ ID NO: 648804 - DNA, 25 bp, Mus musculus
ggtccccatttgaacattcagctga

SEQ ID NO: 648805 - DNA, 25 bp, Mus musculus
ggtccccatttgtacattcagctga

SEQ ID NO: 648806 - DNA, 25 bp, Mus musculus
ggtccccgagaaacacattgctatg

SEQ ID NO: 648807 - DNA, 25 bp, Mus musculus
ggtccccgagaatcacattgctatg

SEQ ID NO: 648808 - DNA, 25 bp, Mus musculus
ggtccccgagatcagacgacttaaa

SEQ ID NO: 648809 - DNA, 25 bp, Mus musculus
ggtccccgagatgagacgacttaaa

SEQ ID NO: 648810 - DNA, 25 bp, Mus musculus
ggtccccgaggccatgatcagatta

SEQ ID NO: 648811 - DNA, 25 bp, Mus musculus
ggtccccgaggcgatgatcagatta

SEQ ID NO: 648812 - DNA, 25 bp, Mus musculus
ggtccccggaccatatatttattgc

SEQ ID NO: 648813 - DNA, 25 bp, Mus musculus
ggtccccggaccttatatttattgc

SEQ ID NO: 648814 - DNA, 25 bp, Mus musculus
ggtcccctaaaaaagctggtcactg

SEQ ID NO: 648815 - DNA, 25 bp, Mus musculus
ggtcccctaaaatagctggtcactg

SEQ ID NO: 648816 - DNA, 25 bp, Mus musculus
ggtcccctatatctctctagaggaa

SEQ ID NO: 648817 - DNA, 25 bp, Mus musculus
ggtcccctatatgtctctagaggaa

SEQ ID NO: 648818 - DNA, 25 bp, Mus musculus
ggtcccctcactaaactctggaaca

SEQ ID NO: 648819 - DNA, 25 bp, Mus musculus
ggtcccctcacttaactctggaaca

SEQ ID NO: 648820 - DNA, 25 bp, Mus musculus
ggtcccctctctctgagtacatgat

SEQ ID NO: 648821 - DNA, 25 bp, Mus musculus
ggtcccctctctgtgagtacatgat

SEQ ID NO: 648822 - DNA, 25 bp, Mus musculus
ggtcccctgagaacacactatcaaa

SEQ ID NO: 648823 - DNA, 25 bp, Mus musculus
ggtcccctgagatcacactatcaaa

SEQ ID NO: 648824 - DNA, 25 bp, Mus musculus
ggtcccctgatgacacatctcaaat

SEQ ID NO: 648825 - DNA, 25 bp, Mus musculus
ggtcccctgatgtcacatctcaaat

SEQ ID NO: 648826 - DNA, 25 bp, Mus musculus
ggtccccttatgccaggaaggcttt

SEQ ID NO: 648827 - DNA, 25 bp, Mus musculus
ggtccccttatggcaggaaggcttt

SEQ ID NO: 648828 - DNA, 25 bp, Mus musculus
ggtccccttgcaccttttgtgtgtg

SEQ ID NO: 648829 - DNA, 25 bp, Mus musculus
ggtccccttgcagcttttgtgtgtg

SEQ ID NO: 648830 - DNA, 25 bp, Mus musculus
ggtccccttttccagcatctgtaag

SEQ ID NO: 648831 - DNA, 25 bp, Mus musculus
ggtccccttttcgagcatctgtaag

SEQ ID NO: 648832 - DNA, 25 bp, Mus musculus
ggtcccgatctgctttgaggtgaaa

SEQ ID NO: 648833 - DNA, 25 bp, Mus musculus
ggtcccgatctggtttgaggtgaaa

SEQ ID NO: 648834 - DNA, 25 bp, Mus musculus
ggtcccgcaaaacttgaatgaatct

SEQ ID NO: 648835 - DNA, 25 bp, Mus musculus
ggtcccgcaaaagttgaatgaatct

SEQ ID NO: 648836 - DNA, 25 bp, Mus musculus
ggtcccgtacataaaatatgctgtt

SEQ ID NO: 648837 - DNA, 25 bp, Mus musculus
ggtcccgtacattaaatatgctgtt

SEQ ID NO: 648838 - DNA, 25 bp, Mus musculus
ggtcccgtgagtcgaagcccagaca

SEQ ID NO: 648839 - DNA, 25 bp, Mus musculus
ggtcccgtgagtggaagcccagaca

SEQ ID NO: 648840 - DNA, 25 bp, Mus musculus
ggtcccgtgcttatattatgacatt

SEQ ID NO: 648841 - DNA, 25 bp, Mus musculus
ggtcccgtgcttttattatgacatt

SEQ ID NO: 648842 - DNA, 25 bp, Mus musculus
ggtcccgtgtacatacttttcagtg

SEQ ID NO: 648843 - DNA, 25 bp, Mus musculus
ggtcccgtgtacttacttttcagtg

SEQ ID NO: 648844 - DNA, 25 bp, Mus musculus
ggtccctaacgtaatattctttatg

SEQ ID NO: 648845 - DNA, 25 bp, Mus musculus
ggtccctaacgttatattctttatg

SEQ ID NO: 648846 - DNA, 25 bp, Mus musculus
ggtccctaggacagaagacacagct

SEQ ID NO: 648847 - DNA, 25 bp, Mus musculus
ggtccctaggactgaagacacagct

SEQ ID NO: 648848 - DNA, 25 bp, Mus musculus
ggtccctaggctctgtgctttatgc

SEQ ID NO: 648849 - DNA, 25 bp, Mus musculus
ggtccctaggctgtgtgctttatgc

SEQ ID NO: 648850 - DNA, 25 bp, Mus musculus
ggtccctatagacatctaggtctgt

SEQ ID NO: 648851 - DNA, 25 bp, Mus musculus
ggtccctatagagatctaggtctgt

SEQ ID NO: 648852 - DNA, 25 bp, Mus musculus
ggtccctatggaattggtccacacc

SEQ ID NO: 648853 - DNA, 25 bp, Mus musculus
ggtccctatggatttggtccacacc

SEQ ID NO: 648854 - DNA, 25 bp, Mus musculus
ggtccctatttgaggttattggtca

SEQ ID NO: 648855 - DNA, 25 bp, Mus musculus
ggtccctatttgtggttattggtca

SEQ ID NO: 648856 - DNA, 25 bp, Mus musculus
ggtccctcaaccatctgggatgagt

SEQ ID NO: 648857 - DNA, 25 bp, Mus musculus
ggtccctcaaccttctgggatgagt

SEQ ID NO: 648858 - DNA, 25 bp, Mus musculus
ggtccctccaggacctttcttagag

SEQ ID NO: 648859 - DNA, 25 bp, Mus musculus
ggtccctccaggtcctttcttagag

SEQ ID NO: 648860 - DNA, 25 bp, Mus musculus
ggtccctcccacagtgtgatgcaga

SEQ ID NO: 648861 - DNA, 25 bp, Mus musculus
ggtccctcccactgtgtgatgcaga

SEQ ID NO: 648862 - DNA, 25 bp, Mus musculus
ggtccctcctgcatcaataactaag

SEQ ID NO: 648863 - DNA, 25 bp, Mus musculus
ggtccctcctgcttcaataactaag

SEQ ID NO: 648864 - DNA, 25 bp, Mus musculus
ggtccctcgatgctccaataaacct

SEQ ID NO: 648865 - DNA, 25 bp, Mus musculus
ggtccctcgatggtccaataaacct

SEQ ID NO: 648866 - DNA, 25 bp, Mus musculus
ggtccctctattaacttctgtgatt

SEQ ID NO: 648867 - DNA, 25 bp, Mus musculus
ggtccctctatttacttctgtgatt

SEQ ID NO: 648868 - DNA, 25 bp, Mus musculus
ggtccctcttcactgatgacgacag

SEQ ID NO: 648869 - DNA, 25 bp, Mus musculus
ggtccctcttcagtgatgacgacag

SEQ ID NO: 648870 - DNA, 25 bp, Mus musculus
ggtccctcttgactttggatgtgaa

SEQ ID NO: 648871 - DNA, 25 bp, Mus musculus
ggtccctcttgagtttggatgtgaa

SEQ ID NO: 648872 - DNA, 25 bp, Mus musculus
ggtccctgaacaaggttagctattg

SEQ ID NO: 648873 - DNA, 25 bp, Mus musculus
ggtccctgaacatggttagctattg

SEQ ID NO: 648874 - DNA, 25 bp, Mus musculus
ggtccctgacatccaagagatccga

SEQ ID NO: 648875 - DNA, 25 bp, Mus musculus
ggtccctgacatgcaagagatccga

SEQ ID NO: 648876 - DNA, 25 bp, Mus musculus
ggtccctgagatctgggctccctta

SEQ ID NO: 648877 - DNA, 25 bp, Mus musculus
ggtccctgagatgtgggctccctta

SEQ ID NO: 648878 - DNA, 25 bp, Mus musculus
ggtccctgctagctacttggagaaa

SEQ ID NO: 648879 - DNA, 25 bp, Mus musculus
ggtccctgctaggtacttggagaaa

SEQ ID NO: 648880 - DNA, 25 bp, Mus musculus
ggtccctgctgactagaactggatt

SEQ ID NO: 648881 - DNA, 25 bp, Mus musculus
ggtccctgctgagtagaactggatt

SEQ ID NO: 648882 - DNA, 25 bp, Mus musculus
ggtccctggaaaacccatgtgtgtg

SEQ ID NO: 648883 - DNA, 25 bp, Mus musculus
ggtccctggaaatcccatgtgtgtg

SEQ ID NO: 648884 - DNA, 25 bp, Mus musculus
ggtccctggcaaaattactgtatac

SEQ ID NO: 648885 - DNA, 25 bp, Mus musculus
ggtccctggcaatattactgtatac

SEQ ID NO: 648886 - DNA, 25 bp, Mus musculus
ggtccctggtctccctttacattct

SEQ ID NO: 648887 - DNA, 25 bp, Mus musculus
ggtccctggtctgcctttacattct

SEQ ID NO: 648888 - DNA, 25 bp, Mus musculus
ggtccctgtaccattgtgacaggtt

SEQ ID NO: 648889 - DNA, 25 bp, Mus musculus
ggtccctgtacctttgtgacaggtt

SEQ ID NO: 648890 - DNA, 25 bp, Mus musculus
ggtccctgtaggcacaagggcacca

SEQ ID NO: 648891 - DNA, 25 bp, Mus musculus
ggtccctgtagggacaagggcacca

SEQ ID NO: 648892 - DNA, 25 bp, Mus musculus
ggtccctgtatcaaattccccgaga

SEQ ID NO: 648893 - DNA, 25 bp, Mus musculus
ggtccctgtatctaattccccgaga

SEQ ID NO: 648894 - DNA, 25 bp, Mus musculus
ggtccctgtctcagatgacaggtca

SEQ ID NO: 648895 - DNA, 25 bp, Mus musculus
ggtccctgtctctgatgacaggtca

SEQ ID NO: 648896 - DNA, 25 bp, Mus musculus
ggtccctgtgttagctgcctttgct

SEQ ID NO: 648897 - DNA, 25 bp, Mus musculus
ggtccctgtgtttgctgcctttgct

SEQ ID NO: 648898 - DNA, 25 bp, Mus musculus
ggtcccttcagcagaggtcagatgc

SEQ ID NO: 648899 - DNA, 25 bp, Mus musculus
ggtcccttcagctgaggtcagatgc

SEQ ID NO: 648900 - DNA, 25 bp, Mus musculus
ggtcccttctgtcccaggcattctg

SEQ ID NO: 648901 - DNA, 25 bp, Mus musculus
ggtcccttctgtgccaggcattctg

SEQ ID NO: 648902 - DNA, 25 bp, Mus musculus
ggtcccttgaggcaacgtatatagc

SEQ ID NO: 648903 - DNA, 25 bp, Mus musculus
ggtcccttgagggaacgtatatagc

SEQ ID NO: 648904 - DNA, 25 bp, Mus musculus
ggtcccttgcttatatactgggcat

SEQ ID NO: 648905 - DNA, 25 bp, Mus musculus
ggtcccttgcttttatactgggcat

SEQ ID NO: 648906 - DNA, 25 bp, Mus musculus
ggtcccttgggaaactggtagataa

SEQ ID NO: 648907 - DNA, 25 bp, Mus musculus
ggtcccttgggatactggtagataa

SEQ ID NO: 648908 - DNA, 25 bp, Mus musculus
ggtcccttgtctccgtggaacaagt

SEQ ID NO: 648909 - DNA, 25 bp, Mus musculus
ggtcccttgtctgcgtggaacaagt

SEQ ID NO: 648910 - DNA, 25 bp, Mus musculus
ggtcccttgtgcctttgatataaga

SEQ ID NO: 648911 - DNA, 25 bp, Mus musculus
ggtcccttgtgcgtttgatataaga

SEQ ID NO: 648912 - DNA, 25 bp, Mus musculus
ggtccctttaaaatcttttggcatg

SEQ ID NO: 648913 - DNA, 25 bp, Mus musculus
ggtccctttaaattcttttggcatg

SEQ ID NO: 648914 - DNA, 25 bp, Mus musculus
ggtcccttttcaacatgaccatgcc

SEQ ID NO: 648915 - DNA, 25 bp, Mus musculus
ggtcccttttcatcatgaccatgcc

SEQ ID NO: 648916 - DNA, 25 bp, Mus musculus
ggtccgaaccttccaggataattgt

SEQ ID NO: 648917 - DNA, 25 bp, Mus musculus
ggtccgaaccttgcaggataattgt

SEQ ID NO: 648918 - DNA, 25 bp, Mus musculus
ggtccgagctccagacgacccagta

SEQ ID NO: 648919 - DNA, 25 bp, Mus musculus
ggtccgagctcctgacgacccagta

SEQ ID NO: 648920 - DNA, 25 bp, Mus musculus
ggtccgatatctctatatgcaacca

SEQ ID NO: 648921 - DNA, 25 bp, Mus musculus
ggtccgatatctgtatatgcaacca

SEQ ID NO: 648922 - DNA, 25 bp, Mus musculus
ggtccgcaatttcctctctgcatca

SEQ ID NO: 648923 - DNA, 25 bp, Mus musculus
ggtccgcaatttgctctctgcatca

SEQ ID NO: 648924 - DNA, 25 bp, Mus musculus
ggtccgcactacaatgggctgtgac

SEQ ID NO: 648925 - DNA, 25 bp, Mus musculus
ggtccgcactactatgggctgtgac

SEQ ID NO: 648926 - DNA, 25 bp, Mus musculus
ggtccgcagagaagactgtgcagtt

SEQ ID NO: 648927 - DNA, 25 bp, Mus musculus
ggtccgcagagatgactgtgcagtt

SEQ ID NO: 648928 - DNA, 25 bp, Mus musculus
ggtccgcagcacagtatattatgat

SEQ ID NO: 648929 - DNA, 25 bp, Mus musculus
ggtccgcagcactgtatattatgat

SEQ ID NO: 648930 - DNA, 25 bp, Mus musculus
ggtccgcctttaaccagaagtggtg

SEQ ID NO: 648931 - DNA, 25 bp, Mus musculus
ggtccgcctttatccagaagtggtg

SEQ ID NO: 648932 - DNA, 25 bp, Mus musculus
ggtccggacacgctatgatcagaag

SEQ ID NO: 648933 - DNA, 25 bp, Mus musculus
ggtccggacacggtatgatcagaag

SEQ ID NO: 648934 - DNA, 25 bp, Mus musculus
ggtccggactccattttaggattcg

SEQ ID NO: 648935 - DNA, 25 bp, Mus musculus
ggtccggactcctttttaggattcg

SEQ ID NO: 648936 - DNA, 25 bp, Mus musculus
ggtccggcttggaagatctcccgaa

SEQ ID NO: 648937 - DNA, 25 bp, Mus musculus
ggtccggcttggtagatctcccgaa

SEQ ID NO: 648938 - DNA, 25 bp, Mus musculus
ggtccgggtggacttcatcaagtat

SEQ ID NO: 648939 - DNA, 25 bp, Mus musculus
ggtccgggtggagttcatcaagtat

SEQ ID NO: 648940 - DNA, 25 bp, Mus musculus
ggtccggtgcatattatattctctt

SEQ ID NO: 648941 - DNA, 25 bp, Mus musculus
ggtccggtgcattttatattctctt

SEQ ID NO: 648942 - DNA, 25 bp, Mus musculus
ggtccgtatcataaacgttccttcg

SEQ ID NO: 648943 - DNA, 25 bp, Mus musculus
ggtccgtatcattaacgttccttcg

SEQ ID NO: 648944 - DNA, 25 bp, Mus musculus
ggtccgtatgcgataccttctaaag

SEQ ID NO: 648945 - DNA, 25 bp, Mus musculus
ggtccgtatgcgttaccttctaaag

SEQ ID NO: 648946 - DNA, 25 bp, Mus musculus
ggtccgtcaagtaatcttggtacaa

SEQ ID NO: 648947 - DNA, 25 bp, Mus musculus
ggtccgtcaagttatcttggtacaa

SEQ ID NO: 648948 - DNA, 25 bp, Mus musculus
ggtccgtccagaagggagctgtaaa

SEQ ID NO: 648949 - DNA, 25 bp, Mus musculus
ggtccgtccagatgggagctgtaaa

SEQ ID NO: 648950 - DNA, 25 bp, Mus musculus
ggtccgtccatgaagtcattttcaa

SEQ ID NO: 648951 - DNA, 25 bp, Mus musculus
ggtccgtccatgtagtcattttcaa

SEQ ID NO: 648952 - DNA, 25 bp, Mus musculus
ggtccgtcccggagcacacagaggt

SEQ ID NO: 648953 - DNA, 25 bp, Mus musculus
ggtccgtcccggtgcacacagaggt

SEQ ID NO: 648954 - DNA, 25 bp, Mus musculus
ggtccgtgatttcttttgagcccca

SEQ ID NO: 648955 - DNA, 25 bp, Mus musculus
ggtccgtgatttgttttgagcccca

SEQ ID NO: 648956 - DNA, 25 bp, Mus musculus
ggtccgtgccatcgtgaaattcttt

SEQ ID NO: 648957 - DNA, 25 bp, Mus musculus
ggtccgtgccatggtgaaattcttt

SEQ ID NO: 648958 - DNA, 25 bp, Mus musculus
ggtccgtttgtgacacctttgattc

SEQ ID NO: 648959 - DNA, 25 bp, Mus musculus
ggtccgtttgtgtcacctttgattc

SEQ ID NO: 648960 - DNA, 25 bp, Mus musculus
ggtcctaaaaatatctgtaaacatg

SEQ ID NO: 648961 - DNA, 25 bp, Mus musculus
ggtcctaaaaatttctgtaaacatg

SEQ ID NO: 648962 - DNA, 25 bp, Mus musculus
ggtcctaaagtactctcagtgtcaa

SEQ ID NO: 648963 - DNA, 25 bp, Mus musculus
ggtcctaaagtagtctcagtgtcaa

SEQ ID NO: 648964 - DNA, 25 bp, Mus musculus
ggtcctaagccccaccattgagcag

SEQ ID NO: 648965 - DNA, 25 bp, Mus musculus
ggtcctaagcccgaccattgagcag

SEQ ID NO: 648966 - DNA, 25 bp, Mus musculus
ggtcctaaggacagtgtgggctaca

SEQ ID NO: 648967 - DNA, 25 bp, Mus musculus
ggtcctaaggactgtgtgggctaca

SEQ ID NO: 648968 - DNA, 25 bp, Mus musculus
ggtcctaataagatcaatttccagc

SEQ ID NO: 648969 - DNA, 25 bp, Mus musculus
ggtcctaataagttcaatttccagc

SEQ ID NO: 648970 - DNA, 25 bp, Mus musculus
ggtcctaatggtcatggcagcctta

SEQ ID NO: 648971 - DNA, 25 bp, Mus musculus
ggtcctaatggtgatggcagcctta

SEQ ID NO: 648972 - DNA, 25 bp, Mus musculus
ggtcctacacaacttccgctttgaa

SEQ ID NO: 648973 - DNA, 25 bp, Mus musculus
ggtcctacacaagttccgctttgaa

SEQ ID NO: 648974 - DNA, 25 bp, Mus musculus
ggtcctacaggactctgacacctac

SEQ ID NO: 648975 - DNA, 25 bp, Mus musculus
ggtcctacaggagtctgacacctac

SEQ ID NO: 648976 - DNA, 25 bp, Mus musculus
ggtcctacatccaacagttcttaaa

SEQ ID NO: 648977 - DNA, 25 bp, Mus musculus
ggtcctacatcctacagttcttaaa

SEQ ID NO: 648978 - DNA, 25 bp, Mus musculus
ggtcctacctggcatgtgtgcatcg

SEQ ID NO: 648979 - DNA, 25 bp, Mus musculus
ggtcctacctgggatgtgtgcatcg

SEQ ID NO: 648980 - DNA, 25 bp, Mus musculus
ggtcctacgggacatcgcctacgca

SEQ ID NO: 648981 - DNA, 25 bp, Mus musculus
ggtcctacgggagatcgcctacgca

SEQ ID NO: 648982 - DNA, 25 bp, Mus musculus
ggtcctactagaactgacagtgcag

SEQ ID NO: 648983 - DNA, 25 bp, Mus musculus
ggtcctactagatctgacagtgcag

SEQ ID NO: 648984 - DNA, 25 bp, Mus musculus
ggtcctagacagaatctggtcacct

SEQ ID NO: 648985 - DNA, 25 bp, Mus musculus
ggtcctagacagatgtccttggact

SEQ ID NO: 648986 - DNA, 25 bp, Mus musculus
ggtcctagacagtatctggtcacct

SEQ ID NO: 648987 - DNA, 25 bp, Mus musculus
ggtcctagacagttgtccttggact

SEQ ID NO: 648988 - DNA, 25 bp, Mus musculus
ggtcctagactgctgtcatcagcat

SEQ ID NO: 648989 - DNA, 25 bp, Mus musculus
ggtcctagactggtgtcatcagcat

SEQ ID NO: 648990 - DNA, 25 bp, Mus musculus
ggtcctaggctcaagtacccagtac

SEQ ID NO: 648991 - DNA, 25 bp, Mus musculus
ggtcctaggctctagtacccagtac

SEQ ID NO: 648992 - DNA, 25 bp, Mus musculus
ggtcctaggtacaatcactgatgac

SEQ ID NO: 648993 - DNA, 25 bp, Mus musculus
ggtcctaggtactatcactgatgac

SEQ ID NO: 648994 - DNA, 25 bp, Mus musculus
ggtcctaggtttactgatcctcaaa

SEQ ID NO: 648995 - DNA, 25 bp, Mus musculus
ggtcctaggttttctgatcctcaaa

SEQ ID NO: 648996 - DNA, 25 bp, Mus musculus
ggtcctagtaggatctgagtccaga

SEQ ID NO: 648997 - DNA, 25 bp, Mus musculus
ggtcctagtaggttctgagtccaga

SEQ ID NO: 648998 - DNA, 25 bp, Mus musculus
ggtcctatagatagcctactcattt

SEQ ID NO: 648999 - DNA, 25 bp, Mus musculus
ggtcctatagattgcctactcattt

SEQ ID NO: 649000 - DNA, 25 bp, Mus musculus
ggtcctatgcttatgaatggtctca

SEQ ID NO: 649001 - DNA, 25 bp, Mus musculus
ggtcctatgcttttgaatggtctca

SEQ ID NO: 649002 - DNA, 25 bp, Mus musculus
ggtcctatggcccattctcgatttt

SEQ ID NO: 649003 - DNA, 25 bp, Mus musculus
ggtcctatggccgattctcgatttt

SEQ ID NO: 649004 - DNA, 25 bp, Mus musculus
ggtcctatgtgcaccatgtctgtga

SEQ ID NO: 649005 - DNA, 25 bp, Mus musculus
ggtcctatgtgctccatgtctgtga

SEQ ID NO: 649006 - DNA, 25 bp, Mus musculus
ggtcctattcacacttatttttctg

SEQ ID NO: 649007 - DNA, 25 bp, Mus musculus
ggtcctattcactcttatttttctg

SEQ ID NO: 649008 - DNA, 25 bp, Mus musculus
ggtcctattgcaaattgtaccatga

SEQ ID NO: 649009 - DNA, 25 bp, Mus musculus
ggtcctattgcatattgtaccatga

SEQ ID NO: 649010 - DNA, 25 bp, Mus musculus
ggtcctattggacctatggttactg

SEQ ID NO: 649011 - DNA, 25 bp, Mus musculus
ggtcctattggagctatggttactg

SEQ ID NO: 649012 - DNA, 25 bp, Mus musculus
ggtcctattttaaactctagccttt

SEQ ID NO: 649013 - DNA, 25 bp, Mus musculus
ggtcctattttatactctagccttt

SEQ ID NO: 649014 - DNA, 25 bp, Mus musculus
ggtcctcaaaatctttgagctttta

SEQ ID NO: 649015 - DNA, 25 bp, Mus musculus
ggtcctcaaaatgtttgagctttta

SEQ ID NO: 649016 - DNA, 25 bp, Mus musculus
ggtcctcaagcaaggccaccaaagg

SEQ ID NO: 649017 - DNA, 25 bp, Mus musculus
ggtcctcaagcatggccaccaaagg

SEQ ID NO: 649018 - DNA, 25 bp, Mus musculus
ggtcctcaaggaagatgctccccga

SEQ ID NO: 649019 - DNA, 25 bp, Mus musculus
ggtcctcaaggatgatgctccccga

SEQ ID NO: 649020 - DNA, 25 bp, Mus musculus
ggtcctcacagtcctggtagtcagg

SEQ ID NO: 649021 - DNA, 25 bp, Mus musculus
ggtcctcacagtgctggtagtcagg

SEQ ID NO: 649022 - DNA, 25 bp, Mus musculus
ggtcctcaccaaagtcctacaggaa

SEQ ID NO: 649023 - DNA, 25 bp, Mus musculus
ggtcctcaccaacgaatggcctgat

SEQ ID NO: 649024 - DNA, 25 bp, Mus musculus
ggtcctcaccaaggaatggcctgat

SEQ ID NO: 649025 - DNA, 25 bp, Mus musculus
ggtcctcaccaatgtcctacaggaa

SEQ ID NO: 649026 - DNA, 25 bp, Mus musculus
ggtcctcacgatcccattgtgctta

SEQ ID NO: 649027 - DNA, 25 bp, Mus musculus
ggtcctcacgatgccattgtgctta

SEQ ID NO: 649028 - DNA, 25 bp, Mus musculus
ggtcctcagaggaatcaggtcctat

SEQ ID NO: 649029 - DNA, 25 bp, Mus musculus
ggtcctcagaggtatcaggtcctat

SEQ ID NO: 649030 - DNA, 25 bp, Mus musculus
ggtcctcagagtcgtctgtccctca

SEQ ID NO: 649031 - DNA, 25 bp, Mus musculus
ggtcctcagagtggtctgtccctca

SEQ ID NO: 649032 - DNA, 25 bp, Mus musculus
ggtcctcagcacaagcatcttggat

SEQ ID NO: 649033 - DNA, 25 bp, Mus musculus
ggtcctcagcactagcatcttggat

SEQ ID NO: 649034 - DNA, 25 bp, Mus musculus
ggtcctcagcccagtgctttaagaa

SEQ ID NO: 649035 - DNA, 25 bp, Mus musculus
ggtcctcagccctgtgctttaagaa

SEQ ID NO: 649036 - DNA, 25 bp, Mus musculus
ggtcctcatcagcagctataacaaa

SEQ ID NO: 649037 - DNA, 25 bp, Mus musculus
ggtcctcatcaggagctataacaaa

SEQ ID NO: 649038 - DNA, 25 bp, Mus musculus
ggtcctcatcatcactgtgtgttat

SEQ ID NO: 649039 - DNA, 25 bp, Mus musculus
ggtcctcatcatgactgtgtgttat

SEQ ID NO: 649040 - DNA, 25 bp, Mus musculus
ggtcctccattcaacacagtataat

SEQ ID NO: 649041 - DNA, 25 bp, Mus musculus
ggtcctccattctacacagtataat

SEQ ID NO: 649042 - DNA, 25 bp, Mus musculus
ggtcctcccattcagagctgacatt

SEQ ID NO: 649043 - DNA, 25 bp, Mus musculus
ggtcctcccattgagagctgacatt

SEQ ID NO: 649044 - DNA, 25 bp, Mus musculus
ggtcctccctggctattcacacata

SEQ ID NO: 649045 - DNA, 25 bp, Mus musculus
ggtcctccctgggtattcacacata

SEQ ID NO: 649046 - DNA, 25 bp, Mus musculus
ggtcctcctagaaatctggtcctct

SEQ ID NO: 649047 - DNA, 25 bp, Mus musculus
ggtcctcctagatatctggtcctct

SEQ ID NO: 649048 - DNA, 25 bp, Mus musculus
ggtcctcctcaaccacaagaagtgc

SEQ ID NO: 649049 - DNA, 25 bp, Mus musculus
ggtcctcctcaagcacaagaagtgc

SEQ ID NO: 649050 - DNA, 25 bp, Mus musculus
ggtcctcctgagatctagagtagcg

SEQ ID NO: 649051 - DNA, 25 bp, Mus musculus
ggtcctcctgagttctagagtagcg

SEQ ID NO: 649052 - DNA, 25 bp, Mus musculus
ggtcctcctggaaattgtgattcat

SEQ ID NO: 649053 - DNA, 25 bp, Mus musculus
ggtcctcctggatattgtgattcat

SEQ ID NO: 649054 - DNA, 25 bp, Mus musculus
ggtcctcctggtccaaaggcctgac

SEQ ID NO: 649055 - DNA, 25 bp, Mus musculus
ggtcctcctggtgcaaaggcctgac

SEQ ID NO: 649056 - DNA, 25 bp, Mus musculus
ggtcctccttagatcttgcttggaa

SEQ ID NO: 649057 - DNA, 25 bp, Mus musculus
ggtcctccttagttcttgcttggaa

SEQ ID NO: 649058 - DNA, 25 bp, Mus musculus
ggtcctccttcacgccgaattagaa

SEQ ID NO: 649059 - DNA, 25 bp, Mus musculus
ggtcctccttcaggccgaattagaa

SEQ ID NO: 649060 - DNA, 25 bp, Mus musculus
ggtcctcggaaaaatgggcttccat

SEQ ID NO: 649061 - DNA, 25 bp, Mus musculus
ggtcctcggaaatatgggcttccat

SEQ ID NO: 649062 - DNA, 25 bp, Mus musculus
ggtcctcgggagatattcttggtgt

SEQ ID NO: 649063 - DNA, 25 bp, Mus musculus
ggtcctcgggagttattcttggtgt

SEQ ID NO: 649064 - DNA, 25 bp, Mus musculus
ggtcctcgtgttctccttctgtctt

SEQ ID NO: 649065 - DNA, 25 bp, Mus musculus
ggtcctcgtgttgtccttctgtctt

SEQ ID NO: 649066 - DNA, 25 bp, Mus musculus
ggtcctctaatgcaatcctcagaac

SEQ ID NO: 649067 - DNA, 25 bp, Mus musculus
ggtcctctaatggaatcctcagaac

SEQ ID NO: 649068 - DNA, 25 bp, Mus musculus
ggtcctctctaaatggtacatggta

SEQ ID NO: 649069 - DNA, 25 bp, Mus musculus
ggtcctctctaattggtacatggta

SEQ ID NO: 649070 - DNA, 25 bp, Mus musculus
ggtcctctctagacacctacagcaa

SEQ ID NO: 649071 - DNA, 25 bp, Mus musculus
ggtcctctctagtcacctacagcaa

SEQ ID NO: 649072 - DNA, 25 bp, Mus musculus
ggtcctctgaacaggtaccggaaca

SEQ ID NO: 649073 - DNA, 25 bp, Mus musculus
ggtcctctgaactggtaccggaaca

SEQ ID NO: 649074 - DNA, 25 bp, Mus musculus
ggtcctctgcaactgacggtctcaa

SEQ ID NO: 649075 - DNA, 25 bp, Mus musculus
ggtcctctgcaagtgacggtctcaa

SEQ ID NO: 649076 - DNA, 25 bp, Mus musculus
ggtcctctgccgctacaagaagatc

SEQ ID NO: 649077 - DNA, 25 bp, Mus musculus
ggtcctctgccggtacaagaagatc

SEQ ID NO: 649078 - DNA, 25 bp, Mus musculus
ggtcctctggaactgtggccatcac

SEQ ID NO: 649079 - DNA, 25 bp, Mus musculus
ggtcctctggaagtgtggccatcac

SEQ ID NO: 649080 - DNA, 25 bp, Mus musculus
ggtcctctggcaactgtgtaacaat

SEQ ID NO: 649081 - DNA, 25 bp, Mus musculus
ggtcctctggcatctgtgtaacaat

SEQ ID NO: 649082 - DNA, 25 bp, Mus musculus
ggtcctctggtacgagggaacctca

SEQ ID NO: 649083 - DNA, 25 bp, Mus musculus
ggtcctctggtaggagggaacctca

SEQ ID NO: 649084 - DNA, 25 bp, Mus musculus
ggtcctcttaggcagtatcttttag

SEQ ID NO: 649085 - DNA, 25 bp, Mus musculus
ggtcctcttagggagtatcttttag

SEQ ID NO: 649086 - DNA, 25 bp, Mus musculus
ggtcctcttgcgctaattgcgggtc

SEQ ID NO: 649087 - DNA, 25 bp, Mus musculus
ggtcctcttgcggtaattgcgggtc

SEQ ID NO: 649088 - DNA, 25 bp, Mus musculus
ggtcctctttaacgaaagccttcat

SEQ ID NO: 649089 - DNA, 25 bp, Mus musculus
ggtcctctttaaggaaagccttcat

SEQ ID NO: 649090 - DNA, 25 bp, Mus musculus
ggtcctctttgtcttcctgatgtat

SEQ ID NO: 649091 - DNA, 25 bp, Mus musculus
ggtcctctttgtgttcctgatgtat

SEQ ID NO: 649092 - DNA, 25 bp, Mus musculus
ggtcctgaaaatctgtggccacaag

SEQ ID NO: 649093 - DNA, 25 bp, Mus musculus
ggtcctgaaaatgtgtggccacaag

SEQ ID NO: 649094 - DNA, 25 bp, Mus musculus
ggtcctgaactcacttctacagttt

SEQ ID NO: 649095 - DNA, 25 bp, Mus musculus
ggtcctgaactctcttctacagttt

SEQ ID NO: 649096 - DNA, 25 bp, Mus musculus
ggtcctgaagatctgctgcgcctga

SEQ ID NO: 649097 - DNA, 25 bp, Mus musculus
ggtcctgaagatgtgctgcgcctga

SEQ ID NO: 649098 - DNA, 25 bp, Mus musculus
ggtcctgaagccagttctacacaga

SEQ ID NO: 649099 - DNA, 25 bp, Mus musculus
ggtcctgaagcctgttctacacaga

SEQ ID NO: 649100 - DNA, 25 bp, Mus musculus
ggtcctgaattccagacttgagcaa

SEQ ID NO: 649101 - DNA, 25 bp, Mus musculus
ggtcctgaattcgagacttgagcaa

SEQ ID NO: 649102 - DNA, 25 bp, Mus musculus
ggtcctgacccaattctagtcctga

SEQ ID NO: 649103 - DNA, 25 bp, Mus musculus
ggtcctgacccatttctagtcctga

SEQ ID NO: 649104 - DNA, 25 bp, Mus musculus
ggtcctgactgaagtaatgacgtta

SEQ ID NO: 649105 - DNA, 25 bp, Mus musculus
ggtcctgactgatgtaatgacgtta

SEQ ID NO: 649106 - DNA, 25 bp, Mus musculus
ggtcctgagacaaaagtaactgccg

SEQ ID NO: 649107 - DNA, 25 bp, Mus musculus
ggtcctgagacataagtaactgccg

SEQ ID NO: 649108 - DNA, 25 bp, Mus musculus
ggtcctgagcttcaggttttcctga

SEQ ID NO: 649109 - DNA, 25 bp, Mus musculus
ggtcctgagcttgaggttttcctga

SEQ ID NO: 649110 - DNA, 25 bp, Mus musculus
ggtcctgagttaaattcatggtgtt

SEQ ID NO: 649111 - DNA, 25 bp, Mus musculus
ggtcctgagttatattcatggtgtt

SEQ ID NO: 649112 - DNA, 25 bp, Mus musculus
ggtcctgataccacagccaagggct

SEQ ID NO: 649113 - DNA, 25 bp, Mus musculus
ggtcctgatacctcagccaagggct

SEQ ID NO: 649114 - DNA, 25 bp, Mus musculus
ggtcctgatgaccatgctgtgtaca

SEQ ID NO: 649115 - DNA, 25 bp, Mus musculus
ggtcctgatgacgatgctgtgtaca

SEQ ID NO: 649116 - DNA, 25 bp, Mus musculus
ggtcctgatgagatgtctccgttca

SEQ ID NO: 649117 - DNA, 25 bp, Mus musculus
ggtcctgatgagttgtctccgttca

SEQ ID NO: 649118 - DNA, 25 bp, Mus musculus
ggtcctgattctcatgatgagcaga

SEQ ID NO: 649119 - DNA, 25 bp, Mus musculus
ggtcctgattctgatgatgagcaga

SEQ ID NO: 649120 - DNA, 25 bp, Mus musculus
ggtcctgatttacagtggataaagg

SEQ ID NO: 649121 - DNA, 25 bp, Mus musculus
ggtcctgatttagagtggataaagg

SEQ ID NO: 649122 - DNA, 25 bp, Mus musculus
ggtcctgcaatgatcccacatgtat

SEQ ID NO: 649123 - DNA, 25 bp, Mus musculus
ggtcctgcaatgctggtgcgccata

SEQ ID NO: 649124 - DNA, 25 bp, Mus musculus
ggtcctgcaatggtggtgcgccata

SEQ ID NO: 649125 - DNA, 25 bp, Mus musculus
ggtcctgcaatgttcccacatgtat

SEQ ID NO: 649126 - DNA, 25 bp, Mus musculus
ggtcctgcacataacatgactgaag

SEQ ID NO: 649127 - DNA, 25 bp, Mus musculus
ggtcctgcacattacatgactgaag

SEQ ID NO: 649128 - DNA, 25 bp, Mus musculus
ggtcctgcaccaactggcttggaaa

SEQ ID NO: 649129 - DNA, 25 bp, Mus musculus
ggtcctgcaccatctggcttggaaa

SEQ ID NO: 649130 - DNA, 25 bp, Mus musculus
ggtcctgccccaattatagatcctg

SEQ ID NO: 649131 - DNA, 25 bp, Mus musculus
ggtcctgccccatttatagatcctg

SEQ ID NO: 649132 - DNA, 25 bp, Mus musculus
ggtcctgccctcaggacagtggctt

SEQ ID NO: 649133 - DNA, 25 bp, Mus musculus
ggtcctgccctctggacagtggctt

SEQ ID NO: 649134 - DNA, 25 bp, Mus musculus
ggtcctgccttaatcctgtccctgt

SEQ ID NO: 649135 - DNA, 25 bp, Mus musculus
ggtcctgccttattcctgtccctgt

SEQ ID NO: 649136 - DNA, 25 bp, Mus musculus
ggtcctgcgatcagagtcccctaga

SEQ ID NO: 649137 - DNA, 25 bp, Mus musculus
ggtcctgcgatctgagtcccctaga

SEQ ID NO: 649138 - DNA, 25 bp, Mus musculus
ggtcctgcgtgcatctgagtgaacc

SEQ ID NO: 649139 - DNA, 25 bp, Mus musculus
ggtcctgcgtgcttctgagtgaacc

SEQ ID NO: 649140 - DNA, 25 bp, Mus musculus
ggtcctgctcgtccccaagggtaga

SEQ ID NO: 649141 - DNA, 25 bp, Mus musculus
ggtcctgctcgtgcccaagggtaga

SEQ ID NO: 649142 - DNA, 25 bp, Mus musculus
ggtcctgctctgagtggatgctgcc

SEQ ID NO: 649143 - DNA, 25 bp, Mus musculus
ggtcctgctctgtgtggatgctgcc

SEQ ID NO: 649144 - DNA, 25 bp, Mus musculus
ggtcctgctcttcactgagacacaa

SEQ ID NO: 649145 - DNA, 25 bp, Mus musculus
ggtcctgctcttgactgagacacaa

SEQ ID NO: 649146 - DNA, 25 bp, Mus musculus
ggtcctgctgatcaactttatcttt

SEQ ID NO: 649147 - DNA, 25 bp, Mus musculus
ggtcctgctgatgaactttatcttt

SEQ ID NO: 649148 - DNA, 25 bp, Mus musculus
ggtcctgctgcgaaactcttaagaa

SEQ ID NO: 649149 - DNA, 25 bp, Mus musculus
ggtcctgctgcgtaactcttaagaa

SEQ ID NO: 649150 - DNA, 25 bp, Mus musculus
ggtcctgctgctcattgttaattgt

SEQ ID NO: 649151 - DNA, 25 bp, Mus musculus
ggtcctgctgctgattgttaattgt

SEQ ID NO: 649152 - DNA, 25 bp, Mus musculus
ggtcctggaatgccctgtctttttc

SEQ ID NO: 649153 - DNA, 25 bp, Mus musculus
ggtcctggaatggcctgtctttttc

SEQ ID NO: 649154 - DNA, 25 bp, Mus musculus
ggtcctggacatcaccacctgggtc

SEQ ID NO: 649155 - DNA, 25 bp, Mus musculus
ggtcctggacatgaccacctgggtc

SEQ ID NO: 649156 - DNA, 25 bp, Mus musculus
ggtcctggacttaacaagcctttca

SEQ ID NO: 649157 - DNA, 25 bp, Mus musculus
ggtcctggactttacaagcctttca

SEQ ID NO: 649158 - DNA, 25 bp, Mus musculus
ggtcctggatgaacaccgccagcat

SEQ ID NO: 649159 - DNA, 25 bp, Mus musculus
ggtcctggatgaagccctgctcaga

SEQ ID NO: 649160 - DNA, 25 bp, Mus musculus
ggtcctggatgatcaccgccagcat

SEQ ID NO: 649161 - DNA, 25 bp, Mus musculus
ggtcctggatgatgccctgctcaga

SEQ ID NO: 649162 - DNA, 25 bp, Mus musculus
ggtcctggcctgactgttaagagca

SEQ ID NO: 649163 - DNA, 25 bp, Mus musculus
ggtcctggcctgtctgttaagagca

SEQ ID NO: 649164 - DNA, 25 bp, Mus musculus
ggtcctggcgcaccaaaaagcccga

SEQ ID NO: 649165 - DNA, 25 bp, Mus musculus
ggtcctggcgcaccagacattggta

SEQ ID NO: 649166 - DNA, 25 bp, Mus musculus
ggtcctggcgcagcaaaaagcccga

SEQ ID NO: 649167 - DNA, 25 bp, Mus musculus
ggtcctggcgcagcagacattggta

SEQ ID NO: 649168 - DNA, 25 bp, Mus musculus
ggtcctggctgtccataaggaaagt

SEQ ID NO: 649169 - DNA, 25 bp, Mus musculus
ggtcctggctgtgcataaggaaagt

SEQ ID NO: 649170 - DNA, 25 bp, Mus musculus
ggtcctgggaggatattagtgcact

SEQ ID NO: 649171 - DNA, 25 bp, Mus musculus
ggtcctgggaggttattagtgcact

SEQ ID NO: 649172 - DNA, 25 bp, Mus musculus
ggtcctggtcatcccaacagagtgt

SEQ ID NO: 649173 - DNA, 25 bp, Mus musculus
ggtcctggtcatgccaacagagtgt

SEQ ID NO: 649174 - DNA, 25 bp, Mus musculus
ggtcctggttcacagtttagtggca

SEQ ID NO: 649175 - DNA, 25 bp, Mus musculus
ggtcctggttcagagtttagtggca

SEQ ID NO: 649176 - DNA, 25 bp, Mus musculus
ggtcctgtcaatactgtgttttatt

SEQ ID NO: 649177 - DNA, 25 bp, Mus musculus
ggtcctgtcaattctgtgttttatt

SEQ ID NO: 649178 - DNA, 25 bp, Mus musculus
ggtcctgtcacaagtcacaactgat

SEQ ID NO: 649179 - DNA, 25 bp, Mus musculus
ggtcctgtcacatgtcacaactgat

SEQ ID NO: 649180 - DNA, 25 bp, Mus musculus
ggtcctgtccacctgttttaagtca

SEQ ID NO: 649181 - DNA, 25 bp, Mus musculus
ggtcctgtccacgtgttttaagtca

SEQ ID NO: 649182 - DNA, 25 bp, Mus musculus
ggtcctgtcccaagtggtaaaccca

SEQ ID NO: 649183 - DNA, 25 bp, Mus musculus
ggtcctgtcccatgtggtaaaccca

SEQ ID NO: 649184 - DNA, 25 bp, Mus musculus
ggtcctgtcttcaggaggtcagcat

SEQ ID NO: 649185 - DNA, 25 bp, Mus musculus
ggtcctgtcttctggaggtcagcat

SEQ ID NO: 649186 - DNA, 25 bp, Mus musculus
ggtcctgtgagtacctgttattagc

SEQ ID NO: 649187 - DNA, 25 bp, Mus musculus
ggtcctgtgagtcccacaagacacc

SEQ ID NO: 649188 - DNA, 25 bp, Mus musculus
ggtcctgtgagtgccacaagacacc

SEQ ID NO: 649189 - DNA, 25 bp, Mus musculus
ggtcctgtgagttcctgttattagc

SEQ ID NO: 649190 - DNA, 25 bp, Mus musculus
ggtcctgtgcacacattactataaa

SEQ ID NO: 649191 - DNA, 25 bp, Mus musculus
ggtcctgtgcactcattactataaa

SEQ ID NO: 649192 - DNA, 25 bp, Mus musculus
ggtcctgtgcatatacctgctaagt

SEQ ID NO: 649193 - DNA, 25 bp, Mus musculus
ggtcctgtgcatttacctgctaagt

SEQ ID NO: 649194 - DNA, 25 bp, Mus musculus
ggtcctgtgcctcagtctatttagg

SEQ ID NO: 649195 - DNA, 25 bp, Mus musculus
ggtcctgtgcctgagtctatttagg

SEQ ID NO: 649196 - DNA, 25 bp, Mus musculus
ggtcctgtgcttactaaggacacca

SEQ ID NO: 649197 - DNA, 25 bp, Mus musculus
ggtcctgtgctttctaaggacacca

SEQ ID NO: 649198 - DNA, 25 bp, Mus musculus
ggtcctgtggagctgccctattaaa

SEQ ID NO: 649199 - DNA, 25 bp, Mus musculus
ggtcctgtggaggtgccctattaaa

SEQ ID NO: 649200 - DNA, 25 bp, Mus musculus
ggtcctgtgggtcacacgcatgctt

SEQ ID NO: 649201 - DNA, 25 bp, Mus musculus
ggtcctgtgggtgacacgcatgctt

SEQ ID NO: 649202 - DNA, 25 bp, Mus musculus
ggtcctgtgttcaagcccatgaaac

SEQ ID NO: 649203 - DNA, 25 bp, Mus musculus
ggtcctgtgttctagcccatgaaac

SEQ ID NO: 649204 - DNA, 25 bp, Mus musculus
ggtcctgtgtttagttgacttgcta

SEQ ID NO: 649205 - DNA, 25 bp, Mus musculus
ggtcctgtgttttgttgacttgcta

SEQ ID NO: 649206 - DNA, 25 bp, Mus musculus
ggtcctgttcaaccttcatcagtag

SEQ ID NO: 649207 - DNA, 25 bp, Mus musculus
ggtcctgttcaagcttcatcagtag

SEQ ID NO: 649208 - DNA, 25 bp, Mus musculus
ggtcctgttggactagatgtatcac

SEQ ID NO: 649209 - DNA, 25 bp, Mus musculus
ggtcctgttggagtagatgtatcac

SEQ ID NO: 649210 - DNA, 25 bp, Mus musculus
ggtcctgttggtaagcccactgata

SEQ ID NO: 649211 - DNA, 25 bp, Mus musculus
ggtcctgttggttagcccactgata

SEQ ID NO: 649212 - DNA, 25 bp, Mus musculus
ggtcctgttgttcctatgtgcagac

SEQ ID NO: 649213 - DNA, 25 bp, Mus musculus
ggtcctgttgttgctatgtgcagac

SEQ ID NO: 649214 - DNA, 25 bp, Mus musculus
ggtcctgtttcaagatgtgactttc

SEQ ID NO: 649215 - DNA, 25 bp, Mus musculus
ggtcctgtttcatgatgtgactttc

SEQ ID NO: 649216 - DNA, 25 bp, Mus musculus
ggtcctgttttgagcccataaaagt

SEQ ID NO: 649217 - DNA, 25 bp, Mus musculus
ggtcctgttttgatttgctaaacag

SEQ ID NO: 649218 - DNA, 25 bp, Mus musculus
ggtcctgttttgtgcccataaaagt

SEQ ID NO: 649219 - DNA, 25 bp, Mus musculus
ggtcctgttttgttttgctaaacag

SEQ ID NO: 649220 - DNA, 25 bp, Mus musculus
ggtccttaacacagggaagcactca

SEQ ID NO: 649221 - DNA, 25 bp, Mus musculus
ggtccttaacactgggaagcactca

SEQ ID NO: 649222 - DNA, 25 bp, Mus musculus
ggtccttaacgactataacttgcat

SEQ ID NO: 649223 - DNA, 25 bp, Mus musculus
ggtccttaacgagtataacttgcat

SEQ ID NO: 649224 - DNA, 25 bp, Mus musculus
ggtccttaagtaagtaacacctttg

SEQ ID NO: 649225 - DNA, 25 bp, Mus musculus
ggtccttaagtatgtaacacctttg

SEQ ID NO: 649226 - DNA, 25 bp, Mus musculus
ggtccttacaggaacaggtcccagg

SEQ ID NO: 649227 - DNA, 25 bp, Mus musculus
ggtccttacaggtacaggtcccagg

SEQ ID NO: 649228 - DNA, 25 bp, Mus musculus
ggtccttacatacagctttcatcag

SEQ ID NO: 649229 - DNA, 25 bp, Mus musculus
ggtccttacatagagctttcatcag

SEQ ID NO: 649230 - DNA, 25 bp, Mus musculus
ggtccttactaaagcgcggagacaa

SEQ ID NO: 649231 - DNA, 25 bp, Mus musculus
ggtccttactaatgcgcggagacaa

SEQ ID NO: 649232 - DNA, 25 bp, Mus musculus
ggtccttagaggacgaactcctggg

SEQ ID NO: 649233 - DNA, 25 bp, Mus musculus
ggtccttagaggtcgaactcctggg

SEQ ID NO: 649234 - DNA, 25 bp, Mus musculus
ggtccttagatactagtgccacttg

SEQ ID NO: 649235 - DNA, 25 bp, Mus musculus
ggtccttagatagtagtgccacttg

SEQ ID NO: 649236 - DNA, 25 bp, Mus musculus
ggtccttagctgagtcattttcctg

SEQ ID NO: 649237 - DNA, 25 bp, Mus musculus
ggtccttagctgtgtcattttcctg

SEQ ID NO: 649238 - DNA, 25 bp, Mus musculus
ggtccttaggaaacatttctccctt

SEQ ID NO: 649239 - DNA, 25 bp, Mus musculus
ggtccttaggaatcatttctccctt

SEQ ID NO: 649240 - DNA, 25 bp, Mus musculus
ggtccttagggcagctctgttccaa

SEQ ID NO: 649241 - DNA, 25 bp, Mus musculus
ggtccttagggctgctctgttccaa

SEQ ID NO: 649242 - DNA, 25 bp, Mus musculus
ggtccttataccaaactaacatctt

SEQ ID NO: 649243 - DNA, 25 bp, Mus musculus
ggtccttatacctaactaacatctt

SEQ ID NO: 649244 - DNA, 25 bp, Mus musculus
ggtccttatgtaaagattggcccag

SEQ ID NO: 649245 - DNA, 25 bp, Mus musculus
ggtccttatgtatagattggcccag

SEQ ID NO: 649246 - DNA, 25 bp, Mus musculus
ggtccttcaaagctgagactgaaag

SEQ ID NO: 649247 - DNA, 25 bp, Mus musculus
ggtccttcaaaggtgagactgaaag

SEQ ID NO: 649248 - DNA, 25 bp, Mus musculus
ggtccttcaagccactggttcagtt

SEQ ID NO: 649249 - DNA, 25 bp, Mus musculus
ggtccttcaagcgactggttcagtt

SEQ ID NO: 649250 - DNA, 25 bp, Mus musculus
ggtccttcacaaatcaccaagagca

SEQ ID NO: 649251 - DNA, 25 bp, Mus musculus
ggtccttcacaattcaccaagagca

SEQ ID NO: 649252 - DNA, 25 bp, Mus musculus
ggtccttcatatcttttgaggcaga

SEQ ID NO: 649253 - DNA, 25 bp, Mus musculus
ggtccttcatatgttttgaggcaga

SEQ ID NO: 649254 - DNA, 25 bp, Mus musculus
ggtccttcatttacacaaagccaat

SEQ ID NO: 649255 - DNA, 25 bp, Mus musculus
ggtccttcattttcacaaagccaat

SEQ ID NO: 649256 - DNA, 25 bp, Mus musculus
ggtccttccgctaggagagttctcg

SEQ ID NO: 649257 - DNA, 25 bp, Mus musculus
ggtccttccgcttggagagttctcg

SEQ ID NO: 649258 - DNA, 25 bp, Mus musculus
ggtccttccttgcaagctgaagcat

SEQ ID NO: 649259 - DNA, 25 bp, Mus musculus
ggtccttccttggaagctgaagcat

SEQ ID NO: 649260 - DNA, 25 bp, Mus musculus
ggtccttcgaacagaacctattgtg

SEQ ID NO: 649261 - DNA, 25 bp, Mus musculus
ggtccttcgaactgaacctattgtg

SEQ ID NO: 649262 - DNA, 25 bp, Mus musculus
ggtccttcggaaatctcctgtatga

SEQ ID NO: 649263 - DNA, 25 bp, Mus musculus
ggtccttcggaattctcctgtatga

SEQ ID NO: 649264 - DNA, 25 bp, Mus musculus
ggtccttctaggctgtgcccctatg

SEQ ID NO: 649265 - DNA, 25 bp, Mus musculus
ggtccttctagggtgtgcccctatg

SEQ ID NO: 649266 - DNA, 25 bp, Mus musculus
ggtccttctgacactgctctaacag

SEQ ID NO: 649267 - DNA, 25 bp, Mus musculus
ggtccttctgactctgctctaacag

SEQ ID NO: 649268 - DNA, 25 bp, Mus musculus
ggtccttctgggatgttcatagatt

SEQ ID NO: 649269 - DNA, 25 bp, Mus musculus
ggtccttctgggttgttcatagatt

SEQ ID NO: 649270 - DNA, 25 bp, Mus musculus
ggtccttctgtgcattattcttgta

SEQ ID NO: 649271 - DNA, 25 bp, Mus musculus
ggtccttctgtggattattcttgta

SEQ ID NO: 649272 - DNA, 25 bp, Mus musculus
ggtccttcttagcagcctggcataa

SEQ ID NO: 649273 - DNA, 25 bp, Mus musculus
ggtccttcttaggagcctggcataa

SEQ ID NO: 649274 - DNA, 25 bp, Mus musculus
ggtccttgaggaagtctgcatggtc

SEQ ID NO: 649275 - DNA, 25 bp, Mus musculus
ggtccttgaggatgtctgcatggtc

SEQ ID NO: 649276 - DNA, 25 bp, Mus musculus
ggtccttgatctatgtatctttcat

SEQ ID NO: 649277 - DNA, 25 bp, Mus musculus
ggtccttgatctttgtatctttcat

SEQ ID NO: 649278 - DNA, 25 bp, Mus musculus
ggtccttgatttcccaaggtcagag

SEQ ID NO: 649279 - DNA, 25 bp, Mus musculus
ggtccttgatttgccaaggtcagag

SEQ ID NO: 649280 - DNA, 25 bp, Mus musculus
ggtccttgctgaaccctaatgagag

SEQ ID NO: 649281 - DNA, 25 bp, Mus musculus
ggtccttgctgatccctaatgagag

SEQ ID NO: 649282 - DNA, 25 bp, Mus musculus
ggtccttgctttccaacttaataca

SEQ ID NO: 649283 - DNA, 25 bp, Mus musculus
ggtccttgctttgcaacttaataca

SEQ ID NO: 649284 - DNA, 25 bp, Mus musculus
ggtccttggagaccatttgtcaagc

SEQ ID NO: 649285 - DNA, 25 bp, Mus musculus
ggtccttggagagcatttgtcaagc

SEQ ID NO: 649286 - DNA, 25 bp, Mus musculus
ggtccttggatgcactcctgcacca

SEQ ID NO: 649287 - DNA, 25 bp, Mus musculus
ggtccttggatggactcctgcacca

SEQ ID NO: 649288 - DNA, 25 bp, Mus musculus
ggtccttggcaccattatctagaca

SEQ ID NO: 649289 - DNA, 25 bp, Mus musculus
ggtccttggcacgattatctagaca

SEQ ID NO: 649290 - DNA, 25 bp, Mus musculus
ggtccttggccactttctggtgcta

SEQ ID NO: 649291 - DNA, 25 bp, Mus musculus
ggtccttggccagtttctggtgcta

SEQ ID NO: 649292 - DNA, 25 bp, Mus musculus
ggtccttggcgccaagcctgaagac

SEQ ID NO: 649293 - DNA, 25 bp, Mus musculus
ggtccttggcgcgaagcctgaagac

SEQ ID NO: 649294 - DNA, 25 bp, Mus musculus
ggtccttgggatactaactagcctg

SEQ ID NO: 649295 - DNA, 25 bp, Mus musculus
ggtccttgggattctaactagcctg

SEQ ID NO: 649296 - DNA, 25 bp, Mus musculus
ggtccttggtgaaaagatgcctaga

SEQ ID NO: 649297 - DNA, 25 bp, Mus musculus
ggtccttggtgataagatgcctaga

SEQ ID NO: 649298 - DNA, 25 bp, Mus musculus
ggtccttggtgcagtatttatattc

SEQ ID NO: 649299 - DNA, 25 bp, Mus musculus
ggtccttggtgctgtatttatattc

SEQ ID NO: 649300 - DNA, 25 bp, Mus musculus
ggtccttgtgaccagttccatggat

SEQ ID NO: 649301 - DNA, 25 bp, Mus musculus
ggtccttgtgacgagttccatggat

SEQ ID NO: 649302 - DNA, 25 bp, Mus musculus
ggtccttgtgtgaggagtcttacaa

SEQ ID NO: 649303 - DNA, 25 bp, Mus musculus
ggtccttgtgtgtggagtcttacaa

SEQ ID NO: 649304 - DNA, 25 bp, Mus musculus
ggtcctttaactattgtgtgcctca

SEQ ID NO: 649305 - DNA, 25 bp, Mus musculus
ggtcctttaacttttgtgtgcctca

SEQ ID NO: 649306 - DNA, 25 bp, Mus musculus
ggtcctttagcaatgtttccatcat

SEQ ID NO: 649307 - DNA, 25 bp, Mus musculus
ggtcctttagcattgtttccatcat

SEQ ID NO: 649308 - DNA, 25 bp, Mus musculus
ggtcctttcctaccacctcaaagga

SEQ ID NO: 649309 - DNA, 25 bp, Mus musculus
ggtcctttcctagcacctcaaagga

SEQ ID NO: 649310 - DNA, 25 bp, Mus musculus
ggtcctttccttagtgaacttgtgg

SEQ ID NO: 649311 - DNA, 25 bp, Mus musculus
ggtcctttcctttgtgaacttgtgg

SEQ ID NO: 649312 - DNA, 25 bp, Mus musculus
ggtcctttctatacatatccacact

SEQ ID NO: 649313 - DNA, 25 bp, Mus musculus
ggtcctttctattcatatccacact

SEQ ID NO: 649314 - DNA, 25 bp, Mus musculus
ggtcctttctcaagaggcgagctga

SEQ ID NO: 649315 - DNA, 25 bp, Mus musculus
ggtcctttctcatgaggcgagctga

SEQ ID NO: 649316 - DNA, 25 bp, Mus musculus
ggtcctttcttgcagcatgatgcca

SEQ ID NO: 649317 - DNA, 25 bp, Mus musculus
ggtcctttcttggagcatgatgcca

SEQ ID NO: 649318 - DNA, 25 bp, Mus musculus
ggtcctttgacacacaaaacggttg

SEQ ID NO: 649319 - DNA, 25 bp, Mus musculus
ggtcctttgacagacaaaacggttg

SEQ ID NO: 649320 - DNA, 25 bp, Mus musculus
ggtcctttgcatatcttacgattaa

SEQ ID NO: 649321 - DNA, 25 bp, Mus musculus
ggtcctttgcatttcttacgattaa

SEQ ID NO: 649322 - DNA, 25 bp, Mus musculus
ggtcctttgctaatcactctataat

SEQ ID NO: 649323 - DNA, 25 bp, Mus musculus
ggtcctttgctattcactctataat

SEQ ID NO: 649324 - DNA, 25 bp, Mus musculus
ggtccttttattcgcgtggcgttga

SEQ ID NO: 649325 - DNA, 25 bp, Mus musculus
ggtccttttattggcgtggcgttga

SEQ ID NO: 649326 - DNA, 25 bp, Mus musculus
ggtcgaacactcagaccctacagga

SEQ ID NO: 649327 - DNA, 25 bp, Mus musculus
ggtcgaacactctgaccctacagga

SEQ ID NO: 649328 - DNA, 25 bp, Mus musculus
ggtcgaaccaaacacagtgcatgct

SEQ ID NO: 649329 - DNA, 25 bp, Mus musculus
ggtcgaaccaaagacagtgcatgct

SEQ ID NO: 649330 - DNA, 25 bp, Mus musculus
ggtcgaagctgacacgacaccagcg

SEQ ID NO: 649331 - DNA, 25 bp, Mus musculus
ggtcgaagctgagacgacaccagcg

SEQ ID NO: 649332 - DNA, 25 bp, Mus musculus
ggtcgaagttctatgtccgggagcc

SEQ ID NO: 649333 - DNA, 25 bp, Mus musculus
ggtcgaagttctttgtccgggagcc

SEQ ID NO: 649334 - DNA, 25 bp, Mus musculus
ggtcgaatccggacacagttagcac

SEQ ID NO: 649335 - DNA, 25 bp, Mus musculus
ggtcgaatccggtcacagttagcac

SEQ ID NO: 649336 - DNA, 25 bp, Mus musculus
ggtcgaatctgtcgtgtatttttaa

SEQ ID NO: 649337 - DNA, 25 bp, Mus musculus
ggtcgaatctgtggtgtatttttaa

SEQ ID NO: 649338 - DNA, 25 bp, Mus musculus
ggtcgacattagacggtgctcggaa

SEQ ID NO: 649339 - DNA, 25 bp, Mus musculus
ggtcgacattagtcggtgctcggaa

SEQ ID NO: 649340 - DNA, 25 bp, Mus musculus
ggtcgacgacggatgtatcgcattt

SEQ ID NO: 649341 - DNA, 25 bp, Mus musculus
ggtcgacgacggttgtatcgcattt

SEQ ID NO: 649342 - DNA, 25 bp, Mus musculus
ggtcgactactgcaacaggctttta

SEQ ID NO: 649343 - DNA, 25 bp, Mus musculus
ggtcgactactggaacaggctttta

SEQ ID NO: 649344 - DNA, 25 bp, Mus musculus
ggtcgagaccttaaagtacatcaga

SEQ ID NO: 649345 - DNA, 25 bp, Mus musculus
ggtcgagacctttaagtacatcaga

SEQ ID NO: 649346 - DNA, 25 bp, Mus musculus
ggtcgagcagacaatggtcagctag

SEQ ID NO: 649347 - DNA, 25 bp, Mus musculus
ggtcgagcagactatggtcagctag

SEQ ID NO: 649348 - DNA, 25 bp, Mus musculus
ggtcgagcatgtccgggcgaggcaa

SEQ ID NO: 649349 - DNA, 25 bp, Mus musculus
ggtcgagcatgtgcgggcgaggcaa

SEQ ID NO: 649350 - DNA, 25 bp, Mus musculus
ggtcgagcgatgcatttccgtctct

SEQ ID NO: 649351 - DNA, 25 bp, Mus musculus
ggtcgagcgatggatttccgtctct

SEQ ID NO: 649352 - DNA, 25 bp, Mus musculus
ggtcgaggatttctgttttggatac

SEQ ID NO: 649353 - DNA, 25 bp, Mus musculus
ggtcgaggatttgtgttttggatac

SEQ ID NO: 649354 - DNA, 25 bp, Mus musculus
ggtcgaggcgggacagctggtctca

SEQ ID NO: 649355 - DNA, 25 bp, Mus musculus
ggtcgaggcgggtcagctggtctca

SEQ ID NO: 649356 - DNA, 25 bp, Mus musculus
ggtcgagggcatcctgattcaccag

SEQ ID NO: 649357 - DNA, 25 bp, Mus musculus
ggtcgagggcatgctgattcaccag

SEQ ID NO: 649358 - DNA, 25 bp, Mus musculus
ggtcgagtcgatatagtccttctca

SEQ ID NO: 649359 - DNA, 25 bp, Mus musculus
ggtcgagtcgatttagtccttctca

SEQ ID NO: 649360 - DNA, 25 bp, Mus musculus
ggtcgagtgcatagatttcaaatat

SEQ ID NO: 649361 - DNA, 25 bp, Mus musculus
ggtcgagtgcattgatttcaaatat

SEQ ID NO: 649362 - DNA, 25 bp, Mus musculus
ggtcgagttgacagcagcaggcact

SEQ ID NO: 649363 - DNA, 25 bp, Mus musculus
ggtcgagttgactgcagcaggcact

SEQ ID NO: 649364 - DNA, 25 bp, Mus musculus
ggtcgataagcgagtttctgaaata

SEQ ID NO: 649365 - DNA, 25 bp, Mus musculus
ggtcgataagcgtgtttctgaaata

SEQ ID NO: 649366 - DNA, 25 bp, Mus musculus
ggtcgatcaaccaaccataaactga

SEQ ID NO: 649367 - DNA, 25 bp, Mus musculus
ggtcgatcaacctaccataaactga

SEQ ID NO: 649368 - DNA, 25 bp, Mus musculus
ggtcgatcacacagaggccaagcta

SEQ ID NO: 649369 - DNA, 25 bp, Mus musculus
ggtcgatcacactgaggccaagcta

SEQ ID NO: 649370 - DNA, 25 bp, Mus musculus
ggtcgattaccactaaattctcatt

SEQ ID NO: 649371 - DNA, 25 bp, Mus musculus
ggtcgattaccagtaaattctcatt

SEQ ID NO: 649372 - DNA, 25 bp, Mus musculus
ggtcgcaaatgaattgcccagtatg

SEQ ID NO: 649373 - DNA, 25 bp, Mus musculus
ggtcgcaaatgatttgcccagtatg

SEQ ID NO: 649374 - DNA, 25 bp, Mus musculus
ggtcgcaacagaagcaagcagcctt

SEQ ID NO: 649375 - DNA, 25 bp, Mus musculus
ggtcgcaacagatgcaagcagcctt

SEQ ID NO: 649376 - DNA, 25 bp, Mus musculus
ggtcgcacatgcagactaatgccat

SEQ ID NO: 649377 - DNA, 25 bp, Mus musculus
ggtcgcacatgctgactaatgccat

SEQ ID NO: 649378 - DNA, 25 bp, Mus musculus
ggtcgcagtcaacatccccgagtaa

SEQ ID NO: 649379 - DNA, 25 bp, Mus musculus
ggtcgcagtcaagatccccgagtaa

SEQ ID NO: 649380 - DNA, 25 bp, Mus musculus
ggtcgcatagtcactgatctgtttc

SEQ ID NO: 649381 - DNA, 25 bp, Mus musculus
ggtcgcatagtctctgatctgtttc

SEQ ID NO: 649382 - DNA, 25 bp, Mus musculus
ggtcgcatcaaacagcttgtgggat

SEQ ID NO: 649383 - DNA, 25 bp, Mus musculus
ggtcgcatcaaagagcttgtgggat

SEQ ID NO: 649384 - DNA, 25 bp, Mus musculus
ggtcgcattggcctgagattattca

SEQ ID NO: 649385 - DNA, 25 bp, Mus musculus
ggtcgcattggcgtgagattattca

SEQ ID NO: 649386 - DNA, 25 bp, Mus musculus
ggtcgcattttgataagcccttgaa

SEQ ID NO: 649387 - DNA, 25 bp, Mus musculus
ggtcgcattttgttaagcccttgaa

SEQ ID NO: 649388 - DNA, 25 bp, Mus musculus
ggtcgccaacgaattaacccttgat

SEQ ID NO: 649389 - DNA, 25 bp, Mus musculus
ggtcgccaacgatttaacccttgat

SEQ ID NO: 649390 - DNA, 25 bp, Mus musculus
ggtcgccaagcacaggatccgtatg

SEQ ID NO: 649391 - DNA, 25 bp, Mus musculus
ggtcgccaagcagaggatccgtatg

SEQ ID NO: 649392 - DNA, 25 bp, Mus musculus
ggtcgccacagacttgtcgagttcc

SEQ ID NO: 649393 - DNA, 25 bp, Mus musculus
ggtcgccacagagttgtcgagttcc

SEQ ID NO: 649394 - DNA, 25 bp, Mus musculus
ggtcgccagagacatccttcacctt

SEQ ID NO: 649395 - DNA, 25 bp, Mus musculus
ggtcgccagagagatccttcacctt

SEQ ID NO: 649396 - DNA, 25 bp, Mus musculus
ggtcgccagcaacctgaatctcaaa

SEQ ID NO: 649397 - DNA, 25 bp, Mus musculus
ggtcgccagcaagctgaatctcaaa

SEQ ID NO: 649398 - DNA, 25 bp, Mus musculus
ggtcgccagttcaacatgtgtgcta

SEQ ID NO: 649399 - DNA, 25 bp, Mus musculus
ggtcgccagttctacatgtgtgcta

SEQ ID NO: 649400 - DNA, 25 bp, Mus musculus
ggtcgccatttaagtcggtagtgtc

SEQ ID NO: 649401 - DNA, 25 bp, Mus musculus
ggtcgccatttatgtcggtagtgtc

SEQ ID NO: 649402 - DNA, 25 bp, Mus musculus
ggtcgccgatgcactggccaatgct

SEQ ID NO: 649403 - DNA, 25 bp, Mus musculus
ggtcgccgatgctctggccaatgct

SEQ ID NO: 649404 - DNA, 25 bp, Mus musculus
ggtcgccgtttaagaagatccctgc

SEQ ID NO: 649405 - DNA, 25 bp, Mus musculus
ggtcgccgtttatgaagatccctgc

SEQ ID NO: 649406 - DNA, 25 bp, Mus musculus
ggtcgcgcggatcatgatgccaacc

SEQ ID NO: 649407 - DNA, 25 bp, Mus musculus
ggtcgcgcggatgatgatgccaacc

SEQ ID NO: 649408 - DNA, 25 bp, Mus musculus
ggtcgcgctagtcggatccttctca

SEQ ID NO: 649409 - DNA, 25 bp, Mus musculus
ggtcgcgctagtgggatccttctca

SEQ ID NO: 649410 - DNA, 25 bp, Mus musculus
ggtcgctacctgatgtgcagaaggc

SEQ ID NO: 649411 - DNA, 25 bp, Mus musculus
ggtcgctacctgttgtgcagaaggc

SEQ ID NO: 649412 - DNA, 25 bp, Mus musculus
ggtcgctatctgcaggagcttagtc

SEQ ID NO: 649413 - DNA, 25 bp, Mus musculus
ggtcgctatctggaggagcttagtc

SEQ ID NO: 649414 - DNA, 25 bp, Mus musculus
ggtcgctgagtgaacccagagattt

SEQ ID NO: 649415 - DNA, 25 bp, Mus musculus
ggtcgctgagtgtacccagagattt

SEQ ID NO: 649416 - DNA, 25 bp, Mus musculus
ggtcgcttctcaattgcaggaactg

SEQ ID NO: 649417 - DNA, 25 bp, Mus musculus
ggtcgcttctcatttgcaggaactg

SEQ ID NO: 649418 - DNA, 25 bp, Mus musculus
ggtcgctttctgagctatttttcac

SEQ ID NO: 649419 - DNA, 25 bp, Mus musculus
ggtcgctttctgtgctatttttcac

SEQ ID NO: 649420 - DNA, 25 bp, Mus musculus
ggtcgctttgaacttcatgcacgtg

SEQ ID NO: 649421 - DNA, 25 bp, Mus musculus
ggtcgctttgaagttcatgcacgtg

SEQ ID NO: 649422 - DNA, 25 bp, Mus musculus
ggtcggaaccagcagctacatgcag

SEQ ID NO: 649423 - DNA, 25 bp, Mus musculus
ggtcggaaccaggagctacatgcag

SEQ ID NO: 649424 - DNA, 25 bp, Mus musculus
ggtcggaagccaacaccagtggtct

SEQ ID NO: 649425 - DNA, 25 bp, Mus musculus
ggtcggaagccatcaccagtggtct

SEQ ID NO: 649426 - DNA, 25 bp, Mus musculus
ggtcggaccagcagagcagctatga

SEQ ID NO: 649427 - DNA, 25 bp, Mus musculus
ggtcggaccagctgagcagctatga

SEQ ID NO: 649428 - DNA, 25 bp, Mus musculus
ggtcggaccaggacctcaagtccta

SEQ ID NO: 649429 - DNA, 25 bp, Mus musculus
ggtcggaccaggtcctcaagtccta

SEQ ID NO: 649430 - DNA, 25 bp, Mus musculus
ggtcggagagacattccaggcgtcc

SEQ ID NO: 649431 - DNA, 25 bp, Mus musculus
ggtcggagagactttccaggcgtcc

SEQ ID NO: 649432 - DNA, 25 bp, Mus musculus
ggtcggagggttcaacaccttctct

SEQ ID NO: 649433 - DNA, 25 bp, Mus musculus
ggtcggagggttgaacaccttctct

SEQ ID NO: 649434 - DNA, 25 bp, Mus musculus
ggtcggcacacaagtagagctccat

SEQ ID NO: 649435 - DNA, 25 bp, Mus musculus
ggtcggcacacatgtagagctccat

SEQ ID NO: 649436 - DNA, 25 bp, Mus musculus
ggtcggcaggagaatcactaagact

SEQ ID NO: 649437 - DNA, 25 bp, Mus musculus
ggtcggcaggagtatcactaagact

SEQ ID NO: 649438 - DNA, 25 bp, Mus musculus
ggtcggccacacactacgtgggcac

SEQ ID NO: 649439 - DNA, 25 bp, Mus musculus
ggtcggccacactctacgtgggcac

SEQ ID NO: 649440 - DNA, 25 bp, Mus musculus
ggtcggccagtgaggatcgggtctt

SEQ ID NO: 649441 - DNA, 25 bp, Mus musculus
ggtcggccagtgtggatcgggtctt

SEQ ID NO: 649442 - DNA, 25 bp, Mus musculus
ggtcggcctattccgtttgtcagaa

SEQ ID NO: 649443 - DNA, 25 bp, Mus musculus
ggtcggcctattgcgtttgtcagaa

SEQ ID NO: 649444 - DNA, 25 bp, Mus musculus
ggtcggcgtacgacaggttgcccca

SEQ ID NO: 649445 - DNA, 25 bp, Mus musculus
ggtcggcgtacgtcaggttgcccca

SEQ ID NO: 649446 - DNA, 25 bp, Mus musculus
ggtcggctaagacgctctgtagcta

SEQ ID NO: 649447 - DNA, 25 bp, Mus musculus
ggtcggctaagaggctctgtagcta

SEQ ID NO: 649448 - DNA, 25 bp, Mus musculus
ggtcggctcaccattaaggcgggct

SEQ ID NO: 649449 - DNA, 25 bp, Mus musculus
ggtcggctcacctttaaggcgggct

SEQ ID NO: 649450 - DNA, 25 bp, Mus musculus
ggtcggcttaccatggctccagatg

SEQ ID NO: 649451 - DNA, 25 bp, Mus musculus
ggtcggcttaccttggctccagatg

SEQ ID NO: 649452 - DNA, 25 bp, Mus musculus
ggtcgggaagtgcatgcttatccaa

SEQ ID NO: 649453 - DNA, 25 bp, Mus musculus
ggtcgggaagtggatgcttatccaa

SEQ ID NO: 649454 - DNA, 25 bp, Mus musculus
ggtcgggatccacgccaacacagag

SEQ ID NO: 649455 - DNA, 25 bp, Mus musculus
ggtcgggatccaggccaacacagag

SEQ ID NO: 649456 - DNA, 25 bp, Mus musculus
ggtcgggtcgacaccctgacaggta

SEQ ID NO: 649457 - DNA, 25 bp, Mus musculus
ggtcgggtcgactccctgacaggta

SEQ ID NO: 649458 - DNA, 25 bp, Mus musculus
ggtcgggttctgacctcaccagaca

SEQ ID NO: 649459 - DNA, 25 bp, Mus musculus
ggtcgggttctgtcctcaccagaca

SEQ ID NO: 649460 - DNA, 25 bp, Mus musculus
ggtcgggttcttaccttgctaagca

SEQ ID NO: 649461 - DNA, 25 bp, Mus musculus
ggtcgggttctttccttgctaagca

SEQ ID NO: 649462 - DNA, 25 bp, Mus musculus
ggtcggtctgtgctcatatataaaa

SEQ ID NO: 649463 - DNA, 25 bp, Mus musculus
ggtcggtctgtggtcatatataaaa

SEQ ID NO: 649464 - DNA, 25 bp, Mus musculus
ggtcggtgaaagagactgcccagct

SEQ ID NO: 649465 - DNA, 25 bp, Mus musculus
ggtcggtgaaagtgactgcccagct

SEQ ID NO: 649466 - DNA, 25 bp, Mus musculus
ggtcggtgtccacccctagagaaag

SEQ ID NO: 649467 - DNA, 25 bp, Mus musculus
ggtcggtgtccagccctagagaaag

SEQ ID NO: 649468 - DNA, 25 bp, Mus musculus
ggtcggttcattcgcttgtctgctg

SEQ ID NO: 649469 - DNA, 25 bp, Mus musculus
ggtcggttcattggcttgtctgctg

SEQ ID NO: 649470 - DNA, 25 bp, Mus musculus
ggtcggttttacatgtatccaccat

SEQ ID NO: 649471 - DNA, 25 bp, Mus musculus
ggtcggttttacttgtatccaccat

SEQ ID NO: 649472 - DNA, 25 bp, Mus musculus
ggtcgtaaattgatccgtatctgta

SEQ ID NO: 649473 - DNA, 25 bp, Mus musculus
ggtcgtaaattgttccgtatctgta

SEQ ID NO: 649474 - DNA, 25 bp, Mus musculus
ggtcgtacaagtcgtacttaccaat

SEQ ID NO: 649475 - DNA, 25 bp, Mus musculus
ggtcgtacaagtggtacttaccaat

SEQ ID NO: 649476 - DNA, 25 bp, Mus musculus
ggtcgtacaattactgtgagaactg

SEQ ID NO: 649477 - DNA, 25 bp, Mus musculus
ggtcgtacaatttctgtgagaactg

SEQ ID NO: 649478 - DNA, 25 bp, Mus musculus
ggtcgtacgtaaacattatttctcg

SEQ ID NO: 649479 - DNA, 25 bp, Mus musculus
ggtcgtacgtaatcattatttctcg

SEQ ID NO: 649480 - DNA, 25 bp, Mus musculus
ggtcgtattcaaactctcttaaaca

SEQ ID NO: 649481 - DNA, 25 bp, Mus musculus
ggtcgtattcaatctctcttaaaca

SEQ ID NO: 649482 - DNA, 25 bp, Mus musculus
ggtcgtcacagaacatacagctcag

SEQ ID NO: 649483 - DNA, 25 bp, Mus musculus
ggtcgtcacagatcatacagctcag

SEQ ID NO: 649484 - DNA, 25 bp, Mus musculus
ggtcgtcagcctaatgtgggatagc

SEQ ID NO: 649485 - DNA, 25 bp, Mus musculus
ggtcgtcagccttatgtgggatagc

SEQ ID NO: 649486 - DNA, 25 bp, Mus musculus
ggtcgtcatgacaaacacactggaa

SEQ ID NO: 649487 - DNA, 25 bp, Mus musculus
ggtcgtcatgactaacacactggaa

SEQ ID NO: 649488 - DNA, 25 bp, Mus musculus
ggtcgtcatggaaccgaagttgcca

SEQ ID NO: 649489 - DNA, 25 bp, Mus musculus
ggtcgtcatggatccgaagttgcca

SEQ ID NO: 649490 - DNA, 25 bp, Mus musculus
ggtcgtccagaacatcggccagaga

SEQ ID NO: 649491 - DNA, 25 bp, Mus musculus
ggtcgtccagaagatcggccagaga

SEQ ID NO: 649492 - DNA, 25 bp, Mus musculus
ggtcgtcccatgagagttgttggct

SEQ ID NO: 649493 - DNA, 25 bp, Mus musculus
ggtcgtcccatgtgagttgttggct

SEQ ID NO: 649494 - DNA, 25 bp, Mus musculus
ggtcgtcgtacacaatgccacggtc

SEQ ID NO: 649495 - DNA, 25 bp, Mus musculus
ggtcgtcgtacagaatgccacggtc

SEQ ID NO: 649496 - DNA, 25 bp, Mus musculus
ggtcgtcgtcctcgataaagtcact

SEQ ID NO: 649497 - DNA, 25 bp, Mus musculus
ggtcgtcgtcctggataaagtcact

SEQ ID NO: 649498 - DNA, 25 bp, Mus musculus
ggtcgtctatctaggccttgaaagc

SEQ ID NO: 649499 - DNA, 25 bp, Mus musculus
ggtcgtctatcttggccttgaaagc

SEQ ID NO: 649500 - DNA, 25 bp, Mus musculus
ggtcgtcttcatctcgagagtctca

SEQ ID NO: 649501 - DNA, 25 bp, Mus musculus
ggtcgtcttcatgtcgagagtctca

SEQ ID NO: 649502 - DNA, 25 bp, Mus musculus
ggtcgtcttcgaactcgtcgtcgga

SEQ ID NO: 649503 - DNA, 25 bp, Mus musculus
ggtcgtcttcgatctcgtcgtcgga

SEQ ID NO: 649504 - DNA, 25 bp, Mus musculus
ggtcgtcttgagatccagatttttt

SEQ ID NO: 649505 - DNA, 25 bp, Mus musculus
ggtcgtcttgagttccagatttttt

SEQ ID NO: 649506 - DNA, 25 bp, Mus musculus
ggtcgtctttaacggatacagccat

SEQ ID NO: 649507 - DNA, 25 bp, Mus musculus
ggtcgtctttaagggatacagccat

SEQ ID NO: 649508 - DNA, 25 bp, Mus musculus
ggtcgtgataagaactcgcttccaa

SEQ ID NO: 649509 - DNA, 25 bp, Mus musculus
ggtcgtgataagtactcgcttccaa

SEQ ID NO: 649510 - DNA, 25 bp, Mus musculus
ggtcgtgatgtcaacgaatgctccg

SEQ ID NO: 649511 - DNA, 25 bp, Mus musculus
ggtcgtgatgtctacgaatgctccg

SEQ ID NO: 649512 - DNA, 25 bp, Mus musculus
ggtcgtgcggttactgaatctctaa

SEQ ID NO: 649513 - DNA, 25 bp, Mus musculus
ggtcgtgcggtttctgaatctctaa

SEQ ID NO: 649514 - DNA, 25 bp, Mus musculus
ggtcgtgctaccaaagtgttgactc

SEQ ID NO: 649515 - DNA, 25 bp, Mus musculus
ggtcgtgctacctaagtgttgactc

SEQ ID NO: 649516 - DNA, 25 bp, Mus musculus
ggtcgtgggctcaactgtctcagcc

SEQ ID NO: 649517 - DNA, 25 bp, Mus musculus
ggtcgtgggctctactgtctcagcc

SEQ ID NO: 649518 - DNA, 25 bp, Mus musculus
ggtcgtggtactattcaacgtggca

SEQ ID NO: 649519 - DNA, 25 bp, Mus musculus
ggtcgtggtacttttcaacgtggca

SEQ ID NO: 649520 - DNA, 25 bp, Mus musculus
ggtcgtggtcagaagccaggacatt

SEQ ID NO: 649521 - DNA, 25 bp, Mus musculus
ggtcgtggtcagtagccaggacatt

SEQ ID NO: 649522 - DNA, 25 bp, Mus musculus
ggtcgtggttcaattccagaattct

SEQ ID NO: 649523 - DNA, 25 bp, Mus musculus
ggtcgtggttcatttccagaattct

SEQ ID NO: 649524 - DNA, 25 bp, Mus musculus
ggtcgtgtcattccctcataaaagg

SEQ ID NO: 649525 - DNA, 25 bp, Mus musculus
ggtcgtgtcattgcctcataaaagg

SEQ ID NO: 649526 - DNA, 25 bp, Mus musculus
ggtcgtgtgagcacatggcaactac

SEQ ID NO: 649527 - DNA, 25 bp, Mus musculus
ggtcgtgtgagctcatggcaactac

SEQ ID NO: 649528 - DNA, 25 bp, Mus musculus
ggtcgtgtgggaaccagctcttgaa

SEQ ID NO: 649529 - DNA, 25 bp, Mus musculus
ggtcgtgtgggatccagctcttgaa

SEQ ID NO: 649530 - DNA, 25 bp, Mus musculus
ggtcgttactgtccacctggtacct

SEQ ID NO: 649531 - DNA, 25 bp, Mus musculus
ggtcgttactgtgcacctggtacct

SEQ ID NO: 649532 - DNA, 25 bp, Mus musculus
ggtcgttagcagcatcctattaggg

SEQ ID NO: 649533 - DNA, 25 bp, Mus musculus
ggtcgttagcaggatcctattaggg

SEQ ID NO: 649534 - DNA, 25 bp, Mus musculus
ggtcgttcattcatggccatataga

SEQ ID NO: 649535 - DNA, 25 bp, Mus musculus
ggtcgttcattcttggccatataga

SEQ ID NO: 649536 - DNA, 25 bp, Mus musculus
ggtcgttgtcacagatggaaccctt

SEQ ID NO: 649537 - DNA, 25 bp, Mus musculus
ggtcgttgtcactgatggaaccctt

SEQ ID NO: 649538 - DNA, 25 bp, Mus musculus
ggtcgttgtctgagatggtaatctc

SEQ ID NO: 649539 - DNA, 25 bp, Mus musculus
ggtcgttgtctgtgatggtaatctc

SEQ ID NO: 649540 - DNA, 25 bp, Mus musculus
ggtcgtttacaacactctccaacat

SEQ ID NO: 649541 - DNA, 25 bp, Mus musculus
ggtcgtttacaagactctccaacat

SEQ ID NO: 649542 - DNA, 25 bp, Mus musculus
ggtcgtttcacgctgctgggctctc

SEQ ID NO: 649543 - DNA, 25 bp, Mus musculus
ggtcgtttcacggtgctgggctctc

SEQ ID NO: 649544 - DNA, 25 bp, Mus musculus
ggtcgtttggctatatcagtactta

SEQ ID NO: 649545 - DNA, 25 bp, Mus musculus
ggtcgtttggctttatcagtactta

SEQ ID NO: 649546 - DNA, 25 bp, Mus musculus
ggtcgttttgcaagcacaccttagg

SEQ ID NO: 649547 - DNA, 25 bp, Mus musculus
ggtcgttttgcatgcacaccttagg

SEQ ID NO: 649548 - DNA, 25 bp, Mus musculus
ggtctaaaagctctacttctaaata

SEQ ID NO: 649549 - DNA, 25 bp, Mus musculus
ggtctaaaagctgtacttctaaata

SEQ ID NO: 649550 - DNA, 25 bp, Mus musculus
ggtctaaagggtcagtaccagggca

SEQ ID NO: 649551 - DNA, 25 bp, Mus musculus
ggtctaaagggtgagtaccagggca

SEQ ID NO: 649552 - DNA, 25 bp, Mus musculus
ggtctaaatctgacaaagcccgtgt

SEQ ID NO: 649553 - DNA, 25 bp, Mus musculus
ggtctaaatctgtcaaagcccgtgt

SEQ ID NO: 649554 - DNA, 25 bp, Mus musculus
ggtctaaatgaaactctgtgtcaaa

SEQ ID NO: 649555 - DNA, 25 bp, Mus musculus
ggtctaaatgaatctctgtgtcaaa

SEQ ID NO: 649556 - DNA, 25 bp, Mus musculus
ggtctaaattcgagtccaggtccga

SEQ ID NO: 649557 - DNA, 25 bp, Mus musculus
ggtctaaattcgtgtccaggtccga

SEQ ID NO: 649558 - DNA, 25 bp, Mus musculus
ggtctaacactacaatattctccat

SEQ ID NO: 649559 - DNA, 25 bp, Mus musculus
ggtctaacactagaatattctccat

SEQ ID NO: 649560 - DNA, 25 bp, Mus musculus
ggtctaacataaaagtgctcctgct

SEQ ID NO: 649561 - DNA, 25 bp, Mus musculus
ggtctaacataatagtgctcctgct

SEQ ID NO: 649562 - DNA, 25 bp, Mus musculus
ggtctaaccatacaccagcattgca

SEQ ID NO: 649563 - DNA, 25 bp, Mus musculus
ggtctaaccatagaccagcattgca

SEQ ID NO: 649564 - DNA, 25 bp, Mus musculus
ggtctaacctagactgttcaaggat

SEQ ID NO: 649565 - DNA, 25 bp, Mus musculus
ggtctaacctagtctgttcaaggat

SEQ ID NO: 649566 - DNA, 25 bp, Mus musculus
ggtctaacgttaactcttttcagcc

SEQ ID NO: 649567 - DNA, 25 bp, Mus musculus
ggtctaacgttatctcttttcagcc

SEQ ID NO: 649568 - DNA, 25 bp, Mus musculus
ggtctaactcgaattttgtgctcag

SEQ ID NO: 649569 - DNA, 25 bp, Mus musculus
ggtctaactcgatttttgtgctcag

SEQ ID NO: 649570 - DNA, 25 bp, Mus musculus
ggtctaacttaaaactgcatcccag

SEQ ID NO: 649571 - DNA, 25 bp, Mus musculus
ggtctaacttaatactgcatcccag

SEQ ID NO: 649572 - DNA, 25 bp, Mus musculus
ggtctaagaaaaccgtttgccatgt

SEQ ID NO: 649573 - DNA, 25 bp, Mus musculus
ggtctaagaaaagcgtttgccatgt

SEQ ID NO: 649574 - DNA, 25 bp, Mus musculus
ggtctaagcgaaccatggccttggc

SEQ ID NO: 649575 - DNA, 25 bp, Mus musculus
ggtctaagcgaagcatggccttggc

SEQ ID NO: 649576 - DNA, 25 bp, Mus musculus
ggtctaagcttgatccaaaggcaat

SEQ ID NO: 649577 - DNA, 25 bp, Mus musculus
ggtctaagcttgttccaaaggcaat

SEQ ID NO: 649578 - DNA, 25 bp, Mus musculus
ggtctaaggttaacggatcaacatt

SEQ ID NO: 649579 - DNA, 25 bp, Mus musculus
ggtctaaggttatcggatcaacatt

SEQ ID NO: 649580 - DNA, 25 bp, Mus musculus
ggtctaagtggacctcagcaggtca

SEQ ID NO: 649581 - DNA, 25 bp, Mus musculus
ggtctaagtggagctcagcaggtca

SEQ ID NO: 649582 - DNA, 25 bp, Mus musculus
ggtctaatgtaccttgggccttcat

SEQ ID NO: 649583 - DNA, 25 bp, Mus musculus
ggtctaatgtacgttgggccttcat

SEQ ID NO: 649584 - DNA, 25 bp, Mus musculus
ggtctaatgtccctaaatgctctcc

SEQ ID NO: 649585 - DNA, 25 bp, Mus musculus
ggtctaatgtccgtaaatgctctcc

SEQ ID NO: 649586 - DNA, 25 bp, Mus musculus
ggtctaatgtctattcacagcctaa

SEQ ID NO: 649587 - DNA, 25 bp, Mus musculus
ggtctaatgtcttttcacagcctaa

SEQ ID NO: 649588 - DNA, 25 bp, Mus musculus
ggtctacaaattagcttcctgcttg

SEQ ID NO: 649589 - DNA, 25 bp, Mus musculus
ggtctacaaatttgcttcctgcttg

SEQ ID NO: 649590 - DNA, 25 bp, Mus musculus
ggtctacaagacactgcattctggc

SEQ ID NO: 649591 - DNA, 25 bp, Mus musculus
ggtctacaagactctgcattctggc

SEQ ID NO: 649592 - DNA, 25 bp, Mus musculus
ggtctacacatcaataagattagca

SEQ ID NO: 649593 - DNA, 25 bp, Mus musculus
ggtctacacatcattccttcataga

SEQ ID NO: 649594 - DNA, 25 bp, Mus musculus
ggtctacacatctataagattagca

SEQ ID NO: 649595 - DNA, 25 bp, Mus musculus
ggtctacacatctttccttcataga

SEQ ID NO: 649596 - DNA, 25 bp, Mus musculus
ggtctacaggacagggaagggccat

SEQ ID NO: 649597 - DNA, 25 bp, Mus musculus
ggtctacaggactgggaagggccat

SEQ ID NO: 649598 - DNA, 25 bp, Mus musculus
ggtctacagtagagcttgtgcccca

SEQ ID NO: 649599 - DNA, 25 bp, Mus musculus
ggtctacagtagtgcttgtgcccca

SEQ ID NO: 649600 - DNA, 25 bp, Mus musculus
ggtctacagtccaagtccggcctga

SEQ ID NO: 649601 - DNA, 25 bp, Mus musculus
ggtctacagtcctagtccggcctga

SEQ ID NO: 649602 - DNA, 25 bp, Mus musculus
ggtctacatttgaacaatggatgca

SEQ ID NO: 649603 - DNA, 25 bp, Mus musculus
ggtctacatttgtacaatggatgca

SEQ ID NO: 649604 - DNA, 25 bp, Mus musculus
ggtctaccactgaatgccatgctta

SEQ ID NO: 649605 - DNA, 25 bp, Mus musculus
ggtctaccactgtatgccatgctta

SEQ ID NO: 649606 - DNA, 25 bp, Mus musculus
ggtctacctcgccaagttagccaag

SEQ ID NO: 649607 - DNA, 25 bp, Mus musculus
ggtctacctcgcgaagttagccaag

SEQ ID NO: 649608 - DNA, 25 bp, Mus musculus
ggtctacctgagacactaccgctga

SEQ ID NO: 649609 - DNA, 25 bp, Mus musculus
ggtctacctgagtcactaccgctga

SEQ ID NO: 649610 - DNA, 25 bp, Mus musculus
ggtctactcaatccaggtggcttct

SEQ ID NO: 649611 - DNA, 25 bp, Mus musculus
ggtctactcaatgcaggtggcttct

SEQ ID NO: 649612 - DNA, 25 bp, Mus musculus
ggtctactggcgaaattacctgtta

SEQ ID NO: 649613 - DNA, 25 bp, Mus musculus
ggtctactggcgtaattacctgtta

SEQ ID NO: 649614 - DNA, 25 bp, Mus musculus
ggtctactttaaacagatagcttca

SEQ ID NO: 649615 - DNA, 25 bp, Mus musculus
ggtctactttaatcagatagcttca

SEQ ID NO: 649616 - DNA, 25 bp, Mus musculus
ggtctagaaatgctggacttatttt

SEQ ID NO: 649617 - DNA, 25 bp, Mus musculus
ggtctagaaatggtggacttatttt

SEQ ID NO: 649618 - DNA, 25 bp, Mus musculus
ggtctagaaggcaagtctattctca

SEQ ID NO: 649619 - DNA, 25 bp, Mus musculus
ggtctagaaggctagtctattctca

SEQ ID NO: 649620 - DNA, 25 bp, Mus musculus
ggtctagaatttatcgcctatcgag

SEQ ID NO: 649621 - DNA, 25 bp, Mus musculus
ggtctagaatttttcgcctatcgag

SEQ ID NO: 649622 - DNA, 25 bp, Mus musculus
ggtctagacaacaagctgcgtgagg

SEQ ID NO: 649623 - DNA, 25 bp, Mus musculus
ggtctagacaactagctgcgtgagg

SEQ ID NO: 649624 - DNA, 25 bp, Mus musculus
ggtctagactcaccaagatcacaga

SEQ ID NO: 649625 - DNA, 25 bp, Mus musculus
ggtctagactcagcaagatcacaga

SEQ ID NO: 649626 - DNA, 25 bp, Mus musculus
ggtctagagccacttcagcctttgt

SEQ ID NO: 649627 - DNA, 25 bp, Mus musculus
ggtctagagccagttcagcctttgt

SEQ ID NO: 649628 - DNA, 25 bp, Mus musculus
ggtctagcatatccatggcttgaat

SEQ ID NO: 649629 - DNA, 25 bp, Mus musculus
ggtctagcatatgcatggcttgaat

SEQ ID NO: 649630 - DNA, 25 bp, Mus musculus
ggtctagcgcttatacaaactggat

SEQ ID NO: 649631 - DNA, 25 bp, Mus musculus
ggtctagcgcttttacaaactggat

SEQ ID NO: 649632 - DNA, 25 bp, Mus musculus
ggtctagctagcacagccacaaatg

SEQ ID NO: 649633 - DNA, 25 bp, Mus musculus
ggtctagctagctcagccacaaatg

SEQ ID NO: 649634 - DNA, 25 bp, Mus musculus
ggtctagctccgatgaattccaaga

SEQ ID NO: 649635 - DNA, 25 bp, Mus musculus
ggtctagctccgttgaattccaaga

SEQ ID NO: 649636 - DNA, 25 bp, Mus musculus
ggtctagctttcctagttccaggaa

SEQ ID NO: 649637 - DNA, 25 bp, Mus musculus
ggtctagctttcgtagttccaggaa

SEQ ID NO: 649638 - DNA, 25 bp, Mus musculus
ggtctaggagttagctcagctgcaa

SEQ ID NO: 649639 - DNA, 25 bp, Mus musculus
ggtctaggagtttgctcagctgcaa

SEQ ID NO: 649640 - DNA, 25 bp, Mus musculus
ggtctaggccatctgatgcccagta

SEQ ID NO: 649641 - DNA, 25 bp, Mus musculus
ggtctaggccatgtgatgcccagta

SEQ ID NO: 649642 - DNA, 25 bp, Mus musculus
ggtctagggaatacctggctcatta

SEQ ID NO: 649643 - DNA, 25 bp, Mus musculus
ggtctagggaattcctggctcatta

SEQ ID NO: 649644 - DNA, 25 bp, Mus musculus
ggtctagggacaccacatagcattt

SEQ ID NO: 649645 - DNA, 25 bp, Mus musculus
ggtctagggacagcacatagcattt

SEQ ID NO: 649646 - DNA, 25 bp, Mus musculus
ggtctagggacccagatgccttctt

SEQ ID NO: 649647 - DNA, 25 bp, Mus musculus
ggtctagggaccgagatgccttctt

SEQ ID NO: 649648 - DNA, 25 bp, Mus musculus
ggtctagggctaacttctttatctt

SEQ ID NO: 649649 - DNA, 25 bp, Mus musculus
ggtctagggctacaaggctcctcat

SEQ ID NO: 649650 - DNA, 25 bp, Mus musculus
ggtctagggctagaaggctcctcat

SEQ ID NO: 649651 - DNA, 25 bp, Mus musculus
ggtctagggctatcttctttatctt

SEQ ID NO: 649652 - DNA, 25 bp, Mus musculus
ggtctaggtatgaattccatgcaga

SEQ ID NO: 649653 - DNA, 25 bp, Mus musculus
ggtctaggtatgtattccatgcaga

SEQ ID NO: 649654 - DNA, 25 bp, Mus musculus
ggtctagtagctcgtgaacacatta

SEQ ID NO: 649655 - DNA, 25 bp, Mus musculus
ggtctagtagctggtgaacacatta

SEQ ID NO: 649656 - DNA, 25 bp, Mus musculus
ggtctagtaggaaaagtcacccttg

SEQ ID NO: 649657 - DNA, 25 bp, Mus musculus
ggtctagtaggataagtcacccttg

SEQ ID NO: 649658 - DNA, 25 bp, Mus musculus
ggtctagtccaccatgattcctgta

SEQ ID NO: 649659 - DNA, 25 bp, Mus musculus
ggtctagtccacgatgattcctgta

SEQ ID NO: 649660 - DNA, 25 bp, Mus musculus
ggtctagtgagccttttgtcatcat

SEQ ID NO: 649661 - DNA, 25 bp, Mus musculus
ggtctagtgagcgttttgtcatcat

SEQ ID NO: 649662 - DNA, 25 bp, Mus musculus
ggtctagtgatcacttggttgtgga

SEQ ID NO: 649663 - DNA, 25 bp, Mus musculus
ggtctagtgatctcttggttgtgga

SEQ ID NO: 649664 - DNA, 25 bp, Mus musculus
ggtctagttgacacttaacagcatt

SEQ ID NO: 649665 - DNA, 25 bp, Mus musculus
ggtctagttgactcttaacagcatt

SEQ ID NO: 649666 - DNA, 25 bp, Mus musculus
ggtctatacagcaagtcccaagctt

SEQ ID NO: 649667 - DNA, 25 bp, Mus musculus
ggtctatacagctagtcccaagctt

SEQ ID NO: 649668 - DNA, 25 bp, Mus musculus
ggtctatattttaccaactctcact

SEQ ID NO: 649669 - DNA, 25 bp, Mus musculus
ggtctatatttttccaactctcact

SEQ ID NO: 649670 - DNA, 25 bp, Mus musculus
ggtctatcactaaatcctggaagct

SEQ ID NO: 649671 - DNA, 25 bp, Mus musculus
ggtctatcactatatcctggaagct

SEQ ID NO: 649672 - DNA, 25 bp, Mus musculus
ggtctatcctacctcaaagaagaag

SEQ ID NO: 649673 - DNA, 25 bp, Mus musculus
ggtctatcctacgtcaaagaagaag

SEQ ID NO: 649674 - DNA, 25 bp, Mus musculus
ggtctatctaaacatctcccagcag

SEQ ID NO: 649675 - DNA, 25 bp, Mus musculus
ggtctatctaaagatctcccagcag

SEQ ID NO: 649676 - DNA, 25 bp, Mus musculus
ggtctatctcaaccggacatcctaa

SEQ ID NO: 649677 - DNA, 25 bp, Mus musculus
ggtctatctcaactgtaaggcccat

SEQ ID NO: 649678 - DNA, 25 bp, Mus musculus
ggtctatctcaagcggacatcctaa

SEQ ID NO: 649679 - DNA, 25 bp, Mus musculus
ggtctatctcaagtgtaaggcccat

SEQ ID NO: 649680 - DNA, 25 bp, Mus musculus
ggtctatctgagagcttttcggcat

SEQ ID NO: 649681 - DNA, 25 bp, Mus musculus
ggtctatctgagtgcttttcggcat

SEQ ID NO: 649682 - DNA, 25 bp, Mus musculus
ggtctatgaggacatctttgatgct

SEQ ID NO: 649683 - DNA, 25 bp, Mus musculus
ggtctatgaggagatctttgatgct

SEQ ID NO: 649684 - DNA, 25 bp, Mus musculus
ggtctatgatctactgaccattgcc

SEQ ID NO: 649685 - DNA, 25 bp, Mus musculus
ggtctatgatcttctgaccattgcc

SEQ ID NO: 649686 - DNA, 25 bp, Mus musculus
ggtctatggccgctaagcatatcaa

SEQ ID NO: 649687 - DNA, 25 bp, Mus musculus
ggtctatggccggtaagcatatcaa

SEQ ID NO: 649688 - DNA, 25 bp, Mus musculus
ggtctatgtaggcaggtcttatact

SEQ ID NO: 649689 - DNA, 25 bp, Mus musculus
ggtctatgtagggaggtcttatact

SEQ ID NO: 649690 - DNA, 25 bp, Mus musculus
ggtctattattgagcaagatatttt

SEQ ID NO: 649691 - DNA, 25 bp, Mus musculus
ggtctattattgtgcaagatatttt

SEQ ID NO: 649692 - DNA, 25 bp, Mus musculus
ggtctattcaaacctgcatcccgca

SEQ ID NO: 649693 - DNA, 25 bp, Mus musculus
ggtctattcaaagctgcatcccgca

SEQ ID NO: 649694 - DNA, 25 bp, Mus musculus
ggtctattctaaatgggctccaggg

SEQ ID NO: 649695 - DNA, 25 bp, Mus musculus
ggtctattctaattgggctccaggg

SEQ ID NO: 649696 - DNA, 25 bp, Mus musculus
ggtctattgtggattctatactgat

SEQ ID NO: 649697 - DNA, 25 bp, Mus musculus
ggtctattgtggtttctatactgat

SEQ ID NO: 649698 - DNA, 25 bp, Mus musculus
ggtctatttaagcaccacatggtta

SEQ ID NO: 649699 - DNA, 25 bp, Mus musculus
ggtctatttaaggaccacatggtta

SEQ ID NO: 649700 - DNA, 25 bp, Mus musculus
ggtctatttcagaatgtggacaaca

SEQ ID NO: 649701 - DNA, 25 bp, Mus musculus
ggtctatttcagtatgtggacaaca

SEQ ID NO: 649702 - DNA, 25 bp, Mus musculus
ggtctcaaaacaaacctctgggtat

SEQ ID NO: 649703 - DNA, 25 bp, Mus musculus
ggtctcaaaacatacctctgggtat

SEQ ID NO: 649704 - DNA, 25 bp, Mus musculus
ggtctcaaactcagatatcttcggt

SEQ ID NO: 649705 - DNA, 25 bp, Mus musculus
ggtctcaaactctgatatcttcggt

SEQ ID NO: 649706 - DNA, 25 bp, Mus musculus
ggtctcaaacttcctacagagctaa

SEQ ID NO: 649707 - DNA, 25 bp, Mus musculus
ggtctcaaacttgctacagagctaa

SEQ ID NO: 649708 - DNA, 25 bp, Mus musculus
ggtctcaaagcacgtagccttcaat

SEQ ID NO: 649709 - DNA, 25 bp, Mus musculus
ggtctcaaagcaggtagccttcaat

SEQ ID NO: 649710 - DNA, 25 bp, Mus musculus
ggtctcaaagttaatttgtacccag

SEQ ID NO: 649711 - DNA, 25 bp, Mus musculus
ggtctcaaagtttatttgtacccag

SEQ ID NO: 649712 - DNA, 25 bp, Mus musculus
ggtctcaacaagaacattccagtcg

SEQ ID NO: 649713 - DNA, 25 bp, Mus musculus
ggtctcaacaagtacattccagtcg

SEQ ID NO: 649714 - DNA, 25 bp, Mus musculus
ggtctcaacctcctgggctgaagct

SEQ ID NO: 649715 - DNA, 25 bp, Mus musculus
ggtctcaacctcgtgggctgaagct

SEQ ID NO: 649716 - DNA, 25 bp, Mus musculus
ggtctcaacggtaaccatggcaaga

SEQ ID NO: 649717 - DNA, 25 bp, Mus musculus
ggtctcaacggttaccatggcaaga

SEQ ID NO: 649718 - DNA, 25 bp, Mus musculus
ggtctcaagcgccagtaatgccaga

SEQ ID NO: 649719 - DNA, 25 bp, Mus musculus
ggtctcaagcgcgagtaatgccaga

SEQ ID NO: 649720 - DNA, 25 bp, Mus musculus
ggtctcaagtgaagaactgccacat

SEQ ID NO: 649721 - DNA, 25 bp, Mus musculus
ggtctcaagtgatgaactgccacat

SEQ ID NO: 649722 - DNA, 25 bp, Mus musculus
ggtctcaatgtgagactgtatctta

SEQ ID NO: 649723 - DNA, 25 bp, Mus musculus
ggtctcaatgtgtgactgtatctta

SEQ ID NO: 649724 - DNA, 25 bp, Mus musculus
ggtctcaattaacttcctgtttcta

SEQ ID NO: 649725 - DNA, 25 bp, Mus musculus
ggtctcaattaagttcctgtttcta

SEQ ID NO: 649726 - DNA, 25 bp, Mus musculus
ggtctcacactgaagcctaggtcgg

SEQ ID NO: 649727 - DNA, 25 bp, Mus musculus
ggtctcacactgatcatgcgcaaga

SEQ ID NO: 649728 - DNA, 25 bp, Mus musculus
ggtctcacactgtagcctaggtcgg

SEQ ID NO: 649729 - DNA, 25 bp, Mus musculus
ggtctcacactgttcatgcgcaaga

SEQ ID NO: 649730 - DNA, 25 bp, Mus musculus
ggtctcacagtaaccccaaggggtg

SEQ ID NO: 649731 - DNA, 25 bp, Mus musculus
ggtctcacagtatccccaaggggtg

SEQ ID NO: 649732 - DNA, 25 bp, Mus musculus
ggtctcaccactcatgactctgaaa

SEQ ID NO: 649733 - DNA, 25 bp, Mus musculus
ggtctcaccactgatgactctgaaa

SEQ ID NO: 649734 - DNA, 25 bp, Mus musculus
ggtctcacctacagcagcaggagga

SEQ ID NO: 649735 - DNA, 25 bp, Mus musculus
ggtctcacctactgcagcaggagga

SEQ ID NO: 649736 - DNA, 25 bp, Mus musculus
ggtctcaccttgattctcacaagaa

SEQ ID NO: 649737 - DNA, 25 bp, Mus musculus
ggtctcaccttgtttctcacaagaa

SEQ ID NO: 649738 - DNA, 25 bp, Mus musculus
ggtctcacggatctgtgtgtctata

SEQ ID NO: 649739 - DNA, 25 bp, Mus musculus
ggtctcacggatgtgtgtgtctata

SEQ ID NO: 649740 - DNA, 25 bp, Mus musculus
ggtctcactaccctttgaggaaggc

SEQ ID NO: 649741 - DNA, 25 bp, Mus musculus
ggtctcactaccgtttgaggaaggc

SEQ ID NO: 649742 - DNA, 25 bp, Mus musculus
ggtctcactaggaaatttgagccag

SEQ ID NO: 649743 - DNA, 25 bp, Mus musculus
ggtctcactaggtaatttgagccag

SEQ ID NO: 649744 - DNA, 25 bp, Mus musculus
ggtctcactatccatggctggtctg

SEQ ID NO: 649745 - DNA, 25 bp, Mus musculus
ggtctcactatcgatggctggtctg

SEQ ID NO: 649746 - DNA, 25 bp, Mus musculus
ggtctcactggtcggccaacagaaa

SEQ ID NO: 649747 - DNA, 25 bp, Mus musculus
ggtctcactggtgggccaacagaaa

SEQ ID NO: 649748 - DNA, 25 bp, Mus musculus
ggtctcacttgcacagaggtgcagg

SEQ ID NO: 649749 - DNA, 25 bp, Mus musculus
ggtctcacttgctcagaggtgcagg

SEQ ID NO: 649750 - DNA, 25 bp, Mus musculus
ggtctcagaacaaaccttgtttggt

SEQ ID NO: 649751 - DNA, 25 bp, Mus musculus
ggtctcagaacataccttgtttggt

SEQ ID NO: 649752 - DNA, 25 bp, Mus musculus
ggtctcagacatcctatgtggccaa

SEQ ID NO: 649753 - DNA, 25 bp, Mus musculus
ggtctcagacatgctatgtggccaa

SEQ ID NO: 649754 - DNA, 25 bp, Mus musculus
ggtctcagagaaatgccctaggttc

SEQ ID NO: 649755 - DNA, 25 bp, Mus musculus
ggtctcagagaattgccctaggttc

SEQ ID NO: 649756 - DNA, 25 bp, Mus musculus
ggtctcagatagcattgttttttca

SEQ ID NO: 649757 - DNA, 25 bp, Mus musculus
ggtctcagataggattgttttttca

SEQ ID NO: 649758 - DNA, 25 bp, Mus musculus
ggtctcagatgtcctgtattccaga

SEQ ID NO: 649759 - DNA, 25 bp, Mus musculus
ggtctcagatgtgctgtattccaga

SEQ ID NO: 649760 - DNA, 25 bp, Mus musculus
ggtctcagatttactgtcctgccaa

SEQ ID NO: 649761 - DNA, 25 bp, Mus musculus
ggtctcagattttctgtcctgccaa

SEQ ID NO: 649762 - DNA, 25 bp, Mus musculus
ggtctcagctatagttgctaccaaa

SEQ ID NO: 649763 - DNA, 25 bp, Mus musculus
ggtctcagctattgttgctaccaaa

SEQ ID NO: 649764 - DNA, 25 bp, Mus musculus
ggtctcagctcccatggcagggatt

SEQ ID NO: 649765 - DNA, 25 bp, Mus musculus
ggtctcagctccgatggcagggatt

SEQ ID NO: 649766 - DNA, 25 bp, Mus musculus
ggtctcagctgaacaccgaagcaag

SEQ ID NO: 649767 - DNA, 25 bp, Mus musculus
ggtctcagctgatcaccgaagcaag

SEQ ID NO: 649768 - DNA, 25 bp, Mus musculus
ggtctcaggagaataactttcatat

SEQ ID NO: 649769 - DNA, 25 bp, Mus musculus
ggtctcaggagattaactttcatat

SEQ ID NO: 649770 - DNA, 25 bp, Mus musculus
ggtctcaggctactttagagcttct

SEQ ID NO: 649771 - DNA, 25 bp, Mus musculus
ggtctcaggctagtttagagcttct

SEQ ID NO: 649772 - DNA, 25 bp, Mus musculus
ggtctcagtcagatgtataggatac

SEQ ID NO: 649773 - DNA, 25 bp, Mus musculus
ggtctcagtcagttgtataggatac

SEQ ID NO: 649774 - DNA, 25 bp, Mus musculus
ggtctcagttgcaaagtcctaattt

SEQ ID NO: 649775 - DNA, 25 bp, Mus musculus
ggtctcagttgctaagtcctaattt

SEQ ID NO: 649776 - DNA, 25 bp, Mus musculus
ggtctcatcgccacgcaggagtgag

SEQ ID NO: 649777 - DNA, 25 bp, Mus musculus
ggtctcatcgcctcgcaggagtgag

SEQ ID NO: 649778 - DNA, 25 bp, Mus musculus
ggtctcatcgttctgttacattcat

SEQ ID NO: 649779 - DNA, 25 bp, Mus musculus
ggtctcatcgttgtgttacattcat

SEQ ID NO: 649780 - DNA, 25 bp, Mus musculus
ggtctcatgattcttaggctgcttc

SEQ ID NO: 649781 - DNA, 25 bp, Mus musculus
ggtctcatgattgttaggctgcttc

SEQ ID NO: 649782 - DNA, 25 bp, Mus musculus
ggtctcatggagcacactcaggcta

SEQ ID NO: 649783 - DNA, 25 bp, Mus musculus
ggtctcatggaggacactcaggcta

SEQ ID NO: 649784 - DNA, 25 bp, Mus musculus
ggtctcattcataaggacacaattc

SEQ ID NO: 649785 - DNA, 25 bp, Mus musculus
ggtctcattcattaggacacaattc

SEQ ID NO: 649786 - DNA, 25 bp, Mus musculus
ggtctcattgacaacaaacccatct

SEQ ID NO: 649787 - DNA, 25 bp, Mus musculus
ggtctcattgactacaaacccatct

SEQ ID NO: 649788 - DNA, 25 bp, Mus musculus
ggtctcatttttcaccgtggaataa

SEQ ID NO: 649789 - DNA, 25 bp, Mus musculus
ggtctcatttttgaccgtggaataa

SEQ ID NO: 649790 - DNA, 25 bp, Mus musculus
ggtctccaaaggaagctaaccgctg

SEQ ID NO: 649791 - DNA, 25 bp, Mus musculus
ggtctccaaaggtagctaaccgctg

SEQ ID NO: 649792 - DNA, 25 bp, Mus musculus
ggtctccaagtacggataccagcat

SEQ ID NO: 649793 - DNA, 25 bp, Mus musculus
ggtctccaagtagggataccagcat

SEQ ID NO: 649794 - DNA, 25 bp, Mus musculus
ggtctccaagtgacggtttgcagta

SEQ ID NO: 649795 - DNA, 25 bp, Mus musculus
ggtctccaagtgtcggtttgcagta

SEQ ID NO: 649796 - DNA, 25 bp, Mus musculus
ggtctccaccagcttagtgagtgca

SEQ ID NO: 649797 - DNA, 25 bp, Mus musculus
ggtctccaccaggttagtgagtgca

SEQ ID NO: 649798 - DNA, 25 bp, Mus musculus
ggtctccacgtccagtgttggaaga

SEQ ID NO: 649799 - DNA, 25 bp, Mus musculus
ggtctccacgtcgagtgttggaaga

SEQ ID NO: 649800 - DNA, 25 bp, Mus musculus
ggtctccactctcgcaaagtcagat

SEQ ID NO: 649801 - DNA, 25 bp, Mus musculus
ggtctccactctggcaaagtcagat

SEQ ID NO: 649802 - DNA, 25 bp, Mus musculus
ggtctccactgccaaggaactgttc

SEQ ID NO: 649803 - DNA, 25 bp, Mus musculus
ggtctccactgcgaaggaactgttc

SEQ ID NO: 649804 - DNA, 25 bp, Mus musculus
ggtctccacttgatgaattggcaac

SEQ ID NO: 649805 - DNA, 25 bp, Mus musculus
ggtctccacttgttgaattggcaac

SEQ ID NO: 649806 - DNA, 25 bp, Mus musculus
ggtctccaggccctagtgcttgttt

SEQ ID NO: 649807 - DNA, 25 bp, Mus musculus
ggtctccaggccgtagtgcttgttt

SEQ ID NO: 649808 - DNA, 25 bp, Mus musculus
ggtctccagggcaacaaatctgcct

SEQ ID NO: 649809 - DNA, 25 bp, Mus musculus
ggtctccagggctacaaatctgcct

SEQ ID NO: 649810 - DNA, 25 bp, Mus musculus
ggtctccataccagcgttttgattg

SEQ ID NO: 649811 - DNA, 25 bp, Mus musculus
ggtctccatacctgcgttttgattg

SEQ ID NO: 649812 - DNA, 25 bp, Mus musculus
ggtctccatcgaagcatgagcagag

SEQ ID NO: 649813 - DNA, 25 bp, Mus musculus
ggtctccatcgatgcatgagcagag

SEQ ID NO: 649814 - DNA, 25 bp, Mus musculus
ggtctccatggaaccactgtagggt

SEQ ID NO: 649815 - DNA, 25 bp, Mus musculus
ggtctccatggatccactgtagggt

SEQ ID NO: 649816 - DNA, 25 bp, Mus musculus
ggtctcccaagaatacactgtgatc

SEQ ID NO: 649817 - DNA, 25 bp, Mus musculus
ggtctcccaagattacactgtgatc

SEQ ID NO: 649818 - DNA, 25 bp, Mus musculus
ggtctcccaccaagtattagatctt

SEQ ID NO: 649819 - DNA, 25 bp, Mus musculus
ggtctcccaccatgtattagatctt

SEQ ID NO: 649820 - DNA, 25 bp, Mus musculus
ggtctcccagagcattgcatcctgg

SEQ ID NO: 649821 - DNA, 25 bp, Mus musculus
ggtctcccagaggattgcatcctgg

SEQ ID NO: 649822 - DNA, 25 bp, Mus musculus
ggtctcccagtgagcctaattctca

SEQ ID NO: 649823 - DNA, 25 bp, Mus musculus
ggtctcccagtgtgcctaattctca

SEQ ID NO: 649824 - DNA, 25 bp, Mus musculus
ggtctcccgaaaaggacgttgtcat

SEQ ID NO: 649825 - DNA, 25 bp, Mus musculus
ggtctcccgaaatggacgttgtcat

SEQ ID NO: 649826 - DNA, 25 bp, Mus musculus
ggtctcccggacaaagcccttagag

SEQ ID NO: 649827 - DNA, 25 bp, Mus musculus
ggtctcccggactaagcccttagag

SEQ ID NO: 649828 - DNA, 25 bp, Mus musculus
ggtctccctctaatattattctaag

SEQ ID NO: 649829 - DNA, 25 bp, Mus musculus
ggtctccctctattattattctaag

SEQ ID NO: 649830 - DNA, 25 bp, Mus musculus
ggtctccctgcaaccgtgaagaaga

SEQ ID NO: 649831 - DNA, 25 bp, Mus musculus
ggtctccctgcatccgtgaagaaga

SEQ ID NO: 649832 - DNA, 25 bp, Mus musculus
ggtctccctgtgatgttgagatcag

SEQ ID NO: 649833 - DNA, 25 bp, Mus musculus
ggtctccctgtgttgttgagatcag

SEQ ID NO: 649834 - DNA, 25 bp, Mus musculus
ggtctccgagctatggcaacgatga

SEQ ID NO: 649835 - DNA, 25 bp, Mus musculus
ggtctccgagctttggcaacgatga

SEQ ID NO: 649836 - DNA, 25 bp, Mus musculus
ggtctccgcgagactggaacaggat

SEQ ID NO: 649837 - DNA, 25 bp, Mus musculus
ggtctccgcgagtctggaacaggat

SEQ ID NO: 649838 - DNA, 25 bp, Mus musculus
ggtctccgctttccagttggaagga

SEQ ID NO: 649839 - DNA, 25 bp, Mus musculus
ggtctccgctttgcagttggaagga

SEQ ID NO: 649840 - DNA, 25 bp, Mus musculus
ggtctccggcctagactggcctcag

SEQ ID NO: 649841 - DNA, 25 bp, Mus musculus
ggtctccggccttgactggcctcag

SEQ ID NO: 649842 - DNA, 25 bp, Mus musculus
ggtctcctaagtcccgagatgaagt

SEQ ID NO: 649843 - DNA, 25 bp, Mus musculus
ggtctcctaagtgccgagatgaagt

SEQ ID NO: 649844 - DNA, 25 bp, Mus musculus
ggtctcctaccaagttatcaggcaa

SEQ ID NO: 649845 - DNA, 25 bp, Mus musculus
ggtctcctaccatgttatcaggcaa

SEQ ID NO: 649846 - DNA, 25 bp, Mus musculus
ggtctcctcagaaccatgaagaata

SEQ ID NO: 649847 - DNA, 25 bp, Mus musculus
ggtctcctcagatccatgaagaata

SEQ ID NO: 649848 - DNA, 25 bp, Mus musculus
ggtctcctctatctagactactgct

SEQ ID NO: 649849 - DNA, 25 bp, Mus musculus
ggtctcctctatgtagactactgct

SEQ ID NO: 649850 - DNA, 25 bp, Mus musculus
ggtctcctgacaatgtcttgttact

SEQ ID NO: 649851 - DNA, 25 bp, Mus musculus
ggtctcctgacattgtcttgttact

SEQ ID NO: 649852 - DNA, 25 bp, Mus musculus
ggtctcctgcaactccttaaagaaa

SEQ ID NO: 649853 - DNA, 25 bp, Mus musculus
ggtctcctgcaagtccttaaagaaa

SEQ ID NO: 649854 - DNA, 25 bp, Mus musculus
ggtctcctgcttaaactatttctaa

SEQ ID NO: 649855 - DNA, 25 bp, Mus musculus
ggtctcctgctttaactatttctaa

SEQ ID NO: 649856 - DNA, 25 bp, Mus musculus
ggtctcctggaaacttaagtgctgt

SEQ ID NO: 649857 - DNA, 25 bp, Mus musculus
ggtctcctggaatcttaagtgctgt

SEQ ID NO: 649858 - DNA, 25 bp, Mus musculus
ggtctcctgtgcatctaggcccaag

SEQ ID NO: 649859 - DNA, 25 bp, Mus musculus
ggtctcctgtgcttctaggcccaag

SEQ ID NO: 649860 - DNA, 25 bp, Mus musculus
ggtctcctgtttcggcctgagtgta

SEQ ID NO: 649861 - DNA, 25 bp, Mus musculus
ggtctcctgtttgggcctgagtgta

SEQ ID NO: 649862 - DNA, 25 bp, Mus musculus
ggtctccttcaaaggtgtagtgtaa

SEQ ID NO: 649863 - DNA, 25 bp, Mus musculus
ggtctccttcaatggtgtagtgtaa

SEQ ID NO: 649864 - DNA, 25 bp, Mus musculus
ggtctccttcagaagagcttaggta

SEQ ID NO: 649865 - DNA, 25 bp, Mus musculus
ggtctccttcagtagagcttaggta

SEQ ID NO: 649866 - DNA, 25 bp, Mus musculus
ggtctccttccaatggaggttgttt

SEQ ID NO: 649867 - DNA, 25 bp, Mus musculus
ggtctccttccattggaggttgttt

SEQ ID NO: 649868 - DNA, 25 bp, Mus musculus
ggtctccttgttacataattttcaa

SEQ ID NO: 649869 - DNA, 25 bp, Mus musculus
ggtctccttgtttcataattttcaa

SEQ ID NO: 649870 - DNA, 25 bp, Mus musculus
ggtctcctttcccagatttcagcag

SEQ ID NO: 649871 - DNA, 25 bp, Mus musculus
ggtctcctttccgagatttcagcag

SEQ ID NO: 649872 - DNA, 25 bp, Mus musculus
ggtctcgacacacagcttttatatg

SEQ ID NO: 649873 - DNA, 25 bp, Mus musculus
ggtctcgacacagagcttttatatg

SEQ ID NO: 649874 - DNA, 25 bp, Mus musculus
ggtctcgcagccacagttagagatg

SEQ ID NO: 649875 - DNA, 25 bp, Mus musculus
ggtctcgcagcctcagttagagatg

SEQ ID NO: 649876 - DNA, 25 bp, Mus musculus
ggtctcgcccggcaacctggcagta

SEQ ID NO: 649877 - DNA, 25 bp, Mus musculus
ggtctcgcccgggaacctggcagta

SEQ ID NO: 649878 - DNA, 25 bp, Mus musculus
ggtctcgccgttcaaaactattatt

SEQ ID NO: 649879 - DNA, 25 bp, Mus musculus
ggtctcgccgttgaaaactattatt

SEQ ID NO: 649880 - DNA, 25 bp, Mus musculus
ggtctcgcggcgatcgacatttagc

SEQ ID NO: 649881 - DNA, 25 bp, Mus musculus
ggtctcgcggcgttcgacatttagc

SEQ ID NO: 649882 - DNA, 25 bp, Mus musculus
ggtctcgggaatacctcaaatattt

SEQ ID NO: 649883 - DNA, 25 bp, Mus musculus
ggtctcgggaattcctcaaatattt

SEQ ID NO: 649884 - DNA, 25 bp, Mus musculus
ggtctcgggtaaatataacacacat

SEQ ID NO: 649885 - DNA, 25 bp, Mus musculus
ggtctcgggtaattataacacacat

SEQ ID NO: 649886 - DNA, 25 bp, Mus musculus
ggtctctaaagactgtttcccgcca

SEQ ID NO: 649887 - DNA, 25 bp, Mus musculus
ggtctctaaagagtgtttcccgcca

SEQ ID NO: 649888 - DNA, 25 bp, Mus musculus
ggtctctaagggaactgcatgcatg

SEQ ID NO: 649889 - DNA, 25 bp, Mus musculus
ggtctctaagggtactgcatgcatg

SEQ ID NO: 649890 - DNA, 25 bp, Mus musculus
ggtctctaagtaacactggctgctc

SEQ ID NO: 649891 - DNA, 25 bp, Mus musculus
ggtctctaagtatcactggctgctc

SEQ ID NO: 649892 - DNA, 25 bp, Mus musculus
ggtctctaatgtacctattcaacaa

SEQ ID NO: 649893 - DNA, 25 bp, Mus musculus
ggtctctaatgttcctattcaacaa

SEQ ID NO: 649894 - DNA, 25 bp, Mus musculus
ggtctctaatttaggcatctgctct

SEQ ID NO: 649895 - DNA, 25 bp, Mus musculus
ggtctctaattttggcatctgctct

SEQ ID NO: 649896 - DNA, 25 bp, Mus musculus
ggtctctacaaaaaggtcttgctgt

SEQ ID NO: 649897 - DNA, 25 bp, Mus musculus
ggtctctacaaataggtcttgctgt

SEQ ID NO: 649898 - DNA, 25 bp, Mus musculus
ggtctctacattcagtgacaacatg

SEQ ID NO: 649899 - DNA, 25 bp, Mus musculus
ggtctctacattgagtgacaacatg

SEQ ID NO: 649900 - DNA, 25 bp, Mus musculus
ggtctctacgatctccgtgcaaaaa

SEQ ID NO: 649901 - DNA, 25 bp, Mus musculus
ggtctctacgatgtccgtgcaaaaa

SEQ ID NO: 649902 - DNA, 25 bp, Mus musculus
ggtctctacggcaccagaaggctcg

SEQ ID NO: 649903 - DNA, 25 bp, Mus musculus
ggtctctacggctccagaaggctcg

SEQ ID NO: 649904 - DNA, 25 bp, Mus musculus
ggtctctagaataacgactcagagt

SEQ ID NO: 649905 - DNA, 25 bp, Mus musculus
ggtctctagaattacgactcagagt

SEQ ID NO: 649906 - DNA, 25 bp, Mus musculus
ggtctctagttcagtaaaatcggtt

SEQ ID NO: 649907 - DNA, 25 bp, Mus musculus
ggtctctagttctgtaaaatcggtt

SEQ ID NO: 649908 - DNA, 25 bp, Mus musculus
ggtctctatggaaccctctgaagat

SEQ ID NO: 649909 - DNA, 25 bp, Mus musculus
ggtctctatggatccctctgaagat

SEQ ID NO: 649910 - DNA, 25 bp, Mus musculus
ggtctctatgttactgagtggtttt

SEQ ID NO: 649911 - DNA, 25 bp, Mus musculus
ggtctctatgtttctgagtggtttt

SEQ ID NO: 649912 - DNA, 25 bp, Mus musculus
ggtctctattgcactgctgcagaaa

SEQ ID NO: 649913 - DNA, 25 bp, Mus musculus
ggtctctattgctctgctgcagaaa

SEQ ID NO: 649914 - DNA, 25 bp, Mus musculus
ggtctctatttcaggagcagtctga

SEQ ID NO: 649915 - DNA, 25 bp, Mus musculus
ggtctctatttctggagcagtctga

SEQ ID NO: 649916 - DNA, 25 bp, Mus musculus
ggtctctcacctcggactctgatca

SEQ ID NO: 649917 - DNA, 25 bp, Mus musculus
ggtctctcacctgggactctgatca

SEQ ID NO: 649918 - DNA, 25 bp, Mus musculus
ggtctctcagaaccattacattcag

SEQ ID NO: 649919 - DNA, 25 bp, Mus musculus
ggtctctcagaagcattacattcag

SEQ ID NO: 649920 - DNA, 25 bp, Mus musculus
ggtctctccatgagcacgaggagca

SEQ ID NO: 649921 - DNA, 25 bp, Mus musculus
ggtctctccatgtgcacgaggagca

SEQ ID NO: 649922 - DNA, 25 bp, Mus musculus
ggtctctccctgaatttagagttct

SEQ ID NO: 649923 - DNA, 25 bp, Mus musculus
ggtctctccctgtatttagagttct

SEQ ID NO: 649924 - DNA, 25 bp, Mus musculus
ggtctctcctaaactggttcgatat

SEQ ID NO: 649925 - DNA, 25 bp, Mus musculus
ggtctctcctaatctggttcgatat

SEQ ID NO: 649926 - DNA, 25 bp, Mus musculus
ggtctctcctagatggatcttctta

SEQ ID NO: 649927 - DNA, 25 bp, Mus musculus
ggtctctcctagttggatcttctta

SEQ ID NO: 649928 - DNA, 25 bp, Mus musculus
ggtctctcgtctcacttcaagtgaa

SEQ ID NO: 649929 - DNA, 25 bp, Mus musculus
ggtctctcgtctgacttcaagtgaa

SEQ ID NO: 649930 - DNA, 25 bp, Mus musculus
ggtctctctacacagctctttctgt

SEQ ID NO: 649931 - DNA, 25 bp, Mus musculus
ggtctctctacagagctctttctgt

SEQ ID NO: 649932 - DNA, 25 bp, Mus musculus
ggtctctgaaaacgagctccagtgt

SEQ ID NO: 649933 - DNA, 25 bp, Mus musculus
ggtctctgaaaaggagctccagtgt

SEQ ID NO: 649934 - DNA, 25 bp, Mus musculus
ggtctctgaaagctcctgcatgtaa

SEQ ID NO: 649935 - DNA, 25 bp, Mus musculus
ggtctctgaaaggtcctgcatgtaa

SEQ ID NO: 649936 - DNA, 25 bp, Mus musculus
ggtctctgacagcaattttttaaag

SEQ ID NO: 649937 - DNA, 25 bp, Mus musculus
ggtctctgacaggaattttttaaag

SEQ ID NO: 649938 - DNA, 25 bp, Mus musculus
ggtctctgagccagtctgtggtgac

SEQ ID NO: 649939 - DNA, 25 bp, Mus musculus
ggtctctgagcctgtctgtggtgac

SEQ ID NO: 649940 - DNA, 25 bp, Mus musculus
ggtctctgagctcgttttcttcaca

SEQ ID NO: 649941 - DNA, 25 bp, Mus musculus
ggtctctgagctggttttcttcaca

SEQ ID NO: 649942 - DNA, 25 bp, Mus musculus
ggtctctgagtcattgagtaaatca

SEQ ID NO: 649943 - DNA, 25 bp, Mus musculus
ggtctctgagtctttgagtaaatca

SEQ ID NO: 649944 - DNA, 25 bp, Mus musculus
ggtctctgatggacttaaagaacat

SEQ ID NO: 649945 - DNA, 25 bp, Mus musculus
ggtctctgatggtcttaaagaacat

SEQ ID NO: 649946 - DNA, 25 bp, Mus musculus
ggtctctgccctcttgggtaaatca

SEQ ID NO: 649947 - DNA, 25 bp, Mus musculus
ggtctctgccctgttgggtaaatca

SEQ ID NO: 649948 - DNA, 25 bp, Mus musculus
ggtctctgggagaattgccttcgaa

SEQ ID NO: 649949 - DNA, 25 bp, Mus musculus
ggtctctgggagtattgccttcgaa

SEQ ID NO: 649950 - DNA, 25 bp, Mus musculus
ggtctctgtaagcaagcttgcaagt

SEQ ID NO: 649951 - DNA, 25 bp, Mus musculus
ggtctctgtaaggaagcttgcaagt

SEQ ID NO: 649952 - DNA, 25 bp, Mus musculus
ggtctctgtaatcgaatttctccct

SEQ ID NO: 649953 - DNA, 25 bp, Mus musculus
ggtctctgtaatggaatttctccct

SEQ ID NO: 649954 - DNA, 25 bp, Mus musculus
ggtctctgtagaacatgatcaccta

SEQ ID NO: 649955 - DNA, 25 bp, Mus musculus
ggtctctgtagatcatgatcaccta

SEQ ID NO: 649956 - DNA, 25 bp, Mus musculus
ggtctctgtaggaatctgcacaaca

SEQ ID NO: 649957 - DNA, 25 bp, Mus musculus
ggtctctgtaggtatctgcacaaca

SEQ ID NO: 649958 - DNA, 25 bp, Mus musculus
ggtctctgtattatcaccccatacc

SEQ ID NO: 649959 - DNA, 25 bp, Mus musculus
ggtctctgtattcctatatatacaa

SEQ ID NO: 649960 - DNA, 25 bp, Mus musculus
ggtctctgtattcgccatgacatgg

SEQ ID NO: 649961 - DNA, 25 bp, Mus musculus
ggtctctgtattgctatatatacaa

SEQ ID NO: 649962 - DNA, 25 bp, Mus musculus
ggtctctgtattggccatgacatgg

SEQ ID NO: 649963 - DNA, 25 bp, Mus musculus
ggtctctgtattttcaccccatacc

SEQ ID NO: 649964 - DNA, 25 bp, Mus musculus
ggtctctgtctacagagtgctgttc

SEQ ID NO: 649965 - DNA, 25 bp, Mus musculus
ggtctctgtctagagagtgctgttc

SEQ ID NO: 649966 - DNA, 25 bp, Mus musculus
ggtctctgttatccctggttaagta

SEQ ID NO: 649967 - DNA, 25 bp, Mus musculus
ggtctctgttatgcctggttaagta

SEQ ID NO: 649968 - DNA, 25 bp, Mus musculus
ggtctcttacatatgcctaggctgg

SEQ ID NO: 649969 - DNA, 25 bp, Mus musculus
ggtctcttacatttgcctaggctgg

SEQ ID NO: 649970 - DNA, 25 bp, Mus musculus
ggtctcttccataagcacagccctt

SEQ ID NO: 649971 - DNA, 25 bp, Mus musculus
ggtctcttccattagcacagccctt

SEQ ID NO: 649972 - DNA, 25 bp, Mus musculus
ggtctcttcgacatagggtggtgcc

SEQ ID NO: 649973 - DNA, 25 bp, Mus musculus
ggtctcttcgacttagggtggtgcc

SEQ ID NO: 649974 - DNA, 25 bp, Mus musculus
ggtctcttctcgctcgggacagaga

SEQ ID NO: 649975 - DNA, 25 bp, Mus musculus
ggtctcttctcggtcgggacagaga

SEQ ID NO: 649976 - DNA, 25 bp, Mus musculus
ggtctcttgaccaaacatctcatga

SEQ ID NO: 649977 - DNA, 25 bp, Mus musculus
ggtctcttgacctaacatctcatga

SEQ ID NO: 649978 - DNA, 25 bp, Mus musculus
ggtctcttgcttactcatttggata

SEQ ID NO: 649979 - DNA, 25 bp, Mus musculus
ggtctcttgctttctcatttggata

SEQ ID NO: 649980 - DNA, 25 bp, Mus musculus
ggtctcttgtcccaaaatgtggaaa

SEQ ID NO: 649981 - DNA, 25 bp, Mus musculus
ggtctcttgtccgaaaatgtggaaa

SEQ ID NO: 649982 - DNA, 25 bp, Mus musculus
ggtctcttgtctcaggccatttgtg

SEQ ID NO: 649983 - DNA, 25 bp, Mus musculus
ggtctcttgtctccatttttatcaa

SEQ ID NO: 649984 - DNA, 25 bp, Mus musculus
ggtctcttgtctgaggccatttgtg

SEQ ID NO: 649985 - DNA, 25 bp, Mus musculus
ggtctcttgtctgcatttttatcaa

SEQ ID NO: 649986 - DNA, 25 bp, Mus musculus
ggtctcttgtgtcatagcccaggca

SEQ ID NO: 649987 - DNA, 25 bp, Mus musculus
ggtctcttgtgtgatagcccaggca

SEQ ID NO: 649988 - DNA, 25 bp, Mus musculus
ggtctctttaacagcaatcaactaa

SEQ ID NO: 649989 - DNA, 25 bp, Mus musculus
ggtctctttaactgcaatcaactaa

SEQ ID NO: 649990 - DNA, 25 bp, Mus musculus
ggtctctttcctctgggagtgtaac

SEQ ID NO: 649991 - DNA, 25 bp, Mus musculus
ggtctctttcctgtgggagtgtaac

SEQ ID NO: 649992 - DNA, 25 bp, Mus musculus
ggtctctttctcatgtctcagattt

SEQ ID NO: 649993 - DNA, 25 bp, Mus musculus
ggtctctttctcttgtctcagattt

SEQ ID NO: 649994 - DNA, 25 bp, Mus musculus
ggtctcttttctccccggttgctca

SEQ ID NO: 649995 - DNA, 25 bp, Mus musculus
ggtctcttttctgcccggttgctca

SEQ ID NO: 649996 - DNA, 25 bp, Mus musculus
ggtctgaaaccccatcactgtaaag

SEQ ID NO: 649997 - DNA, 25 bp, Mus musculus
ggtctgaaacccgatcactgtaaag

SEQ ID NO: 649998 - DNA, 25 bp, Mus musculus
ggtctgaaagttcgcgtgcgaacca

SEQ ID NO: 649999 - DNA, 25 bp, Mus musculus
ggtctgaaagttggcgtgcgaacca

SEQ ID NO: 650000 - DNA, 25 bp, Mus musculus
ggtctgaaatacattggcatccatt

SEQ ID NO: 650001 - DNA, 25 bp, Mus musculus
ggtctgaaatactttggcatccatt

SEQ ID NO: 650002 - DNA, 25 bp, Mus musculus
ggtctgaaatctatgtccagctttg

SEQ ID NO: 650003 - DNA, 25 bp, Mus musculus
ggtctgaaatctttgtccagctttg

SEQ ID NO: 650004 - DNA, 25 bp, Mus musculus
ggtctgaaattcatgcaagcttccg

SEQ ID NO: 650005 - DNA, 25 bp, Mus musculus
ggtctgaaattcttgcaagcttccg

SEQ ID NO: 650006 - DNA, 25 bp, Mus musculus
ggtctgaacacactgtggtgcctcc

SEQ ID NO: 650007 - DNA, 25 bp, Mus musculus
ggtctgaacacagtgtggtgcctcc

SEQ ID NO: 650008 - DNA, 25 bp, Mus musculus
ggtctgaaccacaccattaagtcgg

SEQ ID NO: 650009 - DNA, 25 bp, Mus musculus
ggtctgaaccactccattaagtcgg

SEQ ID NO: 650010 - DNA, 25 bp, Mus musculus
ggtctgaagctaagtggtcaatgat

SEQ ID NO: 650011 - DNA, 25 bp, Mus musculus
ggtctgaagctatgtggtcaatgat

SEQ ID NO: 650012 - DNA, 25 bp, Mus musculus
ggtctgaagtgcatctccaggcaga

SEQ ID NO: 650013 - DNA, 25 bp, Mus musculus
ggtctgaagtgcttctccaggcaga

SEQ ID NO: 650014 - DNA, 25 bp, Mus musculus
ggtctgaataataccttcacctgcc

SEQ ID NO: 650015 - DNA, 25 bp, Mus musculus
ggtctgaataattccttcacctgcc

SEQ ID NO: 650016 - DNA, 25 bp, Mus musculus
ggtctgaatcacatgttttgtccac

SEQ ID NO: 650017 - DNA, 25 bp, Mus musculus
ggtctgaatcacttgttttgtccac

SEQ ID NO: 650018 - DNA, 25 bp, Mus musculus
ggtctgaatcagacgcttggcgtcc

SEQ ID NO: 650019 - DNA, 25 bp, Mus musculus
ggtctgaatcagtcgcttggcgtcc

SEQ ID NO: 650020 - DNA, 25 bp, Mus musculus
ggtctgaattagaatcccacttttc

SEQ ID NO: 650021 - DNA, 25 bp, Mus musculus
ggtctgaattagtatcccacttttc

SEQ ID NO: 650022 - DNA, 25 bp, Mus musculus
ggtctgaattcacccgcagggcccg

SEQ ID NO: 650023 - DNA, 25 bp, Mus musculus
ggtctgaattcagccgcagggcccg

SEQ ID NO: 650024 - DNA, 25 bp, Mus musculus
ggtctgacagtcataagtctcaagt

SEQ ID NO: 650025 - DNA, 25 bp, Mus musculus
ggtctgacagtcttaagtctcaagt

SEQ ID NO: 650026 - DNA, 25 bp, Mus musculus
ggtctgaccagccaatgttgttttt

SEQ ID NO: 650027 - DNA, 25 bp, Mus musculus
ggtctgaccagcgaatgttgttttt

SEQ ID NO: 650028 - DNA, 25 bp, Mus musculus
ggtctgacccagatattaatgaatg

SEQ ID NO: 650029 - DNA, 25 bp, Mus musculus
ggtctgacccagttattaatgaatg

SEQ ID NO: 650030 - DNA, 25 bp, Mus musculus
ggtctgacctaacagggagttttag

SEQ ID NO: 650031 - DNA, 25 bp, Mus musculus
ggtctgacctaagagggagttttag

SEQ ID NO: 650032 - DNA, 25 bp, Mus musculus
ggtctgacctcacaactttggtgct

SEQ ID NO: 650033 - DNA, 25 bp, Mus musculus
ggtctgacctcagaactttggtgct

SEQ ID NO: 650034 - DNA, 25 bp, Mus musculus
ggtctgacgattaggcttgcctgaa

SEQ ID NO: 650035 - DNA, 25 bp, Mus musculus
ggtctgacgatttggcttgcctgaa

SEQ ID NO: 650036 - DNA, 25 bp, Mus musculus
ggtctgacggagatgtttcccgaga

SEQ ID NO: 650037 - DNA, 25 bp, Mus musculus
ggtctgacggagttgtttcccgaga

SEQ ID NO: 650038 - DNA, 25 bp, Mus musculus
ggtctgacttgcctaatagttccta

SEQ ID NO: 650039 - DNA, 25 bp, Mus musculus
ggtctgacttgcgtaatagttccta

SEQ ID NO: 650040 - DNA, 25 bp, Mus musculus
ggtctgagacaaactgacacagcta

SEQ ID NO: 650041 - DNA, 25 bp, Mus musculus
ggtctgagacaatctgacacagcta

SEQ ID NO: 650042 - DNA, 25 bp, Mus musculus
ggtctgagacacacttctggttttc

SEQ ID NO: 650043 - DNA, 25 bp, Mus musculus
ggtctgagacactcttctggttttc

SEQ ID NO: 650044 - DNA, 25 bp, Mus musculus
ggtctgagatagcagaactgccttc

SEQ ID NO: 650045 - DNA, 25 bp, Mus musculus
ggtctgagataggagaactgccttc

SEQ ID NO: 650046 - DNA, 25 bp, Mus musculus
ggtctgaggacacttcacacacaat

SEQ ID NO: 650047 - DNA, 25 bp, Mus musculus
ggtctgaggacagttcacacacaat

SEQ ID NO: 650048 - DNA, 25 bp, Mus musculus
ggtctgaggcccaaggtgtaatccc

SEQ ID NO: 650049 - DNA, 25 bp, Mus musculus
ggtctgaggccccagcaaaaccgat

SEQ ID NO: 650050 - DNA, 25 bp, Mus musculus
ggtctgaggcccgagcaaaaccgat

SEQ ID NO: 650051 - DNA, 25 bp, Mus musculus
ggtctgaggccctaggtgtaatccc

SEQ ID NO: 650052 - DNA, 25 bp, Mus musculus
ggtctgagttagctgtttactgaca

SEQ ID NO: 650053 - DNA, 25 bp, Mus musculus
ggtctgagttaggtgtttactgaca

SEQ ID NO: 650054 - DNA, 25 bp, Mus musculus
ggtctgatagacaggtctgctcaca

SEQ ID NO: 650055 - DNA, 25 bp, Mus musculus
ggtctgatagactggtctgctcaca

SEQ ID NO: 650056 - DNA, 25 bp, Mus musculus
ggtctgatcagtaaatttgtatgtg

SEQ ID NO: 650057 - DNA, 25 bp, Mus musculus
ggtctgatcagttaatttgtatgtg

SEQ ID NO: 650058 - DNA, 25 bp, Mus musculus
ggtctgatcatgcatgccccgttaa

SEQ ID NO: 650059 - DNA, 25 bp, Mus musculus
ggtctgatcatggatgccccgttaa

SEQ ID NO: 650060 - DNA, 25 bp, Mus musculus
ggtctgatgatcaaagcctactttt

SEQ ID NO: 650061 - DNA, 25 bp, Mus musculus
ggtctgatgatctaagcctactttt

SEQ ID NO: 650062 - DNA, 25 bp, Mus musculus
ggtctgatgggtcttacatctcttc

SEQ ID NO: 650063 - DNA, 25 bp, Mus musculus
ggtctgatgggtgttacatctcttc

SEQ ID NO: 650064 - DNA, 25 bp, Mus musculus
ggtctgcaaagaccccactgggatg

SEQ ID NO: 650065 - DNA, 25 bp, Mus musculus
ggtctgcaaagagcccactgggatg

SEQ ID NO: 650066 - DNA, 25 bp, Mus musculus
ggtctgcaagcaatgttgtctgaaa

SEQ ID NO: 650067 - DNA, 25 bp, Mus musculus
ggtctgcaagcattgttgtctgaaa

SEQ ID NO: 650068 - DNA, 25 bp, Mus musculus
ggtctgcaatagagaactccagggt

SEQ ID NO: 650069 - DNA, 25 bp, Mus musculus
ggtctgcaatagtgaactccagggt

SEQ ID NO: 650070 - DNA, 25 bp, Mus musculus
ggtctgcagcaaaaacaaggtccac

SEQ ID NO: 650071 - DNA, 25 bp, Mus musculus
ggtctgcagcaataacaaggtccac

SEQ ID NO: 650072 - DNA, 25 bp, Mus musculus
ggtctgcagcccagtaagtggaaca

SEQ ID NO: 650073 - DNA, 25 bp, Mus musculus
ggtctgcagccctgtaagtggaaca

SEQ ID NO: 650074 - DNA, 25 bp, Mus musculus
ggtctgcagtctctccgaaacagaa

SEQ ID NO: 650075 - DNA, 25 bp, Mus musculus
ggtctgcagtctgtccgaaacagaa

SEQ ID NO: 650076 - DNA, 25 bp, Mus musculus
ggtctgcagtttaagccaaatcctt

SEQ ID NO: 650077 - DNA, 25 bp, Mus musculus
ggtctgcagttttagccaaatcctt

SEQ ID NO: 650078 - DNA, 25 bp, Mus musculus
ggtctgcatgtcaaacgatgtgtgt

SEQ ID NO: 650079 - DNA, 25 bp, Mus musculus
ggtctgcatgtctaacgatgtgtgt

SEQ ID NO: 650080 - DNA, 25 bp, Mus musculus
ggtctgcatgtgaacaggatgcctt

SEQ ID NO: 650081 - DNA, 25 bp, Mus musculus
ggtctgcatgtgtacaggatgcctt

SEQ ID NO: 650082 - DNA, 25 bp, Mus musculus
ggtctgccaggcatgtcaacaggtt

SEQ ID NO: 650083 - DNA, 25 bp, Mus musculus
ggtctgccaggcttgtcaacaggtt

SEQ ID NO: 650084 - DNA, 25 bp, Mus musculus
ggtctgccattcaaaactgtcctga

SEQ ID NO: 650085 - DNA, 25 bp, Mus musculus
ggtctgccattcagttgtctgggcc

SEQ ID NO: 650086 - DNA, 25 bp, Mus musculus
ggtctgccattctaaactgtcctga

SEQ ID NO: 650087 - DNA, 25 bp, Mus musculus
ggtctgccattctgttgtctgggcc

SEQ ID NO: 650088 - DNA, 25 bp, Mus musculus
ggtctgcccatgagcttttagaata

SEQ ID NO: 650089 - DNA, 25 bp, Mus musculus
ggtctgcccatgtgcttttagaata

SEQ ID NO: 650090 - DNA, 25 bp, Mus musculus
ggtctgcctcacatagtttatacgt

SEQ ID NO: 650091 - DNA, 25 bp, Mus musculus
ggtctgcctcacttagtttatacgt

SEQ ID NO: 650092 - DNA, 25 bp, Mus musculus
ggtctgcctctcacttcaagggtgg

SEQ ID NO: 650093 - DNA, 25 bp, Mus musculus
ggtctgcctctctcttcaagggtgg

SEQ ID NO: 650094 - DNA, 25 bp, Mus musculus
ggtctgcgcagtccttcagggaact

SEQ ID NO: 650095 - DNA, 25 bp, Mus musculus
ggtctgcgcagtgcttcagggaact

SEQ ID NO: 650096 - DNA, 25 bp, Mus musculus
ggtctgcgcctacctatgcacatag

SEQ ID NO: 650097 - DNA, 25 bp, Mus musculus
ggtctgcgcctagctatgcacatag

SEQ ID NO: 650098 - DNA, 25 bp, Mus musculus
ggtctgctcatgactgacagctgtc

SEQ ID NO: 650099 - DNA, 25 bp, Mus musculus
ggtctgctcatgtctgacagctgtc

SEQ ID NO: 650100 - DNA, 25 bp, Mus musculus
ggtctgctcccacccgtgatgatga

SEQ ID NO: 650101 - DNA, 25 bp, Mus musculus
ggtctgctcccagccgtgatgatga

SEQ ID NO: 650102 - DNA, 25 bp, Mus musculus
ggtctgctctccagaggaacacatc

SEQ ID NO: 650103 - DNA, 25 bp, Mus musculus
ggtctgctctcctgaggaacacatc

SEQ ID NO: 650104 - DNA, 25 bp, Mus musculus
ggtctgctgagcagataggttctga

SEQ ID NO: 650105 - DNA, 25 bp, Mus musculus
ggtctgctgagctgataggttctga

SEQ ID NO: 650106 - DNA, 25 bp, Mus musculus
ggtctgctggccaagaagtctggac

SEQ ID NO: 650107 - DNA, 25 bp, Mus musculus
ggtctgctggcctagaagtctggac

SEQ ID NO: 650108 - DNA, 25 bp, Mus musculus
ggtctgctgtgaatcaaactgttgt

SEQ ID NO: 650109 - DNA, 25 bp, Mus musculus
ggtctgctgtgattcaaactgttgt

SEQ ID NO: 650110 - DNA, 25 bp, Mus musculus
ggtctgctgtgccttctggactttc

SEQ ID NO: 650111 - DNA, 25 bp, Mus musculus
ggtctgctgtgcgttctggactttc

SEQ ID NO: 650112 - DNA, 25 bp, Mus musculus
ggtctgctgtggcttcatagtctcc

SEQ ID NO: 650113 - DNA, 25 bp, Mus musculus
ggtctgctgtgggttcatagtctcc

SEQ ID NO: 650114 - DNA, 25 bp, Mus musculus
ggtctgcttcgcatgacttgctcag

SEQ ID NO: 650115 - DNA, 25 bp, Mus musculus
ggtctgcttcgcttgacttgctcag

SEQ ID NO: 650116 - DNA, 25 bp, Mus musculus
ggtctgcttggcacattattataat

SEQ ID NO: 650117 - DNA, 25 bp, Mus musculus
ggtctgcttggctcattattataat

SEQ ID NO: 650118 - DNA, 25 bp, Mus musculus
ggtctgctttggctagtcaagtcta

SEQ ID NO: 650119 - DNA, 25 bp, Mus musculus
ggtctgctttgggtagtcaagtcta

SEQ ID NO: 650120 - DNA, 25 bp, Mus musculus
ggtctggaatccattattggttcag

SEQ ID NO: 650121 - DNA, 25 bp, Mus musculus
ggtctggaatcctttattggttcag

SEQ ID NO: 650122 - DNA, 25 bp, Mus musculus
ggtctggaatgcaaaacgccggaag

SEQ ID NO: 650123 - DNA, 25 bp, Mus musculus
ggtctggaatgctaaacgccggaag

SEQ ID NO: 650124 - DNA, 25 bp, Mus musculus
ggtctggaccataaactcaacttga

SEQ ID NO: 650125 - DNA, 25 bp, Mus musculus
ggtctggaccattaactcaacttga

SEQ ID NO: 650126 - DNA, 25 bp, Mus musculus
ggtctggaccttatgtttagcattc

SEQ ID NO: 650127 - DNA, 25 bp, Mus musculus
ggtctggaccttttgtttagcattc

SEQ ID NO: 650128 - DNA, 25 bp, Mus musculus
ggtctggacgaccactccactggta

SEQ ID NO: 650129 - DNA, 25 bp, Mus musculus
ggtctggacgacgactccactggta

SEQ ID NO: 650130 - DNA, 25 bp, Mus musculus
ggtctggacgtgcttttacaagaaa

SEQ ID NO: 650131 - DNA, 25 bp, Mus musculus
ggtctggacgtggttttacaagaaa

SEQ ID NO: 650132 - DNA, 25 bp, Mus musculus
ggtctggactgtcttcagctattaa

SEQ ID NO: 650133 - DNA, 25 bp, Mus musculus
ggtctggactgtgttcagctattaa

SEQ ID NO: 650134 - DNA, 25 bp, Mus musculus
ggtctggagacccttcgcctgaagc

SEQ ID NO: 650135 - DNA, 25 bp, Mus musculus
ggtctggagaccgttcgcctgaagc

SEQ ID NO: 650136 - DNA, 25 bp, Mus musculus
ggtctggaggaccaagctcagttcc

SEQ ID NO: 650137 - DNA, 25 bp, Mus musculus
ggtctggaggacgaagctcagttcc

SEQ ID NO: 650138 - DNA, 25 bp, Mus musculus
ggtctggaggctcgacagttcatca

SEQ ID NO: 650139 - DNA, 25 bp, Mus musculus
ggtctggaggctggacagttcatca

SEQ ID NO: 650140 - DNA, 25 bp, Mus musculus
ggtctggatattagtgccatcgcaa

SEQ ID NO: 650141 - DNA, 25 bp, Mus musculus
ggtctggatatttgtgccatcgcaa

SEQ ID NO: 650142 - DNA, 25 bp, Mus musculus
ggtctggatgaaagctgactgtcag

SEQ ID NO: 650143 - DNA, 25 bp, Mus musculus
ggtctggatgaatgctgactgtcag

SEQ ID NO: 650144 - DNA, 25 bp, Mus musculus
ggtctggcaaatagcaaatctcccc

SEQ ID NO: 650145 - DNA, 25 bp, Mus musculus
ggtctggcaaattgcaaatctcccc

SEQ ID NO: 650146 - DNA, 25 bp, Mus musculus
ggtctggcaacaacatccaaaggtg

SEQ ID NO: 650147 - DNA, 25 bp, Mus musculus
ggtctggcaacatcatccaaaggtg

SEQ ID NO: 650148 - DNA, 25 bp, Mus musculus
ggtctggcacctaagattgctgtcc

SEQ ID NO: 650149 - DNA, 25 bp, Mus musculus
ggtctggcaccttagattgctgtcc

SEQ ID NO: 650150 - DNA, 25 bp, Mus musculus
ggtctggccacgcaaagaacgcctt

SEQ ID NO: 650151 - DNA, 25 bp, Mus musculus
ggtctggccacggaaagaacgcctt

SEQ ID NO: 650152 - DNA, 25 bp, Mus musculus
ggtctggcccaactctgagcagaac

SEQ ID NO: 650153 - DNA, 25 bp, Mus musculus
ggtctggcccaagtctgagcagaac

SEQ ID NO: 650154 - DNA, 25 bp, Mus musculus
ggtctggcccttagtgtgtaggcta

SEQ ID NO: 650155 - DNA, 25 bp, Mus musculus
ggtctggccctttgtgtgtaggcta

SEQ ID NO: 650156 - DNA, 25 bp, Mus musculus
ggtctggccgtaaccatcgtgagaa

SEQ ID NO: 650157 - DNA, 25 bp, Mus musculus
ggtctggccgtatccatcgtgagaa

SEQ ID NO: 650158 - DNA, 25 bp, Mus musculus
ggtctgggaattagtctggccacca

SEQ ID NO: 650159 - DNA, 25 bp, Mus musculus
ggtctgggaatttgtctggccacca

SEQ ID NO: 650160 - DNA, 25 bp, Mus musculus
ggtctgggacctcaacatttttaat

SEQ ID NO: 650161 - DNA, 25 bp, Mus musculus
ggtctgggacctgaacatttttaat

SEQ ID NO: 650162 - DNA, 25 bp, Mus musculus
ggtctgggctagaagggcctccatc

SEQ ID NO: 650163 - DNA, 25 bp, Mus musculus
ggtctgggctagtagggcctccatc

SEQ ID NO: 650164 - DNA, 25 bp, Mus musculus
ggtctgggtgcacaaacatcactga

SEQ ID NO: 650165 - DNA, 25 bp, Mus musculus
ggtctgggtgcagaaacatcactga

SEQ ID NO: 650166 - DNA, 25 bp, Mus musculus
ggtctgggttctcaaacctgacatt

SEQ ID NO: 650167 - DNA, 25 bp, Mus musculus
ggtctgggttctgaaacctgacatt

SEQ ID NO: 650168 - DNA, 25 bp, Mus musculus
ggtctggtaagaaactgaaaagtcc

SEQ ID NO: 650169 - DNA, 25 bp, Mus musculus
ggtctggtaagatactgaaaagtcc

SEQ ID NO: 650170 - DNA, 25 bp, Mus musculus
ggtctggtacctattttgagcacta

SEQ ID NO: 650171 - DNA, 25 bp, Mus musculus
ggtctggtacctcagcattgtcaaa

SEQ ID NO: 650172 - DNA, 25 bp, Mus musculus
ggtctggtacctgagcattgtcaaa

SEQ ID NO: 650173 - DNA, 25 bp, Mus musculus
ggtctggtaccttttttgagcacta

SEQ ID NO: 650174 - DNA, 25 bp, Mus musculus
ggtctggtctggagatcattgtcgc

SEQ ID NO: 650175 - DNA, 25 bp, Mus musculus
ggtctggtctggtgatcattgtcgc

SEQ ID NO: 650176 - DNA, 25 bp, Mus musculus
ggtctggtgccaagattgtcgtttg

SEQ ID NO: 650177 - DNA, 25 bp, Mus musculus
ggtctggtgccatgattgtcgtttg

SEQ ID NO: 650178 - DNA, 25 bp, Mus musculus
ggtctggtgggtactgaatgtttaa

SEQ ID NO: 650179 - DNA, 25 bp, Mus musculus
ggtctggtgggttctgaatgtttaa

SEQ ID NO: 650180 - DNA, 25 bp, Mus musculus
ggtctggttggcctatgtgaattcc

SEQ ID NO: 650181 - DNA, 25 bp, Mus musculus
ggtctggttggcgtatgtgaattcc

SEQ ID NO: 650182 - DNA, 25 bp, Mus musculus
ggtctggtttctctaaaagccctgt

SEQ ID NO: 650183 - DNA, 25 bp, Mus musculus
ggtctggtttctgtaaaagccctgt

SEQ ID NO: 650184 - DNA, 25 bp, Mus musculus
ggtctgtaacccactaggctatttt

SEQ ID NO: 650185 - DNA, 25 bp, Mus musculus
ggtctgtaacccctgtgttgtcatg

SEQ ID NO: 650186 - DNA, 25 bp, Mus musculus
ggtctgtaacccgtgtgttgtcatg

SEQ ID NO: 650187 - DNA, 25 bp, Mus musculus
ggtctgtaaccctctaggctatttt

SEQ ID NO: 650188 - DNA, 25 bp, Mus musculus
ggtctgtaagtcacattgcatatga

SEQ ID NO: 650189 - DNA, 25 bp, Mus musculus
ggtctgtaagtctcattgcatatga

SEQ ID NO: 650190 - DNA, 25 bp, Mus musculus
ggtctgtaatcactgcccaagtgct

SEQ ID NO: 650191 - DNA, 25 bp, Mus musculus
ggtctgtaatcagtgcccaagtgct

SEQ ID NO: 650192 - DNA, 25 bp, Mus musculus
ggtctgtacatgactgctggtgtga

SEQ ID NO: 650193 - DNA, 25 bp, Mus musculus
ggtctgtacatgtctgctggtgtga

SEQ ID NO: 650194 - DNA, 25 bp, Mus musculus
ggtctgtaccagaaagcatccatta

SEQ ID NO: 650195 - DNA, 25 bp, Mus musculus
ggtctgtaccagtaagcatccatta

SEQ ID NO: 650196 - DNA, 25 bp, Mus musculus
ggtctgtacttcagtgacaatccga

SEQ ID NO: 650197 - DNA, 25 bp, Mus musculus
ggtctgtacttctgtgacaatccga

SEQ ID NO: 650198 - DNA, 25 bp, Mus musculus
ggtctgtagattcagcccactgatg

SEQ ID NO: 650199 - DNA, 25 bp, Mus musculus
ggtctgtagattgagcccactgatg

SEQ ID NO: 650200 - DNA, 25 bp, Mus musculus
ggtctgtagctcagcggttgcctat

SEQ ID NO: 650201 - DNA, 25 bp, Mus musculus
ggtctgtagctctgcggttgcctat

SEQ ID NO: 650202 - DNA, 25 bp, Mus musculus
ggtctgtagtagcaatgttttaatc

SEQ ID NO: 650203 - DNA, 25 bp, Mus musculus
ggtctgtagtaggaatgttttaatc

SEQ ID NO: 650204 - DNA, 25 bp, Mus musculus
ggtctgtagtcacctgttagtctat

SEQ ID NO: 650205 - DNA, 25 bp, Mus musculus
ggtctgtagtcagctgttagtctat

SEQ ID NO: 650206 - DNA, 25 bp, Mus musculus
ggtctgtatcagattcaggacagcc

SEQ ID NO: 650207 - DNA, 25 bp, Mus musculus
ggtctgtatcagtttcaggacagcc

SEQ ID NO: 650208 - DNA, 25 bp, Mus musculus
ggtctgtattacatccgaaaacttg

SEQ ID NO: 650209 - DNA, 25 bp, Mus musculus
ggtctgtattacttccgaaaacttg

SEQ ID NO: 650210 - DNA, 25 bp, Mus musculus
ggtctgtcaggccactctctaactg

SEQ ID NO: 650211 - DNA, 25 bp, Mus musculus
ggtctgtcaggcgactctctaactg

SEQ ID NO: 650212 - DNA, 25 bp, Mus musculus
ggtctgtcatgcaccttgcaggagg

SEQ ID NO: 650213 - DNA, 25 bp, Mus musculus
ggtctgtcatgctccttgcaggagg

SEQ ID NO: 650214 - DNA, 25 bp, Mus musculus
ggtctgtcatttaaagaattagcac

SEQ ID NO: 650215 - DNA, 25 bp, Mus musculus
ggtctgtcattttaagaattagcac

SEQ ID NO: 650216 - DNA, 25 bp, Mus musculus
ggtctgtccaggcatagccaaaaat

SEQ ID NO: 650217 - DNA, 25 bp, Mus musculus
ggtctgtccagggatagccaaaaat

SEQ ID NO: 650218 - DNA, 25 bp, Mus musculus
ggtctgtccgggcactcatcttgaa

SEQ ID NO: 650219 - DNA, 25 bp, Mus musculus
ggtctgtccggggactcatcttgaa

SEQ ID NO: 650220 - DNA, 25 bp, Mus musculus
ggtctgtcctgcctttgccttgctc

SEQ ID NO: 650221 - DNA, 25 bp, Mus musculus
ggtctgtcctgcgtttgccttgctc

SEQ ID NO: 650222 - DNA, 25 bp, Mus musculus
ggtctgtcctttatgagagccgtga

SEQ ID NO: 650223 - DNA, 25 bp, Mus musculus
ggtctgtcctttttgagagccgtga

SEQ ID NO: 650224 - DNA, 25 bp, Mus musculus
ggtctgtctcatctttattttactg

SEQ ID NO: 650225 - DNA, 25 bp, Mus musculus
ggtctgtctcatgtttattttactg

SEQ ID NO: 650226 - DNA, 25 bp, Mus musculus
ggtctgtctggtataatagtctttc

SEQ ID NO: 650227 - DNA, 25 bp, Mus musculus
ggtctgtctggtttaatagtctttc

SEQ ID NO: 650228 - DNA, 25 bp, Mus musculus
ggtctgtcttagagagacgctccac

SEQ ID NO: 650229 - DNA, 25 bp, Mus musculus
ggtctgtcttagtgagacgctccac

SEQ ID NO: 650230 - DNA, 25 bp, Mus musculus
ggtctgtctttacaaagctcagcct

SEQ ID NO: 650231 - DNA, 25 bp, Mus musculus
ggtctgtctttagaaagctcagcct

SEQ ID NO: 650232 - DNA, 25 bp, Mus musculus
ggtctgtctttcagttctgtttcaa

SEQ ID NO: 650233 - DNA, 25 bp, Mus musculus
ggtctgtctttctgttctgtttcaa

SEQ ID NO: 650234 - DNA, 25 bp, Mus musculus
ggtctgtgaccccaggcttgcactg

SEQ ID NO: 650235 - DNA, 25 bp, Mus musculus
ggtctgtgacccgaggcttgcactg

SEQ ID NO: 650236 - DNA, 25 bp, Mus musculus
ggtctgtgatacactgattgggttc

SEQ ID NO: 650237 - DNA, 25 bp, Mus musculus
ggtctgtgatactctgattgggttc

SEQ ID NO: 650238 - DNA, 25 bp, Mus musculus
ggtctgtggcataaagtgctgctaa

SEQ ID NO: 650239 - DNA, 25 bp, Mus musculus
ggtctgtggcattaagtgctgctaa

SEQ ID NO: 650240 - DNA, 25 bp, Mus musculus
ggtctgtggcctctcattataatgt

SEQ ID NO: 650241 - DNA, 25 bp, Mus musculus
ggtctgtggcctgtcattataatgt

SEQ ID NO: 650242 - DNA, 25 bp, Mus musculus
ggtctgtggcttagaaggcacttca

SEQ ID NO: 650243 - DNA, 25 bp, Mus musculus
ggtctgtggctttgaaggcacttca

SEQ ID NO: 650244 - DNA, 25 bp, Mus musculus
ggtctgtgggttcacactggttctt

SEQ ID NO: 650245 - DNA, 25 bp, Mus musculus
ggtctgtgggttgacactggttctt

SEQ ID NO: 650246 - DNA, 25 bp, Mus musculus
ggtctgtggtcgatcctgctgtgac

SEQ ID NO: 650247 - DNA, 25 bp, Mus musculus
ggtctgtggtcgttcctgctgtgac

SEQ ID NO: 650248 - DNA, 25 bp, Mus musculus
ggtctgtgtacccttctctcgtaga

SEQ ID NO: 650249 - DNA, 25 bp, Mus musculus
ggtctgtgtaccgttctctcgtaga

SEQ ID NO: 650250 - DNA, 25 bp, Mus musculus
ggtctgtgtacgctcacttccccat

SEQ ID NO: 650251 - DNA, 25 bp, Mus musculus
ggtctgtgtacggtcacttccccat

SEQ ID NO: 650252 - DNA, 25 bp, Mus musculus
ggtctgtgtcatccatgtacatagg

SEQ ID NO: 650253 - DNA, 25 bp, Mus musculus
ggtctgtgtcatctactgtgtggca

SEQ ID NO: 650254 - DNA, 25 bp, Mus musculus
ggtctgtgtcatgcatgtacatagg

SEQ ID NO: 650255 - DNA, 25 bp, Mus musculus
ggtctgtgtcatgtactgtgtggca

SEQ ID NO: 650256 - DNA, 25 bp, Mus musculus
ggtctgtgtcgccttcttgtaaatg

SEQ ID NO: 650257 - DNA, 25 bp, Mus musculus
ggtctgtgtcgcgttcttgtaaatg

SEQ ID NO: 650258 - DNA, 25 bp, Mus musculus
ggtctgtgtgtccatgtttcagttt

SEQ ID NO: 650259 - DNA, 25 bp, Mus musculus
ggtctgtgtgtcgatgtttcagttt

SEQ ID NO: 650260 - DNA, 25 bp, Mus musculus
ggtctgtgttccactacagattcta

SEQ ID NO: 650261 - DNA, 25 bp, Mus musculus
ggtctgtgttcctctacagattcta

SEQ ID NO: 650262 - DNA, 25 bp, Mus musculus
ggtctgttacttaatcttatttttg

SEQ ID NO: 650263 - DNA, 25 bp, Mus musculus
ggtctgttacttatactatcacaaa

SEQ ID NO: 650264 - DNA, 25 bp, Mus musculus
ggtctgttactttatcttatttttg

SEQ ID NO: 650265 - DNA, 25 bp, Mus musculus
ggtctgttacttttactatcacaaa

SEQ ID NO: 650266 - DNA, 25 bp, Mus musculus
ggtctgttatctattcactcatgga

SEQ ID NO: 650267 - DNA, 25 bp, Mus musculus
ggtctgttatcttttcactcatgga

SEQ ID NO: 650268 - DNA, 25 bp, Mus musculus
ggtctgttatgtagcctagctgtcc

SEQ ID NO: 650269 - DNA, 25 bp, Mus musculus
ggtctgttatgttgcctagctgtcc

SEQ ID NO: 650270 - DNA, 25 bp, Mus musculus
ggtctgttcataattaatgccctgt

SEQ ID NO: 650271 - DNA, 25 bp, Mus musculus
ggtctgttcatatttaatgccctgt

SEQ ID NO: 650272 - DNA, 25 bp, Mus musculus
ggtctgttccagatgtttgcatgta

SEQ ID NO: 650273 - DNA, 25 bp, Mus musculus
ggtctgttccagttgtttgcatgta

SEQ ID NO: 650274 - DNA, 25 bp, Mus musculus
ggtctgttcgtcattgcccatgata

SEQ ID NO: 650275 - DNA, 25 bp, Mus musculus
ggtctgttcgtctttgcccatgata

SEQ ID NO: 650276 - DNA, 25 bp, Mus musculus
ggtctgttgaccactttagaagttt

SEQ ID NO: 650277 - DNA, 25 bp, Mus musculus
ggtctgttgacctctttagaagttt

SEQ ID NO: 650278 - DNA, 25 bp, Mus musculus
ggtctgttgcatcagtctgggccct

SEQ ID NO: 650279 - DNA, 25 bp, Mus musculus
ggtctgttgcatgagtctgggccct

SEQ ID NO: 650280 - DNA, 25 bp, Mus musculus
ggtctgttgctactttgtttgctat

SEQ ID NO: 650281 - DNA, 25 bp, Mus musculus
ggtctgttgctagtttgtttgctat

SEQ ID NO: 650282 - DNA, 25 bp, Mus musculus
ggtctgttgcttctgagcttgagaa

SEQ ID NO: 650283 - DNA, 25 bp, Mus musculus
ggtctgttgcttgtgagcttgagaa

SEQ ID NO: 650284 - DNA, 25 bp, Mus musculus
ggtctgtttcagaccctaaaatggg

SEQ ID NO: 650285 - DNA, 25 bp, Mus musculus
ggtctgtttcagtccctaaaatggg

SEQ ID NO: 650286 - DNA, 25 bp, Mus musculus
ggtctgtttgttcccaggccaggaa

SEQ ID NO: 650287 - DNA, 25 bp, Mus musculus
ggtctgtttgttgccaggccaggaa

SEQ ID NO: 650288 - DNA, 25 bp, Mus musculus
ggtcttaaacagaaatcgcttgaaa

SEQ ID NO: 650289 - DNA, 25 bp, Mus musculus
ggtcttaaacagtaatcgcttgaaa

SEQ ID NO: 650290 - DNA, 25 bp, Mus musculus
ggtcttaaagaacattagaaccctg

SEQ ID NO: 650291 - DNA, 25 bp, Mus musculus
ggtcttaaagaagattagaaccctg

SEQ ID NO: 650292 - DNA, 25 bp, Mus musculus
ggtcttaagataaagctcagtagca

SEQ ID NO: 650293 - DNA, 25 bp, Mus musculus
ggtcttaagatatagctcagtagca

SEQ ID NO: 650294 - DNA, 25 bp, Mus musculus
ggtcttaagctactcaacttgccag

SEQ ID NO: 650295 - DNA, 25 bp, Mus musculus
ggtcttaagctagtcaacttgccag

SEQ ID NO: 650296 - DNA, 25 bp, Mus musculus
ggtcttaatccaagtacactttttt

SEQ ID NO: 650297 - DNA, 25 bp, Mus musculus
ggtcttaatccatgtacactttttt

SEQ ID NO: 650298 - DNA, 25 bp, Mus musculus
ggtcttacaaacagtgtatgtccca

SEQ ID NO: 650299 - DNA, 25 bp, Mus musculus
ggtcttacaaactgtgtatgtccca

SEQ ID NO: 650300 - DNA, 25 bp, Mus musculus
ggtcttacatacaacatccatgcac

SEQ ID NO: 650301 - DNA, 25 bp, Mus musculus
ggtcttacatactacatccatgcac

SEQ ID NO: 650302 - DNA, 25 bp, Mus musculus
ggtcttacgatcacacttttgctaa

SEQ ID NO: 650303 - DNA, 25 bp, Mus musculus
ggtcttacgatctcacttttgctaa

SEQ ID NO: 650304 - DNA, 25 bp, Mus musculus
ggtcttactacgatggagcctcaca

SEQ ID NO: 650305 - DNA, 25 bp, Mus musculus
ggtcttactacgttggagcctcaca

SEQ ID NO: 650306 - DNA, 25 bp, Mus musculus
ggtcttactcatccgacaaatattt

SEQ ID NO: 650307 - DNA, 25 bp, Mus musculus
ggtcttactcatgcgacaaatattt

SEQ ID NO: 650308 - DNA, 25 bp, Mus musculus
ggtcttactcctcgaaatcccaaca

SEQ ID NO: 650309 - DNA, 25 bp, Mus musculus
ggtcttactcctggaaatcccaaca

SEQ ID NO: 650310 - DNA, 25 bp, Mus musculus
ggtcttactctcagcaaaggaggca

SEQ ID NO: 650311 - DNA, 25 bp, Mus musculus
ggtcttactctctgcaaaggaggca

SEQ ID NO: 650312 - DNA, 25 bp, Mus musculus
ggtcttacttgtacccgagggtgca

SEQ ID NO: 650313 - DNA, 25 bp, Mus musculus
ggtcttacttgttcccgagggtgca

SEQ ID NO: 650314 - DNA, 25 bp, Mus musculus
ggtcttactttactgggactcaagc

SEQ ID NO: 650315 - DNA, 25 bp, Mus musculus
ggtcttactttagtgggactcaagc

SEQ ID NO: 650316 - DNA, 25 bp, Mus musculus
ggtcttagacataggttctgttctg

SEQ ID NO: 650317 - DNA, 25 bp, Mus musculus
ggtcttagacattggttctgttctg

SEQ ID NO: 650318 - DNA, 25 bp, Mus musculus
ggtcttagaccactgtaagcttttt

SEQ ID NO: 650319 - DNA, 25 bp, Mus musculus
ggtcttagaccagtgtaagcttttt

SEQ ID NO: 650320 - DNA, 25 bp, Mus musculus
ggtcttagacccatcaagcttgagg

SEQ ID NO: 650321 - DNA, 25 bp, Mus musculus
ggtcttagacccttcaagcttgagg

SEQ ID NO: 650322 - DNA, 25 bp, Mus musculus
ggtcttagactccacttcatataaa

SEQ ID NO: 650323 - DNA, 25 bp, Mus musculus
ggtcttagactcgacttcatataaa

SEQ ID NO: 650324 - DNA, 25 bp, Mus musculus
ggtcttagcatcaacccatcctgag

SEQ ID NO: 650325 - DNA, 25 bp, Mus musculus
ggtcttagcatctacccatcctgag

SEQ ID NO: 650326 - DNA, 25 bp, Mus musculus
ggtcttagcattaaatattcagcaa

SEQ ID NO: 650327 - DNA, 25 bp, Mus musculus
ggtcttagcatttaatattcagcaa

SEQ ID NO: 650328 - DNA, 25 bp, Mus musculus
ggtcttaggattacgaattccagct

SEQ ID NO: 650329 - DNA, 25 bp, Mus musculus
ggtcttaggatttcgaattccagct

SEQ ID NO: 650330 - DNA, 25 bp, Mus musculus
ggtcttataaccagcgtctgacttc

SEQ ID NO: 650331 - DNA, 25 bp, Mus musculus
ggtcttataacctgcgtctgacttc

SEQ ID NO: 650332 - DNA, 25 bp, Mus musculus
ggtcttataagacagcctgcatcag

SEQ ID NO: 650333 - DNA, 25 bp, Mus musculus
ggtcttataagagagcctgcatcag

SEQ ID NO: 650334 - DNA, 25 bp, Mus musculus
ggtcttatatgtacagcaggcctgg

SEQ ID NO: 650335 - DNA, 25 bp, Mus musculus
ggtcttatatgttcagcaggcctgg

SEQ ID NO: 650336 - DNA, 25 bp, Mus musculus
ggtcttatcaacactttagctctta

SEQ ID NO: 650337 - DNA, 25 bp, Mus musculus
ggtcttatcaactctttagctctta

SEQ ID NO: 650338 - DNA, 25 bp, Mus musculus
ggtcttatccccaaagaggccagct

SEQ ID NO: 650339 - DNA, 25 bp, Mus musculus
ggtcttatcccctaagaggccagct

SEQ ID NO: 650340 - DNA, 25 bp, Mus musculus
ggtcttatgacccactgttctgaga

SEQ ID NO: 650341 - DNA, 25 bp, Mus musculus
ggtcttatgaccgactgttctgaga

SEQ ID NO: 650342 - DNA, 25 bp, Mus musculus
ggtcttatgattatattaccgaaat

SEQ ID NO: 650343 - DNA, 25 bp, Mus musculus
ggtcttatgattttattaccgaaat

SEQ ID NO: 650344 - DNA, 25 bp, Mus musculus
ggtcttatgccaacttgacacacaa

SEQ ID NO: 650345 - DNA, 25 bp, Mus musculus
ggtcttatgccatcttgacacacaa

SEQ ID NO: 650346 - DNA, 25 bp, Mus musculus
ggtcttattctgactctcaagtgta

SEQ ID NO: 650347 - DNA, 25 bp, Mus musculus
ggtcttattctgtctctcaagtgta

SEQ ID NO: 650348 - DNA, 25 bp, Mus musculus
ggtcttattcttcccagatgggatg

SEQ ID NO: 650349 - DNA, 25 bp, Mus musculus
ggtcttattcttgccagatgggatg

SEQ ID NO: 650350 - DNA, 25 bp, Mus musculus
ggtcttatttagaccctcctgttat

SEQ ID NO: 650351 - DNA, 25 bp, Mus musculus
ggtcttatttagtccctcctgttat

SEQ ID NO: 650352 - DNA, 25 bp, Mus musculus
ggtcttcaaacacgacaaacgtcct

SEQ ID NO: 650353 - DNA, 25 bp, Mus musculus
ggtcttcaaacaggacaaacgtcct

SEQ ID NO: 650354 - DNA, 25 bp, Mus musculus
ggtcttcaaaccatcaataggcaac

SEQ ID NO: 650355 - DNA, 25 bp, Mus musculus
ggtcttcaaaccttcaataggcaac

SEQ ID NO: 650356 - DNA, 25 bp, Mus musculus
ggtcttcaagcgattgcacagatgt

SEQ ID NO: 650357 - DNA, 25 bp, Mus musculus
ggtcttcaagcgtttgcacagatgt

SEQ ID NO: 650358 - DNA, 25 bp, Mus musculus
ggtcttcacagccttctggcagaat

SEQ ID NO: 650359 - DNA, 25 bp, Mus musculus
ggtcttcacagcgttctggcagaat

SEQ ID NO: 650360 - DNA, 25 bp, Mus musculus
ggtcttcactctagatgtggcttta

SEQ ID NO: 650361 - DNA, 25 bp, Mus musculus
ggtcttcactcttgatgtggcttta

SEQ ID NO: 650362 - DNA, 25 bp, Mus musculus
ggtcttcacttgctacatgtggcag

SEQ ID NO: 650363 - DNA, 25 bp, Mus musculus
ggtcttcacttggtacatgtggcag

SEQ ID NO: 650364 - DNA, 25 bp, Mus musculus
ggtcttcagaacaagggctcacctt

SEQ ID NO: 650365 - DNA, 25 bp, Mus musculus
ggtcttcagaactagggctcacctt

SEQ ID NO: 650366 - DNA, 25 bp, Mus musculus
ggtcttcagacaagtccatgtttta

SEQ ID NO: 650367 - DNA, 25 bp, Mus musculus
ggtcttcagacaagtggaacaggtg

SEQ ID NO: 650368 - DNA, 25 bp, Mus musculus
ggtcttcagacatgtccatgtttta

SEQ ID NO: 650369 - DNA, 25 bp, Mus musculus
ggtcttcagacatgtggaacaggtg

SEQ ID NO: 650370 - DNA, 25 bp, Mus musculus
ggtcttcagatacgttttagcacag

SEQ ID NO: 650371 - DNA, 25 bp, Mus musculus
ggtcttcagataggttttagcacag

SEQ ID NO: 650372 - DNA, 25 bp, Mus musculus
ggtcttcagcgacctcttgctaaaa

SEQ ID NO: 650373 - DNA, 25 bp, Mus musculus
ggtcttcagcgagctcttgctaaaa

SEQ ID NO: 650374 - DNA, 25 bp, Mus musculus
ggtcttcaggctctttcccatcact

SEQ ID NO: 650375 - DNA, 25 bp, Mus musculus
ggtcttcaggctgtttcccatcact

SEQ ID NO: 650376 - DNA, 25 bp, Mus musculus
ggtcttcagtggctaaatgtgcata

SEQ ID NO: 650377 - DNA, 25 bp, Mus musculus
ggtcttcagtgggtaaatgtgcata

SEQ ID NO: 650378 - DNA, 25 bp, Mus musculus
ggtcttccaaagctgtccatgtgtg

SEQ ID NO: 650379 - DNA, 25 bp, Mus musculus
ggtcttccaaaggtgtccatgtgtg

SEQ ID NO: 650380 - DNA, 25 bp, Mus musculus
ggtcttccagctatattcatttcaa

SEQ ID NO: 650381 - DNA, 25 bp, Mus musculus
ggtcttccagctttattcatttcaa

SEQ ID NO: 650382 - DNA, 25 bp, Mus musculus
ggtcttcccaacaggtgggaggatc

SEQ ID NO: 650383 - DNA, 25 bp, Mus musculus
ggtcttcccaactggtgggaggatc

SEQ ID NO: 650384 - DNA, 25 bp, Mus musculus
ggtcttcccaagctagcggatttcc

SEQ ID NO: 650385 - DNA, 25 bp, Mus musculus
ggtcttcccaaggtagcggatttcc

SEQ ID NO: 650386 - DNA, 25 bp, Mus musculus
ggtcttcctgaacttttgtctgttc

SEQ ID NO: 650387 - DNA, 25 bp, Mus musculus
ggtcttcctgaagttttgtctgttc

SEQ ID NO: 650388 - DNA, 25 bp, Mus musculus
ggtcttcctgtaaacactgcattag

SEQ ID NO: 650389 - DNA, 25 bp, Mus musculus
ggtcttcctgtatacactgcattag

SEQ ID NO: 650390 - DNA, 25 bp, Mus musculus
ggtcttccttacacccagagggcag

SEQ ID NO: 650391 - DNA, 25 bp, Mus musculus
ggtcttccttactcccagagggcag

SEQ ID NO: 650392 - DNA, 25 bp, Mus musculus
ggtcttcctttcctatgagtgcttt

SEQ ID NO: 650393 - DNA, 25 bp, Mus musculus
ggtcttcctttcgtatgagtgcttt

SEQ ID NO: 650394 - DNA, 25 bp, Mus musculus
ggtcttcgaaaacattcttctacat

SEQ ID NO: 650395 - DNA, 25 bp, Mus musculus
ggtcttcgaaaagattcttctacat

SEQ ID NO: 650396 - DNA, 25 bp, Mus musculus
ggtcttcgacttccagttgagtgag

SEQ ID NO: 650397 - DNA, 25 bp, Mus musculus
ggtcttcgacttgcagttgagtgag

SEQ ID NO: 650398 - DNA, 25 bp, Mus musculus
ggtcttcgcataaattcgatatctt

SEQ ID NO: 650399 - DNA, 25 bp, Mus musculus
ggtcttcgcatatattcgatatctt

SEQ ID NO: 650400 - DNA, 25 bp, Mus musculus
ggtcttctatgtagattccttggag

SEQ ID NO: 650401 - DNA, 25 bp, Mus musculus
ggtcttctatgttgattccttggag

SEQ ID NO: 650402 - DNA, 25 bp, Mus musculus
ggtcttctcaccatagagaacatca

SEQ ID NO: 650403 - DNA, 25 bp, Mus musculus
ggtcttctcaccttagagaacatca

SEQ ID NO: 650404 - DNA, 25 bp, Mus musculus
ggtcttctctgcaccgggaaacaga

SEQ ID NO: 650405 - DNA, 25 bp, Mus musculus
ggtcttctctgctccgggaaacaga

SEQ ID NO: 650406 - DNA, 25 bp, Mus musculus
ggtcttctcttaattccagatttac

SEQ ID NO: 650407 - DNA, 25 bp, Mus musculus
ggtcttctcttatttccagatttac

SEQ ID NO: 650408 - DNA, 25 bp, Mus musculus
ggtcttctgaagctaccattggcaa

SEQ ID NO: 650409 - DNA, 25 bp, Mus musculus
ggtcttctgaaggtaccattggcaa

SEQ ID NO: 650410 - DNA, 25 bp, Mus musculus
ggtcttctgcacatcaggattggta

SEQ ID NO: 650411 - DNA, 25 bp, Mus musculus
ggtcttctgcacttcaggattggta

SEQ ID NO: 650412 - DNA, 25 bp, Mus musculus
ggtcttctgcgcatttatgaaccag

SEQ ID NO: 650413 - DNA, 25 bp, Mus musculus
ggtcttctgcgcttttatgaaccag

SEQ ID NO: 650414 - DNA, 25 bp, Mus musculus
ggtcttctgctcaagctttttcaaa

SEQ ID NO: 650415 - DNA, 25 bp, Mus musculus
ggtcttctgctctagctttttcaaa

SEQ ID NO: 650416 - DNA, 25 bp, Mus musculus
ggtcttctgcttcaaataggcccca

SEQ ID NO: 650417 - DNA, 25 bp, Mus musculus
ggtcttctgcttgaaataggcccca

SEQ ID NO: 650418 - DNA, 25 bp, Mus musculus
ggtcttctggaactataggcattgt

SEQ ID NO: 650419 - DNA, 25 bp, Mus musculus
ggtcttctggaagtataggcattgt

SEQ ID NO: 650420 - DNA, 25 bp, Mus musculus
ggtcttctggacatactaagtactt

SEQ ID NO: 650421 - DNA, 25 bp, Mus musculus
ggtcttctggacttactaagtactt

SEQ ID NO: 650422 - DNA, 25 bp, Mus musculus
ggtcttctggtgctctttaatgagc

SEQ ID NO: 650423 - DNA, 25 bp, Mus musculus
ggtcttctggtggtctttaatgagc

SEQ ID NO: 650424 - DNA, 25 bp, Mus musculus
ggtcttcttagcacacagctagctt

SEQ ID NO: 650425 - DNA, 25 bp, Mus musculus
ggtcttcttagctcacagctagctt

SEQ ID NO: 650426 - DNA, 25 bp, Mus musculus
ggtcttgaacgtcggatcttcctgc

SEQ ID NO: 650427 - DNA, 25 bp, Mus musculus
ggtcttgaacgtgggatcttcctgc

SEQ ID NO: 650428 - DNA, 25 bp, Mus musculus
ggtcttgaactactggctatatggc

SEQ ID NO: 650429 - DNA, 25 bp, Mus musculus
ggtcttgaactagtggctatatggc

SEQ ID NO: 650430 - DNA, 25 bp, Mus musculus
ggtcttgaactgctagatcctcttg

SEQ ID NO: 650431 - DNA, 25 bp, Mus musculus
ggtcttgaactggtagatcctcttg

SEQ ID NO: 650432 - DNA, 25 bp, Mus musculus
ggtcttgaatcgctaacaactactg

SEQ ID NO: 650433 - DNA, 25 bp, Mus musculus
ggtcttgaatcggtaacaactactg

SEQ ID NO: 650434 - DNA, 25 bp, Mus musculus
ggtcttgaatgaagcctgttccact

SEQ ID NO: 650435 - DNA, 25 bp, Mus musculus
ggtcttgaatgatgcctgttccact

SEQ ID NO: 650436 - DNA, 25 bp, Mus musculus
ggtcttgaatttattcctcctctgt

SEQ ID NO: 650437 - DNA, 25 bp, Mus musculus
ggtcttgaattttttcctcctctgt

SEQ ID NO: 650438 - DNA, 25 bp, Mus musculus
ggtcttgaccaaatggattccctgc

SEQ ID NO: 650439 - DNA, 25 bp, Mus musculus
ggtcttgaccaattggattccctgc

SEQ ID NO: 650440 - DNA, 25 bp, Mus musculus
ggtcttgaccgaatgtcctttgcat

SEQ ID NO: 650441 - DNA, 25 bp, Mus musculus
ggtcttgaccgattgtcctttgcat

SEQ ID NO: 650442 - DNA, 25 bp, Mus musculus
ggtcttgagctgagtaaacttgcgt

SEQ ID NO: 650443 - DNA, 25 bp, Mus musculus
ggtcttgagctgtgtaaacttgcgt

SEQ ID NO: 650444 - DNA, 25 bp, Mus musculus
ggtcttgaggctatctgcattgaca

SEQ ID NO: 650445 - DNA, 25 bp, Mus musculus
ggtcttgaggctttctgcattgaca

SEQ ID NO: 650446 - DNA, 25 bp, Mus musculus
ggtcttgatgtcagtggtttaccaa

SEQ ID NO: 650447 - DNA, 25 bp, Mus musculus
ggtcttgatgtctgtggtttaccaa

SEQ ID NO: 650448 - DNA, 25 bp, Mus musculus
ggtcttgcagtaatgcccacactga

SEQ ID NO: 650449 - DNA, 25 bp, Mus musculus
ggtcttgcagtattgcccacactga

SEQ ID NO: 650450 - DNA, 25 bp, Mus musculus
ggtcttgccaagaagtgctattatt

SEQ ID NO: 650451 - DNA, 25 bp, Mus musculus
ggtcttgccaagtagtgctattatt

SEQ ID NO: 650452 - DNA, 25 bp, Mus musculus
ggtcttgcccgccttgagtcgaaag

SEQ ID NO: 650453 - DNA, 25 bp, Mus musculus
ggtcttgcccgcgttgagtcgaaag

SEQ ID NO: 650454 - DNA, 25 bp, Mus musculus
ggtcttgcctcacaaagtagttttt

SEQ ID NO: 650455 - DNA, 25 bp, Mus musculus
ggtcttgcctcagaaagtagttttt

SEQ ID NO: 650456 - DNA, 25 bp, Mus musculus
ggtcttgctagaattcctgatcatc

SEQ ID NO: 650457 - DNA, 25 bp, Mus musculus
ggtcttgctagatttcctgatcatc

SEQ ID NO: 650458 - DNA, 25 bp, Mus musculus
ggtcttgctcagaaccgatatagct

SEQ ID NO: 650459 - DNA, 25 bp, Mus musculus
ggtcttgctcagtaccgatatagct

SEQ ID NO: 650460 - DNA, 25 bp, Mus musculus
ggtcttgctctcattgttcaagaga

SEQ ID NO: 650461 - DNA, 25 bp, Mus musculus
ggtcttgctctctttgttcaagaga

SEQ ID NO: 650462 - DNA, 25 bp, Mus musculus
ggtcttgctctgaagaactctgtag

SEQ ID NO: 650463 - DNA, 25 bp, Mus musculus
ggtcttgctctgtagaactctgtag

SEQ ID NO: 650464 - DNA, 25 bp, Mus musculus
ggtcttgctgttactattgacaccg

SEQ ID NO: 650465 - DNA, 25 bp, Mus musculus
ggtcttgctgtttctattgacaccg

SEQ ID NO: 650466 - DNA, 25 bp, Mus musculus
ggtcttgcttacagcctttctttag

SEQ ID NO: 650467 - DNA, 25 bp, Mus musculus
ggtcttgcttactgcctttctttag

SEQ ID NO: 650468 - DNA, 25 bp, Mus musculus
ggtcttggaccgaatgcaaaggaga

SEQ ID NO: 650469 - DNA, 25 bp, Mus musculus
ggtcttggaccgtatgcaaaggaga

SEQ ID NO: 650470 - DNA, 25 bp, Mus musculus
ggtcttggatttagtcacaccgact

SEQ ID NO: 650471 - DNA, 25 bp, Mus musculus
ggtcttggattttgtcacaccgact

SEQ ID NO: 650472 - DNA, 25 bp, Mus musculus
ggtcttggccaacgtcagcatgtaa

SEQ ID NO: 650473 - DNA, 25 bp, Mus musculus
ggtcttggccaaggtcagcatgtaa

SEQ ID NO: 650474 - DNA, 25 bp, Mus musculus
ggtcttggccagaggaacaccatca

SEQ ID NO: 650475 - DNA, 25 bp, Mus musculus
ggtcttggccagtggaacaccatca

SEQ ID NO: 650476 - DNA, 25 bp, Mus musculus
ggtcttggctatagacacacactac

SEQ ID NO: 650477 - DNA, 25 bp, Mus musculus
ggtcttggctattgacacacactac

SEQ ID NO: 650478 - DNA, 25 bp, Mus musculus
ggtcttgggccaatcaaaacttcct

SEQ ID NO: 650479 - DNA, 25 bp, Mus musculus
ggtcttgggccattcaaaacttcct

SEQ ID NO: 650480 - DNA, 25 bp, Mus musculus
ggtcttgggtagactatctcctgaa

SEQ ID NO: 650481 - DNA, 25 bp, Mus musculus
ggtcttgggtagtctatctcctgaa

SEQ ID NO: 650482 - DNA, 25 bp, Mus musculus
ggtcttggtcctaggacagcgccac

SEQ ID NO: 650483 - DNA, 25 bp, Mus musculus
ggtcttggtccttggacagcgccac

SEQ ID NO: 650484 - DNA, 25 bp, Mus musculus
ggtcttggtctcatggcaggcactt

SEQ ID NO: 650485 - DNA, 25 bp, Mus musculus
ggtcttggtctcttggcaggcactt

SEQ ID NO: 650486 - DNA, 25 bp, Mus musculus
ggtcttgtactacgagtgctgagct

SEQ ID NO: 650487 - DNA, 25 bp, Mus musculus
ggtcttgtactaggagtgctgagct

SEQ ID NO: 650488 - DNA, 25 bp, Mus musculus
ggtcttgtcaagcatcccggaaagt

SEQ ID NO: 650489 - DNA, 25 bp, Mus musculus
ggtcttgtcaaggatcccggaaagt

SEQ ID NO: 650490 - DNA, 25 bp, Mus musculus
ggtcttgtgaaccatgggtctgttt

SEQ ID NO: 650491 - DNA, 25 bp, Mus musculus
ggtcttgtgaacgatgggtctgttt

SEQ ID NO: 650492 - DNA, 25 bp, Mus musculus
ggtcttgtgcggctacccattgcca

SEQ ID NO: 650493 - DNA, 25 bp, Mus musculus
ggtcttgtgcgggtacccattgcca

SEQ ID NO: 650494 - DNA, 25 bp, Mus musculus
ggtcttgtggtgaagtcgtatgctt

SEQ ID NO: 650495 - DNA, 25 bp, Mus musculus
ggtcttgtggtgtagtcgtatgctt

SEQ ID NO: 650496 - DNA, 25 bp, Mus musculus
ggtcttgttactaagccccgagtgc

SEQ ID NO: 650497 - DNA, 25 bp, Mus musculus
ggtcttgttacttagccccgagtgc

SEQ ID NO: 650498 - DNA, 25 bp, Mus musculus
ggtcttgttagtctaatgaaagcca

SEQ ID NO: 650499 - DNA, 25 bp, Mus musculus
ggtcttgttagtgtaatgaaagcca

SEQ ID NO: 650500 - DNA, 25 bp, Mus musculus
ggtctttaaagacagcacggcatct

SEQ ID NO: 650501 - DNA, 25 bp, Mus musculus
ggtctttaaagagagcacggcatct

SEQ ID NO: 650502 - DNA, 25 bp, Mus musculus
ggtctttaacttccatgctcagcaa

SEQ ID NO: 650503 - DNA, 25 bp, Mus musculus
ggtctttaacttgcatgctcagcaa

SEQ ID NO: 650504 - DNA, 25 bp, Mus musculus
ggtctttaatctcatgttgtagttt

SEQ ID NO: 650505 - DNA, 25 bp, Mus musculus
ggtctttaatctgatgttgtagttt

SEQ ID NO: 650506 - DNA, 25 bp, Mus musculus
ggtctttaatgacccctgttgggag

SEQ ID NO: 650507 - DNA, 25 bp, Mus musculus
ggtctttaatgagccctgttgggag

SEQ ID NO: 650508 - DNA, 25 bp, Mus musculus
ggtctttaatttcatagctctaggg

SEQ ID NO: 650509 - DNA, 25 bp, Mus musculus
ggtctttaatttgatagctctaggg

SEQ ID NO: 650510 - DNA, 25 bp, Mus musculus
ggtctttacacacatgggagcatct

SEQ ID NO: 650511 - DNA, 25 bp, Mus musculus
ggtctttacacagatgggagcatct

SEQ ID NO: 650512 - DNA, 25 bp, Mus musculus
ggtctttaccagaattgacaattgt

SEQ ID NO: 650513 - DNA, 25 bp, Mus musculus
ggtctttaccagtattgacaattgt

SEQ ID NO: 650514 - DNA, 25 bp, Mus musculus
ggtctttactctccctagtttcagg

SEQ ID NO: 650515 - DNA, 25 bp, Mus musculus
ggtctttactctgcctagtttcagg

SEQ ID NO: 650516 - DNA, 25 bp, Mus musculus
ggtctttactggaaccacacttcca

SEQ ID NO: 650517 - DNA, 25 bp, Mus musculus
ggtctttactggtaccacacttcca

SEQ ID NO: 650518 - DNA, 25 bp, Mus musculus
ggtctttagaaaaccctacgtgtgg

SEQ ID NO: 650519 - DNA, 25 bp, Mus musculus
ggtctttagaaatccctacgtgtgg

SEQ ID NO: 650520 - DNA, 25 bp, Mus musculus
ggtctttagagccacctcaggtcac

SEQ ID NO: 650521 - DNA, 25 bp, Mus musculus
ggtctttagagcgacctcaggtcac

SEQ ID NO: 650522 - DNA, 25 bp, Mus musculus
ggtctttagcccaaataccatgaca

SEQ ID NO: 650523 - DNA, 25 bp, Mus musculus
ggtctttagccctaataccatgaca

SEQ ID NO: 650524 - DNA, 25 bp, Mus musculus
ggtctttaggcaccagagtctttaa

SEQ ID NO: 650525 - DNA, 25 bp, Mus musculus
ggtctttaggcagcagagtctttaa

SEQ ID NO: 650526 - DNA, 25 bp, Mus musculus
ggtctttatcatattcattcaccag

SEQ ID NO: 650527 - DNA, 25 bp, Mus musculus
ggtctttatcattttcattcaccag

SEQ ID NO: 650528 - DNA, 25 bp, Mus musculus
ggtctttatgtgcatcccaaactat

SEQ ID NO: 650529 - DNA, 25 bp, Mus musculus
ggtctttatgtggatcccaaactat

SEQ ID NO: 650530 - DNA, 25 bp, Mus musculus
ggtctttcaaagacatcctaactat

SEQ ID NO: 650531 - DNA, 25 bp, Mus musculus
ggtctttcaaagtcatcctaactat

SEQ ID NO: 650532 - DNA, 25 bp, Mus musculus
ggtctttcaattaggccttcagtac

SEQ ID NO: 650533 - DNA, 25 bp, Mus musculus
ggtctttcaattattctcttagtag

SEQ ID NO: 650534 - DNA, 25 bp, Mus musculus
ggtctttcaatttggccttcagtac

SEQ ID NO: 650535 - DNA, 25 bp, Mus musculus
ggtctttcaatttttctcttagtag

SEQ ID NO: 650536 - DNA, 25 bp, Mus musculus
ggtctttcacctagtcttttatcag

SEQ ID NO: 650537 - DNA, 25 bp, Mus musculus
ggtctttcaccttgtcttttatcag

SEQ ID NO: 650538 - DNA, 25 bp, Mus musculus
ggtctttcacttaggcctcgcgcga

SEQ ID NO: 650539 - DNA, 25 bp, Mus musculus
ggtctttcactttggcctcgcgcga

SEQ ID NO: 650540 - DNA, 25 bp, Mus musculus
ggtctttccaggaggcactgtccta

SEQ ID NO: 650541 - DNA, 25 bp, Mus musculus
ggtctttccaggtggcactgtccta

SEQ ID NO: 650542 - DNA, 25 bp, Mus musculus
ggtctttcccatattgataggcctt

SEQ ID NO: 650543 - DNA, 25 bp, Mus musculus
ggtctttcccattttgataggcctt

SEQ ID NO: 650544 - DNA, 25 bp, Mus musculus
ggtctttcctaaaaatccaacatat

SEQ ID NO: 650545 - DNA, 25 bp, Mus musculus
ggtctttcctaataatccaacatat

SEQ ID NO: 650546 - DNA, 25 bp, Mus musculus
ggtctttcctggcatagaacacttc

SEQ ID NO: 650547 - DNA, 25 bp, Mus musculus
ggtctttcctgggatagaacacttc

SEQ ID NO: 650548 - DNA, 25 bp, Mus musculus
ggtctttccttcaagctttatgtat

SEQ ID NO: 650549 - DNA, 25 bp, Mus musculus
ggtctttccttctagctttatgtat

SEQ ID NO: 650550 - DNA, 25 bp, Mus musculus
ggtctttcctttagtatctcttcta

SEQ ID NO: 650551 - DNA, 25 bp, Mus musculus
ggtctttccttttgtatctcttcta

SEQ ID NO: 650552 - DNA, 25 bp, Mus musculus
ggtctttcgtgaatttagcacactt

SEQ ID NO: 650553 - DNA, 25 bp, Mus musculus
ggtctttcgtgattttagcacactt

SEQ ID NO: 650554 - DNA, 25 bp, Mus musculus
ggtctttctgttagaaagcaccaca

SEQ ID NO: 650555 - DNA, 25 bp, Mus musculus
ggtctttctgtttgaaagcaccaca

SEQ ID NO: 650556 - DNA, 25 bp, Mus musculus
ggtctttgaattatgcattgctgta

SEQ ID NO: 650557 - DNA, 25 bp, Mus musculus
ggtctttgaattttgcattgctgta

SEQ ID NO: 650558 - DNA, 25 bp, Mus musculus
ggtctttgacagaagctagagtcat

SEQ ID NO: 650559 - DNA, 25 bp, Mus musculus
ggtctttgacagtagctagagtcat

SEQ ID NO: 650560 - DNA, 25 bp, Mus musculus
ggtctttgagtcaacacagtgaacg

SEQ ID NO: 650561 - DNA, 25 bp, Mus musculus
ggtctttgagtctacacagtgaacg

SEQ ID NO: 650562 - DNA, 25 bp, Mus musculus
ggtctttgatttccaattggcttca

SEQ ID NO: 650563 - DNA, 25 bp, Mus musculus
ggtctttgatttgcaattggcttca

SEQ ID NO: 650564 - DNA, 25 bp, Mus musculus
ggtctttgcaaacctacagtctcgg

SEQ ID NO: 650565 - DNA, 25 bp, Mus musculus
ggtctttgcaaagctacagtctcgg

SEQ ID NO: 650566 - DNA, 25 bp, Mus musculus
ggtctttgcagaactttcgagctat

SEQ ID NO: 650567 - DNA, 25 bp, Mus musculus
ggtctttgcagatctttcgagctat

SEQ ID NO: 650568 - DNA, 25 bp, Mus musculus
ggtctttgccaactattacactcct

SEQ ID NO: 650569 - DNA, 25 bp, Mus musculus
ggtctttgccaagtattacactcct

SEQ ID NO: 650570 - DNA, 25 bp, Mus musculus
ggtctttggcctagacatggtagaa

SEQ ID NO: 650571 - DNA, 25 bp, Mus musculus
ggtctttggccttgacatggtagaa

SEQ ID NO: 650572 - DNA, 25 bp, Mus musculus
ggtctttgtcctcagatagtttgat

SEQ ID NO: 650573 - DNA, 25 bp, Mus musculus
ggtctttgtcctgagatagtttgat

SEQ ID NO: 650574 - DNA, 25 bp, Mus musculus
ggtctttgtctaagacgtcaccaag

SEQ ID NO: 650575 - DNA, 25 bp, Mus musculus
ggtctttgtctatgacgtcaccaag

SEQ ID NO: 650576 - DNA, 25 bp, Mus musculus
ggtctttgtcttaagacgcccggct

SEQ ID NO: 650577 - DNA, 25 bp, Mus musculus
ggtctttgtctttagacgcccggct

SEQ ID NO: 650578 - DNA, 25 bp, Mus musculus
ggtctttgtgtccaaggagaagcta

SEQ ID NO: 650579 - DNA, 25 bp, Mus musculus
ggtctttgtgtcgaaggagaagcta

SEQ ID NO: 650580 - DNA, 25 bp, Mus musculus
ggtcttttaattcggtcttcatctc

SEQ ID NO: 650581 - DNA, 25 bp, Mus musculus
ggtcttttaattgggtcttcatctc

SEQ ID NO: 650582 - DNA, 25 bp, Mus musculus
ggtcttttacacagcaggctacagc

SEQ ID NO: 650583 - DNA, 25 bp, Mus musculus
ggtcttttacactgcaggctacagc

SEQ ID NO: 650584 - DNA, 25 bp, Mus musculus
ggtcttttacatctttcactgctat

SEQ ID NO: 650585 - DNA, 25 bp, Mus musculus
ggtcttttacatgtttcactgctat

SEQ ID NO: 650586 - DNA, 25 bp, Mus musculus
ggtcttttatccctggtcaaaacag

SEQ ID NO: 650587 - DNA, 25 bp, Mus musculus
ggtcttttatccgtggtcaaaacag

SEQ ID NO: 650588 - DNA, 25 bp, Mus musculus
ggtcttttattcagactgttcacaa

SEQ ID NO: 650589 - DNA, 25 bp, Mus musculus
ggtcttttattctgactgttcacaa

SEQ ID NO: 650590 - DNA, 25 bp, Mus musculus
ggtcttttccttcattataccaaat

SEQ ID NO: 650591 - DNA, 25 bp, Mus musculus
ggtcttttccttgattataccaaat

SEQ ID NO: 650592 - DNA, 25 bp, Mus musculus
ggtcttttctgtaactccaatattc

SEQ ID NO: 650593 - DNA, 25 bp, Mus musculus
ggtcttttctgttactccaatattc

SEQ ID NO: 650594 - DNA, 25 bp, Mus musculus
ggtcttttctttctagctgttagcc

SEQ ID NO: 650595 - DNA, 25 bp, Mus musculus
ggtcttttctttgtagctgttagcc

SEQ ID NO: 650596 - DNA, 25 bp, Mus musculus
ggtcttttgaccacacatgttcttt

SEQ ID NO: 650597 - DNA, 25 bp, Mus musculus
ggtcttttgacctcacatgttcttt

SEQ ID NO: 650598 - DNA, 25 bp, Mus musculus
ggtcttttgagtacgaggttagcct

SEQ ID NO: 650599 - DNA, 25 bp, Mus musculus
ggtcttttgagttcgaggttagcct

SEQ ID NO: 650600 - DNA, 25 bp, Mus musculus
ggtcttttgataacggctccccaaa

SEQ ID NO: 650601 - DNA, 25 bp, Mus musculus
ggtcttttgatatcggctccccaaa

SEQ ID NO: 650602 - DNA, 25 bp, Mus musculus
ggtcttttgatgatgtcctcgagaa

SEQ ID NO: 650603 - DNA, 25 bp, Mus musculus
ggtcttttgatgttgtcctcgagaa

SEQ ID NO: 650604 - DNA, 25 bp, Mus musculus
ggtcttttgcgcatgctagggaaaa

SEQ ID NO: 650605 - DNA, 25 bp, Mus musculus
ggtcttttgcgcttgctagggaaaa

SEQ ID NO: 650606 - DNA, 25 bp, Mus musculus
ggtcttttgctactcgtggtcgctg

SEQ ID NO: 650607 - DNA, 25 bp, Mus musculus
ggtcttttgctagtcgtggtcgctg

SEQ ID NO: 650608 - DNA, 25 bp, Mus musculus
ggtcttttgtgtcatctacgaagct

SEQ ID NO: 650609 - DNA, 25 bp, Mus musculus
ggtcttttgtgtgatctacgaagct

SEQ ID NO: 650610 - DNA, 25 bp, Mus musculus
ggtctttttacaagatcttctttct

SEQ ID NO: 650611 - DNA, 25 bp, Mus musculus
ggtctttttacacaatagccatctt

SEQ ID NO: 650612 - DNA, 25 bp, Mus musculus
ggtctttttacagaatagccatctt

SEQ ID NO: 650613 - DNA, 25 bp, Mus musculus
ggtctttttacatgatcttctttct

SEQ ID NO: 650614 - DNA, 25 bp, Mus musculus
ggtctttttcatagtctggatctct

SEQ ID NO: 650615 - DNA, 25 bp, Mus musculus
ggtctttttcattgtctggatctct

SEQ ID NO: 650616 - DNA, 25 bp, Mus musculus
ggtctttttctgacggtgctgggtt

SEQ ID NO: 650617 - DNA, 25 bp, Mus musculus
ggtctttttctgtcggtgctgggtt

SEQ ID NO: 650618 - DNA, 25 bp, Mus musculus
ggtgaaaaactgagaccccagcatt

SEQ ID NO: 650619 - DNA, 25 bp, Mus musculus
ggtgaaaaactgtgaccccagcatt

SEQ ID NO: 650620 - DNA, 25 bp, Mus musculus
ggtgaaaacatcaacaagtcctcag

SEQ ID NO: 650621 - DNA, 25 bp, Mus musculus
ggtgaaaacatctacaagtcctcag

SEQ ID NO: 650622 - DNA, 25 bp, Mus musculus
ggtgaaaaccagctcggcgatacta

SEQ ID NO: 650623 - DNA, 25 bp, Mus musculus
ggtgaaaaccaggtcggcgatacta

SEQ ID NO: 650624 - DNA, 25 bp, Mus musculus
ggtgaaaactcccagaaggatagat

SEQ ID NO: 650625 - DNA, 25 bp, Mus musculus
ggtgaaaactccgagaaggatagat

SEQ ID NO: 650626 - DNA, 25 bp, Mus musculus
ggtgaaaagctcacttacatcctag

SEQ ID NO: 650627 - DNA, 25 bp, Mus musculus
ggtgaaaagctctcttacatcctag

SEQ ID NO: 650628 - DNA, 25 bp, Mus musculus
ggtgaaaagggcagtgaacctcctc

SEQ ID NO: 650629 - DNA, 25 bp, Mus musculus
ggtgaaaagggctgtgaacctcctc

SEQ ID NO: 650630 - DNA, 25 bp, Mus musculus
ggtgaaaattccagaccctgaagac

SEQ ID NO: 650631 - DNA, 25 bp, Mus musculus
ggtgaaaattcctgaccctgaagac

SEQ ID NO: 650632 - DNA, 25 bp, Mus musculus
ggtgaaacaccaactcctggagcaa

SEQ ID NO: 650633 - DNA, 25 bp, Mus musculus
ggtgaaacaccatctcctggagcaa

SEQ ID NO: 650634 - DNA, 25 bp, Mus musculus
ggtgaaacctgcacatcagagaaaa

SEQ ID NO: 650635 - DNA, 25 bp, Mus musculus
ggtgaaacctgctcatcagagaaaa

SEQ ID NO: 650636 - DNA, 25 bp, Mus musculus
ggtgaaactagcaaaacgccttaag

SEQ ID NO: 650637 - DNA, 25 bp, Mus musculus
ggtgaaactagctaaacgccttaag

SEQ ID NO: 650638 - DNA, 25 bp, Mus musculus
ggtgaaactggacgtcctgagtctc

SEQ ID NO: 650639 - DNA, 25 bp, Mus musculus
ggtgaaactggaggtcctgagtctc

SEQ ID NO: 650640 - DNA, 25 bp, Mus musculus
ggtgaaagacacatgaatttctctt

SEQ ID NO: 650641 - DNA, 25 bp, Mus musculus
ggtgaaagacacttgaatttctctt

SEQ ID NO: 650642 - DNA, 25 bp, Mus musculus
ggtgaaagataccttcatgtccata

SEQ ID NO: 650643 - DNA, 25 bp, Mus musculus
ggtgaaagatacgttcatgtccata

SEQ ID NO: 650644 - DNA, 25 bp, Mus musculus
ggtgaaagatgcactgcggtccttc

SEQ ID NO: 650645 - DNA, 25 bp, Mus musculus
ggtgaaagatgctctgcggtccttc

SEQ ID NO: 650646 - DNA, 25 bp, Mus musculus
ggtgaaagcctgatgacgtcttcta

SEQ ID NO: 650647 - DNA, 25 bp, Mus musculus
ggtgaaagcctgttgacgtcttcta

SEQ ID NO: 650648 - DNA, 25 bp, Mus musculus
ggtgaaaggaacactgccccaggaa

SEQ ID NO: 650649 - DNA, 25 bp, Mus musculus
ggtgaaaggaactctgccccaggaa

SEQ ID NO: 650650 - DNA, 25 bp, Mus musculus
ggtgaaaggctaataaacagaaact

SEQ ID NO: 650651 - DNA, 25 bp, Mus musculus
ggtgaaaggctattaaacagaaact

SEQ ID NO: 650652 - DNA, 25 bp, Mus musculus
ggtgaaaggctcagtatttcattac

SEQ ID NO: 650653 - DNA, 25 bp, Mus musculus
ggtgaaaggctctgtatttcattac

SEQ ID NO: 650654 - DNA, 25 bp, Mus musculus
ggtgaaagtcaaaaggccagagcca

SEQ ID NO: 650655 - DNA, 25 bp, Mus musculus
ggtgaaagtcaataggccagagcca

SEQ ID NO: 650656 - DNA, 25 bp, Mus musculus
ggtgaaagtctaagtatactctaaa

SEQ ID NO: 650657 - DNA, 25 bp, Mus musculus
ggtgaaagtctatgtatactctaaa

SEQ ID NO: 650658 - DNA, 25 bp, Mus musculus
ggtgaaagtgccaccttaaactggg

SEQ ID NO: 650659 - DNA, 25 bp, Mus musculus
ggtgaaagtgcctccttaaactggg

SEQ ID NO: 650660 - DNA, 25 bp, Mus musculus
ggtgaaataacacggcctagcagtt

SEQ ID NO: 650661 - DNA, 25 bp, Mus musculus
ggtgaaataacagggcctagcagtt

SEQ ID NO: 650662 - DNA, 25 bp, Mus musculus
ggtgaaatacttaacgatgtgtaaa

SEQ ID NO: 650663 - DNA, 25 bp, Mus musculus
ggtgaaatactttacgatgtgtaaa

SEQ ID NO: 650664 - DNA, 25 bp, Mus musculus
ggtgaaatcctacccaacggagcac

SEQ ID NO: 650665 - DNA, 25 bp, Mus musculus
ggtgaaatcctagccaacggagcac

SEQ ID NO: 650666 - DNA, 25 bp, Mus musculus
ggtgaaatccttccccatgtggtgg

SEQ ID NO: 650667 - DNA, 25 bp, Mus musculus
ggtgaaatccttgcccatgtggtgg

SEQ ID NO: 650668 - DNA, 25 bp, Mus musculus
ggtgaaatcttcaacaatgagttct

SEQ ID NO: 650669 - DNA, 25 bp, Mus musculus
ggtgaaatcttctacaatgagttct

SEQ ID NO: 650670 - DNA, 25 bp, Mus musculus
ggtgaaatctttctagttgggcttt

SEQ ID NO: 650671 - DNA, 25 bp, Mus musculus
ggtgaaatctttgtagttgggcttt

SEQ ID NO: 650672 - DNA, 25 bp, Mus musculus
ggtgaaattataccagttatcccaa

SEQ ID NO: 650673 - DNA, 25 bp, Mus musculus
ggtgaaattatagcagttatcccaa

SEQ ID NO: 650674 - DNA, 25 bp, Mus musculus
ggtgaaattggtcttccagctctat

SEQ ID NO: 650675 - DNA, 25 bp, Mus musculus
ggtgaaattggtgttccagctctat

SEQ ID NO: 650676 - DNA, 25 bp, Mus musculus
ggtgaaattgttagatctggtgtaa

SEQ ID NO: 650677 - DNA, 25 bp, Mus musculus
ggtgaaattgtttgatctggtgtaa

SEQ ID NO: 650678 - DNA, 25 bp, Mus musculus
ggtgaacaagcaaaaatctgccttg

SEQ ID NO: 650679 - DNA, 25 bp, Mus musculus
ggtgaacaagcataaatctgccttg

SEQ ID NO: 650680 - DNA, 25 bp, Mus musculus
ggtgaacaagtccagcctgtttcat

SEQ ID NO: 650681 - DNA, 25 bp, Mus musculus
ggtgaacaagtcgagcctgtttcat

SEQ ID NO: 650682 - DNA, 25 bp, Mus musculus
ggtgaacaccttcattctggtagag

SEQ ID NO: 650683 - DNA, 25 bp, Mus musculus
ggtgaacaccttctgtgacagctgc

SEQ ID NO: 650684 - DNA, 25 bp, Mus musculus
ggtgaacaccttgattctggtagag

SEQ ID NO: 650685 - DNA, 25 bp, Mus musculus
ggtgaacaccttgtgtgacagctgc

SEQ ID NO: 650686 - DNA, 25 bp, Mus musculus
ggtgaacactcaagactgccttaac

SEQ ID NO: 650687 - DNA, 25 bp, Mus musculus
ggtgaacactcatgactgccttaac

SEQ ID NO: 650688 - DNA, 25 bp, Mus musculus
ggtgaacactggattgttttagctc

SEQ ID NO: 650689 - DNA, 25 bp, Mus musculus
ggtgaacactggtttgttttagctc

SEQ ID NO: 650690 - DNA, 25 bp, Mus musculus
ggtgaacagaacatgggatccaagt

SEQ ID NO: 650691 - DNA, 25 bp, Mus musculus
ggtgaacagaacttgggatccaagt

SEQ ID NO: 650692 - DNA, 25 bp, Mus musculus
ggtgaacagacaagcacaggctgct

SEQ ID NO: 650693 - DNA, 25 bp, Mus musculus
ggtgaacagacatgcacaggctgct

SEQ ID NO: 650694 - DNA, 25 bp, Mus musculus
ggtgaacagagcactcccttgctaa

SEQ ID NO: 650695 - DNA, 25 bp, Mus musculus
ggtgaacagagctctcccttgctaa

SEQ ID NO: 650696 - DNA, 25 bp, Mus musculus
ggtgaacagcagagtcgaccttcat

SEQ ID NO: 650697 - DNA, 25 bp, Mus musculus
ggtgaacagcagtgtcgaccttcat

SEQ ID NO: 650698 - DNA, 25 bp, Mus musculus
ggtgaacagtcactccatcatggat

SEQ ID NO: 650699 - DNA, 25 bp, Mus musculus
ggtgaacagtcagtccatcatggat

SEQ ID NO: 650700 - DNA, 25 bp, Mus musculus
ggtgaacagtccaatgagatatggt

SEQ ID NO: 650701 - DNA, 25 bp, Mus musculus
ggtgaacagtcctatgagatatggt

SEQ ID NO: 650702 - DNA, 25 bp, Mus musculus
ggtgaacagtgactgcccttacatt

SEQ ID NO: 650703 - DNA, 25 bp, Mus musculus
ggtgaacagtgagtgcccttacatt

SEQ ID NO: 650704 - DNA, 25 bp, Mus musculus
ggtgaacatattctagaactatctt

SEQ ID NO: 650705 - DNA, 25 bp, Mus musculus
ggtgaacatattgtagaactatctt

SEQ ID NO: 650706 - DNA, 25 bp, Mus musculus
ggtgaacatctgacggccaagctaa

SEQ ID NO: 650707 - DNA, 25 bp, Mus musculus
ggtgaacatctgtcggccaagctaa

SEQ ID NO: 650708 - DNA, 25 bp, Mus musculus
ggtgaacatgctcaactcgctgtct

SEQ ID NO: 650709 - DNA, 25 bp, Mus musculus
ggtgaacatgctgaactcgctgtct

SEQ ID NO: 650710 - DNA, 25 bp, Mus musculus
ggtgaacattccagcactgacctat

SEQ ID NO: 650711 - DNA, 25 bp, Mus musculus
ggtgaacattcctgcactgacctat

SEQ ID NO: 650712 - DNA, 25 bp, Mus musculus
ggtgaaccaatgcagctgtgaagat

SEQ ID NO: 650713 - DNA, 25 bp, Mus musculus
ggtgaaccaatggagctgtgaagat

SEQ ID NO: 650714 - DNA, 25 bp, Mus musculus
ggtgaaccacccaaagatagtagct

SEQ ID NO: 650715 - DNA, 25 bp, Mus musculus
ggtgaaccaccctaagatagtagct

SEQ ID NO: 650716 - DNA, 25 bp, Mus musculus
ggtgaaccagccattgtgagtcata

SEQ ID NO: 650717 - DNA, 25 bp, Mus musculus
ggtgaaccagcctttgtgagtcata

SEQ ID NO: 650718 - DNA, 25 bp, Mus musculus
ggtgaaccagctactcaaggtttcc

SEQ ID NO: 650719 - DNA, 25 bp, Mus musculus
ggtgaaccagcttctcaaggtttcc

SEQ ID NO: 650720 - DNA, 25 bp, Mus musculus
ggtgaacccggaagcctcggagatc

SEQ ID NO: 650721 - DNA, 25 bp, Mus musculus
ggtgaacccggatgcctcggagatc

SEQ ID NO: 650722 - DNA, 25 bp, Mus musculus
ggtgaaccttctagtttacagattt

SEQ ID NO: 650723 - DNA, 25 bp, Mus musculus
ggtgaaccttcttgtttacagattt

SEQ ID NO: 650724 - DNA, 25 bp, Mus musculus
ggtgaacgaggcactccaggtccaa

SEQ ID NO: 650725 - DNA, 25 bp, Mus musculus
ggtgaacgaggctctccaggtccaa

SEQ ID NO: 650726 - DNA, 25 bp, Mus musculus
ggtgaacggccaattcaacgaggat

SEQ ID NO: 650727 - DNA, 25 bp, Mus musculus
ggtgaacggccatttcaacgaggat

SEQ ID NO: 650728 - DNA, 25 bp, Mus musculus
ggtgaactaacactccactaatctc

SEQ ID NO: 650729 - DNA, 25 bp, Mus musculus
ggtgaactaacagtccactaatctc

SEQ ID NO: 650730 - DNA, 25 bp, Mus musculus
ggtgaactcctgctcgacatgattt

SEQ ID NO: 650731 - DNA, 25 bp, Mus musculus
ggtgaactcctggtcgacatgattt

SEQ ID NO: 650732 - DNA, 25 bp, Mus musculus
ggtgaactctgtatttgggtcttga

SEQ ID NO: 650733 - DNA, 25 bp, Mus musculus
ggtgaactctgtttttgggtcttga

SEQ ID NO: 650734 - DNA, 25 bp, Mus musculus
ggtgaactgactctgtgcccagagc

SEQ ID NO: 650735 - DNA, 25 bp, Mus musculus
ggtgaactgactgtgtgcccagagc

SEQ ID NO: 650736 - DNA, 25 bp, Mus musculus
ggtgaactgtaaactccttgtgaat

SEQ ID NO: 650737 - DNA, 25 bp, Mus musculus
ggtgaactgtaatctccttgtgaat

SEQ ID NO: 650738 - DNA, 25 bp, Mus musculus
ggtgaactgttaatcattcttattt

SEQ ID NO: 650739 - DNA, 25 bp, Mus musculus
ggtgaactgttattcattcttattt

SEQ ID NO: 650740 - DNA, 25 bp, Mus musculus
ggtgaacttacacaaccactttcag

SEQ ID NO: 650741 - DNA, 25 bp, Mus musculus
ggtgaacttacagaaccactttcag

SEQ ID NO: 650742 - DNA, 25 bp, Mus musculus
ggtgaacttcaacgactcagaaacc

SEQ ID NO: 650743 - DNA, 25 bp, Mus musculus
ggtgaacttcaaggactcagaaacc

SEQ ID NO: 650744 - DNA, 25 bp, Mus musculus
ggtgaactttctcaccctaagacac

SEQ ID NO: 650745 - DNA, 25 bp, Mus musculus
ggtgaactttctgaccctaagacac

SEQ ID NO: 650746 - DNA, 25 bp, Mus musculus
ggtgaagaatctccccatcaaggtg

SEQ ID NO: 650747 - DNA, 25 bp, Mus musculus
ggtgaagaatctgcccatcaaggtg

SEQ ID NO: 650748 - DNA, 25 bp, Mus musculus
ggtgaagaatgtctccttcttacct

SEQ ID NO: 650749 - DNA, 25 bp, Mus musculus
ggtgaagaatgtgtccttcttacct

SEQ ID NO: 650750 - DNA, 25 bp, Mus musculus
ggtgaagaattcctgaagtcccaat

SEQ ID NO: 650751 - DNA, 25 bp, Mus musculus
ggtgaagaattcgtgaagtcccaat

SEQ ID NO: 650752 - DNA, 25 bp, Mus musculus
ggtgaagacctcacccaaggaaagc

SEQ ID NO: 650753 - DNA, 25 bp, Mus musculus
ggtgaagacctctcccaaggaaagc

SEQ ID NO: 650754 - DNA, 25 bp, Mus musculus
ggtgaagacggcattatatacctct

SEQ ID NO: 650755 - DNA, 25 bp, Mus musculus
ggtgaagacggctttatatacctct

SEQ ID NO: 650756 - DNA, 25 bp, Mus musculus
ggtgaagactaaacagactttccca

SEQ ID NO: 650757 - DNA, 25 bp, Mus musculus
ggtgaagactaatcagactttccca

SEQ ID NO: 650758 - DNA, 25 bp, Mus musculus
ggtgaagactcacacaccaggcttc

SEQ ID NO: 650759 - DNA, 25 bp, Mus musculus
ggtgaagactcagacaccaggcttc

SEQ ID NO: 650760 - DNA, 25 bp, Mus musculus
ggtgaagactctacaggtccaggct

SEQ ID NO: 650761 - DNA, 25 bp, Mus musculus
ggtgaagactcttcaggtccaggct

SEQ ID NO: 650762 - DNA, 25 bp, Mus musculus
ggtgaagataccactgccattcaat

SEQ ID NO: 650763 - DNA, 25 bp, Mus musculus
ggtgaagatacctctgccattcaat

SEQ ID NO: 650764 - DNA, 25 bp, Mus musculus
ggtgaagatgaaacctgatcctgtg

SEQ ID NO: 650765 - DNA, 25 bp, Mus musculus
ggtgaagatgaatcctgatcctgtg

SEQ ID NO: 650766 - DNA, 25 bp, Mus musculus
ggtgaagatgaccagaccaagtctg

SEQ ID NO: 650767 - DNA, 25 bp, Mus musculus
ggtgaagatgacgagaccaagtctg

SEQ ID NO: 650768 - DNA, 25 bp, Mus musculus
ggtgaagatggtcaccccgctaatc

SEQ ID NO: 650769 - DNA, 25 bp, Mus musculus
ggtgaagatggtgaccccgctaatc

SEQ ID NO: 650770 - DNA, 25 bp, Mus musculus
ggtgaagcaaccagacactgaactc

SEQ ID NO: 650771 - DNA, 25 bp, Mus musculus
ggtgaagcaacctgacactgaactc

SEQ ID NO: 650772 - DNA, 25 bp, Mus musculus
ggtgaagcactcaaatcaattctga

SEQ ID NO: 650773 - DNA, 25 bp, Mus musculus
ggtgaagcactctaatcaattctga

SEQ ID NO: 650774 - DNA, 25 bp, Mus musculus
ggtgaagccatccatgaagtcatac

SEQ ID NO: 650775 - DNA, 25 bp, Mus musculus
ggtgaagccatcgatgaagtcatac

SEQ ID NO: 650776 - DNA, 25 bp, Mus musculus
ggtgaagcccatattcagtcgcgac

SEQ ID NO: 650777 - DNA, 25 bp, Mus musculus
ggtgaagcccattttcagtcgcgac

SEQ ID NO: 650778 - DNA, 25 bp, Mus musculus
ggtgaagcctgtatttgtatctgaa

SEQ ID NO: 650779 - DNA, 25 bp, Mus musculus
ggtgaagcctgtttttgtatctgaa

SEQ ID NO: 650780 - DNA, 25 bp, Mus musculus
ggtgaagctacgacagtggctgctt

SEQ ID NO: 650781 - DNA, 25 bp, Mus musculus
ggtgaagctacgtcagtggctgctt

SEQ ID NO: 650782 - DNA, 25 bp, Mus musculus
ggtgaagctctaagagggtccccag

SEQ ID NO: 650783 - DNA, 25 bp, Mus musculus
ggtgaagctctatgagggtccccag

SEQ ID NO: 650784 - DNA, 25 bp, Mus musculus
ggtgaagctgaaattgcccgcatta

SEQ ID NO: 650785 - DNA, 25 bp, Mus musculus
ggtgaagctgaatttgcccgcatta

SEQ ID NO: 650786 - DNA, 25 bp, Mus musculus
ggtgaagctgtgctgctgcccccca

SEQ ID NO: 650787 - DNA, 25 bp, Mus musculus
ggtgaagctgtggtgctgcccccca

SEQ ID NO: 650788 - DNA, 25 bp, Mus musculus
ggtgaagcttatattccttggagtt

SEQ ID NO: 650789 - DNA, 25 bp, Mus musculus
ggtgaagcttatctttgtcctctga

SEQ ID NO: 650790 - DNA, 25 bp, Mus musculus
ggtgaagcttatgtttgtcctctga

SEQ ID NO: 650791 - DNA, 25 bp, Mus musculus
ggtgaagcttattttccttggagtt

SEQ ID NO: 650792 - DNA, 25 bp, Mus musculus
ggtgaagctttcctactatctacat

SEQ ID NO: 650793 - DNA, 25 bp, Mus musculus
ggtgaagctttcgtactatctacat

SEQ ID NO: 650794 - DNA, 25 bp, Mus musculus
ggtgaagcttttcacacgccagctt

SEQ ID NO: 650795 - DNA, 25 bp, Mus musculus
ggtgaagcttttgacacgccagctt

SEQ ID NO: 650796 - DNA, 25 bp, Mus musculus
ggtgaaggagagaacttactctgta

SEQ ID NO: 650797 - DNA, 25 bp, Mus musculus
ggtgaaggagagtacttactctgta

SEQ ID NO: 650798 - DNA, 25 bp, Mus musculus
ggtgaaggagtaatcatggctgctc

SEQ ID NO: 650799 - DNA, 25 bp, Mus musculus
ggtgaaggagtattcatggctgctc

SEQ ID NO: 650800 - DNA, 25 bp, Mus musculus
ggtgaaggccaaagacagaacctat

SEQ ID NO: 650801 - DNA, 25 bp, Mus musculus
ggtgaaggccaatgacagaacctat

SEQ ID NO: 650802 - DNA, 25 bp, Mus musculus
ggtgaagggcctagctacataagca

SEQ ID NO: 650803 - DNA, 25 bp, Mus musculus
ggtgaagggccttgctacataagca

SEQ ID NO: 650804 - DNA, 25 bp, Mus musculus
ggtgaaggtcccctacaggaagatc

SEQ ID NO: 650805 - DNA, 25 bp, Mus musculus
ggtgaaggtcccgtacaggaagatc

SEQ ID NO: 650806 - DNA, 25 bp, Mus musculus
ggtgaaggtctgacagtagctctta

SEQ ID NO: 650807 - DNA, 25 bp, Mus musculus
ggtgaaggtctgtcagtagctctta

SEQ ID NO: 650808 - DNA, 25 bp, Mus musculus
ggtgaagtacccaggactcagccaa

SEQ ID NO: 650809 - DNA, 25 bp, Mus musculus
ggtgaagtaccctggactcagccaa

SEQ ID NO: 650810 - DNA, 25 bp, Mus musculus
ggtgaagtcccaatctgcagagtcc

SEQ ID NO: 650811 - DNA, 25 bp, Mus musculus
ggtgaagtcccaccttgaatcgaaa

SEQ ID NO: 650812 - DNA, 25 bp, Mus musculus
ggtgaagtcccagcttgaatcgaaa

SEQ ID NO: 650813 - DNA, 25 bp, Mus musculus
ggtgaagtcccattctgcagagtcc

SEQ ID NO: 650814 - DNA, 25 bp, Mus musculus
ggtgaagtcctgagacatgtccttt

SEQ ID NO: 650815 - DNA, 25 bp, Mus musculus
ggtgaagtcctgtgacatgtccttt

SEQ ID NO: 650816 - DNA, 25 bp, Mus musculus
ggtgaagtctctcaaagacccgcgc

SEQ ID NO: 650817 - DNA, 25 bp, Mus musculus
ggtgaagtctctgaaagacccgcgc

SEQ ID NO: 650818 - DNA, 25 bp, Mus musculus
ggtgaagttccgattatccaagcct

SEQ ID NO: 650819 - DNA, 25 bp, Mus musculus
ggtgaagttccgtttatccaagcct

SEQ ID NO: 650820 - DNA, 25 bp, Mus musculus
ggtgaagttcctagtgtctgttgaa

SEQ ID NO: 650821 - DNA, 25 bp, Mus musculus
ggtgaagttccttgtgtctgttgaa

SEQ ID NO: 650822 - DNA, 25 bp, Mus musculus
ggtgaagttcgtctgttccgatatc

SEQ ID NO: 650823 - DNA, 25 bp, Mus musculus
ggtgaagttcgtgtgttccgatatc

SEQ ID NO: 650824 - DNA, 25 bp, Mus musculus
ggtgaagtttttcctctaaaccatt

SEQ ID NO: 650825 - DNA, 25 bp, Mus musculus
ggtgaagtttttgctctaaaccatt

SEQ ID NO: 650826 - DNA, 25 bp, Mus musculus
ggtgaataagctagctgtcctccct

SEQ ID NO: 650827 - DNA, 25 bp, Mus musculus
ggtgaataagcttgctgtcctccct

SEQ ID NO: 650828 - DNA, 25 bp, Mus musculus
ggtgaataattcaggtgttgaagct

SEQ ID NO: 650829 - DNA, 25 bp, Mus musculus
ggtgaataattctggtgttgaagct

SEQ ID NO: 650830 - DNA, 25 bp, Mus musculus
ggtgaatactaacttgttccttact

SEQ ID NO: 650831 - DNA, 25 bp, Mus musculus
ggtgaatactaagttgttccttact

SEQ ID NO: 650832 - DNA, 25 bp, Mus musculus
ggtgaatagacactcttcccagaac

SEQ ID NO: 650833 - DNA, 25 bp, Mus musculus
ggtgaatagacagtcttcccagaac

SEQ ID NO: 650834 - DNA, 25 bp, Mus musculus
ggtgaataggccattactaagaagc

SEQ ID NO: 650835 - DNA, 25 bp, Mus musculus
ggtgaataggcctttactaagaagc

SEQ ID NO: 650836 - DNA, 25 bp, Mus musculus
ggtgaatattggaccactgctgctt

SEQ ID NO: 650837 - DNA, 25 bp, Mus musculus
ggtgaatattggtccactgctgctt

SEQ ID NO: 650838 - DNA, 25 bp, Mus musculus
ggtgaatattttccacaggcatcaa

SEQ ID NO: 650839 - DNA, 25 bp, Mus musculus
ggtgaatattttgcacaggcatcaa

SEQ ID NO: 650840 - DNA, 25 bp, Mus musculus
ggtgaatccttcaggcagacagcgt

SEQ ID NO: 650841 - DNA, 25 bp, Mus musculus
ggtgaatccttcctggacatactca

SEQ ID NO: 650842 - DNA, 25 bp, Mus musculus
ggtgaatccttcgtggacatactca

SEQ ID NO: 650843 - DNA, 25 bp, Mus musculus
ggtgaatccttctggcagacagcgt

SEQ ID NO: 650844 - DNA, 25 bp, Mus musculus
ggtgaatctcaaactggaggacatt

SEQ ID NO: 650845 - DNA, 25 bp, Mus musculus
ggtgaatctcaaatacctgctgaaa

SEQ ID NO: 650846 - DNA, 25 bp, Mus musculus
ggtgaatctcaatctggaggacatt

SEQ ID NO: 650847 - DNA, 25 bp, Mus musculus
ggtgaatctcaattacctgctgaaa

SEQ ID NO: 650848 - DNA, 25 bp, Mus musculus
ggtgaatctctaacatggaagcctt

SEQ ID NO: 650849 - DNA, 25 bp, Mus musculus
ggtgaatctctatcatggaagcctt

SEQ ID NO: 650850 - DNA, 25 bp, Mus musculus
ggtgaatctgtcctttgtaggtcaa

SEQ ID NO: 650851 - DNA, 25 bp, Mus musculus
ggtgaatctgtcgtttgtaggtcaa

SEQ ID NO: 650852 - DNA, 25 bp, Mus musculus
ggtgaatcttaccagcctaagctaa

SEQ ID NO: 650853 - DNA, 25 bp, Mus musculus
ggtgaatcttacgagcctaagctaa

SEQ ID NO: 650854 - DNA, 25 bp, Mus musculus
ggtgaatgccttaggcttattttaa

SEQ ID NO: 650855 - DNA, 25 bp, Mus musculus
ggtgaatgcctttggcttattttaa

SEQ ID NO: 650856 - DNA, 25 bp, Mus musculus
ggtgaatgctatcctcaaggccctg

SEQ ID NO: 650857 - DNA, 25 bp, Mus musculus
ggtgaatgctatcgaccgaagttat

SEQ ID NO: 650858 - DNA, 25 bp, Mus musculus
ggtgaatgctatgctcaaggccctg

SEQ ID NO: 650859 - DNA, 25 bp, Mus musculus
ggtgaatgctatggaccgaagttat

SEQ ID NO: 650860 - DNA, 25 bp, Mus musculus
ggtgaatgctttcgccacttcctgc

SEQ ID NO: 650861 - DNA, 25 bp, Mus musculus
ggtgaatgctttggccacttcctgc

SEQ ID NO: 650862 - DNA, 25 bp, Mus musculus
ggtgaatggcttacctagcacccca

SEQ ID NO: 650863 - DNA, 25 bp, Mus musculus
ggtgaatggctttcctagcacccca

SEQ ID NO: 650864 - DNA, 25 bp, Mus musculus
ggtgaatgtactactgccatgtgac

SEQ ID NO: 650865 - DNA, 25 bp, Mus musculus
ggtgaatgtacttctgccatgtgac

SEQ ID NO: 650866 - DNA, 25 bp, Mus musculus
ggtgaattaatcatctcctcgtatg

SEQ ID NO: 650867 - DNA, 25 bp, Mus musculus
ggtgaattaatcttctcctcgtatg

SEQ ID NO: 650868 - DNA, 25 bp, Mus musculus
ggtgaattcctcacattccagcgct

SEQ ID NO: 650869 - DNA, 25 bp, Mus musculus
ggtgaattcctctcattccagcgct

SEQ ID NO: 650870 - DNA, 25 bp, Mus musculus
ggtgaattcctgctcatgtctgtac

SEQ ID NO: 650871 - DNA, 25 bp, Mus musculus
ggtgaattcctggtcatgtctgtac

SEQ ID NO: 650872 - DNA, 25 bp, Mus musculus
ggtgaatttcttctctagtaccctg

SEQ ID NO: 650873 - DNA, 25 bp, Mus musculus
ggtgaatttcttgtctagtaccctg

SEQ ID NO: 650874 - DNA, 25 bp, Mus musculus
ggtgaatttggccttaaccagctgc

SEQ ID NO: 650875 - DNA, 25 bp, Mus musculus
ggtgaatttggcgttaaccagctgc

SEQ ID NO: 650876 - DNA, 25 bp, Mus musculus
ggtgaattttttcatgccttggaat

SEQ ID NO: 650877 - DNA, 25 bp, Mus musculus
ggtgaattttttgatgccttggaat

SEQ ID NO: 650878 - DNA, 25 bp, Mus musculus
ggtgacaaaattcagagtttcctat

SEQ ID NO: 650879 - DNA, 25 bp, Mus musculus
ggtgacaaaattgagagtttcctat

SEQ ID NO: 650880 - DNA, 25 bp, Mus musculus
ggtgacaaacctaagcatccgagca

SEQ ID NO: 650881 - DNA, 25 bp, Mus musculus
ggtgacaaaccttagcatccgagca

SEQ ID NO: 650882 - DNA, 25 bp, Mus musculus
ggtgacaaacttagcctttgggatg

SEQ ID NO: 650883 - DNA, 25 bp, Mus musculus
ggtgacaaactttgcctttgggatg

SEQ ID NO: 650884 - DNA, 25 bp, Mus musculus
ggtgacaaaggactggcctccccga

SEQ ID NO: 650885 - DNA, 25 bp, Mus musculus
ggtgacaaaggagtggcctccccga

SEQ ID NO: 650886 - DNA, 25 bp, Mus musculus
ggtgacaaaggtagtttccctcagt

SEQ ID NO: 650887 - DNA, 25 bp, Mus musculus
ggtgacaaaggttgtttccctcagt

SEQ ID NO: 650888 - DNA, 25 bp, Mus musculus
ggtgacaaatctcaggcattcaaag

SEQ ID NO: 650889 - DNA, 25 bp, Mus musculus
ggtgacaaatctgaggcattcaaag

SEQ ID NO: 650890 - DNA, 25 bp, Mus musculus
ggtgacaacacaaatccatctggta

SEQ ID NO: 650891 - DNA, 25 bp, Mus musculus
ggtgacaacacatatccatctggta

SEQ ID NO: 650892 - DNA, 25 bp, Mus musculus
ggtgacaaccccaggaattacagtc

SEQ ID NO: 650893 - DNA, 25 bp, Mus musculus
ggtgacaacccctggaattacagtc

SEQ ID NO: 650894 - DNA, 25 bp, Mus musculus
ggtgacaacgctcaattggtcctca

SEQ ID NO: 650895 - DNA, 25 bp, Mus musculus
ggtgacaacgctgaattggtcctca

SEQ ID NO: 650896 - DNA, 25 bp, Mus musculus
ggtgacaacggtacttacttcttca

SEQ ID NO: 650897 - DNA, 25 bp, Mus musculus
ggtgacaacggttcttacttcttca

SEQ ID NO: 650898 - DNA, 25 bp, Mus musculus
ggtgacaacgtcaacgggcacttta

SEQ ID NO: 650899 - DNA, 25 bp, Mus musculus
ggtgacaacgtctacgggcacttta

SEQ ID NO: 650900 - DNA, 25 bp, Mus musculus
ggtgacaactgaagtattcgcgtat

SEQ ID NO: 650901 - DNA, 25 bp, Mus musculus
ggtgacaactgatgtattcgcgtat

SEQ ID NO: 650902 - DNA, 25 bp, Mus musculus
ggtgacaagttcctcataccttaga

SEQ ID NO: 650903 - DNA, 25 bp, Mus musculus
ggtgacaagttcgtcataccttaga

SEQ ID NO: 650904 - DNA, 25 bp, Mus musculus
ggtgacaatcccacttttggatcat

SEQ ID NO: 650905 - DNA, 25 bp, Mus musculus
ggtgacaatccctcttttggatcat

SEQ ID NO: 650906 - DNA, 25 bp, Mus musculus
ggtgacaatctacataagacttagg

SEQ ID NO: 650907 - DNA, 25 bp, Mus musculus
ggtgacaatctagataagacttagg

SEQ ID NO: 650908 - DNA, 25 bp, Mus musculus
ggtgacaatgccattggtggttccc

SEQ ID NO: 650909 - DNA, 25 bp, Mus musculus
ggtgacaatgcctttggtggttccc

SEQ ID NO: 650910 - DNA, 25 bp, Mus musculus
ggtgacaattgtatactttctagga

SEQ ID NO: 650911 - DNA, 25 bp, Mus musculus
ggtgacaattgtttactttctagga

SEQ ID NO: 650912 - DNA, 25 bp, Mus musculus
ggtgacacaaagaacgcctatttta

SEQ ID NO: 650913 - DNA, 25 bp, Mus musculus
ggtgacacaaagtacgcctatttta

SEQ ID NO: 650914 - DNA, 25 bp, Mus musculus
ggtgacacaagcctgtaatgccatc

SEQ ID NO: 650915 - DNA, 25 bp, Mus musculus
ggtgacacaagccttttaatctcag

SEQ ID NO: 650916 - DNA, 25 bp, Mus musculus
ggtgacacaagcgtgtaatgccatc

SEQ ID NO: 650917 - DNA, 25 bp, Mus musculus
ggtgacacaagcgttttaatctcag

SEQ ID NO: 650918 - DNA, 25 bp, Mus musculus
ggtgacacagacacttcaaactttg

SEQ ID NO: 650919 - DNA, 25 bp, Mus musculus
ggtgacacagactcttcaaactttg

SEQ ID NO: 650920 - DNA, 25 bp, Mus musculus
ggtgacacaggccagtgttttctga

SEQ ID NO: 650921 - DNA, 25 bp, Mus musculus
ggtgacacaggcgagtgttttctga

SEQ ID NO: 650922 - DNA, 25 bp, Mus musculus
ggtgacacatatctcaagctgcttt

SEQ ID NO: 650923 - DNA, 25 bp, Mus musculus
ggtgacacatatgtcaagctgcttt

SEQ ID NO: 650924 - DNA, 25 bp, Mus musculus
ggtgacaccagcaatggctaattgc

SEQ ID NO: 650925 - DNA, 25 bp, Mus musculus
ggtgacaccagctatggctaattgc

SEQ ID NO: 650926 - DNA, 25 bp, Mus musculus
ggtgacaccatcatgcagagcccga

SEQ ID NO: 650927 - DNA, 25 bp, Mus musculus
ggtgacaccatcttgcagagcccga

SEQ ID NO: 650928 - DNA, 25 bp, Mus musculus
ggtgacaccctcatgatacaacatt

SEQ ID NO: 650929 - DNA, 25 bp, Mus musculus
ggtgacaccctcttgatacaacatt

SEQ ID NO: 650930 - DNA, 25 bp, Mus musculus
ggtgacaccgaacccaggaatcgat

SEQ ID NO: 650931 - DNA, 25 bp, Mus musculus
ggtgacaccgaagccaggaatcgat

SEQ ID NO: 650932 - DNA, 25 bp, Mus musculus
ggtgacacctacacaagtctctaat

SEQ ID NO: 650933 - DNA, 25 bp, Mus musculus
ggtgacacctactcaagtctctaat

SEQ ID NO: 650934 - DNA, 25 bp, Mus musculus
ggtgacaccttgaccaactctagag

SEQ ID NO: 650935 - DNA, 25 bp, Mus musculus
ggtgacaccttgtccaactctagag

SEQ ID NO: 650936 - DNA, 25 bp, Mus musculus
ggtgacacgcacaggagaactctat

SEQ ID NO: 650937 - DNA, 25 bp, Mus musculus
ggtgacacgcactggagaactctat

SEQ ID NO: 650938 - DNA, 25 bp, Mus musculus
ggtgacactctgcacaggctgttaa

SEQ ID NO: 650939 - DNA, 25 bp, Mus musculus
ggtgacactctggacaggctgttaa

SEQ ID NO: 650940 - DNA, 25 bp, Mus musculus
ggtgacagaccacttcctatgcagt

SEQ ID NO: 650941 - DNA, 25 bp, Mus musculus
ggtgacagaccagttcctatgcagt

SEQ ID NO: 650942 - DNA, 25 bp, Mus musculus
ggtgacagacgaagtcttcacatat

SEQ ID NO: 650943 - DNA, 25 bp, Mus musculus
ggtgacagacgatgtcttcacatat

SEQ ID NO: 650944 - DNA, 25 bp, Mus musculus
ggtgacagataacaaagcaggttag

SEQ ID NO: 650945 - DNA, 25 bp, Mus musculus
ggtgacagataagaaagcaggttag

SEQ ID NO: 650946 - DNA, 25 bp, Mus musculus
ggtgacagatgtacactccagcaga

SEQ ID NO: 650947 - DNA, 25 bp, Mus musculus
ggtgacagatgttcactccagcaga

SEQ ID NO: 650948 - DNA, 25 bp, Mus musculus
ggtgacagcaaacttcagcccaaaa

SEQ ID NO: 650949 - DNA, 25 bp, Mus musculus
ggtgacagcaaagttcagcccaaaa

SEQ ID NO: 650950 - DNA, 25 bp, Mus musculus
ggtgacagccctctgaaactgtgct

SEQ ID NO: 650951 - DNA, 25 bp, Mus musculus
ggtgacagccctgtgaaactgtgct

SEQ ID NO: 650952 - DNA, 25 bp, Mus musculus
ggtgacagccttctactggtgtgta

SEQ ID NO: 650953 - DNA, 25 bp, Mus musculus
ggtgacagccttgtactggtgtgta

SEQ ID NO: 650954 - DNA, 25 bp, Mus musculus
ggtgacaggcacacatttttgtata

SEQ ID NO: 650955 - DNA, 25 bp, Mus musculus
ggtgacaggcactcatttttgtata

SEQ ID NO: 650956 - DNA, 25 bp, Mus musculus
ggtgacaggctaatgtgcactcaat

SEQ ID NO: 650957 - DNA, 25 bp, Mus musculus
ggtgacaggctattgtgcactcaat

SEQ ID NO: 650958 - DNA, 25 bp, Mus musculus
ggtgacagggacacatgctgaccac

SEQ ID NO: 650959 - DNA, 25 bp, Mus musculus
ggtgacagggactcatgctgaccac

SEQ ID NO: 650960 - DNA, 25 bp, Mus musculus
ggtgacagggcaaatcttggtgaat

SEQ ID NO: 650961 - DNA, 25 bp, Mus musculus
ggtgacagggcatatcttggtgaat

SEQ ID NO: 650962 - DNA, 25 bp, Mus musculus
ggtgacagtaccctatctactaaac

SEQ ID NO: 650963 - DNA, 25 bp, Mus musculus
ggtgacagtaccgtatctactaaac

SEQ ID NO: 650964 - DNA, 25 bp, Mus musculus
ggtgacagtataagtgccccttgcc

SEQ ID NO: 650965 - DNA, 25 bp, Mus musculus
ggtgacagtatatgtgccccttgcc

SEQ ID NO: 650966 - DNA, 25 bp, Mus musculus
ggtgacagtgaaaacagtacaaggt

SEQ ID NO: 650967 - DNA, 25 bp, Mus musculus
ggtgacagtgaatacagtacaaggt

SEQ ID NO: 650968 - DNA, 25 bp, Mus musculus
ggtgacagttaccttctgtagttga

SEQ ID NO: 650969 - DNA, 25 bp, Mus musculus
ggtgacagttacgttctgtagttga

SEQ ID NO: 650970 - DNA, 25 bp, Mus musculus
ggtgacataaccctgaagcctcaat

SEQ ID NO: 650971 - DNA, 25 bp, Mus musculus
ggtgacataaccgtgaagcctcaat

SEQ ID NO: 650972 - DNA, 25 bp, Mus musculus
ggtgacatatgtctcccaagtgttg

SEQ ID NO: 650973 - DNA, 25 bp, Mus musculus
ggtgacatatgtgtcccaagtgttg

SEQ ID NO: 650974 - DNA, 25 bp, Mus musculus
ggtgacatcagcaacgcggtgataa

SEQ ID NO: 650975 - DNA, 25 bp, Mus musculus
ggtgacatcagcacggtgaatcctt

SEQ ID NO: 650976 - DNA, 25 bp, Mus musculus
ggtgacatcagctacgcggtgataa

SEQ ID NO: 650977 - DNA, 25 bp, Mus musculus
ggtgacatcagctcggtgaatcctt

SEQ ID NO: 650978 - DNA, 25 bp, Mus musculus
ggtgacatcataacctccactcaca

SEQ ID NO: 650979 - DNA, 25 bp, Mus musculus
ggtgacatcatatcctccactcaca

SEQ ID NO: 650980 - DNA, 25 bp, Mus musculus
ggtgacatcattcgtcctggataaa

SEQ ID NO: 650981 - DNA, 25 bp, Mus musculus
ggtgacatcattggtcctggataaa

SEQ ID NO: 650982 - DNA, 25 bp, Mus musculus
ggtgacatcctgaagggtctcagct

SEQ ID NO: 650983 - DNA, 25 bp, Mus musculus
ggtgacatcctgtagggtctcagct

SEQ ID NO: 650984 - DNA, 25 bp, Mus musculus
ggtgacatcgcaacactaggtgcat

SEQ ID NO: 650985 - DNA, 25 bp, Mus musculus
ggtgacatcgcatcactaggtgcat

SEQ ID NO: 650986 - DNA, 25 bp, Mus musculus
ggtgacatctgtctcatggaactta

SEQ ID NO: 650987 - DNA, 25 bp, Mus musculus
ggtgacatctgtgtcatggaactta

SEQ ID NO: 650988 - DNA, 25 bp, Mus musculus
ggtgacatgaacaacaggcacattt

SEQ ID NO: 650989 - DNA, 25 bp, Mus musculus
ggtgacatgaactacaggcacattt

SEQ ID NO: 650990 - DNA, 25 bp, Mus musculus
ggtgacatgacgacattggttccct

SEQ ID NO: 650991 - DNA, 25 bp, Mus musculus
ggtgacatgacgtcattggttccct

SEQ ID NO: 650992 - DNA, 25 bp, Mus musculus
ggtgacatgatgacagcttctgtgt

SEQ ID NO: 650993 - DNA, 25 bp, Mus musculus
ggtgacatgatgtcagcttctgtgt

SEQ ID NO: 650994 - DNA, 25 bp, Mus musculus
ggtgacatgctacaactgtttctgt

SEQ ID NO: 650995 - DNA, 25 bp, Mus musculus
ggtgacatgctagaactgtttctgt

SEQ ID NO: 650996 - DNA, 25 bp, Mus musculus
ggtgacatggatacactttgtgtgc

SEQ ID NO: 650997 - DNA, 25 bp, Mus musculus
ggtgacatggattcactttgtgtgc

SEQ ID NO: 650998 - DNA, 25 bp, Mus musculus
ggtgacatggtcaggatgctacaat

SEQ ID NO: 650999 - DNA, 25 bp, Mus musculus
ggtgacatggtctggatgctacaat

SEQ ID NO: 651000 - DNA, 25 bp, Mus musculus
ggtgacatgtctaggctcacaggaa

SEQ ID NO: 651001 - DNA, 25 bp, Mus musculus
ggtgacatgtctataaccattcaag

SEQ ID NO: 651002 - DNA, 25 bp, Mus musculus
ggtgacatgtcttggctcacaggaa

SEQ ID NO: 651003 - DNA, 25 bp, Mus musculus
ggtgacatgtctttaaccattcaag

SEQ ID NO: 651004 - DNA, 25 bp, Mus musculus
ggtgacatgtttatagtgctctggt

SEQ ID NO: 651005 - DNA, 25 bp, Mus musculus
ggtgacatgtttttagtgctctggt

SEQ ID NO: 651006 - DNA, 25 bp, Mus musculus
ggtgacattagaatttcctaaggag

SEQ ID NO: 651007 - DNA, 25 bp, Mus musculus
ggtgacattagattttcctaaggag

SEQ ID NO: 651008 - DNA, 25 bp, Mus musculus
ggtgaccaactaagggtgacgtttg

SEQ ID NO: 651009 - DNA, 25 bp, Mus musculus
ggtgaccaactatgggtgacgtttg

SEQ ID NO: 651010 - DNA, 25 bp, Mus musculus
ggtgaccaacttatatcttctgttt

SEQ ID NO: 651011 - DNA, 25 bp, Mus musculus
ggtgaccaacttttatcttctgttt

SEQ ID NO: 651012 - DNA, 25 bp, Mus musculus
ggtgaccaagaccatctcaggatga

SEQ ID NO: 651013 - DNA, 25 bp, Mus musculus
ggtgaccaagacgatctcaggatga

SEQ ID NO: 651014 - DNA, 25 bp, Mus musculus
ggtgaccaagcaatccagcggatga

SEQ ID NO: 651015 - DNA, 25 bp, Mus musculus
ggtgaccaagcacggcaacgtcgtc

SEQ ID NO: 651016 - DNA, 25 bp, Mus musculus
ggtgaccaagcagggcaacgtcgtc

SEQ ID NO: 651017 - DNA, 25 bp, Mus musculus
ggtgaccaagcattccagcggatga

SEQ ID NO: 651018 - DNA, 25 bp, Mus musculus
ggtgaccaagctcgatgacctcatc

SEQ ID NO: 651019 - DNA, 25 bp, Mus musculus
ggtgaccaagctggatgacctcatc

SEQ ID NO: 651020 - DNA, 25 bp, Mus musculus
ggtgaccacatgagctctgttcaag

SEQ ID NO: 651021 - DNA, 25 bp, Mus musculus
ggtgaccacatgtgctctgttcaag

SEQ ID NO: 651022 - DNA, 25 bp, Mus musculus
ggtgaccactctcccgtgtataata

SEQ ID NO: 651023 - DNA, 25 bp, Mus musculus
ggtgaccactctgccgtgtataata

SEQ ID NO: 651024 - DNA, 25 bp, Mus musculus
ggtgaccagagccttcgttaagtgt

SEQ ID NO: 651025 - DNA, 25 bp, Mus musculus
ggtgaccagagcgttcgttaagtgt

SEQ ID NO: 651026 - DNA, 25 bp, Mus musculus
ggtgaccagcaccacggagcccagt

SEQ ID NO: 651027 - DNA, 25 bp, Mus musculus
ggtgaccagcacgacggagcccagt

SEQ ID NO: 651028 - DNA, 25 bp, Mus musculus
ggtgaccaggtcacttctggtagct

SEQ ID NO: 651029 - DNA, 25 bp, Mus musculus
ggtgaccaggtctcttctggtagct

SEQ ID NO: 651030 - DNA, 25 bp, Mus musculus
ggtgaccagtgtcggcgttcaccac

SEQ ID NO: 651031 - DNA, 25 bp, Mus musculus
ggtgaccagtgtgggcgttcaccac

SEQ ID NO: 651032 - DNA, 25 bp, Mus musculus
ggtgaccataggcaaatgctccagt

SEQ ID NO: 651033 - DNA, 25 bp, Mus musculus
ggtgaccatagggaaatgctccagt

SEQ ID NO: 651034 - DNA, 25 bp, Mus musculus
ggtgaccatttaaccactaaacgtg

SEQ ID NO: 651035 - DNA, 25 bp, Mus musculus
ggtgaccatttatccactaaacgtg

SEQ ID NO: 651036 - DNA, 25 bp, Mus musculus
ggtgacccaaccatacaattatttt

SEQ ID NO: 651037 - DNA, 25 bp, Mus musculus
ggtgacccaaccttacaattatttt

SEQ ID NO: 651038 - DNA, 25 bp, Mus musculus
ggtgacccactaagggatggctttc

SEQ ID NO: 651039 - DNA, 25 bp, Mus musculus
ggtgacccactatgggatggctttc

SEQ ID NO: 651040 - DNA, 25 bp, Mus musculus
ggtgacccagcacttaagaacgctt

SEQ ID NO: 651041 - DNA, 25 bp, Mus musculus
ggtgacccagcagttaagaacgctt

SEQ ID NO: 651042 - DNA, 25 bp, Mus musculus
ggtgacccaggccaggaagaacatc

SEQ ID NO: 651043 - DNA, 25 bp, Mus musculus
ggtgacccaggcgaggaagaacatc

SEQ ID NO: 651044 - DNA, 25 bp, Mus musculus
ggtgacccaggtaataggatgtttg

SEQ ID NO: 651045 - DNA, 25 bp, Mus musculus
ggtgacccaggttataggatgtttg

SEQ ID NO: 651046 - DNA, 25 bp, Mus musculus
ggtgacccataaatctgaaacgttt

SEQ ID NO: 651047 - DNA, 25 bp, Mus musculus
ggtgacccataattctgaaacgttt

SEQ ID NO: 651048 - DNA, 25 bp, Mus musculus
ggtgaccccaaactgtgagcttata

SEQ ID NO: 651049 - DNA, 25 bp, Mus musculus
ggtgaccccaaagtgtgagcttata

SEQ ID NO: 651050 - DNA, 25 bp, Mus musculus
ggtgaccccaccagtgggaagaaga

SEQ ID NO: 651051 - DNA, 25 bp, Mus musculus
ggtgaccccacctgtgggaagaaga

SEQ ID NO: 651052 - DNA, 25 bp, Mus musculus
ggtgaccccggcatggcaactattg

SEQ ID NO: 651053 - DNA, 25 bp, Mus musculus
ggtgaccccggcttggcaactattg

SEQ ID NO: 651054 - DNA, 25 bp, Mus musculus
ggtgacccctttcagattgtagcat

SEQ ID NO: 651055 - DNA, 25 bp, Mus musculus
ggtgacccctttgagattgtagcat

SEQ ID NO: 651056 - DNA, 25 bp, Mus musculus
ggtgaccctcacaattaagacaaaa

SEQ ID NO: 651057 - DNA, 25 bp, Mus musculus
ggtgaccctcactattaagacaaaa

SEQ ID NO: 651058 - DNA, 25 bp, Mus musculus
ggtgaccctcagagtatatttcttg

SEQ ID NO: 651059 - DNA, 25 bp, Mus musculus
ggtgaccctcagtgtatatttcttg

SEQ ID NO: 651060 - DNA, 25 bp, Mus musculus
ggtgaccctcccagagtgcttgggt

SEQ ID NO: 651061 - DNA, 25 bp, Mus musculus
ggtgaccctccctgagtgcttgggt

SEQ ID NO: 651062 - DNA, 25 bp, Mus musculus
ggtgaccgcaagatcggctttgctg

SEQ ID NO: 651063 - DNA, 25 bp, Mus musculus
ggtgaccgcaagttcggctttgctg

SEQ ID NO: 651064 - DNA, 25 bp, Mus musculus
ggtgaccgcgcacacagacagacac

SEQ ID NO: 651065 - DNA, 25 bp, Mus musculus
ggtgaccgcgcagacagacagacac

SEQ ID NO: 651066 - DNA, 25 bp, Mus musculus
ggtgaccgtcacaacaggaggactt

SEQ ID NO: 651067 - DNA, 25 bp, Mus musculus
ggtgaccgtcactacaggaggactt

SEQ ID NO: 651068 - DNA, 25 bp, Mus musculus
ggtgaccgtggtcagcctggcctac

SEQ ID NO: 651069 - DNA, 25 bp, Mus musculus
ggtgaccgtggtgagcctggcctac

SEQ ID NO: 651070 - DNA, 25 bp, Mus musculus
ggtgacctaccccaagctttgtgat

SEQ ID NO: 651071 - DNA, 25 bp, Mus musculus
ggtgacctacccgaagctttgtgat

SEQ ID NO: 651072 - DNA, 25 bp, Mus musculus
ggtgacctcattctcacggactgtg

SEQ ID NO: 651073 - DNA, 25 bp, Mus musculus
ggtgacctcattgtcacggactgtg

SEQ ID NO: 651074 - DNA, 25 bp, Mus musculus
ggtgacctccacagatgtgtctcag

SEQ ID NO: 651075 - DNA, 25 bp, Mus musculus
ggtgacctccactgatgtgtctcag

SEQ ID NO: 651076 - DNA, 25 bp, Mus musculus
ggtgacctccccagaagtagaaatt

SEQ ID NO: 651077 - DNA, 25 bp, Mus musculus
ggtgacctcccctgaagtagaaatt

SEQ ID NO: 651078 - DNA, 25 bp, Mus musculus
ggtgacctcctccaggcacggtgac

SEQ ID NO: 651079 - DNA, 25 bp, Mus musculus
ggtgacctcctcgaggcacggtgac

SEQ ID NO: 651080 - DNA, 25 bp, Mus musculus
ggtgacctgaaacctttaattttga

SEQ ID NO: 651081 - DNA, 25 bp, Mus musculus
ggtgacctgaaagctttaattttga

SEQ ID NO: 651082 - DNA, 25 bp, Mus musculus
ggtgacctgaacatgatccctagga

SEQ ID NO: 651083 - DNA, 25 bp, Mus musculus
ggtgacctgaacttgatccctagga

SEQ ID NO: 651084 - DNA, 25 bp, Mus musculus
ggtgacctgacaagtgcctggcacc

SEQ ID NO: 651085 - DNA, 25 bp, Mus musculus
ggtgacctgacatgtgcctggcacc

SEQ ID NO: 651086 - DNA, 25 bp, Mus musculus
ggtgacctgactacttcccttcaga

SEQ ID NO: 651087 - DNA, 25 bp, Mus musculus
ggtgacctgacttcttcccttcaga

SEQ ID NO: 651088 - DNA, 25 bp, Mus musculus
ggtgacctgagcacagtatctggaa

SEQ ID NO: 651089 - DNA, 25 bp, Mus musculus
ggtgacctgagctcagtatctggaa

SEQ ID NO: 651090 - DNA, 25 bp, Mus musculus
ggtgacctgcacaccagtgattaga

SEQ ID NO: 651091 - DNA, 25 bp, Mus musculus
ggtgacctgcactccagtgattaga

SEQ ID NO: 651092 - DNA, 25 bp, Mus musculus
ggtgacctggcaaagcttagggaat

SEQ ID NO: 651093 - DNA, 25 bp, Mus musculus
ggtgacctggcatagcttagggaat

SEQ ID NO: 651094 - DNA, 25 bp, Mus musculus
ggtgacctggcccagttagaagcca

SEQ ID NO: 651095 - DNA, 25 bp, Mus musculus
ggtgacctggccgagttagaagcca

SEQ ID NO: 651096 - DNA, 25 bp, Mus musculus
ggtgacctgggacaacagctctgtt

SEQ ID NO: 651097 - DNA, 25 bp, Mus musculus
ggtgacctgggagaacagctctgtt

SEQ ID NO: 651098 - DNA, 25 bp, Mus musculus
ggtgacctggtaattagaactccgt

SEQ ID NO: 651099 - DNA, 25 bp, Mus musculus
ggtgacctggtatttagaactccgt

SEQ ID NO: 651100 - DNA, 25 bp, Mus musculus
ggtgacctgtcaatcaagagcctga

SEQ ID NO: 651101 - DNA, 25 bp, Mus musculus
ggtgacctgtcacattttcagatat

SEQ ID NO: 651102 - DNA, 25 bp, Mus musculus
ggtgacctgtcagattttcagatat

SEQ ID NO: 651103 - DNA, 25 bp, Mus musculus
ggtgacctgtcattcaagagcctga

SEQ ID NO: 651104 - DNA, 25 bp, Mus musculus
ggtgaccttaataatgtgactgtgc

SEQ ID NO: 651105 - DNA, 25 bp, Mus musculus
ggtgaccttaattatgtgactgtgc

SEQ ID NO: 651106 - DNA, 25 bp, Mus musculus
ggtgaccttaccaaatgtagttgct

SEQ ID NO: 651107 - DNA, 25 bp, Mus musculus
ggtgaccttacctaatgtagttgct

SEQ ID NO: 651108 - DNA, 25 bp, Mus musculus
ggtgaccttatcctggcagaggcta

SEQ ID NO: 651109 - DNA, 25 bp, Mus musculus
ggtgaccttatcgtggcagaggcta

SEQ ID NO: 651110 - DNA, 25 bp, Mus musculus
ggtgaccttcagcaggctgagaatc

SEQ ID NO: 651111 - DNA, 25 bp, Mus musculus
ggtgaccttcaggaggctgagaatc

SEQ ID NO: 651112 - DNA, 25 bp, Mus musculus
ggtgaccttcctatagtggcacaga

SEQ ID NO: 651113 - DNA, 25 bp, Mus musculus
ggtgaccttcctttagtggcacaga

SEQ ID NO: 651114 - DNA, 25 bp, Mus musculus
ggtgaccttgttcctagactcagaa

SEQ ID NO: 651115 - DNA, 25 bp, Mus musculus
ggtgaccttgttgctagactcagaa

SEQ ID NO: 651116 - DNA, 25 bp, Mus musculus
ggtgacgaaggcatggacatcatca

SEQ ID NO: 651117 - DNA, 25 bp, Mus musculus
ggtgacgaaggcttggacatcatca

SEQ ID NO: 651118 - DNA, 25 bp, Mus musculus
ggtgacgacaccattactgttggga

SEQ ID NO: 651119 - DNA, 25 bp, Mus musculus
ggtgacgacacctttactgttggga

SEQ ID NO: 651120 - DNA, 25 bp, Mus musculus
ggtgacgactatccaggtccagatt

SEQ ID NO: 651121 - DNA, 25 bp, Mus musculus
ggtgacgactatgcaggtccagatt

SEQ ID NO: 651122 - DNA, 25 bp, Mus musculus
ggtgacgactttcgttggaacccag

SEQ ID NO: 651123 - DNA, 25 bp, Mus musculus
ggtgacgactttggttggaacccag

SEQ ID NO: 651124 - DNA, 25 bp, Mus musculus
ggtgacgatcctatgatgacctatc

SEQ ID NO: 651125 - DNA, 25 bp, Mus musculus
ggtgacgatcctttgatgacctatc

SEQ ID NO: 651126 - DNA, 25 bp, Mus musculus
ggtgacgatgaacacgcctatagtg

SEQ ID NO: 651127 - DNA, 25 bp, Mus musculus
ggtgacgatgaagacgcctatagtg

SEQ ID NO: 651128 - DNA, 25 bp, Mus musculus
ggtgacgattttcccaggatcatta

SEQ ID NO: 651129 - DNA, 25 bp, Mus musculus
ggtgacgattttgccaggatcatta

SEQ ID NO: 651130 - DNA, 25 bp, Mus musculus
ggtgacgccagaagactgcgcgata

SEQ ID NO: 651131 - DNA, 25 bp, Mus musculus
ggtgacgccagatgactgcgcgata

SEQ ID NO: 651132 - DNA, 25 bp, Mus musculus
ggtgacgccttcaggaacagcagca

SEQ ID NO: 651133 - DNA, 25 bp, Mus musculus
ggtgacgccttctggaacagcagca

SEQ ID NO: 651134 - DNA, 25 bp, Mus musculus
ggtgacgctttacctgtaagctctt

SEQ ID NO: 651135 - DNA, 25 bp, Mus musculus
ggtgacgctttagctgtaagctctt

SEQ ID NO: 651136 - DNA, 25 bp, Mus musculus
ggtgacggaaaaaactcccagctga

SEQ ID NO: 651137 - DNA, 25 bp, Mus musculus
ggtgacggaaaatactcccagctga

SEQ ID NO: 651138 - DNA, 25 bp, Mus musculus
ggtgacggacctactgcgagcagag

SEQ ID NO: 651139 - DNA, 25 bp, Mus musculus
ggtgacggaccttctgcgagcagag

SEQ ID NO: 651140 - DNA, 25 bp, Mus musculus
ggtgacggcaccatcacaaccaagg

SEQ ID NO: 651141 - DNA, 25 bp, Mus musculus
ggtgacggcaccttcacaaccaagg

SEQ ID NO: 651142 - DNA, 25 bp, Mus musculus
ggtgacgggtatacaaggacatgat

SEQ ID NO: 651143 - DNA, 25 bp, Mus musculus
ggtgacgggtattcaaggacatgat

SEQ ID NO: 651144 - DNA, 25 bp, Mus musculus
ggtgacggttcccatacctcagatg

SEQ ID NO: 651145 - DNA, 25 bp, Mus musculus
ggtgacggttccgatacctcagatg

SEQ ID NO: 651146 - DNA, 25 bp, Mus musculus
ggtgacgtacgacaacctgactaca

SEQ ID NO: 651147 - DNA, 25 bp, Mus musculus
ggtgacgtacgagaacctgactaca

SEQ ID NO: 651148 - DNA, 25 bp, Mus musculus
ggtgacgtactcaatttgcattatc

SEQ ID NO: 651149 - DNA, 25 bp, Mus musculus
ggtgacgtactctatttgcattatc

SEQ ID NO: 651150 - DNA, 25 bp, Mus musculus
ggtgacgtcaagaagtctcttccat

SEQ ID NO: 651151 - DNA, 25 bp, Mus musculus
ggtgacgtcaagtagtctcttccat

SEQ ID NO: 651152 - DNA, 25 bp, Mus musculus
ggtgacgtccccatggatggaatgt

SEQ ID NO: 651153 - DNA, 25 bp, Mus musculus
ggtgacgtccccttggatggaatgt

SEQ ID NO: 651154 - DNA, 25 bp, Mus musculus
ggtgacgtttgcaatccagatcttt

SEQ ID NO: 651155 - DNA, 25 bp, Mus musculus
ggtgacgtttgctatccagatcttt

SEQ ID NO: 651156 - DNA, 25 bp, Mus musculus
ggtgactaagctacgcccaccttgt

SEQ ID NO: 651157 - DNA, 25 bp, Mus musculus
ggtgactaagcttcgcccaccttgt

SEQ ID NO: 651158 - DNA, 25 bp, Mus musculus
ggtgactaaggaaggtccaacctca

SEQ ID NO: 651159 - DNA, 25 bp, Mus musculus
ggtgactaaggatggtccaacctca

SEQ ID NO: 651160 - DNA, 25 bp, Mus musculus
ggtgactaagtccagatgtgatttt

SEQ ID NO: 651161 - DNA, 25 bp, Mus musculus
ggtgactaagtcgagatgtgatttt

SEQ ID NO: 651162 - DNA, 25 bp, Mus musculus
ggtgactaatacaccatattatgta

SEQ ID NO: 651163 - DNA, 25 bp, Mus musculus
ggtgactaatactccatattatgta

SEQ ID NO: 651164 - DNA, 25 bp, Mus musculus
ggtgactacattcatgcctagcttt

SEQ ID NO: 651165 - DNA, 25 bp, Mus musculus
ggtgactacattgatgcctagcttt

SEQ ID NO: 651166 - DNA, 25 bp, Mus musculus
ggtgactactttatgcttgaatgaa

SEQ ID NO: 651167 - DNA, 25 bp, Mus musculus
ggtgactactttttgcttgaatgaa

SEQ ID NO: 651168 - DNA, 25 bp, Mus musculus
ggtgactagaccaggattcccgaaa

SEQ ID NO: 651169 - DNA, 25 bp, Mus musculus
ggtgactagacctggattcccgaaa

SEQ ID NO: 651170 - DNA, 25 bp, Mus musculus
ggtgactagatgagttctttgcagt

SEQ ID NO: 651171 - DNA, 25 bp, Mus musculus
ggtgactagatgtgttctttgcagt

SEQ ID NO: 651172 - DNA, 25 bp, Mus musculus
ggtgactagctaccttcaggagata

SEQ ID NO: 651173 - DNA, 25 bp, Mus musculus
ggtgactagctagcttcaggagata

SEQ ID NO: 651174 - DNA, 25 bp, Mus musculus
ggtgactaggatacccttagcacaa

SEQ ID NO: 651175 - DNA, 25 bp, Mus musculus
ggtgactaggattcccttagcacaa

SEQ ID NO: 651176 - DNA, 25 bp, Mus musculus
ggtgactatggaccaggcacacatc

SEQ ID NO: 651177 - DNA, 25 bp, Mus musculus
ggtgactatggagcaggcacacatc

SEQ ID NO: 651178 - DNA, 25 bp, Mus musculus
ggtgactattcaatgttccttcctc

SEQ ID NO: 651179 - DNA, 25 bp, Mus musculus
ggtgactattcattgttccttcctc

SEQ ID NO: 651180 - DNA, 25 bp, Mus musculus
ggtgactcaaaacctgtgagggaca

SEQ ID NO: 651181 - DNA, 25 bp, Mus musculus
ggtgactcaaaagctgtgagggaca

SEQ ID NO: 651182 - DNA, 25 bp, Mus musculus
ggtgactcacatctatagtctcagc

SEQ ID NO: 651183 - DNA, 25 bp, Mus musculus
ggtgactcacatgtatagtctcagc

SEQ ID NO: 651184 - DNA, 25 bp, Mus musculus
ggtgactcagaacaatccttcggct

SEQ ID NO: 651185 - DNA, 25 bp, Mus musculus
ggtgactcagaagaatccttcggct

SEQ ID NO: 651186 - DNA, 25 bp, Mus musculus
ggtgactcatatcagtaatcccagc

SEQ ID NO: 651187 - DNA, 25 bp, Mus musculus
ggtgactcatatgagtaatcccagc

SEQ ID NO: 651188 - DNA, 25 bp, Mus musculus
ggtgactcccatatattacgtgttc

SEQ ID NO: 651189 - DNA, 25 bp, Mus musculus
ggtgactcccatttattacgtgttc

SEQ ID NO: 651190 - DNA, 25 bp, Mus musculus
ggtgactccctgaactatagttgtc

SEQ ID NO: 651191 - DNA, 25 bp, Mus musculus
ggtgactccctgtactatagttgtc

SEQ ID NO: 651192 - DNA, 25 bp, Mus musculus
ggtgactcgggtattgagctctgcc

SEQ ID NO: 651193 - DNA, 25 bp, Mus musculus
ggtgactcgggttttgagctctgcc

SEQ ID NO: 651194 - DNA, 25 bp, Mus musculus
ggtgactctaaactgtctgtgactc

SEQ ID NO: 651195 - DNA, 25 bp, Mus musculus
ggtgactctaaagtgtctgtgactc

SEQ ID NO: 651196 - DNA, 25 bp, Mus musculus
ggtgactctatacttgtgcagcaac

SEQ ID NO: 651197 - DNA, 25 bp, Mus musculus
ggtgactctatagttgtgcagcaac

SEQ ID NO: 651198 - DNA, 25 bp, Mus musculus
ggtgactctcaaaatgccaaacatg

SEQ ID NO: 651199 - DNA, 25 bp, Mus musculus
ggtgactctcaacctgtgcagtatt

SEQ ID NO: 651200 - DNA, 25 bp, Mus musculus
ggtgactctcaagctgtgcagtatt

SEQ ID NO: 651201 - DNA, 25 bp, Mus musculus
ggtgactctcaatatgccaaacatg

SEQ ID NO: 651202 - DNA, 25 bp, Mus musculus
ggtgactctggacgacccctcaact

SEQ ID NO: 651203 - DNA, 25 bp, Mus musculus
ggtgactctggaggacccctcaact

SEQ ID NO: 651204 - DNA, 25 bp, Mus musculus
ggtgactcttagaccacagaaccat

SEQ ID NO: 651205 - DNA, 25 bp, Mus musculus
ggtgactcttagtccacagaaccat

SEQ ID NO: 651206 - DNA, 25 bp, Mus musculus
ggtgactcttgacccccagacttat

SEQ ID NO: 651207 - DNA, 25 bp, Mus musculus
ggtgactcttgagccccagacttat

SEQ ID NO: 651208 - DNA, 25 bp, Mus musculus
ggtgactgaaccacacattaacata

SEQ ID NO: 651209 - DNA, 25 bp, Mus musculus
ggtgactgaacctcacattaacata

SEQ ID NO: 651210 - DNA, 25 bp, Mus musculus
ggtgactgagctaatttcaccctcc

SEQ ID NO: 651211 - DNA, 25 bp, Mus musculus
ggtgactgagcttatttcaccctcc

SEQ ID NO: 651212 - DNA, 25 bp, Mus musculus
ggtgactgagttatacagcattcat

SEQ ID NO: 651213 - DNA, 25 bp, Mus musculus
ggtgactgagttttacagcattcat

SEQ ID NO: 651214 - DNA, 25 bp, Mus musculus
ggtgactgattcatctcaaggagat

SEQ ID NO: 651215 - DNA, 25 bp, Mus musculus
ggtgactgattcttctcaaggagat

SEQ ID NO: 651216 - DNA, 25 bp, Mus musculus
ggtgactgccagcaacgcctaggat

SEQ ID NO: 651217 - DNA, 25 bp, Mus musculus
ggtgactgccaggaacgcctaggat

SEQ ID NO: 651218 - DNA, 25 bp, Mus musculus
ggtgactgcgacacctcatcatgca

SEQ ID NO: 651219 - DNA, 25 bp, Mus musculus
ggtgactgcgactcctcatcatgca

SEQ ID NO: 651220 - DNA, 25 bp, Mus musculus
ggtgactgctgtattaatatatttt

SEQ ID NO: 651221 - DNA, 25 bp, Mus musculus
ggtgactgctgttttaatatatttt

SEQ ID NO: 651222 - DNA, 25 bp, Mus musculus
ggtgactgctttctagtgaattttc

SEQ ID NO: 651223 - DNA, 25 bp, Mus musculus
ggtgactgctttgtagtgaattttc

SEQ ID NO: 651224 - DNA, 25 bp, Mus musculus
ggtgactgtaacaatgtactccatc

SEQ ID NO: 651225 - DNA, 25 bp, Mus musculus
ggtgactgtaactatgtactccatc

SEQ ID NO: 651226 - DNA, 25 bp, Mus musculus
ggtgactgtgataagccctggctac

SEQ ID NO: 651227 - DNA, 25 bp, Mus musculus
ggtgactgtgattagccctggctac

SEQ ID NO: 651228 - DNA, 25 bp, Mus musculus
ggtgactgtgtacagctgtgcacct

SEQ ID NO: 651229 - DNA, 25 bp, Mus musculus
ggtgactgtgtagagctgtgcacct

SEQ ID NO: 651230 - DNA, 25 bp, Mus musculus
ggtgactgttaaacgacttgacttt

SEQ ID NO: 651231 - DNA, 25 bp, Mus musculus
ggtgactgttaatcgacttgacttt

SEQ ID NO: 651232 - DNA, 25 bp, Mus musculus
ggtgactgttggatattctggcaca

SEQ ID NO: 651233 - DNA, 25 bp, Mus musculus
ggtgactgttggttattctggcaca

SEQ ID NO: 651234 - DNA, 25 bp, Mus musculus
ggtgacttaagaattgggcctctgt

SEQ ID NO: 651235 - DNA, 25 bp, Mus musculus
ggtgacttaagatttgggcctctgt

SEQ ID NO: 651236 - DNA, 25 bp, Mus musculus
ggtgacttagaccatttagaattaa

SEQ ID NO: 651237 - DNA, 25 bp, Mus musculus
ggtgacttagacgatttagaattaa

SEQ ID NO: 651238 - DNA, 25 bp, Mus musculus
ggtgacttcaaaaggttaaacagca

SEQ ID NO: 651239 - DNA, 25 bp, Mus musculus
ggtgacttcaaatggttaaacagca

SEQ ID NO: 651240 - DNA, 25 bp, Mus musculus
ggtgacttcaacctgcagaaccagc

SEQ ID NO: 651241 - DNA, 25 bp, Mus musculus
ggtgacttcaacgtgcagaaccagc

SEQ ID NO: 651242 - DNA, 25 bp, Mus musculus
ggtgacttcaagcagtcctttctat

SEQ ID NO: 651243 - DNA, 25 bp, Mus musculus
ggtgacttcaaggagtcctttctat

SEQ ID NO: 651244 - DNA, 25 bp, Mus musculus
ggtgacttcacccatgaggtaaagt

SEQ ID NO: 651245 - DNA, 25 bp, Mus musculus
ggtgacttcaccgatgaggtaaagt

SEQ ID NO: 651246 - DNA, 25 bp, Mus musculus
ggtgacttcatgattgtaactcggt

SEQ ID NO: 651247 - DNA, 25 bp, Mus musculus
ggtgacttcatgtttgtaactcggt

SEQ ID NO: 651248 - DNA, 25 bp, Mus musculus
ggtgacttcattaggctgtgttcag

SEQ ID NO: 651249 - DNA, 25 bp, Mus musculus
ggtgacttcatttggctgtgttcag

SEQ ID NO: 651250 - DNA, 25 bp, Mus musculus
ggtgacttccacaatccctggaaaa

SEQ ID NO: 651251 - DNA, 25 bp, Mus musculus
ggtgacttccactatccctggaaaa

SEQ ID NO: 651252 - DNA, 25 bp, Mus musculus
ggtgacttccatcagaggttcagct

SEQ ID NO: 651253 - DNA, 25 bp, Mus musculus
ggtgacttccatgagaggttcagct

SEQ ID NO: 651254 - DNA, 25 bp, Mus musculus
ggtgacttctttagttaactaagca

SEQ ID NO: 651255 - DNA, 25 bp, Mus musculus
ggtgacttcttttgttaactaagca

SEQ ID NO: 651256 - DNA, 25 bp, Mus musculus
ggtgacttgagtagaatagccagca

SEQ ID NO: 651257 - DNA, 25 bp, Mus musculus
ggtgacttgagttgaatagccagca

SEQ ID NO: 651258 - DNA, 25 bp, Mus musculus
ggtgactttaggactccagtgtaca

SEQ ID NO: 651259 - DNA, 25 bp, Mus musculus
ggtgactttaggtctccagtgtaca

SEQ ID NO: 651260 - DNA, 25 bp, Mus musculus
ggtgactttcacatgttatgtagct

SEQ ID NO: 651261 - DNA, 25 bp, Mus musculus
ggtgactttcacttgttatgtagct

SEQ ID NO: 651262 - DNA, 25 bp, Mus musculus
ggtgactttcctaggcagacataaa

SEQ ID NO: 651263 - DNA, 25 bp, Mus musculus
ggtgactttccttggcagacataaa

SEQ ID NO: 651264 - DNA, 25 bp, Mus musculus
ggtgactttctgaatcagttacact

SEQ ID NO: 651265 - DNA, 25 bp, Mus musculus
ggtgactttctgctacaataaggtc

SEQ ID NO: 651266 - DNA, 25 bp, Mus musculus
ggtgactttctggtacaataaggtc

SEQ ID NO: 651267 - DNA, 25 bp, Mus musculus
ggtgactttctgtatcagttacact

SEQ ID NO: 651268 - DNA, 25 bp, Mus musculus
ggtgactttgctatgactagattaa

SEQ ID NO: 651269 - DNA, 25 bp, Mus musculus
ggtgactttgctttgactagattaa

SEQ ID NO: 651270 - DNA, 25 bp, Mus musculus
ggtgactttgtgagtacattcttca

SEQ ID NO: 651271 - DNA, 25 bp, Mus musculus
ggtgactttgtgtgtacattcttca

SEQ ID NO: 651272 - DNA, 25 bp, Mus musculus
ggtgacttttcacactgggcttgaa

SEQ ID NO: 651273 - DNA, 25 bp, Mus musculus
ggtgacttttcagactgggcttgaa

SEQ ID NO: 651274 - DNA, 25 bp, Mus musculus
ggtgagaaacctccccaacaatgtt

SEQ ID NO: 651275 - DNA, 25 bp, Mus musculus
ggtgagaaacctgcccaacaatgtt

SEQ ID NO: 651276 - DNA, 25 bp, Mus musculus
ggtgagaaatcacttgggcttctgt

SEQ ID NO: 651277 - DNA, 25 bp, Mus musculus
ggtgagaaatcagttgggcttctgt

SEQ ID NO: 651278 - DNA, 25 bp, Mus musculus
ggtgagaacaggagtcaacttcctt

SEQ ID NO: 651279 - DNA, 25 bp, Mus musculus
ggtgagaacaggtgtcaacttcctt

SEQ ID NO: 651280 - DNA, 25 bp, Mus musculus
ggtgagaacattaaacgtgacattt

SEQ ID NO: 651281 - DNA, 25 bp, Mus musculus
ggtgagaacatttaacgtgacattt

SEQ ID NO: 651282 - DNA, 25 bp, Mus musculus
ggtgagaactgactcggacctatat

SEQ ID NO: 651283 - DNA, 25 bp, Mus musculus
ggtgagaactgagtcggacctatat

SEQ ID NO: 651284 - DNA, 25 bp, Mus musculus
ggtgagaaggccaccgcacgcagca

SEQ ID NO: 651285 - DNA, 25 bp, Mus musculus
ggtgagaaggcctccgcacgcagca

SEQ ID NO: 651286 - DNA, 25 bp, Mus musculus
ggtgagaaggtaacacacgctctgt

SEQ ID NO: 651287 - DNA, 25 bp, Mus musculus
ggtgagaaggtatcacacgctctgt

SEQ ID NO: 651288 - DNA, 25 bp, Mus musculus
ggtgagaatcggatacaagcccatt

SEQ ID NO: 651289 - DNA, 25 bp, Mus musculus
ggtgagaatcggttacaagcccatt

SEQ ID NO: 651290 - DNA, 25 bp, Mus musculus
ggtgagaattaaacccatgcttcct

SEQ ID NO: 651291 - DNA, 25 bp, Mus musculus
ggtgagaattaatcccatgcttcct

SEQ ID NO: 651292 - DNA, 25 bp, Mus musculus
ggtgagacacccaaactcagggcaa

SEQ ID NO: 651293 - DNA, 25 bp, Mus musculus
ggtgagacaccctaactcagggcaa

SEQ ID NO: 651294 - DNA, 25 bp, Mus musculus
ggtgagaccgccagagcctacatgt

SEQ ID NO: 651295 - DNA, 25 bp, Mus musculus
ggtgagaccgcctgagcctacatgt

SEQ ID NO: 651296 - DNA, 25 bp, Mus musculus
ggtgagactcttaggattttatttc

SEQ ID NO: 651297 - DNA, 25 bp, Mus musculus
ggtgagactctttggattttatttc

SEQ ID NO: 651298 - DNA, 25 bp, Mus musculus
ggtgagagaatgaccctgagactat

SEQ ID NO: 651299 - DNA, 25 bp, Mus musculus
ggtgagagaatgtccctgagactat

SEQ ID NO: 651300 - DNA, 25 bp, Mus musculus
ggtgagagccagactattttacaat

SEQ ID NO: 651301 - DNA, 25 bp, Mus musculus
ggtgagagccagtctattttacaat

SEQ ID NO: 651302 - DNA, 25 bp, Mus musculus
ggtgagaggagcatgtctggccact

SEQ ID NO: 651303 - DNA, 25 bp, Mus musculus
ggtgagaggagcttgtctggccact

SEQ ID NO: 651304 - DNA, 25 bp, Mus musculus
ggtgagaggatgcatccatccccat

SEQ ID NO: 651305 - DNA, 25 bp, Mus musculus
ggtgagaggatggatccatccccat

SEQ ID NO: 651306 - DNA, 25 bp, Mus musculus
ggtgagaggtttaaagccacagatt

SEQ ID NO: 651307 - DNA, 25 bp, Mus musculus
ggtgagaggttttaagccacagatt

SEQ ID NO: 651308 - DNA, 25 bp, Mus musculus
ggtgagatacatactttattccttt

SEQ ID NO: 651309 - DNA, 25 bp, Mus musculus
ggtgagatacattctttattccttt

SEQ ID NO: 651310 - DNA, 25 bp, Mus musculus
ggtgagatagctaccattgtgtatt

SEQ ID NO: 651311 - DNA, 25 bp, Mus musculus
ggtgagatagcttccattgtgtatt

SEQ ID NO: 651312 - DNA, 25 bp, Mus musculus
ggtgagatccccattgagacactaa

SEQ ID NO: 651313 - DNA, 25 bp, Mus musculus
ggtgagatcccctttgagacactaa

SEQ ID NO: 651314 - DNA, 25 bp, Mus musculus
ggtgagattccaatcagtaggcatt

SEQ ID NO: 651315 - DNA, 25 bp, Mus musculus
ggtgagattccaatttagtgcttga

SEQ ID NO: 651316 - DNA, 25 bp, Mus musculus
ggtgagattccattcagtaggcatt

SEQ ID NO: 651317 - DNA, 25 bp, Mus musculus
ggtgagattccattttagtgcttga

SEQ ID NO: 651318 - DNA, 25 bp, Mus musculus
ggtgagattctcatggactattttt

SEQ ID NO: 651319 - DNA, 25 bp, Mus musculus
ggtgagattctcttggactattttt

SEQ ID NO: 651320 - DNA, 25 bp, Mus musculus
ggtgagattgcacttctgtttctct

SEQ ID NO: 651321 - DNA, 25 bp, Mus musculus
ggtgagattgcagttctgtttctct

SEQ ID NO: 651322 - DNA, 25 bp, Mus musculus
ggtgagcaaaccagccatctaaagg

SEQ ID NO: 651323 - DNA, 25 bp, Mus musculus
ggtgagcaaacctgccatctaaagg

SEQ ID NO: 651324 - DNA, 25 bp, Mus musculus
ggtgagcaacccatattcaagtctt

SEQ ID NO: 651325 - DNA, 25 bp, Mus musculus
ggtgagcaacccttattcaagtctt

SEQ ID NO: 651326 - DNA, 25 bp, Mus musculus
ggtgagcaaggccatttctttgttt

SEQ ID NO: 651327 - DNA, 25 bp, Mus musculus
ggtgagcaaggcgatttctttgttt

SEQ ID NO: 651328 - DNA, 25 bp, Mus musculus
ggtgagcacagcagcttccttggga

SEQ ID NO: 651329 - DNA, 25 bp, Mus musculus
ggtgagcacagctgcttccttggga

SEQ ID NO: 651330 - DNA, 25 bp, Mus musculus
ggtgagcacctgagggcactgctta

SEQ ID NO: 651331 - DNA, 25 bp, Mus musculus
ggtgagcacctgtgggcactgctta

SEQ ID NO: 651332 - DNA, 25 bp, Mus musculus
ggtgagcactcaaactacaccacac

SEQ ID NO: 651333 - DNA, 25 bp, Mus musculus
ggtgagcactcatactacaccacac

SEQ ID NO: 651334 - DNA, 25 bp, Mus musculus
ggtgagcagactctcttcccatcaa

SEQ ID NO: 651335 - DNA, 25 bp, Mus musculus
ggtgagcagactgtcttcccatcaa

SEQ ID NO: 651336 - DNA, 25 bp, Mus musculus
ggtgagcagggacgatcacactccc

SEQ ID NO: 651337 - DNA, 25 bp, Mus musculus
ggtgagcagggaggatcacactccc

SEQ ID NO: 651338 - DNA, 25 bp, Mus musculus
ggtgagcatatccatcctttgaaag

SEQ ID NO: 651339 - DNA, 25 bp, Mus musculus
ggtgagcatatcgatcctttgaaag

SEQ ID NO: 651340 - DNA, 25 bp, Mus musculus
ggtgagcatcaccactacaatgagt

SEQ ID NO: 651341 - DNA, 25 bp, Mus musculus
ggtgagcatcacgactacaatgagt

SEQ ID NO: 651342 - DNA, 25 bp, Mus musculus
ggtgagcattcccaagtgtttaatt

SEQ ID NO: 651343 - DNA, 25 bp, Mus musculus
ggtgagcattccgaagtgtttaatt

SEQ ID NO: 651344 - DNA, 25 bp, Mus musculus
ggtgagcatttaatcactgctggta

SEQ ID NO: 651345 - DNA, 25 bp, Mus musculus
ggtgagcatttattcactgctggta

SEQ ID NO: 651346 - DNA, 25 bp, Mus musculus
ggtgagccactaattcagagtggtt

SEQ ID NO: 651347 - DNA, 25 bp, Mus musculus
ggtgagccactatttcagagtggtt

SEQ ID NO: 651348 - DNA, 25 bp, Mus musculus
ggtgagccacttctccaacaggaag

SEQ ID NO: 651349 - DNA, 25 bp, Mus musculus
ggtgagccacttgtccaacaggaag

SEQ ID NO: 651350 - DNA, 25 bp, Mus musculus
ggtgagccagttagacatccaggaa

SEQ ID NO: 651351 - DNA, 25 bp, Mus musculus
ggtgagccagtttgacatccaggaa

SEQ ID NO: 651352 - DNA, 25 bp, Mus musculus
ggtgagccatgtaactgcctagaaa

SEQ ID NO: 651353 - DNA, 25 bp, Mus musculus
ggtgagccatgttactgcctagaaa

SEQ ID NO: 651354 - DNA, 25 bp, Mus musculus
ggtgagcctaccagctactaatgaa

SEQ ID NO: 651355 - DNA, 25 bp, Mus musculus
ggtgagcctacctgctactaatgaa

SEQ ID NO: 651356 - DNA, 25 bp, Mus musculus
ggtgagccttagaccctgttaggga

SEQ ID NO: 651357 - DNA, 25 bp, Mus musculus
ggtgagccttagtccctgttaggga

SEQ ID NO: 651358 - DNA, 25 bp, Mus musculus
ggtgagcctttcacagaaccttgga

SEQ ID NO: 651359 - DNA, 25 bp, Mus musculus
ggtgagcctttctcagaaccttgga

SEQ ID NO: 651360 - DNA, 25 bp, Mus musculus
ggtgagcgaacgacagttatctgtt

SEQ ID NO: 651361 - DNA, 25 bp, Mus musculus
ggtgagcgaacgtcagttatctgtt

SEQ ID NO: 651362 - DNA, 25 bp, Mus musculus
ggtgagcgagaaagcaccttctctt

SEQ ID NO: 651363 - DNA, 25 bp, Mus musculus
ggtgagcgagaatgcaccttctctt

SEQ ID NO: 651364 - DNA, 25 bp, Mus musculus
ggtgagctacgtcttgttaacacaa

SEQ ID NO: 651365 - DNA, 25 bp, Mus musculus
ggtgagctacgtgttgttaacacaa

SEQ ID NO: 651366 - DNA, 25 bp, Mus musculus
ggtgagctagaaacccctgattggg

SEQ ID NO: 651367 - DNA, 25 bp, Mus musculus
ggtgagctagaatcccctgattggg

SEQ ID NO: 651368 - DNA, 25 bp, Mus musculus
ggtgagctcactctataagtctgtg

SEQ ID NO: 651369 - DNA, 25 bp, Mus musculus
ggtgagctcactgtataagtctgtg

SEQ ID NO: 651370 - DNA, 25 bp, Mus musculus
ggtgagctccttagtgcatcaggaa

SEQ ID NO: 651371 - DNA, 25 bp, Mus musculus
ggtgagctcctttgtgcatcaggaa

SEQ ID NO: 651372 - DNA, 25 bp, Mus musculus
ggtgagctgcaccaaagtacctgag

SEQ ID NO: 651373 - DNA, 25 bp, Mus musculus
ggtgagctgcacgaaagtacctgag

SEQ ID NO: 651374 - DNA, 25 bp, Mus musculus
ggtgagctgtctaatattggctaaa

SEQ ID NO: 651375 - DNA, 25 bp, Mus musculus
ggtgagctgtcttatattggctaaa

SEQ ID NO: 651376 - DNA, 25 bp, Mus musculus
ggtgagctgtttagcacaaacgtgt

SEQ ID NO: 651377 - DNA, 25 bp, Mus musculus
ggtgagctgttttgcacaaacgtgt

SEQ ID NO: 651378 - DNA, 25 bp, Mus musculus
ggtgagcttcccaggaggaagcccc

SEQ ID NO: 651379 - DNA, 25 bp, Mus musculus
ggtgagcttccctggaggaagcccc

SEQ ID NO: 651380 - DNA, 25 bp, Mus musculus
ggtgagcttctcataatctcttttc

SEQ ID NO: 651381 - DNA, 25 bp, Mus musculus
ggtgagcttctcttaatctcttttc

SEQ ID NO: 651382 - DNA, 25 bp, Mus musculus
ggtgagctttcaaggtgccgctgtc

SEQ ID NO: 651383 - DNA, 25 bp, Mus musculus
ggtgagctttcatggtgccgctgtc

SEQ ID NO: 651384 - DNA, 25 bp, Mus musculus
ggtgaggaaggtacgccctctgtca

SEQ ID NO: 651385 - DNA, 25 bp, Mus musculus
ggtgaggaaggttcgccctctgtca

SEQ ID NO: 651386 - DNA, 25 bp, Mus musculus
ggtgaggacaccaaattatctgaat

SEQ ID NO: 651387 - DNA, 25 bp, Mus musculus
ggtgaggacacctaattatctgaat

SEQ ID NO: 651388 - DNA, 25 bp, Mus musculus
ggtgaggactttctttccttccagc

SEQ ID NO: 651389 - DNA, 25 bp, Mus musculus
ggtgaggactttgtttccttccagc

SEQ ID NO: 651390 - DNA, 25 bp, Mus musculus
ggtgaggatcaaagcttctctcgca

SEQ ID NO: 651391 - DNA, 25 bp, Mus musculus
ggtgaggatcaatgcttctctcgca

SEQ ID NO: 651392 - DNA, 25 bp, Mus musculus
ggtgaggatgtaccctttccagatc

SEQ ID NO: 651393 - DNA, 25 bp, Mus musculus
ggtgaggatgtagcctttccagatc

SEQ ID NO: 651394 - DNA, 25 bp, Mus musculus
ggtgaggattcccttagcgtcagtc

SEQ ID NO: 651395 - DNA, 25 bp, Mus musculus
ggtgaggattccgttagcgtcagtc

SEQ ID NO: 651396 - DNA, 25 bp, Mus musculus
ggtgaggcaaacactgctggctgct

SEQ ID NO: 651397 - DNA, 25 bp, Mus musculus
ggtgaggcaaactctgctggctgct

SEQ ID NO: 651398 - DNA, 25 bp, Mus musculus
ggtgaggcacggaggctcttctcta

SEQ ID NO: 651399 - DNA, 25 bp, Mus musculus
ggtgaggcacggtggctcttctcta

SEQ ID NO: 651400 - DNA, 25 bp, Mus musculus
ggtgaggcaggactatttccccaag

SEQ ID NO: 651401 - DNA, 25 bp, Mus musculus
ggtgaggcaggagtatttccccaag

SEQ ID NO: 651402 - DNA, 25 bp, Mus musculus
ggtgaggcccaacctgctaaggcac

SEQ ID NO: 651403 - DNA, 25 bp, Mus musculus
ggtgaggcccaagctgctaaggcac

SEQ ID NO: 651404 - DNA, 25 bp, Mus musculus
ggtgaggccctcatggctttgcccg

SEQ ID NO: 651405 - DNA, 25 bp, Mus musculus
ggtgaggccctcttggctttgcccg

SEQ ID NO: 651406 - DNA, 25 bp, Mus musculus
ggtgaggctataactccagcattca

SEQ ID NO: 651407 - DNA, 25 bp, Mus musculus
ggtgaggctatatctccagcattca

SEQ ID NO: 651408 - DNA, 25 bp, Mus musculus
ggtgaggcttaccttgcagatgcta

SEQ ID NO: 651409 - DNA, 25 bp, Mus musculus
ggtgaggcttacgttgcagatgcta

SEQ ID NO: 651410 - DNA, 25 bp, Mus musculus
ggtgagggcaagactgttacattct

SEQ ID NO: 651411 - DNA, 25 bp, Mus musculus
ggtgagggcaagtctgttacattct

SEQ ID NO: 651412 - DNA, 25 bp, Mus musculus
ggtgagggcagtctgctggtctcct

SEQ ID NO: 651413 - DNA, 25 bp, Mus musculus
ggtgagggcagtgtgctggtctcct

SEQ ID NO: 651414 - DNA, 25 bp, Mus musculus
ggtgagggccagacctcaaagctga

SEQ ID NO: 651415 - DNA, 25 bp, Mus musculus
ggtgagggccagtcctcaaagctga

SEQ ID NO: 651416 - DNA, 25 bp, Mus musculus
ggtgagggctgcaaccctggaaacc

SEQ ID NO: 651417 - DNA, 25 bp, Mus musculus
ggtgagggctgctaccctggaaacc

SEQ ID NO: 651418 - DNA, 25 bp, Mus musculus
ggtgaggtctttatacagaatagcc

SEQ ID NO: 651419 - DNA, 25 bp, Mus musculus
ggtgaggtctttttacagaatagcc

SEQ ID NO: 651420 - DNA, 25 bp, Mus musculus
ggtgaggtgacaacttgttactttt

SEQ ID NO: 651421 - DNA, 25 bp, Mus musculus
ggtgaggtgacatcttgttactttt

SEQ ID NO: 651422 - DNA, 25 bp, Mus musculus
ggtgaggtgatccatgccgtccacc

SEQ ID NO: 651423 - DNA, 25 bp, Mus musculus
ggtgaggtgatcgatgccgtccacc

SEQ ID NO: 651424 - DNA, 25 bp, Mus musculus
ggtgaggtgccaaatgcctgcaatt

SEQ ID NO: 651425 - DNA, 25 bp, Mus musculus
ggtgaggtgccatatgcctgcaatt

SEQ ID NO: 651426 - DNA, 25 bp, Mus musculus
ggtgaggtgtctcatcagctactga

SEQ ID NO: 651427 - DNA, 25 bp, Mus musculus
ggtgaggtgtctgatcagctactga

SEQ ID NO: 651428 - DNA, 25 bp, Mus musculus
ggtgaggttatcatctacagctgaa

SEQ ID NO: 651429 - DNA, 25 bp, Mus musculus
ggtgaggttatcttctacagctgaa

SEQ ID NO: 651430 - DNA, 25 bp, Mus musculus
ggtgaggttgtccatcttcctaaac

SEQ ID NO: 651431 - DNA, 25 bp, Mus musculus
ggtgaggttgtcgatcttcctaaac

SEQ ID NO: 651432 - DNA, 25 bp, Mus musculus
ggtgagtacagtctctttccagagg

SEQ ID NO: 651433 - DNA, 25 bp, Mus musculus
ggtgagtacagtgtctttccagagg

SEQ ID NO: 651434 - DNA, 25 bp, Mus musculus
ggtgagtaccagctctccttccagt

SEQ ID NO: 651435 - DNA, 25 bp, Mus musculus
ggtgagtaccaggtctccttccagt

SEQ ID NO: 651436 - DNA, 25 bp, Mus musculus
ggtgagtaccatcaattttcaatct

SEQ ID NO: 651437 - DNA, 25 bp, Mus musculus
ggtgagtaccatgaattttcaatct

SEQ ID NO: 651438 - DNA, 25 bp, Mus musculus
ggtgagtactggagatccatcaaat

SEQ ID NO: 651439 - DNA, 25 bp, Mus musculus
ggtgagtactggtgatccatcaaat

SEQ ID NO: 651440 - DNA, 25 bp, Mus musculus
ggtgagtaggcaccacacctgtgac

SEQ ID NO: 651441 - DNA, 25 bp, Mus musculus
ggtgagtaggcagcacacctgtgac

SEQ ID NO: 651442 - DNA, 25 bp, Mus musculus
ggtgagtatcccacctccggtcgtg

SEQ ID NO: 651443 - DNA, 25 bp, Mus musculus
ggtgagtatccctcctccggtcgtg

SEQ ID NO: 651444 - DNA, 25 bp, Mus musculus
ggtgagtccctgatgagtttatttt

SEQ ID NO: 651445 - DNA, 25 bp, Mus musculus
ggtgagtccctgttgagtttatttt

SEQ ID NO: 651446 - DNA, 25 bp, Mus musculus
ggtgagtccttacagatgggccact

SEQ ID NO: 651447 - DNA, 25 bp, Mus musculus
ggtgagtccttagagatgggccact

SEQ ID NO: 651448 - DNA, 25 bp, Mus musculus
ggtgagtctgcaagtaaggtcataa

SEQ ID NO: 651449 - DNA, 25 bp, Mus musculus
ggtgagtctgcaccacattcagcca

SEQ ID NO: 651450 - DNA, 25 bp, Mus musculus
ggtgagtctgcagcacattcagcca

SEQ ID NO: 651451 - DNA, 25 bp, Mus musculus
ggtgagtctgcatgtaaggtcataa

SEQ ID NO: 651452 - DNA, 25 bp, Mus musculus
ggtgagtctgtcagggccagctatc

SEQ ID NO: 651453 - DNA, 25 bp, Mus musculus
ggtgagtctgtctgggccagctatc

SEQ ID NO: 651454 - DNA, 25 bp, Mus musculus
ggtgagtgaattctccagacagcca

SEQ ID NO: 651455 - DNA, 25 bp, Mus musculus
ggtgagtgaattgtccagacagcca

SEQ ID NO: 651456 - DNA, 25 bp, Mus musculus
ggtgagtgactcaccttggctgcta

SEQ ID NO: 651457 - DNA, 25 bp, Mus musculus
ggtgagtgactctccttggctgcta

SEQ ID NO: 651458 - DNA, 25 bp, Mus musculus
ggtgagtgctgcaagaacctttgca

SEQ ID NO: 651459 - DNA, 25 bp, Mus musculus
ggtgagtgctgctagaacctttgca

SEQ ID NO: 651460 - DNA, 25 bp, Mus musculus
ggtgagtggcacacagcatctgcat

SEQ ID NO: 651461 - DNA, 25 bp, Mus musculus
ggtgagtggcactcagcatctgcat

SEQ ID NO: 651462 - DNA, 25 bp, Mus musculus
ggtgagtggcgcagtcactccagct

SEQ ID NO: 651463 - DNA, 25 bp, Mus musculus
ggtgagtggcgctgtcactccagct

SEQ ID NO: 651464 - DNA, 25 bp, Mus musculus
ggtgagtgtgcccaagttactgaaa

SEQ ID NO: 651465 - DNA, 25 bp, Mus musculus
ggtgagtgtgccgaagttactgaaa

SEQ ID NO: 651466 - DNA, 25 bp, Mus musculus
ggtgagtgttcacaattccataagt

SEQ ID NO: 651467 - DNA, 25 bp, Mus musculus
ggtgagtgttcagaattccataagt

SEQ ID NO: 651468 - DNA, 25 bp, Mus musculus
ggtgagttacatcggctcatccagt

SEQ ID NO: 651469 - DNA, 25 bp, Mus musculus
ggtgagttacatgggctcatccagt

SEQ ID NO: 651470 - DNA, 25 bp, Mus musculus
ggtgagttatcacccagttaaactt

SEQ ID NO: 651471 - DNA, 25 bp, Mus musculus
ggtgagttatcagccagttaaactt

SEQ ID NO: 651472 - DNA, 25 bp, Mus musculus
ggtgagttcatgatgttagaagtac

SEQ ID NO: 651473 - DNA, 25 bp, Mus musculus
ggtgagttcatgttgttagaagtac

SEQ ID NO: 651474 - DNA, 25 bp, Mus musculus
ggtgagttcctcacacctgtaaccc

SEQ ID NO: 651475 - DNA, 25 bp, Mus musculus
ggtgagttcctctcacctgtaaccc

SEQ ID NO: 651476 - DNA, 25 bp, Mus musculus
ggtgagttcctgaagatatcctaag

SEQ ID NO: 651477 - DNA, 25 bp, Mus musculus
ggtgagttcctgtagatatcctaag

SEQ ID NO: 651478 - DNA, 25 bp, Mus musculus
ggtgagttctttataccacccataa

SEQ ID NO: 651479 - DNA, 25 bp, Mus musculus
ggtgagttctttttaccacccataa

SEQ ID NO: 651480 - DNA, 25 bp, Mus musculus
ggtgagttgaaaccacactgtatca

SEQ ID NO: 651481 - DNA, 25 bp, Mus musculus
ggtgagttgaaagcacactgtatca

SEQ ID NO: 651482 - DNA, 25 bp, Mus musculus
ggtgataaacaccttttcatcccaa

SEQ ID NO: 651483 - DNA, 25 bp, Mus musculus
ggtgataaacacgttttcatcccaa

SEQ ID NO: 651484 - DNA, 25 bp, Mus musculus
ggtgataaagtcaattgtgccatat

SEQ ID NO: 651485 - DNA, 25 bp, Mus musculus
ggtgataaagtctattgtgccatat

SEQ ID NO: 651486 - DNA, 25 bp, Mus musculus
ggtgataaatccaccctgaagttat

SEQ ID NO: 651487 - DNA, 25 bp, Mus musculus
ggtgataaatcctccctgaagttat

SEQ ID NO: 651488 - DNA, 25 bp, Mus musculus
ggtgataacaatctccctttgcata

SEQ ID NO: 651489 - DNA, 25 bp, Mus musculus
ggtgataacaatgtccctttgcata

SEQ ID NO: 651490 - DNA, 25 bp, Mus musculus
ggtgataacctaaacccaggccagc

SEQ ID NO: 651491 - DNA, 25 bp, Mus musculus
ggtgataacctatacccaggccagc

SEQ ID NO: 651492 - DNA, 25 bp, Mus musculus
ggtgataacgttatctccagttcaa

SEQ ID NO: 651493 - DNA, 25 bp, Mus musculus
ggtgataacgttttctccagttcaa

SEQ ID NO: 651494 - DNA, 25 bp, Mus musculus
ggtgataaggtcaagatggactcca

SEQ ID NO: 651495 - DNA, 25 bp, Mus musculus
ggtgataaggtctagatggactcca

SEQ ID NO: 651496 - DNA, 25 bp, Mus musculus
ggtgataatatcactgctttgacag

SEQ ID NO: 651497 - DNA, 25 bp, Mus musculus
ggtgataatatctctgctttgacag

SEQ ID NO: 651498 - DNA, 25 bp, Mus musculus
ggtgataatcttcttcaggcatcag

SEQ ID NO: 651499 - DNA, 25 bp, Mus musculus
ggtgataatcttgttcaggcatcag

SEQ ID NO: 651500 - DNA, 25 bp, Mus musculus
ggtgataattcacagggattccaag

SEQ ID NO: 651501 - DNA, 25 bp, Mus musculus
ggtgataattcagagggattccaag

SEQ ID NO: 651502 - DNA, 25 bp, Mus musculus
ggtgatacaaagacgctcactttct

SEQ ID NO: 651503 - DNA, 25 bp, Mus musculus
ggtgatacaaagtcgctcactttct

SEQ ID NO: 651504 - DNA, 25 bp, Mus musculus
ggtgatacaaccctttagttaatgg

SEQ ID NO: 651505 - DNA, 25 bp, Mus musculus
ggtgatacaaccgtttagttaatgg

SEQ ID NO: 651506 - DNA, 25 bp, Mus musculus
ggtgatacacatcttgtgccagtgt

SEQ ID NO: 651507 - DNA, 25 bp, Mus musculus
ggtgatacacatgttgtgccagtgt

SEQ ID NO: 651508 - DNA, 25 bp, Mus musculus
ggtgatacacggctaagcactatgg

SEQ ID NO: 651509 - DNA, 25 bp, Mus musculus
ggtgatacacgggtaagcactatgg

SEQ ID NO: 651510 - DNA, 25 bp, Mus musculus
ggtgatacagggaggcttttctttc

SEQ ID NO: 651511 - DNA, 25 bp, Mus musculus
ggtgatacagggtggcttttctttc

SEQ ID NO: 651512 - DNA, 25 bp, Mus musculus
ggtgatacagtaacattagaattcc

SEQ ID NO: 651513 - DNA, 25 bp, Mus musculus
ggtgatacagtaacgcagaggaatt

SEQ ID NO: 651514 - DNA, 25 bp, Mus musculus
ggtgatacagtatcattagaattcc

SEQ ID NO: 651515 - DNA, 25 bp, Mus musculus
ggtgatacagtatcgcagaggaatt

SEQ ID NO: 651516 - DNA, 25 bp, Mus musculus
ggtgatacatctcaaaaacctttca

SEQ ID NO: 651517 - DNA, 25 bp, Mus musculus
ggtgatacatctgaaaaacctttca

SEQ ID NO: 651518 - DNA, 25 bp, Mus musculus
ggtgatacattcctttgggaccagt

SEQ ID NO: 651519 - DNA, 25 bp, Mus musculus
ggtgatacattcgtttgggaccagt

SEQ ID NO: 651520 - DNA, 25 bp, Mus musculus
ggtgatacctcaaacacagagcttt

SEQ ID NO: 651521 - DNA, 25 bp, Mus musculus
ggtgatacctcatacacagagcttt

SEQ ID NO: 651522 - DNA, 25 bp, Mus musculus
ggtgatacctctagagctttctgcc

SEQ ID NO: 651523 - DNA, 25 bp, Mus musculus
ggtgatacctcttgagctttctgcc

SEQ ID NO: 651524 - DNA, 25 bp, Mus musculus
ggtgatagcatgacccgagaagcat

SEQ ID NO: 651525 - DNA, 25 bp, Mus musculus
ggtgatagcatgtcccgagaagcat

SEQ ID NO: 651526 - DNA, 25 bp, Mus musculus
ggtgatagcggcacatactcagtac

SEQ ID NO: 651527 - DNA, 25 bp, Mus musculus
ggtgatagcggctcatactcagtac

SEQ ID NO: 651528 - DNA, 25 bp, Mus musculus
ggtgatagtgacatgccaggccaca

SEQ ID NO: 651529 - DNA, 25 bp, Mus musculus
ggtgatagtgacttgccaggccaca

SEQ ID NO: 651530 - DNA, 25 bp, Mus musculus
ggtgatatactgcatccttaattgt

SEQ ID NO: 651531 - DNA, 25 bp, Mus musculus
ggtgatatactggatccttaattgt

SEQ ID NO: 651532 - DNA, 25 bp, Mus musculus
ggtgatatcaccatatattatcatg

SEQ ID NO: 651533 - DNA, 25 bp, Mus musculus
ggtgatatcaccttatattatcatg

SEQ ID NO: 651534 - DNA, 25 bp, Mus musculus
ggtgatatcatcaagatcctcaata

SEQ ID NO: 651535 - DNA, 25 bp, Mus musculus
ggtgatatcatctagatcctcaata

SEQ ID NO: 651536 - DNA, 25 bp, Mus musculus
ggtgatatcctaaccaaggcagcca

SEQ ID NO: 651537 - DNA, 25 bp, Mus musculus
ggtgatatcctatccaaggcagcca

SEQ ID NO: 651538 - DNA, 25 bp, Mus musculus
ggtgatatcctgcaataattccagc

SEQ ID NO: 651539 - DNA, 25 bp, Mus musculus
ggtgatatcctggaataattccagc

SEQ ID NO: 651540 - DNA, 25 bp, Mus musculus
ggtgatatgctaaaccccagtgctg

SEQ ID NO: 651541 - DNA, 25 bp, Mus musculus
ggtgatatgctataccccagtgctg

SEQ ID NO: 651542 - DNA, 25 bp, Mus musculus
ggtgatatggccatttcgataacta

SEQ ID NO: 651543 - DNA, 25 bp, Mus musculus
ggtgatatggccttttcgataacta

SEQ ID NO: 651544 - DNA, 25 bp, Mus musculus
ggtgatatgtacattttcgctctat

SEQ ID NO: 651545 - DNA, 25 bp, Mus musculus
ggtgatatgtacctgatcccaagtt

SEQ ID NO: 651546 - DNA, 25 bp, Mus musculus
ggtgatatgtacgtgatcccaagtt

SEQ ID NO: 651547 - DNA, 25 bp, Mus musculus
ggtgatatgtactttttcgctctat

SEQ ID NO: 651548 - DNA, 25 bp, Mus musculus
ggtgatattaatagcccctggttac

SEQ ID NO: 651549 - DNA, 25 bp, Mus musculus
ggtgatattaattgcccctggttac

SEQ ID NO: 651550 - DNA, 25 bp, Mus musculus
ggtgatattcagagacagttgttgt

SEQ ID NO: 651551 - DNA, 25 bp, Mus musculus
ggtgatattcagtgacagttgttgt

SEQ ID NO: 651552 - DNA, 25 bp, Mus musculus
ggtgatattcccaccaaagataaca

SEQ ID NO: 651553 - DNA, 25 bp, Mus musculus
ggtgatattccctccaaagataaca

SEQ ID NO: 651554 - DNA, 25 bp, Mus musculus
ggtgatattctaagcaactctagtt

SEQ ID NO: 651555 - DNA, 25 bp, Mus musculus
ggtgatattctatgcaactctagtt

SEQ ID NO: 651556 - DNA, 25 bp, Mus musculus
ggtgatcaaaccacagctcctttag

SEQ ID NO: 651557 - DNA, 25 bp, Mus musculus
ggtgatcaaacctcagctcctttag

SEQ ID NO: 651558 - DNA, 25 bp, Mus musculus
ggtgatcaatccactaatagaagaa

SEQ ID NO: 651559 - DNA, 25 bp, Mus musculus
ggtgatcaatcctctaatagaagaa

SEQ ID NO: 651560 - DNA, 25 bp, Mus musculus
ggtgatcaattaaattatttgccta

SEQ ID NO: 651561 - DNA, 25 bp, Mus musculus
ggtgatcaattatattatttgccta

SEQ ID NO: 651562 - DNA, 25 bp, Mus musculus
ggtgatcactagataattttgcctg

SEQ ID NO: 651563 - DNA, 25 bp, Mus musculus
ggtgatcactagttaattttgcctg

SEQ ID NO: 651564 - DNA, 25 bp, Mus musculus
ggtgatcactgtcttctgtggtctg

SEQ ID NO: 651565 - DNA, 25 bp, Mus musculus
ggtgatcactgtgttctgtggtctg

SEQ ID NO: 651566 - DNA, 25 bp, Mus musculus
ggtgatcacttcatttggaagaact

SEQ ID NO: 651567 - DNA, 25 bp, Mus musculus
ggtgatcacttcttttggaagaact

SEQ ID NO: 651568 - DNA, 25 bp, Mus musculus
ggtgatcagcacaggccacgacaag

SEQ ID NO: 651569 - DNA, 25 bp, Mus musculus
ggtgatcagcactggccacgacaag

SEQ ID NO: 651570 - DNA, 25 bp, Mus musculus
ggtgatcagtagaccaggctccgtg

SEQ ID NO: 651571 - DNA, 25 bp, Mus musculus
ggtgatcagtagtccaggctccgtg

SEQ ID NO: 651572 - DNA, 25 bp, Mus musculus
ggtgatcatctccaaagaggtttac

SEQ ID NO: 651573 - DNA, 25 bp, Mus musculus
ggtgatcatctcgaaagaggtttac

SEQ ID NO: 651574 - DNA, 25 bp, Mus musculus
ggtgatcatgatatctccgctaaaa

SEQ ID NO: 651575 - DNA, 25 bp, Mus musculus
ggtgatcatgatatgcccttctaaa

SEQ ID NO: 651576 - DNA, 25 bp, Mus musculus
ggtgatcatgatttctccgctaaaa

SEQ ID NO: 651577 - DNA, 25 bp, Mus musculus
ggtgatcatgatttgcccttctaaa

SEQ ID NO: 651578 - DNA, 25 bp, Mus musculus
ggtgatcattgcctaggtacagatt

SEQ ID NO: 651579 - DNA, 25 bp, Mus musculus
ggtgatcattgcgtaggtacagatt

SEQ ID NO: 651580 - DNA, 25 bp, Mus musculus
ggtgatccatacacacctggctttc

SEQ ID NO: 651581 - DNA, 25 bp, Mus musculus
ggtgatccatactcacctggctttc

SEQ ID NO: 651582 - DNA, 25 bp, Mus musculus
ggtgatcccagccataatattgttt

SEQ ID NO: 651583 - DNA, 25 bp, Mus musculus
ggtgatcccagcgataatattgttt

SEQ ID NO: 651584 - DNA, 25 bp, Mus musculus
ggtgatccctggaccttaggtggca

SEQ ID NO: 651585 - DNA, 25 bp, Mus musculus
ggtgatccctggtccttaggtggca

SEQ ID NO: 651586 - DNA, 25 bp, Mus musculus
ggtgatccctgtcctcctctatatg

SEQ ID NO: 651587 - DNA, 25 bp, Mus musculus
ggtgatccctgtgctcctctatatg

SEQ ID NO: 651588 - DNA, 25 bp, Mus musculus
ggtgatccgtaaccatacattcttt

SEQ ID NO: 651589 - DNA, 25 bp, Mus musculus
ggtgatccgtaagcatacattcttt

SEQ ID NO: 651590 - DNA, 25 bp, Mus musculus
ggtgatcctcagaattcacaagcaa

SEQ ID NO: 651591 - DNA, 25 bp, Mus musculus
ggtgatcctcagtattcacaagcaa

SEQ ID NO: 651592 - DNA, 25 bp, Mus musculus
ggtgatcctgaactcacaagtgcaa

SEQ ID NO: 651593 - DNA, 25 bp, Mus musculus
ggtgatcctgaagtcacaagtgcaa

SEQ ID NO: 651594 - DNA, 25 bp, Mus musculus
ggtgatccttcaagatacatgtcga

SEQ ID NO: 651595 - DNA, 25 bp, Mus musculus
ggtgatccttcatgatacatgtcga

SEQ ID NO: 651596 - DNA, 25 bp, Mus musculus
ggtgatcgccacaaacatcgggcac

SEQ ID NO: 651597 - DNA, 25 bp, Mus musculus
ggtgatcgccactaacatcgggcac

SEQ ID NO: 651598 - DNA, 25 bp, Mus musculus
ggtgatcggagcagttttctttgga

SEQ ID NO: 651599 - DNA, 25 bp, Mus musculus
ggtgatcggagctgttttctttgga

SEQ ID NO: 651600 - DNA, 25 bp, Mus musculus
ggtgatcgtgagaccctggatctgc

SEQ ID NO: 651601 - DNA, 25 bp, Mus musculus
ggtgatcgtgagtccctggatctgc

SEQ ID NO: 651602 - DNA, 25 bp, Mus musculus
ggtgatctacatctgttattacttt

SEQ ID NO: 651603 - DNA, 25 bp, Mus musculus
ggtgatctacatgtgttattacttt

SEQ ID NO: 651604 - DNA, 25 bp, Mus musculus
ggtgatctatgtcagcagtttaaac

SEQ ID NO: 651605 - DNA, 25 bp, Mus musculus
ggtgatctatgtgagcagtttaaac

SEQ ID NO: 651606 - DNA, 25 bp, Mus musculus
ggtgatctcattaagatgtgctggt

SEQ ID NO: 651607 - DNA, 25 bp, Mus musculus
ggtgatctcatttagatgtgctggt

SEQ ID NO: 651608 - DNA, 25 bp, Mus musculus
ggtgatctccaaaattatagcaggt

SEQ ID NO: 651609 - DNA, 25 bp, Mus musculus
ggtgatctccaatattatagcaggt

SEQ ID NO: 651610 - DNA, 25 bp, Mus musculus
ggtgatctcttaagtggtgtactac

SEQ ID NO: 651611 - DNA, 25 bp, Mus musculus
ggtgatctcttatgtggtgtactac

SEQ ID NO: 651612 - DNA, 25 bp, Mus musculus
ggtgatctgatgactcagctcactg

SEQ ID NO: 651613 - DNA, 25 bp, Mus musculus
ggtgatctgatgtctcagctcactg

SEQ ID NO: 651614 - DNA, 25 bp, Mus musculus
ggtgatctgcatatggttactcctc

SEQ ID NO: 651615 - DNA, 25 bp, Mus musculus
ggtgatctgcatttggttactcctc

SEQ ID NO: 651616 - DNA, 25 bp, Mus musculus
ggtgatctgcgtctgtccatggaca

SEQ ID NO: 651617 - DNA, 25 bp, Mus musculus
ggtgatctgcgtgtgtccatggaca

SEQ ID NO: 651618 - DNA, 25 bp, Mus musculus
ggtgatctggtcacagtgaagaaat

SEQ ID NO: 651619 - DNA, 25 bp, Mus musculus
ggtgatctggtctcagtgaagaaat

SEQ ID NO: 651620 - DNA, 25 bp, Mus musculus
ggtgatctgtatagttccagctgta

SEQ ID NO: 651621 - DNA, 25 bp, Mus musculus
ggtgatctgtattgttccagctgta

SEQ ID NO: 651622 - DNA, 25 bp, Mus musculus
ggtgatctgtttcagttcaaggctg

SEQ ID NO: 651623 - DNA, 25 bp, Mus musculus
ggtgatctgtttgagttcaaggctg

SEQ ID NO: 651624 - DNA, 25 bp, Mus musculus
ggtgatcttaatacaaatgccctca

SEQ ID NO: 651625 - DNA, 25 bp, Mus musculus
ggtgatcttaattcaaatgccctca

SEQ ID NO: 651626 - DNA, 25 bp, Mus musculus
ggtgatcttaggattgcccatcctg

SEQ ID NO: 651627 - DNA, 25 bp, Mus musculus
ggtgatcttaggtttgcccatcctg

SEQ ID NO: 651628 - DNA, 25 bp, Mus musculus
ggtgatcttcacaacttgcaaggtt

SEQ ID NO: 651629 - DNA, 25 bp, Mus musculus
ggtgatcttcactacttgcaaggtt

SEQ ID NO: 651630 - DNA, 25 bp, Mus musculus
ggtgatcttgcaactatagactctt

SEQ ID NO: 651631 - DNA, 25 bp, Mus musculus
ggtgatcttgcatctatagactctt

SEQ ID NO: 651632 - DNA, 25 bp, Mus musculus
ggtgatcttggtactacgagctctg

SEQ ID NO: 651633 - DNA, 25 bp, Mus musculus
ggtgatcttggttctacgagctctg

SEQ ID NO: 651634 - DNA, 25 bp, Mus musculus
ggtgatctttatactcaacatttct

SEQ ID NO: 651635 - DNA, 25 bp, Mus musculus
ggtgatctttattctcaacatttct

SEQ ID NO: 651636 - DNA, 25 bp, Mus musculus
ggtgatctttcccagtcctgctgag

SEQ ID NO: 651637 - DNA, 25 bp, Mus musculus
ggtgatctttccgagtcctgctgag

SEQ ID NO: 651638 - DNA, 25 bp, Mus musculus
ggtgatctttttcagctcagcaagt

SEQ ID NO: 651639 - DNA, 25 bp, Mus musculus
ggtgatctttttgagctcagcaagt

SEQ ID NO: 651640 - DNA, 25 bp, Mus musculus
ggtgatgaaattcctgcccttccac

SEQ ID NO: 651641 - DNA, 25 bp, Mus musculus
ggtgatgaaattgctgcccttccac

SEQ ID NO: 651642 - DNA, 25 bp, Mus musculus
ggtgatgaacaaaccaccatccgct

SEQ ID NO: 651643 - DNA, 25 bp, Mus musculus
ggtgatgaacaatccaccatccgct

SEQ ID NO: 651644 - DNA, 25 bp, Mus musculus
ggtgatgaaccgacacatacatgat

SEQ ID NO: 651645 - DNA, 25 bp, Mus musculus
ggtgatgaaccgtcacatacatgat

SEQ ID NO: 651646 - DNA, 25 bp, Mus musculus
ggtgatgaagccatgagccctaact

SEQ ID NO: 651647 - DNA, 25 bp, Mus musculus
ggtgatgaagccttgagccctaact

SEQ ID NO: 651648 - DNA, 25 bp, Mus musculus
ggtgatgacaaccttccagaagtca

SEQ ID NO: 651649 - DNA, 25 bp, Mus musculus
ggtgatgacaacgttccagaagtca

SEQ ID NO: 651650 - DNA, 25 bp, Mus musculus
ggtgatgacatcagcgtgctctgca

SEQ ID NO: 651651 - DNA, 25 bp, Mus musculus
ggtgatgacatctgcgtgctctgca

SEQ ID NO: 651652 - DNA, 25 bp, Mus musculus
ggtgatgacctaatgtgtttaagct

SEQ ID NO: 651653 - DNA, 25 bp, Mus musculus
ggtgatgacctattgtgtttaagct

SEQ ID NO: 651654 - DNA, 25 bp, Mus musculus
ggtgatgagacactgctcatgtgac

SEQ ID NO: 651655 - DNA, 25 bp, Mus musculus
ggtgatgagacagtgctcatgtgac

SEQ ID NO: 651656 - DNA, 25 bp, Mus musculus
ggtgatgagctacagctgtcgttta

SEQ ID NO: 651657 - DNA, 25 bp, Mus musculus
ggtgatgagctaccagaatccctgg

SEQ ID NO: 651658 - DNA, 25 bp, Mus musculus
ggtgatgagctagagctgtcgttta

SEQ ID NO: 651659 - DNA, 25 bp, Mus musculus
ggtgatgagctagcagaatccctgg

SEQ ID NO: 651660 - DNA, 25 bp, Mus musculus
ggtgatgagttacgcaagctgcaca

SEQ ID NO: 651661 - DNA, 25 bp, Mus musculus
ggtgatgagttaggcaagctgcaca

SEQ ID NO: 651662 - DNA, 25 bp, Mus musculus
ggtgatgagttgaaagccgcaaaca

SEQ ID NO: 651663 - DNA, 25 bp, Mus musculus
ggtgatgagttgtaagccgcaaaca

SEQ ID NO: 651664 - DNA, 25 bp, Mus musculus
ggtgatgatcctctcagaacttttg

SEQ ID NO: 651665 - DNA, 25 bp, Mus musculus
ggtgatgatcctgtcagaacttttg

SEQ ID NO: 651666 - DNA, 25 bp, Mus musculus
ggtgatgatgcaagacctggtcctt

SEQ ID NO: 651667 - DNA, 25 bp, Mus musculus
ggtgatgatgcatgacctggtcctt

SEQ ID NO: 651668 - DNA, 25 bp, Mus musculus
ggtgatgatgtcagagtgtgtactc

SEQ ID NO: 651669 - DNA, 25 bp, Mus musculus
ggtgatgatgtctgagtgtgtactc

SEQ ID NO: 651670 - DNA, 25 bp, Mus musculus
ggtgatgcacaactttcatcctaac

SEQ ID NO: 651671 - DNA, 25 bp, Mus musculus
ggtgatgcacaagtttcatcctaac

SEQ ID NO: 651672 - DNA, 25 bp, Mus musculus
ggtgatgcacacacggaaacggcac

SEQ ID NO: 651673 - DNA, 25 bp, Mus musculus
ggtgatgcacactcggaaacggcac

SEQ ID NO: 651674 - DNA, 25 bp, Mus musculus
ggtgatgcacagcagacgtcctcac

SEQ ID NO: 651675 - DNA, 25 bp, Mus musculus
ggtgatgcacaggagacgtcctcac

SEQ ID NO: 651676 - DNA, 25 bp, Mus musculus
ggtgatgcacctataattgcctcat

SEQ ID NO: 651677 - DNA, 25 bp, Mus musculus
ggtgatgcacctttaattgcctcat

SEQ ID NO: 651678 - DNA, 25 bp, Mus musculus
ggtgatgcagctactcgaccagaga

SEQ ID NO: 651679 - DNA, 25 bp, Mus musculus
ggtgatgcagcttctcgaccagaga

SEQ ID NO: 651680 - DNA, 25 bp, Mus musculus
ggtgatgcagttcgatcctatttct

SEQ ID NO: 651681 - DNA, 25 bp, Mus musculus
ggtgatgcagttggatcctatttct

SEQ ID NO: 651682 - DNA, 25 bp, Mus musculus
ggtgatgcatgcagttcaagtggac

SEQ ID NO: 651683 - DNA, 25 bp, Mus musculus
ggtgatgcatgctgttcaagtggac

SEQ ID NO: 651684 - DNA, 25 bp, Mus musculus
ggtgatgccaacattactgctgcag

SEQ ID NO: 651685 - DNA, 25 bp, Mus musculus
ggtgatgccaactttactgctgcag

SEQ ID NO: 651686 - DNA, 25 bp, Mus musculus
ggtgatgccactcggaaccaaatgt

SEQ ID NO: 651687 - DNA, 25 bp, Mus musculus
ggtgatgccactgggaaccaaatgt

SEQ ID NO: 651688 - DNA, 25 bp, Mus musculus
ggtgatgcctaaactctatggtaac

SEQ ID NO: 651689 - DNA, 25 bp, Mus musculus
ggtgatgcctaatctctatggtaac

SEQ ID NO: 651690 - DNA, 25 bp, Mus musculus
ggtgatgcctctctgagtggaaatc

SEQ ID NO: 651691 - DNA, 25 bp, Mus musculus
ggtgatgcctctgtgagtggaaatc

SEQ ID NO: 651692 - DNA, 25 bp, Mus musculus
ggtgatgctatgcaaaccccacttt

SEQ ID NO: 651693 - DNA, 25 bp, Mus musculus
ggtgatgctatggaaaccccacttt

SEQ ID NO: 651694 - DNA, 25 bp, Mus musculus
ggtgatgcttccatacaggacccaa

SEQ ID NO: 651695 - DNA, 25 bp, Mus musculus
ggtgatgcttccttacaggacccaa

SEQ ID NO: 651696 - DNA, 25 bp, Mus musculus
ggtgatgctttcaagtattctgcac

SEQ ID NO: 651697 - DNA, 25 bp, Mus musculus
ggtgatgctttctagtattctgcac

SEQ ID NO: 651698 - DNA, 25 bp, Mus musculus
ggtgatggacaaacatgacagaatg

SEQ ID NO: 651699 - DNA, 25 bp, Mus musculus
ggtgatggacaatcatgacagaatg

SEQ ID NO: 651700 - DNA, 25 bp, Mus musculus
ggtgatggagaacccttcccatgcc

SEQ ID NO: 651701 - DNA, 25 bp, Mus musculus
ggtgatggagaagccttcccatgcc

SEQ ID NO: 651702 - DNA, 25 bp, Mus musculus
ggtgatggatggcaacaaccactat

SEQ ID NO: 651703 - DNA, 25 bp, Mus musculus
ggtgatggatgggaacaaccactat

SEQ ID NO: 651704 - DNA, 25 bp, Mus musculus
ggtgatggatttcattgttctgatc

SEQ ID NO: 651705 - DNA, 25 bp, Mus musculus
ggtgatggatttgattgttctgatc

SEQ ID NO: 651706 - DNA, 25 bp, Mus musculus
ggtgatggcacaccccaacaggaac

SEQ ID NO: 651707 - DNA, 25 bp, Mus musculus
ggtgatggcacagcccaacaggaac

SEQ ID NO: 651708 - DNA, 25 bp, Mus musculus
ggtgatggcattaagcaaagaacaa

SEQ ID NO: 651709 - DNA, 25 bp, Mus musculus
ggtgatggcatttagcaaagaacaa

SEQ ID NO: 651710 - DNA, 25 bp, Mus musculus
ggtgatggccatctgacaacaacaa

SEQ ID NO: 651711 - DNA, 25 bp, Mus musculus
ggtgatggccatgtgacaacaacaa

SEQ ID NO: 651712 - DNA, 25 bp, Mus musculus
ggtgatgggaccaccgagatctcac

SEQ ID NO: 651713 - DNA, 25 bp, Mus musculus
ggtgatgggacctccgagatctcac

SEQ ID NO: 651714 - DNA, 25 bp, Mus musculus
ggtgatgggatcaaccataccatta

SEQ ID NO: 651715 - DNA, 25 bp, Mus musculus
ggtgatgggatctaccataccatta

SEQ ID NO: 651716 - DNA, 25 bp, Mus musculus
ggtgatgggatgaccttcagtattt

SEQ ID NO: 651717 - DNA, 25 bp, Mus musculus
ggtgatgggatgtccttcagtattt

SEQ ID NO: 651718 - DNA, 25 bp, Mus musculus
ggtgatgtaatgatccaagtgaaga

SEQ ID NO: 651719 - DNA, 25 bp, Mus musculus
ggtgatgtaatgttccaagtgaaga

SEQ ID NO: 651720 - DNA, 25 bp, Mus musculus
ggtgatgtcagtaatcccatacaca

SEQ ID NO: 651721 - DNA, 25 bp, Mus musculus
ggtgatgtcagttatcccatacaca

SEQ ID NO: 651722 - DNA, 25 bp, Mus musculus
ggtgatgtcgcacaacaggccttga

SEQ ID NO: 651723 - DNA, 25 bp, Mus musculus
ggtgatgtcgcagaacaggccttga

SEQ ID NO: 651724 - DNA, 25 bp, Mus musculus
ggtgatgtcgttatctttgtgtatt

SEQ ID NO: 651725 - DNA, 25 bp, Mus musculus
ggtgatgtcgttttctttgtgtatt

SEQ ID NO: 651726 - DNA, 25 bp, Mus musculus
ggtgatgtgaacatctatcgcttaa

SEQ ID NO: 651727 - DNA, 25 bp, Mus musculus
ggtgatgtgaacttctatcgcttaa

SEQ ID NO: 651728 - DNA, 25 bp, Mus musculus
ggtgatgtgaccagttgcagttgca

SEQ ID NO: 651729 - DNA, 25 bp, Mus musculus
ggtgatgtgacctgttgcagttgca

SEQ ID NO: 651730 - DNA, 25 bp, Mus musculus
ggtgatgtggacagttcttcggcct

SEQ ID NO: 651731 - DNA, 25 bp, Mus musculus
ggtgatgtggactgttcttcggcct

SEQ ID NO: 651732 - DNA, 25 bp, Mus musculus
ggtgatgttaaaatgctacgtctat

SEQ ID NO: 651733 - DNA, 25 bp, Mus musculus
ggtgatgttaaattgctacgtctat

SEQ ID NO: 651734 - DNA, 25 bp, Mus musculus
ggtgatgttactctccatttttggt

SEQ ID NO: 651735 - DNA, 25 bp, Mus musculus
ggtgatgttactgtccatttttggt

SEQ ID NO: 651736 - DNA, 25 bp, Mus musculus
ggtgatgttgcacgttaaccttggc

SEQ ID NO: 651737 - DNA, 25 bp, Mus musculus
ggtgatgttgcaggttaaccttggc

SEQ ID NO: 651738 - DNA, 25 bp, Mus musculus
ggtgatgtttcaagatggaggtcaa

SEQ ID NO: 651739 - DNA, 25 bp, Mus musculus
ggtgatgtttcatgatggaggtcaa

SEQ ID NO: 651740 - DNA, 25 bp, Mus musculus
ggtgatgtttctaacaagccttctt

SEQ ID NO: 651741 - DNA, 25 bp, Mus musculus
ggtgatgtttctacactacataatt

SEQ ID NO: 651742 - DNA, 25 bp, Mus musculus
ggtgatgtttcttacaagccttctt

SEQ ID NO: 651743 - DNA, 25 bp, Mus musculus
ggtgatgtttcttcactacataatt

SEQ ID NO: 651744 - DNA, 25 bp, Mus musculus
ggtgattaaattacccacaggcctt

SEQ ID NO: 651745 - DNA, 25 bp, Mus musculus
ggtgattaaatttcccacaggcctt

SEQ ID NO: 651746 - DNA, 25 bp, Mus musculus
ggtgattaacccaaagacggcccag

SEQ ID NO: 651747 - DNA, 25 bp, Mus musculus
ggtgattaaccctaagacggcccag

SEQ ID NO: 651748 - DNA, 25 bp, Mus musculus
ggtgattaaggaattatgctcataa

SEQ ID NO: 651749 - DNA, 25 bp, Mus musculus
ggtgattaaggatttatgctcataa

SEQ ID NO: 651750 - DNA, 25 bp, Mus musculus
ggtgattacaccaaagcctttctca

SEQ ID NO: 651751 - DNA, 25 bp, Mus musculus
ggtgattacacctaagcctttctca

SEQ ID NO: 651752 - DNA, 25 bp, Mus musculus
ggtgattagcttaggcactgtgtaa

SEQ ID NO: 651753 - DNA, 25 bp, Mus musculus
ggtgattagctttggcactgtgtaa

SEQ ID NO: 651754 - DNA, 25 bp, Mus musculus
ggtgattatataattagcacgtcat

SEQ ID NO: 651755 - DNA, 25 bp, Mus musculus
ggtgattatatatttagcacgtcat

SEQ ID NO: 651756 - DNA, 25 bp, Mus musculus
ggtgattatcttctttagacatgag

SEQ ID NO: 651757 - DNA, 25 bp, Mus musculus
ggtgattatcttgtttagacatgag

SEQ ID NO: 651758 - DNA, 25 bp, Mus musculus
ggtgattatttcctcctctatagtt

SEQ ID NO: 651759 - DNA, 25 bp, Mus musculus
ggtgattatttcgtcctctatagtt

SEQ ID NO: 651760 - DNA, 25 bp, Mus musculus
ggtgattatttgatacagtctcatc

SEQ ID NO: 651761 - DNA, 25 bp, Mus musculus
ggtgattatttgttacagtctcatc

SEQ ID NO: 651762 - DNA, 25 bp, Mus musculus
ggtgattcacaactccagatacaga

SEQ ID NO: 651763 - DNA, 25 bp, Mus musculus
ggtgattcacaagtccagatacaga

SEQ ID NO: 651764 - DNA, 25 bp, Mus musculus
ggtgattcatatccaatatttgaga

SEQ ID NO: 651765 - DNA, 25 bp, Mus musculus
ggtgattcatatgcaatatttgaga

SEQ ID NO: 651766 - DNA, 25 bp, Mus musculus
ggtgattcggatcaagattccaaat

SEQ ID NO: 651767 - DNA, 25 bp, Mus musculus
ggtgattcggatgaagattccaaat

SEQ ID NO: 651768 - DNA, 25 bp, Mus musculus
ggtgattctaggaccgtatcaagtt

SEQ ID NO: 651769 - DNA, 25 bp, Mus musculus
ggtgattctaggtccgtatcaagtt

SEQ ID NO: 651770 - DNA, 25 bp, Mus musculus
ggtgattctatactcaataaccaca

SEQ ID NO: 651771 - DNA, 25 bp, Mus musculus
ggtgattctatagtcaataaccaca

SEQ ID NO: 651772 - DNA, 25 bp, Mus musculus
ggtgattctgaaaactcccaagttg

SEQ ID NO: 651773 - DNA, 25 bp, Mus musculus
ggtgattctgaatactcccaagttg

SEQ ID NO: 651774 - DNA, 25 bp, Mus musculus
ggtgattctggacgtcccctagtat

SEQ ID NO: 651775 - DNA, 25 bp, Mus musculus
ggtgattctggaggtcccctagtat

SEQ ID NO: 651776 - DNA, 25 bp, Mus musculus
ggtgattgaagacattccccaggct

SEQ ID NO: 651777 - DNA, 25 bp, Mus musculus
ggtgattgaagagattccccaggct

SEQ ID NO: 651778 - DNA, 25 bp, Mus musculus
ggtgattgatgcagtccgaagcctt

SEQ ID NO: 651779 - DNA, 25 bp, Mus musculus
ggtgattgatgctgtccgaagcctt

SEQ ID NO: 651780 - DNA, 25 bp, Mus musculus
ggtgattgcatcaggaagtgcccat

SEQ ID NO: 651781 - DNA, 25 bp, Mus musculus
ggtgattgcatctggaagtgcccat

SEQ ID NO: 651782 - DNA, 25 bp, Mus musculus
ggtgattgctagacacactaagagt

SEQ ID NO: 651783 - DNA, 25 bp, Mus musculus
ggtgattgctagtcacactaagagt

SEQ ID NO: 651784 - DNA, 25 bp, Mus musculus
ggtgattgctgtatatatgtgtttt

SEQ ID NO: 651785 - DNA, 25 bp, Mus musculus
ggtgattgctgtttatatgtgtttt

SEQ ID NO: 651786 - DNA, 25 bp, Mus musculus
ggtgattggatacctgccaacctgg

SEQ ID NO: 651787 - DNA, 25 bp, Mus musculus
ggtgattggatagctgccaacctgg

SEQ ID NO: 651788 - DNA, 25 bp, Mus musculus
ggtgattggtttcatctacttgata

SEQ ID NO: 651789 - DNA, 25 bp, Mus musculus
ggtgattggtttcatgtacacatct

SEQ ID NO: 651790 - DNA, 25 bp, Mus musculus
ggtgattggtttgatctacttgata

SEQ ID NO: 651791 - DNA, 25 bp, Mus musculus
ggtgattggtttgatgtacacatct

SEQ ID NO: 651792 - DNA, 25 bp, Mus musculus
ggtgattgtaacattattaccctga

SEQ ID NO: 651793 - DNA, 25 bp, Mus musculus
ggtgattgtaactttattaccctga

SEQ ID NO: 651794 - DNA, 25 bp, Mus musculus
ggtgattgtggtcacaccctgacaa

SEQ ID NO: 651795 - DNA, 25 bp, Mus musculus
ggtgattgtggtgacaccctgacaa

SEQ ID NO: 651796 - DNA, 25 bp, Mus musculus
ggtgatttaagtacagctccccaga

SEQ ID NO: 651797 - DNA, 25 bp, Mus musculus
ggtgatttaagttcagctccccaga

SEQ ID NO: 651798 - DNA, 25 bp, Mus musculus
ggtgatttagccaatgtgcctgtcc

SEQ ID NO: 651799 - DNA, 25 bp, Mus musculus
ggtgatttagcctatgtgcctgtcc

SEQ ID NO: 651800 - DNA, 25 bp, Mus musculus
ggtgatttatctaactgccaaaata

SEQ ID NO: 651801 - DNA, 25 bp, Mus musculus
ggtgatttatcttactgccaaaata

SEQ ID NO: 651802 - DNA, 25 bp, Mus musculus
ggtgatttatttctgtactcttctg

SEQ ID NO: 651803 - DNA, 25 bp, Mus musculus
ggtgatttatttgtgtactcttctg

SEQ ID NO: 651804 - DNA, 25 bp, Mus musculus
ggtgatttcacaaaccacaatggca

SEQ ID NO: 651805 - DNA, 25 bp, Mus musculus
ggtgatttcacaaggacaggctgct

SEQ ID NO: 651806 - DNA, 25 bp, Mus musculus
ggtgatttcacataccacaatggca

SEQ ID NO: 651807 - DNA, 25 bp, Mus musculus
ggtgatttcacatggacaggctgct

SEQ ID NO: 651808 - DNA, 25 bp, Mus musculus
ggtgatttcagcaataagacttcta

SEQ ID NO: 651809 - DNA, 25 bp, Mus musculus
ggtgatttcagctataagacttcta

SEQ ID NO: 651810 - DNA, 25 bp, Mus musculus
ggtgatttcctcatgcttttgatac

SEQ ID NO: 651811 - DNA, 25 bp, Mus musculus
ggtgatttcctcttgcttttgatac

SEQ ID NO: 651812 - DNA, 25 bp, Mus musculus
ggtgatttctcaattcatttcagga

SEQ ID NO: 651813 - DNA, 25 bp, Mus musculus
ggtgatttctcatttcatttcagga

SEQ ID NO: 651814 - DNA, 25 bp, Mus musculus
ggtgatttcttcataacatccaagg

SEQ ID NO: 651815 - DNA, 25 bp, Mus musculus
ggtgatttcttcttaacatccaagg

SEQ ID NO: 651816 - DNA, 25 bp, Mus musculus
ggtgatttgagtcagaactgtcccc

SEQ ID NO: 651817 - DNA, 25 bp, Mus musculus
ggtgatttgagtgagaactgtcccc

SEQ ID NO: 651818 - DNA, 25 bp, Mus musculus
ggtgatttgcatacgtttttacatt

SEQ ID NO: 651819 - DNA, 25 bp, Mus musculus
ggtgatttgcattcgtttttacatt

SEQ ID NO: 651820 - DNA, 25 bp, Mus musculus
ggtgattttgacactaaggaccctt

SEQ ID NO: 651821 - DNA, 25 bp, Mus musculus
ggtgattttgactctaaggaccctt

SEQ ID NO: 651822 - DNA, 25 bp, Mus musculus
ggtgattttgagctctttctctaaa

SEQ ID NO: 651823 - DNA, 25 bp, Mus musculus
ggtgattttgaggtctttctctaaa

SEQ ID NO: 651824 - DNA, 25 bp, Mus musculus
ggtgatttttgtactccagagactg

SEQ ID NO: 651825 - DNA, 25 bp, Mus musculus
ggtgatttttgttctccagagactg

SEQ ID NO: 651826 - DNA, 25 bp, Mus musculus
ggtgcaaaactaagtatctccatgt

SEQ ID NO: 651827 - DNA, 25 bp, Mus musculus
ggtgcaaaactatgtatctccatgt

SEQ ID NO: 651828 - DNA, 25 bp, Mus musculus
ggtgcaaaagtcagcccatgtaggc

SEQ ID NO: 651829 - DNA, 25 bp, Mus musculus
ggtgcaaaagtctgcccatgtaggc

SEQ ID NO: 651830 - DNA, 25 bp, Mus musculus
ggtgcaaaataacgcaagaagcttg

SEQ ID NO: 651831 - DNA, 25 bp, Mus musculus
ggtgcaaaataaggcaagaagcttg

SEQ ID NO: 651832 - DNA, 25 bp, Mus musculus
ggtgcaaacagaaaagacttctctc

SEQ ID NO: 651833 - DNA, 25 bp, Mus musculus
ggtgcaaacagataagacttctctc

SEQ ID NO: 651834 - DNA, 25 bp, Mus musculus
ggtgcaaactcaaatgtactgctta

SEQ ID NO: 651835 - DNA, 25 bp, Mus musculus
ggtgcaaactcatatgtactgctta

SEQ ID NO: 651836 - DNA, 25 bp, Mus musculus
ggtgcaaactgccattctctgagtg

SEQ ID NO: 651837 - DNA, 25 bp, Mus musculus
ggtgcaaactgcgattctctgagtg

SEQ ID NO: 651838 - DNA, 25 bp, Mus musculus
ggtgcaaactgtaattgtattgact

SEQ ID NO: 651839 - DNA, 25 bp, Mus musculus
ggtgcaaactgttattgtattgact

SEQ ID NO: 651840 - DNA, 25 bp, Mus musculus
ggtgcaaatagaaccttcctgtgtg

SEQ ID NO: 651841 - DNA, 25 bp, Mus musculus
ggtgcaaatagatccttcctgtgtg

SEQ ID NO: 651842 - DNA, 25 bp, Mus musculus
ggtgcaacaatcagtccaacaatct

SEQ ID NO: 651843 - DNA, 25 bp, Mus musculus
ggtgcaacaatctgtccaacaatct

SEQ ID NO: 651844 - DNA, 25 bp, Mus musculus
ggtgcaacccctcagacaagtcatt

SEQ ID NO: 651845 - DNA, 25 bp, Mus musculus
ggtgcaacccctgagacaagtcatt

SEQ ID NO: 651846 - DNA, 25 bp, Mus musculus
ggtgcaacctagagcccatcagagg

SEQ ID NO: 651847 - DNA, 25 bp, Mus musculus
ggtgcaacctagtgcccatcagagg

SEQ ID NO: 651848 - DNA, 25 bp, Mus musculus
ggtgcaacctttaaatgtgacaaaa

SEQ ID NO: 651849 - DNA, 25 bp, Mus musculus
ggtgcaaccttttaatgtgacaaaa

SEQ ID NO: 651850 - DNA, 25 bp, Mus musculus
ggtgcaactcaaaccttgaaaacag

SEQ ID NO: 651851 - DNA, 25 bp, Mus musculus
ggtgcaactcaatccttgaaaacag

SEQ ID NO: 651852 - DNA, 25 bp, Mus musculus
ggtgcaagaaatccaaagccccaag

SEQ ID NO: 651853 - DNA, 25 bp, Mus musculus
ggtgcaagaaatgcaaagccccaag

SEQ ID NO: 651854 - DNA, 25 bp, Mus musculus
ggtgcaagaccaaaagcatttagct

SEQ ID NO: 651855 - DNA, 25 bp, Mus musculus
ggtgcaagaccataagcatttagct

SEQ ID NO: 651856 - DNA, 25 bp, Mus musculus
ggtgcaaggctacttcatgctgtat

SEQ ID NO: 651857 - DNA, 25 bp, Mus musculus
ggtgcaaggctagttcatgctgtat

SEQ ID NO: 651858 - DNA, 25 bp, Mus musculus
ggtgcaagggctacctagaactttt

SEQ ID NO: 651859 - DNA, 25 bp, Mus musculus
ggtgcaagggcttcctagaactttt

SEQ ID NO: 651860 - DNA, 25 bp, Mus musculus
ggtgcaatacggcagagctgttatt

SEQ ID NO: 651861 - DNA, 25 bp, Mus musculus
ggtgcaatacgggagagctgttatt

SEQ ID NO: 651862 - DNA, 25 bp, Mus musculus
ggtgcaatatctatgttgtcgttgt

SEQ ID NO: 651863 - DNA, 25 bp, Mus musculus
ggtgcaatatctttgttgtcgttgt

SEQ ID NO: 651864 - DNA, 25 bp, Mus musculus
ggtgcaatcccactgaacagtgaca

SEQ ID NO: 651865 - DNA, 25 bp, Mus musculus
ggtgcaatcccagtgaacagtgaca

SEQ ID NO: 651866 - DNA, 25 bp, Mus musculus
ggtgcaatgactcggacaggtccta

SEQ ID NO: 651867 - DNA, 25 bp, Mus musculus
ggtgcaatgactgggacaggtccta

SEQ ID NO: 651868 - DNA, 25 bp, Mus musculus
ggtgcaatgataacccctatcaaag

SEQ ID NO: 651869 - DNA, 25 bp, Mus musculus
ggtgcaatgatatcccctatcaaag

SEQ ID NO: 651870 - DNA, 25 bp, Mus musculus
ggtgcaatgattaagccatggctgt

SEQ ID NO: 651871 - DNA, 25 bp, Mus musculus
ggtgcaatgatttagccatggctgt

SEQ ID NO: 651872 - DNA, 25 bp, Mus musculus
ggtgcaatgcacagtttcttaaaaa

SEQ ID NO: 651873 - DNA, 25 bp, Mus musculus
ggtgcaatgcactgtttcttaaaaa

SEQ ID NO: 651874 - DNA, 25 bp, Mus musculus
ggtgcaatgtctctgttcatcatca

SEQ ID NO: 651875 - DNA, 25 bp, Mus musculus
ggtgcaatgtctgtgttcatcatca

SEQ ID NO: 651876 - DNA, 25 bp, Mus musculus
ggtgcaattaggattcatctgattt

SEQ ID NO: 651877 - DNA, 25 bp, Mus musculus
ggtgcaattaggtttcatctgattt

SEQ ID NO: 651878 - DNA, 25 bp, Mus musculus
ggtgcaattgatatcactttatttt

SEQ ID NO: 651879 - DNA, 25 bp, Mus musculus
ggtgcaattgatttcactttatttt

SEQ ID NO: 651880 - DNA, 25 bp, Mus musculus
ggtgcacaaattacatcaggatcaa

SEQ ID NO: 651881 - DNA, 25 bp, Mus musculus
ggtgcacaaatttcatcaggatcaa

SEQ ID NO: 651882 - DNA, 25 bp, Mus musculus
ggtgcacaacgcatggcgtttccaa

SEQ ID NO: 651883 - DNA, 25 bp, Mus musculus
ggtgcacaacgcttggcgtttccaa

SEQ ID NO: 651884 - DNA, 25 bp, Mus musculus
ggtgcacacatacagttacctctcc

SEQ ID NO: 651885 - DNA, 25 bp, Mus musculus
ggtgcacacatagagttacctctcc

SEQ ID NO: 651886 - DNA, 25 bp, Mus musculus
ggtgcacaccacaccagatcctttg

SEQ ID NO: 651887 - DNA, 25 bp, Mus musculus
ggtgcacaccactccagatcctttg

SEQ ID NO: 651888 - DNA, 25 bp, Mus musculus
ggtgcacacctcagcaccaagaaaa

SEQ ID NO: 651889 - DNA, 25 bp, Mus musculus
ggtgcacacctctgcaccaagaaaa

SEQ ID NO: 651890 - DNA, 25 bp, Mus musculus
ggtgcacacgctctctggaaggaat

SEQ ID NO: 651891 - DNA, 25 bp, Mus musculus
ggtgcacacgctgtctggaaggaat

SEQ ID NO: 651892 - DNA, 25 bp, Mus musculus
ggtgcacagagcctaatgctagcgt

SEQ ID NO: 651893 - DNA, 25 bp, Mus musculus
ggtgcacagagcgtaatgctagcgt

SEQ ID NO: 651894 - DNA, 25 bp, Mus musculus
ggtgcacagatgctatcagcattga

SEQ ID NO: 651895 - DNA, 25 bp, Mus musculus
ggtgcacagatggtatcagcattga

SEQ ID NO: 651896 - DNA, 25 bp, Mus musculus
ggtgcacagcagactccaggtaatt

SEQ ID NO: 651897 - DNA, 25 bp, Mus musculus
ggtgcacagcagtctccaggtaatt

SEQ ID NO: 651898 - DNA, 25 bp, Mus musculus
ggtgcacaggagcagattctcaaga

SEQ ID NO: 651899 - DNA, 25 bp, Mus musculus
ggtgcacaggaggagattctcaaga

SEQ ID NO: 651900 - DNA, 25 bp, Mus musculus
ggtgcacagtgtacggctctttgac

SEQ ID NO: 651901 - DNA, 25 bp, Mus musculus
ggtgcacagtgttcggctctttgac

SEQ ID NO: 651902 - DNA, 25 bp, Mus musculus
ggtgcacatctgaagtcttggtgct

SEQ ID NO: 651903 - DNA, 25 bp, Mus musculus
ggtgcacatctgtagtcttggtgct

SEQ ID NO: 651904 - DNA, 25 bp, Mus musculus
ggtgcacatgtgaatgctgtcaatc

SEQ ID NO: 651905 - DNA, 25 bp, Mus musculus
ggtgcacatgtgtatgctgtcaatc

SEQ ID NO: 651906 - DNA, 25 bp, Mus musculus
ggtgcacattgccaaatgcttctcg

SEQ ID NO: 651907 - DNA, 25 bp, Mus musculus
ggtgcacattgcgaaatgcttctcg

SEQ ID NO: 651908 - DNA, 25 bp, Mus musculus
ggtgcacattttactttagagccct

SEQ ID NO: 651909 - DNA, 25 bp, Mus musculus
ggtgcacatttttctttagagccct

SEQ ID NO: 651910 - DNA, 25 bp, Mus musculus
ggtgcaccacagaggttatactttt

SEQ ID NO: 651911 - DNA, 25 bp, Mus musculus
ggtgcaccacagtggttatactttt

SEQ ID NO: 651912 - DNA, 25 bp, Mus musculus
ggtgcacccaacatcatagagcaaa

SEQ ID NO: 651913 - DNA, 25 bp, Mus musculus
ggtgcacccaacttcatagagcaaa

SEQ ID NO: 651914 - DNA, 25 bp, Mus musculus
ggtgcacccagtctgaaccctatgt

SEQ ID NO: 651915 - DNA, 25 bp, Mus musculus
ggtgcacccagtgtgaaccctatgt

SEQ ID NO: 651916 - DNA, 25 bp, Mus musculus
ggtgcacctgaacatgaggagctca

SEQ ID NO: 651917 - DNA, 25 bp, Mus musculus
ggtgcacctgaagatgaggagctca

SEQ ID NO: 651918 - DNA, 25 bp, Mus musculus
ggtgcacctggtctagcagtcacta

SEQ ID NO: 651919 - DNA, 25 bp, Mus musculus
ggtgcacctggtgtagcagtcacta

SEQ ID NO: 651920 - DNA, 25 bp, Mus musculus
ggtgcaccttatcctcttgagttat

SEQ ID NO: 651921 - DNA, 25 bp, Mus musculus
ggtgcaccttatgctcttgagttat

SEQ ID NO: 651922 - DNA, 25 bp, Mus musculus
ggtgcaccttgcagtgcttgcacag

SEQ ID NO: 651923 - DNA, 25 bp, Mus musculus
ggtgcaccttgctgtgcttgcacag

SEQ ID NO: 651924 - DNA, 25 bp, Mus musculus
ggtgcacgcttcctttaggcaagat

SEQ ID NO: 651925 - DNA, 25 bp, Mus musculus
ggtgcacgcttcgtttaggcaagat

SEQ ID NO: 651926 - DNA, 25 bp, Mus musculus
ggtgcacggtataaggctgctcttt

SEQ ID NO: 651927 - DNA, 25 bp, Mus musculus
ggtgcacggtattaggctgctcttt

SEQ ID NO: 651928 - DNA, 25 bp, Mus musculus
ggtgcacgtctgagagagcgaaact

SEQ ID NO: 651929 - DNA, 25 bp, Mus musculus
ggtgcacgtctgtgagagcgaaact

SEQ ID NO: 651930 - DNA, 25 bp, Mus musculus
ggtgcactaagcagaccagagccag

SEQ ID NO: 651931 - DNA, 25 bp, Mus musculus
ggtgcactaagctgaccagagccag

SEQ ID NO: 651932 - DNA, 25 bp, Mus musculus
ggtgcactacacaagacagggcctg

SEQ ID NO: 651933 - DNA, 25 bp, Mus musculus
ggtgcactacactagacagggcctg

SEQ ID NO: 651934 - DNA, 25 bp, Mus musculus
ggtgcactgaaacctgctgtctcta

SEQ ID NO: 651935 - DNA, 25 bp, Mus musculus
ggtgcactgaaagctgctgtctcta

SEQ ID NO: 651936 - DNA, 25 bp, Mus musculus
ggtgcactgatcagctagagctgta

SEQ ID NO: 651937 - DNA, 25 bp, Mus musculus
ggtgcactgatctgctagagctgta

SEQ ID NO: 651938 - DNA, 25 bp, Mus musculus
ggtgcactgcccatgtagaagacct

SEQ ID NO: 651939 - DNA, 25 bp, Mus musculus
ggtgcactgcccttgtagaagacct

SEQ ID NO: 651940 - DNA, 25 bp, Mus musculus
ggtgcactgtaccttttgacaaaga

SEQ ID NO: 651941 - DNA, 25 bp, Mus musculus
ggtgcactgtacgttttgacaaaga

SEQ ID NO: 651942 - DNA, 25 bp, Mus musculus
ggtgcactgtccaggtgtttctgtt

SEQ ID NO: 651943 - DNA, 25 bp, Mus musculus
ggtgcactgtcctggtgtttctgtt

SEQ ID NO: 651944 - DNA, 25 bp, Mus musculus
ggtgcactgtgcctttctaaaggct

SEQ ID NO: 651945 - DNA, 25 bp, Mus musculus
ggtgcactgtgcgtttctaaaggct

SEQ ID NO: 651946 - DNA, 25 bp, Mus musculus
ggtgcactgttaaggcttttctcca

SEQ ID NO: 651947 - DNA, 25 bp, Mus musculus
ggtgcactgttatggcttttctcca

SEQ ID NO: 651948 - DNA, 25 bp, Mus musculus
ggtgcacttctgacagacaccaggg

SEQ ID NO: 651949 - DNA, 25 bp, Mus musculus
ggtgcacttctgtcagacaccaggg

SEQ ID NO: 651950 - DNA, 25 bp, Mus musculus
ggtgcacttggcaagcctgatgacc

SEQ ID NO: 651951 - DNA, 25 bp, Mus musculus
ggtgcacttggctagcctgatgacc

SEQ ID NO: 651952 - DNA, 25 bp, Mus musculus
ggtgcacttttcatccttgatattg

SEQ ID NO: 651953 - DNA, 25 bp, Mus musculus
ggtgcacttttcttccttgatattg

SEQ ID NO: 651954 - DNA, 25 bp, Mus musculus
ggtgcagaaacccttcaatgggtgt

SEQ ID NO: 651955 - DNA, 25 bp, Mus musculus
ggtgcagaaaccgttcaatgggtgt

SEQ ID NO: 651956 - DNA, 25 bp, Mus musculus
ggtgcagaaatgacaacactgtgct

SEQ ID NO: 651957 - DNA, 25 bp, Mus musculus
ggtgcagaaatgtcaacactgtgct

SEQ ID NO: 651958 - DNA, 25 bp, Mus musculus
ggtgcagaactaactcgttctagct

SEQ ID NO: 651959 - DNA, 25 bp, Mus musculus
ggtgcagaactatctcgttctagct

SEQ ID NO: 651960 - DNA, 25 bp, Mus musculus
ggtgcagacacacgaaggccttcag

SEQ ID NO: 651961 - DNA, 25 bp, Mus musculus
ggtgcagacacaggaaggccttcag

SEQ ID NO: 651962 - DNA, 25 bp, Mus musculus
ggtgcagacatcactggttggactg

SEQ ID NO: 651963 - DNA, 25 bp, Mus musculus
ggtgcagacatctctggttggactg

SEQ ID NO: 651964 - DNA, 25 bp, Mus musculus
ggtgcagacatgagaatccacgcct

SEQ ID NO: 651965 - DNA, 25 bp, Mus musculus
ggtgcagacatgtgaatccacgcct

SEQ ID NO: 651966 - DNA, 25 bp, Mus musculus
ggtgcagacattctcatgctgagac

SEQ ID NO: 651967 - DNA, 25 bp, Mus musculus
ggtgcagacattgtcatgctgagac

SEQ ID NO: 651968 - DNA, 25 bp, Mus musculus
ggtgcagaccatccccaaaaggacc

SEQ ID NO: 651969 - DNA, 25 bp, Mus musculus
ggtgcagaccatgcccaaaaggacc

SEQ ID NO: 651970 - DNA, 25 bp, Mus musculus
ggtgcagaccgacgcccagtacaag

SEQ ID NO: 651971 - DNA, 25 bp, Mus musculus
ggtgcagaccgaggcccagtacaag

SEQ ID NO: 651972 - DNA, 25 bp, Mus musculus
ggtgcagaccgtacagaccaggtac

SEQ ID NO: 651973 - DNA, 25 bp, Mus musculus
ggtgcagaccgttcagaccaggtac

SEQ ID NO: 651974 - DNA, 25 bp, Mus musculus
ggtgcagactgaaccagagagaaac

SEQ ID NO: 651975 - DNA, 25 bp, Mus musculus
ggtgcagactgatccagagagaaac

SEQ ID NO: 651976 - DNA, 25 bp, Mus musculus
ggtgcagagaagacatcgggtttat

SEQ ID NO: 651977 - DNA, 25 bp, Mus musculus
ggtgcagagaagtcatcgggtttat

SEQ ID NO: 651978 - DNA, 25 bp, Mus musculus
ggtgcagagccaactgactatttat

SEQ ID NO: 651979 - DNA, 25 bp, Mus musculus
ggtgcagagccatctgactatttat

SEQ ID NO: 651980 - DNA, 25 bp, Mus musculus
ggtgcagatctcaattctctctgct

SEQ ID NO: 651981 - DNA, 25 bp, Mus musculus
ggtgcagatctcagctgtacacagt

SEQ ID NO: 651982 - DNA, 25 bp, Mus musculus
ggtgcagatctctattctctctgct

SEQ ID NO: 651983 - DNA, 25 bp, Mus musculus
ggtgcagatctctgctgtacacagt

SEQ ID NO: 651984 - DNA, 25 bp, Mus musculus
ggtgcagatgccaatcaccttccca

SEQ ID NO: 651985 - DNA, 25 bp, Mus musculus
ggtgcagatgcctatcaccttccca

SEQ ID NO: 651986 - DNA, 25 bp, Mus musculus
ggtgcagatggacatcgacctccaa

SEQ ID NO: 651987 - DNA, 25 bp, Mus musculus
ggtgcagatggagatcgacctccaa

SEQ ID NO: 651988 - DNA, 25 bp, Mus musculus
ggtgcagcaagaaattccagtgaga

SEQ ID NO: 651989 - DNA, 25 bp, Mus musculus
ggtgcagcaagatattccagtgaga

SEQ ID NO: 651990 - DNA, 25 bp, Mus musculus
ggtgcagcacagcatgcttgttcct

SEQ ID NO: 651991 - DNA, 25 bp, Mus musculus
ggtgcagcacaggatgcttgttcct

SEQ ID NO: 651992 - DNA, 25 bp, Mus musculus
ggtgcagcactgaaatataactctt

SEQ ID NO: 651993 - DNA, 25 bp, Mus musculus
ggtgcagcactgtaatataactctt

SEQ ID NO: 651994 - DNA, 25 bp, Mus musculus
ggtgcagcatgtagttgccaagtct

SEQ ID NO: 651995 - DNA, 25 bp, Mus musculus
ggtgcagcatgttgttgccaagtct

SEQ ID NO: 651996 - DNA, 25 bp, Mus musculus
ggtgcagcattcagagaccgcagaa

SEQ ID NO: 651997 - DNA, 25 bp, Mus musculus
ggtgcagcattctgagaccgcagaa

SEQ ID NO: 651998 - DNA, 25 bp, Mus musculus
ggtgcagccaatcagaattccaaag

SEQ ID NO: 651999 - DNA, 25 bp, Mus musculus
ggtgcagccaatgagaattccaaag

SEQ ID NO: 652000 - DNA, 25 bp, Mus musculus
ggtgcagccacgacaaacaacttta

SEQ ID NO: 652001 - DNA, 25 bp, Mus musculus
ggtgcagccacgtcaaacaacttta

SEQ ID NO: 652002 - DNA, 25 bp, Mus musculus
ggtgcagctcacagagtcccatagg

SEQ ID NO: 652003 - DNA, 25 bp, Mus musculus
ggtgcagctcactgagtcccatagg

SEQ ID NO: 652004 - DNA, 25 bp, Mus musculus
ggtgcagctcatcattccaggtgct

SEQ ID NO: 652005 - DNA, 25 bp, Mus musculus
ggtgcagctcatgattccaggtgct

SEQ ID NO: 652006 - DNA, 25 bp, Mus musculus
ggtgcagctcctccaaaatttacag

SEQ ID NO: 652007 - DNA, 25 bp, Mus musculus
ggtgcagctcctgcaaaatttacag

SEQ ID NO: 652008 - DNA, 25 bp, Mus musculus
ggtgcagctggaactagcagagata

SEQ ID NO: 652009 - DNA, 25 bp, Mus musculus
ggtgcagctggaagcaggtggactc

SEQ ID NO: 652010 - DNA, 25 bp, Mus musculus
ggtgcagctggactttatatggtca

SEQ ID NO: 652011 - DNA, 25 bp, Mus musculus
ggtgcagctggagtttatatggtca

SEQ ID NO: 652012 - DNA, 25 bp, Mus musculus
ggtgcagctggatctagcagagata

SEQ ID NO: 652013 - DNA, 25 bp, Mus musculus
ggtgcagctggatgcaggtggactc

SEQ ID NO: 652014 - DNA, 25 bp, Mus musculus
ggtgcagcttacatattggaaggta

SEQ ID NO: 652015 - DNA, 25 bp, Mus musculus
ggtgcagcttacttattggaaggta

SEQ ID NO: 652016 - DNA, 25 bp, Mus musculus
ggtgcaggaacacaccttcctaaag

SEQ ID NO: 652017 - DNA, 25 bp, Mus musculus
ggtgcaggaacagaccttcctaaag

SEQ ID NO: 652018 - DNA, 25 bp, Mus musculus
ggtgcaggaactatccctgacccaa

SEQ ID NO: 652019 - DNA, 25 bp, Mus musculus
ggtgcaggaactttccctgacccaa

SEQ ID NO: 652020 - DNA, 25 bp, Mus musculus
ggtgcaggaagtcacatgccctcaa

SEQ ID NO: 652021 - DNA, 25 bp, Mus musculus
ggtgcaggaagtgacatgccctcaa

SEQ ID NO: 652022 - DNA, 25 bp, Mus musculus
ggtgcaggatacatggctaagacat

SEQ ID NO: 652023 - DNA, 25 bp, Mus musculus
ggtgcaggatacttggctaagacat

SEQ ID NO: 652024 - DNA, 25 bp, Mus musculus
ggtgcaggcaccagtgttccgtgca

SEQ ID NO: 652025 - DNA, 25 bp, Mus musculus
ggtgcaggcacctgtgttccgtgca

SEQ ID NO: 652026 - DNA, 25 bp, Mus musculus
ggtgcaggcactatgtgaacagata

SEQ ID NO: 652027 - DNA, 25 bp, Mus musculus
ggtgcaggcactttgtgaacagata

SEQ ID NO: 652028 - DNA, 25 bp, Mus musculus
ggtgcaggcataaacgggccccagc

SEQ ID NO: 652029 - DNA, 25 bp, Mus musculus
ggtgcaggcatatacgggccccagc

SEQ ID NO: 652030 - DNA, 25 bp, Mus musculus
ggtgcaggccatcatttacgacgac

SEQ ID NO: 652031 - DNA, 25 bp, Mus musculus
ggtgcaggccatgatttacgacgac

SEQ ID NO: 652032 - DNA, 25 bp, Mus musculus
ggtgcaggtgcacctgttacccaaa

SEQ ID NO: 652033 - DNA, 25 bp, Mus musculus
ggtgcaggtgcagctgttacccaaa

SEQ ID NO: 652034 - DNA, 25 bp, Mus musculus
ggtgcaggttcaatttgcaacacaa

SEQ ID NO: 652035 - DNA, 25 bp, Mus musculus
ggtgcaggttcattttgcaacacaa

SEQ ID NO: 652036 - DNA, 25 bp, Mus musculus
ggtgcagtaagccacacaatgggtt

SEQ ID NO: 652037 - DNA, 25 bp, Mus musculus
ggtgcagtaagcgacacaatgggtt

SEQ ID NO: 652038 - DNA, 25 bp, Mus musculus
ggtgcagtcaaacccatagcctcgg

SEQ ID NO: 652039 - DNA, 25 bp, Mus musculus
ggtgcagtcaaagccatagcctcgg

SEQ ID NO: 652040 - DNA, 25 bp, Mus musculus
ggtgcagtccatcttcaatgttcca

SEQ ID NO: 652041 - DNA, 25 bp, Mus musculus
ggtgcagtccatgttcaatgttcca

SEQ ID NO: 652042 - DNA, 25 bp, Mus musculus
ggtgcagtctaacaataacaacaat

SEQ ID NO: 652043 - DNA, 25 bp, Mus musculus
ggtgcagtctaagaataacaacaat

SEQ ID NO: 652044 - DNA, 25 bp, Mus musculus
ggtgcagtgccacccactattagaa

SEQ ID NO: 652045 - DNA, 25 bp, Mus musculus
ggtgcagtgccagccactattagaa

SEQ ID NO: 652046 - DNA, 25 bp, Mus musculus
ggtgcagtgtagatccttgaataaa

SEQ ID NO: 652047 - DNA, 25 bp, Mus musculus
ggtgcagtgtagttccttgaataaa

SEQ ID NO: 652048 - DNA, 25 bp, Mus musculus
ggtgcagtgtccatatgggcccaaa

SEQ ID NO: 652049 - DNA, 25 bp, Mus musculus
ggtgcagtgtccttatgggcccaaa

SEQ ID NO: 652050 - DNA, 25 bp, Mus musculus
ggtgcagttaaacactccctacagt

SEQ ID NO: 652051 - DNA, 25 bp, Mus musculus
ggtgcagttaaagactccctacagt

SEQ ID NO: 652052 - DNA, 25 bp, Mus musculus
ggtgcagttcatactttctgctctc

SEQ ID NO: 652053 - DNA, 25 bp, Mus musculus
ggtgcagttcattctttctgctctc

SEQ ID NO: 652054 - DNA, 25 bp, Mus musculus
ggtgcagttctccttctggctctgg

SEQ ID NO: 652055 - DNA, 25 bp, Mus musculus
ggtgcagttctcgttctggctctgg

SEQ ID NO: 652056 - DNA, 25 bp, Mus musculus
ggtgcagttgttagatcatgagcct

SEQ ID NO: 652057 - DNA, 25 bp, Mus musculus
ggtgcagttgtttgatcatgagcct

SEQ ID NO: 652058 - DNA, 25 bp, Mus musculus
ggtgcagtttgtcagctaacctgta

SEQ ID NO: 652059 - DNA, 25 bp, Mus musculus
ggtgcagtttgtgagctaacctgta

SEQ ID NO: 652060 - DNA, 25 bp, Mus musculus
ggtgcagttttgaaactacagctac

SEQ ID NO: 652061 - DNA, 25 bp, Mus musculus
ggtgcagttttgtaactacagctac

SEQ ID NO: 652062 - DNA, 25 bp, Mus musculus
ggtgcatagcccaagacgaagactg

SEQ ID NO: 652063 - DNA, 25 bp, Mus musculus
ggtgcatagccctagacgaagactg

SEQ ID NO: 652064 - DNA, 25 bp, Mus musculus
ggtgcatagtaacaggcctccccat

SEQ ID NO: 652065 - DNA, 25 bp, Mus musculus
ggtgcatagtaagaggcctccccat

SEQ ID NO: 652066 - DNA, 25 bp, Mus musculus
ggtgcatatagtcagttggttccaa

SEQ ID NO: 652067 - DNA, 25 bp, Mus musculus
ggtgcatatagtgagttggttccaa

SEQ ID NO: 652068 - DNA, 25 bp, Mus musculus
ggtgcatatattcctattttccatt

SEQ ID NO: 652069 - DNA, 25 bp, Mus musculus
ggtgcatatattgctattttccatt

SEQ ID NO: 652070 - DNA, 25 bp, Mus musculus
ggtgcatattaccaatggctctggg

SEQ ID NO: 652071 - DNA, 25 bp, Mus musculus
ggtgcatattacgaatggctctggg

SEQ ID NO: 652072 - DNA, 25 bp, Mus musculus
ggtgcatcacagctatctaaaatga

SEQ ID NO: 652073 - DNA, 25 bp, Mus musculus
ggtgcatcacaggtatctaaaatga

SEQ ID NO: 652074 - DNA, 25 bp, Mus musculus
ggtgcatcacttcatggaactatgt

SEQ ID NO: 652075 - DNA, 25 bp, Mus musculus
ggtgcatcacttgatggaactatgt

SEQ ID NO: 652076 - DNA, 25 bp, Mus musculus
ggtgcatcagtgattgccagaaacg

SEQ ID NO: 652077 - DNA, 25 bp, Mus musculus
ggtgcatcagtgtttgccagaaacg

SEQ ID NO: 652078 - DNA, 25 bp, Mus musculus
ggtgcatcagttcttgacatccgct

SEQ ID NO: 652079 - DNA, 25 bp, Mus musculus
ggtgcatcagttgttgacatccgct

SEQ ID NO: 652080 - DNA, 25 bp, Mus musculus
ggtgcatcatgaactgggagcctcc

SEQ ID NO: 652081 - DNA, 25 bp, Mus musculus
ggtgcatcatgatctgggagcctcc

SEQ ID NO: 652082 - DNA, 25 bp, Mus musculus
ggtgcatcctggctatgggttcctc

SEQ ID NO: 652083 - DNA, 25 bp, Mus musculus
ggtgcatcctgggtatgggttcctc

SEQ ID NO: 652084 - DNA, 25 bp, Mus musculus
ggtgcatctaggcaaaagcgctgat

SEQ ID NO: 652085 - DNA, 25 bp, Mus musculus
ggtgcatctagggaaaagcgctgat

SEQ ID NO: 652086 - DNA, 25 bp, Mus musculus
ggtgcatctgctcatggatttcgga

SEQ ID NO: 652087 - DNA, 25 bp, Mus musculus
ggtgcatctgctgatggatttcgga

SEQ ID NO: 652088 - DNA, 25 bp, Mus musculus
ggtgcatgacagcttatcaacctta

SEQ ID NO: 652089 - DNA, 25 bp, Mus musculus
ggtgcatgacaggttatcaacctta

SEQ ID NO: 652090 - DNA, 25 bp, Mus musculus
ggtgcatgcttcaaaatcatatcta

SEQ ID NO: 652091 - DNA, 25 bp, Mus musculus
ggtgcatgcttctaaatcatatcta

SEQ ID NO: 652092 - DNA, 25 bp, Mus musculus
ggtgcatgtgcacaattctttctct

SEQ ID NO: 652093 - DNA, 25 bp, Mus musculus
ggtgcatgtgcagaattctttctct

SEQ ID NO: 652094 - DNA, 25 bp, Mus musculus
ggtgcatgtttgagccaacgaaaat

SEQ ID NO: 652095 - DNA, 25 bp, Mus musculus
ggtgcatgtttgtgccaacgaaaat

SEQ ID NO: 652096 - DNA, 25 bp, Mus musculus
ggtgcatgttttactatgtcctgta

SEQ ID NO: 652097 - DNA, 25 bp, Mus musculus
ggtgcatgtttttctatgtcctgta

SEQ ID NO: 652098 - DNA, 25 bp, Mus musculus
ggtgcattaataaccgtagtttcct

SEQ ID NO: 652099 - DNA, 25 bp, Mus musculus
ggtgcattaatatccgtagtttcct

SEQ ID NO: 652100 - DNA, 25 bp, Mus musculus
ggtgcattaatgaccttgaaaacct

SEQ ID NO: 652101 - DNA, 25 bp, Mus musculus
ggtgcattaatgtccttgaaaacct

SEQ ID NO: 652102 - DNA, 25 bp, Mus musculus
ggtgcattcatcattaggtgactga

SEQ ID NO: 652103 - DNA, 25 bp, Mus musculus
ggtgcattcatctttaggtgactga

SEQ ID NO: 652104 - DNA, 25 bp, Mus musculus
ggtgcattccttcggtacctgggca

SEQ ID NO: 652105 - DNA, 25 bp, Mus musculus
ggtgcattccttgggtacctgggca

SEQ ID NO: 652106 - DNA, 25 bp, Mus musculus
ggtgcattctaaccaacacacacac

SEQ ID NO: 652107 - DNA, 25 bp, Mus musculus
ggtgcattctaagcaacacacacac

SEQ ID NO: 652108 - DNA, 25 bp, Mus musculus
ggtgcattctgtataccacataagt

SEQ ID NO: 652109 - DNA, 25 bp, Mus musculus
ggtgcattctgtttaccacataagt

SEQ ID NO: 652110 - DNA, 25 bp, Mus musculus
ggtgcattgcagatcagtctgagat

SEQ ID NO: 652111 - DNA, 25 bp, Mus musculus
ggtgcattgcagttcagtctgagat

SEQ ID NO: 652112 - DNA, 25 bp, Mus musculus
ggtgcattgcccatgttagagcagt

SEQ ID NO: 652113 - DNA, 25 bp, Mus musculus
ggtgcattgcccttgttagagcagt

SEQ ID NO: 652114 - DNA, 25 bp, Mus musculus
ggtgcattggcaacactcgtcagat

SEQ ID NO: 652115 - DNA, 25 bp, Mus musculus
ggtgcattggcatcactcgtcagat

SEQ ID NO: 652116 - DNA, 25 bp, Mus musculus
ggtgcatttattactggtagttata

SEQ ID NO: 652117 - DNA, 25 bp, Mus musculus
ggtgcatttatttctggtagttata

SEQ ID NO: 652118 - DNA, 25 bp, Mus musculus
ggtgcatttcaactcttttgccatg

SEQ ID NO: 652119 - DNA, 25 bp, Mus musculus
ggtgcatttcaagtcttttgccatg

SEQ ID NO: 652120 - DNA, 25 bp, Mus musculus
ggtgcatttcacatctcaggttatt

SEQ ID NO: 652121 - DNA, 25 bp, Mus musculus
ggtgcatttcacttctcaggttatt

SEQ ID NO: 652122 - DNA, 25 bp, Mus musculus
ggtgcatttgttattctgattgggt

SEQ ID NO: 652123 - DNA, 25 bp, Mus musculus
ggtgcatttgtttttctgattgggt

SEQ ID NO: 652124 - DNA, 25 bp, Mus musculus
ggtgcattttggacgtaatctcagt

SEQ ID NO: 652125 - DNA, 25 bp, Mus musculus
ggtgcattttggtcgtaatctcagt

SEQ ID NO: 652126 - DNA, 25 bp, Mus musculus
ggtgccaaactacgacaatgtccat

SEQ ID NO: 652127 - DNA, 25 bp, Mus musculus
ggtgccaaactaggacaatgtccat

SEQ ID NO: 652128 - DNA, 25 bp, Mus musculus
ggtgccaaagaaatccgggacctga

SEQ ID NO: 652129 - DNA, 25 bp, Mus musculus
ggtgccaaagaattccgggacctga

SEQ ID NO: 652130 - DNA, 25 bp, Mus musculus
ggtgccaacaagcaaccttatagtc

SEQ ID NO: 652131 - DNA, 25 bp, Mus musculus
ggtgccaacaaggaaccttatagtc

SEQ ID NO: 652132 - DNA, 25 bp, Mus musculus
ggtgccaacatgaatctacctcgtg

SEQ ID NO: 652133 - DNA, 25 bp, Mus musculus
ggtgccaacatgtatctacctcgtg

SEQ ID NO: 652134 - DNA, 25 bp, Mus musculus
ggtgccaactggagcttctctttag

SEQ ID NO: 652135 - DNA, 25 bp, Mus musculus
ggtgccaactggtgcttctctttag

SEQ ID NO: 652136 - DNA, 25 bp, Mus musculus
ggtgccaacttacggcttgagtcca

SEQ ID NO: 652137 - DNA, 25 bp, Mus musculus
ggtgccaacttagggcttgagtcca

SEQ ID NO: 652138 - DNA, 25 bp, Mus musculus
ggtgccaagcacacagtcccttttg

SEQ ID NO: 652139 - DNA, 25 bp, Mus musculus
ggtgccaagcactcagtcccttttg

SEQ ID NO: 652140 - DNA, 25 bp, Mus musculus
ggtgccaagtataactcatacctga

SEQ ID NO: 652141 - DNA, 25 bp, Mus musculus
ggtgccaagtattactcatacctga

SEQ ID NO: 652142 - DNA, 25 bp, Mus musculus
ggtgccaagtgacgccttttctgaa

SEQ ID NO: 652143 - DNA, 25 bp, Mus musculus
ggtgccaagtgaggccttttctgaa

SEQ ID NO: 652144 - DNA, 25 bp, Mus musculus
ggtgccaatgccaagcagtcccggg

SEQ ID NO: 652145 - DNA, 25 bp, Mus musculus
ggtgccaatgcctagcagtcccggg

SEQ ID NO: 652146 - DNA, 25 bp, Mus musculus
ggtgccacacttaatttccattttt

SEQ ID NO: 652147 - DNA, 25 bp, Mus musculus
ggtgccacactttatttccattttt

SEQ ID NO: 652148 - DNA, 25 bp, Mus musculus
ggtgccacagagaagagcccagttg

SEQ ID NO: 652149 - DNA, 25 bp, Mus musculus
ggtgccacagagagtatcagtccca

SEQ ID NO: 652150 - DNA, 25 bp, Mus musculus
ggtgccacagagtagagcccagttg

SEQ ID NO: 652151 - DNA, 25 bp, Mus musculus
ggtgccacagagtgtatcagtccca

SEQ ID NO: 652152 - DNA, 25 bp, Mus musculus
ggtgccacagatcccctcacttaaa

SEQ ID NO: 652153 - DNA, 25 bp, Mus musculus
ggtgccacagatgccctcacttaaa

SEQ ID NO: 652154 - DNA, 25 bp, Mus musculus
ggtgccacagctcccaagcaggaag

SEQ ID NO: 652155 - DNA, 25 bp, Mus musculus
ggtgccacagctgccaagcaggaag

SEQ ID NO: 652156 - DNA, 25 bp, Mus musculus
ggtgccacccagagcagagggacat

SEQ ID NO: 652157 - DNA, 25 bp, Mus musculus
ggtgccacccagtgcagagggacat

SEQ ID NO: 652158 - DNA, 25 bp, Mus musculus
ggtgccacctgcataaaggtcacgt

SEQ ID NO: 652159 - DNA, 25 bp, Mus musculus
ggtgccacctgcttaaaggtcacgt

SEQ ID NO: 652160 - DNA, 25 bp, Mus musculus
ggtgccactattcgcttaagtaagc

SEQ ID NO: 652161 - DNA, 25 bp, Mus musculus
ggtgccactattggcttaagtaagc

SEQ ID NO: 652162 - DNA, 25 bp, Mus musculus
ggtgccactctgcaagcaagcgcta

SEQ ID NO: 652163 - DNA, 25 bp, Mus musculus
ggtgccactctggaagcaagcgcta

SEQ ID NO: 652164 - DNA, 25 bp, Mus musculus
ggtgccactgcaccttgtgacaggt

SEQ ID NO: 652165 - DNA, 25 bp, Mus musculus
ggtgccactgcagcttgtgacaggt

SEQ ID NO: 652166 - DNA, 25 bp, Mus musculus
ggtgccactgtcctgagcttcctga

SEQ ID NO: 652167 - DNA, 25 bp, Mus musculus
ggtgccactgtcgtgagcttcctga

SEQ ID NO: 652168 - DNA, 25 bp, Mus musculus
ggtgccagactgaagctccggcctt

SEQ ID NO: 652169 - DNA, 25 bp, Mus musculus
ggtgccagactgaaggtacagcgat

SEQ ID NO: 652170 - DNA, 25 bp, Mus musculus
ggtgccagactgaattgttaaaact

SEQ ID NO: 652171 - DNA, 25 bp, Mus musculus
ggtgccagactgtagctccggcctt

SEQ ID NO: 652172 - DNA, 25 bp, Mus musculus
ggtgccagactgtaggtacagcgat

SEQ ID NO: 652173 - DNA, 25 bp, Mus musculus
ggtgccagactgtattgttaaaact

SEQ ID NO: 652174 - DNA, 25 bp, Mus musculus
ggtgccagctaactgagaccttaag

SEQ ID NO: 652175 - DNA, 25 bp, Mus musculus
ggtgccagctaagtgagaccttaag

SEQ ID NO: 652176 - DNA, 25 bp, Mus musculus
ggtgccagcttcagactaacaaatg

SEQ ID NO: 652177 - DNA, 25 bp, Mus musculus
ggtgccagcttctgactaacaaatg

SEQ ID NO: 652178 - DNA, 25 bp, Mus musculus
ggtgccaggaatacaacccagctcc

SEQ ID NO: 652179 - DNA, 25 bp, Mus musculus
ggtgccaggaattcaacccagctcc

SEQ ID NO: 652180 - DNA, 25 bp, Mus musculus
ggtgccagggccacagcttaatact

SEQ ID NO: 652181 - DNA, 25 bp, Mus musculus
ggtgccagggccattgactcaagaa

SEQ ID NO: 652182 - DNA, 25 bp, Mus musculus
ggtgccagggcctcagcttaatact

SEQ ID NO: 652183 - DNA, 25 bp, Mus musculus
ggtgccagggcctttgactcaagaa

SEQ ID NO: 652184 - DNA, 25 bp, Mus musculus
ggtgccagggtcagagagtgccaaa

SEQ ID NO: 652185 - DNA, 25 bp, Mus musculus
ggtgccagggtctgagagtgccaaa

SEQ ID NO: 652186 - DNA, 25 bp, Mus musculus
ggtgccaggtccaaaagacgtcaaa

SEQ ID NO: 652187 - DNA, 25 bp, Mus musculus
ggtgccaggtcctaaagacgtcaaa

SEQ ID NO: 652188 - DNA, 25 bp, Mus musculus
ggtgccagtagcaatgaggagccca

SEQ ID NO: 652189 - DNA, 25 bp, Mus musculus
ggtgccagtagctatgaggagccca

SEQ ID NO: 652190 - DNA, 25 bp, Mus musculus
ggtgccagtctacagctcctggaag

SEQ ID NO: 652191 - DNA, 25 bp, Mus musculus
ggtgccagtctagagctcctggaag

SEQ ID NO: 652192 - DNA, 25 bp, Mus musculus
ggtgccagttccacccgttctggag

SEQ ID NO: 652193 - DNA, 25 bp, Mus musculus
ggtgccagttcctcccgttctggag

SEQ ID NO: 652194 - DNA, 25 bp, Mus musculus
ggtgccatactgaggtctgatctta

SEQ ID NO: 652195 - DNA, 25 bp, Mus musculus
ggtgccatactgtggtctgatctta

SEQ ID NO: 652196 - DNA, 25 bp, Mus musculus
ggtgccatatcaaggactatccaga

SEQ ID NO: 652197 - DNA, 25 bp, Mus musculus
ggtgccatatcatggactatccaga

SEQ ID NO: 652198 - DNA, 25 bp, Mus musculus
ggtgccatatttccacaaagtcact

SEQ ID NO: 652199 - DNA, 25 bp, Mus musculus
ggtgccatatttgcacaaagtcact

SEQ ID NO: 652200 - DNA, 25 bp, Mus musculus
ggtgccatccacaatcagggtagat

SEQ ID NO: 652201 - DNA, 25 bp, Mus musculus
ggtgccatccactatcagggtagat

SEQ ID NO: 652202 - DNA, 25 bp, Mus musculus
ggtgccatcccaaactttaaggtag

SEQ ID NO: 652203 - DNA, 25 bp, Mus musculus
ggtgccatcccatactttaaggtag

SEQ ID NO: 652204 - DNA, 25 bp, Mus musculus
ggtgccatccttactgggaagttgt

SEQ ID NO: 652205 - DNA, 25 bp, Mus musculus
ggtgccatcctttctgggaagttgt

SEQ ID NO: 652206 - DNA, 25 bp, Mus musculus
ggtgccatctatccggctctggagc

SEQ ID NO: 652207 - DNA, 25 bp, Mus musculus
ggtgccatctatgcggctctggagc

SEQ ID NO: 652208 - DNA, 25 bp, Mus musculus
ggtgccatgcccattaagaggagaa

SEQ ID NO: 652209 - DNA, 25 bp, Mus musculus
ggtgccatgccctttaagaggagaa

SEQ ID NO: 652210 - DNA, 25 bp, Mus musculus
ggtgccatggaaacagttgctgtgc

SEQ ID NO: 652211 - DNA, 25 bp, Mus musculus
ggtgccatggaatcagttgctgtgc

SEQ ID NO: 652212 - DNA, 25 bp, Mus musculus
ggtgccatggataatcctgttgagt

SEQ ID NO: 652213 - DNA, 25 bp, Mus musculus
ggtgccatggattatcctgttgagt

SEQ ID NO: 652214 - DNA, 25 bp, Mus musculus
ggtgccatgtgacgttcatcccagc

SEQ ID NO: 652215 - DNA, 25 bp, Mus musculus
ggtgccatgtgaggttcatcccagc

SEQ ID NO: 652216 - DNA, 25 bp, Mus musculus
ggtgccatgttcattgagctgttct

SEQ ID NO: 652217 - DNA, 25 bp, Mus musculus
ggtgccatgttctttgagctgttct

SEQ ID NO: 652218 - DNA, 25 bp, Mus musculus
ggtgccattaaacgatagaaccctt

SEQ ID NO: 652219 - DNA, 25 bp, Mus musculus
ggtgccattaaaggatagaaccctt

SEQ ID NO: 652220 - DNA, 25 bp, Mus musculus
ggtgccattcttacaggactatttt

SEQ ID NO: 652221 - DNA, 25 bp, Mus musculus
ggtgccattctttcaggactatttt

SEQ ID NO: 652222 - DNA, 25 bp, Mus musculus
ggtgcccaacggatcaagtcattgt

SEQ ID NO: 652223 - DNA, 25 bp, Mus musculus
ggtgcccaacggttcaagtcattgt

SEQ ID NO: 652224 - DNA, 25 bp, Mus musculus
ggtgcccaacttccttagaagccag

SEQ ID NO: 652225 - DNA, 25 bp, Mus musculus
ggtgcccaacttgcttagaagccag

SEQ ID NO: 652226 - DNA, 25 bp, Mus musculus
ggtgcccaaggtccctgagatgccc

SEQ ID NO: 652227 - DNA, 25 bp, Mus musculus
ggtgcccaaggtgcctgagatgccc

SEQ ID NO: 652228 - DNA, 25 bp, Mus musculus
ggtgcccacacaacagatactgttg

SEQ ID NO: 652229 - DNA, 25 bp, Mus musculus
ggtgcccacacatcagatactgttg

SEQ ID NO: 652230 - DNA, 25 bp, Mus musculus
ggtgcccacactctaagaaggtcat

SEQ ID NO: 652231 - DNA, 25 bp, Mus musculus
ggtgcccacactgtaagaaggtcat

SEQ ID NO: 652232 - DNA, 25 bp, Mus musculus
ggtgcccaccacaacattgagtgac

SEQ ID NO: 652233 - DNA, 25 bp, Mus musculus
ggtgcccaccactacattgagtgac

SEQ ID NO: 652234 - DNA, 25 bp, Mus musculus
ggtgcccagagaccagaccatgaat

SEQ ID NO: 652235 - DNA, 25 bp, Mus musculus
ggtgcccagagagcagaccatgaat

SEQ ID NO: 652236 - DNA, 25 bp, Mus musculus
ggtgcccagagcagtccagagacgt

SEQ ID NO: 652237 - DNA, 25 bp, Mus musculus
ggtgcccagagctgtccagagacgt

SEQ ID NO: 652238 - DNA, 25 bp, Mus musculus
ggtgcccagtagagacccagttgtg

SEQ ID NO: 652239 - DNA, 25 bp, Mus musculus
ggtgcccagtagtgacccagttgtg

SEQ ID NO: 652240 - DNA, 25 bp, Mus musculus
ggtgcccagtcgatttatacctgaa

SEQ ID NO: 652241 - DNA, 25 bp, Mus musculus
ggtgcccagtcgttttatacctgaa

SEQ ID NO: 652242 - DNA, 25 bp, Mus musculus
ggtgcccagtgcaaggagaccatct

SEQ ID NO: 652243 - DNA, 25 bp, Mus musculus
ggtgcccagtgctaggagaccatct

SEQ ID NO: 652244 - DNA, 25 bp, Mus musculus
ggtgcccatagccaaattccaggag

SEQ ID NO: 652245 - DNA, 25 bp, Mus musculus
ggtgcccatagcgaaattccaggag

SEQ ID NO: 652246 - DNA, 25 bp, Mus musculus
ggtgcccatgctagtaggactggtt

SEQ ID NO: 652247 - DNA, 25 bp, Mus musculus
ggtgcccatgcttgtaggactggtt

SEQ ID NO: 652248 - DNA, 25 bp, Mus musculus
ggtgcccattgtagtagagcctgct

SEQ ID NO: 652249 - DNA, 25 bp, Mus musculus
ggtgcccattgttgtagagcctgct

SEQ ID NO: 652250 - DNA, 25 bp, Mus musculus
ggtgccccaaacatcacacacggga

SEQ ID NO: 652251 - DNA, 25 bp, Mus musculus
ggtgccccaaacttcacacacggga

SEQ ID NO: 652252 - DNA, 25 bp, Mus musculus
ggtgccccaggcctgagtgtacacc

SEQ ID NO: 652253 - DNA, 25 bp, Mus musculus
ggtgccccaggcgtgagtgtacacc

SEQ ID NO: 652254 - DNA, 25 bp, Mus musculus
ggtgccccgcagcttggtgccacaa

SEQ ID NO: 652255 - DNA, 25 bp, Mus musculus
ggtgccccgcaggttggtgccacaa

SEQ ID NO: 652256 - DNA, 25 bp, Mus musculus
ggtgccccggctcagtcacagtgtc

SEQ ID NO: 652257 - DNA, 25 bp, Mus musculus
ggtgccccggctgagtcacagtgtc

SEQ ID NO: 652258 - DNA, 25 bp, Mus musculus
ggtgccccgtgtcataagtttcagc

SEQ ID NO: 652259 - DNA, 25 bp, Mus musculus
ggtgccccgtgtgataagtttcagc

SEQ ID NO: 652260 - DNA, 25 bp, Mus musculus
ggtgcccctccaaccaggatgaggc

SEQ ID NO: 652261 - DNA, 25 bp, Mus musculus
ggtgcccctccatccaggatgaggc

SEQ ID NO: 652262 - DNA, 25 bp, Mus musculus
ggtgcccctggactcaaaagaaagt

SEQ ID NO: 652263 - DNA, 25 bp, Mus musculus
ggtgcccctggagtcaaaagaaagt

SEQ ID NO: 652264 - DNA, 25 bp, Mus musculus
ggtgcccctggcaggttttatttat

SEQ ID NO: 652265 - DNA, 25 bp, Mus musculus
ggtgcccctggctggttttatttat

SEQ ID NO: 652266 - DNA, 25 bp, Mus musculus
ggtgcccgatgactttgagatttct

SEQ ID NO: 652267 - DNA, 25 bp, Mus musculus
ggtgcccgatgagtttgagatttct

SEQ ID NO: 652268 - DNA, 25 bp, Mus musculus
ggtgcccgcacacaacagattgttt

SEQ ID NO: 652269 - DNA, 25 bp, Mus musculus
ggtgcccgcacagaacagattgttt

SEQ ID NO: 652270 - DNA, 25 bp, Mus musculus
ggtgcccgccaaagaacgagtccct

SEQ ID NO: 652271 - DNA, 25 bp, Mus musculus
ggtgcccgccaatgaacgagtccct

SEQ ID NO: 652272 - DNA, 25 bp, Mus musculus
ggtgcccgggtcatcatcgaaaatt

SEQ ID NO: 652273 - DNA, 25 bp, Mus musculus
ggtgcccgggtcttcatcgaaaatt

SEQ ID NO: 652274 - DNA, 25 bp, Mus musculus
ggtgcccgtgggagaatatcacact

SEQ ID NO: 652275 - DNA, 25 bp, Mus musculus
ggtgcccgtgggtgaatatcacact

SEQ ID NO: 652276 - DNA, 25 bp, Mus musculus
ggtgccctaaaaactcttcagctga

SEQ ID NO: 652277 - DNA, 25 bp, Mus musculus
ggtgccctaaaatctcttcagctga

SEQ ID NO: 652278 - DNA, 25 bp, Mus musculus
ggtgccctactgcatcatcaaggga

SEQ ID NO: 652279 - DNA, 25 bp, Mus musculus
ggtgccctactggatcatcaaggga

SEQ ID NO: 652280 - DNA, 25 bp, Mus musculus
ggtgccctcaagatgcatatccgca

SEQ ID NO: 652281 - DNA, 25 bp, Mus musculus
ggtgccctcaagttgcatatccgca

SEQ ID NO: 652282 - DNA, 25 bp, Mus musculus
ggtgccctgaacctcagttttcctc

SEQ ID NO: 652283 - DNA, 25 bp, Mus musculus
ggtgccctgaacgtcagttttcctc

SEQ ID NO: 652284 - DNA, 25 bp, Mus musculus
ggtgccctgagtctttgtttttctt

SEQ ID NO: 652285 - DNA, 25 bp, Mus musculus
ggtgccctgagtgtttgtttttctt

SEQ ID NO: 652286 - DNA, 25 bp, Mus musculus
ggtgccctggtacatgttactgaaa

SEQ ID NO: 652287 - DNA, 25 bp, Mus musculus
ggtgccctggtagatgttactgaaa

SEQ ID NO: 652288 - DNA, 25 bp, Mus musculus
ggtgcccttcacataattgccttac

SEQ ID NO: 652289 - DNA, 25 bp, Mus musculus
ggtgcccttcacttaattgccttac

SEQ ID NO: 652290 - DNA, 25 bp, Mus musculus
ggtgcccttgacagctttgggtcag

SEQ ID NO: 652291 - DNA, 25 bp, Mus musculus
ggtgcccttgactgctttgggtcag

SEQ ID NO: 652292 - DNA, 25 bp, Mus musculus
ggtgccctttgcagggaagtgcatt

SEQ ID NO: 652293 - DNA, 25 bp, Mus musculus
ggtgccctttgctgggaagtgcatt

SEQ ID NO: 652294 - DNA, 25 bp, Mus musculus
ggtgccgaaaccagggacttcaaca

SEQ ID NO: 652295 - DNA, 25 bp, Mus musculus
ggtgccgaaacctgggacttcaaca

SEQ ID NO: 652296 - DNA, 25 bp, Mus musculus
ggtgccgaacgcagaagacaatccc

SEQ ID NO: 652297 - DNA, 25 bp, Mus musculus
ggtgccgaacgctgaagacaatccc

SEQ ID NO: 652298 - DNA, 25 bp, Mus musculus
ggtgccgattatccgttaccgcacg

SEQ ID NO: 652299 - DNA, 25 bp, Mus musculus
ggtgccgattatgcgttaccgcacg

SEQ ID NO: 652300 - DNA, 25 bp, Mus musculus
ggtgccgattccaacaaagatgctg

SEQ ID NO: 652301 - DNA, 25 bp, Mus musculus
ggtgccgattcctacaaagatgctg

SEQ ID NO: 652302 - DNA, 25 bp, Mus musculus
ggtgccgcacacaaacaatgcaatg

SEQ ID NO: 652303 - DNA, 25 bp, Mus musculus
ggtgccgcacactaacaatgcaatg

SEQ ID NO: 652304 - DNA, 25 bp, Mus musculus
ggtgccgcagtaatcagctatagtg

SEQ ID NO: 652305 - DNA, 25 bp, Mus musculus
ggtgccgcagtattcagctatagtg

SEQ ID NO: 652306 - DNA, 25 bp, Mus musculus
ggtgccgccctcagtaagcagggaa

SEQ ID NO: 652307 - DNA, 25 bp, Mus musculus
ggtgccgccctctgtaagcagggaa

SEQ ID NO: 652308 - DNA, 25 bp, Mus musculus
ggtgccgggccaagacgagaaacta

SEQ ID NO: 652309 - DNA, 25 bp, Mus musculus
ggtgccgggccatgacgagaaacta

SEQ ID NO: 652310 - DNA, 25 bp, Mus musculus
ggtgccggtcttaatgagcttgaac

SEQ ID NO: 652311 - DNA, 25 bp, Mus musculus
ggtgccggtctttatgagcttgaac

SEQ ID NO: 652312 - DNA, 25 bp, Mus musculus
ggtgccgtcgctcctaggctctgtc

SEQ ID NO: 652313 - DNA, 25 bp, Mus musculus
ggtgccgtcgctgctaggctctgtc

SEQ ID NO: 652314 - DNA, 25 bp, Mus musculus
ggtgccgtgaccactccaaagggca

SEQ ID NO: 652315 - DNA, 25 bp, Mus musculus
ggtgccgtgacctctccaaagggca

SEQ ID NO: 652316 - DNA, 25 bp, Mus musculus
ggtgccgtgcaaaccaagcgaagaa

SEQ ID NO: 652317 - DNA, 25 bp, Mus musculus
ggtgccgtgcaatccaagcgaagaa

SEQ ID NO: 652318 - DNA, 25 bp, Mus musculus
ggtgccgtgttcacattgtgacatt

SEQ ID NO: 652319 - DNA, 25 bp, Mus musculus
ggtgccgtgttctcattgtgacatt

SEQ ID NO: 652320 - DNA, 25 bp, Mus musculus
ggtgccgttcatagtccatttaatg

SEQ ID NO: 652321 - DNA, 25 bp, Mus musculus
ggtgccgttcattgtccatttaatg

SEQ ID NO: 652322 - DNA, 25 bp, Mus musculus
ggtgcctaaaatccagtgccttatg

SEQ ID NO: 652323 - DNA, 25 bp, Mus musculus
ggtgcctaaaatgcagtgccttatg

SEQ ID NO: 652324 - DNA, 25 bp, Mus musculus
ggtgcctaatagagttcttaacttg

SEQ ID NO: 652325 - DNA, 25 bp, Mus musculus
ggtgcctaatagtgttcttaacttg

SEQ ID NO: 652326 - DNA, 25 bp, Mus musculus
ggtgcctaatccacatctgtatcaa

SEQ ID NO: 652327 - DNA, 25 bp, Mus musculus
ggtgcctaatcctcatctgtatcaa

SEQ ID NO: 652328 - DNA, 25 bp, Mus musculus
ggtgcctacacgctttagagaacat

SEQ ID NO: 652329 - DNA, 25 bp, Mus musculus
ggtgcctacacggtttagagaacat

SEQ ID NO: 652330 - DNA, 25 bp, Mus musculus
ggtgcctacattactagaacagcag

SEQ ID NO: 652331 - DNA, 25 bp, Mus musculus
ggtgcctacatttctagaacagcag

SEQ ID NO: 652332 - DNA, 25 bp, Mus musculus
ggtgcctactcgctgtctttgagag

SEQ ID NO: 652333 - DNA, 25 bp, Mus musculus
ggtgcctactcggtgtctttgagag

SEQ ID NO: 652334 - DNA, 25 bp, Mus musculus
ggtgcctactgtctagttccttaca

SEQ ID NO: 652335 - DNA, 25 bp, Mus musculus
ggtgcctactgtgtagttccttaca

SEQ ID NO: 652336 - DNA, 25 bp, Mus musculus
ggtgcctagctgctgtcacatatca

SEQ ID NO: 652337 - DNA, 25 bp, Mus musculus
ggtgcctagctggtgtcacatatca

SEQ ID NO: 652338 - DNA, 25 bp, Mus musculus
ggtgcctaggatccaggacacatca

SEQ ID NO: 652339 - DNA, 25 bp, Mus musculus
ggtgcctaggatgcaggacacatca

SEQ ID NO: 652340 - DNA, 25 bp, Mus musculus
ggtgcctcaataccagtgggtcagc

SEQ ID NO: 652341 - DNA, 25 bp, Mus musculus
ggtgcctcaatagcagtgggtcagc

SEQ ID NO: 652342 - DNA, 25 bp, Mus musculus
ggtgcctcacacagtttctcgaaga

SEQ ID NO: 652343 - DNA, 25 bp, Mus musculus
ggtgcctcacactgtttctcgaaga

SEQ ID NO: 652344 - DNA, 25 bp, Mus musculus
ggtgcctcaccgcatgatcgcgagt

SEQ ID NO: 652345 - DNA, 25 bp, Mus musculus
ggtgcctcaccggatgatcgcgagt

SEQ ID NO: 652346 - DNA, 25 bp, Mus musculus
ggtgcctcacggagagcgacgaaat

SEQ ID NO: 652347 - DNA, 25 bp, Mus musculus
ggtgcctcacggtgagcgacgaaat

SEQ ID NO: 652348 - DNA, 25 bp, Mus musculus
ggtgcctcagagaacgatgaccctt

SEQ ID NO: 652349 - DNA, 25 bp, Mus musculus
ggtgcctcagagtacgatgaccctt

SEQ ID NO: 652350 - DNA, 25 bp, Mus musculus
ggtgcctccaggcaaagattgactt

SEQ ID NO: 652351 - DNA, 25 bp, Mus musculus
ggtgcctccagggaaagattgactt

SEQ ID NO: 652352 - DNA, 25 bp, Mus musculus
ggtgcctcccaaagtgtggcttgag

SEQ ID NO: 652353 - DNA, 25 bp, Mus musculus
ggtgcctcccaatgtgtggcttgag

SEQ ID NO: 652354 - DNA, 25 bp, Mus musculus
ggtgcctccctgcttgagccataga

SEQ ID NO: 652355 - DNA, 25 bp, Mus musculus
ggtgcctccctggttgagccataga

SEQ ID NO: 652356 - DNA, 25 bp, Mus musculus
ggtgcctcctcaactgggatgaaca

SEQ ID NO: 652357 - DNA, 25 bp, Mus musculus
ggtgcctcctcatctgggatgaaca

SEQ ID NO: 652358 - DNA, 25 bp, Mus musculus
ggtgcctcctgacactttatgtaac

SEQ ID NO: 652359 - DNA, 25 bp, Mus musculus
ggtgcctcctgagactttatgtaac

SEQ ID NO: 652360 - DNA, 25 bp, Mus musculus
ggtgcctcgggtccctcgctatggg

SEQ ID NO: 652361 - DNA, 25 bp, Mus musculus
ggtgcctcgggtgcctcgctatggg

SEQ ID NO: 652362 - DNA, 25 bp, Mus musculus
ggtgcctctcatcagcactctggag

SEQ ID NO: 652363 - DNA, 25 bp, Mus musculus
ggtgcctctcatgagcactctggag

SEQ ID NO: 652364 - DNA, 25 bp, Mus musculus
ggtgcctctgagacaccagagagat

SEQ ID NO: 652365 - DNA, 25 bp, Mus musculus
ggtgcctctgagtcaccagagagat

SEQ ID NO: 652366 - DNA, 25 bp, Mus musculus
ggtgcctctgtacatccacgagaca

SEQ ID NO: 652367 - DNA, 25 bp, Mus musculus
ggtgcctctgtagatccacgagaca

SEQ ID NO: 652368 - DNA, 25 bp, Mus musculus
ggtgcctctgtcatatggttcttga

SEQ ID NO: 652369 - DNA, 25 bp, Mus musculus
ggtgcctctgtcatgtgtgctcata

SEQ ID NO: 652370 - DNA, 25 bp, Mus musculus
ggtgcctctgtcttatggttcttga

SEQ ID NO: 652371 - DNA, 25 bp, Mus musculus
ggtgcctctgtcttgtgtgctcata

SEQ ID NO: 652372 - DNA, 25 bp, Mus musculus
ggtgcctcttgaacaattgctcatc

SEQ ID NO: 652373 - DNA, 25 bp, Mus musculus
ggtgcctcttgatcaattgctcatc

SEQ ID NO: 652374 - DNA, 25 bp, Mus musculus
ggtgcctgacataggttccacattg

SEQ ID NO: 652375 - DNA, 25 bp, Mus musculus
ggtgcctgacattggttccacattg

SEQ ID NO: 652376 - DNA, 25 bp, Mus musculus
ggtgcctgagatccccaatgtgcaa

SEQ ID NO: 652377 - DNA, 25 bp, Mus musculus
ggtgcctgagatgcccaatgtgcaa

SEQ ID NO: 652378 - DNA, 25 bp, Mus musculus
ggtgcctgagccactagcagagatt

SEQ ID NO: 652379 - DNA, 25 bp, Mus musculus
ggtgcctgagcctctagcagagatt

SEQ ID NO: 652380 - DNA, 25 bp, Mus musculus
ggtgcctgatctcgctggcaactga

SEQ ID NO: 652381 - DNA, 25 bp, Mus musculus
ggtgcctgatctggctggcaactga

SEQ ID NO: 652382 - DNA, 25 bp, Mus musculus
ggtgcctgcagaagcatatggccaa

SEQ ID NO: 652383 - DNA, 25 bp, Mus musculus
ggtgcctgcagatgcatatggccaa

SEQ ID NO: 652384 - DNA, 25 bp, Mus musculus
ggtgcctgcattcagtgccacaaag

SEQ ID NO: 652385 - DNA, 25 bp, Mus musculus
ggtgcctgcattgagtgccacaaag

SEQ ID NO: 652386 - DNA, 25 bp, Mus musculus
ggtgcctgctgtacatgtcactgaa

SEQ ID NO: 652387 - DNA, 25 bp, Mus musculus
ggtgcctgctgttcatgtcactgaa

SEQ ID NO: 652388 - DNA, 25 bp, Mus musculus
ggtgcctggcaaatgttaactgttc

SEQ ID NO: 652389 - DNA, 25 bp, Mus musculus
ggtgcctggcaattgttaactgttc

SEQ ID NO: 652390 - DNA, 25 bp, Mus musculus
ggtgcctgggccataagaaactagc

SEQ ID NO: 652391 - DNA, 25 bp, Mus musculus
ggtgcctgggccttaagaaactagc

SEQ ID NO: 652392 - DNA, 25 bp, Mus musculus
ggtgcctgtaacacaagccccagag

SEQ ID NO: 652393 - DNA, 25 bp, Mus musculus
ggtgcctgtaactcaagccccagag

SEQ ID NO: 652394 - DNA, 25 bp, Mus musculus
ggtgccttattcctattctatgctg

SEQ ID NO: 652395 - DNA, 25 bp, Mus musculus
ggtgccttattcgtattctatgctg

SEQ ID NO: 652396 - DNA, 25 bp, Mus musculus
ggtgccttatttcagctctgaacta

SEQ ID NO: 652397 - DNA, 25 bp, Mus musculus
ggtgccttatttgagctctgaacta

SEQ ID NO: 652398 - DNA, 25 bp, Mus musculus
ggtgccttcactagctatctggatg

SEQ ID NO: 652399 - DNA, 25 bp, Mus musculus
ggtgccttcacttgctatctggatg

SEQ ID NO: 652400 - DNA, 25 bp, Mus musculus
ggtgccttcagaaccttcgatagaa

SEQ ID NO: 652401 - DNA, 25 bp, Mus musculus
ggtgccttcagatccttcgatagaa

SEQ ID NO: 652402 - DNA, 25 bp, Mus musculus
ggtgccttcccacggcatcagagta

SEQ ID NO: 652403 - DNA, 25 bp, Mus musculus
ggtgccttcccagggcatcagagta

SEQ ID NO: 652404 - DNA, 25 bp, Mus musculus
ggtgccttccgaatcatgttggaat

SEQ ID NO: 652405 - DNA, 25 bp, Mus musculus
ggtgccttccgattcatgttggaat

SEQ ID NO: 652406 - DNA, 25 bp, Mus musculus
ggtgccttctggatcaaggctttga

SEQ ID NO: 652407 - DNA, 25 bp, Mus musculus
ggtgccttctggttcaaggctttga

SEQ ID NO: 652408 - DNA, 25 bp, Mus musculus
ggtgccttctgtctactgttgtagt

SEQ ID NO: 652409 - DNA, 25 bp, Mus musculus
ggtgccttctgtgtactgttgtagt

SEQ ID NO: 652410 - DNA, 25 bp, Mus musculus
ggtgccttgaatctcctaactgtag

SEQ ID NO: 652411 - DNA, 25 bp, Mus musculus
ggtgccttgaatgtcctaactgtag

SEQ ID NO: 652412 - DNA, 25 bp, Mus musculus
ggtgccttgatccaactatttgaag

SEQ ID NO: 652413 - DNA, 25 bp, Mus musculus
ggtgccttgatcgaactatttgaag

SEQ ID NO: 652414 - DNA, 25 bp, Mus musculus
ggtgccttggagcatcagttcctga

SEQ ID NO: 652415 - DNA, 25 bp, Mus musculus
ggtgccttggaggatcagttcctga

SEQ ID NO: 652416 - DNA, 25 bp, Mus musculus
ggtgccttggatcccgcagcaaaga

SEQ ID NO: 652417 - DNA, 25 bp, Mus musculus
ggtgccttggatgccgcagcaaaga

SEQ ID NO: 652418 - DNA, 25 bp, Mus musculus
ggtgcctttaagacacatcagctct

SEQ ID NO: 652419 - DNA, 25 bp, Mus musculus
ggtgcctttaagtcacatcagctct

SEQ ID NO: 652420 - DNA, 25 bp, Mus musculus
ggtgcctttccactgtttgattgga

SEQ ID NO: 652421 - DNA, 25 bp, Mus musculus
ggtgcctttccagtgtttgattgga

SEQ ID NO: 652422 - DNA, 25 bp, Mus musculus
ggtgcctttgaactatgctcagcca

SEQ ID NO: 652423 - DNA, 25 bp, Mus musculus
ggtgcctttgaagtatgctcagcca

SEQ ID NO: 652424 - DNA, 25 bp, Mus musculus
ggtgcctttgagccctttgatacca

SEQ ID NO: 652425 - DNA, 25 bp, Mus musculus
ggtgcctttgaggcctttgatacca

SEQ ID NO: 652426 - DNA, 25 bp, Mus musculus
ggtgcctttgtaatacagtactgca

SEQ ID NO: 652427 - DNA, 25 bp, Mus musculus
ggtgcctttgtattacagtactgca

SEQ ID NO: 652428 - DNA, 25 bp, Mus musculus
ggtgccttttcaaagacaacgacga

SEQ ID NO: 652429 - DNA, 25 bp, Mus musculus
ggtgccttttcatagacaacgacga

SEQ ID NO: 652430 - DNA, 25 bp, Mus musculus
ggtgccttttccacagtcaagggtg

SEQ ID NO: 652431 - DNA, 25 bp, Mus musculus
ggtgccttttcctcagtcaagggtg

SEQ ID NO: 652432 - DNA, 25 bp, Mus musculus
ggtgccttttctctataacatgttt

SEQ ID NO: 652433 - DNA, 25 bp, Mus musculus
ggtgccttttctgtataacatgttt

SEQ ID NO: 652434 - DNA, 25 bp, Mus musculus
ggtgcgaaagcgatggttccttaga

SEQ ID NO: 652435 - DNA, 25 bp, Mus musculus
ggtgcgaaagcgttggttccttaga

SEQ ID NO: 652436 - DNA, 25 bp, Mus musculus
ggtgcgactttaaaacagaacttca

SEQ ID NO: 652437 - DNA, 25 bp, Mus musculus
ggtgcgactttataacagaacttca

SEQ ID NO: 652438 - DNA, 25 bp, Mus musculus
ggtgcgagagaacgtatcccaaact

SEQ ID NO: 652439 - DNA, 25 bp, Mus musculus
ggtgcgagagaaggtatcccaaact

SEQ ID NO: 652440 - DNA, 25 bp, Mus musculus
ggtgcgatcaccacggtgcctcagc

SEQ ID NO: 652441 - DNA, 25 bp, Mus musculus
ggtgcgatcacctcggtgcctcagc

SEQ ID NO: 652442 - DNA, 25 bp, Mus musculus
ggtgcgcaaacaaaaaggccgtctg

SEQ ID NO: 652443 - DNA, 25 bp, Mus musculus
ggtgcgcaaacataaaggccgtctg

SEQ ID NO: 652444 - DNA, 25 bp, Mus musculus
ggtgcgcaacgtcgaacctcaaagt

SEQ ID NO: 652445 - DNA, 25 bp, Mus musculus
ggtgcgcaacgtggaacctcaaagt

SEQ ID NO: 652446 - DNA, 25 bp, Mus musculus
ggtgcgcacctgcagctacaaggaa

SEQ ID NO: 652447 - DNA, 25 bp, Mus musculus
ggtgcgcacctggagctacaaggaa

SEQ ID NO: 652448 - DNA, 25 bp, Mus musculus
ggtgcgcaggctagtgactgaactt

SEQ ID NO: 652449 - DNA, 25 bp, Mus musculus
ggtgcgcaggcttgtgactgaactt

SEQ ID NO: 652450 - DNA, 25 bp, Mus musculus
ggtgcgccacgacgatttactgctg

SEQ ID NO: 652451 - DNA, 25 bp, Mus musculus
ggtgcgccacgaggatttactgctg

SEQ ID NO: 652452 - DNA, 25 bp, Mus musculus
ggtgcgcctgggacgggagaaaaca

SEQ ID NO: 652453 - DNA, 25 bp, Mus musculus
ggtgcgcctgggtcgggagaaaaca

SEQ ID NO: 652454 - DNA, 25 bp, Mus musculus
ggtgcgcgaaccagtaagctttttt

SEQ ID NO: 652455 - DNA, 25 bp, Mus musculus
ggtgcgcgaacctgtaagctttttt

SEQ ID NO: 652456 - DNA, 25 bp, Mus musculus
ggtgcgctagcaattttaacatttt

SEQ ID NO: 652457 - DNA, 25 bp, Mus musculus
ggtgcgctagcatttttaacatttt

SEQ ID NO: 652458 - DNA, 25 bp, Mus musculus
ggtgcgctctatcctgtagtcagaa

SEQ ID NO: 652459 - DNA, 25 bp, Mus musculus
ggtgcgctctatgctgtagtcagaa

SEQ ID NO: 652460 - DNA, 25 bp, Mus musculus
ggtgcgctgacaatcctcctgtcca

SEQ ID NO: 652461 - DNA, 25 bp, Mus musculus
ggtgcgctgacattcctcctgtcca

SEQ ID NO: 652462 - DNA, 25 bp, Mus musculus
ggtgcgctgtggatcaagacacttt

SEQ ID NO: 652463 - DNA, 25 bp, Mus musculus
ggtgcgctgtggttcaagacacttt

SEQ ID NO: 652464 - DNA, 25 bp, Mus musculus
ggtgcgctttggagcagataagaat

SEQ ID NO: 652465 - DNA, 25 bp, Mus musculus
ggtgcgctttggtgcagataagaat

SEQ ID NO: 652466 - DNA, 25 bp, Mus musculus
ggtgcggaatccctgtaatgtaatg

SEQ ID NO: 652467 - DNA, 25 bp, Mus musculus
ggtgcggaatccgtgtaatgtaatg

SEQ ID NO: 652468 - DNA, 25 bp, Mus musculus
ggtgcggctggaacatggacttcaa

SEQ ID NO: 652469 - DNA, 25 bp, Mus musculus
ggtgcggctggatcatggacttcaa

SEQ ID NO: 652470 - DNA, 25 bp, Mus musculus
ggtgcggctgtgatttccatgagca

SEQ ID NO: 652471 - DNA, 25 bp, Mus musculus
ggtgcggctgtgttttccatgagca

SEQ ID NO: 652472 - DNA, 25 bp, Mus musculus
ggtgcgggctttcttacagatgcta

SEQ ID NO: 652473 - DNA, 25 bp, Mus musculus
ggtgcgggctttgttacagatgcta

SEQ ID NO: 652474 - DNA, 25 bp, Mus musculus
ggtgcggttgtccatgaagatctac

SEQ ID NO: 652475 - DNA, 25 bp, Mus musculus
ggtgcggttgtcgatgaagatctac

SEQ ID NO: 652476 - DNA, 25 bp, Mus musculus
ggtgcgtccttaattgctccccacc

SEQ ID NO: 652477 - DNA, 25 bp, Mus musculus
ggtgcgtccttatttgctccccacc

SEQ ID NO: 652478 - DNA, 25 bp, Mus musculus
ggtgcgtctatcaaacattgttcgt

SEQ ID NO: 652479 - DNA, 25 bp, Mus musculus
ggtgcgtctatctaacattgttcgt

SEQ ID NO: 652480 - DNA, 25 bp, Mus musculus
ggtgcgtcttccacaattaatttat

SEQ ID NO: 652481 - DNA, 25 bp, Mus musculus
ggtgcgtcttcctcaattaatttat

SEQ ID NO: 652482 - DNA, 25 bp, Mus musculus
ggtgcgtgcgcacggatacacataa

SEQ ID NO: 652483 - DNA, 25 bp, Mus musculus
ggtgcgtgcgcagggatacacataa

SEQ ID NO: 652484 - DNA, 25 bp, Mus musculus
ggtgcgtgctagagcaattgctcaa

SEQ ID NO: 652485 - DNA, 25 bp, Mus musculus
ggtgcgtgctagtgcaattgctcaa

SEQ ID NO: 652486 - DNA, 25 bp, Mus musculus
ggtgcgtgtccaacttagatgtggt

SEQ ID NO: 652487 - DNA, 25 bp, Mus musculus
ggtgcgtgtccatcttagatgtggt

SEQ ID NO: 652488 - DNA, 25 bp, Mus musculus
ggtgcgtgtttaattttagtatcct

SEQ ID NO: 652489 - DNA, 25 bp, Mus musculus
ggtgcgtgtttatttttagtatcct

SEQ ID NO: 652490 - DNA, 25 bp, Mus musculus
ggtgcgttaaacattcctctatctt

SEQ ID NO: 652491 - DNA, 25 bp, Mus musculus
ggtgcgttaaactttcctctatctt

SEQ ID NO: 652492 - DNA, 25 bp, Mus musculus
ggtgcgttattccacttattaaaga

SEQ ID NO: 652493 - DNA, 25 bp, Mus musculus
ggtgcgttattcgacttattaaaga

SEQ ID NO: 652494 - DNA, 25 bp, Mus musculus
ggtgctaaaagccacctgttaggac

SEQ ID NO: 652495 - DNA, 25 bp, Mus musculus
ggtgctaaaagcgacctgttaggac

SEQ ID NO: 652496 - DNA, 25 bp, Mus musculus
ggtgctaaatttaattacatgcagt

SEQ ID NO: 652497 - DNA, 25 bp, Mus musculus
ggtgctaaattttattacatgcagt

SEQ ID NO: 652498 - DNA, 25 bp, Mus musculus
ggtgctaacatcacgtcaggccgat

SEQ ID NO: 652499 - DNA, 25 bp, Mus musculus
ggtgctaacatctcgtcaggccgat

SEQ ID NO: 652500 - DNA, 25 bp, Mus musculus
ggtgctaagacaccgtctcagtgct

SEQ ID NO: 652501 - DNA, 25 bp, Mus musculus
ggtgctaagacagcgtctcagtgct

SEQ ID NO: 652502 - DNA, 25 bp, Mus musculus
ggtgctaagatcaaccgcattttcc

SEQ ID NO: 652503 - DNA, 25 bp, Mus musculus
ggtgctaagatctaccgcattttcc

SEQ ID NO: 652504 - DNA, 25 bp, Mus musculus
ggtgctaaggatcctaaaccacact

SEQ ID NO: 652505 - DNA, 25 bp, Mus musculus
ggtgctaaggatgctaaaccacact

SEQ ID NO: 652506 - DNA, 25 bp, Mus musculus
ggtgctaagtccacgaactgacatt

SEQ ID NO: 652507 - DNA, 25 bp, Mus musculus
ggtgctaagtcctcgaactgacatt

SEQ ID NO: 652508 - DNA, 25 bp, Mus musculus
ggtgctaataggaccctagccctgc

SEQ ID NO: 652509 - DNA, 25 bp, Mus musculus
ggtgctaataggtccctagccctgc

SEQ ID NO: 652510 - DNA, 25 bp, Mus musculus
ggtgctaatatcctctatgacgaag

SEQ ID NO: 652511 - DNA, 25 bp, Mus musculus
ggtgctaatatcgtctatgacgaag

SEQ ID NO: 652512 - DNA, 25 bp, Mus musculus
ggtgctaatccaaggctttaaagat

SEQ ID NO: 652513 - DNA, 25 bp, Mus musculus
ggtgctaatccatggctttaaagat

SEQ ID NO: 652514 - DNA, 25 bp, Mus musculus
ggtgctaatcctattgttctgacag

SEQ ID NO: 652515 - DNA, 25 bp, Mus musculus
ggtgctaatccttttgttctgacag

SEQ ID NO: 652516 - DNA, 25 bp, Mus musculus
ggtgctaatggcacagtgatgatat

SEQ ID NO: 652517 - DNA, 25 bp, Mus musculus
ggtgctaatggctcagtgatgatat

SEQ ID NO: 652518 - DNA, 25 bp, Mus musculus
ggtgctaatggtctccatctatact

SEQ ID NO: 652519 - DNA, 25 bp, Mus musculus
ggtgctaatggtgtccatctatact

SEQ ID NO: 652520 - DNA, 25 bp, Mus musculus
ggtgctaattaaatcccattcctcc

SEQ ID NO: 652521 - DNA, 25 bp, Mus musculus
ggtgctaattaattcccattcctcc

SEQ ID NO: 652522 - DNA, 25 bp, Mus musculus
ggtgctacaaatagatccgctccag

SEQ ID NO: 652523 - DNA, 25 bp, Mus musculus
ggtgctacaaatatatccctccggg

SEQ ID NO: 652524 - DNA, 25 bp, Mus musculus
ggtgctacaaattgatccgctccag

SEQ ID NO: 652525 - DNA, 25 bp, Mus musculus
ggtgctacaaatttatccctccggg

SEQ ID NO: 652526 - DNA, 25 bp, Mus musculus
ggtgctacagaaatccactgctctg

SEQ ID NO: 652527 - DNA, 25 bp, Mus musculus
ggtgctacagaattccactgctctg

SEQ ID NO: 652528 - DNA, 25 bp, Mus musculus
ggtgctacaggccaatcgcggcttc

SEQ ID NO: 652529 - DNA, 25 bp, Mus musculus
ggtgctacaggcgaatcgcggcttc

SEQ ID NO: 652530 - DNA, 25 bp, Mus musculus
ggtgctacagtgatggttttgtgaa

SEQ ID NO: 652531 - DNA, 25 bp, Mus musculus
ggtgctacagtgttggttttgtgaa

SEQ ID NO: 652532 - DNA, 25 bp, Mus musculus
ggtgctacatccagattcacggcaa

SEQ ID NO: 652533 - DNA, 25 bp, Mus musculus
ggtgctacatcctgattcacggcaa

SEQ ID NO: 652534 - DNA, 25 bp, Mus musculus
ggtgctaccattcagactcaatctt

SEQ ID NO: 652535 - DNA, 25 bp, Mus musculus
ggtgctaccattgagactcaatctt

SEQ ID NO: 652536 - DNA, 25 bp, Mus musculus
ggtgctaccccaccatcatgatata

SEQ ID NO: 652537 - DNA, 25 bp, Mus musculus
ggtgctaccccagcatcatgatata

SEQ ID NO: 652538 - DNA, 25 bp, Mus musculus
ggtgctacctgtataaacttcttgc

SEQ ID NO: 652539 - DNA, 25 bp, Mus musculus
ggtgctacctgtttaaacttcttgc

SEQ ID NO: 652540 - DNA, 25 bp, Mus musculus
ggtgctaccttacctgtgactgtaa

SEQ ID NO: 652541 - DNA, 25 bp, Mus musculus
ggtgctaccttagctgtgactgtaa

SEQ ID NO: 652542 - DNA, 25 bp, Mus musculus
ggtgctacgtggacatcattcacag

SEQ ID NO: 652543 - DNA, 25 bp, Mus musculus
ggtgctacgtggtcatcattcacag

SEQ ID NO: 652544 - DNA, 25 bp, Mus musculus
ggtgctactccacgaagagcaagta

SEQ ID NO: 652545 - DNA, 25 bp, Mus musculus
ggtgctactccaggaagagcaagta

SEQ ID NO: 652546 - DNA, 25 bp, Mus musculus
ggtgctactgcacacggcgtaacta

SEQ ID NO: 652547 - DNA, 25 bp, Mus musculus
ggtgctactgcagacggcgtaacta

SEQ ID NO: 652548 - DNA, 25 bp, Mus musculus
ggtgctactgtgaaccaggcagaca

SEQ ID NO: 652549 - DNA, 25 bp, Mus musculus
ggtgctactgtgtaccaggcagaca

SEQ ID NO: 652550 - DNA, 25 bp, Mus musculus
ggtgctactgttctaccttcagccc

SEQ ID NO: 652551 - DNA, 25 bp, Mus musculus
ggtgctactgttgtaccttcagccc

SEQ ID NO: 652552 - DNA, 25 bp, Mus musculus
ggtgctagacagacacccacctttg

SEQ ID NO: 652553 - DNA, 25 bp, Mus musculus
ggtgctagacagtcacccacctttg

SEQ ID NO: 652554 - DNA, 25 bp, Mus musculus
ggtgctagagcgaccaaacttcctt

SEQ ID NO: 652555 - DNA, 25 bp, Mus musculus
ggtgctagagcgtccaaacttcctt

SEQ ID NO: 652556 - DNA, 25 bp, Mus musculus
ggtgctagagttcacctccatacat

SEQ ID NO: 652557 - DNA, 25 bp, Mus musculus
ggtgctagagttccactacctcggt

SEQ ID NO: 652558 - DNA, 25 bp, Mus musculus
ggtgctagagttgacctccatacat

SEQ ID NO: 652559 - DNA, 25 bp, Mus musculus
ggtgctagagttgcactacctcggt

SEQ ID NO: 652560 - DNA, 25 bp, Mus musculus
ggtgctagcaccaaaagaaatactt

SEQ ID NO: 652561 - DNA, 25 bp, Mus musculus
ggtgctagcacctaaagaaatactt

SEQ ID NO: 652562 - DNA, 25 bp, Mus musculus
ggtgctaggaccacagtcacggtca

SEQ ID NO: 652563 - DNA, 25 bp, Mus musculus
ggtgctaggacctcagtcacggtca

SEQ ID NO: 652564 - DNA, 25 bp, Mus musculus
ggtgctaggactcatacctttgcct

SEQ ID NO: 652565 - DNA, 25 bp, Mus musculus
ggtgctaggactgatacctttgcct

SEQ ID NO: 652566 - DNA, 25 bp, Mus musculus
ggtgctaggaggacacctgtaccca

SEQ ID NO: 652567 - DNA, 25 bp, Mus musculus
ggtgctaggaggtcacctgtaccca

SEQ ID NO: 652568 - DNA, 25 bp, Mus musculus
ggtgctagggctattaatctccaag

SEQ ID NO: 652569 - DNA, 25 bp, Mus musculus
ggtgctagggcttttaatctccaag

SEQ ID NO: 652570 - DNA, 25 bp, Mus musculus
ggtgctagtgggaattaattaactt

SEQ ID NO: 652571 - DNA, 25 bp, Mus musculus
ggtgctagtgggtattaattaactt

SEQ ID NO: 652572 - DNA, 25 bp, Mus musculus
ggtgctagtggtcaccatgtctata

SEQ ID NO: 652573 - DNA, 25 bp, Mus musculus
ggtgctagtggtgaccatgtctata

SEQ ID NO: 652574 - DNA, 25 bp, Mus musculus
ggtgctagttcaatttaagacgctg

SEQ ID NO: 652575 - DNA, 25 bp, Mus musculus
ggtgctagttcattttaagacgctg

SEQ ID NO: 652576 - DNA, 25 bp, Mus musculus
ggtgctatacatattttgactgcta

SEQ ID NO: 652577 - DNA, 25 bp, Mus musculus
ggtgctatacattttttgactgcta

SEQ ID NO: 652578 - DNA, 25 bp, Mus musculus
ggtgctatagatcaaatccaggtcc

SEQ ID NO: 652579 - DNA, 25 bp, Mus musculus
ggtgctatagatgaaatccaggtcc

SEQ ID NO: 652580 - DNA, 25 bp, Mus musculus
ggtgctatagccattcatctttttt

SEQ ID NO: 652581 - DNA, 25 bp, Mus musculus
ggtgctatagcctttcatctttttt

SEQ ID NO: 652582 - DNA, 25 bp, Mus musculus
ggtgctatcaaaccaacttggacat

SEQ ID NO: 652583 - DNA, 25 bp, Mus musculus
ggtgctatcaaagcaacttggacat

SEQ ID NO: 652584 - DNA, 25 bp, Mus musculus
ggtgctatccctatcacatgaagat

SEQ ID NO: 652585 - DNA, 25 bp, Mus musculus
ggtgctatccctttcacatgaagat

SEQ ID NO: 652586 - DNA, 25 bp, Mus musculus
ggtgctatgggtattgtttcattta

SEQ ID NO: 652587 - DNA, 25 bp, Mus musculus
ggtgctatgggttttgtttcattta

SEQ ID NO: 652588 - DNA, 25 bp, Mus musculus
ggtgctattaaaaaccaggctggtt

SEQ ID NO: 652589 - DNA, 25 bp, Mus musculus
ggtgctattaaataccaggctggtt

SEQ ID NO: 652590 - DNA, 25 bp, Mus musculus
ggtgctattaccaggattgttttca

SEQ ID NO: 652591 - DNA, 25 bp, Mus musculus
ggtgctattacctggattgttttca

SEQ ID NO: 652592 - DNA, 25 bp, Mus musculus
ggtgctattcagaaagtcttgttcc

SEQ ID NO: 652593 - DNA, 25 bp, Mus musculus
ggtgctattcagtaagtcttgttcc

SEQ ID NO: 652594 - DNA, 25 bp, Mus musculus
ggtgctattcctatccatagttgag

SEQ ID NO: 652595 - DNA, 25 bp, Mus musculus
ggtgctattcctttccatagttgag

SEQ ID NO: 652596 - DNA, 25 bp, Mus musculus
ggtgctattgaacatggaatccaga

SEQ ID NO: 652597 - DNA, 25 bp, Mus musculus
ggtgctattgaagatggaatccaga

SEQ ID NO: 652598 - DNA, 25 bp, Mus musculus
ggtgctatttaccaaactctctgcc

SEQ ID NO: 652599 - DNA, 25 bp, Mus musculus
ggtgctatttacgaaactctctgcc

SEQ ID NO: 652600 - DNA, 25 bp, Mus musculus
ggtgctattttcacgcaaggaaact

SEQ ID NO: 652601 - DNA, 25 bp, Mus musculus
ggtgctattttctcgcaaggaaact

SEQ ID NO: 652602 - DNA, 25 bp, Mus musculus
ggtgctcaaactctacatcaacatc

SEQ ID NO: 652603 - DNA, 25 bp, Mus musculus
ggtgctcaaactgtacatcaacatc

SEQ ID NO: 652604 - DNA, 25 bp, Mus musculus
ggtgctcaaccacattttgggccaa

SEQ ID NO: 652605 - DNA, 25 bp, Mus musculus
ggtgctcaaccagattttgggccaa

SEQ ID NO: 652606 - DNA, 25 bp, Mus musculus
ggtgctcaatggcagttctatctga

SEQ ID NO: 652607 - DNA, 25 bp, Mus musculus
ggtgctcaatgggagttctatctga

SEQ ID NO: 652608 - DNA, 25 bp, Mus musculus
ggtgctcacacacacataagcgaat

SEQ ID NO: 652609 - DNA, 25 bp, Mus musculus
ggtgctcacacagacataagcgaat

SEQ ID NO: 652610 - DNA, 25 bp, Mus musculus
ggtgctcacagcagagggtccccag

SEQ ID NO: 652611 - DNA, 25 bp, Mus musculus
ggtgctcacagctgagggtccccag

SEQ ID NO: 652612 - DNA, 25 bp, Mus musculus
ggtgctcaccatacttggatgcata

SEQ ID NO: 652613 - DNA, 25 bp, Mus musculus
ggtgctcaccattcttggatgcata

SEQ ID NO: 652614 - DNA, 25 bp, Mus musculus
ggtgctcactgtagaacccgtcggg

SEQ ID NO: 652615 - DNA, 25 bp, Mus musculus
ggtgctcactgttgaacccgtcggg

SEQ ID NO: 652616 - DNA, 25 bp, Mus musculus
ggtgctcacttcatgaaagctctag

SEQ ID NO: 652617 - DNA, 25 bp, Mus musculus
ggtgctcacttcttgaaagctctag

SEQ ID NO: 652618 - DNA, 25 bp, Mus musculus
ggtgctcagaagagctgtctgtctt

SEQ ID NO: 652619 - DNA, 25 bp, Mus musculus
ggtgctcagaagtgctgtctgtctt

SEQ ID NO: 652620 - DNA, 25 bp, Mus musculus
ggtgctcagacacaaagacaccccg

SEQ ID NO: 652621 - DNA, 25 bp, Mus musculus
ggtgctcagacagaaagacaccccg

SEQ ID NO: 652622 - DNA, 25 bp, Mus musculus
ggtgctcagacgaaatactctttgt

SEQ ID NO: 652623 - DNA, 25 bp, Mus musculus
ggtgctcagacgtaatactctttgt

SEQ ID NO: 652624 - DNA, 25 bp, Mus musculus
ggtgctcagattcacgacaacattc

SEQ ID NO: 652625 - DNA, 25 bp, Mus musculus
ggtgctcagattgacgacaacattc

SEQ ID NO: 652626 - DNA, 25 bp, Mus musculus
ggtgctcagctgaacttcaaggcta

SEQ ID NO: 652627 - DNA, 25 bp, Mus musculus
ggtgctcagctgtacttcaaggcta

SEQ ID NO: 652628 - DNA, 25 bp, Mus musculus
ggtgctcagcttctttactcctgtt

SEQ ID NO: 652629 - DNA, 25 bp, Mus musculus
ggtgctcagcttgtttactcctgtt

SEQ ID NO: 652630 - DNA, 25 bp, Mus musculus
ggtgctcagtagaaagcgcttacct

SEQ ID NO: 652631 - DNA, 25 bp, Mus musculus
ggtgctcagtagtaagcgcttacct

SEQ ID NO: 652632 - DNA, 25 bp, Mus musculus
ggtgctcagttaacagaaaccccaa

SEQ ID NO: 652633 - DNA, 25 bp, Mus musculus
ggtgctcagttatcagaaaccccaa

SEQ ID NO: 652634 - DNA, 25 bp, Mus musculus
ggtgctcagtttccctctgtcagaa

SEQ ID NO: 652635 - DNA, 25 bp, Mus musculus
ggtgctcagtttgcctctgtcagaa

SEQ ID NO: 652636 - DNA, 25 bp, Mus musculus
ggtgctcatcagaggaccttcactt

SEQ ID NO: 652637 - DNA, 25 bp, Mus musculus
ggtgctcatcagtggaccttcactt

SEQ ID NO: 652638 - DNA, 25 bp, Mus musculus
ggtgctcatcggctgccatggccct

SEQ ID NO: 652639 - DNA, 25 bp, Mus musculus
ggtgctcatcgggtgccatggccct

SEQ ID NO: 652640 - DNA, 25 bp, Mus musculus
ggtgctcatgttatggttcttaggt

SEQ ID NO: 652641 - DNA, 25 bp, Mus musculus
ggtgctcatgttttggttcttaggt

SEQ ID NO: 652642 - DNA, 25 bp, Mus musculus
ggtgctccaaggagggccagctgct

SEQ ID NO: 652643 - DNA, 25 bp, Mus musculus
ggtgctccaaggtgggccagctgct

SEQ ID NO: 652644 - DNA, 25 bp, Mus musculus
ggtgctccagaccatgagacagcaa

SEQ ID NO: 652645 - DNA, 25 bp, Mus musculus
ggtgctccagacgatgagacagcaa

SEQ ID NO: 652646 - DNA, 25 bp, Mus musculus
ggtgctccatggagagaaggcctcc

SEQ ID NO: 652647 - DNA, 25 bp, Mus musculus
ggtgctccatggtgagaaggcctcc

SEQ ID NO: 652648 - DNA, 25 bp, Mus musculus
ggtgctcccaatactgattaatgtg

SEQ ID NO: 652649 - DNA, 25 bp, Mus musculus
ggtgctcccaattctgattaatgtg

SEQ ID NO: 652650 - DNA, 25 bp, Mus musculus
ggtgctccccaaagctactgtgaag

SEQ ID NO: 652651 - DNA, 25 bp, Mus musculus
ggtgctccccaatgctactgtgaag

SEQ ID NO: 652652 - DNA, 25 bp, Mus musculus
ggtgctccctaccaagccgtgggct

SEQ ID NO: 652653 - DNA, 25 bp, Mus musculus
ggtgctccctacgaagccgtgggct

SEQ ID NO: 652654 - DNA, 25 bp, Mus musculus
ggtgctccctccaggaagggcaaga

SEQ ID NO: 652655 - DNA, 25 bp, Mus musculus
ggtgctccctcctggaagggcaaga

SEQ ID NO: 652656 - DNA, 25 bp, Mus musculus
ggtgctccgaacaagttgaagattt

SEQ ID NO: 652657 - DNA, 25 bp, Mus musculus
ggtgctccgaactagttgaagattt

SEQ ID NO: 652658 - DNA, 25 bp, Mus musculus
ggtgctcctagcagacaatgtcatt

SEQ ID NO: 652659 - DNA, 25 bp, Mus musculus
ggtgctcctagctgacaatgtcatt

SEQ ID NO: 652660 - DNA, 25 bp, Mus musculus
ggtgctcctatcagtgcttatcaaa

SEQ ID NO: 652661 - DNA, 25 bp, Mus musculus
ggtgctcctatctgtgcttatcaaa

SEQ ID NO: 652662 - DNA, 25 bp, Mus musculus
ggtgctcctgagcaatagcaatctc

SEQ ID NO: 652663 - DNA, 25 bp, Mus musculus
ggtgctcctgaggaatagcaatctc

SEQ ID NO: 652664 - DNA, 25 bp, Mus musculus
ggtgctcctgttacctatagatatc

SEQ ID NO: 652665 - DNA, 25 bp, Mus musculus
ggtgctcctgtttcctatagatatc

SEQ ID NO: 652666 - DNA, 25 bp, Mus musculus
ggtgctccttgaaacagtgacatac

SEQ ID NO: 652667 - DNA, 25 bp, Mus musculus
ggtgctccttgatacagtgacatac

SEQ ID NO: 652668 - DNA, 25 bp, Mus musculus
ggtgctcgctccacgaagggataag

SEQ ID NO: 652669 - DNA, 25 bp, Mus musculus
ggtgctcgctcctcgaagggataag

SEQ ID NO: 652670 - DNA, 25 bp, Mus musculus
ggtgctcgctgtacttctagaagag

SEQ ID NO: 652671 - DNA, 25 bp, Mus musculus
ggtgctcgctgttcttctagaagag

SEQ ID NO: 652672 - DNA, 25 bp, Mus musculus
ggtgctcggttcattccagcttggg

SEQ ID NO: 652673 - DNA, 25 bp, Mus musculus
ggtgctcggttctttccagcttggg

SEQ ID NO: 652674 - DNA, 25 bp, Mus musculus
ggtgctctcaagagctgtcacaaaa

SEQ ID NO: 652675 - DNA, 25 bp, Mus musculus
ggtgctctcaagtgctgtcacaaaa

SEQ ID NO: 652676 - DNA, 25 bp, Mus musculus
ggtgctctcaccattgtaaagattt

SEQ ID NO: 652677 - DNA, 25 bp, Mus musculus
ggtgctctcacctttgtaaagattt

SEQ ID NO: 652678 - DNA, 25 bp, Mus musculus
ggtgctctctttccagcatcttaaa

SEQ ID NO: 652679 - DNA, 25 bp, Mus musculus
ggtgctctctttgcagcatcttaaa

SEQ ID NO: 652680 - DNA, 25 bp, Mus musculus
ggtgctctgaggacactttactata

SEQ ID NO: 652681 - DNA, 25 bp, Mus musculus
ggtgctctgaggtcactttactata

SEQ ID NO: 652682 - DNA, 25 bp, Mus musculus
ggtgctctgattatgctaattgctc

SEQ ID NO: 652683 - DNA, 25 bp, Mus musculus
ggtgctctgattttgctaattgctc

SEQ ID NO: 652684 - DNA, 25 bp, Mus musculus
ggtgctctgcgacaagatgcctact

SEQ ID NO: 652685 - DNA, 25 bp, Mus musculus
ggtgctctgcgagaagatgcctact

SEQ ID NO: 652686 - DNA, 25 bp, Mus musculus
ggtgctctggcaccacactgtagct

SEQ ID NO: 652687 - DNA, 25 bp, Mus musculus
ggtgctctggcagcacactgtagct

SEQ ID NO: 652688 - DNA, 25 bp, Mus musculus
ggtgctctgggtcatccgcaaacaa

SEQ ID NO: 652689 - DNA, 25 bp, Mus musculus
ggtgctctgggtgatccgcaaacaa

SEQ ID NO: 652690 - DNA, 25 bp, Mus musculus
ggtgctctgtgacgctttgaatcac

SEQ ID NO: 652691 - DNA, 25 bp, Mus musculus
ggtgctctgtgaggctttgaatcac

SEQ ID NO: 652692 - DNA, 25 bp, Mus musculus
ggtgctctgttaaaaaggcatgctt

SEQ ID NO: 652693 - DNA, 25 bp, Mus musculus
ggtgctctgttataaaggcatgctt

SEQ ID NO: 652694 - DNA, 25 bp, Mus musculus
ggtgctcttaatacctgttaaattg

SEQ ID NO: 652695 - DNA, 25 bp, Mus musculus
ggtgctcttaattcctgttaaattg

SEQ ID NO: 652696 - DNA, 25 bp, Mus musculus
ggtgctcttagaaacatgactcatt

SEQ ID NO: 652697 - DNA, 25 bp, Mus musculus
ggtgctcttagatacatgactcatt

SEQ ID NO: 652698 - DNA, 25 bp, Mus musculus
ggtgctcttcctagggatccgatgc

SEQ ID NO: 652699 - DNA, 25 bp, Mus musculus
ggtgctcttccttgggatccgatgc

SEQ ID NO: 652700 - DNA, 25 bp, Mus musculus
ggtgctctttcacaatggagccaga

SEQ ID NO: 652701 - DNA, 25 bp, Mus musculus
ggtgctctttcagaatggagccaga

SEQ ID NO: 652702 - DNA, 25 bp, Mus musculus
ggtgctgaaatcatggctgatactt

SEQ ID NO: 652703 - DNA, 25 bp, Mus musculus
ggtgctgaaatcttggctgatactt

SEQ ID NO: 652704 - DNA, 25 bp, Mus musculus
ggtgctgaagctcgtaccagaaccc

SEQ ID NO: 652705 - DNA, 25 bp, Mus musculus
ggtgctgaagctggtaccagaaccc

SEQ ID NO: 652706 - DNA, 25 bp, Mus musculus
ggtgctgaattcaaagttcatcttt

SEQ ID NO: 652707 - DNA, 25 bp, Mus musculus
ggtgctgaattcatatgtgctaggt

SEQ ID NO: 652708 - DNA, 25 bp, Mus musculus
ggtgctgaattctaagttcatcttt

SEQ ID NO: 652709 - DNA, 25 bp, Mus musculus
ggtgctgaattcttatgtgctaggt

SEQ ID NO: 652710 - DNA, 25 bp, Mus musculus
ggtgctgacccaaagaaaggagatt

SEQ ID NO: 652711 - DNA, 25 bp, Mus musculus
ggtgctgacccatagaaaggagatt

SEQ ID NO: 652712 - DNA, 25 bp, Mus musculus
ggtgctgacgctacttagttgggaa

SEQ ID NO: 652713 - DNA, 25 bp, Mus musculus
ggtgctgacgcttcttagttgggaa

SEQ ID NO: 652714 - DNA, 25 bp, Mus musculus
ggtgctgacgttatacagtacataa

SEQ ID NO: 652715 - DNA, 25 bp, Mus musculus
ggtgctgacgttttacagtacataa

SEQ ID NO: 652716 - DNA, 25 bp, Mus musculus
ggtgctgacttgcaacatgcatgtt

SEQ ID NO: 652717 - DNA, 25 bp, Mus musculus
ggtgctgacttggaacatgcatgtt

SEQ ID NO: 652718 - DNA, 25 bp, Mus musculus
ggtgctgagcctaatcagtgagcaa

SEQ ID NO: 652719 - DNA, 25 bp, Mus musculus
ggtgctgagccttatcagtgagcaa

SEQ ID NO: 652720 - DNA, 25 bp, Mus musculus
ggtgctgaggtacaaaactgctgct

SEQ ID NO: 652721 - DNA, 25 bp, Mus musculus
ggtgctgaggtagaaaactgctgct

SEQ ID NO: 652722 - DNA, 25 bp, Mus musculus
ggtgctgatgaaaagacacttcctc

SEQ ID NO: 652723 - DNA, 25 bp, Mus musculus
ggtgctgatgaatagacacttcctc

SEQ ID NO: 652724 - DNA, 25 bp, Mus musculus
ggtgctgatggcaataaggcgtctt

SEQ ID NO: 652725 - DNA, 25 bp, Mus musculus
ggtgctgatggcctcatctggaaat

SEQ ID NO: 652726 - DNA, 25 bp, Mus musculus
ggtgctgatggcgtcatctggaaat

SEQ ID NO: 652727 - DNA, 25 bp, Mus musculus
ggtgctgatggctataaggcgtctt

SEQ ID NO: 652728 - DNA, 25 bp, Mus musculus
ggtgctgatgggagatagtttacct

SEQ ID NO: 652729 - DNA, 25 bp, Mus musculus
ggtgctgatgggtgatagtttacct

SEQ ID NO: 652730 - DNA, 25 bp, Mus musculus
ggtgctgatgttcaatcattttctg

SEQ ID NO: 652731 - DNA, 25 bp, Mus musculus
ggtgctgatgttgaatcattttctg

SEQ ID NO: 652732 - DNA, 25 bp, Mus musculus
ggtgctgcaagaacataaagtgact

SEQ ID NO: 652733 - DNA, 25 bp, Mus musculus
ggtgctgcaagatcataaagtgact

SEQ ID NO: 652734 - DNA, 25 bp, Mus musculus
ggtgctgcaatactcaatcctggaa

SEQ ID NO: 652735 - DNA, 25 bp, Mus musculus
ggtgctgcaatagtcaatcctggaa

SEQ ID NO: 652736 - DNA, 25 bp, Mus musculus
ggtgctgcacaacgcgcttgaagaa

SEQ ID NO: 652737 - DNA, 25 bp, Mus musculus
ggtgctgcacaaggcgcttgaagaa

SEQ ID NO: 652738 - DNA, 25 bp, Mus musculus
ggtgctgcacggacaactggtcatg

SEQ ID NO: 652739 - DNA, 25 bp, Mus musculus
ggtgctgcacggcttcccaagagac

SEQ ID NO: 652740 - DNA, 25 bp, Mus musculus
ggtgctgcacgggttcccaagagac

SEQ ID NO: 652741 - DNA, 25 bp, Mus musculus
ggtgctgcacggtcaactggtcatg

SEQ ID NO: 652742 - DNA, 25 bp, Mus musculus
ggtgctgccaaacactaggttgttt

SEQ ID NO: 652743 - DNA, 25 bp, Mus musculus
ggtgctgccaaagactaggttgttt

SEQ ID NO: 652744 - DNA, 25 bp, Mus musculus
ggtgctgcccaacccactgaattgc

SEQ ID NO: 652745 - DNA, 25 bp, Mus musculus
ggtgctgcccaagccactgaattgc

SEQ ID NO: 652746 - DNA, 25 bp, Mus musculus
ggtgctgccctgctcataactggga

SEQ ID NO: 652747 - DNA, 25 bp, Mus musculus
ggtgctgccctggtcataactggga

SEQ ID NO: 652748 - DNA, 25 bp, Mus musculus
ggtgctgcctgtagtagaagtctct

SEQ ID NO: 652749 - DNA, 25 bp, Mus musculus
ggtgctgcctgttgtagaagtctct

SEQ ID NO: 652750 - DNA, 25 bp, Mus musculus
ggtgctgccttccttacatgaaagt

SEQ ID NO: 652751 - DNA, 25 bp, Mus musculus
ggtgctgccttcgttacatgaaagt

SEQ ID NO: 652752 - DNA, 25 bp, Mus musculus
ggtgctgcgaagaggcttgacttcc

SEQ ID NO: 652753 - DNA, 25 bp, Mus musculus
ggtgctgcgaagtggcttgacttcc

SEQ ID NO: 652754 - DNA, 25 bp, Mus musculus
ggtgctgcgtccatatgaatgtttt

SEQ ID NO: 652755 - DNA, 25 bp, Mus musculus
ggtgctgcgtccttatgaatgtttt

SEQ ID NO: 652756 - DNA, 25 bp, Mus musculus
ggtgctgctcccaacaaaaggatta

SEQ ID NO: 652757 - DNA, 25 bp, Mus musculus
ggtgctgctccctacaaaaggatta

SEQ ID NO: 652758 - DNA, 25 bp, Mus musculus
ggtgctgctgacacactgtgtgtga

SEQ ID NO: 652759 - DNA, 25 bp, Mus musculus
ggtgctgctgactcactgtgtgtga

SEQ ID NO: 652760 - DNA, 25 bp, Mus musculus
ggtgctgctgtacatcttgattcat

SEQ ID NO: 652761 - DNA, 25 bp, Mus musculus
ggtgctgctgtagatcttgattcat

SEQ ID NO: 652762 - DNA, 25 bp, Mus musculus
ggtgctgcttacactgtctgtcagg

SEQ ID NO: 652763 - DNA, 25 bp, Mus musculus
ggtgctgcttactctgtctgtcagg

SEQ ID NO: 652764 - DNA, 25 bp, Mus musculus
ggtgctgcttcgacaagtgccggca

SEQ ID NO: 652765 - DNA, 25 bp, Mus musculus
ggtgctgcttcgtcaagtgccggca

SEQ ID NO: 652766 - DNA, 25 bp, Mus musculus
ggtgctgcttgtagcatctgttaca

SEQ ID NO: 652767 - DNA, 25 bp, Mus musculus
ggtgctgcttgttgcatctgttaca

SEQ ID NO: 652768 - DNA, 25 bp, Mus musculus
ggtgctgctttaaatgtatccattt

SEQ ID NO: 652769 - DNA, 25 bp, Mus musculus
ggtgctgctttatatgtatccattt

SEQ ID NO: 652770 - DNA, 25 bp, Mus musculus
ggtgctggaacacctacggtccatg

SEQ ID NO: 652771 - DNA, 25 bp, Mus musculus
ggtgctggaacagctacggtccatg

SEQ ID NO: 652772 - DNA, 25 bp, Mus musculus
ggtgctggacttagagcacttcctg

SEQ ID NO: 652773 - DNA, 25 bp, Mus musculus
ggtgctggactttgagcacttcctg

SEQ ID NO: 652774 - DNA, 25 bp, Mus musculus
ggtgctggatcaacgagacaaggta

SEQ ID NO: 652775 - DNA, 25 bp, Mus musculus
ggtgctggatcatcgagacaaggta

SEQ ID NO: 652776 - DNA, 25 bp, Mus musculus
ggtgctggatccattgctacagcga

SEQ ID NO: 652777 - DNA, 25 bp, Mus musculus
ggtgctggatcccttcactatcaag

SEQ ID NO: 652778 - DNA, 25 bp, Mus musculus
ggtgctggatccgttcactatcaag

SEQ ID NO: 652779 - DNA, 25 bp, Mus musculus
ggtgctggatcctttgctacagcga

SEQ ID NO: 652780 - DNA, 25 bp, Mus musculus
ggtgctggcagcaacaattctaaca

SEQ ID NO: 652781 - DNA, 25 bp, Mus musculus
ggtgctggcagctacaattctaaca

SEQ ID NO: 652782 - DNA, 25 bp, Mus musculus
ggtgctggcggcaggtttacgccgc

SEQ ID NO: 652783 - DNA, 25 bp, Mus musculus
ggtgctggcggctggtttacgccgc

SEQ ID NO: 652784 - DNA, 25 bp, Mus musculus
ggtgctggctctattatctgtatct

SEQ ID NO: 652785 - DNA, 25 bp, Mus musculus
ggtgctggctctccgcatagacttc

SEQ ID NO: 652786 - DNA, 25 bp, Mus musculus
ggtgctggctctgcgcatagacttc

SEQ ID NO: 652787 - DNA, 25 bp, Mus musculus
ggtgctggctcttttatctgtatct

SEQ ID NO: 652788 - DNA, 25 bp, Mus musculus
ggtgctgggaccacttaagtgctct

SEQ ID NO: 652789 - DNA, 25 bp, Mus musculus
ggtgctgggacctcttaagtgctct

SEQ ID NO: 652790 - DNA, 25 bp, Mus musculus
ggtgctgggaggatcccatagttta

SEQ ID NO: 652791 - DNA, 25 bp, Mus musculus
ggtgctgggaggttcccatagttta

SEQ ID NO: 652792 - DNA, 25 bp, Mus musculus
ggtgctgggcaaacggaactcacgt

SEQ ID NO: 652793 - DNA, 25 bp, Mus musculus
ggtgctgggcaatcggaactcacgt

SEQ ID NO: 652794 - DNA, 25 bp, Mus musculus
ggtgctgggttacactccgcaagtt

SEQ ID NO: 652795 - DNA, 25 bp, Mus musculus
ggtgctgggttagactccgcaagtt

SEQ ID NO: 652796 - DNA, 25 bp, Mus musculus
ggtgctggtaccattggcaagaccc

SEQ ID NO: 652797 - DNA, 25 bp, Mus musculus
ggtgctggtacctttggcaagaccc

SEQ ID NO: 652798 - DNA, 25 bp, Mus musculus
ggtgctggtatcacctctaagtaag

SEQ ID NO: 652799 - DNA, 25 bp, Mus musculus
ggtgctggtatctcctctaagtaag

SEQ ID NO: 652800 - DNA, 25 bp, Mus musculus
ggtgctggttaaagcgagcatgctt

SEQ ID NO: 652801 - DNA, 25 bp, Mus musculus
ggtgctggttaatgcgagcatgctt

SEQ ID NO: 652802 - DNA, 25 bp, Mus musculus
ggtgctggtttgagtattcattcat

SEQ ID NO: 652803 - DNA, 25 bp, Mus musculus
ggtgctggtttgtgtattcattcat

SEQ ID NO: 652804 - DNA, 25 bp, Mus musculus
ggtgctgtataaactgcggttgcat

SEQ ID NO: 652805 - DNA, 25 bp, Mus musculus
ggtgctgtataatctgcggttgcat

SEQ ID NO: 652806 - DNA, 25 bp, Mus musculus
ggtgctgtatgcattactgtccatt

SEQ ID NO: 652807 - DNA, 25 bp, Mus musculus
ggtgctgtatgctttactgtccatt

SEQ ID NO: 652808 - DNA, 25 bp, Mus musculus
ggtgctgtcaccaacgtatgtaaaa

SEQ ID NO: 652809 - DNA, 25 bp, Mus musculus
ggtgctgtcacctacgtatgtaaaa

SEQ ID NO: 652810 - DNA, 25 bp, Mus musculus
ggtgctgtcagcatcagcctacaaa

SEQ ID NO: 652811 - DNA, 25 bp, Mus musculus
ggtgctgtcagcttcagcctacaaa

SEQ ID NO: 652812 - DNA, 25 bp, Mus musculus
ggtgctgtccagctgttagtattaa

SEQ ID NO: 652813 - DNA, 25 bp, Mus musculus
ggtgctgtccaggtgttagtattaa

SEQ ID NO: 652814 - DNA, 25 bp, Mus musculus
ggtgctgtccgtactcatcaaaaaa

SEQ ID NO: 652815 - DNA, 25 bp, Mus musculus
ggtgctgtccgttctcatcaaaaaa

SEQ ID NO: 652816 - DNA, 25 bp, Mus musculus
ggtgctgtctatcgattttcctttt

SEQ ID NO: 652817 - DNA, 25 bp, Mus musculus
ggtgctgtctatggattttcctttt

SEQ ID NO: 652818 - DNA, 25 bp, Mus musculus
ggtgctgtctgactcgaggcattaa

SEQ ID NO: 652819 - DNA, 25 bp, Mus musculus
ggtgctgtctgagtcgaggcattaa

SEQ ID NO: 652820 - DNA, 25 bp, Mus musculus
ggtgctgtctgtataaaccactcaa

SEQ ID NO: 652821 - DNA, 25 bp, Mus musculus
ggtgctgtctgtttaaaccactcaa

SEQ ID NO: 652822 - DNA, 25 bp, Mus musculus
ggtgctgtctttcctgtcctgatca

SEQ ID NO: 652823 - DNA, 25 bp, Mus musculus
ggtgctgtctttgctgtcctgatca

SEQ ID NO: 652824 - DNA, 25 bp, Mus musculus
ggtgctgtgacaatgacctgttcca

SEQ ID NO: 652825 - DNA, 25 bp, Mus musculus
ggtgctgtgacattgacctgttcca

SEQ ID NO: 652826 - DNA, 25 bp, Mus musculus
ggtgctgtgagcatcaactcctgtc

SEQ ID NO: 652827 - DNA, 25 bp, Mus musculus
ggtgctgtgagcttcaactcctgtc

SEQ ID NO: 652828 - DNA, 25 bp, Mus musculus
ggtgctgtgagtcatgtttcccata

SEQ ID NO: 652829 - DNA, 25 bp, Mus musculus
ggtgctgtgagtgatgtttcccata

SEQ ID NO: 652830 - DNA, 25 bp, Mus musculus
ggtgctgtgattcccatctgaatat

SEQ ID NO: 652831 - DNA, 25 bp, Mus musculus
ggtgctgtgattgccatctgaatat

SEQ ID NO: 652832 - DNA, 25 bp, Mus musculus
ggtgctgtgcaacgaatgttctgta

SEQ ID NO: 652833 - DNA, 25 bp, Mus musculus
ggtgctgtgcaaggaatgttctgta

SEQ ID NO: 652834 - DNA, 25 bp, Mus musculus
ggtgctgtgcagaccagttgcccat

SEQ ID NO: 652835 - DNA, 25 bp, Mus musculus
ggtgctgtgcagtccagttgcccat

SEQ ID NO: 652836 - DNA, 25 bp, Mus musculus
ggtgctgtgcctaatctgagttctc

SEQ ID NO: 652837 - DNA, 25 bp, Mus musculus
ggtgctgtgccttatctgagttctc

SEQ ID NO: 652838 - DNA, 25 bp, Mus musculus
ggtgctgtgctcagtgtacgtcttg

SEQ ID NO: 652839 - DNA, 25 bp, Mus musculus
ggtgctgtgctcatttctatcttga

SEQ ID NO: 652840 - DNA, 25 bp, Mus musculus
ggtgctgtgctctgtgtacgtcttg

SEQ ID NO: 652841 - DNA, 25 bp, Mus musculus
ggtgctgtgctcttttctatcttga

SEQ ID NO: 652842 - DNA, 25 bp, Mus musculus
ggtgctgtgctgaggagttctctcc

SEQ ID NO: 652843 - DNA, 25 bp, Mus musculus
ggtgctgtgctgtggagttctctcc

SEQ ID NO: 652844 - DNA, 25 bp, Mus musculus
ggtgctgtgtaacgaatctgactga

SEQ ID NO: 652845 - DNA, 25 bp, Mus musculus
ggtgctgtgtaaggaatctgactga

SEQ ID NO: 652846 - DNA, 25 bp, Mus musculus
ggtgctgtgtgtccttttcttaaat

SEQ ID NO: 652847 - DNA, 25 bp, Mus musculus
ggtgctgtgtgtgcttttcttaaat

SEQ ID NO: 652848 - DNA, 25 bp, Mus musculus
ggtgctgttagacctggaaccgcct

SEQ ID NO: 652849 - DNA, 25 bp, Mus musculus
ggtgctgttagagctggaaccgcct

SEQ ID NO: 652850 - DNA, 25 bp, Mus musculus
ggtgctgttattaaaggttcctcta

SEQ ID NO: 652851 - DNA, 25 bp, Mus musculus
ggtgctgttattagtttctaggaat

SEQ ID NO: 652852 - DNA, 25 bp, Mus musculus
ggtgctgttatttaaggttcctcta

SEQ ID NO: 652853 - DNA, 25 bp, Mus musculus
ggtgctgttatttgtttctaggaat

SEQ ID NO: 652854 - DNA, 25 bp, Mus musculus
ggtgctgttcaaatactcccaaatg

SEQ ID NO: 652855 - DNA, 25 bp, Mus musculus
ggtgctgttcaattactcccaaatg

SEQ ID NO: 652856 - DNA, 25 bp, Mus musculus
ggtgctgttcgcacactcgttagaa

SEQ ID NO: 652857 - DNA, 25 bp, Mus musculus
ggtgctgttcgctcactcgttagaa

SEQ ID NO: 652858 - DNA, 25 bp, Mus musculus
ggtgctgttggcacattatcattga

SEQ ID NO: 652859 - DNA, 25 bp, Mus musculus
ggtgctgttggctcattatcattga

SEQ ID NO: 652860 - DNA, 25 bp, Mus musculus
ggtgctgttgggatcttagttcata

SEQ ID NO: 652861 - DNA, 25 bp, Mus musculus
ggtgctgttgggttcttagttcata

SEQ ID NO: 652862 - DNA, 25 bp, Mus musculus
ggtgctgtttgaacttgcgcgatat

SEQ ID NO: 652863 - DNA, 25 bp, Mus musculus
ggtgctgtttgatcttgcgcgatat

SEQ ID NO: 652864 - DNA, 25 bp, Mus musculus
ggtgcttaaaaaccatccctgagca

SEQ ID NO: 652865 - DNA, 25 bp, Mus musculus
ggtgcttaaaaagcatccctgagca

SEQ ID NO: 652866 - DNA, 25 bp, Mus musculus
ggtgcttaaaagaagaggtcctatt

SEQ ID NO: 652867 - DNA, 25 bp, Mus musculus
ggtgcttaaaagtagaggtcctatt

SEQ ID NO: 652868 - DNA, 25 bp, Mus musculus
ggtgcttaaacaaccattcaggcaa

SEQ ID NO: 652869 - DNA, 25 bp, Mus musculus
ggtgcttaaacatccattcaggcaa

SEQ ID NO: 652870 - DNA, 25 bp, Mus musculus
ggtgcttaccaaccaagaccaggtt

SEQ ID NO: 652871 - DNA, 25 bp, Mus musculus
ggtgcttaccaagcaagaccaggtt

SEQ ID NO: 652872 - DNA, 25 bp, Mus musculus
ggtgcttactcaaatcatgtagctg

SEQ ID NO: 652873 - DNA, 25 bp, Mus musculus
ggtgcttactcatatcatgtagctg

SEQ ID NO: 652874 - DNA, 25 bp, Mus musculus
ggtgcttacttgctaaaaactccca

SEQ ID NO: 652875 - DNA, 25 bp, Mus musculus
ggtgcttacttggtaaaaactccca

SEQ ID NO: 652876 - DNA, 25 bp, Mus musculus
ggtgcttagaagcaggaatcaactt

SEQ ID NO: 652877 - DNA, 25 bp, Mus musculus
ggtgcttagaaggaggaatcaactt

SEQ ID NO: 652878 - DNA, 25 bp, Mus musculus
ggtgcttagattactggcatccctc

SEQ ID NO: 652879 - DNA, 25 bp, Mus musculus
ggtgcttagatttctggcatccctc

SEQ ID NO: 652880 - DNA, 25 bp, Mus musculus
ggtgcttagcataattttgtgtttg

SEQ ID NO: 652881 - DNA, 25 bp, Mus musculus
ggtgcttagcattattttgtgtttg

SEQ ID NO: 652882 - DNA, 25 bp, Mus musculus
ggtgcttagccacataacatcactc

SEQ ID NO: 652883 - DNA, 25 bp, Mus musculus
ggtgcttagccagataacatcactc

SEQ ID NO: 652884 - DNA, 25 bp, Mus musculus
ggtgcttattctaattccatgcaga

SEQ ID NO: 652885 - DNA, 25 bp, Mus musculus
ggtgcttattcttattccatgcaga

SEQ ID NO: 652886 - DNA, 25 bp, Mus musculus
ggtgcttcaaatacctatctacttg

SEQ ID NO: 652887 - DNA, 25 bp, Mus musculus
ggtgcttcaaattcctatctacttg

SEQ ID NO: 652888 - DNA, 25 bp, Mus musculus
ggtgcttcaactatggagtttcaca

SEQ ID NO: 652889 - DNA, 25 bp, Mus musculus
ggtgcttcaactttggagtttcaca

SEQ ID NO: 652890 - DNA, 25 bp, Mus musculus
ggtgcttcaagaccatgatgctttc

SEQ ID NO: 652891 - DNA, 25 bp, Mus musculus
ggtgcttcaagagcatgatgctttc

SEQ ID NO: 652892 - DNA, 25 bp, Mus musculus
ggtgcttcactcagtagttcgggat

SEQ ID NO: 652893 - DNA, 25 bp, Mus musculus
ggtgcttcactctgtagttcgggat

SEQ ID NO: 652894 - DNA, 25 bp, Mus musculus
ggtgcttcagaactaccatgtgcct

SEQ ID NO: 652895 - DNA, 25 bp, Mus musculus
ggtgcttcagaagtaccatgtgcct

SEQ ID NO: 652896 - DNA, 25 bp, Mus musculus
ggtgcttcagttaaggtccatcttt

SEQ ID NO: 652897 - DNA, 25 bp, Mus musculus
ggtgcttcagtttaggtccatcttt

SEQ ID NO: 652898 - DNA, 25 bp, Mus musculus
ggtgcttcatcaaatcaaccctttc

SEQ ID NO: 652899 - DNA, 25 bp, Mus musculus
ggtgcttcatcatatcaaccctttc

SEQ ID NO: 652900 - DNA, 25 bp, Mus musculus
ggtgcttccacacaacaatctcaac

SEQ ID NO: 652901 - DNA, 25 bp, Mus musculus
ggtgcttccacagaacaatctcaac

SEQ ID NO: 652902 - DNA, 25 bp, Mus musculus
ggtgcttcgaagaaaccacagctgt

SEQ ID NO: 652903 - DNA, 25 bp, Mus musculus
ggtgcttcgaagtaaccacagctgt

SEQ ID NO: 652904 - DNA, 25 bp, Mus musculus
ggtgcttctaggctatgttcaacaa

SEQ ID NO: 652905 - DNA, 25 bp, Mus musculus
ggtgcttctagggtatgttcaacaa

SEQ ID NO: 652906 - DNA, 25 bp, Mus musculus
ggtgcttctagtagcaacttggttt

SEQ ID NO: 652907 - DNA, 25 bp, Mus musculus
ggtgcttctagttgcaacttggttt

SEQ ID NO: 652908 - DNA, 25 bp, Mus musculus
ggtgcttctcatctgatttctattc

SEQ ID NO: 652909 - DNA, 25 bp, Mus musculus
ggtgcttctcatgtgatttctattc

SEQ ID NO: 652910 - DNA, 25 bp, Mus musculus
ggtgcttctggcatggaccgagcca

SEQ ID NO: 652911 - DNA, 25 bp, Mus musculus
ggtgcttctggcttggaccgagcca

SEQ ID NO: 652912 - DNA, 25 bp, Mus musculus
ggtgcttctgtgattgtcaacgtga

SEQ ID NO: 652913 - DNA, 25 bp, Mus musculus
ggtgcttctgtgtttgtcaacgtga

SEQ ID NO: 652914 - DNA, 25 bp, Mus musculus
ggtgcttcttttaaatacatgatga

SEQ ID NO: 652915 - DNA, 25 bp, Mus musculus
ggtgcttctttttaatacatgatga

SEQ ID NO: 652916 - DNA, 25 bp, Mus musculus
ggtgcttgaagtacccaatttctta

SEQ ID NO: 652917 - DNA, 25 bp, Mus musculus
ggtgcttgaagttcccaatttctta

SEQ ID NO: 652918 - DNA, 25 bp, Mus musculus
ggtgcttggaagacacgttgcttca

SEQ ID NO: 652919 - DNA, 25 bp, Mus musculus
ggtgcttggaagtcacgttgcttca

SEQ ID NO: 652920 - DNA, 25 bp, Mus musculus
ggtgcttggacaatgtgactgaact

SEQ ID NO: 652921 - DNA, 25 bp, Mus musculus
ggtgcttggacattgtgactgaact

SEQ ID NO: 652922 - DNA, 25 bp, Mus musculus
ggtgcttggcatcgattgtgtccta

SEQ ID NO: 652923 - DNA, 25 bp, Mus musculus
ggtgcttggcatggattgtgtccta

SEQ ID NO: 652924 - DNA, 25 bp, Mus musculus
ggtgcttggccccacacacagacat

SEQ ID NO: 652925 - DNA, 25 bp, Mus musculus
ggtgcttggcccgacacacagacat

SEQ ID NO: 652926 - DNA, 25 bp, Mus musculus
ggtgcttggtaaaatatctgtggta

SEQ ID NO: 652927 - DNA, 25 bp, Mus musculus
ggtgcttggtaatatatctgtggta

SEQ ID NO: 652928 - DNA, 25 bp, Mus musculus
ggtgcttgtctcactgaccggcctg

SEQ ID NO: 652929 - DNA, 25 bp, Mus musculus
ggtgcttgtctctctgaccggcctg

SEQ ID NO: 652930 - DNA, 25 bp, Mus musculus
ggtgcttgttttctggacacaggtc

SEQ ID NO: 652931 - DNA, 25 bp, Mus musculus
ggtgcttgttttgtggacacaggtc

SEQ ID NO: 652932 - DNA, 25 bp, Mus musculus
ggtgctttacttaactagaatgttg

SEQ ID NO: 652933 - DNA, 25 bp, Mus musculus
ggtgctttactttactagaatgttg

SEQ ID NO: 652934 - DNA, 25 bp, Mus musculus
ggtgctttagtgcataatctctcaa

SEQ ID NO: 652935 - DNA, 25 bp, Mus musculus
ggtgctttagtggataatctctcaa

SEQ ID NO: 652936 - DNA, 25 bp, Mus musculus
ggtgctttatcccactgaaaccaaa

SEQ ID NO: 652937 - DNA, 25 bp, Mus musculus
ggtgctttatccgactgaaaccaaa

SEQ ID NO: 652938 - DNA, 25 bp, Mus musculus
ggtgctttcaaacgtgccccgttga

SEQ ID NO: 652939 - DNA, 25 bp, Mus musculus
ggtgctttcaaaggtgccccgttga

SEQ ID NO: 652940 - DNA, 25 bp, Mus musculus
ggtgctttcagaagtttgcagggaa

SEQ ID NO: 652941 - DNA, 25 bp, Mus musculus
ggtgctttcagatgtttgcagggaa

SEQ ID NO: 652942 - DNA, 25 bp, Mus musculus
ggtgctttcataaaagcttttccat

SEQ ID NO: 652943 - DNA, 25 bp, Mus musculus
ggtgctttcatataagcttttccat

SEQ ID NO: 652944 - DNA, 25 bp, Mus musculus
ggtgctttcatgcttttgtgtttct

SEQ ID NO: 652945 - DNA, 25 bp, Mus musculus
ggtgctttcatggttttgtgtttct

SEQ ID NO: 652946 - DNA, 25 bp, Mus musculus
ggtgctttctcaaattctttataca

SEQ ID NO: 652947 - DNA, 25 bp, Mus musculus
ggtgctttctcatattctttataca

SEQ ID NO: 652948 - DNA, 25 bp, Mus musculus
ggtgctttctgcagcttcctgtgcc

SEQ ID NO: 652949 - DNA, 25 bp, Mus musculus
ggtgctttctgctgcttcctgtgcc

SEQ ID NO: 652950 - DNA, 25 bp, Mus musculus
ggtgctttctttatcatgcatatta

SEQ ID NO: 652951 - DNA, 25 bp, Mus musculus
ggtgctttctttttcatgcatatta

SEQ ID NO: 652952 - DNA, 25 bp, Mus musculus
ggtgctttggacaagacttttcctc

SEQ ID NO: 652953 - DNA, 25 bp, Mus musculus
ggtgctttggactagacttttcctc

SEQ ID NO: 652954 - DNA, 25 bp, Mus musculus
ggtgctttgtacaactggttcagcg

SEQ ID NO: 652955 - DNA, 25 bp, Mus musculus
ggtgctttgtactactggttcagcg

SEQ ID NO: 652956 - DNA, 25 bp, Mus musculus
ggtgctttgttcagcacaagctgcc

SEQ ID NO: 652957 - DNA, 25 bp, Mus musculus
ggtgctttgttctgcacaagctgcc

SEQ ID NO: 652958 - DNA, 25 bp, Mus musculus
ggtgcttttaacacctaagctgtct

SEQ ID NO: 652959 - DNA, 25 bp, Mus musculus
ggtgcttttaactcctaagctgtct

SEQ ID NO: 652960 - DNA, 25 bp, Mus musculus
ggtgcttttacacaccgctaataaa

SEQ ID NO: 652961 - DNA, 25 bp, Mus musculus
ggtgcttttacagaccgctaataaa

SEQ ID NO: 652962 - DNA, 25 bp, Mus musculus
ggtgcttttattcccattgctaaga

SEQ ID NO: 652963 - DNA, 25 bp, Mus musculus
ggtgcttttattgccattgctaaga

SEQ ID NO: 652964 - DNA, 25 bp, Mus musculus
ggtgcttttcacactttgagacgca

SEQ ID NO: 652965 - DNA, 25 bp, Mus musculus
ggtgcttttcactctttgagacgca

SEQ ID NO: 652966 - DNA, 25 bp, Mus musculus
ggtgcttttcccactttatccttga

SEQ ID NO: 652967 - DNA, 25 bp, Mus musculus
ggtgcttttccctctttatccttga

SEQ ID NO: 652968 - DNA, 25 bp, Mus musculus
ggtgcttttcctaaacatggtgggt

SEQ ID NO: 652969 - DNA, 25 bp, Mus musculus
ggtgcttttccttaacatggtgggt

SEQ ID NO: 652970 - DNA, 25 bp, Mus musculus
ggtgcttttctcactgcagcagtgt

SEQ ID NO: 652971 - DNA, 25 bp, Mus musculus
ggtgcttttctctctgcagcagtgt

SEQ ID NO: 652972 - DNA, 25 bp, Mus musculus
ggtgcttttgggagatacacccagc

SEQ ID NO: 652973 - DNA, 25 bp, Mus musculus
ggtgcttttgggtgatacacccagc

SEQ ID NO: 652974 - DNA, 25 bp, Mus musculus
ggtgcttttgtaagacagtggcgct

SEQ ID NO: 652975 - DNA, 25 bp, Mus musculus
ggtgcttttgtatgacagtggcgct

SEQ ID NO: 652976 - DNA, 25 bp, Mus musculus
ggtgcttttgtgcactacttgaaaa

SEQ ID NO: 652977 - DNA, 25 bp, Mus musculus
ggtgcttttgtggactacttgaaaa

SEQ ID NO: 652978 - DNA, 25 bp, Mus musculus
ggtgctttttcaacagaaccttaac

SEQ ID NO: 652979 - DNA, 25 bp, Mus musculus
ggtgctttttcatcagaaccttaac

SEQ ID NO: 652980 - DNA, 25 bp, Mus musculus
ggtgctttttcccattacattcttc

SEQ ID NO: 652981 - DNA, 25 bp, Mus musculus
ggtgctttttccgattacattcttc

SEQ ID NO: 652982 - DNA, 25 bp, Mus musculus
ggtgctttttgtacgagaacttttg

SEQ ID NO: 652983 - DNA, 25 bp, Mus musculus
ggtgctttttgttcgagaacttttg

SEQ ID NO: 652984 - DNA, 25 bp, Mus musculus
ggtggaaaacccagactgctattac

SEQ ID NO: 652985 - DNA, 25 bp, Mus musculus
ggtggaaaaccctgactgctattac

SEQ ID NO: 652986 - DNA, 25 bp, Mus musculus
ggtggaaacttcatccaactctcat

SEQ ID NO: 652987 - DNA, 25 bp, Mus musculus
ggtggaaacttcttccaactctcat

SEQ ID NO: 652988 - DNA, 25 bp, Mus musculus
ggtggaaagccacttgagcttcctg

SEQ ID NO: 652989 - DNA, 25 bp, Mus musculus
ggtggaaagccagttgagcttcctg

SEQ ID NO: 652990 - DNA, 25 bp, Mus musculus
ggtggaaagcctcctaaaaaggtat

SEQ ID NO: 652991 - DNA, 25 bp, Mus musculus
ggtggaaagcctgctaaaaaggtat

SEQ ID NO: 652992 - DNA, 25 bp, Mus musculus
ggtggaaagcttaggtattggaaca

SEQ ID NO: 652993 - DNA, 25 bp, Mus musculus
ggtggaaagctttggtattggaaca

SEQ ID NO: 652994 - DNA, 25 bp, Mus musculus
ggtggaaaggcccattaacccagct

SEQ ID NO: 652995 - DNA, 25 bp, Mus musculus
ggtggaaaggccgattaacccagct

SEQ ID NO: 652996 - DNA, 25 bp, Mus musculus
ggtggaaagtatctccctgttgtga

SEQ ID NO: 652997 - DNA, 25 bp, Mus musculus
ggtggaaagtatgtccctgttgtga

SEQ ID NO: 652998 - DNA, 25 bp, Mus musculus
ggtggaaatcccaggcattgacgat

SEQ ID NO: 652999 - DNA, 25 bp, Mus musculus
ggtggaaatccctggcattgacgat

SEQ ID NO: 653000 - DNA, 25 bp, Mus musculus
ggtggaacaaccacgtgcagcagtt

SEQ ID NO: 653001 - DNA, 25 bp, Mus musculus
ggtggaacaacctcgtgcagcagtt

SEQ ID NO: 653002 - DNA, 25 bp, Mus musculus
ggtggaacaccacgctcaggacatc

SEQ ID NO: 653003 - DNA, 25 bp, Mus musculus
ggtggaacaccaggctcaggacatc

SEQ ID NO: 653004 - DNA, 25 bp, Mus musculus
ggtggaacatcgacaagaagggcta

SEQ ID NO: 653005 - DNA, 25 bp, Mus musculus
ggtggaacatcgtcaagaagggcta

SEQ ID NO: 653006 - DNA, 25 bp, Mus musculus
ggtggaacatctcatgcacgggatc

SEQ ID NO: 653007 - DNA, 25 bp, Mus musculus
ggtggaacatctgatgcacgggatc

SEQ ID NO: 653008 - DNA, 25 bp, Mus musculus
ggtggaacattcattctacaagggt

SEQ ID NO: 653009 - DNA, 25 bp, Mus musculus
ggtggaacattcatttaatctcagt

SEQ ID NO: 653010 - DNA, 25 bp, Mus musculus
ggtggaacattctttctacaagggt

SEQ ID NO: 653011 - DNA, 25 bp, Mus musculus
ggtggaacattcttttaatctcagt

SEQ ID NO: 653012 - DNA, 25 bp, Mus musculus
ggtggaaccaagaactctcccaata

SEQ ID NO: 653013 - DNA, 25 bp, Mus musculus
ggtggaaccaagtactctcccaata

SEQ ID NO: 653014 - DNA, 25 bp, Mus musculus
ggtggaaccccacacagaatgtcag

SEQ ID NO: 653015 - DNA, 25 bp, Mus musculus
ggtggaaccccagacagaatgtcag

SEQ ID NO: 653016 - DNA, 25 bp, Mus musculus
ggtggaacgcagcagcagtttgtgg

SEQ ID NO: 653017 - DNA, 25 bp, Mus musculus
ggtggaacgcaggagcagtttgtgg

SEQ ID NO: 653018 - DNA, 25 bp, Mus musculus
ggtggaactttcacagacttctttt

SEQ ID NO: 653019 - DNA, 25 bp, Mus musculus
ggtggaactttctcagacttctttt

SEQ ID NO: 653020 - DNA, 25 bp, Mus musculus
ggtggaagcacacttggcaaccttt

SEQ ID NO: 653021 - DNA, 25 bp, Mus musculus
ggtggaagcacagttggcaaccttt

SEQ ID NO: 653022 - DNA, 25 bp, Mus musculus
ggtggaagcagcatagattcttctc

SEQ ID NO: 653023 - DNA, 25 bp, Mus musculus
ggtggaagcagcttagattcttctc

SEQ ID NO: 653024 - DNA, 25 bp, Mus musculus
ggtggaagcgagctcctgaggtcct

SEQ ID NO: 653025 - DNA, 25 bp, Mus musculus
ggtggaagcgaggtcctgaggtcct

SEQ ID NO: 653026 - DNA, 25 bp, Mus musculus
ggtggaagctctagattgctgtccc

SEQ ID NO: 653027 - DNA, 25 bp, Mus musculus
ggtggaagctcttgattgctgtccc

SEQ ID NO: 653028 - DNA, 25 bp, Mus musculus
ggtggaaggaaaattgtatcccgag

SEQ ID NO: 653029 - DNA, 25 bp, Mus musculus
ggtggaaggaaatttgtatcccgag

SEQ ID NO: 653030 - DNA, 25 bp, Mus musculus
ggtggaatatccctgtttttagaag

SEQ ID NO: 653031 - DNA, 25 bp, Mus musculus
ggtggaatatccgtgtttttagaag

SEQ ID NO: 653032 - DNA, 25 bp, Mus musculus
ggtggaatatctcatctaaacagca

SEQ ID NO: 653033 - DNA, 25 bp, Mus musculus
ggtggaatatctgatctaaacagca

SEQ ID NO: 653034 - DNA, 25 bp, Mus musculus
ggtggaatcacactggactttaatt

SEQ ID NO: 653035 - DNA, 25 bp, Mus musculus
ggtggaatcacagtggactttaatt

SEQ ID NO: 653036 - DNA, 25 bp, Mus musculus
ggtggaatgacgaccctgaagccag

SEQ ID NO: 653037 - DNA, 25 bp, Mus musculus
ggtggaatgacgtccctgaagccag

SEQ ID NO: 653038 - DNA, 25 bp, Mus musculus
ggtggaatgggcatcctttaggctt

SEQ ID NO: 653039 - DNA, 25 bp, Mus musculus
ggtggaatgggcttcctttaggctt

SEQ ID NO: 653040 - DNA, 25 bp, Mus musculus
ggtggaatggtcacttcctcatcat

SEQ ID NO: 653041 - DNA, 25 bp, Mus musculus
ggtggaatggtctcttcctcatcat

SEQ ID NO: 653042 - DNA, 25 bp, Mus musculus
ggtggaattcaccaatgagctccag

SEQ ID NO: 653043 - DNA, 25 bp, Mus musculus
ggtggaattcacgaatgagctccag

SEQ ID NO: 653044 - DNA, 25 bp, Mus musculus
ggtggaattccaaatttcagccatc

SEQ ID NO: 653045 - DNA, 25 bp, Mus musculus
ggtggaattccatatttcagccatc

SEQ ID NO: 653046 - DNA, 25 bp, Mus musculus
ggtggaatttcaaacagattcacaa

SEQ ID NO: 653047 - DNA, 25 bp, Mus musculus
ggtggaatttcatacagattcacaa

SEQ ID NO: 653048 - DNA, 25 bp, Mus musculus
ggtggacaaacccagataccaggga

SEQ ID NO: 653049 - DNA, 25 bp, Mus musculus
ggtggacaaaccgagataccaggga

SEQ ID NO: 653050 - DNA, 25 bp, Mus musculus
ggtggacaacacagattctttctta

SEQ ID NO: 653051 - DNA, 25 bp, Mus musculus
ggtggacaacactgattctttctta

SEQ ID NO: 653052 - DNA, 25 bp, Mus musculus
ggtggacaagcacagcctctctact

SEQ ID NO: 653053 - DNA, 25 bp, Mus musculus
ggtggacaagcagagcctctctact

SEQ ID NO: 653054 - DNA, 25 bp, Mus musculus
ggtggacaaggcaaccgccatttcg

SEQ ID NO: 653055 - DNA, 25 bp, Mus musculus
ggtggacaaggctaccgccatttcg

SEQ ID NO: 653056 - DNA, 25 bp, Mus musculus
ggtggacaaggtatcccatgatatt

SEQ ID NO: 653057 - DNA, 25 bp, Mus musculus
ggtggacaaggtttcccatgatatt

SEQ ID NO: 653058 - DNA, 25 bp, Mus musculus
ggtggacaatgacttccacatccct

SEQ ID NO: 653059 - DNA, 25 bp, Mus musculus
ggtggacaatgagttccacatccct

SEQ ID NO: 653060 - DNA, 25 bp, Mus musculus
ggtggacacagtcaagctggccaaa

SEQ ID NO: 653061 - DNA, 25 bp, Mus musculus
ggtggacacagtgaagctggccaaa

SEQ ID NO: 653062 - DNA, 25 bp, Mus musculus
ggtggacaccaaatgaaactctttt

SEQ ID NO: 653063 - DNA, 25 bp, Mus musculus
ggtggacaccaattgaaactctttt

SEQ ID NO: 653064 - DNA, 25 bp, Mus musculus
ggtggacaccgccacaggcaataag

SEQ ID NO: 653065 - DNA, 25 bp, Mus musculus
ggtggacaccgcgacaggcaataag

SEQ ID NO: 653066 - DNA, 25 bp, Mus musculus
ggtggacacctcagcattcatcaca

SEQ ID NO: 653067 - DNA, 25 bp, Mus musculus
ggtggacacctctgcattcatcaca

SEQ ID NO: 653068 - DNA, 25 bp, Mus musculus
ggtggacacctgcacacgtctatcc

SEQ ID NO: 653069 - DNA, 25 bp, Mus musculus
ggtggacacctggacacgtctatcc

SEQ ID NO: 653070 - DNA, 25 bp, Mus musculus
ggtggacacggaaggacactcttcc

SEQ ID NO: 653071 - DNA, 25 bp, Mus musculus
ggtggacacggatggacactcttcc

SEQ ID NO: 653072 - DNA, 25 bp, Mus musculus
ggtggacactaaacgtccccataga

SEQ ID NO: 653073 - DNA, 25 bp, Mus musculus
ggtggacactaatcgtccccataga

SEQ ID NO: 653074 - DNA, 25 bp, Mus musculus
ggtggacacttcaaaagccttgagt

SEQ ID NO: 653075 - DNA, 25 bp, Mus musculus
ggtggacacttctaaagccttgagt

SEQ ID NO: 653076 - DNA, 25 bp, Mus musculus
ggtggacaggtacatcaccatcttc

SEQ ID NO: 653077 - DNA, 25 bp, Mus musculus
ggtggacaggtagatcaccatcttc

SEQ ID NO: 653078 - DNA, 25 bp, Mus musculus
ggtggacaggtcactttacagtgat

SEQ ID NO: 653079 - DNA, 25 bp, Mus musculus
ggtggacaggtctctttacagtgat

SEQ ID NO: 653080 - DNA, 25 bp, Mus musculus
ggtggacagtaccttctgttgttca

SEQ ID NO: 653081 - DNA, 25 bp, Mus musculus
ggtggacagtacgttctgttgttca

SEQ ID NO: 653082 - DNA, 25 bp, Mus musculus
ggtggacagtcccattatagtgttc

SEQ ID NO: 653083 - DNA, 25 bp, Mus musculus
ggtggacagtccgattatagtgttc

SEQ ID NO: 653084 - DNA, 25 bp, Mus musculus
ggtggacagtctctaggacccctga

SEQ ID NO: 653085 - DNA, 25 bp, Mus musculus
ggtggacagtctgtaggacccctga

SEQ ID NO: 653086 - DNA, 25 bp, Mus musculus
ggtggacatcacctacactgagggc

SEQ ID NO: 653087 - DNA, 25 bp, Mus musculus
ggtggacatcacgtacactgagggc

SEQ ID NO: 653088 - DNA, 25 bp, Mus musculus
ggtggacattggatgatgcatacaa

SEQ ID NO: 653089 - DNA, 25 bp, Mus musculus
ggtggacattggttgatgcatacaa

SEQ ID NO: 653090 - DNA, 25 bp, Mus musculus
ggtggaccacggctgcttctgcaat

SEQ ID NO: 653091 - DNA, 25 bp, Mus musculus
ggtggaccacgggtgcttctgcaat

SEQ ID NO: 653092 - DNA, 25 bp, Mus musculus
ggtggaccaggacatcgctgcttgt

SEQ ID NO: 653093 - DNA, 25 bp, Mus musculus
ggtggaccaggagatcgctgcttgt

SEQ ID NO: 653094 - DNA, 25 bp, Mus musculus
ggtggaccatgaactttctcactgt

SEQ ID NO: 653095 - DNA, 25 bp, Mus musculus
ggtggaccatgatctttctcactgt

SEQ ID NO: 653096 - DNA, 25 bp, Mus musculus
ggtggacccataaatgaccagactt

SEQ ID NO: 653097 - DNA, 25 bp, Mus musculus
ggtggacccatatatgaccagactt

SEQ ID NO: 653098 - DNA, 25 bp, Mus musculus
ggtggaccccaacgacatcgatgac

SEQ ID NO: 653099 - DNA, 25 bp, Mus musculus
ggtggaccccaaggacatcgatgac

SEQ ID NO: 653100 - DNA, 25 bp, Mus musculus
ggtggacctaatctgcacccgcctg

SEQ ID NO: 653101 - DNA, 25 bp, Mus musculus
ggtggacctaatgtgcacccgcctg

SEQ ID NO: 653102 - DNA, 25 bp, Mus musculus
ggtggacctcaaagcttcagccttg

SEQ ID NO: 653103 - DNA, 25 bp, Mus musculus
ggtggacctcaatgcttcagccttg

SEQ ID NO: 653104 - DNA, 25 bp, Mus musculus
ggtggacctcatcgcctacatggcc

SEQ ID NO: 653105 - DNA, 25 bp, Mus musculus
ggtggacctcatggcctacatggcc

SEQ ID NO: 653106 - DNA, 25 bp, Mus musculus
ggtggacctcttcgccaaaatggcc

SEQ ID NO: 653107 - DNA, 25 bp, Mus musculus
ggtggacctcttggccaaaatggcc

SEQ ID NO: 653108 - DNA, 25 bp, Mus musculus
ggtggaccttgcacccaggacttgt

SEQ ID NO: 653109 - DNA, 25 bp, Mus musculus
ggtggaccttgctcccaggacttgt

SEQ ID NO: 653110 - DNA, 25 bp, Mus musculus
ggtggacgaacaaatttacctttca

SEQ ID NO: 653111 - DNA, 25 bp, Mus musculus
ggtggacgaacatatttacctttca

SEQ ID NO: 653112 - DNA, 25 bp, Mus musculus
ggtggacgacaccatcctgacgtga

SEQ ID NO: 653113 - DNA, 25 bp, Mus musculus
ggtggacgacacgatcctgacgtga

SEQ ID NO: 653114 - DNA, 25 bp, Mus musculus
ggtggacgagcgaccgcatgctaat

SEQ ID NO: 653115 - DNA, 25 bp, Mus musculus
ggtggacgagcgtccgcatgctaat

SEQ ID NO: 653116 - DNA, 25 bp, Mus musculus
ggtggacgatccacggaagccgaac

SEQ ID NO: 653117 - DNA, 25 bp, Mus musculus
ggtggacgatcctcggaagccgaac

SEQ ID NO: 653118 - DNA, 25 bp, Mus musculus
ggtggacggcaacaaactgcgtatc

SEQ ID NO: 653119 - DNA, 25 bp, Mus musculus
ggtggacggcaagaaactgcgtatc

SEQ ID NO: 653120 - DNA, 25 bp, Mus musculus
ggtggacgtccacctgctggaactt

SEQ ID NO: 653121 - DNA, 25 bp, Mus musculus
ggtggacgtccagctgctggaactt

SEQ ID NO: 653122 - DNA, 25 bp, Mus musculus
ggtggacgttggagccatatttctt

SEQ ID NO: 653123 - DNA, 25 bp, Mus musculus
ggtggacgttggtgccatatttctt

SEQ ID NO: 653124 - DNA, 25 bp, Mus musculus
ggtggactaacgactcatttgcaat

SEQ ID NO: 653125 - DNA, 25 bp, Mus musculus
ggtggactaacgtctcatttgcaat

SEQ ID NO: 653126 - DNA, 25 bp, Mus musculus
ggtggactacagacatggccaaact

SEQ ID NO: 653127 - DNA, 25 bp, Mus musculus
ggtggactacagtcatggccaaact

SEQ ID NO: 653128 - DNA, 25 bp, Mus musculus
ggtggactacgcctactgtagcatt

SEQ ID NO: 653129 - DNA, 25 bp, Mus musculus
ggtggactacgcgtactgtagcatt

SEQ ID NO: 653130 - DNA, 25 bp, Mus musculus
ggtggactagacctttccaggcttt

SEQ ID NO: 653131 - DNA, 25 bp, Mus musculus
ggtggactagacgtttccaggcttt

SEQ ID NO: 653132 - DNA, 25 bp, Mus musculus
ggtggactagtccttttaccagcac

SEQ ID NO: 653133 - DNA, 25 bp, Mus musculus
ggtggactagtcgttttaccagcac

SEQ ID NO: 653134 - DNA, 25 bp, Mus musculus
ggtggactccagagtttatctgctg

SEQ ID NO: 653135 - DNA, 25 bp, Mus musculus
ggtggactccagatatttgagcctt

SEQ ID NO: 653136 - DNA, 25 bp, Mus musculus
ggtggactccagtgtttatctgctg

SEQ ID NO: 653137 - DNA, 25 bp, Mus musculus
ggtggactccagttatttgagcctt

SEQ ID NO: 653138 - DNA, 25 bp, Mus musculus
ggtggactccgccttaatgagaaag

SEQ ID NO: 653139 - DNA, 25 bp, Mus musculus
ggtggactccgcgttaatgagaaag

SEQ ID NO: 653140 - DNA, 25 bp, Mus musculus
ggtggactccttcgcttatgatttc

SEQ ID NO: 653141 - DNA, 25 bp, Mus musculus
ggtggactccttggcttatgatttc

SEQ ID NO: 653142 - DNA, 25 bp, Mus musculus
ggtggactctgcatggtggtggaca

SEQ ID NO: 653143 - DNA, 25 bp, Mus musculus
ggtggactctgcttggtggtggaca

SEQ ID NO: 653144 - DNA, 25 bp, Mus musculus
ggtggactgatgaaccctgcttgtc

SEQ ID NO: 653145 - DNA, 25 bp, Mus musculus
ggtggactgatgtaccctgcttgtc

SEQ ID NO: 653146 - DNA, 25 bp, Mus musculus
ggtggactggtcatatacttctcat

SEQ ID NO: 653147 - DNA, 25 bp, Mus musculus
ggtggactggtcttatacttctcat

SEQ ID NO: 653148 - DNA, 25 bp, Mus musculus
ggtggacttattagagccctgggaa

SEQ ID NO: 653149 - DNA, 25 bp, Mus musculus
ggtggacttatttgagccctgggaa

SEQ ID NO: 653150 - DNA, 25 bp, Mus musculus
ggtggacttgctatgtgaagagaca

SEQ ID NO: 653151 - DNA, 25 bp, Mus musculus
ggtggacttgctttgtgaagagaca

SEQ ID NO: 653152 - DNA, 25 bp, Mus musculus
ggtggacttggcatgattgcaaaag

SEQ ID NO: 653153 - DNA, 25 bp, Mus musculus
ggtggacttggcttgattgcaaaag

SEQ ID NO: 653154 - DNA, 25 bp, Mus musculus
ggtggacttgtacagccaacgctac

SEQ ID NO: 653155 - DNA, 25 bp, Mus musculus
ggtggacttgtagagccaacgctac

SEQ ID NO: 653156 - DNA, 25 bp, Mus musculus
ggtggacttgtgatggctattcttg

SEQ ID NO: 653157 - DNA, 25 bp, Mus musculus
ggtggacttgtgttggctattcttg

SEQ ID NO: 653158 - DNA, 25 bp, Mus musculus
ggtggactttgtagaccagtggcct

SEQ ID NO: 653159 - DNA, 25 bp, Mus musculus
ggtggactttgttgaccagtggcct

SEQ ID NO: 653160 - DNA, 25 bp, Mus musculus
ggtggagaacatcaaacatcattac

SEQ ID NO: 653161 - DNA, 25 bp, Mus musculus
ggtggagaacatgaaacatcattac

SEQ ID NO: 653162 - DNA, 25 bp, Mus musculus
ggtggagacaaaagaccatctgaaa

SEQ ID NO: 653163 - DNA, 25 bp, Mus musculus
ggtggagacaaatgaccatctgaaa

SEQ ID NO: 653164 - DNA, 25 bp, Mus musculus
ggtggagacagaatgtcctcaggct

SEQ ID NO: 653165 - DNA, 25 bp, Mus musculus
ggtggagacagattgtcctcaggct

SEQ ID NO: 653166 - DNA, 25 bp, Mus musculus
ggtggagacctcagctaacgacagc

SEQ ID NO: 653167 - DNA, 25 bp, Mus musculus
ggtggagacctctgctaacgacagc

SEQ ID NO: 653168 - DNA, 25 bp, Mus musculus
ggtggagactcacccagaactgccg

SEQ ID NO: 653169 - DNA, 25 bp, Mus musculus
ggtggagactcagccagaactgccg

SEQ ID NO: 653170 - DNA, 25 bp, Mus musculus
ggtggagatcacaggcaagcacgaa

SEQ ID NO: 653171 - DNA, 25 bp, Mus musculus
ggtggagatcactggcaagcacgaa

SEQ ID NO: 653172 - DNA, 25 bp, Mus musculus
ggtggagatcgacgactttcaatat

SEQ ID NO: 653173 - DNA, 25 bp, Mus musculus
ggtggagatcgaggactttcaatat

SEQ ID NO: 653174 - DNA, 25 bp, Mus musculus
ggtggagatttgcaaacactatttc

SEQ ID NO: 653175 - DNA, 25 bp, Mus musculus
ggtggagatttggaaacactatttc

SEQ ID NO: 653176 - DNA, 25 bp, Mus musculus
ggtggagcagcacacaacggaactt

SEQ ID NO: 653177 - DNA, 25 bp, Mus musculus
ggtggagcagcagacaacggaactt

SEQ ID NO: 653178 - DNA, 25 bp, Mus musculus
ggtggagcaggtcttcagccctcat

SEQ ID NO: 653179 - DNA, 25 bp, Mus musculus
ggtggagcaggtgttcagccctcat

SEQ ID NO: 653180 - DNA, 25 bp, Mus musculus
ggtggagcatccagacatgtcctgc

SEQ ID NO: 653181 - DNA, 25 bp, Mus musculus
ggtggagcatcctgacatgtcctgc

SEQ ID NO: 653182 - DNA, 25 bp, Mus musculus
ggtggagccacaaattcctttgcat

SEQ ID NO: 653183 - DNA, 25 bp, Mus musculus
ggtggagccacatattcctttgcat

SEQ ID NO: 653184 - DNA, 25 bp, Mus musculus
ggtggagccagcaacgggaaccatt

SEQ ID NO: 653185 - DNA, 25 bp, Mus musculus
ggtggagccagctacgggaaccatt

SEQ ID NO: 653186 - DNA, 25 bp, Mus musculus
ggtggagcccagcagactactagca

SEQ ID NO: 653187 - DNA, 25 bp, Mus musculus
ggtggagcccaggagactactagca

SEQ ID NO: 653188 - DNA, 25 bp, Mus musculus
ggtggagcctcacctatccaaagga

SEQ ID NO: 653189 - DNA, 25 bp, Mus musculus
ggtggagcctcagctatccaaagga

SEQ ID NO: 653190 - DNA, 25 bp, Mus musculus
ggtggagcctgtactgacaatctgt

SEQ ID NO: 653191 - DNA, 25 bp, Mus musculus
ggtggagcctgttctgacaatctgt

SEQ ID NO: 653192 - DNA, 25 bp, Mus musculus
ggtggagcggccattcttgctttgc

SEQ ID NO: 653193 - DNA, 25 bp, Mus musculus
ggtggagcggcctttcttgctttgc

SEQ ID NO: 653194 - DNA, 25 bp, Mus musculus
ggtggagctaccaaacagctgactc

SEQ ID NO: 653195 - DNA, 25 bp, Mus musculus
ggtggagctacctaacagctgactc

SEQ ID NO: 653196 - DNA, 25 bp, Mus musculus
ggtggagctataaaagccgctgttg

SEQ ID NO: 653197 - DNA, 25 bp, Mus musculus
ggtggagctatataagccgctgttg

SEQ ID NO: 653198 - DNA, 25 bp, Mus musculus
ggtggagctcatatactggctgcaa

SEQ ID NO: 653199 - DNA, 25 bp, Mus musculus
ggtggagctcatttactggctgcaa

SEQ ID NO: 653200 - DNA, 25 bp, Mus musculus
ggtggagctgacagttctggattat

SEQ ID NO: 653201 - DNA, 25 bp, Mus musculus
ggtggagctgactgttctggattat

SEQ ID NO: 653202 - DNA, 25 bp, Mus musculus
ggtggagctgttacatcactaaata

SEQ ID NO: 653203 - DNA, 25 bp, Mus musculus
ggtggagctgttagtctgatagtca

SEQ ID NO: 653204 - DNA, 25 bp, Mus musculus
ggtggagctgtttcatcactaaata

SEQ ID NO: 653205 - DNA, 25 bp, Mus musculus
ggtggagctgtttgtctgatagtca

SEQ ID NO: 653206 - DNA, 25 bp, Mus musculus
ggtggagcttcaaagccacccacag

SEQ ID NO: 653207 - DNA, 25 bp, Mus musculus
ggtggagcttcatagccacccacag

SEQ ID NO: 653208 - DNA, 25 bp, Mus musculus
ggtggagctttacatgtaccataaa

SEQ ID NO: 653209 - DNA, 25 bp, Mus musculus
ggtggagctttagatgtaccataaa

SEQ ID NO: 653210 - DNA, 25 bp, Mus musculus
ggtggaggaggcatataccatgttt

SEQ ID NO: 653211 - DNA, 25 bp, Mus musculus
ggtggaggaggcttataccatgttt

SEQ ID NO: 653212 - DNA, 25 bp, Mus musculus
ggtggaggcacacgtttctaatgat

SEQ ID NO: 653213 - DNA, 25 bp, Mus musculus
ggtggaggcacaggtttctaatgat

SEQ ID NO: 653214 - DNA, 25 bp, Mus musculus
ggtggaggcatcatagcatcctaga

SEQ ID NO: 653215 - DNA, 25 bp, Mus musculus
ggtggaggcatcttagcatcctaga

SEQ ID NO: 653216 - DNA, 25 bp, Mus musculus
ggtggaggcattacctcattcacgc

SEQ ID NO: 653217 - DNA, 25 bp, Mus musculus
ggtggaggcatttcctcattcacgc

SEQ ID NO: 653218 - DNA, 25 bp, Mus musculus
ggtggaggcgaactcttcagcccca

SEQ ID NO: 653219 - DNA, 25 bp, Mus musculus
ggtggaggcgaagtcttcagcccca

SEQ ID NO: 653220 - DNA, 25 bp, Mus musculus
ggtggaggtcccactctgagatgta

SEQ ID NO: 653221 - DNA, 25 bp, Mus musculus
ggtggaggtccctctctgagatgta

SEQ ID NO: 653222 - DNA, 25 bp, Mus musculus
ggtggaggtgggacacctgggacct

SEQ ID NO: 653223 - DNA, 25 bp, Mus musculus
ggtggaggtgggtcacctgggacct

SEQ ID NO: 653224 - DNA, 25 bp, Mus musculus
ggtggagtcactagttggagccctc

SEQ ID NO: 653225 - DNA, 25 bp, Mus musculus
ggtggagtcacttgttggagccctc

SEQ ID NO: 653226 - DNA, 25 bp, Mus musculus
ggtggagtcccacttcgaaaaatag

SEQ ID NO: 653227 - DNA, 25 bp, Mus musculus
ggtggagtcccagttcgaaaaatag

SEQ ID NO: 653228 - DNA, 25 bp, Mus musculus
ggtggagtcctcagggtgccaatat

SEQ ID NO: 653229 - DNA, 25 bp, Mus musculus
ggtggagtcctctgggtgccaatat

SEQ ID NO: 653230 - DNA, 25 bp, Mus musculus
ggtggagtctccagatctagatagg

SEQ ID NO: 653231 - DNA, 25 bp, Mus musculus
ggtggagtctcctgatctagatagg

SEQ ID NO: 653232 - DNA, 25 bp, Mus musculus
ggtggagtgaacagtcatccccact

SEQ ID NO: 653233 - DNA, 25 bp, Mus musculus
ggtggagtgaacctgcacactgaat

SEQ ID NO: 653234 - DNA, 25 bp, Mus musculus
ggtggagtgaacgtgcacactgaat

SEQ ID NO: 653235 - DNA, 25 bp, Mus musculus
ggtggagtgaactgtcatccccact

SEQ ID NO: 653236 - DNA, 25 bp, Mus musculus
ggtggagtgaccacctcccagattg

SEQ ID NO: 653237 - DNA, 25 bp, Mus musculus
ggtggagtgacctcctcccagattg

SEQ ID NO: 653238 - DNA, 25 bp, Mus musculus
ggtggagttcccaattgaatcctca

SEQ ID NO: 653239 - DNA, 25 bp, Mus musculus
ggtggagttccctattgaatcctca

SEQ ID NO: 653240 - DNA, 25 bp, Mus musculus
ggtggagttggtacttacatacatt

SEQ ID NO: 653241 - DNA, 25 bp, Mus musculus
ggtggagttggttcttacatacatt

SEQ ID NO: 653242 - DNA, 25 bp, Mus musculus
ggtggagtttacagtactgtgaaat

SEQ ID NO: 653243 - DNA, 25 bp, Mus musculus
ggtggagtttactgtactgtgaaat

SEQ ID NO: 653244 - DNA, 25 bp, Mus musculus
ggtggagtttgtcaccatgtgaact

SEQ ID NO: 653245 - DNA, 25 bp, Mus musculus
ggtggagtttgtgaccatgtgaact

SEQ ID NO: 653246 - DNA, 25 bp, Mus musculus
ggtggataacacatttgcggatgag

SEQ ID NO: 653247 - DNA, 25 bp, Mus musculus
ggtggataacacttttgcggatgag

SEQ ID NO: 653248 - DNA, 25 bp, Mus musculus
ggtggataagtaagtttacccagta

SEQ ID NO: 653249 - DNA, 25 bp, Mus musculus
ggtggataagtatgtttacccagta

SEQ ID NO: 653250 - DNA, 25 bp, Mus musculus
ggtggatacaatagggagcctgccc

SEQ ID NO: 653251 - DNA, 25 bp, Mus musculus
ggtggatacaattgggagcctgccc

SEQ ID NO: 653252 - DNA, 25 bp, Mus musculus
ggtggatacattaagtcccagaact

SEQ ID NO: 653253 - DNA, 25 bp, Mus musculus
ggtggatacatttagtcccagaact

SEQ ID NO: 653254 - DNA, 25 bp, Mus musculus
ggtggatacttccagggtattgcaa

SEQ ID NO: 653255 - DNA, 25 bp, Mus musculus
ggtggatacttcgagggtattgcaa

SEQ ID NO: 653256 - DNA, 25 bp, Mus musculus
ggtggatatcaactgccatcacgtt

SEQ ID NO: 653257 - DNA, 25 bp, Mus musculus
ggtggatatcaagtgccatcacgtt

SEQ ID NO: 653258 - DNA, 25 bp, Mus musculus
ggtggatatcacacagtttgctttc

SEQ ID NO: 653259 - DNA, 25 bp, Mus musculus
ggtggatatcactcagtttgctttc

SEQ ID NO: 653260 - DNA, 25 bp, Mus musculus
ggtggatatcctctaacataaatgc

SEQ ID NO: 653261 - DNA, 25 bp, Mus musculus
ggtggatatcctgtaacataaatgc

SEQ ID NO: 653262 - DNA, 25 bp, Mus musculus
ggtggatatcgccatgtttcagctt

SEQ ID NO: 653263 - DNA, 25 bp, Mus musculus
ggtggatatcgcgatgtttcagctt

SEQ ID NO: 653264 - DNA, 25 bp, Mus musculus
ggtggatatgcaccctacagatatg

SEQ ID NO: 653265 - DNA, 25 bp, Mus musculus
ggtggatatgcagcctacagatatg

SEQ ID NO: 653266 - DNA, 25 bp, Mus musculus
ggtggatatggtatcttagtctctg

SEQ ID NO: 653267 - DNA, 25 bp, Mus musculus
ggtggatatggtttcttagtctctg

SEQ ID NO: 653268 - DNA, 25 bp, Mus musculus
ggtggatcaaaacactcccaggctc

SEQ ID NO: 653269 - DNA, 25 bp, Mus musculus
ggtggatcaaaagactcccaggctc

SEQ ID NO: 653270 - DNA, 25 bp, Mus musculus
ggtggatcactaatgccatctggaa

SEQ ID NO: 653271 - DNA, 25 bp, Mus musculus
ggtggatcactattgccatctggaa

SEQ ID NO: 653272 - DNA, 25 bp, Mus musculus
ggtggatcacttctcctacatgcaa

SEQ ID NO: 653273 - DNA, 25 bp, Mus musculus
ggtggatcacttgtcctacatgcaa

SEQ ID NO: 653274 - DNA, 25 bp, Mus musculus
ggtggatcagcgacaaatgtgttgt

SEQ ID NO: 653275 - DNA, 25 bp, Mus musculus
ggtggatcagcgtcaaatgtgttgt

SEQ ID NO: 653276 - DNA, 25 bp, Mus musculus
ggtggatcagtgaacagattgtata

SEQ ID NO: 653277 - DNA, 25 bp, Mus musculus
ggtggatcagtgtacagattgtata

SEQ ID NO: 653278 - DNA, 25 bp, Mus musculus
ggtggatcatcaagccagatcccta

SEQ ID NO: 653279 - DNA, 25 bp, Mus musculus
ggtggatcatcatgccagatcccta

SEQ ID NO: 653280 - DNA, 25 bp, Mus musculus
ggtggatccatccagacaaccgtac

SEQ ID NO: 653281 - DNA, 25 bp, Mus musculus
ggtggatccatcgagacaaccgtac

SEQ ID NO: 653282 - DNA, 25 bp, Mus musculus
ggtggatcgcaaataagcctcagct

SEQ ID NO: 653283 - DNA, 25 bp, Mus musculus
ggtggatcgcaattaagcctcagct

SEQ ID NO: 653284 - DNA, 25 bp, Mus musculus
ggtggatctacacttgtaatgagaa

SEQ ID NO: 653285 - DNA, 25 bp, Mus musculus
ggtggatctacagttgtaatgagaa

SEQ ID NO: 653286 - DNA, 25 bp, Mus musculus
ggtggatctcacacaaaagctgttg

SEQ ID NO: 653287 - DNA, 25 bp, Mus musculus
ggtggatctcactcaaaagctgttg

SEQ ID NO: 653288 - DNA, 25 bp, Mus musculus
ggtggatctcccaagaattcttatg

SEQ ID NO: 653289 - DNA, 25 bp, Mus musculus
ggtggatctccctagaattcttatg

SEQ ID NO: 653290 - DNA, 25 bp, Mus musculus
ggtggatctctgaaaatctgaggtc

SEQ ID NO: 653291 - DNA, 25 bp, Mus musculus
ggtggatctctgtaaatctgaggtc

SEQ ID NO: 653292 - DNA, 25 bp, Mus musculus
ggtggatctgctacacagtttcttt

SEQ ID NO: 653293 - DNA, 25 bp, Mus musculus
ggtggatctgcttcacagtttcttt

SEQ ID NO: 653294 - DNA, 25 bp, Mus musculus
ggtggatctgtcatgacatccatga

SEQ ID NO: 653295 - DNA, 25 bp, Mus musculus
ggtggatctgtcttgacatccatga

SEQ ID NO: 653296 - DNA, 25 bp, Mus musculus
ggtggatcttgactaatgttttctg

SEQ ID NO: 653297 - DNA, 25 bp, Mus musculus
ggtggatcttgagtaatgttttctg

SEQ ID NO: 653298 - DNA, 25 bp, Mus musculus
ggtggatctttgataattctatgcc

SEQ ID NO: 653299 - DNA, 25 bp, Mus musculus
ggtggatctttgttaattctatgcc

SEQ ID NO: 653300 - DNA, 25 bp, Mus musculus
ggtggatgaaccagctgtatttgta

SEQ ID NO: 653301 - DNA, 25 bp, Mus musculus
ggtggatgaacctgctgtatttgta

SEQ ID NO: 653302 - DNA, 25 bp, Mus musculus
ggtggatgcccacaatttcaaacta

SEQ ID NO: 653303 - DNA, 25 bp, Mus musculus
ggtggatgcccagaatttcaaacta

SEQ ID NO: 653304 - DNA, 25 bp, Mus musculus
ggtggatgctctaatctactatatc

SEQ ID NO: 653305 - DNA, 25 bp, Mus musculus
ggtggatgctcttatctactatatc

SEQ ID NO: 653306 - DNA, 25 bp, Mus musculus
ggtggatgcttcaaagtccgtacgt

SEQ ID NO: 653307 - DNA, 25 bp, Mus musculus
ggtggatgcttctaagtccgtacgt

SEQ ID NO: 653308 - DNA, 25 bp, Mus musculus
ggtggatggaacattccttttgcta

SEQ ID NO: 653309 - DNA, 25 bp, Mus musculus
ggtggatggaactttccttttgcta

SEQ ID NO: 653310 - DNA, 25 bp, Mus musculus
ggtggatggccaaaagcaatctcaa

SEQ ID NO: 653311 - DNA, 25 bp, Mus musculus
ggtggatggccataagcaatctcaa

SEQ ID NO: 653312 - DNA, 25 bp, Mus musculus
ggtggatggctcaggacaactcctt

SEQ ID NO: 653313 - DNA, 25 bp, Mus musculus
ggtggatggctctggacaactcctt

SEQ ID NO: 653314 - DNA, 25 bp, Mus musculus
ggtggatgggaaataaatgtgcaat

SEQ ID NO: 653315 - DNA, 25 bp, Mus musculus
ggtggatgggaattaaatgtgcaat

SEQ ID NO: 653316 - DNA, 25 bp, Mus musculus
ggtggatgtaatattgtgtctttat

SEQ ID NO: 653317 - DNA, 25 bp, Mus musculus
ggtggatgtaattttgtgtctttat

SEQ ID NO: 653318 - DNA, 25 bp, Mus musculus
ggtggatgtatcatagctgctcaat

SEQ ID NO: 653319 - DNA, 25 bp, Mus musculus
ggtggatgtatcttagctgctcaat

SEQ ID NO: 653320 - DNA, 25 bp, Mus musculus
ggtggatgtgatcttctgactgcaa

SEQ ID NO: 653321 - DNA, 25 bp, Mus musculus
ggtggatgtgatgttctgactgcaa

SEQ ID NO: 653322 - DNA, 25 bp, Mus musculus
ggtggattaattccactccggttaa

SEQ ID NO: 653323 - DNA, 25 bp, Mus musculus
ggtggattaattgcactccggttaa

SEQ ID NO: 653324 - DNA, 25 bp, Mus musculus
ggtggattatttaccctggatgcgg

SEQ ID NO: 653325 - DNA, 25 bp, Mus musculus
ggtggattattttccctggatgcgg

SEQ ID NO: 653326 - DNA, 25 bp, Mus musculus
ggtggattcatcatttgattcttgt

SEQ ID NO: 653327 - DNA, 25 bp, Mus musculus
ggtggattcatcttttgattcttgt

SEQ ID NO: 653328 - DNA, 25 bp, Mus musculus
ggtggattccaaattctcaggtttt

SEQ ID NO: 653329 - DNA, 25 bp, Mus musculus
ggtggattccaatttctcaggtttt

SEQ ID NO: 653330 - DNA, 25 bp, Mus musculus
ggtggattcctaatgcagcagtggc

SEQ ID NO: 653331 - DNA, 25 bp, Mus musculus
ggtggattcctattgcagcagtggc

SEQ ID NO: 653332 - DNA, 25 bp, Mus musculus
ggtggattctagctgcttgtttcaa

SEQ ID NO: 653333 - DNA, 25 bp, Mus musculus
ggtggattctaggtgcttgtttcaa

SEQ ID NO: 653334 - DNA, 25 bp, Mus musculus
ggtggattcttcacggaaactgcaa

SEQ ID NO: 653335 - DNA, 25 bp, Mus musculus
ggtggattcttctcggaaactgcaa

SEQ ID NO: 653336 - DNA, 25 bp, Mus musculus
ggtggattgtatcagcagcctcagt

SEQ ID NO: 653337 - DNA, 25 bp, Mus musculus
ggtggattgtatgagcagcctcagt

SEQ ID NO: 653338 - DNA, 25 bp, Mus musculus
ggtggatttccaatttgtttcctgt

SEQ ID NO: 653339 - DNA, 25 bp, Mus musculus
ggtggatttccattttgtttcctgt

SEQ ID NO: 653340 - DNA, 25 bp, Mus musculus
ggtggatttgtgaggccagtctaca

SEQ ID NO: 653341 - DNA, 25 bp, Mus musculus
ggtggatttgtgtggccagtctaca

SEQ ID NO: 653342 - DNA, 25 bp, Mus musculus
ggtggcaaagccacgtctagaggcc

SEQ ID NO: 653343 - DNA, 25 bp, Mus musculus
ggtggcaaagcctcgtctagaggcc

SEQ ID NO: 653344 - DNA, 25 bp, Mus musculus
ggtggcaaaggtagttactacactt

SEQ ID NO: 653345 - DNA, 25 bp, Mus musculus
ggtggcaaaggttgttactacactt

SEQ ID NO: 653346 - DNA, 25 bp, Mus musculus
ggtggcaaagtcatccactcagcag

SEQ ID NO: 653347 - DNA, 25 bp, Mus musculus
ggtggcaaagtcttccactcagcag

SEQ ID NO: 653348 - DNA, 25 bp, Mus musculus
ggtggcaacaaaccagcaactatct

SEQ ID NO: 653349 - DNA, 25 bp, Mus musculus
ggtggcaacaaagcagcaactatct

SEQ ID NO: 653350 - DNA, 25 bp, Mus musculus
ggtggcaacaagacgcatatccgtg

SEQ ID NO: 653351 - DNA, 25 bp, Mus musculus
ggtggcaacaagtcgcatatccgtg

SEQ ID NO: 653352 - DNA, 25 bp, Mus musculus
ggtggcaacactcatattgaaatta

SEQ ID NO: 653353 - DNA, 25 bp, Mus musculus
ggtggcaacactgatattgaaatta

SEQ ID NO: 653354 - DNA, 25 bp, Mus musculus
ggtggcaacctgagacttaggactt

SEQ ID NO: 653355 - DNA, 25 bp, Mus musculus
ggtggcaacctgcttggccatacca

SEQ ID NO: 653356 - DNA, 25 bp, Mus musculus
ggtggcaacctggttggccatacca

SEQ ID NO: 653357 - DNA, 25 bp, Mus musculus
ggtggcaacctgtgacttaggactt

SEQ ID NO: 653358 - DNA, 25 bp, Mus musculus
ggtggcaagaacctggcgacttcac

SEQ ID NO: 653359 - DNA, 25 bp, Mus musculus
ggtggcaagaacgtggcgacttcac

SEQ ID NO: 653360 - DNA, 25 bp, Mus musculus
ggtggcaagcatacactacccggtg

SEQ ID NO: 653361 - DNA, 25 bp, Mus musculus
ggtggcaagcattcactacccggtg

SEQ ID NO: 653362 - DNA, 25 bp, Mus musculus
ggtggcaagcgtctgctcttccttg

SEQ ID NO: 653363 - DNA, 25 bp, Mus musculus
ggtggcaagcgtgtgctcttccttg

SEQ ID NO: 653364 - DNA, 25 bp, Mus musculus
ggtggcaagtgactttacctttcag

SEQ ID NO: 653365 - DNA, 25 bp, Mus musculus
ggtggcaagtgagtttacctttcag

SEQ ID NO: 653366 - DNA, 25 bp, Mus musculus
ggtggcaataatagtcccgagttca

SEQ ID NO: 653367 - DNA, 25 bp, Mus musculus
ggtggcaataattgtcccgagttca

SEQ ID NO: 653368 - DNA, 25 bp, Mus musculus
ggtggcaatgatatcctttccccag

SEQ ID NO: 653369 - DNA, 25 bp, Mus musculus
ggtggcaatgatttcctttccccag

SEQ ID NO: 653370 - DNA, 25 bp, Mus musculus
ggtggcaatgccatttgtttggact

SEQ ID NO: 653371 - DNA, 25 bp, Mus musculus
ggtggcaatgccttttgtttggact

SEQ ID NO: 653372 - DNA, 25 bp, Mus musculus
ggtggcaatggccttccctgaatag

SEQ ID NO: 653373 - DNA, 25 bp, Mus musculus
ggtggcaatggcgttccctgaatag

SEQ ID NO: 653374 - DNA, 25 bp, Mus musculus
ggtggcacacacaggtatgctgaaa

SEQ ID NO: 653375 - DNA, 25 bp, Mus musculus
ggtggcacacacagtagtctcggtt

SEQ ID NO: 653376 - DNA, 25 bp, Mus musculus
ggtggcacacactggtatgctgaaa

SEQ ID NO: 653377 - DNA, 25 bp, Mus musculus
ggtggcacacactgtagtctcggtt

SEQ ID NO: 653378 - DNA, 25 bp, Mus musculus
ggtggcacacagatttgttccaata

SEQ ID NO: 653379 - DNA, 25 bp, Mus musculus
ggtggcacacagttttgttccaata

SEQ ID NO: 653380 - DNA, 25 bp, Mus musculus
ggtggcacagcactgttctgtttga

SEQ ID NO: 653381 - DNA, 25 bp, Mus musculus
ggtggcacagcagtgttctgtttga

SEQ ID NO: 653382 - DNA, 25 bp, Mus musculus
ggtggcacagcgagacttagtgact

SEQ ID NO: 653383 - DNA, 25 bp, Mus musculus
ggtggcacagcgtgacttagtgact

SEQ ID NO: 653384 - DNA, 25 bp, Mus musculus
ggtggcacatgcatggaaactcagc

SEQ ID NO: 653385 - DNA, 25 bp, Mus musculus
ggtggcacatgcctcgagtctcagc

SEQ ID NO: 653386 - DNA, 25 bp, Mus musculus
ggtggcacatgcgtcgagtctcagc

SEQ ID NO: 653387 - DNA, 25 bp, Mus musculus
ggtggcacatgcttggaaactcagc

SEQ ID NO: 653388 - DNA, 25 bp, Mus musculus
ggtggcacattaatgaactgcactt

SEQ ID NO: 653389 - DNA, 25 bp, Mus musculus
ggtggcacattattgaactgcactt

SEQ ID NO: 653390 - DNA, 25 bp, Mus musculus
ggtggcacattcctagctctcagga

SEQ ID NO: 653391 - DNA, 25 bp, Mus musculus
ggtggcacattcgtagctctcagga

SEQ ID NO: 653392 - DNA, 25 bp, Mus musculus
ggtggcaccaacagaggtgacattt

SEQ ID NO: 653393 - DNA, 25 bp, Mus musculus
ggtggcaccaactgaggtgacattt

SEQ ID NO: 653394 - DNA, 25 bp, Mus musculus
ggtggcacccagagtgagcagtacc

SEQ ID NO: 653395 - DNA, 25 bp, Mus musculus
ggtggcacccagtgtgagcagtacc

SEQ ID NO: 653396 - DNA, 25 bp, Mus musculus
ggtggcaccgagaggcagtgatcat

SEQ ID NO: 653397 - DNA, 25 bp, Mus musculus
ggtggcaccgagtggcagtgatcat

SEQ ID NO: 653398 - DNA, 25 bp, Mus musculus
ggtggcaccggaagaatgctatgaa

SEQ ID NO: 653399 - DNA, 25 bp, Mus musculus
ggtggcaccggatgaatgctatgaa

SEQ ID NO: 653400 - DNA, 25 bp, Mus musculus
ggtggcacctcaatattacatcgta

SEQ ID NO: 653401 - DNA, 25 bp, Mus musculus
ggtggcacctcattattacatcgta

SEQ ID NO: 653402 - DNA, 25 bp, Mus musculus
ggtggcacctgcataacttcgctat

SEQ ID NO: 653403 - DNA, 25 bp, Mus musculus
ggtggcacctgcttaacttcgctat

SEQ ID NO: 653404 - DNA, 25 bp, Mus musculus
ggtggcactatgaataccctcagtg

SEQ ID NO: 653405 - DNA, 25 bp, Mus musculus
ggtggcactatgtataccctcagtg

SEQ ID NO: 653406 - DNA, 25 bp, Mus musculus
ggtggcactcatatttccatacatt

SEQ ID NO: 653407 - DNA, 25 bp, Mus musculus
ggtggcactcatttttccatacatt

SEQ ID NO: 653408 - DNA, 25 bp, Mus musculus
ggtggcactctgaaaatgttttact

SEQ ID NO: 653409 - DNA, 25 bp, Mus musculus
ggtggcactctgtaaatgttttact

SEQ ID NO: 653410 - DNA, 25 bp, Mus musculus
ggtggcactgtcctagaaaattcaa

SEQ ID NO: 653411 - DNA, 25 bp, Mus musculus
ggtggcactgtcgtagaaaattcaa

SEQ ID NO: 653412 - DNA, 25 bp, Mus musculus
ggtggcacttaaacctcaaacgtga

SEQ ID NO: 653413 - DNA, 25 bp, Mus musculus
ggtggcacttaatcctcaaacgtga

SEQ ID NO: 653414 - DNA, 25 bp, Mus musculus
ggtggcacttgacccttcaaaactg

SEQ ID NO: 653415 - DNA, 25 bp, Mus musculus
ggtggcacttgagccttcaaaactg

SEQ ID NO: 653416 - DNA, 25 bp, Mus musculus
ggtggcacttggctttaatcctatg

SEQ ID NO: 653417 - DNA, 25 bp, Mus musculus
ggtggcacttgggtttaatcctatg

SEQ ID NO: 653418 - DNA, 25 bp, Mus musculus
ggtggcactttaaagatcacgaaga

SEQ ID NO: 653419 - DNA, 25 bp, Mus musculus
ggtggcactttatagatcacgaaga

SEQ ID NO: 653420 - DNA, 25 bp, Mus musculus
ggtggcagaatgaaggtttttccca

SEQ ID NO: 653421 - DNA, 25 bp, Mus musculus
ggtggcagaatgtaggtttttccca

SEQ ID NO: 653422 - DNA, 25 bp, Mus musculus
ggtggcagacatctttcttgcatct

SEQ ID NO: 653423 - DNA, 25 bp, Mus musculus
ggtggcagacatgtttcttgcatct

SEQ ID NO: 653424 - DNA, 25 bp, Mus musculus
ggtggcagacgcaggtcccaaacct

SEQ ID NO: 653425 - DNA, 25 bp, Mus musculus
ggtggcagacgctggtcccaaacct

SEQ ID NO: 653426 - DNA, 25 bp, Mus musculus
ggtggcagacttagctgactcacaa

SEQ ID NO: 653427 - DNA, 25 bp, Mus musculus
ggtggcagactttgctgactcacaa

SEQ ID NO: 653428 - DNA, 25 bp, Mus musculus
ggtggcagataaattgtgcatattt

SEQ ID NO: 653429 - DNA, 25 bp, Mus musculus
ggtggcagataatttgtgcatattt

SEQ ID NO: 653430 - DNA, 25 bp, Mus musculus
ggtggcagatcactctggccaagta

SEQ ID NO: 653431 - DNA, 25 bp, Mus musculus
ggtggcagatcagtctggccaagta

SEQ ID NO: 653432 - DNA, 25 bp, Mus musculus
ggtggcagatgccttatgtcccagc

SEQ ID NO: 653433 - DNA, 25 bp, Mus musculus
ggtggcagatgcgttatgtcccagc

SEQ ID NO: 653434 - DNA, 25 bp, Mus musculus
ggtggcagatggacgctttcaagtt

SEQ ID NO: 653435 - DNA, 25 bp, Mus musculus
ggtggcagatggtcgctttcaagtt

SEQ ID NO: 653436 - DNA, 25 bp, Mus musculus
ggtggcagattcacgaacatttgtt

SEQ ID NO: 653437 - DNA, 25 bp, Mus musculus
ggtggcagattctcgaacatttgtt

SEQ ID NO: 653438 - DNA, 25 bp, Mus musculus
ggtggcagcagtcactaaagaaatt

SEQ ID NO: 653439 - DNA, 25 bp, Mus musculus
ggtggcagcagtgactaaagaaatt

SEQ ID NO: 653440 - DNA, 25 bp, Mus musculus
ggtggcagccagacctcagtaggca

SEQ ID NO: 653441 - DNA, 25 bp, Mus musculus
ggtggcagccagtcctcagtaggca

SEQ ID NO: 653442 - DNA, 25 bp, Mus musculus
ggtggcagcccacgttttatttaca

SEQ ID NO: 653443 - DNA, 25 bp, Mus musculus
ggtggcagcccaggttttatttaca

SEQ ID NO: 653444 - DNA, 25 bp, Mus musculus
ggtggcagccctacttgagatatga

SEQ ID NO: 653445 - DNA, 25 bp, Mus musculus
ggtggcagcccttcttgagatatga

SEQ ID NO: 653446 - DNA, 25 bp, Mus musculus
ggtggcagcctcaactgggcaaaaa

SEQ ID NO: 653447 - DNA, 25 bp, Mus musculus
ggtggcagcctctactgggcaaaaa

SEQ ID NO: 653448 - DNA, 25 bp, Mus musculus
ggtggcagctacagcaataatgctc

SEQ ID NO: 653449 - DNA, 25 bp, Mus musculus
ggtggcagctactgcaataatgctc

SEQ ID NO: 653450 - DNA, 25 bp, Mus musculus
ggtggcagctgcacatcctgtctgt

SEQ ID NO: 653451 - DNA, 25 bp, Mus musculus
ggtggcagctgctcatcctgtctgt

SEQ ID NO: 653452 - DNA, 25 bp, Mus musculus
ggtggcagggccaagctgctacaaa

SEQ ID NO: 653453 - DNA, 25 bp, Mus musculus
ggtggcagggcctagctgctacaaa

SEQ ID NO: 653454 - DNA, 25 bp, Mus musculus
ggtggcagtgacacccgaatcattc

SEQ ID NO: 653455 - DNA, 25 bp, Mus musculus
ggtggcagtgactcccgaatcattc

SEQ ID NO: 653456 - DNA, 25 bp, Mus musculus
ggtggcatactaagttgcaataaaa

SEQ ID NO: 653457 - DNA, 25 bp, Mus musculus
ggtggcatactatgttgcaataaaa

SEQ ID NO: 653458 - DNA, 25 bp, Mus musculus
ggtggcatactcctttgattctaaa

SEQ ID NO: 653459 - DNA, 25 bp, Mus musculus
ggtggcatactcgtttgattctaaa

SEQ ID NO: 653460 - DNA, 25 bp, Mus musculus
ggtggcatatacagcacacactagt

SEQ ID NO: 653461 - DNA, 25 bp, Mus musculus
ggtggcatatactgcacacactagt

SEQ ID NO: 653462 - DNA, 25 bp, Mus musculus
ggtggcatatttctagtccagcaga

SEQ ID NO: 653463 - DNA, 25 bp, Mus musculus
ggtggcatatttgtagtccagcaga

SEQ ID NO: 653464 - DNA, 25 bp, Mus musculus
ggtggcatcaacctgtggagattac

SEQ ID NO: 653465 - DNA, 25 bp, Mus musculus
ggtggcatcaacgtgtggagattac

SEQ ID NO: 653466 - DNA, 25 bp, Mus musculus
ggtggcatccttagtgaactgcatc

SEQ ID NO: 653467 - DNA, 25 bp, Mus musculus
ggtggcatccttatttgatagtaac

SEQ ID NO: 653468 - DNA, 25 bp, Mus musculus
ggtggcatcctttgtgaactgcatc

SEQ ID NO: 653469 - DNA, 25 bp, Mus musculus
ggtggcatccttttttgatagtaac

SEQ ID NO: 653470 - DNA, 25 bp, Mus musculus
ggtggcatctagcaccagattcttt

SEQ ID NO: 653471 - DNA, 25 bp, Mus musculus
ggtggcatctaggaccagattcttt

SEQ ID NO: 653472 - DNA, 25 bp, Mus musculus
ggtggcatgccacatctttgtgaag

SEQ ID NO: 653473 - DNA, 25 bp, Mus musculus
ggtggcatgccagatctttgtgaag

SEQ ID NO: 653474 - DNA, 25 bp, Mus musculus
ggtggcatgtagcaagttagtacaa

SEQ ID NO: 653475 - DNA, 25 bp, Mus musculus
ggtggcatgtaggaagttagtacaa

SEQ ID NO: 653476 - DNA, 25 bp, Mus musculus
ggtggcatgtgcatcaagacactgg

SEQ ID NO: 653477 - DNA, 25 bp, Mus musculus
ggtggcatgtgcttcaagacactgg

SEQ ID NO: 653478 - DNA, 25 bp, Mus musculus
ggtggcattcaacgatacccacata

SEQ ID NO: 653479 - DNA, 25 bp, Mus musculus
ggtggcattcaaggatacccacata

SEQ ID NO: 653480 - DNA, 25 bp, Mus musculus
ggtggcattcttctaagctctgaaa

SEQ ID NO: 653481 - DNA, 25 bp, Mus musculus
ggtggcattcttgtaagctctgaaa

SEQ ID NO: 653482 - DNA, 25 bp, Mus musculus
ggtggcattggtaattttccataaa

SEQ ID NO: 653483 - DNA, 25 bp, Mus musculus
ggtggcattggtagtctcagaaatt

SEQ ID NO: 653484 - DNA, 25 bp, Mus musculus
ggtggcattggttattttccataaa

SEQ ID NO: 653485 - DNA, 25 bp, Mus musculus
ggtggcattggttgtctcagaaatt

SEQ ID NO: 653486 - DNA, 25 bp, Mus musculus
ggtggcatttaaattataaaccatc

SEQ ID NO: 653487 - DNA, 25 bp, Mus musculus
ggtggcatttaatttataaaccatc

SEQ ID NO: 653488 - DNA, 25 bp, Mus musculus
ggtggcatttctcggagcttgtcac

SEQ ID NO: 653489 - DNA, 25 bp, Mus musculus
ggtggcatttctgggagcttgtcac

SEQ ID NO: 653490 - DNA, 25 bp, Mus musculus
ggtggcatttgcactctgagcagat

SEQ ID NO: 653491 - DNA, 25 bp, Mus musculus
ggtggcatttgctctctgagcagat

SEQ ID NO: 653492 - DNA, 25 bp, Mus musculus
ggtggccaaatgcactttcctttct

SEQ ID NO: 653493 - DNA, 25 bp, Mus musculus
ggtggccaaatggactttcctttct

SEQ ID NO: 653494 - DNA, 25 bp, Mus musculus
ggtggccaacaacaaaccataattc

SEQ ID NO: 653495 - DNA, 25 bp, Mus musculus
ggtggccaacaagaaaccataattc

SEQ ID NO: 653496 - DNA, 25 bp, Mus musculus
ggtggccaagaaagaatgctgaatc

SEQ ID NO: 653497 - DNA, 25 bp, Mus musculus
ggtggccaagaatgaatgctgaatc

SEQ ID NO: 653498 - DNA, 25 bp, Mus musculus
ggtggccaatacacaccacattttg

SEQ ID NO: 653499 - DNA, 25 bp, Mus musculus
ggtggccaatactcaccacattttg

SEQ ID NO: 653500 - DNA, 25 bp, Mus musculus
ggtggccacactagggtttctggaa

SEQ ID NO: 653501 - DNA, 25 bp, Mus musculus
ggtggccacacttgggtttctggaa

SEQ ID NO: 653502 - DNA, 25 bp, Mus musculus
ggtggccacatcatgcctattgaat

SEQ ID NO: 653503 - DNA, 25 bp, Mus musculus
ggtggccacatcttgcctattgaat

SEQ ID NO: 653504 - DNA, 25 bp, Mus musculus
ggtggccaccaacctgaacttgagc

SEQ ID NO: 653505 - DNA, 25 bp, Mus musculus
ggtggccaccaagctgaacttgagc

SEQ ID NO: 653506 - DNA, 25 bp, Mus musculus
ggtggccactagaaggtgactcatc

SEQ ID NO: 653507 - DNA, 25 bp, Mus musculus
ggtggccactagtaggtgactcatc

SEQ ID NO: 653508 - DNA, 25 bp, Mus musculus
ggtggccactatcctgtatgtcatt

SEQ ID NO: 653509 - DNA, 25 bp, Mus musculus
ggtggccactatgctgtatgtcatt

SEQ ID NO: 653510 - DNA, 25 bp, Mus musculus
ggtggccactctctattgaagggta

SEQ ID NO: 653511 - DNA, 25 bp, Mus musculus
ggtggccactctgtattgaagggta

SEQ ID NO: 653512 - DNA, 25 bp, Mus musculus
ggtggccagactcaaattggaccta

SEQ ID NO: 653513 - DNA, 25 bp, Mus musculus
ggtggccagactgaaattggaccta

SEQ ID NO: 653514 - DNA, 25 bp, Mus musculus
ggtggccagatcactatgaacttgt

SEQ ID NO: 653515 - DNA, 25 bp, Mus musculus
ggtggccagatctctatgaacttgt

SEQ ID NO: 653516 - DNA, 25 bp, Mus musculus
ggtggccagatgagcttccatcaca

SEQ ID NO: 653517 - DNA, 25 bp, Mus musculus
ggtggccagatgtgcttccatcaca

SEQ ID NO: 653518 - DNA, 25 bp, Mus musculus
ggtggccagggcacaatgtgttcct

SEQ ID NO: 653519 - DNA, 25 bp, Mus musculus
ggtggccagggctcaatgtgttcct

SEQ ID NO: 653520 - DNA, 25 bp, Mus musculus
ggtggccagtggatagctatccgca

SEQ ID NO: 653521 - DNA, 25 bp, Mus musculus
ggtggccagtggttagctatccgca

SEQ ID NO: 653522 - DNA, 25 bp, Mus musculus
ggtggccagttcacggatcatctcc

SEQ ID NO: 653523 - DNA, 25 bp, Mus musculus
ggtggccagttctcggatcatctcc

SEQ ID NO: 653524 - DNA, 25 bp, Mus musculus
ggtggccatactcagatctgatgtg

SEQ ID NO: 653525 - DNA, 25 bp, Mus musculus
ggtggccatactgagatctgatgtg

SEQ ID NO: 653526 - DNA, 25 bp, Mus musculus
ggtggccatataactatacaggtgt

SEQ ID NO: 653527 - DNA, 25 bp, Mus musculus
ggtggccatatatctatacaggtgt

SEQ ID NO: 653528 - DNA, 25 bp, Mus musculus
ggtggccatcttagaaaagggaagt

SEQ ID NO: 653529 - DNA, 25 bp, Mus musculus
ggtggccatctttgaaaagggaagt

SEQ ID NO: 653530 - DNA, 25 bp, Mus musculus
ggtggccatgcacaccaagcgaatg

SEQ ID NO: 653531 - DNA, 25 bp, Mus musculus
ggtggccatgcagaccaagcgaatg

SEQ ID NO: 653532 - DNA, 25 bp, Mus musculus
ggtggccatgccagatggtacagat

SEQ ID NO: 653533 - DNA, 25 bp, Mus musculus
ggtggccatgcctgatggtacagat

SEQ ID NO: 653534 - DNA, 25 bp, Mus musculus
ggtggccattggagattgttgtact

SEQ ID NO: 653535 - DNA, 25 bp, Mus musculus
ggtggccattggtgattgttgtact

SEQ ID NO: 653536 - DNA, 25 bp, Mus musculus
ggtggcccaaaactgctccaaagaa

SEQ ID NO: 653537 - DNA, 25 bp, Mus musculus
ggtggcccaaaagtgctccaaagaa

SEQ ID NO: 653538 - DNA, 25 bp, Mus musculus
ggtggcccacagcatcatttacatt

SEQ ID NO: 653539 - DNA, 25 bp, Mus musculus
ggtggcccacaggatcatttacatt

SEQ ID NO: 653540 - DNA, 25 bp, Mus musculus
ggtggcccacatcatagagttggat

SEQ ID NO: 653541 - DNA, 25 bp, Mus musculus
ggtggcccacatgatagagttggat

SEQ ID NO: 653542 - DNA, 25 bp, Mus musculus
ggtggcccactcatttgtgaacaac

SEQ ID NO: 653543 - DNA, 25 bp, Mus musculus
ggtggcccactcttttgtgaacaac

SEQ ID NO: 653544 - DNA, 25 bp, Mus musculus
ggtggcccagatctcagcagaatac

SEQ ID NO: 653545 - DNA, 25 bp, Mus musculus
ggtggcccagatgtcagcagaatac

SEQ ID NO: 653546 - DNA, 25 bp, Mus musculus
ggtggcccaggaattattgtctaca

SEQ ID NO: 653547 - DNA, 25 bp, Mus musculus
ggtggcccaggatttattgtctaca

SEQ ID NO: 653548 - DNA, 25 bp, Mus musculus
ggtggcccaggcaagacatagatgc

SEQ ID NO: 653549 - DNA, 25 bp, Mus musculus
ggtggcccaggctagacatagatgc

SEQ ID NO: 653550 - DNA, 25 bp, Mus musculus
ggtggccccaaaaagatgttaccag

SEQ ID NO: 653551 - DNA, 25 bp, Mus musculus
ggtggccccaaatagatgttaccag

SEQ ID NO: 653552 - DNA, 25 bp, Mus musculus
ggtggccccagacaagcacagactc

SEQ ID NO: 653553 - DNA, 25 bp, Mus musculus
ggtggccccagagaagcacagactc

SEQ ID NO: 653554 - DNA, 25 bp, Mus musculus
ggtggccccagccatcaaggagaaa

SEQ ID NO: 653555 - DNA, 25 bp, Mus musculus
ggtggccccagcgatcaaggagaaa

SEQ ID NO: 653556 - DNA, 25 bp, Mus musculus
ggtggccccagtactgttgagaatg

SEQ ID NO: 653557 - DNA, 25 bp, Mus musculus
ggtggccccagttctgttgagaatg

SEQ ID NO: 653558 - DNA, 25 bp, Mus musculus
ggtggccccatcatgagagtgtctg

SEQ ID NO: 653559 - DNA, 25 bp, Mus musculus
ggtggccccatcttgagagtgtctg

SEQ ID NO: 653560 - DNA, 25 bp, Mus musculus
ggtggccccattagcaggagagtcc

SEQ ID NO: 653561 - DNA, 25 bp, Mus musculus
ggtggccccattcttggcaatgtga

SEQ ID NO: 653562 - DNA, 25 bp, Mus musculus
ggtggccccattgttggcaatgtga

SEQ ID NO: 653563 - DNA, 25 bp, Mus musculus
ggtggccccatttgcaggagagtcc

SEQ ID NO: 653564 - DNA, 25 bp, Mus musculus
ggtggcccctgaaggttgctttaag

SEQ ID NO: 653565 - DNA, 25 bp, Mus musculus
ggtggcccctgatggttgctttaag

SEQ ID NO: 653566 - DNA, 25 bp, Mus musculus
ggtggcccctttctttatagcaaat

SEQ ID NO: 653567 - DNA, 25 bp, Mus musculus
ggtggcccctttgtttatagcaaat

SEQ ID NO: 653568 - DNA, 25 bp, Mus musculus
ggtggcccgtaacctggtcatcatc

SEQ ID NO: 653569 - DNA, 25 bp, Mus musculus
ggtggcccgtaagctggtcatcatc

SEQ ID NO: 653570 - DNA, 25 bp, Mus musculus
ggtggccctcataggtgatgcagcc

SEQ ID NO: 653571 - DNA, 25 bp, Mus musculus
ggtggccctcattggtgatgcagcc

SEQ ID NO: 653572 - DNA, 25 bp, Mus musculus
ggtggccctgagcaaaaccaaacag

SEQ ID NO: 653573 - DNA, 25 bp, Mus musculus
ggtggccctgaggaaaaccaaacag

SEQ ID NO: 653574 - DNA, 25 bp, Mus musculus
ggtggccctggaaattgaagtctgt

SEQ ID NO: 653575 - DNA, 25 bp, Mus musculus
ggtggccctggaaggtggtgacgaa

SEQ ID NO: 653576 - DNA, 25 bp, Mus musculus
ggtggccctggatattgaagtctgt

SEQ ID NO: 653577 - DNA, 25 bp, Mus musculus
ggtggccctggatggtggtgacgaa

SEQ ID NO: 653578 - DNA, 25 bp, Mus musculus
ggtggcccttaaccaaagtctttag

SEQ ID NO: 653579 - DNA, 25 bp, Mus musculus
ggtggcccttaagcaaagtctttag

SEQ ID NO: 653580 - DNA, 25 bp, Mus musculus
ggtggccctttaagctgagaggctt

SEQ ID NO: 653581 - DNA, 25 bp, Mus musculus
ggtggccctttatgctgagaggctt

SEQ ID NO: 653582 - DNA, 25 bp, Mus musculus
ggtggccgcagtctgaccgtaatcc

SEQ ID NO: 653583 - DNA, 25 bp, Mus musculus
ggtggccgcagtgtgaccgtaatcc

SEQ ID NO: 653584 - DNA, 25 bp, Mus musculus
ggtggccgccagactggtacctgaa

SEQ ID NO: 653585 - DNA, 25 bp, Mus musculus
ggtggccgccagtctggtacctgaa

SEQ ID NO: 653586 - DNA, 25 bp, Mus musculus
ggtggccggtatccagctttagcaa

SEQ ID NO: 653587 - DNA, 25 bp, Mus musculus
ggtggccggtatgcagctttagcaa

SEQ ID NO: 653588 - DNA, 25 bp, Mus musculus
ggtggcctaacacagttcaaaccct

SEQ ID NO: 653589 - DNA, 25 bp, Mus musculus
ggtggcctaacagagttcaaaccct

SEQ ID NO: 653590 - DNA, 25 bp, Mus musculus
ggtggcctacttagtgaatgaataa

SEQ ID NO: 653591 - DNA, 25 bp, Mus musculus
ggtggcctactttgtgaatgaataa

SEQ ID NO: 653592 - DNA, 25 bp, Mus musculus
ggtggcctagataaccttggctcaa

SEQ ID NO: 653593 - DNA, 25 bp, Mus musculus
ggtggcctagattaccttggctcaa

SEQ ID NO: 653594 - DNA, 25 bp, Mus musculus
ggtggcctatctagagtgttcagct

SEQ ID NO: 653595 - DNA, 25 bp, Mus musculus
ggtggcctatcttgagtgttcagct

SEQ ID NO: 653596 - DNA, 25 bp, Mus musculus
ggtggcctatgaaaaacagacaaca

SEQ ID NO: 653597 - DNA, 25 bp, Mus musculus
ggtggcctatgataaacagacaaca

SEQ ID NO: 653598 - DNA, 25 bp, Mus musculus
ggtggcctatttcctcttattaaaa

SEQ ID NO: 653599 - DNA, 25 bp, Mus musculus
ggtggcctatttgctcttattaaaa

SEQ ID NO: 653600 - DNA, 25 bp, Mus musculus
ggtggcctcaaactgtcgggacaca

SEQ ID NO: 653601 - DNA, 25 bp, Mus musculus
ggtggcctcaaagtgtcgggacaca

SEQ ID NO: 653602 - DNA, 25 bp, Mus musculus
ggtggcctcccacataatgaattat

SEQ ID NO: 653603 - DNA, 25 bp, Mus musculus
ggtggcctcccagataatgaattat

SEQ ID NO: 653604 - DNA, 25 bp, Mus musculus
ggtggcctcgtcctgaaaagtaatg

SEQ ID NO: 653605 - DNA, 25 bp, Mus musculus
ggtggcctcgtcgtgaaaagtaatg

SEQ ID NO: 653606 - DNA, 25 bp, Mus musculus
ggtggcctcgtgaggaaaagcatta

SEQ ID NO: 653607 - DNA, 25 bp, Mus musculus
ggtggcctcgtgtggaaaagcatta

SEQ ID NO: 653608 - DNA, 25 bp, Mus musculus
ggtggcctgaacagacttgtgaaca

SEQ ID NO: 653609 - DNA, 25 bp, Mus musculus
ggtggcctgaactgacttgtgaaca

SEQ ID NO: 653610 - DNA, 25 bp, Mus musculus
ggtggcctggacatctgtgcagtca

SEQ ID NO: 653611 - DNA, 25 bp, Mus musculus
ggtggcctggacttctgtgcagtca

SEQ ID NO: 653612 - DNA, 25 bp, Mus musculus
ggtggcctgtatcccagagcaagat

SEQ ID NO: 653613 - DNA, 25 bp, Mus musculus
ggtggcctgtatgccagagcaagat

SEQ ID NO: 653614 - DNA, 25 bp, Mus musculus
ggtggcctgttcaggtgctacaggg

SEQ ID NO: 653615 - DNA, 25 bp, Mus musculus
ggtggcctgttctggtgctacaggg

SEQ ID NO: 653616 - DNA, 25 bp, Mus musculus
ggtggccttcttcggctacaaatat

SEQ ID NO: 653617 - DNA, 25 bp, Mus musculus
ggtggccttcttgggctacaaatat

SEQ ID NO: 653618 - DNA, 25 bp, Mus musculus
ggtggccttggaaatacaagccttt

SEQ ID NO: 653619 - DNA, 25 bp, Mus musculus
ggtggccttggatatacaagccttt

SEQ ID NO: 653620 - DNA, 25 bp, Mus musculus
ggtggcgaccagcatgaccttaaac

SEQ ID NO: 653621 - DNA, 25 bp, Mus musculus
ggtggcgaccaggatgaccttaaac

SEQ ID NO: 653622 - DNA, 25 bp, Mus musculus
ggtggcgacgtcatgcaccccgtcg

SEQ ID NO: 653623 - DNA, 25 bp, Mus musculus
ggtggcgacgtcttgcaccccgtcg

SEQ ID NO: 653624 - DNA, 25 bp, Mus musculus
ggtggcgagccaaggtacccaaaga

SEQ ID NO: 653625 - DNA, 25 bp, Mus musculus
ggtggcgagccatggtacccaaaga

SEQ ID NO: 653626 - DNA, 25 bp, Mus musculus
ggtggcgagtaaatccttgacggat

SEQ ID NO: 653627 - DNA, 25 bp, Mus musculus
ggtggcgagtaattccttgacggat

SEQ ID NO: 653628 - DNA, 25 bp, Mus musculus
ggtggcgatgttctagtacaacttt

SEQ ID NO: 653629 - DNA, 25 bp, Mus musculus
ggtggcgatgttgtagtacaacttt

SEQ ID NO: 653630 - DNA, 25 bp, Mus musculus
ggtggcgcacgcagaccagcctagt

SEQ ID NO: 653631 - DNA, 25 bp, Mus musculus
ggtggcgcacgctgaccagcctagt

SEQ ID NO: 653632 - DNA, 25 bp, Mus musculus
ggtggcgcagataccgcagcagcac

SEQ ID NO: 653633 - DNA, 25 bp, Mus musculus
ggtggcgcagattccgcagcagcac

SEQ ID NO: 653634 - DNA, 25 bp, Mus musculus
ggtggcgctgggatcactgaaatat

SEQ ID NO: 653635 - DNA, 25 bp, Mus musculus
ggtggcgctgggttcactgaaatat

SEQ ID NO: 653636 - DNA, 25 bp, Mus musculus
ggtggcggacaaacggttcagttta

SEQ ID NO: 653637 - DNA, 25 bp, Mus musculus
ggtggcggacaatcggttcagttta

SEQ ID NO: 653638 - DNA, 25 bp, Mus musculus
ggtggcggcgaccaatcatctaaag

SEQ ID NO: 653639 - DNA, 25 bp, Mus musculus
ggtggcggcgacgaatcatctaaag

SEQ ID NO: 653640 - DNA, 25 bp, Mus musculus
ggtggcgtacatagttaatcccagc

SEQ ID NO: 653641 - DNA, 25 bp, Mus musculus
ggtggcgtacattgttaatcccagc

SEQ ID NO: 653642 - DNA, 25 bp, Mus musculus
ggtggcgtcagcagcataccaggca

SEQ ID NO: 653643 - DNA, 25 bp, Mus musculus
ggtggcgtcagctgcataccaggca

SEQ ID NO: 653644 - DNA, 25 bp, Mus musculus
ggtggcgtgaatattccactgcctg

SEQ ID NO: 653645 - DNA, 25 bp, Mus musculus
ggtggcgtgaattttccactgcctg

SEQ ID NO: 653646 - DNA, 25 bp, Mus musculus
ggtggcgtgctaacctagtatgtga

SEQ ID NO: 653647 - DNA, 25 bp, Mus musculus
ggtggcgtgctatcctagtatgtga

SEQ ID NO: 653648 - DNA, 25 bp, Mus musculus
ggtggcgtggtcctctctctaagac

SEQ ID NO: 653649 - DNA, 25 bp, Mus musculus
ggtggcgtggtcgtctctctaagac

SEQ ID NO: 653650 - DNA, 25 bp, Mus musculus
ggtggcgttcttcaataactttctc

SEQ ID NO: 653651 - DNA, 25 bp, Mus musculus
ggtggcgttcttgaataactttctc

SEQ ID NO: 653652 - DNA, 25 bp, Mus musculus
ggtggctaacacatctagttccagt

SEQ ID NO: 653653 - DNA, 25 bp, Mus musculus
ggtggctaacacttctagttccagt

SEQ ID NO: 653654 - DNA, 25 bp, Mus musculus
ggtggctaatatagtcagcttgact

SEQ ID NO: 653655 - DNA, 25 bp, Mus musculus
ggtggctaatattgtcagcttgact

SEQ ID NO: 653656 - DNA, 25 bp, Mus musculus
ggtggctaatgaaccttttaactgg

SEQ ID NO: 653657 - DNA, 25 bp, Mus musculus
ggtggctaatgatccttttaactgg

SEQ ID NO: 653658 - DNA, 25 bp, Mus musculus
ggtggctaatttactcttatgcctt

SEQ ID NO: 653659 - DNA, 25 bp, Mus musculus
ggtggctaattttctcttatgcctt

SEQ ID NO: 653660 - DNA, 25 bp, Mus musculus
ggtggctacagcaaacactaaggaa

SEQ ID NO: 653661 - DNA, 25 bp, Mus musculus
ggtggctacagctaacactaaggaa

SEQ ID NO: 653662 - DNA, 25 bp, Mus musculus
ggtggctacatcatttggctagctc

SEQ ID NO: 653663 - DNA, 25 bp, Mus musculus
ggtggctacatcttttggctagctc

SEQ ID NO: 653664 - DNA, 25 bp, Mus musculus
ggtggctaccctatgtaaacaagct

SEQ ID NO: 653665 - DNA, 25 bp, Mus musculus
ggtggctaccctttgtaaacaagct

SEQ ID NO: 653666 - DNA, 25 bp, Mus musculus
ggtggctacctgaatttctgagtac

SEQ ID NO: 653667 - DNA, 25 bp, Mus musculus
ggtggctacctgtatttctgagtac

SEQ ID NO: 653668 - DNA, 25 bp, Mus musculus
ggtggctactaaactgtttggcaga

SEQ ID NO: 653669 - DNA, 25 bp, Mus musculus
ggtggctactaatctgtttggcaga

SEQ ID NO: 653670 - DNA, 25 bp, Mus musculus
ggtggctagcacagatcttaatgat

SEQ ID NO: 653671 - DNA, 25 bp, Mus musculus
ggtggctagcactgatcttaatgat

SEQ ID NO: 653672 - DNA, 25 bp, Mus musculus
ggtggctagcatcaccaagcctact

SEQ ID NO: 653673 - DNA, 25 bp, Mus musculus
ggtggctagcatgaccaagcctact

SEQ ID NO: 653674 - DNA, 25 bp, Mus musculus
ggtggctagctcacacttgaagttc

SEQ ID NO: 653675 - DNA, 25 bp, Mus musculus
ggtggctagctctcacttgaagttc

SEQ ID NO: 653676 - DNA, 25 bp, Mus musculus
ggtggctagtgcactattttcgaag

SEQ ID NO: 653677 - DNA, 25 bp, Mus musculus
ggtggctagtgctctattttcgaag

SEQ ID NO: 653678 - DNA, 25 bp, Mus musculus
ggtggctagttcagtgataccataa

SEQ ID NO: 653679 - DNA, 25 bp, Mus musculus
ggtggctagttctgtgataccataa

SEQ ID NO: 653680 - DNA, 25 bp, Mus musculus
ggtggctatactcactacacataaa

SEQ ID NO: 653681 - DNA, 25 bp, Mus musculus
ggtggctatactgactacacataaa

SEQ ID NO: 653682 - DNA, 25 bp, Mus musculus
ggtggctatgacaagcctgctgcta

SEQ ID NO: 653683 - DNA, 25 bp, Mus musculus
ggtggctatgactagcctgctgcta

SEQ ID NO: 653684 - DNA, 25 bp, Mus musculus
ggtggctatggcctccaacctaggt

SEQ ID NO: 653685 - DNA, 25 bp, Mus musculus
ggtggctatggcgtccaacctaggt

SEQ ID NO: 653686 - DNA, 25 bp, Mus musculus
ggtggctattgtaaaagacccaaag

SEQ ID NO: 653687 - DNA, 25 bp, Mus musculus
ggtggctattgttaaagacccaaag

SEQ ID NO: 653688 - DNA, 25 bp, Mus musculus
ggtggctcaattctttacaaactac

SEQ ID NO: 653689 - DNA, 25 bp, Mus musculus
ggtggctcaattgtttacaaactac

SEQ ID NO: 653690 - DNA, 25 bp, Mus musculus
ggtggctcacaaaagctgctggaat

SEQ ID NO: 653691 - DNA, 25 bp, Mus musculus
ggtggctcacaatagctgctggaat

SEQ ID NO: 653692 - DNA, 25 bp, Mus musculus
ggtggctcagatatttcaactcttg

SEQ ID NO: 653693 - DNA, 25 bp, Mus musculus
ggtggctcagatttttcaactcttg

SEQ ID NO: 653694 - DNA, 25 bp, Mus musculus
ggtggctcataacaacctacagctc

SEQ ID NO: 653695 - DNA, 25 bp, Mus musculus
ggtggctcataagaacctacagctc

SEQ ID NO: 653696 - DNA, 25 bp, Mus musculus
ggtggctcatgtccataattctaga

SEQ ID NO: 653697 - DNA, 25 bp, Mus musculus
ggtggctcatgtgcataattctaga

SEQ ID NO: 653698 - DNA, 25 bp, Mus musculus
ggtggctcatttctatcctgttttc

SEQ ID NO: 653699 - DNA, 25 bp, Mus musculus
ggtggctcatttgtatcctgttttc

SEQ ID NO: 653700 - DNA, 25 bp, Mus musculus
ggtggctccacactgtttgttggtc

SEQ ID NO: 653701 - DNA, 25 bp, Mus musculus
ggtggctccacagtgtttgttggtc

SEQ ID NO: 653702 - DNA, 25 bp, Mus musculus
ggtggctccaccacatcaatcatca

SEQ ID NO: 653703 - DNA, 25 bp, Mus musculus
ggtggctccacctcatcaatcatca

SEQ ID NO: 653704 - DNA, 25 bp, Mus musculus
ggtggctcccaacctgactgcagag

SEQ ID NO: 653705 - DNA, 25 bp, Mus musculus
ggtggctcccaagctgactgcagag

SEQ ID NO: 653706 - DNA, 25 bp, Mus musculus
ggtggctcccacagaaaataataat

SEQ ID NO: 653707 - DNA, 25 bp, Mus musculus
ggtggctcccactgaaaataataat

SEQ ID NO: 653708 - DNA, 25 bp, Mus musculus
ggtggctccggtcgctacgtaccat

SEQ ID NO: 653709 - DNA, 25 bp, Mus musculus
ggtggctccggtggctacgtaccat

SEQ ID NO: 653710 - DNA, 25 bp, Mus musculus
ggtggctcctctaaaagatgcatca

SEQ ID NO: 653711 - DNA, 25 bp, Mus musculus
ggtggctcctcttaaagatgcatca

SEQ ID NO: 653712 - DNA, 25 bp, Mus musculus
ggtggctcctgactgacatttttag

SEQ ID NO: 653713 - DNA, 25 bp, Mus musculus
ggtggctcctgagtgacatttttag

SEQ ID NO: 653714 - DNA, 25 bp, Mus musculus
ggtggctcgagtctctacatggcaa

SEQ ID NO: 653715 - DNA, 25 bp, Mus musculus
ggtggctcgagtgtctacatggcaa

SEQ ID NO: 653716 - DNA, 25 bp, Mus musculus
ggtggctctaatctctaggagaaaa

SEQ ID NO: 653717 - DNA, 25 bp, Mus musculus
ggtggctctaatgtctaggagaaaa

SEQ ID NO: 653718 - DNA, 25 bp, Mus musculus
ggtggctctcctagactatgagaca

SEQ ID NO: 653719 - DNA, 25 bp, Mus musculus
ggtggctctccttgactatgagaca

SEQ ID NO: 653720 - DNA, 25 bp, Mus musculus
ggtggctctctgaagaaaccagcaa

SEQ ID NO: 653721 - DNA, 25 bp, Mus musculus
ggtggctctctgtagaaaccagcaa

SEQ ID NO: 653722 - DNA, 25 bp, Mus musculus
ggtggctctgctcgctctgttagct

SEQ ID NO: 653723 - DNA, 25 bp, Mus musculus
ggtggctctgctggctctgttagct

SEQ ID NO: 653724 - DNA, 25 bp, Mus musculus
ggtggctctggacgagttccacaaa

SEQ ID NO: 653725 - DNA, 25 bp, Mus musculus
ggtggctctggaggagttccacaaa

SEQ ID NO: 653726 - DNA, 25 bp, Mus musculus
ggtggctctgggaatggatttccaa

SEQ ID NO: 653727 - DNA, 25 bp, Mus musculus
ggtggctctgggtatggatttccaa

SEQ ID NO: 653728 - DNA, 25 bp, Mus musculus
ggtggctctgttcctgaaaccaatc

SEQ ID NO: 653729 - DNA, 25 bp, Mus musculus
ggtggctctgttgctgaaaccaatc

SEQ ID NO: 653730 - DNA, 25 bp, Mus musculus
ggtggctctttaatcattactacag

SEQ ID NO: 653731 - DNA, 25 bp, Mus musculus
ggtggctctttattcattactacag

SEQ ID NO: 653732 - DNA, 25 bp, Mus musculus
ggtggctgaaacaccgtgtcttgtc

SEQ ID NO: 653733 - DNA, 25 bp, Mus musculus
ggtggctgaaacagcggcccatcat

SEQ ID NO: 653734 - DNA, 25 bp, Mus musculus
ggtggctgaaactccgtgtcttgtc

SEQ ID NO: 653735 - DNA, 25 bp, Mus musculus
ggtggctgaaactgcggcccatcat

SEQ ID NO: 653736 - DNA, 25 bp, Mus musculus
ggtggctgcccaattttaaaagagg

SEQ ID NO: 653737 - DNA, 25 bp, Mus musculus
ggtggctgcccatttttaaaagagg

SEQ ID NO: 653738 - DNA, 25 bp, Mus musculus
ggtggctgccttataaactatgatc

SEQ ID NO: 653739 - DNA, 25 bp, Mus musculus
ggtggctgccttttaaactatgatc

SEQ ID NO: 653740 - DNA, 25 bp, Mus musculus
ggtggctgctggaatggtatatcta

SEQ ID NO: 653741 - DNA, 25 bp, Mus musculus
ggtggctgctggtatggtatatcta

SEQ ID NO: 653742 - DNA, 25 bp, Mus musculus
ggtggctgctttagagttctttgga

SEQ ID NO: 653743 - DNA, 25 bp, Mus musculus
ggtggctgcttttgagttctttgga

SEQ ID NO: 653744 - DNA, 25 bp, Mus musculus
ggtggctggaacatctatttttcta

SEQ ID NO: 653745 - DNA, 25 bp, Mus musculus
ggtggctggaacttctatttttcta

SEQ ID NO: 653746 - DNA, 25 bp, Mus musculus
ggtggctggaatagaccgctatccc

SEQ ID NO: 653747 - DNA, 25 bp, Mus musculus
ggtggctggaattgaccgctatccc

SEQ ID NO: 653748 - DNA, 25 bp, Mus musculus
ggtggctggaccaccacttgaagga

SEQ ID NO: 653749 - DNA, 25 bp, Mus musculus
ggtggctggacctccacttgaagga

SEQ ID NO: 653750 - DNA, 25 bp, Mus musculus
ggtggctggcctcttttatagagtt

SEQ ID NO: 653751 - DNA, 25 bp, Mus musculus
ggtggctggcctgttttatagagtt

SEQ ID NO: 653752 - DNA, 25 bp, Mus musculus
ggtggctggctcatgcttctcagag

SEQ ID NO: 653753 - DNA, 25 bp, Mus musculus
ggtggctggctcttgcttctcagag

SEQ ID NO: 653754 - DNA, 25 bp, Mus musculus
ggtggctggtccactctctaggact

SEQ ID NO: 653755 - DNA, 25 bp, Mus musculus
ggtggctggtcctctctctaggact

SEQ ID NO: 653756 - DNA, 25 bp, Mus musculus
ggtggctggttcaatgcctacgctc

SEQ ID NO: 653757 - DNA, 25 bp, Mus musculus
ggtggctggttctatgcctacgctc

SEQ ID NO: 653758 - DNA, 25 bp, Mus musculus
ggtggctgtcacagtaaggagttaa

SEQ ID NO: 653759 - DNA, 25 bp, Mus musculus
ggtggctgtcactgtaaggagttaa

SEQ ID NO: 653760 - DNA, 25 bp, Mus musculus
ggtggctgtccgcaagcagaaacta

SEQ ID NO: 653761 - DNA, 25 bp, Mus musculus
ggtggctgtccggaagcagaaacta

SEQ ID NO: 653762 - DNA, 25 bp, Mus musculus
ggtggctgtcttctggctcatttgt

SEQ ID NO: 653763 - DNA, 25 bp, Mus musculus
ggtggctgtcttgtggctcatttgt

SEQ ID NO: 653764 - DNA, 25 bp, Mus musculus
ggtggctgtgaccagaactacctca

SEQ ID NO: 653765 - DNA, 25 bp, Mus musculus
ggtggctgtgacgagaactacctca

SEQ ID NO: 653766 - DNA, 25 bp, Mus musculus
ggtggctgtgcaatacaaaaggtat

SEQ ID NO: 653767 - DNA, 25 bp, Mus musculus
ggtggctgtgcattacaaaaggtat

SEQ ID NO: 653768 - DNA, 25 bp, Mus musculus
ggtggctgtggcattaccattagta

SEQ ID NO: 653769 - DNA, 25 bp, Mus musculus
ggtggctgtggctttaccattagta

SEQ ID NO: 653770 - DNA, 25 bp, Mus musculus
ggtggctgtgtgcagtactactttc

SEQ ID NO: 653771 - DNA, 25 bp, Mus musculus
ggtggctgtgtggagtactactttc

SEQ ID NO: 653772 - DNA, 25 bp, Mus musculus
ggtggctgttgaagtgtcccctcct

SEQ ID NO: 653773 - DNA, 25 bp, Mus musculus
ggtggctgttgatgtgtcccctcct

SEQ ID NO: 653774 - DNA, 25 bp, Mus musculus
ggtggcttaatgctatatgcatgaa

SEQ ID NO: 653775 - DNA, 25 bp, Mus musculus
ggtggcttaatggtatatgcatgaa

SEQ ID NO: 653776 - DNA, 25 bp, Mus musculus
ggtggcttacatcctcaatcaaaac

SEQ ID NO: 653777 - DNA, 25 bp, Mus musculus
ggtggcttacatgctcaatcaaaac

SEQ ID NO: 653778 - DNA, 25 bp, Mus musculus
ggtggcttatctaggttggcaacct

SEQ ID NO: 653779 - DNA, 25 bp, Mus musculus
ggtggcttatcttggttggcaacct

SEQ ID NO: 653780 - DNA, 25 bp, Mus musculus
ggtggcttcaccattgatgacgtaa

SEQ ID NO: 653781 - DNA, 25 bp, Mus musculus
ggtggcttcacctttgatgacgtaa

SEQ ID NO: 653782 - DNA, 25 bp, Mus musculus
ggtggcttcagaaggaacccctgtg

SEQ ID NO: 653783 - DNA, 25 bp, Mus musculus
ggtggcttcagatggaacccctgtg

SEQ ID NO: 653784 - DNA, 25 bp, Mus musculus
ggtggcttccaacaaggtgtcatgt

SEQ ID NO: 653785 - DNA, 25 bp, Mus musculus
ggtggcttccaacgcacagcctgtg

SEQ ID NO: 653786 - DNA, 25 bp, Mus musculus
ggtggcttccaagaaggtgtcatgt

SEQ ID NO: 653787 - DNA, 25 bp, Mus musculus
ggtggcttccaaggcacagcctgtg

SEQ ID NO: 653788 - DNA, 25 bp, Mus musculus
ggtggcttccacagaacacaagagt

SEQ ID NO: 653789 - DNA, 25 bp, Mus musculus
ggtggcttccactgaacacaagagt

SEQ ID NO: 653790 - DNA, 25 bp, Mus musculus
ggtggcttgaacaagaactcaggga

SEQ ID NO: 653791 - DNA, 25 bp, Mus musculus
ggtggcttgaactagaactcaggga

SEQ ID NO: 653792 - DNA, 25 bp, Mus musculus
ggtggcttgagaaagtgccccaact

SEQ ID NO: 653793 - DNA, 25 bp, Mus musculus
ggtggcttgagatagtgccccaact

SEQ ID NO: 653794 - DNA, 25 bp, Mus musculus
ggtggcttgtccactgacaaagcaa

SEQ ID NO: 653795 - DNA, 25 bp, Mus musculus
ggtggcttgtcctctgacaaagcaa

SEQ ID NO: 653796 - DNA, 25 bp, Mus musculus
ggtggctttaatcagctaacctcca

SEQ ID NO: 653797 - DNA, 25 bp, Mus musculus
ggtggctttaatgagctaacctcca

SEQ ID NO: 653798 - DNA, 25 bp, Mus musculus
ggtggctttataatgcagataggaa

SEQ ID NO: 653799 - DNA, 25 bp, Mus musculus
ggtggctttatattgcagataggaa

SEQ ID NO: 653800 - DNA, 25 bp, Mus musculus
ggtggctttcaacatcaactctgtc

SEQ ID NO: 653801 - DNA, 25 bp, Mus musculus
ggtggctttcaagatcaactctgtc

SEQ ID NO: 653802 - DNA, 25 bp, Mus musculus
ggtggctttccaataacatgtattt

SEQ ID NO: 653803 - DNA, 25 bp, Mus musculus
ggtggctttccattaacatgtattt

SEQ ID NO: 653804 - DNA, 25 bp, Mus musculus
ggtggctttctcaatcaccacatct

SEQ ID NO: 653805 - DNA, 25 bp, Mus musculus
ggtggctttctctatcaccacatct

SEQ ID NO: 653806 - DNA, 25 bp, Mus musculus
ggtggctttgatcacttgtccatct

SEQ ID NO: 653807 - DNA, 25 bp, Mus musculus
ggtggctttgatgacttgtccatct

SEQ ID NO: 653808 - DNA, 25 bp, Mus musculus
ggtggctttgcgaagtgactgcccc

SEQ ID NO: 653809 - DNA, 25 bp, Mus musculus
ggtggctttgcgtagtgactgcccc

SEQ ID NO: 653810 - DNA, 25 bp, Mus musculus
ggtggctttgctctgagcacataca

SEQ ID NO: 653811 - DNA, 25 bp, Mus musculus
ggtggctttgctgtgagcacataca

SEQ ID NO: 653812 - DNA, 25 bp, Mus musculus
ggtggcttttgtataattggcttgg

SEQ ID NO: 653813 - DNA, 25 bp, Mus musculus
ggtggcttttgtttaattggcttgg

SEQ ID NO: 653814 - DNA, 25 bp, Mus musculus
ggtgggaaagacaccagaactccct

SEQ ID NO: 653815 - DNA, 25 bp, Mus musculus
ggtgggaaagactccagaactccct

SEQ ID NO: 653816 - DNA, 25 bp, Mus musculus
ggtgggaaagctactatctcatatg

SEQ ID NO: 653817 - DNA, 25 bp, Mus musculus
ggtgggaaagctcattctattctgc

SEQ ID NO: 653818 - DNA, 25 bp, Mus musculus
ggtgggaaagctgattctattctgc

SEQ ID NO: 653819 - DNA, 25 bp, Mus musculus
ggtgggaaagcttctatctcatatg

SEQ ID NO: 653820 - DNA, 25 bp, Mus musculus
ggtgggaaccagcttttccgaatca

SEQ ID NO: 653821 - DNA, 25 bp, Mus musculus
ggtgggaaccaggttttccgaatca

SEQ ID NO: 653822 - DNA, 25 bp, Mus musculus
ggtgggaaccctcccctcaaagatg

SEQ ID NO: 653823 - DNA, 25 bp, Mus musculus
ggtgggaaccctgccctcaaagatg

SEQ ID NO: 653824 - DNA, 25 bp, Mus musculus
ggtgggaagaacaccttctcttgga

SEQ ID NO: 653825 - DNA, 25 bp, Mus musculus
ggtgggaagaactccttctcttgga

SEQ ID NO: 653826 - DNA, 25 bp, Mus musculus
ggtgggaagccaacgtcatgcaagc

SEQ ID NO: 653827 - DNA, 25 bp, Mus musculus
ggtgggaagccatcgtcatgcaagc

SEQ ID NO: 653828 - DNA, 25 bp, Mus musculus
ggtgggacaaatcagtgccttccct

SEQ ID NO: 653829 - DNA, 25 bp, Mus musculus
ggtgggacaaatgagtgccttccct

SEQ ID NO: 653830 - DNA, 25 bp, Mus musculus
ggtgggacaacaagctttctactag

SEQ ID NO: 653831 - DNA, 25 bp, Mus musculus
ggtgggacaacatgctttctactag

SEQ ID NO: 653832 - DNA, 25 bp, Mus musculus
ggtgggacacataaaaaggtgagct

SEQ ID NO: 653833 - DNA, 25 bp, Mus musculus
ggtgggacacattaaaaggtgagct

SEQ ID NO: 653834 - DNA, 25 bp, Mus musculus
ggtgggacagctcccttccccggaa

SEQ ID NO: 653835 - DNA, 25 bp, Mus musculus
ggtgggacagctgccttccccggaa

SEQ ID NO: 653836 - DNA, 25 bp, Mus musculus
ggtgggacatatatgcctcttttac

SEQ ID NO: 653837 - DNA, 25 bp, Mus musculus
ggtgggacatatttgcctcttttac

SEQ ID NO: 653838 - DNA, 25 bp, Mus musculus
ggtgggaccaagcagatgccctcat

SEQ ID NO: 653839 - DNA, 25 bp, Mus musculus
ggtgggaccaaggagatgccctcat

SEQ ID NO: 653840 - DNA, 25 bp, Mus musculus
ggtgggaccacacctctgtaacgct

SEQ ID NO: 653841 - DNA, 25 bp, Mus musculus
ggtgggaccacagctctgtaacgct

SEQ ID NO: 653842 - DNA, 25 bp, Mus musculus
ggtgggacccaaatcagagattccc

SEQ ID NO: 653843 - DNA, 25 bp, Mus musculus
ggtgggacccaattcagagattccc

SEQ ID NO: 653844 - DNA, 25 bp, Mus musculus
ggtgggacccgacgacaatcttaca

SEQ ID NO: 653845 - DNA, 25 bp, Mus musculus
ggtgggacccgaggacaatcttaca

SEQ ID NO: 653846 - DNA, 25 bp, Mus musculus
ggtgggacctcaagaattttcttca

SEQ ID NO: 653847 - DNA, 25 bp, Mus musculus
ggtgggacctcatgaattttcttca

SEQ ID NO: 653848 - DNA, 25 bp, Mus musculus
ggtgggacgcacctttatctcagca

SEQ ID NO: 653849 - DNA, 25 bp, Mus musculus
ggtgggacgcacgtttatctcagca

SEQ ID NO: 653850 - DNA, 25 bp, Mus musculus
ggtgggagaaccagccggcagccgc

SEQ ID NO: 653851 - DNA, 25 bp, Mus musculus
ggtgggagaaccagtggccatcact

SEQ ID NO: 653852 - DNA, 25 bp, Mus musculus
ggtgggagaacctgccggcagccgc

SEQ ID NO: 653853 - DNA, 25 bp, Mus musculus
ggtgggagaacctgtggccatcact

SEQ ID NO: 653854 - DNA, 25 bp, Mus musculus
ggtgggagaccaacatggactcaat

SEQ ID NO: 653855 - DNA, 25 bp, Mus musculus
ggtgggagaccatcatggactcaat

SEQ ID NO: 653856 - DNA, 25 bp, Mus musculus
ggtgggagactgatgttgaaaccaa

SEQ ID NO: 653857 - DNA, 25 bp, Mus musculus
ggtgggagactgttgttgaaaccaa

SEQ ID NO: 653858 - DNA, 25 bp, Mus musculus
ggtgggagcgtcaattcacacacta

SEQ ID NO: 653859 - DNA, 25 bp, Mus musculus
ggtgggagcgtctattcacacacta

SEQ ID NO: 653860 - DNA, 25 bp, Mus musculus
ggtgggagctctccacttgaagcca

SEQ ID NO: 653861 - DNA, 25 bp, Mus musculus
ggtgggagctctgcacttgaagcca

SEQ ID NO: 653862 - DNA, 25 bp, Mus musculus
ggtgggatacctccaaaaactgtgt

SEQ ID NO: 653863 - DNA, 25 bp, Mus musculus
ggtgggatacctgcaaaaactgtgt

SEQ ID NO: 653864 - DNA, 25 bp, Mus musculus
ggtgggatagatattcttatctctc

SEQ ID NO: 653865 - DNA, 25 bp, Mus musculus
ggtgggatagattttcttatctctc

SEQ ID NO: 653866 - DNA, 25 bp, Mus musculus
ggtgggatatagcttccccatgatt

SEQ ID NO: 653867 - DNA, 25 bp, Mus musculus
ggtgggatataggttccccatgatt

SEQ ID NO: 653868 - DNA, 25 bp, Mus musculus
ggtgggatcgaacacgtatcctcca

SEQ ID NO: 653869 - DNA, 25 bp, Mus musculus
ggtgggatcgaagacgtatcctcca

SEQ ID NO: 653870 - DNA, 25 bp, Mus musculus
ggtgggatctccagatacaatctgg

SEQ ID NO: 653871 - DNA, 25 bp, Mus musculus
ggtgggatctcctgatacaatctgg

SEQ ID NO: 653872 - DNA, 25 bp, Mus musculus
ggtgggatctgcattctagaggaat

SEQ ID NO: 653873 - DNA, 25 bp, Mus musculus
ggtgggatctgctttctagaggaat

SEQ ID NO: 653874 - DNA, 25 bp, Mus musculus
ggtgggatgataattttacgtacaa

SEQ ID NO: 653875 - DNA, 25 bp, Mus musculus
ggtgggatgatatttttacgtacaa

SEQ ID NO: 653876 - DNA, 25 bp, Mus musculus
ggtgggatggatacactactgctaa

SEQ ID NO: 653877 - DNA, 25 bp, Mus musculus
ggtgggatggattcactactgctaa

SEQ ID NO: 653878 - DNA, 25 bp, Mus musculus
ggtgggattcttcctccaggtccaa

SEQ ID NO: 653879 - DNA, 25 bp, Mus musculus
ggtgggattcttgctccaggtccaa

SEQ ID NO: 653880 - DNA, 25 bp, Mus musculus
ggtgggatttgaacacagacaccac

SEQ ID NO: 653881 - DNA, 25 bp, Mus musculus
ggtgggatttgatcacagacaccac

SEQ ID NO: 653882 - DNA, 25 bp, Mus musculus
ggtgggcaacataggcagcttcttt

SEQ ID NO: 653883 - DNA, 25 bp, Mus musculus
ggtgggcaacattggcagcttcttt

SEQ ID NO: 653884 - DNA, 25 bp, Mus musculus
ggtgggcaactacgacaaactgaat

SEQ ID NO: 653885 - DNA, 25 bp, Mus musculus
ggtgggcaactaggacaaactgaat

SEQ ID NO: 653886 - DNA, 25 bp, Mus musculus
ggtgggcaccatcttcatcattcaa

SEQ ID NO: 653887 - DNA, 25 bp, Mus musculus
ggtgggcaccatgttcatcattcaa

SEQ ID NO: 653888 - DNA, 25 bp, Mus musculus
ggtgggcactataatgattccttaa

SEQ ID NO: 653889 - DNA, 25 bp, Mus musculus
ggtgggcactattatgattccttaa

SEQ ID NO: 653890 - DNA, 25 bp, Mus musculus
ggtgggcactgcagactttatatgt

SEQ ID NO: 653891 - DNA, 25 bp, Mus musculus
ggtgggcactgctgactttatatgt

SEQ ID NO: 653892 - DNA, 25 bp, Mus musculus
ggtgggcagatcactctaacacact

SEQ ID NO: 653893 - DNA, 25 bp, Mus musculus
ggtgggcagatctctctaacacact

SEQ ID NO: 653894 - DNA, 25 bp, Mus musculus
ggtgggcagattctccacaccactg

SEQ ID NO: 653895 - DNA, 25 bp, Mus musculus
ggtgggcagattgtccacaccactg

SEQ ID NO: 653896 - DNA, 25 bp, Mus musculus
ggtgggcagccgacctacctctgct

SEQ ID NO: 653897 - DNA, 25 bp, Mus musculus
ggtgggcagccgtcctacctctgct

SEQ ID NO: 653898 - DNA, 25 bp, Mus musculus
ggtgggcaggcaagaactcagacat

SEQ ID NO: 653899 - DNA, 25 bp, Mus musculus
ggtgggcaggcatgaactcagacat

SEQ ID NO: 653900 - DNA, 25 bp, Mus musculus
ggtgggcaggttcaaatcaaccaat

SEQ ID NO: 653901 - DNA, 25 bp, Mus musculus
ggtgggcaggttgaaatcaaccaat

SEQ ID NO: 653902 - DNA, 25 bp, Mus musculus
ggtgggcagtaccagctacacaaat

SEQ ID NO: 653903 - DNA, 25 bp, Mus musculus
ggtgggcagtacgagctacacaaat

SEQ ID NO: 653904 - DNA, 25 bp, Mus musculus
ggtgggcagttaccaattacttctc

SEQ ID NO: 653905 - DNA, 25 bp, Mus musculus
ggtgggcagttagcaattacttctc

SEQ ID NO: 653906 - DNA, 25 bp, Mus musculus
ggtgggcatctacttgagcagtttt

SEQ ID NO: 653907 - DNA, 25 bp, Mus musculus
ggtgggcatctagttgagcagtttt

SEQ ID NO: 653908 - DNA, 25 bp, Mus musculus
ggtgggccccgaaaccagtcatgtg

SEQ ID NO: 653909 - DNA, 25 bp, Mus musculus
ggtgggccccgataccagtcatgtg

SEQ ID NO: 653910 - DNA, 25 bp, Mus musculus
ggtgggcctatgactttataaaaca

SEQ ID NO: 653911 - DNA, 25 bp, Mus musculus
ggtgggcctatgtctttataaaaca

SEQ ID NO: 653912 - DNA, 25 bp, Mus musculus
ggtgggcctgggattgcttctgttt

SEQ ID NO: 653913 - DNA, 25 bp, Mus musculus
ggtgggcctgggtttgcttctgttt

SEQ ID NO: 653914 - DNA, 25 bp, Mus musculus
ggtgggccttaaaggacagccacca

SEQ ID NO: 653915 - DNA, 25 bp, Mus musculus
ggtgggccttaatggacagccacca

SEQ ID NO: 653916 - DNA, 25 bp, Mus musculus
ggtgggccttctcatatattttctt

SEQ ID NO: 653917 - DNA, 25 bp, Mus musculus
ggtgggccttctgatatattttctt

SEQ ID NO: 653918 - DNA, 25 bp, Mus musculus
ggtgggcgagacactggccatcatt

SEQ ID NO: 653919 - DNA, 25 bp, Mus musculus
ggtgggcgagactctggccatcatt

SEQ ID NO: 653920 - DNA, 25 bp, Mus musculus
ggtgggcgccgcaagccaagaaaac

SEQ ID NO: 653921 - DNA, 25 bp, Mus musculus
ggtgggcgccgctagccaagaaaac

SEQ ID NO: 653922 - DNA, 25 bp, Mus musculus
ggtgggctccgaatttatatcaatc

SEQ ID NO: 653923 - DNA, 25 bp, Mus musculus
ggtgggctccgattttatatcaatc

SEQ ID NO: 653924 - DNA, 25 bp, Mus musculus
ggtgggctgccaaatctgtttagca

SEQ ID NO: 653925 - DNA, 25 bp, Mus musculus
ggtgggctgccatatctgtttagca

SEQ ID NO: 653926 - DNA, 25 bp, Mus musculus
ggtgggctgcggactacaattcaac

SEQ ID NO: 653927 - DNA, 25 bp, Mus musculus
ggtgggctgcggtctacaattcaac

SEQ ID NO: 653928 - DNA, 25 bp, Mus musculus
ggtgggtaatcaacggctgccttta

SEQ ID NO: 653929 - DNA, 25 bp, Mus musculus
ggtgggtaatcatcggctgccttta

SEQ ID NO: 653930 - DNA, 25 bp, Mus musculus
ggtgggtagatcatgttttcaatat

SEQ ID NO: 653931 - DNA, 25 bp, Mus musculus
ggtgggtagatcttgttttcaatat

SEQ ID NO: 653932 - DNA, 25 bp, Mus musculus
ggtgggtaggctctctggttttcta

SEQ ID NO: 653933 - DNA, 25 bp, Mus musculus
ggtgggtaggctgtctggttttcta

SEQ ID NO: 653934 - DNA, 25 bp, Mus musculus
ggtgggtatatcatccgcagcatct

SEQ ID NO: 653935 - DNA, 25 bp, Mus musculus
ggtgggtatatcttccgcagcatct

SEQ ID NO: 653936 - DNA, 25 bp, Mus musculus
ggtgggtcacagacaacggctataa

SEQ ID NO: 653937 - DNA, 25 bp, Mus musculus
ggtgggtcacagtcaacggctataa

SEQ ID NO: 653938 - DNA, 25 bp, Mus musculus
ggtgggtcactcacagacatttagt

SEQ ID NO: 653939 - DNA, 25 bp, Mus musculus
ggtgggtcactctcagacatttagt

SEQ ID NO: 653940 - DNA, 25 bp, Mus musculus
ggtgggtcccaaaatacattgctaa

SEQ ID NO: 653941 - DNA, 25 bp, Mus musculus
ggtgggtcccaatatacattgctaa

SEQ ID NO: 653942 - DNA, 25 bp, Mus musculus
ggtgggtcctatagtaacaaccgct

SEQ ID NO: 653943 - DNA, 25 bp, Mus musculus
ggtgggtcctattgtaacaaccgct

SEQ ID NO: 653944 - DNA, 25 bp, Mus musculus
ggtgggtcctcgagcttctcagatc

SEQ ID NO: 653945 - DNA, 25 bp, Mus musculus
ggtgggtcctcgtgcttctcagatc

SEQ ID NO: 653946 - DNA, 25 bp, Mus musculus
ggtgggtctaaccatacaccagcat

SEQ ID NO: 653947 - DNA, 25 bp, Mus musculus
ggtgggtctaacgatacaccagcat

SEQ ID NO: 653948 - DNA, 25 bp, Mus musculus
ggtgggtctataaaatctgctctgt

SEQ ID NO: 653949 - DNA, 25 bp, Mus musculus
ggtgggtctatataatctgctctgt

SEQ ID NO: 653950 - DNA, 25 bp, Mus musculus
ggtgggtctcatcggcaccatctcc

SEQ ID NO: 653951 - DNA, 25 bp, Mus musculus
ggtgggtctcatgggcaccatctcc

SEQ ID NO: 653952 - DNA, 25 bp, Mus musculus
ggtgggtcttacaaatccgtccaga

SEQ ID NO: 653953 - DNA, 25 bp, Mus musculus
ggtgggtcttactaatccgtccaga

SEQ ID NO: 653954 - DNA, 25 bp, Mus musculus
ggtgggtgaattatctggtgccctt

SEQ ID NO: 653955 - DNA, 25 bp, Mus musculus
ggtgggtgaattttctggtgccctt

SEQ ID NO: 653956 - DNA, 25 bp, Mus musculus
ggtgggtggatcattcctgtagtct

SEQ ID NO: 653957 - DNA, 25 bp, Mus musculus
ggtgggtggatctttcctgtagtct

SEQ ID NO: 653958 - DNA, 25 bp, Mus musculus
ggtgggtggcagattctcgaacatt

SEQ ID NO: 653959 - DNA, 25 bp, Mus musculus
ggtgggtggcagtttctcgaacatt

SEQ ID NO: 653960 - DNA, 25 bp, Mus musculus
ggtgggtgggatacctcctctgtaa

SEQ ID NO: 653961 - DNA, 25 bp, Mus musculus
ggtgggtgggattcctcctctgtaa

SEQ ID NO: 653962 - DNA, 25 bp, Mus musculus
ggtgggtgggtaatcccatctcaaa

SEQ ID NO: 653963 - DNA, 25 bp, Mus musculus
ggtgggtgggtattcccatctcaaa

SEQ ID NO: 653964 - DNA, 25 bp, Mus musculus
ggtgggttacacaatagactggaat

SEQ ID NO: 653965 - DNA, 25 bp, Mus musculus
ggtgggttacactatagactggaat

SEQ ID NO: 653966 - DNA, 25 bp, Mus musculus
ggtgggttcaacatcatttagtggt

SEQ ID NO: 653967 - DNA, 25 bp, Mus musculus
ggtgggttcaacttcatttagtggt

SEQ ID NO: 653968 - DNA, 25 bp, Mus musculus
ggtgggttccgaagcctgttcatac

SEQ ID NO: 653969 - DNA, 25 bp, Mus musculus
ggtgggttccgatgcctgttcatac

SEQ ID NO: 653970 - DNA, 25 bp, Mus musculus
ggtgggttccttaaccacttgtcag

SEQ ID NO: 653971 - DNA, 25 bp, Mus musculus
ggtgggttcctttaccacttgtcag

SEQ ID NO: 653972 - DNA, 25 bp, Mus musculus
ggtgggttctaaccttcacgtcagc

SEQ ID NO: 653973 - DNA, 25 bp, Mus musculus
ggtgggttctaagcttcacgtcagc

SEQ ID NO: 653974 - DNA, 25 bp, Mus musculus
ggtgggttgcacatttcataaagca

SEQ ID NO: 653975 - DNA, 25 bp, Mus musculus
ggtgggttgcacttttcataaagca

SEQ ID NO: 653976 - DNA, 25 bp, Mus musculus
ggtgggttgctaagatcagtatgat

SEQ ID NO: 653977 - DNA, 25 bp, Mus musculus
ggtgggttgctatgatcagtatgat

SEQ ID NO: 653978 - DNA, 25 bp, Mus musculus
ggtgggttgtccaagcctagatcct

SEQ ID NO: 653979 - DNA, 25 bp, Mus musculus
ggtgggttgtcctagcctagatcct

SEQ ID NO: 653980 - DNA, 25 bp, Mus musculus
ggtgggtttcaaagaccgtgtgcta

SEQ ID NO: 653981 - DNA, 25 bp, Mus musculus
ggtgggtttcaatgaccgtgtgcta

SEQ ID NO: 653982 - DNA, 25 bp, Mus musculus
ggtgggttttgccagctagaaacat

SEQ ID NO: 653983 - DNA, 25 bp, Mus musculus
ggtgggttttgcgagctagaaacat

SEQ ID NO: 653984 - DNA, 25 bp, Mus musculus
ggtggtaaatatacagagtcctctg

SEQ ID NO: 653985 - DNA, 25 bp, Mus musculus
ggtggtaaatattcagagtcctctg

SEQ ID NO: 653986 - DNA, 25 bp, Mus musculus
ggtggtaaccatctgttatgcccat

SEQ ID NO: 653987 - DNA, 25 bp, Mus musculus
ggtggtaaccatgtgttatgcccat

SEQ ID NO: 653988 - DNA, 25 bp, Mus musculus
ggtggtaactacattgatgtcctag

SEQ ID NO: 653989 - DNA, 25 bp, Mus musculus
ggtggtaactactttgatgtcctag

SEQ ID NO: 653990 - DNA, 25 bp, Mus musculus
ggtggtaacttcacatctgtaggga

SEQ ID NO: 653991 - DNA, 25 bp, Mus musculus
ggtggtaacttctcatctgtaggga

SEQ ID NO: 653992 - DNA, 25 bp, Mus musculus
ggtggtaagcaaattccgggcagaa

SEQ ID NO: 653993 - DNA, 25 bp, Mus musculus
ggtggtaagcaatttccgggcagaa

SEQ ID NO: 653994 - DNA, 25 bp, Mus musculus
ggtggtacagacagccctcaggaac

SEQ ID NO: 653995 - DNA, 25 bp, Mus musculus
ggtggtacagactgccctcaggaac

SEQ ID NO: 653996 - DNA, 25 bp, Mus musculus
ggtggtacagatcccagtagcataa

SEQ ID NO: 653997 - DNA, 25 bp, Mus musculus
ggtggtacagatgccagtagcataa

SEQ ID NO: 653998 - DNA, 25 bp, Mus musculus
ggtggtacatccaagaacccatgtc

SEQ ID NO: 653999 - DNA, 25 bp, Mus musculus
ggtggtacatcctagaacccatgtc

SEQ ID NO: 654000 - DNA, 25 bp, Mus musculus
ggtggtacatgcctggaaacagcac

SEQ ID NO: 654001 - DNA, 25 bp, Mus musculus
ggtggtacatgcgtggaaacagcac

SEQ ID NO: 654002 - DNA, 25 bp, Mus musculus
ggtggtaccaatcgtgctggcacat

SEQ ID NO: 654003 - DNA, 25 bp, Mus musculus
ggtggtaccaatggtgctggcacat

SEQ ID NO: 654004 - DNA, 25 bp, Mus musculus
ggtggtaccaccctaagtatgctgg

SEQ ID NO: 654005 - DNA, 25 bp, Mus musculus
ggtggtaccaccgtaagtatgctgg

SEQ ID NO: 654006 - DNA, 25 bp, Mus musculus
ggtggtaccacgcagcacaaaggat

SEQ ID NO: 654007 - DNA, 25 bp, Mus musculus
ggtggtaccacggagcacaaaggat

SEQ ID NO: 654008 - DNA, 25 bp, Mus musculus
ggtggtaccttcattatggaaccca

SEQ ID NO: 654009 - DNA, 25 bp, Mus musculus
ggtggtaccttctttatggaaccca

SEQ ID NO: 654010 - DNA, 25 bp, Mus musculus
ggtggtacgtggattcttgatctaa

SEQ ID NO: 654011 - DNA, 25 bp, Mus musculus
ggtggtacgtggtttcttgatctaa

SEQ ID NO: 654012 - DNA, 25 bp, Mus musculus
ggtggtactggcaaccatgagatct

SEQ ID NO: 654013 - DNA, 25 bp, Mus musculus
ggtggtactggctaccatgagatct

SEQ ID NO: 654014 - DNA, 25 bp, Mus musculus
ggtggtacttacacaaaatcatcta

SEQ ID NO: 654015 - DNA, 25 bp, Mus musculus
ggtggtacttactcaaaatcatcta

SEQ ID NO: 654016 - DNA, 25 bp, Mus musculus
ggtggtagaactaatcccttactgt

SEQ ID NO: 654017 - DNA, 25 bp, Mus musculus
ggtggtagaacttatcccttactgt

SEQ ID NO: 654018 - DNA, 25 bp, Mus musculus
ggtggtagacatagaggctttccct

SEQ ID NO: 654019 - DNA, 25 bp, Mus musculus
ggtggtagacattgaggctttccct

SEQ ID NO: 654020 - DNA, 25 bp, Mus musculus
ggtggtagcattactcaaaaggcct

SEQ ID NO: 654021 - DNA, 25 bp, Mus musculus
ggtggtagcatttctcaaaaggcct

SEQ ID NO: 654022 - DNA, 25 bp, Mus musculus
ggtggtagccataagcttaagctgt

SEQ ID NO: 654023 - DNA, 25 bp, Mus musculus
ggtggtagccattagcttaagctgt

SEQ ID NO: 654024 - DNA, 25 bp, Mus musculus
ggtggtagctgtcctttactgcttc

SEQ ID NO: 654025 - DNA, 25 bp, Mus musculus
ggtggtagctgtgctttactgcttc

SEQ ID NO: 654026 - DNA, 25 bp, Mus musculus
ggtggtaggctccttatatctccaa

SEQ ID NO: 654027 - DNA, 25 bp, Mus musculus
ggtggtaggctcgttatatctccaa

SEQ ID NO: 654028 - DNA, 25 bp, Mus musculus
ggtggtaggtacagccctgtttgct

SEQ ID NO: 654029 - DNA, 25 bp, Mus musculus
ggtggtaggtactgccctgtttgct

SEQ ID NO: 654030 - DNA, 25 bp, Mus musculus
ggtggtagtatactctaaatcgcag

SEQ ID NO: 654031 - DNA, 25 bp, Mus musculus
ggtggtagtatagtctaaatcgcag

SEQ ID NO: 654032 - DNA, 25 bp, Mus musculus
ggtggtatataaatttctatctttt

SEQ ID NO: 654033 - DNA, 25 bp, Mus musculus
ggtggtatataattttctatctttt

SEQ ID NO: 654034 - DNA, 25 bp, Mus musculus
ggtggtatcttaaacataagcacac

SEQ ID NO: 654035 - DNA, 25 bp, Mus musculus
ggtggtatcttatacataagcacac

SEQ ID NO: 654036 - DNA, 25 bp, Mus musculus
ggtggtatgctccttgatactgacc

SEQ ID NO: 654037 - DNA, 25 bp, Mus musculus
ggtggtatgctcgttgatactgacc

SEQ ID NO: 654038 - DNA, 25 bp, Mus musculus
ggtggtatgttgacagccatctgaa

SEQ ID NO: 654039 - DNA, 25 bp, Mus musculus
ggtggtatgttgtcagccatctgaa

SEQ ID NO: 654040 - DNA, 25 bp, Mus musculus
ggtggtattcagcttatgtctacat

SEQ ID NO: 654041 - DNA, 25 bp, Mus musculus
ggtggtattcaggttatgtctacat

SEQ ID NO: 654042 - DNA, 25 bp, Mus musculus
ggtggtcaaacaccccttagtgagg

SEQ ID NO: 654043 - DNA, 25 bp, Mus musculus
ggtggtcaaacagcccttagtgagg

SEQ ID NO: 654044 - DNA, 25 bp, Mus musculus
ggtggtcaaaggcatcggcaaactt

SEQ ID NO: 654045 - DNA, 25 bp, Mus musculus
ggtggtcaaagggatcggcaaactt

SEQ ID NO: 654046 - DNA, 25 bp, Mus musculus
ggtggtcaacaaacccaacattttg

SEQ ID NO: 654047 - DNA, 25 bp, Mus musculus
ggtggtcaacaatcccaacattttg

SEQ ID NO: 654048 - DNA, 25 bp, Mus musculus
ggtggtcaatcaagcccagttggct

SEQ ID NO: 654049 - DNA, 25 bp, Mus musculus
ggtggtcaatcatgcccagttggct

SEQ ID NO: 654050 - DNA, 25 bp, Mus musculus
ggtggtcaattactatggtcctaaa

SEQ ID NO: 654051 - DNA, 25 bp, Mus musculus
ggtggtcaattagtatggtcctaaa

SEQ ID NO: 654052 - DNA, 25 bp, Mus musculus
ggtggtcaccaacttcaatgttcct

SEQ ID NO: 654053 - DNA, 25 bp, Mus musculus
ggtggtcaccaagttcaatgttcct

SEQ ID NO: 654054 - DNA, 25 bp, Mus musculus
ggtggtcaccatcctatagtttcag

SEQ ID NO: 654055 - DNA, 25 bp, Mus musculus
ggtggtcaccatgctatagtttcag

SEQ ID NO: 654056 - DNA, 25 bp, Mus musculus
ggtggtcacctcatagaatgaacat

SEQ ID NO: 654057 - DNA, 25 bp, Mus musculus
ggtggtcacctcttagaatgaacat

SEQ ID NO: 654058 - DNA, 25 bp, Mus musculus
ggtggtcacctgatttctgaagaca

SEQ ID NO: 654059 - DNA, 25 bp, Mus musculus
ggtggtcacctgcagagtttcttac

SEQ ID NO: 654060 - DNA, 25 bp, Mus musculus
ggtggtcacctggagagtttcttac

SEQ ID NO: 654061 - DNA, 25 bp, Mus musculus
ggtggtcacctgttttctgaagaca

SEQ ID NO: 654062 - DNA, 25 bp, Mus musculus
ggtggtcactgactgagcaatctca

SEQ ID NO: 654063 - DNA, 25 bp, Mus musculus
ggtggtcactgagtgagcaatctca

SEQ ID NO: 654064 - DNA, 25 bp, Mus musculus
ggtggtcactgcaggattagctcca

SEQ ID NO: 654065 - DNA, 25 bp, Mus musculus
ggtggtcactgctggattagctcca

SEQ ID NO: 654066 - DNA, 25 bp, Mus musculus
ggtggtcagcatcatcaacttcaag

SEQ ID NO: 654067 - DNA, 25 bp, Mus musculus
ggtggtcagcatgatcaacttcaag

SEQ ID NO: 654068 - DNA, 25 bp, Mus musculus
ggtggtcagcttagccataatcagc

SEQ ID NO: 654069 - DNA, 25 bp, Mus musculus
ggtggtcagctttgccataatcagc

SEQ ID NO: 654070 - DNA, 25 bp, Mus musculus
ggtggtcagtcaacagtgtcctcaa

SEQ ID NO: 654071 - DNA, 25 bp, Mus musculus
ggtggtcagtcatcagtgtcctcaa

SEQ ID NO: 654072 - DNA, 25 bp, Mus musculus
ggtggtcatcacagtctgtcaaaga

SEQ ID NO: 654073 - DNA, 25 bp, Mus musculus
ggtggtcatcactgtctgtcaaaga

SEQ ID NO: 654074 - DNA, 25 bp, Mus musculus
ggtggtcatgctataattcccagca

SEQ ID NO: 654075 - DNA, 25 bp, Mus musculus
ggtggtcatgctttaattcccagca

SEQ ID NO: 654076 - DNA, 25 bp, Mus musculus
ggtggtcattttcctagttgtctat

SEQ ID NO: 654077 - DNA, 25 bp, Mus musculus
ggtggtcattttgctagttgtctat

SEQ ID NO: 654078 - DNA, 25 bp, Mus musculus
ggtggtccacacagcaggaagcaca

SEQ ID NO: 654079 - DNA, 25 bp, Mus musculus
ggtggtccacactgcaggaagcaca

SEQ ID NO: 654080 - DNA, 25 bp, Mus musculus
ggtggtccagatctaccagacccac

SEQ ID NO: 654081 - DNA, 25 bp, Mus musculus
ggtggtccagatgtaccagacccac

SEQ ID NO: 654082 - DNA, 25 bp, Mus musculus
ggtggtccaggaagtcaacagcagt

SEQ ID NO: 654083 - DNA, 25 bp, Mus musculus
ggtggtccaggaatcagctaagaaa

SEQ ID NO: 654084 - DNA, 25 bp, Mus musculus
ggtggtccaggatgtcaacagcagt

SEQ ID NO: 654085 - DNA, 25 bp, Mus musculus
ggtggtccaggattcagctaagaaa

SEQ ID NO: 654086 - DNA, 25 bp, Mus musculus
ggtggtcctcagagaactgaattgc

SEQ ID NO: 654087 - DNA, 25 bp, Mus musculus
ggtggtcctcagtgaactgaattgc

SEQ ID NO: 654088 - DNA, 25 bp, Mus musculus
ggtggtccttacagcctaaagtgaa

SEQ ID NO: 654089 - DNA, 25 bp, Mus musculus
ggtggtccttactgcctaaagtgaa

SEQ ID NO: 654090 - DNA, 25 bp, Mus musculus
ggtggtccttcaccaagcccaagag

SEQ ID NO: 654091 - DNA, 25 bp, Mus musculus
ggtggtccttcagcaagcccaagag

SEQ ID NO: 654092 - DNA, 25 bp, Mus musculus
ggtggtcgaggaagaatgttcttca

SEQ ID NO: 654093 - DNA, 25 bp, Mus musculus
ggtggtcgaggatgaatgttcttca

SEQ ID NO: 654094 - DNA, 25 bp, Mus musculus
ggtggtcggaaacctatcataattt

SEQ ID NO: 654095 - DNA, 25 bp, Mus musculus
ggtggtcggaaagctatcataattt

SEQ ID NO: 654096 - DNA, 25 bp, Mus musculus
ggtggtcgtctcagctgtttatgaa

SEQ ID NO: 654097 - DNA, 25 bp, Mus musculus
ggtggtcgtctctgctgtttatgaa

SEQ ID NO: 654098 - DNA, 25 bp, Mus musculus
ggtggtcgtgccacggaatgctccc

SEQ ID NO: 654099 - DNA, 25 bp, Mus musculus
ggtggtcgtgcctcggaatgctccc

SEQ ID NO: 654100 - DNA, 25 bp, Mus musculus
ggtggtctaccactgctgacctgac

SEQ ID NO: 654101 - DNA, 25 bp, Mus musculus
ggtggtctaccagtgctgacctgac

SEQ ID NO: 654102 - DNA, 25 bp, Mus musculus
ggtggtcttaggagacctacaggtt

SEQ ID NO: 654103 - DNA, 25 bp, Mus musculus
ggtggtcttaggtgacctacaggtt

SEQ ID NO: 654104 - DNA, 25 bp, Mus musculus
ggtggtcttcacaagtgagttcata

SEQ ID NO: 654105 - DNA, 25 bp, Mus musculus
ggtggtcttcactagtgagttcata

SEQ ID NO: 654106 - DNA, 25 bp, Mus musculus
ggtggtctttaaagagccctgttgg

SEQ ID NO: 654107 - DNA, 25 bp, Mus musculus
ggtggtctttaatgagccctgttgg

SEQ ID NO: 654108 - DNA, 25 bp, Mus musculus
ggtggtgaagcactattttccaatt

SEQ ID NO: 654109 - DNA, 25 bp, Mus musculus
ggtggtgaagcagtattttccaatt

SEQ ID NO: 654110 - DNA, 25 bp, Mus musculus
ggtggtgaagtacccgcctaccctg

SEQ ID NO: 654111 - DNA, 25 bp, Mus musculus
ggtggtgaagtagccgcctaccctg

SEQ ID NO: 654112 - DNA, 25 bp, Mus musculus
ggtggtgaatgcatatcccgcaatt

SEQ ID NO: 654113 - DNA, 25 bp, Mus musculus
ggtggtgaatgcttatcccgcaatt

SEQ ID NO: 654114 - DNA, 25 bp, Mus musculus
ggtggtgacagactatgacctgcaa

SEQ ID NO: 654115 - DNA, 25 bp, Mus musculus
ggtggtgacagagtatgacctgcaa

SEQ ID NO: 654116 - DNA, 25 bp, Mus musculus
ggtggtgaccaaagtttctataggt

SEQ ID NO: 654117 - DNA, 25 bp, Mus musculus
ggtggtgaccaatgtttctataggt

SEQ ID NO: 654118 - DNA, 25 bp, Mus musculus
ggtggtgactcgaaagacacattca

SEQ ID NO: 654119 - DNA, 25 bp, Mus musculus
ggtggtgactcgtaagacacattca

SEQ ID NO: 654120 - DNA, 25 bp, Mus musculus
ggtggtgagacccttcctggctccc

SEQ ID NO: 654121 - DNA, 25 bp, Mus musculus
ggtggtgagaccgttcctggctccc

SEQ ID NO: 654122 - DNA, 25 bp, Mus musculus
ggtggtgagattattctccatgtaa

SEQ ID NO: 654123 - DNA, 25 bp, Mus musculus
ggtggtgagatttttctccatgtaa

SEQ ID NO: 654124 - DNA, 25 bp, Mus musculus
ggtggtgagccaccctgatactgac

SEQ ID NO: 654125 - DNA, 25 bp, Mus musculus
ggtggtgagccagcctgatactgac

SEQ ID NO: 654126 - DNA, 25 bp, Mus musculus
ggtggtgagcctatacatatgctaa

SEQ ID NO: 654127 - DNA, 25 bp, Mus musculus
ggtggtgagcctttacatatgctaa

SEQ ID NO: 654128 - DNA, 25 bp, Mus musculus
ggtggtgataagctactggtcaacc

SEQ ID NO: 654129 - DNA, 25 bp, Mus musculus
ggtggtgataaggtactggtcaacc

SEQ ID NO: 654130 - DNA, 25 bp, Mus musculus
ggtggtgatgacagccttcgcagac

SEQ ID NO: 654131 - DNA, 25 bp, Mus musculus
ggtggtgatgactgccttcgcagac

SEQ ID NO: 654132 - DNA, 25 bp, Mus musculus
ggtggtgatgatcgtccattctcac

SEQ ID NO: 654133 - DNA, 25 bp, Mus musculus
ggtggtgatgatggtccattctcac

SEQ ID NO: 654134 - DNA, 25 bp, Mus musculus
ggtggtgatgcgaattctcctgaaa

SEQ ID NO: 654135 - DNA, 25 bp, Mus musculus
ggtggtgatgcgtattctcctgaaa

SEQ ID NO: 654136 - DNA, 25 bp, Mus musculus
ggtggtgattcactgcactgtacat

SEQ ID NO: 654137 - DNA, 25 bp, Mus musculus
ggtggtgattcagtgcactgtacat

SEQ ID NO: 654138 - DNA, 25 bp, Mus musculus
ggtggtgattggcacagtatactta

SEQ ID NO: 654139 - DNA, 25 bp, Mus musculus
ggtggtgattgggacagtatactta

SEQ ID NO: 654140 - DNA, 25 bp, Mus musculus
ggtggtgcacacactgatgaaatca

SEQ ID NO: 654141 - DNA, 25 bp, Mus musculus
ggtggtgcacactctgatgaaatca

SEQ ID NO: 654142 - DNA, 25 bp, Mus musculus
ggtggtgcacagactggtcatagat

SEQ ID NO: 654143 - DNA, 25 bp, Mus musculus
ggtggtgcacagtctggtcatagat

SEQ ID NO: 654144 - DNA, 25 bp, Mus musculus
ggtggtgcacatctcagtatattcc

SEQ ID NO: 654145 - DNA, 25 bp, Mus musculus
ggtggtgcacatgtcagtatattcc

SEQ ID NO: 654146 - DNA, 25 bp, Mus musculus
ggtggtgcactaatcatcctagcag

SEQ ID NO: 654147 - DNA, 25 bp, Mus musculus
ggtggtgcactattcatcctagcag

SEQ ID NO: 654148 - DNA, 25 bp, Mus musculus
ggtggtgcatgacttaagtcccaga

SEQ ID NO: 654149 - DNA, 25 bp, Mus musculus
ggtggtgcatgagttaagtcccaga

SEQ ID NO: 654150 - DNA, 25 bp, Mus musculus
ggtggtgcctcacattaaacctatc

SEQ ID NO: 654151 - DNA, 25 bp, Mus musculus
ggtggtgcctcagattaaacctatc

SEQ ID NO: 654152 - DNA, 25 bp, Mus musculus
ggtggtgcctctcagcatggaactc

SEQ ID NO: 654153 - DNA, 25 bp, Mus musculus
ggtggtgcctctgagcatggaactc

SEQ ID NO: 654154 - DNA, 25 bp, Mus musculus
ggtggtgccttcatcagccacattc

SEQ ID NO: 654155 - DNA, 25 bp, Mus musculus
ggtggtgccttcttcagccacattc

SEQ ID NO: 654156 - DNA, 25 bp, Mus musculus
ggtggtgctaacagtgcgcaactat

SEQ ID NO: 654157 - DNA, 25 bp, Mus musculus
ggtggtgctaactgtgcgcaactat

SEQ ID NO: 654158 - DNA, 25 bp, Mus musculus
ggtggtgctgtgatggctctccttc

SEQ ID NO: 654159 - DNA, 25 bp, Mus musculus
ggtggtgctgtgttggctctccttc

SEQ ID NO: 654160 - DNA, 25 bp, Mus musculus
ggtggtggacatctggcccaaattt

SEQ ID NO: 654161 - DNA, 25 bp, Mus musculus
ggtggtggacatgtggcccaaattt

SEQ ID NO: 654162 - DNA, 25 bp, Mus musculus
ggtggtggcagcatgaattgattcc

SEQ ID NO: 654163 - DNA, 25 bp, Mus musculus
ggtggtggcagcttgaattgattcc

SEQ ID NO: 654164 - DNA, 25 bp, Mus musculus
ggtggtggcagtatgtttataactc

SEQ ID NO: 654165 - DNA, 25 bp, Mus musculus
ggtggtggcagtttgtttataactc

SEQ ID NO: 654166 - DNA, 25 bp, Mus musculus
ggtggtggccatagttcatcacact

SEQ ID NO: 654167 - DNA, 25 bp, Mus musculus
ggtggtggccattgttcatcacact

SEQ ID NO: 654168 - DNA, 25 bp, Mus musculus
ggtggtggcgatctgtctcttttac

SEQ ID NO: 654169 - DNA, 25 bp, Mus musculus
ggtggtggcgatgtgtctcttttac

SEQ ID NO: 654170 - DNA, 25 bp, Mus musculus
ggtggtggctttagcaacagcttga

SEQ ID NO: 654171 - DNA, 25 bp, Mus musculus
ggtggtggctttatattgcagatag

SEQ ID NO: 654172 - DNA, 25 bp, Mus musculus
ggtggtggcttttgcaacagcttga

SEQ ID NO: 654173 - DNA, 25 bp, Mus musculus
ggtggtggctttttattgcagatag

SEQ ID NO: 654174 - DNA, 25 bp, Mus musculus
ggtggtgggctacttcaacacatac

SEQ ID NO: 654175 - DNA, 25 bp, Mus musculus
ggtggtgggctagttcaacacatac

SEQ ID NO: 654176 - DNA, 25 bp, Mus musculus
ggtggtgggtacacaatactgctca

SEQ ID NO: 654177 - DNA, 25 bp, Mus musculus
ggtggtgggtactcaatactgctca

SEQ ID NO: 654178 - DNA, 25 bp, Mus musculus
ggtggtggtcacaaacacgatccca

SEQ ID NO: 654179 - DNA, 25 bp, Mus musculus
ggtggtggtcactaacacgatccca

SEQ ID NO: 654180 - DNA, 25 bp, Mus musculus
ggtggtggtgcaaggccgttcttag

SEQ ID NO: 654181 - DNA, 25 bp, Mus musculus
ggtggtggtgcatggccgttcttag

SEQ ID NO: 654182 - DNA, 25 bp, Mus musculus
ggtggtgtacagacctcatcagttt

SEQ ID NO: 654183 - DNA, 25 bp, Mus musculus
ggtggtgtacagtcctcatcagttt

SEQ ID NO: 654184 - DNA, 25 bp, Mus musculus
ggtggtgtacatattcagccccggt

SEQ ID NO: 654185 - DNA, 25 bp, Mus musculus
ggtggtgtacattttcagccccggt

SEQ ID NO: 654186 - DNA, 25 bp, Mus musculus
ggtggtgtaccaccaatgccttagg

SEQ ID NO: 654187 - DNA, 25 bp, Mus musculus
ggtggtgtaccagcaatgccttagg

SEQ ID NO: 654188 - DNA, 25 bp, Mus musculus
ggtggtgtactgagccatctgctgc

SEQ ID NO: 654189 - DNA, 25 bp, Mus musculus
ggtggtgtactgtgccatctgctgc

SEQ ID NO: 654190 - DNA, 25 bp, Mus musculus
ggtggtgtcaatactgctgttctta

SEQ ID NO: 654191 - DNA, 25 bp, Mus musculus
ggtggtgtcaattctgctgttctta

SEQ ID NO: 654192 - DNA, 25 bp, Mus musculus
ggtggtgtcagaagcacccactgaa

SEQ ID NO: 654193 - DNA, 25 bp, Mus musculus
ggtggtgtcagatgcacccactgaa

SEQ ID NO: 654194 - DNA, 25 bp, Mus musculus
ggtggtgtcatcaggttcgttccca

SEQ ID NO: 654195 - DNA, 25 bp, Mus musculus
ggtggtgtcatctggttcgttccca

SEQ ID NO: 654196 - DNA, 25 bp, Mus musculus
ggtggtgtctatatattccttcatg

SEQ ID NO: 654197 - DNA, 25 bp, Mus musculus
ggtggtgtctatttattccttcatg

SEQ ID NO: 654198 - DNA, 25 bp, Mus musculus
ggtggtgtctcgcatcaaacaggac

SEQ ID NO: 654199 - DNA, 25 bp, Mus musculus
ggtggtgtctcggatcaaacaggac

SEQ ID NO: 654200 - DNA, 25 bp, Mus musculus
ggtggtgtgaaaacttgtacttcaa

SEQ ID NO: 654201 - DNA, 25 bp, Mus musculus
ggtggtgtgaaatcttgtacttcaa

SEQ ID NO: 654202 - DNA, 25 bp, Mus musculus
ggtggtgtgaacagaacccagatac

SEQ ID NO: 654203 - DNA, 25 bp, Mus musculus
ggtggtgtgaactgaacccagatac

SEQ ID NO: 654204 - DNA, 25 bp, Mus musculus
ggtggtgtgacccacacctgcccga

SEQ ID NO: 654205 - DNA, 25 bp, Mus musculus
ggtggtgtgaccgacacctgcccga

SEQ ID NO: 654206 - DNA, 25 bp, Mus musculus
ggtggtgtggatctactccaagcta

SEQ ID NO: 654207 - DNA, 25 bp, Mus musculus
ggtggtgtggatgtactccaagcta

SEQ ID NO: 654208 - DNA, 25 bp, Mus musculus
ggtggtgttacaagcccaaggctat

SEQ ID NO: 654209 - DNA, 25 bp, Mus musculus
ggtggtgttacatgcccaaggctat

SEQ ID NO: 654210 - DNA, 25 bp, Mus musculus
ggtggtgttagaaatcttaattctt

SEQ ID NO: 654211 - DNA, 25 bp, Mus musculus
ggtggtgttagatatcttaattctt

SEQ ID NO: 654212 - DNA, 25 bp, Mus musculus
ggtggtgttccactcaggtgtacat

SEQ ID NO: 654213 - DNA, 25 bp, Mus musculus
ggtggtgttccagtcaggtgtacat

SEQ ID NO: 654214 - DNA, 25 bp, Mus musculus
ggtggtgttggcaattgctagacat

SEQ ID NO: 654215 - DNA, 25 bp, Mus musculus
ggtggtgttggctattgctagacat

SEQ ID NO: 654216 - DNA, 25 bp, Mus musculus
ggtggtgttgttatgtttacactgt

SEQ ID NO: 654217 - DNA, 25 bp, Mus musculus
ggtggtgttgttttgtttacactgt

SEQ ID NO: 654218 - DNA, 25 bp, Mus musculus
ggtggtgtttcaacgcgacagaatc

SEQ ID NO: 654219 - DNA, 25 bp, Mus musculus
ggtggtgtttcatcgcgacagaatc

SEQ ID NO: 654220 - DNA, 25 bp, Mus musculus
ggtggtgtttgtatactggatctaa

SEQ ID NO: 654221 - DNA, 25 bp, Mus musculus
ggtggtgtttgtcgaagcctctgaa

SEQ ID NO: 654222 - DNA, 25 bp, Mus musculus
ggtggtgtttgtggaagcctctgaa

SEQ ID NO: 654223 - DNA, 25 bp, Mus musculus
ggtggtgtttgtttactggatctaa

SEQ ID NO: 654224 - DNA, 25 bp, Mus musculus
ggtggttaacctatgacattcagat

SEQ ID NO: 654225 - DNA, 25 bp, Mus musculus
ggtggttaacctttgacattcagat

SEQ ID NO: 654226 - DNA, 25 bp, Mus musculus
ggtggttaagctctggtccagttat

SEQ ID NO: 654227 - DNA, 25 bp, Mus musculus
ggtggttaagctgtggtccagttat

SEQ ID NO: 654228 - DNA, 25 bp, Mus musculus
ggtggttaattcagtctgatacctg

SEQ ID NO: 654229 - DNA, 25 bp, Mus musculus
ggtggttaattctgtctgatacctg

SEQ ID NO: 654230 - DNA, 25 bp, Mus musculus
ggtggttacacaacccactcaaggg

SEQ ID NO: 654231 - DNA, 25 bp, Mus musculus
ggtggttacacatcccactcaaggg

SEQ ID NO: 654232 - DNA, 25 bp, Mus musculus
ggtggttacaccatctcagaaactc

SEQ ID NO: 654233 - DNA, 25 bp, Mus musculus
ggtggttacaccttctcagaaactc

SEQ ID NO: 654234 - DNA, 25 bp, Mus musculus
ggtggttactataagttctgggaca

SEQ ID NO: 654235 - DNA, 25 bp, Mus musculus
ggtggttactattagttctgggaca

SEQ ID NO: 654236 - DNA, 25 bp, Mus musculus
ggtggttagttaacccatgatgtaa

SEQ ID NO: 654237 - DNA, 25 bp, Mus musculus
ggtggttagttatcccatgatgtaa

SEQ ID NO: 654238 - DNA, 25 bp, Mus musculus
ggtggttatggcattaggagactac

SEQ ID NO: 654239 - DNA, 25 bp, Mus musculus
ggtggttatggctttaggagactac

SEQ ID NO: 654240 - DNA, 25 bp, Mus musculus
ggtggttattatcaagctgacccaa

SEQ ID NO: 654241 - DNA, 25 bp, Mus musculus
ggtggttattatgaagctgacccaa

SEQ ID NO: 654242 - DNA, 25 bp, Mus musculus
ggtggttcactgactgtatgatctt

SEQ ID NO: 654243 - DNA, 25 bp, Mus musculus
ggtggttcactgtctgtatgatctt

SEQ ID NO: 654244 - DNA, 25 bp, Mus musculus
ggtggttcagccatagtcccagcac

SEQ ID NO: 654245 - DNA, 25 bp, Mus musculus
ggtggttcagccttagtcccagcac

SEQ ID NO: 654246 - DNA, 25 bp, Mus musculus
ggtggttcctcccaatatgaatctt

SEQ ID NO: 654247 - DNA, 25 bp, Mus musculus
ggtggttcctccgaatatgaatctt

SEQ ID NO: 654248 - DNA, 25 bp, Mus musculus
ggtggttccttccagttcagataac

SEQ ID NO: 654249 - DNA, 25 bp, Mus musculus
ggtggttccttcgagttcagataac

SEQ ID NO: 654250 - DNA, 25 bp, Mus musculus
ggtggttcgttcatttcatctccca

SEQ ID NO: 654251 - DNA, 25 bp, Mus musculus
ggtggttcgttcttttcatctccca

SEQ ID NO: 654252 - DNA, 25 bp, Mus musculus
ggtggttctattagacagagcagat

SEQ ID NO: 654253 - DNA, 25 bp, Mus musculus
ggtggttctatttgacagagcagat

SEQ ID NO: 654254 - DNA, 25 bp, Mus musculus
ggtggttctcaaacgtatcaaactc

SEQ ID NO: 654255 - DNA, 25 bp, Mus musculus
ggtggttctcaatcgtatcaaactc

SEQ ID NO: 654256 - DNA, 25 bp, Mus musculus
ggtggttctcagctgtgtactgtaa

SEQ ID NO: 654257 - DNA, 25 bp, Mus musculus
ggtggttctcaggtgtgtactgtaa

SEQ ID NO: 654258 - DNA, 25 bp, Mus musculus
ggtggttctctgaactaaaggccag

SEQ ID NO: 654259 - DNA, 25 bp, Mus musculus
ggtggttctctgtactaaaggccag

SEQ ID NO: 654260 - DNA, 25 bp, Mus musculus
ggtggttctgaaagcctggcaggga

SEQ ID NO: 654261 - DNA, 25 bp, Mus musculus
ggtggttctgaatgcctggcaggga

SEQ ID NO: 654262 - DNA, 25 bp, Mus musculus
ggtggttcttgaagctcacccaaag

SEQ ID NO: 654263 - DNA, 25 bp, Mus musculus
ggtggttcttgatgctcacccaaag

SEQ ID NO: 654264 - DNA, 25 bp, Mus musculus
ggtggttctttgcaactagtttgga

SEQ ID NO: 654265 - DNA, 25 bp, Mus musculus
ggtggttctttggaactagtttgga

SEQ ID NO: 654266 - DNA, 25 bp, Mus musculus
ggtggttggcatatcacatattgat

SEQ ID NO: 654267 - DNA, 25 bp, Mus musculus
ggtggttggcatttcacatattgat

SEQ ID NO: 654268 - DNA, 25 bp, Mus musculus
ggtggttgtaatatgtttcttctct

SEQ ID NO: 654269 - DNA, 25 bp, Mus musculus
ggtggttgtaatttgtttcttctct

SEQ ID NO: 654270 - DNA, 25 bp, Mus musculus
ggtggttgtgaaactccttatgtag

SEQ ID NO: 654271 - DNA, 25 bp, Mus musculus
ggtggttgtgaatctccttatgtag

SEQ ID NO: 654272 - DNA, 25 bp, Mus musculus
ggtggttgtgtcagtgtctcctcag

SEQ ID NO: 654273 - DNA, 25 bp, Mus musculus
ggtggttgtgtctgtgtctcctcag

SEQ ID NO: 654274 - DNA, 25 bp, Mus musculus
ggtggtttacatctatcattctctg

SEQ ID NO: 654275 - DNA, 25 bp, Mus musculus
ggtggtttacatgtatcattctctg

SEQ ID NO: 654276 - DNA, 25 bp, Mus musculus
ggtggtttagtccaagtgatctctg

SEQ ID NO: 654277 - DNA, 25 bp, Mus musculus
ggtggtttagtcgaagtgatctctg

SEQ ID NO: 654278 - DNA, 25 bp, Mus musculus
ggtggtttatctctgtgcatcccat

SEQ ID NO: 654279 - DNA, 25 bp, Mus musculus
ggtggtttatctgtgtgcatcccat

SEQ ID NO: 654280 - DNA, 25 bp, Mus musculus
ggtggtttcacaccttctacagcat

SEQ ID NO: 654281 - DNA, 25 bp, Mus musculus
ggtggtttcacagcttctacagcat

SEQ ID NO: 654282 - DNA, 25 bp, Mus musculus
ggtggtttccagcaactcaggcctg

SEQ ID NO: 654283 - DNA, 25 bp, Mus musculus
ggtggtttccaggaactcaggcctg

SEQ ID NO: 654284 - DNA, 25 bp, Mus musculus
ggtggtttctatcgcccagaggcaa

SEQ ID NO: 654285 - DNA, 25 bp, Mus musculus
ggtggtttctatggcccagaggcaa

SEQ ID NO: 654286 - DNA, 25 bp, Mus musculus
ggtggtttgaagattcctcttcaga

SEQ ID NO: 654287 - DNA, 25 bp, Mus musculus
ggtggtttgaagtttcctcttcaga

SEQ ID NO: 654288 - DNA, 25 bp, Mus musculus
ggtggtttgcctaatcagtgggtta

SEQ ID NO: 654289 - DNA, 25 bp, Mus musculus
ggtggtttgccttatcagtgggtta

SEQ ID NO: 654290 - DNA, 25 bp, Mus musculus
ggtggtttgctcatttattgctttt

SEQ ID NO: 654291 - DNA, 25 bp, Mus musculus
ggtggtttgctcttttattgctttt

SEQ ID NO: 654292 - DNA, 25 bp, Mus musculus
ggtggtttgtcaactattcatgtaa

SEQ ID NO: 654293 - DNA, 25 bp, Mus musculus
ggtggtttgtcatctattcatgtaa

SEQ ID NO: 654294 - DNA, 25 bp, Mus musculus
ggtggtttgtttacactcccctgca

SEQ ID NO: 654295 - DNA, 25 bp, Mus musculus
ggtggtttgttttcactcccctgca

SEQ ID NO: 654296 - DNA, 25 bp, Mus musculus
ggtggttttaccaacatgagtcaga

SEQ ID NO: 654297 - DNA, 25 bp, Mus musculus
ggtggttttacctacatgagtcaga

SEQ ID NO: 654298 - DNA, 25 bp, Mus musculus
ggtggttttatccagtctctctgac

SEQ ID NO: 654299 - DNA, 25 bp, Mus musculus
ggtggttttatcgagtctctctgac

SEQ ID NO: 654300 - DNA, 25 bp, Mus musculus
ggtggttttatgagcttttgacttt

SEQ ID NO: 654301 - DNA, 25 bp, Mus musculus
ggtggttttatgtgcttttgacttt

SEQ ID NO: 654302 - DNA, 25 bp, Mus musculus
ggtggttttcacaattacaaaggag

SEQ ID NO: 654303 - DNA, 25 bp, Mus musculus
ggtggttttcacctgagtcttgatt

SEQ ID NO: 654304 - DNA, 25 bp, Mus musculus
ggtggttttcacgtgagtcttgatt

SEQ ID NO: 654305 - DNA, 25 bp, Mus musculus
ggtggttttcactattacaaaggag

SEQ ID NO: 654306 - DNA, 25 bp, Mus musculus
ggtggttttgcaaaaagctttgcca

SEQ ID NO: 654307 - DNA, 25 bp, Mus musculus
ggtggttttgcataaagctttgcca

SEQ ID NO: 654308 - DNA, 25 bp, Mus musculus
ggtggttttgctctatgcttactgt

SEQ ID NO: 654309 - DNA, 25 bp, Mus musculus
ggtggttttgctgtatgcttactgt

SEQ ID NO: 654310 - DNA, 25 bp, Mus musculus
ggtgtaaaaaatactagatgcacag

SEQ ID NO: 654311 - DNA, 25 bp, Mus musculus
ggtgtaaaaaattctagatgcacag

SEQ ID NO: 654312 - DNA, 25 bp, Mus musculus
ggtgtaaaaggacttcccctgatga

SEQ ID NO: 654313 - DNA, 25 bp, Mus musculus
ggtgtaaaaggagttcccctgatga

SEQ ID NO: 654314 - DNA, 25 bp, Mus musculus
ggtgtaaacactccttccgtgacta

SEQ ID NO: 654315 - DNA, 25 bp, Mus musculus
ggtgtaaacactgcttccgtgacta

SEQ ID NO: 654316 - DNA, 25 bp, Mus musculus
ggtgtaaactccctctatgtaattt

SEQ ID NO: 654317 - DNA, 25 bp, Mus musculus
ggtgtaaactccgtctatgtaattt

SEQ ID NO: 654318 - DNA, 25 bp, Mus musculus
ggtgtaaatttgaacagttcatgta

SEQ ID NO: 654319 - DNA, 25 bp, Mus musculus
ggtgtaaatttgtacagttcatgta

SEQ ID NO: 654320 - DNA, 25 bp, Mus musculus
ggtgtaacaactcataaattgctca

SEQ ID NO: 654321 - DNA, 25 bp, Mus musculus
ggtgtaacaactgataaattgctca

SEQ ID NO: 654322 - DNA, 25 bp, Mus musculus
ggtgtaacaccaaagatccctggcc

SEQ ID NO: 654323 - DNA, 25 bp, Mus musculus
ggtgtaacaccatagatccctggcc

SEQ ID NO: 654324 - DNA, 25 bp, Mus musculus
ggtgtaaccaatccgcaatcctctg

SEQ ID NO: 654325 - DNA, 25 bp, Mus musculus
ggtgtaaccaatgcgcaatcctctg

SEQ ID NO: 654326 - DNA, 25 bp, Mus musculus
ggtgtaaccccgagacttgagaggt

SEQ ID NO: 654327 - DNA, 25 bp, Mus musculus
ggtgtaaccccgtgacttgagaggt

SEQ ID NO: 654328 - DNA, 25 bp, Mus musculus
ggtgtaacctcacgcctctgggtga

SEQ ID NO: 654329 - DNA, 25 bp, Mus musculus
ggtgtaacctcaggcctctgggtga

SEQ ID NO: 654330 - DNA, 25 bp, Mus musculus
ggtgtaacgacacaaatccaagata

SEQ ID NO: 654331 - DNA, 25 bp, Mus musculus
ggtgtaacgacagaaatccaagata

SEQ ID NO: 654332 - DNA, 25 bp, Mus musculus
ggtgtaacttacagccaaggccatc

SEQ ID NO: 654333 - DNA, 25 bp, Mus musculus
ggtgtaacttactgccaaggccatc

SEQ ID NO: 654334 - DNA, 25 bp, Mus musculus
ggtgtaaggtcgaccctctcggtga

SEQ ID NO: 654335 - DNA, 25 bp, Mus musculus
ggtgtaaggtcgtccctctcggtga

SEQ ID NO: 654336 - DNA, 25 bp, Mus musculus
ggtgtaagtaccagctgttggaaga

SEQ ID NO: 654337 - DNA, 25 bp, Mus musculus
ggtgtaagtacctgctgttggaaga

SEQ ID NO: 654338 - DNA, 25 bp, Mus musculus
ggtgtaatcatcagtgcgctggcca

SEQ ID NO: 654339 - DNA, 25 bp, Mus musculus
ggtgtaatcatctgtgcgctggcca

SEQ ID NO: 654340 - DNA, 25 bp, Mus musculus
ggtgtaatccccattactacatgta

SEQ ID NO: 654341 - DNA, 25 bp, Mus musculus
ggtgtaatcccctttactacatgta

SEQ ID NO: 654342 - DNA, 25 bp, Mus musculus
ggtgtaatgcaaatcctatcaagac

SEQ ID NO: 654343 - DNA, 25 bp, Mus musculus
ggtgtaatgcaattcctatcaagac

SEQ ID NO: 654344 - DNA, 25 bp, Mus musculus
ggtgtaattctgatcagtctgccat

SEQ ID NO: 654345 - DNA, 25 bp, Mus musculus
ggtgtaattctgttcagtctgccat

SEQ ID NO: 654346 - DNA, 25 bp, Mus musculus
ggtgtaattgctagcctttttgttt

SEQ ID NO: 654347 - DNA, 25 bp, Mus musculus
ggtgtaattgcttgcctttttgttt

SEQ ID NO: 654348 - DNA, 25 bp, Mus musculus
ggtgtaatttacaatagtgttttga

SEQ ID NO: 654349 - DNA, 25 bp, Mus musculus
ggtgtaatttactatagtgttttga

SEQ ID NO: 654350 - DNA, 25 bp, Mus musculus
ggtgtaatttgtctcattgaaacta

SEQ ID NO: 654351 - DNA, 25 bp, Mus musculus
ggtgtaatttgtgtcattgaaacta

SEQ ID NO: 654352 - DNA, 25 bp, Mus musculus
ggtgtacaaagccaagtaccccatt

SEQ ID NO: 654353 - DNA, 25 bp, Mus musculus
ggtgtacaaagcgaagtaccccatt

SEQ ID NO: 654354 - DNA, 25 bp, Mus musculus
ggtgtacaacgtcttgaaggcattt

SEQ ID NO: 654355 - DNA, 25 bp, Mus musculus
ggtgtacaacgtgttgaaggcattt

SEQ ID NO: 654356 - DNA, 25 bp, Mus musculus
ggtgtacacaccatcttgacaagga

SEQ ID NO: 654357 - DNA, 25 bp, Mus musculus
ggtgtacacaccttcttgacaagga

SEQ ID NO: 654358 - DNA, 25 bp, Mus musculus
ggtgtacacataactggtccacagg

SEQ ID NO: 654359 - DNA, 25 bp, Mus musculus
ggtgtacacatatctggtccacagg

SEQ ID NO: 654360 - DNA, 25 bp, Mus musculus
ggtgtacacattattgctaattaga

SEQ ID NO: 654361 - DNA, 25 bp, Mus musculus
ggtgtacacatttttgctaattaga

SEQ ID NO: 654362 - DNA, 25 bp, Mus musculus
ggtgtacaccaccaagtacaactcc

SEQ ID NO: 654363 - DNA, 25 bp, Mus musculus
ggtgtacaccacgaagtacaactcc

SEQ ID NO: 654364 - DNA, 25 bp, Mus musculus
ggtgtacaccagacatttcgcagag

SEQ ID NO: 654365 - DNA, 25 bp, Mus musculus
ggtgtacaccagtcatttcgcagag

SEQ ID NO: 654366 - DNA, 25 bp, Mus musculus
ggtgtacacctgaagcctggatggt

SEQ ID NO: 654367 - DNA, 25 bp, Mus musculus
ggtgtacacctgtagcctggatggt

SEQ ID NO: 654368 - DNA, 25 bp, Mus musculus
ggtgtacactgcagctacagaaaca

SEQ ID NO: 654369 - DNA, 25 bp, Mus musculus
ggtgtacactgctgctacagaaaca

SEQ ID NO: 654370 - DNA, 25 bp, Mus musculus
ggtgtacacttgaaatcttactgct

SEQ ID NO: 654371 - DNA, 25 bp, Mus musculus
ggtgtacacttgtaatcttactgct

SEQ ID NO: 654372 - DNA, 25 bp, Mus musculus
ggtgtacagaaaaatatggtggcaa

SEQ ID NO: 654373 - DNA, 25 bp, Mus musculus
ggtgtacagaaatatatggtggcaa

SEQ ID NO: 654374 - DNA, 25 bp, Mus musculus
ggtgtacagaccacatcagtttaag

SEQ ID NO: 654375 - DNA, 25 bp, Mus musculus
ggtgtacagacctcatcagtttaag

SEQ ID NO: 654376 - DNA, 25 bp, Mus musculus
ggtgtacagagcattaaaatgcagt

SEQ ID NO: 654377 - DNA, 25 bp, Mus musculus
ggtgtacagagctttaaaatgcagt

SEQ ID NO: 654378 - DNA, 25 bp, Mus musculus
ggtgtacatagtcaggtttaggcca

SEQ ID NO: 654379 - DNA, 25 bp, Mus musculus
ggtgtacatagtgaggtttaggcca

SEQ ID NO: 654380 - DNA, 25 bp, Mus musculus
ggtgtacattgtacttatgggacta

SEQ ID NO: 654381 - DNA, 25 bp, Mus musculus
ggtgtacattgttcttatgggacta

SEQ ID NO: 654382 - DNA, 25 bp, Mus musculus
ggtgtacattttaaaagctgatcct

SEQ ID NO: 654383 - DNA, 25 bp, Mus musculus
ggtgtacatttttaaagctgatcct

SEQ ID NO: 654384 - DNA, 25 bp, Mus musculus
ggtgtaccacagaccatcgcaaatg

SEQ ID NO: 654385 - DNA, 25 bp, Mus musculus
ggtgtaccacagtccatcgcaaatg

SEQ ID NO: 654386 - DNA, 25 bp, Mus musculus
ggtgtaccaggacatgatctatgca

SEQ ID NO: 654387 - DNA, 25 bp, Mus musculus
ggtgtaccaggagatgatctatgca

SEQ ID NO: 654388 - DNA, 25 bp, Mus musculus
ggtgtaccccaacgttgctgagaac

SEQ ID NO: 654389 - DNA, 25 bp, Mus musculus
ggtgtaccccaaggttgctgagaac

SEQ ID NO: 654390 - DNA, 25 bp, Mus musculus
ggtgtaccctttcctggaacatatt

SEQ ID NO: 654391 - DNA, 25 bp, Mus musculus
ggtgtaccctttgctggaacatatt

SEQ ID NO: 654392 - DNA, 25 bp, Mus musculus
ggtgtacctaggacatttctcacta

SEQ ID NO: 654393 - DNA, 25 bp, Mus musculus
ggtgtacctaggtcatttctcacta

SEQ ID NO: 654394 - DNA, 25 bp, Mus musculus
ggtgtacctggcatcagcaaagatg

SEQ ID NO: 654395 - DNA, 25 bp, Mus musculus
ggtgtacctggcttcagcaaagatg

SEQ ID NO: 654396 - DNA, 25 bp, Mus musculus
ggtgtaccttttcgtgtgtaaccat

SEQ ID NO: 654397 - DNA, 25 bp, Mus musculus
ggtgtaccttttggtgtgtaaccat

SEQ ID NO: 654398 - DNA, 25 bp, Mus musculus
ggtgtacgcataaccttaggtttta

SEQ ID NO: 654399 - DNA, 25 bp, Mus musculus
ggtgtacgcatatccttaggtttta

SEQ ID NO: 654400 - DNA, 25 bp, Mus musculus
ggtgtactaactaccccacagatgg

SEQ ID NO: 654401 - DNA, 25 bp, Mus musculus
ggtgtactaacttccccacagatgg

SEQ ID NO: 654402 - DNA, 25 bp, Mus musculus
ggtgtactacagcaaatctttctaa

SEQ ID NO: 654403 - DNA, 25 bp, Mus musculus
ggtgtactacaggaaatctttctaa

SEQ ID NO: 654404 - DNA, 25 bp, Mus musculus
ggtgtactaccgatttgtcattcaa

SEQ ID NO: 654405 - DNA, 25 bp, Mus musculus
ggtgtactaccgttttgtcattcaa

SEQ ID NO: 654406 - DNA, 25 bp, Mus musculus
ggtgtactcaaaaatcagctctcta

SEQ ID NO: 654407 - DNA, 25 bp, Mus musculus
ggtgtactcaaatatcagctctcta

SEQ ID NO: 654408 - DNA, 25 bp, Mus musculus
ggtgtactgccccagtggagacaaa

SEQ ID NO: 654409 - DNA, 25 bp, Mus musculus
ggtgtactgcccgagtggagacaaa

SEQ ID NO: 654410 - DNA, 25 bp, Mus musculus
ggtgtactgcttactagattgttct

SEQ ID NO: 654411 - DNA, 25 bp, Mus musculus
ggtgtactgctttctagattgttct

SEQ ID NO: 654412 - DNA, 25 bp, Mus musculus
ggtgtagaaattcatcctttattct

SEQ ID NO: 654413 - DNA, 25 bp, Mus musculus
ggtgtagaaattgatcctttattct

SEQ ID NO: 654414 - DNA, 25 bp, Mus musculus
ggtgtagaactcatctcctgaactc

SEQ ID NO: 654415 - DNA, 25 bp, Mus musculus
ggtgtagaactcttctcctgaactc

SEQ ID NO: 654416 - DNA, 25 bp, Mus musculus
ggtgtagacattactgctgcagtca

SEQ ID NO: 654417 - DNA, 25 bp, Mus musculus
ggtgtagacatttctgctgcagtca

SEQ ID NO: 654418 - DNA, 25 bp, Mus musculus
ggtgtagattctagctctttcttct

SEQ ID NO: 654419 - DNA, 25 bp, Mus musculus
ggtgtagattcttgctctttcttct

SEQ ID NO: 654420 - DNA, 25 bp, Mus musculus
ggtgtagcaatgcattcctataatc

SEQ ID NO: 654421 - DNA, 25 bp, Mus musculus
ggtgtagcaatggattcctataatc

SEQ ID NO: 654422 - DNA, 25 bp, Mus musculus
ggtgtagcacataacctgccaggaa

SEQ ID NO: 654423 - DNA, 25 bp, Mus musculus
ggtgtagcacattacctgccaggaa

SEQ ID NO: 654424 - DNA, 25 bp, Mus musculus
ggtgtagcaggcattattacatatt

SEQ ID NO: 654425 - DNA, 25 bp, Mus musculus
ggtgtagcaggctttattacatatt

SEQ ID NO: 654426 - DNA, 25 bp, Mus musculus
ggtgtagcatagatactcaaagtaa

SEQ ID NO: 654427 - DNA, 25 bp, Mus musculus
ggtgtagcatagttactcaaagtaa

SEQ ID NO: 654428 - DNA, 25 bp, Mus musculus
ggtgtagccactacataaggtgcca

SEQ ID NO: 654429 - DNA, 25 bp, Mus musculus
ggtgtagccacttcataaggtgcca

SEQ ID NO: 654430 - DNA, 25 bp, Mus musculus
ggtgtagctacacagaaaccagctt

SEQ ID NO: 654431 - DNA, 25 bp, Mus musculus
ggtgtagctacagagaaaccagctt

SEQ ID NO: 654432 - DNA, 25 bp, Mus musculus
ggtgtagctcagatggtaagtagtt

SEQ ID NO: 654433 - DNA, 25 bp, Mus musculus
ggtgtagctcagttggtaagtagtt

SEQ ID NO: 654434 - DNA, 25 bp, Mus musculus
ggtgtagctgctcgttctacatctt

SEQ ID NO: 654435 - DNA, 25 bp, Mus musculus
ggtgtagctgctggttctacatctt

SEQ ID NO: 654436 - DNA, 25 bp, Mus musculus
ggtgtagcttatcaagccccttcac

SEQ ID NO: 654437 - DNA, 25 bp, Mus musculus
ggtgtagcttatgaagccccttcac

SEQ ID NO: 654438 - DNA, 25 bp, Mus musculus
ggtgtaggaagaatgcatgtgcaca

SEQ ID NO: 654439 - DNA, 25 bp, Mus musculus
ggtgtaggaagattgcatgtgcaca

SEQ ID NO: 654440 - DNA, 25 bp, Mus musculus
ggtgtaggccctcaagtcccaggaa

SEQ ID NO: 654441 - DNA, 25 bp, Mus musculus
ggtgtaggccctgaagtcccaggaa

SEQ ID NO: 654442 - DNA, 25 bp, Mus musculus
ggtgtagggagaacatattgtccta

SEQ ID NO: 654443 - DNA, 25 bp, Mus musculus
ggtgtagggagatcatattgtccta

SEQ ID NO: 654444 - DNA, 25 bp, Mus musculus
ggtgtaggtgttcctcttttgaatt

SEQ ID NO: 654445 - DNA, 25 bp, Mus musculus
ggtgtaggtgttgctcttttgaatt

SEQ ID NO: 654446 - DNA, 25 bp, Mus musculus
ggtgtagtaacacaggatgtcaaca

SEQ ID NO: 654447 - DNA, 25 bp, Mus musculus
ggtgtagtaacagaggatgtcaaca

SEQ ID NO: 654448 - DNA, 25 bp, Mus musculus
ggtgtagtaaccctatgccatcttc

SEQ ID NO: 654449 - DNA, 25 bp, Mus musculus
ggtgtagtaaccgtatgccatcttc

SEQ ID NO: 654450 - DNA, 25 bp, Mus musculus
ggtgtagtaggtaccacctagtgct

SEQ ID NO: 654451 - DNA, 25 bp, Mus musculus
ggtgtagtaggttccacctagtgct

SEQ ID NO: 654452 - DNA, 25 bp, Mus musculus
ggtgtagtgactaccaaagcccaag

SEQ ID NO: 654453 - DNA, 25 bp, Mus musculus
ggtgtagtgacttccaaagcccaag

SEQ ID NO: 654454 - DNA, 25 bp, Mus musculus
ggtgtagttgcacttttgatttgat

SEQ ID NO: 654455 - DNA, 25 bp, Mus musculus
ggtgtagttgcagttttgatttgat

SEQ ID NO: 654456 - DNA, 25 bp, Mus musculus
ggtgtataatttacaaagtctggat

SEQ ID NO: 654457 - DNA, 25 bp, Mus musculus
ggtgtataattttcaaagtctggat

SEQ ID NO: 654458 - DNA, 25 bp, Mus musculus
ggtgtatacaccaaggaacagaatg

SEQ ID NO: 654459 - DNA, 25 bp, Mus musculus
ggtgtatacacctaggaacagaatg

SEQ ID NO: 654460 - DNA, 25 bp, Mus musculus
ggtgtatacagacgtggctatgact

SEQ ID NO: 654461 - DNA, 25 bp, Mus musculus
ggtgtatacagaggtggctatgact

SEQ ID NO: 654462 - DNA, 25 bp, Mus musculus
ggtgtataccatagcattcagtcat

SEQ ID NO: 654463 - DNA, 25 bp, Mus musculus
ggtgtataccattgcattcagtcat

SEQ ID NO: 654464 - DNA, 25 bp, Mus musculus
ggtgtatacctgagatccggcacat

SEQ ID NO: 654465 - DNA, 25 bp, Mus musculus
ggtgtatacctgtgatccggcacat

SEQ ID NO: 654466 - DNA, 25 bp, Mus musculus
ggtgtatactttcatgactctggca

SEQ ID NO: 654467 - DNA, 25 bp, Mus musculus
ggtgtatactttgatgactctggca

SEQ ID NO: 654468 - DNA, 25 bp, Mus musculus
ggtgtatcaagccagaccaagaaca

SEQ ID NO: 654469 - DNA, 25 bp, Mus musculus
ggtgtatcaagcgagaccaagaaca

SEQ ID NO: 654470 - DNA, 25 bp, Mus musculus
ggtgtatcaatcactggaccagaaa

SEQ ID NO: 654471 - DNA, 25 bp, Mus musculus
ggtgtatcaatctctggaccagaaa

SEQ ID NO: 654472 - DNA, 25 bp, Mus musculus
ggtgtatcaatgactgacccagtta

SEQ ID NO: 654473 - DNA, 25 bp, Mus musculus
ggtgtatcaatgtctgacccagtta

SEQ ID NO: 654474 - DNA, 25 bp, Mus musculus
ggtgtatcagagatgacccacagga

SEQ ID NO: 654475 - DNA, 25 bp, Mus musculus
ggtgtatcagagttgacccacagga

SEQ ID NO: 654476 - DNA, 25 bp, Mus musculus
ggtgtatcagcactggccgttttcc

SEQ ID NO: 654477 - DNA, 25 bp, Mus musculus
ggtgtatcagcagtggccgttttcc

SEQ ID NO: 654478 - DNA, 25 bp, Mus musculus
ggtgtatcccaccaagaagcattca

SEQ ID NO: 654479 - DNA, 25 bp, Mus musculus
ggtgtatcccacgaagaagcattca

SEQ ID NO: 654480 - DNA, 25 bp, Mus musculus
ggtgtatctactaggtatggtacca

SEQ ID NO: 654481 - DNA, 25 bp, Mus musculus
ggtgtatctacttggtatggtacca

SEQ ID NO: 654482 - DNA, 25 bp, Mus musculus
ggtgtatctcaaagtgcggccggat

SEQ ID NO: 654483 - DNA, 25 bp, Mus musculus
ggtgtatctcaatgtgcggccggat

SEQ ID NO: 654484 - DNA, 25 bp, Mus musculus
ggtgtatctcccctgtgagtgtatt

SEQ ID NO: 654485 - DNA, 25 bp, Mus musculus
ggtgtatctcccgtgtgagtgtatt

SEQ ID NO: 654486 - DNA, 25 bp, Mus musculus
ggtgtatctgttctgttaacttctg

SEQ ID NO: 654487 - DNA, 25 bp, Mus musculus
ggtgtatctgttgtgttaacttctg

SEQ ID NO: 654488 - DNA, 25 bp, Mus musculus
ggtgtatgactcatgatgacggtct

SEQ ID NO: 654489 - DNA, 25 bp, Mus musculus
ggtgtatgactcttgatgacggtct

SEQ ID NO: 654490 - DNA, 25 bp, Mus musculus
ggtgtatgagctccggtttcagttc

SEQ ID NO: 654491 - DNA, 25 bp, Mus musculus
ggtgtatgagctgcggtttcagttc

SEQ ID NO: 654492 - DNA, 25 bp, Mus musculus
ggtgtatgcaccattcactgggaag

SEQ ID NO: 654493 - DNA, 25 bp, Mus musculus
ggtgtatgcacctttcactgggaag

SEQ ID NO: 654494 - DNA, 25 bp, Mus musculus
ggtgtatgcgtcactagaagcgtac

SEQ ID NO: 654495 - DNA, 25 bp, Mus musculus
ggtgtatgcgtctctagaagcgtac

SEQ ID NO: 654496 - DNA, 25 bp, Mus musculus
ggtgtatggcaaaatccgagctgtg

SEQ ID NO: 654497 - DNA, 25 bp, Mus musculus
ggtgtatggcaatatccgagctgtg

SEQ ID NO: 654498 - DNA, 25 bp, Mus musculus
ggtgtatgtaaaagagtagcttgtt

SEQ ID NO: 654499 - DNA, 25 bp, Mus musculus
ggtgtatgtaaatgagtagcttgtt

SEQ ID NO: 654500 - DNA, 25 bp, Mus musculus
ggtgtatgtggacatggcatccttt

SEQ ID NO: 654501 - DNA, 25 bp, Mus musculus
ggtgtatgtggagatggcatccttt

SEQ ID NO: 654502 - DNA, 25 bp, Mus musculus
ggtgtattactgatgattcactttg

SEQ ID NO: 654503 - DNA, 25 bp, Mus musculus
ggtgtattactgttgattcactttg

SEQ ID NO: 654504 - DNA, 25 bp, Mus musculus
ggtgtattatcaccacgcgatccat

SEQ ID NO: 654505 - DNA, 25 bp, Mus musculus
ggtgtattatcagcacgcgatccat

SEQ ID NO: 654506 - DNA, 25 bp, Mus musculus
ggtgtattggacacaccaattcctt

SEQ ID NO: 654507 - DNA, 25 bp, Mus musculus
ggtgtattggactcaccaattcctt

SEQ ID NO: 654508 - DNA, 25 bp, Mus musculus
ggtgtattgttccaaattctgactg

SEQ ID NO: 654509 - DNA, 25 bp, Mus musculus
ggtgtattgttcgaaattctgactg

SEQ ID NO: 654510 - DNA, 25 bp, Mus musculus
ggtgtatttacgatttcagctctaa

SEQ ID NO: 654511 - DNA, 25 bp, Mus musculus
ggtgtatttacgttttcagctctaa

SEQ ID NO: 654512 - DNA, 25 bp, Mus musculus
ggtgtcaaaccaagaacctttatgt

SEQ ID NO: 654513 - DNA, 25 bp, Mus musculus
ggtgtcaaaccatgaacctttatgt

SEQ ID NO: 654514 - DNA, 25 bp, Mus musculus
ggtgtcaaacctactgtcacacagt

SEQ ID NO: 654515 - DNA, 25 bp, Mus musculus
ggtgtcaaaccttctgtcacacagt

SEQ ID NO: 654516 - DNA, 25 bp, Mus musculus
ggtgtcaaagaacccgggtctgtct

SEQ ID NO: 654517 - DNA, 25 bp, Mus musculus
ggtgtcaaagaagccgggtctgtct

SEQ ID NO: 654518 - DNA, 25 bp, Mus musculus
ggtgtcaacagcactgcctttggag

SEQ ID NO: 654519 - DNA, 25 bp, Mus musculus
ggtgtcaacagctctgcctttggag

SEQ ID NO: 654520 - DNA, 25 bp, Mus musculus
ggtgtcaacctaaaattatggtcat

SEQ ID NO: 654521 - DNA, 25 bp, Mus musculus
ggtgtcaacctataattatggtcat

SEQ ID NO: 654522 - DNA, 25 bp, Mus musculus
ggtgtcaagacactgatctgagcta

SEQ ID NO: 654523 - DNA, 25 bp, Mus musculus
ggtgtcaagacagtgatctgagcta

SEQ ID NO: 654524 - DNA, 25 bp, Mus musculus
ggtgtcaagcaacgacgagccagct

SEQ ID NO: 654525 - DNA, 25 bp, Mus musculus
ggtgtcaagcaaggacgagccagct

SEQ ID NO: 654526 - DNA, 25 bp, Mus musculus
ggtgtcaagcagaccagaagctctt

SEQ ID NO: 654527 - DNA, 25 bp, Mus musculus
ggtgtcaagcagtccagaagctctt

SEQ ID NO: 654528 - DNA, 25 bp, Mus musculus
ggtgtcaatgacagcacatgccaga

SEQ ID NO: 654529 - DNA, 25 bp, Mus musculus
ggtgtcaatgactgcacatgccaga

SEQ ID NO: 654530 - DNA, 25 bp, Mus musculus
ggtgtcacactccaagtactcggga

SEQ ID NO: 654531 - DNA, 25 bp, Mus musculus
ggtgtcacactcgaagtactcggga

SEQ ID NO: 654532 - DNA, 25 bp, Mus musculus
ggtgtcacagaactgggcactaaaa

SEQ ID NO: 654533 - DNA, 25 bp, Mus musculus
ggtgtcacagaagtgggcactaaaa

SEQ ID NO: 654534 - DNA, 25 bp, Mus musculus
ggtgtcaccaagaactttccagcgt

SEQ ID NO: 654535 - DNA, 25 bp, Mus musculus
ggtgtcaccaagtactttccagcgt

SEQ ID NO: 654536 - DNA, 25 bp, Mus musculus
ggtgtcacccacagacacagttgat

SEQ ID NO: 654537 - DNA, 25 bp, Mus musculus
ggtgtcacccactgacacagttgat

SEQ ID NO: 654538 - DNA, 25 bp, Mus musculus
ggtgtcaccctgacaggattcctgt

SEQ ID NO: 654539 - DNA, 25 bp, Mus musculus
ggtgtcaccctgtcaggattcctgt

SEQ ID NO: 654540 - DNA, 25 bp, Mus musculus
ggtgtcaccggcacagagaaaaagc

SEQ ID NO: 654541 - DNA, 25 bp, Mus musculus
ggtgtcaccggctcagagaaaaagc

SEQ ID NO: 654542 - DNA, 25 bp, Mus musculus
ggtgtcaccttacctcatgagaatg

SEQ ID NO: 654543 - DNA, 25 bp, Mus musculus
ggtgtcaccttagctcatgagaatg

SEQ ID NO: 654544 - DNA, 25 bp, Mus musculus
ggtgtcacgtgaagctgccattcca

SEQ ID NO: 654545 - DNA, 25 bp, Mus musculus
ggtgtcacgtgatgctgccattcca

SEQ ID NO: 654546 - DNA, 25 bp, Mus musculus
ggtgtcactcctaagtcagcttaat

SEQ ID NO: 654547 - DNA, 25 bp, Mus musculus
ggtgtcactccttagtcagcttaat

SEQ ID NO: 654548 - DNA, 25 bp, Mus musculus
ggtgtcactgaaacctggctactaa

SEQ ID NO: 654549 - DNA, 25 bp, Mus musculus
ggtgtcactgaatcctggctactaa

SEQ ID NO: 654550 - DNA, 25 bp, Mus musculus
ggtgtcactgcacttacacgtgtct

SEQ ID NO: 654551 - DNA, 25 bp, Mus musculus
ggtgtcactgcagttacacgtgtct

SEQ ID NO: 654552 - DNA, 25 bp, Mus musculus
ggtgtcagagacaagatcaaagtgc

SEQ ID NO: 654553 - DNA, 25 bp, Mus musculus
ggtgtcagagactagatcaaagtgc

SEQ ID NO: 654554 - DNA, 25 bp, Mus musculus
ggtgtcagaggcaaccagggttcca

SEQ ID NO: 654555 - DNA, 25 bp, Mus musculus
ggtgtcagaggctaccagggttcca

SEQ ID NO: 654556 - DNA, 25 bp, Mus musculus
ggtgtcagcaaccatggcatcgagt

SEQ ID NO: 654557 - DNA, 25 bp, Mus musculus
ggtgtcagcaacgatggcatcgagt

SEQ ID NO: 654558 - DNA, 25 bp, Mus musculus
ggtgtcagcccacgcaaaatcgcga

SEQ ID NO: 654559 - DNA, 25 bp, Mus musculus
ggtgtcagcccaggcaaaatcgcga

SEQ ID NO: 654560 - DNA, 25 bp, Mus musculus
ggtgtcagcgagcaagccccttcaa

SEQ ID NO: 654561 - DNA, 25 bp, Mus musculus
ggtgtcagcgaggaagccccttcaa

SEQ ID NO: 654562 - DNA, 25 bp, Mus musculus
ggtgtcaggacacttgccaaaggct

SEQ ID NO: 654563 - DNA, 25 bp, Mus musculus
ggtgtcaggacagttgccaaaggct

SEQ ID NO: 654564 - DNA, 25 bp, Mus musculus
ggtgtcaggcatatctggccgcgtg

SEQ ID NO: 654565 - DNA, 25 bp, Mus musculus
ggtgtcaggcatttctggccgcgtg

SEQ ID NO: 654566 - DNA, 25 bp, Mus musculus
ggtgtcaggtacaccataggtcaac

SEQ ID NO: 654567 - DNA, 25 bp, Mus musculus
ggtgtcaggtactccataggtcaac

SEQ ID NO: 654568 - DNA, 25 bp, Mus musculus
ggtgtcatacttacttttagctgga

SEQ ID NO: 654569 - DNA, 25 bp, Mus musculus
ggtgtcatactttcttttagctgga

SEQ ID NO: 654570 - DNA, 25 bp, Mus musculus
ggtgtcatcacacctggttttatgg

SEQ ID NO: 654571 - DNA, 25 bp, Mus musculus
ggtgtcatcacagctggttttatgg

SEQ ID NO: 654572 - DNA, 25 bp, Mus musculus
ggtgtcatcaccacaaccatgacag

SEQ ID NO: 654573 - DNA, 25 bp, Mus musculus
ggtgtcatcacctcaaccatgacag

SEQ ID NO: 654574 - DNA, 25 bp, Mus musculus
ggtgtcatcccacacatccacaaat

SEQ ID NO: 654575 - DNA, 25 bp, Mus musculus
ggtgtcatcccagacatccacaaat

SEQ ID NO: 654576 - DNA, 25 bp, Mus musculus
ggtgtcatctcgctattttgaatgt

SEQ ID NO: 654577 - DNA, 25 bp, Mus musculus
ggtgtcatctcggtattttgaatgt

SEQ ID NO: 654578 - DNA, 25 bp, Mus musculus
ggtgtcattgaaagcttactcttat

SEQ ID NO: 654579 - DNA, 25 bp, Mus musculus
ggtgtcattgaatgcttactcttat

SEQ ID NO: 654580 - DNA, 25 bp, Mus musculus
ggtgtcattgtgactgcgtccagaa

SEQ ID NO: 654581 - DNA, 25 bp, Mus musculus
ggtgtcattgtgtctgcgtccagaa

SEQ ID NO: 654582 - DNA, 25 bp, Mus musculus
ggtgtcatttacagaatctttccca

SEQ ID NO: 654583 - DNA, 25 bp, Mus musculus
ggtgtcatttacagtcattgtttca

SEQ ID NO: 654584 - DNA, 25 bp, Mus musculus
ggtgtcatttactgaatctttccca

SEQ ID NO: 654585 - DNA, 25 bp, Mus musculus
ggtgtcatttactgtcattgtttca

SEQ ID NO: 654586 - DNA, 25 bp, Mus musculus
ggtgtcatttataatcgctgctacg

SEQ ID NO: 654587 - DNA, 25 bp, Mus musculus
ggtgtcatttattatcgctgctacg

SEQ ID NO: 654588 - DNA, 25 bp, Mus musculus
ggtgtcattttcacaatgtcactgt

SEQ ID NO: 654589 - DNA, 25 bp, Mus musculus
ggtgtcattttctcaatgtcactgt

SEQ ID NO: 654590 - DNA, 25 bp, Mus musculus
ggtgtccaaaccaagagccaagcct

SEQ ID NO: 654591 - DNA, 25 bp, Mus musculus
ggtgtccaaacctagagccaagcct

SEQ ID NO: 654592 - DNA, 25 bp, Mus musculus
ggtgtccaaggccagctttaaaatg

SEQ ID NO: 654593 - DNA, 25 bp, Mus musculus
ggtgtccaaggcgagctttaaaatg

SEQ ID NO: 654594 - DNA, 25 bp, Mus musculus
ggtgtccaatacacgagggattgtt

SEQ ID NO: 654595 - DNA, 25 bp, Mus musculus
ggtgtccaatactcgagggattgtt

SEQ ID NO: 654596 - DNA, 25 bp, Mus musculus
ggtgtccacagccaagtctgctcat

SEQ ID NO: 654597 - DNA, 25 bp, Mus musculus
ggtgtccacagcgaagtctgctcat

SEQ ID NO: 654598 - DNA, 25 bp, Mus musculus
ggtgtccacatcagaggcatgccgt

SEQ ID NO: 654599 - DNA, 25 bp, Mus musculus
ggtgtccacatctgaggcatgccgt

SEQ ID NO: 654600 - DNA, 25 bp, Mus musculus
ggtgtccactaaaatgttgggtgac

SEQ ID NO: 654601 - DNA, 25 bp, Mus musculus
ggtgtccactaatatgttgggtgac

SEQ ID NO: 654602 - DNA, 25 bp, Mus musculus
ggtgtccacttgaagatttctttca

SEQ ID NO: 654603 - DNA, 25 bp, Mus musculus
ggtgtccacttgtagatttctttca

SEQ ID NO: 654604 - DNA, 25 bp, Mus musculus
ggtgtccaggcacgcgtccgttcaa

SEQ ID NO: 654605 - DNA, 25 bp, Mus musculus
ggtgtccaggcaggcgtccgttcaa

SEQ ID NO: 654606 - DNA, 25 bp, Mus musculus
ggtgtccatcacaacagaggcatca

SEQ ID NO: 654607 - DNA, 25 bp, Mus musculus
ggtgtccatcactacagaggcatca

SEQ ID NO: 654608 - DNA, 25 bp, Mus musculus
ggtgtccatcataggaatcgccatg

SEQ ID NO: 654609 - DNA, 25 bp, Mus musculus
ggtgtccatcattggaatcgccatg

SEQ ID NO: 654610 - DNA, 25 bp, Mus musculus
ggtgtcccaaagaagctgtagtttt

SEQ ID NO: 654611 - DNA, 25 bp, Mus musculus
ggtgtcccaaagtagctgtagtttt

SEQ ID NO: 654612 - DNA, 25 bp, Mus musculus
ggtgtcccaaccagtcagcaataga

SEQ ID NO: 654613 - DNA, 25 bp, Mus musculus
ggtgtcccaacctgtcagcaataga

SEQ ID NO: 654614 - DNA, 25 bp, Mus musculus
ggtgtcccactaccgtgttactatt

SEQ ID NO: 654615 - DNA, 25 bp, Mus musculus
ggtgtcccactagcgtgttactatt

SEQ ID NO: 654616 - DNA, 25 bp, Mus musculus
ggtgtcccgtctaatggagatccat

SEQ ID NO: 654617 - DNA, 25 bp, Mus musculus
ggtgtcccgtcttatggagatccat

SEQ ID NO: 654618 - DNA, 25 bp, Mus musculus
ggtgtccctaaaagtctattctttt

SEQ ID NO: 654619 - DNA, 25 bp, Mus musculus
ggtgtccctaaatgtctattctttt

SEQ ID NO: 654620 - DNA, 25 bp, Mus musculus
ggtgtccctggacgagatctaccat

SEQ ID NO: 654621 - DNA, 25 bp, Mus musculus
ggtgtccctggaggagatctaccat

SEQ ID NO: 654622 - DNA, 25 bp, Mus musculus
ggtgtccctgtactgggaatcccac

SEQ ID NO: 654623 - DNA, 25 bp, Mus musculus
ggtgtccctgtagtgggaatcccac

SEQ ID NO: 654624 - DNA, 25 bp, Mus musculus
ggtgtccctgtgaccaaagctatag

SEQ ID NO: 654625 - DNA, 25 bp, Mus musculus
ggtgtccctgtgtccaaagctatag

SEQ ID NO: 654626 - DNA, 25 bp, Mus musculus
ggtgtccgtaaaattctggaatttg

SEQ ID NO: 654627 - DNA, 25 bp, Mus musculus
ggtgtccgtaaatttctggaatttg

SEQ ID NO: 654628 - DNA, 25 bp, Mus musculus
ggtgtcctacgaaggtctcaaccag

SEQ ID NO: 654629 - DNA, 25 bp, Mus musculus
ggtgtcctacgatggtctcaaccag

SEQ ID NO: 654630 - DNA, 25 bp, Mus musculus
ggtgtcctagaaatggccagagttt

SEQ ID NO: 654631 - DNA, 25 bp, Mus musculus
ggtgtcctagaattggccagagttt

SEQ ID NO: 654632 - DNA, 25 bp, Mus musculus
ggtgtcctagccattgcgcagcaat

SEQ ID NO: 654633 - DNA, 25 bp, Mus musculus
ggtgtcctagcctttgcgcagcaat

SEQ ID NO: 654634 - DNA, 25 bp, Mus musculus
ggtgtcctagcgcacactctggaac

SEQ ID NO: 654635 - DNA, 25 bp, Mus musculus
ggtgtcctagcggacactctggaac

SEQ ID NO: 654636 - DNA, 25 bp, Mus musculus
ggtgtcctatgaatacagcgcgggc

SEQ ID NO: 654637 - DNA, 25 bp, Mus musculus
ggtgtcctatgattacagcgcgggc

SEQ ID NO: 654638 - DNA, 25 bp, Mus musculus
ggtgtcctcaacacctgaaaaagca

SEQ ID NO: 654639 - DNA, 25 bp, Mus musculus
ggtgtcctcaactcctgaaaaagca

SEQ ID NO: 654640 - DNA, 25 bp, Mus musculus
ggtgtcctccagctgttccaggtcg

SEQ ID NO: 654641 - DNA, 25 bp, Mus musculus
ggtgtcctccaggtgttccaggtcg

SEQ ID NO: 654642 - DNA, 25 bp, Mus musculus
ggtgtcctctaaaacacgcatctta

SEQ ID NO: 654643 - DNA, 25 bp, Mus musculus
ggtgtcctctaatacacgcatctta

SEQ ID NO: 654644 - DNA, 25 bp, Mus musculus
ggtgtcctgctcacaaatcagcata

SEQ ID NO: 654645 - DNA, 25 bp, Mus musculus
ggtgtcctgctctcaaatcagcata

SEQ ID NO: 654646 - DNA, 25 bp, Mus musculus
ggtgtcctggatcatgcctgtcaag

SEQ ID NO: 654647 - DNA, 25 bp, Mus musculus
ggtgtcctggatgatgcctgtcaag

SEQ ID NO: 654648 - DNA, 25 bp, Mus musculus
ggtgtcctggctccactgaggaact

SEQ ID NO: 654649 - DNA, 25 bp, Mus musculus
ggtgtcctggctgcactgaggaact

SEQ ID NO: 654650 - DNA, 25 bp, Mus musculus
ggtgtccttcagctccaaactaagg

SEQ ID NO: 654651 - DNA, 25 bp, Mus musculus
ggtgtccttcaggtccaaactaagg

SEQ ID NO: 654652 - DNA, 25 bp, Mus musculus
ggtgtccttcttcgaggaacatctg

SEQ ID NO: 654653 - DNA, 25 bp, Mus musculus
ggtgtccttcttggaggaacatctg

SEQ ID NO: 654654 - DNA, 25 bp, Mus musculus
ggtgtccttgcccagaactccactg

SEQ ID NO: 654655 - DNA, 25 bp, Mus musculus
ggtgtccttgccgagaactccactg

SEQ ID NO: 654656 - DNA, 25 bp, Mus musculus
ggtgtccttgttagcactggacttg

SEQ ID NO: 654657 - DNA, 25 bp, Mus musculus
ggtgtccttgtttgcactggacttg

SEQ ID NO: 654658 - DNA, 25 bp, Mus musculus
ggtgtcctttgcagctcacattgca

SEQ ID NO: 654659 - DNA, 25 bp, Mus musculus
ggtgtcctttgctgctcacattgca

SEQ ID NO: 654660 - DNA, 25 bp, Mus musculus
ggtgtcgacggcatgtgccacagca

SEQ ID NO: 654661 - DNA, 25 bp, Mus musculus
ggtgtcgacggcttgtgccacagca

SEQ ID NO: 654662 - DNA, 25 bp, Mus musculus
ggtgtcgcagaaccttttgtctagg

SEQ ID NO: 654663 - DNA, 25 bp, Mus musculus
ggtgtcgcagaagcttttgtctagg

SEQ ID NO: 654664 - DNA, 25 bp, Mus musculus
ggtgtcgctaagaggatcccatttg

SEQ ID NO: 654665 - DNA, 25 bp, Mus musculus
ggtgtcgctaagtggatcccatttg

SEQ ID NO: 654666 - DNA, 25 bp, Mus musculus
ggtgtcgctggtcagtaagaactat

SEQ ID NO: 654667 - DNA, 25 bp, Mus musculus
ggtgtcgctggtgagtaagaactat

SEQ ID NO: 654668 - DNA, 25 bp, Mus musculus
ggtgtcggctcacaggatcctagca

SEQ ID NO: 654669 - DNA, 25 bp, Mus musculus
ggtgtcggctcagaggatcctagca

SEQ ID NO: 654670 - DNA, 25 bp, Mus musculus
ggtgtcgtactgattggtgtcctcc

SEQ ID NO: 654671 - DNA, 25 bp, Mus musculus
ggtgtcgtactgtttggtgtcctcc

SEQ ID NO: 654672 - DNA, 25 bp, Mus musculus
ggtgtcgtcaccaacaagtttaaat

SEQ ID NO: 654673 - DNA, 25 bp, Mus musculus
ggtgtcgtcacctacaagtttaaat

SEQ ID NO: 654674 - DNA, 25 bp, Mus musculus
ggtgtcgttaccatagatgagttca

SEQ ID NO: 654675 - DNA, 25 bp, Mus musculus
ggtgtcgttaccttagatgagttca

SEQ ID NO: 654676 - DNA, 25 bp, Mus musculus
ggtgtctaacacacactacgaactg

SEQ ID NO: 654677 - DNA, 25 bp, Mus musculus
ggtgtctaacactcactacgaactg

SEQ ID NO: 654678 - DNA, 25 bp, Mus musculus
ggtgtctaattcaacatcctgacca

SEQ ID NO: 654679 - DNA, 25 bp, Mus musculus
ggtgtctaattctacatcctgacca

SEQ ID NO: 654680 - DNA, 25 bp, Mus musculus
ggtgtctacacaatggcctgaacca

SEQ ID NO: 654681 - DNA, 25 bp, Mus musculus
ggtgtctacacattggcctgaacca

SEQ ID NO: 654682 - DNA, 25 bp, Mus musculus
ggtgtctacatccatagcatgaggg

SEQ ID NO: 654683 - DNA, 25 bp, Mus musculus
ggtgtctacatcgatagcatgaggg

SEQ ID NO: 654684 - DNA, 25 bp, Mus musculus
ggtgtctacgttaagagccctatgt

SEQ ID NO: 654685 - DNA, 25 bp, Mus musculus
ggtgtctacgtttagagccctatgt

SEQ ID NO: 654686 - DNA, 25 bp, Mus musculus
ggtgtctaggacctttcatttttat

SEQ ID NO: 654687 - DNA, 25 bp, Mus musculus
ggtgtctaggacgtttcatttttat

SEQ ID NO: 654688 - DNA, 25 bp, Mus musculus
ggtgtctagttacctcttaactgcc

SEQ ID NO: 654689 - DNA, 25 bp, Mus musculus
ggtgtctagttagctcttaactgcc

SEQ ID NO: 654690 - DNA, 25 bp, Mus musculus
ggtgtctataacacctggttgtagc

SEQ ID NO: 654691 - DNA, 25 bp, Mus musculus
ggtgtctataactcctggttgtagc

SEQ ID NO: 654692 - DNA, 25 bp, Mus musculus
ggtgtctcaaaacttaagtcccagc

SEQ ID NO: 654693 - DNA, 25 bp, Mus musculus
ggtgtctcaaaagttaagtcccagc

SEQ ID NO: 654694 - DNA, 25 bp, Mus musculus
ggtgtctcacgacccaagttttgaa

SEQ ID NO: 654695 - DNA, 25 bp, Mus musculus
ggtgtctcacgagccaagttttgaa

SEQ ID NO: 654696 - DNA, 25 bp, Mus musculus
ggtgtctcactgagttcccagggct

SEQ ID NO: 654697 - DNA, 25 bp, Mus musculus
ggtgtctcactgtgttcccagggct

SEQ ID NO: 654698 - DNA, 25 bp, Mus musculus
ggtgtctcagatcgtctgactcgca

SEQ ID NO: 654699 - DNA, 25 bp, Mus musculus
ggtgtctcagatggtctgactcgca

SEQ ID NO: 654700 - DNA, 25 bp, Mus musculus
ggtgtctccatactgtgatagccag

SEQ ID NO: 654701 - DNA, 25 bp, Mus musculus
ggtgtctccatagtgtgatagccag

SEQ ID NO: 654702 - DNA, 25 bp, Mus musculus
ggtgtctccatgcattcgtcccttt

SEQ ID NO: 654703 - DNA, 25 bp, Mus musculus
ggtgtctccatggattcgtcccttt

SEQ ID NO: 654704 - DNA, 25 bp, Mus musculus
ggtgtctcctagaccaggatttgaa

SEQ ID NO: 654705 - DNA, 25 bp, Mus musculus
ggtgtctcctagtccaggatttgaa

SEQ ID NO: 654706 - DNA, 25 bp, Mus musculus
ggtgtctctaaaaatgccttaacgc

SEQ ID NO: 654707 - DNA, 25 bp, Mus musculus
ggtgtctctaaatatgccttaacgc

SEQ ID NO: 654708 - DNA, 25 bp, Mus musculus
ggtgtctctgacacatgtgtatcag

SEQ ID NO: 654709 - DNA, 25 bp, Mus musculus
ggtgtctctgactcatgtgtatcag

SEQ ID NO: 654710 - DNA, 25 bp, Mus musculus
ggtgtctctgagagtaaaccagaag

SEQ ID NO: 654711 - DNA, 25 bp, Mus musculus
ggtgtctctgagtgtaaaccagaag

SEQ ID NO: 654712 - DNA, 25 bp, Mus musculus
ggtgtctctgggagcaagaagaaca

SEQ ID NO: 654713 - DNA, 25 bp, Mus musculus
ggtgtctctgggtgcaagaagaaca

SEQ ID NO: 654714 - DNA, 25 bp, Mus musculus
ggtgtctcttcaaatgccttgtatg

SEQ ID NO: 654715 - DNA, 25 bp, Mus musculus
ggtgtctcttcaagtatagctgtat

SEQ ID NO: 654716 - DNA, 25 bp, Mus musculus
ggtgtctcttcatatgccttgtatg

SEQ ID NO: 654717 - DNA, 25 bp, Mus musculus
ggtgtctcttcatgtatagctgtat

SEQ ID NO: 654718 - DNA, 25 bp, Mus musculus
ggtgtctgaaaaacttttatgcatc

SEQ ID NO: 654719 - DNA, 25 bp, Mus musculus
ggtgtctgaaaatcttttatgcatc

SEQ ID NO: 654720 - DNA, 25 bp, Mus musculus
ggtgtctgaattcccttgaactgga

SEQ ID NO: 654721 - DNA, 25 bp, Mus musculus
ggtgtctgaattgccttgaactgga

SEQ ID NO: 654722 - DNA, 25 bp, Mus musculus
ggtgtctgagaacctacgtgatgtc

SEQ ID NO: 654723 - DNA, 25 bp, Mus musculus
ggtgtctgagaagctacgtgatgtc

SEQ ID NO: 654724 - DNA, 25 bp, Mus musculus
ggtgtctgagacatcttacatctgt

SEQ ID NO: 654725 - DNA, 25 bp, Mus musculus
ggtgtctgagacttcttacatctgt

SEQ ID NO: 654726 - DNA, 25 bp, Mus musculus
ggtgtctgatctccaaagccaaatg

SEQ ID NO: 654727 - DNA, 25 bp, Mus musculus
ggtgtctgatctgcaaagccaaatg

SEQ ID NO: 654728 - DNA, 25 bp, Mus musculus
ggtgtctgcggtaccagtgacctga

SEQ ID NO: 654729 - DNA, 25 bp, Mus musculus
ggtgtctgcggttccagtgacctga

SEQ ID NO: 654730 - DNA, 25 bp, Mus musculus
ggtgtctgcgtgagcccagattgtc

SEQ ID NO: 654731 - DNA, 25 bp, Mus musculus
ggtgtctgcgtgtgcccagattgtc

SEQ ID NO: 654732 - DNA, 25 bp, Mus musculus
ggtgtctgcttgactgaatccttag

SEQ ID NO: 654733 - DNA, 25 bp, Mus musculus
ggtgtctgcttgtctgaatccttag

SEQ ID NO: 654734 - DNA, 25 bp, Mus musculus
ggtgtctggactatgacggccatgt

SEQ ID NO: 654735 - DNA, 25 bp, Mus musculus
ggtgtctggactttgacggccatgt

SEQ ID NO: 654736 - DNA, 25 bp, Mus musculus
ggtgtctggcaactacaaatcatac

SEQ ID NO: 654737 - DNA, 25 bp, Mus musculus
ggtgtctggcaagtacaaatcatac

SEQ ID NO: 654738 - DNA, 25 bp, Mus musculus
ggtgtctgggcaaccagactcaggc

SEQ ID NO: 654739 - DNA, 25 bp, Mus musculus
ggtgtctgggcatccagactcaggc

SEQ ID NO: 654740 - DNA, 25 bp, Mus musculus
ggtgtctggtttagcaaatagctat

SEQ ID NO: 654741 - DNA, 25 bp, Mus musculus
ggtgtctggttttgcaaatagctat

SEQ ID NO: 654742 - DNA, 25 bp, Mus musculus
ggtgtctgtctaaggtatcatcaga

SEQ ID NO: 654743 - DNA, 25 bp, Mus musculus
ggtgtctgtctatggtatcatcaga

SEQ ID NO: 654744 - DNA, 25 bp, Mus musculus
ggtgtctgtgacaaactccatgatg

SEQ ID NO: 654745 - DNA, 25 bp, Mus musculus
ggtgtctgtgactaactccatgatg

SEQ ID NO: 654746 - DNA, 25 bp, Mus musculus
ggtgtctgtgagaatgttttgcaaa

SEQ ID NO: 654747 - DNA, 25 bp, Mus musculus
ggtgtctgtgagtatgttttgcaaa

SEQ ID NO: 654748 - DNA, 25 bp, Mus musculus
ggtgtcttactgactgccttgtaac

SEQ ID NO: 654749 - DNA, 25 bp, Mus musculus
ggtgtcttactgtctgccttgtaac

SEQ ID NO: 654750 - DNA, 25 bp, Mus musculus
ggtgtcttagttagctctgtgctta

SEQ ID NO: 654751 - DNA, 25 bp, Mus musculus
ggtgtcttagtttgctctgtgctta

SEQ ID NO: 654752 - DNA, 25 bp, Mus musculus
ggtgtcttatagaacctgcctctta

SEQ ID NO: 654753 - DNA, 25 bp, Mus musculus
ggtgtcttatagtacctgcctctta

SEQ ID NO: 654754 - DNA, 25 bp, Mus musculus
ggtgtcttatggacaactaggtact

SEQ ID NO: 654755 - DNA, 25 bp, Mus musculus
ggtgtcttatggtcaactaggtact

SEQ ID NO: 654756 - DNA, 25 bp, Mus musculus
ggtgtcttctgtccaagtccattac

SEQ ID NO: 654757 - DNA, 25 bp, Mus musculus
ggtgtcttctgtgcaagtccattac

SEQ ID NO: 654758 - DNA, 25 bp, Mus musculus
ggtgtcttcttacctgcacatatga

SEQ ID NO: 654759 - DNA, 25 bp, Mus musculus
ggtgtcttcttagctgcacatatga

SEQ ID NO: 654760 - DNA, 25 bp, Mus musculus
ggtgtcttgctgcaggtaactaatg

SEQ ID NO: 654761 - DNA, 25 bp, Mus musculus
ggtgtcttgctggaggtaactaatg

SEQ ID NO: 654762 - DNA, 25 bp, Mus musculus
ggtgtcttggaccagttctgtacga

SEQ ID NO: 654763 - DNA, 25 bp, Mus musculus
ggtgtcttggacgagttctgtacga

SEQ ID NO: 654764 - DNA, 25 bp, Mus musculus
ggtgtcttgggcaggtcataccaca

SEQ ID NO: 654765 - DNA, 25 bp, Mus musculus
ggtgtcttgggctggtcataccaca

SEQ ID NO: 654766 - DNA, 25 bp, Mus musculus
ggtgtcttgtacctcagattccaga

SEQ ID NO: 654767 - DNA, 25 bp, Mus musculus
ggtgtcttgtacgtcagattccaga

SEQ ID NO: 654768 - DNA, 25 bp, Mus musculus
ggtgtctttgatagccctgtaaggc

SEQ ID NO: 654769 - DNA, 25 bp, Mus musculus
ggtgtctttgattgccctgtaaggc

SEQ ID NO: 654770 - DNA, 25 bp, Mus musculus
ggtgtctttgtcaacgggcggccac

SEQ ID NO: 654771 - DNA, 25 bp, Mus musculus
ggtgtctttgtctacgggcggccac

SEQ ID NO: 654772 - DNA, 25 bp, Mus musculus
ggtgtcttttccattgatgttttat

SEQ ID NO: 654773 - DNA, 25 bp, Mus musculus
ggtgtcttttcctttgatgttttat

SEQ ID NO: 654774 - DNA, 25 bp, Mus musculus
ggtgtcttttgtctttctgtaatta

SEQ ID NO: 654775 - DNA, 25 bp, Mus musculus
ggtgtcttttgtgtttctgtaatta

SEQ ID NO: 654776 - DNA, 25 bp, Mus musculus
ggtgtgaaacaacctctcagactgt

SEQ ID NO: 654777 - DNA, 25 bp, Mus musculus
ggtgtgaaacaagctctcagactgt

SEQ ID NO: 654778 - DNA, 25 bp, Mus musculus
ggtgtgaaaccaatggccatcctct

SEQ ID NO: 654779 - DNA, 25 bp, Mus musculus
ggtgtgaaaccattggccatcctct

SEQ ID NO: 654780 - DNA, 25 bp, Mus musculus
ggtgtgaaccacagtaatgtctgca

SEQ ID NO: 654781 - DNA, 25 bp, Mus musculus
ggtgtgaaccactgtaatgtctgca

SEQ ID NO: 654782 - DNA, 25 bp, Mus musculus
ggtgtgaaccctaccgaaagagact

SEQ ID NO: 654783 - DNA, 25 bp, Mus musculus
ggtgtgaacccttccgaaagagact

SEQ ID NO: 654784 - DNA, 25 bp, Mus musculus
ggtgtgaacctgagactccagaaca

SEQ ID NO: 654785 - DNA, 25 bp, Mus musculus
ggtgtgaacctgtgactccagaaca

SEQ ID NO: 654786 - DNA, 25 bp, Mus musculus
ggtgtgaactacctaatccagggaa

SEQ ID NO: 654787 - DNA, 25 bp, Mus musculus
ggtgtgaactacgtaatccagggaa

SEQ ID NO: 654788 - DNA, 25 bp, Mus musculus
ggtgtgaactcactctacagctccc

SEQ ID NO: 654789 - DNA, 25 bp, Mus musculus
ggtgtgaactcagtctacagctccc

SEQ ID NO: 654790 - DNA, 25 bp, Mus musculus
ggtgtgaactgaacccagatactct

SEQ ID NO: 654791 - DNA, 25 bp, Mus musculus
ggtgtgaactgatcccagatactct

SEQ ID NO: 654792 - DNA, 25 bp, Mus musculus
ggtgtgaagaccaaacttaatcaat

SEQ ID NO: 654793 - DNA, 25 bp, Mus musculus
ggtgtgaagacctaacttaatcaat

SEQ ID NO: 654794 - DNA, 25 bp, Mus musculus
ggtgtgaagcccagcctagtctata

SEQ ID NO: 654795 - DNA, 25 bp, Mus musculus
ggtgtgaagccctgcctagtctata

SEQ ID NO: 654796 - DNA, 25 bp, Mus musculus
ggtgtgaagtgtccagactctgaaa

SEQ ID NO: 654797 - DNA, 25 bp, Mus musculus
ggtgtgaagtgtgcagactctgaaa

SEQ ID NO: 654798 - DNA, 25 bp, Mus musculus
ggtgtgaatcttagggacacttccc

SEQ ID NO: 654799 - DNA, 25 bp, Mus musculus
ggtgtgaatctttgggacacttccc

SEQ ID NO: 654800 - DNA, 25 bp, Mus musculus
ggtgtgaatttgctgacgtgttttt

SEQ ID NO: 654801 - DNA, 25 bp, Mus musculus
ggtgtgaatttggtgacgtgttttt

SEQ ID NO: 654802 - DNA, 25 bp, Mus musculus
ggtgtgacaaaaacagagcctggaa

SEQ ID NO: 654803 - DNA, 25 bp, Mus musculus
ggtgtgacaaaatcagagcctggaa

SEQ ID NO: 654804 - DNA, 25 bp, Mus musculus
ggtgtgacacaacccagttctggac

SEQ ID NO: 654805 - DNA, 25 bp, Mus musculus
ggtgtgacacaagccagttctggac

SEQ ID NO: 654806 - DNA, 25 bp, Mus musculus
ggtgtgacacatccgctattgatct

SEQ ID NO: 654807 - DNA, 25 bp, Mus musculus
ggtgtgacacatgcgctattgatct

SEQ ID NO: 654808 - DNA, 25 bp, Mus musculus
ggtgtgacacgcatgttaggcaagt

SEQ ID NO: 654809 - DNA, 25 bp, Mus musculus
ggtgtgacacgcttgttaggcaagt

SEQ ID NO: 654810 - DNA, 25 bp, Mus musculus
ggtgtgacagtgatgtctccttcca

SEQ ID NO: 654811 - DNA, 25 bp, Mus musculus
ggtgtgacagtgttgtctccttcca

SEQ ID NO: 654812 - DNA, 25 bp, Mus musculus
ggtgtgacatacaatccccatggga

SEQ ID NO: 654813 - DNA, 25 bp, Mus musculus
ggtgtgacatactatccccatggga

SEQ ID NO: 654814 - DNA, 25 bp, Mus musculus
ggtgtgaccatgatcattataatct

SEQ ID NO: 654815 - DNA, 25 bp, Mus musculus
ggtgtgaccatgttcattataatct

SEQ ID NO: 654816 - DNA, 25 bp, Mus musculus
ggtgtgacccaaatgggccagagct

SEQ ID NO: 654817 - DNA, 25 bp, Mus musculus
ggtgtgacccaattgggccagagct

SEQ ID NO: 654818 - DNA, 25 bp, Mus musculus
ggtgtgacccagactttagactttt

SEQ ID NO: 654819 - DNA, 25 bp, Mus musculus
ggtgtgacccagtctttagactttt

SEQ ID NO: 654820 - DNA, 25 bp, Mus musculus
ggtgtgacccatctgatttctcaat

SEQ ID NO: 654821 - DNA, 25 bp, Mus musculus
ggtgtgacccatgtgatttctcaat

SEQ ID NO: 654822 - DNA, 25 bp, Mus musculus
ggtgtgaccgtaacataacatgctg

SEQ ID NO: 654823 - DNA, 25 bp, Mus musculus
ggtgtgaccgtatcataacatgctg

SEQ ID NO: 654824 - DNA, 25 bp, Mus musculus
ggtgtgacctacctttttcagaaga

SEQ ID NO: 654825 - DNA, 25 bp, Mus musculus
ggtgtgacctacgtttttcagaaga

SEQ ID NO: 654826 - DNA, 25 bp, Mus musculus
ggtgtgaccttcacctttagataga

SEQ ID NO: 654827 - DNA, 25 bp, Mus musculus
ggtgtgaccttctcctttagataga

SEQ ID NO: 654828 - DNA, 25 bp, Mus musculus
ggtgtgactagaaacccactggatt

SEQ ID NO: 654829 - DNA, 25 bp, Mus musculus
ggtgtgactagaacccgagggctct

SEQ ID NO: 654830 - DNA, 25 bp, Mus musculus
ggtgtgactagatacccactggatt

SEQ ID NO: 654831 - DNA, 25 bp, Mus musculus
ggtgtgactagatcccgagggctct

SEQ ID NO: 654832 - DNA, 25 bp, Mus musculus
ggtgtgactccaatcatgattttct

SEQ ID NO: 654833 - DNA, 25 bp, Mus musculus
ggtgtgactccattcatgattttct

SEQ ID NO: 654834 - DNA, 25 bp, Mus musculus
ggtgtgactctacctgaactcagaa

SEQ ID NO: 654835 - DNA, 25 bp, Mus musculus
ggtgtgactctagctgaactcagaa

SEQ ID NO: 654836 - DNA, 25 bp, Mus musculus
ggtgtgacttcacggccaatatcta

SEQ ID NO: 654837 - DNA, 25 bp, Mus musculus
ggtgtgacttcagggccaatatcta

SEQ ID NO: 654838 - DNA, 25 bp, Mus musculus
ggtgtgagcagtccagtaaagaccc

SEQ ID NO: 654839 - DNA, 25 bp, Mus musculus
ggtgtgagcagtgcagtaaagaccc

SEQ ID NO: 654840 - DNA, 25 bp, Mus musculus
ggtgtgagctacatatgcatatctt

SEQ ID NO: 654841 - DNA, 25 bp, Mus musculus
ggtgtgagctacttatgcatatctt

SEQ ID NO: 654842 - DNA, 25 bp, Mus musculus
ggtgtgaggacacgtttcgttataa

SEQ ID NO: 654843 - DNA, 25 bp, Mus musculus
ggtgtgaggacaggtttcgttataa

SEQ ID NO: 654844 - DNA, 25 bp, Mus musculus
ggtgtgaggtcaatttcccagctga

SEQ ID NO: 654845 - DNA, 25 bp, Mus musculus
ggtgtgaggtcattttcccagctga

SEQ ID NO: 654846 - DNA, 25 bp, Mus musculus
ggtgtgagtcttcgaccatttcttt

SEQ ID NO: 654847 - DNA, 25 bp, Mus musculus
ggtgtgagtcttggaccatttcttt

SEQ ID NO: 654848 - DNA, 25 bp, Mus musculus
ggtgtgataccactttgcagatttg

SEQ ID NO: 654849 - DNA, 25 bp, Mus musculus
ggtgtgataccagtttgcagatttg

SEQ ID NO: 654850 - DNA, 25 bp, Mus musculus
ggtgtgatcacaaccagtccccgct

SEQ ID NO: 654851 - DNA, 25 bp, Mus musculus
ggtgtgatcacatccagtccccgct

SEQ ID NO: 654852 - DNA, 25 bp, Mus musculus
ggtgtgatcttgagtattggttttt

SEQ ID NO: 654853 - DNA, 25 bp, Mus musculus
ggtgtgatcttgtgtattggttttt

SEQ ID NO: 654854 - DNA, 25 bp, Mus musculus
ggtgtgatggtcatctttacttcaa

SEQ ID NO: 654855 - DNA, 25 bp, Mus musculus
ggtgtgatggtcttctttacttcaa

SEQ ID NO: 654856 - DNA, 25 bp, Mus musculus
ggtgtgatgtcaagcatgaacggta

SEQ ID NO: 654857 - DNA, 25 bp, Mus musculus
ggtgtgatgtcatgcatgaacggta

SEQ ID NO: 654858 - DNA, 25 bp, Mus musculus
ggtgtgatgtgactggtacaacccc

SEQ ID NO: 654859 - DNA, 25 bp, Mus musculus
ggtgtgatgtgagtggtacaacccc

SEQ ID NO: 654860 - DNA, 25 bp, Mus musculus
ggtgtgattactcaactttatcctt

SEQ ID NO: 654861 - DNA, 25 bp, Mus musculus
ggtgtgattactgaactttatcctt

SEQ ID NO: 654862 - DNA, 25 bp, Mus musculus
ggtgtgatttcaaacatggattttt

SEQ ID NO: 654863 - DNA, 25 bp, Mus musculus
ggtgtgatttcatacatggattttt

SEQ ID NO: 654864 - DNA, 25 bp, Mus musculus
ggtgtgcaaagaatcgccccagtac

SEQ ID NO: 654865 - DNA, 25 bp, Mus musculus
ggtgtgcaaagattcgccccagtac

SEQ ID NO: 654866 - DNA, 25 bp, Mus musculus
ggtgtgcaacaaatatcttctgatc

SEQ ID NO: 654867 - DNA, 25 bp, Mus musculus
ggtgtgcaacaattatcttctgatc

SEQ ID NO: 654868 - DNA, 25 bp, Mus musculus
ggtgtgcaacttaactggagatctt

SEQ ID NO: 654869 - DNA, 25 bp, Mus musculus
ggtgtgcaacttcaatcccaacgca

SEQ ID NO: 654870 - DNA, 25 bp, Mus musculus
ggtgtgcaacttgaatcccaacgca

SEQ ID NO: 654871 - DNA, 25 bp, Mus musculus
ggtgtgcaactttactggagatctt

SEQ ID NO: 654872 - DNA, 25 bp, Mus musculus
ggtgtgcaagcacgcctttaacttg

SEQ ID NO: 654873 - DNA, 25 bp, Mus musculus
ggtgtgcaagcaggcctttaacttg

SEQ ID NO: 654874 - DNA, 25 bp, Mus musculus
ggtgtgcaatttactttcattctta

SEQ ID NO: 654875 - DNA, 25 bp, Mus musculus
ggtgtgcaatttagttacattcctg

SEQ ID NO: 654876 - DNA, 25 bp, Mus musculus
ggtgtgcaattttctttcattctta

SEQ ID NO: 654877 - DNA, 25 bp, Mus musculus
ggtgtgcaattttgttacattcctg

SEQ ID NO: 654878 - DNA, 25 bp, Mus musculus
ggtgtgcacaccaaccaagactttg

SEQ ID NO: 654879 - DNA, 25 bp, Mus musculus
ggtgtgcacacctaccaagactttg

SEQ ID NO: 654880 - DNA, 25 bp, Mus musculus
ggtgtgcaccataacatctggccca

SEQ ID NO: 654881 - DNA, 25 bp, Mus musculus
ggtgtgcaccatcaacgacggtccc

SEQ ID NO: 654882 - DNA, 25 bp, Mus musculus
ggtgtgcaccatcacgtgagcccag

SEQ ID NO: 654883 - DNA, 25 bp, Mus musculus
ggtgtgcaccatgaacgacggtccc

SEQ ID NO: 654884 - DNA, 25 bp, Mus musculus
ggtgtgcaccatgacgtgagcccag

SEQ ID NO: 654885 - DNA, 25 bp, Mus musculus
ggtgtgcaccattacatctggccca

SEQ ID NO: 654886 - DNA, 25 bp, Mus musculus
ggtgtgcaccgaaatgttacttttt

SEQ ID NO: 654887 - DNA, 25 bp, Mus musculus
ggtgtgcaccgatatgttacttttt

SEQ ID NO: 654888 - DNA, 25 bp, Mus musculus
ggtgtgcactgacccacccatgcgt

SEQ ID NO: 654889 - DNA, 25 bp, Mus musculus
ggtgtgcactgagccacccatgcgt

SEQ ID NO: 654890 - DNA, 25 bp, Mus musculus
ggtgtgcactttaatagtctgtttt

SEQ ID NO: 654891 - DNA, 25 bp, Mus musculus
ggtgtgcacttttatagtctgtttt

SEQ ID NO: 654892 - DNA, 25 bp, Mus musculus
ggtgtgcagtgcagtgttctgtaaa

SEQ ID NO: 654893 - DNA, 25 bp, Mus musculus
ggtgtgcagtgctgtgttctgtaaa

SEQ ID NO: 654894 - DNA, 25 bp, Mus musculus
ggtgtgcatgtcattaactacccct

SEQ ID NO: 654895 - DNA, 25 bp, Mus musculus
ggtgtgcatgtctttaactacccct

SEQ ID NO: 654896 - DNA, 25 bp, Mus musculus
ggtgtgccaataaaagagcctctgc

SEQ ID NO: 654897 - DNA, 25 bp, Mus musculus
ggtgtgccaatataagagcctctgc

SEQ ID NO: 654898 - DNA, 25 bp, Mus musculus
ggtgtgccacagagaagtccggcct

SEQ ID NO: 654899 - DNA, 25 bp, Mus musculus
ggtgtgccacagtgaagtccggcct

SEQ ID NO: 654900 - DNA, 25 bp, Mus musculus
ggtgtgccagttaccctagtaaatc

SEQ ID NO: 654901 - DNA, 25 bp, Mus musculus
ggtgtgccagtttccctagtaaatc

SEQ ID NO: 654902 - DNA, 25 bp, Mus musculus
ggtgtgcccacacctgtgctaggca

SEQ ID NO: 654903 - DNA, 25 bp, Mus musculus
ggtgtgcccacagctgtgctaggca

SEQ ID NO: 654904 - DNA, 25 bp, Mus musculus
ggtgtgccgctgagtaatatttcta

SEQ ID NO: 654905 - DNA, 25 bp, Mus musculus
ggtgtgccgctgtgtaatatttcta

SEQ ID NO: 654906 - DNA, 25 bp, Mus musculus
ggtgtgcctaagataacttactata

SEQ ID NO: 654907 - DNA, 25 bp, Mus musculus
ggtgtgcctaagttaacttactata

SEQ ID NO: 654908 - DNA, 25 bp, Mus musculus
ggtgtgcctcccacttataatttat

SEQ ID NO: 654909 - DNA, 25 bp, Mus musculus
ggtgtgcctccctcttataatttat

SEQ ID NO: 654910 - DNA, 25 bp, Mus musculus
ggtgtgccttgtctctgtgcttctc

SEQ ID NO: 654911 - DNA, 25 bp, Mus musculus
ggtgtgccttgtgtctgtgcttctc

SEQ ID NO: 654912 - DNA, 25 bp, Mus musculus
ggtgtgcgcaataagaaagcctgtt

SEQ ID NO: 654913 - DNA, 25 bp, Mus musculus
ggtgtgcgcaattagaaagcctgtt

SEQ ID NO: 654914 - DNA, 25 bp, Mus musculus
ggtgtgcgcattcttcaaacaggga

SEQ ID NO: 654915 - DNA, 25 bp, Mus musculus
ggtgtgcgcattgttcaaacaggga

SEQ ID NO: 654916 - DNA, 25 bp, Mus musculus
ggtgtgcgtgtgagcgactcagaat

SEQ ID NO: 654917 - DNA, 25 bp, Mus musculus
ggtgtgcgtgtgtgcgactcagaat

SEQ ID NO: 654918 - DNA, 25 bp, Mus musculus
ggtgtgctaattactgcccatggca

SEQ ID NO: 654919 - DNA, 25 bp, Mus musculus
ggtgtgctaatttctgcccatggca

SEQ ID NO: 654920 - DNA, 25 bp, Mus musculus
ggtgtgctagcccagctcatctgga

SEQ ID NO: 654921 - DNA, 25 bp, Mus musculus
ggtgtgctagccgagctcatctgga

SEQ ID NO: 654922 - DNA, 25 bp, Mus musculus
ggtgtgctatagctttaacgcttct

SEQ ID NO: 654923 - DNA, 25 bp, Mus musculus
ggtgtgctataggtttaacgcttct

SEQ ID NO: 654924 - DNA, 25 bp, Mus musculus
ggtgtgctcagaatctttccccaaa

SEQ ID NO: 654925 - DNA, 25 bp, Mus musculus
ggtgtgctcagattctttccccaaa

SEQ ID NO: 654926 - DNA, 25 bp, Mus musculus
ggtgtgctcagtaaatctactcttc

SEQ ID NO: 654927 - DNA, 25 bp, Mus musculus
ggtgtgctcagttaatctactcttc

SEQ ID NO: 654928 - DNA, 25 bp, Mus musculus
ggtgtgctccttactaaggacatgt

SEQ ID NO: 654929 - DNA, 25 bp, Mus musculus
ggtgtgctcctttctaaggacatgt

SEQ ID NO: 654930 - DNA, 25 bp, Mus musculus
ggtgtgctgatccttcctttagtac

SEQ ID NO: 654931 - DNA, 25 bp, Mus musculus
ggtgtgctgatcgttcctttagtac

SEQ ID NO: 654932 - DNA, 25 bp, Mus musculus
ggtgtgctgccaacaattttgtata

SEQ ID NO: 654933 - DNA, 25 bp, Mus musculus
ggtgtgctgccatcaattttgtata

SEQ ID NO: 654934 - DNA, 25 bp, Mus musculus
ggtgtgctgtccctagtgtccaaag

SEQ ID NO: 654935 - DNA, 25 bp, Mus musculus
ggtgtgctgtccgtagtgtccaaag

SEQ ID NO: 654936 - DNA, 25 bp, Mus musculus
ggtgtgcttattcaatagtctctat

SEQ ID NO: 654937 - DNA, 25 bp, Mus musculus
ggtgtgcttattgaatagtctctat

SEQ ID NO: 654938 - DNA, 25 bp, Mus musculus
ggtgtgctttatatactcttcctac

SEQ ID NO: 654939 - DNA, 25 bp, Mus musculus
ggtgtgctttatttactcttcctac

SEQ ID NO: 654940 - DNA, 25 bp, Mus musculus
ggtgtggaaataagtcctgccgact

SEQ ID NO: 654941 - DNA, 25 bp, Mus musculus
ggtgtggaaatatgtcctgccgact

SEQ ID NO: 654942 - DNA, 25 bp, Mus musculus
ggtgtggaatatacgcctggctctc

SEQ ID NO: 654943 - DNA, 25 bp, Mus musculus
ggtgtggaatattcgcctggctctc

SEQ ID NO: 654944 - DNA, 25 bp, Mus musculus
ggtgtggaatgtcaacgcctcacta

SEQ ID NO: 654945 - DNA, 25 bp, Mus musculus
ggtgtggaatgtgaacgcctcacta

SEQ ID NO: 654946 - DNA, 25 bp, Mus musculus
ggtgtggagatgcaatccaacccca

SEQ ID NO: 654947 - DNA, 25 bp, Mus musculus
ggtgtggagatggaatccaacccca

SEQ ID NO: 654948 - DNA, 25 bp, Mus musculus
ggtgtggagccaacacccgtgcgct

SEQ ID NO: 654949 - DNA, 25 bp, Mus musculus
ggtgtggagccatcacccgtgcgct

SEQ ID NO: 654950 - DNA, 25 bp, Mus musculus
ggtgtggagctccttcatgctaaaa

SEQ ID NO: 654951 - DNA, 25 bp, Mus musculus
ggtgtggagctcgttcatgctaaaa

SEQ ID NO: 654952 - DNA, 25 bp, Mus musculus
ggtgtggaggcaaacgtctgtaatc

SEQ ID NO: 654953 - DNA, 25 bp, Mus musculus
ggtgtggaggcatacgtctgtaatc

SEQ ID NO: 654954 - DNA, 25 bp, Mus musculus
ggtgtggatcctaaattcatagagc

SEQ ID NO: 654955 - DNA, 25 bp, Mus musculus
ggtgtggatccttaattcatagagc

SEQ ID NO: 654956 - DNA, 25 bp, Mus musculus
ggtgtggatggcatgcctttcctgc

SEQ ID NO: 654957 - DNA, 25 bp, Mus musculus
ggtgtggatggcttgcctttcctgc

SEQ ID NO: 654958 - DNA, 25 bp, Mus musculus
ggtgtggatgtgctcttatctccga

SEQ ID NO: 654959 - DNA, 25 bp, Mus musculus
ggtgtggatgtggtcttatctccga

SEQ ID NO: 654960 - DNA, 25 bp, Mus musculus
ggtgtggatttacctactaccctgt

SEQ ID NO: 654961 - DNA, 25 bp, Mus musculus
ggtgtggatttagctactaccctgt

SEQ ID NO: 654962 - DNA, 25 bp, Mus musculus
ggtgtggcaattatgatattacgtt

SEQ ID NO: 654963 - DNA, 25 bp, Mus musculus
ggtgtggcaattttgatattacgtt

SEQ ID NO: 654964 - DNA, 25 bp, Mus musculus
ggtgtggcatctcacaaagacagcc

SEQ ID NO: 654965 - DNA, 25 bp, Mus musculus
ggtgtggcatctgacaaagacagcc

SEQ ID NO: 654966 - DNA, 25 bp, Mus musculus
ggtgtggccatcatgatctacctgc

SEQ ID NO: 654967 - DNA, 25 bp, Mus musculus
ggtgtggccatcttgatctacctgc

SEQ ID NO: 654968 - DNA, 25 bp, Mus musculus
ggtgtggcccaaaccctctaaccag

SEQ ID NO: 654969 - DNA, 25 bp, Mus musculus
ggtgtggcccaatccctctaaccag

SEQ ID NO: 654970 - DNA, 25 bp, Mus musculus
ggtgtggcctagcagaccaactcat

SEQ ID NO: 654971 - DNA, 25 bp, Mus musculus
ggtgtggcctaggagaccaactcat

SEQ ID NO: 654972 - DNA, 25 bp, Mus musculus
ggtgtggctcaaatgtcaggatgct

SEQ ID NO: 654973 - DNA, 25 bp, Mus musculus
ggtgtggctcaattgtcaggatgct

SEQ ID NO: 654974 - DNA, 25 bp, Mus musculus
ggtgtggctctcctgaagtcagact

SEQ ID NO: 654975 - DNA, 25 bp, Mus musculus
ggtgtggctctcgtgaagtcagact

SEQ ID NO: 654976 - DNA, 25 bp, Mus musculus
ggtgtggctgtcctctacagactca

SEQ ID NO: 654977 - DNA, 25 bp, Mus musculus
ggtgtggctgtcgtctacagactca

SEQ ID NO: 654978 - DNA, 25 bp, Mus musculus
ggtgtggctgtgaaattgcatctca

SEQ ID NO: 654979 - DNA, 25 bp, Mus musculus
ggtgtggctgtgtaattgcatctca

SEQ ID NO: 654980 - DNA, 25 bp, Mus musculus
ggtgtggctgttacttagacatgac

SEQ ID NO: 654981 - DNA, 25 bp, Mus musculus
ggtgtggctgtttcttagacatgac

SEQ ID NO: 654982 - DNA, 25 bp, Mus musculus
ggtgtgggatacatttgttctaact

SEQ ID NO: 654983 - DNA, 25 bp, Mus musculus
ggtgtgggatacttttgttctaact

SEQ ID NO: 654984 - DNA, 25 bp, Mus musculus
ggtgtgggatatacctccctacgat

SEQ ID NO: 654985 - DNA, 25 bp, Mus musculus
ggtgtgggatattcctccctacgat

SEQ ID NO: 654986 - DNA, 25 bp, Mus musculus
ggtgtgggcaagaacccagccccag

SEQ ID NO: 654987 - DNA, 25 bp, Mus musculus
ggtgtgggcaagtacccagccccag

SEQ ID NO: 654988 - DNA, 25 bp, Mus musculus
ggtgtgggcatgctatcatctcctc

SEQ ID NO: 654989 - DNA, 25 bp, Mus musculus
ggtgtgggcatggtatcatctcctc

SEQ ID NO: 654990 - DNA, 25 bp, Mus musculus
ggtgtgggccttagcaatcgcagca

SEQ ID NO: 654991 - DNA, 25 bp, Mus musculus
ggtgtgggcctttgcaatcgcagca

SEQ ID NO: 654992 - DNA, 25 bp, Mus musculus
ggtgtgggctccaacagacacagtt

SEQ ID NO: 654993 - DNA, 25 bp, Mus musculus
ggtgtgggctcctacagacacagtt

SEQ ID NO: 654994 - DNA, 25 bp, Mus musculus
ggtgtgggtacaagcacctgcctga

SEQ ID NO: 654995 - DNA, 25 bp, Mus musculus
ggtgtgggtacatgcacctgcctga

SEQ ID NO: 654996 - DNA, 25 bp, Mus musculus
ggtgtgggtccgctgtatatttaac

SEQ ID NO: 654997 - DNA, 25 bp, Mus musculus
ggtgtgggtccggtgtatatttaac

SEQ ID NO: 654998 - DNA, 25 bp, Mus musculus
ggtgtgggtgctcactactattagt

SEQ ID NO: 654999 - DNA, 25 bp, Mus musculus
ggtgtgggtgctgactactattagt

SEQ ID NO: 655000 - DNA, 25 bp, Mus musculus
ggtgtggtaaataaatgatgtcagt

SEQ ID NO: 655001 - DNA, 25 bp, Mus musculus
ggtgtggtaaattaatgatgtcagt

SEQ ID NO: 655002 - DNA, 25 bp, Mus musculus
ggtgtggtaactcattttccatgaa

SEQ ID NO: 655003 - DNA, 25 bp, Mus musculus
ggtgtggtaactgattttccatgaa

SEQ ID NO: 655004 - DNA, 25 bp, Mus musculus
ggtgtggtaatgagcataccccatc

SEQ ID NO: 655005 - DNA, 25 bp, Mus musculus
ggtgtggtaatgtgcataccccatc

SEQ ID NO: 655006 - DNA, 25 bp, Mus musculus
ggtgtggtcaccactgccacattca

SEQ ID NO: 655007 - DNA, 25 bp, Mus musculus
ggtgtggtcacctctgccacattca

SEQ ID NO: 655008 - DNA, 25 bp, Mus musculus
ggtgtggtcactattcatgtaacat

SEQ ID NO: 655009 - DNA, 25 bp, Mus musculus
ggtgtggtcacttttcatgtaacat

SEQ ID NO: 655010 - DNA, 25 bp, Mus musculus
ggtgtggtcctccatttctgaacct

SEQ ID NO: 655011 - DNA, 25 bp, Mus musculus
ggtgtggtcctcgatttctgaacct

SEQ ID NO: 655012 - DNA, 25 bp, Mus musculus
ggtgtggtcttgcttcaaggtccct

SEQ ID NO: 655013 - DNA, 25 bp, Mus musculus
ggtgtggtcttggttcaaggtccct

SEQ ID NO: 655014 - DNA, 25 bp, Mus musculus
ggtgtggtggctcaaacgttttaat

SEQ ID NO: 655015 - DNA, 25 bp, Mus musculus
ggtgtggtggctgaaacgttttaat

SEQ ID NO: 655016 - DNA, 25 bp, Mus musculus
ggtgtggtgtgcatagctttactcc

SEQ ID NO: 655017 - DNA, 25 bp, Mus musculus
ggtgtggtgtgcttagctttactcc

SEQ ID NO: 655018 - DNA, 25 bp, Mus musculus
ggtgtggttatcctctctgagctca

SEQ ID NO: 655019 - DNA, 25 bp, Mus musculus
ggtgtggttatcgtctctgagctca

SEQ ID NO: 655020 - DNA, 25 bp, Mus musculus
ggtgtggttcaaatatgctcttgta

SEQ ID NO: 655021 - DNA, 25 bp, Mus musculus
ggtgtggttcaattatgctcttgta

SEQ ID NO: 655022 - DNA, 25 bp, Mus musculus
ggtgtggttttgaacttgtgtgatc

SEQ ID NO: 655023 - DNA, 25 bp, Mus musculus
ggtgtggttttgtacttgtgtgatc

SEQ ID NO: 655024 - DNA, 25 bp, Mus musculus
ggtgtgtaacccatactgtttcttt

SEQ ID NO: 655025 - DNA, 25 bp, Mus musculus
ggtgtgtaacccttactgtttcttt

SEQ ID NO: 655026 - DNA, 25 bp, Mus musculus
ggtgtgtacaacaggatctcttaga

SEQ ID NO: 655027 - DNA, 25 bp, Mus musculus
ggtgtgtacaactggatctcttaga

SEQ ID NO: 655028 - DNA, 25 bp, Mus musculus
ggtgtgtacttgaattccagcatgc

SEQ ID NO: 655029 - DNA, 25 bp, Mus musculus
ggtgtgtacttgtattccagcatgc

SEQ ID NO: 655030 - DNA, 25 bp, Mus musculus
ggtgtgtagcctcgtggccctccaa

SEQ ID NO: 655031 - DNA, 25 bp, Mus musculus
ggtgtgtagcctggtggccctccaa

SEQ ID NO: 655032 - DNA, 25 bp, Mus musculus
ggtgtgtagggcaatgctacttaaa

SEQ ID NO: 655033 - DNA, 25 bp, Mus musculus
ggtgtgtagggctatgctacttaaa

SEQ ID NO: 655034 - DNA, 25 bp, Mus musculus
ggtgtgtagtcaatgttcatggtat

SEQ ID NO: 655035 - DNA, 25 bp, Mus musculus
ggtgtgtagtcattgttcatggtat

SEQ ID NO: 655036 - DNA, 25 bp, Mus musculus
ggtgtgtatcttaatcctacattgt

SEQ ID NO: 655037 - DNA, 25 bp, Mus musculus
ggtgtgtatctttatcctacattgt

SEQ ID NO: 655038 - DNA, 25 bp, Mus musculus
ggtgtgtatgtaatctcagccccag

SEQ ID NO: 655039 - DNA, 25 bp, Mus musculus
ggtgtgtatgtattctcagccccag

SEQ ID NO: 655040 - DNA, 25 bp, Mus musculus
ggtgtgtcaccaatttacccgtcca

SEQ ID NO: 655041 - DNA, 25 bp, Mus musculus
ggtgtgtcaccattttacccgtcca

SEQ ID NO: 655042 - DNA, 25 bp, Mus musculus
ggtgtgtcacgcagttcttcactcc

SEQ ID NO: 655043 - DNA, 25 bp, Mus musculus
ggtgtgtcacgctgttcttcactcc

SEQ ID NO: 655044 - DNA, 25 bp, Mus musculus
ggtgtgtcagatacatctttttcga

SEQ ID NO: 655045 - DNA, 25 bp, Mus musculus
ggtgtgtcagattcatctttttcga

SEQ ID NO: 655046 - DNA, 25 bp, Mus musculus
ggtgtgtcataaactcactgtttgg

SEQ ID NO: 655047 - DNA, 25 bp, Mus musculus
ggtgtgtcataatctcactgtttgg

SEQ ID NO: 655048 - DNA, 25 bp, Mus musculus
ggtgtgtcatctagggagatctgta

SEQ ID NO: 655049 - DNA, 25 bp, Mus musculus
ggtgtgtcatcttgggagatctgta

SEQ ID NO: 655050 - DNA, 25 bp, Mus musculus
ggtgtgtccattctgagttctccgt

SEQ ID NO: 655051 - DNA, 25 bp, Mus musculus
ggtgtgtccattgtgagttctccgt

SEQ ID NO: 655052 - DNA, 25 bp, Mus musculus
ggtgtgtccccaagtttagtatttg

SEQ ID NO: 655053 - DNA, 25 bp, Mus musculus
ggtgtgtccccacctaatagatctc

SEQ ID NO: 655054 - DNA, 25 bp, Mus musculus
ggtgtgtccccagctaatagatctc

SEQ ID NO: 655055 - DNA, 25 bp, Mus musculus
ggtgtgtccccatgtttagtatttg

SEQ ID NO: 655056 - DNA, 25 bp, Mus musculus
ggtgtgtctaatcggaggttcctct

SEQ ID NO: 655057 - DNA, 25 bp, Mus musculus
ggtgtgtctaatgggaggttcctct

SEQ ID NO: 655058 - DNA, 25 bp, Mus musculus
ggtgtgtctatcacagagcatgcat

SEQ ID NO: 655059 - DNA, 25 bp, Mus musculus
ggtgtgtctatctcagagcatgcat

SEQ ID NO: 655060 - DNA, 25 bp, Mus musculus
ggtgtgtctcagattccacgacgaa

SEQ ID NO: 655061 - DNA, 25 bp, Mus musculus
ggtgtgtctcagtttccacgacgaa

SEQ ID NO: 655062 - DNA, 25 bp, Mus musculus
ggtgtgtctgaccggaggtactgga

SEQ ID NO: 655063 - DNA, 25 bp, Mus musculus
ggtgtgtctgacgggaggtactgga

SEQ ID NO: 655064 - DNA, 25 bp, Mus musculus
ggtgtgtctgatatccaacttttcc

SEQ ID NO: 655065 - DNA, 25 bp, Mus musculus
ggtgtgtctgatttccaacttttcc

SEQ ID NO: 655066 - DNA, 25 bp, Mus musculus
ggtgtgtctgtgattgccaacatgc

SEQ ID NO: 655067 - DNA, 25 bp, Mus musculus
ggtgtgtctgtgtttgccaacatgc

SEQ ID NO: 655068 - DNA, 25 bp, Mus musculus
ggtgtgtcttacagggaactctggc

SEQ ID NO: 655069 - DNA, 25 bp, Mus musculus
ggtgtgtcttactgggaactctggc

SEQ ID NO: 655070 - DNA, 25 bp, Mus musculus
ggtgtgtgaaaccacagagctccca

SEQ ID NO: 655071 - DNA, 25 bp, Mus musculus
ggtgtgtgaaacgacagagctccca

SEQ ID NO: 655072 - DNA, 25 bp, Mus musculus
ggtgtgtgatcaaccgctagagcat

SEQ ID NO: 655073 - DNA, 25 bp, Mus musculus
ggtgtgtgatcatccgctagagcat

SEQ ID NO: 655074 - DNA, 25 bp, Mus musculus
ggtgtgtgatctcatgggctcacca

SEQ ID NO: 655075 - DNA, 25 bp, Mus musculus
ggtgtgtgatctgatgggctcacca

SEQ ID NO: 655076 - DNA, 25 bp, Mus musculus
ggtgtgtgatgccaaagagctcaac

SEQ ID NO: 655077 - DNA, 25 bp, Mus musculus
ggtgtgtgatgcgaaagagctcaac

SEQ ID NO: 655078 - DNA, 25 bp, Mus musculus
ggtgtgtgcatactagtgtctcatc

SEQ ID NO: 655079 - DNA, 25 bp, Mus musculus
ggtgtgtgcatagtagtgtctcatc

SEQ ID NO: 655080 - DNA, 25 bp, Mus musculus
ggtgtgtgccacattggtgcaaata

SEQ ID NO: 655081 - DNA, 25 bp, Mus musculus
ggtgtgtgccactttggtgcaaata

SEQ ID NO: 655082 - DNA, 25 bp, Mus musculus
ggtgtgtgccagatgttaggtcttt

SEQ ID NO: 655083 - DNA, 25 bp, Mus musculus
ggtgtgtgccagttgttaggtcttt

SEQ ID NO: 655084 - DNA, 25 bp, Mus musculus
ggtgtgtgccataatgcctttgcag

SEQ ID NO: 655085 - DNA, 25 bp, Mus musculus
ggtgtgtgccatattaagtatctct

SEQ ID NO: 655086 - DNA, 25 bp, Mus musculus
ggtgtgtgccattatgcctttgcag

SEQ ID NO: 655087 - DNA, 25 bp, Mus musculus
ggtgtgtgccattttaagtatctct

SEQ ID NO: 655088 - DNA, 25 bp, Mus musculus
ggtgtgtgctacagtgcccgattgc

SEQ ID NO: 655089 - DNA, 25 bp, Mus musculus
ggtgtgtgctactgtgcccgattgc

SEQ ID NO: 655090 - DNA, 25 bp, Mus musculus
ggtgtgtggagtcccatttttattg

SEQ ID NO: 655091 - DNA, 25 bp, Mus musculus
ggtgtgtggagtgccatttttattg

SEQ ID NO: 655092 - DNA, 25 bp, Mus musculus
ggtgtgtggccgatctcactgcgca

SEQ ID NO: 655093 - DNA, 25 bp, Mus musculus
ggtgtgtggccgttctcactgcgca

SEQ ID NO: 655094 - DNA, 25 bp, Mus musculus
ggtgtgtggctgaatttttctattc

SEQ ID NO: 655095 - DNA, 25 bp, Mus musculus
ggtgtgtggctgtatttttctattc

SEQ ID NO: 655096 - DNA, 25 bp, Mus musculus
ggtgtgtgtaccactgcagcaggca

SEQ ID NO: 655097 - DNA, 25 bp, Mus musculus
ggtgtgtgtacctctgcagcaggca

SEQ ID NO: 655098 - DNA, 25 bp, Mus musculus
ggtgtgtgtgagagactttctttca

SEQ ID NO: 655099 - DNA, 25 bp, Mus musculus
ggtgtgtgtgagtgactttctttca

SEQ ID NO: 655100 - DNA, 25 bp, Mus musculus
ggtgtgtgttcgacaatactgcttc

SEQ ID NO: 655101 - DNA, 25 bp, Mus musculus
ggtgtgtgttcgtcaatactgcttc

SEQ ID NO: 655102 - DNA, 25 bp, Mus musculus
ggtgtgtgttgtacctgttttacca

SEQ ID NO: 655103 - DNA, 25 bp, Mus musculus
ggtgtgtgttgttcctgttttacca

SEQ ID NO: 655104 - DNA, 25 bp, Mus musculus
ggtgtgttcttcagagactctgtaa

SEQ ID NO: 655105 - DNA, 25 bp, Mus musculus
ggtgtgttcttctgagactctgtaa

SEQ ID NO: 655106 - DNA, 25 bp, Mus musculus
ggtgtgttgccccaaataacttcct

SEQ ID NO: 655107 - DNA, 25 bp, Mus musculus
ggtgtgttgcccgaaataacttcct

SEQ ID NO: 655108 - DNA, 25 bp, Mus musculus
ggtgtgttggacaggctgccagcat

SEQ ID NO: 655109 - DNA, 25 bp, Mus musculus
ggtgtgttggactggctgccagcat

SEQ ID NO: 655110 - DNA, 25 bp, Mus musculus
ggtgtgttgggaaacacctttaatt

SEQ ID NO: 655111 - DNA, 25 bp, Mus musculus
ggtgtgttgggatacacctttaatt

SEQ ID NO: 655112 - DNA, 25 bp, Mus musculus
ggtgtgttgttaatacagttgctta

SEQ ID NO: 655113 - DNA, 25 bp, Mus musculus
ggtgtgttgttattacagttgctta

SEQ ID NO: 655114 - DNA, 25 bp, Mus musculus
ggtgtgtttcagagtgtccatagag

SEQ ID NO: 655115 - DNA, 25 bp, Mus musculus
ggtgtgtttcagtgtgtccatagag

SEQ ID NO: 655116 - DNA, 25 bp, Mus musculus
ggtgtgtttgacctggacaagaaaa

SEQ ID NO: 655117 - DNA, 25 bp, Mus musculus
ggtgtgtttgacgtggacaagaaaa

SEQ ID NO: 655118 - DNA, 25 bp, Mus musculus
ggtgtgttttcaaaccacggcacct

SEQ ID NO: 655119 - DNA, 25 bp, Mus musculus
ggtgtgttttcataccacggcacct

SEQ ID NO: 655120 - DNA, 25 bp, Mus musculus
ggtgtgttttgcacttacattacag

SEQ ID NO: 655121 - DNA, 25 bp, Mus musculus
ggtgtgttttgctcttacattacag

SEQ ID NO: 655122 - DNA, 25 bp, Mus musculus
ggtgttaaatttcaacttatcccag

SEQ ID NO: 655123 - DNA, 25 bp, Mus musculus
ggtgttaaatttgaacttatcccag

SEQ ID NO: 655124 - DNA, 25 bp, Mus musculus
ggtgttaacacacgttgagcccaac

SEQ ID NO: 655125 - DNA, 25 bp, Mus musculus
ggtgttaacacaggttgagcccaac

SEQ ID NO: 655126 - DNA, 25 bp, Mus musculus
ggtgttaacacgcttgaggcatcat

SEQ ID NO: 655127 - DNA, 25 bp, Mus musculus
ggtgttaacacggttgaggcatcat

SEQ ID NO: 655128 - DNA, 25 bp, Mus musculus
ggtgttaacatcatcttccctataa

SEQ ID NO: 655129 - DNA, 25 bp, Mus musculus
ggtgttaacatcttcttccctataa

SEQ ID NO: 655130 - DNA, 25 bp, Mus musculus
ggtgttaaccatcacatccggacag

SEQ ID NO: 655131 - DNA, 25 bp, Mus musculus
ggtgttaaccatgacatccggacag

SEQ ID NO: 655132 - DNA, 25 bp, Mus musculus
ggtgttaagctgaacaccctggcag

SEQ ID NO: 655133 - DNA, 25 bp, Mus musculus
ggtgttaagctgtacaccctggcag

SEQ ID NO: 655134 - DNA, 25 bp, Mus musculus
ggtgttaaggtacttcccatggaga

SEQ ID NO: 655135 - DNA, 25 bp, Mus musculus
ggtgttaaggtagttcccatggaga

SEQ ID NO: 655136 - DNA, 25 bp, Mus musculus
ggtgttaatataatgcccaatcggg

SEQ ID NO: 655137 - DNA, 25 bp, Mus musculus
ggtgttaatatattgcccaatcggg

SEQ ID NO: 655138 - DNA, 25 bp, Mus musculus
ggtgttaatcagcaaacccatattg

SEQ ID NO: 655139 - DNA, 25 bp, Mus musculus
ggtgttaatcaggaaacccatattg

SEQ ID NO: 655140 - DNA, 25 bp, Mus musculus
ggtgttaatgtcactgtgtctcaga

SEQ ID NO: 655141 - DNA, 25 bp, Mus musculus
ggtgttaatgtctctgtgtctcaga

SEQ ID NO: 655142 - DNA, 25 bp, Mus musculus
ggtgttacaacacagtttcatgcat

SEQ ID NO: 655143 - DNA, 25 bp, Mus musculus
ggtgttacaacagagtttcatgcat

SEQ ID NO: 655144 - DNA, 25 bp, Mus musculus
ggtgttacaaccaagttacattctt

SEQ ID NO: 655145 - DNA, 25 bp, Mus musculus
ggtgttacaacctagttacattctt

SEQ ID NO: 655146 - DNA, 25 bp, Mus musculus
ggtgttacaagacctgttatccatt

SEQ ID NO: 655147 - DNA, 25 bp, Mus musculus
ggtgttacaagagctgttatccatt

SEQ ID NO: 655148 - DNA, 25 bp, Mus musculus
ggtgttacagtgctatctgcagttc

SEQ ID NO: 655149 - DNA, 25 bp, Mus musculus
ggtgttacagtggtatctgcagttc

SEQ ID NO: 655150 - DNA, 25 bp, Mus musculus
ggtgttacatccagaagttcaaaga

SEQ ID NO: 655151 - DNA, 25 bp, Mus musculus
ggtgttacatcctgaagttcaaaga

SEQ ID NO: 655152 - DNA, 25 bp, Mus musculus
ggtgttacattgatgctgcagataa

SEQ ID NO: 655153 - DNA, 25 bp, Mus musculus
ggtgttacattgttgctgcagataa

SEQ ID NO: 655154 - DNA, 25 bp, Mus musculus
ggtgttacctaacctgactttgaag

SEQ ID NO: 655155 - DNA, 25 bp, Mus musculus
ggtgttacctaagctgactttgaag

SEQ ID NO: 655156 - DNA, 25 bp, Mus musculus
ggtgttactatgcttcctgtgggac

SEQ ID NO: 655157 - DNA, 25 bp, Mus musculus
ggtgttactatggttcctgtgggac

SEQ ID NO: 655158 - DNA, 25 bp, Mus musculus
ggtgttactattctttgccattggt

SEQ ID NO: 655159 - DNA, 25 bp, Mus musculus
ggtgttactattgtttgccattggt

SEQ ID NO: 655160 - DNA, 25 bp, Mus musculus
ggtgttacttgcctgttcaagacca

SEQ ID NO: 655161 - DNA, 25 bp, Mus musculus
ggtgttacttgcgtgttcaagacca

SEQ ID NO: 655162 - DNA, 25 bp, Mus musculus
ggtgttagctcacgacagcagaatc

SEQ ID NO: 655163 - DNA, 25 bp, Mus musculus
ggtgttagctcaggacagcagaatc

SEQ ID NO: 655164 - DNA, 25 bp, Mus musculus
ggtgttagctctctaccactaagtt

SEQ ID NO: 655165 - DNA, 25 bp, Mus musculus
ggtgttagctctgtaccactaagtt

SEQ ID NO: 655166 - DNA, 25 bp, Mus musculus
ggtgttagtaagattccatttagca

SEQ ID NO: 655167 - DNA, 25 bp, Mus musculus
ggtgttagtaagtttccatttagca

SEQ ID NO: 655168 - DNA, 25 bp, Mus musculus
ggtgttataagcagggcgtatctgc

SEQ ID NO: 655169 - DNA, 25 bp, Mus musculus
ggtgttataagctgggcgtatctgc

SEQ ID NO: 655170 - DNA, 25 bp, Mus musculus
ggtgttatcaccaagctgaatgttt

SEQ ID NO: 655171 - DNA, 25 bp, Mus musculus
ggtgttatcacctagctgaatgttt

SEQ ID NO: 655172 - DNA, 25 bp, Mus musculus
ggtgttatcatcagtcatcagatga

SEQ ID NO: 655173 - DNA, 25 bp, Mus musculus
ggtgttatcatctgtcatcagatga

SEQ ID NO: 655174 - DNA, 25 bp, Mus musculus
ggtgttatccaccttttggtttgtg

SEQ ID NO: 655175 - DNA, 25 bp, Mus musculus
ggtgttatccacgttttggtttgtg

SEQ ID NO: 655176 - DNA, 25 bp, Mus musculus
ggtgttatccttcacaaggcctggg

SEQ ID NO: 655177 - DNA, 25 bp, Mus musculus
ggtgttatccttgacaaggcctggg

SEQ ID NO: 655178 - DNA, 25 bp, Mus musculus
ggtgttatgaaacccagcccagggt

SEQ ID NO: 655179 - DNA, 25 bp, Mus musculus
ggtgttatgaaagccagcccagggt

SEQ ID NO: 655180 - DNA, 25 bp, Mus musculus
ggtgttatgttccagtcttcttttc

SEQ ID NO: 655181 - DNA, 25 bp, Mus musculus
ggtgttatgttcgagtcttcttttc

SEQ ID NO: 655182 - DNA, 25 bp, Mus musculus
ggtgttattagcacttttgttcata

SEQ ID NO: 655183 - DNA, 25 bp, Mus musculus
ggtgttattagctcttttgttcata

SEQ ID NO: 655184 - DNA, 25 bp, Mus musculus
ggtgttattagtctcattagcccat

SEQ ID NO: 655185 - DNA, 25 bp, Mus musculus
ggtgttattagtgtcattagcccat

SEQ ID NO: 655186 - DNA, 25 bp, Mus musculus
ggtgttattgctattgctcagaatt

SEQ ID NO: 655187 - DNA, 25 bp, Mus musculus
ggtgttattgcttttgctcagaatt

SEQ ID NO: 655188 - DNA, 25 bp, Mus musculus
ggtgttattgtgacatgcttccata

SEQ ID NO: 655189 - DNA, 25 bp, Mus musculus
ggtgttattgtgtcatgcttccata

SEQ ID NO: 655190 - DNA, 25 bp, Mus musculus
ggtgttattttacacaaagccagta

SEQ ID NO: 655191 - DNA, 25 bp, Mus musculus
ggtgttattttagacaaagccagta

SEQ ID NO: 655192 - DNA, 25 bp, Mus musculus
ggtgttcaaacacttaactgtctac

SEQ ID NO: 655193 - DNA, 25 bp, Mus musculus
ggtgttcaaacagttaactgtctac

SEQ ID NO: 655194 - DNA, 25 bp, Mus musculus
ggtgttcaaattctgtcacatctga

SEQ ID NO: 655195 - DNA, 25 bp, Mus musculus
ggtgttcaaattgtgtcacatctga

SEQ ID NO: 655196 - DNA, 25 bp, Mus musculus
ggtgttcaagatcctgccatatcaa

SEQ ID NO: 655197 - DNA, 25 bp, Mus musculus
ggtgttcaagatgctgccatatcaa

SEQ ID NO: 655198 - DNA, 25 bp, Mus musculus
ggtgttcaatggcaaaaggccacga

SEQ ID NO: 655199 - DNA, 25 bp, Mus musculus
ggtgttcaatgggaaaaggccacga

SEQ ID NO: 655200 - DNA, 25 bp, Mus musculus
ggtgttcacacaagaaatcttacaa

SEQ ID NO: 655201 - DNA, 25 bp, Mus musculus
ggtgttcacacatgaaatcttacaa

SEQ ID NO: 655202 - DNA, 25 bp, Mus musculus
ggtgttcaccatctgttttggttat

SEQ ID NO: 655203 - DNA, 25 bp, Mus musculus
ggtgttcaccatgtgttttggttat

SEQ ID NO: 655204 - DNA, 25 bp, Mus musculus
ggtgttcacctcagtacagaccttt

SEQ ID NO: 655205 - DNA, 25 bp, Mus musculus
ggtgttcacctctgtacagaccttt

SEQ ID NO: 655206 - DNA, 25 bp, Mus musculus
ggtgttcagaacagcctcagcttga

SEQ ID NO: 655207 - DNA, 25 bp, Mus musculus
ggtgttcagaactgcctcagcttga

SEQ ID NO: 655208 - DNA, 25 bp, Mus musculus
ggtgttcagcacctaaatgacctat

SEQ ID NO: 655209 - DNA, 25 bp, Mus musculus
ggtgttcagcacgtaaatgacctat

SEQ ID NO: 655210 - DNA, 25 bp, Mus musculus
ggtgttcagcatctgagaggcccct

SEQ ID NO: 655211 - DNA, 25 bp, Mus musculus
ggtgttcagcatgtgagaggcccct

SEQ ID NO: 655212 - DNA, 25 bp, Mus musculus
ggtgttcagctcactactggaggat

SEQ ID NO: 655213 - DNA, 25 bp, Mus musculus
ggtgttcagctcatcacagggagta

SEQ ID NO: 655214 - DNA, 25 bp, Mus musculus
ggtgttcagctctctactggaggat

SEQ ID NO: 655215 - DNA, 25 bp, Mus musculus
ggtgttcagctcttcacagggagta

SEQ ID NO: 655216 - DNA, 25 bp, Mus musculus
ggtgttcagtaccagcattgcttct

SEQ ID NO: 655217 - DNA, 25 bp, Mus musculus
ggtgttcagtacgagcattgcttct

SEQ ID NO: 655218 - DNA, 25 bp, Mus musculus
ggtgttcagtggaatagatcccagc

SEQ ID NO: 655219 - DNA, 25 bp, Mus musculus
ggtgttcagtggagtatatttcttc

SEQ ID NO: 655220 - DNA, 25 bp, Mus musculus
ggtgttcagtggtatagatcccagc

SEQ ID NO: 655221 - DNA, 25 bp, Mus musculus
ggtgttcagtggtgtatatttcttc

SEQ ID NO: 655222 - DNA, 25 bp, Mus musculus
ggtgttcagttaattcttctgggac

SEQ ID NO: 655223 - DNA, 25 bp, Mus musculus
ggtgttcagttatttcttctgggac

SEQ ID NO: 655224 - DNA, 25 bp, Mus musculus
ggtgttcagttgaccacagaacaga

SEQ ID NO: 655225 - DNA, 25 bp, Mus musculus
ggtgttcagttgtccacagaacaga

SEQ ID NO: 655226 - DNA, 25 bp, Mus musculus
ggtgttcatcgaaggacccctagcc

SEQ ID NO: 655227 - DNA, 25 bp, Mus musculus
ggtgttcatcgatggacccctagcc

SEQ ID NO: 655228 - DNA, 25 bp, Mus musculus
ggtgttcatggaagcctgtgtactt

SEQ ID NO: 655229 - DNA, 25 bp, Mus musculus
ggtgttcatggatgcctgtgtactt

SEQ ID NO: 655230 - DNA, 25 bp, Mus musculus
ggtgttcatgtaaagcccagctatg

SEQ ID NO: 655231 - DNA, 25 bp, Mus musculus
ggtgttcatgtatagcccagctatg

SEQ ID NO: 655232 - DNA, 25 bp, Mus musculus
ggtgttcatgtgaatccctttaagt

SEQ ID NO: 655233 - DNA, 25 bp, Mus musculus
ggtgttcatgtgtatccctttaagt

SEQ ID NO: 655234 - DNA, 25 bp, Mus musculus
ggtgttcattctatcttcatgtttg

SEQ ID NO: 655235 - DNA, 25 bp, Mus musculus
ggtgttcattctttcttcatgtttg

SEQ ID NO: 655236 - DNA, 25 bp, Mus musculus
ggtgttccaaagacaatcctccatt

SEQ ID NO: 655237 - DNA, 25 bp, Mus musculus
ggtgttccaaagtcaatcctccatt

SEQ ID NO: 655238 - DNA, 25 bp, Mus musculus
ggtgttccaagtataggcctctcta

SEQ ID NO: 655239 - DNA, 25 bp, Mus musculus
ggtgttccaagtttaggcctctcta

SEQ ID NO: 655240 - DNA, 25 bp, Mus musculus
ggtgttccaatcactcagtgtgaag

SEQ ID NO: 655241 - DNA, 25 bp, Mus musculus
ggtgttccaatctctcagtgtgaag

SEQ ID NO: 655242 - DNA, 25 bp, Mus musculus
ggtgttccatatctacttctgtgta

SEQ ID NO: 655243 - DNA, 25 bp, Mus musculus
ggtgttccatatgtacttctgtgta

SEQ ID NO: 655244 - DNA, 25 bp, Mus musculus
ggtgttcccatcaaaaggtggtgtt

SEQ ID NO: 655245 - DNA, 25 bp, Mus musculus
ggtgttcccatctaaaggtggtgtt

SEQ ID NO: 655246 - DNA, 25 bp, Mus musculus
ggtgttcccgcacccatattgtatt

SEQ ID NO: 655247 - DNA, 25 bp, Mus musculus
ggtgttcccgcagccatattgtatt

SEQ ID NO: 655248 - DNA, 25 bp, Mus musculus
ggtgttcccttccataagatttgct

SEQ ID NO: 655249 - DNA, 25 bp, Mus musculus
ggtgttcccttcgataagatttgct

SEQ ID NO: 655250 - DNA, 25 bp, Mus musculus
ggtgttcccttgaaatgaatgctga

SEQ ID NO: 655251 - DNA, 25 bp, Mus musculus
ggtgttcccttgtaatgaatgctga

SEQ ID NO: 655252 - DNA, 25 bp, Mus musculus
ggtgttccgcatctatgaggaccat

SEQ ID NO: 655253 - DNA, 25 bp, Mus musculus
ggtgttccgcatgtatgaggaccat

SEQ ID NO: 655254 - DNA, 25 bp, Mus musculus
ggtgttccgtttcttggtctgcttt

SEQ ID NO: 655255 - DNA, 25 bp, Mus musculus
ggtgttccgtttgttggtctgcttt

SEQ ID NO: 655256 - DNA, 25 bp, Mus musculus
ggtgttcctcttcatttgggtatat

SEQ ID NO: 655257 - DNA, 25 bp, Mus musculus
ggtgttcctcttgatttgggtatat

SEQ ID NO: 655258 - DNA, 25 bp, Mus musculus
ggtgttcctggacaacgtgatccgc

SEQ ID NO: 655259 - DNA, 25 bp, Mus musculus
ggtgttcctggagaacgtgatccgc

SEQ ID NO: 655260 - DNA, 25 bp, Mus musculus
ggtgttcctgtaaatttggttctat

SEQ ID NO: 655261 - DNA, 25 bp, Mus musculus
ggtgttcctgtaagtacctttagtt

SEQ ID NO: 655262 - DNA, 25 bp, Mus musculus
ggtgttcctgtatatttggttctat

SEQ ID NO: 655263 - DNA, 25 bp, Mus musculus
ggtgttcctgtatgtacctttagtt

SEQ ID NO: 655264 - DNA, 25 bp, Mus musculus
ggtgttccttgaaaattctgagcat

SEQ ID NO: 655265 - DNA, 25 bp, Mus musculus
ggtgttccttgataattctgagcat

SEQ ID NO: 655266 - DNA, 25 bp, Mus musculus
ggtgttccttgcagttccaaaatgc

SEQ ID NO: 655267 - DNA, 25 bp, Mus musculus
ggtgttccttgctgttccaaaatgc

SEQ ID NO: 655268 - DNA, 25 bp, Mus musculus
ggtgttcctttaattcacttataag

SEQ ID NO: 655269 - DNA, 25 bp, Mus musculus
ggtgttcctttatttcacttataag

SEQ ID NO: 655270 - DNA, 25 bp, Mus musculus
ggtgttcgtgtgaaatctcagcatt

SEQ ID NO: 655271 - DNA, 25 bp, Mus musculus
ggtgttcgtgtgtaatctcagcatt

SEQ ID NO: 655272 - DNA, 25 bp, Mus musculus
ggtgttctaagtagtcgcgtcatca

SEQ ID NO: 655273 - DNA, 25 bp, Mus musculus
ggtgttctaagttgtcgcgtcatca

SEQ ID NO: 655274 - DNA, 25 bp, Mus musculus
ggtgttctaattctgaggcactttg

SEQ ID NO: 655275 - DNA, 25 bp, Mus musculus
ggtgttctaattgtgaggcactttg

SEQ ID NO: 655276 - DNA, 25 bp, Mus musculus
ggtgttctatatatgttcagttgct

SEQ ID NO: 655277 - DNA, 25 bp, Mus musculus
ggtgttctatatttgttcagttgct

SEQ ID NO: 655278 - DNA, 25 bp, Mus musculus
ggtgttctatgaatgagctatagct

SEQ ID NO: 655279 - DNA, 25 bp, Mus musculus
ggtgttctatgattgagctatagct

SEQ ID NO: 655280 - DNA, 25 bp, Mus musculus
ggtgttctattcaccagttgacttc

SEQ ID NO: 655281 - DNA, 25 bp, Mus musculus
ggtgttctattctccagttgacttc

SEQ ID NO: 655282 - DNA, 25 bp, Mus musculus
ggtgttctcagacttcggtttccca

SEQ ID NO: 655283 - DNA, 25 bp, Mus musculus
ggtgttctcagagttcggtttccca

SEQ ID NO: 655284 - DNA, 25 bp, Mus musculus
ggtgttctcattatatcttcccata

SEQ ID NO: 655285 - DNA, 25 bp, Mus musculus
ggtgttctcattttatcttcccata

SEQ ID NO: 655286 - DNA, 25 bp, Mus musculus
ggtgttctccaacgaaccgtatcaa

SEQ ID NO: 655287 - DNA, 25 bp, Mus musculus
ggtgttctccaaggaaccgtatcaa

SEQ ID NO: 655288 - DNA, 25 bp, Mus musculus
ggtgttctctcaactgtcatttctg

SEQ ID NO: 655289 - DNA, 25 bp, Mus musculus
ggtgttctctcatctgtcatttctg

SEQ ID NO: 655290 - DNA, 25 bp, Mus musculus
ggtgttctcttcagtcatggcgaca

SEQ ID NO: 655291 - DNA, 25 bp, Mus musculus
ggtgttctcttctgtcatggcgaca

SEQ ID NO: 655292 - DNA, 25 bp, Mus musculus
ggtgttctgaagagtccagctacaa

SEQ ID NO: 655293 - DNA, 25 bp, Mus musculus
ggtgttctgaagtgtccagctacaa

SEQ ID NO: 655294 - DNA, 25 bp, Mus musculus
ggtgttctgagccatcaggccagct

SEQ ID NO: 655295 - DNA, 25 bp, Mus musculus
ggtgttctgagcgatcaggccagct

SEQ ID NO: 655296 - DNA, 25 bp, Mus musculus
ggtgttctgataaaatggccatcca

SEQ ID NO: 655297 - DNA, 25 bp, Mus musculus
ggtgttctgatataatggccatcca

SEQ ID NO: 655298 - DNA, 25 bp, Mus musculus
ggtgttctgcccaaatgtatgcctc

SEQ ID NO: 655299 - DNA, 25 bp, Mus musculus
ggtgttctgccctaatgtatgcctc

SEQ ID NO: 655300 - DNA, 25 bp, Mus musculus
ggtgttctgcggctgtcccttgctt

SEQ ID NO: 655301 - DNA, 25 bp, Mus musculus
ggtgttctgcgggtgtcccttgctt

SEQ ID NO: 655302 - DNA, 25 bp, Mus musculus
ggtgttctgctaactgttcattatc

SEQ ID NO: 655303 - DNA, 25 bp, Mus musculus
ggtgttctgctatctgttcattatc

SEQ ID NO: 655304 - DNA, 25 bp, Mus musculus
ggtgttctggcacacgactttagtc

SEQ ID NO: 655305 - DNA, 25 bp, Mus musculus
ggtgttctggcagacgactttagtc

SEQ ID NO: 655306 - DNA, 25 bp, Mus musculus
ggtgttctgtgaaattaagtgctgt

SEQ ID NO: 655307 - DNA, 25 bp, Mus musculus
ggtgttctgtgatattaagtgctgt

SEQ ID NO: 655308 - DNA, 25 bp, Mus musculus
ggtgttctgtgtactcattgattca

SEQ ID NO: 655309 - DNA, 25 bp, Mus musculus
ggtgttctgtgttctcattgattca

SEQ ID NO: 655310 - DNA, 25 bp, Mus musculus
ggtgttcttagaccagggccatctc

SEQ ID NO: 655311 - DNA, 25 bp, Mus musculus
ggtgttcttagagcagggccatctc

SEQ ID NO: 655312 - DNA, 25 bp, Mus musculus
ggtgttcttcctaaatagtctttct

SEQ ID NO: 655313 - DNA, 25 bp, Mus musculus
ggtgttcttccttaatagtctttct

SEQ ID NO: 655314 - DNA, 25 bp, Mus musculus
ggtgttcttgaaactcacaaccatt

SEQ ID NO: 655315 - DNA, 25 bp, Mus musculus
ggtgttcttgaatctcacaaccatt

SEQ ID NO: 655316 - DNA, 25 bp, Mus musculus
ggtgttctttgccatgcacggaata

SEQ ID NO: 655317 - DNA, 25 bp, Mus musculus
ggtgttctttgcgatgcacggaata

SEQ ID NO: 655318 - DNA, 25 bp, Mus musculus
ggtgttctttggcaaggttctccct

SEQ ID NO: 655319 - DNA, 25 bp, Mus musculus
ggtgttctttgggaaggttctccct

SEQ ID NO: 655320 - DNA, 25 bp, Mus musculus
ggtgttgaacaactaagtcagtaat

SEQ ID NO: 655321 - DNA, 25 bp, Mus musculus
ggtgttgaacaagtaagtcagtaat

SEQ ID NO: 655322 - DNA, 25 bp, Mus musculus
ggtgttgaacccagggctacctcct

SEQ ID NO: 655323 - DNA, 25 bp, Mus musculus
ggtgttgaaccctgggctacctcct

SEQ ID NO: 655324 - DNA, 25 bp, Mus musculus
ggtgttgaagcgatgactgctcttc

SEQ ID NO: 655325 - DNA, 25 bp, Mus musculus
ggtgttgaagcgttgactgctcttc

SEQ ID NO: 655326 - DNA, 25 bp, Mus musculus
ggtgttgacaagatccaccatctgt

SEQ ID NO: 655327 - DNA, 25 bp, Mus musculus
ggtgttgacaagttccaccatctgt

SEQ ID NO: 655328 - DNA, 25 bp, Mus musculus
ggtgttgacctcagattctttccac

SEQ ID NO: 655329 - DNA, 25 bp, Mus musculus
ggtgttgacctctgattctttccac

SEQ ID NO: 655330 - DNA, 25 bp, Mus musculus
ggtgttgaccttccattttgaagtt

SEQ ID NO: 655331 - DNA, 25 bp, Mus musculus
ggtgttgaccttgcattttgaagtt

SEQ ID NO: 655332 - DNA, 25 bp, Mus musculus
ggtgttgactccagacacacaaata

SEQ ID NO: 655333 - DNA, 25 bp, Mus musculus
ggtgttgactcctgacacacaaata

SEQ ID NO: 655334 - DNA, 25 bp, Mus musculus
ggtgttgacttcagagtagttccta

SEQ ID NO: 655335 - DNA, 25 bp, Mus musculus
ggtgttgacttctgagtagttccta

SEQ ID NO: 655336 - DNA, 25 bp, Mus musculus
ggtgttgaggctattagatactgta

SEQ ID NO: 655337 - DNA, 25 bp, Mus musculus
ggtgttgaggcttttagatactgta

SEQ ID NO: 655338 - DNA, 25 bp, Mus musculus
ggtgttgaggttcgtctgacttact

SEQ ID NO: 655339 - DNA, 25 bp, Mus musculus
ggtgttgaggttggtctgacttact

SEQ ID NO: 655340 - DNA, 25 bp, Mus musculus
ggtgttgagtgtctccctctgtgaa

SEQ ID NO: 655341 - DNA, 25 bp, Mus musculus
ggtgttgagtgtgtccctctgtgaa

SEQ ID NO: 655342 - DNA, 25 bp, Mus musculus
ggtgttgatcccaggtctccacaga

SEQ ID NO: 655343 - DNA, 25 bp, Mus musculus
ggtgttgatccctggtctccacaga

SEQ ID NO: 655344 - DNA, 25 bp, Mus musculus
ggtgttgattgcaaatcactttaga

SEQ ID NO: 655345 - DNA, 25 bp, Mus musculus
ggtgttgattgctaatcactttaga

SEQ ID NO: 655346 - DNA, 25 bp, Mus musculus
ggtgttgcaccccttttattatgtc

SEQ ID NO: 655347 - DNA, 25 bp, Mus musculus
ggtgttgcacccgttttattatgtc

SEQ ID NO: 655348 - DNA, 25 bp, Mus musculus
ggtgttgcagctaaacttcccagaa

SEQ ID NO: 655349 - DNA, 25 bp, Mus musculus
ggtgttgcagcttaacttcccagaa

SEQ ID NO: 655350 - DNA, 25 bp, Mus musculus
ggtgttgcccaacctagaatgcatg

SEQ ID NO: 655351 - DNA, 25 bp, Mus musculus
ggtgttgcccaagctagaatgcatg

SEQ ID NO: 655352 - DNA, 25 bp, Mus musculus
ggtgttgcccagattgctctcagaa

SEQ ID NO: 655353 - DNA, 25 bp, Mus musculus
ggtgttgcccagtttgctctcagaa

SEQ ID NO: 655354 - DNA, 25 bp, Mus musculus
ggtgttgccccgactccagatcagc

SEQ ID NO: 655355 - DNA, 25 bp, Mus musculus
ggtgttgccccgtctccagatcagc

SEQ ID NO: 655356 - DNA, 25 bp, Mus musculus
ggtgttgccgttcaaagactggatt

SEQ ID NO: 655357 - DNA, 25 bp, Mus musculus
ggtgttgccgttgaaagactggatt

SEQ ID NO: 655358 - DNA, 25 bp, Mus musculus
ggtgttgcctgcacattgtgcatac

SEQ ID NO: 655359 - DNA, 25 bp, Mus musculus
ggtgttgcctgctcattgtgcatac

SEQ ID NO: 655360 - DNA, 25 bp, Mus musculus
ggtgttgccttaatcctgtgtagcc

SEQ ID NO: 655361 - DNA, 25 bp, Mus musculus
ggtgttgccttattcctgtgtagcc

SEQ ID NO: 655362 - DNA, 25 bp, Mus musculus
ggtgttgctgacatctcagtgctgc

SEQ ID NO: 655363 - DNA, 25 bp, Mus musculus
ggtgttgctgacttctcagtgctgc

SEQ ID NO: 655364 - DNA, 25 bp, Mus musculus
ggtgttggaccccaggaactgcaaa

SEQ ID NO: 655365 - DNA, 25 bp, Mus musculus
ggtgttggacccgaggaactgcaaa

SEQ ID NO: 655366 - DNA, 25 bp, Mus musculus
ggtgttggcaatctaacctgggtcc

SEQ ID NO: 655367 - DNA, 25 bp, Mus musculus
ggtgttggcaatgtaacctgggtcc

SEQ ID NO: 655368 - DNA, 25 bp, Mus musculus
ggtgttgggctccatgctactctgc

SEQ ID NO: 655369 - DNA, 25 bp, Mus musculus
ggtgttgggctcgatgctactctgc

SEQ ID NO: 655370 - DNA, 25 bp, Mus musculus
ggtgttggtgatacctttccagaac

SEQ ID NO: 655371 - DNA, 25 bp, Mus musculus
ggtgttggtgattcctttccagaac

SEQ ID NO: 655372 - DNA, 25 bp, Mus musculus
ggtgttgtacagctcacatgtttac

SEQ ID NO: 655373 - DNA, 25 bp, Mus musculus
ggtgttgtacaggtcacatgtttac

SEQ ID NO: 655374 - DNA, 25 bp, Mus musculus
ggtgttgtatcaatttacctactaa

SEQ ID NO: 655375 - DNA, 25 bp, Mus musculus
ggtgttgtatcattttacctactaa

SEQ ID NO: 655376 - DNA, 25 bp, Mus musculus
ggtgttgtcctaaagagccgtttct

SEQ ID NO: 655377 - DNA, 25 bp, Mus musculus
ggtgttgtcctatagagccgtttct

SEQ ID NO: 655378 - DNA, 25 bp, Mus musculus
ggtgttgtctccaggaagcatcatg

SEQ ID NO: 655379 - DNA, 25 bp, Mus musculus
ggtgttgtctcctggaagcatcatg

SEQ ID NO: 655380 - DNA, 25 bp, Mus musculus
ggtgttgtgcagcactttattttct

SEQ ID NO: 655381 - DNA, 25 bp, Mus musculus
ggtgttgtgcaggactttattttct

SEQ ID NO: 655382 - DNA, 25 bp, Mus musculus
ggtgttgtgtgtatttcttgcttaa

SEQ ID NO: 655383 - DNA, 25 bp, Mus musculus
ggtgttgtgtgtttttcttgcttaa

SEQ ID NO: 655384 - DNA, 25 bp, Mus musculus
ggtgttgttaccacagccattcaaa

SEQ ID NO: 655385 - DNA, 25 bp, Mus musculus
ggtgttgttacctcagccattcaaa

SEQ ID NO: 655386 - DNA, 25 bp, Mus musculus
ggtgttgttctccttgatcagcatc

SEQ ID NO: 655387 - DNA, 25 bp, Mus musculus
ggtgttgttctcgttgatcagcatc

SEQ ID NO: 655388 - DNA, 25 bp, Mus musculus
ggtgtttaaacaaggcaccaaacca

SEQ ID NO: 655389 - DNA, 25 bp, Mus musculus
ggtgtttaaacatggcaccaaacca

SEQ ID NO: 655390 - DNA, 25 bp, Mus musculus
ggtgtttaacatacctgtacctgtt

SEQ ID NO: 655391 - DNA, 25 bp, Mus musculus
ggtgtttaacattcctgtacctgtt

SEQ ID NO: 655392 - DNA, 25 bp, Mus musculus
ggtgtttaacttactagtgatgatg

SEQ ID NO: 655393 - DNA, 25 bp, Mus musculus
ggtgtttaactttctagtgatgatg

SEQ ID NO: 655394 - DNA, 25 bp, Mus musculus
ggtgtttaagccctgttccatatta

SEQ ID NO: 655395 - DNA, 25 bp, Mus musculus
ggtgtttaagccgtgttccatatta

SEQ ID NO: 655396 - DNA, 25 bp, Mus musculus
ggtgtttaatttccgacctgaatca

SEQ ID NO: 655397 - DNA, 25 bp, Mus musculus
ggtgtttaatttgcgacctgaatca

SEQ ID NO: 655398 - DNA, 25 bp, Mus musculus
ggtgtttacagactccatcctcgaa

SEQ ID NO: 655399 - DNA, 25 bp, Mus musculus
ggtgtttacagagtccatcctcgaa

SEQ ID NO: 655400 - DNA, 25 bp, Mus musculus
ggtgtttacagccttggagatatgt

SEQ ID NO: 655401 - DNA, 25 bp, Mus musculus
ggtgtttacagcgttggagatatgt

SEQ ID NO: 655402 - DNA, 25 bp, Mus musculus
ggtgtttattatccatcaacctatg

SEQ ID NO: 655403 - DNA, 25 bp, Mus musculus
ggtgtttattatgcatcaacctatg

SEQ ID NO: 655404 - DNA, 25 bp, Mus musculus
ggtgtttcactgaatctacttgatg

SEQ ID NO: 655405 - DNA, 25 bp, Mus musculus
ggtgtttcactgtatctacttgatg

SEQ ID NO: 655406 - DNA, 25 bp, Mus musculus
ggtgtttccaccaagaagctgagca

SEQ ID NO: 655407 - DNA, 25 bp, Mus musculus
ggtgtttccacctagaagctgagca

SEQ ID NO: 655408 - DNA, 25 bp, Mus musculus
ggtgtttccatgaaaatcctgccag

SEQ ID NO: 655409 - DNA, 25 bp, Mus musculus
ggtgtttccatgacctgaccagatt

SEQ ID NO: 655410 - DNA, 25 bp, Mus musculus
ggtgtttccatgtaaatcctgccag

SEQ ID NO: 655411 - DNA, 25 bp, Mus musculus
ggtgtttccatgtcctgaccagatt

SEQ ID NO: 655412 - DNA, 25 bp, Mus musculus
ggtgtttcctatccaaaccagtaag

SEQ ID NO: 655413 - DNA, 25 bp, Mus musculus
ggtgtttcctatgcaaaccagtaag

SEQ ID NO: 655414 - DNA, 25 bp, Mus musculus
ggtgtttcctcacctcttgaatagg

SEQ ID NO: 655415 - DNA, 25 bp, Mus musculus
ggtgtttcctcagctcttgaatagg

SEQ ID NO: 655416 - DNA, 25 bp, Mus musculus
ggtgtttccttgatctacaaagctg

SEQ ID NO: 655417 - DNA, 25 bp, Mus musculus
ggtgtttccttgttctacaaagctg

SEQ ID NO: 655418 - DNA, 25 bp, Mus musculus
ggtgtttcctttcccttatgaatat

SEQ ID NO: 655419 - DNA, 25 bp, Mus musculus
ggtgtttcctttgccttatgaatat

SEQ ID NO: 655420 - DNA, 25 bp, Mus musculus
ggtgtttcgccgcaacctgtaccat

SEQ ID NO: 655421 - DNA, 25 bp, Mus musculus
ggtgtttcgccggaacctgtaccat

SEQ ID NO: 655422 - DNA, 25 bp, Mus musculus
ggtgtttctatcagacaacgctgcc

SEQ ID NO: 655423 - DNA, 25 bp, Mus musculus
ggtgtttctatctgacaacgctgcc

SEQ ID NO: 655424 - DNA, 25 bp, Mus musculus
ggtgtttctccaatagttcttcctg

SEQ ID NO: 655425 - DNA, 25 bp, Mus musculus
ggtgtttctccattagttcttcctg

SEQ ID NO: 655426 - DNA, 25 bp, Mus musculus
ggtgtttctgctcttgaagattcct

SEQ ID NO: 655427 - DNA, 25 bp, Mus musculus
ggtgtttctgctgttgaagattcct

SEQ ID NO: 655428 - DNA, 25 bp, Mus musculus
ggtgtttctggccatttgattctac

SEQ ID NO: 655429 - DNA, 25 bp, Mus musculus
ggtgtttctggcgatttgattctac

SEQ ID NO: 655430 - DNA, 25 bp, Mus musculus
ggtgtttctgtgagctctgtccttc

SEQ ID NO: 655431 - DNA, 25 bp, Mus musculus
ggtgtttctgtgtgctctgtccttc

SEQ ID NO: 655432 - DNA, 25 bp, Mus musculus
ggtgtttcttgaaatgtctccaatt

SEQ ID NO: 655433 - DNA, 25 bp, Mus musculus
ggtgtttcttgactttaccaactca

SEQ ID NO: 655434 - DNA, 25 bp, Mus musculus
ggtgtttcttgagtttaccaactca

SEQ ID NO: 655435 - DNA, 25 bp, Mus musculus
ggtgtttcttgatatgtctccaatt

SEQ ID NO: 655436 - DNA, 25 bp, Mus musculus
ggtgtttcttttaagctactatggg

SEQ ID NO: 655437 - DNA, 25 bp, Mus musculus
ggtgtttctttttagctactatggg

SEQ ID NO: 655438 - DNA, 25 bp, Mus musculus
ggtgtttgaatgatttcctgccctt

SEQ ID NO: 655439 - DNA, 25 bp, Mus musculus
ggtgtttgaatgttttcctgccctt

SEQ ID NO: 655440 - DNA, 25 bp, Mus musculus
ggtgtttgacaaaccaagcacagtg

SEQ ID NO: 655441 - DNA, 25 bp, Mus musculus
ggtgtttgacaacggcagcatttat

SEQ ID NO: 655442 - DNA, 25 bp, Mus musculus
ggtgtttgacaagggcagcatttat

SEQ ID NO: 655443 - DNA, 25 bp, Mus musculus
ggtgtttgacaatccaagcacagtg

SEQ ID NO: 655444 - DNA, 25 bp, Mus musculus
ggtgtttgacacagccagtgctctt

SEQ ID NO: 655445 - DNA, 25 bp, Mus musculus
ggtgtttgacactgccagtgctctt

SEQ ID NO: 655446 - DNA, 25 bp, Mus musculus
ggtgtttgacctccggcgctttcag

SEQ ID NO: 655447 - DNA, 25 bp, Mus musculus
ggtgtttgacctgcggcgctttcag

SEQ ID NO: 655448 - DNA, 25 bp, Mus musculus
ggtgtttgctccagagcacacactc

SEQ ID NO: 655449 - DNA, 25 bp, Mus musculus
ggtgtttgctcctgagcacacactc

SEQ ID NO: 655450 - DNA, 25 bp, Mus musculus
ggtgtttgcttcaaactcagatgac

SEQ ID NO: 655451 - DNA, 25 bp, Mus musculus
ggtgtttgcttctaactcagatgac

SEQ ID NO: 655452 - DNA, 25 bp, Mus musculus
ggtgtttggcgacaaactttataca

SEQ ID NO: 655453 - DNA, 25 bp, Mus musculus
ggtgtttggcgagaaactttataca

SEQ ID NO: 655454 - DNA, 25 bp, Mus musculus
ggtgtttggcttataaattacttca

SEQ ID NO: 655455 - DNA, 25 bp, Mus musculus
ggtgtttggcttttaaattacttca

SEQ ID NO: 655456 - DNA, 25 bp, Mus musculus
ggtgtttgggtcactcactgctgcg

SEQ ID NO: 655457 - DNA, 25 bp, Mus musculus
ggtgtttgggtctctcactgctgcg

SEQ ID NO: 655458 - DNA, 25 bp, Mus musculus
ggtgtttggtacatagtgggctctc

SEQ ID NO: 655459 - DNA, 25 bp, Mus musculus
ggtgtttggtacttagtgggctctc

SEQ ID NO: 655460 - DNA, 25 bp, Mus musculus
ggtgtttgtaagcttctgactcagt

SEQ ID NO: 655461 - DNA, 25 bp, Mus musculus
ggtgtttgtaaggttctgactcagt

SEQ ID NO: 655462 - DNA, 25 bp, Mus musculus
ggtgtttgtaccattcagtctcatc

SEQ ID NO: 655463 - DNA, 25 bp, Mus musculus
ggtgtttgtacctttcagtctcatc

SEQ ID NO: 655464 - DNA, 25 bp, Mus musculus
ggtgtttgtattctgcttatggcta

SEQ ID NO: 655465 - DNA, 25 bp, Mus musculus
ggtgtttgtattgtgcttatggcta

SEQ ID NO: 655466 - DNA, 25 bp, Mus musculus
ggtgtttgtcctatctctctgtaca

SEQ ID NO: 655467 - DNA, 25 bp, Mus musculus
ggtgtttgtcctttctctctgtaca

SEQ ID NO: 655468 - DNA, 25 bp, Mus musculus
ggtgtttgttgcagcaaagggcttt

SEQ ID NO: 655469 - DNA, 25 bp, Mus musculus
ggtgtttgttgctgcaaagggcttt

SEQ ID NO: 655470 - DNA, 25 bp, Mus musculus
ggtgttttacagctttgtccagaca

SEQ ID NO: 655471 - DNA, 25 bp, Mus musculus
ggtgttttacaggtttgtccagaca

SEQ ID NO: 655472 - DNA, 25 bp, Mus musculus
ggtgttttacatcgtgattcgcatt

SEQ ID NO: 655473 - DNA, 25 bp, Mus musculus
ggtgttttacatggtgattcgcatt

SEQ ID NO: 655474 - DNA, 25 bp, Mus musculus
ggtgttttagtgctcaaagcctttg

SEQ ID NO: 655475 - DNA, 25 bp, Mus musculus
ggtgttttagtggtcaaagcctttg

SEQ ID NO: 655476 - DNA, 25 bp, Mus musculus
ggtgttttatccaggtactcggaca

SEQ ID NO: 655477 - DNA, 25 bp, Mus musculus
ggtgttttatcctggtactcggaca

SEQ ID NO: 655478 - DNA, 25 bp, Mus musculus
ggtgttttcaataacctgtgtcatt

SEQ ID NO: 655479 - DNA, 25 bp, Mus musculus
ggtgttttcaattacctgtgtcatt

SEQ ID NO: 655480 - DNA, 25 bp, Mus musculus
ggtgttttcaggagtgcctaaatgt

SEQ ID NO: 655481 - DNA, 25 bp, Mus musculus
ggtgttttcaggtgtgcctaaatgt

SEQ ID NO: 655482 - DNA, 25 bp, Mus musculus
ggtgttttccataaacctactccat

SEQ ID NO: 655483 - DNA, 25 bp, Mus musculus
ggtgttttccatctattatactttg

SEQ ID NO: 655484 - DNA, 25 bp, Mus musculus
ggtgttttccatgtattatactttg

SEQ ID NO: 655485 - DNA, 25 bp, Mus musculus
ggtgttttccattaacctactccat

SEQ ID NO: 655486 - DNA, 25 bp, Mus musculus
ggtgttttcctgcagagatcttttg

SEQ ID NO: 655487 - DNA, 25 bp, Mus musculus
ggtgttttcctggagagatcttttg

SEQ ID NO: 655488 - DNA, 25 bp, Mus musculus
ggtgttttctacaaaacctcattca

SEQ ID NO: 655489 - DNA, 25 bp, Mus musculus
ggtgttttctactaaacctcattca

SEQ ID NO: 655490 - DNA, 25 bp, Mus musculus
ggtgttttctcacatccagtttgta

SEQ ID NO: 655491 - DNA, 25 bp, Mus musculus
ggtgttttctcagatccagtttgta

SEQ ID NO: 655492 - DNA, 25 bp, Mus musculus
ggtgttttctgcaccaaaagtcttg

SEQ ID NO: 655493 - DNA, 25 bp, Mus musculus
ggtgttttctgctccaaaagtcttg

SEQ ID NO: 655494 - DNA, 25 bp, Mus musculus
ggtgttttgacaaagcaacttcctg

SEQ ID NO: 655495 - DNA, 25 bp, Mus musculus
ggtgttttgacatagcaacttcctg

SEQ ID NO: 655496 - DNA, 25 bp, Mus musculus
ggtgttttgagcctacaaagagtct

SEQ ID NO: 655497 - DNA, 25 bp, Mus musculus
ggtgttttgagcgtacaaagagtct

SEQ ID NO: 655498 - DNA, 25 bp, Mus musculus
ggtgttttgcccattaaatcaagag

SEQ ID NO: 655499 - DNA, 25 bp, Mus musculus
ggtgttttgccctttaaatcaagag

SEQ ID NO: 655500 - DNA, 25 bp, Mus musculus
ggtgttttgccgctatgtctatatt

SEQ ID NO: 655501 - DNA, 25 bp, Mus musculus
ggtgttttgccggtatgtctatatt

SEQ ID NO: 655502 - DNA, 25 bp, Mus musculus
ggtgttttgctaatctgtttctatg

SEQ ID NO: 655503 - DNA, 25 bp, Mus musculus
ggtgttttgctattctgtttctatg

SEQ ID NO: 655504 - DNA, 25 bp, Mus musculus
ggtgttttgtaaccccaggcaccaa

SEQ ID NO: 655505 - DNA, 25 bp, Mus musculus
ggtgttttgtaacggctgccaatgc

SEQ ID NO: 655506 - DNA, 25 bp, Mus musculus
ggtgttttgtaagcccaggcaccaa

SEQ ID NO: 655507 - DNA, 25 bp, Mus musculus
ggtgttttgtaagggctgccaatgc

SEQ ID NO: 655508 - DNA, 25 bp, Mus musculus
ggtgttttgtttccctggtatgtaa

SEQ ID NO: 655509 - DNA, 25 bp, Mus musculus
ggtgttttgtttgcctggtatgtaa

SEQ ID NO: 655510 - DNA, 25 bp, Mus musculus
ggtgtttttagaaatgccagtctgt

SEQ ID NO: 655511 - DNA, 25 bp, Mus musculus
ggtgtttttagatatgccagtctgt

SEQ ID NO: 655512 - DNA, 25 bp, Mus musculus
ggtgtttttatactgatatgcatgt

SEQ ID NO: 655513 - DNA, 25 bp, Mus musculus
ggtgtttttatagtgatatgcatgt

SEQ ID NO: 655514 - DNA, 25 bp, Mus musculus
ggtgtttttatgcttttatggacag

SEQ ID NO: 655515 - DNA, 25 bp, Mus musculus
ggtgtttttatggttttatggacag

SEQ ID NO: 655516 - DNA, 25 bp, Mus musculus
ggtgtttttccgcaagtacactcag

SEQ ID NO: 655517 - DNA, 25 bp, Mus musculus
ggtgtttttccggaagtacactcag

SEQ ID NO: 655518 - DNA, 25 bp, Mus musculus
ggtgtttttgcactcagggacagaa

SEQ ID NO: 655519 - DNA, 25 bp, Mus musculus
ggtgtttttgcagtcagggacagaa

SEQ ID NO: 655520 - DNA, 25 bp, Mus musculus
ggttaaaaacaaaccgactccatat

SEQ ID NO: 655521 - DNA, 25 bp, Mus musculus
ggttaaaaacaatccgactccatat

SEQ ID NO: 655522 - DNA, 25 bp, Mus musculus
ggttaaaatatgcttcccaaaagat

SEQ ID NO: 655523 - DNA, 25 bp, Mus musculus
ggttaaaatatggttcccaaaagat

SEQ ID NO: 655524 - DNA, 25 bp, Mus musculus
ggttaaacaataagccactgcctga

SEQ ID NO: 655525 - DNA, 25 bp, Mus musculus
ggttaaacaatatgccactgcctga

SEQ ID NO: 655526 - DNA, 25 bp, Mus musculus
ggttaaacacacatccagtgtgtca

SEQ ID NO: 655527 - DNA, 25 bp, Mus musculus
ggttaaacacacttccagtgtgtca

SEQ ID NO: 655528 - DNA, 25 bp, Mus musculus
ggttaaacatggactgcgtgcctta

SEQ ID NO: 655529 - DNA, 25 bp, Mus musculus
ggttaaacatggtctgcgtgcctta

SEQ ID NO: 655530 - DNA, 25 bp, Mus musculus
ggttaaacctgtctcttcaatatta

SEQ ID NO: 655531 - DNA, 25 bp, Mus musculus
ggttaaacctgtgtcttcaatatta

SEQ ID NO: 655532 - DNA, 25 bp, Mus musculus
ggttaaagacgtcccctatcatatc

SEQ ID NO: 655533 - DNA, 25 bp, Mus musculus
ggttaaagacgtgccctatcatatc

SEQ ID NO: 655534 - DNA, 25 bp, Mus musculus
ggttaaagccatatacatccattgt

SEQ ID NO: 655535 - DNA, 25 bp, Mus musculus
ggttaaagccatttacatccattgt

SEQ ID NO: 655536 - DNA, 25 bp, Mus musculus
ggttaaaggctcatcttgccaccaa

SEQ ID NO: 655537 - DNA, 25 bp, Mus musculus
ggttaaaggctcttcttgccaccaa

SEQ ID NO: 655538 - DNA, 25 bp, Mus musculus
ggttaaagtctaccattggccagat

SEQ ID NO: 655539 - DNA, 25 bp, Mus musculus
ggttaaagtctagcattggccagat

SEQ ID NO: 655540 - DNA, 25 bp, Mus musculus
ggttaaagtggcaaaacatcgctta

SEQ ID NO: 655541 - DNA, 25 bp, Mus musculus
ggttaaagtggctaaacatcgctta

SEQ ID NO: 655542 - DNA, 25 bp, Mus musculus
ggttaaagttgtagcatgtaagtac

SEQ ID NO: 655543 - DNA, 25 bp, Mus musculus
ggttaaagttgttgcatgtaagtac

SEQ ID NO: 655544 - DNA, 25 bp, Mus musculus
ggttaaatgatgaattcctttagaa

SEQ ID NO: 655545 - DNA, 25 bp, Mus musculus
ggttaaatgatgtattcctttagaa

SEQ ID NO: 655546 - DNA, 25 bp, Mus musculus
ggttaaatggctaatgcggcgtaaa

SEQ ID NO: 655547 - DNA, 25 bp, Mus musculus
ggttaaatggcttatgcggcgtaaa

SEQ ID NO: 655548 - DNA, 25 bp, Mus musculus
ggttaaatgttacctcttcagcaga

SEQ ID NO: 655549 - DNA, 25 bp, Mus musculus
ggttaaatgttagctcttcagcaga

SEQ ID NO: 655550 - DNA, 25 bp, Mus musculus
ggttaaattaagcaagctccaccat

SEQ ID NO: 655551 - DNA, 25 bp, Mus musculus
ggttaaattaaggaagctccaccat

SEQ ID NO: 655552 - DNA, 25 bp, Mus musculus
ggttaacaatacaacgttcatggaa

SEQ ID NO: 655553 - DNA, 25 bp, Mus musculus
ggttaacaatactacgttcatggaa

SEQ ID NO: 655554 - DNA, 25 bp, Mus musculus
ggttaacagtgccaatatccacggt

SEQ ID NO: 655555 - DNA, 25 bp, Mus musculus
ggttaacagtgcgaatatccacggt

SEQ ID NO: 655556 - DNA, 25 bp, Mus musculus
ggttaacatggcaggtgctcacaca

SEQ ID NO: 655557 - DNA, 25 bp, Mus musculus
ggttaacatggctggtgctcacaca

SEQ ID NO: 655558 - DNA, 25 bp, Mus musculus
ggttaacattatccatccattgcct

SEQ ID NO: 655559 - DNA, 25 bp, Mus musculus
ggttaacattatgcatccattgcct

SEQ ID NO: 655560 - DNA, 25 bp, Mus musculus
ggttaacattggagctgccaactgt

SEQ ID NO: 655561 - DNA, 25 bp, Mus musculus
ggttaacattggtgctgccaactgt

SEQ ID NO: 655562 - DNA, 25 bp, Mus musculus
ggttaacattttacagccttgactt

SEQ ID NO: 655563 - DNA, 25 bp, Mus musculus
ggttaacatttttcagccttgactt

SEQ ID NO: 655564 - DNA, 25 bp, Mus musculus
ggttaaccaacaactgagtgtccta

SEQ ID NO: 655565 - DNA, 25 bp, Mus musculus
ggttaaccaacatctgagtgtccta

SEQ ID NO: 655566 - DNA, 25 bp, Mus musculus
ggttaaccagccaatttatcattgt

SEQ ID NO: 655567 - DNA, 25 bp, Mus musculus
ggttaaccagcctatttatcattgt

SEQ ID NO: 655568 - DNA, 25 bp, Mus musculus
ggttaaccaggtataatgagcttta

SEQ ID NO: 655569 - DNA, 25 bp, Mus musculus
ggttaaccaggtttaatgagcttta

SEQ ID NO: 655570 - DNA, 25 bp, Mus musculus
ggttaacccaatcccagtgacagat

SEQ ID NO: 655571 - DNA, 25 bp, Mus musculus
ggttaacccaatgccagtgacagat

SEQ ID NO: 655572 - DNA, 25 bp, Mus musculus
ggttaaccctgtatggaaagctact

SEQ ID NO: 655573 - DNA, 25 bp, Mus musculus
ggttaaccctgtttggaaagctact

SEQ ID NO: 655574 - DNA, 25 bp, Mus musculus
ggttaacctgaaagctgacccagct

SEQ ID NO: 655575 - DNA, 25 bp, Mus musculus
ggttaacctgaatgctgacccagct

SEQ ID NO: 655576 - DNA, 25 bp, Mus musculus
ggttaaccttggcagtgtgtacatt

SEQ ID NO: 655577 - DNA, 25 bp, Mus musculus
ggttaaccttgggagtgtgtacatt

SEQ ID NO: 655578 - DNA, 25 bp, Mus musculus
ggttaacggactcgatgcataaaca

SEQ ID NO: 655579 - DNA, 25 bp, Mus musculus
ggttaacggactggatgcataaaca

SEQ ID NO: 655580 - DNA, 25 bp, Mus musculus
ggttaacgtcagcatccttcaggat

SEQ ID NO: 655581 - DNA, 25 bp, Mus musculus
ggttaacgtcaggatccttcaggat

SEQ ID NO: 655582 - DNA, 25 bp, Mus musculus
ggttaacgtgttcgatgatttgaaa

SEQ ID NO: 655583 - DNA, 25 bp, Mus musculus
ggttaacgtgttggatgatttgaaa

SEQ ID NO: 655584 - DNA, 25 bp, Mus musculus
ggttaacgttctatatcagcttggt

SEQ ID NO: 655585 - DNA, 25 bp, Mus musculus
ggttaacgttctttatcagcttggt

SEQ ID NO: 655586 - DNA, 25 bp, Mus musculus
ggttaactacatcctggaatcacga

SEQ ID NO: 655587 - DNA, 25 bp, Mus musculus
ggttaactacatgctggaatcacga

SEQ ID NO: 655588 - DNA, 25 bp, Mus musculus
ggttaactagaacagaggcaccttc

SEQ ID NO: 655589 - DNA, 25 bp, Mus musculus
ggttaactagaagagaggcaccttc

SEQ ID NO: 655590 - DNA, 25 bp, Mus musculus
ggttaactgagcaaatattccactt

SEQ ID NO: 655591 - DNA, 25 bp, Mus musculus
ggttaactgagctaatattccactt

SEQ ID NO: 655592 - DNA, 25 bp, Mus musculus
ggttaactgaggctttagatcacat

SEQ ID NO: 655593 - DNA, 25 bp, Mus musculus
ggttaactgagggtttagatcacat

SEQ ID NO: 655594 - DNA, 25 bp, Mus musculus
ggttaactggccaacaaatttctag

SEQ ID NO: 655595 - DNA, 25 bp, Mus musculus
ggttaactggcctacaaatttctag

SEQ ID NO: 655596 - DNA, 25 bp, Mus musculus
ggttaactgtggaggttatctgcta

SEQ ID NO: 655597 - DNA, 25 bp, Mus musculus
ggttaactgtggtggttatctgcta

SEQ ID NO: 655598 - DNA, 25 bp, Mus musculus
ggttaactgttgactcctcaagggt

SEQ ID NO: 655599 - DNA, 25 bp, Mus musculus
ggttaactgttgtctcctcaagggt

SEQ ID NO: 655600 - DNA, 25 bp, Mus musculus
ggttaacttccgatgtagaaagcag

SEQ ID NO: 655601 - DNA, 25 bp, Mus musculus
ggttaacttccgttgtagaaagcag

SEQ ID NO: 655602 - DNA, 25 bp, Mus musculus
ggttaagaaccaagctttccattca

SEQ ID NO: 655603 - DNA, 25 bp, Mus musculus
ggttaagaaccatgctttccattca

SEQ ID NO: 655604 - DNA, 25 bp, Mus musculus
ggttaagaacgtccgcacatgagtt

SEQ ID NO: 655605 - DNA, 25 bp, Mus musculus
ggttaagaacgtgcgcacatgagtt

SEQ ID NO: 655606 - DNA, 25 bp, Mus musculus
ggttaagacacgctgctctagtcag

SEQ ID NO: 655607 - DNA, 25 bp, Mus musculus
ggttaagacacggtgctctagtcag

SEQ ID NO: 655608 - DNA, 25 bp, Mus musculus
ggttaagagcttcttccttctccta

SEQ ID NO: 655609 - DNA, 25 bp, Mus musculus
ggttaagagcttgttccttctccta

SEQ ID NO: 655610 - DNA, 25 bp, Mus musculus
ggttaagagtgcagaatgttcatcc

SEQ ID NO: 655611 - DNA, 25 bp, Mus musculus
ggttaagagtgctgaatgttcatcc

SEQ ID NO: 655612 - DNA, 25 bp, Mus musculus
ggttaagatggccagaccacctcag

SEQ ID NO: 655613 - DNA, 25 bp, Mus musculus
ggttaagatggcgagaccacctcag

SEQ ID NO: 655614 - DNA, 25 bp, Mus musculus
ggttaagatgttaacactgttatta

SEQ ID NO: 655615 - DNA, 25 bp, Mus musculus
ggttaagatgtttacactgttatta

SEQ ID NO: 655616 - DNA, 25 bp, Mus musculus
ggttaagcctcgcactggtgtcagt

SEQ ID NO: 655617 - DNA, 25 bp, Mus musculus
ggttaagcctcggactggtgtcagt

SEQ ID NO: 655618 - DNA, 25 bp, Mus musculus
ggttaagccttcatttgtcatttat

SEQ ID NO: 655619 - DNA, 25 bp, Mus musculus
ggttaagccttcttttgtcatttat

SEQ ID NO: 655620 - DNA, 25 bp, Mus musculus
ggttaagcgcacagtccaacagcaa

SEQ ID NO: 655621 - DNA, 25 bp, Mus musculus
ggttaagcgcactgtccaacagcaa

SEQ ID NO: 655622 - DNA, 25 bp, Mus musculus
ggttaagctcttatataattgcaaa

SEQ ID NO: 655623 - DNA, 25 bp, Mus musculus
ggttaagctcttttataattgcaaa

SEQ ID NO: 655624 - DNA, 25 bp, Mus musculus
ggttaaggaagtcgtaactgtgaca

SEQ ID NO: 655625 - DNA, 25 bp, Mus musculus
ggttaaggaagtggtaactgtgaca

SEQ ID NO: 655626 - DNA, 25 bp, Mus musculus
ggttaaggatgaattccacctcata

SEQ ID NO: 655627 - DNA, 25 bp, Mus musculus
ggttaaggatgatttccacctcata

SEQ ID NO: 655628 - DNA, 25 bp, Mus musculus
ggttaaggcaagacctctgaacaga

SEQ ID NO: 655629 - DNA, 25 bp, Mus musculus
ggttaaggcaagtcctctgaacaga

SEQ ID NO: 655630 - DNA, 25 bp, Mus musculus
ggttaaggcaataggttcaccacca

SEQ ID NO: 655631 - DNA, 25 bp, Mus musculus
ggttaaggcaattggttcaccacca

SEQ ID NO: 655632 - DNA, 25 bp, Mus musculus
ggttaaggcccaaccttgcaataat

SEQ ID NO: 655633 - DNA, 25 bp, Mus musculus
ggttaaggcccatccttgcaataat

SEQ ID NO: 655634 - DNA, 25 bp, Mus musculus
ggttaaggccttctagtcatgtttg

SEQ ID NO: 655635 - DNA, 25 bp, Mus musculus
ggttaaggccttgtagtcatgtttg

SEQ ID NO: 655636 - DNA, 25 bp, Mus musculus
ggttaagggtttatctgcatgtcat

SEQ ID NO: 655637 - DNA, 25 bp, Mus musculus
ggttaagggtttttctgcatgtcat

SEQ ID NO: 655638 - DNA, 25 bp, Mus musculus
ggttaaggttctcatggacgcacat

SEQ ID NO: 655639 - DNA, 25 bp, Mus musculus
ggttaaggttctgatggacgcacat

SEQ ID NO: 655640 - DNA, 25 bp, Mus musculus
ggttaagtcttcagggatcccgctg

SEQ ID NO: 655641 - DNA, 25 bp, Mus musculus
ggttaagtcttctgggatcccgctg

SEQ ID NO: 655642 - DNA, 25 bp, Mus musculus
ggttaagtgcctatccataactgtc

SEQ ID NO: 655643 - DNA, 25 bp, Mus musculus
ggttaagtgcctttccataactgtc

SEQ ID NO: 655644 - DNA, 25 bp, Mus musculus
ggttaagtgttgcttcagtttctag

SEQ ID NO: 655645 - DNA, 25 bp, Mus musculus
ggttaagtgttggttcagtttctag

SEQ ID NO: 655646 - DNA, 25 bp, Mus musculus
ggttaagttacacgttcctccgatg

SEQ ID NO: 655647 - DNA, 25 bp, Mus musculus
ggttaagttacaggttcctccgatg

SEQ ID NO: 655648 - DNA, 25 bp, Mus musculus
ggttaagttggcagtgctgaaatac

SEQ ID NO: 655649 - DNA, 25 bp, Mus musculus
ggttaagttggctgtgctgaaatac

SEQ ID NO: 655650 - DNA, 25 bp, Mus musculus
ggttaagtttgcatgctacattgct

SEQ ID NO: 655651 - DNA, 25 bp, Mus musculus
ggttaagtttgcttgctacattgct

SEQ ID NO: 655652 - DNA, 25 bp, Mus musculus
ggttaatacctgagtcggccgctga

SEQ ID NO: 655653 - DNA, 25 bp, Mus musculus
ggttaatacctgtgtcggccgctga

SEQ ID NO: 655654 - DNA, 25 bp, Mus musculus
ggttaatactaaacttcgagcactg

SEQ ID NO: 655655 - DNA, 25 bp, Mus musculus
ggttaatactaatcttcgagcactg

SEQ ID NO: 655656 - DNA, 25 bp, Mus musculus
ggttaatagccacgcctatattcaa

SEQ ID NO: 655657 - DNA, 25 bp, Mus musculus
ggttaatagccaggcctatattcaa

SEQ ID NO: 655658 - DNA, 25 bp, Mus musculus
ggttaatatggcattgttactggta

SEQ ID NO: 655659 - DNA, 25 bp, Mus musculus
ggttaatatggctttgttactggta

SEQ ID NO: 655660 - DNA, 25 bp, Mus musculus
ggttaatattcaagaggcgccgccc

SEQ ID NO: 655661 - DNA, 25 bp, Mus musculus
ggttaatattcatgaggcgccgccc

SEQ ID NO: 655662 - DNA, 25 bp, Mus musculus
ggttaatatttcacatctggccttc

SEQ ID NO: 655663 - DNA, 25 bp, Mus musculus
ggttaatatttctcatctggccttc

SEQ ID NO: 655664 - DNA, 25 bp, Mus musculus
ggttaatccacacccggagttccag

SEQ ID NO: 655665 - DNA, 25 bp, Mus musculus
ggttaatccacagccggagttccag

SEQ ID NO: 655666 - DNA, 25 bp, Mus musculus
ggttaatccgaaaggtccagcctgg

SEQ ID NO: 655667 - DNA, 25 bp, Mus musculus
ggttaatccgaatggtccagcctgg

SEQ ID NO: 655668 - DNA, 25 bp, Mus musculus
ggttaatctggtctacatgcggccc

SEQ ID NO: 655669 - DNA, 25 bp, Mus musculus
ggttaatctggtgtacatgcggccc

SEQ ID NO: 655670 - DNA, 25 bp, Mus musculus
ggttaatgatttcagatccttgtat

SEQ ID NO: 655671 - DNA, 25 bp, Mus musculus
ggttaatgatttgagatccttgtat

SEQ ID NO: 655672 - DNA, 25 bp, Mus musculus
ggttaatgggttcctgcggcacatc

SEQ ID NO: 655673 - DNA, 25 bp, Mus musculus
ggttaatgggttgctgcggcacatc

SEQ ID NO: 655674 - DNA, 25 bp, Mus musculus
ggttaatggtgcataattccgtcat

SEQ ID NO: 655675 - DNA, 25 bp, Mus musculus
ggttaatggtgcttaattccgtcat

SEQ ID NO: 655676 - DNA, 25 bp, Mus musculus
ggttaatgtcctccaacaacaccga

SEQ ID NO: 655677 - DNA, 25 bp, Mus musculus
ggttaatgtcctgcaacaacaccga

SEQ ID NO: 655678 - DNA, 25 bp, Mus musculus
ggttaatgttctcacactaggatga

SEQ ID NO: 655679 - DNA, 25 bp, Mus musculus
ggttaatgttctgacactaggatga

SEQ ID NO: 655680 - DNA, 25 bp, Mus musculus
ggttaatgttggattgaagctatca

SEQ ID NO: 655681 - DNA, 25 bp, Mus musculus
ggttaatgttggtttgaagctatca

SEQ ID NO: 655682 - DNA, 25 bp, Mus musculus
ggttaattctggattttgctctctt

SEQ ID NO: 655683 - DNA, 25 bp, Mus musculus
ggttaattctggtttttgctctctt

SEQ ID NO: 655684 - DNA, 25 bp, Mus musculus
ggttaatttcatcccaaccggatca

SEQ ID NO: 655685 - DNA, 25 bp, Mus musculus
ggttaatttcatgccaaccggatca

SEQ ID NO: 655686 - DNA, 25 bp, Mus musculus
ggttaatttttaatcactatagaca

SEQ ID NO: 655687 - DNA, 25 bp, Mus musculus
ggttaatttttattcactatagaca

SEQ ID NO: 655688 - DNA, 25 bp, Mus musculus
ggttacaaacacagttgcttgctgt

SEQ ID NO: 655689 - DNA, 25 bp, Mus musculus
ggttacaaacactgttgcttgctgt

SEQ ID NO: 655690 - DNA, 25 bp, Mus musculus
ggttacaaagtaagagaccctgctt

SEQ ID NO: 655691 - DNA, 25 bp, Mus musculus
ggttacaaagtatgagaccctgctt

SEQ ID NO: 655692 - DNA, 25 bp, Mus musculus
ggttacaaagttctcctcataggtg

SEQ ID NO: 655693 - DNA, 25 bp, Mus musculus
ggttacaaagttgtcctcataggtg

SEQ ID NO: 655694 - DNA, 25 bp, Mus musculus
ggttacaaatcaatctcacctttta

SEQ ID NO: 655695 - DNA, 25 bp, Mus musculus
ggttacaaatcattctcacctttta

SEQ ID NO: 655696 - DNA, 25 bp, Mus musculus
ggttacaacaggatgctcactaagt

SEQ ID NO: 655697 - DNA, 25 bp, Mus musculus
ggttacaacaggttgctcactaagt

SEQ ID NO: 655698 - DNA, 25 bp, Mus musculus
ggttacaacatccagcagagacctc

SEQ ID NO: 655699 - DNA, 25 bp, Mus musculus
ggttacaacatcgagcagagacctc

SEQ ID NO: 655700 - DNA, 25 bp, Mus musculus
ggttacaaccataaacaacttccat

SEQ ID NO: 655701 - DNA, 25 bp, Mus musculus
ggttacaaccattaacaacttccat

SEQ ID NO: 655702 - DNA, 25 bp, Mus musculus
ggttacaacgaaatccccaagagca

SEQ ID NO: 655703 - DNA, 25 bp, Mus musculus
ggttacaacgaattccccaagagca

SEQ ID NO: 655704 - DNA, 25 bp, Mus musculus
ggttacaacgtaaatggcatcgaga

SEQ ID NO: 655705 - DNA, 25 bp, Mus musculus
ggttacaacgtatatggcatcgaga

SEQ ID NO: 655706 - DNA, 25 bp, Mus musculus
ggttacaactgaatatcctggaatg

SEQ ID NO: 655707 - DNA, 25 bp, Mus musculus
ggttacaactgattatcctggaatg

SEQ ID NO: 655708 - DNA, 25 bp, Mus musculus
ggttacaagcccctgagactgagtg

SEQ ID NO: 655709 - DNA, 25 bp, Mus musculus
ggttacaagcccgtgagactgagtg

SEQ ID NO: 655710 - DNA, 25 bp, Mus musculus
ggttacaagctcagtttccgacaga

SEQ ID NO: 655711 - DNA, 25 bp, Mus musculus
ggttacaagctctgtttccgacaga

SEQ ID NO: 655712 - DNA, 25 bp, Mus musculus
ggttacaattacagctgtgcttact

SEQ ID NO: 655713 - DNA, 25 bp, Mus musculus
ggttacaattactgctgtgcttact

SEQ ID NO: 655714 - DNA, 25 bp, Mus musculus
ggttacacactcaatctttacgttt

SEQ ID NO: 655715 - DNA, 25 bp, Mus musculus
ggttacacactctatctttacgttt

SEQ ID NO: 655716 - DNA, 25 bp, Mus musculus
ggttacacagttatgccccacttgg

SEQ ID NO: 655717 - DNA, 25 bp, Mus musculus
ggttacacagttatttatccagagt

SEQ ID NO: 655718 - DNA, 25 bp, Mus musculus
ggttacacagttttgccccacttgg

SEQ ID NO: 655719 - DNA, 25 bp, Mus musculus
ggttacacagttttttatccagagt

SEQ ID NO: 655720 - DNA, 25 bp, Mus musculus
ggttacacatgcctggacgtcacag

SEQ ID NO: 655721 - DNA, 25 bp, Mus musculus
ggttacacatgcgtggacgtcacag

SEQ ID NO: 655722 - DNA, 25 bp, Mus musculus
ggttacaccaccatgaagttgaatg

SEQ ID NO: 655723 - DNA, 25 bp, Mus musculus
ggttacaccaccttgaagttgaatg

SEQ ID NO: 655724 - DNA, 25 bp, Mus musculus
ggttacaccattcagcagtttgagg

SEQ ID NO: 655725 - DNA, 25 bp, Mus musculus
ggttacaccattgagcagtttgagg

SEQ ID NO: 655726 - DNA, 25 bp, Mus musculus
ggttacacccagcacaatagccagc

SEQ ID NO: 655727 - DNA, 25 bp, Mus musculus
ggttacacccaggacaatagccagc

SEQ ID NO: 655728 - DNA, 25 bp, Mus musculus
ggttacactccgcaagttcctgctt

SEQ ID NO: 655729 - DNA, 25 bp, Mus musculus
ggttacactccggaagttcctgctt

SEQ ID NO: 655730 - DNA, 25 bp, Mus musculus
ggttacagacggactccattgacct

SEQ ID NO: 655731 - DNA, 25 bp, Mus musculus
ggttacagacggtctccattgacct

SEQ ID NO: 655732 - DNA, 25 bp, Mus musculus
ggttacagagctacattgtatccct

SEQ ID NO: 655733 - DNA, 25 bp, Mus musculus
ggttacagagcttcattgtatccct

SEQ ID NO: 655734 - DNA, 25 bp, Mus musculus
ggttacagaggacatgccggccact

SEQ ID NO: 655735 - DNA, 25 bp, Mus musculus
ggttacagaggagatgccggccact

SEQ ID NO: 655736 - DNA, 25 bp, Mus musculus
ggttacagcagacccaggcacaagt

SEQ ID NO: 655737 - DNA, 25 bp, Mus musculus
ggttacagcagagccaggcacaagt

SEQ ID NO: 655738 - DNA, 25 bp, Mus musculus
ggttacagccagaacctaattcctg

SEQ ID NO: 655739 - DNA, 25 bp, Mus musculus
ggttacagccagtacctaattcctg

SEQ ID NO: 655740 - DNA, 25 bp, Mus musculus
ggttacagcctaagtttgttccaat

SEQ ID NO: 655741 - DNA, 25 bp, Mus musculus
ggttacagcctatgtttgttccaat

SEQ ID NO: 655742 - DNA, 25 bp, Mus musculus
ggttacaggtgaacgctggtctcct

SEQ ID NO: 655743 - DNA, 25 bp, Mus musculus
ggttacaggtgatcgctggtctcct

SEQ ID NO: 655744 - DNA, 25 bp, Mus musculus
ggttacaggtttccgctgacatgcc

SEQ ID NO: 655745 - DNA, 25 bp, Mus musculus
ggttacaggtttgcgctgacatgcc

SEQ ID NO: 655746 - DNA, 25 bp, Mus musculus
ggttacagtaatagacagcagcata

SEQ ID NO: 655747 - DNA, 25 bp, Mus musculus
ggttacagtaattgacagcagcata

SEQ ID NO: 655748 - DNA, 25 bp, Mus musculus
ggttacagtctcaccgagtgccagc

SEQ ID NO: 655749 - DNA, 25 bp, Mus musculus
ggttacagtctctccgagtgccagc

SEQ ID NO: 655750 - DNA, 25 bp, Mus musculus
ggttacagtgagaaaatgacgcctt

SEQ ID NO: 655751 - DNA, 25 bp, Mus musculus
ggttacagtgagtaaatgacgcctt

SEQ ID NO: 655752 - DNA, 25 bp, Mus musculus
ggttacagtgtcaaacattttgcct

SEQ ID NO: 655753 - DNA, 25 bp, Mus musculus
ggttacagtgtctaacattttgcct

SEQ ID NO: 655754 - DNA, 25 bp, Mus musculus
ggttacataaccctatttgattcat

SEQ ID NO: 655755 - DNA, 25 bp, Mus musculus
ggttacataaccgtatttgattcat

SEQ ID NO: 655756 - DNA, 25 bp, Mus musculus
ggttacatagctactagaacttaga

SEQ ID NO: 655757 - DNA, 25 bp, Mus musculus
ggttacatagcttctagaacttaga

SEQ ID NO: 655758 - DNA, 25 bp, Mus musculus
ggttacatatttctccttccacatt

SEQ ID NO: 655759 - DNA, 25 bp, Mus musculus
ggttacatatttgtccttccacatt

SEQ ID NO: 655760 - DNA, 25 bp, Mus musculus
ggttacatccttctgtgcatattct

SEQ ID NO: 655761 - DNA, 25 bp, Mus musculus
ggttacatccttgtgtgcatattct

SEQ ID NO: 655762 - DNA, 25 bp, Mus musculus
ggttacatctaaaatggaacactta

SEQ ID NO: 655763 - DNA, 25 bp, Mus musculus
ggttacatctaatatggaacactta

SEQ ID NO: 655764 - DNA, 25 bp, Mus musculus
ggttacatctttctgtgacaacagg

SEQ ID NO: 655765 - DNA, 25 bp, Mus musculus
ggttacatctttgtgtgacaacagg

SEQ ID NO: 655766 - DNA, 25 bp, Mus musculus
ggttacatgataaactttatgctca

SEQ ID NO: 655767 - DNA, 25 bp, Mus musculus
ggttacatgatatactttatgctca

SEQ ID NO: 655768 - DNA, 25 bp, Mus musculus
ggttacatgcttcgtgtacccagag

SEQ ID NO: 655769 - DNA, 25 bp, Mus musculus
ggttacatgcttggtgtacccagag

SEQ ID NO: 655770 - DNA, 25 bp, Mus musculus
ggttacatgtggagagtctttggat

SEQ ID NO: 655771 - DNA, 25 bp, Mus musculus
ggttacatgtggtgagtctttggat

SEQ ID NO: 655772 - DNA, 25 bp, Mus musculus
ggttacatgttaactcagggctctg

SEQ ID NO: 655773 - DNA, 25 bp, Mus musculus
ggttacatgttatctcagggctctg

SEQ ID NO: 655774 - DNA, 25 bp, Mus musculus
ggttacatttctccaggcatgacta

SEQ ID NO: 655775 - DNA, 25 bp, Mus musculus
ggttacatttctgcaggcatgacta

SEQ ID NO: 655776 - DNA, 25 bp, Mus musculus
ggttaccaaatccttagagcttgct

SEQ ID NO: 655777 - DNA, 25 bp, Mus musculus
ggttaccaaatcgttagagcttgct

SEQ ID NO: 655778 - DNA, 25 bp, Mus musculus
ggttaccaagtaactgtaacccttg

SEQ ID NO: 655779 - DNA, 25 bp, Mus musculus
ggttaccaagtatctgtaacccttg

SEQ ID NO: 655780 - DNA, 25 bp, Mus musculus
ggttaccagaacaagtcttcacgag

SEQ ID NO: 655781 - DNA, 25 bp, Mus musculus
ggttaccagaacagaccaccagaga

SEQ ID NO: 655782 - DNA, 25 bp, Mus musculus
ggttaccagaactagtcttcacgag

SEQ ID NO: 655783 - DNA, 25 bp, Mus musculus
ggttaccagaactgaccaccagaga

SEQ ID NO: 655784 - DNA, 25 bp, Mus musculus
ggttaccagagtcctgaaggtcaca

SEQ ID NO: 655785 - DNA, 25 bp, Mus musculus
ggttaccagagtgctgaaggtcaca

SEQ ID NO: 655786 - DNA, 25 bp, Mus musculus
ggttaccagcgtaaaactagacatt

SEQ ID NO: 655787 - DNA, 25 bp, Mus musculus
ggttaccagcgttaaactagacatt

SEQ ID NO: 655788 - DNA, 25 bp, Mus musculus
ggttaccagtacatgttactcttgc

SEQ ID NO: 655789 - DNA, 25 bp, Mus musculus
ggttaccagtacttgttactcttgc

SEQ ID NO: 655790 - DNA, 25 bp, Mus musculus
ggttaccagtgaccccgaaatcaat

SEQ ID NO: 655791 - DNA, 25 bp, Mus musculus
ggttaccagtgagcccgaaatcaat

SEQ ID NO: 655792 - DNA, 25 bp, Mus musculus
ggttaccatgcgacacccagacaag

SEQ ID NO: 655793 - DNA, 25 bp, Mus musculus
ggttaccatgcgtcacccagacaag

SEQ ID NO: 655794 - DNA, 25 bp, Mus musculus
ggttaccattgcagttctggagaca

SEQ ID NO: 655795 - DNA, 25 bp, Mus musculus
ggttaccattgctgttctggagaca

SEQ ID NO: 655796 - DNA, 25 bp, Mus musculus
ggttacccaacaagtgaaatttcag

SEQ ID NO: 655797 - DNA, 25 bp, Mus musculus
ggttacccaacatgtgaaatttcag

SEQ ID NO: 655798 - DNA, 25 bp, Mus musculus
ggttacccaatgcattctcttgtga

SEQ ID NO: 655799 - DNA, 25 bp, Mus musculus
ggttacccaatggattctcttgtga

SEQ ID NO: 655800 - DNA, 25 bp, Mus musculus
ggttacccacagagtatatcttcta

SEQ ID NO: 655801 - DNA, 25 bp, Mus musculus
ggttacccacagtgtatatcttcta

SEQ ID NO: 655802 - DNA, 25 bp, Mus musculus
ggttacccaggactagagactatat

SEQ ID NO: 655803 - DNA, 25 bp, Mus musculus
ggttacccaggagtagagactatat

SEQ ID NO: 655804 - DNA, 25 bp, Mus musculus
ggttacccatgtacggtttgctcat

SEQ ID NO: 655805 - DNA, 25 bp, Mus musculus
ggttacccatgttcggtttgctcat

SEQ ID NO: 655806 - DNA, 25 bp, Mus musculus
ggttaccccaagcactattctcaga

SEQ ID NO: 655807 - DNA, 25 bp, Mus musculus
ggttaccccaaggactattctcaga

SEQ ID NO: 655808 - DNA, 25 bp, Mus musculus
ggttaccccagaaatcatgttataa

SEQ ID NO: 655809 - DNA, 25 bp, Mus musculus
ggttaccccagacacgtaatgccac

SEQ ID NO: 655810 - DNA, 25 bp, Mus musculus
ggttaccccagagacgtaatgccac

SEQ ID NO: 655811 - DNA, 25 bp, Mus musculus
ggttaccccagatatcatgttataa

SEQ ID NO: 655812 - DNA, 25 bp, Mus musculus
ggttacccgggtaaggctgtgatat

SEQ ID NO: 655813 - DNA, 25 bp, Mus musculus
ggttacccgggttaggctgtgatat

SEQ ID NO: 655814 - DNA, 25 bp, Mus musculus
ggttaccctaggataacaccaggag

SEQ ID NO: 655815 - DNA, 25 bp, Mus musculus
ggttaccctaggttaacaccaggag

SEQ ID NO: 655816 - DNA, 25 bp, Mus musculus
ggttaccctgtgatagacatggatt

SEQ ID NO: 655817 - DNA, 25 bp, Mus musculus
ggttaccctgtgttagacatggatt

SEQ ID NO: 655818 - DNA, 25 bp, Mus musculus
ggttacctatagacagttttatgaa

SEQ ID NO: 655819 - DNA, 25 bp, Mus musculus
ggttacctatagtcagttttatgaa

SEQ ID NO: 655820 - DNA, 25 bp, Mus musculus
ggttacctatctacagtaaagcctg

SEQ ID NO: 655821 - DNA, 25 bp, Mus musculus
ggttacctatcttcagtaaagcctg

SEQ ID NO: 655822 - DNA, 25 bp, Mus musculus
ggttacctcatcctctttctgggaa

SEQ ID NO: 655823 - DNA, 25 bp, Mus musculus
ggttacctcatcgtctttctgggaa

SEQ ID NO: 655824 - DNA, 25 bp, Mus musculus
ggttacctcattctttaccaacatt

SEQ ID NO: 655825 - DNA, 25 bp, Mus musculus
ggttacctcattgtttaccaacatt

SEQ ID NO: 655826 - DNA, 25 bp, Mus musculus
ggttacctcctacgatggacagggt

SEQ ID NO: 655827 - DNA, 25 bp, Mus musculus
ggttacctcctaggatggacagggt

SEQ ID NO: 655828 - DNA, 25 bp, Mus musculus
ggttacctcgttactgctataaaga

SEQ ID NO: 655829 - DNA, 25 bp, Mus musculus
ggttacctcgtttctgctataaaga

SEQ ID NO: 655830 - DNA, 25 bp, Mus musculus
ggttacctctaacacagctttgcct

SEQ ID NO: 655831 - DNA, 25 bp, Mus musculus
ggttacctctaagacagctttgcct

SEQ ID NO: 655832 - DNA, 25 bp, Mus musculus
ggttacctgattatactcacttgag

SEQ ID NO: 655833 - DNA, 25 bp, Mus musculus
ggttacctgattttactcacttgag

SEQ ID NO: 655834 - DNA, 25 bp, Mus musculus
ggttacctgcacaaggccaggcaga

SEQ ID NO: 655835 - DNA, 25 bp, Mus musculus
ggttacctgcactaggccaggcaga

SEQ ID NO: 655836 - DNA, 25 bp, Mus musculus
ggttacctgcctagctggagaagaa

SEQ ID NO: 655837 - DNA, 25 bp, Mus musculus
ggttacctgccttgctggagaagaa

SEQ ID NO: 655838 - DNA, 25 bp, Mus musculus
ggttacctgttgatactcagctcca

SEQ ID NO: 655839 - DNA, 25 bp, Mus musculus
ggttacctgttgttactcagctcca

SEQ ID NO: 655840 - DNA, 25 bp, Mus musculus
ggttaccttagaactctttcctaga

SEQ ID NO: 655841 - DNA, 25 bp, Mus musculus
ggttaccttagatctctttcctaga

SEQ ID NO: 655842 - DNA, 25 bp, Mus musculus
ggttaccttctaaatatggctctag

SEQ ID NO: 655843 - DNA, 25 bp, Mus musculus
ggttaccttctatatatggctctag

SEQ ID NO: 655844 - DNA, 25 bp, Mus musculus
ggttaccttcttactgccctacaca

SEQ ID NO: 655845 - DNA, 25 bp, Mus musculus
ggttaccttctttctgccctacaca

SEQ ID NO: 655846 - DNA, 25 bp, Mus musculus
ggttacgaagtgactcctgctgcat

SEQ ID NO: 655847 - DNA, 25 bp, Mus musculus
ggttacgaagtgtctcctgctgcat

SEQ ID NO: 655848 - DNA, 25 bp, Mus musculus
ggttacgacaccagtgacagagcat

SEQ ID NO: 655849 - DNA, 25 bp, Mus musculus
ggttacgacacctgtgacagagcat

SEQ ID NO: 655850 - DNA, 25 bp, Mus musculus
ggttacgagaagacccgcagcctga

SEQ ID NO: 655851 - DNA, 25 bp, Mus musculus
ggttacgagaagtcccgcagcctga

SEQ ID NO: 655852 - DNA, 25 bp, Mus musculus
ggttacggagagaacaagcctgtct

SEQ ID NO: 655853 - DNA, 25 bp, Mus musculus
ggttacggagagtacaagcctgtct

SEQ ID NO: 655854 - DNA, 25 bp, Mus musculus
ggttacgtccaaccctcaaagagag

SEQ ID NO: 655855 - DNA, 25 bp, Mus musculus
ggttacgtccaagcctcaaagagag

SEQ ID NO: 655856 - DNA, 25 bp, Mus musculus
ggttactacatgaacactggattgt

SEQ ID NO: 655857 - DNA, 25 bp, Mus musculus
ggttactacatgtacactggattgt

SEQ ID NO: 655858 - DNA, 25 bp, Mus musculus
ggttactaccatatttcgtttgaat

SEQ ID NO: 655859 - DNA, 25 bp, Mus musculus
ggttactaccatttttcgtttgaat

SEQ ID NO: 655860 - DNA, 25 bp, Mus musculus
ggttactactctcccatacaaagga

SEQ ID NO: 655861 - DNA, 25 bp, Mus musculus
ggttactactctgccatacaaagga

SEQ ID NO: 655862 - DNA, 25 bp, Mus musculus
ggttactatattctccatctgccat

SEQ ID NO: 655863 - DNA, 25 bp, Mus musculus
ggttactatattgtccatctgccat

SEQ ID NO: 655864 - DNA, 25 bp, Mus musculus
ggttactatgtaagactgggactat

SEQ ID NO: 655865 - DNA, 25 bp, Mus musculus
ggttactatgtatgactgggactat

SEQ ID NO: 655866 - DNA, 25 bp, Mus musculus
ggttactcaattagtagttcccata

SEQ ID NO: 655867 - DNA, 25 bp, Mus musculus
ggttactcaatttgtagttcccata

SEQ ID NO: 655868 - DNA, 25 bp, Mus musculus
ggttactccactcccacgtgactga

SEQ ID NO: 655869 - DNA, 25 bp, Mus musculus
ggttactccactgccacgtgactga

SEQ ID NO: 655870 - DNA, 25 bp, Mus musculus
ggttactcccatatgcaagaattta

SEQ ID NO: 655871 - DNA, 25 bp, Mus musculus
ggttactcccatttgcaagaattta

SEQ ID NO: 655872 - DNA, 25 bp, Mus musculus
ggttactccgcacataagagcacta

SEQ ID NO: 655873 - DNA, 25 bp, Mus musculus
ggttactccgcagataagagcacta

SEQ ID NO: 655874 - DNA, 25 bp, Mus musculus
ggttactcctggctgattaccaagg

SEQ ID NO: 655875 - DNA, 25 bp, Mus musculus
ggttactcctgggtgattaccaagg

SEQ ID NO: 655876 - DNA, 25 bp, Mus musculus
ggttactcctttatcaatgatgctg

SEQ ID NO: 655877 - DNA, 25 bp, Mus musculus
ggttactcctttttcaatgatgctg

SEQ ID NO: 655878 - DNA, 25 bp, Mus musculus
ggttactctgcaagcattttagggt

SEQ ID NO: 655879 - DNA, 25 bp, Mus musculus
ggttactctgcatgcattttagggt

SEQ ID NO: 655880 - DNA, 25 bp, Mus musculus
ggttactgagaaagcttcccgcata

SEQ ID NO: 655881 - DNA, 25 bp, Mus musculus
ggttactgagaatgcttcccgcata

SEQ ID NO: 655882 - DNA, 25 bp, Mus musculus
ggttactgagacaacggttaccgag

SEQ ID NO: 655883 - DNA, 25 bp, Mus musculus
ggttactgagactacggttaccgag

SEQ ID NO: 655884 - DNA, 25 bp, Mus musculus
ggttactgatagaagctctcggaat

SEQ ID NO: 655885 - DNA, 25 bp, Mus musculus
ggttactgatagtagctctcggaat

SEQ ID NO: 655886 - DNA, 25 bp, Mus musculus
ggttactgatggaatctcactctaa

SEQ ID NO: 655887 - DNA, 25 bp, Mus musculus
ggttactgatggtatctcactctaa

SEQ ID NO: 655888 - DNA, 25 bp, Mus musculus
ggttactgcacacctgaggagtgaa

SEQ ID NO: 655889 - DNA, 25 bp, Mus musculus
ggttactgcacagctgaggagtgaa

SEQ ID NO: 655890 - DNA, 25 bp, Mus musculus
ggttactgcactcagaatgatattt

SEQ ID NO: 655891 - DNA, 25 bp, Mus musculus
ggttactgcactgagaatgatattt

SEQ ID NO: 655892 - DNA, 25 bp, Mus musculus
ggttactggcggatctgttttagca

SEQ ID NO: 655893 - DNA, 25 bp, Mus musculus
ggttactggcggttctgttttagca

SEQ ID NO: 655894 - DNA, 25 bp, Mus musculus
ggttactgggccacgcttgactgac

SEQ ID NO: 655895 - DNA, 25 bp, Mus musculus
ggttactgggcctcgcttgactgac

SEQ ID NO: 655896 - DNA, 25 bp, Mus musculus
ggttactgggttagccattatctaa

SEQ ID NO: 655897 - DNA, 25 bp, Mus musculus
ggttactgggtttgccattatctaa

SEQ ID NO: 655898 - DNA, 25 bp, Mus musculus
ggttactgtaacagcagtggactct

SEQ ID NO: 655899 - DNA, 25 bp, Mus musculus
ggttactgtaactgcagtggactct

SEQ ID NO: 655900 - DNA, 25 bp, Mus musculus
ggttactgtctgacagagggagcac

SEQ ID NO: 655901 - DNA, 25 bp, Mus musculus
ggttactgtctgtcagagggagcac

SEQ ID NO: 655902 - DNA, 25 bp, Mus musculus
ggttactgtgctaagtgtgttttca

SEQ ID NO: 655903 - DNA, 25 bp, Mus musculus
ggttactgtgcttagtgtgttttca

SEQ ID NO: 655904 - DNA, 25 bp, Mus musculus
ggttactgtgtcctatagacgtaaa

SEQ ID NO: 655905 - DNA, 25 bp, Mus musculus
ggttactgtgtcgtatagacgtaaa

SEQ ID NO: 655906 - DNA, 25 bp, Mus musculus
ggttactgttgtatttactgtcgtc

SEQ ID NO: 655907 - DNA, 25 bp, Mus musculus
ggttactgttgtttttactgtcgtc

SEQ ID NO: 655908 - DNA, 25 bp, Mus musculus
ggttacttacatactgtttcttgct

SEQ ID NO: 655909 - DNA, 25 bp, Mus musculus
ggttacttacattctgtttcttgct

SEQ ID NO: 655910 - DNA, 25 bp, Mus musculus
ggttacttagaaactgttttgagag

SEQ ID NO: 655911 - DNA, 25 bp, Mus musculus
ggttacttagaatctgttttgagag

SEQ ID NO: 655912 - DNA, 25 bp, Mus musculus
ggttacttcattaaggacctccaag

SEQ ID NO: 655913 - DNA, 25 bp, Mus musculus
ggttacttcattatacctgttcaga

SEQ ID NO: 655914 - DNA, 25 bp, Mus musculus
ggttacttcatttaggacctccaag

SEQ ID NO: 655915 - DNA, 25 bp, Mus musculus
ggttacttcattttacctgttcaga

SEQ ID NO: 655916 - DNA, 25 bp, Mus musculus
ggttacttccgcaagaacctggaga

SEQ ID NO: 655917 - DNA, 25 bp, Mus musculus
ggttacttccgctagaacctggaga

SEQ ID NO: 655918 - DNA, 25 bp, Mus musculus
ggttacttcctgacagtttgttgca

SEQ ID NO: 655919 - DNA, 25 bp, Mus musculus
ggttacttcctgtcagtttgttgca

SEQ ID NO: 655920 - DNA, 25 bp, Mus musculus
ggttacttcggtcctggaacatcta

SEQ ID NO: 655921 - DNA, 25 bp, Mus musculus
ggttacttcggtgctggaacatcta

SEQ ID NO: 655922 - DNA, 25 bp, Mus musculus
ggttactttgagacagtcgtcccaa

SEQ ID NO: 655923 - DNA, 25 bp, Mus musculus
ggttactttgagtcagtcgtcccaa

SEQ ID NO: 655924 - DNA, 25 bp, Mus musculus
ggttacttttacctgagcctagtag

SEQ ID NO: 655925 - DNA, 25 bp, Mus musculus
ggttacttttacgtgagcctagtag

SEQ ID NO: 655926 - DNA, 25 bp, Mus musculus
ggttagaacgctcctgtctacagag

SEQ ID NO: 655927 - DNA, 25 bp, Mus musculus
ggttagaacgctgctgtctacagag

SEQ ID NO: 655928 - DNA, 25 bp, Mus musculus
ggttagaagcacatactgcccttgt

SEQ ID NO: 655929 - DNA, 25 bp, Mus musculus
ggttagaagcacttactgcccttgt

SEQ ID NO: 655930 - DNA, 25 bp, Mus musculus
ggttagaattacatgtcttcatctt

SEQ ID NO: 655931 - DNA, 25 bp, Mus musculus
ggttagaattacttgtcttcatctt

SEQ ID NO: 655932 - DNA, 25 bp, Mus musculus
ggttagacacgtcgactcagggcct

SEQ ID NO: 655933 - DNA, 25 bp, Mus musculus
ggttagacacgtggactcagggcct

SEQ ID NO: 655934 - DNA, 25 bp, Mus musculus
ggttagacctagaccacatgagcat

SEQ ID NO: 655935 - DNA, 25 bp, Mus musculus
ggttagacctagtccacatgagcat

SEQ ID NO: 655936 - DNA, 25 bp, Mus musculus
ggttagacctccagacaccggctag

SEQ ID NO: 655937 - DNA, 25 bp, Mus musculus
ggttagacctcctgacaccggctag

SEQ ID NO: 655938 - DNA, 25 bp, Mus musculus
ggttagagagctaagaccttttaca

SEQ ID NO: 655939 - DNA, 25 bp, Mus musculus
ggttagagagcttagaccttttaca

SEQ ID NO: 655940 - DNA, 25 bp, Mus musculus
ggttagagatttacagattctgtta

SEQ ID NO: 655941 - DNA, 25 bp, Mus musculus
ggttagagattttcagattctgtta

SEQ ID NO: 655942 - DNA, 25 bp, Mus musculus
ggttagaggcagcacctcaactcct

SEQ ID NO: 655943 - DNA, 25 bp, Mus musculus
ggttagaggcaggacctcaactcct

SEQ ID NO: 655944 - DNA, 25 bp, Mus musculus
ggttagagtagcagccaatcatggc

SEQ ID NO: 655945 - DNA, 25 bp, Mus musculus
ggttagagtagctgccaatcatggc

SEQ ID NO: 655946 - DNA, 25 bp, Mus musculus
ggttagagtgatcctgtttcccaga

SEQ ID NO: 655947 - DNA, 25 bp, Mus musculus
ggttagagtgatgctgtttcccaga

SEQ ID NO: 655948 - DNA, 25 bp, Mus musculus
ggttagatacatatggcaactgcaa

SEQ ID NO: 655949 - DNA, 25 bp, Mus musculus
ggttagatacatttggcaactgcaa

SEQ ID NO: 655950 - DNA, 25 bp, Mus musculus
ggttagatccccagcattagattaa

SEQ ID NO: 655951 - DNA, 25 bp, Mus musculus
ggttagatcccctgcattagattaa

SEQ ID NO: 655952 - DNA, 25 bp, Mus musculus
ggttagatgtgtacgccaatgttta

SEQ ID NO: 655953 - DNA, 25 bp, Mus musculus
ggttagatgtgttcgccaatgttta

SEQ ID NO: 655954 - DNA, 25 bp, Mus musculus
ggttagattttcagggatcccctga

SEQ ID NO: 655955 - DNA, 25 bp, Mus musculus
ggttagattttctgggatcccctga

SEQ ID NO: 655956 - DNA, 25 bp, Mus musculus
ggttagcaaaagattgtatcacaca

SEQ ID NO: 655957 - DNA, 25 bp, Mus musculus
ggttagcaaaagtttgtatcacaca

SEQ ID NO: 655958 - DNA, 25 bp, Mus musculus
ggttagcaatcactggtcccctgtt

SEQ ID NO: 655959 - DNA, 25 bp, Mus musculus
ggttagcaatcagtggtcccctgtt

SEQ ID NO: 655960 - DNA, 25 bp, Mus musculus
ggttagcaattccatcaatttcttg

SEQ ID NO: 655961 - DNA, 25 bp, Mus musculus
ggttagcaattcgatcaatttcttg

SEQ ID NO: 655962 - DNA, 25 bp, Mus musculus
ggttagcacaggatgctatgtgatg

SEQ ID NO: 655963 - DNA, 25 bp, Mus musculus
ggttagcacaggttgctatgtgatg

SEQ ID NO: 655964 - DNA, 25 bp, Mus musculus
ggttagcacggaagcttgtatcaat

SEQ ID NO: 655965 - DNA, 25 bp, Mus musculus
ggttagcacggatgcttgtatcaat

SEQ ID NO: 655966 - DNA, 25 bp, Mus musculus
ggttagcagcacattcattgttctt

SEQ ID NO: 655967 - DNA, 25 bp, Mus musculus
ggttagcagcactttcattgttctt

SEQ ID NO: 655968 - DNA, 25 bp, Mus musculus
ggttagcagcagatgccttcaccta

SEQ ID NO: 655969 - DNA, 25 bp, Mus musculus
ggttagcagcagttgccttcaccta

SEQ ID NO: 655970 - DNA, 25 bp, Mus musculus
ggttagcagttcagacctgtgcact

SEQ ID NO: 655971 - DNA, 25 bp, Mus musculus
ggttagcagttctgacctgtgcact

SEQ ID NO: 655972 - DNA, 25 bp, Mus musculus
ggttagcatatacactttaaagttg

SEQ ID NO: 655973 - DNA, 25 bp, Mus musculus
ggttagcatatagactttaaagttg

SEQ ID NO: 655974 - DNA, 25 bp, Mus musculus
ggttagcatgcaatcccatcagaga

SEQ ID NO: 655975 - DNA, 25 bp, Mus musculus
ggttagcatgcattcccatcagaga

SEQ ID NO: 655976 - DNA, 25 bp, Mus musculus
ggttagcccatgaactcatggcatt

SEQ ID NO: 655977 - DNA, 25 bp, Mus musculus
ggttagcccatgtactcatggcatt

SEQ ID NO: 655978 - DNA, 25 bp, Mus musculus
ggttagccccagcagggactgaact

SEQ ID NO: 655979 - DNA, 25 bp, Mus musculus
ggttagccccaggagggactgaact

SEQ ID NO: 655980 - DNA, 25 bp, Mus musculus
ggttagcctaaaatccaaaagctgt

SEQ ID NO: 655981 - DNA, 25 bp, Mus musculus
ggttagcctaaattccaaaagctgt

SEQ ID NO: 655982 - DNA, 25 bp, Mus musculus
ggttagcgagttcttgatccaaggt

SEQ ID NO: 655983 - DNA, 25 bp, Mus musculus
ggttagcgagttgttgatccaaggt

SEQ ID NO: 655984 - DNA, 25 bp, Mus musculus
ggttagcggagccactttgcccttc

SEQ ID NO: 655985 - DNA, 25 bp, Mus musculus
ggttagcggagcgactttgcccttc

SEQ ID NO: 655986 - DNA, 25 bp, Mus musculus
ggttagcgtacaattattcacacat

SEQ ID NO: 655987 - DNA, 25 bp, Mus musculus
ggttagcgtacatttattcacacat

SEQ ID NO: 655988 - DNA, 25 bp, Mus musculus
ggttagctaccacttggccaacggc

SEQ ID NO: 655989 - DNA, 25 bp, Mus musculus
ggttagctaccagttggccaacggc

SEQ ID NO: 655990 - DNA, 25 bp, Mus musculus
ggttagctacgtcagatagatccat

SEQ ID NO: 655991 - DNA, 25 bp, Mus musculus
ggttagctacgtgagatagatccat

SEQ ID NO: 655992 - DNA, 25 bp, Mus musculus
ggttagctcttcaattcacaaaggt

SEQ ID NO: 655993 - DNA, 25 bp, Mus musculus
ggttagctcttctattcacaaaggt

SEQ ID NO: 655994 - DNA, 25 bp, Mus musculus
ggttagctttctccatacttcagcc

SEQ ID NO: 655995 - DNA, 25 bp, Mus musculus
ggttagctttctgcatacttcagcc

SEQ ID NO: 655996 - DNA, 25 bp, Mus musculus
ggttagctttgtctttgttataaag

SEQ ID NO: 655997 - DNA, 25 bp, Mus musculus
ggttagctttgtgtttgttataaag

SEQ ID NO: 655998 - DNA, 25 bp, Mus musculus
ggttaggaactaccatccagctttg

SEQ ID NO: 655999 - DNA, 25 bp, Mus musculus
ggttaggaactagcatccagctttg

SEQ ID NO: 656000 - DNA, 25 bp, Mus musculus
ggttaggaccttcattagagcatct

SEQ ID NO: 656001 - DNA, 25 bp, Mus musculus
ggttaggaccttgattagagcatct

SEQ ID NO: 656002 - DNA, 25 bp, Mus musculus
ggttaggagtaaagacccctgccct

SEQ ID NO: 656003 - DNA, 25 bp, Mus musculus
ggttaggagtaatgacccctgccct

SEQ ID NO: 656004 - DNA, 25 bp, Mus musculus
ggttaggatatgacaaaatcaccac

SEQ ID NO: 656005 - DNA, 25 bp, Mus musculus
ggttaggatatgtcaaaatcaccac

SEQ ID NO: 656006 - DNA, 25 bp, Mus musculus
ggttaggatgctctctactcagtaa

SEQ ID NO: 656007 - DNA, 25 bp, Mus musculus
ggttaggatgctgtctactcagtaa

SEQ ID NO: 656008 - DNA, 25 bp, Mus musculus
ggttaggcatttaggaagcacactg

SEQ ID NO: 656009 - DNA, 25 bp, Mus musculus
ggttaggcattttggaagcacactg

SEQ ID NO: 656010 - DNA, 25 bp, Mus musculus
ggttaggccatgactatttagggta

SEQ ID NO: 656011 - DNA, 25 bp, Mus musculus
ggttaggccatgtctatttagggta

SEQ ID NO: 656012 - DNA, 25 bp, Mus musculus
ggttaggctagaatctgtgatcttc

SEQ ID NO: 656013 - DNA, 25 bp, Mus musculus
ggttaggctagattctgtgatcttc

SEQ ID NO: 656014 - DNA, 25 bp, Mus musculus
ggttaggctgggaaagtctgtcttt

SEQ ID NO: 656015 - DNA, 25 bp, Mus musculus
ggttaggctgggtaagtctgtcttt

SEQ ID NO: 656016 - DNA, 25 bp, Mus musculus
ggttaggtagttatggttgcttgat

SEQ ID NO: 656017 - DNA, 25 bp, Mus musculus
ggttaggtagttttggttgcttgat

SEQ ID NO: 656018 - DNA, 25 bp, Mus musculus
ggttaggtgtagatgtcccatttac

SEQ ID NO: 656019 - DNA, 25 bp, Mus musculus
ggttaggtgtagcatagatactcaa

SEQ ID NO: 656020 - DNA, 25 bp, Mus musculus
ggttaggtgtaggatagatactcaa

SEQ ID NO: 656021 - DNA, 25 bp, Mus musculus
ggttaggtgtagttgtcccatttac

SEQ ID NO: 656022 - DNA, 25 bp, Mus musculus
ggttagtaaccgagactttgccctg

SEQ ID NO: 656023 - DNA, 25 bp, Mus musculus
ggttagtaaccgtgactttgccctg

SEQ ID NO: 656024 - DNA, 25 bp, Mus musculus
ggttagtacctgagtttagatcttt

SEQ ID NO: 656025 - DNA, 25 bp, Mus musculus
ggttagtacctgtgtttagatcttt

SEQ ID NO: 656026 - DNA, 25 bp, Mus musculus
ggttagtcaaaactcggccctatag

SEQ ID NO: 656027 - DNA, 25 bp, Mus musculus
ggttagtcaaaagtcggccctatag

SEQ ID NO: 656028 - DNA, 25 bp, Mus musculus
ggttagtcagaaactgccatttgaa

SEQ ID NO: 656029 - DNA, 25 bp, Mus musculus
ggttagtcagaatctgccatttgaa

SEQ ID NO: 656030 - DNA, 25 bp, Mus musculus
ggttagtctgttaaacctgtctgtc

SEQ ID NO: 656031 - DNA, 25 bp, Mus musculus
ggttagtctgttctatactcagtgt

SEQ ID NO: 656032 - DNA, 25 bp, Mus musculus
ggttagtctgttgtatactcagtgt

SEQ ID NO: 656033 - DNA, 25 bp, Mus musculus
ggttagtctgtttaacctgtctgtc

SEQ ID NO: 656034 - DNA, 25 bp, Mus musculus
ggttagtgaggcatttcctccatta

SEQ ID NO: 656035 - DNA, 25 bp, Mus musculus
ggttagtgaggcttttcctccatta

SEQ ID NO: 656036 - DNA, 25 bp, Mus musculus
ggttagtggacccatctttgattat

SEQ ID NO: 656037 - DNA, 25 bp, Mus musculus
ggttagtggaccgatctttgattat

SEQ ID NO: 656038 - DNA, 25 bp, Mus musculus
ggttagtggtttcattctttaatat

SEQ ID NO: 656039 - DNA, 25 bp, Mus musculus
ggttagtggtttgattctttaatat

SEQ ID NO: 656040 - DNA, 25 bp, Mus musculus
ggttagtgtattcttgagcaggtct

SEQ ID NO: 656041 - DNA, 25 bp, Mus musculus
ggttagtgtattgttgagcaggtct

SEQ ID NO: 656042 - DNA, 25 bp, Mus musculus
ggttagttaagacaaagccctcatt

SEQ ID NO: 656043 - DNA, 25 bp, Mus musculus
ggttagttaagactttgatccatac

SEQ ID NO: 656044 - DNA, 25 bp, Mus musculus
ggttagttaagagaaagccctcatt

SEQ ID NO: 656045 - DNA, 25 bp, Mus musculus
ggttagttaagagtttgatccatac

SEQ ID NO: 656046 - DNA, 25 bp, Mus musculus
ggttagttaagtccaattctccatt

SEQ ID NO: 656047 - DNA, 25 bp, Mus musculus
ggttagttaagtgcaattctccatt

SEQ ID NO: 656048 - DNA, 25 bp, Mus musculus
ggttagttaccaacatctcgtttga

SEQ ID NO: 656049 - DNA, 25 bp, Mus musculus
ggttagttaccatcatctcgtttga

SEQ ID NO: 656050 - DNA, 25 bp, Mus musculus
ggttagttccccagagagtgtctgg

SEQ ID NO: 656051 - DNA, 25 bp, Mus musculus
ggttagttcccctgagagtgtctgg

SEQ ID NO: 656052 - DNA, 25 bp, Mus musculus
ggttagttctaaatgttgtttgctt

SEQ ID NO: 656053 - DNA, 25 bp, Mus musculus
ggttagttctaattgttgtttgctt

SEQ ID NO: 656054 - DNA, 25 bp, Mus musculus
ggttagttctagaccataatggcct

SEQ ID NO: 656055 - DNA, 25 bp, Mus musculus
ggttagttctagtccataatggcct

SEQ ID NO: 656056 - DNA, 25 bp, Mus musculus
ggttagttcttacgcagctcacctc

SEQ ID NO: 656057 - DNA, 25 bp, Mus musculus
ggttagttcttaggcagctcacctc

SEQ ID NO: 656058 - DNA, 25 bp, Mus musculus
ggttagttgttgatagccttgctac

SEQ ID NO: 656059 - DNA, 25 bp, Mus musculus
ggttagttgttgttagccttgctac

SEQ ID NO: 656060 - DNA, 25 bp, Mus musculus
ggttagtttacacagcaagggccta

SEQ ID NO: 656061 - DNA, 25 bp, Mus musculus
ggttagtttacagagcaagggccta

SEQ ID NO: 656062 - DNA, 25 bp, Mus musculus
ggttagtttactcctgtaactgtca

SEQ ID NO: 656063 - DNA, 25 bp, Mus musculus
ggttagtttactgctgtaactgtca

SEQ ID NO: 656064 - DNA, 25 bp, Mus musculus
ggttagttttacacattactttcag

SEQ ID NO: 656065 - DNA, 25 bp, Mus musculus
ggttagttttactcattactttcag

SEQ ID NO: 656066 - DNA, 25 bp, Mus musculus
ggttagttttcaacatccttgtagt

SEQ ID NO: 656067 - DNA, 25 bp, Mus musculus
ggttagttttcatcatccttgtagt

SEQ ID NO: 656068 - DNA, 25 bp, Mus musculus
ggttataaaatcctcacctttgaat

SEQ ID NO: 656069 - DNA, 25 bp, Mus musculus
ggttataaaatcgtcacctttgaat

SEQ ID NO: 656070 - DNA, 25 bp, Mus musculus
ggttataaacacaggctgggctgag

SEQ ID NO: 656071 - DNA, 25 bp, Mus musculus
ggttataaacacatgccactgccct

SEQ ID NO: 656072 - DNA, 25 bp, Mus musculus
ggttataaacactggctgggctgag

SEQ ID NO: 656073 - DNA, 25 bp, Mus musculus
ggttataaacacttgccactgccct

SEQ ID NO: 656074 - DNA, 25 bp, Mus musculus
ggttataaaccccaactcaagagca

SEQ ID NO: 656075 - DNA, 25 bp, Mus musculus
ggttataaacccgaactcaagagca

SEQ ID NO: 656076 - DNA, 25 bp, Mus musculus
ggttataaactcatggattccatgt

SEQ ID NO: 656077 - DNA, 25 bp, Mus musculus
ggttataaactcttggattccatgt

SEQ ID NO: 656078 - DNA, 25 bp, Mus musculus
ggttataaagagatgtatcctgaag

SEQ ID NO: 656079 - DNA, 25 bp, Mus musculus
ggttataaagagttgtatcctgaag

SEQ ID NO: 656080 - DNA, 25 bp, Mus musculus
ggttataaagtcagcccgtgtcatg

SEQ ID NO: 656081 - DNA, 25 bp, Mus musculus
ggttataaagtctgcccgtgtcatg

SEQ ID NO: 656082 - DNA, 25 bp, Mus musculus
ggttataaattgctaatggctggag

SEQ ID NO: 656083 - DNA, 25 bp, Mus musculus
ggttataaattggtaatggctggag

SEQ ID NO: 656084 - DNA, 25 bp, Mus musculus
ggttataactgtcactattagaggc

SEQ ID NO: 656085 - DNA, 25 bp, Mus musculus
ggttataactgtgactattagaggc

SEQ ID NO: 656086 - DNA, 25 bp, Mus musculus
ggttataagcccagtgtttgccatc

SEQ ID NO: 656087 - DNA, 25 bp, Mus musculus
ggttataagccctgtgtttgccatc

SEQ ID NO: 656088 - DNA, 25 bp, Mus musculus
ggttataattctacaggttgaggac

SEQ ID NO: 656089 - DNA, 25 bp, Mus musculus
ggttataattcttcaggttgaggac

SEQ ID NO: 656090 - DNA, 25 bp, Mus musculus
ggttatacaaccaggctcaacaaaa

SEQ ID NO: 656091 - DNA, 25 bp, Mus musculus
ggttatacaacctggctcaacaaaa

SEQ ID NO: 656092 - DNA, 25 bp, Mus musculus
ggttatacatgtattctctacttaa

SEQ ID NO: 656093 - DNA, 25 bp, Mus musculus
ggttatacatgttttctctacttaa

SEQ ID NO: 656094 - DNA, 25 bp, Mus musculus
ggttataccatgcacattgtttcta

SEQ ID NO: 656095 - DNA, 25 bp, Mus musculus
ggttataccatggacattgtttcta

SEQ ID NO: 656096 - DNA, 25 bp, Mus musculus
ggttatacccaaaagactgagcaga

SEQ ID NO: 656097 - DNA, 25 bp, Mus musculus
ggttatacccaatagactgagcaga

SEQ ID NO: 656098 - DNA, 25 bp, Mus musculus
ggttatactctaaatttccacttag

SEQ ID NO: 656099 - DNA, 25 bp, Mus musculus
ggttatactctatatttccacttag

SEQ ID NO: 656100 - DNA, 25 bp, Mus musculus
ggttatacttggacgaagcctgtga

SEQ ID NO: 656101 - DNA, 25 bp, Mus musculus
ggttatacttggtcgaagcctgtga

SEQ ID NO: 656102 - DNA, 25 bp, Mus musculus
ggttatagacatccagttcagtttg

SEQ ID NO: 656103 - DNA, 25 bp, Mus musculus
ggttatagacatgcagttcagtttg

SEQ ID NO: 656104 - DNA, 25 bp, Mus musculus
ggttatagcagcaagccaagcactt

SEQ ID NO: 656105 - DNA, 25 bp, Mus musculus
ggttatagcagctagccaagcactt

SEQ ID NO: 656106 - DNA, 25 bp, Mus musculus
ggttatagctgtccaactccaggaa

SEQ ID NO: 656107 - DNA, 25 bp, Mus musculus
ggttatagctgtgcaactccaggaa

SEQ ID NO: 656108 - DNA, 25 bp, Mus musculus
ggttataggcagatcccaataggaa

SEQ ID NO: 656109 - DNA, 25 bp, Mus musculus
ggttataggcagttcccaataggaa

SEQ ID NO: 656110 - DNA, 25 bp, Mus musculus
ggttatagggccacaggtctggtaa

SEQ ID NO: 656111 - DNA, 25 bp, Mus musculus
ggttatagggcctcaggtctggtaa

SEQ ID NO: 656112 - DNA, 25 bp, Mus musculus
ggttataggtatactttgcccagct

SEQ ID NO: 656113 - DNA, 25 bp, Mus musculus
ggttataggtattctttgcccagct

SEQ ID NO: 656114 - DNA, 25 bp, Mus musculus
ggttatatactgcttatatctgtgg

SEQ ID NO: 656115 - DNA, 25 bp, Mus musculus
ggttatatactggttatatctgtgg

SEQ ID NO: 656116 - DNA, 25 bp, Mus musculus
ggttatatagagctgaatcccgttg

SEQ ID NO: 656117 - DNA, 25 bp, Mus musculus
ggttatatagaggtgaatcccgttg

SEQ ID NO: 656118 - DNA, 25 bp, Mus musculus
ggttatattcagcataagctatttc

SEQ ID NO: 656119 - DNA, 25 bp, Mus musculus
ggttatattcaggataagctatttc

SEQ ID NO: 656120 - DNA, 25 bp, Mus musculus
ggttatatttccacactaatctgag

SEQ ID NO: 656121 - DNA, 25 bp, Mus musculus
ggttatatttcctcactaatctgag

SEQ ID NO: 656122 - DNA, 25 bp, Mus musculus
ggttatcaaaatccctgtgtagtgt

SEQ ID NO: 656123 - DNA, 25 bp, Mus musculus
ggttatcaaaatgcctgtgtagtgt

SEQ ID NO: 656124 - DNA, 25 bp, Mus musculus
ggttatcaactcatattaaatcctg

SEQ ID NO: 656125 - DNA, 25 bp, Mus musculus
ggttatcaactcttattaaatcctg

SEQ ID NO: 656126 - DNA, 25 bp, Mus musculus
ggttatcaattaagtccctatcaaa

SEQ ID NO: 656127 - DNA, 25 bp, Mus musculus
ggttatcaattatgtccctatcaaa

SEQ ID NO: 656128 - DNA, 25 bp, Mus musculus
ggttatcaatttcatgagtccttgt

SEQ ID NO: 656129 - DNA, 25 bp, Mus musculus
ggttatcaatttgatgagtccttgt

SEQ ID NO: 656130 - DNA, 25 bp, Mus musculus
ggttatcaccctctggtcaaaggaa

SEQ ID NO: 656131 - DNA, 25 bp, Mus musculus
ggttatcaccctgtggtcaaaggaa

SEQ ID NO: 656132 - DNA, 25 bp, Mus musculus
ggttatcagatcattgggagttcca

SEQ ID NO: 656133 - DNA, 25 bp, Mus musculus
ggttatcagatctttgggagttcca

SEQ ID NO: 656134 - DNA, 25 bp, Mus musculus
ggttatcagcttagcgacagtacat

SEQ ID NO: 656135 - DNA, 25 bp, Mus musculus
ggttatcagctttgcgacagtacat

SEQ ID NO: 656136 - DNA, 25 bp, Mus musculus
ggttatcagtaactctgacaaccta

SEQ ID NO: 656137 - DNA, 25 bp, Mus musculus
ggttatcagtaagtctgacaaccta

SEQ ID NO: 656138 - DNA, 25 bp, Mus musculus
ggttatcataatacccacctttcgt

SEQ ID NO: 656139 - DNA, 25 bp, Mus musculus
ggttatcataattcccacctttcgt

SEQ ID NO: 656140 - DNA, 25 bp, Mus musculus
ggttatcatcctctacttgaccctg

SEQ ID NO: 656141 - DNA, 25 bp, Mus musculus
ggttatcatcctgtacttgaccctg

SEQ ID NO: 656142 - DNA, 25 bp, Mus musculus
ggttatcatgccagaagccagcatt

SEQ ID NO: 656143 - DNA, 25 bp, Mus musculus
ggttatcatgcctgaagccagcatt

SEQ ID NO: 656144 - DNA, 25 bp, Mus musculus
ggttatcatggcaactaataggatt

SEQ ID NO: 656145 - DNA, 25 bp, Mus musculus
ggttatcatggctactaataggatt

SEQ ID NO: 656146 - DNA, 25 bp, Mus musculus
ggttatcatgtcacgatgcctgtga

SEQ ID NO: 656147 - DNA, 25 bp, Mus musculus
ggttatcatgtctcgatgcctgtga

SEQ ID NO: 656148 - DNA, 25 bp, Mus musculus
ggttatccaataaccagtactgctt

SEQ ID NO: 656149 - DNA, 25 bp, Mus musculus
ggttatccaatatccagtactgctt

SEQ ID NO: 656150 - DNA, 25 bp, Mus musculus
ggttatccaccactaatcttggcag

SEQ ID NO: 656151 - DNA, 25 bp, Mus musculus
ggttatccaccagtaatcttggcag

SEQ ID NO: 656152 - DNA, 25 bp, Mus musculus
ggttatccattgacctcacagggac

SEQ ID NO: 656153 - DNA, 25 bp, Mus musculus
ggttatccattgtcctcacagggac

SEQ ID NO: 656154 - DNA, 25 bp, Mus musculus
ggttatccccatcatcagcttaggt

SEQ ID NO: 656155 - DNA, 25 bp, Mus musculus
ggttatccccatgatcagcttaggt

SEQ ID NO: 656156 - DNA, 25 bp, Mus musculus
ggttatcctcagctatgcagtgcat

SEQ ID NO: 656157 - DNA, 25 bp, Mus musculus
ggttatcctcaggtatgcagtgcat

SEQ ID NO: 656158 - DNA, 25 bp, Mus musculus
ggttatcctctcctacatagtgaat

SEQ ID NO: 656159 - DNA, 25 bp, Mus musculus
ggttatcctctcgtacatagtgaat

SEQ ID NO: 656160 - DNA, 25 bp, Mus musculus
ggttatcctctgctagacaaggatg

SEQ ID NO: 656161 - DNA, 25 bp, Mus musculus
ggttatcctctggtagacaaggatg

SEQ ID NO: 656162 - DNA, 25 bp, Mus musculus
ggttatcctgacatctttgattaaa

SEQ ID NO: 656163 - DNA, 25 bp, Mus musculus
ggttatcctgacttctttgattaaa

SEQ ID NO: 656164 - DNA, 25 bp, Mus musculus
ggttatccttttcgtactttctatg

SEQ ID NO: 656165 - DNA, 25 bp, Mus musculus
ggttatccttttggtactttctatg

SEQ ID NO: 656166 - DNA, 25 bp, Mus musculus
ggttatcgacctccgaatcagcaat

SEQ ID NO: 656167 - DNA, 25 bp, Mus musculus
ggttatcgacctgcgaatcagcaat

SEQ ID NO: 656168 - DNA, 25 bp, Mus musculus
ggttatctaataactcagggcttat

SEQ ID NO: 656169 - DNA, 25 bp, Mus musculus
ggttatctaatatctcagggcttat

SEQ ID NO: 656170 - DNA, 25 bp, Mus musculus
ggttatctagttcccaccttatata

SEQ ID NO: 656171 - DNA, 25 bp, Mus musculus
ggttatctagttgccaccttatata

SEQ ID NO: 656172 - DNA, 25 bp, Mus musculus
ggttatctcattagtcacttgtctg

SEQ ID NO: 656173 - DNA, 25 bp, Mus musculus
ggttatctcatttgtcacttgtctg

SEQ ID NO: 656174 - DNA, 25 bp, Mus musculus
ggttatctccatatcctagctattt

SEQ ID NO: 656175 - DNA, 25 bp, Mus musculus
ggttatctccatttcctagctattt

SEQ ID NO: 656176 - DNA, 25 bp, Mus musculus
ggttatcttacaactgttacgcttt

SEQ ID NO: 656177 - DNA, 25 bp, Mus musculus
ggttatcttacatctgttacgcttt

SEQ ID NO: 656178 - DNA, 25 bp, Mus musculus
ggttatgaaatacccagaccctgcc

SEQ ID NO: 656179 - DNA, 25 bp, Mus musculus
ggttatgaaatagccagaccctgcc

SEQ ID NO: 656180 - DNA, 25 bp, Mus musculus
ggttatgaccatattcacttactga

SEQ ID NO: 656181 - DNA, 25 bp, Mus musculus
ggttatgaccattttcacttactga

SEQ ID NO: 656182 - DNA, 25 bp, Mus musculus
ggttatgactgcaccccagaaaaat

SEQ ID NO: 656183 - DNA, 25 bp, Mus musculus
ggttatgactgctccccagaaaaat

SEQ ID NO: 656184 - DNA, 25 bp, Mus musculus
ggttatgcaagaaggcactctagct

SEQ ID NO: 656185 - DNA, 25 bp, Mus musculus
ggttatgcaagatggcactctagct

SEQ ID NO: 656186 - DNA, 25 bp, Mus musculus
ggttatgcctcactacagtggactt

SEQ ID NO: 656187 - DNA, 25 bp, Mus musculus
ggttatgcctcagtacagtggactt

SEQ ID NO: 656188 - DNA, 25 bp, Mus musculus
ggttatgccttaagtaactggataa

SEQ ID NO: 656189 - DNA, 25 bp, Mus musculus
ggttatgccttatgtaactggataa

SEQ ID NO: 656190 - DNA, 25 bp, Mus musculus
ggttatgcgtatcacccggtatgaa

SEQ ID NO: 656191 - DNA, 25 bp, Mus musculus
ggttatgcgtatgacccggtatgaa

SEQ ID NO: 656192 - DNA, 25 bp, Mus musculus
ggttatgctatcacatagattcctt

SEQ ID NO: 656193 - DNA, 25 bp, Mus musculus
ggttatgctatctcatagattcctt

SEQ ID NO: 656194 - DNA, 25 bp, Mus musculus
ggttatgctgtcattgttacctaat

SEQ ID NO: 656195 - DNA, 25 bp, Mus musculus
ggttatgctgtctttgttacctaat

SEQ ID NO: 656196 - DNA, 25 bp, Mus musculus
ggttatgcttgcaccaaaacaaatt

SEQ ID NO: 656197 - DNA, 25 bp, Mus musculus
ggttatgcttgctccaaaacaaatt

SEQ ID NO: 656198 - DNA, 25 bp, Mus musculus
ggttatgctttcacatagctctgaa

SEQ ID NO: 656199 - DNA, 25 bp, Mus musculus
ggttatgctttctcatagctctgaa

SEQ ID NO: 656200 - DNA, 25 bp, Mus musculus
ggttatggaactcagcgccgattac

SEQ ID NO: 656201 - DNA, 25 bp, Mus musculus
ggttatggaactgagcgccgattac

SEQ ID NO: 656202 - DNA, 25 bp, Mus musculus
ggttatggaatcaggctgccttaat

SEQ ID NO: 656203 - DNA, 25 bp, Mus musculus
ggttatggaatctggctgccttaat

SEQ ID NO: 656204 - DNA, 25 bp, Mus musculus
ggttatggctagaagaaccttaact

SEQ ID NO: 656205 - DNA, 25 bp, Mus musculus
ggttatggctagtagaaccttaact

SEQ ID NO: 656206 - DNA, 25 bp, Mus musculus
ggttatggctgacaaccccaaatat

SEQ ID NO: 656207 - DNA, 25 bp, Mus musculus
ggttatggctgagaaccccaaatat

SEQ ID NO: 656208 - DNA, 25 bp, Mus musculus
ggttatgggtctattttaagtgatt

SEQ ID NO: 656209 - DNA, 25 bp, Mus musculus
ggttatgggtcttttttaagtgatt

SEQ ID NO: 656210 - DNA, 25 bp, Mus musculus
ggttatggtgaacttctgacttctg

SEQ ID NO: 656211 - DNA, 25 bp, Mus musculus
ggttatggtgaagttctgacttctg

SEQ ID NO: 656212 - DNA, 25 bp, Mus musculus
ggttatgtactgaatgttccaggaa

SEQ ID NO: 656213 - DNA, 25 bp, Mus musculus
ggttatgtactgagacctcgtttca

SEQ ID NO: 656214 - DNA, 25 bp, Mus musculus
ggttatgtactgtatgttccaggaa

SEQ ID NO: 656215 - DNA, 25 bp, Mus musculus
ggttatgtactgtgacctcgtttca

SEQ ID NO: 656216 - DNA, 25 bp, Mus musculus
ggttatgtagtccattatccaaact

SEQ ID NO: 656217 - DNA, 25 bp, Mus musculus
ggttatgtagtcgattatccaaact

SEQ ID NO: 656218 - DNA, 25 bp, Mus musculus
ggttatgttccacacggctttgtta

SEQ ID NO: 656219 - DNA, 25 bp, Mus musculus
ggttatgttccagacggctttgtta

SEQ ID NO: 656220 - DNA, 25 bp, Mus musculus
ggttatgttcctattcgaactccag

SEQ ID NO: 656221 - DNA, 25 bp, Mus musculus
ggttatgttccttttcgaactccag

SEQ ID NO: 656222 - DNA, 25 bp, Mus musculus
ggttattacaatcaacgtgtttaca

SEQ ID NO: 656223 - DNA, 25 bp, Mus musculus
ggttattacaatgaacgtgtttaca

SEQ ID NO: 656224 - DNA, 25 bp, Mus musculus
ggttattacctgatccgaagcaact

SEQ ID NO: 656225 - DNA, 25 bp, Mus musculus
ggttattacctgttccgaagcaact

SEQ ID NO: 656226 - DNA, 25 bp, Mus musculus
ggttattactctcggactgcgatga

SEQ ID NO: 656227 - DNA, 25 bp, Mus musculus
ggttattactctgggactgcgatga

SEQ ID NO: 656228 - DNA, 25 bp, Mus musculus
ggttattagacccaatgccactata

SEQ ID NO: 656229 - DNA, 25 bp, Mus musculus
ggttattagaccgaatgccactata

SEQ ID NO: 656230 - DNA, 25 bp, Mus musculus
ggttattagccaccatatggatgct

SEQ ID NO: 656231 - DNA, 25 bp, Mus musculus
ggttattagccagcatatggatgct

SEQ ID NO: 656232 - DNA, 25 bp, Mus musculus
ggttattataatcatctggtcccac

SEQ ID NO: 656233 - DNA, 25 bp, Mus musculus
ggttattataatgatctggtcccac

SEQ ID NO: 656234 - DNA, 25 bp, Mus musculus
ggttattatgttctgtctgaagcca

SEQ ID NO: 656235 - DNA, 25 bp, Mus musculus
ggttattatgttgtgtctgaagcca

SEQ ID NO: 656236 - DNA, 25 bp, Mus musculus
ggttattattacagcaccaggatga

SEQ ID NO: 656237 - DNA, 25 bp, Mus musculus
ggttattattactgcaccaggatga

SEQ ID NO: 656238 - DNA, 25 bp, Mus musculus
ggttattcaaaaactccatccattt

SEQ ID NO: 656239 - DNA, 25 bp, Mus musculus
ggttattcaaaatctccatccattt

SEQ ID NO: 656240 - DNA, 25 bp, Mus musculus
ggttattcaagtcttccagttctgc

SEQ ID NO: 656241 - DNA, 25 bp, Mus musculus
ggttattcaagtgttccagttctgc

SEQ ID NO: 656242 - DNA, 25 bp, Mus musculus
ggttattcacatctagttcctaaac

SEQ ID NO: 656243 - DNA, 25 bp, Mus musculus
ggttattcacatgtagttcctaaac

SEQ ID NO: 656244 - DNA, 25 bp, Mus musculus
ggttattcagaccttcaagctgcaa

SEQ ID NO: 656245 - DNA, 25 bp, Mus musculus
ggttattcagacgttcaagctgcaa

SEQ ID NO: 656246 - DNA, 25 bp, Mus musculus
ggttattcatacatagcagggtcaa

SEQ ID NO: 656247 - DNA, 25 bp, Mus musculus
ggttattcatacttagcagggtcaa

SEQ ID NO: 656248 - DNA, 25 bp, Mus musculus
ggttattcattaatcctcaaattgc

SEQ ID NO: 656249 - DNA, 25 bp, Mus musculus
ggttattcattattcctcaaattgc

SEQ ID NO: 656250 - DNA, 25 bp, Mus musculus
ggttattcccacagctttaagtcac

SEQ ID NO: 656251 - DNA, 25 bp, Mus musculus
ggttattcccactgctttaagtcac

SEQ ID NO: 656252 - DNA, 25 bp, Mus musculus
ggttattctaagaagccatggcttt

SEQ ID NO: 656253 - DNA, 25 bp, Mus musculus
ggttattctaagtagccatggcttt

SEQ ID NO: 656254 - DNA, 25 bp, Mus musculus
ggttattctcatcagaggcccactg

SEQ ID NO: 656255 - DNA, 25 bp, Mus musculus
ggttattctcatgagaggcccactg

SEQ ID NO: 656256 - DNA, 25 bp, Mus musculus
ggttattcttccacctgcctcagga

SEQ ID NO: 656257 - DNA, 25 bp, Mus musculus
ggttattcttcctcctgcctcagga

SEQ ID NO: 656258 - DNA, 25 bp, Mus musculus
ggttattcttctcagatttctggca

SEQ ID NO: 656259 - DNA, 25 bp, Mus musculus
ggttattcttctgagatttctggca

SEQ ID NO: 656260 - DNA, 25 bp, Mus musculus
ggttattcttgcctacatagtaagc

SEQ ID NO: 656261 - DNA, 25 bp, Mus musculus
ggttattcttgcgtacatagtaagc

SEQ ID NO: 656262 - DNA, 25 bp, Mus musculus
ggttattgaagcacttcatcctccc

SEQ ID NO: 656263 - DNA, 25 bp, Mus musculus
ggttattgaagctcttcatcctccc

SEQ ID NO: 656264 - DNA, 25 bp, Mus musculus
ggttattgaataatgcctgtgctgc

SEQ ID NO: 656265 - DNA, 25 bp, Mus musculus
ggttattgaatattgcctgtgctgc

SEQ ID NO: 656266 - DNA, 25 bp, Mus musculus
ggttattggcagcagcaggcataat

SEQ ID NO: 656267 - DNA, 25 bp, Mus musculus
ggttattggcaggagcaggcataat

SEQ ID NO: 656268 - DNA, 25 bp, Mus musculus
ggttattggctaacaaaggtgtcaa

SEQ ID NO: 656269 - DNA, 25 bp, Mus musculus
ggttattggctatcaaaggtgtcaa

SEQ ID NO: 656270 - DNA, 25 bp, Mus musculus
ggttattggcttctggctgtttata

SEQ ID NO: 656271 - DNA, 25 bp, Mus musculus
ggttattggcttgtggctgtttata

SEQ ID NO: 656272 - DNA, 25 bp, Mus musculus
ggttattgtcatctctctgttttga

SEQ ID NO: 656273 - DNA, 25 bp, Mus musculus
ggttattgtcatgtctctgttttga

SEQ ID NO: 656274 - DNA, 25 bp, Mus musculus
ggttattgtgtaacgctgacttcaa

SEQ ID NO: 656275 - DNA, 25 bp, Mus musculus
ggttattgtgtatcgctgacttcaa

SEQ ID NO: 656276 - DNA, 25 bp, Mus musculus
ggttattgtgtgagtcatgagccct

SEQ ID NO: 656277 - DNA, 25 bp, Mus musculus
ggttattgtgtgtgtcatgagccct

SEQ ID NO: 656278 - DNA, 25 bp, Mus musculus
ggttattgtttcaacatggccctgt

SEQ ID NO: 656279 - DNA, 25 bp, Mus musculus
ggttattgtttctacatggccctgt

SEQ ID NO: 656280 - DNA, 25 bp, Mus musculus
ggttatttaaagacttcttcatggt

SEQ ID NO: 656281 - DNA, 25 bp, Mus musculus
ggttatttaaagtcttcttcatggt

SEQ ID NO: 656282 - DNA, 25 bp, Mus musculus
ggttatttaagaaccacttttgaca

SEQ ID NO: 656283 - DNA, 25 bp, Mus musculus
ggttatttaagatccacttttgaca

SEQ ID NO: 656284 - DNA, 25 bp, Mus musculus
ggttatttacataccccagagtgtg

SEQ ID NO: 656285 - DNA, 25 bp, Mus musculus
ggttatttacattccccagagtgtg

SEQ ID NO: 656286 - DNA, 25 bp, Mus musculus
ggttatttagctatgtgttcataca

SEQ ID NO: 656287 - DNA, 25 bp, Mus musculus
ggttatttagctttgtgttcataca

SEQ ID NO: 656288 - DNA, 25 bp, Mus musculus
ggttatttatttagcttgtccttat

SEQ ID NO: 656289 - DNA, 25 bp, Mus musculus
ggttatttattttgcttgtccttat

SEQ ID NO: 656290 - DNA, 25 bp, Mus musculus
ggttatttcagacgttatggctcat

SEQ ID NO: 656291 - DNA, 25 bp, Mus musculus
ggttatttcagaggttatggctcat

SEQ ID NO: 656292 - DNA, 25 bp, Mus musculus
ggttatttcattactgtcaccagac

SEQ ID NO: 656293 - DNA, 25 bp, Mus musculus
ggttatttcatttctgtcaccagac

SEQ ID NO: 656294 - DNA, 25 bp, Mus musculus
ggttatttcccactctaaaacagca

SEQ ID NO: 656295 - DNA, 25 bp, Mus musculus
ggttatttcccagtctaaaacagca

SEQ ID NO: 656296 - DNA, 25 bp, Mus musculus
ggttatttctgacagcatgtgtaga

SEQ ID NO: 656297 - DNA, 25 bp, Mus musculus
ggttatttctgagagcatgtgtaga

SEQ ID NO: 656298 - DNA, 25 bp, Mus musculus
ggttatttctgccttagtgatgttg

SEQ ID NO: 656299 - DNA, 25 bp, Mus musculus
ggttatttctgcgttagtgatgttg

SEQ ID NO: 656300 - DNA, 25 bp, Mus musculus
ggttatttcttgacttccatcttag

SEQ ID NO: 656301 - DNA, 25 bp, Mus musculus
ggttatttcttgtcttccatcttag

SEQ ID NO: 656302 - DNA, 25 bp, Mus musculus
ggttatttgaggaagcatctcatgt

SEQ ID NO: 656303 - DNA, 25 bp, Mus musculus
ggttatttgaggtagcatctcatgt

SEQ ID NO: 656304 - DNA, 25 bp, Mus musculus
ggttatttgctcacatcttacatgt

SEQ ID NO: 656305 - DNA, 25 bp, Mus musculus
ggttatttgctctcatcttacatgt

SEQ ID NO: 656306 - DNA, 25 bp, Mus musculus
ggttatttgcttccattccatgcgt

SEQ ID NO: 656307 - DNA, 25 bp, Mus musculus
ggttatttgcttgcattccatgcgt

SEQ ID NO: 656308 - DNA, 25 bp, Mus musculus
ggttattttcccatgaagtctttat

SEQ ID NO: 656309 - DNA, 25 bp, Mus musculus
ggttattttcccttgaagtctttat

SEQ ID NO: 656310 - DNA, 25 bp, Mus musculus
ggttattttgtgaggaccaaagtca

SEQ ID NO: 656311 - DNA, 25 bp, Mus musculus
ggttattttgtgtggaccaaagtca

SEQ ID NO: 656312 - DNA, 25 bp, Mus musculus
ggttattttgttcgtcactgcctaa

SEQ ID NO: 656313 - DNA, 25 bp, Mus musculus
ggttattttgttggtcactgcctaa

SEQ ID NO: 656314 - DNA, 25 bp, Mus musculus
ggttatttttccagttcatgtgttt

SEQ ID NO: 656315 - DNA, 25 bp, Mus musculus
ggttatttttcctgttcatgtgttt

SEQ ID NO: 656316 - DNA, 25 bp, Mus musculus
ggttatttttgtcattgcctctagt

SEQ ID NO: 656317 - DNA, 25 bp, Mus musculus
ggttatttttgtgattgcctctagt

SEQ ID NO: 656318 - DNA, 25 bp, Mus musculus
ggttcaaaagtgcattatttagttt

SEQ ID NO: 656319 - DNA, 25 bp, Mus musculus
ggttcaaaagtggattatttagttt

SEQ ID NO: 656320 - DNA, 25 bp, Mus musculus
ggttcaaaatcccataaatgacagc

SEQ ID NO: 656321 - DNA, 25 bp, Mus musculus
ggttcaaaatccgataaatgacagc

SEQ ID NO: 656322 - DNA, 25 bp, Mus musculus
ggttcaaagacaagtccccacatag

SEQ ID NO: 656323 - DNA, 25 bp, Mus musculus
ggttcaaagacatgtccccacatag

SEQ ID NO: 656324 - DNA, 25 bp, Mus musculus
ggttcaaagatgactgctactcccc

SEQ ID NO: 656325 - DNA, 25 bp, Mus musculus
ggttcaaagatgtctgctactcccc

SEQ ID NO: 656326 - DNA, 25 bp, Mus musculus
ggttcaaaggcaaggatcgtcacag

SEQ ID NO: 656327 - DNA, 25 bp, Mus musculus
ggttcaaaggcatggatcgtcacag

SEQ ID NO: 656328 - DNA, 25 bp, Mus musculus
ggttcaaagtcaaaatcactcaggg

SEQ ID NO: 656329 - DNA, 25 bp, Mus musculus
ggttcaaagtcataatcactcaggg

SEQ ID NO: 656330 - DNA, 25 bp, Mus musculus
ggttcaaagtctataaccacttctg

SEQ ID NO: 656331 - DNA, 25 bp, Mus musculus
ggttcaaagtctttaaccacttctg

SEQ ID NO: 656332 - DNA, 25 bp, Mus musculus
ggttcaaatcataccacccatatgg

SEQ ID NO: 656333 - DNA, 25 bp, Mus musculus
ggttcaaatcattccacccatatgg

SEQ ID NO: 656334 - DNA, 25 bp, Mus musculus
ggttcaaatcctcttagacatgtta

SEQ ID NO: 656335 - DNA, 25 bp, Mus musculus
ggttcaaatcctgttagacatgtta

SEQ ID NO: 656336 - DNA, 25 bp, Mus musculus
ggttcaaatgatcgccagatggatt

SEQ ID NO: 656337 - DNA, 25 bp, Mus musculus
ggttcaaatgatggccagatggatt

SEQ ID NO: 656338 - DNA, 25 bp, Mus musculus
ggttcaacaaaacaaagaggatgcc

SEQ ID NO: 656339 - DNA, 25 bp, Mus musculus
ggttcaacaaaagaaagaggatgcc

SEQ ID NO: 656340 - DNA, 25 bp, Mus musculus
ggttcaacacctactctggtgggaa

SEQ ID NO: 656341 - DNA, 25 bp, Mus musculus
ggttcaacaccttctctggtgggaa

SEQ ID NO: 656342 - DNA, 25 bp, Mus musculus
ggttcaacactaacttgactacttt

SEQ ID NO: 656343 - DNA, 25 bp, Mus musculus
ggttcaacactatcttgactacttt

SEQ ID NO: 656344 - DNA, 25 bp, Mus musculus
ggttcaacagtcaccatgtttcagt

SEQ ID NO: 656345 - DNA, 25 bp, Mus musculus
ggttcaacagtctccatgtttcagt

SEQ ID NO: 656346 - DNA, 25 bp, Mus musculus
ggttcaacctaaaagcgtgccttgc

SEQ ID NO: 656347 - DNA, 25 bp, Mus musculus
ggttcaacctaatagcgtgccttgc

SEQ ID NO: 656348 - DNA, 25 bp, Mus musculus
ggttcaacctgaaggagaaaatgct

SEQ ID NO: 656349 - DNA, 25 bp, Mus musculus
ggttcaacctgatggagaaaatgct

SEQ ID NO: 656350 - DNA, 25 bp, Mus musculus
ggttcaaccttaacaatcctgttct

SEQ ID NO: 656351 - DNA, 25 bp, Mus musculus
ggttcaaccttatcaatcctgttct

SEQ ID NO: 656352 - DNA, 25 bp, Mus musculus
ggttcaacgctaacatttcctacag

SEQ ID NO: 656353 - DNA, 25 bp, Mus musculus
ggttcaacgctatcatttcctacag

SEQ ID NO: 656354 - DNA, 25 bp, Mus musculus
ggttcaactcctcctgcgtttatta

SEQ ID NO: 656355 - DNA, 25 bp, Mus musculus
ggttcaactcctgctgcgtttatta

SEQ ID NO: 656356 - DNA, 25 bp, Mus musculus
ggttcaacttcacactgagacactt

SEQ ID NO: 656357 - DNA, 25 bp, Mus musculus
ggttcaacttcagactgagacactt

SEQ ID NO: 656358 - DNA, 25 bp, Mus musculus
ggttcaacttccaagcagtgtttct

SEQ ID NO: 656359 - DNA, 25 bp, Mus musculus
ggttcaacttcctagcagtgtttct

SEQ ID NO: 656360 - DNA, 25 bp, Mus musculus
ggttcaagaccgctttgcacaacat

SEQ ID NO: 656361 - DNA, 25 bp, Mus musculus
ggttcaagaccggtttgcacaacat

SEQ ID NO: 656362 - DNA, 25 bp, Mus musculus
ggttcaagagcaccgaagcctggaa

SEQ ID NO: 656363 - DNA, 25 bp, Mus musculus
ggttcaagagcagcgaagcctggaa

SEQ ID NO: 656364 - DNA, 25 bp, Mus musculus
ggttcaagcataatcgtccaattct

SEQ ID NO: 656365 - DNA, 25 bp, Mus musculus
ggttcaagcatattcgtccaattct

SEQ ID NO: 656366 - DNA, 25 bp, Mus musculus
ggttcaagccttccagtacactgac

SEQ ID NO: 656367 - DNA, 25 bp, Mus musculus
ggttcaagccttgcagtacactgac

SEQ ID NO: 656368 - DNA, 25 bp, Mus musculus
ggttcaagcttactgctttagctgc

SEQ ID NO: 656369 - DNA, 25 bp, Mus musculus
ggttcaagcttagtgctttagctgc

SEQ ID NO: 656370 - DNA, 25 bp, Mus musculus
ggttcaagggcaagtcaggctccat

SEQ ID NO: 656371 - DNA, 25 bp, Mus musculus
ggttcaagggcatgtcaggctccat

SEQ ID NO: 656372 - DNA, 25 bp, Mus musculus
ggttcaaggtatcaatgttccaagt

SEQ ID NO: 656373 - DNA, 25 bp, Mus musculus
ggttcaaggtatgaatgttccaagt

SEQ ID NO: 656374 - DNA, 25 bp, Mus musculus
ggttcaaggtgcattttctgctaca

SEQ ID NO: 656375 - DNA, 25 bp, Mus musculus
ggttcaaggtgctttttctgctaca

SEQ ID NO: 656376 - DNA, 25 bp, Mus musculus
ggttcaagtacaacggcagcgccag

SEQ ID NO: 656377 - DNA, 25 bp, Mus musculus
ggttcaagtacatcggcagcgccag

SEQ ID NO: 656378 - DNA, 25 bp, Mus musculus
ggttcaagtcaacagcgactcacga

SEQ ID NO: 656379 - DNA, 25 bp, Mus musculus
ggttcaagtcaagagcgactcacga

SEQ ID NO: 656380 - DNA, 25 bp, Mus musculus
ggttcaatcccactatcagcatgat

SEQ ID NO: 656381 - DNA, 25 bp, Mus musculus
ggttcaatcccagtatcagcatgat

SEQ ID NO: 656382 - DNA, 25 bp, Mus musculus
ggttcaatcgagcaagaccctgcct

SEQ ID NO: 656383 - DNA, 25 bp, Mus musculus
ggttcaatcgaggaagaccctgcct

SEQ ID NO: 656384 - DNA, 25 bp, Mus musculus
ggttcaatcgctcagttgatctaga

SEQ ID NO: 656385 - DNA, 25 bp, Mus musculus
ggttcaatcgctgagttgatctaga

SEQ ID NO: 656386 - DNA, 25 bp, Mus musculus
ggttcaatgtggattttcagttgta

SEQ ID NO: 656387 - DNA, 25 bp, Mus musculus
ggttcaatgtggtttttcagttgta

SEQ ID NO: 656388 - DNA, 25 bp, Mus musculus
ggttcaattactaggacccacttgg

SEQ ID NO: 656389 - DNA, 25 bp, Mus musculus
ggttcaattacttggacccacttgg

SEQ ID NO: 656390 - DNA, 25 bp, Mus musculus
ggttcaattcctcactcttgaggta

SEQ ID NO: 656391 - DNA, 25 bp, Mus musculus
ggttcaattcctgactcttgaggta

SEQ ID NO: 656392 - DNA, 25 bp, Mus musculus
ggttcaatttctattacatgcagtt

SEQ ID NO: 656393 - DNA, 25 bp, Mus musculus
ggttcaatttcttttacatgcagtt

SEQ ID NO: 656394 - DNA, 25 bp, Mus musculus
ggttcaattttccaatagggcactg

SEQ ID NO: 656395 - DNA, 25 bp, Mus musculus
ggttcaattttcgaatagggcactg

SEQ ID NO: 656396 - DNA, 25 bp, Mus musculus
ggttcacaaactaagcacctcgagt

SEQ ID NO: 656397 - DNA, 25 bp, Mus musculus
ggttcacaaacttagcacctcgagt

SEQ ID NO: 656398 - DNA, 25 bp, Mus musculus
ggttcacaaggtacttgacctccaa

SEQ ID NO: 656399 - DNA, 25 bp, Mus musculus
ggttcacaaggttcttgacctccaa

SEQ ID NO: 656400 - DNA, 25 bp, Mus musculus
ggttcacagcacagaactttcctga

SEQ ID NO: 656401 - DNA, 25 bp, Mus musculus
ggttcacagcactgaactttcctga

SEQ ID NO: 656402 - DNA, 25 bp, Mus musculus
ggttcacaggcgcactgcctacatt

SEQ ID NO: 656403 - DNA, 25 bp, Mus musculus
ggttcacaggcggactgcctacatt

SEQ ID NO: 656404 - DNA, 25 bp, Mus musculus
ggttcacagtgaagcactactgcag

SEQ ID NO: 656405 - DNA, 25 bp, Mus musculus
ggttcacagtgatgcactactgcag

SEQ ID NO: 656406 - DNA, 25 bp, Mus musculus
ggttcacataaaacagctctgcaga

SEQ ID NO: 656407 - DNA, 25 bp, Mus musculus
ggttcacataaatcagctctgcaga

SEQ ID NO: 656408 - DNA, 25 bp, Mus musculus
ggttcacatccacggatctcagaac

SEQ ID NO: 656409 - DNA, 25 bp, Mus musculus
ggttcacatccagggatctcagaac

SEQ ID NO: 656410 - DNA, 25 bp, Mus musculus
ggttcacatctgaggttgccatgag

SEQ ID NO: 656411 - DNA, 25 bp, Mus musculus
ggttcacatctgtggttgccatgag

SEQ ID NO: 656412 - DNA, 25 bp, Mus musculus
ggttcacatgaacttggctgtattc

SEQ ID NO: 656413 - DNA, 25 bp, Mus musculus
ggttcacatgaagttggctgtattc

SEQ ID NO: 656414 - DNA, 25 bp, Mus musculus
ggttcacattaaacttgtttccatt

SEQ ID NO: 656415 - DNA, 25 bp, Mus musculus
ggttcacattaatcttgtttccatt

SEQ ID NO: 656416 - DNA, 25 bp, Mus musculus
ggttcaccacaacccttcagtctgg

SEQ ID NO: 656417 - DNA, 25 bp, Mus musculus
ggttcaccacaagccttcagtctgg

SEQ ID NO: 656418 - DNA, 25 bp, Mus musculus
ggttcaccacctcttgtgggaaata

SEQ ID NO: 656419 - DNA, 25 bp, Mus musculus
ggttcaccacctgttgtgggaaata

SEQ ID NO: 656420 - DNA, 25 bp, Mus musculus
ggttcaccagtcactagtaagttcc

SEQ ID NO: 656421 - DNA, 25 bp, Mus musculus
ggttcaccagtctctagtaagttcc

SEQ ID NO: 656422 - DNA, 25 bp, Mus musculus
ggttcaccatttcctttggtgatga

SEQ ID NO: 656423 - DNA, 25 bp, Mus musculus
ggttcaccatttgctttggtgatga

SEQ ID NO: 656424 - DNA, 25 bp, Mus musculus
ggttcaccccaacaaatacagtcaa

SEQ ID NO: 656425 - DNA, 25 bp, Mus musculus
ggttcaccccaagaaatacagtcaa

SEQ ID NO: 656426 - DNA, 25 bp, Mus musculus
ggttcaccggctctaagcattatat

SEQ ID NO: 656427 - DNA, 25 bp, Mus musculus
ggttcaccggctgtaagcattatat

SEQ ID NO: 656428 - DNA, 25 bp, Mus musculus
ggttcacctaagaagcttccctcaa

SEQ ID NO: 656429 - DNA, 25 bp, Mus musculus
ggttcacctaagtagcttccctcaa

SEQ ID NO: 656430 - DNA, 25 bp, Mus musculus
ggttcacctctgctgttagtgaggc

SEQ ID NO: 656431 - DNA, 25 bp, Mus musculus
ggttcacctctggtgttagtgaggc

SEQ ID NO: 656432 - DNA, 25 bp, Mus musculus
ggttcacctgctcttggtatatact

SEQ ID NO: 656433 - DNA, 25 bp, Mus musculus
ggttcacctgctgttggtatatact

SEQ ID NO: 656434 - DNA, 25 bp, Mus musculus
ggttcacctgtaaagtccacacctg

SEQ ID NO: 656435 - DNA, 25 bp, Mus musculus
ggttcacctgtatagtccacacctg

SEQ ID NO: 656436 - DNA, 25 bp, Mus musculus
ggttcaccttgcatagtgttgttta

SEQ ID NO: 656437 - DNA, 25 bp, Mus musculus
ggttcaccttgcttagtgttgttta

SEQ ID NO: 656438 - DNA, 25 bp, Mus musculus
ggttcaccttggctttgcttctgac

SEQ ID NO: 656439 - DNA, 25 bp, Mus musculus
ggttcaccttgggtttgcttctgac

SEQ ID NO: 656440 - DNA, 25 bp, Mus musculus
ggttcacgaacccttgcaagaccat

SEQ ID NO: 656441 - DNA, 25 bp, Mus musculus
ggttcacgaaccgttgcaagaccat

SEQ ID NO: 656442 - DNA, 25 bp, Mus musculus
ggttcacgggatccagtacattttt

SEQ ID NO: 656443 - DNA, 25 bp, Mus musculus
ggttcacgggatgcagtacattttt

SEQ ID NO: 656444 - DNA, 25 bp, Mus musculus
ggttcactatctccctactgtctgg

SEQ ID NO: 656445 - DNA, 25 bp, Mus musculus
ggttcactatctgcctactgtctgg

SEQ ID NO: 656446 - DNA, 25 bp, Mus musculus
ggttcactccacacactcaaggaaa

SEQ ID NO: 656447 - DNA, 25 bp, Mus musculus
ggttcactccactcactcaaggaaa

SEQ ID NO: 656448 - DNA, 25 bp, Mus musculus
ggttcactgacaattttcttactgg

SEQ ID NO: 656449 - DNA, 25 bp, Mus musculus
ggttcactgacatttttcttactgg

SEQ ID NO: 656450 - DNA, 25 bp, Mus musculus
ggttcactggaaacctcagatcaac

SEQ ID NO: 656451 - DNA, 25 bp, Mus musculus
ggttcactggaatcctcagatcaac

SEQ ID NO: 656452 - DNA, 25 bp, Mus musculus
ggttcactggccattcccatatgag

SEQ ID NO: 656453 - DNA, 25 bp, Mus musculus
ggttcactggcctttcccatatgag

SEQ ID NO: 656454 - DNA, 25 bp, Mus musculus
ggttcacttccgagattttcattca

SEQ ID NO: 656455 - DNA, 25 bp, Mus musculus
ggttcacttccgtgattttcattca

SEQ ID NO: 656456 - DNA, 25 bp, Mus musculus
ggttcacttgagattacatttgaaa

SEQ ID NO: 656457 - DNA, 25 bp, Mus musculus
ggttcacttgagtttacatttgaaa

SEQ ID NO: 656458 - DNA, 25 bp, Mus musculus
ggttcacttggaacggctattttag

SEQ ID NO: 656459 - DNA, 25 bp, Mus musculus
ggttcacttggatcggctattttag

SEQ ID NO: 656460 - DNA, 25 bp, Mus musculus
ggttcacttgtacactcttgggttt

SEQ ID NO: 656461 - DNA, 25 bp, Mus musculus
ggttcacttgtagactcttgggttt

SEQ ID NO: 656462 - DNA, 25 bp, Mus musculus
ggttcactttctcctattgaagagc

SEQ ID NO: 656463 - DNA, 25 bp, Mus musculus
ggttcactttctgctattgaagagc

SEQ ID NO: 656464 - DNA, 25 bp, Mus musculus
ggttcagaacagagcctgcgctgca

SEQ ID NO: 656465 - DNA, 25 bp, Mus musculus
ggttcagaacagtgcctgcgctgca

SEQ ID NO: 656466 - DNA, 25 bp, Mus musculus
ggttcagaacccctaggcgaagcaa

SEQ ID NO: 656467 - DNA, 25 bp, Mus musculus
ggttcagaacccgtaggcgaagcaa

SEQ ID NO: 656468 - DNA, 25 bp, Mus musculus
ggttcagaacctaacaccatcgttg

SEQ ID NO: 656469 - DNA, 25 bp, Mus musculus
ggttcagaaccttacaccatcgttg

SEQ ID NO: 656470 - DNA, 25 bp, Mus musculus
ggttcagaactgacatgtttacatc

SEQ ID NO: 656471 - DNA, 25 bp, Mus musculus
ggttcagaactgtcatgtttacatc

SEQ ID NO: 656472 - DNA, 25 bp, Mus musculus
ggttcagaataccacaagaaatctt

SEQ ID NO: 656473 - DNA, 25 bp, Mus musculus
ggttcagaatacgacaagaaatctt

SEQ ID NO: 656474 - DNA, 25 bp, Mus musculus
ggttcagaatgcaccattacatgtt

SEQ ID NO: 656475 - DNA, 25 bp, Mus musculus
ggttcagaatgctccattacatgtt

SEQ ID NO: 656476 - DNA, 25 bp, Mus musculus
ggttcagacagaatttccttgcaca

SEQ ID NO: 656477 - DNA, 25 bp, Mus musculus
ggttcagacagattttccttgcaca

SEQ ID NO: 656478 - DNA, 25 bp, Mus musculus
ggttcagacagcaccgattagacgc

SEQ ID NO: 656479 - DNA, 25 bp, Mus musculus
ggttcagacagctccgattagacgc

SEQ ID NO: 656480 - DNA, 25 bp, Mus musculus
ggttcagacattacattcttgtttg

SEQ ID NO: 656481 - DNA, 25 bp, Mus musculus
ggttcagacatttcattcttgtttg

SEQ ID NO: 656482 - DNA, 25 bp, Mus musculus
ggttcagaccccagcaggaacgtgc

SEQ ID NO: 656483 - DNA, 25 bp, Mus musculus
ggttcagacccctgcaggaacgtgc

SEQ ID NO: 656484 - DNA, 25 bp, Mus musculus
ggttcagaccgcagttagttttcta

SEQ ID NO: 656485 - DNA, 25 bp, Mus musculus
ggttcagaccgctgttagttttcta

SEQ ID NO: 656486 - DNA, 25 bp, Mus musculus
ggttcagacgacaagcagagtgtaa

SEQ ID NO: 656487 - DNA, 25 bp, Mus musculus
ggttcagacgactagcagagtgtaa

SEQ ID NO: 656488 - DNA, 25 bp, Mus musculus
ggttcagacggccataatccttggg

SEQ ID NO: 656489 - DNA, 25 bp, Mus musculus
ggttcagacggcgataatccttggg

SEQ ID NO: 656490 - DNA, 25 bp, Mus musculus
ggttcagactgaacacctgtgctca

SEQ ID NO: 656491 - DNA, 25 bp, Mus musculus
ggttcagactgatcacctgtgctca

SEQ ID NO: 656492 - DNA, 25 bp, Mus musculus
ggttcagagcccaaattcttacttc

SEQ ID NO: 656493 - DNA, 25 bp, Mus musculus
ggttcagagccctaattcttacttc

SEQ ID NO: 656494 - DNA, 25 bp, Mus musculus
ggttcagaggcgagggcttcttcat

SEQ ID NO: 656495 - DNA, 25 bp, Mus musculus
ggttcagaggcgtgggcttcttcat

SEQ ID NO: 656496 - DNA, 25 bp, Mus musculus
ggttcagagtgcatgctgctttcac

SEQ ID NO: 656497 - DNA, 25 bp, Mus musculus
ggttcagagtgcttgctgctttcac

SEQ ID NO: 656498 - DNA, 25 bp, Mus musculus
ggttcagataagctttcccagtatg

SEQ ID NO: 656499 - DNA, 25 bp, Mus musculus
ggttcagataaggtttcccagtatg

SEQ ID NO: 656500 - DNA, 25 bp, Mus musculus
ggttcagatcttaccgtctatggat

SEQ ID NO: 656501 - DNA, 25 bp, Mus musculus
ggttcagatctttccgtctatggat

SEQ ID NO: 656502 - DNA, 25 bp, Mus musculus
ggttcagcaactcacttactgataa

SEQ ID NO: 656503 - DNA, 25 bp, Mus musculus
ggttcagcaactgacttactgataa

SEQ ID NO: 656504 - DNA, 25 bp, Mus musculus
ggttcagcactcacacccccacagg

SEQ ID NO: 656505 - DNA, 25 bp, Mus musculus
ggttcagcactctcacccccacagg

SEQ ID NO: 656506 - DNA, 25 bp, Mus musculus
ggttcagcagccacaggaccaagct

SEQ ID NO: 656507 - DNA, 25 bp, Mus musculus
ggttcagcagcctcaggaccaagct

SEQ ID NO: 656508 - DNA, 25 bp, Mus musculus
ggttcagcaggtatagacacttggt

SEQ ID NO: 656509 - DNA, 25 bp, Mus musculus
ggttcagcaggtttagacacttggt

SEQ ID NO: 656510 - DNA, 25 bp, Mus musculus
ggttcagcatggcatatttctttct

SEQ ID NO: 656511 - DNA, 25 bp, Mus musculus
ggttcagcatgggatatttctttct

SEQ ID NO: 656512 - DNA, 25 bp, Mus musculus
ggttcagcccaacgctggttgcatc

SEQ ID NO: 656513 - DNA, 25 bp, Mus musculus
ggttcagcccaaggctggttgcatc

SEQ ID NO: 656514 - DNA, 25 bp, Mus musculus
ggttcagcccacagctgtctgtaat

SEQ ID NO: 656515 - DNA, 25 bp, Mus musculus
ggttcagcccactgctgtctgtaat

SEQ ID NO: 656516 - DNA, 25 bp, Mus musculus
ggttcagccgggatcttgcctggac

SEQ ID NO: 656517 - DNA, 25 bp, Mus musculus
ggttcagccgggttcttgcctggac

SEQ ID NO: 656518 - DNA, 25 bp, Mus musculus
ggttcagcctatagtaggtggtgct

SEQ ID NO: 656519 - DNA, 25 bp, Mus musculus
ggttcagcctattgtaggtggtgct

SEQ ID NO: 656520 - DNA, 25 bp, Mus musculus
ggttcagcctcacgaaggatttcaa

SEQ ID NO: 656521 - DNA, 25 bp, Mus musculus
ggttcagcctcaggaaggatttcaa

SEQ ID NO: 656522 - DNA, 25 bp, Mus musculus
ggttcagcgttcactgtcatgggcc

SEQ ID NO: 656523 - DNA, 25 bp, Mus musculus
ggttcagcgttctctgtcatgggcc

SEQ ID NO: 656524 - DNA, 25 bp, Mus musculus
ggttcagctatgaccaggaatggca

SEQ ID NO: 656525 - DNA, 25 bp, Mus musculus
ggttcagctatgtccaggaatggca

SEQ ID NO: 656526 - DNA, 25 bp, Mus musculus
ggttcagctcatatataataacgtt

SEQ ID NO: 656527 - DNA, 25 bp, Mus musculus
ggttcagctcatttataataacgtt

SEQ ID NO: 656528 - DNA, 25 bp, Mus musculus
ggttcagctcgcctcgaaccctgtg

SEQ ID NO: 656529 - DNA, 25 bp, Mus musculus
ggttcagctcgcgtcgaaccctgtg

SEQ ID NO: 656530 - DNA, 25 bp, Mus musculus
ggttcagctcggagtatcctctcca

SEQ ID NO: 656531 - DNA, 25 bp, Mus musculus
ggttcagctcggtgtatcctctcca

SEQ ID NO: 656532 - DNA, 25 bp, Mus musculus
ggttcagctcttagcatccacatgt

SEQ ID NO: 656533 - DNA, 25 bp, Mus musculus
ggttcagctcttataaatctttggg

SEQ ID NO: 656534 - DNA, 25 bp, Mus musculus
ggttcagctctttgcatccacatgt

SEQ ID NO: 656535 - DNA, 25 bp, Mus musculus
ggttcagctcttttaaatctttggg

SEQ ID NO: 656536 - DNA, 25 bp, Mus musculus
ggttcagctgtcatgctgctctgac

SEQ ID NO: 656537 - DNA, 25 bp, Mus musculus
ggttcagctgtcttgctgctctgac

SEQ ID NO: 656538 - DNA, 25 bp, Mus musculus
ggttcagctgtgaatgtagctatgg

SEQ ID NO: 656539 - DNA, 25 bp, Mus musculus
ggttcagctgtgtatgtagctatgg

SEQ ID NO: 656540 - DNA, 25 bp, Mus musculus
ggttcagctgttcagggagcacgag

SEQ ID NO: 656541 - DNA, 25 bp, Mus musculus
ggttcagctgttgagggagcacgag

SEQ ID NO: 656542 - DNA, 25 bp, Mus musculus
ggttcaggaccacctcatcgaaaag

SEQ ID NO: 656543 - DNA, 25 bp, Mus musculus
ggttcaggaccagctcatcgaaaag

SEQ ID NO: 656544 - DNA, 25 bp, Mus musculus
ggttcaggacctaaacagccatgat

SEQ ID NO: 656545 - DNA, 25 bp, Mus musculus
ggttcaggaccttaacagccatgat

SEQ ID NO: 656546 - DNA, 25 bp, Mus musculus
ggttcaggatttaccgtgctgccaa

SEQ ID NO: 656547 - DNA, 25 bp, Mus musculus
ggttcaggattttccgtgctgccaa

SEQ ID NO: 656548 - DNA, 25 bp, Mus musculus
ggttcaggcactaaactagaggtca

SEQ ID NO: 656549 - DNA, 25 bp, Mus musculus
ggttcaggcacttaactagaggtca

SEQ ID NO: 656550 - DNA, 25 bp, Mus musculus
ggttcaggctctctaaaggtggcta

SEQ ID NO: 656551 - DNA, 25 bp, Mus musculus
ggttcaggctctgtaaaggtggcta

SEQ ID NO: 656552 - DNA, 25 bp, Mus musculus
ggttcagggctaccctcagctatat

SEQ ID NO: 656553 - DNA, 25 bp, Mus musculus
ggttcagggctagcctcagctatat

SEQ ID NO: 656554 - DNA, 25 bp, Mus musculus
ggttcagggctgcatgatttaaaaa

SEQ ID NO: 656555 - DNA, 25 bp, Mus musculus
ggttcagggctggatgatttaaaaa

SEQ ID NO: 656556 - DNA, 25 bp, Mus musculus
ggttcaggtcccaaacatgtctatc

SEQ ID NO: 656557 - DNA, 25 bp, Mus musculus
ggttcaggtcccatggagcgaaaca

SEQ ID NO: 656558 - DNA, 25 bp, Mus musculus
ggttcaggtccctaacatgtctatc

SEQ ID NO: 656559 - DNA, 25 bp, Mus musculus
ggttcaggtcccttggagcgaaaca

SEQ ID NO: 656560 - DNA, 25 bp, Mus musculus
ggttcaggtcgaccaggtcgtcttc

SEQ ID NO: 656561 - DNA, 25 bp, Mus musculus
ggttcaggtcgagcaggtcgtcttc

SEQ ID NO: 656562 - DNA, 25 bp, Mus musculus
ggttcagtaaaacgtagatgcgctc

SEQ ID NO: 656563 - DNA, 25 bp, Mus musculus
ggttcagtaaaaggtagatgcgctc

SEQ ID NO: 656564 - DNA, 25 bp, Mus musculus
ggttcagtaggcattgacgctttga

SEQ ID NO: 656565 - DNA, 25 bp, Mus musculus
ggttcagtaggctttgacgctttga

SEQ ID NO: 656566 - DNA, 25 bp, Mus musculus
ggttcagtagttaaatatgcttgct

SEQ ID NO: 656567 - DNA, 25 bp, Mus musculus
ggttcagtagtttaatatgcttgct

SEQ ID NO: 656568 - DNA, 25 bp, Mus musculus
ggttcagtatggatcgttgtgccga

SEQ ID NO: 656569 - DNA, 25 bp, Mus musculus
ggttcagtatggttcgttgtgccga

SEQ ID NO: 656570 - DNA, 25 bp, Mus musculus
ggttcagtcactaggcacttggtgc

SEQ ID NO: 656571 - DNA, 25 bp, Mus musculus
ggttcagtcacttggcacttggtgc

SEQ ID NO: 656572 - DNA, 25 bp, Mus musculus
ggttcagtcctgaaatccaacgagc

SEQ ID NO: 656573 - DNA, 25 bp, Mus musculus
ggttcagtcctgtaatccaacgagc

SEQ ID NO: 656574 - DNA, 25 bp, Mus musculus
ggttcagtctgccagtgaattccag

SEQ ID NO: 656575 - DNA, 25 bp, Mus musculus
ggttcagtctgcgagtgaattccag

SEQ ID NO: 656576 - DNA, 25 bp, Mus musculus
ggttcagtgaacctatttcctaatg

SEQ ID NO: 656577 - DNA, 25 bp, Mus musculus
ggttcagtgaacgtatttcctaatg

SEQ ID NO: 656578 - DNA, 25 bp, Mus musculus
ggttcagtgagactatttctagtca

SEQ ID NO: 656579 - DNA, 25 bp, Mus musculus
ggttcagtgagagtatttctagtca

SEQ ID NO: 656580 - DNA, 25 bp, Mus musculus
ggttcagtgatcaagactctctacc

SEQ ID NO: 656581 - DNA, 25 bp, Mus musculus
ggttcagtgatctagactctctacc

SEQ ID NO: 656582 - DNA, 25 bp, Mus musculus
ggttcagtgtgtatcttaagtggtt

SEQ ID NO: 656583 - DNA, 25 bp, Mus musculus
ggttcagtgtgtttcttaagtggtt

SEQ ID NO: 656584 - DNA, 25 bp, Mus musculus
ggttcagtgttcctagttgcccttc

SEQ ID NO: 656585 - DNA, 25 bp, Mus musculus
ggttcagtgttcgtagttgcccttc

SEQ ID NO: 656586 - DNA, 25 bp, Mus musculus
ggttcagttctgaagtcctgtgatt

SEQ ID NO: 656587 - DNA, 25 bp, Mus musculus
ggttcagttctgatggatccttatg

SEQ ID NO: 656588 - DNA, 25 bp, Mus musculus
ggttcagttctgtagtcctgtgatt

SEQ ID NO: 656589 - DNA, 25 bp, Mus musculus
ggttcagttctgttggatccttatg

SEQ ID NO: 656590 - DNA, 25 bp, Mus musculus
ggttcagttgccagttcttgtgata

SEQ ID NO: 656591 - DNA, 25 bp, Mus musculus
ggttcagttgcctgttcttgtgata

SEQ ID NO: 656592 - DNA, 25 bp, Mus musculus
ggttcagttgtcagtctattgtgct

SEQ ID NO: 656593 - DNA, 25 bp, Mus musculus
ggttcagttgtctgtctattgtgct

SEQ ID NO: 656594 - DNA, 25 bp, Mus musculus
ggttcagtttcacacaatgaatcag

SEQ ID NO: 656595 - DNA, 25 bp, Mus musculus
ggttcagtttcagacaatgaatcag

SEQ ID NO: 656596 - DNA, 25 bp, Mus musculus
ggttcagtttgtctcttagaccttc

SEQ ID NO: 656597 - DNA, 25 bp, Mus musculus
ggttcagtttgtgtcttagaccttc

SEQ ID NO: 656598 - DNA, 25 bp, Mus musculus
ggttcagtttttccatttggatctc

SEQ ID NO: 656599 - DNA, 25 bp, Mus musculus
ggttcagtttttgcatttggatctc

SEQ ID NO: 656600 - DNA, 25 bp, Mus musculus
ggttcatacaaacgaccttccattt

SEQ ID NO: 656601 - DNA, 25 bp, Mus musculus
ggttcatacaaaggaccttccattt

SEQ ID NO: 656602 - DNA, 25 bp, Mus musculus
ggttcatactccacagccaagagaa

SEQ ID NO: 656603 - DNA, 25 bp, Mus musculus
ggttcatactcctcagccaagagaa

SEQ ID NO: 656604 - DNA, 25 bp, Mus musculus
ggttcatagcgacaccttgtgtcaa

SEQ ID NO: 656605 - DNA, 25 bp, Mus musculus
ggttcatagcgagaccttgtgtcaa

SEQ ID NO: 656606 - DNA, 25 bp, Mus musculus
ggttcatagctacaaagttctgaca

SEQ ID NO: 656607 - DNA, 25 bp, Mus musculus
ggttcatagctagaaagttctgaca

SEQ ID NO: 656608 - DNA, 25 bp, Mus musculus
ggttcataggaactactggcgtcca

SEQ ID NO: 656609 - DNA, 25 bp, Mus musculus
ggttcataggaagtactggcgtcca

SEQ ID NO: 656610 - DNA, 25 bp, Mus musculus
ggttcataggcgatttgccaacctg

SEQ ID NO: 656611 - DNA, 25 bp, Mus musculus
ggttcataggcgttttgccaacctg

SEQ ID NO: 656612 - DNA, 25 bp, Mus musculus
ggttcatagtgtacaaggccctttg

SEQ ID NO: 656613 - DNA, 25 bp, Mus musculus
ggttcatagtgttcaaggccctttg

SEQ ID NO: 656614 - DNA, 25 bp, Mus musculus
ggttcatagttgaggccttctgttc

SEQ ID NO: 656615 - DNA, 25 bp, Mus musculus
ggttcatagttgtggccttctgttc

SEQ ID NO: 656616 - DNA, 25 bp, Mus musculus
ggttcatataaccttggcaatcaag

SEQ ID NO: 656617 - DNA, 25 bp, Mus musculus
ggttcatataacgttggcaatcaag

SEQ ID NO: 656618 - DNA, 25 bp, Mus musculus
ggttcatatcatattaccttcactt

SEQ ID NO: 656619 - DNA, 25 bp, Mus musculus
ggttcatatcattttaccttcactt

SEQ ID NO: 656620 - DNA, 25 bp, Mus musculus
ggttcatatcctacctgtactggac

SEQ ID NO: 656621 - DNA, 25 bp, Mus musculus
ggttcatatccttcctgtactggac

SEQ ID NO: 656622 - DNA, 25 bp, Mus musculus
ggttcatattgcatactgcattgta

SEQ ID NO: 656623 - DNA, 25 bp, Mus musculus
ggttcatattgcttactgcattgta

SEQ ID NO: 656624 - DNA, 25 bp, Mus musculus
ggttcatatttacagcccttttttg

SEQ ID NO: 656625 - DNA, 25 bp, Mus musculus
ggttcatatttagagcccttttttg

SEQ ID NO: 656626 - DNA, 25 bp, Mus musculus
ggttcatcaactaattatacttttc

SEQ ID NO: 656627 - DNA, 25 bp, Mus musculus
ggttcatcaacttattatacttttc

SEQ ID NO: 656628 - DNA, 25 bp, Mus musculus
ggttcatcaccaatatctacaggta

SEQ ID NO: 656629 - DNA, 25 bp, Mus musculus
ggttcatcaccattatctacaggta

SEQ ID NO: 656630 - DNA, 25 bp, Mus musculus
ggttcatcagccaagctgagagtgt

SEQ ID NO: 656631 - DNA, 25 bp, Mus musculus
ggttcatcagcctagctgagagtgt

SEQ ID NO: 656632 - DNA, 25 bp, Mus musculus
ggttcatcagtaatcccaattccat

SEQ ID NO: 656633 - DNA, 25 bp, Mus musculus
ggttcatcagtattcccaattccat

SEQ ID NO: 656634 - DNA, 25 bp, Mus musculus
ggttcatcatacaccagaccatgta

SEQ ID NO: 656635 - DNA, 25 bp, Mus musculus
ggttcatcatactccagaccatgta

SEQ ID NO: 656636 - DNA, 25 bp, Mus musculus
ggttcatcatctaggcctccctttc

SEQ ID NO: 656637 - DNA, 25 bp, Mus musculus
ggttcatcatctataccttccctgt

SEQ ID NO: 656638 - DNA, 25 bp, Mus musculus
ggttcatcatcttggcctccctttc

SEQ ID NO: 656639 - DNA, 25 bp, Mus musculus
ggttcatcatctttaccttccctgt

SEQ ID NO: 656640 - DNA, 25 bp, Mus musculus
ggttcatcatgccaagaaagaagct

SEQ ID NO: 656641 - DNA, 25 bp, Mus musculus
ggttcatcatgcgaagaaagaagct

SEQ ID NO: 656642 - DNA, 25 bp, Mus musculus
ggttcatccaggactgcgtgctcgg

SEQ ID NO: 656643 - DNA, 25 bp, Mus musculus
ggttcatccaggcatgaaggctaat

SEQ ID NO: 656644 - DNA, 25 bp, Mus musculus
ggttcatccagggatgaaggctaat

SEQ ID NO: 656645 - DNA, 25 bp, Mus musculus
ggttcatccaggtctgcgtgctcgg

SEQ ID NO: 656646 - DNA, 25 bp, Mus musculus
ggttcatccctcctgagaaccggaa

SEQ ID NO: 656647 - DNA, 25 bp, Mus musculus
ggttcatccctcgtgagaaccggaa

SEQ ID NO: 656648 - DNA, 25 bp, Mus musculus
ggttcatccctgacggaaaagctga

SEQ ID NO: 656649 - DNA, 25 bp, Mus musculus
ggttcatccctgtcggaaaagctga

SEQ ID NO: 656650 - DNA, 25 bp, Mus musculus
ggttcatccggaaagacacagcctg

SEQ ID NO: 656651 - DNA, 25 bp, Mus musculus
ggttcatccggatagacacagcctg

SEQ ID NO: 656652 - DNA, 25 bp, Mus musculus
ggttcatcctggaacactcagcttg

SEQ ID NO: 656653 - DNA, 25 bp, Mus musculus
ggttcatcctggtacactcagcttg

SEQ ID NO: 656654 - DNA, 25 bp, Mus musculus
ggttcatcgactaatctgtacttgt

SEQ ID NO: 656655 - DNA, 25 bp, Mus musculus
ggttcatcgacttatctgtacttgt

SEQ ID NO: 656656 - DNA, 25 bp, Mus musculus
ggttcatcgccaaccactcactaag

SEQ ID NO: 656657 - DNA, 25 bp, Mus musculus
ggttcatcgccatccactcactaag

SEQ ID NO: 656658 - DNA, 25 bp, Mus musculus
ggttcatctacgactctgtgaaggt

SEQ ID NO: 656659 - DNA, 25 bp, Mus musculus
ggttcatctacgtctctgtgaaggt

SEQ ID NO: 656660 - DNA, 25 bp, Mus musculus
ggttcatctctcatgatctgtcaga

SEQ ID NO: 656661 - DNA, 25 bp, Mus musculus
ggttcatctctcttgatctgtcaga

SEQ ID NO: 656662 - DNA, 25 bp, Mus musculus
ggttcatctcttcctaataactggc

SEQ ID NO: 656663 - DNA, 25 bp, Mus musculus
ggttcatctcttgctaataactggc

SEQ ID NO: 656664 - DNA, 25 bp, Mus musculus
ggttcatctgctaggtctattactc

SEQ ID NO: 656665 - DNA, 25 bp, Mus musculus
ggttcatctgcttggtctattactc

SEQ ID NO: 656666 - DNA, 25 bp, Mus musculus
ggttcatctgtgatgagtgcacgac

SEQ ID NO: 656667 - DNA, 25 bp, Mus musculus
ggttcatctgtgttgagtgcacgac

SEQ ID NO: 656668 - DNA, 25 bp, Mus musculus
ggttcatctttaatttccctgtaat

SEQ ID NO: 656669 - DNA, 25 bp, Mus musculus
ggttcatctttattttccctgtaat

SEQ ID NO: 656670 - DNA, 25 bp, Mus musculus
ggttcatgacccacattctctagcg

SEQ ID NO: 656671 - DNA, 25 bp, Mus musculus
ggttcatgaccctcattctctagcg

SEQ ID NO: 656672 - DNA, 25 bp, Mus musculus
ggttcatgacgcattctgagtggta

SEQ ID NO: 656673 - DNA, 25 bp, Mus musculus
ggttcatgacgctttctgagtggta

SEQ ID NO: 656674 - DNA, 25 bp, Mus musculus
ggttcatgagaaaggcttccaaaat

SEQ ID NO: 656675 - DNA, 25 bp, Mus musculus
ggttcatgagaatggcttccaaaat

SEQ ID NO: 656676 - DNA, 25 bp, Mus musculus
ggttcatgaggtaatttagcacaaa

SEQ ID NO: 656677 - DNA, 25 bp, Mus musculus
ggttcatgaggttatttagcacaaa

SEQ ID NO: 656678 - DNA, 25 bp, Mus musculus
ggttcatgatgtaaagttccaaatt

SEQ ID NO: 656679 - DNA, 25 bp, Mus musculus
ggttcatgatgttaagttccaaatt

SEQ ID NO: 656680 - DNA, 25 bp, Mus musculus
ggttcatgctttctgctgtttctga

SEQ ID NO: 656681 - DNA, 25 bp, Mus musculus
ggttcatgctttgtgctgtttctga

SEQ ID NO: 656682 - DNA, 25 bp, Mus musculus
ggttcatggcatccctagtgccaat

SEQ ID NO: 656683 - DNA, 25 bp, Mus musculus
ggttcatggcatgcctagtgccaat

SEQ ID NO: 656684 - DNA, 25 bp, Mus musculus
ggttcatgggtcctctaccaagaga

SEQ ID NO: 656685 - DNA, 25 bp, Mus musculus
ggttcatgggtcgtctaccaagaga

SEQ ID NO: 656686 - DNA, 25 bp, Mus musculus
ggttcatgtagtagaagcctagccg

SEQ ID NO: 656687 - DNA, 25 bp, Mus musculus
ggttcatgtagttgaagcctagccg

SEQ ID NO: 656688 - DNA, 25 bp, Mus musculus
ggttcatgtatacccctggtttacc

SEQ ID NO: 656689 - DNA, 25 bp, Mus musculus
ggttcatgtatagccctggtttacc

SEQ ID NO: 656690 - DNA, 25 bp, Mus musculus
ggttcatgtgtcagcccatgctcac

SEQ ID NO: 656691 - DNA, 25 bp, Mus musculus
ggttcatgtgtctgcccatgctcac

SEQ ID NO: 656692 - DNA, 25 bp, Mus musculus
ggttcattagctcccctcttgtaac

SEQ ID NO: 656693 - DNA, 25 bp, Mus musculus
ggttcattagctgccctcttgtaac

SEQ ID NO: 656694 - DNA, 25 bp, Mus musculus
ggttcattaggccactgggcccatg

SEQ ID NO: 656695 - DNA, 25 bp, Mus musculus
ggttcattaggcgactgggcccatg

SEQ ID NO: 656696 - DNA, 25 bp, Mus musculus
ggttcattagttagcctgggaatat

SEQ ID NO: 656697 - DNA, 25 bp, Mus musculus
ggttcattagtttgcctgggaatat

SEQ ID NO: 656698 - DNA, 25 bp, Mus musculus
ggttcattattgaagcacatgtgct

SEQ ID NO: 656699 - DNA, 25 bp, Mus musculus
ggttcattattgtagcacatgtgct

SEQ ID NO: 656700 - DNA, 25 bp, Mus musculus
ggttcattcacaagggcatttattc

SEQ ID NO: 656701 - DNA, 25 bp, Mus musculus
ggttcattcacatgggcatttattc

SEQ ID NO: 656702 - DNA, 25 bp, Mus musculus
ggttcattccaaatagttctgtgca

SEQ ID NO: 656703 - DNA, 25 bp, Mus musculus
ggttcattccaattagttctgtgca

SEQ ID NO: 656704 - DNA, 25 bp, Mus musculus
ggttcattcgcactgtgttggccat

SEQ ID NO: 656705 - DNA, 25 bp, Mus musculus
ggttcattcgcagtgtgttggccat

SEQ ID NO: 656706 - DNA, 25 bp, Mus musculus
ggttcattcgttcttttgtcatttt

SEQ ID NO: 656707 - DNA, 25 bp, Mus musculus
ggttcattcgttgttttgtcatttt

SEQ ID NO: 656708 - DNA, 25 bp, Mus musculus
ggttcattctccaagtgccccaagt

SEQ ID NO: 656709 - DNA, 25 bp, Mus musculus
ggttcattctcctagtgccccaagt

SEQ ID NO: 656710 - DNA, 25 bp, Mus musculus
ggttcattcttcaacttgatcaacg

SEQ ID NO: 656711 - DNA, 25 bp, Mus musculus
ggttcattcttctacttgatcaacg

SEQ ID NO: 656712 - DNA, 25 bp, Mus musculus
ggttcattgatacacacgctccaca

SEQ ID NO: 656713 - DNA, 25 bp, Mus musculus
ggttcattgatagacacgctccaca

SEQ ID NO: 656714 - DNA, 25 bp, Mus musculus
ggttcattgtacacatctcaggctg

SEQ ID NO: 656715 - DNA, 25 bp, Mus musculus
ggttcattgtactcatctcaggctg

SEQ ID NO: 656716 - DNA, 25 bp, Mus musculus
ggttcattgtgtagttctacttcct

SEQ ID NO: 656717 - DNA, 25 bp, Mus musculus
ggttcattgtgttgttctacttcct

SEQ ID NO: 656718 - DNA, 25 bp, Mus musculus
ggttcatttagcagtttggcagaat

SEQ ID NO: 656719 - DNA, 25 bp, Mus musculus
ggttcatttagctgtttggcagaat

SEQ ID NO: 656720 - DNA, 25 bp, Mus musculus
ggttcatttagtatatgttgcacaa

SEQ ID NO: 656721 - DNA, 25 bp, Mus musculus
ggttcatttagtttatgttgcacaa

SEQ ID NO: 656722 - DNA, 25 bp, Mus musculus
ggttcatttggtatgcacttttcgt

SEQ ID NO: 656723 - DNA, 25 bp, Mus musculus
ggttcatttggtttgcacttttcgt

SEQ ID NO: 656724 - DNA, 25 bp, Mus musculus
ggttcatttgtgcaatgagcccaga

SEQ ID NO: 656725 - DNA, 25 bp, Mus musculus
ggttcatttgtggaatgagcccaga

SEQ ID NO: 656726 - DNA, 25 bp, Mus musculus
ggttcattttatcttgatgcacata

SEQ ID NO: 656727 - DNA, 25 bp, Mus musculus
ggttcattttatgttgatgcacata

SEQ ID NO: 656728 - DNA, 25 bp, Mus musculus
ggttcatttttactgcatggcctag

SEQ ID NO: 656729 - DNA, 25 bp, Mus musculus
ggttcatttttagtgcatggcctag

SEQ ID NO: 656730 - DNA, 25 bp, Mus musculus
ggttcatttttcaaggagtcccagt

SEQ ID NO: 656731 - DNA, 25 bp, Mus musculus
ggttcatttttctaggagtcccagt

SEQ ID NO: 656732 - DNA, 25 bp, Mus musculus
ggttccaaaactccagccgaaagcg

SEQ ID NO: 656733 - DNA, 25 bp, Mus musculus
ggttccaaaactgcagccgaaagcg

SEQ ID NO: 656734 - DNA, 25 bp, Mus musculus
ggttccaaaatcatccgaggtcctg

SEQ ID NO: 656735 - DNA, 25 bp, Mus musculus
ggttccaaaatcttccgaggtcctg

SEQ ID NO: 656736 - DNA, 25 bp, Mus musculus
ggttccaaacgtagtcgaggtgaca

SEQ ID NO: 656737 - DNA, 25 bp, Mus musculus
ggttccaaacgttgtcgaggtgaca

SEQ ID NO: 656738 - DNA, 25 bp, Mus musculus
ggttccaactcccaatgcaaagggc

SEQ ID NO: 656739 - DNA, 25 bp, Mus musculus
ggttccaactccgaatgcaaagggc

SEQ ID NO: 656740 - DNA, 25 bp, Mus musculus
ggttccaagccaagagagccagaca

SEQ ID NO: 656741 - DNA, 25 bp, Mus musculus
ggttccaagccatgagagccagaca

SEQ ID NO: 656742 - DNA, 25 bp, Mus musculus
ggttccaagctgactctattttcag

SEQ ID NO: 656743 - DNA, 25 bp, Mus musculus
ggttccaagctgtctctattttcag

SEQ ID NO: 656744 - DNA, 25 bp, Mus musculus
ggttccaaggttacatgccataaat

SEQ ID NO: 656745 - DNA, 25 bp, Mus musculus
ggttccaaggtttcatgccataaat

SEQ ID NO: 656746 - DNA, 25 bp, Mus musculus
ggttccaagtctctagctcctgtag

SEQ ID NO: 656747 - DNA, 25 bp, Mus musculus
ggttccaagtctgtagctcctgtag

SEQ ID NO: 656748 - DNA, 25 bp, Mus musculus
ggttccaagtgcctgaatcctgttc

SEQ ID NO: 656749 - DNA, 25 bp, Mus musculus
ggttccaagtgcgtgaatcctgttc

SEQ ID NO: 656750 - DNA, 25 bp, Mus musculus
ggttccaagttacaaagctctgccc

SEQ ID NO: 656751 - DNA, 25 bp, Mus musculus
ggttccaagttagaaagctctgccc

SEQ ID NO: 656752 - DNA, 25 bp, Mus musculus
ggttccaataaaaagagcctgcaca

SEQ ID NO: 656753 - DNA, 25 bp, Mus musculus
ggttccaataaatagagcctgcaca

SEQ ID NO: 656754 - DNA, 25 bp, Mus musculus
ggttccaatccacttatcaccaggg

SEQ ID NO: 656755 - DNA, 25 bp, Mus musculus
ggttccaatccagttatcaccaggg

SEQ ID NO: 656756 - DNA, 25 bp, Mus musculus
ggttccaattttctattcctgctct

SEQ ID NO: 656757 - DNA, 25 bp, Mus musculus
ggttccaattttgtattcctgctct

SEQ ID NO: 656758 - DNA, 25 bp, Mus musculus
ggttccaccaatataagtccgtgag

SEQ ID NO: 656759 - DNA, 25 bp, Mus musculus
ggttccaccaatttaagtccgtgag

SEQ ID NO: 656760 - DNA, 25 bp, Mus musculus
ggttccacctcaaagttttcacaat

SEQ ID NO: 656761 - DNA, 25 bp, Mus musculus
ggttccacctcatagttttcacaat

SEQ ID NO: 656762 - DNA, 25 bp, Mus musculus
ggttccacgccgcaagtcacaaagc

SEQ ID NO: 656763 - DNA, 25 bp, Mus musculus
ggttccacgccggaagtcacaaagc

SEQ ID NO: 656764 - DNA, 25 bp, Mus musculus
ggttccacgggcaactgagaagaaa

SEQ ID NO: 656765 - DNA, 25 bp, Mus musculus
ggttccacgggctactgagaagaaa

SEQ ID NO: 656766 - DNA, 25 bp, Mus musculus
ggttccactggtcacattgtgctga

SEQ ID NO: 656767 - DNA, 25 bp, Mus musculus
ggttccactggtgacattgtgctga

SEQ ID NO: 656768 - DNA, 25 bp, Mus musculus
ggttccactgtcatttctgcaaaaa

SEQ ID NO: 656769 - DNA, 25 bp, Mus musculus
ggttccactgtcttttctgcaaaaa

SEQ ID NO: 656770 - DNA, 25 bp, Mus musculus
ggttccacttggaagtcagtcgaat

SEQ ID NO: 656771 - DNA, 25 bp, Mus musculus
ggttccacttggtagtcagtcgaat

SEQ ID NO: 656772 - DNA, 25 bp, Mus musculus
ggttccactttcataagagctcgca

SEQ ID NO: 656773 - DNA, 25 bp, Mus musculus
ggttccactttcttaagagctcgca

SEQ ID NO: 656774 - DNA, 25 bp, Mus musculus
ggttccagacccatctgaagaggaa

SEQ ID NO: 656775 - DNA, 25 bp, Mus musculus
ggttccagacccttctgaagaggaa

SEQ ID NO: 656776 - DNA, 25 bp, Mus musculus
ggttccagactacgatgctggccag

SEQ ID NO: 656777 - DNA, 25 bp, Mus musculus
ggttccagactaggatgctggccag

SEQ ID NO: 656778 - DNA, 25 bp, Mus musculus
ggttccagagcgagcagagagccaa

SEQ ID NO: 656779 - DNA, 25 bp, Mus musculus
ggttccagagcgtgcagagagccaa

SEQ ID NO: 656780 - DNA, 25 bp, Mus musculus
ggttccagatggataaaaatgtcaa

SEQ ID NO: 656781 - DNA, 25 bp, Mus musculus
ggttccagatggttaaaaatgtcaa

SEQ ID NO: 656782 - DNA, 25 bp, Mus musculus
ggttccagccaaaatcttggacggt

SEQ ID NO: 656783 - DNA, 25 bp, Mus musculus
ggttccagccaatatcttggacggt

SEQ ID NO: 656784 - DNA, 25 bp, Mus musculus
ggttccagccatcgtctatggcata

SEQ ID NO: 656785 - DNA, 25 bp, Mus musculus
ggttccagccatggtctatggcata

SEQ ID NO: 656786 - DNA, 25 bp, Mus musculus
ggttccagcttgaactttatccatg

SEQ ID NO: 656787 - DNA, 25 bp, Mus musculus
ggttccagcttgtactttatccatg

SEQ ID NO: 656788 - DNA, 25 bp, Mus musculus
ggttccaggaagatgtacccgcgtc

SEQ ID NO: 656789 - DNA, 25 bp, Mus musculus
ggttccaggaagttgtacccgcgtc

SEQ ID NO: 656790 - DNA, 25 bp, Mus musculus
ggttccaggagtcgtgtcttagtta

SEQ ID NO: 656791 - DNA, 25 bp, Mus musculus
ggttccaggagtggtgtcttagtta

SEQ ID NO: 656792 - DNA, 25 bp, Mus musculus
ggttccagggaaccagtagcctgaa

SEQ ID NO: 656793 - DNA, 25 bp, Mus musculus
ggttccagggaagcagtagcctgaa

SEQ ID NO: 656794 - DNA, 25 bp, Mus musculus
ggttccaggtatcaaactccacagg

SEQ ID NO: 656795 - DNA, 25 bp, Mus musculus
ggttccaggtatgaaactccacagg

SEQ ID NO: 656796 - DNA, 25 bp, Mus musculus
ggttccaggttactgacagttccct

SEQ ID NO: 656797 - DNA, 25 bp, Mus musculus
ggttccaggttagtgacagttccct

SEQ ID NO: 656798 - DNA, 25 bp, Mus musculus
ggttccaggttccactggtgacatt

SEQ ID NO: 656799 - DNA, 25 bp, Mus musculus
ggttccaggttcgactggtgacatt

SEQ ID NO: 656800 - DNA, 25 bp, Mus musculus
ggttccagtgaaaactagcctgtaa

SEQ ID NO: 656801 - DNA, 25 bp, Mus musculus
ggttccagtgaatactagcctgtaa

SEQ ID NO: 656802 - DNA, 25 bp, Mus musculus
ggttccagtttgaatgcttgagttc

SEQ ID NO: 656803 - DNA, 25 bp, Mus musculus
ggttccagtttgtatgcttgagttc

SEQ ID NO: 656804 - DNA, 25 bp, Mus musculus
ggttccataataacctggtcctata

SEQ ID NO: 656805 - DNA, 25 bp, Mus musculus
ggttccataatatcctggtcctata

SEQ ID NO: 656806 - DNA, 25 bp, Mus musculus
ggttccatacacacatctctggaat

SEQ ID NO: 656807 - DNA, 25 bp, Mus musculus
ggttccatacactcatctctggaat

SEQ ID NO: 656808 - DNA, 25 bp, Mus musculus
ggttccatactcctagattcatgca

SEQ ID NO: 656809 - DNA, 25 bp, Mus musculus
ggttccatactcgtagattcatgca

SEQ ID NO: 656810 - DNA, 25 bp, Mus musculus
ggttccatagctcaatgccattatt

SEQ ID NO: 656811 - DNA, 25 bp, Mus musculus
ggttccatagctgaatgccattatt

SEQ ID NO: 656812 - DNA, 25 bp, Mus musculus
ggttccatatggctctgttcaaact

SEQ ID NO: 656813 - DNA, 25 bp, Mus musculus
ggttccatatgggtctgttcaaact

SEQ ID NO: 656814 - DNA, 25 bp, Mus musculus
ggttccatattacctacctcaagag

SEQ ID NO: 656815 - DNA, 25 bp, Mus musculus
ggttccatattagctacctcaagag

SEQ ID NO: 656816 - DNA, 25 bp, Mus musculus
ggttccatcaacatggacaacctgc

SEQ ID NO: 656817 - DNA, 25 bp, Mus musculus
ggttccatcaacttggacaacctgc

SEQ ID NO: 656818 - DNA, 25 bp, Mus musculus
ggttccatcaagaagacaccctttg

SEQ ID NO: 656819 - DNA, 25 bp, Mus musculus
ggttccatcaagtagacaccctttg

SEQ ID NO: 656820 - DNA, 25 bp, Mus musculus
ggttccatccccagccatgcataaa

SEQ ID NO: 656821 - DNA, 25 bp, Mus musculus
ggttccatccccatcgtgaaaatag

SEQ ID NO: 656822 - DNA, 25 bp, Mus musculus
ggttccatcccctgccatgcataaa

SEQ ID NO: 656823 - DNA, 25 bp, Mus musculus
ggttccatccccttcgtgaaaatag

SEQ ID NO: 656824 - DNA, 25 bp, Mus musculus
ggttccatcttcaaagtctcattgt

SEQ ID NO: 656825 - DNA, 25 bp, Mus musculus
ggttccatcttctaagtctcattgt

SEQ ID NO: 656826 - DNA, 25 bp, Mus musculus
ggttccatgggccagcctgcaacaa

SEQ ID NO: 656827 - DNA, 25 bp, Mus musculus
ggttccatgggcgagcctgcaacaa

SEQ ID NO: 656828 - DNA, 25 bp, Mus musculus
ggttccatgttcatagtcatttcct

SEQ ID NO: 656829 - DNA, 25 bp, Mus musculus
ggttccatgttcttagtcatttcct

SEQ ID NO: 656830 - DNA, 25 bp, Mus musculus
ggttcccaagaacagtgtcaaggtt

SEQ ID NO: 656831 - DNA, 25 bp, Mus musculus
ggttcccaagaagagtgtcaaggtt

SEQ ID NO: 656832 - DNA, 25 bp, Mus musculus
ggttcccaaggacgctacagaaaca

SEQ ID NO: 656833 - DNA, 25 bp, Mus musculus
ggttcccaaggaggctacagaaaca

SEQ ID NO: 656834 - DNA, 25 bp, Mus musculus
ggttcccaaggtctaagtgagttca

SEQ ID NO: 656835 - DNA, 25 bp, Mus musculus
ggttcccaaggtgtaagtgagttca

SEQ ID NO: 656836 - DNA, 25 bp, Mus musculus
ggttcccactgcaacttggttccca

SEQ ID NO: 656837 - DNA, 25 bp, Mus musculus
ggttcccactgctacttggttccca

SEQ ID NO: 656838 - DNA, 25 bp, Mus musculus
ggttcccagaagaccttgaagcgct

SEQ ID NO: 656839 - DNA, 25 bp, Mus musculus
ggttcccagaagtccttgaagcgct

SEQ ID NO: 656840 - DNA, 25 bp, Mus musculus
ggttcccagctcctagcaagaagga

SEQ ID NO: 656841 - DNA, 25 bp, Mus musculus
ggttcccagctcgtagcaagaagga

SEQ ID NO: 656842 - DNA, 25 bp, Mus musculus
ggttcccagggaactcacagtgtga

SEQ ID NO: 656843 - DNA, 25 bp, Mus musculus
ggttcccagggatctcacagtgtga

SEQ ID NO: 656844 - DNA, 25 bp, Mus musculus
ggttcccaggtcctacttgatggaa

SEQ ID NO: 656845 - DNA, 25 bp, Mus musculus
ggttcccaggtcgtacttgatggaa

SEQ ID NO: 656846 - DNA, 25 bp, Mus musculus
ggttcccagtagctgcctggtgaca

SEQ ID NO: 656847 - DNA, 25 bp, Mus musculus
ggttcccagtaggtgcctggtgaca

SEQ ID NO: 656848 - DNA, 25 bp, Mus musculus
ggttcccagtgactacggttgatgc

SEQ ID NO: 656849 - DNA, 25 bp, Mus musculus
ggttcccagtgagtacggttgatgc

SEQ ID NO: 656850 - DNA, 25 bp, Mus musculus
ggttcccagtgtcgcgctcatgagc

SEQ ID NO: 656851 - DNA, 25 bp, Mus musculus
ggttcccagtgtggcgctcatgagc

SEQ ID NO: 656852 - DNA, 25 bp, Mus musculus
ggttcccatatcctcattgctcagg

SEQ ID NO: 656853 - DNA, 25 bp, Mus musculus
ggttcccatatcgtcattgctcagg

SEQ ID NO: 656854 - DNA, 25 bp, Mus musculus
ggttcccatgaactcagggatttgt

SEQ ID NO: 656855 - DNA, 25 bp, Mus musculus
ggttcccatgaagtcagggatttgt

SEQ ID NO: 656856 - DNA, 25 bp, Mus musculus
ggttcccatggccaacacatcaaat

SEQ ID NO: 656857 - DNA, 25 bp, Mus musculus
ggttcccatggcgaacacatcaaat

SEQ ID NO: 656858 - DNA, 25 bp, Mus musculus
ggttcccattgcattatacattttc

SEQ ID NO: 656859 - DNA, 25 bp, Mus musculus
ggttcccattgctttatacattttc

SEQ ID NO: 656860 - DNA, 25 bp, Mus musculus
ggttcccattggactacaagttgat

SEQ ID NO: 656861 - DNA, 25 bp, Mus musculus
ggttcccattggtctacaagttgat

SEQ ID NO: 656862 - DNA, 25 bp, Mus musculus
ggttccccaacacaccataatgata

SEQ ID NO: 656863 - DNA, 25 bp, Mus musculus
ggttccccaacagaccataatgata

SEQ ID NO: 656864 - DNA, 25 bp, Mus musculus
ggttccccaagaaacgcggaagtat

SEQ ID NO: 656865 - DNA, 25 bp, Mus musculus
ggttccccaagatacgcggaagtat

SEQ ID NO: 656866 - DNA, 25 bp, Mus musculus
ggttccccagcgaggttagcattat

SEQ ID NO: 656867 - DNA, 25 bp, Mus musculus
ggttccccagcgtggttagcattat

SEQ ID NO: 656868 - DNA, 25 bp, Mus musculus
ggttccccatcaaatcgtttacata

SEQ ID NO: 656869 - DNA, 25 bp, Mus musculus
ggttccccatcatatcgtttacata

SEQ ID NO: 656870 - DNA, 25 bp, Mus musculus
ggttccccattaacacaaattattt

SEQ ID NO: 656871 - DNA, 25 bp, Mus musculus
ggttccccattatcacaaattattt

SEQ ID NO: 656872 - DNA, 25 bp, Mus musculus
ggttccccgaacctctggatgaaca

SEQ ID NO: 656873 - DNA, 25 bp, Mus musculus
ggttccccgaacgtctggatgaaca

SEQ ID NO: 656874 - DNA, 25 bp, Mus musculus
ggttccccgggcagagatcagtcat

SEQ ID NO: 656875 - DNA, 25 bp, Mus musculus
ggttccccgggctgagatcagtcat

SEQ ID NO: 656876 - DNA, 25 bp, Mus musculus
ggttcccctgtaccttttatcacat

SEQ ID NO: 656877 - DNA, 25 bp, Mus musculus
ggttcccctgtagcttttatcacat

SEQ ID NO: 656878 - DNA, 25 bp, Mus musculus
ggttcccgagacattttcagtttca

SEQ ID NO: 656879 - DNA, 25 bp, Mus musculus
ggttcccgagactttttcagtttca

SEQ ID NO: 656880 - DNA, 25 bp, Mus musculus
ggttccctacttagccatctgagta

SEQ ID NO: 656881 - DNA, 25 bp, Mus musculus
ggttccctactttgccatctgagta

SEQ ID NO: 656882 - DNA, 25 bp, Mus musculus
ggttccctcaaaaccagcatcaaaa

SEQ ID NO: 656883 - DNA, 25 bp, Mus musculus
ggttccctcaaatccagcatcaaaa

SEQ ID NO: 656884 - DNA, 25 bp, Mus musculus
ggttccctcactctataagtgtcgg

SEQ ID NO: 656885 - DNA, 25 bp, Mus musculus
ggttccctcactgtataagtgtcgg

SEQ ID NO: 656886 - DNA, 25 bp, Mus musculus
ggttccctccggctgtggtgaacat

SEQ ID NO: 656887 - DNA, 25 bp, Mus musculus
ggttccctccgggtgtggtgaacat

SEQ ID NO: 656888 - DNA, 25 bp, Mus musculus
ggttccctcgttcagtcacaacttt

SEQ ID NO: 656889 - DNA, 25 bp, Mus musculus
ggttccctcgttgagtcacaacttt

SEQ ID NO: 656890 - DNA, 25 bp, Mus musculus
ggttccctctctacatctaatgtca

SEQ ID NO: 656891 - DNA, 25 bp, Mus musculus
ggttccctctcttcatctaatgtca

SEQ ID NO: 656892 - DNA, 25 bp, Mus musculus
ggttccctgaaacccgattgactgg

SEQ ID NO: 656893 - DNA, 25 bp, Mus musculus
ggttccctgaaagccgattgactgg

SEQ ID NO: 656894 - DNA, 25 bp, Mus musculus
ggttccctgaggctcaattctattc

SEQ ID NO: 656895 - DNA, 25 bp, Mus musculus
ggttccctgagggtcaattctattc

SEQ ID NO: 656896 - DNA, 25 bp, Mus musculus
ggttccctgcatatgactctcatga

SEQ ID NO: 656897 - DNA, 25 bp, Mus musculus
ggttccctgcatttgactctcatga

SEQ ID NO: 656898 - DNA, 25 bp, Mus musculus
ggttccctgggaatgctccaaggag

SEQ ID NO: 656899 - DNA, 25 bp, Mus musculus
ggttccctgggattgctccaaggag

SEQ ID NO: 656900 - DNA, 25 bp, Mus musculus
ggttccctggtacaggagtctttct

SEQ ID NO: 656901 - DNA, 25 bp, Mus musculus
ggttccctggtagaggagtctttct

SEQ ID NO: 656902 - DNA, 25 bp, Mus musculus
ggttcccttcacatgcagaacttta

SEQ ID NO: 656903 - DNA, 25 bp, Mus musculus
ggttcccttcacttgcagaacttta

SEQ ID NO: 656904 - DNA, 25 bp, Mus musculus
ggttcccttccaccagaacgatatg

SEQ ID NO: 656905 - DNA, 25 bp, Mus musculus
ggttcccttccagcagaacgatatg

SEQ ID NO: 656906 - DNA, 25 bp, Mus musculus
ggttcccttctcagctgaggaatgt

SEQ ID NO: 656907 - DNA, 25 bp, Mus musculus
ggttcccttctctgctgaggaatgt

SEQ ID NO: 656908 - DNA, 25 bp, Mus musculus
ggttccctttatcgaagtgatgctg

SEQ ID NO: 656909 - DNA, 25 bp, Mus musculus
ggttccctttatggaagtgatgctg

SEQ ID NO: 656910 - DNA, 25 bp, Mus musculus
ggttccctttctcaagcacaggaga

SEQ ID NO: 656911 - DNA, 25 bp, Mus musculus
ggttccctttctgaagcacaggaga

SEQ ID NO: 656912 - DNA, 25 bp, Mus musculus
ggttcccttttcaactgattattct

SEQ ID NO: 656913 - DNA, 25 bp, Mus musculus
ggttcccttttctactgattattct

SEQ ID NO: 656914 - DNA, 25 bp, Mus musculus
ggttccgaagccagttcatacccca

SEQ ID NO: 656915 - DNA, 25 bp, Mus musculus
ggttccgaagcctgttcatacccca

SEQ ID NO: 656916 - DNA, 25 bp, Mus musculus
ggttccgaagttattgtgatgctca

SEQ ID NO: 656917 - DNA, 25 bp, Mus musculus
ggttccgaagtttttgtgatgctca

SEQ ID NO: 656918 - DNA, 25 bp, Mus musculus
ggttccgactgcctgtttgattgaa

SEQ ID NO: 656919 - DNA, 25 bp, Mus musculus
ggttccgactgcgtgtttgattgaa

SEQ ID NO: 656920 - DNA, 25 bp, Mus musculus
ggttccgcaatcaccagaatttcat

SEQ ID NO: 656921 - DNA, 25 bp, Mus musculus
ggttccgcaatctccagaatttcat

SEQ ID NO: 656922 - DNA, 25 bp, Mus musculus
ggttccgcggacagcgcccgctgtt

SEQ ID NO: 656923 - DNA, 25 bp, Mus musculus
ggttccgcggactgcgcccgctgtt

SEQ ID NO: 656924 - DNA, 25 bp, Mus musculus
ggttccgctgtcagggaagctctca

SEQ ID NO: 656925 - DNA, 25 bp, Mus musculus
ggttccgctgtctgggaagctctca

SEQ ID NO: 656926 - DNA, 25 bp, Mus musculus
ggttccggcgacatggctaaacgca

SEQ ID NO: 656927 - DNA, 25 bp, Mus musculus
ggttccggcgacttggctaaacgca

SEQ ID NO: 656928 - DNA, 25 bp, Mus musculus
ggttccggctggagacttacaagat

SEQ ID NO: 656929 - DNA, 25 bp, Mus musculus
ggttccggctggtgacttacaagat

SEQ ID NO: 656930 - DNA, 25 bp, Mus musculus
ggttccgggccacctaaagctacat

SEQ ID NO: 656931 - DNA, 25 bp, Mus musculus
ggttccgggccagctaaagctacat

SEQ ID NO: 656932 - DNA, 25 bp, Mus musculus
ggttccggtgccaacaatgtggaaa

SEQ ID NO: 656933 - DNA, 25 bp, Mus musculus
ggttccggtgcctacaatgtggaaa

SEQ ID NO: 656934 - DNA, 25 bp, Mus musculus
ggttcctaagttaagagcacttgac

SEQ ID NO: 656935 - DNA, 25 bp, Mus musculus
ggttcctaagtttagagcacttgac

SEQ ID NO: 656936 - DNA, 25 bp, Mus musculus
ggttcctacagccagagttctgttc

SEQ ID NO: 656937 - DNA, 25 bp, Mus musculus
ggttcctacagcgagagttctgttc

SEQ ID NO: 656938 - DNA, 25 bp, Mus musculus
ggttcctaccaaaccaatggaagat

SEQ ID NO: 656939 - DNA, 25 bp, Mus musculus
ggttcctaccaatccaatggaagat

SEQ ID NO: 656940 - DNA, 25 bp, Mus musculus
ggttcctagaatcctacacagctga

SEQ ID NO: 656941 - DNA, 25 bp, Mus musculus
ggttcctagaatgctacacagctga

SEQ ID NO: 656942 - DNA, 25 bp, Mus musculus
ggttcctagcagatgttcttcacaa

SEQ ID NO: 656943 - DNA, 25 bp, Mus musculus
ggttcctagcagttgttcttcacaa

SEQ ID NO: 656944 - DNA, 25 bp, Mus musculus
ggttcctagcccctgaaagttagtg

SEQ ID NO: 656945 - DNA, 25 bp, Mus musculus
ggttcctagcccgtgaaagttagtg

SEQ ID NO: 656946 - DNA, 25 bp, Mus musculus
ggttcctaggttctcatctgagttt

SEQ ID NO: 656947 - DNA, 25 bp, Mus musculus
ggttcctaggttgtcatctgagttt

SEQ ID NO: 656948 - DNA, 25 bp, Mus musculus
ggttcctagtacctgcattaggcag

SEQ ID NO: 656949 - DNA, 25 bp, Mus musculus
ggttcctagtacgtgcattaggcag

SEQ ID NO: 656950 - DNA, 25 bp, Mus musculus
ggttcctatattataatgtctggtc

SEQ ID NO: 656951 - DNA, 25 bp, Mus musculus
ggttcctatattttaatgtctggtc

SEQ ID NO: 656952 - DNA, 25 bp, Mus musculus
ggttcctatctacccatacaatctt

SEQ ID NO: 656953 - DNA, 25 bp, Mus musculus
ggttcctatctagccatacaatctt

SEQ ID NO: 656954 - DNA, 25 bp, Mus musculus
ggttcctattccatggaaatcccag

SEQ ID NO: 656955 - DNA, 25 bp, Mus musculus
ggttcctattccttggaaatcccag

SEQ ID NO: 656956 - DNA, 25 bp, Mus musculus
ggttcctcacctcttagaagaggct

SEQ ID NO: 656957 - DNA, 25 bp, Mus musculus
ggttcctcacctgttagaagaggct

SEQ ID NO: 656958 - DNA, 25 bp, Mus musculus
ggttcctcactaagctggtactaaa

SEQ ID NO: 656959 - DNA, 25 bp, Mus musculus
ggttcctcactatgctggtactaaa

SEQ ID NO: 656960 - DNA, 25 bp, Mus musculus
ggttcctcacttcatcacagaatac

SEQ ID NO: 656961 - DNA, 25 bp, Mus musculus
ggttcctcacttgatcacagaatac

SEQ ID NO: 656962 - DNA, 25 bp, Mus musculus
ggttcctcatagaaagatccttcag

SEQ ID NO: 656963 - DNA, 25 bp, Mus musculus
ggttcctcatagtaagatccttcag

SEQ ID NO: 656964 - DNA, 25 bp, Mus musculus
ggttcctcattacctcagcagtctg

SEQ ID NO: 656965 - DNA, 25 bp, Mus musculus
ggttcctcattagctcagcagtctg

SEQ ID NO: 656966 - DNA, 25 bp, Mus musculus
ggttcctccaacaaaaacttgcgca

SEQ ID NO: 656967 - DNA, 25 bp, Mus musculus
ggttcctccaactaaaacttgcgca

SEQ ID NO: 656968 - DNA, 25 bp, Mus musculus
ggttcctcccaaaatgaatcttttc

SEQ ID NO: 656969 - DNA, 25 bp, Mus musculus
ggttcctcccaatatgaatcttttc

SEQ ID NO: 656970 - DNA, 25 bp, Mus musculus
ggttcctcccatattcagagtggga

SEQ ID NO: 656971 - DNA, 25 bp, Mus musculus
ggttcctcccattttcagagtggga

SEQ ID NO: 656972 - DNA, 25 bp, Mus musculus
ggttcctcctacagaaggccagaaa

SEQ ID NO: 656973 - DNA, 25 bp, Mus musculus
ggttcctcctactgaaggccagaaa

SEQ ID NO: 656974 - DNA, 25 bp, Mus musculus
ggttcctcctagcagagttcaggtt

SEQ ID NO: 656975 - DNA, 25 bp, Mus musculus
ggttcctcctaggagagttcaggtt

SEQ ID NO: 656976 - DNA, 25 bp, Mus musculus
ggttcctcctggacagtcagaaatt

SEQ ID NO: 656977 - DNA, 25 bp, Mus musculus
ggttcctcctggtcagtcagaaatt

SEQ ID NO: 656978 - DNA, 25 bp, Mus musculus
ggttcctcggtgaccttggactttg

SEQ ID NO: 656979 - DNA, 25 bp, Mus musculus
ggttcctcggtgtccttggactttg

SEQ ID NO: 656980 - DNA, 25 bp, Mus musculus
ggttcctctacgagaagcagacaat

SEQ ID NO: 656981 - DNA, 25 bp, Mus musculus
ggttcctctacgtgaagcagacaat

SEQ ID NO: 656982 - DNA, 25 bp, Mus musculus
ggttcctctctcatttaccgtgaga

SEQ ID NO: 656983 - DNA, 25 bp, Mus musculus
ggttcctctctcttttaccgtgaga

SEQ ID NO: 656984 - DNA, 25 bp, Mus musculus
ggttcctcttcaccgatgtcctgaa

SEQ ID NO: 656985 - DNA, 25 bp, Mus musculus
ggttcctcttcagcgatgtcctgaa

SEQ ID NO: 656986 - DNA, 25 bp, Mus musculus
ggttcctcttttatagaaggtgcca

SEQ ID NO: 656987 - DNA, 25 bp, Mus musculus
ggttcctcttttttagaaggtgcca

SEQ ID NO: 656988 - DNA, 25 bp, Mus musculus
ggttcctgaacaaagagccttactg

SEQ ID NO: 656989 - DNA, 25 bp, Mus musculus
ggttcctgaacatagagccttactg

SEQ ID NO: 656990 - DNA, 25 bp, Mus musculus
ggttcctgaacccatgacataatca

SEQ ID NO: 656991 - DNA, 25 bp, Mus musculus
ggttcctgaaccgatgacataatca

SEQ ID NO: 656992 - DNA, 25 bp, Mus musculus
ggttcctgacgtaaatgacttcaaa

SEQ ID NO: 656993 - DNA, 25 bp, Mus musculus
ggttcctgacgttaatgacttcaaa

SEQ ID NO: 656994 - DNA, 25 bp, Mus musculus
ggttcctgagcaaaggcatgcccgg

SEQ ID NO: 656995 - DNA, 25 bp, Mus musculus
ggttcctgagcataggcatgcccgg

SEQ ID NO: 656996 - DNA, 25 bp, Mus musculus
ggttcctgaggcaggtcgccacaga

SEQ ID NO: 656997 - DNA, 25 bp, Mus musculus
ggttcctgaggctggtcgccacaga

SEQ ID NO: 656998 - DNA, 25 bp, Mus musculus
ggttcctgatctaggtgcgatgttt

SEQ ID NO: 656999 - DNA, 25 bp, Mus musculus
ggttcctgatcttggtgcgatgttt

SEQ ID NO: 657000 - DNA, 25 bp, Mus musculus
ggttcctgcagcattgagtgatact

SEQ ID NO: 657001 - DNA, 25 bp, Mus musculus
ggttcctgcagctttgagtgatact

SEQ ID NO: 657002 - DNA, 25 bp, Mus musculus
ggttcctgcatgaccagaagtctgc

SEQ ID NO: 657003 - DNA, 25 bp, Mus musculus
ggttcctgcatgtccagaagtctgc

SEQ ID NO: 657004 - DNA, 25 bp, Mus musculus
ggttcctgccaccttagactggaga

SEQ ID NO: 657005 - DNA, 25 bp, Mus musculus
ggttcctgccacgttagactggaga

SEQ ID NO: 657006 - DNA, 25 bp, Mus musculus
ggttcctgccagagcgagctgcacc

SEQ ID NO: 657007 - DNA, 25 bp, Mus musculus
ggttcctgccagtgcgagctgcacc

SEQ ID NO: 657008 - DNA, 25 bp, Mus musculus
ggttcctgcggtcgctaggattaaa

SEQ ID NO: 657009 - DNA, 25 bp, Mus musculus
ggttcctgcggtggctaggattaaa

SEQ ID NO: 657010 - DNA, 25 bp, Mus musculus
ggttcctgctgtcattaaaaggtgt

SEQ ID NO: 657011 - DNA, 25 bp, Mus musculus
ggttcctgctgtgattaaaaggtgt

SEQ ID NO: 657012 - DNA, 25 bp, Mus musculus
ggttcctgggatcatttgacacttg

SEQ ID NO: 657013 - DNA, 25 bp, Mus musculus
ggttcctgggatgatttgacacttg

SEQ ID NO: 657014 - DNA, 25 bp, Mus musculus
ggttcctgggccaacagccaggcct

SEQ ID NO: 657015 - DNA, 25 bp, Mus musculus
ggttcctgggcctacagccaggcct

SEQ ID NO: 657016 - DNA, 25 bp, Mus musculus
ggttcctgtaccagcttgctatgtc

SEQ ID NO: 657017 - DNA, 25 bp, Mus musculus
ggttcctgtacctgcttgctatgtc

SEQ ID NO: 657018 - DNA, 25 bp, Mus musculus
ggttcctgtactactagacttctag

SEQ ID NO: 657019 - DNA, 25 bp, Mus musculus
ggttcctgtacttctagacttctag

SEQ ID NO: 657020 - DNA, 25 bp, Mus musculus
ggttcctgtatcagaccccactgag

SEQ ID NO: 657021 - DNA, 25 bp, Mus musculus
ggttcctgtatctgaccccactgag

SEQ ID NO: 657022 - DNA, 25 bp, Mus musculus
ggttcctgtgtcagcataactaatg

SEQ ID NO: 657023 - DNA, 25 bp, Mus musculus
ggttcctgtgtctgcataactaatg

SEQ ID NO: 657024 - DNA, 25 bp, Mus musculus
ggttcctgttctagagcgtgttcga

SEQ ID NO: 657025 - DNA, 25 bp, Mus musculus
ggttcctgttcttgagcgtgttcga

SEQ ID NO: 657026 - DNA, 25 bp, Mus musculus
ggttccttactccactcttcgaggg

SEQ ID NO: 657027 - DNA, 25 bp, Mus musculus
ggttccttactcgactcttcgaggg

SEQ ID NO: 657028 - DNA, 25 bp, Mus musculus
ggttccttatacaccatttgcataa

SEQ ID NO: 657029 - DNA, 25 bp, Mus musculus
ggttccttatactccatttgcataa

SEQ ID NO: 657030 - DNA, 25 bp, Mus musculus
ggttccttatgcaaattttcaactt

SEQ ID NO: 657031 - DNA, 25 bp, Mus musculus
ggttccttatgctaattttcaactt

SEQ ID NO: 657032 - DNA, 25 bp, Mus musculus
ggttccttatgtaaacagccctggg

SEQ ID NO: 657033 - DNA, 25 bp, Mus musculus
ggttccttatgttaacagccctggg

SEQ ID NO: 657034 - DNA, 25 bp, Mus musculus
ggttccttcaaaacagatcttattg

SEQ ID NO: 657035 - DNA, 25 bp, Mus musculus
ggttccttcaaacagcacggagact

SEQ ID NO: 657036 - DNA, 25 bp, Mus musculus
ggttccttcaaagagcacggagact

SEQ ID NO: 657037 - DNA, 25 bp, Mus musculus
ggttccttcaaatcagatcttattg

SEQ ID NO: 657038 - DNA, 25 bp, Mus musculus
ggttccttcccaagagagagttggt

SEQ ID NO: 657039 - DNA, 25 bp, Mus musculus
ggttccttcccatgagagagttggt

SEQ ID NO: 657040 - DNA, 25 bp, Mus musculus
ggttccttccccaggacagtgaaag

SEQ ID NO: 657041 - DNA, 25 bp, Mus musculus
ggttccttcccctggacagtgaaag

SEQ ID NO: 657042 - DNA, 25 bp, Mus musculus
ggttccttccctaaagattgcatca

SEQ ID NO: 657043 - DNA, 25 bp, Mus musculus
ggttccttcccttaagattgcatca

SEQ ID NO: 657044 - DNA, 25 bp, Mus musculus
ggttccttcctcataatgcttgtca

SEQ ID NO: 657045 - DNA, 25 bp, Mus musculus
ggttccttcctcttaatgcttgtca

SEQ ID NO: 657046 - DNA, 25 bp, Mus musculus
ggttccttcgatcctgatgttccat

SEQ ID NO: 657047 - DNA, 25 bp, Mus musculus
ggttccttcgatgctgatgttccat

SEQ ID NO: 657048 - DNA, 25 bp, Mus musculus
ggttccttctggaaattgaatcctg

SEQ ID NO: 657049 - DNA, 25 bp, Mus musculus
ggttccttctggtaattgaatcctg

SEQ ID NO: 657050 - DNA, 25 bp, Mus musculus
ggttccttcttgaggagtggcctta

SEQ ID NO: 657051 - DNA, 25 bp, Mus musculus
ggttccttcttgtggagtggcctta

SEQ ID NO: 657052 - DNA, 25 bp, Mus musculus
ggttccttctttctatcattatcta

SEQ ID NO: 657053 - DNA, 25 bp, Mus musculus
ggttccttctttgtatcattatcta

SEQ ID NO: 657054 - DNA, 25 bp, Mus musculus
ggttccttgccacattctagaaact

SEQ ID NO: 657055 - DNA, 25 bp, Mus musculus
ggttccttgccagattctagaaact

SEQ ID NO: 657056 - DNA, 25 bp, Mus musculus
ggttccttgcttatacattttcact

SEQ ID NO: 657057 - DNA, 25 bp, Mus musculus
ggttccttgcttttacattttcact

SEQ ID NO: 657058 - DNA, 25 bp, Mus musculus
ggttccttggttaggttataatgca

SEQ ID NO: 657059 - DNA, 25 bp, Mus musculus
ggttccttggtttggttataatgca

SEQ ID NO: 657060 - DNA, 25 bp, Mus musculus
ggttccttgttcacagacaacatta

SEQ ID NO: 657061 - DNA, 25 bp, Mus musculus
ggttccttgttctcagacaacatta

SEQ ID NO: 657062 - DNA, 25 bp, Mus musculus
ggttcctttcataagggatccagga

SEQ ID NO: 657063 - DNA, 25 bp, Mus musculus
ggttcctttcattagggatccagga

SEQ ID NO: 657064 - DNA, 25 bp, Mus musculus
ggttcctttgatctcatacttcctt

SEQ ID NO: 657065 - DNA, 25 bp, Mus musculus
ggttcctttgatgtcatacttcctt

SEQ ID NO: 657066 - DNA, 25 bp, Mus musculus
ggttcctttgctcctacttcatttc

SEQ ID NO: 657067 - DNA, 25 bp, Mus musculus
ggttcctttgctcctacttcatttg

SEQ ID NO: 657068 - DNA, 25 bp, Mus musculus
ggttcctttgctgctacttcatttc

SEQ ID NO: 657069 - DNA, 25 bp, Mus musculus
ggttcctttgctgctacttcatttg

SEQ ID NO: 657070 - DNA, 25 bp, Mus musculus
ggttccttttcccatcattgctttg

SEQ ID NO: 657071 - DNA, 25 bp, Mus musculus
ggttccttttccgatcattgctttg

SEQ ID NO: 657072 - DNA, 25 bp, Mus musculus
ggttcctttttcagaagagactcga

SEQ ID NO: 657073 - DNA, 25 bp, Mus musculus
ggttcctttttctgaagagactcga

SEQ ID NO: 657074 - DNA, 25 bp, Mus musculus
ggttcgaaaatcaatgggtgctctt

SEQ ID NO: 657075 - DNA, 25 bp, Mus musculus
ggttcgaaaatctatgggtgctctt

SEQ ID NO: 657076 - DNA, 25 bp, Mus musculus
ggttcgaactgcagctgccaatgca

SEQ ID NO: 657077 - DNA, 25 bp, Mus musculus
ggttcgaactgctgctgccaatgca

SEQ ID NO: 657078 - DNA, 25 bp, Mus musculus
ggttcgaatcaacgagctggcttca

SEQ ID NO: 657079 - DNA, 25 bp, Mus musculus
ggttcgaatcaaggagctggcttca

SEQ ID NO: 657080 - DNA, 25 bp, Mus musculus
ggttcgaatgagcatggccctctag

SEQ ID NO: 657081 - DNA, 25 bp, Mus musculus
ggttcgaatgaggatggccctctag

SEQ ID NO: 657082 - DNA, 25 bp, Mus musculus
ggttcgaccatcactgtgtttgggt

SEQ ID NO: 657083 - DNA, 25 bp, Mus musculus
ggttcgaccatctctgtgtttgggt

SEQ ID NO: 657084 - DNA, 25 bp, Mus musculus
ggttcgacttcccaaggagcccgcg

SEQ ID NO: 657085 - DNA, 25 bp, Mus musculus
ggttcgacttccgaaggagcccgcg

SEQ ID NO: 657086 - DNA, 25 bp, Mus musculus
ggttcgacttgcaagggatttccca

SEQ ID NO: 657087 - DNA, 25 bp, Mus musculus
ggttcgacttgctagggatttccca

SEQ ID NO: 657088 - DNA, 25 bp, Mus musculus
ggttcgagaaatcgctgctaccacc

SEQ ID NO: 657089 - DNA, 25 bp, Mus musculus
ggttcgagaaatggctgctaccacc

SEQ ID NO: 657090 - DNA, 25 bp, Mus musculus
ggttcgagacacctatctggacaca

SEQ ID NO: 657091 - DNA, 25 bp, Mus musculus
ggttcgagacacgtatctggacaca

SEQ ID NO: 657092 - DNA, 25 bp, Mus musculus
ggttcgagagacacctcaggactgg

SEQ ID NO: 657093 - DNA, 25 bp, Mus musculus
ggttcgagagactcctcaggactgg

SEQ ID NO: 657094 - DNA, 25 bp, Mus musculus
ggttcgaggataatggagctccagc

SEQ ID NO: 657095 - DNA, 25 bp, Mus musculus
ggttcgaggatattggagctccagc

SEQ ID NO: 657096 - DNA, 25 bp, Mus musculus
ggttcgataatgatcttcctgtcag

SEQ ID NO: 657097 - DNA, 25 bp, Mus musculus
ggttcgataatgttcttcctgtcag

SEQ ID NO: 657098 - DNA, 25 bp, Mus musculus
ggttcgatcctaagcatcttgaaaa

SEQ ID NO: 657099 - DNA, 25 bp, Mus musculus
ggttcgatcctatgcatcttgaaaa

SEQ ID NO: 657100 - DNA, 25 bp, Mus musculus
ggttcgatctgtatcaagacatcct

SEQ ID NO: 657101 - DNA, 25 bp, Mus musculus
ggttcgatctgtttcaagacatcct

SEQ ID NO: 657102 - DNA, 25 bp, Mus musculus
ggttcgattctgaacatttgcatat

SEQ ID NO: 657103 - DNA, 25 bp, Mus musculus
ggttcgattctgtacatttgcatat

SEQ ID NO: 657104 - DNA, 25 bp, Mus musculus
ggttcgcaaaacaagaagtagccct

SEQ ID NO: 657105 - DNA, 25 bp, Mus musculus
ggttcgcaaaactagaagtagccct

SEQ ID NO: 657106 - DNA, 25 bp, Mus musculus
ggttcgcaagcgcccaacacagcgg

SEQ ID NO: 657107 - DNA, 25 bp, Mus musculus
ggttcgcaagcggccaacacagcgg

SEQ ID NO: 657108 - DNA, 25 bp, Mus musculus
ggttcgcaatgacctaagccttcag

SEQ ID NO: 657109 - DNA, 25 bp, Mus musculus
ggttcgcaatgagctaagccttcag

SEQ ID NO: 657110 - DNA, 25 bp, Mus musculus
ggttcgcactgacaatgatcgccca

SEQ ID NO: 657111 - DNA, 25 bp, Mus musculus
ggttcgcactgagaatgatcgccca

SEQ ID NO: 657112 - DNA, 25 bp, Mus musculus
ggttcgccagtcaccaggaaagggt

SEQ ID NO: 657113 - DNA, 25 bp, Mus musculus
ggttcgccagtctccaggaaagggt

SEQ ID NO: 657114 - DNA, 25 bp, Mus musculus
ggttcgcctcttcttttggaagcaa

SEQ ID NO: 657115 - DNA, 25 bp, Mus musculus
ggttcgcctcttgttttggaagcaa

SEQ ID NO: 657116 - DNA, 25 bp, Mus musculus
ggttcgccttcacaatctacgacat

SEQ ID NO: 657117 - DNA, 25 bp, Mus musculus
ggttcgccttcagaatctacgacat

SEQ ID NO: 657118 - DNA, 25 bp, Mus musculus
ggttcgccttgtaactttgtaatag

SEQ ID NO: 657119 - DNA, 25 bp, Mus musculus
ggttcgccttgttactttgtaatag

SEQ ID NO: 657120 - DNA, 25 bp, Mus musculus
ggttcgctcagtctaggtggtttcc

SEQ ID NO: 657121 - DNA, 25 bp, Mus musculus
ggttcgctcagtgtaggtggtttcc

SEQ ID NO: 657122 - DNA, 25 bp, Mus musculus
ggttcgctggtaacaagaccctaca

SEQ ID NO: 657123 - DNA, 25 bp, Mus musculus
ggttcgctggtatcaagaccctaca

SEQ ID NO: 657124 - DNA, 25 bp, Mus musculus
ggttcgcttaacagaatcgcccttt

SEQ ID NO: 657125 - DNA, 25 bp, Mus musculus
ggttcgcttaactgaatcgcccttt

SEQ ID NO: 657126 - DNA, 25 bp, Mus musculus
ggttcgctttccactctgatgagag

SEQ ID NO: 657127 - DNA, 25 bp, Mus musculus
ggttcgctttcctctctgatgagag

SEQ ID NO: 657128 - DNA, 25 bp, Mus musculus
ggttcggatgtcctaatcacggtta

SEQ ID NO: 657129 - DNA, 25 bp, Mus musculus
ggttcggatgtcgtaatcacggtta

SEQ ID NO: 657130 - DNA, 25 bp, Mus musculus
ggttcggattgtcttgcagttcgcc

SEQ ID NO: 657131 - DNA, 25 bp, Mus musculus
ggttcggattgtgttgcagttcgcc

SEQ ID NO: 657132 - DNA, 25 bp, Mus musculus
ggttcggcggcgacgtgcctcctct

SEQ ID NO: 657133 - DNA, 25 bp, Mus musculus
ggttcggcggcgtcgtgcctcctct

SEQ ID NO: 657134 - DNA, 25 bp, Mus musculus
ggttcggcggttaagctgctcagtt

SEQ ID NO: 657135 - DNA, 25 bp, Mus musculus
ggttcggcggtttagctgctcagtt

SEQ ID NO: 657136 - DNA, 25 bp, Mus musculus
ggttcgggaccaatatatcttttct

SEQ ID NO: 657137 - DNA, 25 bp, Mus musculus
ggttcgggaccattatatcttttct

SEQ ID NO: 657138 - DNA, 25 bp, Mus musculus
ggttcgggactgctatagcccagaa

SEQ ID NO: 657139 - DNA, 25 bp, Mus musculus
ggttcgggactggtatagcccagaa

SEQ ID NO: 657140 - DNA, 25 bp, Mus musculus
ggttcgggccctccagcaaacatgg

SEQ ID NO: 657141 - DNA, 25 bp, Mus musculus
ggttcgggccctgcagcaaacatgg

SEQ ID NO: 657142 - DNA, 25 bp, Mus musculus
ggttcgggttttcgcagtaacatat

SEQ ID NO: 657143 - DNA, 25 bp, Mus musculus
ggttcgggttttggcagtaacatat

SEQ ID NO: 657144 - DNA, 25 bp, Mus musculus
ggttcggttaatctgcttagctgca

SEQ ID NO: 657145 - DNA, 25 bp, Mus musculus
ggttcggttaatgtgcttagctgca

SEQ ID NO: 657146 - DNA, 25 bp, Mus musculus
ggttcgtacgtcagtaacactgcat

SEQ ID NO: 657147 - DNA, 25 bp, Mus musculus
ggttcgtacgtctgtaacactgcat

SEQ ID NO: 657148 - DNA, 25 bp, Mus musculus
ggttcgtagaacaatgtcaagtggc

SEQ ID NO: 657149 - DNA, 25 bp, Mus musculus
ggttcgtagaactatgtcaagtggc

SEQ ID NO: 657150 - DNA, 25 bp, Mus musculus
ggttcgtcactcactggagcatatc

SEQ ID NO: 657151 - DNA, 25 bp, Mus musculus
ggttcgtcactctctggagcatatc

SEQ ID NO: 657152 - DNA, 25 bp, Mus musculus
ggttcgtcatccacgatacagatga

SEQ ID NO: 657153 - DNA, 25 bp, Mus musculus
ggttcgtcatcctcgatacagatga

SEQ ID NO: 657154 - DNA, 25 bp, Mus musculus
ggttcgtcccatcgcggaggcacat

SEQ ID NO: 657155 - DNA, 25 bp, Mus musculus
ggttcgtcccatggcggaggcacat

SEQ ID NO: 657156 - DNA, 25 bp, Mus musculus
ggttcgtcgagtcccatcttattta

SEQ ID NO: 657157 - DNA, 25 bp, Mus musculus
ggttcgtcgagtgccatcttattta

SEQ ID NO: 657158 - DNA, 25 bp, Mus musculus
ggttcgtgaatacacttagcatgat

SEQ ID NO: 657159 - DNA, 25 bp, Mus musculus
ggttcgtgaatagacttagcatgat

SEQ ID NO: 657160 - DNA, 25 bp, Mus musculus
ggttcgtgcaatactgagcgggtca

SEQ ID NO: 657161 - DNA, 25 bp, Mus musculus
ggttcgtgcaattctgagcgggtca

SEQ ID NO: 657162 - DNA, 25 bp, Mus musculus
ggttcgtggataaccctcagcaaga

SEQ ID NO: 657163 - DNA, 25 bp, Mus musculus
ggttcgtggatatccctcagcaaga

SEQ ID NO: 657164 - DNA, 25 bp, Mus musculus
ggttcgtggtataagcgcgctagtt

SEQ ID NO: 657165 - DNA, 25 bp, Mus musculus
ggttcgtggtattagcgcgctagtt

SEQ ID NO: 657166 - DNA, 25 bp, Mus musculus
ggttcgttgatcatattctgctcat

SEQ ID NO: 657167 - DNA, 25 bp, Mus musculus
ggttcgttgatcttattctgctcat

SEQ ID NO: 657168 - DNA, 25 bp, Mus musculus
ggttcgtttgacaaccacagtctgg

SEQ ID NO: 657169 - DNA, 25 bp, Mus musculus
ggttcgtttgactaccacagtctgg

SEQ ID NO: 657170 - DNA, 25 bp, Mus musculus
ggttctaaaaccatttgagcccatt

SEQ ID NO: 657171 - DNA, 25 bp, Mus musculus
ggttctaaaaccttttgagcccatt

SEQ ID NO: 657172 - DNA, 25 bp, Mus musculus
ggttctaactttaccatgacagcag

SEQ ID NO: 657173 - DNA, 25 bp, Mus musculus
ggttctaacttttccatgacagcag

SEQ ID NO: 657174 - DNA, 25 bp, Mus musculus
ggttctaaggagctgcaaacttgca

SEQ ID NO: 657175 - DNA, 25 bp, Mus musculus
ggttctaaggaggtgcaaacttgca

SEQ ID NO: 657176 - DNA, 25 bp, Mus musculus
ggttctaagggcacacagtgattat

SEQ ID NO: 657177 - DNA, 25 bp, Mus musculus
ggttctaagggctcacagtgattat

SEQ ID NO: 657178 - DNA, 25 bp, Mus musculus
ggttctaatatgcacaggaattcta

SEQ ID NO: 657179 - DNA, 25 bp, Mus musculus
ggttctaatatggacaggaattcta

SEQ ID NO: 657180 - DNA, 25 bp, Mus musculus
ggttctaatgatcaccagcgtatta

SEQ ID NO: 657181 - DNA, 25 bp, Mus musculus
ggttctaatgatgaccagcgtatta

SEQ ID NO: 657182 - DNA, 25 bp, Mus musculus
ggttctaatgtcacagggatccagt

SEQ ID NO: 657183 - DNA, 25 bp, Mus musculus
ggttctaatgtctcagggatccagt

SEQ ID NO: 657184 - DNA, 25 bp, Mus musculus
ggttctaattacatacagccaggaa

SEQ ID NO: 657185 - DNA, 25 bp, Mus musculus
ggttctaattacttacagccaggaa

SEQ ID NO: 657186 - DNA, 25 bp, Mus musculus
ggttctaattttatcttcaactcag

SEQ ID NO: 657187 - DNA, 25 bp, Mus musculus
ggttctaattttttcttcaactcag

SEQ ID NO: 657188 - DNA, 25 bp, Mus musculus
ggttctacaaaacgcaatgggtctc

SEQ ID NO: 657189 - DNA, 25 bp, Mus musculus
ggttctacaaaaggcaatgggtctc

SEQ ID NO: 657190 - DNA, 25 bp, Mus musculus
ggttctacacctctgtgtgagactg

SEQ ID NO: 657191 - DNA, 25 bp, Mus musculus
ggttctacacctgtgtgtgagactg

SEQ ID NO: 657192 - DNA, 25 bp, Mus musculus
ggttctacacttacctaggagacac

SEQ ID NO: 657193 - DNA, 25 bp, Mus musculus
ggttctacacttctttttccattat

SEQ ID NO: 657194 - DNA, 25 bp, Mus musculus
ggttctacacttgtttttccattat

SEQ ID NO: 657195 - DNA, 25 bp, Mus musculus
ggttctacactttcctaggagacac

SEQ ID NO: 657196 - DNA, 25 bp, Mus musculus
ggttctacatgtagctggaggactt

SEQ ID NO: 657197 - DNA, 25 bp, Mus musculus
ggttctacatgttgctggaggactt

SEQ ID NO: 657198 - DNA, 25 bp, Mus musculus
ggttctaccaacatttagtctgtgt

SEQ ID NO: 657199 - DNA, 25 bp, Mus musculus
ggttctaccaacttttagtctgtgt

SEQ ID NO: 657200 - DNA, 25 bp, Mus musculus
ggttctaccattacatctcagtacc

SEQ ID NO: 657201 - DNA, 25 bp, Mus musculus
ggttctaccatttcatctcagtacc

SEQ ID NO: 657202 - DNA, 25 bp, Mus musculus
ggttctacggagaagcgcttgccct

SEQ ID NO: 657203 - DNA, 25 bp, Mus musculus
ggttctacggagtagcgcttgccct

SEQ ID NO: 657204 - DNA, 25 bp, Mus musculus
ggttctagaaagctctctgatctta

SEQ ID NO: 657205 - DNA, 25 bp, Mus musculus
ggttctagaaaggtctctgatctta

SEQ ID NO: 657206 - DNA, 25 bp, Mus musculus
ggttctagaaatcgagcctgagttc

SEQ ID NO: 657207 - DNA, 25 bp, Mus musculus
ggttctagaaatggagcctgagttc

SEQ ID NO: 657208 - DNA, 25 bp, Mus musculus
ggttctagagacaatgctttagcca

SEQ ID NO: 657209 - DNA, 25 bp, Mus musculus
ggttctagagactatgctttagcca

SEQ ID NO: 657210 - DNA, 25 bp, Mus musculus
ggttctagattcctaagcttccacg

SEQ ID NO: 657211 - DNA, 25 bp, Mus musculus
ggttctagattcgtaagcttccacg

SEQ ID NO: 657212 - DNA, 25 bp, Mus musculus
ggttctagcatgaggactatccctt

SEQ ID NO: 657213 - DNA, 25 bp, Mus musculus
ggttctagcatgtggactatccctt

SEQ ID NO: 657214 - DNA, 25 bp, Mus musculus
ggttctagctttaaggaccatcctg

SEQ ID NO: 657215 - DNA, 25 bp, Mus musculus
ggttctagcttttaggaccatcctg

SEQ ID NO: 657216 - DNA, 25 bp, Mus musculus
ggttctaggagtatggcagccccag

SEQ ID NO: 657217 - DNA, 25 bp, Mus musculus
ggttctaggagtttggcagccccag

SEQ ID NO: 657218 - DNA, 25 bp, Mus musculus
ggttctagtttgaaggtcggccttg

SEQ ID NO: 657219 - DNA, 25 bp, Mus musculus
ggttctagtttgtaggtcggccttg

SEQ ID NO: 657220 - DNA, 25 bp, Mus musculus
ggttctatatcaaccttcccgaaga

SEQ ID NO: 657221 - DNA, 25 bp, Mus musculus
ggttctatatcatccttcccgaaga

SEQ ID NO: 657222 - DNA, 25 bp, Mus musculus
ggttctatcttaaactgcacaacag

SEQ ID NO: 657223 - DNA, 25 bp, Mus musculus
ggttctatcttatactgcacaacag

SEQ ID NO: 657224 - DNA, 25 bp, Mus musculus
ggttctatgctaatgacctcattct

SEQ ID NO: 657225 - DNA, 25 bp, Mus musculus
ggttctatgctattgacctcattct

SEQ ID NO: 657226 - DNA, 25 bp, Mus musculus
ggttctatggctaaaagcactcact

SEQ ID NO: 657227 - DNA, 25 bp, Mus musculus
ggttctatggcttaaagcactcact

SEQ ID NO: 657228 - DNA, 25 bp, Mus musculus
ggttctatgtttaactgcaggtgga

SEQ ID NO: 657229 - DNA, 25 bp, Mus musculus
ggttctatgttttactgcaggtgga

SEQ ID NO: 657230 - DNA, 25 bp, Mus musculus
ggttctatttctctcttttcactca

SEQ ID NO: 657231 - DNA, 25 bp, Mus musculus
ggttctatttctgtcttttcactca

SEQ ID NO: 657232 - DNA, 25 bp, Mus musculus
ggttctatttggcatctgtcttaat

SEQ ID NO: 657233 - DNA, 25 bp, Mus musculus
ggttctatttggcttccttgtggaa

SEQ ID NO: 657234 - DNA, 25 bp, Mus musculus
ggttctatttgggatctgtcttaat

SEQ ID NO: 657235 - DNA, 25 bp, Mus musculus
ggttctatttgggttccttgtggaa

SEQ ID NO: 657236 - DNA, 25 bp, Mus musculus
ggttctattttcacaatgcatcagt

SEQ ID NO: 657237 - DNA, 25 bp, Mus musculus
ggttctattttctcaatgcatcagt

SEQ ID NO: 657238 - DNA, 25 bp, Mus musculus
ggttctatttttctactgttactga

SEQ ID NO: 657239 - DNA, 25 bp, Mus musculus
ggttctatttttgtactgttactga

SEQ ID NO: 657240 - DNA, 25 bp, Mus musculus
ggttctcaaaaaactgctccttggt

SEQ ID NO: 657241 - DNA, 25 bp, Mus musculus
ggttctcaaaaatctgctccttggt

SEQ ID NO: 657242 - DNA, 25 bp, Mus musculus
ggttctcaacctcttgctgtattga

SEQ ID NO: 657243 - DNA, 25 bp, Mus musculus
ggttctcaacctgttgctgtattga

SEQ ID NO: 657244 - DNA, 25 bp, Mus musculus
ggttctcaattccaacagtttaatg

SEQ ID NO: 657245 - DNA, 25 bp, Mus musculus
ggttctcaattcgaacagtttaatg

SEQ ID NO: 657246 - DNA, 25 bp, Mus musculus
ggttctcacaggagtgtcctgggca

SEQ ID NO: 657247 - DNA, 25 bp, Mus musculus
ggttctcacaggtgtgtcctgggca

SEQ ID NO: 657248 - DNA, 25 bp, Mus musculus
ggttctcacataccagaaggagctt

SEQ ID NO: 657249 - DNA, 25 bp, Mus musculus
ggttctcacatagcagaaggagctt

SEQ ID NO: 657250 - DNA, 25 bp, Mus musculus
ggttctcacccaagttagttttacg

SEQ ID NO: 657251 - DNA, 25 bp, Mus musculus
ggttctcacccatgttagttttacg

SEQ ID NO: 657252 - DNA, 25 bp, Mus musculus
ggttctcactacatctttagcaagg

SEQ ID NO: 657253 - DNA, 25 bp, Mus musculus
ggttctcactacttctttagcaagg

SEQ ID NO: 657254 - DNA, 25 bp, Mus musculus
ggttctcactccaagctaaagctca

SEQ ID NO: 657255 - DNA, 25 bp, Mus musculus
ggttctcactccagaacatctagta

SEQ ID NO: 657256 - DNA, 25 bp, Mus musculus
ggttctcactcctagctaaagctca

SEQ ID NO: 657257 - DNA, 25 bp, Mus musculus
ggttctcactcctgaacatctagta

SEQ ID NO: 657258 - DNA, 25 bp, Mus musculus
ggttctcactgactcacactaactc

SEQ ID NO: 657259 - DNA, 25 bp, Mus musculus
ggttctcactgagtcacactaactc

SEQ ID NO: 657260 - DNA, 25 bp, Mus musculus
ggttctcactgcattctgtagtcac

SEQ ID NO: 657261 - DNA, 25 bp, Mus musculus
ggttctcactgctttctgtagtcac

SEQ ID NO: 657262 - DNA, 25 bp, Mus musculus
ggttctcagaacacatattggacag

SEQ ID NO: 657263 - DNA, 25 bp, Mus musculus
ggttctcagaactcatattggacag

SEQ ID NO: 657264 - DNA, 25 bp, Mus musculus
ggttctcagaggaggccccgtgatc

SEQ ID NO: 657265 - DNA, 25 bp, Mus musculus
ggttctcagaggtggccccgtgatc

SEQ ID NO: 657266 - DNA, 25 bp, Mus musculus
ggttctcagagtctcctgttatttt

SEQ ID NO: 657267 - DNA, 25 bp, Mus musculus
ggttctcagagtgtcctgttatttt

SEQ ID NO: 657268 - DNA, 25 bp, Mus musculus
ggttctcagcatattcacaaaagca

SEQ ID NO: 657269 - DNA, 25 bp, Mus musculus
ggttctcagcattttcacaaaagca

SEQ ID NO: 657270 - DNA, 25 bp, Mus musculus
ggttctcagctcctacatcagatga

SEQ ID NO: 657271 - DNA, 25 bp, Mus musculus
ggttctcagctcgtacatcagatga

SEQ ID NO: 657272 - DNA, 25 bp, Mus musculus
ggttctcaggtacccacaaccagaa

SEQ ID NO: 657273 - DNA, 25 bp, Mus musculus
ggttctcaggtagccacaaccagaa

SEQ ID NO: 657274 - DNA, 25 bp, Mus musculus
ggttctcagtaaccacgcatccaca

SEQ ID NO: 657275 - DNA, 25 bp, Mus musculus
ggttctcagtaagcacgcatccaca

SEQ ID NO: 657276 - DNA, 25 bp, Mus musculus
ggttctcagtttaagtcgggcagca

SEQ ID NO: 657277 - DNA, 25 bp, Mus musculus
ggttctcagtttatccaaatccatc

SEQ ID NO: 657278 - DNA, 25 bp, Mus musculus
ggttctcagttttagtcgggcagca

SEQ ID NO: 657279 - DNA, 25 bp, Mus musculus
ggttctcagtttttccaaatccatc

SEQ ID NO: 657280 - DNA, 25 bp, Mus musculus
ggttctcatattcccgttcccatgt

SEQ ID NO: 657281 - DNA, 25 bp, Mus musculus
ggttctcatattgccgttcccatgt

SEQ ID NO: 657282 - DNA, 25 bp, Mus musculus
ggttctccaaacactgccagaggag

SEQ ID NO: 657283 - DNA, 25 bp, Mus musculus
ggttctccaaactctgccagaggag

SEQ ID NO: 657284 - DNA, 25 bp, Mus musculus
ggttctccacacaaggtggttggaa

SEQ ID NO: 657285 - DNA, 25 bp, Mus musculus
ggttctccacactaggtggttggaa

SEQ ID NO: 657286 - DNA, 25 bp, Mus musculus
ggttctccagatcggatgggctatt

SEQ ID NO: 657287 - DNA, 25 bp, Mus musculus
ggttctccagatctatacaagtatt

SEQ ID NO: 657288 - DNA, 25 bp, Mus musculus
ggttctccagatgggatgggctatt

SEQ ID NO: 657289 - DNA, 25 bp, Mus musculus
ggttctccagatgtatacaagtatt

SEQ ID NO: 657290 - DNA, 25 bp, Mus musculus
ggttctccagcgctcgactggtgtt

SEQ ID NO: 657291 - DNA, 25 bp, Mus musculus
ggttctccagcggtcgactggtgtt

SEQ ID NO: 657292 - DNA, 25 bp, Mus musculus
ggttctccagggaggcaacttccca

SEQ ID NO: 657293 - DNA, 25 bp, Mus musculus
ggttctccagggtggcaacttccca

SEQ ID NO: 657294 - DNA, 25 bp, Mus musculus
ggttctccagttccggttgggtcac

SEQ ID NO: 657295 - DNA, 25 bp, Mus musculus
ggttctccagttgcggttgggtcac

SEQ ID NO: 657296 - DNA, 25 bp, Mus musculus
ggttctccataaaaccttggattat

SEQ ID NO: 657297 - DNA, 25 bp, Mus musculus
ggttctccataataccttggattat

SEQ ID NO: 657298 - DNA, 25 bp, Mus musculus
ggttctcccaagagtactgcataaa

SEQ ID NO: 657299 - DNA, 25 bp, Mus musculus
ggttctcccaagtgtactgcataaa

SEQ ID NO: 657300 - DNA, 25 bp, Mus musculus
ggttctcccagtaggcatttgaagg

SEQ ID NO: 657301 - DNA, 25 bp, Mus musculus
ggttctcccagttggcatttgaagg

SEQ ID NO: 657302 - DNA, 25 bp, Mus musculus
ggttctcccgagatctcccaggtca

SEQ ID NO: 657303 - DNA, 25 bp, Mus musculus
ggttctcccgagttctcccaggtca

SEQ ID NO: 657304 - DNA, 25 bp, Mus musculus
ggttctcccttgaactgtgcttgaa

SEQ ID NO: 657305 - DNA, 25 bp, Mus musculus
ggttctcccttgtactgtgcttgaa

SEQ ID NO: 657306 - DNA, 25 bp, Mus musculus
ggttctcctaccataaatgagctcc

SEQ ID NO: 657307 - DNA, 25 bp, Mus musculus
ggttctcctaccttaaatgagctcc

SEQ ID NO: 657308 - DNA, 25 bp, Mus musculus
ggttctcctagccacaggccaagta

SEQ ID NO: 657309 - DNA, 25 bp, Mus musculus
ggttctcctagcgacaggccaagta

SEQ ID NO: 657310 - DNA, 25 bp, Mus musculus
ggttctcctccacttgatagagaaa

SEQ ID NO: 657311 - DNA, 25 bp, Mus musculus
ggttctcctccagttgatagagaaa

SEQ ID NO: 657312 - DNA, 25 bp, Mus musculus
ggttctcctggcaagttcctcaaaa

SEQ ID NO: 657313 - DNA, 25 bp, Mus musculus
ggttctcctggctagttcctcaaaa

SEQ ID NO: 657314 - DNA, 25 bp, Mus musculus
ggttctcctgggaattgacttctga

SEQ ID NO: 657315 - DNA, 25 bp, Mus musculus
ggttctcctgggtattgacttctga

SEQ ID NO: 657316 - DNA, 25 bp, Mus musculus
ggttctcctggtacttgacagtaaa

SEQ ID NO: 657317 - DNA, 25 bp, Mus musculus
ggttctcctggttcttgacagtaaa

SEQ ID NO: 657318 - DNA, 25 bp, Mus musculus
ggttctccttctctgagcatggagt

SEQ ID NO: 657319 - DNA, 25 bp, Mus musculus
ggttctccttctgtgagcatggagt

SEQ ID NO: 657320 - DNA, 25 bp, Mus musculus
ggttctccttggcttactagagtct

SEQ ID NO: 657321 - DNA, 25 bp, Mus musculus
ggttctccttgggttactagagtct

SEQ ID NO: 657322 - DNA, 25 bp, Mus musculus
ggttctcgaaatcctagtagtattt

SEQ ID NO: 657323 - DNA, 25 bp, Mus musculus
ggttctcgaaatgctagtagtattt

SEQ ID NO: 657324 - DNA, 25 bp, Mus musculus
ggttctcgaagcacagaatctctaa

SEQ ID NO: 657325 - DNA, 25 bp, Mus musculus
ggttctcgaagctcagaatctctaa

SEQ ID NO: 657326 - DNA, 25 bp, Mus musculus
ggttctcggaccacatcgagggaca

SEQ ID NO: 657327 - DNA, 25 bp, Mus musculus
ggttctcggacctcatcgagggaca

SEQ ID NO: 657328 - DNA, 25 bp, Mus musculus
ggttctcgtcgtctttaagccacag

SEQ ID NO: 657329 - DNA, 25 bp, Mus musculus
ggttctcgtcgtgtttaagccacag

SEQ ID NO: 657330 - DNA, 25 bp, Mus musculus
ggttctctaaacaccagagactcat

SEQ ID NO: 657331 - DNA, 25 bp, Mus musculus
ggttctctaaactccagagactcat

SEQ ID NO: 657332 - DNA, 25 bp, Mus musculus
ggttctctcaaccaagtagatccta

SEQ ID NO: 657333 - DNA, 25 bp, Mus musculus
ggttctctcaacgaagtagatccta

SEQ ID NO: 657334 - DNA, 25 bp, Mus musculus
ggttctctcaagatgcttatttgca

SEQ ID NO: 657335 - DNA, 25 bp, Mus musculus
ggttctctcaagcactcttcctgag

SEQ ID NO: 657336 - DNA, 25 bp, Mus musculus
ggttctctcaaggactcttcctgag

SEQ ID NO: 657337 - DNA, 25 bp, Mus musculus
ggttctctcaagttgcttatttgca

SEQ ID NO: 657338 - DNA, 25 bp, Mus musculus
ggttctctcagaagattattccagt

SEQ ID NO: 657339 - DNA, 25 bp, Mus musculus
ggttctctcagatgattattccagt

SEQ ID NO: 657340 - DNA, 25 bp, Mus musculus
ggttctctcagtcggcggaagaccc

SEQ ID NO: 657341 - DNA, 25 bp, Mus musculus
ggttctctcagtgggcggaagaccc

SEQ ID NO: 657342 - DNA, 25 bp, Mus musculus
ggttctctccatatatttgcattct

SEQ ID NO: 657343 - DNA, 25 bp, Mus musculus
ggttctctccatttatttgcattct

SEQ ID NO: 657344 - DNA, 25 bp, Mus musculus
ggttctctcctaccaaataaactca

SEQ ID NO: 657345 - DNA, 25 bp, Mus musculus
ggttctctcctagcaaataaactca

SEQ ID NO: 657346 - DNA, 25 bp, Mus musculus
ggttctctcttcacagataactcta

SEQ ID NO: 657347 - DNA, 25 bp, Mus musculus
ggttctctcttctcagataactcta

SEQ ID NO: 657348 - DNA, 25 bp, Mus musculus
ggttctctgaaaaagcaacaggtac

SEQ ID NO: 657349 - DNA, 25 bp, Mus musculus
ggttctctgaaatagcaacaggtac

SEQ ID NO: 657350 - DNA, 25 bp, Mus musculus
ggttctctgaataggtttggtctct

SEQ ID NO: 657351 - DNA, 25 bp, Mus musculus
ggttctctgaattggtttggtctct

SEQ ID NO: 657352 - DNA, 25 bp, Mus musculus
ggttctctgatcaaatgtctggctg

SEQ ID NO: 657353 - DNA, 25 bp, Mus musculus
ggttctctgatctaatgtctggctg

SEQ ID NO: 657354 - DNA, 25 bp, Mus musculus
ggttctctgcagatggccccagcta

SEQ ID NO: 657355 - DNA, 25 bp, Mus musculus
ggttctctgcagttggccccagcta

SEQ ID NO: 657356 - DNA, 25 bp, Mus musculus
ggttctctggaactgctcagtctga

SEQ ID NO: 657357 - DNA, 25 bp, Mus musculus
ggttctctggaagtgctcagtctga

SEQ ID NO: 657358 - DNA, 25 bp, Mus musculus
ggttctctgtccacatttcagggtt

SEQ ID NO: 657359 - DNA, 25 bp, Mus musculus
ggttctctgtcctcatttcagggtt

SEQ ID NO: 657360 - DNA, 25 bp, Mus musculus
ggttctctgtggaaacccattaaca

SEQ ID NO: 657361 - DNA, 25 bp, Mus musculus
ggttctctgtggtaacccattaaca

SEQ ID NO: 657362 - DNA, 25 bp, Mus musculus
ggttctctgtgtattactggcttct

SEQ ID NO: 657363 - DNA, 25 bp, Mus musculus
ggttctctgtgtcaccagtgttcaa

SEQ ID NO: 657364 - DNA, 25 bp, Mus musculus
ggttctctgtgtgaccagtgttcaa

SEQ ID NO: 657365 - DNA, 25 bp, Mus musculus
ggttctctgtgttttactggcttct

SEQ ID NO: 657366 - DNA, 25 bp, Mus musculus
ggttctctgttgagaagcaacttta

SEQ ID NO: 657367 - DNA, 25 bp, Mus musculus
ggttctctgttgagataggtgtgac

SEQ ID NO: 657368 - DNA, 25 bp, Mus musculus
ggttctctgttgtgaagcaacttta

SEQ ID NO: 657369 - DNA, 25 bp, Mus musculus
ggttctctgttgtgataggtgtgac

SEQ ID NO: 657370 - DNA, 25 bp, Mus musculus
ggttctcttacgaactgatgttcat

SEQ ID NO: 657371 - DNA, 25 bp, Mus musculus
ggttctcttacgtactgatgttcat

SEQ ID NO: 657372 - DNA, 25 bp, Mus musculus
ggttctcttgagctggtgtcacttt

SEQ ID NO: 657373 - DNA, 25 bp, Mus musculus
ggttctcttgaggtggtgtcacttt

SEQ ID NO: 657374 - DNA, 25 bp, Mus musculus
ggttctcttgtaactgtgttggctt

SEQ ID NO: 657375 - DNA, 25 bp, Mus musculus
ggttctcttgtatctgtgttggctt

SEQ ID NO: 657376 - DNA, 25 bp, Mus musculus
ggttctgaaactcctggatccctct

SEQ ID NO: 657377 - DNA, 25 bp, Mus musculus
ggttctgaaactgctggatccctct

SEQ ID NO: 657378 - DNA, 25 bp, Mus musculus
ggttctgaaatgctatgaaaacttt

SEQ ID NO: 657379 - DNA, 25 bp, Mus musculus
ggttctgaaatggtatgaaaacttt

SEQ ID NO: 657380 - DNA, 25 bp, Mus musculus
ggttctgaacccagaatacaggatt

SEQ ID NO: 657381 - DNA, 25 bp, Mus musculus
ggttctgaaccctgaatacaggatt

SEQ ID NO: 657382 - DNA, 25 bp, Mus musculus
ggttctgaacgtactatttgaccct

SEQ ID NO: 657383 - DNA, 25 bp, Mus musculus
ggttctgaacgttctatttgaccct

SEQ ID NO: 657384 - DNA, 25 bp, Mus musculus
ggttctgaaggaccatgcaggttct

SEQ ID NO: 657385 - DNA, 25 bp, Mus musculus
ggttctgaaggagcatgcaggttct

SEQ ID NO: 657386 - DNA, 25 bp, Mus musculus
ggttctgaagttcaccaaaggcaag

SEQ ID NO: 657387 - DNA, 25 bp, Mus musculus
ggttctgaagttgaccaaaggcaag

SEQ ID NO: 657388 - DNA, 25 bp, Mus musculus
ggttctgaccagatccgggttttgt

SEQ ID NO: 657389 - DNA, 25 bp, Mus musculus
ggttctgaccagttccgggttttgt

SEQ ID NO: 657390 - DNA, 25 bp, Mus musculus
ggttctgactatagacccaccatac

SEQ ID NO: 657391 - DNA, 25 bp, Mus musculus
ggttctgactattgacccaccatac

SEQ ID NO: 657392 - DNA, 25 bp, Mus musculus
ggttctgagcatagtttctgtccca

SEQ ID NO: 657393 - DNA, 25 bp, Mus musculus
ggttctgagcattgtttctgtccca

SEQ ID NO: 657394 - DNA, 25 bp, Mus musculus
ggttctgagccactctgtaacccga

SEQ ID NO: 657395 - DNA, 25 bp, Mus musculus
ggttctgagccagtctgtaacccga

SEQ ID NO: 657396 - DNA, 25 bp, Mus musculus
ggttctgaggaactgcagccagcac

SEQ ID NO: 657397 - DNA, 25 bp, Mus musculus
ggttctgaggaagtgcagccagcac

SEQ ID NO: 657398 - DNA, 25 bp, Mus musculus
ggttctgataatacagcccagcgaa

SEQ ID NO: 657399 - DNA, 25 bp, Mus musculus
ggttctgataattcagcccagcgaa

SEQ ID NO: 657400 - DNA, 25 bp, Mus musculus
ggttctgatccaaagacacagtctg

SEQ ID NO: 657401 - DNA, 25 bp, Mus musculus
ggttctgatccatagacacagtctg

SEQ ID NO: 657402 - DNA, 25 bp, Mus musculus
ggttctgatgggagtttgcctgcta

SEQ ID NO: 657403 - DNA, 25 bp, Mus musculus
ggttctgatgggtgtttgcctgcta

SEQ ID NO: 657404 - DNA, 25 bp, Mus musculus
ggttctgattgtcatatttccatac

SEQ ID NO: 657405 - DNA, 25 bp, Mus musculus
ggttctgattgtgatatttccatac

SEQ ID NO: 657406 - DNA, 25 bp, Mus musculus
ggttctgcaaggcataaccttagaa

SEQ ID NO: 657407 - DNA, 25 bp, Mus musculus
ggttctgcaagggataaccttagaa

SEQ ID NO: 657408 - DNA, 25 bp, Mus musculus
ggttctgcacccatacaaattcctt

SEQ ID NO: 657409 - DNA, 25 bp, Mus musculus
ggttctgcacccttacaaattcctt

SEQ ID NO: 657410 - DNA, 25 bp, Mus musculus
ggttctgccatgcttcgcaatctac

SEQ ID NO: 657411 - DNA, 25 bp, Mus musculus
ggttctgccatggttcgcaatctac

SEQ ID NO: 657412 - DNA, 25 bp, Mus musculus
ggttctgcccacactgtgaggtttt

SEQ ID NO: 657413 - DNA, 25 bp, Mus musculus
ggttctgcccactctgtgaggtttt

SEQ ID NO: 657414 - DNA, 25 bp, Mus musculus
ggttctgcccctagattgatttgca

SEQ ID NO: 657415 - DNA, 25 bp, Mus musculus
ggttctgccccttgattgatttgca

SEQ ID NO: 657416 - DNA, 25 bp, Mus musculus
ggttctgcctcaagtgcatcgaagc

SEQ ID NO: 657417 - DNA, 25 bp, Mus musculus
ggttctgcctcatgtgcatcgaagc

SEQ ID NO: 657418 - DNA, 25 bp, Mus musculus
ggttctgcctgacctactagactca

SEQ ID NO: 657419 - DNA, 25 bp, Mus musculus
ggttctgcctgagctactagactca

SEQ ID NO: 657420 - DNA, 25 bp, Mus musculus
ggttctgctaccaaactaaatgtta

SEQ ID NO: 657421 - DNA, 25 bp, Mus musculus
ggttctgctacctaactaaatgtta

SEQ ID NO: 657422 - DNA, 25 bp, Mus musculus
ggttctgctactatctgcttgtaaa

SEQ ID NO: 657423 - DNA, 25 bp, Mus musculus
ggttctgctactttctgcttgtaaa

SEQ ID NO: 657424 - DNA, 25 bp, Mus musculus
ggttctgctcaaacagtcaacattg

SEQ ID NO: 657425 - DNA, 25 bp, Mus musculus
ggttctgctcaatcagtcaacattg

SEQ ID NO: 657426 - DNA, 25 bp, Mus musculus
ggttctgctctgattaccagtccat

SEQ ID NO: 657427 - DNA, 25 bp, Mus musculus
ggttctgctctgtttaccagtccat

SEQ ID NO: 657428 - DNA, 25 bp, Mus musculus
ggttctgcttcaagtgtcaagggaa

SEQ ID NO: 657429 - DNA, 25 bp, Mus musculus
ggttctgcttcaatgactcacatgt

SEQ ID NO: 657430 - DNA, 25 bp, Mus musculus
ggttctgcttcatgtgtcaagggaa

SEQ ID NO: 657431 - DNA, 25 bp, Mus musculus
ggttctgcttcattgactcacatgt

SEQ ID NO: 657432 - DNA, 25 bp, Mus musculus
ggttctggaaccagaagacagatgt

SEQ ID NO: 657433 - DNA, 25 bp, Mus musculus
ggttctggaacctgaagacagatgt

SEQ ID NO: 657434 - DNA, 25 bp, Mus musculus
ggttctggagtgaaagcctctacat

SEQ ID NO: 657435 - DNA, 25 bp, Mus musculus
ggttctggagtgtaagcctctacat

SEQ ID NO: 657436 - DNA, 25 bp, Mus musculus
ggttctggcagcattggaaattaca

SEQ ID NO: 657437 - DNA, 25 bp, Mus musculus
ggttctggcagctttggaaattaca

SEQ ID NO: 657438 - DNA, 25 bp, Mus musculus
ggttctggccacacaggatgctaca

SEQ ID NO: 657439 - DNA, 25 bp, Mus musculus
ggttctggccactcaggatgctaca

SEQ ID NO: 657440 - DNA, 25 bp, Mus musculus
ggttctggccatcggattatgctac

SEQ ID NO: 657441 - DNA, 25 bp, Mus musculus
ggttctggccatgggattatgctac

SEQ ID NO: 657442 - DNA, 25 bp, Mus musculus
ggttctggccttcagaaaagctatt

SEQ ID NO: 657443 - DNA, 25 bp, Mus musculus
ggttctggccttgagaaaagctatt

SEQ ID NO: 657444 - DNA, 25 bp, Mus musculus
ggttctggctacatttgctaatcgt

SEQ ID NO: 657445 - DNA, 25 bp, Mus musculus
ggttctggctacttttgctaatcgt

SEQ ID NO: 657446 - DNA, 25 bp, Mus musculus
ggttctgggattcagctcagactgt

SEQ ID NO: 657447 - DNA, 25 bp, Mus musculus
ggttctgggattgagctcagactgt

SEQ ID NO: 657448 - DNA, 25 bp, Mus musculus
ggttctgggtctacccaacaggtgg

SEQ ID NO: 657449 - DNA, 25 bp, Mus musculus
ggttctgggtcttcccaacaggtgg

SEQ ID NO: 657450 - DNA, 25 bp, Mus musculus
ggttctggtgaacatgagcaagcca

SEQ ID NO: 657451 - DNA, 25 bp, Mus musculus
ggttctggtgaagatgagcaagcca

SEQ ID NO: 657452 - DNA, 25 bp, Mus musculus
ggttctggttaacgagacagcttta

SEQ ID NO: 657453 - DNA, 25 bp, Mus musculus
ggttctggttaaggagacagcttta

SEQ ID NO: 657454 - DNA, 25 bp, Mus musculus
ggttctggttccaagatcacctctt

SEQ ID NO: 657455 - DNA, 25 bp, Mus musculus
ggttctggttcctagatcacctctt

SEQ ID NO: 657456 - DNA, 25 bp, Mus musculus
ggttctggttgcctagtctgaattt

SEQ ID NO: 657457 - DNA, 25 bp, Mus musculus
ggttctggttgcgtagtctgaattt

SEQ ID NO: 657458 - DNA, 25 bp, Mus musculus
ggttctgtaacgagactgggactgt

SEQ ID NO: 657459 - DNA, 25 bp, Mus musculus
ggttctgtaacgtgactgggactgt

SEQ ID NO: 657460 - DNA, 25 bp, Mus musculus
ggttctgtaactcctgtggcccagt

SEQ ID NO: 657461 - DNA, 25 bp, Mus musculus
ggttctgtaactgctgtggcccagt

SEQ ID NO: 657462 - DNA, 25 bp, Mus musculus
ggttctgtaagcatctgggttttat

SEQ ID NO: 657463 - DNA, 25 bp, Mus musculus
ggttctgtaagcttctgggttttat

SEQ ID NO: 657464 - DNA, 25 bp, Mus musculus
ggttctgtaataagctctgaggtca

SEQ ID NO: 657465 - DNA, 25 bp, Mus musculus
ggttctgtaatatgctctgaggtca

SEQ ID NO: 657466 - DNA, 25 bp, Mus musculus
ggttctgtaatccacgccagacact

SEQ ID NO: 657467 - DNA, 25 bp, Mus musculus
ggttctgtaatcgacgccagacact

SEQ ID NO: 657468 - DNA, 25 bp, Mus musculus
ggttctgtacataccacgggaactt

SEQ ID NO: 657469 - DNA, 25 bp, Mus musculus
ggttctgtacattccacgggaactt

SEQ ID NO: 657470 - DNA, 25 bp, Mus musculus
ggttctgtactaaatctataactgt

SEQ ID NO: 657471 - DNA, 25 bp, Mus musculus
ggttctgtactatatctataactgt

SEQ ID NO: 657472 - DNA, 25 bp, Mus musculus
ggttctgtagaaaccgagcctagca

SEQ ID NO: 657473 - DNA, 25 bp, Mus musculus
ggttctgtagaatccgagcctagca

SEQ ID NO: 657474 - DNA, 25 bp, Mus musculus
ggttctgtagagattctgtgctcca

SEQ ID NO: 657475 - DNA, 25 bp, Mus musculus
ggttctgtagagtttctgtgctcca

SEQ ID NO: 657476 - DNA, 25 bp, Mus musculus
ggttctgtagcaccaggtcaggcca

SEQ ID NO: 657477 - DNA, 25 bp, Mus musculus
ggttctgtagcacgcttcactcggt

SEQ ID NO: 657478 - DNA, 25 bp, Mus musculus
ggttctgtagcagcaggtcaggcca

SEQ ID NO: 657479 - DNA, 25 bp, Mus musculus
ggttctgtagcaggcttcactcggt

SEQ ID NO: 657480 - DNA, 25 bp, Mus musculus
ggttctgtatctctgctacactgat

SEQ ID NO: 657481 - DNA, 25 bp, Mus musculus
ggttctgtatctgtgctacactgat

SEQ ID NO: 657482 - DNA, 25 bp, Mus musculus
ggttctgtcaaaataagggcctggc

SEQ ID NO: 657483 - DNA, 25 bp, Mus musculus
ggttctgtcaaattaagggcctggc

SEQ ID NO: 657484 - DNA, 25 bp, Mus musculus
ggttctgtccccatggacctgacag

SEQ ID NO: 657485 - DNA, 25 bp, Mus musculus
ggttctgtccccttggacctgacag

SEQ ID NO: 657486 - DNA, 25 bp, Mus musculus
ggttctgtccgaatccatgatgcac

SEQ ID NO: 657487 - DNA, 25 bp, Mus musculus
ggttctgtccgattccatgatgcac

SEQ ID NO: 657488 - DNA, 25 bp, Mus musculus
ggttctgtcgaacaaagcacgggat

SEQ ID NO: 657489 - DNA, 25 bp, Mus musculus
ggttctgtcgaagaaagcacgggat

SEQ ID NO: 657490 - DNA, 25 bp, Mus musculus
ggttctgtcttgagatgatcctgat

SEQ ID NO: 657491 - DNA, 25 bp, Mus musculus
ggttctgtcttgtgatgatcctgat

SEQ ID NO: 657492 - DNA, 25 bp, Mus musculus
ggttctgtgaaacccagttctttgg

SEQ ID NO: 657493 - DNA, 25 bp, Mus musculus
ggttctgtgaaagccagttctttgg

SEQ ID NO: 657494 - DNA, 25 bp, Mus musculus
ggttctgtggcgaacacgctggctc

SEQ ID NO: 657495 - DNA, 25 bp, Mus musculus
ggttctgtggcgtacacgctggctc

SEQ ID NO: 657496 - DNA, 25 bp, Mus musculus
ggttctgttatgagcacctacatca

SEQ ID NO: 657497 - DNA, 25 bp, Mus musculus
ggttctgttatgtgcacctacatca

SEQ ID NO: 657498 - DNA, 25 bp, Mus musculus
ggttctgttgaactacacacctagt

SEQ ID NO: 657499 - DNA, 25 bp, Mus musculus
ggttctgttgaagtacacacctagt

SEQ ID NO: 657500 - DNA, 25 bp, Mus musculus
ggttctgtttctatgaggagtccaa

SEQ ID NO: 657501 - DNA, 25 bp, Mus musculus
ggttctgtttctttgaggagtccaa

SEQ ID NO: 657502 - DNA, 25 bp, Mus musculus
ggttcttaaccgagatgatgaagca

SEQ ID NO: 657503 - DNA, 25 bp, Mus musculus
ggttcttaaccgtgatgatgaagca

SEQ ID NO: 657504 - DNA, 25 bp, Mus musculus
ggttcttaagtgatcccagtctttc

SEQ ID NO: 657505 - DNA, 25 bp, Mus musculus
ggttcttaagtgttcccagtctttc

SEQ ID NO: 657506 - DNA, 25 bp, Mus musculus
ggttcttaattaatcctctgatggt

SEQ ID NO: 657507 - DNA, 25 bp, Mus musculus
ggttcttaattattcctctgatggt

SEQ ID NO: 657508 - DNA, 25 bp, Mus musculus
ggttcttaccagctgcagtgtatag

SEQ ID NO: 657509 - DNA, 25 bp, Mus musculus
ggttcttaccaggtgcagtgtatag

SEQ ID NO: 657510 - DNA, 25 bp, Mus musculus
ggttcttactgtcgtataaaagcaa

SEQ ID NO: 657511 - DNA, 25 bp, Mus musculus
ggttcttactgtggtataaaagcaa

SEQ ID NO: 657512 - DNA, 25 bp, Mus musculus
ggttcttacttcatcagactggaaa

SEQ ID NO: 657513 - DNA, 25 bp, Mus musculus
ggttcttacttcttcagactggaaa

SEQ ID NO: 657514 - DNA, 25 bp, Mus musculus
ggttcttacttgattttgcaatccg

SEQ ID NO: 657515 - DNA, 25 bp, Mus musculus
ggttcttacttgtttttgcaatccg

SEQ ID NO: 657516 - DNA, 25 bp, Mus musculus
ggttcttagaaccagaccctgtgtt

SEQ ID NO: 657517 - DNA, 25 bp, Mus musculus
ggttcttagaacgagaccctgtgtt

SEQ ID NO: 657518 - DNA, 25 bp, Mus musculus
ggttcttagcacagcactaaataag

SEQ ID NO: 657519 - DNA, 25 bp, Mus musculus
ggttcttagcactgcactaaataag

SEQ ID NO: 657520 - DNA, 25 bp, Mus musculus
ggttcttagcctaaaccatgcagaa

SEQ ID NO: 657521 - DNA, 25 bp, Mus musculus
ggttcttagccttaaccatgcagaa

SEQ ID NO: 657522 - DNA, 25 bp, Mus musculus
ggttcttagtgcagaaaatactgag

SEQ ID NO: 657523 - DNA, 25 bp, Mus musculus
ggttcttagtgctgaaaatactgag

SEQ ID NO: 657524 - DNA, 25 bp, Mus musculus
ggttcttatcagagagtcctggtgc

SEQ ID NO: 657525 - DNA, 25 bp, Mus musculus
ggttcttatcagtgagtcctggtgc

SEQ ID NO: 657526 - DNA, 25 bp, Mus musculus
ggttcttatgggacagtggacatat

SEQ ID NO: 657527 - DNA, 25 bp, Mus musculus
ggttcttatgggtcagtggacatat

SEQ ID NO: 657528 - DNA, 25 bp, Mus musculus
ggttcttcaaacacccagtctagag

SEQ ID NO: 657529 - DNA, 25 bp, Mus musculus
ggttcttcaaaccttggaggatttg

SEQ ID NO: 657530 - DNA, 25 bp, Mus musculus
ggttcttcaaacgttggaggatttg

SEQ ID NO: 657531 - DNA, 25 bp, Mus musculus
ggttcttcaaactcccagtctagag

SEQ ID NO: 657532 - DNA, 25 bp, Mus musculus
ggttcttcaatcacaacgacttagg

SEQ ID NO: 657533 - DNA, 25 bp, Mus musculus
ggttcttcaatctcaacgacttagg

SEQ ID NO: 657534 - DNA, 25 bp, Mus musculus
ggttcttcaattagtcttccagttg

SEQ ID NO: 657535 - DNA, 25 bp, Mus musculus
ggttcttcaatttgtcttccagttg

SEQ ID NO: 657536 - DNA, 25 bp, Mus musculus
ggttcttcaccactagtagatctga

SEQ ID NO: 657537 - DNA, 25 bp, Mus musculus
ggttcttcaccagtagtagatctga

SEQ ID NO: 657538 - DNA, 25 bp, Mus musculus
ggttcttcactcagcatcaagagag

SEQ ID NO: 657539 - DNA, 25 bp, Mus musculus
ggttcttcactctgcatcaagagag

SEQ ID NO: 657540 - DNA, 25 bp, Mus musculus
ggttcttcagcacccctaaacagct

SEQ ID NO: 657541 - DNA, 25 bp, Mus musculus
ggttcttcagcagccctaaacagct

SEQ ID NO: 657542 - DNA, 25 bp, Mus musculus
ggttcttcagttatgtccatttctc

SEQ ID NO: 657543 - DNA, 25 bp, Mus musculus
ggttcttcagttttgtccatttctc

SEQ ID NO: 657544 - DNA, 25 bp, Mus musculus
ggttcttcattcatttactcagatt

SEQ ID NO: 657545 - DNA, 25 bp, Mus musculus
ggttcttcattccagagattcacgg

SEQ ID NO: 657546 - DNA, 25 bp, Mus musculus
ggttcttcattcgagagattcacgg

SEQ ID NO: 657547 - DNA, 25 bp, Mus musculus
ggttcttcattcttttactcagatt

SEQ ID NO: 657548 - DNA, 25 bp, Mus musculus
ggttcttccacaaattagtatctga

SEQ ID NO: 657549 - DNA, 25 bp, Mus musculus
ggttcttccacacaattccaaggtt

SEQ ID NO: 657550 - DNA, 25 bp, Mus musculus
ggttcttccacagaattccaaggtt

SEQ ID NO: 657551 - DNA, 25 bp, Mus musculus
ggttcttccacatattagtatctga

SEQ ID NO: 657552 - DNA, 25 bp, Mus musculus
ggttcttcgagcagaaacccagcac

SEQ ID NO: 657553 - DNA, 25 bp, Mus musculus
ggttcttcgagctgaaacccagcac

SEQ ID NO: 657554 - DNA, 25 bp, Mus musculus
ggttcttcgtttcatgatggcatgc

SEQ ID NO: 657555 - DNA, 25 bp, Mus musculus
ggttcttcgtttgatgatggcatgc

SEQ ID NO: 657556 - DNA, 25 bp, Mus musculus
ggttcttctcttcagtatcagccct

SEQ ID NO: 657557 - DNA, 25 bp, Mus musculus
ggttcttctcttgagtatcagccct

SEQ ID NO: 657558 - DNA, 25 bp, Mus musculus
ggttcttctgtaaatctagtcctcc

SEQ ID NO: 657559 - DNA, 25 bp, Mus musculus
ggttcttctgtatatctagtcctcc

SEQ ID NO: 657560 - DNA, 25 bp, Mus musculus
ggttcttcttccagctcatggtaaa

SEQ ID NO: 657561 - DNA, 25 bp, Mus musculus
ggttcttcttcctgctcatggtaaa

SEQ ID NO: 657562 - DNA, 25 bp, Mus musculus
ggttcttgaatcagtttccaccatg

SEQ ID NO: 657563 - DNA, 25 bp, Mus musculus
ggttcttgaatctgtttccaccatg

SEQ ID NO: 657564 - DNA, 25 bp, Mus musculus
ggttcttgcaccacactttaaagtt

SEQ ID NO: 657565 - DNA, 25 bp, Mus musculus
ggttcttgcacctcactttaaagtt

SEQ ID NO: 657566 - DNA, 25 bp, Mus musculus
ggttcttgcctcaacgcaaaacaga

SEQ ID NO: 657567 - DNA, 25 bp, Mus musculus
ggttcttgcctctacgcaaaacaga

SEQ ID NO: 657568 - DNA, 25 bp, Mus musculus
ggttcttggaacagaggtatggcaa

SEQ ID NO: 657569 - DNA, 25 bp, Mus musculus
ggttcttggaactgaggtatggcaa

SEQ ID NO: 657570 - DNA, 25 bp, Mus musculus
ggttcttggagtccgaattctacca

SEQ ID NO: 657571 - DNA, 25 bp, Mus musculus
ggttcttggagtgcgaattctacca

SEQ ID NO: 657572 - DNA, 25 bp, Mus musculus
ggttcttgggaaccacctgcatgta

SEQ ID NO: 657573 - DNA, 25 bp, Mus musculus
ggttcttgggaagcacctgcatgta

SEQ ID NO: 657574 - DNA, 25 bp, Mus musculus
ggttcttgggttcaatccaccacct

SEQ ID NO: 657575 - DNA, 25 bp, Mus musculus
ggttcttgggttgaatccaccacct

SEQ ID NO: 657576 - DNA, 25 bp, Mus musculus
ggttcttggtgactacataatatat

SEQ ID NO: 657577 - DNA, 25 bp, Mus musculus
ggttcttggtgagtacataatatat

SEQ ID NO: 657578 - DNA, 25 bp, Mus musculus
ggttcttggttacgcttctagcatt

SEQ ID NO: 657579 - DNA, 25 bp, Mus musculus
ggttcttggttaggcttctagcatt

SEQ ID NO: 657580 - DNA, 25 bp, Mus musculus
ggttcttgtactcacatacagttgt

SEQ ID NO: 657581 - DNA, 25 bp, Mus musculus
ggttcttgtactgacatacagttgt

SEQ ID NO: 657582 - DNA, 25 bp, Mus musculus
ggttcttgtgttatgtccgcacaca

SEQ ID NO: 657583 - DNA, 25 bp, Mus musculus
ggttcttgtgttttgtccgcacaca

SEQ ID NO: 657584 - DNA, 25 bp, Mus musculus
ggttcttgttatcatgccattggct

SEQ ID NO: 657585 - DNA, 25 bp, Mus musculus
ggttcttgttatgatgccattggct

SEQ ID NO: 657586 - DNA, 25 bp, Mus musculus
ggttctttaaccaggaggatacgct

SEQ ID NO: 657587 - DNA, 25 bp, Mus musculus
ggttctttaacctggaggatacgct

SEQ ID NO: 657588 - DNA, 25 bp, Mus musculus
ggttctttaactagtgtgtcattga

SEQ ID NO: 657589 - DNA, 25 bp, Mus musculus
ggttctttaacttgtgtgtcattga

SEQ ID NO: 657590 - DNA, 25 bp, Mus musculus
ggttctttaatactcctttgaggtg

SEQ ID NO: 657591 - DNA, 25 bp, Mus musculus
ggttctttaatagtcctttgaggtg

SEQ ID NO: 657592 - DNA, 25 bp, Mus musculus
ggttctttacaaccttcctttagat

SEQ ID NO: 657593 - DNA, 25 bp, Mus musculus
ggttctttacaagcttcctttagat

SEQ ID NO: 657594 - DNA, 25 bp, Mus musculus
ggttctttacacattcatttgcagc

SEQ ID NO: 657595 - DNA, 25 bp, Mus musculus
ggttctttacactttcatttgcagc

SEQ ID NO: 657596 - DNA, 25 bp, Mus musculus
ggttctttatatacacagcctagca

SEQ ID NO: 657597 - DNA, 25 bp, Mus musculus
ggttctttatattcacagcctagca

SEQ ID NO: 657598 - DNA, 25 bp, Mus musculus
ggttctttccatacaagctactgaa

SEQ ID NO: 657599 - DNA, 25 bp, Mus musculus
ggttctttccattcaagctactgaa

SEQ ID NO: 657600 - DNA, 25 bp, Mus musculus
ggttctttctagaatattcttccaa

SEQ ID NO: 657601 - DNA, 25 bp, Mus musculus
ggttctttctagtatattcttccaa

SEQ ID NO: 657602 - DNA, 25 bp, Mus musculus
ggttctttctcacgaactcaattta

SEQ ID NO: 657603 - DNA, 25 bp, Mus musculus
ggttctttctcaggaactcaattta

SEQ ID NO: 657604 - DNA, 25 bp, Mus musculus
ggttctttgaacatgggctccacag

SEQ ID NO: 657605 - DNA, 25 bp, Mus musculus
ggttctttgaacttgggctccacag

SEQ ID NO: 657606 - DNA, 25 bp, Mus musculus
ggttctttgaatagtattttcttat

SEQ ID NO: 657607 - DNA, 25 bp, Mus musculus
ggttctttgaatattcgccagtttg

SEQ ID NO: 657608 - DNA, 25 bp, Mus musculus
ggttctttgaattgtattttcttat

SEQ ID NO: 657609 - DNA, 25 bp, Mus musculus
ggttctttgaattttcgccagtttg

SEQ ID NO: 657610 - DNA, 25 bp, Mus musculus
ggttctttgcataaagttgtctgat

SEQ ID NO: 657611 - DNA, 25 bp, Mus musculus
ggttctttgcattaagttgtctgat

SEQ ID NO: 657612 - DNA, 25 bp, Mus musculus
ggttctttgcccacagcgagatgaa

SEQ ID NO: 657613 - DNA, 25 bp, Mus musculus
ggttctttgccctcagcgagatgaa

SEQ ID NO: 657614 - DNA, 25 bp, Mus musculus
ggttctttggccaattgggtggaat

SEQ ID NO: 657615 - DNA, 25 bp, Mus musculus
ggttctttggcctattgggtggaat

SEQ ID NO: 657616 - DNA, 25 bp, Mus musculus
ggttctttggttcccactaagataa

SEQ ID NO: 657617 - DNA, 25 bp, Mus musculus
ggttctttggttgccactaagataa

SEQ ID NO: 657618 - DNA, 25 bp, Mus musculus
ggttctttgttacctccatggctct

SEQ ID NO: 657619 - DNA, 25 bp, Mus musculus
ggttctttgttagctccatggctct

SEQ ID NO: 657620 - DNA, 25 bp, Mus musculus
ggttctttgttgctcactcagcgtc

SEQ ID NO: 657621 - DNA, 25 bp, Mus musculus
ggttctttgttggtcactcagcgtc

SEQ ID NO: 657622 - DNA, 25 bp, Mus musculus
ggttcttttactaatggacttctga

SEQ ID NO: 657623 - DNA, 25 bp, Mus musculus
ggttcttttacttatggacttctga

SEQ ID NO: 657624 - DNA, 25 bp, Mus musculus
ggttcttttcccacatactgtgtgc

SEQ ID NO: 657625 - DNA, 25 bp, Mus musculus
ggttcttttccctcatactgtgtgc

SEQ ID NO: 657626 - DNA, 25 bp, Mus musculus
ggttcttttgtaatagtccatggtt

SEQ ID NO: 657627 - DNA, 25 bp, Mus musculus
ggttcttttgtattagtccatggtt

SEQ ID NO: 657628 - DNA, 25 bp, Mus musculus
ggttctttttgcacaaaggtgtgat

SEQ ID NO: 657629 - DNA, 25 bp, Mus musculus
ggttctttttgctcaaaggtgtgat

SEQ ID NO: 657630 - DNA, 25 bp, Mus musculus
ggttgaaaaagaaccaccaccaaga

SEQ ID NO: 657631 - DNA, 25 bp, Mus musculus
ggttgaaaaagatccaccaccaaga

SEQ ID NO: 657632 - DNA, 25 bp, Mus musculus
ggttgaaaacacagcatggaagatt

SEQ ID NO: 657633 - DNA, 25 bp, Mus musculus
ggttgaaaacactgcatggaagatt

SEQ ID NO: 657634 - DNA, 25 bp, Mus musculus
ggttgaaaacctcgctgcttgatcg

SEQ ID NO: 657635 - DNA, 25 bp, Mus musculus
ggttgaaaacctggctgcttgatcg

SEQ ID NO: 657636 - DNA, 25 bp, Mus musculus
ggttgaaacacccactcagagctat

SEQ ID NO: 657637 - DNA, 25 bp, Mus musculus
ggttgaaacaccgactcagagctat

SEQ ID NO: 657638 - DNA, 25 bp, Mus musculus
ggttgaaaccacaggtctaaatttg

SEQ ID NO: 657639 - DNA, 25 bp, Mus musculus
ggttgaaaccactggtctaaatttg

SEQ ID NO: 657640 - DNA, 25 bp, Mus musculus
ggttgaaagctgacacctccacgcc

SEQ ID NO: 657641 - DNA, 25 bp, Mus musculus
ggttgaaagctgtcacctccacgcc

SEQ ID NO: 657642 - DNA, 25 bp, Mus musculus
ggttgaaaggaaagccgccgaaatt

SEQ ID NO: 657643 - DNA, 25 bp, Mus musculus
ggttgaaaggaatgccgccgaaatt

SEQ ID NO: 657644 - DNA, 25 bp, Mus musculus
ggttgaacatatacgtgccttggcc

SEQ ID NO: 657645 - DNA, 25 bp, Mus musculus
ggttgaacatattcgtgccttggcc

SEQ ID NO: 657646 - DNA, 25 bp, Mus musculus
ggttgaacatctccagttcctgctg

SEQ ID NO: 657647 - DNA, 25 bp, Mus musculus
ggttgaacatctgcagttcctgctg

SEQ ID NO: 657648 - DNA, 25 bp, Mus musculus
ggttgaacattcagtttgctttgct

SEQ ID NO: 657649 - DNA, 25 bp, Mus musculus
ggttgaacattctgtttgctttgct

SEQ ID NO: 657650 - DNA, 25 bp, Mus musculus
ggttgaactttaactcaagctatta

SEQ ID NO: 657651 - DNA, 25 bp, Mus musculus
ggttgaactttacccaaacttctga

SEQ ID NO: 657652 - DNA, 25 bp, Mus musculus
ggttgaactttagccaaacttctga

SEQ ID NO: 657653 - DNA, 25 bp, Mus musculus
ggttgaactttatctcaagctatta

SEQ ID NO: 657654 - DNA, 25 bp, Mus musculus
ggttgaagaagactccagttctgct

SEQ ID NO: 657655 - DNA, 25 bp, Mus musculus
ggttgaagaagagtccagttctgct

SEQ ID NO: 657656 - DNA, 25 bp, Mus musculus
ggttgaagaattcctggcgatgaac

SEQ ID NO: 657657 - DNA, 25 bp, Mus musculus
ggttgaagaattgctggcgatgaac

SEQ ID NO: 657658 - DNA, 25 bp, Mus musculus
ggttgaagacccagtgcatggcatc

SEQ ID NO: 657659 - DNA, 25 bp, Mus musculus
ggttgaagaccctgtgcatggcatc

SEQ ID NO: 657660 - DNA, 25 bp, Mus musculus
ggttgaagagagcttccaagcacac

SEQ ID NO: 657661 - DNA, 25 bp, Mus musculus
ggttgaagagaggttccaagcacac

SEQ ID NO: 657662 - DNA, 25 bp, Mus musculus
ggttgaagattcaccaagctctgta

SEQ ID NO: 657663 - DNA, 25 bp, Mus musculus
ggttgaagattctccaagctctgta

SEQ ID NO: 657664 - DNA, 25 bp, Mus musculus
ggttgaagcaatctttacactgaca

SEQ ID NO: 657665 - DNA, 25 bp, Mus musculus
ggttgaagcaatgtttacactgaca

SEQ ID NO: 657666 - DNA, 25 bp, Mus musculus
ggttgaagcagcagtgctctgctct

SEQ ID NO: 657667 - DNA, 25 bp, Mus musculus
ggttgaagcagctgtgctctgctct

SEQ ID NO: 657668 - DNA, 25 bp, Mus musculus
ggttgaaggatgaactggcccacac

SEQ ID NO: 657669 - DNA, 25 bp, Mus musculus
ggttgaaggatgtactggcccacac

SEQ ID NO: 657670 - DNA, 25 bp, Mus musculus
ggttgaaggtatccccaccgcatgc

SEQ ID NO: 657671 - DNA, 25 bp, Mus musculus
ggttgaaggtatgcccaccgcatgc

SEQ ID NO: 657672 - DNA, 25 bp, Mus musculus
ggttgaagtcctcgacagctccaac

SEQ ID NO: 657673 - DNA, 25 bp, Mus musculus
ggttgaagtcctggacagctccaac

SEQ ID NO: 657674 - DNA, 25 bp, Mus musculus
ggttgaagtctgatagtggtcctaa

SEQ ID NO: 657675 - DNA, 25 bp, Mus musculus
ggttgaagtctgttagtggtcctaa

SEQ ID NO: 657676 - DNA, 25 bp, Mus musculus
ggttgaagttgccttgatcgcctgc

SEQ ID NO: 657677 - DNA, 25 bp, Mus musculus
ggttgaagttgcgttgatcgcctgc

SEQ ID NO: 657678 - DNA, 25 bp, Mus musculus
ggttgaatcattatctagctgagaa

SEQ ID NO: 657679 - DNA, 25 bp, Mus musculus
ggttgaatcattttctagctgagaa

SEQ ID NO: 657680 - DNA, 25 bp, Mus musculus
ggttgaatccccagcagtgtgtaaa

SEQ ID NO: 657681 - DNA, 25 bp, Mus musculus
ggttgaatcccctgcagtgtgtaaa

SEQ ID NO: 657682 - DNA, 25 bp, Mus musculus
ggttgaatcctccagttaactgctt

SEQ ID NO: 657683 - DNA, 25 bp, Mus musculus
ggttgaatcctcgagttaactgctt

SEQ ID NO: 657684 - DNA, 25 bp, Mus musculus
ggttgaatctccatgtgagcatttg

SEQ ID NO: 657685 - DNA, 25 bp, Mus musculus
ggttgaatctccttgtgagcatttg

SEQ ID NO: 657686 - DNA, 25 bp, Mus musculus
ggttgaatgaggctagctcctgctc

SEQ ID NO: 657687 - DNA, 25 bp, Mus musculus
ggttgaatgagggtagctcctgctc

SEQ ID NO: 657688 - DNA, 25 bp, Mus musculus
ggttgaatgctgaattttgtaaaga

SEQ ID NO: 657689 - DNA, 25 bp, Mus musculus
ggttgaatgctgtattttgtaaaga

SEQ ID NO: 657690 - DNA, 25 bp, Mus musculus
ggttgaatgttccaagtgctctttg

SEQ ID NO: 657691 - DNA, 25 bp, Mus musculus
ggttgaatgttcgaagtgctctttg

SEQ ID NO: 657692 - DNA, 25 bp, Mus musculus
ggttgaattcagctggctctttcct

SEQ ID NO: 657693 - DNA, 25 bp, Mus musculus
ggttgaattcaggtggctctttcct

SEQ ID NO: 657694 - DNA, 25 bp, Mus musculus
ggttgaattgccagatgttaagaat

SEQ ID NO: 657695 - DNA, 25 bp, Mus musculus
ggttgaattgcctgatgttaagaat

SEQ ID NO: 657696 - DNA, 25 bp, Mus musculus
ggttgaattggtcaccctttctatt

SEQ ID NO: 657697 - DNA, 25 bp, Mus musculus
ggttgaattggtgaccctttctatt

SEQ ID NO: 657698 - DNA, 25 bp, Mus musculus
ggttgacaaaatatcccgcatcatc

SEQ ID NO: 657699 - DNA, 25 bp, Mus musculus
ggttgacaaaatttcccgcatcatc

SEQ ID NO: 657700 - DNA, 25 bp, Mus musculus
ggttgacaaactaacctcagtgtgg

SEQ ID NO: 657701 - DNA, 25 bp, Mus musculus
ggttgacaaacttacctcagtgtgg

SEQ ID NO: 657702 - DNA, 25 bp, Mus musculus
ggttgacacaagatgcaccttcaaa

SEQ ID NO: 657703 - DNA, 25 bp, Mus musculus
ggttgacacaagttgcaccttcaaa

SEQ ID NO: 657704 - DNA, 25 bp, Mus musculus
ggttgacaccttaccctaagagaag

SEQ ID NO: 657705 - DNA, 25 bp, Mus musculus
ggttgacacctttccctaagagaag

SEQ ID NO: 657706 - DNA, 25 bp, Mus musculus
ggttgacactaacttcacacttctt

SEQ ID NO: 657707 - DNA, 25 bp, Mus musculus
ggttgacactaagttcacacttctt

SEQ ID NO: 657708 - DNA, 25 bp, Mus musculus
ggttgacagataacagcggctttct

SEQ ID NO: 657709 - DNA, 25 bp, Mus musculus
ggttgacagatatcagcggctttct

SEQ ID NO: 657710 - DNA, 25 bp, Mus musculus
ggttgacagatcaaacagcctaatc

SEQ ID NO: 657711 - DNA, 25 bp, Mus musculus
ggttgacagatctaacagcctaatc

SEQ ID NO: 657712 - DNA, 25 bp, Mus musculus
ggttgacagcaaccctatacatgtt

SEQ ID NO: 657713 - DNA, 25 bp, Mus musculus
ggttgacagcaagcctatacatgtt

SEQ ID NO: 657714 - DNA, 25 bp, Mus musculus
ggttgacagtgtaccatgtgttcaa

SEQ ID NO: 657715 - DNA, 25 bp, Mus musculus
ggttgacagtgttccatgtgttcaa

SEQ ID NO: 657716 - DNA, 25 bp, Mus musculus
ggttgacatcatcgccacatacagg

SEQ ID NO: 657717 - DNA, 25 bp, Mus musculus
ggttgacatcatggccacatacagg

SEQ ID NO: 657718 - DNA, 25 bp, Mus musculus
ggttgacatctgacctccattggca

SEQ ID NO: 657719 - DNA, 25 bp, Mus musculus
ggttgacatctgtcctccattggca

SEQ ID NO: 657720 - DNA, 25 bp, Mus musculus
ggttgacatcttaggacttctcagt

SEQ ID NO: 657721 - DNA, 25 bp, Mus musculus
ggttgacatctttggacttctcagt

SEQ ID NO: 657722 - DNA, 25 bp, Mus musculus
ggttgacatggaccagtctgtacca

SEQ ID NO: 657723 - DNA, 25 bp, Mus musculus
ggttgacatggagcagtctgtacca

SEQ ID NO: 657724 - DNA, 25 bp, Mus musculus
ggttgaccaaacagaacacttgcct

SEQ ID NO: 657725 - DNA, 25 bp, Mus musculus
ggttgaccaaactgaacacttgcct

SEQ ID NO: 657726 - DNA, 25 bp, Mus musculus
ggttgaccacagagctgaggtagaa

SEQ ID NO: 657727 - DNA, 25 bp, Mus musculus
ggttgaccacagtgctgaggtagaa

SEQ ID NO: 657728 - DNA, 25 bp, Mus musculus
ggttgaccacgacttgattgacatt

SEQ ID NO: 657729 - DNA, 25 bp, Mus musculus
ggttgaccacgagttgattgacatt

SEQ ID NO: 657730 - DNA, 25 bp, Mus musculus
ggttgaccagatatctatcctcctt

SEQ ID NO: 657731 - DNA, 25 bp, Mus musculus
ggttgaccagatcgccaatggcttt

SEQ ID NO: 657732 - DNA, 25 bp, Mus musculus
ggttgaccagatggccaatggcttt

SEQ ID NO: 657733 - DNA, 25 bp, Mus musculus
ggttgaccagatttctatcctcctt

SEQ ID NO: 657734 - DNA, 25 bp, Mus musculus
ggttgaccagggactgtctacagca

SEQ ID NO: 657735 - DNA, 25 bp, Mus musculus
ggttgaccagggtctgtctacagca

SEQ ID NO: 657736 - DNA, 25 bp, Mus musculus
ggttgacccacactaggcgaaactg

SEQ ID NO: 657737 - DNA, 25 bp, Mus musculus
ggttgacccacagtaggcgaaactg

SEQ ID NO: 657738 - DNA, 25 bp, Mus musculus
ggttgaccgcagagagctagccact

SEQ ID NO: 657739 - DNA, 25 bp, Mus musculus
ggttgaccgcagtgagctagccact

SEQ ID NO: 657740 - DNA, 25 bp, Mus musculus
ggttgacctaatcagtgctgtggca

SEQ ID NO: 657741 - DNA, 25 bp, Mus musculus
ggttgacctaatgagtgctgtggca

SEQ ID NO: 657742 - DNA, 25 bp, Mus musculus
ggttgaccttaaaaaagtagacatg

SEQ ID NO: 657743 - DNA, 25 bp, Mus musculus
ggttgaccttaataaagtagacatg

SEQ ID NO: 657744 - DNA, 25 bp, Mus musculus
ggttgaccttcactttgcatcgatc

SEQ ID NO: 657745 - DNA, 25 bp, Mus musculus
ggttgaccttcagtttgcatcgatc

SEQ ID NO: 657746 - DNA, 25 bp, Mus musculus
ggttgacgaagcacaggtccagcca

SEQ ID NO: 657747 - DNA, 25 bp, Mus musculus
ggttgacgaagctcaggtccagcca

SEQ ID NO: 657748 - DNA, 25 bp, Mus musculus
ggttgacgtccacggacacgcgcca

SEQ ID NO: 657749 - DNA, 25 bp, Mus musculus
ggttgacgtccagggacacgcgcca

SEQ ID NO: 657750 - DNA, 25 bp, Mus musculus
ggttgacgtcgaccagcacactttg

SEQ ID NO: 657751 - DNA, 25 bp, Mus musculus
ggttgacgtcgagcagcacactttg

SEQ ID NO: 657752 - DNA, 25 bp, Mus musculus
ggttgacgttcgaagcagccacact

SEQ ID NO: 657753 - DNA, 25 bp, Mus musculus
ggttgacgttcgtagcagccacact

SEQ ID NO: 657754 - DNA, 25 bp, Mus musculus
ggttgactactaacttctcttttat

SEQ ID NO: 657755 - DNA, 25 bp, Mus musculus
ggttgactactatcttctcttttat

SEQ ID NO: 657756 - DNA, 25 bp, Mus musculus
ggttgactcattatgtacactaagc

SEQ ID NO: 657757 - DNA, 25 bp, Mus musculus
ggttgactcattttgtacactaagc

SEQ ID NO: 657758 - DNA, 25 bp, Mus musculus
ggttgactctgaaagcttggccttc

SEQ ID NO: 657759 - DNA, 25 bp, Mus musculus
ggttgactctgatagcttggccttc

SEQ ID NO: 657760 - DNA, 25 bp, Mus musculus
ggttgactgcatcattatggacaga

SEQ ID NO: 657761 - DNA, 25 bp, Mus musculus
ggttgactgcatgattatggacaga

SEQ ID NO: 657762 - DNA, 25 bp, Mus musculus
ggttgactggacacactatatcctg

SEQ ID NO: 657763 - DNA, 25 bp, Mus musculus
ggttgactggactcactatatcctg

SEQ ID NO: 657764 - DNA, 25 bp, Mus musculus
ggttgactgtacaaatgactcccat

SEQ ID NO: 657765 - DNA, 25 bp, Mus musculus
ggttgactgtactaatgactcccat

SEQ ID NO: 657766 - DNA, 25 bp, Mus musculus
ggttgactttcaacatttgcatttt

SEQ ID NO: 657767 - DNA, 25 bp, Mus musculus
ggttgactttcacgtactactttct

SEQ ID NO: 657768 - DNA, 25 bp, Mus musculus
ggttgactttcaggtactactttct

SEQ ID NO: 657769 - DNA, 25 bp, Mus musculus
ggttgactttcatcatttgcatttt

SEQ ID NO: 657770 - DNA, 25 bp, Mus musculus
ggttgagaaactaaagccctgcaca

SEQ ID NO: 657771 - DNA, 25 bp, Mus musculus
ggttgagaaacttaagccctgcaca

SEQ ID NO: 657772 - DNA, 25 bp, Mus musculus
ggttgagaaattccccactgaagat

SEQ ID NO: 657773 - DNA, 25 bp, Mus musculus
ggttgagaaattgcccactgaagat

SEQ ID NO: 657774 - DNA, 25 bp, Mus musculus
ggttgagaatacatagcatttttct

SEQ ID NO: 657775 - DNA, 25 bp, Mus musculus
ggttgagaatacttagcatttttct

SEQ ID NO: 657776 - DNA, 25 bp, Mus musculus
ggttgagacacaagttgccaggcag

SEQ ID NO: 657777 - DNA, 25 bp, Mus musculus
ggttgagacacatgttgccaggcag

SEQ ID NO: 657778 - DNA, 25 bp, Mus musculus
ggttgagatattagagttcccataa

SEQ ID NO: 657779 - DNA, 25 bp, Mus musculus
ggttgagatatttgagttcccataa

SEQ ID NO: 657780 - DNA, 25 bp, Mus musculus
ggttgagatcgtctctggtcaactt

SEQ ID NO: 657781 - DNA, 25 bp, Mus musculus
ggttgagatcgtgtctggtcaactt

SEQ ID NO: 657782 - DNA, 25 bp, Mus musculus
ggttgagatggcatcatctggcctc

SEQ ID NO: 657783 - DNA, 25 bp, Mus musculus
ggttgagatggcttcatctggcctc

SEQ ID NO: 657784 - DNA, 25 bp, Mus musculus
ggttgagattatctgccaccctacc

SEQ ID NO: 657785 - DNA, 25 bp, Mus musculus
ggttgagattatgtgccaccctacc

SEQ ID NO: 657786 - DNA, 25 bp, Mus musculus
ggttgagcaagccacatgagcaagc

SEQ ID NO: 657787 - DNA, 25 bp, Mus musculus
ggttgagcaagcgacatgagcaagc

SEQ ID NO: 657788 - DNA, 25 bp, Mus musculus
ggttgagcatccataatccaaaatc

SEQ ID NO: 657789 - DNA, 25 bp, Mus musculus
ggttgagcatccttaatccaaaatc

SEQ ID NO: 657790 - DNA, 25 bp, Mus musculus
ggttgagcatttccgccaggcacac

SEQ ID NO: 657791 - DNA, 25 bp, Mus musculus
ggttgagcatttgcgccaggcacac

SEQ ID NO: 657792 - DNA, 25 bp, Mus musculus
ggttgagcccaacaacgctgtgtaa

SEQ ID NO: 657793 - DNA, 25 bp, Mus musculus
ggttgagcccaagaacgctgtgtaa

SEQ ID NO: 657794 - DNA, 25 bp, Mus musculus
ggttgagccccacctgccgcttagg

SEQ ID NO: 657795 - DNA, 25 bp, Mus musculus
ggttgagccccagctgccgcttagg

SEQ ID NO: 657796 - DNA, 25 bp, Mus musculus
ggttgagcgccaatttaccatgaat

SEQ ID NO: 657797 - DNA, 25 bp, Mus musculus
ggttgagcgccattttaccatgaat

SEQ ID NO: 657798 - DNA, 25 bp, Mus musculus
ggttgagctagaagtaggagaccct

SEQ ID NO: 657799 - DNA, 25 bp, Mus musculus
ggttgagctagatgtaggagaccct

SEQ ID NO: 657800 - DNA, 25 bp, Mus musculus
ggttgagctctgctgcacattggca

SEQ ID NO: 657801 - DNA, 25 bp, Mus musculus
ggttgagctctggtgcacattggca

SEQ ID NO: 657802 - DNA, 25 bp, Mus musculus
ggttgaggccaaacagccaaattct

SEQ ID NO: 657803 - DNA, 25 bp, Mus musculus
ggttgaggccaatcagccaaattct

SEQ ID NO: 657804 - DNA, 25 bp, Mus musculus
ggttgaggctatacgctattgccat

SEQ ID NO: 657805 - DNA, 25 bp, Mus musculus
ggttgaggctattcgctattgccat

SEQ ID NO: 657806 - DNA, 25 bp, Mus musculus
ggttgaggctccattcataccaaag

SEQ ID NO: 657807 - DNA, 25 bp, Mus musculus
ggttgaggctcctttcataccaaag

SEQ ID NO: 657808 - DNA, 25 bp, Mus musculus
ggttgagggtgccttttccatgcaa

SEQ ID NO: 657809 - DNA, 25 bp, Mus musculus
ggttgagggtgcgttttccatgcaa

SEQ ID NO: 657810 - DNA, 25 bp, Mus musculus
ggttgaggtattcttgaggcttcct

SEQ ID NO: 657811 - DNA, 25 bp, Mus musculus
ggttgaggtattgttgaggcttcct

SEQ ID NO: 657812 - DNA, 25 bp, Mus musculus
ggttgaggtgacagctgccctcatt

SEQ ID NO: 657813 - DNA, 25 bp, Mus musculus
ggttgaggtgactgctgccctcatt

SEQ ID NO: 657814 - DNA, 25 bp, Mus musculus
ggttgagtcatgctctaacagttaa

SEQ ID NO: 657815 - DNA, 25 bp, Mus musculus
ggttgagtcatggtctaacagttaa

SEQ ID NO: 657816 - DNA, 25 bp, Mus musculus
ggttgagtcattagagtatcccaaa

SEQ ID NO: 657817 - DNA, 25 bp, Mus musculus
ggttgagtcatttgagtatcccaaa

SEQ ID NO: 657818 - DNA, 25 bp, Mus musculus
ggttgagtccacattgtgcttcaca

SEQ ID NO: 657819 - DNA, 25 bp, Mus musculus
ggttgagtccactttgtgcttcaca

SEQ ID NO: 657820 - DNA, 25 bp, Mus musculus
ggttgagtcccgatgcatattcctg

SEQ ID NO: 657821 - DNA, 25 bp, Mus musculus
ggttgagtcccgttgcatattcctg

SEQ ID NO: 657822 - DNA, 25 bp, Mus musculus
ggttgagtccttctgtgggacatcc

SEQ ID NO: 657823 - DNA, 25 bp, Mus musculus
ggttgagtccttgtgtgggacatcc

SEQ ID NO: 657824 - DNA, 25 bp, Mus musculus
ggttgagtcgccatgagatgcacag

SEQ ID NO: 657825 - DNA, 25 bp, Mus musculus
ggttgagtcgccttgagatgcacag

SEQ ID NO: 657826 - DNA, 25 bp, Mus musculus
ggttgagtctccaatgtaaagtgta

SEQ ID NO: 657827 - DNA, 25 bp, Mus musculus
ggttgagtctcctatgtaaagtgta

SEQ ID NO: 657828 - DNA, 25 bp, Mus musculus
ggttgagtggttaagacctctgctc

SEQ ID NO: 657829 - DNA, 25 bp, Mus musculus
ggttgagtggtttagacctctgctc

SEQ ID NO: 657830 - DNA, 25 bp, Mus musculus
ggttgagttcacagattatgctttg

SEQ ID NO: 657831 - DNA, 25 bp, Mus musculus
ggttgagttcactgattatgctttg

SEQ ID NO: 657832 - DNA, 25 bp, Mus musculus
ggttgagttcgccttgctgatgact

SEQ ID NO: 657833 - DNA, 25 bp, Mus musculus
ggttgagttcgcgttgctgatgact

SEQ ID NO: 657834 - DNA, 25 bp, Mus musculus
ggttgagttgccagactgataacta

SEQ ID NO: 657835 - DNA, 25 bp, Mus musculus
ggttgagttgcctgactgataacta

SEQ ID NO: 657836 - DNA, 25 bp, Mus musculus
ggttgataacagcacctacctcgaa

SEQ ID NO: 657837 - DNA, 25 bp, Mus musculus
ggttgataacaggacctacctcgaa

SEQ ID NO: 657838 - DNA, 25 bp, Mus musculus
ggttgatactttaaggcgtggctga

SEQ ID NO: 657839 - DNA, 25 bp, Mus musculus
ggttgatacttttaggcgtggctga

SEQ ID NO: 657840 - DNA, 25 bp, Mus musculus
ggttgatagactaaattacccaagc

SEQ ID NO: 657841 - DNA, 25 bp, Mus musculus
ggttgatagacttaattacccaagc

SEQ ID NO: 657842 - DNA, 25 bp, Mus musculus
ggttgatagatgctcccgtttcctc

SEQ ID NO: 657843 - DNA, 25 bp, Mus musculus
ggttgatagatggtcccgtttcctc

SEQ ID NO: 657844 - DNA, 25 bp, Mus musculus
ggttgatagccccattggcccaggt

SEQ ID NO: 657845 - DNA, 25 bp, Mus musculus
ggttgatagcccgattggcccaggt

SEQ ID NO: 657846 - DNA, 25 bp, Mus musculus
ggttgatagcgaaagtcctcctcta

SEQ ID NO: 657847 - DNA, 25 bp, Mus musculus
ggttgatagcgatagtcctcctcta

SEQ ID NO: 657848 - DNA, 25 bp, Mus musculus
ggttgatcagtcaagctcttagtag

SEQ ID NO: 657849 - DNA, 25 bp, Mus musculus
ggttgatcagtctagctcttagtag

SEQ ID NO: 657850 - DNA, 25 bp, Mus musculus
ggttgatcccacagacataccaatt

SEQ ID NO: 657851 - DNA, 25 bp, Mus musculus
ggttgatcccactgacataccaatt

SEQ ID NO: 657852 - DNA, 25 bp, Mus musculus
ggttgatccccacctacaaaaggcg

SEQ ID NO: 657853 - DNA, 25 bp, Mus musculus
ggttgatccccagctacaaaaggcg

SEQ ID NO: 657854 - DNA, 25 bp, Mus musculus
ggttgatcccttagattctggccta

SEQ ID NO: 657855 - DNA, 25 bp, Mus musculus
ggttgatccctttgattctggccta

SEQ ID NO: 657856 - DNA, 25 bp, Mus musculus
ggttgatctgaaaccttggtgttct

SEQ ID NO: 657857 - DNA, 25 bp, Mus musculus
ggttgatctgaaattcacgtgaaag

SEQ ID NO: 657858 - DNA, 25 bp, Mus musculus
ggttgatctgaatccttggtgttct

SEQ ID NO: 657859 - DNA, 25 bp, Mus musculus
ggttgatctgaatttcacgtgaaag

SEQ ID NO: 657860 - DNA, 25 bp, Mus musculus
ggttgatgagtgctacgacatgaca

SEQ ID NO: 657861 - DNA, 25 bp, Mus musculus
ggttgatgagtggtacgacatgaca

SEQ ID NO: 657862 - DNA, 25 bp, Mus musculus
ggttgatgattgacttcggcagcca

SEQ ID NO: 657863 - DNA, 25 bp, Mus musculus
ggttgatgattgtcttcggcagcca

SEQ ID NO: 657864 - DNA, 25 bp, Mus musculus
ggttgatgctaacactctactggct

SEQ ID NO: 657865 - DNA, 25 bp, Mus musculus
ggttgatgctaagactctactggct

SEQ ID NO: 657866 - DNA, 25 bp, Mus musculus
ggttgatggctactatttcctaata

SEQ ID NO: 657867 - DNA, 25 bp, Mus musculus
ggttgatggctagtatttcctaata

SEQ ID NO: 657868 - DNA, 25 bp, Mus musculus
ggttgatgggacacattggctcacc

SEQ ID NO: 657869 - DNA, 25 bp, Mus musculus
ggttgatgggactcattggctcacc

SEQ ID NO: 657870 - DNA, 25 bp, Mus musculus
ggttgatgggatattgtttttcttt

SEQ ID NO: 657871 - DNA, 25 bp, Mus musculus
ggttgatgggattttgtttttcttt

SEQ ID NO: 657872 - DNA, 25 bp, Mus musculus
ggttgatggtggagcatacatctat

SEQ ID NO: 657873 - DNA, 25 bp, Mus musculus
ggttgatggtggtgcatacatctat

SEQ ID NO: 657874 - DNA, 25 bp, Mus musculus
ggttgatgtcaacagagccctagga

SEQ ID NO: 657875 - DNA, 25 bp, Mus musculus
ggttgatgtcaagagagccctagga

SEQ ID NO: 657876 - DNA, 25 bp, Mus musculus
ggttgattaattacactctctagaa

SEQ ID NO: 657877 - DNA, 25 bp, Mus musculus
ggttgattaatttcactctctagaa

SEQ ID NO: 657878 - DNA, 25 bp, Mus musculus
ggttgattcctaacgggtaagcagt

SEQ ID NO: 657879 - DNA, 25 bp, Mus musculus
ggttgattcctaagtactatttctc

SEQ ID NO: 657880 - DNA, 25 bp, Mus musculus
ggttgattcctatcgggtaagcagt

SEQ ID NO: 657881 - DNA, 25 bp, Mus musculus
ggttgattcctatgtactatttctc

SEQ ID NO: 657882 - DNA, 25 bp, Mus musculus
ggttgattctcgagtctcgctccgg

SEQ ID NO: 657883 - DNA, 25 bp, Mus musculus
ggttgattctcgtgtctcgctccgg

SEQ ID NO: 657884 - DNA, 25 bp, Mus musculus
ggttgattgcttaatctctcgaatg

SEQ ID NO: 657885 - DNA, 25 bp, Mus musculus
ggttgattgctttatctctcgaatg

SEQ ID NO: 657886 - DNA, 25 bp, Mus musculus
ggttgattggtgacctgacaagtgc

SEQ ID NO: 657887 - DNA, 25 bp, Mus musculus
ggttgattggtgtcctgacaagtgc

SEQ ID NO: 657888 - DNA, 25 bp, Mus musculus
ggttgatttcatcgagctgctaaga

SEQ ID NO: 657889 - DNA, 25 bp, Mus musculus
ggttgatttcatggagctgctaaga

SEQ ID NO: 657890 - DNA, 25 bp, Mus musculus
ggttgatttctaagccacacgctat

SEQ ID NO: 657891 - DNA, 25 bp, Mus musculus
ggttgatttctatgccacacgctat

SEQ ID NO: 657892 - DNA, 25 bp, Mus musculus
ggttgcaagatacgctctaccctag

SEQ ID NO: 657893 - DNA, 25 bp, Mus musculus
ggttgcaagataggctctaccctag

SEQ ID NO: 657894 - DNA, 25 bp, Mus musculus
ggttgcaagcagacccaacatgtca

SEQ ID NO: 657895 - DNA, 25 bp, Mus musculus
ggttgcaagcagtcccaacatgtca

SEQ ID NO: 657896 - DNA, 25 bp, Mus musculus
ggttgcacaagaattcttcctgtca

SEQ ID NO: 657897 - DNA, 25 bp, Mus musculus
ggttgcacaagatttcttcctgtca

SEQ ID NO: 657898 - DNA, 25 bp, Mus musculus
ggttgcactagtcaatactacactt

SEQ ID NO: 657899 - DNA, 25 bp, Mus musculus
ggttgcactagtgaatactacactt

SEQ ID NO: 657900 - DNA, 25 bp, Mus musculus
ggttgcactcagaccggccatcatc

SEQ ID NO: 657901 - DNA, 25 bp, Mus musculus
ggttgcactcagtccggccatcatc

SEQ ID NO: 657902 - DNA, 25 bp, Mus musculus
ggttgcactcttcctgaattggatg

SEQ ID NO: 657903 - DNA, 25 bp, Mus musculus
ggttgcactcttgctgaattggatg

SEQ ID NO: 657904 - DNA, 25 bp, Mus musculus
ggttgcactggaatgttttgagact

SEQ ID NO: 657905 - DNA, 25 bp, Mus musculus
ggttgcactggattgttttgagact

SEQ ID NO: 657906 - DNA, 25 bp, Mus musculus
ggttgcagaaggaggcagcccatct

SEQ ID NO: 657907 - DNA, 25 bp, Mus musculus
ggttgcagaaggtggcagcccatct

SEQ ID NO: 657908 - DNA, 25 bp, Mus musculus
ggttgcagacctatgttcttttgac

SEQ ID NO: 657909 - DNA, 25 bp, Mus musculus
ggttgcagacctttgttcttttgac

SEQ ID NO: 657910 - DNA, 25 bp, Mus musculus
ggttgcagatctccacagcgtgttc

SEQ ID NO: 657911 - DNA, 25 bp, Mus musculus
ggttgcagatctgcacagcgtgttc

SEQ ID NO: 657912 - DNA, 25 bp, Mus musculus
ggttgcagatgtatgccacacacac

SEQ ID NO: 657913 - DNA, 25 bp, Mus musculus
ggttgcagatgtttgccacacacac

SEQ ID NO: 657914 - DNA, 25 bp, Mus musculus
ggttgcagccaaccttcagccggga

SEQ ID NO: 657915 - DNA, 25 bp, Mus musculus
ggttgcagccaagcttcagccggga

SEQ ID NO: 657916 - DNA, 25 bp, Mus musculus
ggttgcagcctaatctaactgactg

SEQ ID NO: 657917 - DNA, 25 bp, Mus musculus
ggttgcagcctattctaactgactg

SEQ ID NO: 657918 - DNA, 25 bp, Mus musculus
ggttgcagcgcaacctattttgaga

SEQ ID NO: 657919 - DNA, 25 bp, Mus musculus
ggttgcagcgcatcctattttgaga

SEQ ID NO: 657920 - DNA, 25 bp, Mus musculus
ggttgcagggatagaaaccctaact

SEQ ID NO: 657921 - DNA, 25 bp, Mus musculus
ggttgcagggattgaaaccctaact

SEQ ID NO: 657922 - DNA, 25 bp, Mus musculus
ggttgcaggtttaacatcacatgag

SEQ ID NO: 657923 - DNA, 25 bp, Mus musculus
ggttgcaggttttacatcacatgag

SEQ ID NO: 657924 - DNA, 25 bp, Mus musculus
ggttgcagtcctattcattcaatca

SEQ ID NO: 657925 - DNA, 25 bp, Mus musculus
ggttgcagtccttttcattcaatca

SEQ ID NO: 657926 - DNA, 25 bp, Mus musculus
ggttgcagtgttaaagcctaccaca

SEQ ID NO: 657927 - DNA, 25 bp, Mus musculus
ggttgcagtgtttaagcctaccaca

SEQ ID NO: 657928 - DNA, 25 bp, Mus musculus
ggttgcatatagctcacgggctcca

SEQ ID NO: 657929 - DNA, 25 bp, Mus musculus
ggttgcatataggtcacgggctcca

SEQ ID NO: 657930 - DNA, 25 bp, Mus musculus
ggttgcattataagtggaggctcaa

SEQ ID NO: 657931 - DNA, 25 bp, Mus musculus
ggttgcattatatgtggaggctcaa

SEQ ID NO: 657932 - DNA, 25 bp, Mus musculus
ggttgccaacatattagccatattt

SEQ ID NO: 657933 - DNA, 25 bp, Mus musculus
ggttgccaacattttagccatattt

SEQ ID NO: 657934 - DNA, 25 bp, Mus musculus
ggttgccaactgatcagtcggtgag

SEQ ID NO: 657935 - DNA, 25 bp, Mus musculus
ggttgccaactgttcagtcggtgag

SEQ ID NO: 657936 - DNA, 25 bp, Mus musculus
ggttgccaatggacacacatttcat

SEQ ID NO: 657937 - DNA, 25 bp, Mus musculus
ggttgccaatggtcacacatttcat

SEQ ID NO: 657938 - DNA, 25 bp, Mus musculus
ggttgccacaaactgcctcgtttac

SEQ ID NO: 657939 - DNA, 25 bp, Mus musculus
ggttgccacaaagtgcctcgtttac

SEQ ID NO: 657940 - DNA, 25 bp, Mus musculus
ggttgccacacaccattgtacccag

SEQ ID NO: 657941 - DNA, 25 bp, Mus musculus
ggttgccacacagcattgtacccag

SEQ ID NO: 657942 - DNA, 25 bp, Mus musculus
ggttgccacagccttccgtgaaggt

SEQ ID NO: 657943 - DNA, 25 bp, Mus musculus
ggttgccacagcgttccgtgaaggt

SEQ ID NO: 657944 - DNA, 25 bp, Mus musculus
ggttgccaccctacatagagtttag

SEQ ID NO: 657945 - DNA, 25 bp, Mus musculus
ggttgccacccttcatagagtttag

SEQ ID NO: 657946 - DNA, 25 bp, Mus musculus
ggttgccacgagagttggactagtt

SEQ ID NO: 657947 - DNA, 25 bp, Mus musculus
ggttgccacgagtgttggactagtt

SEQ ID NO: 657948 - DNA, 25 bp, Mus musculus
ggttgccactggagtaagctttttt

SEQ ID NO: 657949 - DNA, 25 bp, Mus musculus
ggttgccactggtgtaagctttttt

SEQ ID NO: 657950 - DNA, 25 bp, Mus musculus
ggttgccactttaagtctattccag

SEQ ID NO: 657951 - DNA, 25 bp, Mus musculus
ggttgccacttttagtctattccag

SEQ ID NO: 657952 - DNA, 25 bp, Mus musculus
ggttgccagaaaatgttgttgctaa

SEQ ID NO: 657953 - DNA, 25 bp, Mus musculus
ggttgccagaaattgttgttgctaa

SEQ ID NO: 657954 - DNA, 25 bp, Mus musculus
ggttgccagaaccacaaaaactgtg

SEQ ID NO: 657955 - DNA, 25 bp, Mus musculus
ggttgccagaaccaccacatcatcg

SEQ ID NO: 657956 - DNA, 25 bp, Mus musculus
ggttgccagaacgacaaaaactgtg

SEQ ID NO: 657957 - DNA, 25 bp, Mus musculus
ggttgccagaacgaccacatcatcg

SEQ ID NO: 657958 - DNA, 25 bp, Mus musculus
ggttgccaggagagcgctgtccctc

SEQ ID NO: 657959 - DNA, 25 bp, Mus musculus
ggttgccaggagtgcgctgtccctc

SEQ ID NO: 657960 - DNA, 25 bp, Mus musculus
ggttgccaggcgcacctgtgtacct

SEQ ID NO: 657961 - DNA, 25 bp, Mus musculus
ggttgccaggcggacctgtgtacct

SEQ ID NO: 657962 - DNA, 25 bp, Mus musculus
ggttgccagggtatatagctttcta

SEQ ID NO: 657963 - DNA, 25 bp, Mus musculus
ggttgccagggtttatagctttcta

SEQ ID NO: 657964 - DNA, 25 bp, Mus musculus
ggttgccatacacagtactaggtct

SEQ ID NO: 657965 - DNA, 25 bp, Mus musculus
ggttgccatacagagtactaggtct

SEQ ID NO: 657966 - DNA, 25 bp, Mus musculus
ggttgccatattattcaattagtgt

SEQ ID NO: 657967 - DNA, 25 bp, Mus musculus
ggttgccatatttttcaattagtgt

SEQ ID NO: 657968 - DNA, 25 bp, Mus musculus
ggttgccatcggaaagtcattgtat

SEQ ID NO: 657969 - DNA, 25 bp, Mus musculus
ggttgccatcggtaagtcattgtat

SEQ ID NO: 657970 - DNA, 25 bp, Mus musculus
ggttgccatttgatgcccctgggaa

SEQ ID NO: 657971 - DNA, 25 bp, Mus musculus
ggttgccatttgttgcccctgggaa

SEQ ID NO: 657972 - DNA, 25 bp, Mus musculus
ggttgcccaaagattaagcaccaat

SEQ ID NO: 657973 - DNA, 25 bp, Mus musculus
ggttgcccaaagtttaagcaccaat

SEQ ID NO: 657974 - DNA, 25 bp, Mus musculus
ggttgcccacacctgtcctgctgaa

SEQ ID NO: 657975 - DNA, 25 bp, Mus musculus
ggttgcccacacgtgtcctgctgaa

SEQ ID NO: 657976 - DNA, 25 bp, Mus musculus
ggttgcccagcccaaagaggtgtat

SEQ ID NO: 657977 - DNA, 25 bp, Mus musculus
ggttgcccagccgaaagaggtgtat

SEQ ID NO: 657978 - DNA, 25 bp, Mus musculus
ggttgccccagtcgactgtaaatga

SEQ ID NO: 657979 - DNA, 25 bp, Mus musculus
ggttgccccagtggactgtaaatga

SEQ ID NO: 657980 - DNA, 25 bp, Mus musculus
ggttgccctgatatttcaatgtgct

SEQ ID NO: 657981 - DNA, 25 bp, Mus musculus
ggttgccctgatttttcaatgtgct

SEQ ID NO: 657982 - DNA, 25 bp, Mus musculus
ggttgccgccagattctactcagaa

SEQ ID NO: 657983 - DNA, 25 bp, Mus musculus
ggttgccgccagtttctactcagaa

SEQ ID NO: 657984 - DNA, 25 bp, Mus musculus
ggttgccggcatctgaccagcctga

SEQ ID NO: 657985 - DNA, 25 bp, Mus musculus
ggttgccggcatgtgaccagcctga

SEQ ID NO: 657986 - DNA, 25 bp, Mus musculus
ggttgcctatgaaggcttgccactt

SEQ ID NO: 657987 - DNA, 25 bp, Mus musculus
ggttgcctatgatggcttgccactt

SEQ ID NO: 657988 - DNA, 25 bp, Mus musculus
ggttgcctcaaccatgaacacttgg

SEQ ID NO: 657989 - DNA, 25 bp, Mus musculus
ggttgcctcaacgatgaacacttgg

SEQ ID NO: 657990 - DNA, 25 bp, Mus musculus
ggttgcctgatgctgatgtcatccc

SEQ ID NO: 657991 - DNA, 25 bp, Mus musculus
ggttgcctgatggtgatgtcatccc

SEQ ID NO: 657992 - DNA, 25 bp, Mus musculus
ggttgcctggctcactggtgggagt

SEQ ID NO: 657993 - DNA, 25 bp, Mus musculus
ggttgcctggctgactggtgggagt

SEQ ID NO: 657994 - DNA, 25 bp, Mus musculus
ggttgccttaacagatctctgatct

SEQ ID NO: 657995 - DNA, 25 bp, Mus musculus
ggttgccttaactgatctctgatct

SEQ ID NO: 657996 - DNA, 25 bp, Mus musculus
ggttgccttcaaatgcacgatattc

SEQ ID NO: 657997 - DNA, 25 bp, Mus musculus
ggttgccttcaattgcacgatattc

SEQ ID NO: 657998 - DNA, 25 bp, Mus musculus
ggttgccttgcacatatttgttagt

SEQ ID NO: 657999 - DNA, 25 bp, Mus musculus
ggttgccttgcagatatttgttagt

SEQ ID NO: 658000 - DNA, 25 bp, Mus musculus
ggttgccttgccagtggtgataaac

SEQ ID NO: 658001 - DNA, 25 bp, Mus musculus
ggttgccttgcctgtggtgataaac

SEQ ID NO: 658002 - DNA, 25 bp, Mus musculus
ggttgccttggtaggcagtgttaat

SEQ ID NO: 658003 - DNA, 25 bp, Mus musculus
ggttgccttggttggcagtgttaat

SEQ ID NO: 658004 - DNA, 25 bp, Mus musculus
ggttgccttgtgattattagtcatc

SEQ ID NO: 658005 - DNA, 25 bp, Mus musculus
ggttgccttgtgtttattagtcatc

SEQ ID NO: 658006 - DNA, 25 bp, Mus musculus
ggttgcgaaggaatcacaaggtatt

SEQ ID NO: 658007 - DNA, 25 bp, Mus musculus
ggttgcgaaggattcacaaggtatt

SEQ ID NO: 658008 - DNA, 25 bp, Mus musculus
ggttgcggctggaattctgacagtc

SEQ ID NO: 658009 - DNA, 25 bp, Mus musculus
ggttgcggctggtattctgacagtc

SEQ ID NO: 658010 - DNA, 25 bp, Mus musculus
ggttgctaaaatctttccatggctt

SEQ ID NO: 658011 - DNA, 25 bp, Mus musculus
ggttgctaaaatgtttccatggctt

SEQ ID NO: 658012 - DNA, 25 bp, Mus musculus
ggttgctaactgaacattgtattac

SEQ ID NO: 658013 - DNA, 25 bp, Mus musculus
ggttgctaactgtacattgtattac

SEQ ID NO: 658014 - DNA, 25 bp, Mus musculus
ggttgctaagcaatggcccctgaat

SEQ ID NO: 658015 - DNA, 25 bp, Mus musculus
ggttgctaagcattggcccctgaat

SEQ ID NO: 658016 - DNA, 25 bp, Mus musculus
ggttgctacaagagcggcctttcaa

SEQ ID NO: 658017 - DNA, 25 bp, Mus musculus
ggttgctacaagattactacagttt

SEQ ID NO: 658018 - DNA, 25 bp, Mus musculus
ggttgctacaagtgcggcctttcaa

SEQ ID NO: 658019 - DNA, 25 bp, Mus musculus
ggttgctacaagtttactacagttt

SEQ ID NO: 658020 - DNA, 25 bp, Mus musculus
ggttgctaccatataccatatctgc

SEQ ID NO: 658021 - DNA, 25 bp, Mus musculus
ggttgctaccatttaccatatctgc

SEQ ID NO: 658022 - DNA, 25 bp, Mus musculus
ggttgctacctaagggtttacgctt

SEQ ID NO: 658023 - DNA, 25 bp, Mus musculus
ggttgctacctatgggtttacgctt

SEQ ID NO: 658024 - DNA, 25 bp, Mus musculus
ggttgctagggacccaaaatactag

SEQ ID NO: 658025 - DNA, 25 bp, Mus musculus
ggttgctagggagccaaaatactag

SEQ ID NO: 658026 - DNA, 25 bp, Mus musculus
ggttgctaggtactaacttcttgta

SEQ ID NO: 658027 - DNA, 25 bp, Mus musculus
ggttgctaggtagtaacttcttgta

SEQ ID NO: 658028 - DNA, 25 bp, Mus musculus
ggttgctagtacatagtagtgctta

SEQ ID NO: 658029 - DNA, 25 bp, Mus musculus
ggttgctagtacttagtagtgctta

SEQ ID NO: 658030 - DNA, 25 bp, Mus musculus
ggttgctatagtcatccagcgccaa

SEQ ID NO: 658031 - DNA, 25 bp, Mus musculus
ggttgctatagtgatccagcgccaa

SEQ ID NO: 658032 - DNA, 25 bp, Mus musculus
ggttgctatcacaagtttcacctga

SEQ ID NO: 658033 - DNA, 25 bp, Mus musculus
ggttgctatcactagtttcacctga

SEQ ID NO: 658034 - DNA, 25 bp, Mus musculus
ggttgctatcatatatccagggttg

SEQ ID NO: 658035 - DNA, 25 bp, Mus musculus
ggttgctatcatttatccagggttg

SEQ ID NO: 658036 - DNA, 25 bp, Mus musculus
ggttgctatggtactagatgtctct

SEQ ID NO: 658037 - DNA, 25 bp, Mus musculus
ggttgctatggttctagatgtctct

SEQ ID NO: 658038 - DNA, 25 bp, Mus musculus
ggttgctatgtacttcacacgtcac

SEQ ID NO: 658039 - DNA, 25 bp, Mus musculus
ggttgctatgtagttcacacgtcac

SEQ ID NO: 658040 - DNA, 25 bp, Mus musculus
ggttgctatttaaatgttcctcaga

SEQ ID NO: 658041 - DNA, 25 bp, Mus musculus
ggttgctatttatatgttcctcaga

SEQ ID NO: 658042 - DNA, 25 bp, Mus musculus
ggttgctcaccccagcatatgggag

SEQ ID NO: 658043 - DNA, 25 bp, Mus musculus
ggttgctcacccgagcatatgggag

SEQ ID NO: 658044 - DNA, 25 bp, Mus musculus
ggttgctcactactaatttgggtct

SEQ ID NO: 658045 - DNA, 25 bp, Mus musculus
ggttgctcactagtaatttgggtct

SEQ ID NO: 658046 - DNA, 25 bp, Mus musculus
ggttgctcactcaggtcaattacga

SEQ ID NO: 658047 - DNA, 25 bp, Mus musculus
ggttgctcactctggtcaattacga

SEQ ID NO: 658048 - DNA, 25 bp, Mus musculus
ggttgctcagagctagttgatttgt

SEQ ID NO: 658049 - DNA, 25 bp, Mus musculus
ggttgctcagaggtagttgatttgt

SEQ ID NO: 658050 - DNA, 25 bp, Mus musculus
ggttgctcatcgagccaagctaaga

SEQ ID NO: 658051 - DNA, 25 bp, Mus musculus
ggttgctcatcgtgccaagctaaga

SEQ ID NO: 658052 - DNA, 25 bp, Mus musculus
ggttgctcattcaaattttatgcca

SEQ ID NO: 658053 - DNA, 25 bp, Mus musculus
ggttgctcattctaattttatgcca

SEQ ID NO: 658054 - DNA, 25 bp, Mus musculus
ggttgctcattgaatgctctctcat

SEQ ID NO: 658055 - DNA, 25 bp, Mus musculus
ggttgctcattgtatgctctctcat

SEQ ID NO: 658056 - DNA, 25 bp, Mus musculus
ggttgctccagcaaaggacctgagt

SEQ ID NO: 658057 - DNA, 25 bp, Mus musculus
ggttgctccagctaaggacctgagt

SEQ ID NO: 658058 - DNA, 25 bp, Mus musculus
ggttgctcctggctgcagtagtaca

SEQ ID NO: 658059 - DNA, 25 bp, Mus musculus
ggttgctcctgggtgcagtagtaca

SEQ ID NO: 658060 - DNA, 25 bp, Mus musculus
ggttgctctcctctaaaacccgaga

SEQ ID NO: 658061 - DNA, 25 bp, Mus musculus
ggttgctctcctgtaaaacccgaga

SEQ ID NO: 658062 - DNA, 25 bp, Mus musculus
ggttgctctttaatattccctgata

SEQ ID NO: 658063 - DNA, 25 bp, Mus musculus
ggttgctctttattattccctgata

SEQ ID NO: 658064 - DNA, 25 bp, Mus musculus
ggttgctgagctcacattggttcaa

SEQ ID NO: 658065 - DNA, 25 bp, Mus musculus
ggttgctgagctgacattggttcaa

SEQ ID NO: 658066 - DNA, 25 bp, Mus musculus
ggttgctgattcaactttgtatcta

SEQ ID NO: 658067 - DNA, 25 bp, Mus musculus
ggttgctgattctactttgtatcta

SEQ ID NO: 658068 - DNA, 25 bp, Mus musculus
ggttgctgcatgatcttaacttttc

SEQ ID NO: 658069 - DNA, 25 bp, Mus musculus
ggttgctgcatgttcttaacttttc

SEQ ID NO: 658070 - DNA, 25 bp, Mus musculus
ggttgctgcgtcacaaacgaggcca

SEQ ID NO: 658071 - DNA, 25 bp, Mus musculus
ggttgctgcgtctcaaacgaggcca

SEQ ID NO: 658072 - DNA, 25 bp, Mus musculus
ggttgctgcttaattactgtcaagt

SEQ ID NO: 658073 - DNA, 25 bp, Mus musculus
ggttgctgcttatttactgtcaagt

SEQ ID NO: 658074 - DNA, 25 bp, Mus musculus
ggttgctgcttgattcctagagaac

SEQ ID NO: 658075 - DNA, 25 bp, Mus musculus
ggttgctgcttgtttcctagagaac

SEQ ID NO: 658076 - DNA, 25 bp, Mus musculus
ggttgctggaccacaatactttgat

SEQ ID NO: 658077 - DNA, 25 bp, Mus musculus
ggttgctggacctcaatactttgat

SEQ ID NO: 658078 - DNA, 25 bp, Mus musculus
ggttgctggattcaatgaagtcttt

SEQ ID NO: 658079 - DNA, 25 bp, Mus musculus
ggttgctggattgaatgaagtcttt

SEQ ID NO: 658080 - DNA, 25 bp, Mus musculus
ggttgctgtaagcatgacctccaga

SEQ ID NO: 658081 - DNA, 25 bp, Mus musculus
ggttgctgtaaggatgacctccaga

SEQ ID NO: 658082 - DNA, 25 bp, Mus musculus
ggttgctgtgggatggtataacttc

SEQ ID NO: 658083 - DNA, 25 bp, Mus musculus
ggttgctgtgggttggtataacttc

SEQ ID NO: 658084 - DNA, 25 bp, Mus musculus
ggttgctgtgttatgcacaaacttt

SEQ ID NO: 658085 - DNA, 25 bp, Mus musculus
ggttgctgtgttttgcacaaacttt

SEQ ID NO: 658086 - DNA, 25 bp, Mus musculus
ggttgctgtttccacactctaaaat

SEQ ID NO: 658087 - DNA, 25 bp, Mus musculus
ggttgctgtttcgacactctaaaat

SEQ ID NO: 658088 - DNA, 25 bp, Mus musculus
ggttgcttaaaccatgccagtgctg

SEQ ID NO: 658089 - DNA, 25 bp, Mus musculus
ggttgcttaaacgatgccagtgctg

SEQ ID NO: 658090 - DNA, 25 bp, Mus musculus
ggttgcttacccagacttatgcatg

SEQ ID NO: 658091 - DNA, 25 bp, Mus musculus
ggttgcttaccctgacttatgcatg

SEQ ID NO: 658092 - DNA, 25 bp, Mus musculus
ggttgcttactaaatccccttcaat

SEQ ID NO: 658093 - DNA, 25 bp, Mus musculus
ggttgcttactatatccccttcaat

SEQ ID NO: 658094 - DNA, 25 bp, Mus musculus
ggttgcttagtcctgggtgtggcca

SEQ ID NO: 658095 - DNA, 25 bp, Mus musculus
ggttgcttagtcgtgggtgtggcca

SEQ ID NO: 658096 - DNA, 25 bp, Mus musculus
ggttgcttatatatctgcacattct

SEQ ID NO: 658097 - DNA, 25 bp, Mus musculus
ggttgcttatatttctgcacattct

SEQ ID NO: 658098 - DNA, 25 bp, Mus musculus
ggttgcttcgggagttgtccacttc

SEQ ID NO: 658099 - DNA, 25 bp, Mus musculus
ggttgcttcgggtgttgtccacttc

SEQ ID NO: 658100 - DNA, 25 bp, Mus musculus
ggttgcttgagactacagggccaca

SEQ ID NO: 658101 - DNA, 25 bp, Mus musculus
ggttgcttgagagtacagggccaca

SEQ ID NO: 658102 - DNA, 25 bp, Mus musculus
ggttgcttgcacaaaacagcttctt

SEQ ID NO: 658103 - DNA, 25 bp, Mus musculus
ggttgcttgcactaaacagcttctt

SEQ ID NO: 658104 - DNA, 25 bp, Mus musculus
ggttgctttataagctttgcattct

SEQ ID NO: 658105 - DNA, 25 bp, Mus musculus
ggttgctttatatgctttgcattct

SEQ ID NO: 658106 - DNA, 25 bp, Mus musculus
ggttgctttatgatatccttttctc

SEQ ID NO: 658107 - DNA, 25 bp, Mus musculus
ggttgctttatgttatccttttctc

SEQ ID NO: 658108 - DNA, 25 bp, Mus musculus
ggttgcttttacagattatcccaaa

SEQ ID NO: 658109 - DNA, 25 bp, Mus musculus
ggttgcttttactgattatcccaaa

SEQ ID NO: 658110 - DNA, 25 bp, Mus musculus
ggttgcttttccatatgggctccaa

SEQ ID NO: 658111 - DNA, 25 bp, Mus musculus
ggttgcttttccttatgggctccaa

SEQ ID NO: 658112 - DNA, 25 bp, Mus musculus
ggttgctttttcattagtgtattct

SEQ ID NO: 658113 - DNA, 25 bp, Mus musculus
ggttgctttttcattgattttaaca

SEQ ID NO: 658114 - DNA, 25 bp, Mus musculus
ggttgctttttctttagtgtattct

SEQ ID NO: 658115 - DNA, 25 bp, Mus musculus
ggttgctttttctttgattttaaca

SEQ ID NO: 658116 - DNA, 25 bp, Mus musculus
ggttggaaacatagtatttggatca

SEQ ID NO: 658117 - DNA, 25 bp, Mus musculus
ggttggaaacattgtatttggatca

SEQ ID NO: 658118 - DNA, 25 bp, Mus musculus
ggttggaaactcaaggacctacaga

SEQ ID NO: 658119 - DNA, 25 bp, Mus musculus
ggttggaaactctaggacctacaga

SEQ ID NO: 658120 - DNA, 25 bp, Mus musculus
ggttggaacaccaggtacagctgaa

SEQ ID NO: 658121 - DNA, 25 bp, Mus musculus
ggttggaacacctggtacagctgaa

SEQ ID NO: 658122 - DNA, 25 bp, Mus musculus
ggttggaaccctatagcaatagaca

SEQ ID NO: 658123 - DNA, 25 bp, Mus musculus
ggttggaaccctttagcaatagaca

SEQ ID NO: 658124 - DNA, 25 bp, Mus musculus
ggttggaagctgaacagttctccag

SEQ ID NO: 658125 - DNA, 25 bp, Mus musculus
ggttggaagctgtacagttctccag

SEQ ID NO: 658126 - DNA, 25 bp, Mus musculus
ggttggaataagcatgaccccaccc

SEQ ID NO: 658127 - DNA, 25 bp, Mus musculus
ggttggaataaggatgaccccaccc

SEQ ID NO: 658128 - DNA, 25 bp, Mus musculus
ggttggaattgcctggcctccctca

SEQ ID NO: 658129 - DNA, 25 bp, Mus musculus
ggttggaattgcgtggcctccctca

SEQ ID NO: 658130 - DNA, 25 bp, Mus musculus
ggttggacaaagctccacagtgact

SEQ ID NO: 658131 - DNA, 25 bp, Mus musculus
ggttggacaaaggtccacagtgact

SEQ ID NO: 658132 - DNA, 25 bp, Mus musculus
ggttggacacaaatcctgtcactgt

SEQ ID NO: 658133 - DNA, 25 bp, Mus musculus
ggttggacacaattcctgtcactgt

SEQ ID NO: 658134 - DNA, 25 bp, Mus musculus
ggttggaccaggcaccctcaggacc

SEQ ID NO: 658135 - DNA, 25 bp, Mus musculus
ggttggaccagggaccctcaggacc

SEQ ID NO: 658136 - DNA, 25 bp, Mus musculus
ggttggacccaaatcaaaaactcat

SEQ ID NO: 658137 - DNA, 25 bp, Mus musculus
ggttggacccaattcaaaaactcat

SEQ ID NO: 658138 - DNA, 25 bp, Mus musculus
ggttggactgagctgggacccagga

SEQ ID NO: 658139 - DNA, 25 bp, Mus musculus
ggttggactgaggtgggacccagga

SEQ ID NO: 658140 - DNA, 25 bp, Mus musculus
ggttggacttacaaagcctctagtt

SEQ ID NO: 658141 - DNA, 25 bp, Mus musculus
ggttggacttactaagcctctagtt

SEQ ID NO: 658142 - DNA, 25 bp, Mus musculus
ggttggacttccatttatgtacact

SEQ ID NO: 658143 - DNA, 25 bp, Mus musculus
ggttggacttccttttatgtacact

SEQ ID NO: 658144 - DNA, 25 bp, Mus musculus
ggttggactttcaatgttgtgctat

SEQ ID NO: 658145 - DNA, 25 bp, Mus musculus
ggttggactttctatgttgtgctat

SEQ ID NO: 658146 - DNA, 25 bp, Mus musculus
ggttggagcaggcacacttgtgaca

SEQ ID NO: 658147 - DNA, 25 bp, Mus musculus
ggttggagcagggacacttgtgaca

SEQ ID NO: 658148 - DNA, 25 bp, Mus musculus
ggttggagccaaactactagtgaag

SEQ ID NO: 658149 - DNA, 25 bp, Mus musculus
ggttggagccaatctactagtgaag

SEQ ID NO: 658150 - DNA, 25 bp, Mus musculus
ggttggagcctcctgaagctcagaa

SEQ ID NO: 658151 - DNA, 25 bp, Mus musculus
ggttggagcctcgtgaagctcagaa

SEQ ID NO: 658152 - DNA, 25 bp, Mus musculus
ggttggagctccagaaactagagtt

SEQ ID NO: 658153 - DNA, 25 bp, Mus musculus
ggttggagctcctgaaactagagtt

SEQ ID NO: 658154 - DNA, 25 bp, Mus musculus
ggttggaggcacaggaaacttcatg

SEQ ID NO: 658155 - DNA, 25 bp, Mus musculus
ggttggaggcactggaaacttcatg

SEQ ID NO: 658156 - DNA, 25 bp, Mus musculus
ggttggatacaaccctaaccaggct

SEQ ID NO: 658157 - DNA, 25 bp, Mus musculus
ggttggatacaagcctaaccaggct

SEQ ID NO: 658158 - DNA, 25 bp, Mus musculus
ggttggatacatctgacggacaaca

SEQ ID NO: 658159 - DNA, 25 bp, Mus musculus
ggttggatacatgtgacggacaaca

SEQ ID NO: 658160 - DNA, 25 bp, Mus musculus
ggttggataggcactaactactatt

SEQ ID NO: 658161 - DNA, 25 bp, Mus musculus
ggttggataggctctaactactatt

SEQ ID NO: 658162 - DNA, 25 bp, Mus musculus
ggttggatgtagatgacagtcgatt

SEQ ID NO: 658163 - DNA, 25 bp, Mus musculus
ggttggatgtagttgacagtcgatt

SEQ ID NO: 658164 - DNA, 25 bp, Mus musculus
ggttggattcaccagtatttgggtc

SEQ ID NO: 658165 - DNA, 25 bp, Mus musculus
ggttggattcacgagtatttgggtc

SEQ ID NO: 658166 - DNA, 25 bp, Mus musculus
ggttggattctaacatcccatgaca

SEQ ID NO: 658167 - DNA, 25 bp, Mus musculus
ggttggattctatcatcccatgaca

SEQ ID NO: 658168 - DNA, 25 bp, Mus musculus
ggttggattctgatagctgccgtta

SEQ ID NO: 658169 - DNA, 25 bp, Mus musculus
ggttggattctgttagctgccgtta

SEQ ID NO: 658170 - DNA, 25 bp, Mus musculus
ggttggcaactcctgatacacataa

SEQ ID NO: 658171 - DNA, 25 bp, Mus musculus
ggttggcaactcgtgatacacataa

SEQ ID NO: 658172 - DNA, 25 bp, Mus musculus
ggttggcaactgaactgtgcagaca

SEQ ID NO: 658173 - DNA, 25 bp, Mus musculus
ggttggcaactgtactgtgcagaca

SEQ ID NO: 658174 - DNA, 25 bp, Mus musculus
ggttggcacaagctattgtcttcat

SEQ ID NO: 658175 - DNA, 25 bp, Mus musculus
ggttggcacaaggtattgtcttcat

SEQ ID NO: 658176 - DNA, 25 bp, Mus musculus
ggttggcacctgagcagctgtgaca

SEQ ID NO: 658177 - DNA, 25 bp, Mus musculus
ggttggcacctgtgcagctgtgaca

SEQ ID NO: 658178 - DNA, 25 bp, Mus musculus
ggttggcacggaaatcatcatatat

SEQ ID NO: 658179 - DNA, 25 bp, Mus musculus
ggttggcacggatatcatcatatat

SEQ ID NO: 658180 - DNA, 25 bp, Mus musculus
ggttggcactgacctatttcttgag

SEQ ID NO: 658181 - DNA, 25 bp, Mus musculus
ggttggcactgagctatttcttgag

SEQ ID NO: 658182 - DNA, 25 bp, Mus musculus
ggttggcactggagccgtccacctc

SEQ ID NO: 658183 - DNA, 25 bp, Mus musculus
ggttggcactggtgccgtccacctc

SEQ ID NO: 658184 - DNA, 25 bp, Mus musculus
ggttggcagagcacatttgtctact

SEQ ID NO: 658185 - DNA, 25 bp, Mus musculus
ggttggcagagctcatttgtctact

SEQ ID NO: 658186 - DNA, 25 bp, Mus musculus
ggttggcagcataacttttactagg

SEQ ID NO: 658187 - DNA, 25 bp, Mus musculus
ggttggcagcattacttttactagg

SEQ ID NO: 658188 - DNA, 25 bp, Mus musculus
ggttggcagttgattctagtgagct

SEQ ID NO: 658189 - DNA, 25 bp, Mus musculus
ggttggcagttgtttctagtgagct

SEQ ID NO: 658190 - DNA, 25 bp, Mus musculus
ggttggcattaactagcagctccca

SEQ ID NO: 658191 - DNA, 25 bp, Mus musculus
ggttggcattaagtagcagctccca

SEQ ID NO: 658192 - DNA, 25 bp, Mus musculus
ggttggcattttctttgagctatct

SEQ ID NO: 658193 - DNA, 25 bp, Mus musculus
ggttggcattttgtttgagctatct

SEQ ID NO: 658194 - DNA, 25 bp, Mus musculus
ggttggccagctcatgtgaccctga

SEQ ID NO: 658195 - DNA, 25 bp, Mus musculus
ggttggccagctgatgtgaccctga

SEQ ID NO: 658196 - DNA, 25 bp, Mus musculus
ggttggccagttagccaggtgggaa

SEQ ID NO: 658197 - DNA, 25 bp, Mus musculus
ggttggccagtttgccaggtgggaa

SEQ ID NO: 658198 - DNA, 25 bp, Mus musculus
ggttggccattcattttgttcactt

SEQ ID NO: 658199 - DNA, 25 bp, Mus musculus
ggttggccattctttttgttcactt

SEQ ID NO: 658200 - DNA, 25 bp, Mus musculus
ggttggccccaaatttcaattgtat

SEQ ID NO: 658201 - DNA, 25 bp, Mus musculus
ggttggccccaattttcaattgtat

SEQ ID NO: 658202 - DNA, 25 bp, Mus musculus
ggttggcccggcattggcacttcaa

SEQ ID NO: 658203 - DNA, 25 bp, Mus musculus
ggttggcccggctttggcacttcaa

SEQ ID NO: 658204 - DNA, 25 bp, Mus musculus
ggttggccctgaacttgctatcctt

SEQ ID NO: 658205 - DNA, 25 bp, Mus musculus
ggttggccctgatcttgctatcctt

SEQ ID NO: 658206 - DNA, 25 bp, Mus musculus
ggttggcctgaaacgaaaactcaca

SEQ ID NO: 658207 - DNA, 25 bp, Mus musculus
ggttggcctgaatcgaaaactcaca

SEQ ID NO: 658208 - DNA, 25 bp, Mus musculus
ggttggcctggcattagtaatattc

SEQ ID NO: 658209 - DNA, 25 bp, Mus musculus
ggttggcctggctttagtaatattc

SEQ ID NO: 658210 - DNA, 25 bp, Mus musculus
ggttggcctttaagctccttatcct

SEQ ID NO: 658211 - DNA, 25 bp, Mus musculus
ggttggcctttatgctccttatcct

SEQ ID NO: 658212 - DNA, 25 bp, Mus musculus
ggttggcggtgtccgacactccaca

SEQ ID NO: 658213 - DNA, 25 bp, Mus musculus
ggttggcggtgtgcgacactccaca

SEQ ID NO: 658214 - DNA, 25 bp, Mus musculus
ggttggctaataaacagcttattct

SEQ ID NO: 658215 - DNA, 25 bp, Mus musculus
ggttggctaatatacagcttattct

SEQ ID NO: 658216 - DNA, 25 bp, Mus musculus
ggttggctacaaaccttcataagtc

SEQ ID NO: 658217 - DNA, 25 bp, Mus musculus
ggttggctacaatccttcataagtc

SEQ ID NO: 658218 - DNA, 25 bp, Mus musculus
ggttggctacagaaacgctgggcca

SEQ ID NO: 658219 - DNA, 25 bp, Mus musculus
ggttggctacagtaacgctgggcca

SEQ ID NO: 658220 - DNA, 25 bp, Mus musculus
ggttggctactgcaccatgaacaca

SEQ ID NO: 658221 - DNA, 25 bp, Mus musculus
ggttggctactggaccatgaacaca

SEQ ID NO: 658222 - DNA, 25 bp, Mus musculus
ggttggctacttctcttagtttcta

SEQ ID NO: 658223 - DNA, 25 bp, Mus musculus
ggttggctacttgtcttagtttcta

SEQ ID NO: 658224 - DNA, 25 bp, Mus musculus
ggttggctagatcttcaactttcca

SEQ ID NO: 658225 - DNA, 25 bp, Mus musculus
ggttggctagatgttcaactttcca

SEQ ID NO: 658226 - DNA, 25 bp, Mus musculus
ggttggctaggcatgctcagtccat

SEQ ID NO: 658227 - DNA, 25 bp, Mus musculus
ggttggctaggcttgctcagtccat

SEQ ID NO: 658228 - DNA, 25 bp, Mus musculus
ggttggctatgcaaatattaggcct

SEQ ID NO: 658229 - DNA, 25 bp, Mus musculus
ggttggctatgctaatattaggcct

SEQ ID NO: 658230 - DNA, 25 bp, Mus musculus
ggttggctcctcagcaggatcctcc

SEQ ID NO: 658231 - DNA, 25 bp, Mus musculus
ggttggctcctctgcaggatcctcc

SEQ ID NO: 658232 - DNA, 25 bp, Mus musculus
ggttggctctagaattaggagtgct

SEQ ID NO: 658233 - DNA, 25 bp, Mus musculus
ggttggctctagtattaggagtgct

SEQ ID NO: 658234 - DNA, 25 bp, Mus musculus
ggttggctgaccatattcacataat

SEQ ID NO: 658235 - DNA, 25 bp, Mus musculus
ggttggctgaccttattcacataat

SEQ ID NO: 658236 - DNA, 25 bp, Mus musculus
ggttggctggtgctgatactcctta

SEQ ID NO: 658237 - DNA, 25 bp, Mus musculus
ggttggctggtggtgatactcctta

SEQ ID NO: 658238 - DNA, 25 bp, Mus musculus
ggttggctgtacagctacacaaata

SEQ ID NO: 658239 - DNA, 25 bp, Mus musculus
ggttggctgtactgctacacaaata

SEQ ID NO: 658240 - DNA, 25 bp, Mus musculus
ggttggctgtttaacaactcacaga

SEQ ID NO: 658241 - DNA, 25 bp, Mus musculus
ggttggctgttttacaactcacaga

SEQ ID NO: 658242 - DNA, 25 bp, Mus musculus
ggttggcttaacatgtattctcaga

SEQ ID NO: 658243 - DNA, 25 bp, Mus musculus
ggttggcttaacttgtattctcaga

SEQ ID NO: 658244 - DNA, 25 bp, Mus musculus
ggttggcttactcacaaacttgcaa

SEQ ID NO: 658245 - DNA, 25 bp, Mus musculus
ggttggcttactgacaaacttgcaa

SEQ ID NO: 658246 - DNA, 25 bp, Mus musculus
ggttggcttatgatcttaccagtat

SEQ ID NO: 658247 - DNA, 25 bp, Mus musculus
ggttggcttatgttcttaccagtat

SEQ ID NO: 658248 - DNA, 25 bp, Mus musculus
ggttggcttcgaacctagtgaattt

SEQ ID NO: 658249 - DNA, 25 bp, Mus musculus
ggttggcttcgatcctagtgaattt

SEQ ID NO: 658250 - DNA, 25 bp, Mus musculus
ggttggcttctgcaacttggatatc

SEQ ID NO: 658251 - DNA, 25 bp, Mus musculus
ggttggcttctggaacttggatatc

SEQ ID NO: 658252 - DNA, 25 bp, Mus musculus
ggttggctttacagtacgcctgcgc

SEQ ID NO: 658253 - DNA, 25 bp, Mus musculus
ggttggctttactgtacgcctgcgc

SEQ ID NO: 658254 - DNA, 25 bp, Mus musculus
ggttggcttttaaggtgctaggcat

SEQ ID NO: 658255 - DNA, 25 bp, Mus musculus
ggttggcttttatggtgctaggcat

SEQ ID NO: 658256 - DNA, 25 bp, Mus musculus
ggttgggaacacaacttgcttcctc

SEQ ID NO: 658257 - DNA, 25 bp, Mus musculus
ggttgggaacactacttgcttcctc

SEQ ID NO: 658258 - DNA, 25 bp, Mus musculus
ggttgggaagatcgcttcataaaga

SEQ ID NO: 658259 - DNA, 25 bp, Mus musculus
ggttgggaagatggcttcataaaga

SEQ ID NO: 658260 - DNA, 25 bp, Mus musculus
ggttgggaagctcggctcattccac

SEQ ID NO: 658261 - DNA, 25 bp, Mus musculus
ggttgggaagctgggctcattccac

SEQ ID NO: 658262 - DNA, 25 bp, Mus musculus
ggttgggacccacacaagccaagtg

SEQ ID NO: 658263 - DNA, 25 bp, Mus musculus
ggttgggacccagacaagccaagtg

SEQ ID NO: 658264 - DNA, 25 bp, Mus musculus
ggttgggacttgaaacatagcgttc

SEQ ID NO: 658265 - DNA, 25 bp, Mus musculus
ggttgggacttgtaacatagcgttc

SEQ ID NO: 658266 - DNA, 25 bp, Mus musculus
ggttgggagccgatgtgtcccatcc

SEQ ID NO: 658267 - DNA, 25 bp, Mus musculus
ggttgggagccgttgtgtcccatcc

SEQ ID NO: 658268 - DNA, 25 bp, Mus musculus
ggttgggatagacacctcaataaat

SEQ ID NO: 658269 - DNA, 25 bp, Mus musculus
ggttgggatagagacctcaataaat

SEQ ID NO: 658270 - DNA, 25 bp, Mus musculus
ggttgggccgtgaaaatcagtgttc

SEQ ID NO: 658271 - DNA, 25 bp, Mus musculus
ggttgggccgtgtaaatcagtgttc

SEQ ID NO: 658272 - DNA, 25 bp, Mus musculus
ggttgggcgccaatcatatagtgat

SEQ ID NO: 658273 - DNA, 25 bp, Mus musculus
ggttgggcgccattcatatagtgat

SEQ ID NO: 658274 - DNA, 25 bp, Mus musculus
ggttgggcgttgctgccaaagctga

SEQ ID NO: 658275 - DNA, 25 bp, Mus musculus
ggttgggcgttggtgccaaagctga

SEQ ID NO: 658276 - DNA, 25 bp, Mus musculus
ggttgggctatgcaagaatctctca

SEQ ID NO: 658277 - DNA, 25 bp, Mus musculus
ggttgggctatggaagaatctctca

SEQ ID NO: 658278 - DNA, 25 bp, Mus musculus
ggttgggctttacgacatactgtca

SEQ ID NO: 658279 - DNA, 25 bp, Mus musculus
ggttgggctttaggacatactgtca

SEQ ID NO: 658280 - DNA, 25 bp, Mus musculus
ggttgggtaccaatttcaatttcag

SEQ ID NO: 658281 - DNA, 25 bp, Mus musculus
ggttgggtaccattttcaatttcag

SEQ ID NO: 658282 - DNA, 25 bp, Mus musculus
ggttgggtccctaataaagctgtgt

SEQ ID NO: 658283 - DNA, 25 bp, Mus musculus
ggttgggtcccttataaagctgtgt

SEQ ID NO: 658284 - DNA, 25 bp, Mus musculus
ggttgggtcctcaaaattcccagca

SEQ ID NO: 658285 - DNA, 25 bp, Mus musculus
ggttgggtcctctaaattcccagca

SEQ ID NO: 658286 - DNA, 25 bp, Mus musculus
ggttgggtgcgcagtgccatctcct

SEQ ID NO: 658287 - DNA, 25 bp, Mus musculus
ggttgggtgcgctgtgccatctcct

SEQ ID NO: 658288 - DNA, 25 bp, Mus musculus
ggttgggtggtgaacatgtccccac

SEQ ID NO: 658289 - DNA, 25 bp, Mus musculus
ggttgggtggtgtacatgtccccac

SEQ ID NO: 658290 - DNA, 25 bp, Mus musculus
ggttgggttcagatttcctctcagg

SEQ ID NO: 658291 - DNA, 25 bp, Mus musculus
ggttgggttcagttttcctctcagg

SEQ ID NO: 658292 - DNA, 25 bp, Mus musculus
ggttgggttccacattagacattag

SEQ ID NO: 658293 - DNA, 25 bp, Mus musculus
ggttgggttccagattagacattag

SEQ ID NO: 658294 - DNA, 25 bp, Mus musculus
ggttgggttggtacactccatttgg

SEQ ID NO: 658295 - DNA, 25 bp, Mus musculus
ggttgggttggttcactccatttgg

SEQ ID NO: 658296 - DNA, 25 bp, Mus musculus
ggttgggtttgcataccacttctct

SEQ ID NO: 658297 - DNA, 25 bp, Mus musculus
ggttgggtttgcttaccacttctct

SEQ ID NO: 658298 - DNA, 25 bp, Mus musculus
ggttgggttttcaatatgaattatc

SEQ ID NO: 658299 - DNA, 25 bp, Mus musculus
ggttgggttttctatatgaattatc

SEQ ID NO: 658300 - DNA, 25 bp, Mus musculus
ggttgggttttgattcctcagagca

SEQ ID NO: 658301 - DNA, 25 bp, Mus musculus
ggttgggttttgtttcctcagagca

SEQ ID NO: 658302 - DNA, 25 bp, Mus musculus
ggttggtagctgacttctgatccat

SEQ ID NO: 658303 - DNA, 25 bp, Mus musculus
ggttggtagctgtcttctgatccat

SEQ ID NO: 658304 - DNA, 25 bp, Mus musculus
ggttggtattcactgggccatttac

SEQ ID NO: 658305 - DNA, 25 bp, Mus musculus
ggttggtattcagtgggccatttac

SEQ ID NO: 658306 - DNA, 25 bp, Mus musculus
ggttggtattccagtcactgatgaa

SEQ ID NO: 658307 - DNA, 25 bp, Mus musculus
ggttggtattcctgtcactgatgaa

SEQ ID NO: 658308 - DNA, 25 bp, Mus musculus
ggttggtcacaacacctaggaaagt

SEQ ID NO: 658309 - DNA, 25 bp, Mus musculus
ggttggtcacaagacctaggaaagt

SEQ ID NO: 658310 - DNA, 25 bp, Mus musculus
ggttggtcagtcaattactacagtt

SEQ ID NO: 658311 - DNA, 25 bp, Mus musculus
ggttggtcagtctattactacagtt

SEQ ID NO: 658312 - DNA, 25 bp, Mus musculus
ggttggtcagtgagtgctcgccaca

SEQ ID NO: 658313 - DNA, 25 bp, Mus musculus
ggttggtcagtgtgtgctcgccaca

SEQ ID NO: 658314 - DNA, 25 bp, Mus musculus
ggttggtcattcatagcttctactg

SEQ ID NO: 658315 - DNA, 25 bp, Mus musculus
ggttggtcattcttagcttctactg

SEQ ID NO: 658316 - DNA, 25 bp, Mus musculus
ggttggtccaagaagcctcgctcag

SEQ ID NO: 658317 - DNA, 25 bp, Mus musculus
ggttggtccaagtagcctcgctcag

SEQ ID NO: 658318 - DNA, 25 bp, Mus musculus
ggttggtccctcagaagatcttcaa

SEQ ID NO: 658319 - DNA, 25 bp, Mus musculus
ggttggtccctctgaagatcttcaa

SEQ ID NO: 658320 - DNA, 25 bp, Mus musculus
ggttggtcctcaacatgacatggaa

SEQ ID NO: 658321 - DNA, 25 bp, Mus musculus
ggttggtcctcatcatgacatggaa

SEQ ID NO: 658322 - DNA, 25 bp, Mus musculus
ggttggtctcatccggaaagcaaat

SEQ ID NO: 658323 - DNA, 25 bp, Mus musculus
ggttggtctcatgcggaaagcaaat

SEQ ID NO: 658324 - DNA, 25 bp, Mus musculus
ggttggtctgccactagtctagata

SEQ ID NO: 658325 - DNA, 25 bp, Mus musculus
ggttggtctgcctctagtctagata

SEQ ID NO: 658326 - DNA, 25 bp, Mus musculus
ggttggtctgtcctatatatggtac

SEQ ID NO: 658327 - DNA, 25 bp, Mus musculus
ggttggtctgtcgtatatatggtac

SEQ ID NO: 658328 - DNA, 25 bp, Mus musculus
ggttggtcttggactggattctcag

SEQ ID NO: 658329 - DNA, 25 bp, Mus musculus
ggttggtcttggtctggattctcag

SEQ ID NO: 658330 - DNA, 25 bp, Mus musculus
ggttggtgacataaaacacaaagat

SEQ ID NO: 658331 - DNA, 25 bp, Mus musculus
ggttggtgacattaaacacaaagat

SEQ ID NO: 658332 - DNA, 25 bp, Mus musculus
ggttggtgcaccaatcacgtgtcaa

SEQ ID NO: 658333 - DNA, 25 bp, Mus musculus
ggttggtgcacctatcacgtgtcaa

SEQ ID NO: 658334 - DNA, 25 bp, Mus musculus
ggttggtgctatcaaactttcttac

SEQ ID NO: 658335 - DNA, 25 bp, Mus musculus
ggttggtgctatgaaactttcttac

SEQ ID NO: 658336 - DNA, 25 bp, Mus musculus
ggttggtggtgaaacttttcttaag

SEQ ID NO: 658337 - DNA, 25 bp, Mus musculus
ggttggtggtgatacttttcttaag

SEQ ID NO: 658338 - DNA, 25 bp, Mus musculus
ggttggtggtttctggctcctccca

SEQ ID NO: 658339 - DNA, 25 bp, Mus musculus
ggttggtggtttgtggctcctccca

SEQ ID NO: 658340 - DNA, 25 bp, Mus musculus
ggttggttccagagcgaagctgaaa

SEQ ID NO: 658341 - DNA, 25 bp, Mus musculus
ggttggttccagtgcgaagctgaaa

SEQ ID NO: 658342 - DNA, 25 bp, Mus musculus
ggttggttcttacacaaaggctcac

SEQ ID NO: 658343 - DNA, 25 bp, Mus musculus
ggttggttcttagacaaaggctcac

SEQ ID NO: 658344 - DNA, 25 bp, Mus musculus
ggttggttgaaaacccatgtacaaa

SEQ ID NO: 658345 - DNA, 25 bp, Mus musculus
ggttggttgaaatcccatgtacaaa

SEQ ID NO: 658346 - DNA, 25 bp, Mus musculus
ggttggttgaagacgcatgccattt

SEQ ID NO: 658347 - DNA, 25 bp, Mus musculus
ggttggttgaagtcgcatgccattt

SEQ ID NO: 658348 - DNA, 25 bp, Mus musculus
ggttggttgacactgtacacctctt

SEQ ID NO: 658349 - DNA, 25 bp, Mus musculus
ggttggttgacagtgtacacctctt

SEQ ID NO: 658350 - DNA, 25 bp, Mus musculus
ggttggttggtcacatccggaaagc

SEQ ID NO: 658351 - DNA, 25 bp, Mus musculus
ggttggttggtcattcatagcttct

SEQ ID NO: 658352 - DNA, 25 bp, Mus musculus
ggttggttggtctcatccggaaagc

SEQ ID NO: 658353 - DNA, 25 bp, Mus musculus
ggttggttggtctttcatagcttct

SEQ ID NO: 658354 - DNA, 25 bp, Mus musculus
ggttggttggtgcaattactctgta

SEQ ID NO: 658355 - DNA, 25 bp, Mus musculus
ggttggttggtggaattactctgta

SEQ ID NO: 658356 - DNA, 25 bp, Mus musculus
ggttggttgtctcagtccttatcac

SEQ ID NO: 658357 - DNA, 25 bp, Mus musculus
ggttggttgtctgagtccttatcac

SEQ ID NO: 658358 - DNA, 25 bp, Mus musculus
ggttggtttcatatctggtactcat

SEQ ID NO: 658359 - DNA, 25 bp, Mus musculus
ggttggtttcatttctggtactcat

SEQ ID NO: 658360 - DNA, 25 bp, Mus musculus
ggttggtttcctcttgcaacacaga

SEQ ID NO: 658361 - DNA, 25 bp, Mus musculus
ggttggtttcctgttgcaacacaga

SEQ ID NO: 658362 - DNA, 25 bp, Mus musculus
ggttggttttatacatggatatgca

SEQ ID NO: 658363 - DNA, 25 bp, Mus musculus
ggttggttttattcatggatatgca

SEQ ID NO: 658364 - DNA, 25 bp, Mus musculus
ggttgtaatttcatgccctttatca

SEQ ID NO: 658365 - DNA, 25 bp, Mus musculus
ggttgtaatttcttgccctttatca

SEQ ID NO: 658366 - DNA, 25 bp, Mus musculus
ggttgtacaacaatctgtctctcaa

SEQ ID NO: 658367 - DNA, 25 bp, Mus musculus
ggttgtacaacattctgtctctcaa

SEQ ID NO: 658368 - DNA, 25 bp, Mus musculus
ggttgtacaacccactgctgcagcg

SEQ ID NO: 658369 - DNA, 25 bp, Mus musculus
ggttgtacaaccgactgctgcagcg

SEQ ID NO: 658370 - DNA, 25 bp, Mus musculus
ggttgtacagacacctgtgaatatt

SEQ ID NO: 658371 - DNA, 25 bp, Mus musculus
ggttgtacagactcctgtgaatatt

SEQ ID NO: 658372 - DNA, 25 bp, Mus musculus
ggttgtacagatacttctcgttagg

SEQ ID NO: 658373 - DNA, 25 bp, Mus musculus
ggttgtacagattcttctcgttagg

SEQ ID NO: 658374 - DNA, 25 bp, Mus musculus
ggttgtacagttagggatcccatga

SEQ ID NO: 658375 - DNA, 25 bp, Mus musculus
ggttgtacagtttgggatcccatga

SEQ ID NO: 658376 - DNA, 25 bp, Mus musculus
ggttgtacatatctccacactatag

SEQ ID NO: 658377 - DNA, 25 bp, Mus musculus
ggttgtacatatgtccacactatag

SEQ ID NO: 658378 - DNA, 25 bp, Mus musculus
ggttgtaccccgattagatggtgag

SEQ ID NO: 658379 - DNA, 25 bp, Mus musculus
ggttgtaccccgtttagatggtgag

SEQ ID NO: 658380 - DNA, 25 bp, Mus musculus
ggttgtaccgtgctctttgaattat

SEQ ID NO: 658381 - DNA, 25 bp, Mus musculus
ggttgtaccgtggtctttgaattat

SEQ ID NO: 658382 - DNA, 25 bp, Mus musculus
ggttgtactagaatagattaccaag

SEQ ID NO: 658383 - DNA, 25 bp, Mus musculus
ggttgtactagattagattaccaag

SEQ ID NO: 658384 - DNA, 25 bp, Mus musculus
ggttgtactcatagtatttacaaag

SEQ ID NO: 658385 - DNA, 25 bp, Mus musculus
ggttgtactcattgtatttacaaag

SEQ ID NO: 658386 - DNA, 25 bp, Mus musculus
ggttgtagcccaaccaactttaaag

SEQ ID NO: 658387 - DNA, 25 bp, Mus musculus
ggttgtagcccatccaactttaaag

SEQ ID NO: 658388 - DNA, 25 bp, Mus musculus
ggttgtaggcataggatgttttcca

SEQ ID NO: 658389 - DNA, 25 bp, Mus musculus
ggttgtaggcattggatgttttcca

SEQ ID NO: 658390 - DNA, 25 bp, Mus musculus
ggttgtaggccaacatgtggatgct

SEQ ID NO: 658391 - DNA, 25 bp, Mus musculus
ggttgtaggccatcatgtggatgct

SEQ ID NO: 658392 - DNA, 25 bp, Mus musculus
ggttgtaggcctcttttgtatataa

SEQ ID NO: 658393 - DNA, 25 bp, Mus musculus
ggttgtaggcctgttttgtatataa

SEQ ID NO: 658394 - DNA, 25 bp, Mus musculus
ggttgtagtatcacagttcctggaa

SEQ ID NO: 658395 - DNA, 25 bp, Mus musculus
ggttgtagtatctcagttcctggaa

SEQ ID NO: 658396 - DNA, 25 bp, Mus musculus
ggttgtagtttcagctaccaccctt

SEQ ID NO: 658397 - DNA, 25 bp, Mus musculus
ggttgtagtttctgctaccaccctt

SEQ ID NO: 658398 - DNA, 25 bp, Mus musculus
ggttgtataaacctcagtgtccata

SEQ ID NO: 658399 - DNA, 25 bp, Mus musculus
ggttgtataaacgtcagtgtccata

SEQ ID NO: 658400 - DNA, 25 bp, Mus musculus
ggttgtataatgctgagcgccacat

SEQ ID NO: 658401 - DNA, 25 bp, Mus musculus
ggttgtataatggtgagcgccacat

SEQ ID NO: 658402 - DNA, 25 bp, Mus musculus
ggttgtataccaccaaggcttttgc

SEQ ID NO: 658403 - DNA, 25 bp, Mus musculus
ggttgtataccagcaaggcttttgc

SEQ ID NO: 658404 - DNA, 25 bp, Mus musculus
ggttgtataccgaaaatgctactaa

SEQ ID NO: 658405 - DNA, 25 bp, Mus musculus
ggttgtataccgtaaatgctactaa

SEQ ID NO: 658406 - DNA, 25 bp, Mus musculus
ggttgtatctgtaacttctttctct

SEQ ID NO: 658407 - DNA, 25 bp, Mus musculus
ggttgtatctgttacttctttctct

SEQ ID NO: 658408 - DNA, 25 bp, Mus musculus
ggttgtatgctcctagaatttctca

SEQ ID NO: 658409 - DNA, 25 bp, Mus musculus
ggttgtatgctcgtagaatttctca

SEQ ID NO: 658410 - DNA, 25 bp, Mus musculus
ggttgtatggctacatcatttggat

SEQ ID NO: 658411 - DNA, 25 bp, Mus musculus
ggttgtatggcttcatcatttggat

SEQ ID NO: 658412 - DNA, 25 bp, Mus musculus
ggttgtatgggacacctcccagctc

SEQ ID NO: 658413 - DNA, 25 bp, Mus musculus
ggttgtatgggagacctcccagctc

SEQ ID NO: 658414 - DNA, 25 bp, Mus musculus
ggttgtatgggtagctccagttcaa

SEQ ID NO: 658415 - DNA, 25 bp, Mus musculus
ggttgtatgggttgctccagttcaa

SEQ ID NO: 658416 - DNA, 25 bp, Mus musculus
ggttgtatttctcctggttgtaatt

SEQ ID NO: 658417 - DNA, 25 bp, Mus musculus
ggttgtatttctgctggttgtaatt

SEQ ID NO: 658418 - DNA, 25 bp, Mus musculus
ggttgtatttttaacgattcagttg

SEQ ID NO: 658419 - DNA, 25 bp, Mus musculus
ggttgtattttttacgattcagttg

SEQ ID NO: 658420 - DNA, 25 bp, Mus musculus
ggttgtcaaaaaagctgccacccac

SEQ ID NO: 658421 - DNA, 25 bp, Mus musculus
ggttgtcaaaaatgctgccacccac

SEQ ID NO: 658422 - DNA, 25 bp, Mus musculus
ggttgtcaagtacatctttgccgaa

SEQ ID NO: 658423 - DNA, 25 bp, Mus musculus
ggttgtcaagtacctctgcagtgat

SEQ ID NO: 658424 - DNA, 25 bp, Mus musculus
ggttgtcaagtagatctttgccgaa

SEQ ID NO: 658425 - DNA, 25 bp, Mus musculus
ggttgtcaagtagctctgcagtgat

SEQ ID NO: 658426 - DNA, 25 bp, Mus musculus
ggttgtcaatgcatgttatgtcctt

SEQ ID NO: 658427 - DNA, 25 bp, Mus musculus
ggttgtcaatgcttgttatgtcctt

SEQ ID NO: 658428 - DNA, 25 bp, Mus musculus
ggttgtcacagccacttgatgcaaa

SEQ ID NO: 658429 - DNA, 25 bp, Mus musculus
ggttgtcacagcgacttgatgcaaa

SEQ ID NO: 658430 - DNA, 25 bp, Mus musculus
ggttgtcacatgctaccagcagctg

SEQ ID NO: 658431 - DNA, 25 bp, Mus musculus
ggttgtcacatggtaccagcagctg

SEQ ID NO: 658432 - DNA, 25 bp, Mus musculus
ggttgtcaccataccagcatacggt

SEQ ID NO: 658433 - DNA, 25 bp, Mus musculus
ggttgtcaccattccagcatacggt

SEQ ID NO: 658434 - DNA, 25 bp, Mus musculus
ggttgtcacggcatcattggagccc

SEQ ID NO: 658435 - DNA, 25 bp, Mus musculus
ggttgtcacggcttcattggagccc

SEQ ID NO: 658436 - DNA, 25 bp, Mus musculus
ggttgtcactgacaagcacttctac

SEQ ID NO: 658437 - DNA, 25 bp, Mus musculus
ggttgtcactgagaagcacttctac

SEQ ID NO: 658438 - DNA, 25 bp, Mus musculus
ggttgtcagcagatagcttttttaa

SEQ ID NO: 658439 - DNA, 25 bp, Mus musculus
ggttgtcagcagttagcttttttaa

SEQ ID NO: 658440 - DNA, 25 bp, Mus musculus
ggttgtcagcctctatagcatgtaa

SEQ ID NO: 658441 - DNA, 25 bp, Mus musculus
ggttgtcagcctgtatagcatgtaa

SEQ ID NO: 658442 - DNA, 25 bp, Mus musculus
ggttgtcaggcacagctataagctt

SEQ ID NO: 658443 - DNA, 25 bp, Mus musculus
ggttgtcaggcagagctataagctt

SEQ ID NO: 658444 - DNA, 25 bp, Mus musculus
ggttgtcagtgtaaggtgcattgtc

SEQ ID NO: 658445 - DNA, 25 bp, Mus musculus
ggttgtcagtgttaggtgcattgtc

SEQ ID NO: 658446 - DNA, 25 bp, Mus musculus
ggttgtcatacgatactatggatac

SEQ ID NO: 658447 - DNA, 25 bp, Mus musculus
ggttgtcatacgttactatggatac

SEQ ID NO: 658448 - DNA, 25 bp, Mus musculus
ggttgtcatcagaagccaagcctgt

SEQ ID NO: 658449 - DNA, 25 bp, Mus musculus
ggttgtcatcagtagccaagcctgt

SEQ ID NO: 658450 - DNA, 25 bp, Mus musculus
ggttgtcatcttcaatactactagg

SEQ ID NO: 658451 - DNA, 25 bp, Mus musculus
ggttgtcatcttgaatactactagg

SEQ ID NO: 658452 - DNA, 25 bp, Mus musculus
ggttgtcatggaatatgagaacttg

SEQ ID NO: 658453 - DNA, 25 bp, Mus musculus
ggttgtcatggattatgagaacttg

SEQ ID NO: 658454 - DNA, 25 bp, Mus musculus
ggttgtcattaaccccaactatgaa

SEQ ID NO: 658455 - DNA, 25 bp, Mus musculus
ggttgtcattaagcccaactatgaa

SEQ ID NO: 658456 - DNA, 25 bp, Mus musculus
ggttgtcattggacattggttttgc

SEQ ID NO: 658457 - DNA, 25 bp, Mus musculus
ggttgtcattggtcattggttttgc

SEQ ID NO: 658458 - DNA, 25 bp, Mus musculus
ggttgtcatttcacgattatagaac

SEQ ID NO: 658459 - DNA, 25 bp, Mus musculus
ggttgtcatttctcgattatagaac

SEQ ID NO: 658460 - DNA, 25 bp, Mus musculus
ggttgtccaaatactatctgctcta

SEQ ID NO: 658461 - DNA, 25 bp, Mus musculus
ggttgtccaaattctatctgctcta

SEQ ID NO: 658462 - DNA, 25 bp, Mus musculus
ggttgtccagcaccaagcagtcagc

SEQ ID NO: 658463 - DNA, 25 bp, Mus musculus
ggttgtccagcagcaagcagtcagc

SEQ ID NO: 658464 - DNA, 25 bp, Mus musculus
ggttgtccatgtcaaagcagggcct

SEQ ID NO: 658465 - DNA, 25 bp, Mus musculus
ggttgtccatgtgaaagcagggcct

SEQ ID NO: 658466 - DNA, 25 bp, Mus musculus
ggttgtcccaggctatggccatgca

SEQ ID NO: 658467 - DNA, 25 bp, Mus musculus
ggttgtcccagggtatggccatgca

SEQ ID NO: 658468 - DNA, 25 bp, Mus musculus
ggttgtcccgacacaggttcacagt

SEQ ID NO: 658469 - DNA, 25 bp, Mus musculus
ggttgtcccgactcaggttcacagt

SEQ ID NO: 658470 - DNA, 25 bp, Mus musculus
ggttgtcccgcacctaaggcaggaa

SEQ ID NO: 658471 - DNA, 25 bp, Mus musculus
ggttgtcccgcagctaaggcaggaa

SEQ ID NO: 658472 - DNA, 25 bp, Mus musculus
ggttgtcccttcaaggtgcgtagaa

SEQ ID NO: 658473 - DNA, 25 bp, Mus musculus
ggttgtcccttctaggtgcgtagaa

SEQ ID NO: 658474 - DNA, 25 bp, Mus musculus
ggttgtcctagtcaaacatctttaa

SEQ ID NO: 658475 - DNA, 25 bp, Mus musculus
ggttgtcctagtgaaacatctttaa

SEQ ID NO: 658476 - DNA, 25 bp, Mus musculus
ggttgtcctttacgccttgacgcct

SEQ ID NO: 658477 - DNA, 25 bp, Mus musculus
ggttgtcctttaggccttgacgcct

SEQ ID NO: 658478 - DNA, 25 bp, Mus musculus
ggttgtcgacaaactctcactgtaa

SEQ ID NO: 658479 - DNA, 25 bp, Mus musculus
ggttgtcgacaatctctcactgtaa

SEQ ID NO: 658480 - DNA, 25 bp, Mus musculus
ggttgtctcacactttgcttaatca

SEQ ID NO: 658481 - DNA, 25 bp, Mus musculus
ggttgtctcacagtttgcttaatca

SEQ ID NO: 658482 - DNA, 25 bp, Mus musculus
ggttgtctcaccatagttacagctc

SEQ ID NO: 658483 - DNA, 25 bp, Mus musculus
ggttgtctcaccttagttacagctc

SEQ ID NO: 658484 - DNA, 25 bp, Mus musculus
ggttgtctcactatcctggaattgg

SEQ ID NO: 658485 - DNA, 25 bp, Mus musculus
ggttgtctcactttcctggaattgg

SEQ ID NO: 658486 - DNA, 25 bp, Mus musculus
ggttgtctctataactcctttaact

SEQ ID NO: 658487 - DNA, 25 bp, Mus musculus
ggttgtctctattactcctttaact

SEQ ID NO: 658488 - DNA, 25 bp, Mus musculus
ggttgtctcttcactggaatgatga

SEQ ID NO: 658489 - DNA, 25 bp, Mus musculus
ggttgtctcttctctggaatgatga

SEQ ID NO: 658490 - DNA, 25 bp, Mus musculus
ggttgtctgaaacactatgcagtca

SEQ ID NO: 658491 - DNA, 25 bp, Mus musculus
ggttgtctgaaagactatgcagtca

SEQ ID NO: 658492 - DNA, 25 bp, Mus musculus
ggttgtctgtctctgtaagttctgg

SEQ ID NO: 658493 - DNA, 25 bp, Mus musculus
ggttgtctgtctgtgtaagttctgg

SEQ ID NO: 658494 - DNA, 25 bp, Mus musculus
ggttgtcttcatcttaaaacttgtt

SEQ ID NO: 658495 - DNA, 25 bp, Mus musculus
ggttgtcttcatgttaaaacttgtt

SEQ ID NO: 658496 - DNA, 25 bp, Mus musculus
ggttgtcttttgatcagtcatgtgt

SEQ ID NO: 658497 - DNA, 25 bp, Mus musculus
ggttgtcttttgttcagtcatgtgt

SEQ ID NO: 658498 - DNA, 25 bp, Mus musculus
ggttgtgaaacacttagtcagtcaa

SEQ ID NO: 658499 - DNA, 25 bp, Mus musculus
ggttgtgaaacagttagtcagtcaa

SEQ ID NO: 658500 - DNA, 25 bp, Mus musculus
ggttgtgaagcacagccctactcat

SEQ ID NO: 658501 - DNA, 25 bp, Mus musculus
ggttgtgaagcagagccctactcat

SEQ ID NO: 658502 - DNA, 25 bp, Mus musculus
ggttgtgaatgtatgtgctattcct

SEQ ID NO: 658503 - DNA, 25 bp, Mus musculus
ggttgtgaatgtttgtgctattcct

SEQ ID NO: 658504 - DNA, 25 bp, Mus musculus
ggttgtgacaggacaccctcatgaa

SEQ ID NO: 658505 - DNA, 25 bp, Mus musculus
ggttgtgacaggtcaccctcatgaa

SEQ ID NO: 658506 - DNA, 25 bp, Mus musculus
ggttgtgaccagagaacaccttgaa

SEQ ID NO: 658507 - DNA, 25 bp, Mus musculus
ggttgtgaccagtgaacaccttgaa

SEQ ID NO: 658508 - DNA, 25 bp, Mus musculus
ggttgtgacccaaaactcactgagg

SEQ ID NO: 658509 - DNA, 25 bp, Mus musculus
ggttgtgacccataactcactgagg

SEQ ID NO: 658510 - DNA, 25 bp, Mus musculus
ggttgtgacgtcagtttctgtggaa

SEQ ID NO: 658511 - DNA, 25 bp, Mus musculus
ggttgtgacgtctgtttctgtggaa

SEQ ID NO: 658512 - DNA, 25 bp, Mus musculus
ggttgtgacttaagatgcttatgta

SEQ ID NO: 658513 - DNA, 25 bp, Mus musculus
ggttgtgacttatgatgcttatgta

SEQ ID NO: 658514 - DNA, 25 bp, Mus musculus
ggttgtgagaacagccttactggat

SEQ ID NO: 658515 - DNA, 25 bp, Mus musculus
ggttgtgagaactgccttactggat

SEQ ID NO: 658516 - DNA, 25 bp, Mus musculus
ggttgtgagagcaccactgctctaa

SEQ ID NO: 658517 - DNA, 25 bp, Mus musculus
ggttgtgagagctccactgctctaa

SEQ ID NO: 658518 - DNA, 25 bp, Mus musculus
ggttgtgagatactgcactgacctc

SEQ ID NO: 658519 - DNA, 25 bp, Mus musculus
ggttgtgagatagtgcactgacctc

SEQ ID NO: 658520 - DNA, 25 bp, Mus musculus
ggttgtgagcacatccatcatttat

SEQ ID NO: 658521 - DNA, 25 bp, Mus musculus
ggttgtgagcacttccatcatttat

SEQ ID NO: 658522 - DNA, 25 bp, Mus musculus
ggttgtgagttcaaaggcagcctaa

SEQ ID NO: 658523 - DNA, 25 bp, Mus musculus
ggttgtgagttctaaggcagcctaa

SEQ ID NO: 658524 - DNA, 25 bp, Mus musculus
ggttgtgagttgatttttcccatta

SEQ ID NO: 658525 - DNA, 25 bp, Mus musculus
ggttgtgagttgttttttcccatta

SEQ ID NO: 658526 - DNA, 25 bp, Mus musculus
ggttgtgataaccatttcagaagtc

SEQ ID NO: 658527 - DNA, 25 bp, Mus musculus
ggttgtgataacgatttcagaagtc

SEQ ID NO: 658528 - DNA, 25 bp, Mus musculus
ggttgtgatcatctttcgtttattc

SEQ ID NO: 658529 - DNA, 25 bp, Mus musculus
ggttgtgatcatgtttcgtttattc

SEQ ID NO: 658530 - DNA, 25 bp, Mus musculus
ggttgtgattatagccattttgttc

SEQ ID NO: 658531 - DNA, 25 bp, Mus musculus
ggttgtgattattgccattttgttc

SEQ ID NO: 658532 - DNA, 25 bp, Mus musculus
ggttgtgcacagcagtgttcaaaac

SEQ ID NO: 658533 - DNA, 25 bp, Mus musculus
ggttgtgcacaggagtgttcaaaac

SEQ ID NO: 658534 - DNA, 25 bp, Mus musculus
ggttgtgcagataagactttccagt

SEQ ID NO: 658535 - DNA, 25 bp, Mus musculus
ggttgtgcagatatgtctgtcttca

SEQ ID NO: 658536 - DNA, 25 bp, Mus musculus
ggttgtgcagattagactttccagt

SEQ ID NO: 658537 - DNA, 25 bp, Mus musculus
ggttgtgcagatttgtctgtcttca

SEQ ID NO: 658538 - DNA, 25 bp, Mus musculus
ggttgtgcagtaatggtcaccacgg

SEQ ID NO: 658539 - DNA, 25 bp, Mus musculus
ggttgtgcagtattggtcaccacgg

SEQ ID NO: 658540 - DNA, 25 bp, Mus musculus
ggttgtgcatgcatgacccagcggc

SEQ ID NO: 658541 - DNA, 25 bp, Mus musculus
ggttgtgcatgcttgacccagcggc

SEQ ID NO: 658542 - DNA, 25 bp, Mus musculus
ggttgtgccattaagagccactgta

SEQ ID NO: 658543 - DNA, 25 bp, Mus musculus
ggttgtgccatttagagccactgta

SEQ ID NO: 658544 - DNA, 25 bp, Mus musculus
ggttgtgcccaaaacaattctttgg

SEQ ID NO: 658545 - DNA, 25 bp, Mus musculus
ggttgtgcccaatacaattctttgg

SEQ ID NO: 658546 - DNA, 25 bp, Mus musculus
ggttgtgcgcataggcaagtcattt

SEQ ID NO: 658547 - DNA, 25 bp, Mus musculus
ggttgtgcgcattggcaagtcattt

SEQ ID NO: 658548 - DNA, 25 bp, Mus musculus
ggttgtgctcaacgccaaacagtca

SEQ ID NO: 658549 - DNA, 25 bp, Mus musculus
ggttgtgctcaaggccaaacagtca

SEQ ID NO: 658550 - DNA, 25 bp, Mus musculus
ggttgtgctgatagacagtcacact

SEQ ID NO: 658551 - DNA, 25 bp, Mus musculus
ggttgtgctgattgacagtcacact

SEQ ID NO: 658552 - DNA, 25 bp, Mus musculus
ggttgtggaccaatgatctaagctc

SEQ ID NO: 658553 - DNA, 25 bp, Mus musculus
ggttgtggaccattgatctaagctc

SEQ ID NO: 658554 - DNA, 25 bp, Mus musculus
ggttgtggatctacagaattcagac

SEQ ID NO: 658555 - DNA, 25 bp, Mus musculus
ggttgtggatcttcagaattcagac

SEQ ID NO: 658556 - DNA, 25 bp, Mus musculus
ggttgtggatggacactgctcatat

SEQ ID NO: 658557 - DNA, 25 bp, Mus musculus
ggttgtggatggtcactgctcatat

SEQ ID NO: 658558 - DNA, 25 bp, Mus musculus
ggttgtggcaaaaccactcaggtta

SEQ ID NO: 658559 - DNA, 25 bp, Mus musculus
ggttgtggcaaatccactcaggtta

SEQ ID NO: 658560 - DNA, 25 bp, Mus musculus
ggttgtggccaacatgatcttcttg

SEQ ID NO: 658561 - DNA, 25 bp, Mus musculus
ggttgtggccaagatgatcttcttg

SEQ ID NO: 658562 - DNA, 25 bp, Mus musculus
ggttgtggccacacgctaagattat

SEQ ID NO: 658563 - DNA, 25 bp, Mus musculus
ggttgtggccactcgctaagattat

SEQ ID NO: 658564 - DNA, 25 bp, Mus musculus
ggttgtggcgagattgtcttttcaa

SEQ ID NO: 658565 - DNA, 25 bp, Mus musculus
ggttgtggcgagtttgtcttttcaa

SEQ ID NO: 658566 - DNA, 25 bp, Mus musculus
ggttgtgggatcatacattcaagtc

SEQ ID NO: 658567 - DNA, 25 bp, Mus musculus
ggttgtgggatcttacattcaagtc

SEQ ID NO: 658568 - DNA, 25 bp, Mus musculus
ggttgtgggcaacaccatgtgcacc

SEQ ID NO: 658569 - DNA, 25 bp, Mus musculus
ggttgtgggcaagaccatgtgcacc

SEQ ID NO: 658570 - DNA, 25 bp, Mus musculus
ggttgtgggcctaagaagtcttcac

SEQ ID NO: 658571 - DNA, 25 bp, Mus musculus
ggttgtgggccttagaagtcttcac

SEQ ID NO: 658572 - DNA, 25 bp, Mus musculus
ggttgtggtacacgtgcctgttcat

SEQ ID NO: 658573 - DNA, 25 bp, Mus musculus
ggttgtggtacaggtgcctgttcat

SEQ ID NO: 658574 - DNA, 25 bp, Mus musculus
ggttgtggtttacatccacactgga

SEQ ID NO: 658575 - DNA, 25 bp, Mus musculus
ggttgtggtttagatccacactgga

SEQ ID NO: 658576 - DNA, 25 bp, Mus musculus
ggttgtgtaactcaccattccctac

SEQ ID NO: 658577 - DNA, 25 bp, Mus musculus
ggttgtgtaactgaccattccctac

SEQ ID NO: 658578 - DNA, 25 bp, Mus musculus
ggttgtgtacaaagcttgcctgtca

SEQ ID NO: 658579 - DNA, 25 bp, Mus musculus
ggttgtgtacaacaggtctgtccca

SEQ ID NO: 658580 - DNA, 25 bp, Mus musculus
ggttgtgtacaagaggtctgtccca

SEQ ID NO: 658581 - DNA, 25 bp, Mus musculus
ggttgtgtacaatgcttgcctgtca

SEQ ID NO: 658582 - DNA, 25 bp, Mus musculus
ggttgtgtacataaaggcctcatag

SEQ ID NO: 658583 - DNA, 25 bp, Mus musculus
ggttgtgtacattaaggcctcatag

SEQ ID NO: 658584 - DNA, 25 bp, Mus musculus
ggttgtgtacccattgcaaacgcag

SEQ ID NO: 658585 - DNA, 25 bp, Mus musculus
ggttgtgtaccctttgcaaacgcag

SEQ ID NO: 658586 - DNA, 25 bp, Mus musculus
ggttgtgtagggatctcagctacca

SEQ ID NO: 658587 - DNA, 25 bp, Mus musculus
ggttgtgtagggttctcagctacca

SEQ ID NO: 658588 - DNA, 25 bp, Mus musculus
ggttgtgtatggctagcactactca

SEQ ID NO: 658589 - DNA, 25 bp, Mus musculus
ggttgtgtatgggtagcactactca

SEQ ID NO: 658590 - DNA, 25 bp, Mus musculus
ggttgtgtctttacaagtcatgtac

SEQ ID NO: 658591 - DNA, 25 bp, Mus musculus
ggttgtgtcttttcaagtcatgtac

SEQ ID NO: 658592 - DNA, 25 bp, Mus musculus
ggttgtgtgaccaatggccctcaga

SEQ ID NO: 658593 - DNA, 25 bp, Mus musculus
ggttgtgtgacctatggccctcaga

SEQ ID NO: 658594 - DNA, 25 bp, Mus musculus
ggttgtgtgccaagagtttattact

SEQ ID NO: 658595 - DNA, 25 bp, Mus musculus
ggttgtgtgccatgagtttattact

SEQ ID NO: 658596 - DNA, 25 bp, Mus musculus
ggttgtgtgttaccacatccatgtt

SEQ ID NO: 658597 - DNA, 25 bp, Mus musculus
ggttgtgtgttagcacatccatgtt

SEQ ID NO: 658598 - DNA, 25 bp, Mus musculus
ggttgtgtgttgctttttaacttat

SEQ ID NO: 658599 - DNA, 25 bp, Mus musculus
ggttgtgtgttggtttttaacttat

SEQ ID NO: 658600 - DNA, 25 bp, Mus musculus
ggttgtgttcatcgagaagactaca

SEQ ID NO: 658601 - DNA, 25 bp, Mus musculus
ggttgtgttcatggagaagactaca

SEQ ID NO: 658602 - DNA, 25 bp, Mus musculus
ggttgtgtttctaagcctaattcaa

SEQ ID NO: 658603 - DNA, 25 bp, Mus musculus
ggttgtgtttctaggttctgtttca

SEQ ID NO: 658604 - DNA, 25 bp, Mus musculus
ggttgtgtttcttagcctaattcaa

SEQ ID NO: 658605 - DNA, 25 bp, Mus musculus
ggttgtgtttcttggttctgtttca

SEQ ID NO: 658606 - DNA, 25 bp, Mus musculus
ggttgtgtttgtacttgtgtagagt

SEQ ID NO: 658607 - DNA, 25 bp, Mus musculus
ggttgtgtttgttcttgtgtagagt

SEQ ID NO: 658608 - DNA, 25 bp, Mus musculus
ggttgttaaacaagagcctgcggaa

SEQ ID NO: 658609 - DNA, 25 bp, Mus musculus
ggttgttaaacatgagcctgcggaa

SEQ ID NO: 658610 - DNA, 25 bp, Mus musculus
ggttgttacagacacaagatatttt

SEQ ID NO: 658611 - DNA, 25 bp, Mus musculus
ggttgttacagagacaagatatttt

SEQ ID NO: 658612 - DNA, 25 bp, Mus musculus
ggttgttaccatcaataccctaact

SEQ ID NO: 658613 - DNA, 25 bp, Mus musculus
ggttgttaccatgaataccctaact

SEQ ID NO: 658614 - DNA, 25 bp, Mus musculus
ggttgttactggatagtctcactgt

SEQ ID NO: 658615 - DNA, 25 bp, Mus musculus
ggttgttactggttagtctcactgt

SEQ ID NO: 658616 - DNA, 25 bp, Mus musculus
ggttgttatcaactggcacaagtta

SEQ ID NO: 658617 - DNA, 25 bp, Mus musculus
ggttgttatcaagtggcacaagtta

SEQ ID NO: 658618 - DNA, 25 bp, Mus musculus
ggttgttatccaactcaaggctcag

SEQ ID NO: 658619 - DNA, 25 bp, Mus musculus
ggttgttatccatctcaaggctcag

SEQ ID NO: 658620 - DNA, 25 bp, Mus musculus
ggttgttatccccaagtgtttatat

SEQ ID NO: 658621 - DNA, 25 bp, Mus musculus
ggttgttatcccgaagtgtttatat

SEQ ID NO: 658622 - DNA, 25 bp, Mus musculus
ggttgttcaaacacctttccaggtg

SEQ ID NO: 658623 - DNA, 25 bp, Mus musculus
ggttgttcaaactcctttccaggtg

SEQ ID NO: 658624 - DNA, 25 bp, Mus musculus
ggttgttcaaagagcttacattata

SEQ ID NO: 658625 - DNA, 25 bp, Mus musculus
ggttgttcaaagtgcttacattata

SEQ ID NO: 658626 - DNA, 25 bp, Mus musculus
ggttgttcacttacattgctggctg

SEQ ID NO: 658627 - DNA, 25 bp, Mus musculus
ggttgttcactttcattgctggctg

SEQ ID NO: 658628 - DNA, 25 bp, Mus musculus
ggttgttcagtgacgtccccagaac

SEQ ID NO: 658629 - DNA, 25 bp, Mus musculus
ggttgttcagtgtcgtccccagaac

SEQ ID NO: 658630 - DNA, 25 bp, Mus musculus
ggttgttcattcagtcctcacaaag

SEQ ID NO: 658631 - DNA, 25 bp, Mus musculus
ggttgttcattctgtcctcacaaag

SEQ ID NO: 658632 - DNA, 25 bp, Mus musculus
ggttgttccaagatgtgtggcccag

SEQ ID NO: 658633 - DNA, 25 bp, Mus musculus
ggttgttccaagttgtgtggcccag

SEQ ID NO: 658634 - DNA, 25 bp, Mus musculus
ggttgttcccatagcactatggaca

SEQ ID NO: 658635 - DNA, 25 bp, Mus musculus
ggttgttcccattgcactatggaca

SEQ ID NO: 658636 - DNA, 25 bp, Mus musculus
ggttgttccctcatccaaacaaatg

SEQ ID NO: 658637 - DNA, 25 bp, Mus musculus
ggttgttccctcttccaaacaaatg

SEQ ID NO: 658638 - DNA, 25 bp, Mus musculus
ggttgttcctatataccttctgtaa

SEQ ID NO: 658639 - DNA, 25 bp, Mus musculus
ggttgttcctatttaccttctgtaa

SEQ ID NO: 658640 - DNA, 25 bp, Mus musculus
ggttgttctcagagatgggcctgct

SEQ ID NO: 658641 - DNA, 25 bp, Mus musculus
ggttgttctcagtgatgggcctgct

SEQ ID NO: 658642 - DNA, 25 bp, Mus musculus
ggttgttctgatcttatcaattaca

SEQ ID NO: 658643 - DNA, 25 bp, Mus musculus
ggttgttctgatgttatcaattaca

SEQ ID NO: 658644 - DNA, 25 bp, Mus musculus
ggttgttctggaattctctcatcat

SEQ ID NO: 658645 - DNA, 25 bp, Mus musculus
ggttgttctggatttctctcatcat

SEQ ID NO: 658646 - DNA, 25 bp, Mus musculus
ggttgttctggcaattgactctttt

SEQ ID NO: 658647 - DNA, 25 bp, Mus musculus
ggttgttctggctattgactctttt

SEQ ID NO: 658648 - DNA, 25 bp, Mus musculus
ggttgttcttagcaggacagcaagt

SEQ ID NO: 658649 - DNA, 25 bp, Mus musculus
ggttgttcttaggaggacagcaagt

SEQ ID NO: 658650 - DNA, 25 bp, Mus musculus
ggttgttcttttccacactgcaggg

SEQ ID NO: 658651 - DNA, 25 bp, Mus musculus
ggttgttcttttgcacactgcaggg

SEQ ID NO: 658652 - DNA, 25 bp, Mus musculus
ggttgttgagacatccactttggaa

SEQ ID NO: 658653 - DNA, 25 bp, Mus musculus
ggttgttgagacttccactttggaa

SEQ ID NO: 658654 - DNA, 25 bp, Mus musculus
ggttgttgatgcaaacccttcccaa

SEQ ID NO: 658655 - DNA, 25 bp, Mus musculus
ggttgttgatgctaacccttcccaa

SEQ ID NO: 658656 - DNA, 25 bp, Mus musculus
ggttgttgattgatttcacaatttg

SEQ ID NO: 658657 - DNA, 25 bp, Mus musculus
ggttgttgattgttttcacaatttg

SEQ ID NO: 658658 - DNA, 25 bp, Mus musculus
ggttgttgcatacaggccatcttcc

SEQ ID NO: 658659 - DNA, 25 bp, Mus musculus
ggttgttgcatagaggccatcttcc

SEQ ID NO: 658660 - DNA, 25 bp, Mus musculus
ggttgttgccatattccacttggga

SEQ ID NO: 658661 - DNA, 25 bp, Mus musculus
ggttgttgccattttccacttggga

SEQ ID NO: 658662 - DNA, 25 bp, Mus musculus
ggttgttgccgtaagtcagtggcat

SEQ ID NO: 658663 - DNA, 25 bp, Mus musculus
ggttgttgccgttagtcagtggcat

SEQ ID NO: 658664 - DNA, 25 bp, Mus musculus
ggttgttgcctcacttagttaagac

SEQ ID NO: 658665 - DNA, 25 bp, Mus musculus
ggttgttgcctctcttagttaagac

SEQ ID NO: 658666 - DNA, 25 bp, Mus musculus
ggttgttgctaaaacaggcattgct

SEQ ID NO: 658667 - DNA, 25 bp, Mus musculus
ggttgttgctaatacaggcattgct

SEQ ID NO: 658668 - DNA, 25 bp, Mus musculus
ggttgttggattaccagctacttcc

SEQ ID NO: 658669 - DNA, 25 bp, Mus musculus
ggttgttggatttccagctacttcc

SEQ ID NO: 658670 - DNA, 25 bp, Mus musculus
ggttgttggtacatcccaggatata

SEQ ID NO: 658671 - DNA, 25 bp, Mus musculus
ggttgttggtacttcccaggatata

SEQ ID NO: 658672 - DNA, 25 bp, Mus musculus
ggttgttggtttcttacagctgacc

SEQ ID NO: 658673 - DNA, 25 bp, Mus musculus
ggttgttggtttgttacagctgacc

SEQ ID NO: 658674 - DNA, 25 bp, Mus musculus
ggttgttgtgagcactccatgagct

SEQ ID NO: 658675 - DNA, 25 bp, Mus musculus
ggttgttgtgaggactccatgagct

SEQ ID NO: 658676 - DNA, 25 bp, Mus musculus
ggttgtttaatgcaaaatgtccagc

SEQ ID NO: 658677 - DNA, 25 bp, Mus musculus
ggttgtttaatggaaaatgtccagc

SEQ ID NO: 658678 - DNA, 25 bp, Mus musculus
ggttgtttactaattctgtatgcat

SEQ ID NO: 658679 - DNA, 25 bp, Mus musculus
ggttgtttactacaatccaactgcc

SEQ ID NO: 658680 - DNA, 25 bp, Mus musculus
ggttgtttactagaatccaactgcc

SEQ ID NO: 658681 - DNA, 25 bp, Mus musculus
ggttgtttactatttctgtatgcat

SEQ ID NO: 658682 - DNA, 25 bp, Mus musculus
ggttgtttagagaagcagcactcca

SEQ ID NO: 658683 - DNA, 25 bp, Mus musculus
ggttgtttagagtagcagcactcca

SEQ ID NO: 658684 - DNA, 25 bp, Mus musculus
ggttgtttagttcgcaacactgccc

SEQ ID NO: 658685 - DNA, 25 bp, Mus musculus
ggttgtttagttggcaacactgccc

SEQ ID NO: 658686 - DNA, 25 bp, Mus musculus
ggttgtttattgctcacatgtgccc

SEQ ID NO: 658687 - DNA, 25 bp, Mus musculus
ggttgtttattggtcacatgtgccc

SEQ ID NO: 658688 - DNA, 25 bp, Mus musculus
ggttgtttcaggacccatctgattc

SEQ ID NO: 658689 - DNA, 25 bp, Mus musculus
ggttgtttcaggtcccatctgattc

SEQ ID NO: 658690 - DNA, 25 bp, Mus musculus
ggttgtttccccaactttgctctca

SEQ ID NO: 658691 - DNA, 25 bp, Mus musculus
ggttgtttcccctactttgctctca

SEQ ID NO: 658692 - DNA, 25 bp, Mus musculus
ggttgtttcggtcataacattttct

SEQ ID NO: 658693 - DNA, 25 bp, Mus musculus
ggttgtttcggtgataacattttct

SEQ ID NO: 658694 - DNA, 25 bp, Mus musculus
ggttgtttctagacccacagggatt

SEQ ID NO: 658695 - DNA, 25 bp, Mus musculus
ggttgtttctagtcccacagggatt

SEQ ID NO: 658696 - DNA, 25 bp, Mus musculus
ggttgtttctggcttttcagggcct

SEQ ID NO: 658697 - DNA, 25 bp, Mus musculus
ggttgtttctgggttttcagggcct

SEQ ID NO: 658698 - DNA, 25 bp, Mus musculus
ggttgtttcttccataagcctaagg

SEQ ID NO: 658699 - DNA, 25 bp, Mus musculus
ggttgtttcttcgataagcctaagg

SEQ ID NO: 658700 - DNA, 25 bp, Mus musculus
ggttgtttcttgctgcttttagtca

SEQ ID NO: 658701 - DNA, 25 bp, Mus musculus
ggttgtttcttggtgcttttagtca

SEQ ID NO: 658702 - DNA, 25 bp, Mus musculus
ggttgtttgaccaccacatgtgggc

SEQ ID NO: 658703 - DNA, 25 bp, Mus musculus
ggttgtttgacctccacatgtgggc

SEQ ID NO: 658704 - DNA, 25 bp, Mus musculus
ggttgtttgagacatattttcttgt

SEQ ID NO: 658705 - DNA, 25 bp, Mus musculus
ggttgtttgagagatattttcttgt

SEQ ID NO: 658706 - DNA, 25 bp, Mus musculus
ggttgtttgagccagatccgttaaa

SEQ ID NO: 658707 - DNA, 25 bp, Mus musculus
ggttgtttgagcgagatccgttaaa

SEQ ID NO: 658708 - DNA, 25 bp, Mus musculus
ggttgtttgaggattcagtctgtta

SEQ ID NO: 658709 - DNA, 25 bp, Mus musculus
ggttgtttgaggtttcagtctgtta

SEQ ID NO: 658710 - DNA, 25 bp, Mus musculus
ggttgtttgatgctgtttacccaga

SEQ ID NO: 658711 - DNA, 25 bp, Mus musculus
ggttgtttgatggtgtttacccaga

SEQ ID NO: 658712 - DNA, 25 bp, Mus musculus
ggttgtttgcatatgctctgctcca

SEQ ID NO: 658713 - DNA, 25 bp, Mus musculus
ggttgtttgcatttgctctgctcca

SEQ ID NO: 658714 - DNA, 25 bp, Mus musculus
ggttgtttggttctttggtacatca

SEQ ID NO: 658715 - DNA, 25 bp, Mus musculus
ggttgtttggttgtttggtacatca

SEQ ID NO: 658716 - DNA, 25 bp, Mus musculus
ggttgtttgtagatgcttgctttgc

SEQ ID NO: 658717 - DNA, 25 bp, Mus musculus
ggttgtttgtagttgcttgctttgc

SEQ ID NO: 658718 - DNA, 25 bp, Mus musculus
ggttgtttgtcccagtcagtggaaa

SEQ ID NO: 658719 - DNA, 25 bp, Mus musculus
ggttgtttgtccgagtcagtggaaa

SEQ ID NO: 658720 - DNA, 25 bp, Mus musculus
ggttgtttgtgtatcacttttccca

SEQ ID NO: 658721 - DNA, 25 bp, Mus musculus
ggttgtttgtgtttcacttttccca

SEQ ID NO: 658722 - DNA, 25 bp, Mus musculus
ggttgtttgttgcttcaggctccac

SEQ ID NO: 658723 - DNA, 25 bp, Mus musculus
ggttgtttgttggttcaggctccac

SEQ ID NO: 658724 - DNA, 25 bp, Mus musculus
ggttgttttaagatgttcaagatag

SEQ ID NO: 658725 - DNA, 25 bp, Mus musculus
ggttgttttaagttgttcaagatag

SEQ ID NO: 658726 - DNA, 25 bp, Mus musculus
ggttgttttgaacgcactgtccagg

SEQ ID NO: 658727 - DNA, 25 bp, Mus musculus
ggttgttttgaaggcactgtccagg

SEQ ID NO: 658728 - DNA, 25 bp, Mus musculus
ggttgtttttacacactgcagtgtc

SEQ ID NO: 658729 - DNA, 25 bp, Mus musculus
ggttgtttttactcactgcagtgtc

SEQ ID NO: 658730 - DNA, 25 bp, Mus musculus
ggttgtttttcaagctatgcaccag

SEQ ID NO: 658731 - DNA, 25 bp, Mus musculus
ggttgtttttcatgctatgcaccag

SEQ ID NO: 658732 - DNA, 25 bp, Mus musculus
ggtttaaacttcatatctgagagga

SEQ ID NO: 658733 - DNA, 25 bp, Mus musculus
ggtttaaacttcttatctgagagga

SEQ ID NO: 658734 - DNA, 25 bp, Mus musculus
ggtttaaagcccctcagaagaatca

SEQ ID NO: 658735 - DNA, 25 bp, Mus musculus
ggtttaaagcccgtcagaagaatca

SEQ ID NO: 658736 - DNA, 25 bp, Mus musculus
ggtttaaagctcaggcaatgcctta

SEQ ID NO: 658737 - DNA, 25 bp, Mus musculus
ggtttaaagctctggcaatgcctta

SEQ ID NO: 658738 - DNA, 25 bp, Mus musculus
ggtttaacaaatccacaatctactg

SEQ ID NO: 658739 - DNA, 25 bp, Mus musculus
ggtttaacaaatgcacaatctactg

SEQ ID NO: 658740 - DNA, 25 bp, Mus musculus
ggtttaacaactcccagttcatggg

SEQ ID NO: 658741 - DNA, 25 bp, Mus musculus
ggtttaacaactgccagttcatggg

SEQ ID NO: 658742 - DNA, 25 bp, Mus musculus
ggtttaacaagcagcctcttacaaa

SEQ ID NO: 658743 - DNA, 25 bp, Mus musculus
ggtttaacaagctgcctcttacaaa

SEQ ID NO: 658744 - DNA, 25 bp, Mus musculus
ggtttaacacaccacattttgtcta

SEQ ID NO: 658745 - DNA, 25 bp, Mus musculus
ggtttaacacacgacattttgtcta

SEQ ID NO: 658746 - DNA, 25 bp, Mus musculus
ggtttaacatacacagcgatctctt

SEQ ID NO: 658747 - DNA, 25 bp, Mus musculus
ggtttaacatactcagcgatctctt

SEQ ID NO: 658748 - DNA, 25 bp, Mus musculus
ggtttaactgccacaagcttgattt

SEQ ID NO: 658749 - DNA, 25 bp, Mus musculus
ggtttaactgcctcaagcttgattt

SEQ ID NO: 658750 - DNA, 25 bp, Mus musculus
ggtttaacttataagccagcaggct

SEQ ID NO: 658751 - DNA, 25 bp, Mus musculus
ggtttaacttattagccagcaggct

SEQ ID NO: 658752 - DNA, 25 bp, Mus musculus
ggtttaagacaacagttcccacaga

SEQ ID NO: 658753 - DNA, 25 bp, Mus musculus
ggtttaagacaagagttcccacaga

SEQ ID NO: 658754 - DNA, 25 bp, Mus musculus
ggtttaagatcacaacgcgcttccg

SEQ ID NO: 658755 - DNA, 25 bp, Mus musculus
ggtttaagatcagaacgcgcttccg

SEQ ID NO: 658756 - DNA, 25 bp, Mus musculus
ggtttaagcaaccactattcagttt

SEQ ID NO: 658757 - DNA, 25 bp, Mus musculus
ggtttaagcaaccagctcaggatat

SEQ ID NO: 658758 - DNA, 25 bp, Mus musculus
ggtttaagcaacgactattcagttt

SEQ ID NO: 658759 - DNA, 25 bp, Mus musculus
ggtttaagcaacgagctcaggatat

SEQ ID NO: 658760 - DNA, 25 bp, Mus musculus
ggtttaagctcacacctagatttag

SEQ ID NO: 658761 - DNA, 25 bp, Mus musculus
ggtttaagctcagacctagatttag

SEQ ID NO: 658762 - DNA, 25 bp, Mus musculus
ggtttaagtaagatcatggtcacaa

SEQ ID NO: 658763 - DNA, 25 bp, Mus musculus
ggtttaagtaagttcatggtcacaa

SEQ ID NO: 658764 - DNA, 25 bp, Mus musculus
ggtttaagttccacatagccaacat

SEQ ID NO: 658765 - DNA, 25 bp, Mus musculus
ggtttaagttcctcatagccaacat

SEQ ID NO: 658766 - DNA, 25 bp, Mus musculus
ggtttaatctctagcacctacatgg

SEQ ID NO: 658767 - DNA, 25 bp, Mus musculus
ggtttaatctcttgcacctacatgg

SEQ ID NO: 658768 - DNA, 25 bp, Mus musculus
ggtttaatctggaacaaacaggcag

SEQ ID NO: 658769 - DNA, 25 bp, Mus musculus
ggtttaatctggtacaaacaggcag

SEQ ID NO: 658770 - DNA, 25 bp, Mus musculus
ggtttaatcttcatcagcttcgcaa

SEQ ID NO: 658771 - DNA, 25 bp, Mus musculus
ggtttaatcttcttcagcttcgcaa

SEQ ID NO: 658772 - DNA, 25 bp, Mus musculus
ggtttaattttgattctctgacttt

SEQ ID NO: 658773 - DNA, 25 bp, Mus musculus
ggtttaattttgtttctctgacttt

SEQ ID NO: 658774 - DNA, 25 bp, Mus musculus
ggtttacactgtcttccagttcaag

SEQ ID NO: 658775 - DNA, 25 bp, Mus musculus
ggtttacactgtgttccagttcaag

SEQ ID NO: 658776 - DNA, 25 bp, Mus musculus
ggtttacagaacaagctccagcaca

SEQ ID NO: 658777 - DNA, 25 bp, Mus musculus
ggtttacagaactagctccagcaca

SEQ ID NO: 658778 - DNA, 25 bp, Mus musculus
ggtttacaggcactgatggacacag

SEQ ID NO: 658779 - DNA, 25 bp, Mus musculus
ggtttacaggcagtgatggacacag

SEQ ID NO: 658780 - DNA, 25 bp, Mus musculus
ggtttacagtccaaggctatacaga

SEQ ID NO: 658781 - DNA, 25 bp, Mus musculus
ggtttacagtcctaggctatacaga

SEQ ID NO: 658782 - DNA, 25 bp, Mus musculus
ggtttacagtttactcatcccagag

SEQ ID NO: 658783 - DNA, 25 bp, Mus musculus
ggtttacagttttctcatcccagag

SEQ ID NO: 658784 - DNA, 25 bp, Mus musculus
ggtttacatagacatgggtcctgtt

SEQ ID NO: 658785 - DNA, 25 bp, Mus musculus
ggtttacatagagatgggtcctgtt

SEQ ID NO: 658786 - DNA, 25 bp, Mus musculus
ggtttacatagcaagctctaggtca

SEQ ID NO: 658787 - DNA, 25 bp, Mus musculus
ggtttacatagctagctctaggtca

SEQ ID NO: 658788 - DNA, 25 bp, Mus musculus
ggtttacatatgattttgtcacaaa

SEQ ID NO: 658789 - DNA, 25 bp, Mus musculus
ggtttacatatgtttttgtcacaaa

SEQ ID NO: 658790 - DNA, 25 bp, Mus musculus
ggtttacatctcaactcacgtatct

SEQ ID NO: 658791 - DNA, 25 bp, Mus musculus
ggtttacatctctactcacgtatct

SEQ ID NO: 658792 - DNA, 25 bp, Mus musculus
ggtttaccctgcaaacgtaggtgct

SEQ ID NO: 658793 - DNA, 25 bp, Mus musculus
ggtttaccctgctaacgtaggtgct

SEQ ID NO: 658794 - DNA, 25 bp, Mus musculus
ggtttacctggtacccggctgtgtg

SEQ ID NO: 658795 - DNA, 25 bp, Mus musculus
ggtttacctggttcccggctgtgtg

SEQ ID NO: 658796 - DNA, 25 bp, Mus musculus
ggtttacctgtgagcaggccttgca

SEQ ID NO: 658797 - DNA, 25 bp, Mus musculus
ggtttacctgtgtgcaggccttgca

SEQ ID NO: 658798 - DNA, 25 bp, Mus musculus
ggtttactaaggcttggtctctgtg

SEQ ID NO: 658799 - DNA, 25 bp, Mus musculus
ggtttactaagggttggtctctgtg

SEQ ID NO: 658800 - DNA, 25 bp, Mus musculus
ggtttactctacaaactgtgcacct

SEQ ID NO: 658801 - DNA, 25 bp, Mus musculus
ggtttactctacattctaacaccag

SEQ ID NO: 658802 - DNA, 25 bp, Mus musculus
ggtttactctactaactgtgcacct

SEQ ID NO: 658803 - DNA, 25 bp, Mus musculus
ggtttactctactttctaacaccag

SEQ ID NO: 658804 - DNA, 25 bp, Mus musculus
ggtttactgaccattctgacgcagg

SEQ ID NO: 658805 - DNA, 25 bp, Mus musculus
ggtttactgacctttctgacgcagg

SEQ ID NO: 658806 - DNA, 25 bp, Mus musculus
ggtttactgcacagtatggtttatc

SEQ ID NO: 658807 - DNA, 25 bp, Mus musculus
ggtttactgcactgtatggtttatc

SEQ ID NO: 658808 - DNA, 25 bp, Mus musculus
ggtttactggcaatcccatttgttc

SEQ ID NO: 658809 - DNA, 25 bp, Mus musculus
ggtttactggcattcccatttgttc

SEQ ID NO: 658810 - DNA, 25 bp, Mus musculus
ggtttacttctcaacattcacatgg

SEQ ID NO: 658811 - DNA, 25 bp, Mus musculus
ggtttacttctctacattcacatgg

SEQ ID NO: 658812 - DNA, 25 bp, Mus musculus
ggtttagacaaactgagtccctcag

SEQ ID NO: 658813 - DNA, 25 bp, Mus musculus
ggtttagacaaagtgagtccctcag

SEQ ID NO: 658814 - DNA, 25 bp, Mus musculus
ggtttagacttcatacgtctgcatt

SEQ ID NO: 658815 - DNA, 25 bp, Mus musculus
ggtttagacttcatgcatcataaat

SEQ ID NO: 658816 - DNA, 25 bp, Mus musculus
ggtttagacttcttacgtctgcatt

SEQ ID NO: 658817 - DNA, 25 bp, Mus musculus
ggtttagacttcttgcatcataaat

SEQ ID NO: 658818 - DNA, 25 bp, Mus musculus
ggtttagagtctacagaggctttgt

SEQ ID NO: 658819 - DNA, 25 bp, Mus musculus
ggtttagagtcttcagaggctttgt

SEQ ID NO: 658820 - DNA, 25 bp, Mus musculus
ggtttagattcaaggattattcctc

SEQ ID NO: 658821 - DNA, 25 bp, Mus musculus
ggtttagattcatggattattcctc

SEQ ID NO: 658822 - DNA, 25 bp, Mus musculus
ggtttagcaccactgatgttttctt

SEQ ID NO: 658823 - DNA, 25 bp, Mus musculus
ggtttagcaccagtgatgttttctt

SEQ ID NO: 658824 - DNA, 25 bp, Mus musculus
ggtttagcctgaatgggcaccctgg

SEQ ID NO: 658825 - DNA, 25 bp, Mus musculus
ggtttagcctgattgggcaccctgg

SEQ ID NO: 658826 - DNA, 25 bp, Mus musculus
ggtttagccttgcatgaccttgaac

SEQ ID NO: 658827 - DNA, 25 bp, Mus musculus
ggtttagccttggatgaccttgaac

SEQ ID NO: 658828 - DNA, 25 bp, Mus musculus
ggtttagcgacaaattccatctggc

SEQ ID NO: 658829 - DNA, 25 bp, Mus musculus
ggtttagcgacatattccatctggc

SEQ ID NO: 658830 - DNA, 25 bp, Mus musculus
ggtttagctaacaactgccagggaa

SEQ ID NO: 658831 - DNA, 25 bp, Mus musculus
ggtttagctaactactgccagggaa

SEQ ID NO: 658832 - DNA, 25 bp, Mus musculus
ggtttagctcatctgcgtagaatac

SEQ ID NO: 658833 - DNA, 25 bp, Mus musculus
ggtttagctcatgtgcgtagaatac

SEQ ID NO: 658834 - DNA, 25 bp, Mus musculus
ggtttagctctgactagatactgga

SEQ ID NO: 658835 - DNA, 25 bp, Mus musculus
ggtttagctctgtctagatactgga

SEQ ID NO: 658836 - DNA, 25 bp, Mus musculus
ggtttagcttaaatgcactacacat

SEQ ID NO: 658837 - DNA, 25 bp, Mus musculus
ggtttagcttaattgcactacacat

SEQ ID NO: 658838 - DNA, 25 bp, Mus musculus
ggtttagcttccaactaagccagca

SEQ ID NO: 658839 - DNA, 25 bp, Mus musculus
ggtttagcttcctactaagccagca

SEQ ID NO: 658840 - DNA, 25 bp, Mus musculus
ggtttagcttgtctgttgccttgaa

SEQ ID NO: 658841 - DNA, 25 bp, Mus musculus
ggtttagcttgtgtgttgccttgaa

SEQ ID NO: 658842 - DNA, 25 bp, Mus musculus
ggtttagggttccatcttaagctct

SEQ ID NO: 658843 - DNA, 25 bp, Mus musculus
ggtttagggttcgatcttaagctct

SEQ ID NO: 658844 - DNA, 25 bp, Mus musculus
ggtttaggtcacattgtatatagaa

SEQ ID NO: 658845 - DNA, 25 bp, Mus musculus
ggtttaggtcactttgtatatagaa

SEQ ID NO: 658846 - DNA, 25 bp, Mus musculus
ggtttagtaattccagagttcttat

SEQ ID NO: 658847 - DNA, 25 bp, Mus musculus
ggtttagtaattgcagagttcttat

SEQ ID NO: 658848 - DNA, 25 bp, Mus musculus
ggtttagtattccagcttcaagtac

SEQ ID NO: 658849 - DNA, 25 bp, Mus musculus
ggtttagtattcgagcttcaagtac

SEQ ID NO: 658850 - DNA, 25 bp, Mus musculus
ggtttagtgaggagaagtctccaaa

SEQ ID NO: 658851 - DNA, 25 bp, Mus musculus
ggtttagtgaggtgaagtctccaaa

SEQ ID NO: 658852 - DNA, 25 bp, Mus musculus
ggtttagtgcttccctgtgatccta

SEQ ID NO: 658853 - DNA, 25 bp, Mus musculus
ggtttagtgcttgcctgtgatccta

SEQ ID NO: 658854 - DNA, 25 bp, Mus musculus
ggtttagtgggaaggctctgactct

SEQ ID NO: 658855 - DNA, 25 bp, Mus musculus
ggtttagtgggatggctctgactct

SEQ ID NO: 658856 - DNA, 25 bp, Mus musculus
ggtttagtgtggacccagcccagaa

SEQ ID NO: 658857 - DNA, 25 bp, Mus musculus
ggtttagtgtggtcccagcccagaa

SEQ ID NO: 658858 - DNA, 25 bp, Mus musculus
ggtttagttagacattcggtctcca

SEQ ID NO: 658859 - DNA, 25 bp, Mus musculus
ggtttagttagagattcggtctcca

SEQ ID NO: 658860 - DNA, 25 bp, Mus musculus
ggtttagttccaccttggactacgt

SEQ ID NO: 658861 - DNA, 25 bp, Mus musculus
ggtttagttccagcttggactacgt

SEQ ID NO: 658862 - DNA, 25 bp, Mus musculus
ggtttataatgtccttttcctctat

SEQ ID NO: 658863 - DNA, 25 bp, Mus musculus
ggtttataatgtgcttttcctctat

SEQ ID NO: 658864 - DNA, 25 bp, Mus musculus
ggtttatacaggactcagcaccaga

SEQ ID NO: 658865 - DNA, 25 bp, Mus musculus
ggtttatacaggtctcagcaccaga

SEQ ID NO: 658866 - DNA, 25 bp, Mus musculus
ggtttatactgacctcatgggtgtt

SEQ ID NO: 658867 - DNA, 25 bp, Mus musculus
ggtttatactgagctcatgggtgtt

SEQ ID NO: 658868 - DNA, 25 bp, Mus musculus
ggtttatactgccttcttgctttaa

SEQ ID NO: 658869 - DNA, 25 bp, Mus musculus
ggtttatactgcgttcttgctttaa

SEQ ID NO: 658870 - DNA, 25 bp, Mus musculus
ggtttatacttgactcatctgaatg

SEQ ID NO: 658871 - DNA, 25 bp, Mus musculus
ggtttatacttgtctcatctgaatg

SEQ ID NO: 658872 - DNA, 25 bp, Mus musculus
ggtttatagtcaccccaagcacatg

SEQ ID NO: 658873 - DNA, 25 bp, Mus musculus
ggtttatagtcagcccaagcacatg

SEQ ID NO: 658874 - DNA, 25 bp, Mus musculus
ggtttatagttacctatgctagcat

SEQ ID NO: 658875 - DNA, 25 bp, Mus musculus
ggtttatagttagctatgctagcat

SEQ ID NO: 658876 - DNA, 25 bp, Mus musculus
ggtttatatcctccattgattcaag

SEQ ID NO: 658877 - DNA, 25 bp, Mus musculus
ggtttatatcctgcattgattcaag

SEQ ID NO: 658878 - DNA, 25 bp, Mus musculus
ggtttatatctgattcgtacttcat

SEQ ID NO: 658879 - DNA, 25 bp, Mus musculus
ggtttatatctgtttcgtacttcat

SEQ ID NO: 658880 - DNA, 25 bp, Mus musculus
ggtttatattcacgagtgctcactc

SEQ ID NO: 658881 - DNA, 25 bp, Mus musculus
ggtttatattcaggagtgctcactc

SEQ ID NO: 658882 - DNA, 25 bp, Mus musculus
ggtttatcacccagatcttgtcaaa

SEQ ID NO: 658883 - DNA, 25 bp, Mus musculus
ggtttatcaccctgatcttgtcaaa

SEQ ID NO: 658884 - DNA, 25 bp, Mus musculus
ggtttatcactaagcaccctgctga

SEQ ID NO: 658885 - DNA, 25 bp, Mus musculus
ggtttatcactatgcaccctgctga

SEQ ID NO: 658886 - DNA, 25 bp, Mus musculus
ggtttatcagacaagctgagagttt

SEQ ID NO: 658887 - DNA, 25 bp, Mus musculus
ggtttatcagactagctgagagttt

SEQ ID NO: 658888 - DNA, 25 bp, Mus musculus
ggtttatcagatcgacccaaaaggt

SEQ ID NO: 658889 - DNA, 25 bp, Mus musculus
ggtttatcagatggacccaaaaggt

SEQ ID NO: 658890 - DNA, 25 bp, Mus musculus
ggtttatcaggtaatcagacttagt

SEQ ID NO: 658891 - DNA, 25 bp, Mus musculus
ggtttatcaggttatcagacttagt

SEQ ID NO: 658892 - DNA, 25 bp, Mus musculus
ggtttatcatacacttcttgtcact

SEQ ID NO: 658893 - DNA, 25 bp, Mus musculus
ggtttatcatactcttcttgtcact

SEQ ID NO: 658894 - DNA, 25 bp, Mus musculus
ggtttatcatctcccacagaagctt

SEQ ID NO: 658895 - DNA, 25 bp, Mus musculus
ggtttatcatctgccacagaagctt

SEQ ID NO: 658896 - DNA, 25 bp, Mus musculus
ggtttatcatgaaccaatttacaat

SEQ ID NO: 658897 - DNA, 25 bp, Mus musculus
ggtttatcatgatccaatttacaat

SEQ ID NO: 658898 - DNA, 25 bp, Mus musculus
ggtttatccagcagtctttcaagaa

SEQ ID NO: 658899 - DNA, 25 bp, Mus musculus
ggtttatccagctgtctttcaagaa

SEQ ID NO: 658900 - DNA, 25 bp, Mus musculus
ggtttatccatactcctgtcagcaa

SEQ ID NO: 658901 - DNA, 25 bp, Mus musculus
ggtttatccatagtcctgtcagcaa

SEQ ID NO: 658902 - DNA, 25 bp, Mus musculus
ggtttatccattagatttccacata

SEQ ID NO: 658903 - DNA, 25 bp, Mus musculus
ggtttatccatttgatttccacata

SEQ ID NO: 658904 - DNA, 25 bp, Mus musculus
ggtttatcccgtcattgctgggatt

SEQ ID NO: 658905 - DNA, 25 bp, Mus musculus
ggtttatcccgtgattgctgggatt

SEQ ID NO: 658906 - DNA, 25 bp, Mus musculus
ggtttatcctggcaatgataatgcg

SEQ ID NO: 658907 - DNA, 25 bp, Mus musculus
ggtttatcctgggaatgataatgcg

SEQ ID NO: 658908 - DNA, 25 bp, Mus musculus
ggtttatctattaagccttgcagtg

SEQ ID NO: 658909 - DNA, 25 bp, Mus musculus
ggtttatctatttagccttgcagtg

SEQ ID NO: 658910 - DNA, 25 bp, Mus musculus
ggtttatctgtcatacttattgccc

SEQ ID NO: 658911 - DNA, 25 bp, Mus musculus
ggtttatctgtcttacttattgccc

SEQ ID NO: 658912 - DNA, 25 bp, Mus musculus
ggtttatcttataccttgaacacta

SEQ ID NO: 658913 - DNA, 25 bp, Mus musculus
ggtttatcttattccttgaacacta

SEQ ID NO: 658914 - DNA, 25 bp, Mus musculus
ggtttatgaacccaagaaatagtgt

SEQ ID NO: 658915 - DNA, 25 bp, Mus musculus
ggtttatgaaccgaagaaatagtgt

SEQ ID NO: 658916 - DNA, 25 bp, Mus musculus
ggtttatgaagacaagagcccacag

SEQ ID NO: 658917 - DNA, 25 bp, Mus musculus
ggtttatgaagagaagagcccacag

SEQ ID NO: 658918 - DNA, 25 bp, Mus musculus
ggtttatgaatgaatcttctctgaa

SEQ ID NO: 658919 - DNA, 25 bp, Mus musculus
ggtttatgaatgtatcttctctgaa

SEQ ID NO: 658920 - DNA, 25 bp, Mus musculus
ggtttatgatccctctccaatccta

SEQ ID NO: 658921 - DNA, 25 bp, Mus musculus
ggtttatgatccgtctccaatccta

SEQ ID NO: 658922 - DNA, 25 bp, Mus musculus
ggtttatgccctaagaggacaatac

SEQ ID NO: 658923 - DNA, 25 bp, Mus musculus
ggtttatgcccttagaggacaatac

SEQ ID NO: 658924 - DNA, 25 bp, Mus musculus
ggtttatgcgatcctgcggaccaaa

SEQ ID NO: 658925 - DNA, 25 bp, Mus musculus
ggtttatgcgatgctgcggaccaaa

SEQ ID NO: 658926 - DNA, 25 bp, Mus musculus
ggtttatgcgtacaccagacccgat

SEQ ID NO: 658927 - DNA, 25 bp, Mus musculus
ggtttatgcgtagaccagacccgat

SEQ ID NO: 658928 - DNA, 25 bp, Mus musculus
ggtttatgtaacaggagcactgatc

SEQ ID NO: 658929 - DNA, 25 bp, Mus musculus
ggtttatgtaactggagcactgatc

SEQ ID NO: 658930 - DNA, 25 bp, Mus musculus
ggtttatgtagtaaatgcttgactc

SEQ ID NO: 658931 - DNA, 25 bp, Mus musculus
ggtttatgtagttaatgcttgactc

SEQ ID NO: 658932 - DNA, 25 bp, Mus musculus
ggtttatgtcctatgctgcacagat

SEQ ID NO: 658933 - DNA, 25 bp, Mus musculus
ggtttatgtcctttgctgcacagat

SEQ ID NO: 658934 - DNA, 25 bp, Mus musculus
ggtttattaagtcctgtgccagcac

SEQ ID NO: 658935 - DNA, 25 bp, Mus musculus
ggtttattaagtgctgtgccagcac

SEQ ID NO: 658936 - DNA, 25 bp, Mus musculus
ggtttattcaggaacaagctgttat

SEQ ID NO: 658937 - DNA, 25 bp, Mus musculus
ggtttattcaggtacaagctgttat

SEQ ID NO: 658938 - DNA, 25 bp, Mus musculus
ggtttattcatacccacattgtctg

SEQ ID NO: 658939 - DNA, 25 bp, Mus musculus
ggtttattcatagccacattgtctg

SEQ ID NO: 658940 - DNA, 25 bp, Mus musculus
ggtttattcatgatacagctattca

SEQ ID NO: 658941 - DNA, 25 bp, Mus musculus
ggtttattcatgttacagctattca

SEQ ID NO: 658942 - DNA, 25 bp, Mus musculus
ggtttattggaacacgcggatgcat

SEQ ID NO: 658943 - DNA, 25 bp, Mus musculus
ggtttattggaagacgcggatgcat

SEQ ID NO: 658944 - DNA, 25 bp, Mus musculus
ggtttatttaagaggcttcctgtgc

SEQ ID NO: 658945 - DNA, 25 bp, Mus musculus
ggtttatttaagtggcttcctgtgc

SEQ ID NO: 658946 - DNA, 25 bp, Mus musculus
ggtttatttcaccatgcacctcaat

SEQ ID NO: 658947 - DNA, 25 bp, Mus musculus
ggtttatttcacgatgcacctcaat

SEQ ID NO: 658948 - DNA, 25 bp, Mus musculus
ggtttatttcccatgataactcaca

SEQ ID NO: 658949 - DNA, 25 bp, Mus musculus
ggtttatttcccttgataactcaca

SEQ ID NO: 658950 - DNA, 25 bp, Mus musculus
ggtttatttcctcacctgttcaatt

SEQ ID NO: 658951 - DNA, 25 bp, Mus musculus
ggtttatttcctgacctgttcaatt

SEQ ID NO: 658952 - DNA, 25 bp, Mus musculus
ggtttatttgtaaaccctcatcctc

SEQ ID NO: 658953 - DNA, 25 bp, Mus musculus
ggtttatttgtataccctcatcctc

SEQ ID NO: 658954 - DNA, 25 bp, Mus musculus
ggtttcaaacagattctgaacacga

SEQ ID NO: 658955 - DNA, 25 bp, Mus musculus
ggtttcaaacagtttctgaacacga

SEQ ID NO: 658956 - DNA, 25 bp, Mus musculus
ggtttcaaactgcagaaccagtcta

SEQ ID NO: 658957 - DNA, 25 bp, Mus musculus
ggtttcaaactggagaaccagtcta

SEQ ID NO: 658958 - DNA, 25 bp, Mus musculus
ggtttcaaaggcatgcgctgtgtac

SEQ ID NO: 658959 - DNA, 25 bp, Mus musculus
ggtttcaaaggcttgcgctgtgtac

SEQ ID NO: 658960 - DNA, 25 bp, Mus musculus
ggtttcaaagtacccagcataaatg

SEQ ID NO: 658961 - DNA, 25 bp, Mus musculus
ggtttcaaagtagccagcataaatg

SEQ ID NO: 658962 - DNA, 25 bp, Mus musculus
ggtttcaaatgaaggtcttctctta

SEQ ID NO: 658963 - DNA, 25 bp, Mus musculus
ggtttcaaatgactaggcctgcaca

SEQ ID NO: 658964 - DNA, 25 bp, Mus musculus
ggtttcaaatgagtaggcctgcaca

SEQ ID NO: 658965 - DNA, 25 bp, Mus musculus
ggtttcaaatgatggtcttctctta

SEQ ID NO: 658966 - DNA, 25 bp, Mus musculus
ggtttcaacagtacccttagagcac

SEQ ID NO: 658967 - DNA, 25 bp, Mus musculus
ggtttcaacagttcccttagagcac

SEQ ID NO: 658968 - DNA, 25 bp, Mus musculus
ggtttcaacgtcaggcagctttgca

SEQ ID NO: 658969 - DNA, 25 bp, Mus musculus
ggtttcaacgtctggcagctttgca

SEQ ID NO: 658970 - DNA, 25 bp, Mus musculus
ggtttcaactttaacattccttgag

SEQ ID NO: 658971 - DNA, 25 bp, Mus musculus
ggtttcaacttttacattccttgag

SEQ ID NO: 658972 - DNA, 25 bp, Mus musculus
ggtttcaagctcatatttgtcagca

SEQ ID NO: 658973 - DNA, 25 bp, Mus musculus
ggtttcaagctcttatttgtcagca

SEQ ID NO: 658974 - DNA, 25 bp, Mus musculus
ggtttcaatcataattctgtccctt

SEQ ID NO: 658975 - DNA, 25 bp, Mus musculus
ggtttcaatcattattctgtccctt

SEQ ID NO: 658976 - DNA, 25 bp, Mus musculus
ggtttcaatggcatcagcttcagta

SEQ ID NO: 658977 - DNA, 25 bp, Mus musculus
ggtttcaatggcttcagcttcagta

SEQ ID NO: 658978 - DNA, 25 bp, Mus musculus
ggtttcaatttgatgctgtgactac

SEQ ID NO: 658979 - DNA, 25 bp, Mus musculus
ggtttcaatttgttgctgtgactac

SEQ ID NO: 658980 - DNA, 25 bp, Mus musculus
ggtttcacaagacagatggccgatg

SEQ ID NO: 658981 - DNA, 25 bp, Mus musculus
ggtttcacaagagagatggccgatg

SEQ ID NO: 658982 - DNA, 25 bp, Mus musculus
ggtttcacacaaattcccttgtatt

SEQ ID NO: 658983 - DNA, 25 bp, Mus musculus
ggtttcacacaatttcccttgtatt

SEQ ID NO: 658984 - DNA, 25 bp, Mus musculus
ggtttcacagtgctagcctatggca

SEQ ID NO: 658985 - DNA, 25 bp, Mus musculus
ggtttcacagtggtagcctatggca

SEQ ID NO: 658986 - DNA, 25 bp, Mus musculus
ggtttcacattaagagcccacactt

SEQ ID NO: 658987 - DNA, 25 bp, Mus musculus
ggtttcacattatgagcccacactt

SEQ ID NO: 658988 - DNA, 25 bp, Mus musculus
ggtttcaccaaccagatgtaatgtt

SEQ ID NO: 658989 - DNA, 25 bp, Mus musculus
ggtttcaccaacgagatgtaatgtt

SEQ ID NO: 658990 - DNA, 25 bp, Mus musculus
ggtttcaccacacaatttccagaga

SEQ ID NO: 658991 - DNA, 25 bp, Mus musculus
ggtttcaccacagaatttccagaga

SEQ ID NO: 658992 - DNA, 25 bp, Mus musculus
ggtttcaccgccatgcaaatgggaa

SEQ ID NO: 658993 - DNA, 25 bp, Mus musculus
ggtttcaccgccttgcaaatgggaa

SEQ ID NO: 658994 - DNA, 25 bp, Mus musculus
ggtttcacctctcacatcattacat

SEQ ID NO: 658995 - DNA, 25 bp, Mus musculus
ggtttcacctctgacatcattacat

SEQ ID NO: 658996 - DNA, 25 bp, Mus musculus
ggtttcacctgcaattgtcgatgcc

SEQ ID NO: 658997 - DNA, 25 bp, Mus musculus
ggtttcacctgctattgtcgatgcc

SEQ ID NO: 658998 - DNA, 25 bp, Mus musculus
ggtttcaccttactttcagtggcaa

SEQ ID NO: 658999 - DNA, 25 bp, Mus musculus
ggtttcaccttagtttcagtggcaa

SEQ ID NO: 659000 - DNA, 25 bp, Mus musculus
ggtttcaccttgctagatgttcgca

SEQ ID NO: 659001 - DNA, 25 bp, Mus musculus
ggtttcaccttggtagatgttcgca

SEQ ID NO: 659002 - DNA, 25 bp, Mus musculus
ggtttcactaacaagcccagttgac

SEQ ID NO: 659003 - DNA, 25 bp, Mus musculus
ggtttcactaactagcccagttgac

SEQ ID NO: 659004 - DNA, 25 bp, Mus musculus
ggtttcactgttagcagaacttttc

SEQ ID NO: 659005 - DNA, 25 bp, Mus musculus
ggtttcactgtttgcagaacttttc

SEQ ID NO: 659006 - DNA, 25 bp, Mus musculus
ggtttcagaaatccggttctcggcc

SEQ ID NO: 659007 - DNA, 25 bp, Mus musculus
ggtttcagaaatgcggttctcggcc

SEQ ID NO: 659008 - DNA, 25 bp, Mus musculus
ggtttcagagagcacttgttctcaa

SEQ ID NO: 659009 - DNA, 25 bp, Mus musculus
ggtttcagagaggacttgttctcaa

SEQ ID NO: 659010 - DNA, 25 bp, Mus musculus
ggtttcagagcaccactttccaaag

SEQ ID NO: 659011 - DNA, 25 bp, Mus musculus
ggtttcagagcagcactttccaaag

SEQ ID NO: 659012 - DNA, 25 bp, Mus musculus
ggtttcagagtgatgccgccattta

SEQ ID NO: 659013 - DNA, 25 bp, Mus musculus
ggtttcagagtgttgccgccattta

SEQ ID NO: 659014 - DNA, 25 bp, Mus musculus
ggtttcagagttcagctcaggtcat

SEQ ID NO: 659015 - DNA, 25 bp, Mus musculus
ggtttcagagttgagctcaggtcat

SEQ ID NO: 659016 - DNA, 25 bp, Mus musculus
ggtttcagatgcagtgaggagcact

SEQ ID NO: 659017 - DNA, 25 bp, Mus musculus
ggtttcagatgctgtgaggagcact

SEQ ID NO: 659018 - DNA, 25 bp, Mus musculus
ggtttcagatggctgcttcaagtat

SEQ ID NO: 659019 - DNA, 25 bp, Mus musculus
ggtttcagatgggtgcttcaagtat

SEQ ID NO: 659020 - DNA, 25 bp, Mus musculus
ggtttcagatgtatgactctcaggt

SEQ ID NO: 659021 - DNA, 25 bp, Mus musculus
ggtttcagatgtttgactctcaggt

SEQ ID NO: 659022 - DNA, 25 bp, Mus musculus
ggtttcagattactccaatgttgtg

SEQ ID NO: 659023 - DNA, 25 bp, Mus musculus
ggtttcagattagtccaatgttgtg

SEQ ID NO: 659024 - DNA, 25 bp, Mus musculus
ggtttcagcattcccaattatcaaa

SEQ ID NO: 659025 - DNA, 25 bp, Mus musculus
ggtttcagcattgccaattatcaaa

SEQ ID NO: 659026 - DNA, 25 bp, Mus musculus
ggtttcaggaatccaactcggacta

SEQ ID NO: 659027 - DNA, 25 bp, Mus musculus
ggtttcaggaatgcaactcggacta

SEQ ID NO: 659028 - DNA, 25 bp, Mus musculus
ggtttcaggtagatctgcaggcctt

SEQ ID NO: 659029 - DNA, 25 bp, Mus musculus
ggtttcaggtagttctgcaggcctt

SEQ ID NO: 659030 - DNA, 25 bp, Mus musculus
ggtttcagtattcaactctccactc

SEQ ID NO: 659031 - DNA, 25 bp, Mus musculus
ggtttcagtattgaactctccactc

SEQ ID NO: 659032 - DNA, 25 bp, Mus musculus
ggtttcagtcccagcttaaaacgca

SEQ ID NO: 659033 - DNA, 25 bp, Mus musculus
ggtttcagtccctgcttaaaacgca

SEQ ID NO: 659034 - DNA, 25 bp, Mus musculus
ggtttcagtgttaccagatgccaca

SEQ ID NO: 659035 - DNA, 25 bp, Mus musculus
ggtttcagtgtttccagatgccaca

SEQ ID NO: 659036 - DNA, 25 bp, Mus musculus
ggtttcataatcctggaccgatcca

SEQ ID NO: 659037 - DNA, 25 bp, Mus musculus
ggtttcataatcgtggaccgatcca

SEQ ID NO: 659038 - DNA, 25 bp, Mus musculus
ggtttcatacagatctgccgagcac

SEQ ID NO: 659039 - DNA, 25 bp, Mus musculus
ggtttcatacagttctgccgagcac

SEQ ID NO: 659040 - DNA, 25 bp, Mus musculus
ggtttcatacttatccaccgattat

SEQ ID NO: 659041 - DNA, 25 bp, Mus musculus
ggtttcatacttttccaccgattat

SEQ ID NO: 659042 - DNA, 25 bp, Mus musculus
ggtttcatcaccacagggagagctt

SEQ ID NO: 659043 - DNA, 25 bp, Mus musculus
ggtttcatcacctcagggagagctt

SEQ ID NO: 659044 - DNA, 25 bp, Mus musculus
ggtttcatcactatgatttgcctga

SEQ ID NO: 659045 - DNA, 25 bp, Mus musculus
ggtttcatcactttgatttgcctga

SEQ ID NO: 659046 - DNA, 25 bp, Mus musculus
ggtttcatcaggcagaacgtctcaa

SEQ ID NO: 659047 - DNA, 25 bp, Mus musculus
ggtttcatcagggagaacgtctcaa

SEQ ID NO: 659048 - DNA, 25 bp, Mus musculus
ggtttcatccatactatctgcaatt

SEQ ID NO: 659049 - DNA, 25 bp, Mus musculus
ggtttcatccattctatctgcaatt

SEQ ID NO: 659050 - DNA, 25 bp, Mus musculus
ggtttcatcctcataacacatacac

SEQ ID NO: 659051 - DNA, 25 bp, Mus musculus
ggtttcatcctcttaacacatacac

SEQ ID NO: 659052 - DNA, 25 bp, Mus musculus
ggtttcatcgaccttaacagtggga

SEQ ID NO: 659053 - DNA, 25 bp, Mus musculus
ggtttcatcgacgttaacagtggga

SEQ ID NO: 659054 - DNA, 25 bp, Mus musculus
ggtttcatcttgagcccatgctcta

SEQ ID NO: 659055 - DNA, 25 bp, Mus musculus
ggtttcatcttgtgcccatgctcta

SEQ ID NO: 659056 - DNA, 25 bp, Mus musculus
ggtttcatgagtcgacatcgcgaat

SEQ ID NO: 659057 - DNA, 25 bp, Mus musculus
ggtttcatgagtggacatcgcgaat

SEQ ID NO: 659058 - DNA, 25 bp, Mus musculus
ggtttcatggctacgggaccaagga

SEQ ID NO: 659059 - DNA, 25 bp, Mus musculus
ggtttcatggcttcgggaccaagga

SEQ ID NO: 659060 - DNA, 25 bp, Mus musculus
ggtttcatgttacctggaagcaaac

SEQ ID NO: 659061 - DNA, 25 bp, Mus musculus
ggtttcatgttagctggaagcaaac

SEQ ID NO: 659062 - DNA, 25 bp, Mus musculus
ggtttcattaatacagagcttctga

SEQ ID NO: 659063 - DNA, 25 bp, Mus musculus
ggtttcattaattcagagcttctga

SEQ ID NO: 659064 - DNA, 25 bp, Mus musculus
ggtttcattataatagctttcccaa

SEQ ID NO: 659065 - DNA, 25 bp, Mus musculus
ggtttcattatattagctttcccaa

SEQ ID NO: 659066 - DNA, 25 bp, Mus musculus
ggtttcattcacactagttgaccat

SEQ ID NO: 659067 - DNA, 25 bp, Mus musculus
ggtttcattcactctagttgaccat

SEQ ID NO: 659068 - DNA, 25 bp, Mus musculus
ggtttcattcctattggtgactaat

SEQ ID NO: 659069 - DNA, 25 bp, Mus musculus
ggtttcattccttttggtgactaat

SEQ ID NO: 659070 - DNA, 25 bp, Mus musculus
ggtttcattgcgcatgcactcagtc

SEQ ID NO: 659071 - DNA, 25 bp, Mus musculus
ggtttcattgcggatgcactcagtc

SEQ ID NO: 659072 - DNA, 25 bp, Mus musculus
ggtttcattggcaccatccacacgc

SEQ ID NO: 659073 - DNA, 25 bp, Mus musculus
ggtttcattggctccatccacacgc

SEQ ID NO: 659074 - DNA, 25 bp, Mus musculus
ggtttcatttaaattgctagctcat

SEQ ID NO: 659075 - DNA, 25 bp, Mus musculus
ggtttcatttaatttgctagctcat

SEQ ID NO: 659076 - DNA, 25 bp, Mus musculus
ggtttcatttctatggctaatcccc

SEQ ID NO: 659077 - DNA, 25 bp, Mus musculus
ggtttcatttctttggctaatcccc

SEQ ID NO: 659078 - DNA, 25 bp, Mus musculus
ggtttcatttggaccttactcatcc

SEQ ID NO: 659079 - DNA, 25 bp, Mus musculus
ggtttcatttggtccttactcatcc

SEQ ID NO: 659080 - DNA, 25 bp, Mus musculus
ggtttccaacctcttgaacttgtca

SEQ ID NO: 659081 - DNA, 25 bp, Mus musculus
ggtttccaacctgttgaacttgtca

SEQ ID NO: 659082 - DNA, 25 bp, Mus musculus
ggtttccaaggaactgcctgggcag

SEQ ID NO: 659083 - DNA, 25 bp, Mus musculus
ggtttccaaggatctgcctgggcag

SEQ ID NO: 659084 - DNA, 25 bp, Mus musculus
ggtttccaaggtcctgcacctggag

SEQ ID NO: 659085 - DNA, 25 bp, Mus musculus
ggtttccaaggtgctgcacctggag

SEQ ID NO: 659086 - DNA, 25 bp, Mus musculus
ggtttccaatccactattaaaaatg

SEQ ID NO: 659087 - DNA, 25 bp, Mus musculus
ggtttccaatcctctattaaaaatg

SEQ ID NO: 659088 - DNA, 25 bp, Mus musculus
ggtttccaccagaacgcaaggcagt

SEQ ID NO: 659089 - DNA, 25 bp, Mus musculus
ggtttccaccagtacgcaaggcagt

SEQ ID NO: 659090 - DNA, 25 bp, Mus musculus
ggtttccactaaacggctactgcca

SEQ ID NO: 659091 - DNA, 25 bp, Mus musculus
ggtttccactaatcggctactgcca

SEQ ID NO: 659092 - DNA, 25 bp, Mus musculus
ggtttccactcgcaatgtcaacaga

SEQ ID NO: 659093 - DNA, 25 bp, Mus musculus
ggtttccactcggaatgtcaacaga

SEQ ID NO: 659094 - DNA, 25 bp, Mus musculus
ggtttccactctcgctgcattgcag

SEQ ID NO: 659095 - DNA, 25 bp, Mus musculus
ggtttccactctggctgcattgcag

SEQ ID NO: 659096 - DNA, 25 bp, Mus musculus
ggtttccactttcaggttaggcagg

SEQ ID NO: 659097 - DNA, 25 bp, Mus musculus
ggtttccactttgaggttaggcagg

SEQ ID NO: 659098 - DNA, 25 bp, Mus musculus
ggtttccagatgaaaccctggttgt

SEQ ID NO: 659099 - DNA, 25 bp, Mus musculus
ggtttccagatgtaaccctggttgt

SEQ ID NO: 659100 - DNA, 25 bp, Mus musculus
ggtttccagcacatatgtcaggcag

SEQ ID NO: 659101 - DNA, 25 bp, Mus musculus
ggtttccagcacttatgtcaggcag

SEQ ID NO: 659102 - DNA, 25 bp, Mus musculus
ggtttccagctccagccagaatatt

SEQ ID NO: 659103 - DNA, 25 bp, Mus musculus
ggtttccagctcgagccagaatatt

SEQ ID NO: 659104 - DNA, 25 bp, Mus musculus
ggtttccaggagatgctttgcccac

SEQ ID NO: 659105 - DNA, 25 bp, Mus musculus
ggtttccaggagttgctttgcccac

SEQ ID NO: 659106 - DNA, 25 bp, Mus musculus
ggtttccagggacaatgatgttttt

SEQ ID NO: 659107 - DNA, 25 bp, Mus musculus
ggtttccagggagaatgatgttttt

SEQ ID NO: 659108 - DNA, 25 bp, Mus musculus
ggtttccatttcaagcgcaggtctg

SEQ ID NO: 659109 - DNA, 25 bp, Mus musculus
ggtttccatttctagcgcaggtctg

SEQ ID NO: 659110 - DNA, 25 bp, Mus musculus
ggtttcccaaagaccttcataacat

SEQ ID NO: 659111 - DNA, 25 bp, Mus musculus
ggtttcccaaagtccttcataacat

SEQ ID NO: 659112 - DNA, 25 bp, Mus musculus
ggtttcccacctccaaagtcatcag

SEQ ID NO: 659113 - DNA, 25 bp, Mus musculus
ggtttcccacctgcaaagtcatcag

SEQ ID NO: 659114 - DNA, 25 bp, Mus musculus
ggtttcccagacagcagagggagct

SEQ ID NO: 659115 - DNA, 25 bp, Mus musculus
ggtttcccagactgcagagggagct

SEQ ID NO: 659116 - DNA, 25 bp, Mus musculus
ggtttcccagctcacattcaagtgg

SEQ ID NO: 659117 - DNA, 25 bp, Mus musculus
ggtttcccagctgacattcaagtgg

SEQ ID NO: 659118 - DNA, 25 bp, Mus musculus
ggtttcccagtgaccctgagaagag

SEQ ID NO: 659119 - DNA, 25 bp, Mus musculus
ggtttcccagtgtccctgagaagag

SEQ ID NO: 659120 - DNA, 25 bp, Mus musculus
ggtttcccagttatgcatgacattt

SEQ ID NO: 659121 - DNA, 25 bp, Mus musculus
ggtttcccagttttgcatgacattt

SEQ ID NO: 659122 - DNA, 25 bp, Mus musculus
ggtttcccatgtcacaataaagttt

SEQ ID NO: 659123 - DNA, 25 bp, Mus musculus
ggtttcccatgtgacaataaagttt

SEQ ID NO: 659124 - DNA, 25 bp, Mus musculus
ggtttcccattaattcacagtgaat

SEQ ID NO: 659125 - DNA, 25 bp, Mus musculus
ggtttcccattatttcacagtgaat

SEQ ID NO: 659126 - DNA, 25 bp, Mus musculus
ggtttccccacacagtaacgctttg

SEQ ID NO: 659127 - DNA, 25 bp, Mus musculus
ggtttccccacagagtaacgctttg

SEQ ID NO: 659128 - DNA, 25 bp, Mus musculus
ggtttccccgctcatacctgagcag

SEQ ID NO: 659129 - DNA, 25 bp, Mus musculus
ggtttccccgctgatacctgagcag

SEQ ID NO: 659130 - DNA, 25 bp, Mus musculus
ggtttcccgagacccagacaaattg

SEQ ID NO: 659131 - DNA, 25 bp, Mus musculus
ggtttcccgagagccagacaaattg

SEQ ID NO: 659132 - DNA, 25 bp, Mus musculus
ggtttcccgggaagacatcgtgaag

SEQ ID NO: 659133 - DNA, 25 bp, Mus musculus
ggtttcccgggatgacatcgtgaag

SEQ ID NO: 659134 - DNA, 25 bp, Mus musculus
ggtttccctccaccagtgcttacta

SEQ ID NO: 659135 - DNA, 25 bp, Mus musculus
ggtttccctccagcagtgcttacta

SEQ ID NO: 659136 - DNA, 25 bp, Mus musculus
ggtttccctgtgcatatggtccatc

SEQ ID NO: 659137 - DNA, 25 bp, Mus musculus
ggtttccctgtggatatggtccatc

SEQ ID NO: 659138 - DNA, 25 bp, Mus musculus
ggtttcctaattactgacccatctc

SEQ ID NO: 659139 - DNA, 25 bp, Mus musculus
ggtttcctaatttctgacccatctc

SEQ ID NO: 659140 - DNA, 25 bp, Mus musculus
ggtttcctacaaagatatccttttt

SEQ ID NO: 659141 - DNA, 25 bp, Mus musculus
ggtttcctacaatgatatccttttt

SEQ ID NO: 659142 - DNA, 25 bp, Mus musculus
ggtttcctatatacgtagatgcagt

SEQ ID NO: 659143 - DNA, 25 bp, Mus musculus
ggtttcctatattcgtagatgcagt

SEQ ID NO: 659144 - DNA, 25 bp, Mus musculus
ggtttcctcctcaaatgatctcaag

SEQ ID NO: 659145 - DNA, 25 bp, Mus musculus
ggtttcctcctctaatgatctcaag

SEQ ID NO: 659146 - DNA, 25 bp, Mus musculus
ggtttcctcttcctcgagactggga

SEQ ID NO: 659147 - DNA, 25 bp, Mus musculus
ggtttcctcttcgtcgagactggga

SEQ ID NO: 659148 - DNA, 25 bp, Mus musculus
ggtttcctgagcaagagtcttttgt

SEQ ID NO: 659149 - DNA, 25 bp, Mus musculus
ggtttcctgagctagagtcttttgt

SEQ ID NO: 659150 - DNA, 25 bp, Mus musculus
ggtttcctgcccatgaaagcccagg

SEQ ID NO: 659151 - DNA, 25 bp, Mus musculus
ggtttcctgcccttgaaagcccagg

SEQ ID NO: 659152 - DNA, 25 bp, Mus musculus
ggtttcctgcggacagtgtggagca

SEQ ID NO: 659153 - DNA, 25 bp, Mus musculus
ggtttcctgcggtcagtgtggagca

SEQ ID NO: 659154 - DNA, 25 bp, Mus musculus
ggtttcctgggactgtgcaatcgca

SEQ ID NO: 659155 - DNA, 25 bp, Mus musculus
ggtttcctgggagtgtgcaatcgca

SEQ ID NO: 659156 - DNA, 25 bp, Mus musculus
ggtttcctggtcagtgattgtgcac

SEQ ID NO: 659157 - DNA, 25 bp, Mus musculus
ggtttcctggtctgtgattgtgcac

SEQ ID NO: 659158 - DNA, 25 bp, Mus musculus
ggtttccttattctgtacgtgggat

SEQ ID NO: 659159 - DNA, 25 bp, Mus musculus
ggtttccttattgtgtacgtgggat

SEQ ID NO: 659160 - DNA, 25 bp, Mus musculus
ggtttccttgatcattgcccatttc

SEQ ID NO: 659161 - DNA, 25 bp, Mus musculus
ggtttccttgatgattgcccatttc

SEQ ID NO: 659162 - DNA, 25 bp, Mus musculus
ggtttcctttagacaatccaagaga

SEQ ID NO: 659163 - DNA, 25 bp, Mus musculus
ggtttcctttagtcaatccaagaga

SEQ ID NO: 659164 - DNA, 25 bp, Mus musculus
ggtttcctttcacatcagccaagat

SEQ ID NO: 659165 - DNA, 25 bp, Mus musculus
ggtttcctttcagatcagccaagat

SEQ ID NO: 659166 - DNA, 25 bp, Mus musculus
ggtttcgaacctcagctgtgctcat

SEQ ID NO: 659167 - DNA, 25 bp, Mus musculus
ggtttcgaacctgagctgtgctcat

SEQ ID NO: 659168 - DNA, 25 bp, Mus musculus
ggtttcgaatatccagatggccttg

SEQ ID NO: 659169 - DNA, 25 bp, Mus musculus
ggtttcgaatatgcagatggccttg

SEQ ID NO: 659170 - DNA, 25 bp, Mus musculus
ggtttcgagtcacctgaagtctcta

SEQ ID NO: 659171 - DNA, 25 bp, Mus musculus
ggtttcgagtcagctgaagtctcta

SEQ ID NO: 659172 - DNA, 25 bp, Mus musculus
ggtttcgagtgaccacactgactgt

SEQ ID NO: 659173 - DNA, 25 bp, Mus musculus
ggtttcgagtgagcacactgactgt

SEQ ID NO: 659174 - DNA, 25 bp, Mus musculus
ggtttcgcaagaaacatgttttcat

SEQ ID NO: 659175 - DNA, 25 bp, Mus musculus
ggtttcgcaagatacatgttttcat

SEQ ID NO: 659176 - DNA, 25 bp, Mus musculus
ggtttcgcatcaaccatttgcccta

SEQ ID NO: 659177 - DNA, 25 bp, Mus musculus
ggtttcgcatcatccatttgcccta

SEQ ID NO: 659178 - DNA, 25 bp, Mus musculus
ggtttcgccagtagctggcttgctc

SEQ ID NO: 659179 - DNA, 25 bp, Mus musculus
ggtttcgccagttgctggcttgctc

SEQ ID NO: 659180 - DNA, 25 bp, Mus musculus
ggtttcgctaccagatggaactcaa

SEQ ID NO: 659181 - DNA, 25 bp, Mus musculus
ggtttcgctacctgatggaactcaa

SEQ ID NO: 659182 - DNA, 25 bp, Mus musculus
ggtttcgctggacccatcatcctca

SEQ ID NO: 659183 - DNA, 25 bp, Mus musculus
ggtttcgctggagccatcatcctca

SEQ ID NO: 659184 - DNA, 25 bp, Mus musculus
ggtttcggataaagccaatagcagc

SEQ ID NO: 659185 - DNA, 25 bp, Mus musculus
ggtttcggataatgccaatagcagc

SEQ ID NO: 659186 - DNA, 25 bp, Mus musculus
ggtttcgggttgctctgaagacttt

SEQ ID NO: 659187 - DNA, 25 bp, Mus musculus
ggtttcgggttggtctgaagacttt

SEQ ID NO: 659188 - DNA, 25 bp, Mus musculus
ggtttcgtctttctcccattataga

SEQ ID NO: 659189 - DNA, 25 bp, Mus musculus
ggtttcgtctttgtcccattataga

SEQ ID NO: 659190 - DNA, 25 bp, Mus musculus
ggtttcgttgagatacagctgcttc

SEQ ID NO: 659191 - DNA, 25 bp, Mus musculus
ggtttcgttgagttacagctgcttc

SEQ ID NO: 659192 - DNA, 25 bp, Mus musculus
ggtttctaaacaatcaaggacattg

SEQ ID NO: 659193 - DNA, 25 bp, Mus musculus
ggtttctaaacattcaaggacattg

SEQ ID NO: 659194 - DNA, 25 bp, Mus musculus
ggtttctaacacatataatcaggca

SEQ ID NO: 659195 - DNA, 25 bp, Mus musculus
ggtttctaacacttataatcaggca

SEQ ID NO: 659196 - DNA, 25 bp, Mus musculus
ggtttctaacttagtaacttgctct

SEQ ID NO: 659197 - DNA, 25 bp, Mus musculus
ggtttctaactttgtaacttgctct

SEQ ID NO: 659198 - DNA, 25 bp, Mus musculus
ggtttctaagttatgggtctacact

SEQ ID NO: 659199 - DNA, 25 bp, Mus musculus
ggtttctaagttttgggtctacact

SEQ ID NO: 659200 - DNA, 25 bp, Mus musculus
ggtttctaatcaatttttgcacatt

SEQ ID NO: 659201 - DNA, 25 bp, Mus musculus
ggtttctaatcattttttgcacatt

SEQ ID NO: 659202 - DNA, 25 bp, Mus musculus
ggtttctacctaatcgttgctattt

SEQ ID NO: 659203 - DNA, 25 bp, Mus musculus
ggtttctacctattcgttgctattt

SEQ ID NO: 659204 - DNA, 25 bp, Mus musculus
ggtttctacgaaatctactattata

SEQ ID NO: 659205 - DNA, 25 bp, Mus musculus
ggtttctacgaattctactattata

SEQ ID NO: 659206 - DNA, 25 bp, Mus musculus
ggtttctacttgcataaatcctctc

SEQ ID NO: 659207 - DNA, 25 bp, Mus musculus
ggtttctacttggataaatcctctc

SEQ ID NO: 659208 - DNA, 25 bp, Mus musculus
ggtttctagcacaagtaactgggta

SEQ ID NO: 659209 - DNA, 25 bp, Mus musculus
ggtttctagcactagtaactgggta

SEQ ID NO: 659210 - DNA, 25 bp, Mus musculus
ggtttctagtccagtttcactccca

SEQ ID NO: 659211 - DNA, 25 bp, Mus musculus
ggtttctagtcctgtttcactccca

SEQ ID NO: 659212 - DNA, 25 bp, Mus musculus
ggtttctatcagagacatcaggtta

SEQ ID NO: 659213 - DNA, 25 bp, Mus musculus
ggtttctatcagtgacatcaggtta

SEQ ID NO: 659214 - DNA, 25 bp, Mus musculus
ggtttctatgtgcaggtggtatcct

SEQ ID NO: 659215 - DNA, 25 bp, Mus musculus
ggtttctatgtggaggtggtatcct

SEQ ID NO: 659216 - DNA, 25 bp, Mus musculus
ggtttctatgttagggcttcttcct

SEQ ID NO: 659217 - DNA, 25 bp, Mus musculus
ggtttctatgtttgggcttcttcct

SEQ ID NO: 659218 - DNA, 25 bp, Mus musculus
ggtttctattacacataccacatgt

SEQ ID NO: 659219 - DNA, 25 bp, Mus musculus
ggtttctattactcataccacatgt

SEQ ID NO: 659220 - DNA, 25 bp, Mus musculus
ggtttctcaatgacttttgctttca

SEQ ID NO: 659221 - DNA, 25 bp, Mus musculus
ggtttctcaatgtcttttgctttca

SEQ ID NO: 659222 - DNA, 25 bp, Mus musculus
ggtttctcagcaactccaaatcagt

SEQ ID NO: 659223 - DNA, 25 bp, Mus musculus
ggtttctcagcatctccaaatcagt

SEQ ID NO: 659224 - DNA, 25 bp, Mus musculus
ggtttctcatcaaattcagcctgta

SEQ ID NO: 659225 - DNA, 25 bp, Mus musculus
ggtttctcatcatattcagcctgta

SEQ ID NO: 659226 - DNA, 25 bp, Mus musculus
ggtttctcatgtatcaatgtccttg

SEQ ID NO: 659227 - DNA, 25 bp, Mus musculus
ggtttctcatgtttcaatgtccttg

SEQ ID NO: 659228 - DNA, 25 bp, Mus musculus
ggtttctcatttatgaatcaacatc

SEQ ID NO: 659229 - DNA, 25 bp, Mus musculus
ggtttctcatttttgaatcaacatc

SEQ ID NO: 659230 - DNA, 25 bp, Mus musculus
ggtttctccaatagactgtgcgtgt

SEQ ID NO: 659231 - DNA, 25 bp, Mus musculus
ggtttctccaattgactgtgcgtgt

SEQ ID NO: 659232 - DNA, 25 bp, Mus musculus
ggtttctccatcaggacttttccag

SEQ ID NO: 659233 - DNA, 25 bp, Mus musculus
ggtttctccatctggacttttccag

SEQ ID NO: 659234 - DNA, 25 bp, Mus musculus
ggtttctcctaacgtgtgtgtggtc

SEQ ID NO: 659235 - DNA, 25 bp, Mus musculus
ggtttctcctaaggtgtgtgtggtc

SEQ ID NO: 659236 - DNA, 25 bp, Mus musculus
ggtttctcctctatgtcgatacaga

SEQ ID NO: 659237 - DNA, 25 bp, Mus musculus
ggtttctcctctttgtcgatacaga

SEQ ID NO: 659238 - DNA, 25 bp, Mus musculus
ggtttctctacaaggtccaactagg

SEQ ID NO: 659239 - DNA, 25 bp, Mus musculus
ggtttctctacatggtccaactagg

SEQ ID NO: 659240 - DNA, 25 bp, Mus musculus
ggtttctctatgaatagctcaggct

SEQ ID NO: 659241 - DNA, 25 bp, Mus musculus
ggtttctctatgacttatctctttc

SEQ ID NO: 659242 - DNA, 25 bp, Mus musculus
ggtttctctatgtatagctcaggct

SEQ ID NO: 659243 - DNA, 25 bp, Mus musculus
ggtttctctatgtcttatctctttc

SEQ ID NO: 659244 - DNA, 25 bp, Mus musculus
ggtttctctattcttgatacaacta

SEQ ID NO: 659245 - DNA, 25 bp, Mus musculus
ggtttctctattgttgatacaacta

SEQ ID NO: 659246 - DNA, 25 bp, Mus musculus
ggtttctctgataaagacactgtta

SEQ ID NO: 659247 - DNA, 25 bp, Mus musculus
ggtttctctgattaagacactgtta

SEQ ID NO: 659248 - DNA, 25 bp, Mus musculus
ggtttctctgtaagtctcgaaaaac

SEQ ID NO: 659249 - DNA, 25 bp, Mus musculus
ggtttctctgtaatattctatcatt

SEQ ID NO: 659250 - DNA, 25 bp, Mus musculus
ggtttctctgtatgtctcgaaaaac

SEQ ID NO: 659251 - DNA, 25 bp, Mus musculus
ggtttctctgtattattctatcatt

SEQ ID NO: 659252 - DNA, 25 bp, Mus musculus
ggtttctcttatccagtgtgaggga

SEQ ID NO: 659253 - DNA, 25 bp, Mus musculus
ggtttctcttatgcagtgtgaggga

SEQ ID NO: 659254 - DNA, 25 bp, Mus musculus
ggtttctgaagaaccaagttcttac

SEQ ID NO: 659255 - DNA, 25 bp, Mus musculus
ggtttctgaagatccaagttcttac

SEQ ID NO: 659256 - DNA, 25 bp, Mus musculus
ggtttctgcaacattgtctccttta

SEQ ID NO: 659257 - DNA, 25 bp, Mus musculus
ggtttctgcaactttgtctccttta

SEQ ID NO: 659258 - DNA, 25 bp, Mus musculus
ggtttctgcaccctgagtggagcta

SEQ ID NO: 659259 - DNA, 25 bp, Mus musculus
ggtttctgcaccgtgagtggagcta

SEQ ID NO: 659260 - DNA, 25 bp, Mus musculus
ggtttctgcaggaaccattctaaat

SEQ ID NO: 659261 - DNA, 25 bp, Mus musculus
ggtttctgcaggacgtgccaaagca

SEQ ID NO: 659262 - DNA, 25 bp, Mus musculus
ggtttctgcaggtaccattctaaat

SEQ ID NO: 659263 - DNA, 25 bp, Mus musculus
ggtttctgcaggtcgtgccaaagca

SEQ ID NO: 659264 - DNA, 25 bp, Mus musculus
ggtttctgccagaccttttgtatgc

SEQ ID NO: 659265 - DNA, 25 bp, Mus musculus
ggtttctgccagtccttttgtatgc

SEQ ID NO: 659266 - DNA, 25 bp, Mus musculus
ggtttctgccatatgcataattaga

SEQ ID NO: 659267 - DNA, 25 bp, Mus musculus
ggtttctgccatttgcataattaga

SEQ ID NO: 659268 - DNA, 25 bp, Mus musculus
ggtttctgccttcttcaaatcatta

SEQ ID NO: 659269 - DNA, 25 bp, Mus musculus
ggtttctgccttgttcaaatcatta

SEQ ID NO: 659270 - DNA, 25 bp, Mus musculus
ggtttctgctgacgactttggcaaa

SEQ ID NO: 659271 - DNA, 25 bp, Mus musculus
ggtttctgctgaggactttggcaaa

SEQ ID NO: 659272 - DNA, 25 bp, Mus musculus
ggtttctgctgtcaaaggagatcat

SEQ ID NO: 659273 - DNA, 25 bp, Mus musculus
ggtttctgctgtgaaaggagatcat

SEQ ID NO: 659274 - DNA, 25 bp, Mus musculus
ggtttctgcttacaagtcttcctcg

SEQ ID NO: 659275 - DNA, 25 bp, Mus musculus
ggtttctgcttagaagtcttcctcg

SEQ ID NO: 659276 - DNA, 25 bp, Mus musculus
ggtttctgcttcacgggatggaatt

SEQ ID NO: 659277 - DNA, 25 bp, Mus musculus
ggtttctgcttctcgggatggaatt

SEQ ID NO: 659278 - DNA, 25 bp, Mus musculus
ggtttctgcttgcttttatgtacat

SEQ ID NO: 659279 - DNA, 25 bp, Mus musculus
ggtttctgcttggttttatgtacat

SEQ ID NO: 659280 - DNA, 25 bp, Mus musculus
ggtttctgtaaactcatccttggaa

SEQ ID NO: 659281 - DNA, 25 bp, Mus musculus
ggtttctgtaaagtcatccttggaa

SEQ ID NO: 659282 - DNA, 25 bp, Mus musculus
ggtttctgtaccagtgttccttgat

SEQ ID NO: 659283 - DNA, 25 bp, Mus musculus
ggtttctgtacctgtgttccttgat

SEQ ID NO: 659284 - DNA, 25 bp, Mus musculus
ggtttctgtcggaatgcccagtgac

SEQ ID NO: 659285 - DNA, 25 bp, Mus musculus
ggtttctgtcggtatgcccagtgac

SEQ ID NO: 659286 - DNA, 25 bp, Mus musculus
ggtttctgtcgtacactcggtgtga

SEQ ID NO: 659287 - DNA, 25 bp, Mus musculus
ggtttctgtcgttcactcggtgtga

SEQ ID NO: 659288 - DNA, 25 bp, Mus musculus
ggtttctgttgaaaccaggctacaa

SEQ ID NO: 659289 - DNA, 25 bp, Mus musculus
ggtttctgttgataccaggctacaa

SEQ ID NO: 659290 - DNA, 25 bp, Mus musculus
ggtttctgtttaagtagtcctgcat

SEQ ID NO: 659291 - DNA, 25 bp, Mus musculus
ggtttctgtttatgtagtcctgcat

SEQ ID NO: 659292 - DNA, 25 bp, Mus musculus
ggtttctgtttgaaggtgtctccct

SEQ ID NO: 659293 - DNA, 25 bp, Mus musculus
ggtttctgtttgtaggtgtctccct

SEQ ID NO: 659294 - DNA, 25 bp, Mus musculus
ggtttcttacatacctgttatcaat

SEQ ID NO: 659295 - DNA, 25 bp, Mus musculus
ggtttcttacatactaactatctca

SEQ ID NO: 659296 - DNA, 25 bp, Mus musculus
ggtttcttacatcggtcttgctaat

SEQ ID NO: 659297 - DNA, 25 bp, Mus musculus
ggtttcttacatgggtcttgctaat

SEQ ID NO: 659298 - DNA, 25 bp, Mus musculus
ggtttcttacattcctgttatcaat

SEQ ID NO: 659299 - DNA, 25 bp, Mus musculus
ggtttcttacattctaactatctca

SEQ ID NO: 659300 - DNA, 25 bp, Mus musculus
ggtttcttacgtaactgttgagtca

SEQ ID NO: 659301 - DNA, 25 bp, Mus musculus
ggtttcttacgttactgttgagtca

SEQ ID NO: 659302 - DNA, 25 bp, Mus musculus
ggtttcttagccagcgcaggcagat

SEQ ID NO: 659303 - DNA, 25 bp, Mus musculus
ggtttcttagcctgcgcaggcagat

SEQ ID NO: 659304 - DNA, 25 bp, Mus musculus
ggtttcttaggcatgcaaagagcac

SEQ ID NO: 659305 - DNA, 25 bp, Mus musculus
ggtttcttaggcttgcaaagagcac

SEQ ID NO: 659306 - DNA, 25 bp, Mus musculus
ggtttcttaggtacaggcagagtag

SEQ ID NO: 659307 - DNA, 25 bp, Mus musculus
ggtttcttaggttcaggcagagtag

SEQ ID NO: 659308 - DNA, 25 bp, Mus musculus
ggtttcttatccaacttcagtctaa

SEQ ID NO: 659309 - DNA, 25 bp, Mus musculus
ggtttcttatcctacttcagtctaa

SEQ ID NO: 659310 - DNA, 25 bp, Mus musculus
ggtttcttattgagtagtgcatcat

SEQ ID NO: 659311 - DNA, 25 bp, Mus musculus
ggtttcttattgtgtagtgcatcat

SEQ ID NO: 659312 - DNA, 25 bp, Mus musculus
ggtttcttcattcatggttcagctc

SEQ ID NO: 659313 - DNA, 25 bp, Mus musculus
ggtttcttcattgatggttcagctc

SEQ ID NO: 659314 - DNA, 25 bp, Mus musculus
ggtttcttcctgcatgtattagcca

SEQ ID NO: 659315 - DNA, 25 bp, Mus musculus
ggtttcttcctggatgtattagcca

SEQ ID NO: 659316 - DNA, 25 bp, Mus musculus
ggtttcttccttctcatcaataatt

SEQ ID NO: 659317 - DNA, 25 bp, Mus musculus
ggtttcttccttgtcatcaataatt

SEQ ID NO: 659318 - DNA, 25 bp, Mus musculus
ggtttcttgaagaccatagcaccaa

SEQ ID NO: 659319 - DNA, 25 bp, Mus musculus
ggtttcttgaagtccatagcaccaa

SEQ ID NO: 659320 - DNA, 25 bp, Mus musculus
ggtttcttgctcaccaaaggttcct

SEQ ID NO: 659321 - DNA, 25 bp, Mus musculus
ggtttcttgctctccaaaggttcct

SEQ ID NO: 659322 - DNA, 25 bp, Mus musculus
ggtttcttggctctacaatgggctt

SEQ ID NO: 659323 - DNA, 25 bp, Mus musculus
ggtttcttggctgtacaatgggctt

SEQ ID NO: 659324 - DNA, 25 bp, Mus musculus
ggtttcttggtaatgctttgtacaa

SEQ ID NO: 659325 - DNA, 25 bp, Mus musculus
ggtttcttggtattgctttgtacaa

SEQ ID NO: 659326 - DNA, 25 bp, Mus musculus
ggtttcttggtgatgacatggccat

SEQ ID NO: 659327 - DNA, 25 bp, Mus musculus
ggtttcttggtgttgacatggccat

SEQ ID NO: 659328 - DNA, 25 bp, Mus musculus
ggtttcttgtatagccttgactgtc

SEQ ID NO: 659329 - DNA, 25 bp, Mus musculus
ggtttcttgtattgccttgactgtc

SEQ ID NO: 659330 - DNA, 25 bp, Mus musculus
ggtttcttgttcattcagatctgat

SEQ ID NO: 659331 - DNA, 25 bp, Mus musculus
ggtttcttgttctttcagatctgat

SEQ ID NO: 659332 - DNA, 25 bp, Mus musculus
ggtttctttaagagcacacttccaa

SEQ ID NO: 659333 - DNA, 25 bp, Mus musculus
ggtttctttaagtgcacacttccaa

SEQ ID NO: 659334 - DNA, 25 bp, Mus musculus
ggtttctttcttctctctccccata

SEQ ID NO: 659335 - DNA, 25 bp, Mus musculus
ggtttctttcttctgagactgttta

SEQ ID NO: 659336 - DNA, 25 bp, Mus musculus
ggtttctttcttgtctctccccata

SEQ ID NO: 659337 - DNA, 25 bp, Mus musculus
ggtttctttcttgtgagactgttta

SEQ ID NO: 659338 - DNA, 25 bp, Mus musculus
ggtttctttgctaacgtgtttctca

SEQ ID NO: 659339 - DNA, 25 bp, Mus musculus
ggtttctttgcttacgtgtttctca

SEQ ID NO: 659340 - DNA, 25 bp, Mus musculus
ggtttcttttatatgccaactttca

SEQ ID NO: 659341 - DNA, 25 bp, Mus musculus
ggtttcttttatttgccaactttca

SEQ ID NO: 659342 - DNA, 25 bp, Mus musculus
ggtttgaaacctcgctattctcgaa

SEQ ID NO: 659343 - DNA, 25 bp, Mus musculus
ggtttgaaacctggctattctcgaa

SEQ ID NO: 659344 - DNA, 25 bp, Mus musculus
ggtttgaaagatccgatgccccaat

SEQ ID NO: 659345 - DNA, 25 bp, Mus musculus
ggtttgaaagatgcgatgccccaat

SEQ ID NO: 659346 - DNA, 25 bp, Mus musculus
ggtttgaaatctcatagctcatcta

SEQ ID NO: 659347 - DNA, 25 bp, Mus musculus
ggtttgaaatctgatagctcatcta

SEQ ID NO: 659348 - DNA, 25 bp, Mus musculus
ggtttgaacaagaggccccatctgg

SEQ ID NO: 659349 - DNA, 25 bp, Mus musculus
ggtttgaacaagtggccccatctgg

SEQ ID NO: 659350 - DNA, 25 bp, Mus musculus
ggtttgaacctcatgcttgaagcag

SEQ ID NO: 659351 - DNA, 25 bp, Mus musculus
ggtttgaacctcatgtgtgctgagt

SEQ ID NO: 659352 - DNA, 25 bp, Mus musculus
ggtttgaacctcttgcttgaagcag

SEQ ID NO: 659353 - DNA, 25 bp, Mus musculus
ggtttgaacctcttgtgtgctgagt

SEQ ID NO: 659354 - DNA, 25 bp, Mus musculus
ggtttgaactctcctctttttactt

SEQ ID NO: 659355 - DNA, 25 bp, Mus musculus
ggtttgaactctgctctttttactt

SEQ ID NO: 659356 - DNA, 25 bp, Mus musculus
ggtttgaactgcagagccgagagtt

SEQ ID NO: 659357 - DNA, 25 bp, Mus musculus
ggtttgaactgctgagccgagagtt

SEQ ID NO: 659358 - DNA, 25 bp, Mus musculus
ggtttgaacttacctgtgtgctcac

SEQ ID NO: 659359 - DNA, 25 bp, Mus musculus
ggtttgaacttagctgtgtgctcac

SEQ ID NO: 659360 - DNA, 25 bp, Mus musculus
ggtttgaactttagtcatttttgtg

SEQ ID NO: 659361 - DNA, 25 bp, Mus musculus
ggtttgaacttttgtcatttttgtg

SEQ ID NO: 659362 - DNA, 25 bp, Mus musculus
ggtttgaagaccacatttatagagc

SEQ ID NO: 659363 - DNA, 25 bp, Mus musculus
ggtttgaagacctcatttatagagc

SEQ ID NO: 659364 - DNA, 25 bp, Mus musculus
ggtttgaagactcccaatggctgcg

SEQ ID NO: 659365 - DNA, 25 bp, Mus musculus
ggtttgaagactgccaatggctgcg

SEQ ID NO: 659366 - DNA, 25 bp, Mus musculus
ggtttgaagagaattggctcccata

SEQ ID NO: 659367 - DNA, 25 bp, Mus musculus
ggtttgaagagatttggctcccata

SEQ ID NO: 659368 - DNA, 25 bp, Mus musculus
ggtttgaagctgcactttctttctg

SEQ ID NO: 659369 - DNA, 25 bp, Mus musculus
ggtttgaagctggactttctttctg

SEQ ID NO: 659370 - DNA, 25 bp, Mus musculus
ggtttgaaggtgattgacagctccc

SEQ ID NO: 659371 - DNA, 25 bp, Mus musculus
ggtttgaaggtgtttgacagctccc

SEQ ID NO: 659372 - DNA, 25 bp, Mus musculus
ggtttgaatcccaatgtgagataag

SEQ ID NO: 659373 - DNA, 25 bp, Mus musculus
ggtttgaatccctatgtgagataag

SEQ ID NO: 659374 - DNA, 25 bp, Mus musculus
ggtttgaatgtcacttccatctcta

SEQ ID NO: 659375 - DNA, 25 bp, Mus musculus
ggtttgaatgtctcttccatctcta

SEQ ID NO: 659376 - DNA, 25 bp, Mus musculus
ggtttgaatgtgaaagtttccccat

SEQ ID NO: 659377 - DNA, 25 bp, Mus musculus
ggtttgaatgtgaatgctccctata

SEQ ID NO: 659378 - DNA, 25 bp, Mus musculus
ggtttgaatgtgtaagtttccccat

SEQ ID NO: 659379 - DNA, 25 bp, Mus musculus
ggtttgaatgtgtatgctccctata

SEQ ID NO: 659380 - DNA, 25 bp, Mus musculus
ggtttgaatttcatatggcctcagg

SEQ ID NO: 659381 - DNA, 25 bp, Mus musculus
ggtttgaatttcttatggcctcagg

SEQ ID NO: 659382 - DNA, 25 bp, Mus musculus
ggtttgaatttgaaattccccaatg

SEQ ID NO: 659383 - DNA, 25 bp, Mus musculus
ggtttgaatttgtaattccccaatg

SEQ ID NO: 659384 - DNA, 25 bp, Mus musculus
ggtttgacaaaaatgacctcagcat

SEQ ID NO: 659385 - DNA, 25 bp, Mus musculus
ggtttgacaaaattgacctcagcat

SEQ ID NO: 659386 - DNA, 25 bp, Mus musculus
ggtttgacagatacgactcaggcat

SEQ ID NO: 659387 - DNA, 25 bp, Mus musculus
ggtttgacagattcgactcaggcat

SEQ ID NO: 659388 - DNA, 25 bp, Mus musculus
ggtttgacatgcaagacctcagttt

SEQ ID NO: 659389 - DNA, 25 bp, Mus musculus
ggtttgacatgctagacctcagttt

SEQ ID NO: 659390 - DNA, 25 bp, Mus musculus
ggtttgaccacaacaagggctggat

SEQ ID NO: 659391 - DNA, 25 bp, Mus musculus
ggtttgaccacatcaagggctggat

SEQ ID NO: 659392 - DNA, 25 bp, Mus musculus
ggtttgacccagctctgtaaatttt

SEQ ID NO: 659393 - DNA, 25 bp, Mus musculus
ggtttgacccaggtctgtaaatttt

SEQ ID NO: 659394 - DNA, 25 bp, Mus musculus
ggtttgacccttctatcacgttagt

SEQ ID NO: 659395 - DNA, 25 bp, Mus musculus
ggtttgacccttgtatcacgttagt

SEQ ID NO: 659396 - DNA, 25 bp, Mus musculus
ggtttgaccgatagccgtgcacaca

SEQ ID NO: 659397 - DNA, 25 bp, Mus musculus
ggtttgaccgattgccgtgcacaca

SEQ ID NO: 659398 - DNA, 25 bp, Mus musculus
ggtttgacctgtcagcatgcttgac

SEQ ID NO: 659399 - DNA, 25 bp, Mus musculus
ggtttgacctgtcagtcgcgacccc

SEQ ID NO: 659400 - DNA, 25 bp, Mus musculus
ggtttgacctgtgagcatgcttgac

SEQ ID NO: 659401 - DNA, 25 bp, Mus musculus
ggtttgacctgtgagtcgcgacccc

SEQ ID NO: 659402 - DNA, 25 bp, Mus musculus
ggtttgactcatagtttttcccaga

SEQ ID NO: 659403 - DNA, 25 bp, Mus musculus
ggtttgactcattgtttttcccaga

SEQ ID NO: 659404 - DNA, 25 bp, Mus musculus
ggtttgactgtgaaacccacacact

SEQ ID NO: 659405 - DNA, 25 bp, Mus musculus
ggtttgactgtgtaacccacacact

SEQ ID NO: 659406 - DNA, 25 bp, Mus musculus
ggtttgactttaaatcctatggcat

SEQ ID NO: 659407 - DNA, 25 bp, Mus musculus
ggtttgactttatatcctatggcat

SEQ ID NO: 659408 - DNA, 25 bp, Mus musculus
ggtttgactttgagaaactccacct

SEQ ID NO: 659409 - DNA, 25 bp, Mus musculus
ggtttgactttgtgaaactccacct

SEQ ID NO: 659410 - DNA, 25 bp, Mus musculus
ggtttgagacccacactctagaaga

SEQ ID NO: 659411 - DNA, 25 bp, Mus musculus
ggtttgagaccctcactctagaaga

SEQ ID NO: 659412 - DNA, 25 bp, Mus musculus
ggtttgagcaccatgagagcccggc

SEQ ID NO: 659413 - DNA, 25 bp, Mus musculus
ggtttgagcaccttgagagcccggc

SEQ ID NO: 659414 - DNA, 25 bp, Mus musculus
ggtttgaggcctactatgcagcgga

SEQ ID NO: 659415 - DNA, 25 bp, Mus musculus
ggtttgaggccttctatgcagcgga

SEQ ID NO: 659416 - DNA, 25 bp, Mus musculus
ggtttgaggctcacttgatctagtt

SEQ ID NO: 659417 - DNA, 25 bp, Mus musculus
ggtttgaggctctcttgatctagtt

SEQ ID NO: 659418 - DNA, 25 bp, Mus musculus
ggtttgagttctatacccacaccct

SEQ ID NO: 659419 - DNA, 25 bp, Mus musculus
ggtttgagttctttacccacaccct

SEQ ID NO: 659420 - DNA, 25 bp, Mus musculus
ggtttgatacagacatctagatttg

SEQ ID NO: 659421 - DNA, 25 bp, Mus musculus
ggtttgatacagtcatctagatttg

SEQ ID NO: 659422 - DNA, 25 bp, Mus musculus
ggtttgatccaaatcctattacagt

SEQ ID NO: 659423 - DNA, 25 bp, Mus musculus
ggtttgatccaattcctattacagt

SEQ ID NO: 659424 - DNA, 25 bp, Mus musculus
ggtttgatcctgcactcaccagaag

SEQ ID NO: 659425 - DNA, 25 bp, Mus musculus
ggtttgatcctggactcaccagaag

SEQ ID NO: 659426 - DNA, 25 bp, Mus musculus
ggtttgatcgagacagaccactgag

SEQ ID NO: 659427 - DNA, 25 bp, Mus musculus
ggtttgatcgagtcagaccactgag

SEQ ID NO: 659428 - DNA, 25 bp, Mus musculus
ggtttgatctacataaattcccttg

SEQ ID NO: 659429 - DNA, 25 bp, Mus musculus
ggtttgatctacttaaattcccttg

SEQ ID NO: 659430 - DNA, 25 bp, Mus musculus
ggtttgatctatattcggatgtaca

SEQ ID NO: 659431 - DNA, 25 bp, Mus musculus
ggtttgatctattttcggatgtaca

SEQ ID NO: 659432 - DNA, 25 bp, Mus musculus
ggtttgatgagccttcttcgtgaaa

SEQ ID NO: 659433 - DNA, 25 bp, Mus musculus
ggtttgatgagcgttcttcgtgaaa

SEQ ID NO: 659434 - DNA, 25 bp, Mus musculus
ggtttgatgatgcgctcagtgccat

SEQ ID NO: 659435 - DNA, 25 bp, Mus musculus
ggtttgatgatgggctcagtgccat

SEQ ID NO: 659436 - DNA, 25 bp, Mus musculus
ggtttgattacacccaggttccttt

SEQ ID NO: 659437 - DNA, 25 bp, Mus musculus
ggtttgattacagccaggttccttt

SEQ ID NO: 659438 - DNA, 25 bp, Mus musculus
ggtttgattagtaagggctagccat

SEQ ID NO: 659439 - DNA, 25 bp, Mus musculus
ggtttgattagttagggctagccat

SEQ ID NO: 659440 - DNA, 25 bp, Mus musculus
ggtttgattccacctgcataataat

SEQ ID NO: 659441 - DNA, 25 bp, Mus musculus
ggtttgattccagctgcataataat

SEQ ID NO: 659442 - DNA, 25 bp, Mus musculus
ggtttgattcttcatggtcagatgt

SEQ ID NO: 659443 - DNA, 25 bp, Mus musculus
ggtttgattcttgatggtcagatgt

SEQ ID NO: 659444 - DNA, 25 bp, Mus musculus
ggtttgatttgcagttcccaggtga

SEQ ID NO: 659445 - DNA, 25 bp, Mus musculus
ggtttgatttgctgttcccaggtga

SEQ ID NO: 659446 - DNA, 25 bp, Mus musculus
ggtttgcacatgatgttactgcctt

SEQ ID NO: 659447 - DNA, 25 bp, Mus musculus
ggtttgcacatgttgttactgcctt

SEQ ID NO: 659448 - DNA, 25 bp, Mus musculus
ggtttgcaccccacgcagggagcaa

SEQ ID NO: 659449 - DNA, 25 bp, Mus musculus
ggtttgcacccctcgcagggagcaa

SEQ ID NO: 659450 - DNA, 25 bp, Mus musculus
ggtttgcactcacatttcagaccaa

SEQ ID NO: 659451 - DNA, 25 bp, Mus musculus
ggtttgcactcagatttcagaccaa

SEQ ID NO: 659452 - DNA, 25 bp, Mus musculus
ggtttgcagaaacacctcattctcc

SEQ ID NO: 659453 - DNA, 25 bp, Mus musculus
ggtttgcagaaagacctcattctcc

SEQ ID NO: 659454 - DNA, 25 bp, Mus musculus
ggtttgcagataaaggtctccagtt

SEQ ID NO: 659455 - DNA, 25 bp, Mus musculus
ggtttgcagatataggtctccagtt

SEQ ID NO: 659456 - DNA, 25 bp, Mus musculus
ggtttgcagcttaagcacttagaac

SEQ ID NO: 659457 - DNA, 25 bp, Mus musculus
ggtttgcagctttagcacttagaac

SEQ ID NO: 659458 - DNA, 25 bp, Mus musculus
ggtttgcagtgaaatgcccactctc

SEQ ID NO: 659459 - DNA, 25 bp, Mus musculus
ggtttgcagtgatatgcccactctc

SEQ ID NO: 659460 - DNA, 25 bp, Mus musculus
ggtttgcagtttataaggctttcat

SEQ ID NO: 659461 - DNA, 25 bp, Mus musculus
ggtttgcagtttttaaggctttcat

SEQ ID NO: 659462 - DNA, 25 bp, Mus musculus
ggtttgcatagtatgtttttctgct

SEQ ID NO: 659463 - DNA, 25 bp, Mus musculus
ggtttgcatagtttgtttttctgct

SEQ ID NO: 659464 - DNA, 25 bp, Mus musculus
ggtttgcatatacttgttccatagg

SEQ ID NO: 659465 - DNA, 25 bp, Mus musculus
ggtttgcatatagttgttccatagg

SEQ ID NO: 659466 - DNA, 25 bp, Mus musculus
ggtttgcatatcacaccctggtgtc

SEQ ID NO: 659467 - DNA, 25 bp, Mus musculus
ggtttgcatatctcaccctggtgtc

SEQ ID NO: 659468 - DNA, 25 bp, Mus musculus
ggtttgcatcctctgtttagtttgt

SEQ ID NO: 659469 - DNA, 25 bp, Mus musculus
ggtttgcatcctgtgtttagtttgt

SEQ ID NO: 659470 - DNA, 25 bp, Mus musculus
ggtttgcatgggaaaatccctctgt

SEQ ID NO: 659471 - DNA, 25 bp, Mus musculus
ggtttgcatgggtaaatccctctgt

SEQ ID NO: 659472 - DNA, 25 bp, Mus musculus
ggtttgcattctcccattggctaaa

SEQ ID NO: 659473 - DNA, 25 bp, Mus musculus
ggtttgcattctgccattggctaaa

SEQ ID NO: 659474 - DNA, 25 bp, Mus musculus
ggtttgccaagacccctaaggagcg

SEQ ID NO: 659475 - DNA, 25 bp, Mus musculus
ggtttgccaagagccctaaggagcg

SEQ ID NO: 659476 - DNA, 25 bp, Mus musculus
ggtttgccaagcaaggacaaggaaa

SEQ ID NO: 659477 - DNA, 25 bp, Mus musculus
ggtttgccaagctaggacaaggaaa

SEQ ID NO: 659478 - DNA, 25 bp, Mus musculus
ggtttgccaagtaactgccagtgtt

SEQ ID NO: 659479 - DNA, 25 bp, Mus musculus
ggtttgccaagttactgccagtgtt

SEQ ID NO: 659480 - DNA, 25 bp, Mus musculus
ggtttgccagccattattatgctgt

SEQ ID NO: 659481 - DNA, 25 bp, Mus musculus
ggtttgccagcctttattatgctgt

SEQ ID NO: 659482 - DNA, 25 bp, Mus musculus
ggtttgccagtaccttttagtcttg

SEQ ID NO: 659483 - DNA, 25 bp, Mus musculus
ggtttgccagtagcttttagtcttg

SEQ ID NO: 659484 - DNA, 25 bp, Mus musculus
ggtttgccatgcactatttaagtgt

SEQ ID NO: 659485 - DNA, 25 bp, Mus musculus
ggtttgccatgctctatttaagtgt

SEQ ID NO: 659486 - DNA, 25 bp, Mus musculus
ggtttgccattcagtagctgtgact

SEQ ID NO: 659487 - DNA, 25 bp, Mus musculus
ggtttgccattctgtagctgtgact

SEQ ID NO: 659488 - DNA, 25 bp, Mus musculus
ggtttgcccattaatatttcctgta

SEQ ID NO: 659489 - DNA, 25 bp, Mus musculus
ggtttgcccatttatatttcctgta

SEQ ID NO: 659490 - DNA, 25 bp, Mus musculus
ggtttgcccgttctttcacaagagc

SEQ ID NO: 659491 - DNA, 25 bp, Mus musculus
ggtttgcccgttgtttcacaagagc

SEQ ID NO: 659492 - DNA, 25 bp, Mus musculus
ggtttgcccttcctgagcaaagcat

SEQ ID NO: 659493 - DNA, 25 bp, Mus musculus
ggtttgcccttcgtgagcaaagcat

SEQ ID NO: 659494 - DNA, 25 bp, Mus musculus
ggtttgccgtctagggatcccatgg

SEQ ID NO: 659495 - DNA, 25 bp, Mus musculus
ggtttgccgtcttgggatcccatgg

SEQ ID NO: 659496 - DNA, 25 bp, Mus musculus
ggtttgccttcgagtgagttttcat

SEQ ID NO: 659497 - DNA, 25 bp, Mus musculus
ggtttgccttcgtgtgagttttcat

SEQ ID NO: 659498 - DNA, 25 bp, Mus musculus
ggtttgcgagttcaactaatcctca

SEQ ID NO: 659499 - DNA, 25 bp, Mus musculus
ggtttgcgagttgaactaatcctca

SEQ ID NO: 659500 - DNA, 25 bp, Mus musculus
ggtttgctaaatatccttttctggc

SEQ ID NO: 659501 - DNA, 25 bp, Mus musculus
ggtttgctaaatttccttttctggc

SEQ ID NO: 659502 - DNA, 25 bp, Mus musculus
ggtttgctcataagtcaggtttata

SEQ ID NO: 659503 - DNA, 25 bp, Mus musculus
ggtttgctcatatgtcaggtttata

SEQ ID NO: 659504 - DNA, 25 bp, Mus musculus
ggtttgctccccaggactgaaatgg

SEQ ID NO: 659505 - DNA, 25 bp, Mus musculus
ggtttgctcccctggactgaaatgg

SEQ ID NO: 659506 - DNA, 25 bp, Mus musculus
ggtttgctcctcagtactccaagga

SEQ ID NO: 659507 - DNA, 25 bp, Mus musculus
ggtttgctcctctgtactccaagga

SEQ ID NO: 659508 - DNA, 25 bp, Mus musculus
ggtttgctctctatcaatctgaata

SEQ ID NO: 659509 - DNA, 25 bp, Mus musculus
ggtttgctctctttcaatctgaata

SEQ ID NO: 659510 - DNA, 25 bp, Mus musculus
ggtttgctgaataacttgcctgccc

SEQ ID NO: 659511 - DNA, 25 bp, Mus musculus
ggtttgctgaattacttgcctgccc

SEQ ID NO: 659512 - DNA, 25 bp, Mus musculus
ggtttgctgactaattgtgccatga

SEQ ID NO: 659513 - DNA, 25 bp, Mus musculus
ggtttgctgacttattgtgccatga

SEQ ID NO: 659514 - DNA, 25 bp, Mus musculus
ggtttgctgctaaaggcaggagatt

SEQ ID NO: 659515 - DNA, 25 bp, Mus musculus
ggtttgctgctataggcaggagatt

SEQ ID NO: 659516 - DNA, 25 bp, Mus musculus
ggtttgctgctgagatacaatcatg

SEQ ID NO: 659517 - DNA, 25 bp, Mus musculus
ggtttgctgctgtgatacaatcatg

SEQ ID NO: 659518 - DNA, 25 bp, Mus musculus
ggtttgcttatactcattctccata

SEQ ID NO: 659519 - DNA, 25 bp, Mus musculus
ggtttgcttatagtcattctccata

SEQ ID NO: 659520 - DNA, 25 bp, Mus musculus
ggtttgcttattcatcagatccaga

SEQ ID NO: 659521 - DNA, 25 bp, Mus musculus
ggtttgcttattgatcagatccaga

SEQ ID NO: 659522 - DNA, 25 bp, Mus musculus
ggtttgcttctgatgtgagtggcca

SEQ ID NO: 659523 - DNA, 25 bp, Mus musculus
ggtttgcttctgttgtgagtggcca

SEQ ID NO: 659524 - DNA, 25 bp, Mus musculus
ggtttgcttgacagtactggacttt

SEQ ID NO: 659525 - DNA, 25 bp, Mus musculus
ggtttgcttgactgtactggacttt

SEQ ID NO: 659526 - DNA, 25 bp, Mus musculus
ggtttgcttggtatacatccctcat

SEQ ID NO: 659527 - DNA, 25 bp, Mus musculus
ggtttgcttggtttacatccctcat

SEQ ID NO: 659528 - DNA, 25 bp, Mus musculus
ggtttgctttcaataccataaatct

SEQ ID NO: 659529 - DNA, 25 bp, Mus musculus
ggtttgctttcattaccataaatct

SEQ ID NO: 659530 - DNA, 25 bp, Mus musculus
ggtttgctttccagagagtagtcaa

SEQ ID NO: 659531 - DNA, 25 bp, Mus musculus
ggtttgctttcctgagagtagtcaa

SEQ ID NO: 659532 - DNA, 25 bp, Mus musculus
ggtttggaaagaacgctccccatgt

SEQ ID NO: 659533 - DNA, 25 bp, Mus musculus
ggtttggaaagatcgctccccatgt

SEQ ID NO: 659534 - DNA, 25 bp, Mus musculus
ggtttggaaagtagcttactgacat

SEQ ID NO: 659535 - DNA, 25 bp, Mus musculus
ggtttggaaagttgcttactgacat

SEQ ID NO: 659536 - DNA, 25 bp, Mus musculus
ggtttggaacacaggacttgactat

SEQ ID NO: 659537 - DNA, 25 bp, Mus musculus
ggtttggaacactggacttgactat

SEQ ID NO: 659538 - DNA, 25 bp, Mus musculus
ggtttggacattctgggctctacat

SEQ ID NO: 659539 - DNA, 25 bp, Mus musculus
ggtttggacattgtgggctctacat

SEQ ID NO: 659540 - DNA, 25 bp, Mus musculus
ggtttggactctactcaaatactgt

SEQ ID NO: 659541 - DNA, 25 bp, Mus musculus
ggtttggactcttctcaaatactgt

SEQ ID NO: 659542 - DNA, 25 bp, Mus musculus
ggtttggagtttacgctcaggcaaa

SEQ ID NO: 659543 - DNA, 25 bp, Mus musculus
ggtttggagttttcgctcaggcaaa

SEQ ID NO: 659544 - DNA, 25 bp, Mus musculus
ggtttggatatgcttggcctattag

SEQ ID NO: 659545 - DNA, 25 bp, Mus musculus
ggtttggatatggttggcctattag

SEQ ID NO: 659546 - DNA, 25 bp, Mus musculus
ggtttggatcacacaagtctgatgt

SEQ ID NO: 659547 - DNA, 25 bp, Mus musculus
ggtttggatcactcaagtctgatgt

SEQ ID NO: 659548 - DNA, 25 bp, Mus musculus
ggtttggatcttcaacctttatgtt

SEQ ID NO: 659549 - DNA, 25 bp, Mus musculus
ggtttggatcttgaacctttatgtt

SEQ ID NO: 659550 - DNA, 25 bp, Mus musculus
ggtttggatgatctggtcacacatg

SEQ ID NO: 659551 - DNA, 25 bp, Mus musculus
ggtttggatgatgtggtcacacatg

SEQ ID NO: 659552 - DNA, 25 bp, Mus musculus
ggtttggatgctactatattgcccc

SEQ ID NO: 659553 - DNA, 25 bp, Mus musculus
ggtttggatgcttctatattgcccc

SEQ ID NO: 659554 - DNA, 25 bp, Mus musculus
ggtttggattgacccagcaggccca

SEQ ID NO: 659555 - DNA, 25 bp, Mus musculus
ggtttggattgagccagcaggccca

SEQ ID NO: 659556 - DNA, 25 bp, Mus musculus
ggtttggattttcgcagccctggcc

SEQ ID NO: 659557 - DNA, 25 bp, Mus musculus
ggtttggattttggcagccctggcc

SEQ ID NO: 659558 - DNA, 25 bp, Mus musculus
ggtttggcacaaccttctggaggcc

SEQ ID NO: 659559 - DNA, 25 bp, Mus musculus
ggtttggcacaagcttctggaggcc

SEQ ID NO: 659560 - DNA, 25 bp, Mus musculus
ggtttggcaccaccgaatccatgat

SEQ ID NO: 659561 - DNA, 25 bp, Mus musculus
ggtttggcaccagcgaatccatgat

SEQ ID NO: 659562 - DNA, 25 bp, Mus musculus
ggtttggcagacacgatgcctgcat

SEQ ID NO: 659563 - DNA, 25 bp, Mus musculus
ggtttggcagactcgatgcctgcat

SEQ ID NO: 659564 - DNA, 25 bp, Mus musculus
ggtttggcagtaaatgcttgcttta

SEQ ID NO: 659565 - DNA, 25 bp, Mus musculus
ggtttggcagtatatgcttgcttta

SEQ ID NO: 659566 - DNA, 25 bp, Mus musculus
ggtttggcagttaccctgattgcgg

SEQ ID NO: 659567 - DNA, 25 bp, Mus musculus
ggtttggcagtttccctgattgcgg

SEQ ID NO: 659568 - DNA, 25 bp, Mus musculus
ggtttggcatgaaagccccagaact

SEQ ID NO: 659569 - DNA, 25 bp, Mus musculus
ggtttggcatgatagccccagaact

SEQ ID NO: 659570 - DNA, 25 bp, Mus musculus
ggtttggccaacactatgggtctga

SEQ ID NO: 659571 - DNA, 25 bp, Mus musculus
ggtttggccaactctatgggtctga

SEQ ID NO: 659572 - DNA, 25 bp, Mus musculus
ggtttggccctacatagaatggtca

SEQ ID NO: 659573 - DNA, 25 bp, Mus musculus
ggtttggccctagatagaatggtca

SEQ ID NO: 659574 - DNA, 25 bp, Mus musculus
ggtttggcctggcattgtaaacaga

SEQ ID NO: 659575 - DNA, 25 bp, Mus musculus
ggtttggcctgggattgtaaacaga

SEQ ID NO: 659576 - DNA, 25 bp, Mus musculus
ggtttggctatgaatgcactaatca

SEQ ID NO: 659577 - DNA, 25 bp, Mus musculus
ggtttggctatgtatgcactaatca

SEQ ID NO: 659578 - DNA, 25 bp, Mus musculus
ggtttggctctaatggtgccaccat

SEQ ID NO: 659579 - DNA, 25 bp, Mus musculus
ggtttggctctattggtgccaccat

SEQ ID NO: 659580 - DNA, 25 bp, Mus musculus
ggtttgggcaaacgacatacaattt

SEQ ID NO: 659581 - DNA, 25 bp, Mus musculus
ggtttgggcaaaggacatacaattt

SEQ ID NO: 659582 - DNA, 25 bp, Mus musculus
ggtttgggccatactttaacaactg

SEQ ID NO: 659583 - DNA, 25 bp, Mus musculus
ggtttgggccattctttaacaactg

SEQ ID NO: 659584 - DNA, 25 bp, Mus musculus
ggtttgggctaacagtccacagttt

SEQ ID NO: 659585 - DNA, 25 bp, Mus musculus
ggtttgggctaagagtccacagttt

SEQ ID NO: 659586 - DNA, 25 bp, Mus musculus
ggtttgggctataacacatgaatat

SEQ ID NO: 659587 - DNA, 25 bp, Mus musculus
ggtttgggctattacacatgaatat

SEQ ID NO: 659588 - DNA, 25 bp, Mus musculus
ggtttgggctctagtcctttggaga

SEQ ID NO: 659589 - DNA, 25 bp, Mus musculus
ggtttgggctcttgtcctttggaga

SEQ ID NO: 659590 - DNA, 25 bp, Mus musculus
ggtttggtattcaccatttctattt

SEQ ID NO: 659591 - DNA, 25 bp, Mus musculus
ggtttggtattctccatttctattt

SEQ ID NO: 659592 - DNA, 25 bp, Mus musculus
ggtttggtcactaacacatcttact

SEQ ID NO: 659593 - DNA, 25 bp, Mus musculus
ggtttggtcacttacacatcttact

SEQ ID NO: 659594 - DNA, 25 bp, Mus musculus
ggtttggtcaggagataagcgcccc

SEQ ID NO: 659595 - DNA, 25 bp, Mus musculus
ggtttggtcaggtgataagcgcccc

SEQ ID NO: 659596 - DNA, 25 bp, Mus musculus
ggtttggtcattcattacacttcag

SEQ ID NO: 659597 - DNA, 25 bp, Mus musculus
ggtttggtcattgattacacttcag

SEQ ID NO: 659598 - DNA, 25 bp, Mus musculus
ggtttggtccatctacctaaggtga

SEQ ID NO: 659599 - DNA, 25 bp, Mus musculus
ggtttggtccatgtacctaaggtga

SEQ ID NO: 659600 - DNA, 25 bp, Mus musculus
ggtttggtgcagattgtttctttgt

SEQ ID NO: 659601 - DNA, 25 bp, Mus musculus
ggtttggtgcagtttgtttctttgt

SEQ ID NO: 659602 - DNA, 25 bp, Mus musculus
ggtttggttacaactatttctcatc

SEQ ID NO: 659603 - DNA, 25 bp, Mus musculus
ggtttggttacatctatttctcatc

SEQ ID NO: 659604 - DNA, 25 bp, Mus musculus
ggtttggttactccacagctgagga

SEQ ID NO: 659605 - DNA, 25 bp, Mus musculus
ggtttggttactgcacagctgagga

SEQ ID NO: 659606 - DNA, 25 bp, Mus musculus
ggtttggttcagagcttagcttccc

SEQ ID NO: 659607 - DNA, 25 bp, Mus musculus
ggtttggttcagtgcttagcttccc

SEQ ID NO: 659608 - DNA, 25 bp, Mus musculus
ggtttggttccaatctctacaagac

SEQ ID NO: 659609 - DNA, 25 bp, Mus musculus
ggtttggttccattctctacaagac

SEQ ID NO: 659610 - DNA, 25 bp, Mus musculus
ggtttggttcccagtgcacgcatgg

SEQ ID NO: 659611 - DNA, 25 bp, Mus musculus
ggtttggttccctgtgcacgcatgg

SEQ ID NO: 659612 - DNA, 25 bp, Mus musculus
ggtttggttctgatactgtttttga

SEQ ID NO: 659613 - DNA, 25 bp, Mus musculus
ggtttggttctgttactgtttttga

SEQ ID NO: 659614 - DNA, 25 bp, Mus musculus
ggtttggttcttacttgacaactca

SEQ ID NO: 659615 - DNA, 25 bp, Mus musculus
ggtttggttctttcttgacaactca

SEQ ID NO: 659616 - DNA, 25 bp, Mus musculus
ggtttgtaacgaattctctctgccc

SEQ ID NO: 659617 - DNA, 25 bp, Mus musculus
ggtttgtaacgatttctctctgccc

SEQ ID NO: 659618 - DNA, 25 bp, Mus musculus
ggtttgtacagtcgcaagtcctccc

SEQ ID NO: 659619 - DNA, 25 bp, Mus musculus
ggtttgtacagtctctacccaatca

SEQ ID NO: 659620 - DNA, 25 bp, Mus musculus
ggtttgtacagtggcaagtcctccc

SEQ ID NO: 659621 - DNA, 25 bp, Mus musculus
ggtttgtacagtgtctacccaatca

SEQ ID NO: 659622 - DNA, 25 bp, Mus musculus
ggtttgtacctcctagtttgcgcac

SEQ ID NO: 659623 - DNA, 25 bp, Mus musculus
ggtttgtacctcgtagtttgcgcac

SEQ ID NO: 659624 - DNA, 25 bp, Mus musculus
ggtttgtatattaccctctaatctt

SEQ ID NO: 659625 - DNA, 25 bp, Mus musculus
ggtttgtatatttccctctaatctt

SEQ ID NO: 659626 - DNA, 25 bp, Mus musculus
ggtttgtatggtcccagaactatta

SEQ ID NO: 659627 - DNA, 25 bp, Mus musculus
ggtttgtatggtgccagaactatta

SEQ ID NO: 659628 - DNA, 25 bp, Mus musculus
ggtttgtattgcatatacctttagt

SEQ ID NO: 659629 - DNA, 25 bp, Mus musculus
ggtttgtattgcttatacctttagt

SEQ ID NO: 659630 - DNA, 25 bp, Mus musculus
ggtttgtcacctacagtgtcacagc

SEQ ID NO: 659631 - DNA, 25 bp, Mus musculus
ggtttgtcaccttcagtgtcacagc

SEQ ID NO: 659632 - DNA, 25 bp, Mus musculus
ggtttgtcaggcatttcactgcctt

SEQ ID NO: 659633 - DNA, 25 bp, Mus musculus
ggtttgtcaggcttttcactgcctt

SEQ ID NO: 659634 - DNA, 25 bp, Mus musculus
ggtttgtcagtacgattcttagctt

SEQ ID NO: 659635 - DNA, 25 bp, Mus musculus
ggtttgtcagtaggattcttagctt

SEQ ID NO: 659636 - DNA, 25 bp, Mus musculus
ggtttgtccatcaataccattgtaa

SEQ ID NO: 659637 - DNA, 25 bp, Mus musculus
ggtttgtccatctataccattgtaa

SEQ ID NO: 659638 - DNA, 25 bp, Mus musculus
ggtttgtcctggcagttagctcaat

SEQ ID NO: 659639 - DNA, 25 bp, Mus musculus
ggtttgtcctgggagttagctcaat

SEQ ID NO: 659640 - DNA, 25 bp, Mus musculus
ggtttgtctatcagcctcattataa

SEQ ID NO: 659641 - DNA, 25 bp, Mus musculus
ggtttgtctatctgcctcattataa

SEQ ID NO: 659642 - DNA, 25 bp, Mus musculus
ggtttgtctcccacatcaaaaacaa

SEQ ID NO: 659643 - DNA, 25 bp, Mus musculus
ggtttgtctccctcatcaaaaacaa

SEQ ID NO: 659644 - DNA, 25 bp, Mus musculus
ggtttgtctgttcataggtagcttc

SEQ ID NO: 659645 - DNA, 25 bp, Mus musculus
ggtttgtctgttgataggtagcttc

SEQ ID NO: 659646 - DNA, 25 bp, Mus musculus
ggtttgtgaataatgatccccagat

SEQ ID NO: 659647 - DNA, 25 bp, Mus musculus
ggtttgtgaatattgatccccagat

SEQ ID NO: 659648 - DNA, 25 bp, Mus musculus
ggtttgtgatctcttgtaggttata

SEQ ID NO: 659649 - DNA, 25 bp, Mus musculus
ggtttgtgatctgttgtaggttata

SEQ ID NO: 659650 - DNA, 25 bp, Mus musculus
ggtttgtgcatcacaattaagccaa

SEQ ID NO: 659651 - DNA, 25 bp, Mus musculus
ggtttgtgcatctcaattaagccaa

SEQ ID NO: 659652 - DNA, 25 bp, Mus musculus
ggtttgtggcatcatctcagatctt

SEQ ID NO: 659653 - DNA, 25 bp, Mus musculus
ggtttgtggcatgatctcagatctt

SEQ ID NO: 659654 - DNA, 25 bp, Mus musculus
ggtttgtggtataagccatttctcc

SEQ ID NO: 659655 - DNA, 25 bp, Mus musculus
ggtttgtggtattagccatttctcc

SEQ ID NO: 659656 - DNA, 25 bp, Mus musculus
ggtttgtgtaagcagtattcggtca

SEQ ID NO: 659657 - DNA, 25 bp, Mus musculus
ggtttgtgtaaggagtattcggtca

SEQ ID NO: 659658 - DNA, 25 bp, Mus musculus
ggtttgtgtaggactccagggacaa

SEQ ID NO: 659659 - DNA, 25 bp, Mus musculus
ggtttgtgtaggtctccagggacaa

SEQ ID NO: 659660 - DNA, 25 bp, Mus musculus
ggtttgtgtcacagttttttgttgg

SEQ ID NO: 659661 - DNA, 25 bp, Mus musculus
ggtttgtgtcactgttttttgttgg

SEQ ID NO: 659662 - DNA, 25 bp, Mus musculus
ggtttgtgtgtgctatggcttcaat

SEQ ID NO: 659663 - DNA, 25 bp, Mus musculus
ggtttgtgtgtggtatggcttcaat

SEQ ID NO: 659664 - DNA, 25 bp, Mus musculus
ggtttgttagaccagggcagattaa

SEQ ID NO: 659665 - DNA, 25 bp, Mus musculus
ggtttgttagacgagggcagattaa

SEQ ID NO: 659666 - DNA, 25 bp, Mus musculus
ggtttgttcaggatgctgcaagctc

SEQ ID NO: 659667 - DNA, 25 bp, Mus musculus
ggtttgttcaggttgctgcaagctc

SEQ ID NO: 659668 - DNA, 25 bp, Mus musculus
ggtttgttcagtcgatgcttagact

SEQ ID NO: 659669 - DNA, 25 bp, Mus musculus
ggtttgttcagtggatgcttagact

SEQ ID NO: 659670 - DNA, 25 bp, Mus musculus
ggtttgttggtcacatagcactgtt

SEQ ID NO: 659671 - DNA, 25 bp, Mus musculus
ggtttgttggtctcatagcactgtt

SEQ ID NO: 659672 - DNA, 25 bp, Mus musculus
ggtttgttgtatctggccccagagt

SEQ ID NO: 659673 - DNA, 25 bp, Mus musculus
ggtttgttgtatgtggccccagagt

SEQ ID NO: 659674 - DNA, 25 bp, Mus musculus
ggtttgtttactaggatctccaaag

SEQ ID NO: 659675 - DNA, 25 bp, Mus musculus
ggtttgtttacttggatctccaaag

SEQ ID NO: 659676 - DNA, 25 bp, Mus musculus
ggtttgtttcagcatattttggttc

SEQ ID NO: 659677 - DNA, 25 bp, Mus musculus
ggtttgtttcaggatattttggttc

SEQ ID NO: 659678 - DNA, 25 bp, Mus musculus
ggtttgtttgccataacagctcctt

SEQ ID NO: 659679 - DNA, 25 bp, Mus musculus
ggtttgtttgccttaacagctcctt

SEQ ID NO: 659680 - DNA, 25 bp, Mus musculus
ggtttgttttatcccagcttaatac

SEQ ID NO: 659681 - DNA, 25 bp, Mus musculus
ggtttgttttatgccagcttaatac

SEQ ID NO: 659682 - DNA, 25 bp, Mus musculus
ggtttgttttccactgaagcctagc

SEQ ID NO: 659683 - DNA, 25 bp, Mus musculus
ggtttgttttcctctgaagcctagc

SEQ ID NO: 659684 - DNA, 25 bp, Mus musculus
ggtttgttttgtcaccaagctgtgt

SEQ ID NO: 659685 - DNA, 25 bp, Mus musculus
ggtttgttttgtctaggcacctatt

SEQ ID NO: 659686 - DNA, 25 bp, Mus musculus
ggtttgttttgtgaccaagctgtgt

SEQ ID NO: 659687 - DNA, 25 bp, Mus musculus
ggtttgttttgtgtaggcacctatt

SEQ ID NO: 659688 - DNA, 25 bp, Mus musculus
ggtttgtttttacttgagcctgcct

SEQ ID NO: 659689 - DNA, 25 bp, Mus musculus
ggtttgtttttagttgagcctgcct

SEQ ID NO: 659690 - DNA, 25 bp, Mus musculus
ggttttaaagggagccatgggctct

SEQ ID NO: 659691 - DNA, 25 bp, Mus musculus
ggttttaaagggtgccatgggctct

SEQ ID NO: 659692 - DNA, 25 bp, Mus musculus
ggttttaaatgaacacacttcccac

SEQ ID NO: 659693 - DNA, 25 bp, Mus musculus
ggttttaaatgatcacacttcccac

SEQ ID NO: 659694 - DNA, 25 bp, Mus musculus
ggttttaacattctcactacagtgg

SEQ ID NO: 659695 - DNA, 25 bp, Mus musculus
ggttttaacattgtcactacagtgg

SEQ ID NO: 659696 - DNA, 25 bp, Mus musculus
ggttttaagaatatcctgatgctct

SEQ ID NO: 659697 - DNA, 25 bp, Mus musculus
ggttttaagaatttcctgatgctct

SEQ ID NO: 659698 - DNA, 25 bp, Mus musculus
ggttttaagattactcaccttacag

SEQ ID NO: 659699 - DNA, 25 bp, Mus musculus
ggttttaagatttctcaccttacag

SEQ ID NO: 659700 - DNA, 25 bp, Mus musculus
ggttttaagcagatactcctactag

SEQ ID NO: 659701 - DNA, 25 bp, Mus musculus
ggttttaagcagttactcctactag

SEQ ID NO: 659702 - DNA, 25 bp, Mus musculus
ggttttaatcttatgccatcattca

SEQ ID NO: 659703 - DNA, 25 bp, Mus musculus
ggttttaatcttttgccatcattca

SEQ ID NO: 659704 - DNA, 25 bp, Mus musculus
ggttttaattgcactgtagtcagtg

SEQ ID NO: 659705 - DNA, 25 bp, Mus musculus
ggttttaattgctctgtagtcagtg

SEQ ID NO: 659706 - DNA, 25 bp, Mus musculus
ggttttaattgtacagacgtgtgag

SEQ ID NO: 659707 - DNA, 25 bp, Mus musculus
ggttttaattgttcagacgtgtgag

SEQ ID NO: 659708 - DNA, 25 bp, Mus musculus
ggttttacaaaaacacaggcttgga

SEQ ID NO: 659709 - DNA, 25 bp, Mus musculus
ggttttacaaaatcacaggcttgga

SEQ ID NO: 659710 - DNA, 25 bp, Mus musculus
ggttttacaaatcctctgtaggcta

SEQ ID NO: 659711 - DNA, 25 bp, Mus musculus
ggttttacaaatgctctgtaggcta

SEQ ID NO: 659712 - DNA, 25 bp, Mus musculus
ggttttacacagaagctctgctcca

SEQ ID NO: 659713 - DNA, 25 bp, Mus musculus
ggttttacacagtagctctgctcca

SEQ ID NO: 659714 - DNA, 25 bp, Mus musculus
ggttttacaccactaatcctagcac

SEQ ID NO: 659715 - DNA, 25 bp, Mus musculus
ggttttacaccagtaatcctagcac

SEQ ID NO: 659716 - DNA, 25 bp, Mus musculus
ggttttacagaaatcaatgcccgtt

SEQ ID NO: 659717 - DNA, 25 bp, Mus musculus
ggttttacagaattcaatgcccgtt

SEQ ID NO: 659718 - DNA, 25 bp, Mus musculus
ggttttacagcaagtcacttgtgca

SEQ ID NO: 659719 - DNA, 25 bp, Mus musculus
ggttttacagcatgtcacttgtgca

SEQ ID NO: 659720 - DNA, 25 bp, Mus musculus
ggttttaccaagcatccgtgtgcat

SEQ ID NO: 659721 - DNA, 25 bp, Mus musculus
ggttttaccaaggatccgtgtgcat

SEQ ID NO: 659722 - DNA, 25 bp, Mus musculus
ggttttaccagccttagagttgtca

SEQ ID NO: 659723 - DNA, 25 bp, Mus musculus
ggttttaccagcgttagagttgtca

SEQ ID NO: 659724 - DNA, 25 bp, Mus musculus
ggttttacctggaactcttctatct

SEQ ID NO: 659725 - DNA, 25 bp, Mus musculus
ggttttacctggtactcttctatct

SEQ ID NO: 659726 - DNA, 25 bp, Mus musculus
ggttttactattcttggcattttgc

SEQ ID NO: 659727 - DNA, 25 bp, Mus musculus
ggttttactattgttggcattttgc

SEQ ID NO: 659728 - DNA, 25 bp, Mus musculus
ggttttactctgactgagctccaat

SEQ ID NO: 659729 - DNA, 25 bp, Mus musculus
ggttttactctgtctgagctccaat

SEQ ID NO: 659730 - DNA, 25 bp, Mus musculus
ggttttactgtaagctgtgttcact

SEQ ID NO: 659731 - DNA, 25 bp, Mus musculus
ggttttactgtatgctgtgttcact

SEQ ID NO: 659732 - DNA, 25 bp, Mus musculus
ggttttactgtcacaggagccgatc

SEQ ID NO: 659733 - DNA, 25 bp, Mus musculus
ggttttactgtctcaggagccgatc

SEQ ID NO: 659734 - DNA, 25 bp, Mus musculus
ggttttagaatgactttcacacttt

SEQ ID NO: 659735 - DNA, 25 bp, Mus musculus
ggttttagaatgtctttcacacttt

SEQ ID NO: 659736 - DNA, 25 bp, Mus musculus
ggttttagacctagatgactcttcc

SEQ ID NO: 659737 - DNA, 25 bp, Mus musculus
ggttttagaccttgatgactcttcc

SEQ ID NO: 659738 - DNA, 25 bp, Mus musculus
ggttttagatttaagcccgtgctgt

SEQ ID NO: 659739 - DNA, 25 bp, Mus musculus
ggttttagattttagcccgtgctgt

SEQ ID NO: 659740 - DNA, 25 bp, Mus musculus
ggttttagcaccaatgtagagaaat

SEQ ID NO: 659741 - DNA, 25 bp, Mus musculus
ggttttagcacctatgtagagaaat

SEQ ID NO: 659742 - DNA, 25 bp, Mus musculus
ggttttagcagcactacttggtaga

SEQ ID NO: 659743 - DNA, 25 bp, Mus musculus
ggttttagcagctctacttggtaga

SEQ ID NO: 659744 - DNA, 25 bp, Mus musculus
ggttttagcctgaatggagccagaa

SEQ ID NO: 659745 - DNA, 25 bp, Mus musculus
ggttttagcctgtatggagccagaa

SEQ ID NO: 659746 - DNA, 25 bp, Mus musculus
ggttttagccttaactcaagcactg

SEQ ID NO: 659747 - DNA, 25 bp, Mus musculus
ggttttagcctttactcaagcactg

SEQ ID NO: 659748 - DNA, 25 bp, Mus musculus
ggttttagctttagttcagatttat

SEQ ID NO: 659749 - DNA, 25 bp, Mus musculus
ggttttagcttttgttcagatttat

SEQ ID NO: 659750 - DNA, 25 bp, Mus musculus
ggttttaggaacaccatcctgcagg

SEQ ID NO: 659751 - DNA, 25 bp, Mus musculus
ggttttaggaactccatcctgcagg

SEQ ID NO: 659752 - DNA, 25 bp, Mus musculus
ggttttaggctacatgggactcact

SEQ ID NO: 659753 - DNA, 25 bp, Mus musculus
ggttttaggctagatgggactcact

SEQ ID NO: 659754 - DNA, 25 bp, Mus musculus
ggttttagtccaagcataattcaca

SEQ ID NO: 659755 - DNA, 25 bp, Mus musculus
ggttttagtccaatacatgccttta

SEQ ID NO: 659756 - DNA, 25 bp, Mus musculus
ggttttagtccatgcataattcaca

SEQ ID NO: 659757 - DNA, 25 bp, Mus musculus
ggttttagtccattacatgccttta

SEQ ID NO: 659758 - DNA, 25 bp, Mus musculus
ggttttagtctacagcctgccgttc

SEQ ID NO: 659759 - DNA, 25 bp, Mus musculus
ggttttagtctagagcctgccgttc

SEQ ID NO: 659760 - DNA, 25 bp, Mus musculus
ggttttagttacacttctgggtgct

SEQ ID NO: 659761 - DNA, 25 bp, Mus musculus
ggttttagttactcttctgggtgct

SEQ ID NO: 659762 - DNA, 25 bp, Mus musculus
ggttttagtttcactggcagggaca

SEQ ID NO: 659763 - DNA, 25 bp, Mus musculus
ggttttagtttctctggcagggaca

SEQ ID NO: 659764 - DNA, 25 bp, Mus musculus
ggttttataaaccacatgagcctat

SEQ ID NO: 659765 - DNA, 25 bp, Mus musculus
ggttttataaacgacatgagcctat

SEQ ID NO: 659766 - DNA, 25 bp, Mus musculus
ggttttataaccatcatcatgaaag

SEQ ID NO: 659767 - DNA, 25 bp, Mus musculus
ggttttataaccttcatcatgaaag

SEQ ID NO: 659768 - DNA, 25 bp, Mus musculus
ggttttataatcatcttaccgtaag

SEQ ID NO: 659769 - DNA, 25 bp, Mus musculus
ggttttataatcttcttaccgtaag

SEQ ID NO: 659770 - DNA, 25 bp, Mus musculus
ggttttatacatccttgtctacatt

SEQ ID NO: 659771 - DNA, 25 bp, Mus musculus
ggttttatacatgcttgtctacatt

SEQ ID NO: 659772 - DNA, 25 bp, Mus musculus
ggttttatacttagtatcagttgct

SEQ ID NO: 659773 - DNA, 25 bp, Mus musculus
ggttttatactttgtatcagttgct

SEQ ID NO: 659774 - DNA, 25 bp, Mus musculus
ggttttatagttcccagcgatatat

SEQ ID NO: 659775 - DNA, 25 bp, Mus musculus
ggttttatagttgccagcgatatat

SEQ ID NO: 659776 - DNA, 25 bp, Mus musculus
ggttttatatgtcaggtccttagca

SEQ ID NO: 659777 - DNA, 25 bp, Mus musculus
ggttttatatgtgaggtccttagca

SEQ ID NO: 659778 - DNA, 25 bp, Mus musculus
ggttttatcatgctagctccagatc

SEQ ID NO: 659779 - DNA, 25 bp, Mus musculus
ggttttatcatggtagctccagatc

SEQ ID NO: 659780 - DNA, 25 bp, Mus musculus
ggttttatccaacaagggcactttg

SEQ ID NO: 659781 - DNA, 25 bp, Mus musculus
ggttttatccaagaagggcactttg

SEQ ID NO: 659782 - DNA, 25 bp, Mus musculus
ggttttatcttaactctttagcact

SEQ ID NO: 659783 - DNA, 25 bp, Mus musculus
ggttttatcttatctctttagcact

SEQ ID NO: 659784 - DNA, 25 bp, Mus musculus
ggttttatcttcatcatggatataa

SEQ ID NO: 659785 - DNA, 25 bp, Mus musculus
ggttttatcttcttcatggatataa

SEQ ID NO: 659786 - DNA, 25 bp, Mus musculus
ggttttatgaacagcagactctatg

SEQ ID NO: 659787 - DNA, 25 bp, Mus musculus
ggttttatgaactgcagactctatg

SEQ ID NO: 659788 - DNA, 25 bp, Mus musculus
ggttttatgcatatatacttctgtc

SEQ ID NO: 659789 - DNA, 25 bp, Mus musculus
ggttttatgcatttatacttctgtc

SEQ ID NO: 659790 - DNA, 25 bp, Mus musculus
ggttttatgcctcctcttaagtgaa

SEQ ID NO: 659791 - DNA, 25 bp, Mus musculus
ggttttatgcctgctcttaagtgaa

SEQ ID NO: 659792 - DNA, 25 bp, Mus musculus
ggttttatgtgcatgtgaatggcct

SEQ ID NO: 659793 - DNA, 25 bp, Mus musculus
ggttttatgtgcattcatattcatg

SEQ ID NO: 659794 - DNA, 25 bp, Mus musculus
ggttttatgtgcttgtgaatggcct

SEQ ID NO: 659795 - DNA, 25 bp, Mus musculus
ggttttatgtgctttcatattcatg

SEQ ID NO: 659796 - DNA, 25 bp, Mus musculus
ggttttatgttaccgtgggtccact

SEQ ID NO: 659797 - DNA, 25 bp, Mus musculus
ggttttatgttagcgtgggtccact

SEQ ID NO: 659798 - DNA, 25 bp, Mus musculus
ggttttattcacatgcaggtttgga

SEQ ID NO: 659799 - DNA, 25 bp, Mus musculus
ggttttattcacttgcaggtttgga

SEQ ID NO: 659800 - DNA, 25 bp, Mus musculus
ggttttattcatcgatatgcagctt

SEQ ID NO: 659801 - DNA, 25 bp, Mus musculus
ggttttattcatggatatgcagctt

SEQ ID NO: 659802 - DNA, 25 bp, Mus musculus
ggttttattcctcttgatgctctga

SEQ ID NO: 659803 - DNA, 25 bp, Mus musculus
ggttttattcctgttgatgctctga

SEQ ID NO: 659804 - DNA, 25 bp, Mus musculus
ggttttattgtgaggtaagatgccc

SEQ ID NO: 659805 - DNA, 25 bp, Mus musculus
ggttttattgtgtggtaagatgccc

SEQ ID NO: 659806 - DNA, 25 bp, Mus musculus
ggttttatttatacttcagacagtt

SEQ ID NO: 659807 - DNA, 25 bp, Mus musculus
ggttttatttattcttcagacagtt

SEQ ID NO: 659808 - DNA, 25 bp, Mus musculus
ggttttatttctcacactgtgtgtg

SEQ ID NO: 659809 - DNA, 25 bp, Mus musculus
ggttttatttctgacactgtgtgtg

SEQ ID NO: 659810 - DNA, 25 bp, Mus musculus
ggttttcaaacaatccccagcttat

SEQ ID NO: 659811 - DNA, 25 bp, Mus musculus
ggttttcaaacattccccagcttat

SEQ ID NO: 659812 - DNA, 25 bp, Mus musculus
ggttttcaacagagtttgcaattgc

SEQ ID NO: 659813 - DNA, 25 bp, Mus musculus
ggttttcaacagtgtttgcaattgc

SEQ ID NO: 659814 - DNA, 25 bp, Mus musculus
ggttttcaagttatagtgtggctgc

SEQ ID NO: 659815 - DNA, 25 bp, Mus musculus
ggttttcaagttttagtgtggctgc

SEQ ID NO: 659816 - DNA, 25 bp, Mus musculus
ggttttcaatggagctgatcagtcg

SEQ ID NO: 659817 - DNA, 25 bp, Mus musculus
ggttttcaatggtgctgatcagtcg

SEQ ID NO: 659818 - DNA, 25 bp, Mus musculus
ggttttcacatgctctgcaatgggt

SEQ ID NO: 659819 - DNA, 25 bp, Mus musculus
ggttttcacatggtctgcaatgggt

SEQ ID NO: 659820 - DNA, 25 bp, Mus musculus
ggttttcaccagaatccagcatgta

SEQ ID NO: 659821 - DNA, 25 bp, Mus musculus
ggttttcaccagtatccagcatgta

SEQ ID NO: 659822 - DNA, 25 bp, Mus musculus
ggttttcacctccacatttatatag

SEQ ID NO: 659823 - DNA, 25 bp, Mus musculus
ggttttcacctcgacatttatatag

SEQ ID NO: 659824 - DNA, 25 bp, Mus musculus
ggttttcactaaatgattcatctcc

SEQ ID NO: 659825 - DNA, 25 bp, Mus musculus
ggttttcactaattgattcatctcc

SEQ ID NO: 659826 - DNA, 25 bp, Mus musculus
ggttttcactcaattgtctcatttc

SEQ ID NO: 659827 - DNA, 25 bp, Mus musculus
ggttttcactcatttgtctcatttc

SEQ ID NO: 659828 - DNA, 25 bp, Mus musculus
ggttttcagaaaccatccctgctgt

SEQ ID NO: 659829 - DNA, 25 bp, Mus musculus
ggttttcagaaagcatccctgctgt

SEQ ID NO: 659830 - DNA, 25 bp, Mus musculus
ggttttcagagactgcactgagctg

SEQ ID NO: 659831 - DNA, 25 bp, Mus musculus
ggttttcagagagtgcactgagctg

SEQ ID NO: 659832 - DNA, 25 bp, Mus musculus
ggttttcagataacataactcacat

SEQ ID NO: 659833 - DNA, 25 bp, Mus musculus
ggttttcagatatcataactcacat

SEQ ID NO: 659834 - DNA, 25 bp, Mus musculus
ggttttcagcagctccgcgaaagga

SEQ ID NO: 659835 - DNA, 25 bp, Mus musculus
ggttttcagcaggtccgcgaaagga

SEQ ID NO: 659836 - DNA, 25 bp, Mus musculus
ggttttcagcatcatatcctgtcaa

SEQ ID NO: 659837 - DNA, 25 bp, Mus musculus
ggttttcagcatgatatcctgtcaa

SEQ ID NO: 659838 - DNA, 25 bp, Mus musculus
ggttttcagctaaactttgctttgg

SEQ ID NO: 659839 - DNA, 25 bp, Mus musculus
ggttttcagctatactttgctttgg

SEQ ID NO: 659840 - DNA, 25 bp, Mus musculus
ggttttcaggaaaggttggtgcctt

SEQ ID NO: 659841 - DNA, 25 bp, Mus musculus
ggttttcaggaatggttggtgcctt

SEQ ID NO: 659842 - DNA, 25 bp, Mus musculus
ggttttcagggcaatgtgtcctatt

SEQ ID NO: 659843 - DNA, 25 bp, Mus musculus
ggttttcagggctatgtgtcctatt

SEQ ID NO: 659844 - DNA, 25 bp, Mus musculus
ggttttcatcccagaagtcacagtg

SEQ ID NO: 659845 - DNA, 25 bp, Mus musculus
ggttttcatccctgaagtcacagtg

SEQ ID NO: 659846 - DNA, 25 bp, Mus musculus
ggttttcatcctcgtgtgcatttta

SEQ ID NO: 659847 - DNA, 25 bp, Mus musculus
ggttttcatcctggtgtgcatttta

SEQ ID NO: 659848 - DNA, 25 bp, Mus musculus
ggttttcatgccaagtggctaccta

SEQ ID NO: 659849 - DNA, 25 bp, Mus musculus
ggttttcatgcctagtggctaccta

SEQ ID NO: 659850 - DNA, 25 bp, Mus musculus
ggttttcatggtcttacctaagaca

SEQ ID NO: 659851 - DNA, 25 bp, Mus musculus
ggttttcatggtgttacctaagaca

SEQ ID NO: 659852 - DNA, 25 bp, Mus musculus
ggttttcattccagtaccttcaaat

SEQ ID NO: 659853 - DNA, 25 bp, Mus musculus
ggttttcattcctgtaccttcaaat

SEQ ID NO: 659854 - DNA, 25 bp, Mus musculus
ggttttcattctcttatctgtagaa

SEQ ID NO: 659855 - DNA, 25 bp, Mus musculus
ggttttcattctgttatctgtagaa

SEQ ID NO: 659856 - DNA, 25 bp, Mus musculus
ggttttcattgacttgtagctctct

SEQ ID NO: 659857 - DNA, 25 bp, Mus musculus
ggttttcattgagttgtagctctct

SEQ ID NO: 659858 - DNA, 25 bp, Mus musculus
ggttttcatttaaagagctgaatgc

SEQ ID NO: 659859 - DNA, 25 bp, Mus musculus
ggttttcatttatagagctgaatgc

SEQ ID NO: 659860 - DNA, 25 bp, Mus musculus
ggttttcattttccctggcaatcaa

SEQ ID NO: 659861 - DNA, 25 bp, Mus musculus
ggttttcattttgcctggcaatcaa

SEQ ID NO: 659862 - DNA, 25 bp, Mus musculus
ggttttccaaatcttatatgactct

SEQ ID NO: 659863 - DNA, 25 bp, Mus musculus
ggttttccaaatgttatatgactct

SEQ ID NO: 659864 - DNA, 25 bp, Mus musculus
ggttttccactccaagattagagca

SEQ ID NO: 659865 - DNA, 25 bp, Mus musculus
ggttttccactcgaagattagagca

SEQ ID NO: 659866 - DNA, 25 bp, Mus musculus
ggttttccagatacctgagtgctta

SEQ ID NO: 659867 - DNA, 25 bp, Mus musculus
ggttttccagattcctgagtgctta

SEQ ID NO: 659868 - DNA, 25 bp, Mus musculus
ggttttccagttagtgtacactcac

SEQ ID NO: 659869 - DNA, 25 bp, Mus musculus
ggttttccagtttgtgtacactcac

SEQ ID NO: 659870 - DNA, 25 bp, Mus musculus
ggttttccatttccgcagcacgtgt

SEQ ID NO: 659871 - DNA, 25 bp, Mus musculus
ggttttccatttgcgcagcacgtgt

SEQ ID NO: 659872 - DNA, 25 bp, Mus musculus
ggttttcccagtcatgtatctcaat

SEQ ID NO: 659873 - DNA, 25 bp, Mus musculus
ggttttcccagtgatgtatctcaat

SEQ ID NO: 659874 - DNA, 25 bp, Mus musculus
ggttttccctgtatgtgtatttctg

SEQ ID NO: 659875 - DNA, 25 bp, Mus musculus
ggttttccctgtcagtgcctcagtc

SEQ ID NO: 659876 - DNA, 25 bp, Mus musculus
ggttttccctgtgagtgcctcagtc

SEQ ID NO: 659877 - DNA, 25 bp, Mus musculus
ggttttccctgtttgtgtatttctg

SEQ ID NO: 659878 - DNA, 25 bp, Mus musculus
ggttttccgaaaatctctgtatcta

SEQ ID NO: 659879 - DNA, 25 bp, Mus musculus
ggttttccgaaattctctgtatcta

SEQ ID NO: 659880 - DNA, 25 bp, Mus musculus
ggttttccgcaaccatcaagagaca

SEQ ID NO: 659881 - DNA, 25 bp, Mus musculus
ggttttccgcaagcatcaagagaca

SEQ ID NO: 659882 - DNA, 25 bp, Mus musculus
ggttttccgtcactggtaaatgaat

SEQ ID NO: 659883 - DNA, 25 bp, Mus musculus
ggttttccgtcagtggtaaatgaat

SEQ ID NO: 659884 - DNA, 25 bp, Mus musculus
ggttttcctcatagtaatgtaagca

SEQ ID NO: 659885 - DNA, 25 bp, Mus musculus
ggttttcctcattgtaatgtaagca

SEQ ID NO: 659886 - DNA, 25 bp, Mus musculus
ggttttcctgagcttgtgagatatt

SEQ ID NO: 659887 - DNA, 25 bp, Mus musculus
ggttttcctgaggttgtgagatatt

SEQ ID NO: 659888 - DNA, 25 bp, Mus musculus
ggttttccttatcagtgattatcca

SEQ ID NO: 659889 - DNA, 25 bp, Mus musculus
ggttttccttatgagtgattatcca

SEQ ID NO: 659890 - DNA, 25 bp, Mus musculus
ggttttcctttgcagcccaaagaat

SEQ ID NO: 659891 - DNA, 25 bp, Mus musculus
ggttttcctttggagcccaaagaat

SEQ ID NO: 659892 - DNA, 25 bp, Mus musculus
ggttttcgagctactagatatggga

SEQ ID NO: 659893 - DNA, 25 bp, Mus musculus
ggttttcgagcttctagatatggga

SEQ ID NO: 659894 - DNA, 25 bp, Mus musculus
ggttttcggaacagaggccatgatt

SEQ ID NO: 659895 - DNA, 25 bp, Mus musculus
ggttttcggaactgaggccatgatt

SEQ ID NO: 659896 - DNA, 25 bp, Mus musculus
ggttttctaagtcaccatagccatc

SEQ ID NO: 659897 - DNA, 25 bp, Mus musculus
ggttttctaagtgaccatagccatc

SEQ ID NO: 659898 - DNA, 25 bp, Mus musculus
ggttttctaatgagacatcatccta

SEQ ID NO: 659899 - DNA, 25 bp, Mus musculus
ggttttctaatgtgacatcatccta

SEQ ID NO: 659900 - DNA, 25 bp, Mus musculus
ggttttctaccgacaatgatttcaa

SEQ ID NO: 659901 - DNA, 25 bp, Mus musculus
ggttttctaccgtcaatgatttcaa

SEQ ID NO: 659902 - DNA, 25 bp, Mus musculus
ggttttctagagaacctagcatctg

SEQ ID NO: 659903 - DNA, 25 bp, Mus musculus
ggttttctagagtacctagcatctg

SEQ ID NO: 659904 - DNA, 25 bp, Mus musculus
ggttttctagctatgacctctatgt

SEQ ID NO: 659905 - DNA, 25 bp, Mus musculus
ggttttctagctttgacctctatgt

SEQ ID NO: 659906 - DNA, 25 bp, Mus musculus
ggttttctatctctcactagtttga

SEQ ID NO: 659907 - DNA, 25 bp, Mus musculus
ggttttctatctgtcactagtttga

SEQ ID NO: 659908 - DNA, 25 bp, Mus musculus
ggttttctatgaaggtgactgtgca

SEQ ID NO: 659909 - DNA, 25 bp, Mus musculus
ggttttctatgatggtgactgtgca

SEQ ID NO: 659910 - DNA, 25 bp, Mus musculus
ggttttctcagtcagaatctctcat

SEQ ID NO: 659911 - DNA, 25 bp, Mus musculus
ggttttctcagtgagaatctctcat

SEQ ID NO: 659912 - DNA, 25 bp, Mus musculus
ggttttctcatccaaccatccacaa

SEQ ID NO: 659913 - DNA, 25 bp, Mus musculus
ggttttctcatcgaaccatccacaa

SEQ ID NO: 659914 - DNA, 25 bp, Mus musculus
ggttttctcctgagttatatatgca

SEQ ID NO: 659915 - DNA, 25 bp, Mus musculus
ggttttctcctgtgttatatatgca

SEQ ID NO: 659916 - DNA, 25 bp, Mus musculus
ggttttctgaaaagcgcgcatctgt

SEQ ID NO: 659917 - DNA, 25 bp, Mus musculus
ggttttctgaaatgcgcgcatctgt

SEQ ID NO: 659918 - DNA, 25 bp, Mus musculus
ggttttctgaagctaacactctgaa

SEQ ID NO: 659919 - DNA, 25 bp, Mus musculus
ggttttctgaaggtaacactctgaa

SEQ ID NO: 659920 - DNA, 25 bp, Mus musculus
ggttttctgaatataccaggttctg

SEQ ID NO: 659921 - DNA, 25 bp, Mus musculus
ggttttctgaatttaccaggttctg

SEQ ID NO: 659922 - DNA, 25 bp, Mus musculus
ggttttctggctattaatacagaca

SEQ ID NO: 659923 - DNA, 25 bp, Mus musculus
ggttttctggcttttaatacagaca

SEQ ID NO: 659924 - DNA, 25 bp, Mus musculus
ggttttctgggaatggattcacaca

SEQ ID NO: 659925 - DNA, 25 bp, Mus musculus
ggttttctgggattggattcacaca

SEQ ID NO: 659926 - DNA, 25 bp, Mus musculus
ggttttctggttcataagggattca

SEQ ID NO: 659927 - DNA, 25 bp, Mus musculus
ggttttctggttgataagggattca

SEQ ID NO: 659928 - DNA, 25 bp, Mus musculus
ggttttctgttcagaagatacaatg

SEQ ID NO: 659929 - DNA, 25 bp, Mus musculus
ggttttctgttctgaagatacaatg

SEQ ID NO: 659930 - DNA, 25 bp, Mus musculus
ggttttctgttgcaacacttactat

SEQ ID NO: 659931 - DNA, 25 bp, Mus musculus
ggttttctgttggaacacttactat

SEQ ID NO: 659932 - DNA, 25 bp, Mus musculus
ggttttcttccacacataactaggc

SEQ ID NO: 659933 - DNA, 25 bp, Mus musculus
ggttttcttccagacataactaggc

SEQ ID NO: 659934 - DNA, 25 bp, Mus musculus
ggttttcttctgcactgtttcagta

SEQ ID NO: 659935 - DNA, 25 bp, Mus musculus
ggttttcttctggactgtttcagta

SEQ ID NO: 659936 - DNA, 25 bp, Mus musculus
ggttttcttgcaaccaagtgagaaa

SEQ ID NO: 659937 - DNA, 25 bp, Mus musculus
ggttttcttgcatccaagtgagaaa

SEQ ID NO: 659938 - DNA, 25 bp, Mus musculus
ggttttcttggtcatactgtggtcc

SEQ ID NO: 659939 - DNA, 25 bp, Mus musculus
ggttttcttggtgatactgtggtcc

SEQ ID NO: 659940 - DNA, 25 bp, Mus musculus
ggttttctttcacattaagctctga

SEQ ID NO: 659941 - DNA, 25 bp, Mus musculus
ggttttctttcagattaagctctga

SEQ ID NO: 659942 - DNA, 25 bp, Mus musculus
ggttttctttctaggatgatggccc

SEQ ID NO: 659943 - DNA, 25 bp, Mus musculus
ggttttctttctcagaactacttgt

SEQ ID NO: 659944 - DNA, 25 bp, Mus musculus
ggttttctttctgagaactacttgt

SEQ ID NO: 659945 - DNA, 25 bp, Mus musculus
ggttttctttcttggatgatggccc

SEQ ID NO: 659946 - DNA, 25 bp, Mus musculus
ggttttcttttaaaccacatgggat

SEQ ID NO: 659947 - DNA, 25 bp, Mus musculus
ggttttcttttaactgacaagccat

SEQ ID NO: 659948 - DNA, 25 bp, Mus musculus
ggttttcttttataccacatgggat

SEQ ID NO: 659949 - DNA, 25 bp, Mus musculus
ggttttcttttatctgacaagccat

SEQ ID NO: 659950 - DNA, 25 bp, Mus musculus
ggttttgaaaacactcccacaccat

SEQ ID NO: 659951 - DNA, 25 bp, Mus musculus
ggttttgaaaactctcccacaccat

SEQ ID NO: 659952 - DNA, 25 bp, Mus musculus
ggttttgaaatgaacttgccattgt

SEQ ID NO: 659953 - DNA, 25 bp, Mus musculus
ggttttgaaatgtacttgccattgt

SEQ ID NO: 659954 - DNA, 25 bp, Mus musculus
ggttttgaaattacattgctccaag

SEQ ID NO: 659955 - DNA, 25 bp, Mus musculus
ggttttgaaatttcattgctccaag

SEQ ID NO: 659956 - DNA, 25 bp, Mus musculus
ggttttgaacacaacatcctttctg

SEQ ID NO: 659957 - DNA, 25 bp, Mus musculus
ggttttgaacactacatcctttctg

SEQ ID NO: 659958 - DNA, 25 bp, Mus musculus
ggttttgaaccccattatcagatta

SEQ ID NO: 659959 - DNA, 25 bp, Mus musculus
ggttttgaacccgattatcagatta

SEQ ID NO: 659960 - DNA, 25 bp, Mus musculus
ggttttgaactcacttttcacctgc

SEQ ID NO: 659961 - DNA, 25 bp, Mus musculus
ggttttgaactctcttttcacctgc

SEQ ID NO: 659962 - DNA, 25 bp, Mus musculus
ggttttgacaacacactctaggcct

SEQ ID NO: 659963 - DNA, 25 bp, Mus musculus
ggttttgacaactcactctaggcct

SEQ ID NO: 659964 - DNA, 25 bp, Mus musculus
ggttttgacagccacatatcctgat

SEQ ID NO: 659965 - DNA, 25 bp, Mus musculus
ggttttgacagcgacatatcctgat

SEQ ID NO: 659966 - DNA, 25 bp, Mus musculus
ggttttgaccagaccattaacttga

SEQ ID NO: 659967 - DNA, 25 bp, Mus musculus
ggttttgaccagtccattaacttga

SEQ ID NO: 659968 - DNA, 25 bp, Mus musculus
ggttttgacccaacagtatcaccaa

SEQ ID NO: 659969 - DNA, 25 bp, Mus musculus
ggttttgacccacctcaccagaagg

SEQ ID NO: 659970 - DNA, 25 bp, Mus musculus
ggttttgacccagctcaccagaagg

SEQ ID NO: 659971 - DNA, 25 bp, Mus musculus
ggttttgacccatcagtatcaccaa

SEQ ID NO: 659972 - DNA, 25 bp, Mus musculus
ggttttgacgctcacacctgggaaa

SEQ ID NO: 659973 - DNA, 25 bp, Mus musculus
ggttttgacgctgacacctgggaaa

SEQ ID NO: 659974 - DNA, 25 bp, Mus musculus
ggttttgactccctattcatgcaat

SEQ ID NO: 659975 - DNA, 25 bp, Mus musculus
ggttttgactccgtattcatgcaat

SEQ ID NO: 659976 - DNA, 25 bp, Mus musculus
ggttttgagactactgtaagacaga

SEQ ID NO: 659977 - DNA, 25 bp, Mus musculus
ggttttgagacttctgtaagacaga

SEQ ID NO: 659978 - DNA, 25 bp, Mus musculus
ggttttgagcccagtctctcctgac

SEQ ID NO: 659979 - DNA, 25 bp, Mus musculus
ggttttgagccctgtctctcctgac

SEQ ID NO: 659980 - DNA, 25 bp, Mus musculus
ggttttgagtcaattctactcctgt

SEQ ID NO: 659981 - DNA, 25 bp, Mus musculus
ggttttgagtcatttctactcctgt

SEQ ID NO: 659982 - DNA, 25 bp, Mus musculus
ggttttgagtttccaccacatagga

SEQ ID NO: 659983 - DNA, 25 bp, Mus musculus
ggttttgagtttgcaccacatagga

SEQ ID NO: 659984 - DNA, 25 bp, Mus musculus
ggttttgatactcattttctaagac

SEQ ID NO: 659985 - DNA, 25 bp, Mus musculus
ggttttgatactgattttctaagac

SEQ ID NO: 659986 - DNA, 25 bp, Mus musculus
ggttttgatgctaggctctttgctg

SEQ ID NO: 659987 - DNA, 25 bp, Mus musculus
ggttttgatgcttggctctttgctg

SEQ ID NO: 659988 - DNA, 25 bp, Mus musculus
ggttttgatttcatgcatattttat

SEQ ID NO: 659989 - DNA, 25 bp, Mus musculus
ggttttgatttcttgcatattttat

SEQ ID NO: 659990 - DNA, 25 bp, Mus musculus
ggttttgatttgatgttgcattctt

SEQ ID NO: 659991 - DNA, 25 bp, Mus musculus
ggttttgatttgcactaaattttat

SEQ ID NO: 659992 - DNA, 25 bp, Mus musculus
ggttttgatttggactaaattttat

SEQ ID NO: 659993 - DNA, 25 bp, Mus musculus
ggttttgatttgttgttgcattctt

SEQ ID NO: 659994 - DNA, 25 bp, Mus musculus
ggttttgattttcccagctgagcaa

SEQ ID NO: 659995 - DNA, 25 bp, Mus musculus
ggttttgattttgccagctgagcaa

SEQ ID NO: 659996 - DNA, 25 bp, Mus musculus
ggttttgcaacacgaaactgagatc

SEQ ID NO: 659997 - DNA, 25 bp, Mus musculus
ggttttgcaacaggaaactgagatc

SEQ ID NO: 659998 - DNA, 25 bp, Mus musculus
ggttttgcactacctgctcgacagc

SEQ ID NO: 659999 - DNA, 25 bp, Mus musculus
ggttttgcactagctgctcgacagc

SEQ ID NO: 660000 - DNA, 25 bp, Mus musculus
ggttttgcactccagaccttggtgt

SEQ ID NO: 660001 - DNA, 25 bp, Mus musculus
ggttttgcactcgagaccttggtgt

SEQ ID NO: 660002 - DNA, 25 bp, Mus musculus
ggttttgcagatccagacatcgctg

SEQ ID NO: 660003 - DNA, 25 bp, Mus musculus
ggttttgcagatgcagacatcgctg

SEQ ID NO: 660004 - DNA, 25 bp, Mus musculus
ggttttgcagcactactacggcgtc

SEQ ID NO: 660005 - DNA, 25 bp, Mus musculus
ggttttgcagcagtactacggcgtc

SEQ ID NO: 660006 - DNA, 25 bp, Mus musculus
ggttttgccaaaaccagagcagaga

SEQ ID NO: 660007 - DNA, 25 bp, Mus musculus
ggttttgccaaaagtaactgtgtgt

SEQ ID NO: 660008 - DNA, 25 bp, Mus musculus
ggttttgccaaatccagagcagaga

SEQ ID NO: 660009 - DNA, 25 bp, Mus musculus
ggttttgccaaatgtaactgtgtgt

SEQ ID NO: 660010 - DNA, 25 bp, Mus musculus
ggttttgccagcaataatttctaca

SEQ ID NO: 660011 - DNA, 25 bp, Mus musculus
ggttttgccagctataatttctaca

SEQ ID NO: 660012 - DNA, 25 bp, Mus musculus
ggttttgccaggcacttgggaagca

SEQ ID NO: 660013 - DNA, 25 bp, Mus musculus
ggttttgccagggacttgggaagca

SEQ ID NO: 660014 - DNA, 25 bp, Mus musculus
ggttttgccggactccaggataccg

SEQ ID NO: 660015 - DNA, 25 bp, Mus musculus
ggttttgccggagtccaggataccg

SEQ ID NO: 660016 - DNA, 25 bp, Mus musculus
ggttttgcctcccatagtagtattt

SEQ ID NO: 660017 - DNA, 25 bp, Mus musculus
ggttttgcctccgatagtagtattt

SEQ ID NO: 660018 - DNA, 25 bp, Mus musculus
ggttttgcgaccaactaagagagtg

SEQ ID NO: 660019 - DNA, 25 bp, Mus musculus
ggttttgcgacctactaagagagtg

SEQ ID NO: 660020 - DNA, 25 bp, Mus musculus
ggttttgcgttaaatctgaacttcg

SEQ ID NO: 660021 - DNA, 25 bp, Mus musculus
ggttttgcgttatatctgaacttcg

SEQ ID NO: 660022 - DNA, 25 bp, Mus musculus
ggttttgctgcccagactctgaaaa

SEQ ID NO: 660023 - DNA, 25 bp, Mus musculus
ggttttgctgccgagactctgaaaa

SEQ ID NO: 660024 - DNA, 25 bp, Mus musculus
ggttttgctggcatgaagacaacaa

SEQ ID NO: 660025 - DNA, 25 bp, Mus musculus
ggttttgctggccttgaaaatgtaa

SEQ ID NO: 660026 - DNA, 25 bp, Mus musculus
ggttttgctggcgttgaaaatgtaa

SEQ ID NO: 660027 - DNA, 25 bp, Mus musculus
ggttttgctggcttgaagacaacaa

SEQ ID NO: 660028 - DNA, 25 bp, Mus musculus
ggttttgctggtattttctaatttg

SEQ ID NO: 660029 - DNA, 25 bp, Mus musculus
ggttttgctggttttttctaatttg

SEQ ID NO: 660030 - DNA, 25 bp, Mus musculus
ggttttgcttcccatctataattga

SEQ ID NO: 660031 - DNA, 25 bp, Mus musculus
ggttttgcttccgatctataattga

SEQ ID NO: 660032 - DNA, 25 bp, Mus musculus
ggttttgctttactttgatgtccac

SEQ ID NO: 660033 - DNA, 25 bp, Mus musculus
ggttttgctttagtttgatgtccac

SEQ ID NO: 660034 - DNA, 25 bp, Mus musculus
ggttttggaaagaactctcctcata

SEQ ID NO: 660035 - DNA, 25 bp, Mus musculus
ggttttggaaagtactctcctcata

SEQ ID NO: 660036 - DNA, 25 bp, Mus musculus
ggttttggaaggcatcaagtagaat

SEQ ID NO: 660037 - DNA, 25 bp, Mus musculus
ggttttggaagggatcaagtagaat

SEQ ID NO: 660038 - DNA, 25 bp, Mus musculus
ggttttggacaaccatagcccaggg

SEQ ID NO: 660039 - DNA, 25 bp, Mus musculus
ggttttggacaagcatagcccaggg

SEQ ID NO: 660040 - DNA, 25 bp, Mus musculus
ggttttggatgcaaggtcacaacac

SEQ ID NO: 660041 - DNA, 25 bp, Mus musculus
ggttttggatgctaggtcacaacac

SEQ ID NO: 660042 - DNA, 25 bp, Mus musculus
ggttttggcgagagagaaacaacag

SEQ ID NO: 660043 - DNA, 25 bp, Mus musculus
ggttttggcgagtgagaaacaacag

SEQ ID NO: 660044 - DNA, 25 bp, Mus musculus
ggttttggcttcataccgaaatatg

SEQ ID NO: 660045 - DNA, 25 bp, Mus musculus
ggttttggcttcttaccgaaatatg

SEQ ID NO: 660046 - DNA, 25 bp, Mus musculus
ggttttgggaatattctatgccagt

SEQ ID NO: 660047 - DNA, 25 bp, Mus musculus
ggttttgggaattttctatgccagt

SEQ ID NO: 660048 - DNA, 25 bp, Mus musculus
ggttttgggcaaaattgagagagcc

SEQ ID NO: 660049 - DNA, 25 bp, Mus musculus
ggttttgggcaatattgagagagcc

SEQ ID NO: 660050 - DNA, 25 bp, Mus musculus
ggttttggtatcagttcctggaact

SEQ ID NO: 660051 - DNA, 25 bp, Mus musculus
ggttttggtatctgttcctggaact

SEQ ID NO: 660052 - DNA, 25 bp, Mus musculus
ggttttggtcatctatgtctacttt

SEQ ID NO: 660053 - DNA, 25 bp, Mus musculus
ggttttggtcatgtatgtctacttt

SEQ ID NO: 660054 - DNA, 25 bp, Mus musculus
ggttttggtggcaattgtactggaa

SEQ ID NO: 660055 - DNA, 25 bp, Mus musculus
ggttttggtggctattgtactggaa

SEQ ID NO: 660056 - DNA, 25 bp, Mus musculus
ggttttgtaagacccactgcagggt

SEQ ID NO: 660057 - DNA, 25 bp, Mus musculus
ggttttgtaagagccactgcagggt

SEQ ID NO: 660058 - DNA, 25 bp, Mus musculus
ggttttgtattgagaacaggcacta

SEQ ID NO: 660059 - DNA, 25 bp, Mus musculus
ggttttgtattgtgaacaggcacta

SEQ ID NO: 660060 - DNA, 25 bp, Mus musculus
ggttttgtccaccatgtgttcagga

SEQ ID NO: 660061 - DNA, 25 bp, Mus musculus
ggttttgtccacgatgtgttcagga

SEQ ID NO: 660062 - DNA, 25 bp, Mus musculus
ggttttgtcctaaacaggcaaccat

SEQ ID NO: 660063 - DNA, 25 bp, Mus musculus
ggttttgtcctatacaggcaaccat

SEQ ID NO: 660064 - DNA, 25 bp, Mus musculus
ggttttgtctacatgtccgtatgca

SEQ ID NO: 660065 - DNA, 25 bp, Mus musculus
ggttttgtctacttgtccgtatgca

SEQ ID NO: 660066 - DNA, 25 bp, Mus musculus
ggttttgtctccatattaagcttac

SEQ ID NO: 660067 - DNA, 25 bp, Mus musculus
ggttttgtctccttattaagcttac

SEQ ID NO: 660068 - DNA, 25 bp, Mus musculus
ggttttgtctgtattctgcttcatt

SEQ ID NO: 660069 - DNA, 25 bp, Mus musculus
ggttttgtctgttttctgcttcatt

SEQ ID NO: 660070 - DNA, 25 bp, Mus musculus
ggttttgtgaccatggtgctcatta

SEQ ID NO: 660071 - DNA, 25 bp, Mus musculus
ggttttgtgaccttggtgctcatta

SEQ ID NO: 660072 - DNA, 25 bp, Mus musculus
ggttttgtggaccatcgtagcccca

SEQ ID NO: 660073 - DNA, 25 bp, Mus musculus
ggttttgtggacgatcgtagcccca

SEQ ID NO: 660074 - DNA, 25 bp, Mus musculus
ggttttgttaatacgatcggctaca

SEQ ID NO: 660075 - DNA, 25 bp, Mus musculus
ggttttgttaattcgatcggctaca

SEQ ID NO: 660076 - DNA, 25 bp, Mus musculus
ggttttgttcccactacaagctggc

SEQ ID NO: 660077 - DNA, 25 bp, Mus musculus
ggttttgttccctctacaagctggc

SEQ ID NO: 660078 - DNA, 25 bp, Mus musculus
ggttttgttctcaaactcagtttgg

SEQ ID NO: 660079 - DNA, 25 bp, Mus musculus
ggttttgttctcaacgatgagagta

SEQ ID NO: 660080 - DNA, 25 bp, Mus musculus
ggttttgttctcatatcaagctcag

SEQ ID NO: 660081 - DNA, 25 bp, Mus musculus
ggttttgttctctaactcagtttgg

SEQ ID NO: 660082 - DNA, 25 bp, Mus musculus
ggttttgttctctacgatgagagta

SEQ ID NO: 660083 - DNA, 25 bp, Mus musculus
ggttttgttctcttatcaagctcag

SEQ ID NO: 660084 - DNA, 25 bp, Mus musculus
ggttttgtttatatcgcctggctga

SEQ ID NO: 660085 - DNA, 25 bp, Mus musculus
ggttttgtttatttcgcctggctga

SEQ ID NO: 660086 - DNA, 25 bp, Mus musculus
ggttttgtttctactccatcatgat

SEQ ID NO: 660087 - DNA, 25 bp, Mus musculus
ggttttgtttcttctccatcatgat

SEQ ID NO: 660088 - DNA, 25 bp, Mus musculus
ggttttgttttgctacgagtccaca

SEQ ID NO: 660089 - DNA, 25 bp, Mus musculus
ggttttgttttggtacgagtccaca

SEQ ID NO: 660090 - DNA, 25 bp, Mus musculus
ggtttttaaaacaggtgcattcaca

SEQ ID NO: 660091 - DNA, 25 bp, Mus musculus
ggtttttaaaactggtgcattcaca

SEQ ID NO: 660092 - DNA, 25 bp, Mus musculus
ggtttttaacccaaactcagtgcat

SEQ ID NO: 660093 - DNA, 25 bp, Mus musculus
ggtttttaaccctaactcagtgcat

SEQ ID NO: 660094 - DNA, 25 bp, Mus musculus
ggtttttacatccttactgacaaag

SEQ ID NO: 660095 - DNA, 25 bp, Mus musculus
ggtttttacatcgttactgacaaag

SEQ ID NO: 660096 - DNA, 25 bp, Mus musculus
ggtttttacctgcagcttgtcaact

SEQ ID NO: 660097 - DNA, 25 bp, Mus musculus
ggtttttacctggagcttgtcaact

SEQ ID NO: 660098 - DNA, 25 bp, Mus musculus
ggtttttactctatccagcacttta

SEQ ID NO: 660099 - DNA, 25 bp, Mus musculus
ggtttttactctttccagcacttta

SEQ ID NO: 660100 - DNA, 25 bp, Mus musculus
ggtttttagaacaataatatcaaca

SEQ ID NO: 660101 - DNA, 25 bp, Mus musculus
ggtttttagaactataatatcaaca

SEQ ID NO: 660102 - DNA, 25 bp, Mus musculus
ggtttttatccactgatccatctca

SEQ ID NO: 660103 - DNA, 25 bp, Mus musculus
ggtttttatccagtgatccatctca

SEQ ID NO: 660104 - DNA, 25 bp, Mus musculus
ggtttttatggaccaatgccccagt

SEQ ID NO: 660105 - DNA, 25 bp, Mus musculus
ggtttttatggagcaatgccccagt

SEQ ID NO: 660106 - DNA, 25 bp, Mus musculus
ggtttttcaaacatctggacacaga

SEQ ID NO: 660107 - DNA, 25 bp, Mus musculus
ggtttttcaaacttctggacacaga

SEQ ID NO: 660108 - DNA, 25 bp, Mus musculus
ggtttttcaattagtctgtttgtag

SEQ ID NO: 660109 - DNA, 25 bp, Mus musculus
ggtttttcaattcagcttatggctt

SEQ ID NO: 660110 - DNA, 25 bp, Mus musculus
ggtttttcaattgagcttatggctt

SEQ ID NO: 660111 - DNA, 25 bp, Mus musculus
ggtttttcaatttgtctgtttgtag

SEQ ID NO: 660112 - DNA, 25 bp, Mus musculus
ggtttttcaggtctgcatggttctt

SEQ ID NO: 660113 - DNA, 25 bp, Mus musculus
ggtttttcaggtgtgcatggttctt

SEQ ID NO: 660114 - DNA, 25 bp, Mus musculus
ggtttttcagtaacgcatttggtta

SEQ ID NO: 660115 - DNA, 25 bp, Mus musculus
ggtttttcagtatcgcatttggtta

SEQ ID NO: 660116 - DNA, 25 bp, Mus musculus
ggtttttcccatccattattcaccg

SEQ ID NO: 660117 - DNA, 25 bp, Mus musculus
ggtttttcccatgcattattcaccg

SEQ ID NO: 660118 - DNA, 25 bp, Mus musculus
ggtttttccctaatccaatatctgt

SEQ ID NO: 660119 - DNA, 25 bp, Mus musculus
ggtttttccctattccaatatctgt

SEQ ID NO: 660120 - DNA, 25 bp, Mus musculus
ggtttttctactcttcgtctgtcca

SEQ ID NO: 660121 - DNA, 25 bp, Mus musculus
ggtttttctactgttcgtctgtcca

SEQ ID NO: 660122 - DNA, 25 bp, Mus musculus
ggtttttctagaacctgtacaactt

SEQ ID NO: 660123 - DNA, 25 bp, Mus musculus
ggtttttctagatcctgtacaactt

SEQ ID NO: 660124 - DNA, 25 bp, Mus musculus
ggtttttctcacacatattttgtag

SEQ ID NO: 660125 - DNA, 25 bp, Mus musculus
ggtttttctcactcatattttgtag

SEQ ID NO: 660126 - DNA, 25 bp, Mus musculus
ggtttttctgacctgctaattagca

SEQ ID NO: 660127 - DNA, 25 bp, Mus musculus
ggtttttctgacgtgctaattagca

SEQ ID NO: 660128 - DNA, 25 bp, Mus musculus
ggtttttctgtgatgtactagtgac

SEQ ID NO: 660129 - DNA, 25 bp, Mus musculus
ggtttttctgtgttgtactagtgac

SEQ ID NO: 660130 - DNA, 25 bp, Mus musculus
ggtttttctttaagtacttctgtgt

SEQ ID NO: 660131 - DNA, 25 bp, Mus musculus
ggtttttctttatgtacttctgtgt

SEQ ID NO: 660132 - DNA, 25 bp, Mus musculus
ggtttttgaactacttactatcctg

SEQ ID NO: 660133 - DNA, 25 bp, Mus musculus
ggtttttgaacttcttactatcctg

SEQ ID NO: 660134 - DNA, 25 bp, Mus musculus
ggtttttgaagcctatacacttggt

SEQ ID NO: 660135 - DNA, 25 bp, Mus musculus
ggtttttgaagcgtatacacttggt

SEQ ID NO: 660136 - DNA, 25 bp, Mus musculus
ggtttttgccaaagcgtttgtcatg

SEQ ID NO: 660137 - DNA, 25 bp, Mus musculus
ggtttttgccaaccagttgttgagt

SEQ ID NO: 660138 - DNA, 25 bp, Mus musculus
ggtttttgccaagcagttgttgagt

SEQ ID NO: 660139 - DNA, 25 bp, Mus musculus
ggtttttgccaatgcgtttgtcatg

SEQ ID NO: 660140 - DNA, 25 bp, Mus musculus
ggtttttgcctcaggtcaggagcat

SEQ ID NO: 660141 - DNA, 25 bp, Mus musculus
ggtttttgcctctggtcaggagcat

SEQ ID NO: 660142 - DNA, 25 bp, Mus musculus
ggtttttgctatccgctgtactgtg

SEQ ID NO: 660143 - DNA, 25 bp, Mus musculus
ggtttttgctatgcgctgtactgtg

SEQ ID NO: 660144 - DNA, 25 bp, Mus musculus
ggtttttggatacctgtcaccagcc

SEQ ID NO: 660145 - DNA, 25 bp, Mus musculus
ggtttttggatagctgtcaccagcc

SEQ ID NO: 660146 - DNA, 25 bp, Mus musculus
ggtttttggccaattgtataccatt

SEQ ID NO: 660147 - DNA, 25 bp, Mus musculus
ggtttttggccatttgtataccatt

SEQ ID NO: 660148 - DNA, 25 bp, Mus musculus
ggtttttgtaagactgttgatgata

SEQ ID NO: 660149 - DNA, 25 bp, Mus musculus
ggtttttgtaagtctgttgatgata

SEQ ID NO: 660150 - DNA, 25 bp, Mus musculus
ggtttttgtataacttccttgagct

SEQ ID NO: 660151 - DNA, 25 bp, Mus musculus
ggtttttgtatatcttccttgagct

SEQ ID NO: 660152 - DNA, 25 bp, Mus musculus
ggtttttgttttcttacatgcgtga

SEQ ID NO: 660153 - DNA, 25 bp, Mus musculus
ggtttttgttttgttacatgcgtga

SEQ ID NO: 660154 - DNA, 25 bp, Mus musculus
ggttttttactaagcattgcccata

SEQ ID NO: 660155 - DNA, 25 bp, Mus musculus
ggttttttactatgcattgcccata

SEQ ID NO: 660156 - DNA, 25 bp, Mus musculus
ggttttttatgtccagactgtctca

SEQ ID NO: 660157 - DNA, 25 bp, Mus musculus
ggttttttatgtgcagactgtctca

SEQ ID NO: 660158 - DNA, 25 bp, Mus musculus
ggttttttcatcaggtttctcccag

SEQ ID NO: 660159 - DNA, 25 bp, Mus musculus
ggttttttcatctggtttctcccag

SEQ ID NO: 660160 - DNA, 25 bp, Mus musculus
ggttttttgatcaccaatgttgttt

SEQ ID NO: 660161 - DNA, 25 bp, Mus musculus
ggttttttgatctccaatgttgttt

SEQ ID NO: 660162 - DNA, 25 bp, Mus musculus
ggttttttggctcacaacccagcag

SEQ ID NO: 660163 - DNA, 25 bp, Mus musculus
ggttttttggctgacaacccagcag

SEQ ID NO: 660164 - DNA, 25 bp, Mus musculus
gtaaaaaagtatcctctgttgccaa

SEQ ID NO: 660165 - DNA, 25 bp, Mus musculus
gtaaaaaagtatgctctgttgccaa

SEQ ID NO: 660166 - DNA, 25 bp, Mus musculus
gtaaaaaatctcatctcagcgtttc

SEQ ID NO: 660167 - DNA, 25 bp, Mus musculus
gtaaaaaatctcttctcagcgtttc

SEQ ID NO: 660168 - DNA, 25 bp, Mus musculus
gtaaaaacactgagctctctgtaag

SEQ ID NO: 660169 - DNA, 25 bp, Mus musculus
gtaaaaacactgtgctctctgtaag

SEQ ID NO: 660170 - DNA, 25 bp, Mus musculus
gtaaaaacagcccagtagacacttc

SEQ ID NO: 660171 - DNA, 25 bp, Mus musculus
gtaaaaacagccgagtagacacttc

SEQ ID NO: 660172 - DNA, 25 bp, Mus musculus
gtaaaaaccctcacaacagtccaag

SEQ ID NO: 660173 - DNA, 25 bp, Mus musculus
gtaaaaaccctctcaacagtccaag

SEQ ID NO: 660174 - DNA, 25 bp, Mus musculus
gtaaaaacgagtagcttggtgtgcc

SEQ ID NO: 660175 - DNA, 25 bp, Mus musculus
gtaaaaacgagttgcttggtgtgcc

SEQ ID NO: 660176 - DNA, 25 bp, Mus musculus
gtaaaaactaccagtcccctgcagt

SEQ ID NO: 660177 - DNA, 25 bp, Mus musculus
gtaaaaactacctgtcccctgcagt

SEQ ID NO: 660178 - DNA, 25 bp, Mus musculus
gtaaaaactttgatcctcgctatag

SEQ ID NO: 660179 - DNA, 25 bp, Mus musculus
gtaaaaactttgttcctcgctatag

SEQ ID NO: 660180 - DNA, 25 bp, Mus musculus
gtaaaaagggcccaacatcctctgc

SEQ ID NO: 660181 - DNA, 25 bp, Mus musculus
gtaaaaagggccgaacatcctctgc

SEQ ID NO: 660182 - DNA, 25 bp, Mus musculus
gtaaaaagtacgacgcctgaggctg

SEQ ID NO: 660183 - DNA, 25 bp, Mus musculus
gtaaaaagtacgtcgcctgaggctg

SEQ ID NO: 660184 - DNA, 25 bp, Mus musculus
gtaaaaagtcacacttaattcccag

SEQ ID NO: 660185 - DNA, 25 bp, Mus musculus
gtaaaaagtcactcttaattcccag

SEQ ID NO: 660186 - DNA, 25 bp, Mus musculus
gtaaaaataatcctcttccctgcaa

SEQ ID NO: 660187 - DNA, 25 bp, Mus musculus
gtaaaaataatcgtcttccctgcaa

SEQ ID NO: 660188 - DNA, 25 bp, Mus musculus
gtaaaaataattaccttgatcctca

SEQ ID NO: 660189 - DNA, 25 bp, Mus musculus
gtaaaaataatttccttgatcctca

SEQ ID NO: 660190 - DNA, 25 bp, Mus musculus
gtaaaaatccggattcccagcagag

SEQ ID NO: 660191 - DNA, 25 bp, Mus musculus
gtaaaaatccggtttcccagcagag

SEQ ID NO: 660192 - DNA, 25 bp, Mus musculus
gtaaaaatgacaagccgctctgaag

SEQ ID NO: 660193 - DNA, 25 bp, Mus musculus
gtaaaaatgacatgccgctctgaag

SEQ ID NO: 660194 - DNA, 25 bp, Mus musculus
gtaaaaatgccacctcactctcagg

SEQ ID NO: 660195 - DNA, 25 bp, Mus musculus
gtaaaaatgccagctcactctcagg

SEQ ID NO: 660196 - DNA, 25 bp, Mus musculus
gtaaaaatggccagttttgatttct

SEQ ID NO: 660197 - DNA, 25 bp, Mus musculus
gtaaaaatggcctgttttgatttct

SEQ ID NO: 660198 - DNA, 25 bp, Mus musculus
gtaaaacacatccatatctatacaa

SEQ ID NO: 660199 - DNA, 25 bp, Mus musculus
gtaaaacacatcgatatctatacaa

SEQ ID NO: 660200 - DNA, 25 bp, Mus musculus
gtaaaacaccatattcttgatgaga

SEQ ID NO: 660201 - DNA, 25 bp, Mus musculus
gtaaaacaccattttcttgatgaga

SEQ ID NO: 660202 - DNA, 25 bp, Mus musculus
gtaaaacacctgcactgggtaaaca

SEQ ID NO: 660203 - DNA, 25 bp, Mus musculus
gtaaaacacctggactgggtaaaca

SEQ ID NO: 660204 - DNA, 25 bp, Mus musculus
gtaaaacacgtcctcgatgtccttg

SEQ ID NO: 660205 - DNA, 25 bp, Mus musculus
gtaaaacacgtcgtcgatgtccttg

SEQ ID NO: 660206 - DNA, 25 bp, Mus musculus
gtaaaacagaccatccagaaaccag

SEQ ID NO: 660207 - DNA, 25 bp, Mus musculus
gtaaaacagaccttccagaaaccag

SEQ ID NO: 660208 - DNA, 25 bp, Mus musculus
gtaaaacagcttacatttgtattta

SEQ ID NO: 660209 - DNA, 25 bp, Mus musculus
gtaaaacagctttcatttgtattta

SEQ ID NO: 660210 - DNA, 25 bp, Mus musculus
gtaaaacatactcaagttcacttaa

SEQ ID NO: 660211 - DNA, 25 bp, Mus musculus
gtaaaacatactgaagttcacttaa

SEQ ID NO: 660212 - DNA, 25 bp, Mus musculus
gtaaaaccactactctgctactctg

SEQ ID NO: 660213 - DNA, 25 bp, Mus musculus
gtaaaaccactagtctgctactctg

SEQ ID NO: 660214 - DNA, 25 bp, Mus musculus
gtaaaaccaggcacggttgcgcacg

SEQ ID NO: 660215 - DNA, 25 bp, Mus musculus
gtaaaaccaggctcggttgcgcacg

SEQ ID NO: 660216 - DNA, 25 bp, Mus musculus
gtaaaacccaggaggccatggaagc

SEQ ID NO: 660217 - DNA, 25 bp, Mus musculus
gtaaaacccaggtggccatggaagc

SEQ ID NO: 660218 - DNA, 25 bp, Mus musculus
gtaaaaccctggacagccaaagcaa

SEQ ID NO: 660219 - DNA, 25 bp, Mus musculus
gtaaaaccctggtcagccaaagcaa

SEQ ID NO: 660220 - DNA, 25 bp, Mus musculus
gtaaaaccctgtagcggccggcctg

SEQ ID NO: 660221 - DNA, 25 bp, Mus musculus
gtaaaaccctgttgcggccggcctg

SEQ ID NO: 660222 - DNA, 25 bp, Mus musculus
gtaaaacccttaagtgccagccatg

SEQ ID NO: 660223 - DNA, 25 bp, Mus musculus
gtaaaacccttatgtgccagccatg

SEQ ID NO: 660224 - DNA, 25 bp, Mus musculus
gtaaaacctagaacacacttgtgat

SEQ ID NO: 660225 - DNA, 25 bp, Mus musculus
gtaaaacctagatcacacttgtgat

SEQ ID NO: 660226 - DNA, 25 bp, Mus musculus
gtaaaacctcacagctaagaataga

SEQ ID NO: 660227 - DNA, 25 bp, Mus musculus
gtaaaacctcactgctaagaataga

SEQ ID NO: 660228 - DNA, 25 bp, Mus musculus
gtaaaacctgatccgtgccattagt

SEQ ID NO: 660229 - DNA, 25 bp, Mus musculus
gtaaaacctgatgcgtgccattagt

SEQ ID NO: 660230 - DNA, 25 bp, Mus musculus
gtaaaacctgctacaatcactagat

SEQ ID NO: 660231 - DNA, 25 bp, Mus musculus
gtaaaacctgcttcaatcactagat

SEQ ID NO: 660232 - DNA, 25 bp, Mus musculus
gtaaaaccttagcacttagcacaat

SEQ ID NO: 660233 - DNA, 25 bp, Mus musculus
gtaaaaccttaggacttagcacaat

SEQ ID NO: 660234 - DNA, 25 bp, Mus musculus
gtaaaaccttgcctgctaggccggg

SEQ ID NO: 660235 - DNA, 25 bp, Mus musculus
gtaaaaccttgcgtgctaggccggg

SEQ ID NO: 660236 - DNA, 25 bp, Mus musculus
gtaaaacctttgagtgtagtcttag

SEQ ID NO: 660237 - DNA, 25 bp, Mus musculus
gtaaaacctttgtgtgtagtcttag

SEQ ID NO: 660238 - DNA, 25 bp, Mus musculus
gtaaaacgcaggactcttccagcct

SEQ ID NO: 660239 - DNA, 25 bp, Mus musculus
gtaaaacgcaggtctcttccagcct

SEQ ID NO: 660240 - DNA, 25 bp, Mus musculus
gtaaaacggcagagttagcaaacag

SEQ ID NO: 660241 - DNA, 25 bp, Mus musculus
gtaaaacggcagtgttagcaaacag

SEQ ID NO: 660242 - DNA, 25 bp, Mus musculus
gtaaaactagttacagctacatgga

SEQ ID NO: 660243 - DNA, 25 bp, Mus musculus
gtaaaactagtttcagctacatgga

SEQ ID NO: 660244 - DNA, 25 bp, Mus musculus
gtaaaactattcatcacactcccct

SEQ ID NO: 660245 - DNA, 25 bp, Mus musculus
gtaaaactattcttcacactcccct

SEQ ID NO: 660246 - DNA, 25 bp, Mus musculus
gtaaaactcatactccagccaacac

SEQ ID NO: 660247 - DNA, 25 bp, Mus musculus
gtaaaactcatagtccagccaacac

SEQ ID NO: 660248 - DNA, 25 bp, Mus musculus
gtaaaactctccagtttgacaagag

SEQ ID NO: 660249 - DNA, 25 bp, Mus musculus
gtaaaactctcctgtttgacaagag

SEQ ID NO: 660250 - DNA, 25 bp, Mus musculus
gtaaaactcttacgcatgtctggaa

SEQ ID NO: 660251 - DNA, 25 bp, Mus musculus
gtaaaactcttaggcatgtctggaa

SEQ ID NO: 660252 - DNA, 25 bp, Mus musculus
gtaaaactgcaccttagtaagacgc

SEQ ID NO: 660253 - DNA, 25 bp, Mus musculus
gtaaaactgcacgttagtaagacgc

SEQ ID NO: 660254 - DNA, 25 bp, Mus musculus
gtaaaactgcttactttcctagtat

SEQ ID NO: 660255 - DNA, 25 bp, Mus musculus
gtaaaactgctttctttcctagtat

SEQ ID NO: 660256 - DNA, 25 bp, Mus musculus
gtaaaactggtcactgatcacttag

SEQ ID NO: 660257 - DNA, 25 bp, Mus musculus
gtaaaactggtctctgatcacttag

SEQ ID NO: 660258 - DNA, 25 bp, Mus musculus
gtaaaactggttcaccattcaccct

SEQ ID NO: 660259 - DNA, 25 bp, Mus musculus
gtaaaactggttgaccattcaccct

SEQ ID NO: 660260 - DNA, 25 bp, Mus musculus
gtaaaactgtaccttgtctcttgaa

SEQ ID NO: 660261 - DNA, 25 bp, Mus musculus
gtaaaactgtacgttgtctcttgaa

SEQ ID NO: 660262 - DNA, 25 bp, Mus musculus
gtaaaactgtctctttgaactattg

SEQ ID NO: 660263 - DNA, 25 bp, Mus musculus
gtaaaactgtctgtttgaactattg

SEQ ID NO: 660264 - DNA, 25 bp, Mus musculus
gtaaaacttcgtcctctgaaatgct

SEQ ID NO: 660265 - DNA, 25 bp, Mus musculus
gtaaaacttcgtgctctgaaatgct

SEQ ID NO: 660266 - DNA, 25 bp, Mus musculus
gtaaaacttcttaatgctgagtcat

SEQ ID NO: 660267 - DNA, 25 bp, Mus musculus
gtaaaacttctttatgctgagtcat

SEQ ID NO: 660268 - DNA, 25 bp, Mus musculus
gtaaaacttgaccaacctgccaact

SEQ ID NO: 660269 - DNA, 25 bp, Mus musculus
gtaaaacttgacgaacctgccaact

SEQ ID NO: 660270 - DNA, 25 bp, Mus musculus
gtaaaacttggtcccttgtctgaag

SEQ ID NO: 660271 - DNA, 25 bp, Mus musculus
gtaaaacttggtgccttgtctgaag

SEQ ID NO: 660272 - DNA, 25 bp, Mus musculus
gtaaaacttgtcagattcaatataa

SEQ ID NO: 660273 - DNA, 25 bp, Mus musculus
gtaaaacttgtctgattcaatataa

SEQ ID NO: 660274 - DNA, 25 bp, Mus musculus
gtaaaactttaccaatacagctaat

SEQ ID NO: 660275 - DNA, 25 bp, Mus musculus
gtaaaactttacgaatacagctaat

SEQ ID NO: 660276 - DNA, 25 bp, Mus musculus
gtaaaactttagacctctacactga

SEQ ID NO: 660277 - DNA, 25 bp, Mus musculus
gtaaaactttagtcctctacactga

SEQ ID NO: 660278 - DNA, 25 bp, Mus musculus
gtaaaactttcacagtcctgggccg

SEQ ID NO: 660279 - DNA, 25 bp, Mus musculus
gtaaaactttcagagtcctgggccg

SEQ ID NO: 660280 - DNA, 25 bp, Mus musculus
gtaaaagaccaccaaagtatcctat

SEQ ID NO: 660281 - DNA, 25 bp, Mus musculus
gtaaaagaccacgaaagtatcctat

SEQ ID NO: 660282 - DNA, 25 bp, Mus musculus
gtaaaagaccagatccatgggttct

SEQ ID NO: 660283 - DNA, 25 bp, Mus musculus
gtaaaagaccagttccatgggttct

SEQ ID NO: 660284 - DNA, 25 bp, Mus musculus
gtaaaagactctacatactccccaa

SEQ ID NO: 660285 - DNA, 25 bp, Mus musculus
gtaaaagactcttcatactccccaa

SEQ ID NO: 660286 - DNA, 25 bp, Mus musculus
gtaaaagatccacgcatcatgcaag

SEQ ID NO: 660287 - DNA, 25 bp, Mus musculus
gtaaaagatccaggcatcatgcaag

SEQ ID NO: 660288 - DNA, 25 bp, Mus musculus
gtaaaagatcccagtgttcgttcat

SEQ ID NO: 660289 - DNA, 25 bp, Mus musculus
gtaaaagatccctgtgttcgttcat

SEQ ID NO: 660290 - DNA, 25 bp, Mus musculus
gtaaaagcaaatctcttgtctcctt

SEQ ID NO: 660291 - DNA, 25 bp, Mus musculus
gtaaaagcaaatgtcttgtctcctt

SEQ ID NO: 660292 - DNA, 25 bp, Mus musculus
gtaaaagcaagtaagtgtgctccca

SEQ ID NO: 660293 - DNA, 25 bp, Mus musculus
gtaaaagcaagttagtgtgctccca

SEQ ID NO: 660294 - DNA, 25 bp, Mus musculus
gtaaaagcacgtcgtatcagttaat

SEQ ID NO: 660295 - DNA, 25 bp, Mus musculus
gtaaaagcacgtggtatcagttaat

SEQ ID NO: 660296 - DNA, 25 bp, Mus musculus
gtaaaagcactgcaccatggtccta

SEQ ID NO: 660297 - DNA, 25 bp, Mus musculus
gtaaaagcactggaccatggtccta

SEQ ID NO: 660298 - DNA, 25 bp, Mus musculus
gtaaaagccatcaagacacttggaa

SEQ ID NO: 660299 - DNA, 25 bp, Mus musculus
gtaaaagccatctagacacttggaa

SEQ ID NO: 660300 - DNA, 25 bp, Mus musculus
gtaaaagccgtgataacggccctgt

SEQ ID NO: 660301 - DNA, 25 bp, Mus musculus
gtaaaagccgtgttaacggccctgt

SEQ ID NO: 660302 - DNA, 25 bp, Mus musculus
gtaaaagcctgtaagcctcaagagc

SEQ ID NO: 660303 - DNA, 25 bp, Mus musculus
gtaaaagcctgttagcctcaagagc

SEQ ID NO: 660304 - DNA, 25 bp, Mus musculus
gtaaaagccttaactcacagacaag

SEQ ID NO: 660305 - DNA, 25 bp, Mus musculus
gtaaaagccttatctcacagacaag

SEQ ID NO: 660306 - DNA, 25 bp, Mus musculus
gtaaaagcgaagatcacccatgggc

SEQ ID NO: 660307 - DNA, 25 bp, Mus musculus
gtaaaagcgaagttcacccatgggc

SEQ ID NO: 660308 - DNA, 25 bp, Mus musculus
gtaaaagcgtggactgactgcatcc

SEQ ID NO: 660309 - DNA, 25 bp, Mus musculus
gtaaaagcgtggtctgactgcatcc

SEQ ID NO: 660310 - DNA, 25 bp, Mus musculus
gtaaaagctagtaccttctccttgt

SEQ ID NO: 660311 - DNA, 25 bp, Mus musculus
gtaaaagctagttccttctccttgt

SEQ ID NO: 660312 - DNA, 25 bp, Mus musculus
gtaaaagctcccaaggatgctgtcc

SEQ ID NO: 660313 - DNA, 25 bp, Mus musculus
gtaaaagctccctaggatgctgtcc

SEQ ID NO: 660314 - DNA, 25 bp, Mus musculus
gtaaaagcttgcatcgcatgagaaa

SEQ ID NO: 660315 - DNA, 25 bp, Mus musculus
gtaaaagcttgcttcgcatgagaaa

SEQ ID NO: 660316 - DNA, 25 bp, Mus musculus
gtaaaaggacacaggcacaagggac

SEQ ID NO: 660317 - DNA, 25 bp, Mus musculus
gtaaaaggacactggcacaagggac

SEQ ID NO: 660318 - DNA, 25 bp, Mus musculus
gtaaaaggatctcaggtcgcccaga

SEQ ID NO: 660319 - DNA, 25 bp, Mus musculus
gtaaaaggatctgaggtcgcccaga

SEQ ID NO: 660320 - DNA, 25 bp, Mus musculus
gtaaaaggcaagcagtaccaaagat

SEQ ID NO: 660321 - DNA, 25 bp, Mus musculus
gtaaaaggcaaggagtaccaaagat

SEQ ID NO: 660322 - DNA, 25 bp, Mus musculus
gtaaaaggcatcatctatcgcaaga

SEQ ID NO: 660323 - DNA, 25 bp, Mus musculus
gtaaaaggcatcttctatcgcaaga

SEQ ID NO: 660324 - DNA, 25 bp, Mus musculus
gtaaaaggtccaacactcgtagccc

SEQ ID NO: 660325 - DNA, 25 bp, Mus musculus
gtaaaaggtccatcactcgtagccc

SEQ ID NO: 660326 - DNA, 25 bp, Mus musculus
gtaaaaggtgtgagttacaggatat

SEQ ID NO: 660327 - DNA, 25 bp, Mus musculus
gtaaaaggtgtgtgttacaggatat

SEQ ID NO: 660328 - DNA, 25 bp, Mus musculus
gtaaaagtccaacaacactactaga

SEQ ID NO: 660329 - DNA, 25 bp, Mus musculus
gtaaaagtccaacattccacctgtg

SEQ ID NO: 660330 - DNA, 25 bp, Mus musculus
gtaaaagtccaagaacactactaga

SEQ ID NO: 660331 - DNA, 25 bp, Mus musculus
gtaaaagtccaagattccacctgtg

SEQ ID NO: 660332 - DNA, 25 bp, Mus musculus
gtaaaagtccagagctgcccttgat

SEQ ID NO: 660333 - DNA, 25 bp, Mus musculus
gtaaaagtccagtgctgcccttgat

SEQ ID NO: 660334 - DNA, 25 bp, Mus musculus
gtaaaagtctccaagaaatgcctct

SEQ ID NO: 660335 - DNA, 25 bp, Mus musculus
gtaaaagtctcctagaaatgcctct

SEQ ID NO: 660336 - DNA, 25 bp, Mus musculus
gtaaaagtctgtcggctctcaaagc

SEQ ID NO: 660337 - DNA, 25 bp, Mus musculus
gtaaaagtctgtgggctctcaaagc

SEQ ID NO: 660338 - DNA, 25 bp, Mus musculus
gtaaaagtctttcttctccataatt

SEQ ID NO: 660339 - DNA, 25 bp, Mus musculus
gtaaaagtctttgttctccataatt

SEQ ID NO: 660340 - DNA, 25 bp, Mus musculus
gtaaaagtgaccatccttcatgcct

SEQ ID NO: 660341 - DNA, 25 bp, Mus musculus
gtaaaagtgaccttccttcatgcct

SEQ ID NO: 660342 - DNA, 25 bp, Mus musculus
gtaaaagtgatcatccccatgtcct

SEQ ID NO: 660343 - DNA, 25 bp, Mus musculus
gtaaaagtgatcttccccatgtcct

SEQ ID NO: 660344 - DNA, 25 bp, Mus musculus
gtaaaagtggatccttcgtccaact

SEQ ID NO: 660345 - DNA, 25 bp, Mus musculus
gtaaaagtggatgcttcgtccaact

SEQ ID NO: 660346 - DNA, 25 bp, Mus musculus
gtaaaagttcacacattaactcact

SEQ ID NO: 660347 - DNA, 25 bp, Mus musculus
gtaaaagttcactcattaactcact

SEQ ID NO: 660348 - DNA, 25 bp, Mus musculus
gtaaaagtttgcactgtcctctcag

SEQ ID NO: 660349 - DNA, 25 bp, Mus musculus
gtaaaagtttgctctgtcctctcag

SEQ ID NO: 660350 - DNA, 25 bp, Mus musculus
gtaaaataccctacatgacacaagg

SEQ ID NO: 660351 - DNA, 25 bp, Mus musculus
gtaaaatacccttcatgacacaagg

SEQ ID NO: 660352 - DNA, 25 bp, Mus musculus
gtaaaatactcaccattcagaccct

SEQ ID NO: 660353 - DNA, 25 bp, Mus musculus
gtaaaatactcagcattcagaccct

SEQ ID NO: 660354 - DNA, 25 bp, Mus musculus
gtaaaatagatcatcgggctgacag

SEQ ID NO: 660355 - DNA, 25 bp, Mus musculus
gtaaaatagatcttcgggctgacag

SEQ ID NO: 660356 - DNA, 25 bp, Mus musculus
gtaaaatagcaaactctccacctaa

SEQ ID NO: 660357 - DNA, 25 bp, Mus musculus
gtaaaatagcaatctctccacctaa

SEQ ID NO: 660358 - DNA, 25 bp, Mus musculus
gtaaaatagccccattcctcaaagg

SEQ ID NO: 660359 - DNA, 25 bp, Mus musculus
gtaaaatagcccgattcctcaaagg

SEQ ID NO: 660360 - DNA, 25 bp, Mus musculus
gtaaaatagcttcccaatgtgtaac

SEQ ID NO: 660361 - DNA, 25 bp, Mus musculus
gtaaaatagcttgccaatgtgtaac

SEQ ID NO: 660362 - DNA, 25 bp, Mus musculus
gtaaaatagtccactctgctcttct

SEQ ID NO: 660363 - DNA, 25 bp, Mus musculus
gtaaaatagtcctctctgctcttct

SEQ ID NO: 660364 - DNA, 25 bp, Mus musculus
gtaaaatattttagcactgttgtga

SEQ ID NO: 660365 - DNA, 25 bp, Mus musculus
gtaaaatatttttgcactgttgtga

SEQ ID NO: 660366 - DNA, 25 bp, Mus musculus
gtaaaatcaggcacaaataggtcac

SEQ ID NO: 660367 - DNA, 25 bp, Mus musculus
gtaaaatcaggctcaaataggtcac

SEQ ID NO: 660368 - DNA, 25 bp, Mus musculus
gtaaaatcaggtcccctaagtgtga

SEQ ID NO: 660369 - DNA, 25 bp, Mus musculus
gtaaaatcaggtgccctaagtgtga

SEQ ID NO: 660370 - DNA, 25 bp, Mus musculus
gtaaaatccaacaccaacagtattt

SEQ ID NO: 660371 - DNA, 25 bp, Mus musculus
gtaaaatccaactccaacagtattt

SEQ ID NO: 660372 - DNA, 25 bp, Mus musculus
gtaaaatccacaatgctaccctcag

SEQ ID NO: 660373 - DNA, 25 bp, Mus musculus
gtaaaatccacattgctaccctcag

SEQ ID NO: 660374 - DNA, 25 bp, Mus musculus
gtaaaatccattctcgtgaccacag

SEQ ID NO: 660375 - DNA, 25 bp, Mus musculus
gtaaaatccattgtcgtgaccacag

SEQ ID NO: 660376 - DNA, 25 bp, Mus musculus
gtaaaatcccataaccttcaatata

SEQ ID NO: 660377 - DNA, 25 bp, Mus musculus
gtaaaatcccattaccttcaatata

SEQ ID NO: 660378 - DNA, 25 bp, Mus musculus
gtaaaatctaaaatccaggagctat

SEQ ID NO: 660379 - DNA, 25 bp, Mus musculus
gtaaaatctaaattccaggagctat

SEQ ID NO: 660380 - DNA, 25 bp, Mus musculus
gtaaaatctatgagtggccaccaag

SEQ ID NO: 660381 - DNA, 25 bp, Mus musculus
gtaaaatctatgtgtggccaccaag

SEQ ID NO: 660382 - DNA, 25 bp, Mus musculus
gtaaaatctctccaatccactcaag

SEQ ID NO: 660383 - DNA, 25 bp, Mus musculus
gtaaaatctctcgaatccactcaag

SEQ ID NO: 660384 - DNA, 25 bp, Mus musculus
gtaaaatctgccactttttgaacat

SEQ ID NO: 660385 - DNA, 25 bp, Mus musculus
gtaaaatctgcctctttttgaacat

SEQ ID NO: 660386 - DNA, 25 bp, Mus musculus
gtaaaatctgctcgtcttgtgggaa

SEQ ID NO: 660387 - DNA, 25 bp, Mus musculus
gtaaaatctgctggtcttgtgggaa

SEQ ID NO: 660388 - DNA, 25 bp, Mus musculus
gtaaaatcttttacagcatgtgtta

SEQ ID NO: 660389 - DNA, 25 bp, Mus musculus
gtaaaatctttttcagcatgtgtta

SEQ ID NO: 660390 - DNA, 25 bp, Mus musculus
gtaaaatgcactatatttggtcagt

SEQ ID NO: 660391 - DNA, 25 bp, Mus musculus
gtaaaatgcactttatttggtcagt

SEQ ID NO: 660392 - DNA, 25 bp, Mus musculus
gtaaaatgcatgaccttgtttcctg

SEQ ID NO: 660393 - DNA, 25 bp, Mus musculus
gtaaaatgcatgtccttgtttcctg

SEQ ID NO: 660394 - DNA, 25 bp, Mus musculus
gtaaaatgctatatggagcctgcaa

SEQ ID NO: 660395 - DNA, 25 bp, Mus musculus
gtaaaatgctatttggagcctgcaa

SEQ ID NO: 660396 - DNA, 25 bp, Mus musculus
gtaaaatggtatatgcctgtattcc

SEQ ID NO: 660397 - DNA, 25 bp, Mus musculus
gtaaaatggtatttgcctgtattcc

SEQ ID NO: 660398 - DNA, 25 bp, Mus musculus
gtaaaatgtccaagccagtagtact

SEQ ID NO: 660399 - DNA, 25 bp, Mus musculus
gtaaaatgtccatgccagtagtact

SEQ ID NO: 660400 - DNA, 25 bp, Mus musculus
gtaaaatgttgtcactgctttccag

SEQ ID NO: 660401 - DNA, 25 bp, Mus musculus
gtaaaatgttgtgactgctttccag

SEQ ID NO: 660402 - DNA, 25 bp, Mus musculus
gtaaaattacagatcaatatatcta

SEQ ID NO: 660403 - DNA, 25 bp, Mus musculus
gtaaaattacagttcaatatatcta

SEQ ID NO: 660404 - DNA, 25 bp, Mus musculus
gtaaaattaccacaccccaactgca

SEQ ID NO: 660405 - DNA, 25 bp, Mus musculus
gtaaaattaccagaccccaactgca

SEQ ID NO: 660406 - DNA, 25 bp, Mus musculus
gtaaaattcaatcaaggcagctaag

SEQ ID NO: 660407 - DNA, 25 bp, Mus musculus
gtaaaattcaatgaaggcagctaag

SEQ ID NO: 660408 - DNA, 25 bp, Mus musculus
gtaaaattccaaagcattccaccca

SEQ ID NO: 660409 - DNA, 25 bp, Mus musculus
gtaaaattccaatgcattccaccca

SEQ ID NO: 660410 - DNA, 25 bp, Mus musculus
gtaaaattccttctcttctctagaa

SEQ ID NO: 660411 - DNA, 25 bp, Mus musculus
gtaaaattccttgtcttctctagaa

SEQ ID NO: 660412 - DNA, 25 bp, Mus musculus
gtaaaattgaggatccacgtggaaa

SEQ ID NO: 660413 - DNA, 25 bp, Mus musculus
gtaaaattgaggttccacgtggaaa

SEQ ID NO: 660414 - DNA, 25 bp, Mus musculus
gtaaaattgccaactgtacctgaaa

SEQ ID NO: 660415 - DNA, 25 bp, Mus musculus
gtaaaattgccatctgtacctgaaa

SEQ ID NO: 660416 - DNA, 25 bp, Mus musculus
gtaaaattgcctattagtgtctata

SEQ ID NO: 660417 - DNA, 25 bp, Mus musculus
gtaaaattgccttttagtgtctata

SEQ ID NO: 660418 - DNA, 25 bp, Mus musculus
gtaaaatttcgcagtagtactcagc

SEQ ID NO: 660419 - DNA, 25 bp, Mus musculus
gtaaaatttcgctgtagtactcagc

SEQ ID NO: 660420 - DNA, 25 bp, Mus musculus
gtaaacaaacacactattcctgtat

SEQ ID NO: 660421 - DNA, 25 bp, Mus musculus
gtaaacaaacactctattcctgtat

SEQ ID NO: 660422 - DNA, 25 bp, Mus musculus
gtaaacaacaacattgtcacacttt

SEQ ID NO: 660423 - DNA, 25 bp, Mus musculus
gtaaacaacaactttgtcacacttt

SEQ ID NO: 660424 - DNA, 25 bp, Mus musculus
gtaaacaaccaacccattcatatgt

SEQ ID NO: 660425 - DNA, 25 bp, Mus musculus
gtaaacaaccaagccattcatatgt

SEQ ID NO: 660426 - DNA, 25 bp, Mus musculus
gtaaacaaccgtcaggtctggccac

SEQ ID NO: 660427 - DNA, 25 bp, Mus musculus
gtaaacaaccgtgaggtctggccac

SEQ ID NO: 660428 - DNA, 25 bp, Mus musculus
gtaaacaagacaacacccaacgcat

SEQ ID NO: 660429 - DNA, 25 bp, Mus musculus
gtaaacaagacatcacccaacgcat

SEQ ID NO: 660430 - DNA, 25 bp, Mus musculus
gtaaacaaggacatgcctccagaaa

SEQ ID NO: 660431 - DNA, 25 bp, Mus musculus
gtaaacaaggacttgcctccagaaa

SEQ ID NO: 660432 - DNA, 25 bp, Mus musculus
gtaaacaaggccaggtcattcccag

SEQ ID NO: 660433 - DNA, 25 bp, Mus musculus
gtaaacaaggcctggtcattcccag

SEQ ID NO: 660434 - DNA, 25 bp, Mus musculus
gtaaacaaggtgactttctgctaca

SEQ ID NO: 660435 - DNA, 25 bp, Mus musculus
gtaaacaaggtgtctttctgctaca

SEQ ID NO: 660436 - DNA, 25 bp, Mus musculus
gtaaacaagttcctcaacctgcaaa

SEQ ID NO: 660437 - DNA, 25 bp, Mus musculus
gtaaacaagttcgtcaacctgcaaa

SEQ ID NO: 660438 - DNA, 25 bp, Mus musculus
gtaaacaatgttaatcatggccaga

SEQ ID NO: 660439 - DNA, 25 bp, Mus musculus
gtaaacaatgtttatcatggccaga

SEQ ID NO: 660440 - DNA, 25 bp, Mus musculus
gtaaacaattgcaaaagacatctca

SEQ ID NO: 660441 - DNA, 25 bp, Mus musculus
gtaaacaattgctaaagacatctca

SEQ ID NO: 660442 - DNA, 25 bp, Mus musculus
gtaaacacaacactcgaggccaaca

SEQ ID NO: 660443 - DNA, 25 bp, Mus musculus
gtaaacacaacagtcgaggccaaca

SEQ ID NO: 660444 - DNA, 25 bp, Mus musculus
gtaaacacaactatctctacatttg

SEQ ID NO: 660445 - DNA, 25 bp, Mus musculus
gtaaacacaactttctctacatttg

SEQ ID NO: 660446 - DNA, 25 bp, Mus musculus
gtaaacacaagcatttgtacttgaa

SEQ ID NO: 660447 - DNA, 25 bp, Mus musculus
gtaaacacaagcttttgtacttgaa

SEQ ID NO: 660448 - DNA, 25 bp, Mus musculus
gtaaacacacatacagaggctaatt

SEQ ID NO: 660449 - DNA, 25 bp, Mus musculus
gtaaacacacattcagaggctaatt

SEQ ID NO: 660450 - DNA, 25 bp, Mus musculus
gtaaacacagccaccgagttcagta

SEQ ID NO: 660451 - DNA, 25 bp, Mus musculus
gtaaacacagcctccgagttcagta

SEQ ID NO: 660452 - DNA, 25 bp, Mus musculus
gtaaacacagctcgtcgcgggcatc

SEQ ID NO: 660453 - DNA, 25 bp, Mus musculus
gtaaacacagctggtcgcgggcatc

SEQ ID NO: 660454 - DNA, 25 bp, Mus musculus
gtaaacacagtcaagccattcttag

SEQ ID NO: 660455 - DNA, 25 bp, Mus musculus
gtaaacacagtctagccattcttag

SEQ ID NO: 660456 - DNA, 25 bp, Mus musculus
gtaaacaccgaacggacatctatat

SEQ ID NO: 660457 - DNA, 25 bp, Mus musculus
gtaaacaccgaagggacatctatat

SEQ ID NO: 660458 - DNA, 25 bp, Mus musculus
gtaaacaccgagcaaggcatagaaa

SEQ ID NO: 660459 - DNA, 25 bp, Mus musculus
gtaaacaccgaggaaggcatagaaa

SEQ ID NO: 660460 - DNA, 25 bp, Mus musculus
gtaaacaccgccacagagacagcaa

SEQ ID NO: 660461 - DNA, 25 bp, Mus musculus
gtaaacaccgcctcagagacagcaa

SEQ ID NO: 660462 - DNA, 25 bp, Mus musculus
gtaaacacctaccacttaagccaat

SEQ ID NO: 660463 - DNA, 25 bp, Mus musculus
gtaaacacctacgacttaagccaat

SEQ ID NO: 660464 - DNA, 25 bp, Mus musculus
gtaaacacctgtacccagatcaatt

SEQ ID NO: 660465 - DNA, 25 bp, Mus musculus
gtaaacacctgtcatgtgtgtccct

SEQ ID NO: 660466 - DNA, 25 bp, Mus musculus
gtaaacacctgtgatgtgtgtccct

SEQ ID NO: 660467 - DNA, 25 bp, Mus musculus
gtaaacacctgttcccagatcaatt

SEQ ID NO: 660468 - DNA, 25 bp, Mus musculus
gtaaacacgtccagtcgctgattaa

SEQ ID NO: 660469 - DNA, 25 bp, Mus musculus
gtaaacacgtcctgtcgctgattaa

SEQ ID NO: 660470 - DNA, 25 bp, Mus musculus
gtaaacactcagaatcttgacccct

SEQ ID NO: 660471 - DNA, 25 bp, Mus musculus
gtaaacactcagaatgctgctgcta

SEQ ID NO: 660472 - DNA, 25 bp, Mus musculus
gtaaacactcagtatcttgacccct

SEQ ID NO: 660473 - DNA, 25 bp, Mus musculus
gtaaacactcagtatgctgctgcta

SEQ ID NO: 660474 - DNA, 25 bp, Mus musculus
gtaaacactgcactgcacagggcac

SEQ ID NO: 660475 - DNA, 25 bp, Mus musculus
gtaaacactgcagtgcacagggcac

SEQ ID NO: 660476 - DNA, 25 bp, Mus musculus
gtaaacactgccaggtttctgcttg

SEQ ID NO: 660477 - DNA, 25 bp, Mus musculus
gtaaacactgcctggtttctgcttg

SEQ ID NO: 660478 - DNA, 25 bp, Mus musculus
gtaaacactgctactcgaatggagt

SEQ ID NO: 660479 - DNA, 25 bp, Mus musculus
gtaaacactgctattattcttgtat

SEQ ID NO: 660480 - DNA, 25 bp, Mus musculus
gtaaacactgcttctcgaatggagt

SEQ ID NO: 660481 - DNA, 25 bp, Mus musculus
gtaaacactgcttttattcttgtat

SEQ ID NO: 660482 - DNA, 25 bp, Mus musculus
gtaaacacttgtatatgggtgtaac

SEQ ID NO: 660483 - DNA, 25 bp, Mus musculus
gtaaacacttgtttatgggtgtaac

SEQ ID NO: 660484 - DNA, 25 bp, Mus musculus
gtaaacagaccccaacaaggatgaa

SEQ ID NO: 660485 - DNA, 25 bp, Mus musculus
gtaaacagacccgaacaaggatgaa

SEQ ID NO: 660486 - DNA, 25 bp, Mus musculus
gtaaacagagatagcttcagtaaga

SEQ ID NO: 660487 - DNA, 25 bp, Mus musculus
gtaaacagagattgcttcagtaaga

SEQ ID NO: 660488 - DNA, 25 bp, Mus musculus
gtaaacagccacagcatttgcaatg

SEQ ID NO: 660489 - DNA, 25 bp, Mus musculus
gtaaacagccactgcatttgcaatg

SEQ ID NO: 660490 - DNA, 25 bp, Mus musculus
gtaaacagccctatgttcacagctg

SEQ ID NO: 660491 - DNA, 25 bp, Mus musculus
gtaaacagccctttgttcacagctg

SEQ ID NO: 660492 - DNA, 25 bp, Mus musculus
gtaaacaggcaaccggaaaccagcg

SEQ ID NO: 660493 - DNA, 25 bp, Mus musculus
gtaaacaggcaagcggaaaccagcg

SEQ ID NO: 660494 - DNA, 25 bp, Mus musculus
gtaaacagtactacaacaatttcaa

SEQ ID NO: 660495 - DNA, 25 bp, Mus musculus
gtaaacagtacttcaacaatttcaa

SEQ ID NO: 660496 - DNA, 25 bp, Mus musculus
gtaaacagtggaagagctcctcccc

SEQ ID NO: 660497 - DNA, 25 bp, Mus musculus
gtaaacagtggatgagctcctcccc

SEQ ID NO: 660498 - DNA, 25 bp, Mus musculus
gtaaacagttctcgtctttccagtg

SEQ ID NO: 660499 - DNA, 25 bp, Mus musculus
gtaaacagttctggtctttccagtg

SEQ ID NO: 660500 - DNA, 25 bp, Mus musculus
gtaaacataggtcgcgacttcgacg

SEQ ID NO: 660501 - DNA, 25 bp, Mus musculus
gtaaacataggtggcgacttcgacg

SEQ ID NO: 660502 - DNA, 25 bp, Mus musculus
gtaaacatatctcccttgacttatt

SEQ ID NO: 660503 - DNA, 25 bp, Mus musculus
gtaaacatatctgccttgacttatt

SEQ ID NO: 660504 - DNA, 25 bp, Mus musculus
gtaaacatatgtcctataacctcaa

SEQ ID NO: 660505 - DNA, 25 bp, Mus musculus
gtaaacatatgtgctataacctcaa

SEQ ID NO: 660506 - DNA, 25 bp, Mus musculus
gtaaacatattacctcactcttggt

SEQ ID NO: 660507 - DNA, 25 bp, Mus musculus
gtaaacatattagctcactcttggt

SEQ ID NO: 660508 - DNA, 25 bp, Mus musculus
gtaaacatccatctaatctgtcagg

SEQ ID NO: 660509 - DNA, 25 bp, Mus musculus
gtaaacatccatgtaatctgtcagg

SEQ ID NO: 660510 - DNA, 25 bp, Mus musculus
gtaaacatctatacgatctgggatt

SEQ ID NO: 660511 - DNA, 25 bp, Mus musculus
gtaaacatctattcgatctgggatt

SEQ ID NO: 660512 - DNA, 25 bp, Mus musculus
gtaaacatctggcttgcaagccatt

SEQ ID NO: 660513 - DNA, 25 bp, Mus musculus
gtaaacatctgggttgcaagccatt

SEQ ID NO: 660514 - DNA, 25 bp, Mus musculus
gtaaacatgaccagagccctatctc

SEQ ID NO: 660515 - DNA, 25 bp, Mus musculus
gtaaacatgacctgagccctatctc

SEQ ID NO: 660516 - DNA, 25 bp, Mus musculus
gtaaacatgcatactacttgatcgt

SEQ ID NO: 660517 - DNA, 25 bp, Mus musculus
gtaaacatgcattctacttgatcgt

SEQ ID NO: 660518 - DNA, 25 bp, Mus musculus
gtaaacatggagagcccagtccatt

SEQ ID NO: 660519 - DNA, 25 bp, Mus musculus
gtaaacatggagtgcccagtccatt

SEQ ID NO: 660520 - DNA, 25 bp, Mus musculus
gtaaacatggcccaagttcttcaaa

SEQ ID NO: 660521 - DNA, 25 bp, Mus musculus
gtaaacatggccgaagttcttcaaa

SEQ ID NO: 660522 - DNA, 25 bp, Mus musculus
gtaaacatgtaccatcaagggcaca

SEQ ID NO: 660523 - DNA, 25 bp, Mus musculus
gtaaacatgtacgatcaagggcaca

SEQ ID NO: 660524 - DNA, 25 bp, Mus musculus
gtaaacattcatcgtaattttgctt

SEQ ID NO: 660525 - DNA, 25 bp, Mus musculus
gtaaacattcatggtaattttgctt

SEQ ID NO: 660526 - DNA, 25 bp, Mus musculus
gtaaacattgccaaacaacattgag

SEQ ID NO: 660527 - DNA, 25 bp, Mus musculus
gtaaacattgcctaacaacattgag

SEQ ID NO: 660528 - DNA, 25 bp, Mus musculus
gtaaacattggaatcggaataaata

SEQ ID NO: 660529 - DNA, 25 bp, Mus musculus
gtaaacattggattcggaataaata

SEQ ID NO: 660530 - DNA, 25 bp, Mus musculus
gtaaacattggtctggtaactatta

SEQ ID NO: 660531 - DNA, 25 bp, Mus musculus
gtaaacattggtgtggtaactatta

SEQ ID NO: 660532 - DNA, 25 bp, Mus musculus
gtaaacatttctatgctcaaccatg

SEQ ID NO: 660533 - DNA, 25 bp, Mus musculus
gtaaacatttctttgctcaaccatg

SEQ ID NO: 660534 - DNA, 25 bp, Mus musculus
gtaaacatttgtacttggactccaa

SEQ ID NO: 660535 - DNA, 25 bp, Mus musculus
gtaaacatttgttcttggactccaa

SEQ ID NO: 660536 - DNA, 25 bp, Mus musculus
gtaaaccaaacccatactcatcttt

SEQ ID NO: 660537 - DNA, 25 bp, Mus musculus
gtaaaccaaaccgatactcatcttt

SEQ ID NO: 660538 - DNA, 25 bp, Mus musculus
gtaaaccaactcagtgcgggatgca

SEQ ID NO: 660539 - DNA, 25 bp, Mus musculus
gtaaaccaactctgtgcgggatgca

SEQ ID NO: 660540 - DNA, 25 bp, Mus musculus
gtaaaccaagctctgaacctaaaat

SEQ ID NO: 660541 - DNA, 25 bp, Mus musculus
gtaaaccaagctgtgaacctaaaat

SEQ ID NO: 660542 - DNA, 25 bp, Mus musculus
gtaaaccaatgtatgcttatcccca

SEQ ID NO: 660543 - DNA, 25 bp, Mus musculus
gtaaaccaatgtttgcttatcccca

SEQ ID NO: 660544 - DNA, 25 bp, Mus musculus
gtaaaccacagcaatttaggcactg

SEQ ID NO: 660545 - DNA, 25 bp, Mus musculus
gtaaaccacagctatttaggcactg

SEQ ID NO: 660546 - DNA, 25 bp, Mus musculus
gtaaaccacaggcaccgaatgcatg

SEQ ID NO: 660547 - DNA, 25 bp, Mus musculus
gtaaaccacagggaccgaatgcatg

SEQ ID NO: 660548 - DNA, 25 bp, Mus musculus
gtaaaccacatcatttttgcacttt

SEQ ID NO: 660549 - DNA, 25 bp, Mus musculus
gtaaaccacatcttttttgcacttt

SEQ ID NO: 660550 - DNA, 25 bp, Mus musculus
gtaaaccaccaaccttctcttgtag

SEQ ID NO: 660551 - DNA, 25 bp, Mus musculus
gtaaaccaccaagcttctcttgtag

SEQ ID NO: 660552 - DNA, 25 bp, Mus musculus
gtaaaccagaagatgtcacaccttg

SEQ ID NO: 660553 - DNA, 25 bp, Mus musculus
gtaaaccagaagttgtcacaccttg

SEQ ID NO: 660554 - DNA, 25 bp, Mus musculus
gtaaaccagaatagggctcccagac

SEQ ID NO: 660555 - DNA, 25 bp, Mus musculus
gtaaaccagaattgggctcccagac

SEQ ID NO: 660556 - DNA, 25 bp, Mus musculus
gtaaaccagcataaaagagcacagc

SEQ ID NO: 660557 - DNA, 25 bp, Mus musculus
gtaaaccagcattaaagagcacagc

SEQ ID NO: 660558 - DNA, 25 bp, Mus musculus
gtaaaccagggcaatacatgaacct

SEQ ID NO: 660559 - DNA, 25 bp, Mus musculus
gtaaaccagggctatacatgaacct

SEQ ID NO: 660560 - DNA, 25 bp, Mus musculus
gtaaaccatggactttttcgaagag

SEQ ID NO: 660561 - DNA, 25 bp, Mus musculus
gtaaaccatggagtttttcgaagag

SEQ ID NO: 660562 - DNA, 25 bp, Mus musculus
gtaaacccagacattctcgtggaca

SEQ ID NO: 660563 - DNA, 25 bp, Mus musculus
gtaaacccagactttctcgtggaca

SEQ ID NO: 660564 - DNA, 25 bp, Mus musculus
gtaaacccatttcccacttaatctg

SEQ ID NO: 660565 - DNA, 25 bp, Mus musculus
gtaaacccatttgccacttaatctg

SEQ ID NO: 660566 - DNA, 25 bp, Mus musculus
gtaaaccctacaactgtgtttttca

SEQ ID NO: 660567 - DNA, 25 bp, Mus musculus
gtaaaccctacatctgtgtttttca

SEQ ID NO: 660568 - DNA, 25 bp, Mus musculus
gtaaaccctccaacatgggacagag

SEQ ID NO: 660569 - DNA, 25 bp, Mus musculus
gtaaaccctccatcatgggacagag

SEQ ID NO: 660570 - DNA, 25 bp, Mus musculus
gtaaacccttgtaccagagtatgaa

SEQ ID NO: 660571 - DNA, 25 bp, Mus musculus
gtaaacccttgttccagagtatgaa

SEQ ID NO: 660572 - DNA, 25 bp, Mus musculus
gtaaaccgaggaaggcaccattaga

SEQ ID NO: 660573 - DNA, 25 bp, Mus musculus
gtaaaccgaggatggcaccattaga

SEQ ID NO: 660574 - DNA, 25 bp, Mus musculus
gtaaaccggagaccatgcaggattt

SEQ ID NO: 660575 - DNA, 25 bp, Mus musculus
gtaaaccggagagcatgcaggattt

SEQ ID NO: 660576 - DNA, 25 bp, Mus musculus
gtaaaccgggtgatgatgaggattt

SEQ ID NO: 660577 - DNA, 25 bp, Mus musculus
gtaaaccgggtgttgatgaggattt

SEQ ID NO: 660578 - DNA, 25 bp, Mus musculus
gtaaaccgtgacagatcttattctt

SEQ ID NO: 660579 - DNA, 25 bp, Mus musculus
gtaaaccgtgactgatcttattctt

SEQ ID NO: 660580 - DNA, 25 bp, Mus musculus
gtaaacctacccatagagctctttg

SEQ ID NO: 660581 - DNA, 25 bp, Mus musculus
gtaaacctacccttagagctctttg

SEQ ID NO: 660582 - DNA, 25 bp, Mus musculus
gtaaacctagtgcacaaagatgtat

SEQ ID NO: 660583 - DNA, 25 bp, Mus musculus
gtaaacctagtggacaaagatgtat

SEQ ID NO: 660584 - DNA, 25 bp, Mus musculus
gtaaacctcaaaaagttgtgtatct

SEQ ID NO: 660585 - DNA, 25 bp, Mus musculus
gtaaacctcaaatagttgtgtatct

SEQ ID NO: 660586 - DNA, 25 bp, Mus musculus
gtaaacctccttccagtggttatct

SEQ ID NO: 660587 - DNA, 25 bp, Mus musculus
gtaaacctccttgcagtggttatct

SEQ ID NO: 660588 - DNA, 25 bp, Mus musculus
gtaaacctcgccatggctagggcgg

SEQ ID NO: 660589 - DNA, 25 bp, Mus musculus
gtaaacctcgccttggctagggcgg

SEQ ID NO: 660590 - DNA, 25 bp, Mus musculus
gtaaacctctatctcttttgctgta

SEQ ID NO: 660591 - DNA, 25 bp, Mus musculus
gtaaacctctatgtcttttgctgta

SEQ ID NO: 660592 - DNA, 25 bp, Mus musculus
gtaaacctgaaaagtgctctggaga

SEQ ID NO: 660593 - DNA, 25 bp, Mus musculus
gtaaacctgaaatgtgctctggaga

SEQ ID NO: 660594 - DNA, 25 bp, Mus musculus
gtaaacctgactaggccactgtttg

SEQ ID NO: 660595 - DNA, 25 bp, Mus musculus
gtaaacctgacttggccactgtttg

SEQ ID NO: 660596 - DNA, 25 bp, Mus musculus
gtaaacctgcccatggtaagtctgg

SEQ ID NO: 660597 - DNA, 25 bp, Mus musculus
gtaaacctgcccttggtaagtctgg

SEQ ID NO: 660598 - DNA, 25 bp, Mus musculus
gtaaacctggaacaaccatctgtaa

SEQ ID NO: 660599 - DNA, 25 bp, Mus musculus
gtaaacctggaagaaccatctgtaa

SEQ ID NO: 660600 - DNA, 25 bp, Mus musculus
gtaaacctggcccatgccttggcta

SEQ ID NO: 660601 - DNA, 25 bp, Mus musculus
gtaaacctggccgatgccttggcta

SEQ ID NO: 660602 - DNA, 25 bp, Mus musculus
gtaaacctgtgtaaacacttgtcac

SEQ ID NO: 660603 - DNA, 25 bp, Mus musculus
gtaaacctgtgttaacacttgtcac

SEQ ID NO: 660604 - DNA, 25 bp, Mus musculus
gtaaacctgttgcatttagtaatcg

SEQ ID NO: 660605 - DNA, 25 bp, Mus musculus
gtaaacctgttggatttagtaatcg

SEQ ID NO: 660606 - DNA, 25 bp, Mus musculus
gtaaaccttacaacgtcaaacagat

SEQ ID NO: 660607 - DNA, 25 bp, Mus musculus
gtaaaccttacatcgtcaaacagat

SEQ ID NO: 660608 - DNA, 25 bp, Mus musculus
gtaaaccttagtagttagaactcag

SEQ ID NO: 660609 - DNA, 25 bp, Mus musculus
gtaaaccttagttgttagaactcag

SEQ ID NO: 660610 - DNA, 25 bp, Mus musculus
gtaaaccttcatatttcgctgagag

SEQ ID NO: 660611 - DNA, 25 bp, Mus musculus
gtaaaccttcatttttcgctgagag

SEQ ID NO: 660612 - DNA, 25 bp, Mus musculus
gtaaaccttgtaactgtcaggtcat

SEQ ID NO: 660613 - DNA, 25 bp, Mus musculus
gtaaaccttgtatctgtcaggtcat

SEQ ID NO: 660614 - DNA, 25 bp, Mus musculus
gtaaacgacaatataaaagaggcct

SEQ ID NO: 660615 - DNA, 25 bp, Mus musculus
gtaaacgacaatttaaaagaggcct

SEQ ID NO: 660616 - DNA, 25 bp, Mus musculus
gtaaacgctgagaggcaccattgaa

SEQ ID NO: 660617 - DNA, 25 bp, Mus musculus
gtaaacgctgagtggcaccattgaa

SEQ ID NO: 660618 - DNA, 25 bp, Mus musculus
gtaaacgctttcagatgtatcatca

SEQ ID NO: 660619 - DNA, 25 bp, Mus musculus
gtaaacgctttctgatgtatcatca

SEQ ID NO: 660620 - DNA, 25 bp, Mus musculus
gtaaacggcatactgtatcccgcag

SEQ ID NO: 660621 - DNA, 25 bp, Mus musculus
gtaaacggcatagtgtatcccgcag

SEQ ID NO: 660622 - DNA, 25 bp, Mus musculus
gtaaacgtgctacccatggaaacat

SEQ ID NO: 660623 - DNA, 25 bp, Mus musculus
gtaaacgtgctagccatggaaacat

SEQ ID NO: 660624 - DNA, 25 bp, Mus musculus
gtaaacgtgcttatcaattcattat

SEQ ID NO: 660625 - DNA, 25 bp, Mus musculus
gtaaacgtgcttttcaattcattat

SEQ ID NO: 660626 - DNA, 25 bp, Mus musculus
gtaaacgttagaatgcgaatgctag

SEQ ID NO: 660627 - DNA, 25 bp, Mus musculus
gtaaacgttagattgcgaatgctag

SEQ ID NO: 660628 - DNA, 25 bp, Mus musculus
gtaaactacctgcacaatagcccct

SEQ ID NO: 660629 - DNA, 25 bp, Mus musculus
gtaaactacctggacaatagcccct

SEQ ID NO: 660630 - DNA, 25 bp, Mus musculus
gtaaactatactcagcctttggtgg

SEQ ID NO: 660631 - DNA, 25 bp, Mus musculus
gtaaactatactgagcctttggtgg

SEQ ID NO: 660632 - DNA, 25 bp, Mus musculus
gtaaactatgtgatgcgacctcgct

SEQ ID NO: 660633 - DNA, 25 bp, Mus musculus
gtaaactatgtgttgcgacctcgct

SEQ ID NO: 660634 - DNA, 25 bp, Mus musculus
gtaaactatgttactccaagtgctt

SEQ ID NO: 660635 - DNA, 25 bp, Mus musculus
gtaaactatgtttctccaagtgctt

SEQ ID NO: 660636 - DNA, 25 bp, Mus musculus
gtaaactattaaagttgtgccatat

SEQ ID NO: 660637 - DNA, 25 bp, Mus musculus
gtaaactattaatgttgtgccatat

SEQ ID NO: 660638 - DNA, 25 bp, Mus musculus
gtaaactattacatcgtcaacccaa

SEQ ID NO: 660639 - DNA, 25 bp, Mus musculus
gtaaactattacttcgtcaacccaa

SEQ ID NO: 660640 - DNA, 25 bp, Mus musculus
gtaaactcactgctaccttaacagg

SEQ ID NO: 660641 - DNA, 25 bp, Mus musculus
gtaaactcactggtaccttaacagg

SEQ ID NO: 660642 - DNA, 25 bp, Mus musculus
gtaaactcatgaagtttgtgtgacc

SEQ ID NO: 660643 - DNA, 25 bp, Mus musculus
gtaaactcatgatgtttgtgtgacc

SEQ ID NO: 660644 - DNA, 25 bp, Mus musculus
gtaaactccagaagggaaccaagat

SEQ ID NO: 660645 - DNA, 25 bp, Mus musculus
gtaaactccagatgggaaccaagat

SEQ ID NO: 660646 - DNA, 25 bp, Mus musculus
gtaaactcgtatcaaatctggaaca

SEQ ID NO: 660647 - DNA, 25 bp, Mus musculus
gtaaactcgtatgaaatctggaaca

SEQ ID NO: 660648 - DNA, 25 bp, Mus musculus
gtaaactctaaaactctgaacataa

SEQ ID NO: 660649 - DNA, 25 bp, Mus musculus
gtaaactctaaatctctgaacataa

SEQ ID NO: 660650 - DNA, 25 bp, Mus musculus
gtaaactctgtaagctaccgtggtt

SEQ ID NO: 660651 - DNA, 25 bp, Mus musculus
gtaaactctgtatgctaccgtggtt

SEQ ID NO: 660652 - DNA, 25 bp, Mus musculus
gtaaactcttacaccataatctctt

SEQ ID NO: 660653 - DNA, 25 bp, Mus musculus
gtaaactcttactccataatctctt

SEQ ID NO: 660654 - DNA, 25 bp, Mus musculus
gtaaactgaagactgcaccgcaaat

SEQ ID NO: 660655 - DNA, 25 bp, Mus musculus
gtaaactgaagagtgcaccgcaaat

SEQ ID NO: 660656 - DNA, 25 bp, Mus musculus
gtaaactgaggaaggccccacactg

SEQ ID NO: 660657 - DNA, 25 bp, Mus musculus
gtaaactgaggatggccccacactg

SEQ ID NO: 660658 - DNA, 25 bp, Mus musculus
gtaaactgcctgcttaccaggcacg

SEQ ID NO: 660659 - DNA, 25 bp, Mus musculus
gtaaactgcctggttaccaggcacg

SEQ ID NO: 660660 - DNA, 25 bp, Mus musculus
gtaaactgctctagcacatcggaag

SEQ ID NO: 660661 - DNA, 25 bp, Mus musculus
gtaaactgctcttgcacatcggaag

SEQ ID NO: 660662 - DNA, 25 bp, Mus musculus
gtaaactgcttaaactatcaccata

SEQ ID NO: 660663 - DNA, 25 bp, Mus musculus
gtaaactgcttatactatcaccata

SEQ ID NO: 660664 - DNA, 25 bp, Mus musculus
gtaaactggcgccatgtttccgaca

SEQ ID NO: 660665 - DNA, 25 bp, Mus musculus
gtaaactggcgcgatgtttccgaca

SEQ ID NO: 660666 - DNA, 25 bp, Mus musculus
gtaaactggcttaacggagaccgag

SEQ ID NO: 660667 - DNA, 25 bp, Mus musculus
gtaaactggctttacggagaccgag

SEQ ID NO: 660668 - DNA, 25 bp, Mus musculus
gtaaactgtaatcttattctcccta

SEQ ID NO: 660669 - DNA, 25 bp, Mus musculus
gtaaactgtaatgttattctcccta

SEQ ID NO: 660670 - DNA, 25 bp, Mus musculus
gtaaactgtgcgagtgatctcctta

SEQ ID NO: 660671 - DNA, 25 bp, Mus musculus
gtaaactgtgcgtgtgatctcctta

SEQ ID NO: 660672 - DNA, 25 bp, Mus musculus
gtaaactgtgtgatggtctttgaca

SEQ ID NO: 660673 - DNA, 25 bp, Mus musculus
gtaaactgtgtgttggtctttgaca

SEQ ID NO: 660674 - DNA, 25 bp, Mus musculus
gtaaactgtgttaggaactctgctg

SEQ ID NO: 660675 - DNA, 25 bp, Mus musculus
gtaaactgtgttatgacttcaaaat

SEQ ID NO: 660676 - DNA, 25 bp, Mus musculus
gtaaactgtgtttggaactctgctg

SEQ ID NO: 660677 - DNA, 25 bp, Mus musculus
gtaaactgtgttttgacttcaaaat

SEQ ID NO: 660678 - DNA, 25 bp, Mus musculus
gtaaactgttccatcatcagtcttc

SEQ ID NO: 660679 - DNA, 25 bp, Mus musculus
gtaaactgttccttcatcagtcttc

SEQ ID NO: 660680 - DNA, 25 bp, Mus musculus
gtaaactgtttcctctgtgctttgc

SEQ ID NO: 660681 - DNA, 25 bp, Mus musculus
gtaaactgtttcgtctgtgctttgc

SEQ ID NO: 660682 - DNA, 25 bp, Mus musculus
gtaaacttacaaatcaggatcgctc

SEQ ID NO: 660683 - DNA, 25 bp, Mus musculus
gtaaacttacaattcaggatcgctc

SEQ ID NO: 660684 - DNA, 25 bp, Mus musculus
gtaaacttactcagctaacaatggg

SEQ ID NO: 660685 - DNA, 25 bp, Mus musculus
gtaaacttactctgctaacaatggg

SEQ ID NO: 660686 - DNA, 25 bp, Mus musculus
gtaaacttacttcgtcattgtcatt

SEQ ID NO: 660687 - DNA, 25 bp, Mus musculus
gtaaacttacttggtcattgtcatt

SEQ ID NO: 660688 - DNA, 25 bp, Mus musculus
gtaaacttcacaatttcatgctaag

SEQ ID NO: 660689 - DNA, 25 bp, Mus musculus
gtaaacttcacattttcatgctaag

SEQ ID NO: 660690 - DNA, 25 bp, Mus musculus
gtaaacttcagaaacgaaatatccc

SEQ ID NO: 660691 - DNA, 25 bp, Mus musculus
gtaaacttcagatacgaaatatccc

SEQ ID NO: 660692 - DNA, 25 bp, Mus musculus
gtaaacttcagcagagtccacttgt

SEQ ID NO: 660693 - DNA, 25 bp, Mus musculus
gtaaacttcagctgagtccacttgt

SEQ ID NO: 660694 - DNA, 25 bp, Mus musculus
gtaaacttcatccagctatagcttg

SEQ ID NO: 660695 - DNA, 25 bp, Mus musculus
gtaaacttcatcgagctatagcttg

SEQ ID NO: 660696 - DNA, 25 bp, Mus musculus
gtaaacttcatgaaacctgcctttg

SEQ ID NO: 660697 - DNA, 25 bp, Mus musculus
gtaaacttcatgtaacctgcctttg

SEQ ID NO: 660698 - DNA, 25 bp, Mus musculus
gtaaacttcctaacttcttagaaca

SEQ ID NO: 660699 - DNA, 25 bp, Mus musculus
gtaaacttcctatcttcttagaaca

SEQ ID NO: 660700 - DNA, 25 bp, Mus musculus
gtaaacttgccaagggtccgaatat

SEQ ID NO: 660701 - DNA, 25 bp, Mus musculus
gtaaacttgccatgggtccgaatat

SEQ ID NO: 660702 - DNA, 25 bp, Mus musculus
gtaaacttgcgtaatgatttccact

SEQ ID NO: 660703 - DNA, 25 bp, Mus musculus
gtaaacttgcgttatgatttccact

SEQ ID NO: 660704 - DNA, 25 bp, Mus musculus
gtaaacttggttctacatccacaaa

SEQ ID NO: 660705 - DNA, 25 bp, Mus musculus
gtaaacttggttgtacatccacaaa

SEQ ID NO: 660706 - DNA, 25 bp, Mus musculus
gtaaacttgtgactttgctctttag

SEQ ID NO: 660707 - DNA, 25 bp, Mus musculus
gtaaacttgtgagtttgctctttag

SEQ ID NO: 660708 - DNA, 25 bp, Mus musculus
gtaaacttgttaaatgtcaccggat

SEQ ID NO: 660709 - DNA, 25 bp, Mus musculus
gtaaacttgttatatgtcaccggat

SEQ ID NO: 660710 - DNA, 25 bp, Mus musculus
gtaaactttattccctcaagcatct

SEQ ID NO: 660711 - DNA, 25 bp, Mus musculus
gtaaactttattgcctcaagcatct

SEQ ID NO: 660712 - DNA, 25 bp, Mus musculus
gtaaactttgccaggattttcctca

SEQ ID NO: 660713 - DNA, 25 bp, Mus musculus
gtaaactttgcctggattttcctca

SEQ ID NO: 660714 - DNA, 25 bp, Mus musculus
gtaaacttttcaatggccaacacca

SEQ ID NO: 660715 - DNA, 25 bp, Mus musculus
gtaaacttttcattggccaacacca

SEQ ID NO: 660716 - DNA, 25 bp, Mus musculus
gtaaagaaaactccctcatgcgtcc

SEQ ID NO: 660717 - DNA, 25 bp, Mus musculus
gtaaagaaaactgcctcatgcgtcc

SEQ ID NO: 660718 - DNA, 25 bp, Mus musculus
gtaaagaacagtcgcctctaggtct

SEQ ID NO: 660719 - DNA, 25 bp, Mus musculus
gtaaagaacagtggcctctaggtct

SEQ ID NO: 660720 - DNA, 25 bp, Mus musculus
gtaaagaaccataatgcatctcgat

SEQ ID NO: 660721 - DNA, 25 bp, Mus musculus
gtaaagaaccattatgcatctcgat

SEQ ID NO: 660722 - DNA, 25 bp, Mus musculus
gtaaagaagtcactttgcttgagaa

SEQ ID NO: 660723 - DNA, 25 bp, Mus musculus
gtaaagaagtcagtttgcttgagaa

SEQ ID NO: 660724 - DNA, 25 bp, Mus musculus
gtaaagaatctactgcctctgaaga

SEQ ID NO: 660725 - DNA, 25 bp, Mus musculus
gtaaagaatctagtgcctctgaaga

SEQ ID NO: 660726 - DNA, 25 bp, Mus musculus
gtaaagaatctgacccaggtgtagt

SEQ ID NO: 660727 - DNA, 25 bp, Mus musculus
gtaaagaatctgtcccaggtgtagt

SEQ ID NO: 660728 - DNA, 25 bp, Mus musculus
gtaaagaatgtcacccacagggcta

SEQ ID NO: 660729 - DNA, 25 bp, Mus musculus
gtaaagaatgtctcccacagggcta

SEQ ID NO: 660730 - DNA, 25 bp, Mus musculus
gtaaagaattgacccaccttgaaca

SEQ ID NO: 660731 - DNA, 25 bp, Mus musculus
gtaaagaattgagccaccttgaaca

SEQ ID NO: 660732 - DNA, 25 bp, Mus musculus
gtaaagacaccgaaattgcagcagt

SEQ ID NO: 660733 - DNA, 25 bp, Mus musculus
gtaaagacaccgtaattgcagcagt

SEQ ID NO: 660734 - DNA, 25 bp, Mus musculus
gtaaagacagctctggcaccaagcc

SEQ ID NO: 660735 - DNA, 25 bp, Mus musculus
gtaaagacagctgtggcaccaagcc

SEQ ID NO: 660736 - DNA, 25 bp, Mus musculus
gtaaagaccctcatcttctgaggca

SEQ ID NO: 660737 - DNA, 25 bp, Mus musculus
gtaaagaccctcttcttctgaggca

SEQ ID NO: 660738 - DNA, 25 bp, Mus musculus
gtaaagacctgcagccaggcttaca

SEQ ID NO: 660739 - DNA, 25 bp, Mus musculus
gtaaagacctgctgccaggcttaca

SEQ ID NO: 660740 - DNA, 25 bp, Mus musculus
gtaaagacgcatagaccagaccctg

SEQ ID NO: 660741 - DNA, 25 bp, Mus musculus
gtaaagacgcattgaccagaccctg

SEQ ID NO: 660742 - DNA, 25 bp, Mus musculus
gtaaagactgggactcattttgtag

SEQ ID NO: 660743 - DNA, 25 bp, Mus musculus
gtaaagactgggtctcattttgtag

SEQ ID NO: 660744 - DNA, 25 bp, Mus musculus
gtaaagacttatctcgctctcagta

SEQ ID NO: 660745 - DNA, 25 bp, Mus musculus
gtaaagacttatgtcgctctcagta

SEQ ID NO: 660746 - DNA, 25 bp, Mus musculus
gtaaagacttctatacctcatagca

SEQ ID NO: 660747 - DNA, 25 bp, Mus musculus
gtaaagacttctttacctcatagca

SEQ ID NO: 660748 - DNA, 25 bp, Mus musculus
gtaaagacttgtcggacttctacat

SEQ ID NO: 660749 - DNA, 25 bp, Mus musculus
gtaaagacttgtgggacttctacat

SEQ ID NO: 660750 - DNA, 25 bp, Mus musculus
gtaaagactttgcaatcattcacac

SEQ ID NO: 660751 - DNA, 25 bp, Mus musculus
gtaaagactttggaatcattcacac

SEQ ID NO: 660752 - DNA, 25 bp, Mus musculus
gtaaagagactcaggcactaagaag

SEQ ID NO: 660753 - DNA, 25 bp, Mus musculus
gtaaagagactctggcactaagaag

SEQ ID NO: 660754 - DNA, 25 bp, Mus musculus
gtaaagagctttcggtgacacactt

SEQ ID NO: 660755 - DNA, 25 bp, Mus musculus
gtaaagagctttgggtgacacactt

SEQ ID NO: 660756 - DNA, 25 bp, Mus musculus
gtaaagataatgatcctatgatgac

SEQ ID NO: 660757 - DNA, 25 bp, Mus musculus
gtaaagataatgttcctatgatgac

SEQ ID NO: 660758 - DNA, 25 bp, Mus musculus
gtaaagatccaaacgccccaaagag

SEQ ID NO: 660759 - DNA, 25 bp, Mus musculus
gtaaagatccaatcgccccaaagag

SEQ ID NO: 660760 - DNA, 25 bp, Mus musculus
gtaaagatcctaaatttatccatca

SEQ ID NO: 660761 - DNA, 25 bp, Mus musculus
gtaaagatcctatatttatccatca

SEQ ID NO: 660762 - DNA, 25 bp, Mus musculus
gtaaagatgcgtcttttgttttatt

SEQ ID NO: 660763 - DNA, 25 bp, Mus musculus
gtaaagatgcgtgttttgttttatt

SEQ ID NO: 660764 - DNA, 25 bp, Mus musculus
gtaaagatttctcccctgggtttag

SEQ ID NO: 660765 - DNA, 25 bp, Mus musculus
gtaaagatttctgccctgggtttag

SEQ ID NO: 660766 - DNA, 25 bp, Mus musculus
gtaaagattttactgatcaggtatg

SEQ ID NO: 660767 - DNA, 25 bp, Mus musculus
gtaaagattttagtgatcaggtatg

SEQ ID NO: 660768 - DNA, 25 bp, Mus musculus
gtaaagcaactaaaccttcagttta

SEQ ID NO: 660769 - DNA, 25 bp, Mus musculus
gtaaagcaactataccttcagttta

SEQ ID NO: 660770 - DNA, 25 bp, Mus musculus
gtaaagcacaatagcaggagcgtcc

SEQ ID NO: 660771 - DNA, 25 bp, Mus musculus
gtaaagcacaattgcaggagcgtcc

SEQ ID NO: 660772 - DNA, 25 bp, Mus musculus
gtaaagcacgtaccttccgagcttc

SEQ ID NO: 660773 - DNA, 25 bp, Mus musculus
gtaaagcacgtagcttccgagcttc

SEQ ID NO: 660774 - DNA, 25 bp, Mus musculus
gtaaagcacgtgaaaccggctctcc

SEQ ID NO: 660775 - DNA, 25 bp, Mus musculus
gtaaagcacgtgtaaccggctctcc

SEQ ID NO: 660776 - DNA, 25 bp, Mus musculus
gtaaagcagatccatagcaaatgtg

SEQ ID NO: 660777 - DNA, 25 bp, Mus musculus
gtaaagcagatcgatagcaaatgtg

SEQ ID NO: 660778 - DNA, 25 bp, Mus musculus
gtaaagcatgagaggcccctccact

SEQ ID NO: 660779 - DNA, 25 bp, Mus musculus
gtaaagcatgagtggcccctccact

SEQ ID NO: 660780 - DNA, 25 bp, Mus musculus
gtaaagcattagaaccaccattgat

SEQ ID NO: 660781 - DNA, 25 bp, Mus musculus
gtaaagcattagtaccaccattgat

SEQ ID NO: 660782 - DNA, 25 bp, Mus musculus
gtaaagcattctagttgtcactgaa

SEQ ID NO: 660783 - DNA, 25 bp, Mus musculus
gtaaagcattcttgttgtcactgaa

SEQ ID NO: 660784 - DNA, 25 bp, Mus musculus
gtaaagccaaaacattgttccagaa

SEQ ID NO: 660785 - DNA, 25 bp, Mus musculus
gtaaagccaaaagattgttccagaa

SEQ ID NO: 660786 - DNA, 25 bp, Mus musculus
gtaaagccaactagcaggaatgctg

SEQ ID NO: 660787 - DNA, 25 bp, Mus musculus
gtaaagccaacttgcaggaatgctg

SEQ ID NO: 660788 - DNA, 25 bp, Mus musculus
gtaaagccacagaattcacaccatt

SEQ ID NO: 660789 - DNA, 25 bp, Mus musculus
gtaaagccacagtattcacaccatt

SEQ ID NO: 660790 - DNA, 25 bp, Mus musculus
gtaaagccagtgcagtacagccaga

SEQ ID NO: 660791 - DNA, 25 bp, Mus musculus
gtaaagccagtggagtacagccaga

SEQ ID NO: 660792 - DNA, 25 bp, Mus musculus
gtaaagcccagaagtactcaccgag

SEQ ID NO: 660793 - DNA, 25 bp, Mus musculus
gtaaagcccagatgtactcaccgag

SEQ ID NO: 660794 - DNA, 25 bp, Mus musculus
gtaaagcccgagctgtgccgttgcc

SEQ ID NO: 660795 - DNA, 25 bp, Mus musculus
gtaaagcccgaggtgtgccgttgcc

SEQ ID NO: 660796 - DNA, 25 bp, Mus musculus
gtaaagcccgtcatgttcagagttg

SEQ ID NO: 660797 - DNA, 25 bp, Mus musculus
gtaaagcccgtcttgttcagagttg

SEQ ID NO: 660798 - DNA, 25 bp, Mus musculus
gtaaagccctctcccaatggtgtgg

SEQ ID NO: 660799 - DNA, 25 bp, Mus musculus
gtaaagccctctgccaatggtgtgg

SEQ ID NO: 660800 - DNA, 25 bp, Mus musculus
gtaaagcccttcatttttagcctga

SEQ ID NO: 660801 - DNA, 25 bp, Mus musculus
gtaaagcccttcttttttagcctga

SEQ ID NO: 660802 - DNA, 25 bp, Mus musculus
gtaaagccgagaccctcacgctgga

SEQ ID NO: 660803 - DNA, 25 bp, Mus musculus
gtaaagccgagagcctcacgctgga

SEQ ID NO: 660804 - DNA, 25 bp, Mus musculus
gtaaagccggatcctgactagtcat

SEQ ID NO: 660805 - DNA, 25 bp, Mus musculus
gtaaagccggatgctgactagtcat

SEQ ID NO: 660806 - DNA, 25 bp, Mus musculus
gtaaagcctccgctgttaatgtctc

SEQ ID NO: 660807 - DNA, 25 bp, Mus musculus
gtaaagcctccggtgttaatgtctc

SEQ ID NO: 660808 - DNA, 25 bp, Mus musculus
gtaaagcctctgaatacttcaaatt

SEQ ID NO: 660809 - DNA, 25 bp, Mus musculus
gtaaagcctctgtatacttcaaatt

SEQ ID NO: 660810 - DNA, 25 bp, Mus musculus
gtaaagcctttgacagcggcatcat

SEQ ID NO: 660811 - DNA, 25 bp, Mus musculus
gtaaagcctttgctgttcacaatta

SEQ ID NO: 660812 - DNA, 25 bp, Mus musculus
gtaaagcctttggtgttcacaatta

SEQ ID NO: 660813 - DNA, 25 bp, Mus musculus
gtaaagcctttgtcagcggcatcat

SEQ ID NO: 660814 - DNA, 25 bp, Mus musculus
gtaaagcgcccaaaccagaagacat

SEQ ID NO: 660815 - DNA, 25 bp, Mus musculus
gtaaagcgcccataccagaagacat

SEQ ID NO: 660816 - DNA, 25 bp, Mus musculus
gtaaagcgttagcataattcttgtt

SEQ ID NO: 660817 - DNA, 25 bp, Mus musculus
gtaaagcgttaggataattcttgtt

SEQ ID NO: 660818 - DNA, 25 bp, Mus musculus
gtaaagctaccaattttccagtact

SEQ ID NO: 660819 - DNA, 25 bp, Mus musculus
gtaaagctaccatttttccagtact

SEQ ID NO: 660820 - DNA, 25 bp, Mus musculus
gtaaagctagaaccctgacattttt

SEQ ID NO: 660821 - DNA, 25 bp, Mus musculus
gtaaagctagaagcctgacattttt

SEQ ID NO: 660822 - DNA, 25 bp, Mus musculus
gtaaagctattgcactgcgttgccc

SEQ ID NO: 660823 - DNA, 25 bp, Mus musculus
gtaaagctattggactgcgttgccc

SEQ ID NO: 660824 - DNA, 25 bp, Mus musculus
gtaaagctctccataaacagtgaaa

SEQ ID NO: 660825 - DNA, 25 bp, Mus musculus
gtaaagctctccttaaacagtgaaa

SEQ ID NO: 660826 - DNA, 25 bp, Mus musculus
gtaaagctgaaaatcttggttctta

SEQ ID NO: 660827 - DNA, 25 bp, Mus musculus
gtaaagctgaaattcttggttctta

SEQ ID NO: 660828 - DNA, 25 bp, Mus musculus
gtaaagctgcaaactactgtccttg

SEQ ID NO: 660829 - DNA, 25 bp, Mus musculus
gtaaagctgcaatctactgtccttg

SEQ ID NO: 660830 - DNA, 25 bp, Mus musculus
gtaaagctgctgatccctaactaaa

SEQ ID NO: 660831 - DNA, 25 bp, Mus musculus
gtaaagctgctgttccctaactaaa

SEQ ID NO: 660832 - DNA, 25 bp, Mus musculus
gtaaagctgggcacagtgctcccat

SEQ ID NO: 660833 - DNA, 25 bp, Mus musculus
gtaaagctgggctcagtgctcccat

SEQ ID NO: 660834 - DNA, 25 bp, Mus musculus
gtaaagctgggtaacttctacccag

SEQ ID NO: 660835 - DNA, 25 bp, Mus musculus
gtaaagctgggttacttctacccag

SEQ ID NO: 660836 - DNA, 25 bp, Mus musculus
gtaaagcttctccatcaataccaga

SEQ ID NO: 660837 - DNA, 25 bp, Mus musculus
gtaaagcttctcgatcaataccaga

SEQ ID NO: 660838 - DNA, 25 bp, Mus musculus
gtaaagcttgctaaacaattctata

SEQ ID NO: 660839 - DNA, 25 bp, Mus musculus
gtaaagcttgcttaacaattctata

SEQ ID NO: 660840 - DNA, 25 bp, Mus musculus
gtaaagctttgaccaggccaaggga

SEQ ID NO: 660841 - DNA, 25 bp, Mus musculus
gtaaagctttgacccagctcctcag

SEQ ID NO: 660842 - DNA, 25 bp, Mus musculus
gtaaagctttgagcaggccaaggga

SEQ ID NO: 660843 - DNA, 25 bp, Mus musculus
gtaaagctttgagccagctcctcag

SEQ ID NO: 660844 - DNA, 25 bp, Mus musculus
gtaaaggaacaaagtctccacagat

SEQ ID NO: 660845 - DNA, 25 bp, Mus musculus
gtaaaggaacaatgtctccacagat

SEQ ID NO: 660846 - DNA, 25 bp, Mus musculus
gtaaaggaacttacctaccagactg

SEQ ID NO: 660847 - DNA, 25 bp, Mus musculus
gtaaaggaactttcctaccagactg

SEQ ID NO: 660848 - DNA, 25 bp, Mus musculus
gtaaaggacccacctagagctctag

SEQ ID NO: 660849 - DNA, 25 bp, Mus musculus
gtaaaggacccagctagagctctag

SEQ ID NO: 660850 - DNA, 25 bp, Mus musculus
gtaaaggactcaattcggctggtta

SEQ ID NO: 660851 - DNA, 25 bp, Mus musculus
gtaaaggactcatttcggctggtta

SEQ ID NO: 660852 - DNA, 25 bp, Mus musculus
gtaaaggagacactgagaagtaagt

SEQ ID NO: 660853 - DNA, 25 bp, Mus musculus
gtaaaggagacagtgagaagtaagt

SEQ ID NO: 660854 - DNA, 25 bp, Mus musculus
gtaaaggagactccccgtctagatt

SEQ ID NO: 660855 - DNA, 25 bp, Mus musculus
gtaaaggagactgcccgtctagatt

SEQ ID NO: 660856 - DNA, 25 bp, Mus musculus
gtaaaggcacacaacagaacaggtt

SEQ ID NO: 660857 - DNA, 25 bp, Mus musculus
gtaaaggcacactacagaacaggtt

SEQ ID NO: 660858 - DNA, 25 bp, Mus musculus
gtaaaggcactcctctaagagagaa

SEQ ID NO: 660859 - DNA, 25 bp, Mus musculus
gtaaaggcactcgtctaagagagaa

SEQ ID NO: 660860 - DNA, 25 bp, Mus musculus
gtaaaggcacttatctccaaggttg

SEQ ID NO: 660861 - DNA, 25 bp, Mus musculus
gtaaaggcacttcattttcattcta

SEQ ID NO: 660862 - DNA, 25 bp, Mus musculus
gtaaaggcacttgattttcattcta

SEQ ID NO: 660863 - DNA, 25 bp, Mus musculus
gtaaaggcacttttctccaaggttg

SEQ ID NO: 660864 - DNA, 25 bp, Mus musculus
gtaaaggcagccaatgtttgcttct

SEQ ID NO: 660865 - DNA, 25 bp, Mus musculus
gtaaaggcagcccaggaatccaatg

SEQ ID NO: 660866 - DNA, 25 bp, Mus musculus
gtaaaggcagccgaggaatccaatg

SEQ ID NO: 660867 - DNA, 25 bp, Mus musculus
gtaaaggcagcctatgtttgcttct

SEQ ID NO: 660868 - DNA, 25 bp, Mus musculus
gtaaaggcattccacagactcagca

SEQ ID NO: 660869 - DNA, 25 bp, Mus musculus
gtaaaggcattcgacagactcagca

SEQ ID NO: 660870 - DNA, 25 bp, Mus musculus
gtaaaggccaacatatcaaataggg

SEQ ID NO: 660871 - DNA, 25 bp, Mus musculus
gtaaaggccaacttatcaaataggg

SEQ ID NO: 660872 - DNA, 25 bp, Mus musculus
gtaaaggccagaccagtttccagaa

SEQ ID NO: 660873 - DNA, 25 bp, Mus musculus
gtaaaggccagagcagtttccagaa

SEQ ID NO: 660874 - DNA, 25 bp, Mus musculus
gtaaaggccgttcgcagaaccccat

SEQ ID NO: 660875 - DNA, 25 bp, Mus musculus
gtaaaggccgttggcagaaccccat

SEQ ID NO: 660876 - DNA, 25 bp, Mus musculus
gtaaaggcctatcaagttctccata

SEQ ID NO: 660877 - DNA, 25 bp, Mus musculus
gtaaaggcctatgaagttctccata

SEQ ID NO: 660878 - DNA, 25 bp, Mus musculus
gtaaaggcgattccctagacccagg

SEQ ID NO: 660879 - DNA, 25 bp, Mus musculus
gtaaaggcgattgcctagacccagg

SEQ ID NO: 660880 - DNA, 25 bp, Mus musculus
gtaaaggctcatatagctctgtagc

SEQ ID NO: 660881 - DNA, 25 bp, Mus musculus
gtaaaggctcatttagctctgtagc

SEQ ID NO: 660882 - DNA, 25 bp, Mus musculus
gtaaaggctgctctattccacatga

SEQ ID NO: 660883 - DNA, 25 bp, Mus musculus
gtaaaggctgctgtattccacatga

SEQ ID NO: 660884 - DNA, 25 bp, Mus musculus
gtaaaggctgtgcagtactaagaca

SEQ ID NO: 660885 - DNA, 25 bp, Mus musculus
gtaaaggctgtggagtactaagaca

SEQ ID NO: 660886 - DNA, 25 bp, Mus musculus
gtaaaggctttgatctcattagagt

SEQ ID NO: 660887 - DNA, 25 bp, Mus musculus
gtaaaggctttgttctcattagagt

SEQ ID NO: 660888 - DNA, 25 bp, Mus musculus
gtaaagggcattctacttcagagaa

SEQ ID NO: 660889 - DNA, 25 bp, Mus musculus
gtaaagggcattgtacttcagagaa

SEQ ID NO: 660890 - DNA, 25 bp, Mus musculus
gtaaagggccccagacttcatactg

SEQ ID NO: 660891 - DNA, 25 bp, Mus musculus
gtaaagggcccctgacttcatactg

SEQ ID NO: 660892 - DNA, 25 bp, Mus musculus
gtaaagggctctctgactgctaaat

SEQ ID NO: 660893 - DNA, 25 bp, Mus musculus
gtaaagggctctgtgactgctaaat

SEQ ID NO: 660894 - DNA, 25 bp, Mus musculus
gtaaagggcttgaatctaccatgga

SEQ ID NO: 660895 - DNA, 25 bp, Mus musculus
gtaaagggcttgtatctaccatgga

SEQ ID NO: 660896 - DNA, 25 bp, Mus musculus
gtaaagggtgcaataccctggcctg

SEQ ID NO: 660897 - DNA, 25 bp, Mus musculus
gtaaagggtgcattaccctggcctg

SEQ ID NO: 660898 - DNA, 25 bp, Mus musculus
gtaaaggtacgcatttacaacacat

SEQ ID NO: 660899 - DNA, 25 bp, Mus musculus
gtaaaggtacgcttttacaacacat

SEQ ID NO: 660900 - DNA, 25 bp, Mus musculus
gtaaaggtctttacagccaatccaa

SEQ ID NO: 660901 - DNA, 25 bp, Mus musculus
gtaaaggtcttttcagccaatccaa

SEQ ID NO: 660902 - DNA, 25 bp, Mus musculus
gtaaaggtgacgacgacccactgcc

SEQ ID NO: 660903 - DNA, 25 bp, Mus musculus
gtaaaggtgacgtcgacccactgcc

SEQ ID NO: 660904 - DNA, 25 bp, Mus musculus
gtaaaggtgctactgccaaacctaa

SEQ ID NO: 660905 - DNA, 25 bp, Mus musculus
gtaaaggtgctagtgccaaacctaa

SEQ ID NO: 660906 - DNA, 25 bp, Mus musculus
gtaaaggtgcttaccccaagccaga

SEQ ID NO: 660907 - DNA, 25 bp, Mus musculus
gtaaaggtgctttccccaagccaga

SEQ ID NO: 660908 - DNA, 25 bp, Mus musculus
gtaaaggtggcaaccaggccagcct

SEQ ID NO: 660909 - DNA, 25 bp, Mus musculus
gtaaaggtggcatccaggccagcct

SEQ ID NO: 660910 - DNA, 25 bp, Mus musculus
gtaaaggtttacactgaagattaat

SEQ ID NO: 660911 - DNA, 25 bp, Mus musculus
gtaaaggtttactctgaagattaat

SEQ ID NO: 660912 - DNA, 25 bp, Mus musculus
gtaaagtaactcagaggtgctgggc

SEQ ID NO: 660913 - DNA, 25 bp, Mus musculus
gtaaagtaactctgaggtgctgggc

SEQ ID NO: 660914 - DNA, 25 bp, Mus musculus
gtaaagtactcaatttcttacactg

SEQ ID NO: 660915 - DNA, 25 bp, Mus musculus
gtaaagtactcattttcttacactg

SEQ ID NO: 660916 - DNA, 25 bp, Mus musculus
gtaaagtacttcagtctccagctac

SEQ ID NO: 660917 - DNA, 25 bp, Mus musculus
gtaaagtacttctgtctccagctac

SEQ ID NO: 660918 - DNA, 25 bp, Mus musculus
gtaaagtagactcacggtggtaaca

SEQ ID NO: 660919 - DNA, 25 bp, Mus musculus
gtaaagtagactgacggtggtaaca

SEQ ID NO: 660920 - DNA, 25 bp, Mus musculus
gtaaagtagcagcaaaacactcact

SEQ ID NO: 660921 - DNA, 25 bp, Mus musculus
gtaaagtagcaggaaaacactcact

SEQ ID NO: 660922 - DNA, 25 bp, Mus musculus
gtaaagtagcttctgaatagctcaa

SEQ ID NO: 660923 - DNA, 25 bp, Mus musculus
gtaaagtagcttgtgaatagctcaa

SEQ ID NO: 660924 - DNA, 25 bp, Mus musculus
gtaaagtcaccaattccactcacat

SEQ ID NO: 660925 - DNA, 25 bp, Mus musculus
gtaaagtcaccatttccactcacat

SEQ ID NO: 660926 - DNA, 25 bp, Mus musculus
gtaaagtcattgaatcattgagtac

SEQ ID NO: 660927 - DNA, 25 bp, Mus musculus
gtaaagtcattgtatcattgagtac

SEQ ID NO: 660928 - DNA, 25 bp, Mus musculus
gtaaagtccacaagatctctctgtc

SEQ ID NO: 660929 - DNA, 25 bp, Mus musculus
gtaaagtccacacaaatcactgaaa

SEQ ID NO: 660930 - DNA, 25 bp, Mus musculus
gtaaagtccacagaaatcactgaaa

SEQ ID NO: 660931 - DNA, 25 bp, Mus musculus
gtaaagtccacatgatctctctgtc

SEQ ID NO: 660932 - DNA, 25 bp, Mus musculus
gtaaagtcccagataagttcatcac

SEQ ID NO: 660933 - DNA, 25 bp, Mus musculus
gtaaagtcccagttaagttcatcac

SEQ ID NO: 660934 - DNA, 25 bp, Mus musculus
gtaaagtccctaacaaagaccgaga

SEQ ID NO: 660935 - DNA, 25 bp, Mus musculus
gtaaagtccctatcaaagaccgaga

SEQ ID NO: 660936 - DNA, 25 bp, Mus musculus
gtaaagtcgtcaaagtctttcctgc

SEQ ID NO: 660937 - DNA, 25 bp, Mus musculus
gtaaagtcgtcatagtctttcctgc

SEQ ID NO: 660938 - DNA, 25 bp, Mus musculus
gtaaagtctcttaggaaacaggata

SEQ ID NO: 660939 - DNA, 25 bp, Mus musculus
gtaaagtctctttggaaacaggata

SEQ ID NO: 660940 - DNA, 25 bp, Mus musculus
gtaaagtctgacacacaccattaat

SEQ ID NO: 660941 - DNA, 25 bp, Mus musculus
gtaaagtctgactcacaccattaat

SEQ ID NO: 660942 - DNA, 25 bp, Mus musculus
gtaaagtctgcacccaaagaagagc

SEQ ID NO: 660943 - DNA, 25 bp, Mus musculus
gtaaagtctgcagccaaagaagagc

SEQ ID NO: 660944 - DNA, 25 bp, Mus musculus
gtaaagtctgcgacctactcataaa

SEQ ID NO: 660945 - DNA, 25 bp, Mus musculus
gtaaagtctgcgtcctactcataaa

SEQ ID NO: 660946 - DNA, 25 bp, Mus musculus
gtaaagtctgtgcttggctttgaat

SEQ ID NO: 660947 - DNA, 25 bp, Mus musculus
gtaaagtctgtggttggctttgaat

SEQ ID NO: 660948 - DNA, 25 bp, Mus musculus
gtaaagtgcactatctgaatacctg

SEQ ID NO: 660949 - DNA, 25 bp, Mus musculus
gtaaagtgcactttctgaatacctg

SEQ ID NO: 660950 - DNA, 25 bp, Mus musculus
gtaaagtgctcacggaggccgctca

SEQ ID NO: 660951 - DNA, 25 bp, Mus musculus
gtaaagtgctcagggaggccgctca

SEQ ID NO: 660952 - DNA, 25 bp, Mus musculus
gtaaagtgctgaagctaccctgtgt

SEQ ID NO: 660953 - DNA, 25 bp, Mus musculus
gtaaagtgctgatgctaccctgtgt

SEQ ID NO: 660954 - DNA, 25 bp, Mus musculus
gtaaagtgcttaatatgtttgtgat

SEQ ID NO: 660955 - DNA, 25 bp, Mus musculus
gtaaagtgcttattatgtttgtgat

SEQ ID NO: 660956 - DNA, 25 bp, Mus musculus
gtaaagtgcttgacccagtgtatca

SEQ ID NO: 660957 - DNA, 25 bp, Mus musculus
gtaaagtgcttgtcccagtgtatca

SEQ ID NO: 660958 - DNA, 25 bp, Mus musculus
gtaaagtggacaatgcctagaattt

SEQ ID NO: 660959 - DNA, 25 bp, Mus musculus
gtaaagtggacattgcctagaattt

SEQ ID NO: 660960 - DNA, 25 bp, Mus musculus
gtaaagtggcccctatcaaaactgt

SEQ ID NO: 660961 - DNA, 25 bp, Mus musculus
gtaaagtggcccgtatcaaaactgt

SEQ ID NO: 660962 - DNA, 25 bp, Mus musculus
gtaaagtgtcatctgtactgcagat

SEQ ID NO: 660963 - DNA, 25 bp, Mus musculus
gtaaagtgtcatgtgtactgcagat

SEQ ID NO: 660964 - DNA, 25 bp, Mus musculus
gtaaagttaaaaccctgagctgctg

SEQ ID NO: 660965 - DNA, 25 bp, Mus musculus
gtaaagttaaaagcctgagctgctg

SEQ ID NO: 660966 - DNA, 25 bp, Mus musculus
gtaaagttctgcacctggtttcagc

SEQ ID NO: 660967 - DNA, 25 bp, Mus musculus
gtaaagttctgctcctggtttcagc

SEQ ID NO: 660968 - DNA, 25 bp, Mus musculus
gtaaagttgtgtattagtaagtcat

SEQ ID NO: 660969 - DNA, 25 bp, Mus musculus
gtaaagttgtgttttagtaagtcat

SEQ ID NO: 660970 - DNA, 25 bp, Mus musculus
gtaaagttttacatggtgacagcag

SEQ ID NO: 660971 - DNA, 25 bp, Mus musculus
gtaaagttttacttggtgacagcag

SEQ ID NO: 660972 - DNA, 25 bp, Mus musculus
gtaaagttttatacatccttgcctt

SEQ ID NO: 660973 - DNA, 25 bp, Mus musculus
gtaaagttttattcatccttgcctt

SEQ ID NO: 660974 - DNA, 25 bp, Mus musculus
gtaaagtttttaaatcctgatgaag

SEQ ID NO: 660975 - DNA, 25 bp, Mus musculus
gtaaagtttttatatcctgatgaag

SEQ ID NO: 660976 - DNA, 25 bp, Mus musculus
gtaaataaaagtacactctgtgagt

SEQ ID NO: 660977 - DNA, 25 bp, Mus musculus
gtaaataaaagttcactctgtgagt

SEQ ID NO: 660978 - DNA, 25 bp, Mus musculus
gtaaataacatcctggttccccagt

SEQ ID NO: 660979 - DNA, 25 bp, Mus musculus
gtaaataacatcgtggttccccagt

SEQ ID NO: 660980 - DNA, 25 bp, Mus musculus
gtaaataacctaccccatatactgc

SEQ ID NO: 660981 - DNA, 25 bp, Mus musculus
gtaaataacctagcccatatactgc

SEQ ID NO: 660982 - DNA, 25 bp, Mus musculus
gtaaataacgtcaactgctgtttat

SEQ ID NO: 660983 - DNA, 25 bp, Mus musculus
gtaaataacgtctactgctgtttat

SEQ ID NO: 660984 - DNA, 25 bp, Mus musculus
gtaaataagatgatgcactggtggc

SEQ ID NO: 660985 - DNA, 25 bp, Mus musculus
gtaaataagatgttgcactggtggc

SEQ ID NO: 660986 - DNA, 25 bp, Mus musculus
gtaaataatggtcaacagtggtcaa

SEQ ID NO: 660987 - DNA, 25 bp, Mus musculus
gtaaataatggtgaacagtggtcaa

SEQ ID NO: 660988 - DNA, 25 bp, Mus musculus
gtaaataatgtacaggcccaggact

SEQ ID NO: 660989 - DNA, 25 bp, Mus musculus
gtaaataatgtagaggcccaggact

SEQ ID NO: 660990 - DNA, 25 bp, Mus musculus
gtaaatacacatatctagtggtgct

SEQ ID NO: 660991 - DNA, 25 bp, Mus musculus
gtaaatacacatttctagtggtgct

SEQ ID NO: 660992 - DNA, 25 bp, Mus musculus
gtaaatacacccacgtactggacgc

SEQ ID NO: 660993 - DNA, 25 bp, Mus musculus
gtaaatacaccctcgtactggacgc

SEQ ID NO: 660994 - DNA, 25 bp, Mus musculus
gtaaatacactcaaaaccgcaaact

SEQ ID NO: 660995 - DNA, 25 bp, Mus musculus
gtaaatacactctaaaccgcaaact

SEQ ID NO: 660996 - DNA, 25 bp, Mus musculus
gtaaatacagcaattcctctttcaa

SEQ ID NO: 660997 - DNA, 25 bp, Mus musculus
gtaaatacagcatttcctctttcaa

SEQ ID NO: 660998 - DNA, 25 bp, Mus musculus
gtaaatacagtgacttagggctttg

SEQ ID NO: 660999 - DNA, 25 bp, Mus musculus
gtaaatacagtgtcttagggctttg

SEQ ID NO: 661000 - DNA, 25 bp, Mus musculus
gtaaatacattacactcatatccaa

SEQ ID NO: 661001 - DNA, 25 bp, Mus musculus
gtaaatacattagactcatatccaa

SEQ ID NO: 661002 - DNA, 25 bp, Mus musculus
gtaaatacatttcctcacttgattc

SEQ ID NO: 661003 - DNA, 25 bp, Mus musculus
gtaaatacatttgctcacttgattc

SEQ ID NO: 661004 - DNA, 25 bp, Mus musculus
gtaaataccagactacattttctct

SEQ ID NO: 661005 - DNA, 25 bp, Mus musculus
gtaaataccagagtacattttctct

SEQ ID NO: 661006 - DNA, 25 bp, Mus musculus
gtaaataccattcatacacccgcct

SEQ ID NO: 661007 - DNA, 25 bp, Mus musculus
gtaaataccattgatacacccgcct

SEQ ID NO: 661008 - DNA, 25 bp, Mus musculus
gtaaataccccgaaattgagatgta

SEQ ID NO: 661009 - DNA, 25 bp, Mus musculus
gtaaataccccgtaattgagatgta

SEQ ID NO: 661010 - DNA, 25 bp, Mus musculus
gtaaatacctacattgtccctatga

SEQ ID NO: 661011 - DNA, 25 bp, Mus musculus
gtaaatacctactttgtccctatga

SEQ ID NO: 661012 - DNA, 25 bp, Mus musculus
gtaaatactaacatttccacatatg

SEQ ID NO: 661013 - DNA, 25 bp, Mus musculus
gtaaatactaacttttccacatatg

SEQ ID NO: 661014 - DNA, 25 bp, Mus musculus
gtaaatactaccaagcagcggttag

SEQ ID NO: 661015 - DNA, 25 bp, Mus musculus
gtaaatactacctagcagcggttag

SEQ ID NO: 661016 - DNA, 25 bp, Mus musculus
gtaaatactcaaagcatatactttt

SEQ ID NO: 661017 - DNA, 25 bp, Mus musculus
gtaaatactcaatgcatatactttt

SEQ ID NO: 661018 - DNA, 25 bp, Mus musculus
gtaaatactcctaggtcatgcatct

SEQ ID NO: 661019 - DNA, 25 bp, Mus musculus
gtaaatactccttggtcatgcatct

SEQ ID NO: 661020 - DNA, 25 bp, Mus musculus
gtaaatactctacccgttcaagtct

SEQ ID NO: 661021 - DNA, 25 bp, Mus musculus
gtaaatactctagccgttcaagtct

SEQ ID NO: 661022 - DNA, 25 bp, Mus musculus
gtaaatactcttctcaaacatgatt

SEQ ID NO: 661023 - DNA, 25 bp, Mus musculus
gtaaatactcttgtcaaacatgatt

SEQ ID NO: 661024 - DNA, 25 bp, Mus musculus
gtaaatactgccaagagatcactaa

SEQ ID NO: 661025 - DNA, 25 bp, Mus musculus
gtaaatactgcctagagatcactaa

SEQ ID NO: 661026 - DNA, 25 bp, Mus musculus
gtaaatactggcacgactgtaactc

SEQ ID NO: 661027 - DNA, 25 bp, Mus musculus
gtaaatactggctcgactgtaactc

SEQ ID NO: 661028 - DNA, 25 bp, Mus musculus
gtaaatactgtaacctcagtttaga

SEQ ID NO: 661029 - DNA, 25 bp, Mus musculus
gtaaatactgtatcctcagtttaga

SEQ ID NO: 661030 - DNA, 25 bp, Mus musculus
gtaaatacttagaccatccatcctg

SEQ ID NO: 661031 - DNA, 25 bp, Mus musculus
gtaaatacttagtccatccatcctg

SEQ ID NO: 661032 - DNA, 25 bp, Mus musculus
gtaaatacttgaaatcacgacactc

SEQ ID NO: 661033 - DNA, 25 bp, Mus musculus
gtaaatacttgatatcacgacactc

SEQ ID NO: 661034 - DNA, 25 bp, Mus musculus
gtaaatactttacccaccgcttgtc

SEQ ID NO: 661035 - DNA, 25 bp, Mus musculus
gtaaatactttagccaccgcttgtc

SEQ ID NO: 661036 - DNA, 25 bp, Mus musculus
gtaaatagcaaccaaaaggcgtatt

SEQ ID NO: 661037 - DNA, 25 bp, Mus musculus
gtaaatagcaacgaaaaggcgtatt

SEQ ID NO: 661038 - DNA, 25 bp, Mus musculus
gtaaatagcatcattgtcaaactgg

SEQ ID NO: 661039 - DNA, 25 bp, Mus musculus
gtaaatagcatctttgtcaaactgg

SEQ ID NO: 661040 - DNA, 25 bp, Mus musculus
gtaaatagctccaaacctcagaaaa

SEQ ID NO: 661041 - DNA, 25 bp, Mus musculus
gtaaatagctcctaacctcagaaaa

SEQ ID NO: 661042 - DNA, 25 bp, Mus musculus
gtaaataggaacatctgacagcaat

SEQ ID NO: 661043 - DNA, 25 bp, Mus musculus
gtaaataggaacttctgacagcaat

SEQ ID NO: 661044 - DNA, 25 bp, Mus musculus
gtaaataggcgtaaattcttcacta

SEQ ID NO: 661045 - DNA, 25 bp, Mus musculus
gtaaataggcgttaattcttcacta

SEQ ID NO: 661046 - DNA, 25 bp, Mus musculus
gtaaatatactcagagcttttcctt

SEQ ID NO: 661047 - DNA, 25 bp, Mus musculus
gtaaatatactctgagcttttcctt

SEQ ID NO: 661048 - DNA, 25 bp, Mus musculus
gtaaatatccggattttctgtatag

SEQ ID NO: 661049 - DNA, 25 bp, Mus musculus
gtaaatatccggtttttctgtatag

SEQ ID NO: 661050 - DNA, 25 bp, Mus musculus
gtaaatatctgcaaggctccagtct

SEQ ID NO: 661051 - DNA, 25 bp, Mus musculus
gtaaatatctgccattctcttgttt

SEQ ID NO: 661052 - DNA, 25 bp, Mus musculus
gtaaatatctgcgattctcttgttt

SEQ ID NO: 661053 - DNA, 25 bp, Mus musculus
gtaaatatctgctaggctccagtct

SEQ ID NO: 661054 - DNA, 25 bp, Mus musculus
gtaaatatctttactaagcagccta

SEQ ID NO: 661055 - DNA, 25 bp, Mus musculus
gtaaatatcttttctaagcagccta

SEQ ID NO: 661056 - DNA, 25 bp, Mus musculus
gtaaatatgctgatccaatactgtt

SEQ ID NO: 661057 - DNA, 25 bp, Mus musculus
gtaaatatgctgttccaatactgtt

SEQ ID NO: 661058 - DNA, 25 bp, Mus musculus
gtaaatatgggtagctgacttcaag

SEQ ID NO: 661059 - DNA, 25 bp, Mus musculus
gtaaatatgggttgctgacttcaag

SEQ ID NO: 661060 - DNA, 25 bp, Mus musculus
gtaaatatgttcacatgagtgcaga

SEQ ID NO: 661061 - DNA, 25 bp, Mus musculus
gtaaatatgttctcatgagtgcaga

SEQ ID NO: 661062 - DNA, 25 bp, Mus musculus
gtaaatattaggagtctccatctca

SEQ ID NO: 661063 - DNA, 25 bp, Mus musculus
gtaaatattaggtgtctccatctca

SEQ ID NO: 661064 - DNA, 25 bp, Mus musculus
gtaaatattatcctttgggtgcagt

SEQ ID NO: 661065 - DNA, 25 bp, Mus musculus
gtaaatattatcgtttgggtgcagt

SEQ ID NO: 661066 - DNA, 25 bp, Mus musculus
gtaaatattgaaacagtgagtgaat

SEQ ID NO: 661067 - DNA, 25 bp, Mus musculus
gtaaatattgaatcagtgagtgaat

SEQ ID NO: 661068 - DNA, 25 bp, Mus musculus
gtaaatatttaacgaccactgcatc

SEQ ID NO: 661069 - DNA, 25 bp, Mus musculus
gtaaatatttaaggaccactgcatc

SEQ ID NO: 661070 - DNA, 25 bp, Mus musculus
gtaaatcaaagacccggatacttca

SEQ ID NO: 661071 - DNA, 25 bp, Mus musculus
gtaaatcaaagagccggatacttca

SEQ ID NO: 661072 - DNA, 25 bp, Mus musculus
gtaaatcacgatatctaagtgtcct

SEQ ID NO: 661073 - DNA, 25 bp, Mus musculus
gtaaatcacgatttctaagtgtcct

SEQ ID NO: 661074 - DNA, 25 bp, Mus musculus
gtaaatcacgtgatgctgccatctt

SEQ ID NO: 661075 - DNA, 25 bp, Mus musculus
gtaaatcacgtgttgctgccatctt

SEQ ID NO: 661076 - DNA, 25 bp, Mus musculus
gtaaatcactttccagcacagcaat

SEQ ID NO: 661077 - DNA, 25 bp, Mus musculus
gtaaatcactttgcagcacagcaat

SEQ ID NO: 661078 - DNA, 25 bp, Mus musculus
gtaaatcagaccacacttccgaatg

SEQ ID NO: 661079 - DNA, 25 bp, Mus musculus
gtaaatcagacctcacttccgaatg

SEQ ID NO: 661080 - DNA, 25 bp, Mus musculus
gtaaatcagataatgcagtgcctct

SEQ ID NO: 661081 - DNA, 25 bp, Mus musculus
gtaaatcagatattgcagtgcctct

SEQ ID NO: 661082 - DNA, 25 bp, Mus musculus
gtaaatcaggcaaagcacacaggag

SEQ ID NO: 661083 - DNA, 25 bp, Mus musculus
gtaaatcaggcatagcacacaggag

SEQ ID NO: 661084 - DNA, 25 bp, Mus musculus
gtaaatcatgttatcactgttagtt

SEQ ID NO: 661085 - DNA, 25 bp, Mus musculus
gtaaatcatgttttcactgttagtt

SEQ ID NO: 661086 - DNA, 25 bp, Mus musculus
gtaaatcatttccagacacctctta

SEQ ID NO: 661087 - DNA, 25 bp, Mus musculus
gtaaatcatttcgagacacctctta

SEQ ID NO: 661088 - DNA, 25 bp, Mus musculus
gtaaatcattttcaggcttctgcag

SEQ ID NO: 661089 - DNA, 25 bp, Mus musculus
gtaaatcattttgaggcttctgcag

SEQ ID NO: 661090 - DNA, 25 bp, Mus musculus
gtaaatccaacactcacctgaaagc

SEQ ID NO: 661091 - DNA, 25 bp, Mus musculus
gtaaatccaacagtcacctgaaagc

SEQ ID NO: 661092 - DNA, 25 bp, Mus musculus
gtaaatccagacactcatcagatag

SEQ ID NO: 661093 - DNA, 25 bp, Mus musculus
gtaaatccagactctcatcagatag

SEQ ID NO: 661094 - DNA, 25 bp, Mus musculus
gtaaatccagataagtcagtgagca

SEQ ID NO: 661095 - DNA, 25 bp, Mus musculus
gtaaatccagattagtcagtgagca

SEQ ID NO: 661096 - DNA, 25 bp, Mus musculus
gtaaatccaggacattgactcaact

SEQ ID NO: 661097 - DNA, 25 bp, Mus musculus
gtaaatccaggagattgactcaact

SEQ ID NO: 661098 - DNA, 25 bp, Mus musculus
gtaaatccatttcctgcgtgtgttc

SEQ ID NO: 661099 - DNA, 25 bp, Mus musculus
gtaaatccatttgctgcgtgtgttc

SEQ ID NO: 661100 - DNA, 25 bp, Mus musculus
gtaaatcccagaacatccagcaaat

SEQ ID NO: 661101 - DNA, 25 bp, Mus musculus
gtaaatcccagatcatccagcaaat

SEQ ID NO: 661102 - DNA, 25 bp, Mus musculus
gtaaatccctaactgcctcaactgc

SEQ ID NO: 661103 - DNA, 25 bp, Mus musculus
gtaaatccctaagtgcctcaactgc

SEQ ID NO: 661104 - DNA, 25 bp, Mus musculus
gtaaatccctttaaatctgcgacaa

SEQ ID NO: 661105 - DNA, 25 bp, Mus musculus
gtaaatcccttttaatctgcgacaa

SEQ ID NO: 661106 - DNA, 25 bp, Mus musculus
gtaaatcctacaactgaagtgctaa

SEQ ID NO: 661107 - DNA, 25 bp, Mus musculus
gtaaatcctacatctgaagtgctaa

SEQ ID NO: 661108 - DNA, 25 bp, Mus musculus
gtaaatcctcagcttcacttgcttc

SEQ ID NO: 661109 - DNA, 25 bp, Mus musculus
gtaaatcctcaggttcacttgcttc

SEQ ID NO: 661110 - DNA, 25 bp, Mus musculus
gtaaatcctctaccgcatgtatgtg

SEQ ID NO: 661111 - DNA, 25 bp, Mus musculus
gtaaatcctctagcgcatgtatgtg

SEQ ID NO: 661112 - DNA, 25 bp, Mus musculus
gtaaatcctgagaacgagccaatcc

SEQ ID NO: 661113 - DNA, 25 bp, Mus musculus
gtaaatcctgagtacgagccaatcc

SEQ ID NO: 661114 - DNA, 25 bp, Mus musculus
gtaaatcctgtaaccatggctttaa

SEQ ID NO: 661115 - DNA, 25 bp, Mus musculus
gtaaatcctgtatccatggctttaa

SEQ ID NO: 661116 - DNA, 25 bp, Mus musculus
gtaaatcctgttccaaatgtagcaa

SEQ ID NO: 661117 - DNA, 25 bp, Mus musculus
gtaaatcctgttgcaaatgtagcaa

SEQ ID NO: 661118 - DNA, 25 bp, Mus musculus
gtaaatccttacaccttcgcagaac

SEQ ID NO: 661119 - DNA, 25 bp, Mus musculus
gtaaatccttactccttcgcagaac

SEQ ID NO: 661120 - DNA, 25 bp, Mus musculus
gtaaatccttagacgcttgagaata

SEQ ID NO: 661121 - DNA, 25 bp, Mus musculus
gtaaatccttagtcgcttgagaata

SEQ ID NO: 661122 - DNA, 25 bp, Mus musculus
gtaaatccttcccatctcctcatgt

SEQ ID NO: 661123 - DNA, 25 bp, Mus musculus
gtaaatccttccgatctcctcatgt

SEQ ID NO: 661124 - DNA, 25 bp, Mus musculus
gtaaatccttctcaagccaagcaga

SEQ ID NO: 661125 - DNA, 25 bp, Mus musculus
gtaaatccttctgaagccaagcaga

SEQ ID NO: 661126 - DNA, 25 bp, Mus musculus
gtaaatccttgtagtcacatcccag

SEQ ID NO: 661127 - DNA, 25 bp, Mus musculus
gtaaatccttgttgtcacatcccag

SEQ ID NO: 661128 - DNA, 25 bp, Mus musculus
gtaaatcctttgattctcatgctat

SEQ ID NO: 661129 - DNA, 25 bp, Mus musculus
gtaaatcctttgtttctcatgctat

SEQ ID NO: 661130 - DNA, 25 bp, Mus musculus
gtaaatcgcattacacatggaacaa

SEQ ID NO: 661131 - DNA, 25 bp, Mus musculus
gtaaatcgcatttcacatggaacaa

SEQ ID NO: 661132 - DNA, 25 bp, Mus musculus
gtaaatcgctacagctttctagcct

SEQ ID NO: 661133 - DNA, 25 bp, Mus musculus
gtaaatcgctactgctttctagcct

SEQ ID NO: 661134 - DNA, 25 bp, Mus musculus
gtaaatcgtacacatcaaagaaggg

SEQ ID NO: 661135 - DNA, 25 bp, Mus musculus
gtaaatcgtacagatcaaagaaggg

SEQ ID NO: 661136 - DNA, 25 bp, Mus musculus
gtaaatctaacaactactagtacaa

SEQ ID NO: 661137 - DNA, 25 bp, Mus musculus
gtaaatctaacatctactagtacaa

SEQ ID NO: 661138 - DNA, 25 bp, Mus musculus
gtaaatctacatacaccaatcttgt

SEQ ID NO: 661139 - DNA, 25 bp, Mus musculus
gtaaatctacattcaccaatcttgt

SEQ ID NO: 661140 - DNA, 25 bp, Mus musculus
gtaaatctatctcccttgtctaatc

SEQ ID NO: 661141 - DNA, 25 bp, Mus musculus
gtaaatctatctgccttgtctaatc

SEQ ID NO: 661142 - DNA, 25 bp, Mus musculus
gtaaatctattgcaatctcactaat

SEQ ID NO: 661143 - DNA, 25 bp, Mus musculus
gtaaatctattggaatctcactaat

SEQ ID NO: 661144 - DNA, 25 bp, Mus musculus
gtaaatctcaccagctgcaaggagg

SEQ ID NO: 661145 - DNA, 25 bp, Mus musculus
gtaaatctcacctgctgcaaggagg

SEQ ID NO: 661146 - DNA, 25 bp, Mus musculus
gtaaatctcttacccaatccgttat

SEQ ID NO: 661147 - DNA, 25 bp, Mus musculus
gtaaatctcttagccaatccgttat

SEQ ID NO: 661148 - DNA, 25 bp, Mus musculus
gtaaatctgaaaacagcctgtctgt

SEQ ID NO: 661149 - DNA, 25 bp, Mus musculus
gtaaatctgaaatcagcctgtctgt

SEQ ID NO: 661150 - DNA, 25 bp, Mus musculus
gtaaatctgactaccaagaccgcag

SEQ ID NO: 661151 - DNA, 25 bp, Mus musculus
gtaaatctgacttccaagaccgcag

SEQ ID NO: 661152 - DNA, 25 bp, Mus musculus
gtaaatctgagtcagaatcagctca

SEQ ID NO: 661153 - DNA, 25 bp, Mus musculus
gtaaatctgagtgagaatcagctca

SEQ ID NO: 661154 - DNA, 25 bp, Mus musculus
gtaaatctggtaccaattctttcta

SEQ ID NO: 661155 - DNA, 25 bp, Mus musculus
gtaaatctggtagcaattctttcta

SEQ ID NO: 661156 - DNA, 25 bp, Mus musculus
gtaaatctgtagaatcgctcgtata

SEQ ID NO: 661157 - DNA, 25 bp, Mus musculus
gtaaatctgtagtatcgctcgtata

SEQ ID NO: 661158 - DNA, 25 bp, Mus musculus
gtaaatctgtatatgaagtccctca

SEQ ID NO: 661159 - DNA, 25 bp, Mus musculus
gtaaatctgtatttgaagtccctca

SEQ ID NO: 661160 - DNA, 25 bp, Mus musculus
gtaaatctgtctctgatctgctgtt

SEQ ID NO: 661161 - DNA, 25 bp, Mus musculus
gtaaatctgtctgtgatctgctgtt

SEQ ID NO: 661162 - DNA, 25 bp, Mus musculus
gtaaatcttacacaccctgtgtcag

SEQ ID NO: 661163 - DNA, 25 bp, Mus musculus
gtaaatcttacagaccctgtgtcag

SEQ ID NO: 661164 - DNA, 25 bp, Mus musculus
gtaaatcttagccacttgtctatgt

SEQ ID NO: 661165 - DNA, 25 bp, Mus musculus
gtaaatcttagcgacttgtctatgt

SEQ ID NO: 661166 - DNA, 25 bp, Mus musculus
gtaaatcttccaaacgctaacccag

SEQ ID NO: 661167 - DNA, 25 bp, Mus musculus
gtaaatcttccatacgctaacccag

SEQ ID NO: 661168 - DNA, 25 bp, Mus musculus
gtaaatctttgcacagggatctaga

SEQ ID NO: 661169 - DNA, 25 bp, Mus musculus
gtaaatctttgctcagggatctaga

SEQ ID NO: 661170 - DNA, 25 bp, Mus musculus
gtaaatctttgtaatgagtaatcta

SEQ ID NO: 661171 - DNA, 25 bp, Mus musculus
gtaaatctttgttatgagtaatcta

SEQ ID NO: 661172 - DNA, 25 bp, Mus musculus
gtaaatgaaatgatgccttctctga

SEQ ID NO: 661173 - DNA, 25 bp, Mus musculus
gtaaatgaaatgttgccttctctga

SEQ ID NO: 661174 - DNA, 25 bp, Mus musculus
gtaaatgaagtcacaggctttggct

SEQ ID NO: 661175 - DNA, 25 bp, Mus musculus
gtaaatgaagtctcaggctttggct

SEQ ID NO: 661176 - DNA, 25 bp, Mus musculus
gtaaatgaatcacagggccaagttc

SEQ ID NO: 661177 - DNA, 25 bp, Mus musculus
gtaaatgaatcagagggccaagttc

SEQ ID NO: 661178 - DNA, 25 bp, Mus musculus
gtaaatgacacacaacttcacttcc

SEQ ID NO: 661179 - DNA, 25 bp, Mus musculus
gtaaatgacacagaacttcacttcc

SEQ ID NO: 661180 - DNA, 25 bp, Mus musculus
gtaaatgaccaacataattgtactg

SEQ ID NO: 661181 - DNA, 25 bp, Mus musculus
gtaaatgaccaagataattgtactg

SEQ ID NO: 661182 - DNA, 25 bp, Mus musculus
gtaaatgacctaacccatgtttcag

SEQ ID NO: 661183 - DNA, 25 bp, Mus musculus
gtaaatgacctatcccatgtttcag

SEQ ID NO: 661184 - DNA, 25 bp, Mus musculus
gtaaatgactcaagcctgcagacat

SEQ ID NO: 661185 - DNA, 25 bp, Mus musculus
gtaaatgactcatgcctgcagacat

SEQ ID NO: 661186 - DNA, 25 bp, Mus musculus
gtaaatgagaccattctggaagttt

SEQ ID NO: 661187 - DNA, 25 bp, Mus musculus
gtaaatgagacctttctggaagttt

SEQ ID NO: 661188 - DNA, 25 bp, Mus musculus
gtaaatgagacgacacagtgcccag

SEQ ID NO: 661189 - DNA, 25 bp, Mus musculus
gtaaatgagacgtcacagtgcccag

SEQ ID NO: 661190 - DNA, 25 bp, Mus musculus
gtaaatgagcgcatggagacagtct

SEQ ID NO: 661191 - DNA, 25 bp, Mus musculus
gtaaatgagcgcttggagacagtct

SEQ ID NO: 661192 - DNA, 25 bp, Mus musculus
gtaaatgagcttcaccttgtgcaaa

SEQ ID NO: 661193 - DNA, 25 bp, Mus musculus
gtaaatgagcttgaccttgtgcaaa

SEQ ID NO: 661194 - DNA, 25 bp, Mus musculus
gtaaatgatcatcacccaaggacag

SEQ ID NO: 661195 - DNA, 25 bp, Mus musculus
gtaaatgatcatgacccaaggacag

SEQ ID NO: 661196 - DNA, 25 bp, Mus musculus
gtaaatgattgtcgaccttgtccca

SEQ ID NO: 661197 - DNA, 25 bp, Mus musculus
gtaaatgattgtggaccttgtccca

SEQ ID NO: 661198 - DNA, 25 bp, Mus musculus
gtaaatgattttacgcattgtgcat

SEQ ID NO: 661199 - DNA, 25 bp, Mus musculus
gtaaatgatttttcgcattgtgcat

SEQ ID NO: 661200 - DNA, 25 bp, Mus musculus
gtaaatgcagaaccggtcctaccca

SEQ ID NO: 661201 - DNA, 25 bp, Mus musculus
gtaaatgcagaagcggtcctaccca

SEQ ID NO: 661202 - DNA, 25 bp, Mus musculus
gtaaatgcagccatcttttcaaaac

SEQ ID NO: 661203 - DNA, 25 bp, Mus musculus
gtaaatgcagccttcttttcaaaac

SEQ ID NO: 661204 - DNA, 25 bp, Mus musculus
gtaaatgcagtcataataaaccagg

SEQ ID NO: 661205 - DNA, 25 bp, Mus musculus
gtaaatgcagtcttaataaaccagg

SEQ ID NO: 661206 - DNA, 25 bp, Mus musculus
gtaaatgcatcccagcgtgaagcgt

SEQ ID NO: 661207 - DNA, 25 bp, Mus musculus
gtaaatgcatccgagcgtgaagcgt

SEQ ID NO: 661208 - DNA, 25 bp, Mus musculus
gtaaatgcatgcatacttcactgtg

SEQ ID NO: 661209 - DNA, 25 bp, Mus musculus
gtaaatgcatgcttacttcactgtg

SEQ ID NO: 661210 - DNA, 25 bp, Mus musculus
gtaaatgccacactaggcctagctt

SEQ ID NO: 661211 - DNA, 25 bp, Mus musculus
gtaaatgccacagtaggcctagctt

SEQ ID NO: 661212 - DNA, 25 bp, Mus musculus
gtaaatgccatcagtaacttggagt

SEQ ID NO: 661213 - DNA, 25 bp, Mus musculus
gtaaatgccatctgtaacttggagt

SEQ ID NO: 661214 - DNA, 25 bp, Mus musculus
gtaaatgctaacaaaccatattggt

SEQ ID NO: 661215 - DNA, 25 bp, Mus musculus
gtaaatgctaactaaccatattggt

SEQ ID NO: 661216 - DNA, 25 bp, Mus musculus
gtaaatgctagtcatttcttgctgt

SEQ ID NO: 661217 - DNA, 25 bp, Mus musculus
gtaaatgctagtgatttcttgctgt

SEQ ID NO: 661218 - DNA, 25 bp, Mus musculus
gtaaatgctatgactttaagggtct

SEQ ID NO: 661219 - DNA, 25 bp, Mus musculus
gtaaatgctatgtctttaagggtct

SEQ ID NO: 661220 - DNA, 25 bp, Mus musculus
gtaaatgctcccatatgcttttgaa

SEQ ID NO: 661221 - DNA, 25 bp, Mus musculus
gtaaatgctcccttatgcttttgaa

SEQ ID NO: 661222 - DNA, 25 bp, Mus musculus
gtaaatgctcttaatttcatagaag

SEQ ID NO: 661223 - DNA, 25 bp, Mus musculus
gtaaatgctctttatttcatagaag

SEQ ID NO: 661224 - DNA, 25 bp, Mus musculus
gtaaatgctgtaacaattcccagtg

SEQ ID NO: 661225 - DNA, 25 bp, Mus musculus
gtaaatgctgtatcaattcccagtg

SEQ ID NO: 661226 - DNA, 25 bp, Mus musculus
gtaaatgctgtcactgccgatggct

SEQ ID NO: 661227 - DNA, 25 bp, Mus musculus
gtaaatgctgtctctgccgatggct

SEQ ID NO: 661228 - DNA, 25 bp, Mus musculus
gtaaatgcttaaactgtgcccaagt

SEQ ID NO: 661229 - DNA, 25 bp, Mus musculus
gtaaatgcttaatctgtgcccaagt

SEQ ID NO: 661230 - DNA, 25 bp, Mus musculus
gtaaatgctttgaagatctgattaa

SEQ ID NO: 661231 - DNA, 25 bp, Mus musculus
gtaaatgctttgtagatctgattaa

SEQ ID NO: 661232 - DNA, 25 bp, Mus musculus
gtaaatggaaacacccatgccttgt

SEQ ID NO: 661233 - DNA, 25 bp, Mus musculus
gtaaatggaaactcccatgccttgt

SEQ ID NO: 661234 - DNA, 25 bp, Mus musculus
gtaaatggaatcagttttctctctt

SEQ ID NO: 661235 - DNA, 25 bp, Mus musculus
gtaaatggaatctgttttctctctt

SEQ ID NO: 661236 - DNA, 25 bp, Mus musculus
gtaaatggcacccacagtgctgttg

SEQ ID NO: 661237 - DNA, 25 bp, Mus musculus
gtaaatggcaccgacagtgctgttg

SEQ ID NO: 661238 - DNA, 25 bp, Mus musculus
gtaaatggcgatagatctttagttt

SEQ ID NO: 661239 - DNA, 25 bp, Mus musculus
gtaaatggcgattgatctttagttt

SEQ ID NO: 661240 - DNA, 25 bp, Mus musculus
gtaaatgggagcaattctttctatt

SEQ ID NO: 661241 - DNA, 25 bp, Mus musculus
gtaaatgggagctattctttctatt

SEQ ID NO: 661242 - DNA, 25 bp, Mus musculus
gtaaatgggatgatcaacgggacaa

SEQ ID NO: 661243 - DNA, 25 bp, Mus musculus
gtaaatgggatgttcaacgggacaa

SEQ ID NO: 661244 - DNA, 25 bp, Mus musculus
gtaaatggtacaactcagtggtggg

SEQ ID NO: 661245 - DNA, 25 bp, Mus musculus
gtaaatggtacatctcagtggtggg

SEQ ID NO: 661246 - DNA, 25 bp, Mus musculus
gtaaatggtcacctgatcgctgaga

SEQ ID NO: 661247 - DNA, 25 bp, Mus musculus
gtaaatggtcacgtgatcgctgaga

SEQ ID NO: 661248 - DNA, 25 bp, Mus musculus
gtaaatggttctatgccagtttaag

SEQ ID NO: 661249 - DNA, 25 bp, Mus musculus
gtaaatggttctttgccagtttaag

SEQ ID NO: 661250 - DNA, 25 bp, Mus musculus
gtaaatgtaattacccagacgggat

SEQ ID NO: 661251 - DNA, 25 bp, Mus musculus
gtaaatgtaatttcccagacgggat

SEQ ID NO: 661252 - DNA, 25 bp, Mus musculus
gtaaatgtacctcagtctaatcaga

SEQ ID NO: 661253 - DNA, 25 bp, Mus musculus
gtaaatgtacctgagtctaatcaga

SEQ ID NO: 661254 - DNA, 25 bp, Mus musculus
gtaaatgtcagtacagcctagccca

SEQ ID NO: 661255 - DNA, 25 bp, Mus musculus
gtaaatgtcagttcagcctagccca

SEQ ID NO: 661256 - DNA, 25 bp, Mus musculus
gtaaatgtccctcatgtttctgaaa

SEQ ID NO: 661257 - DNA, 25 bp, Mus musculus
gtaaatgtccctgatgtttctgaaa

SEQ ID NO: 661258 - DNA, 25 bp, Mus musculus
gtaaatgtcggaatctctgctaaac

SEQ ID NO: 661259 - DNA, 25 bp, Mus musculus
gtaaatgtcggattctctgctaaac

SEQ ID NO: 661260 - DNA, 25 bp, Mus musculus
gtaaatgtctgaaatgctaacccca

SEQ ID NO: 661261 - DNA, 25 bp, Mus musculus
gtaaatgtctgacagttgtgttgat

SEQ ID NO: 661262 - DNA, 25 bp, Mus musculus
gtaaatgtctgagagttgtgttgat

SEQ ID NO: 661263 - DNA, 25 bp, Mus musculus
gtaaatgtctgatatgctaacccca

SEQ ID NO: 661264 - DNA, 25 bp, Mus musculus
gtaaatgtctgcattctgtgcagca

SEQ ID NO: 661265 - DNA, 25 bp, Mus musculus
gtaaatgtctgctttctgtgcagca

SEQ ID NO: 661266 - DNA, 25 bp, Mus musculus
gtaaatgtcttgacaatcagccaga

SEQ ID NO: 661267 - DNA, 25 bp, Mus musculus
gtaaatgtcttgatctgctgtaaat

SEQ ID NO: 661268 - DNA, 25 bp, Mus musculus
gtaaatgtcttgtcaatcagccaga

SEQ ID NO: 661269 - DNA, 25 bp, Mus musculus
gtaaatgtcttgttctgctgtaaat

SEQ ID NO: 661270 - DNA, 25 bp, Mus musculus
gtaaatgtgctaaggttttatcaac

SEQ ID NO: 661271 - DNA, 25 bp, Mus musculus
gtaaatgtgctatggttttatcaac

SEQ ID NO: 661272 - DNA, 25 bp, Mus musculus
gtaaatgtggccctgcatatgaatc

SEQ ID NO: 661273 - DNA, 25 bp, Mus musculus
gtaaatgtggccgtgcatatgaatc

SEQ ID NO: 661274 - DNA, 25 bp, Mus musculus
gtaaatgtggctcgaaaattcgcta

SEQ ID NO: 661275 - DNA, 25 bp, Mus musculus
gtaaatgtggctcgtctagggatat

SEQ ID NO: 661276 - DNA, 25 bp, Mus musculus
gtaaatgtggctggaaaattcgcta

SEQ ID NO: 661277 - DNA, 25 bp, Mus musculus
gtaaatgtggctggtctagggatat

SEQ ID NO: 661278 - DNA, 25 bp, Mus musculus
gtaaatgtggttctttgcagcaaaa

SEQ ID NO: 661279 - DNA, 25 bp, Mus musculus
gtaaatgtggttgtttgcagcaaaa

SEQ ID NO: 661280 - DNA, 25 bp, Mus musculus
gtaaatgtgtttacagtccatcttc

SEQ ID NO: 661281 - DNA, 25 bp, Mus musculus
gtaaatgtgttttcagtccatcttc

SEQ ID NO: 661282 - DNA, 25 bp, Mus musculus
gtaaatgttcaaatccttcagtgtt

SEQ ID NO: 661283 - DNA, 25 bp, Mus musculus
gtaaatgttcaattccttcagtgtt

SEQ ID NO: 661284 - DNA, 25 bp, Mus musculus
gtaaatgtttttccacaacctgtaa

SEQ ID NO: 661285 - DNA, 25 bp, Mus musculus
gtaaatgtttttgcacaacctgtaa

SEQ ID NO: 661286 - DNA, 25 bp, Mus musculus
gtaaattaaggcatcctaaattcat

SEQ ID NO: 661287 - DNA, 25 bp, Mus musculus
gtaaattaaggcttcctaaattcat

SEQ ID NO: 661288 - DNA, 25 bp, Mus musculus
gtaaattaccttcacttgtagaatc

SEQ ID NO: 661289 - DNA, 25 bp, Mus musculus
gtaaattaccttgacttgtagaatc

SEQ ID NO: 661290 - DNA, 25 bp, Mus musculus
gtaaattagagcacatcactccccg

SEQ ID NO: 661291 - DNA, 25 bp, Mus musculus
gtaaattagagctcatcactccccg

SEQ ID NO: 661292 - DNA, 25 bp, Mus musculus
gtaaattagtcacggctcatggaga

SEQ ID NO: 661293 - DNA, 25 bp, Mus musculus
gtaaattagtcagggctcatggaga

SEQ ID NO: 661294 - DNA, 25 bp, Mus musculus
gtaaattatccacgctggtactggt

SEQ ID NO: 661295 - DNA, 25 bp, Mus musculus
gtaaattatccaggctggtactggt

SEQ ID NO: 661296 - DNA, 25 bp, Mus musculus
gtaaattatccccatgttgcttgtg

SEQ ID NO: 661297 - DNA, 25 bp, Mus musculus
gtaaattatcccgatgttgcttgtg

SEQ ID NO: 661298 - DNA, 25 bp, Mus musculus
gtaaattatgatactgtctgggtcc

SEQ ID NO: 661299 - DNA, 25 bp, Mus musculus
gtaaattatgattctgtctgggtcc

SEQ ID NO: 661300 - DNA, 25 bp, Mus musculus
gtaaattatgtcatccagaactgag

SEQ ID NO: 661301 - DNA, 25 bp, Mus musculus
gtaaattatgtcttccagaactgag

SEQ ID NO: 661302 - DNA, 25 bp, Mus musculus
gtaaattatgttctcgatgcctcct

SEQ ID NO: 661303 - DNA, 25 bp, Mus musculus
gtaaattatgttgtcgatgcctcct

SEQ ID NO: 661304 - DNA, 25 bp, Mus musculus
gtaaattatttaagcactcctggtg

SEQ ID NO: 661305 - DNA, 25 bp, Mus musculus
gtaaattatttatgcactcctggtg

SEQ ID NO: 661306 - DNA, 25 bp, Mus musculus
gtaaattcaaaactcctgtgagtgg

SEQ ID NO: 661307 - DNA, 25 bp, Mus musculus
gtaaattcaaaagtcctgtgagtgg

SEQ ID NO: 661308 - DNA, 25 bp, Mus musculus
gtaaattcaataccactggcttctt

SEQ ID NO: 661309 - DNA, 25 bp, Mus musculus
gtaaattcaatagcactggcttctt

SEQ ID NO: 661310 - DNA, 25 bp, Mus musculus
gtaaattcagagcttgttggacttt

SEQ ID NO: 661311 - DNA, 25 bp, Mus musculus
gtaaattcagaggttgttggacttt

SEQ ID NO: 661312 - DNA, 25 bp, Mus musculus
gtaaattcagtgatctctatccctt

SEQ ID NO: 661313 - DNA, 25 bp, Mus musculus
gtaaattcagtgttctctatccctt

SEQ ID NO: 661314 - DNA, 25 bp, Mus musculus
gtaaattcattcatcctgggactat

SEQ ID NO: 661315 - DNA, 25 bp, Mus musculus
gtaaattcattcttcctgggactat

SEQ ID NO: 661316 - DNA, 25 bp, Mus musculus
gtaaattcattgacctacttaaggc

SEQ ID NO: 661317 - DNA, 25 bp, Mus musculus
gtaaattcattgtcctacttaaggc

SEQ ID NO: 661318 - DNA, 25 bp, Mus musculus
gtaaattccggaaagacttctctga

SEQ ID NO: 661319 - DNA, 25 bp, Mus musculus
gtaaattccggatagacttctctga

SEQ ID NO: 661320 - DNA, 25 bp, Mus musculus
gtaaattcgataaacggattcactt

SEQ ID NO: 661321 - DNA, 25 bp, Mus musculus
gtaaattcgatatacggattcactt

SEQ ID NO: 661322 - DNA, 25 bp, Mus musculus
gtaaattcgcgaccaggaccatcga

SEQ ID NO: 661323 - DNA, 25 bp, Mus musculus
gtaaattcgcgagcaggaccatcga

SEQ ID NO: 661324 - DNA, 25 bp, Mus musculus
gtaaattctacaatacagtgggcat

SEQ ID NO: 661325 - DNA, 25 bp, Mus musculus
gtaaattctacattacagtgggcat

SEQ ID NO: 661326 - DNA, 25 bp, Mus musculus
gtaaattctcagatctctacagtaa

SEQ ID NO: 661327 - DNA, 25 bp, Mus musculus
gtaaattctcagttctctacagtaa

SEQ ID NO: 661328 - DNA, 25 bp, Mus musculus
gtaaattctcatcagctgttgtaga

SEQ ID NO: 661329 - DNA, 25 bp, Mus musculus
gtaaattctcatgagctgttgtaga

SEQ ID NO: 661330 - DNA, 25 bp, Mus musculus
gtaaattctccactgagctgctccc

SEQ ID NO: 661331 - DNA, 25 bp, Mus musculus
gtaaattctccagtgagctgctccc

SEQ ID NO: 661332 - DNA, 25 bp, Mus musculus
gtaaattctgacatttgccctaata

SEQ ID NO: 661333 - DNA, 25 bp, Mus musculus
gtaaattctgacttttgccctaata

SEQ ID NO: 661334 - DNA, 25 bp, Mus musculus
gtaaattctgtacttagcagagaca

SEQ ID NO: 661335 - DNA, 25 bp, Mus musculus
gtaaattctgtagttagcagagaca

SEQ ID NO: 661336 - DNA, 25 bp, Mus musculus
gtaaattcttggaaatgcctccgtt

SEQ ID NO: 661337 - DNA, 25 bp, Mus musculus
gtaaattcttggtaatgcctccgtt

SEQ ID NO: 661338 - DNA, 25 bp, Mus musculus
gtaaattgccatcctttgtctcctc

SEQ ID NO: 661339 - DNA, 25 bp, Mus musculus
gtaaattgccatgctttgtctcctc

SEQ ID NO: 661340 - DNA, 25 bp, Mus musculus
gtaaattgctacacatctataggtg

SEQ ID NO: 661341 - DNA, 25 bp, Mus musculus
gtaaattgctactcatctataggtg

SEQ ID NO: 661342 - DNA, 25 bp, Mus musculus
gtaaattggccgcttctttccagag

SEQ ID NO: 661343 - DNA, 25 bp, Mus musculus
gtaaattggccggttctttccagag

SEQ ID NO: 661344 - DNA, 25 bp, Mus musculus
gtaaattgttccctgaagccgcgct

SEQ ID NO: 661345 - DNA, 25 bp, Mus musculus
gtaaattgttccgtgaagccgcgct

SEQ ID NO: 661346 - DNA, 25 bp, Mus musculus
gtaaatttactcactttgaactcat

SEQ ID NO: 661347 - DNA, 25 bp, Mus musculus
gtaaatttactctctttgaactcat

SEQ ID NO: 661348 - DNA, 25 bp, Mus musculus
gtaaatttactgaggcagactgggt

SEQ ID NO: 661349 - DNA, 25 bp, Mus musculus
gtaaatttactgtggcagactgggt

SEQ ID NO: 661350 - DNA, 25 bp, Mus musculus
gtaaatttaggtcttatgagcacaa

SEQ ID NO: 661351 - DNA, 25 bp, Mus musculus
gtaaatttaggtgttatgagcacaa

SEQ ID NO: 661352 - DNA, 25 bp, Mus musculus
gtaaatttccacatcaccagcaata

SEQ ID NO: 661353 - DNA, 25 bp, Mus musculus
gtaaatttccacttcaccagcaata

SEQ ID NO: 661354 - DNA, 25 bp, Mus musculus
gtaaatttctaaatgtcttcaggcc

SEQ ID NO: 661355 - DNA, 25 bp, Mus musculus
gtaaatttctaattgtcttcaggcc

SEQ ID NO: 661356 - DNA, 25 bp, Mus musculus
gtaaatttctctccatcagtgacca

SEQ ID NO: 661357 - DNA, 25 bp, Mus musculus
gtaaatttctctgcatcagtgacca

SEQ ID NO: 661358 - DNA, 25 bp, Mus musculus
gtaaatttctgccaactgtagtaat

SEQ ID NO: 661359 - DNA, 25 bp, Mus musculus
gtaaatttctgcgaactgtagtaat

SEQ ID NO: 661360 - DNA, 25 bp, Mus musculus
gtaaatttgcacctatactcataag

SEQ ID NO: 661361 - DNA, 25 bp, Mus musculus
gtaaatttgcacgtatactcataag

SEQ ID NO: 661362 - DNA, 25 bp, Mus musculus
gtaaatttgcagctatgactcgtgc

SEQ ID NO: 661363 - DNA, 25 bp, Mus musculus
gtaaatttgcaggtatgactcgtgc

SEQ ID NO: 661364 - DNA, 25 bp, Mus musculus
gtaaatttgccaccaactacctgaa

SEQ ID NO: 661365 - DNA, 25 bp, Mus musculus
gtaaatttgccagcaactacctgaa

SEQ ID NO: 661366 - DNA, 25 bp, Mus musculus
gtaaatttggaaacagtgctgtagc

SEQ ID NO: 661367 - DNA, 25 bp, Mus musculus
gtaaatttggaatcagtgctgtagc

SEQ ID NO: 661368 - DNA, 25 bp, Mus musculus
gtaaatttgtttagtctctgcttcc

SEQ ID NO: 661369 - DNA, 25 bp, Mus musculus
gtaaatttgttttgtctctgcttcc

SEQ ID NO: 661370 - DNA, 25 bp, Mus musculus
gtaaatttttaacagtcaccagcat

SEQ ID NO: 661371 - DNA, 25 bp, Mus musculus
gtaaatttttaagagtcaccagcat

SEQ ID NO: 661372 - DNA, 25 bp, Mus musculus
gtaacaaaataacctgctgccacct

SEQ ID NO: 661373 - DNA, 25 bp, Mus musculus
gtaacaaaataagctgctgccacct

SEQ ID NO: 661374 - DNA, 25 bp, Mus musculus
gtaacaaaccagaatgatcaccagg

SEQ ID NO: 661375 - DNA, 25 bp, Mus musculus
gtaacaaaccagtatgatcaccagg

SEQ ID NO: 661376 - DNA, 25 bp, Mus musculus
gtaacaaacctcacattacacagtt

SEQ ID NO: 661377 - DNA, 25 bp, Mus musculus
gtaacaaacctctcattacacagtt

SEQ ID NO: 661378 - DNA, 25 bp, Mus musculus
gtaacaaacctgaagttctgggaag

SEQ ID NO: 661379 - DNA, 25 bp, Mus musculus
gtaacaaacctgtagttctgggaag

SEQ ID NO: 661380 - DNA, 25 bp, Mus musculus
gtaacaaagaacaccaactgcctgg

SEQ ID NO: 661381 - DNA, 25 bp, Mus musculus
gtaacaaagaactccaactgcctgg

SEQ ID NO: 661382 - DNA, 25 bp, Mus musculus
gtaacaaagtttccagctgagacga

SEQ ID NO: 661383 - DNA, 25 bp, Mus musculus
gtaacaaagtttgcagctgagacga

SEQ ID NO: 661384 - DNA, 25 bp, Mus musculus
gtaacaaatgatcaaactggccata

SEQ ID NO: 661385 - DNA, 25 bp, Mus musculus
gtaacaaatgatgaaactggccata

SEQ ID NO: 661386 - DNA, 25 bp, Mus musculus
gtaacaacaactacccacagcagag

SEQ ID NO: 661387 - DNA, 25 bp, Mus musculus
gtaacaacaacttcccacagcagag

SEQ ID NO: 661388 - DNA, 25 bp, Mus musculus
gtaacaacagctcctcccttcagtt

SEQ ID NO: 661389 - DNA, 25 bp, Mus musculus
gtaacaacagctgctcccttcagtt

SEQ ID NO: 661390 - DNA, 25 bp, Mus musculus
gtaacaacataaccacctggattcc

SEQ ID NO: 661391 - DNA, 25 bp, Mus musculus
gtaacaacataagcacctggattcc

SEQ ID NO: 661392 - DNA, 25 bp, Mus musculus
gtaacaacatcacatacttctgaaa

SEQ ID NO: 661393 - DNA, 25 bp, Mus musculus
gtaacaacatcagatacttctgaaa

SEQ ID NO: 661394 - DNA, 25 bp, Mus musculus
gtaacaacatctatcatccaaacat

SEQ ID NO: 661395 - DNA, 25 bp, Mus musculus
gtaacaacatctttcatccaaacat

SEQ ID NO: 661396 - DNA, 25 bp, Mus musculus
gtaacaacatgcagctggtgggcgt

SEQ ID NO: 661397 - DNA, 25 bp, Mus musculus
gtaacaacatgctgctggtgggcgt

SEQ ID NO: 661398 - DNA, 25 bp, Mus musculus
gtaacaacccaaatccaactactat

SEQ ID NO: 661399 - DNA, 25 bp, Mus musculus
gtaacaacccaattccaactactat

SEQ ID NO: 661400 - DNA, 25 bp, Mus musculus
gtaacaaccggtctcaactggatct

SEQ ID NO: 661401 - DNA, 25 bp, Mus musculus
gtaacaaccggtgtcaactggatct

SEQ ID NO: 661402 - DNA, 25 bp, Mus musculus
gtaacaacgagtactcgtattccct

SEQ ID NO: 661403 - DNA, 25 bp, Mus musculus
gtaacaacgagttctcgtattccct

SEQ ID NO: 661404 - DNA, 25 bp, Mus musculus
gtaacaagaatccagttgccaagct

SEQ ID NO: 661405 - DNA, 25 bp, Mus musculus
gtaacaagaatcgagttgccaagct

SEQ ID NO: 661406 - DNA, 25 bp, Mus musculus
gtaacaagagtgattcttgctgcta

SEQ ID NO: 661407 - DNA, 25 bp, Mus musculus
gtaacaagagtgtttcttgctgcta

SEQ ID NO: 661408 - DNA, 25 bp, Mus musculus
gtaacaagatgcagccttcttctct

SEQ ID NO: 661409 - DNA, 25 bp, Mus musculus
gtaacaagatgctgccttcttctct

SEQ ID NO: 661410 - DNA, 25 bp, Mus musculus
gtaacaagccttaagcagtgggatg

SEQ ID NO: 661411 - DNA, 25 bp, Mus musculus
gtaacaagcctttagcagtgggatg

SEQ ID NO: 661412 - DNA, 25 bp, Mus musculus
gtaacaagctgactgtgattctgat

SEQ ID NO: 661413 - DNA, 25 bp, Mus musculus
gtaacaagctgagtgtgattctgat

SEQ ID NO: 661414 - DNA, 25 bp, Mus musculus
gtaacaagggtgatgcatcgcagcc

SEQ ID NO: 661415 - DNA, 25 bp, Mus musculus
gtaacaagggtgttgcatcgcagcc

SEQ ID NO: 661416 - DNA, 25 bp, Mus musculus
gtaacaagtcatatgggccccaagc

SEQ ID NO: 661417 - DNA, 25 bp, Mus musculus
gtaacaagtcatttgggccccaagc

SEQ ID NO: 661418 - DNA, 25 bp, Mus musculus
gtaacaatatctcactccatctcct

SEQ ID NO: 661419 - DNA, 25 bp, Mus musculus
gtaacaatatctgactccatctcct

SEQ ID NO: 661420 - DNA, 25 bp, Mus musculus
gtaacaatcaggacaaacccaggag

SEQ ID NO: 661421 - DNA, 25 bp, Mus musculus
gtaacaatcaggactctccagattt

SEQ ID NO: 661422 - DNA, 25 bp, Mus musculus
gtaacaatcaggtcaaacccaggag

SEQ ID NO: 661423 - DNA, 25 bp, Mus musculus
gtaacaatcaggtctctccagattt

SEQ ID NO: 661424 - DNA, 25 bp, Mus musculus
gtaacaatcgacagcaatgcgaaag

SEQ ID NO: 661425 - DNA, 25 bp, Mus musculus
gtaacaatcgactgcaatgcgaaag

SEQ ID NO: 661426 - DNA, 25 bp, Mus musculus
gtaacaatcttaattttgggtgagt

SEQ ID NO: 661427 - DNA, 25 bp, Mus musculus
gtaacaatcttatttttgggtgagt

SEQ ID NO: 661428 - DNA, 25 bp, Mus musculus
gtaacaatgattatctccagagtgt

SEQ ID NO: 661429 - DNA, 25 bp, Mus musculus
gtaacaatgattttctccagagtgt

SEQ ID NO: 661430 - DNA, 25 bp, Mus musculus
gtaacaatggccctgtcacaattcc

SEQ ID NO: 661431 - DNA, 25 bp, Mus musculus
gtaacaatggccgtgtcacaattcc

SEQ ID NO: 661432 - DNA, 25 bp, Mus musculus
gtaacaatgttcatggttgtgattt

SEQ ID NO: 661433 - DNA, 25 bp, Mus musculus
gtaacaatgttcttggttgtgattt

SEQ ID NO: 661434 - DNA, 25 bp, Mus musculus
gtaacaatgttgactctcctcagaa

SEQ ID NO: 661435 - DNA, 25 bp, Mus musculus
gtaacaatgttgtctctcctcagaa

SEQ ID NO: 661436 - DNA, 25 bp, Mus musculus
gtaacaattactcatctccatgatg

SEQ ID NO: 661437 - DNA, 25 bp, Mus musculus
gtaacaattactgatctccatgatg

SEQ ID NO: 661438 - DNA, 25 bp, Mus musculus
gtaacaattgcaatggcctctcaaa

SEQ ID NO: 661439 - DNA, 25 bp, Mus musculus
gtaacaattgcattggcctctcaaa

SEQ ID NO: 661440 - DNA, 25 bp, Mus musculus
gtaacaattgctcttacagagtgat

SEQ ID NO: 661441 - DNA, 25 bp, Mus musculus
gtaacaattgctgttacagagtgat

SEQ ID NO: 661442 - DNA, 25 bp, Mus musculus
gtaacaattgtgaactctgggtaaa

SEQ ID NO: 661443 - DNA, 25 bp, Mus musculus
gtaacaattgtgtactctgggtaaa

SEQ ID NO: 661444 - DNA, 25 bp, Mus musculus
gtaacaatttgcatgctcctgaata

SEQ ID NO: 661445 - DNA, 25 bp, Mus musculus
gtaacaatttgcttgctcctgaata

SEQ ID NO: 661446 - DNA, 25 bp, Mus musculus
gtaacacaagccaccgacatcaata

SEQ ID NO: 661447 - DNA, 25 bp, Mus musculus
gtaacacaagcctccgacatcaata

SEQ ID NO: 661448 - DNA, 25 bp, Mus musculus
gtaacacacagaagtatctgactgt

SEQ ID NO: 661449 - DNA, 25 bp, Mus musculus
gtaacacacagatgtatctgactgt

SEQ ID NO: 661450 - DNA, 25 bp, Mus musculus
gtaacacacccacgttcaggaccat

SEQ ID NO: 661451 - DNA, 25 bp, Mus musculus
gtaacacacccaggttcaggaccat

SEQ ID NO: 661452 - DNA, 25 bp, Mus musculus
gtaacacacctgataggctctcaaa

SEQ ID NO: 661453 - DNA, 25 bp, Mus musculus
gtaacacacctgttaggctctcaaa

SEQ ID NO: 661454 - DNA, 25 bp, Mus musculus
gtaacacagccaaccgtagagcttt

SEQ ID NO: 661455 - DNA, 25 bp, Mus musculus
gtaacacagccatccgtagagcttt

SEQ ID NO: 661456 - DNA, 25 bp, Mus musculus
gtaacacagcttaaggaggtccaat

SEQ ID NO: 661457 - DNA, 25 bp, Mus musculus
gtaacacagcttatcagtcttctca

SEQ ID NO: 661458 - DNA, 25 bp, Mus musculus
gtaacacagcttccacatgaggcca

SEQ ID NO: 661459 - DNA, 25 bp, Mus musculus
gtaacacagcttgcacatgaggcca

SEQ ID NO: 661460 - DNA, 25 bp, Mus musculus
gtaacacagctttaggaggtccaat

SEQ ID NO: 661461 - DNA, 25 bp, Mus musculus
gtaacacagcttttcagtcttctca

SEQ ID NO: 661462 - DNA, 25 bp, Mus musculus
gtaacacaggccattaaccacagca

SEQ ID NO: 661463 - DNA, 25 bp, Mus musculus
gtaacacaggcctttaaccacagca

SEQ ID NO: 661464 - DNA, 25 bp, Mus musculus
gtaacacagttaactaagcagccag

SEQ ID NO: 661465 - DNA, 25 bp, Mus musculus
gtaacacagttatctaagcagccag

SEQ ID NO: 661466 - DNA, 25 bp, Mus musculus
gtaacacatacacactaaacaggct

SEQ ID NO: 661467 - DNA, 25 bp, Mus musculus
gtaacacatacagactaaacaggct

SEQ ID NO: 661468 - DNA, 25 bp, Mus musculus
gtaacacatcgcagcccctttattt

SEQ ID NO: 661469 - DNA, 25 bp, Mus musculus
gtaacacatcgctgcccctttattt

SEQ ID NO: 661470 - DNA, 25 bp, Mus musculus
gtaacacatggacccattgctgttg

SEQ ID NO: 661471 - DNA, 25 bp, Mus musculus
gtaacacatggagccattgctgttg

SEQ ID NO: 661472 - DNA, 25 bp, Mus musculus
gtaacaccaagccagtgagcctgtc

SEQ ID NO: 661473 - DNA, 25 bp, Mus musculus
gtaacaccaagcgagtgagcctgtc

SEQ ID NO: 661474 - DNA, 25 bp, Mus musculus
gtaacaccacatactgaagtctcca

SEQ ID NO: 661475 - DNA, 25 bp, Mus musculus
gtaacaccacattctgaagtctcca

SEQ ID NO: 661476 - DNA, 25 bp, Mus musculus
gtaacacccagccagaaaagaattt

SEQ ID NO: 661477 - DNA, 25 bp, Mus musculus
gtaacacccagcgagaaaagaattt

SEQ ID NO: 661478 - DNA, 25 bp, Mus musculus
gtaacaccctgccatgagtgatgtg

SEQ ID NO: 661479 - DNA, 25 bp, Mus musculus
gtaacaccctgcgatgagtgatgtg

SEQ ID NO: 661480 - DNA, 25 bp, Mus musculus
gtaacaccggatctaccatgtatgg

SEQ ID NO: 661481 - DNA, 25 bp, Mus musculus
gtaacaccggatgtaccatgtatgg

SEQ ID NO: 661482 - DNA, 25 bp, Mus musculus
gtaacaccgtttccagaggatctgc

SEQ ID NO: 661483 - DNA, 25 bp, Mus musculus
gtaacaccgtttgcagaggatctgc

SEQ ID NO: 661484 - DNA, 25 bp, Mus musculus
gtaacacctcagagggcaaccaata

SEQ ID NO: 661485 - DNA, 25 bp, Mus musculus
gtaacacctcagtgggcaaccaata

SEQ ID NO: 661486 - DNA, 25 bp, Mus musculus
gtaacacctgagctaagagtggcag

SEQ ID NO: 661487 - DNA, 25 bp, Mus musculus
gtaacacctgaggtaagagtggcag

SEQ ID NO: 661488 - DNA, 25 bp, Mus musculus
gtaacacctgttcatctatgtcata

SEQ ID NO: 661489 - DNA, 25 bp, Mus musculus
gtaacacctgttgatctatgtcata

SEQ ID NO: 661490 - DNA, 25 bp, Mus musculus
gtaacaccttttaagttcactgatt

SEQ ID NO: 661491 - DNA, 25 bp, Mus musculus
gtaacacctttttagttcactgatt

SEQ ID NO: 661492 - DNA, 25 bp, Mus musculus
gtaacacgaaacaagcacttccttt

SEQ ID NO: 661493 - DNA, 25 bp, Mus musculus
gtaacacgaaactagcacttccttt

SEQ ID NO: 661494 - DNA, 25 bp, Mus musculus
gtaacacgaagtaccgaggacacat

SEQ ID NO: 661495 - DNA, 25 bp, Mus musculus
gtaacacgaagttccgaggacacat

SEQ ID NO: 661496 - DNA, 25 bp, Mus musculus
gtaacacgacgcacaatagcaaaat

SEQ ID NO: 661497 - DNA, 25 bp, Mus musculus
gtaacacgacgctcaatagcaaaat

SEQ ID NO: 661498 - DNA, 25 bp, Mus musculus
gtaacacgtaccatcctgttgtaat

SEQ ID NO: 661499 - DNA, 25 bp, Mus musculus
gtaacacgtaccttcctgttgtaat

SEQ ID NO: 661500 - DNA, 25 bp, Mus musculus
gtaacacgtcaaacatctggctctg

SEQ ID NO: 661501 - DNA, 25 bp, Mus musculus
gtaacacgtcaatcatctggctctg

SEQ ID NO: 661502 - DNA, 25 bp, Mus musculus
gtaacacgtgtactccagcaaggcc

SEQ ID NO: 661503 - DNA, 25 bp, Mus musculus
gtaacacgtgtagtccagcaaggcc

SEQ ID NO: 661504 - DNA, 25 bp, Mus musculus
gtaacactaattctctttctcttta

SEQ ID NO: 661505 - DNA, 25 bp, Mus musculus
gtaacactaattgtctttctcttta

SEQ ID NO: 661506 - DNA, 25 bp, Mus musculus
gtaacactacctagttggtgctaga

SEQ ID NO: 661507 - DNA, 25 bp, Mus musculus
gtaacactaccttgttggtgctaga

SEQ ID NO: 661508 - DNA, 25 bp, Mus musculus
gtaacactatcaactgttctgacac

SEQ ID NO: 661509 - DNA, 25 bp, Mus musculus
gtaacactatcatctgttctgacac

SEQ ID NO: 661510 - DNA, 25 bp, Mus musculus
gtaacactatgtagcctaagctggt

SEQ ID NO: 661511 - DNA, 25 bp, Mus musculus
gtaacactatgttgcctaagctggt

SEQ ID NO: 661512 - DNA, 25 bp, Mus musculus
gtaacactcacgacagaagtttgac

SEQ ID NO: 661513 - DNA, 25 bp, Mus musculus
gtaacactcacgtcagaagtttgac

SEQ ID NO: 661514 - DNA, 25 bp, Mus musculus
gtaacactccttagaagtctagaaa

SEQ ID NO: 661515 - DNA, 25 bp, Mus musculus
gtaacactcctttgaagtctagaaa

SEQ ID NO: 661516 - DNA, 25 bp, Mus musculus
gtaacactcgttctatagctgctta

SEQ ID NO: 661517 - DNA, 25 bp, Mus musculus
gtaacactcgttgtatagctgctta

SEQ ID NO: 661518 - DNA, 25 bp, Mus musculus
gtaacactctcacatttcctaaagg

SEQ ID NO: 661519 - DNA, 25 bp, Mus musculus
gtaacactctcagatttcctaaagg

SEQ ID NO: 661520 - DNA, 25 bp, Mus musculus
gtaacactctggctacagttttagg

SEQ ID NO: 661521 - DNA, 25 bp, Mus musculus
gtaacactctgggtacagttttagg

SEQ ID NO: 661522 - DNA, 25 bp, Mus musculus
gtaacactgactacataggctccgc

SEQ ID NO: 661523 - DNA, 25 bp, Mus musculus
gtaacactgacttcataggctccgc

SEQ ID NO: 661524 - DNA, 25 bp, Mus musculus
gtaacactgattcacctaaatatgc

SEQ ID NO: 661525 - DNA, 25 bp, Mus musculus
gtaacactgattgacctaaatatgc

SEQ ID NO: 661526 - DNA, 25 bp, Mus musculus
gtaacactggcaacaatgggcttgt

SEQ ID NO: 661527 - DNA, 25 bp, Mus musculus
gtaacactggcatcaatgggcttgt

SEQ ID NO: 661528 - DNA, 25 bp, Mus musculus
gtaacactgtaaacacagggccttc

SEQ ID NO: 661529 - DNA, 25 bp, Mus musculus
gtaacactgtaatcacagggccttc

SEQ ID NO: 661530 - DNA, 25 bp, Mus musculus
gtaacactgtacatgcgatttcccc

SEQ ID NO: 661531 - DNA, 25 bp, Mus musculus
gtaacactgtacttgcgatttcccc

SEQ ID NO: 661532 - DNA, 25 bp, Mus musculus
gtaacactgtgtcgatgaatcccgg

SEQ ID NO: 661533 - DNA, 25 bp, Mus musculus
gtaacactgtgtggatgaatcccgg

SEQ ID NO: 661534 - DNA, 25 bp, Mus musculus
gtaacacttagcctaaataacccat

SEQ ID NO: 661535 - DNA, 25 bp, Mus musculus
gtaacacttagcgtaaataacccat

SEQ ID NO: 661536 - DNA, 25 bp, Mus musculus
gtaacacttattatagcttgcatat

SEQ ID NO: 661537 - DNA, 25 bp, Mus musculus
gtaacacttattttagcttgcatat

SEQ ID NO: 661538 - DNA, 25 bp, Mus musculus
gtaacacttcagcttcatgacgctt

SEQ ID NO: 661539 - DNA, 25 bp, Mus musculus
gtaacacttcaggttcatgacgctt

SEQ ID NO: 661540 - DNA, 25 bp, Mus musculus
gtaacactttgtaacacactttaga

SEQ ID NO: 661541 - DNA, 25 bp, Mus musculus
gtaacactttgttacacactttaga

SEQ ID NO: 661542 - DNA, 25 bp, Mus musculus
gtaacagaatcaaggagactctcaa

SEQ ID NO: 661543 - DNA, 25 bp, Mus musculus
gtaacagaatcatggagactctcaa

SEQ ID NO: 661544 - DNA, 25 bp, Mus musculus
gtaacagaatctagcctctagcaat

SEQ ID NO: 661545 - DNA, 25 bp, Mus musculus
gtaacagaatcttgcctctagcaat

SEQ ID NO: 661546 - DNA, 25 bp, Mus musculus
gtaacagacagcagcacgtgaccga

SEQ ID NO: 661547 - DNA, 25 bp, Mus musculus
gtaacagacagctgcacgtgaccga

SEQ ID NO: 661548 - DNA, 25 bp, Mus musculus
gtaacagacatgacacagcggcctt

SEQ ID NO: 661549 - DNA, 25 bp, Mus musculus
gtaacagacatgtcacagcggcctt

SEQ ID NO: 661550 - DNA, 25 bp, Mus musculus
gtaacagacttacattccagtcggg

SEQ ID NO: 661551 - DNA, 25 bp, Mus musculus
gtaacagacttagattccagtcggg

SEQ ID NO: 661552 - DNA, 25 bp, Mus musculus
gtaacagaggcaatacccctttcag

SEQ ID NO: 661553 - DNA, 25 bp, Mus musculus
gtaacagaggcattacccctttcag

SEQ ID NO: 661554 - DNA, 25 bp, Mus musculus
gtaacagaggttatggttccccaag

SEQ ID NO: 661555 - DNA, 25 bp, Mus musculus
gtaacagaggttttggttccccaag

SEQ ID NO: 661556 - DNA, 25 bp, Mus musculus
gtaacagatacgctttcctcaaggg

SEQ ID NO: 661557 - DNA, 25 bp, Mus musculus
gtaacagatacggtttcctcaaggg

SEQ ID NO: 661558 - DNA, 25 bp, Mus musculus
gtaacagatcaaacaccggcgctaa

SEQ ID NO: 661559 - DNA, 25 bp, Mus musculus
gtaacagatcaatcaccggcgctaa

SEQ ID NO: 661560 - DNA, 25 bp, Mus musculus
gtaacagatccccagtctttagtcc

SEQ ID NO: 661561 - DNA, 25 bp, Mus musculus
gtaacagatcccgagtctttagtcc

SEQ ID NO: 661562 - DNA, 25 bp, Mus musculus
gtaacagatgttagccattaaacct

SEQ ID NO: 661563 - DNA, 25 bp, Mus musculus
gtaacagatgtttgccattaaacct

SEQ ID NO: 661564 - DNA, 25 bp, Mus musculus
gtaacagcacagctgagccttttca

SEQ ID NO: 661565 - DNA, 25 bp, Mus musculus
gtaacagcacaggtgagccttttca

SEQ ID NO: 661566 - DNA, 25 bp, Mus musculus
gtaacagcacatctccaagtcaaca

SEQ ID NO: 661567 - DNA, 25 bp, Mus musculus
gtaacagcacatgtccaagtcaaca

SEQ ID NO: 661568 - DNA, 25 bp, Mus musculus
gtaacagcacttaaaaagggcgaca

SEQ ID NO: 661569 - DNA, 25 bp, Mus musculus
gtaacagcactttaaaagggcgaca

SEQ ID NO: 661570 - DNA, 25 bp, Mus musculus
gtaacagcagaaacctatccttcct

SEQ ID NO: 661571 - DNA, 25 bp, Mus musculus
gtaacagcagaatcctatccttcct

SEQ ID NO: 661572 - DNA, 25 bp, Mus musculus
gtaacagcagagaaacataaaaata

SEQ ID NO: 661573 - DNA, 25 bp, Mus musculus
gtaacagcagagtaacataaaaata

SEQ ID NO: 661574 - DNA, 25 bp, Mus musculus
gtaacagcagctatccaagcctaag

SEQ ID NO: 661575 - DNA, 25 bp, Mus musculus
gtaacagcagctttccaagcctaag

SEQ ID NO: 661576 - DNA, 25 bp, Mus musculus
gtaacagcaggacttcggctttaga

SEQ ID NO: 661577 - DNA, 25 bp, Mus musculus
gtaacagcaggagttcggctttaga

SEQ ID NO: 661578 - DNA, 25 bp, Mus musculus
gtaacagccatcctttgggtcttga

SEQ ID NO: 661579 - DNA, 25 bp, Mus musculus
gtaacagccatcgtttgggtcttga

SEQ ID NO: 661580 - DNA, 25 bp, Mus musculus
gtaacagccattctcttctattaag

SEQ ID NO: 661581 - DNA, 25 bp, Mus musculus
gtaacagccattgtcttctattaag

SEQ ID NO: 661582 - DNA, 25 bp, Mus musculus
gtaacagcgaagcagacatccctaa

SEQ ID NO: 661583 - DNA, 25 bp, Mus musculus
gtaacagcgaaggagacatccctaa

SEQ ID NO: 661584 - DNA, 25 bp, Mus musculus
gtaacagcggccaaatccagctaat

SEQ ID NO: 661585 - DNA, 25 bp, Mus musculus
gtaacagcggcctaatccagctaat

SEQ ID NO: 661586 - DNA, 25 bp, Mus musculus
gtaacagctactctcttcagttgct

SEQ ID NO: 661587 - DNA, 25 bp, Mus musculus
gtaacagctactgtcttcagttgct

SEQ ID NO: 661588 - DNA, 25 bp, Mus musculus
gtaacagctagcattcagcatccag

SEQ ID NO: 661589 - DNA, 25 bp, Mus musculus
gtaacagctagctttcagcatccag

SEQ ID NO: 661590 - DNA, 25 bp, Mus musculus
gtaacagctataccaccggagtggt

SEQ ID NO: 661591 - DNA, 25 bp, Mus musculus
gtaacagctatagcaccggagtggt

SEQ ID NO: 661592 - DNA, 25 bp, Mus musculus
gtaacagcttgtcttactaccagtc

SEQ ID NO: 661593 - DNA, 25 bp, Mus musculus
gtaacagcttgtgttactaccagtc

SEQ ID NO: 661594 - DNA, 25 bp, Mus musculus
gtaacaggacacaattaccgtgggt

SEQ ID NO: 661595 - DNA, 25 bp, Mus musculus
gtaacaggacactattaccgtgggt

SEQ ID NO: 661596 - DNA, 25 bp, Mus musculus
gtaacaggaccactagctaactttt

SEQ ID NO: 661597 - DNA, 25 bp, Mus musculus
gtaacaggaccagtagctaactttt

SEQ ID NO: 661598 - DNA, 25 bp, Mus musculus
gtaacaggacctcgctcagcatctg

SEQ ID NO: 661599 - DNA, 25 bp, Mus musculus
gtaacaggacctggctcagcatctg

SEQ ID NO: 661600 - DNA, 25 bp, Mus musculus
gtaacaggagagacctcgctggctc

SEQ ID NO: 661601 - DNA, 25 bp, Mus musculus
gtaacaggagagtcctcgctggctc

SEQ ID NO: 661602 - DNA, 25 bp, Mus musculus
gtaacaggccaaacataccaagcac

SEQ ID NO: 661603 - DNA, 25 bp, Mus musculus
gtaacaggccaatcataccaagcac

SEQ ID NO: 661604 - DNA, 25 bp, Mus musculus
gtaacaggctgcatcctgctgagga

SEQ ID NO: 661605 - DNA, 25 bp, Mus musculus
gtaacaggctgcttcctgctgagga

SEQ ID NO: 661606 - DNA, 25 bp, Mus musculus
gtaacagggttgatcccacatgcag

SEQ ID NO: 661607 - DNA, 25 bp, Mus musculus
gtaacagggttgttcccacatgcag

SEQ ID NO: 661608 - DNA, 25 bp, Mus musculus
gtaacaggtacaatggtcagaagtg

SEQ ID NO: 661609 - DNA, 25 bp, Mus musculus
gtaacaggtacattggtcagaagtg

SEQ ID NO: 661610 - DNA, 25 bp, Mus musculus
gtaacaggtttaaccgagatgatca

SEQ ID NO: 661611 - DNA, 25 bp, Mus musculus
gtaacaggtttatccgagatgatca

SEQ ID NO: 661612 - DNA, 25 bp, Mus musculus
gtaacagtacatcatcctgggtgat

SEQ ID NO: 661613 - DNA, 25 bp, Mus musculus
gtaacagtacatgatcctgggtgat

SEQ ID NO: 661614 - DNA, 25 bp, Mus musculus
gtaacagtagctccaaatcgacttt

SEQ ID NO: 661615 - DNA, 25 bp, Mus musculus
gtaacagtagctgcaaatcgacttt

SEQ ID NO: 661616 - DNA, 25 bp, Mus musculus
gtaacagtagtgaggtgctctttaa

SEQ ID NO: 661617 - DNA, 25 bp, Mus musculus
gtaacagtagtgtggtgctctttaa

SEQ ID NO: 661618 - DNA, 25 bp, Mus musculus
gtaacagtattcataatgctctaat

SEQ ID NO: 661619 - DNA, 25 bp, Mus musculus
gtaacagtattcttaatgctctaat

SEQ ID NO: 661620 - DNA, 25 bp, Mus musculus
gtaacagtattgagtcttcccacag

SEQ ID NO: 661621 - DNA, 25 bp, Mus musculus
gtaacagtattgtgtcttcccacag

SEQ ID NO: 661622 - DNA, 25 bp, Mus musculus
gtaacagtgcctaaaagtggccttt

SEQ ID NO: 661623 - DNA, 25 bp, Mus musculus
gtaacagtgccttaaagtggccttt

SEQ ID NO: 661624 - DNA, 25 bp, Mus musculus
gtaacagtgctaagtgtgctcagta

SEQ ID NO: 661625 - DNA, 25 bp, Mus musculus
gtaacagtgctatgtgtgctcagta

SEQ ID NO: 661626 - DNA, 25 bp, Mus musculus
gtaacagttgttaagctcagggcaa

SEQ ID NO: 661627 - DNA, 25 bp, Mus musculus
gtaacagttgtttagctcagggcaa

SEQ ID NO: 661628 - DNA, 25 bp, Mus musculus
gtaacataaacccaagttatctgtg

SEQ ID NO: 661629 - DNA, 25 bp, Mus musculus
gtaacataaaccgaagttatctgtg

SEQ ID NO: 661630 - DNA, 25 bp, Mus musculus
gtaacataaccgatgtctgctcttt

SEQ ID NO: 661631 - DNA, 25 bp, Mus musculus
gtaacataaccgttgtctgctcttt

SEQ ID NO: 661632 - DNA, 25 bp, Mus musculus
gtaacataactgcttcttggagctt

SEQ ID NO: 661633 - DNA, 25 bp, Mus musculus
gtaacataactggttcttggagctt

SEQ ID NO: 661634 - DNA, 25 bp, Mus musculus
gtaacatacaagactttacaacggg

SEQ ID NO: 661635 - DNA, 25 bp, Mus musculus
gtaacatacaagtctttacaacggg

SEQ ID NO: 661636 - DNA, 25 bp, Mus musculus
gtaacatacattaaggcacttgtga

SEQ ID NO: 661637 - DNA, 25 bp, Mus musculus
gtaacatacatttaggcacttgtga

SEQ ID NO: 661638 - DNA, 25 bp, Mus musculus
gtaacataccttattctgtggcttt

SEQ ID NO: 661639 - DNA, 25 bp, Mus musculus
gtaacatacctttttctgtggcttt

SEQ ID NO: 661640 - DNA, 25 bp, Mus musculus
gtaacatagaggatgagtcgtttct

SEQ ID NO: 661641 - DNA, 25 bp, Mus musculus
gtaacatagaggttgagtcgtttct

SEQ ID NO: 661642 - DNA, 25 bp, Mus musculus
gtaacatagtatatatccagtattc

SEQ ID NO: 661643 - DNA, 25 bp, Mus musculus
gtaacatagtatttatccagtattc

SEQ ID NO: 661644 - DNA, 25 bp, Mus musculus
gtaacatatgtaatcagtccccaag

SEQ ID NO: 661645 - DNA, 25 bp, Mus musculus
gtaacatatgtattcagtccccaag

SEQ ID NO: 661646 - DNA, 25 bp, Mus musculus
gtaacatcagagaagaggcagtaca

SEQ ID NO: 661647 - DNA, 25 bp, Mus musculus
gtaacatcagagtagaggcagtaca

SEQ ID NO: 661648 - DNA, 25 bp, Mus musculus
gtaacatcagcacatcacactcacg

SEQ ID NO: 661649 - DNA, 25 bp, Mus musculus
gtaacatcagcagatcacactcacg

SEQ ID NO: 661650 - DNA, 25 bp, Mus musculus
gtaacatcatatatgcacatccata

SEQ ID NO: 661651 - DNA, 25 bp, Mus musculus
gtaacatcatatttgcacatccata

SEQ ID NO: 661652 - DNA, 25 bp, Mus musculus
gtaacatcctggactggactgtcta

SEQ ID NO: 661653 - DNA, 25 bp, Mus musculus
gtaacatcctggtctggactgtcta

SEQ ID NO: 661654 - DNA, 25 bp, Mus musculus
gtaacatcgtgtattcatggtcatt

SEQ ID NO: 661655 - DNA, 25 bp, Mus musculus
gtaacatcgtgttttcatggtcatt

SEQ ID NO: 661656 - DNA, 25 bp, Mus musculus
gtaacatctactagaatagcgtcca

SEQ ID NO: 661657 - DNA, 25 bp, Mus musculus
gtaacatctacttgaatagcgtcca

SEQ ID NO: 661658 - DNA, 25 bp, Mus musculus
gtaacatctcacactattaatacca

SEQ ID NO: 661659 - DNA, 25 bp, Mus musculus
gtaacatctcactctattaatacca

SEQ ID NO: 661660 - DNA, 25 bp, Mus musculus
gtaacatcttaacagtgcctttctg

SEQ ID NO: 661661 - DNA, 25 bp, Mus musculus
gtaacatcttaagagtgcctttctg

SEQ ID NO: 661662 - DNA, 25 bp, Mus musculus
gtaacatgaactctggccctccaag

SEQ ID NO: 661663 - DNA, 25 bp, Mus musculus
gtaacatgaactgtggccctccaag

SEQ ID NO: 661664 - DNA, 25 bp, Mus musculus
gtaacatgatataggtatccctacc

SEQ ID NO: 661665 - DNA, 25 bp, Mus musculus
gtaacatgatattggtatccctacc

SEQ ID NO: 661666 - DNA, 25 bp, Mus musculus
gtaacatgcagaccgatcaggttat

SEQ ID NO: 661667 - DNA, 25 bp, Mus musculus
gtaacatgcagagcgatcaggttat

SEQ ID NO: 661668 - DNA, 25 bp, Mus musculus
gtaacatgccacactgttggctgat

SEQ ID NO: 661669 - DNA, 25 bp, Mus musculus
gtaacatgccactctgttggctgat

SEQ ID NO: 661670 - DNA, 25 bp, Mus musculus
gtaacatgccagatcaacttggtca

SEQ ID NO: 661671 - DNA, 25 bp, Mus musculus
gtaacatgccagttcaacttggtca

SEQ ID NO: 661672 - DNA, 25 bp, Mus musculus
gtaacatgctgacatcctactttca

SEQ ID NO: 661673 - DNA, 25 bp, Mus musculus
gtaacatgctgagatcctactttca

SEQ ID NO: 661674 - DNA, 25 bp, Mus musculus
gtaacatgcttcacttatttcctcc

SEQ ID NO: 661675 - DNA, 25 bp, Mus musculus
gtaacatgcttctcttatttcctcc

SEQ ID NO: 661676 - DNA, 25 bp, Mus musculus
gtaacatggcacactttggacaaat

SEQ ID NO: 661677 - DNA, 25 bp, Mus musculus
gtaacatggcactctttggacaaat

SEQ ID NO: 661678 - DNA, 25 bp, Mus musculus
gtaacatggtttatatcgtgtccgt

SEQ ID NO: 661679 - DNA, 25 bp, Mus musculus
gtaacatggtttttatcgtgtccgt

SEQ ID NO: 661680 - DNA, 25 bp, Mus musculus
gtaacatgtctcatagagtcctgag

SEQ ID NO: 661681 - DNA, 25 bp, Mus musculus
gtaacatgtctcttagagtcctgag

SEQ ID NO: 661682 - DNA, 25 bp, Mus musculus
gtaacatgtctgaggctacttctcc

SEQ ID NO: 661683 - DNA, 25 bp, Mus musculus
gtaacatgtctgtggctacttctcc

SEQ ID NO: 661684 - DNA, 25 bp, Mus musculus
gtaacatgtgtaaccagatgctttt

SEQ ID NO: 661685 - DNA, 25 bp, Mus musculus
gtaacatgtgtatccagatgctttt

SEQ ID NO: 661686 - DNA, 25 bp, Mus musculus
gtaacatgttttcgacaatgtcact

SEQ ID NO: 661687 - DNA, 25 bp, Mus musculus
gtaacatgttttggacaatgtcact

SEQ ID NO: 661688 - DNA, 25 bp, Mus musculus
gtaacattagagcatccatccgtcc

SEQ ID NO: 661689 - DNA, 25 bp, Mus musculus
gtaacattagaggatccatccgtcc

SEQ ID NO: 661690 - DNA, 25 bp, Mus musculus
gtaacattagatagtgcgtgcatat

SEQ ID NO: 661691 - DNA, 25 bp, Mus musculus
gtaacattagattgtgcgtgcatat

SEQ ID NO: 661692 - DNA, 25 bp, Mus musculus
gtaacattcaggattatgcattgaa

SEQ ID NO: 661693 - DNA, 25 bp, Mus musculus
gtaacattcaggtttatgcattgaa

SEQ ID NO: 661694 - DNA, 25 bp, Mus musculus
gtaacattcataatttcacagtttg

SEQ ID NO: 661695 - DNA, 25 bp, Mus musculus
gtaacattcatattttcacagtttg

SEQ ID NO: 661696 - DNA, 25 bp, Mus musculus
gtaacattcatgagaccctggtttc

SEQ ID NO: 661697 - DNA, 25 bp, Mus musculus
gtaacattcatgtgaccctggtttc

SEQ ID NO: 661698 - DNA, 25 bp, Mus musculus
gtaacattgattccatagctcctta

SEQ ID NO: 661699 - DNA, 25 bp, Mus musculus
gtaacattgattgcatagctcctta

SEQ ID NO: 661700 - DNA, 25 bp, Mus musculus
gtaacattggctccctttgtgcaga

SEQ ID NO: 661701 - DNA, 25 bp, Mus musculus
gtaacattggctgcctttgtgcaga

SEQ ID NO: 661702 - DNA, 25 bp, Mus musculus
gtaacattgtacatgtggcaccacg

SEQ ID NO: 661703 - DNA, 25 bp, Mus musculus
gtaacattgtacttgtggcaccacg

SEQ ID NO: 661704 - DNA, 25 bp, Mus musculus
gtaacatttaaacaccatttgtgaa

SEQ ID NO: 661705 - DNA, 25 bp, Mus musculus
gtaacatttaaagaccatttgtgaa

SEQ ID NO: 661706 - DNA, 25 bp, Mus musculus
gtaacatttcagaagagcacaatat

SEQ ID NO: 661707 - DNA, 25 bp, Mus musculus
gtaacatttcagtagagcacaatat

SEQ ID NO: 661708 - DNA, 25 bp, Mus musculus
gtaacatttccaaactgtccctgag

SEQ ID NO: 661709 - DNA, 25 bp, Mus musculus
gtaacatttccatactgtccctgag

SEQ ID NO: 661710 - DNA, 25 bp, Mus musculus
gtaacatttctgcagttgccagatc

SEQ ID NO: 661711 - DNA, 25 bp, Mus musculus
gtaacatttctggagttgccagatc

SEQ ID NO: 661712 - DNA, 25 bp, Mus musculus
gtaacatttgtaacactgcactcgc

SEQ ID NO: 661713 - DNA, 25 bp, Mus musculus
gtaacatttgtatcactgcactcgc

SEQ ID NO: 661714 - DNA, 25 bp, Mus musculus
gtaacatttgtgcagcgcagttcaa

SEQ ID NO: 661715 - DNA, 25 bp, Mus musculus
gtaacatttgtggagcgcagttcaa

SEQ ID NO: 661716 - DNA, 25 bp, Mus musculus
gtaacattttgtagtctgagcaatt

SEQ ID NO: 661717 - DNA, 25 bp, Mus musculus
gtaacattttgttgtctgagcaatt

SEQ ID NO: 661718 - DNA, 25 bp, Mus musculus
gtaacatttttacatacgttgccat

SEQ ID NO: 661719 - DNA, 25 bp, Mus musculus
gtaacatttttagatacgttgccat

SEQ ID NO: 661720 - DNA, 25 bp, Mus musculus
gtaacatttttcctctaaccatatc

SEQ ID NO: 661721 - DNA, 25 bp, Mus musculus
gtaacatttttcgtctaaccatatc

SEQ ID NO: 661722 - DNA, 25 bp, Mus musculus
gtaaccaaacatcgctcttctgcaa

SEQ ID NO: 661723 - DNA, 25 bp, Mus musculus
gtaaccaaacatggctcttctgcaa

SEQ ID NO: 661724 - DNA, 25 bp, Mus musculus
gtaaccaaagacacggagacagagt

SEQ ID NO: 661725 - DNA, 25 bp, Mus musculus
gtaaccaaagactcggagacagagt

SEQ ID NO: 661726 - DNA, 25 bp, Mus musculus
gtaaccaaagatcacgcactttctc

SEQ ID NO: 661727 - DNA, 25 bp, Mus musculus
gtaaccaaagatgacgcactttctc

SEQ ID NO: 661728 - DNA, 25 bp, Mus musculus
gtaaccaaagctaccgcgttcccag

SEQ ID NO: 661729 - DNA, 25 bp, Mus musculus
gtaaccaaagcttccgcgttcccag

SEQ ID NO: 661730 - DNA, 25 bp, Mus musculus
gtaaccaacacacatccagtcctgg

SEQ ID NO: 661731 - DNA, 25 bp, Mus musculus
gtaaccaacacagatccagtcctgg

SEQ ID NO: 661732 - DNA, 25 bp, Mus musculus
gtaaccaacatcagaaaatccacct

SEQ ID NO: 661733 - DNA, 25 bp, Mus musculus
gtaaccaacatctgaaaatccacct

SEQ ID NO: 661734 - DNA, 25 bp, Mus musculus
gtaaccaactagagaagccaaggct

SEQ ID NO: 661735 - DNA, 25 bp, Mus musculus
gtaaccaactagtgaagccaaggct

SEQ ID NO: 661736 - DNA, 25 bp, Mus musculus
gtaaccaactgccttgcggaacttc

SEQ ID NO: 661737 - DNA, 25 bp, Mus musculus
gtaaccaactgcgttgcggaacttc

SEQ ID NO: 661738 - DNA, 25 bp, Mus musculus
gtaaccaagatcatcaaatgaacaa

SEQ ID NO: 661739 - DNA, 25 bp, Mus musculus
gtaaccaagatcttcaaatgaacaa

SEQ ID NO: 661740 - DNA, 25 bp, Mus musculus
gtaaccaagctacttcccaaacaat

SEQ ID NO: 661741 - DNA, 25 bp, Mus musculus
gtaaccaagctagttcccaaacaat

SEQ ID NO: 661742 - DNA, 25 bp, Mus musculus
gtaaccaagctcagaatttcccaag

SEQ ID NO: 661743 - DNA, 25 bp, Mus musculus
gtaaccaagctctgaatttcccaag

SEQ ID NO: 661744 - DNA, 25 bp, Mus musculus
gtaaccaagtgtctcctgattcttc

SEQ ID NO: 661745 - DNA, 25 bp, Mus musculus
gtaaccaagtgtgtcctgattcttc

SEQ ID NO: 661746 - DNA, 25 bp, Mus musculus
gtaaccaagttaacctggcctcctg

SEQ ID NO: 661747 - DNA, 25 bp, Mus musculus
gtaaccaagttatcctggcctcctg

SEQ ID NO: 661748 - DNA, 25 bp, Mus musculus
gtaaccaagtttccagtggcattat

SEQ ID NO: 661749 - DNA, 25 bp, Mus musculus
gtaaccaagtttgcagtggcattat

SEQ ID NO: 661750 - DNA, 25 bp, Mus musculus
gtaaccaataccactaataaaccag

SEQ ID NO: 661751 - DNA, 25 bp, Mus musculus
gtaaccaatacctctaataaaccag

SEQ ID NO: 661752 - DNA, 25 bp, Mus musculus
gtaaccacattcactacctagggat

SEQ ID NO: 661753 - DNA, 25 bp, Mus musculus
gtaaccacattcataccttgtgccc

SEQ ID NO: 661754 - DNA, 25 bp, Mus musculus
gtaaccacattctctacctagggat

SEQ ID NO: 661755 - DNA, 25 bp, Mus musculus
gtaaccacattcttaccttgtgccc

SEQ ID NO: 661756 - DNA, 25 bp, Mus musculus
gtaaccactgcgacaggtgtttctc

SEQ ID NO: 661757 - DNA, 25 bp, Mus musculus
gtaaccactgcgtcaggtgtttctc

SEQ ID NO: 661758 - DNA, 25 bp, Mus musculus
gtaaccactgctcagttgactgtgc

SEQ ID NO: 661759 - DNA, 25 bp, Mus musculus
gtaaccactgctgagttgactgtgc

SEQ ID NO: 661760 - DNA, 25 bp, Mus musculus
gtaaccactgtcactgtgaagccac

SEQ ID NO: 661761 - DNA, 25 bp, Mus musculus
gtaaccactgtctctgtgaagccac

SEQ ID NO: 661762 - DNA, 25 bp, Mus musculus
gtaaccacttcaaacagttcctcgt

SEQ ID NO: 661763 - DNA, 25 bp, Mus musculus
gtaaccacttcatacagttcctcgt

SEQ ID NO: 661764 - DNA, 25 bp, Mus musculus
gtaaccagaaggcttctaggcccta

SEQ ID NO: 661765 - DNA, 25 bp, Mus musculus
gtaaccagaagggttctaggcccta

SEQ ID NO: 661766 - DNA, 25 bp, Mus musculus
gtaaccagaatgagcctcctgaaag

SEQ ID NO: 661767 - DNA, 25 bp, Mus musculus
gtaaccagaatgctcctgaggcagc

SEQ ID NO: 661768 - DNA, 25 bp, Mus musculus
gtaaccagaatggtcctgaggcagc

SEQ ID NO: 661769 - DNA, 25 bp, Mus musculus
gtaaccagaatgtgcctcctgaaag

SEQ ID NO: 661770 - DNA, 25 bp, Mus musculus
gtaaccagagccatgcagaatgtgc

SEQ ID NO: 661771 - DNA, 25 bp, Mus musculus
gtaaccagagccttgcagaatgtgc

SEQ ID NO: 661772 - DNA, 25 bp, Mus musculus
gtaaccagagggagactaaccattg

SEQ ID NO: 661773 - DNA, 25 bp, Mus musculus
gtaaccagagggtgactaaccattg

SEQ ID NO: 661774 - DNA, 25 bp, Mus musculus
gtaaccagatagaccacacacacaa

SEQ ID NO: 661775 - DNA, 25 bp, Mus musculus
gtaaccagatagtccacacacacaa

SEQ ID NO: 661776 - DNA, 25 bp, Mus musculus
gtaaccagatctagagaaccagtgt

SEQ ID NO: 661777 - DNA, 25 bp, Mus musculus
gtaaccagatcttgagaaccagtgt

SEQ ID NO: 661778 - DNA, 25 bp, Mus musculus
gtaaccagatgcactgttggacctt

SEQ ID NO: 661779 - DNA, 25 bp, Mus musculus
gtaaccagatgctctgttggacctt

SEQ ID NO: 661780 - DNA, 25 bp, Mus musculus
gtaaccagattccaacagtgctttg

SEQ ID NO: 661781 - DNA, 25 bp, Mus musculus
gtaaccagattcgaacagtgctttg

SEQ ID NO: 661782 - DNA, 25 bp, Mus musculus
gtaaccagcaagcttctgcttttta

SEQ ID NO: 661783 - DNA, 25 bp, Mus musculus
gtaaccagcaaggttctgcttttta

SEQ ID NO: 661784 - DNA, 25 bp, Mus musculus
gtaaccagcaatcaggacctgccag

SEQ ID NO: 661785 - DNA, 25 bp, Mus musculus
gtaaccagcaatgaggacctgccag

SEQ ID NO: 661786 - DNA, 25 bp, Mus musculus
gtaaccagcatactcgtgttttatt

SEQ ID NO: 661787 - DNA, 25 bp, Mus musculus
gtaaccagcatagtcgtgttttatt

SEQ ID NO: 661788 - DNA, 25 bp, Mus musculus
gtaaccagcatgaacgacacactct

SEQ ID NO: 661789 - DNA, 25 bp, Mus musculus
gtaaccagcatgtacgacacactct

SEQ ID NO: 661790 - DNA, 25 bp, Mus musculus
gtaaccagccaaactacacagatgt

SEQ ID NO: 661791 - DNA, 25 bp, Mus musculus
gtaaccagccaatctacacagatgt

SEQ ID NO: 661792 - DNA, 25 bp, Mus musculus
gtaaccagcttgcagtctagcaatt

SEQ ID NO: 661793 - DNA, 25 bp, Mus musculus
gtaaccagcttggagtctagcaatt

SEQ ID NO: 661794 - DNA, 25 bp, Mus musculus
gtaaccaggagcaccatttcaggat

SEQ ID NO: 661795 - DNA, 25 bp, Mus musculus
gtaaccaggagctccatttcaggat

SEQ ID NO: 661796 - DNA, 25 bp, Mus musculus
gtaaccagtagcctctgtgtgtgcg

SEQ ID NO: 661797 - DNA, 25 bp, Mus musculus
gtaaccagtagcgtctgtgtgtgcg

SEQ ID NO: 661798 - DNA, 25 bp, Mus musculus
gtaaccagtataaatctcagctcac

SEQ ID NO: 661799 - DNA, 25 bp, Mus musculus
gtaaccagtatatatctcagctcac

SEQ ID NO: 661800 - DNA, 25 bp, Mus musculus
gtaaccagtcacctgctagcaattg

SEQ ID NO: 661801 - DNA, 25 bp, Mus musculus
gtaaccagtcacgtgctagcaattg

SEQ ID NO: 661802 - DNA, 25 bp, Mus musculus
gtaaccagttgacccttcacacaga

SEQ ID NO: 661803 - DNA, 25 bp, Mus musculus
gtaaccagttgagccttcacacaga

SEQ ID NO: 661804 - DNA, 25 bp, Mus musculus
gtaaccataccgatcaaattcccag

SEQ ID NO: 661805 - DNA, 25 bp, Mus musculus
gtaaccataccgttcaaattcccag

SEQ ID NO: 661806 - DNA, 25 bp, Mus musculus
gtaaccatagcaaccagaatcgata

SEQ ID NO: 661807 - DNA, 25 bp, Mus musculus
gtaaccatagcatccagaatcgata

SEQ ID NO: 661808 - DNA, 25 bp, Mus musculus
gtaaccataggaactcagcatttat

SEQ ID NO: 661809 - DNA, 25 bp, Mus musculus
gtaaccataggatctcagcatttat

SEQ ID NO: 661810 - DNA, 25 bp, Mus musculus
gtaaccatatcacctgggagtattt

SEQ ID NO: 661811 - DNA, 25 bp, Mus musculus
gtaaccatatcagctgggagtattt

SEQ ID NO: 661812 - DNA, 25 bp, Mus musculus
gtaaccatccggaccaggaagttca

SEQ ID NO: 661813 - DNA, 25 bp, Mus musculus
gtaaccatccggtccaggaagttca

SEQ ID NO: 661814 - DNA, 25 bp, Mus musculus
gtaaccatccttcaaatgactgtcc

SEQ ID NO: 661815 - DNA, 25 bp, Mus musculus
gtaaccatccttgaaatgactgtcc

SEQ ID NO: 661816 - DNA, 25 bp, Mus musculus
gtaaccatctacatatgtcctcatg

SEQ ID NO: 661817 - DNA, 25 bp, Mus musculus
gtaaccatctacttatgtcctcatg

SEQ ID NO: 661818 - DNA, 25 bp, Mus musculus
gtaaccatctggaatgaccacatct

SEQ ID NO: 661819 - DNA, 25 bp, Mus musculus
gtaaccatctggtatgaccacatct

SEQ ID NO: 661820 - DNA, 25 bp, Mus musculus
gtaaccatcttcaacaacctgtctt

SEQ ID NO: 661821 - DNA, 25 bp, Mus musculus
gtaaccatcttctacaacctgtctt

SEQ ID NO: 661822 - DNA, 25 bp, Mus musculus
gtaaccatgtatctactctgccaag

SEQ ID NO: 661823 - DNA, 25 bp, Mus musculus
gtaaccatgtatgtactctgccaag

SEQ ID NO: 661824 - DNA, 25 bp, Mus musculus
gtaaccatgtgcctgggccgaagta

SEQ ID NO: 661825 - DNA, 25 bp, Mus musculus
gtaaccatgtgcgtgggccgaagta

SEQ ID NO: 661826 - DNA, 25 bp, Mus musculus
gtaaccattccaataccacactcta

SEQ ID NO: 661827 - DNA, 25 bp, Mus musculus
gtaaccattccattaccacactcta

SEQ ID NO: 661828 - DNA, 25 bp, Mus musculus
gtaaccatttttccttatagtaggg

SEQ ID NO: 661829 - DNA, 25 bp, Mus musculus
gtaaccatttttgcttatagtaggg

SEQ ID NO: 661830 - DNA, 25 bp, Mus musculus
gtaacccaaagactcttagctatta

SEQ ID NO: 661831 - DNA, 25 bp, Mus musculus
gtaacccaaagagtcttagctatta

SEQ ID NO: 661832 - DNA, 25 bp, Mus musculus
gtaacccaagagcttagagccttca

SEQ ID NO: 661833 - DNA, 25 bp, Mus musculus
gtaacccaagaggttagagccttca

SEQ ID NO: 661834 - DNA, 25 bp, Mus musculus
gtaacccaatcacgacattcaggca

SEQ ID NO: 661835 - DNA, 25 bp, Mus musculus
gtaacccaatcaggacattcaggca

SEQ ID NO: 661836 - DNA, 25 bp, Mus musculus
gtaacccaatgtctgggtttttcat

SEQ ID NO: 661837 - DNA, 25 bp, Mus musculus
gtaacccaatgtgtgggtttttcat

SEQ ID NO: 661838 - DNA, 25 bp, Mus musculus
gtaacccacagaacatctgatcttt

SEQ ID NO: 661839 - DNA, 25 bp, Mus musculus
gtaacccacagatcatctgatcttt

SEQ ID NO: 661840 - DNA, 25 bp, Mus musculus
gtaacccagaagactgccgagcgct

SEQ ID NO: 661841 - DNA, 25 bp, Mus musculus
gtaacccagaagtctgccgagcgct

SEQ ID NO: 661842 - DNA, 25 bp, Mus musculus
gtaacccaggatacatctgtacaca

SEQ ID NO: 661843 - DNA, 25 bp, Mus musculus
gtaacccaggattcatctgtacaca

SEQ ID NO: 661844 - DNA, 25 bp, Mus musculus
gtaacccaggcacctggtactgaat

SEQ ID NO: 661845 - DNA, 25 bp, Mus musculus
gtaacccaggcagctggtactgaat

SEQ ID NO: 661846 - DNA, 25 bp, Mus musculus
gtaacccaggtgctcattaagaggt

SEQ ID NO: 661847 - DNA, 25 bp, Mus musculus
gtaacccaggtggtcattaagaggt

SEQ ID NO: 661848 - DNA, 25 bp, Mus musculus
gtaacccagtgaagatcgatgccat

SEQ ID NO: 661849 - DNA, 25 bp, Mus musculus
gtaacccagtgatgatcgatgccat

SEQ ID NO: 661850 - DNA, 25 bp, Mus musculus
gtaacccagttaattaggagtgcaa

SEQ ID NO: 661851 - DNA, 25 bp, Mus musculus
gtaacccagttatttaggagtgcaa

SEQ ID NO: 661852 - DNA, 25 bp, Mus musculus
gtaacccatatcaactgttctggcg

SEQ ID NO: 661853 - DNA, 25 bp, Mus musculus
gtaacccatatctactgttctggcg

SEQ ID NO: 661854 - DNA, 25 bp, Mus musculus
gtaacccattatatcagcccattat

SEQ ID NO: 661855 - DNA, 25 bp, Mus musculus
gtaacccattatttcagcccattat

SEQ ID NO: 661856 - DNA, 25 bp, Mus musculus
gtaaccccaaaactgcagtgctatt

SEQ ID NO: 661857 - DNA, 25 bp, Mus musculus
gtaaccccaaaagtgcagtgctatt

SEQ ID NO: 661858 - DNA, 25 bp, Mus musculus
gtaaccccaataaaggcatactcag

SEQ ID NO: 661859 - DNA, 25 bp, Mus musculus
gtaaccccaatataggcatactcag

SEQ ID NO: 661860 - DNA, 25 bp, Mus musculus
gtaaccccagcgaaaaggcattatg

SEQ ID NO: 661861 - DNA, 25 bp, Mus musculus
gtaaccccagcgtaaaggcattatg

SEQ ID NO: 661862 - DNA, 25 bp, Mus musculus
gtaaccccagctatgtaaccttgat

SEQ ID NO: 661863 - DNA, 25 bp, Mus musculus
gtaaccccagctttgtaaccttgat

SEQ ID NO: 661864 - DNA, 25 bp, Mus musculus
gtaaccccagggactcaggcagaga

SEQ ID NO: 661865 - DNA, 25 bp, Mus musculus
gtaaccccagggtctcaggcagaga

SEQ ID NO: 661866 - DNA, 25 bp, Mus musculus
gtaaccccgactcaggaaagcagct

SEQ ID NO: 661867 - DNA, 25 bp, Mus musculus
gtaaccccgactgaggaaagcagct

SEQ ID NO: 661868 - DNA, 25 bp, Mus musculus
gtaacccctcacagtatttagtcac

SEQ ID NO: 661869 - DNA, 25 bp, Mus musculus
gtaacccctcactgtatttagtcac

SEQ ID NO: 661870 - DNA, 25 bp, Mus musculus
gtaaccccttcaatggagtggctta

SEQ ID NO: 661871 - DNA, 25 bp, Mus musculus
gtaaccccttcattggagtggctta

SEQ ID NO: 661872 - DNA, 25 bp, Mus musculus
gtaaccctcaacacaaattcacttt

SEQ ID NO: 661873 - DNA, 25 bp, Mus musculus
gtaaccctcaactcaaattcacttt

SEQ ID NO: 661874 - DNA, 25 bp, Mus musculus
gtaaccctctcccatataacactat

SEQ ID NO: 661875 - DNA, 25 bp, Mus musculus
gtaaccctctccgatataacactat

SEQ ID NO: 661876 - DNA, 25 bp, Mus musculus
gtaaccctctgtcctcactggaaga

SEQ ID NO: 661877 - DNA, 25 bp, Mus musculus
gtaaccctctgtgctcactggaaga

SEQ ID NO: 661878 - DNA, 25 bp, Mus musculus
gtaaccctgagaaagccagcatgtt

SEQ ID NO: 661879 - DNA, 25 bp, Mus musculus
gtaaccctgagatagccagcatgtt

SEQ ID NO: 661880 - DNA, 25 bp, Mus musculus
gtaaccctgaggcatccagaggtat

SEQ ID NO: 661881 - DNA, 25 bp, Mus musculus
gtaaccctgagggatccagaggtat

SEQ ID NO: 661882 - DNA, 25 bp, Mus musculus
gtaaccctgccaatttttggtaatg

SEQ ID NO: 661883 - DNA, 25 bp, Mus musculus
gtaaccctgccattttttggtaatg

SEQ ID NO: 661884 - DNA, 25 bp, Mus musculus
gtaaccctggtactccagagtctga

SEQ ID NO: 661885 - DNA, 25 bp, Mus musculus
gtaaccctggtagtccagagtctga

SEQ ID NO: 661886 - DNA, 25 bp, Mus musculus
gtaaccctggttctactctagttgt

SEQ ID NO: 661887 - DNA, 25 bp, Mus musculus
gtaaccctggttctagaccaggcag

SEQ ID NO: 661888 - DNA, 25 bp, Mus musculus
gtaaccctggttgtactctagttgt

SEQ ID NO: 661889 - DNA, 25 bp, Mus musculus
gtaaccctggttgtagaccaggcag

SEQ ID NO: 661890 - DNA, 25 bp, Mus musculus
gtaacccttactatgtctcatggag

SEQ ID NO: 661891 - DNA, 25 bp, Mus musculus
gtaacccttactttgtctcatggag

SEQ ID NO: 661892 - DNA, 25 bp, Mus musculus
gtaaccctttgtcagtcttacacat

SEQ ID NO: 661893 - DNA, 25 bp, Mus musculus
gtaaccctttgtgagtcttacacat

SEQ ID NO: 661894 - DNA, 25 bp, Mus musculus
gtaaccgattcccaggtggctttgg

SEQ ID NO: 661895 - DNA, 25 bp, Mus musculus
gtaaccgattccgaggtggctttgg

SEQ ID NO: 661896 - DNA, 25 bp, Mus musculus
gtaaccgcaaatcactgcctgccag

SEQ ID NO: 661897 - DNA, 25 bp, Mus musculus
gtaaccgcaaatgactgcctgccag

SEQ ID NO: 661898 - DNA, 25 bp, Mus musculus
gtaaccgcatagatctatagcatgg

SEQ ID NO: 661899 - DNA, 25 bp, Mus musculus
gtaaccgcatagttctatagcatgg

SEQ ID NO: 661900 - DNA, 25 bp, Mus musculus
gtaaccgctcaccactagttgtttc

SEQ ID NO: 661901 - DNA, 25 bp, Mus musculus
gtaaccgctcacgactagttgtttc

SEQ ID NO: 661902 - DNA, 25 bp, Mus musculus
gtaaccgcttgactggtgcctgttc

SEQ ID NO: 661903 - DNA, 25 bp, Mus musculus
gtaaccgcttgagtggtgcctgttc

SEQ ID NO: 661904 - DNA, 25 bp, Mus musculus
gtaaccggaacaactcatatgggac

SEQ ID NO: 661905 - DNA, 25 bp, Mus musculus
gtaaccggaacatctcatatgggac

SEQ ID NO: 661906 - DNA, 25 bp, Mus musculus
gtaaccggagcccagagagtctgct

SEQ ID NO: 661907 - DNA, 25 bp, Mus musculus
gtaaccggagccgagagagtctgct

SEQ ID NO: 661908 - DNA, 25 bp, Mus musculus
gtaaccgtacacatcatcttcagga

SEQ ID NO: 661909 - DNA, 25 bp, Mus musculus
gtaaccgtacacttcatcttcagga

SEQ ID NO: 661910 - DNA, 25 bp, Mus musculus
gtaaccgtatggagcccagttccag

SEQ ID NO: 661911 - DNA, 25 bp, Mus musculus
gtaaccgtatggtgcccagttccag

SEQ ID NO: 661912 - DNA, 25 bp, Mus musculus
gtaaccgtatgtctagccagggcaa

SEQ ID NO: 661913 - DNA, 25 bp, Mus musculus
gtaaccgtatgtgtagccagggcaa

SEQ ID NO: 661914 - DNA, 25 bp, Mus musculus
gtaaccgttaatctcataccagttt

SEQ ID NO: 661915 - DNA, 25 bp, Mus musculus
gtaaccgttaatgtcataccagttt

SEQ ID NO: 661916 - DNA, 25 bp, Mus musculus
gtaacctaacccaaatcactagatg

SEQ ID NO: 661917 - DNA, 25 bp, Mus musculus
gtaacctaaccctaatcactagatg

SEQ ID NO: 661918 - DNA, 25 bp, Mus musculus
gtaacctaacctattgacctgcatg

SEQ ID NO: 661919 - DNA, 25 bp, Mus musculus
gtaacctaaccttttgacctgcatg

SEQ ID NO: 661920 - DNA, 25 bp, Mus musculus
gtaacctaagacaagcaccactttt

SEQ ID NO: 661921 - DNA, 25 bp, Mus musculus
gtaacctaagactagcaccactttt

SEQ ID NO: 661922 - DNA, 25 bp, Mus musculus
gtaacctaagtcatttgccatgcca

SEQ ID NO: 661923 - DNA, 25 bp, Mus musculus
gtaacctaagtcttttgccatgcca

SEQ ID NO: 661924 - DNA, 25 bp, Mus musculus
gtaacctacatcagcccgccaagat

SEQ ID NO: 661925 - DNA, 25 bp, Mus musculus
gtaacctacatctgcccgccaagat

SEQ ID NO: 661926 - DNA, 25 bp, Mus musculus
gtaacctactggctattcaaaaaag

SEQ ID NO: 661927 - DNA, 25 bp, Mus musculus
gtaacctactgggtattcaaaaaag

SEQ ID NO: 661928 - DNA, 25 bp, Mus musculus
gtaacctacttcatttgcagtccag

SEQ ID NO: 661929 - DNA, 25 bp, Mus musculus
gtaacctacttcttttgcagtccag

SEQ ID NO: 661930 - DNA, 25 bp, Mus musculus
gtaacctaggctcgctttcaactgg

SEQ ID NO: 661931 - DNA, 25 bp, Mus musculus
gtaacctaggctggctttcaactgg

SEQ ID NO: 661932 - DNA, 25 bp, Mus musculus
gtaacctagtgaacctactttaaga

SEQ ID NO: 661933 - DNA, 25 bp, Mus musculus
gtaacctagtgatcctactttaaga

SEQ ID NO: 661934 - DNA, 25 bp, Mus musculus
gtaacctatacactgacggtccccg

SEQ ID NO: 661935 - DNA, 25 bp, Mus musculus
gtaacctatacagtgacggtccccg

SEQ ID NO: 661936 - DNA, 25 bp, Mus musculus
gtaacctataggaggagacctctcg

SEQ ID NO: 661937 - DNA, 25 bp, Mus musculus
gtaacctataggtggagacctctcg

SEQ ID NO: 661938 - DNA, 25 bp, Mus musculus
gtaacctatgcccagttgtgcatca

SEQ ID NO: 661939 - DNA, 25 bp, Mus musculus
gtaacctatgccgagttgtgcatca

SEQ ID NO: 661940 - DNA, 25 bp, Mus musculus
gtaacctattccagaatgccttctt

SEQ ID NO: 661941 - DNA, 25 bp, Mus musculus
gtaacctattcctgaatgccttctt

SEQ ID NO: 661942 - DNA, 25 bp, Mus musculus
gtaacctcaagaacctttctgcaat

SEQ ID NO: 661943 - DNA, 25 bp, Mus musculus
gtaacctcaagacagtgcaaatggg

SEQ ID NO: 661944 - DNA, 25 bp, Mus musculus
gtaacctcaagagagtgcaaatggg

SEQ ID NO: 661945 - DNA, 25 bp, Mus musculus
gtaacctcaagatcctttctgcaat

SEQ ID NO: 661946 - DNA, 25 bp, Mus musculus
gtaacctcacgcagattggtggcct

SEQ ID NO: 661947 - DNA, 25 bp, Mus musculus
gtaacctcacgctgattggtggcct

SEQ ID NO: 661948 - DNA, 25 bp, Mus musculus
gtaacctcactaagccgacaagaat

SEQ ID NO: 661949 - DNA, 25 bp, Mus musculus
gtaacctcactatgccgacaagaat

SEQ ID NO: 661950 - DNA, 25 bp, Mus musculus
gtaacctcgaaaaatccagcggctg

SEQ ID NO: 661951 - DNA, 25 bp, Mus musculus
gtaacctcgaaatatccagcggctg

SEQ ID NO: 661952 - DNA, 25 bp, Mus musculus
gtaacctctgtgcaatgtgccaaca

SEQ ID NO: 661953 - DNA, 25 bp, Mus musculus
gtaacctctgtggaatgtgccaaca

SEQ ID NO: 661954 - DNA, 25 bp, Mus musculus
gtaacctcttccactgcataaggag

SEQ ID NO: 661955 - DNA, 25 bp, Mus musculus
gtaacctcttcctctgcataaggag

SEQ ID NO: 661956 - DNA, 25 bp, Mus musculus
gtaacctcttgtaattagactctct

SEQ ID NO: 661957 - DNA, 25 bp, Mus musculus
gtaacctcttgttattagactctct

SEQ ID NO: 661958 - DNA, 25 bp, Mus musculus
gtaacctgaagacactcctagaaat

SEQ ID NO: 661959 - DNA, 25 bp, Mus musculus
gtaacctgaagagactcctagaaat

SEQ ID NO: 661960 - DNA, 25 bp, Mus musculus
gtaacctgaccaaatgtataatagt

SEQ ID NO: 661961 - DNA, 25 bp, Mus musculus
gtaacctgaccatatgtataatagt

SEQ ID NO: 661962 - DNA, 25 bp, Mus musculus
gtaacctgacctcagctggatgttg

SEQ ID NO: 661963 - DNA, 25 bp, Mus musculus
gtaacctgacctgagctggatgttg

SEQ ID NO: 661964 - DNA, 25 bp, Mus musculus
gtaacctgcagacaggtgtctcagg

SEQ ID NO: 661965 - DNA, 25 bp, Mus musculus
gtaacctgcagagaggtgtctcagg

SEQ ID NO: 661966 - DNA, 25 bp, Mus musculus
gtaacctgctagaagccacttgtct

SEQ ID NO: 661967 - DNA, 25 bp, Mus musculus
gtaacctgctagtagccacttgtct

SEQ ID NO: 661968 - DNA, 25 bp, Mus musculus
gtaacctgcttacatctggacttca

SEQ ID NO: 661969 - DNA, 25 bp, Mus musculus
gtaacctgcttagatctggacttca

SEQ ID NO: 661970 - DNA, 25 bp, Mus musculus
gtaacctgctttatcatgttgcttc

SEQ ID NO: 661971 - DNA, 25 bp, Mus musculus
gtaacctgctttttcatgttgcttc

SEQ ID NO: 661972 - DNA, 25 bp, Mus musculus
gtaacctggacaatgacttccttga

SEQ ID NO: 661973 - DNA, 25 bp, Mus musculus
gtaacctggacattgacttccttga

SEQ ID NO: 661974 - DNA, 25 bp, Mus musculus
gtaacctggagtcagttgtagctgt

SEQ ID NO: 661975 - DNA, 25 bp, Mus musculus
gtaacctggagtgagttgtagctgt

SEQ ID NO: 661976 - DNA, 25 bp, Mus musculus
gtaacctggattcaagtccctgtaa

SEQ ID NO: 661977 - DNA, 25 bp, Mus musculus
gtaacctggattgaagtccctgtaa

SEQ ID NO: 661978 - DNA, 25 bp, Mus musculus
gtaacctggcacatgaaaacgggca

SEQ ID NO: 661979 - DNA, 25 bp, Mus musculus
gtaacctggcacttgaaaacgggca

SEQ ID NO: 661980 - DNA, 25 bp, Mus musculus
gtaacctggtaaaggatgctagcac

SEQ ID NO: 661981 - DNA, 25 bp, Mus musculus
gtaacctggtaatggatgctagcac

SEQ ID NO: 661982 - DNA, 25 bp, Mus musculus
gtaacctgtgatactaagttcagaa

SEQ ID NO: 661983 - DNA, 25 bp, Mus musculus
gtaacctgtgattctaagttcagaa

SEQ ID NO: 661984 - DNA, 25 bp, Mus musculus
gtaacctgtgtaatttcaagccatt

SEQ ID NO: 661985 - DNA, 25 bp, Mus musculus
gtaacctgtgtattttcaagccatt

SEQ ID NO: 661986 - DNA, 25 bp, Mus musculus
gtaacctgttctatgttgagcacta

SEQ ID NO: 661987 - DNA, 25 bp, Mus musculus
gtaacctgttctttgttgagcacta

SEQ ID NO: 661988 - DNA, 25 bp, Mus musculus
gtaacctgtttcagtgtatataggg

SEQ ID NO: 661989 - DNA, 25 bp, Mus musculus
gtaacctgtttctgtgtatataggg

SEQ ID NO: 661990 - DNA, 25 bp, Mus musculus
gtaaccttagatatatgcttgctca

SEQ ID NO: 661991 - DNA, 25 bp, Mus musculus
gtaaccttagatttatgcttgctca

SEQ ID NO: 661992 - DNA, 25 bp, Mus musculus
gtaaccttcaccagggctcagaaac

SEQ ID NO: 661993 - DNA, 25 bp, Mus musculus
gtaaccttcacctgggctcagaaac

SEQ ID NO: 661994 - DNA, 25 bp, Mus musculus
gtaaccttgactctagttaacactg

SEQ ID NO: 661995 - DNA, 25 bp, Mus musculus
gtaaccttgactgtagttaacactg

SEQ ID NO: 661996 - DNA, 25 bp, Mus musculus
gtaaccttgctcaattcatgttaat

SEQ ID NO: 661997 - DNA, 25 bp, Mus musculus
gtaaccttgctcagaacatgttcaa

SEQ ID NO: 661998 - DNA, 25 bp, Mus musculus
gtaaccttgctctattcatgttaat

SEQ ID NO: 661999 - DNA, 25 bp, Mus musculus
gtaaccttgctctgaacatgttcaa

SEQ ID NO: 662000 - DNA, 25 bp, Mus musculus
gtaaccttggacatggaactctcag

SEQ ID NO: 662001 - DNA, 25 bp, Mus musculus
gtaaccttggacttggaactctcag

SEQ ID NO: 662002 - DNA, 25 bp, Mus musculus
gtaaccttggtcatcttctattcct

SEQ ID NO: 662003 - DNA, 25 bp, Mus musculus
gtaaccttggtcttcttctattcct

SEQ ID NO: 662004 - DNA, 25 bp, Mus musculus
gtaaccttgttcataggagaactgt

SEQ ID NO: 662005 - DNA, 25 bp, Mus musculus
gtaaccttgttcttaggagaactgt

SEQ ID NO: 662006 - DNA, 25 bp, Mus musculus
gtaacctttacacgcatgaaagaag

SEQ ID NO: 662007 - DNA, 25 bp, Mus musculus
gtaacctttacaggcatgaaagaag

SEQ ID NO: 662008 - DNA, 25 bp, Mus musculus
gtaacctttagactatgttctgaaa

SEQ ID NO: 662009 - DNA, 25 bp, Mus musculus
gtaacctttagagtatgttctgaaa

SEQ ID NO: 662010 - DNA, 25 bp, Mus musculus
gtaacctttcaaaattgtcactcta

SEQ ID NO: 662011 - DNA, 25 bp, Mus musculus
gtaacctttcaatattgtcactcta

SEQ ID NO: 662012 - DNA, 25 bp, Mus musculus
gtaacctttgcacctcaaccatgag

SEQ ID NO: 662013 - DNA, 25 bp, Mus musculus
gtaacctttgcagctcaaccatgag

SEQ ID NO: 662014 - DNA, 25 bp, Mus musculus
gtaacctttttgattctccttcacg

SEQ ID NO: 662015 - DNA, 25 bp, Mus musculus
gtaacctttttgtttctccttcacg

SEQ ID NO: 662016 - DNA, 25 bp, Mus musculus
gtaacgaaaagtcccagagctccca

SEQ ID NO: 662017 - DNA, 25 bp, Mus musculus
gtaacgaaaagtgccagagctccca

SEQ ID NO: 662018 - DNA, 25 bp, Mus musculus
gtaacgaaagccagcggccagcagg

SEQ ID NO: 662019 - DNA, 25 bp, Mus musculus
gtaacgaaagcctgcggccagcagg

SEQ ID NO: 662020 - DNA, 25 bp, Mus musculus
gtaacgaacattatatgcatctgaa

SEQ ID NO: 662021 - DNA, 25 bp, Mus musculus
gtaacgaacattttatgcatctgaa

SEQ ID NO: 662022 - DNA, 25 bp, Mus musculus
gtaacgaactagctctgtgaattta

SEQ ID NO: 662023 - DNA, 25 bp, Mus musculus
gtaacgaactaggtctgtgaattta

SEQ ID NO: 662024 - DNA, 25 bp, Mus musculus
gtaacgaccctgaaatagctcaagt

SEQ ID NO: 662025 - DNA, 25 bp, Mus musculus
gtaacgaccctgtaatagctcaagt

SEQ ID NO: 662026 - DNA, 25 bp, Mus musculus
gtaacgaccggtctgcttcagtttg

SEQ ID NO: 662027 - DNA, 25 bp, Mus musculus
gtaacgaccggtgtgcttcagtttg

SEQ ID NO: 662028 - DNA, 25 bp, Mus musculus
gtaacgagaaccacactgaaggaga

SEQ ID NO: 662029 - DNA, 25 bp, Mus musculus
gtaacgagaacctcactgaaggaga

SEQ ID NO: 662030 - DNA, 25 bp, Mus musculus
gtaacgagacgtacacaaatgctgt

SEQ ID NO: 662031 - DNA, 25 bp, Mus musculus
gtaacgagacgttcacaaatgctgt

SEQ ID NO: 662032 - DNA, 25 bp, Mus musculus
gtaacgagagcaattcagacaacca

SEQ ID NO: 662033 - DNA, 25 bp, Mus musculus
gtaacgagagcatttcagacaacca

SEQ ID NO: 662034 - DNA, 25 bp, Mus musculus
gtaacgagtaatcccgtccagccta

SEQ ID NO: 662035 - DNA, 25 bp, Mus musculus
gtaacgagtaatgccgtccagccta

SEQ ID NO: 662036 - DNA, 25 bp, Mus musculus
gtaacgagtatcacttcctggaggt

SEQ ID NO: 662037 - DNA, 25 bp, Mus musculus
gtaacgagtatctcttcctggaggt

SEQ ID NO: 662038 - DNA, 25 bp, Mus musculus
gtaacgatgaggattcttcacccct

SEQ ID NO: 662039 - DNA, 25 bp, Mus musculus
gtaacgatgaggtttcttcacccct

SEQ ID NO: 662040 - DNA, 25 bp, Mus musculus
gtaacgatgttaccacagcaatggc

SEQ ID NO: 662041 - DNA, 25 bp, Mus musculus
gtaacgatgttagcacagcaatggc

SEQ ID NO: 662042 - DNA, 25 bp, Mus musculus
gtaacgcaaaataatgcaagcacat

SEQ ID NO: 662043 - DNA, 25 bp, Mus musculus
gtaacgcaaaattatgcaagcacat

SEQ ID NO: 662044 - DNA, 25 bp, Mus musculus
gtaacgcacagcagcttcagggtca

SEQ ID NO: 662045 - DNA, 25 bp, Mus musculus
gtaacgcacagctgcttcagggtca

SEQ ID NO: 662046 - DNA, 25 bp, Mus musculus
gtaacgcacgttcttgtgtcatcaa

SEQ ID NO: 662047 - DNA, 25 bp, Mus musculus
gtaacgcacgttgttgtgtcatcaa

SEQ ID NO: 662048 - DNA, 25 bp, Mus musculus
gtaacgcagctgacatagatcctct

SEQ ID NO: 662049 - DNA, 25 bp, Mus musculus
gtaacgcagctgtcatagatcctct

SEQ ID NO: 662050 - DNA, 25 bp, Mus musculus
gtaacgcatccacagggtcaaggcc

SEQ ID NO: 662051 - DNA, 25 bp, Mus musculus
gtaacgcatccagagggtcaaggcc

SEQ ID NO: 662052 - DNA, 25 bp, Mus musculus
gtaacgccaactattaggtcacata

SEQ ID NO: 662053 - DNA, 25 bp, Mus musculus
gtaacgccaacttttaggtcacata

SEQ ID NO: 662054 - DNA, 25 bp, Mus musculus
gtaacgccatccagagatacatcgc

SEQ ID NO: 662055 - DNA, 25 bp, Mus musculus
gtaacgccatcctgagatacatcgc

SEQ ID NO: 662056 - DNA, 25 bp, Mus musculus
gtaacgcctccacgcccagtattgt

SEQ ID NO: 662057 - DNA, 25 bp, Mus musculus
gtaacgcctccaggcccagtattgt

SEQ ID NO: 662058 - DNA, 25 bp, Mus musculus
gtaacgcctgcgagtatgttcttct

SEQ ID NO: 662059 - DNA, 25 bp, Mus musculus
gtaacgcctgcgtgtatgttcttct

SEQ ID NO: 662060 - DNA, 25 bp, Mus musculus
gtaacgcgccagagcaacatccaga

SEQ ID NO: 662061 - DNA, 25 bp, Mus musculus
gtaacgcgccagtgcaacatccaga

SEQ ID NO: 662062 - DNA, 25 bp, Mus musculus
gtaacgcggttgaagtgctcttgca

SEQ ID NO: 662063 - DNA, 25 bp, Mus musculus
gtaacgcggttgtagtgctcttgca

SEQ ID NO: 662064 - DNA, 25 bp, Mus musculus
gtaacgctgtacagtaagccacatt

SEQ ID NO: 662065 - DNA, 25 bp, Mus musculus
gtaacgctgtactgtaagccacatt

SEQ ID NO: 662066 - DNA, 25 bp, Mus musculus
gtaacggaatccctgtcaaggagct

SEQ ID NO: 662067 - DNA, 25 bp, Mus musculus
gtaacggaatccgtgtcaaggagct

SEQ ID NO: 662068 - DNA, 25 bp, Mus musculus
gtaacggaatgcacagcccgggcaa

SEQ ID NO: 662069 - DNA, 25 bp, Mus musculus
gtaacggaatgctcagcccgggcaa

SEQ ID NO: 662070 - DNA, 25 bp, Mus musculus
gtaacggacactatgatcttgcgtg

SEQ ID NO: 662071 - DNA, 25 bp, Mus musculus
gtaacggacactttgatcttgcgtg

SEQ ID NO: 662072 - DNA, 25 bp, Mus musculus
gtaacggatggaatatctaggacac

SEQ ID NO: 662073 - DNA, 25 bp, Mus musculus
gtaacggatggattatctaggacac

SEQ ID NO: 662074 - DNA, 25 bp, Mus musculus
gtaacgggtttcagcatggtggctt

SEQ ID NO: 662075 - DNA, 25 bp, Mus musculus
gtaacgggtttctgcatggtggctt

SEQ ID NO: 662076 - DNA, 25 bp, Mus musculus
gtaacggtcactacgaggacaagct

SEQ ID NO: 662077 - DNA, 25 bp, Mus musculus
gtaacggtcacttcgaggacaagct

SEQ ID NO: 662078 - DNA, 25 bp, Mus musculus
gtaacggttctccaggcgacacagg

SEQ ID NO: 662079 - DNA, 25 bp, Mus musculus
gtaacggttctcgaggcgacacagg

SEQ ID NO: 662080 - DNA, 25 bp, Mus musculus
gtaacgtacaacaacttcagctggc

SEQ ID NO: 662081 - DNA, 25 bp, Mus musculus
gtaacgtacaactacttcagctggc

SEQ ID NO: 662082 - DNA, 25 bp, Mus musculus
gtaacgtcgtgtcccagcgatgcaa

SEQ ID NO: 662083 - DNA, 25 bp, Mus musculus
gtaacgtcgtgtgccagcgatgcaa

SEQ ID NO: 662084 - DNA, 25 bp, Mus musculus
gtaacgtgacatagaagcttgggaa

SEQ ID NO: 662085 - DNA, 25 bp, Mus musculus
gtaacgtgacattgaagcttgggaa

SEQ ID NO: 662086 - DNA, 25 bp, Mus musculus
gtaacgtggtctccattcattttgt

SEQ ID NO: 662087 - DNA, 25 bp, Mus musculus
gtaacgtggtctgcattcattttgt

SEQ ID NO: 662088 - DNA, 25 bp, Mus musculus
gtaacgtgtaaaaagccaatggtct

SEQ ID NO: 662089 - DNA, 25 bp, Mus musculus
gtaacgtgtaaatagccaatggtct

SEQ ID NO: 662090 - DNA, 25 bp, Mus musculus
gtaacgtgtattcgaccgggctggg

SEQ ID NO: 662091 - DNA, 25 bp, Mus musculus
gtaacgtgtattggaccgggctggg

SEQ ID NO: 662092 - DNA, 25 bp, Mus musculus
gtaacgtgtgacattacctccaagt

SEQ ID NO: 662093 - DNA, 25 bp, Mus musculus
gtaacgtgtgactttacctccaagt

SEQ ID NO: 662094 - DNA, 25 bp, Mus musculus
gtaacgttgtatatgcattctggaa

SEQ ID NO: 662095 - DNA, 25 bp, Mus musculus
gtaacgttgtatttgcattctggaa

SEQ ID NO: 662096 - DNA, 25 bp, Mus musculus
gtaacgtttctgatttctccaatga

SEQ ID NO: 662097 - DNA, 25 bp, Mus musculus
gtaacgtttctgttttctccaatga

SEQ ID NO: 662098 - DNA, 25 bp, Mus musculus
gtaactaaacacaaactggtcaata

SEQ ID NO: 662099 - DNA, 25 bp, Mus musculus
gtaactaaacactaactggtcaata

SEQ ID NO: 662100 - DNA, 25 bp, Mus musculus
gtaactaaactcacaatatctactg

SEQ ID NO: 662101 - DNA, 25 bp, Mus musculus
gtaactaaactctcaatatctactg

SEQ ID NO: 662102 - DNA, 25 bp, Mus musculus
gtaactaaatggagtggcaactgct

SEQ ID NO: 662103 - DNA, 25 bp, Mus musculus
gtaactaaatggtgtggcaactgct

SEQ ID NO: 662104 - DNA, 25 bp, Mus musculus
gtaactaactataagccagctgcat

SEQ ID NO: 662105 - DNA, 25 bp, Mus musculus
gtaactaactattagccagctgcat

SEQ ID NO: 662106 - DNA, 25 bp, Mus musculus
gtaactaactgtcttgaacgtcact

SEQ ID NO: 662107 - DNA, 25 bp, Mus musculus
gtaactaactgtgttgaacgtcact

SEQ ID NO: 662108 - DNA, 25 bp, Mus musculus
gtaactaacttgacaacaccaactt

SEQ ID NO: 662109 - DNA, 25 bp, Mus musculus
gtaactaacttgtcaacaccaactt

SEQ ID NO: 662110 - DNA, 25 bp, Mus musculus
gtaactaagacacttacccgctaag

SEQ ID NO: 662111 - DNA, 25 bp, Mus musculus
gtaactaagacagttacccgctaag

SEQ ID NO: 662112 - DNA, 25 bp, Mus musculus
gtaactaagagacaccaaccccagg

SEQ ID NO: 662113 - DNA, 25 bp, Mus musculus
gtaactaagagagaccaaccccagg

SEQ ID NO: 662114 - DNA, 25 bp, Mus musculus
gtaactaagcccctttcagaatcat

SEQ ID NO: 662115 - DNA, 25 bp, Mus musculus
gtaactaagcccgtttcagaatcat

SEQ ID NO: 662116 - DNA, 25 bp, Mus musculus
gtaactaagcttctctagagggcaa

SEQ ID NO: 662117 - DNA, 25 bp, Mus musculus
gtaactaagcttgtctagagggcaa

SEQ ID NO: 662118 - DNA, 25 bp, Mus musculus
gtaactaatcccaattatactgtga

SEQ ID NO: 662119 - DNA, 25 bp, Mus musculus
gtaactaatccctattatactgtga

SEQ ID NO: 662120 - DNA, 25 bp, Mus musculus
gtaactaatctcatgttcttaatat

SEQ ID NO: 662121 - DNA, 25 bp, Mus musculus
gtaactaatctcttgttcttaatat

SEQ ID NO: 662122 - DNA, 25 bp, Mus musculus
gtaactaatgaccttgagggatcag

SEQ ID NO: 662123 - DNA, 25 bp, Mus musculus
gtaactaatgacgttgagggatcag

SEQ ID NO: 662124 - DNA, 25 bp, Mus musculus
gtaactaattaccttggaacagttg

SEQ ID NO: 662125 - DNA, 25 bp, Mus musculus
gtaactaattacgttggaacagttg

SEQ ID NO: 662126 - DNA, 25 bp, Mus musculus
gtaactacacaactctttccctgta

SEQ ID NO: 662127 - DNA, 25 bp, Mus musculus
gtaactacacaagtctttccctgta

SEQ ID NO: 662128 - DNA, 25 bp, Mus musculus
gtaactacagagctgctcataaaat

SEQ ID NO: 662129 - DNA, 25 bp, Mus musculus
gtaactacagaggtgctcataaaat

SEQ ID NO: 662130 - DNA, 25 bp, Mus musculus
gtaactacagccaggaacatctcct

SEQ ID NO: 662131 - DNA, 25 bp, Mus musculus
gtaactacagcctggaacatctcct

SEQ ID NO: 662132 - DNA, 25 bp, Mus musculus
gtaactacagctctacactctgttt

SEQ ID NO: 662133 - DNA, 25 bp, Mus musculus
gtaactacagctgtacactctgttt

SEQ ID NO: 662134 - DNA, 25 bp, Mus musculus
gtaactaccaatatcaatttggaca

SEQ ID NO: 662135 - DNA, 25 bp, Mus musculus
gtaactaccaatttcaatttggaca

SEQ ID NO: 662136 - DNA, 25 bp, Mus musculus
gtaactaccctgatctagtcacagt

SEQ ID NO: 662137 - DNA, 25 bp, Mus musculus
gtaactaccctgttctagtcacagt

SEQ ID NO: 662138 - DNA, 25 bp, Mus musculus
gtaactacctttcggttttctgcat

SEQ ID NO: 662139 - DNA, 25 bp, Mus musculus
gtaactacctttgggttttctgcat

SEQ ID NO: 662140 - DNA, 25 bp, Mus musculus
gtaactacgtagactactttgacta

SEQ ID NO: 662141 - DNA, 25 bp, Mus musculus
gtaactacgtagtctactttgacta

SEQ ID NO: 662142 - DNA, 25 bp, Mus musculus
gtaactacgtcccaaacactttgat

SEQ ID NO: 662143 - DNA, 25 bp, Mus musculus
gtaactacgtccgaaacactttgat

SEQ ID NO: 662144 - DNA, 25 bp, Mus musculus
gtaactactaacactagatggtaca

SEQ ID NO: 662145 - DNA, 25 bp, Mus musculus
gtaactactaactctagatggtaca

SEQ ID NO: 662146 - DNA, 25 bp, Mus musculus
gtaactactttgacagattgctttt

SEQ ID NO: 662147 - DNA, 25 bp, Mus musculus
gtaactactttgtcagattgctttt

SEQ ID NO: 662148 - DNA, 25 bp, Mus musculus
gtaactagaccaattcaaactaaag

SEQ ID NO: 662149 - DNA, 25 bp, Mus musculus
gtaactagaccatttcaaactaaag

SEQ ID NO: 662150 - DNA, 25 bp, Mus musculus
gtaactagataccactgccaataaa

SEQ ID NO: 662151 - DNA, 25 bp, Mus musculus
gtaactagatacgactgccaataaa

SEQ ID NO: 662152 - DNA, 25 bp, Mus musculus
gtaactagcagacatctatttgtgt

SEQ ID NO: 662153 - DNA, 25 bp, Mus musculus
gtaactagcagagatctatttgtgt

SEQ ID NO: 662154 - DNA, 25 bp, Mus musculus
gtaactagcattcttccaggcaatt

SEQ ID NO: 662155 - DNA, 25 bp, Mus musculus
gtaactagcattgttccaggcaatt

SEQ ID NO: 662156 - DNA, 25 bp, Mus musculus
gtaactagctatcttcataagtcaa

SEQ ID NO: 662157 - DNA, 25 bp, Mus musculus
gtaactagctatgttcataagtcaa

SEQ ID NO: 662158 - DNA, 25 bp, Mus musculus
gtaactagctggcactctatgaggt

SEQ ID NO: 662159 - DNA, 25 bp, Mus musculus
gtaactagctgggactctatgaggt

SEQ ID NO: 662160 - DNA, 25 bp, Mus musculus
gtaactagtaccaagcacactcact

SEQ ID NO: 662161 - DNA, 25 bp, Mus musculus
gtaactagtacctagcacactcact

SEQ ID NO: 662162 - DNA, 25 bp, Mus musculus
gtaactagtagcattctcaatagca

SEQ ID NO: 662163 - DNA, 25 bp, Mus musculus
gtaactagtagctttctcaatagca

SEQ ID NO: 662164 - DNA, 25 bp, Mus musculus
gtaactataactcgctgctcactgc

SEQ ID NO: 662165 - DNA, 25 bp, Mus musculus
gtaactataactggctgctcactgc

SEQ ID NO: 662166 - DNA, 25 bp, Mus musculus
gtaactataatgcaggtggctccta

SEQ ID NO: 662167 - DNA, 25 bp, Mus musculus
gtaactataatggaggtggctccta

SEQ ID NO: 662168 - DNA, 25 bp, Mus musculus
gtaactatattcctatcaccatgat

SEQ ID NO: 662169 - DNA, 25 bp, Mus musculus
gtaactatattcgtatcaccatgat

SEQ ID NO: 662170 - DNA, 25 bp, Mus musculus
gtaactatcagtccacatcttgggc

SEQ ID NO: 662171 - DNA, 25 bp, Mus musculus
gtaactatcagtgcacatcttgggc

SEQ ID NO: 662172 - DNA, 25 bp, Mus musculus
gtaactatctagacccagggcatct

SEQ ID NO: 662173 - DNA, 25 bp, Mus musculus
gtaactatctagtcccagggcatct

SEQ ID NO: 662174 - DNA, 25 bp, Mus musculus
gtaactatgccaactgggtccaaga

SEQ ID NO: 662175 - DNA, 25 bp, Mus musculus
gtaactatgccatctgggtccaaga

SEQ ID NO: 662176 - DNA, 25 bp, Mus musculus
gtaactatggcaagcttatgaagat

SEQ ID NO: 662177 - DNA, 25 bp, Mus musculus
gtaactatggcatgcttatgaagat

SEQ ID NO: 662178 - DNA, 25 bp, Mus musculus
gtaactatggtgctggtggaaacta

SEQ ID NO: 662179 - DNA, 25 bp, Mus musculus
gtaactatggtggtggtggaaacta

SEQ ID NO: 662180 - DNA, 25 bp, Mus musculus
gtaactatggttccctgcagtggag

SEQ ID NO: 662181 - DNA, 25 bp, Mus musculus
gtaactatggttgcctgcagtggag

SEQ ID NO: 662182 - DNA, 25 bp, Mus musculus
gtaactatgtagacatttcagtatg

SEQ ID NO: 662183 - DNA, 25 bp, Mus musculus
gtaactatgtagtcatttcagtatg

SEQ ID NO: 662184 - DNA, 25 bp, Mus musculus
gtaactatgtggcagtctcccagta

SEQ ID NO: 662185 - DNA, 25 bp, Mus musculus
gtaactatgtgggagtctcccagta

SEQ ID NO: 662186 - DNA, 25 bp, Mus musculus
gtaactatgttaacctactcgcatc

SEQ ID NO: 662187 - DNA, 25 bp, Mus musculus
gtaactatgttatcctactcgcatc

SEQ ID NO: 662188 - DNA, 25 bp, Mus musculus
gtaactattgtgagcctaatgaatg

SEQ ID NO: 662189 - DNA, 25 bp, Mus musculus
gtaactattgtgtgcctaatgaatg

SEQ ID NO: 662190 - DNA, 25 bp, Mus musculus
gtaactatttacagaccacgcatcc

SEQ ID NO: 662191 - DNA, 25 bp, Mus musculus
gtaactatttactgaccacgcatcc

SEQ ID NO: 662192 - DNA, 25 bp, Mus musculus
gtaactcaaacgattcccaaggcat

SEQ ID NO: 662193 - DNA, 25 bp, Mus musculus
gtaactcaaacgtttcccaaggcat

SEQ ID NO: 662194 - DNA, 25 bp, Mus musculus
gtaactcaagttccaagggatatag

SEQ ID NO: 662195 - DNA, 25 bp, Mus musculus
gtaactcaagttgcaagggatatag

SEQ ID NO: 662196 - DNA, 25 bp, Mus musculus
gtaactcacatactttgctttaaaa

SEQ ID NO: 662197 - DNA, 25 bp, Mus musculus
gtaactcacatagtttgctttaaaa

SEQ ID NO: 662198 - DNA, 25 bp, Mus musculus
gtaactcaccctcacgtgacaaaca

SEQ ID NO: 662199 - DNA, 25 bp, Mus musculus
gtaactcaccctgacgtgacaaaca

SEQ ID NO: 662200 - DNA, 25 bp, Mus musculus
gtaactcactccacaggacctgaca

SEQ ID NO: 662201 - DNA, 25 bp, Mus musculus
gtaactcactcctcaggacctgaca

SEQ ID NO: 662202 - DNA, 25 bp, Mus musculus
gtaactcacttacaatacccactga

SEQ ID NO: 662203 - DNA, 25 bp, Mus musculus
gtaactcacttagaatacccactga

SEQ ID NO: 662204 - DNA, 25 bp, Mus musculus
gtaactcactttaccatatattttg

SEQ ID NO: 662205 - DNA, 25 bp, Mus musculus
gtaactcactttagaactgactttt

SEQ ID NO: 662206 - DNA, 25 bp, Mus musculus
gtaactcactttagacattcagcag

SEQ ID NO: 662207 - DNA, 25 bp, Mus musculus
gtaactcacttttccatatattttg

SEQ ID NO: 662208 - DNA, 25 bp, Mus musculus
gtaactcacttttgaactgactttt

SEQ ID NO: 662209 - DNA, 25 bp, Mus musculus
gtaactcacttttgacattcagcag

SEQ ID NO: 662210 - DNA, 25 bp, Mus musculus
gtaactcagaacactatcctggtcc

SEQ ID NO: 662211 - DNA, 25 bp, Mus musculus
gtaactcagaactctatcctggtcc

SEQ ID NO: 662212 - DNA, 25 bp, Mus musculus
gtaactcagcagaaggagacttacc

SEQ ID NO: 662213 - DNA, 25 bp, Mus musculus
gtaactcagcagtaggagacttacc

SEQ ID NO: 662214 - DNA, 25 bp, Mus musculus
gtaactcagcatatgataccttcac

SEQ ID NO: 662215 - DNA, 25 bp, Mus musculus
gtaactcagcatttgataccttcac

SEQ ID NO: 662216 - DNA, 25 bp, Mus musculus
gtaactcagctgatgaatacctaaa

SEQ ID NO: 662217 - DNA, 25 bp, Mus musculus
gtaactcagctgttgaatacctaaa

SEQ ID NO: 662218 - DNA, 25 bp, Mus musculus
gtaactcagtacatgcttaatggca

SEQ ID NO: 662219 - DNA, 25 bp, Mus musculus
gtaactcagtacttgcttaatggca

SEQ ID NO: 662220 - DNA, 25 bp, Mus musculus
gtaactcagtccacatgaaagccga

SEQ ID NO: 662221 - DNA, 25 bp, Mus musculus
gtaactcagtcctcatgaaagccga

SEQ ID NO: 662222 - DNA, 25 bp, Mus musculus
gtaactcagtggctcctgtattaac

SEQ ID NO: 662223 - DNA, 25 bp, Mus musculus
gtaactcagtggctctagggctata

SEQ ID NO: 662224 - DNA, 25 bp, Mus musculus
gtaactcagtgggtcctgtattaac

SEQ ID NO: 662225 - DNA, 25 bp, Mus musculus
gtaactcagtgggtctagggctata

SEQ ID NO: 662226 - DNA, 25 bp, Mus musculus
gtaactcatattatcaggtcttggc

SEQ ID NO: 662227 - DNA, 25 bp, Mus musculus
gtaactcatattttcaggtcttggc

SEQ ID NO: 662228 - DNA, 25 bp, Mus musculus
gtaactcattcaagggaaccttcgg

SEQ ID NO: 662229 - DNA, 25 bp, Mus musculus
gtaactcattcatgggaaccttcgg

SEQ ID NO: 662230 - DNA, 25 bp, Mus musculus
gtaactcatttccatttattcactt

SEQ ID NO: 662231 - DNA, 25 bp, Mus musculus
gtaactcatttcgatttattcactt

SEQ ID NO: 662232 - DNA, 25 bp, Mus musculus
gtaactcatttgaaacgacctatca

SEQ ID NO: 662233 - DNA, 25 bp, Mus musculus
gtaactcatttgtaacgacctatca

SEQ ID NO: 662234 - DNA, 25 bp, Mus musculus
gtaactccaaataaaactgcagctt

SEQ ID NO: 662235 - DNA, 25 bp, Mus musculus
gtaactccaaattaaactgcagctt

SEQ ID NO: 662236 - DNA, 25 bp, Mus musculus
gtaactccaatgaccagttccagag

SEQ ID NO: 662237 - DNA, 25 bp, Mus musculus
gtaactccaatgtccagttccagag

SEQ ID NO: 662238 - DNA, 25 bp, Mus musculus
gtaactccactcagagtaagtcgga

SEQ ID NO: 662239 - DNA, 25 bp, Mus musculus
gtaactccactctgagtaagtcgga

SEQ ID NO: 662240 - DNA, 25 bp, Mus musculus
gtaactccactgcttgacgatgcca

SEQ ID NO: 662241 - DNA, 25 bp, Mus musculus
gtaactccactggttgacgatgcca

SEQ ID NO: 662242 - DNA, 25 bp, Mus musculus
gtaactccacttctagggtatctgt

SEQ ID NO: 662243 - DNA, 25 bp, Mus musculus
gtaactccacttgtagggtatctgt

SEQ ID NO: 662244 - DNA, 25 bp, Mus musculus
gtaactccagacaggtgtgtctaga

SEQ ID NO: 662245 - DNA, 25 bp, Mus musculus
gtaactccagactggtgtgtctaga

SEQ ID NO: 662246 - DNA, 25 bp, Mus musculus
gtaactccagcaaaaacttaggtac

SEQ ID NO: 662247 - DNA, 25 bp, Mus musculus
gtaactccagcaatgccactagcag

SEQ ID NO: 662248 - DNA, 25 bp, Mus musculus
gtaactccagcaccaagctttgctt

SEQ ID NO: 662249 - DNA, 25 bp, Mus musculus
gtaactccagcagcaagctttgctt

SEQ ID NO: 662250 - DNA, 25 bp, Mus musculus
gtaactccagcataaacttaggtac

SEQ ID NO: 662251 - DNA, 25 bp, Mus musculus
gtaactccagcattgccactagcag

SEQ ID NO: 662252 - DNA, 25 bp, Mus musculus
gtaactccagctactcaaaagttga

SEQ ID NO: 662253 - DNA, 25 bp, Mus musculus
gtaactccagcttctcaaaagttga

SEQ ID NO: 662254 - DNA, 25 bp, Mus musculus
gtaactccaggcatcctgaaacaag

SEQ ID NO: 662255 - DNA, 25 bp, Mus musculus
gtaactccaggcttcctgaaacaag

SEQ ID NO: 662256 - DNA, 25 bp, Mus musculus
gtaactccagtcctggaaaacctga

SEQ ID NO: 662257 - DNA, 25 bp, Mus musculus
gtaactccagtcgtggaaaacctga

SEQ ID NO: 662258 - DNA, 25 bp, Mus musculus
gtaactcccaaccagagtagacagt

SEQ ID NO: 662259 - DNA, 25 bp, Mus musculus
gtaactcccaacgagagtagacagt

SEQ ID NO: 662260 - DNA, 25 bp, Mus musculus
gtaactcccagtctgttgtatcata

SEQ ID NO: 662261 - DNA, 25 bp, Mus musculus
gtaactcccagtgtgttgtatcata

SEQ ID NO: 662262 - DNA, 25 bp, Mus musculus
gtaactccctcccaaaaagcactgt

SEQ ID NO: 662263 - DNA, 25 bp, Mus musculus
gtaactccctccgaaaaagcactgt

SEQ ID NO: 662264 - DNA, 25 bp, Mus musculus
gtaactccctgacagttcttgaggt

SEQ ID NO: 662265 - DNA, 25 bp, Mus musculus
gtaactccctgagagttcttgaggt

SEQ ID NO: 662266 - DNA, 25 bp, Mus musculus
gtaactcccttcaatagactgaatg

SEQ ID NO: 662267 - DNA, 25 bp, Mus musculus
gtaactcccttctatagactgaatg

SEQ ID NO: 662268 - DNA, 25 bp, Mus musculus
gtaactccgtcaagaccaggtgctt

SEQ ID NO: 662269 - DNA, 25 bp, Mus musculus
gtaactccgtcatgaccaggtgctt

SEQ ID NO: 662270 - DNA, 25 bp, Mus musculus
gtaactccttgactcatgagccacc

SEQ ID NO: 662271 - DNA, 25 bp, Mus musculus
gtaactccttgagtcatgagccacc

SEQ ID NO: 662272 - DNA, 25 bp, Mus musculus
gtaactcgagaccagatgaagatat

SEQ ID NO: 662273 - DNA, 25 bp, Mus musculus
gtaactcgagacgagatgaagatat

SEQ ID NO: 662274 - DNA, 25 bp, Mus musculus
gtaactcgcggcctaaacgccagtc

SEQ ID NO: 662275 - DNA, 25 bp, Mus musculus
gtaactcgcggcgtaaacgccagtc

SEQ ID NO: 662276 - DNA, 25 bp, Mus musculus
gtaactcgcgtcagtaccatggaaa

SEQ ID NO: 662277 - DNA, 25 bp, Mus musculus
gtaactcgcgtctgtaccatggaaa

SEQ ID NO: 662278 - DNA, 25 bp, Mus musculus
gtaactcggagcatggaattgtctg

SEQ ID NO: 662279 - DNA, 25 bp, Mus musculus
gtaactcggagcttggaattgtctg

SEQ ID NO: 662280 - DNA, 25 bp, Mus musculus
gtaactcggagtctgatctctggca

SEQ ID NO: 662281 - DNA, 25 bp, Mus musculus
gtaactcggagtgtgatctctggca

SEQ ID NO: 662282 - DNA, 25 bp, Mus musculus
gtaactcggcatactgagcttcacc

SEQ ID NO: 662283 - DNA, 25 bp, Mus musculus
gtaactcggcattctgagcttcacc

SEQ ID NO: 662284 - DNA, 25 bp, Mus musculus
gtaactcgttccatacacggtagat

SEQ ID NO: 662285 - DNA, 25 bp, Mus musculus
gtaactcgttccttacacggtagat

SEQ ID NO: 662286 - DNA, 25 bp, Mus musculus
gtaactctaggtacattaaacctgg

SEQ ID NO: 662287 - DNA, 25 bp, Mus musculus
gtaactctaggttcattaaacctgg

SEQ ID NO: 662288 - DNA, 25 bp, Mus musculus
gtaactctatttaagtaccgacata

SEQ ID NO: 662289 - DNA, 25 bp, Mus musculus
gtaactctattttagtaccgacata

SEQ ID NO: 662290 - DNA, 25 bp, Mus musculus
gtaactctccagactgaaagtgacc

SEQ ID NO: 662291 - DNA, 25 bp, Mus musculus
gtaactctccagtctgaaagtgacc

SEQ ID NO: 662292 - DNA, 25 bp, Mus musculus
gtaactctccttaatcagttttacg

SEQ ID NO: 662293 - DNA, 25 bp, Mus musculus
gtaactctcctttatcagttttacg

SEQ ID NO: 662294 - DNA, 25 bp, Mus musculus
gtaactctgaaactagccacttgta

SEQ ID NO: 662295 - DNA, 25 bp, Mus musculus
gtaactctgaaagtagccacttgta

SEQ ID NO: 662296 - DNA, 25 bp, Mus musculus
gtaactctgacgcacatagttccat

SEQ ID NO: 662297 - DNA, 25 bp, Mus musculus
gtaactctgacggacatagttccat

SEQ ID NO: 662298 - DNA, 25 bp, Mus musculus
gtaactctgagacatcatacgtgct

SEQ ID NO: 662299 - DNA, 25 bp, Mus musculus
gtaactctgagagatcatacgtgct

SEQ ID NO: 662300 - DNA, 25 bp, Mus musculus
gtaactctgcatagaataaccaacc

SEQ ID NO: 662301 - DNA, 25 bp, Mus musculus
gtaactctgcattgaataaccaacc

SEQ ID NO: 662302 - DNA, 25 bp, Mus musculus
gtaactctgccacagtacaaggtac

SEQ ID NO: 662303 - DNA, 25 bp, Mus musculus
gtaactctgccagagtacaaggtac

SEQ ID NO: 662304 - DNA, 25 bp, Mus musculus
gtaactctggctatagtatatacat

SEQ ID NO: 662305 - DNA, 25 bp, Mus musculus
gtaactctggctttagtatatacat

SEQ ID NO: 662306 - DNA, 25 bp, Mus musculus
gtaactctggttagcctgtacagca

SEQ ID NO: 662307 - DNA, 25 bp, Mus musculus
gtaactctggtttgcctgtacagca

SEQ ID NO: 662308 - DNA, 25 bp, Mus musculus
gtaactctgtacattactcctattt

SEQ ID NO: 662309 - DNA, 25 bp, Mus musculus
gtaactctgtactttactcctattt

SEQ ID NO: 662310 - DNA, 25 bp, Mus musculus
gtaactctgtcgagaaccaggctat

SEQ ID NO: 662311 - DNA, 25 bp, Mus musculus
gtaactctgtcgtgaaccaggctat

SEQ ID NO: 662312 - DNA, 25 bp, Mus musculus
gtaactcttatgaacgcgcatgaat

SEQ ID NO: 662313 - DNA, 25 bp, Mus musculus
gtaactcttatgtacgcgcatgaat

SEQ ID NO: 662314 - DNA, 25 bp, Mus musculus
gtaactcttctgaagcaagctctgg

SEQ ID NO: 662315 - DNA, 25 bp, Mus musculus
gtaactcttctgtagcaagctctgg

SEQ ID NO: 662316 - DNA, 25 bp, Mus musculus
gtaactcttgacagggatgcatgca

SEQ ID NO: 662317 - DNA, 25 bp, Mus musculus
gtaactcttgactgggatgcatgca

SEQ ID NO: 662318 - DNA, 25 bp, Mus musculus
gtaactcttgctaaaatcttttgta

SEQ ID NO: 662319 - DNA, 25 bp, Mus musculus
gtaactcttgcttaaatcttttgta

SEQ ID NO: 662320 - DNA, 25 bp, Mus musculus
gtaactcttggacagcccgtgagaa

SEQ ID NO: 662321 - DNA, 25 bp, Mus musculus
gtaactcttggagagcccgtgagaa

SEQ ID NO: 662322 - DNA, 25 bp, Mus musculus
gtaactgaacggaccagactcctct

SEQ ID NO: 662323 - DNA, 25 bp, Mus musculus
gtaactgaacggtccagactcctct

SEQ ID NO: 662324 - DNA, 25 bp, Mus musculus
gtaactgaactgaagctatctagtc

SEQ ID NO: 662325 - DNA, 25 bp, Mus musculus
gtaactgaactgtagctatctagtc

SEQ ID NO: 662326 - DNA, 25 bp, Mus musculus
gtaactgaatccactggcagaatca

SEQ ID NO: 662327 - DNA, 25 bp, Mus musculus
gtaactgaatcctctggcagaatca

SEQ ID NO: 662328 - DNA, 25 bp, Mus musculus
gtaactgacacgctccgggtatcat

SEQ ID NO: 662329 - DNA, 25 bp, Mus musculus
gtaactgacacggtccgggtatcat

SEQ ID NO: 662330 - DNA, 25 bp, Mus musculus
gtaactgacagtcacacttccgtgt

SEQ ID NO: 662331 - DNA, 25 bp, Mus musculus
gtaactgacagtgacacttccgtgt

SEQ ID NO: 662332 - DNA, 25 bp, Mus musculus
gtaactgacctcaagtactctggaa

SEQ ID NO: 662333 - DNA, 25 bp, Mus musculus
gtaactgacctctagtactctggaa

SEQ ID NO: 662334 - DNA, 25 bp, Mus musculus
gtaactgactacactcgtgacaaac

SEQ ID NO: 662335 - DNA, 25 bp, Mus musculus
gtaactgactactctcgtgacaaac

SEQ ID NO: 662336 - DNA, 25 bp, Mus musculus
gtaactgactggaaacttctcttct

SEQ ID NO: 662337 - DNA, 25 bp, Mus musculus
gtaactgactggtaacttctcttct

SEQ ID NO: 662338 - DNA, 25 bp, Mus musculus
gtaactgagcttcatccagaatgag

SEQ ID NO: 662339 - DNA, 25 bp, Mus musculus
gtaactgagcttgatccagaatgag

SEQ ID NO: 662340 - DNA, 25 bp, Mus musculus
gtaactgaggacactggccattctg

SEQ ID NO: 662341 - DNA, 25 bp, Mus musculus
gtaactgaggactctggccattctg

SEQ ID NO: 662342 - DNA, 25 bp, Mus musculus
gtaactgagtggacctatagagcaa

SEQ ID NO: 662343 - DNA, 25 bp, Mus musculus
gtaactgagtggtcctatagagcaa

SEQ ID NO: 662344 - DNA, 25 bp, Mus musculus
gtaactgatattacccacaccattt

SEQ ID NO: 662345 - DNA, 25 bp, Mus musculus
gtaactgatatttcccacaccattt

SEQ ID NO: 662346 - DNA, 25 bp, Mus musculus
gtaactgatcgcagtactgtaaata

SEQ ID NO: 662347 - DNA, 25 bp, Mus musculus
gtaactgatcgctgtactgtaaata

SEQ ID NO: 662348 - DNA, 25 bp, Mus musculus
gtaactgatgcacatggtctccttt

SEQ ID NO: 662349 - DNA, 25 bp, Mus musculus
gtaactgatgcagatggtctccttt

SEQ ID NO: 662350 - DNA, 25 bp, Mus musculus
gtaactgatggcatgtttgtcttta

SEQ ID NO: 662351 - DNA, 25 bp, Mus musculus
gtaactgatggcttgtttgtcttta

SEQ ID NO: 662352 - DNA, 25 bp, Mus musculus
gtaactgatgttactagcaaactgt

SEQ ID NO: 662353 - DNA, 25 bp, Mus musculus
gtaactgatgtttctagcaaactgt

SEQ ID NO: 662354 - DNA, 25 bp, Mus musculus
gtaactgattacactgtagggcact

SEQ ID NO: 662355 - DNA, 25 bp, Mus musculus
gtaactgattactctgtagggcact

SEQ ID NO: 662356 - DNA, 25 bp, Mus musculus
gtaactgatttcacactgtagtgtg

SEQ ID NO: 662357 - DNA, 25 bp, Mus musculus
gtaactgatttctcactgtagtgtg

SEQ ID NO: 662358 - DNA, 25 bp, Mus musculus
gtaactgcaaataaaccctctcacg

SEQ ID NO: 662359 - DNA, 25 bp, Mus musculus
gtaactgcaaattaaccctctcacg

SEQ ID NO: 662360 - DNA, 25 bp, Mus musculus
gtaactgcaagcctactactcttga

SEQ ID NO: 662361 - DNA, 25 bp, Mus musculus
gtaactgcaagcgtactactcttga

SEQ ID NO: 662362 - DNA, 25 bp, Mus musculus
gtaactgcaaggatagggccctatg

SEQ ID NO: 662363 - DNA, 25 bp, Mus musculus
gtaactgcaaggcaactgaactcgg

SEQ ID NO: 662364 - DNA, 25 bp, Mus musculus
gtaactgcaagggaactgaactcgg

SEQ ID NO: 662365 - DNA, 25 bp, Mus musculus
gtaactgcaaggttagggccctatg

SEQ ID NO: 662366 - DNA, 25 bp, Mus musculus
gtaactgcaatcatccgatgtttat

SEQ ID NO: 662367 - DNA, 25 bp, Mus musculus
gtaactgcaatcttccgatgtttat

SEQ ID NO: 662368 - DNA, 25 bp, Mus musculus
gtaactgcagagagactattagact

SEQ ID NO: 662369 - DNA, 25 bp, Mus musculus
gtaactgcagagagccagggcacac

SEQ ID NO: 662370 - DNA, 25 bp, Mus musculus
gtaactgcagagtgactattagact

SEQ ID NO: 662371 - DNA, 25 bp, Mus musculus
gtaactgcagagtgccagggcacac

SEQ ID NO: 662372 - DNA, 25 bp, Mus musculus
gtaactgcaggtccagactacccaa

SEQ ID NO: 662373 - DNA, 25 bp, Mus musculus
gtaactgcaggtgcagactacccaa

SEQ ID NO: 662374 - DNA, 25 bp, Mus musculus
gtaactgcatgaaggttgtcagctt

SEQ ID NO: 662375 - DNA, 25 bp, Mus musculus
gtaactgcatgatggttgtcagctt

SEQ ID NO: 662376 - DNA, 25 bp, Mus musculus
gtaactgccaagatggaaagtccct

SEQ ID NO: 662377 - DNA, 25 bp, Mus musculus
gtaactgccaagttggaaagtccct

SEQ ID NO: 662378 - DNA, 25 bp, Mus musculus
gtaactgccaatagattcctgtgag

SEQ ID NO: 662379 - DNA, 25 bp, Mus musculus
gtaactgccaattgattcctgtgag

SEQ ID NO: 662380 - DNA, 25 bp, Mus musculus
gtaactgcccttctttctaaggaag

SEQ ID NO: 662381 - DNA, 25 bp, Mus musculus
gtaactgcccttgtttctaaggaag

SEQ ID NO: 662382 - DNA, 25 bp, Mus musculus
gtaactgccgaaccaagaattcttt

SEQ ID NO: 662383 - DNA, 25 bp, Mus musculus
gtaactgccgaagcaagaattcttt

SEQ ID NO: 662384 - DNA, 25 bp, Mus musculus
gtaactgcctctcgactcggaacag

SEQ ID NO: 662385 - DNA, 25 bp, Mus musculus
gtaactgcctctggactcggaacag

SEQ ID NO: 662386 - DNA, 25 bp, Mus musculus
gtaactgcctgacttttgttcatca

SEQ ID NO: 662387 - DNA, 25 bp, Mus musculus
gtaactgcctgagttttgttcatca

SEQ ID NO: 662388 - DNA, 25 bp, Mus musculus
gtaactgcgactcaggagttccttc

SEQ ID NO: 662389 - DNA, 25 bp, Mus musculus
gtaactgcgactgaggagttccttc

SEQ ID NO: 662390 - DNA, 25 bp, Mus musculus
gtaactgcgagaagctttccctgtc

SEQ ID NO: 662391 - DNA, 25 bp, Mus musculus
gtaactgcgagatgctttccctgtc

SEQ ID NO: 662392 - DNA, 25 bp, Mus musculus
gtaactgctagcattgactacctcc

SEQ ID NO: 662393 - DNA, 25 bp, Mus musculus
gtaactgctagctttgactacctcc

SEQ ID NO: 662394 - DNA, 25 bp, Mus musculus
gtaactgctaggaatggctgcccac

SEQ ID NO: 662395 - DNA, 25 bp, Mus musculus
gtaactgctaggtatggctgcccac

SEQ ID NO: 662396 - DNA, 25 bp, Mus musculus
gtaactgctagtactttaaccacat

SEQ ID NO: 662397 - DNA, 25 bp, Mus musculus
gtaactgctagttctttaaccacat

SEQ ID NO: 662398 - DNA, 25 bp, Mus musculus
gtaactgctattaacacgtattcct

SEQ ID NO: 662399 - DNA, 25 bp, Mus musculus
gtaactgctatttacacgtattcct

SEQ ID NO: 662400 - DNA, 25 bp, Mus musculus
gtaactgctcaaattgggtctcaca

SEQ ID NO: 662401 - DNA, 25 bp, Mus musculus
gtaactgctcaatttgggtctcaca

SEQ ID NO: 662402 - DNA, 25 bp, Mus musculus
gtaactgctcccaccggtcacatgc

SEQ ID NO: 662403 - DNA, 25 bp, Mus musculus
gtaactgctccctccggtcacatgc

SEQ ID NO: 662404 - DNA, 25 bp, Mus musculus
gtaactgctggcaatctccttcagt

SEQ ID NO: 662405 - DNA, 25 bp, Mus musculus
gtaactgctggctatctccttcagt

SEQ ID NO: 662406 - DNA, 25 bp, Mus musculus
gtaactgcttaccaacttctcttat

SEQ ID NO: 662407 - DNA, 25 bp, Mus musculus
gtaactgcttacgaacttctcttat

SEQ ID NO: 662408 - DNA, 25 bp, Mus musculus
gtaactgcttgcaacaggtgccatg

SEQ ID NO: 662409 - DNA, 25 bp, Mus musculus
gtaactgcttgctacaggtgccatg

SEQ ID NO: 662410 - DNA, 25 bp, Mus musculus
gtaactggagctacaagcatctgaa

SEQ ID NO: 662411 - DNA, 25 bp, Mus musculus
gtaactggagcttcaagcatctgaa

SEQ ID NO: 662412 - DNA, 25 bp, Mus musculus
gtaactggatacacaactcaggagt

SEQ ID NO: 662413 - DNA, 25 bp, Mus musculus
gtaactggatactcaactcaggagt

SEQ ID NO: 662414 - DNA, 25 bp, Mus musculus
gtaactggcaggactccaggacatt

SEQ ID NO: 662415 - DNA, 25 bp, Mus musculus
gtaactggcaggtctccaggacatt

SEQ ID NO: 662416 - DNA, 25 bp, Mus musculus
gtaactggcattaattgtaggctta

SEQ ID NO: 662417 - DNA, 25 bp, Mus musculus
gtaactggcatttattgtaggctta

SEQ ID NO: 662418 - DNA, 25 bp, Mus musculus
gtaactggccaaaatcctggtctcc

SEQ ID NO: 662419 - DNA, 25 bp, Mus musculus
gtaactggccaatatcctggtctcc

SEQ ID NO: 662420 - DNA, 25 bp, Mus musculus
gtaactggccagaataagacttaca

SEQ ID NO: 662421 - DNA, 25 bp, Mus musculus
gtaactggccagtataagacttaca

SEQ ID NO: 662422 - DNA, 25 bp, Mus musculus
gtaactggcttcctttggacggttg

SEQ ID NO: 662423 - DNA, 25 bp, Mus musculus
gtaactggcttcgtttggacggttg

SEQ ID NO: 662424 - DNA, 25 bp, Mus musculus
gtaactggcttgatggttgatcata

SEQ ID NO: 662425 - DNA, 25 bp, Mus musculus
gtaactggcttgttggttgatcata

SEQ ID NO: 662426 - DNA, 25 bp, Mus musculus
gtaactgggacgaaaggcacctggt

SEQ ID NO: 662427 - DNA, 25 bp, Mus musculus
gtaactgggacgtaaggcacctggt

SEQ ID NO: 662428 - DNA, 25 bp, Mus musculus
gtaactgggctgctttgtctagcca

SEQ ID NO: 662429 - DNA, 25 bp, Mus musculus
gtaactgggctggtttgtctagcca

SEQ ID NO: 662430 - DNA, 25 bp, Mus musculus
gtaactgggtcaaagccttgctgag

SEQ ID NO: 662431 - DNA, 25 bp, Mus musculus
gtaactgggtcatagccttgctgag

SEQ ID NO: 662432 - DNA, 25 bp, Mus musculus
gtaactgggttacagaactggcatt

SEQ ID NO: 662433 - DNA, 25 bp, Mus musculus
gtaactgggttagagaactggcatt

SEQ ID NO: 662434 - DNA, 25 bp, Mus musculus
gtaactggtagtcaataaatctcat

SEQ ID NO: 662435 - DNA, 25 bp, Mus musculus
gtaactggtagtgaataaatctcat

SEQ ID NO: 662436 - DNA, 25 bp, Mus musculus
gtaactggtattatcctctgcatct

SEQ ID NO: 662437 - DNA, 25 bp, Mus musculus
gtaactggtattttcctctgcatct

SEQ ID NO: 662438 - DNA, 25 bp, Mus musculus
gtaactggtcaaaatgcttctcatg

SEQ ID NO: 662439 - DNA, 25 bp, Mus musculus
gtaactggtcaatatgcttctcatg

SEQ ID NO: 662440 - DNA, 25 bp, Mus musculus
gtaactggtgtaaccagcagtttgg

SEQ ID NO: 662441 - DNA, 25 bp, Mus musculus
gtaactggtgtaagtgcacactcat

SEQ ID NO: 662442 - DNA, 25 bp, Mus musculus
gtaactggtgtatccagcagtttgg

SEQ ID NO: 662443 - DNA, 25 bp, Mus musculus
gtaactggtgtatgtgcacactcat

SEQ ID NO: 662444 - DNA, 25 bp, Mus musculus
gtaactggttttcacgggtgttcag

SEQ ID NO: 662445 - DNA, 25 bp, Mus musculus
gtaactggttttgacgggtgttcag

SEQ ID NO: 662446 - DNA, 25 bp, Mus musculus
gtaactgtaaccagatcggctctgt

SEQ ID NO: 662447 - DNA, 25 bp, Mus musculus
gtaactgtaaccattttgggacatg

SEQ ID NO: 662448 - DNA, 25 bp, Mus musculus
gtaactgtaacctgatcggctctgt

SEQ ID NO: 662449 - DNA, 25 bp, Mus musculus
gtaactgtaacctttttgggacatg

SEQ ID NO: 662450 - DNA, 25 bp, Mus musculus
gtaactgtaagcctgcaagaagaca

SEQ ID NO: 662451 - DNA, 25 bp, Mus musculus
gtaactgtaagcgtgcaagaagaca

SEQ ID NO: 662452 - DNA, 25 bp, Mus musculus
gtaactgtacagagatttcaaatac

SEQ ID NO: 662453 - DNA, 25 bp, Mus musculus
gtaactgtacagtgatttcaaatac

SEQ ID NO: 662454 - DNA, 25 bp, Mus musculus
gtaactgtaccacctaagtcagcag

SEQ ID NO: 662455 - DNA, 25 bp, Mus musculus
gtaactgtaccagctaagtcagcag

SEQ ID NO: 662456 - DNA, 25 bp, Mus musculus
gtaactgtacccatctgcatggaaa

SEQ ID NO: 662457 - DNA, 25 bp, Mus musculus
gtaactgtacccttctgcatggaaa

SEQ ID NO: 662458 - DNA, 25 bp, Mus musculus
gtaactgtagacctgaacccaagcc

SEQ ID NO: 662459 - DNA, 25 bp, Mus musculus
gtaactgtagacgtgaacccaagcc

SEQ ID NO: 662460 - DNA, 25 bp, Mus musculus
gtaactgtagtactactaggacctt

SEQ ID NO: 662461 - DNA, 25 bp, Mus musculus
gtaactgtagtagtactaggacctt

SEQ ID NO: 662462 - DNA, 25 bp, Mus musculus
gtaactgtagtgacgcctttgtaac

SEQ ID NO: 662463 - DNA, 25 bp, Mus musculus
gtaactgtagtgcattctgtactgg

SEQ ID NO: 662464 - DNA, 25 bp, Mus musculus
gtaactgtagtggattctgtactgg

SEQ ID NO: 662465 - DNA, 25 bp, Mus musculus
gtaactgtagtgtcgcctttgtaac

SEQ ID NO: 662466 - DNA, 25 bp, Mus musculus
gtaactgtcagtcaggtgaccaaga

SEQ ID NO: 662467 - DNA, 25 bp, Mus musculus
gtaactgtcagtgaggtgaccaaga

SEQ ID NO: 662468 - DNA, 25 bp, Mus musculus
gtaactgtctctacggtctgtggag

SEQ ID NO: 662469 - DNA, 25 bp, Mus musculus
gtaactgtctcttcggtctgtggag

SEQ ID NO: 662470 - DNA, 25 bp, Mus musculus
gtaactgtgaacaatttccttatgt

SEQ ID NO: 662471 - DNA, 25 bp, Mus musculus
gtaactgtgaacatgctataatcct

SEQ ID NO: 662472 - DNA, 25 bp, Mus musculus
gtaactgtgaactatttccttatgt

SEQ ID NO: 662473 - DNA, 25 bp, Mus musculus
gtaactgtgaacttgctataatcct

SEQ ID NO: 662474 - DNA, 25 bp, Mus musculus
gtaactgtgagcagtccacgcgggt

SEQ ID NO: 662475 - DNA, 25 bp, Mus musculus
gtaactgtgagctgtccacgcgggt

SEQ ID NO: 662476 - DNA, 25 bp, Mus musculus
gtaactgtgatcaagtattcatctg

SEQ ID NO: 662477 - DNA, 25 bp, Mus musculus
gtaactgtgatctagtattcatctg

SEQ ID NO: 662478 - DNA, 25 bp, Mus musculus
gtaactgtgattctgattcgtaata

SEQ ID NO: 662479 - DNA, 25 bp, Mus musculus
gtaactgtgattgtgattcgtaata

SEQ ID NO: 662480 - DNA, 25 bp, Mus musculus
gtaactgtggacattgctatgcttt

SEQ ID NO: 662481 - DNA, 25 bp, Mus musculus
gtaactgtggactttgctatgcttt

SEQ ID NO: 662482 - DNA, 25 bp, Mus musculus
gtaactgtgggaacatatccaggct

SEQ ID NO: 662483 - DNA, 25 bp, Mus musculus
gtaactgtgggatcatatccaggct

SEQ ID NO: 662484 - DNA, 25 bp, Mus musculus
gtaactgtgggcaacgtcaccgtca

SEQ ID NO: 662485 - DNA, 25 bp, Mus musculus
gtaactgtgggctacgtcaccgtca

SEQ ID NO: 662486 - DNA, 25 bp, Mus musculus
gtaactgtgtaaccactctgggaca

SEQ ID NO: 662487 - DNA, 25 bp, Mus musculus
gtaactgtgtaagcactctgggaca

SEQ ID NO: 662488 - DNA, 25 bp, Mus musculus
gtaactgtgtgtaaaagtgcactct

SEQ ID NO: 662489 - DNA, 25 bp, Mus musculus
gtaactgtgtgtagcttgttattgt

SEQ ID NO: 662490 - DNA, 25 bp, Mus musculus
gtaactgtgtgttaaagtgcactct

SEQ ID NO: 662491 - DNA, 25 bp, Mus musculus
gtaactgtgtgttgcttgttattgt

SEQ ID NO: 662492 - DNA, 25 bp, Mus musculus
gtaactgtgtttcatttggaccttg

SEQ ID NO: 662493 - DNA, 25 bp, Mus musculus
gtaactgtgtttccacgcttgagaa

SEQ ID NO: 662494 - DNA, 25 bp, Mus musculus
gtaactgtgtttgatttggaccttg

SEQ ID NO: 662495 - DNA, 25 bp, Mus musculus
gtaactgtgtttgcacgcttgagaa

SEQ ID NO: 662496 - DNA, 25 bp, Mus musculus
gtaactgttaaccaagcctttcatt

SEQ ID NO: 662497 - DNA, 25 bp, Mus musculus
gtaactgttaacgaagcctttcatt

SEQ ID NO: 662498 - DNA, 25 bp, Mus musculus
gtaactgttacaacctgagtacatt

SEQ ID NO: 662499 - DNA, 25 bp, Mus musculus
gtaactgttacatcctgagtacatt

SEQ ID NO: 662500 - DNA, 25 bp, Mus musculus
gtaactgttagacaatctccctttg

SEQ ID NO: 662501 - DNA, 25 bp, Mus musculus
gtaactgttagagaatctccctttg

SEQ ID NO: 662502 - DNA, 25 bp, Mus musculus
gtaactgttaggattaggtcataga

SEQ ID NO: 662503 - DNA, 25 bp, Mus musculus
gtaactgttaggtttaggtcataga

SEQ ID NO: 662504 - DNA, 25 bp, Mus musculus
gtaactgttataacaacccactttg

SEQ ID NO: 662505 - DNA, 25 bp, Mus musculus
gtaactgttatatcaacccactttg

SEQ ID NO: 662506 - DNA, 25 bp, Mus musculus
gtaactgttatcaccgcgcttgtga

SEQ ID NO: 662507 - DNA, 25 bp, Mus musculus
gtaactgttatctccgcgcttgtga

SEQ ID NO: 662508 - DNA, 25 bp, Mus musculus
gtaactgttcaaaatcctttctaat

SEQ ID NO: 662509 - DNA, 25 bp, Mus musculus
gtaactgttcaatatcctttctaat

SEQ ID NO: 662510 - DNA, 25 bp, Mus musculus
gtaactgttcacattactctaaaag

SEQ ID NO: 662511 - DNA, 25 bp, Mus musculus
gtaactgttcactttactctaaaag

SEQ ID NO: 662512 - DNA, 25 bp, Mus musculus
gtaactgttctgaaggtgtgaccat

SEQ ID NO: 662513 - DNA, 25 bp, Mus musculus
gtaactgttctgtaggtgtgaccat

SEQ ID NO: 662514 - DNA, 25 bp, Mus musculus
gtaactgttgggactcaggcaacca

SEQ ID NO: 662515 - DNA, 25 bp, Mus musculus
gtaactgttgggtctcaggcaacca

SEQ ID NO: 662516 - DNA, 25 bp, Mus musculus
gtaactgttggtacaggccattgag

SEQ ID NO: 662517 - DNA, 25 bp, Mus musculus
gtaactgttggttcaggccattgag

SEQ ID NO: 662518 - DNA, 25 bp, Mus musculus
gtaactgtttcaccattcggcattt

SEQ ID NO: 662519 - DNA, 25 bp, Mus musculus
gtaactgtttcagcattcggcattt

SEQ ID NO: 662520 - DNA, 25 bp, Mus musculus
gtaacttaaagccagctacttccaa

SEQ ID NO: 662521 - DNA, 25 bp, Mus musculus
gtaacttaaagcgagctacttccaa

SEQ ID NO: 662522 - DNA, 25 bp, Mus musculus
gtaacttaacaaactcttgagggct

SEQ ID NO: 662523 - DNA, 25 bp, Mus musculus
gtaacttaacaatctcttgagggct

SEQ ID NO: 662524 - DNA, 25 bp, Mus musculus
gtaacttaacatcactttggagact

SEQ ID NO: 662525 - DNA, 25 bp, Mus musculus
gtaacttaacatgactttggagact

SEQ ID NO: 662526 - DNA, 25 bp, Mus musculus
gtaacttaagcgcacactcctgctc

SEQ ID NO: 662527 - DNA, 25 bp, Mus musculus
gtaacttaagcggacactcctgctc

SEQ ID NO: 662528 - DNA, 25 bp, Mus musculus
gtaacttaccatagtttctggccac

SEQ ID NO: 662529 - DNA, 25 bp, Mus musculus
gtaacttaccattgtttctggccac

SEQ ID NO: 662530 - DNA, 25 bp, Mus musculus
gtaacttacctgatgtgtggattct

SEQ ID NO: 662531 - DNA, 25 bp, Mus musculus
gtaacttacctgttgtgtggattct

SEQ ID NO: 662532 - DNA, 25 bp, Mus musculus
gtaacttactaacttccaaatctgc

SEQ ID NO: 662533 - DNA, 25 bp, Mus musculus
gtaacttactaagttccaaatctgc

SEQ ID NO: 662534 - DNA, 25 bp, Mus musculus
gtaacttaggctcgcatgttcatgt

SEQ ID NO: 662535 - DNA, 25 bp, Mus musculus
gtaacttaggctggcatgttcatgt

SEQ ID NO: 662536 - DNA, 25 bp, Mus musculus
gtaacttagtcaaaaccgtggctgg

SEQ ID NO: 662537 - DNA, 25 bp, Mus musculus
gtaacttagtcataaccgtggctgg

SEQ ID NO: 662538 - DNA, 25 bp, Mus musculus
gtaacttagtgacgctctgacctga

SEQ ID NO: 662539 - DNA, 25 bp, Mus musculus
gtaacttagtgaggctctgacctga

SEQ ID NO: 662540 - DNA, 25 bp, Mus musculus
gtaacttatgaaatgtggagccgtt

SEQ ID NO: 662541 - DNA, 25 bp, Mus musculus
gtaacttatgaattgtggagccgtt

SEQ ID NO: 662542 - DNA, 25 bp, Mus musculus
gtaacttattatacagcttggcgag

SEQ ID NO: 662543 - DNA, 25 bp, Mus musculus
gtaacttattattcagcttggcgag

SEQ ID NO: 662544 - DNA, 25 bp, Mus musculus
gtaacttcaaagattctgccagccc

SEQ ID NO: 662545 - DNA, 25 bp, Mus musculus
gtaacttcaaagtttctgccagccc

SEQ ID NO: 662546 - DNA, 25 bp, Mus musculus
gtaacttcagctacatctgacctga

SEQ ID NO: 662547 - DNA, 25 bp, Mus musculus
gtaacttcagcttcatctgacctga

SEQ ID NO: 662548 - DNA, 25 bp, Mus musculus
gtaacttcaggcagagtgactatgg

SEQ ID NO: 662549 - DNA, 25 bp, Mus musculus
gtaacttcaggctgagtgactatgg

SEQ ID NO: 662550 - DNA, 25 bp, Mus musculus
gtaacttcaggtcgcagattgtcat

SEQ ID NO: 662551 - DNA, 25 bp, Mus musculus
gtaacttcaggtggcagattgtcat

SEQ ID NO: 662552 - DNA, 25 bp, Mus musculus
gtaacttcatgcataccatgtgtgt

SEQ ID NO: 662553 - DNA, 25 bp, Mus musculus
gtaacttcatgcttaccatgtgtgt

SEQ ID NO: 662554 - DNA, 25 bp, Mus musculus
gtaacttccagtcttgttgaccatt

SEQ ID NO: 662555 - DNA, 25 bp, Mus musculus
gtaacttccagtgttgttgaccatt

SEQ ID NO: 662556 - DNA, 25 bp, Mus musculus
gtaacttcccatagtgcttttcatg

SEQ ID NO: 662557 - DNA, 25 bp, Mus musculus
gtaacttcccattgtgcttttcatg

SEQ ID NO: 662558 - DNA, 25 bp, Mus musculus
gtaacttccctaaaagccgactcag

SEQ ID NO: 662559 - DNA, 25 bp, Mus musculus
gtaacttccctataagccgactcag

SEQ ID NO: 662560 - DNA, 25 bp, Mus musculus
gtaacttcctacaaacttcaagaca

SEQ ID NO: 662561 - DNA, 25 bp, Mus musculus
gtaacttcctacctagaaactgcta

SEQ ID NO: 662562 - DNA, 25 bp, Mus musculus
gtaacttcctacgtagaaactgcta

SEQ ID NO: 662563 - DNA, 25 bp, Mus musculus
gtaacttcctactaacttcaagaca

SEQ ID NO: 662564 - DNA, 25 bp, Mus musculus
gtaacttcctgtagccagatctaaa

SEQ ID NO: 662565 - DNA, 25 bp, Mus musculus
gtaacttcctgttgccagatctaaa

SEQ ID NO: 662566 - DNA, 25 bp, Mus musculus
gtaacttcgcaacctgactcgtatt

SEQ ID NO: 662567 - DNA, 25 bp, Mus musculus
gtaacttcgcaagctgactcgtatt

SEQ ID NO: 662568 - DNA, 25 bp, Mus musculus
gtaacttcgcggagaaggcaccgtc

SEQ ID NO: 662569 - DNA, 25 bp, Mus musculus
gtaacttcgcggtgaaggcaccgtc

SEQ ID NO: 662570 - DNA, 25 bp, Mus musculus
gtaacttctaagcttcttgctcatt

SEQ ID NO: 662571 - DNA, 25 bp, Mus musculus
gtaacttctaaggttcttgctcatt

SEQ ID NO: 662572 - DNA, 25 bp, Mus musculus
gtaacttctcacagtcaaacttagg

SEQ ID NO: 662573 - DNA, 25 bp, Mus musculus
gtaacttctcactgtcaaacttagg

SEQ ID NO: 662574 - DNA, 25 bp, Mus musculus
gtaacttctcctaaaacaggatgtg

SEQ ID NO: 662575 - DNA, 25 bp, Mus musculus
gtaacttctccttaaacaggatgtg

SEQ ID NO: 662576 - DNA, 25 bp, Mus musculus
gtaacttctctcaggttgtttgggt

SEQ ID NO: 662577 - DNA, 25 bp, Mus musculus
gtaacttctctcatctcaaataggt

SEQ ID NO: 662578 - DNA, 25 bp, Mus musculus
gtaacttctctctggttgtttgggt

SEQ ID NO: 662579 - DNA, 25 bp, Mus musculus
gtaacttctctcttctcaaataggt

SEQ ID NO: 662580 - DNA, 25 bp, Mus musculus
gtaacttcttgactgtggtagactt

SEQ ID NO: 662581 - DNA, 25 bp, Mus musculus
gtaacttcttgagtgtggtagactt

SEQ ID NO: 662582 - DNA, 25 bp, Mus musculus
gtaacttcttgtataagcatctcaa

SEQ ID NO: 662583 - DNA, 25 bp, Mus musculus
gtaacttcttgtttaagcatctcaa

SEQ ID NO: 662584 - DNA, 25 bp, Mus musculus
gtaacttgaatgacgagccagccct

SEQ ID NO: 662585 - DNA, 25 bp, Mus musculus
gtaacttgaatgacttcaccaaatg

SEQ ID NO: 662586 - DNA, 25 bp, Mus musculus
gtaacttgaatgtcgagccagccct

SEQ ID NO: 662587 - DNA, 25 bp, Mus musculus
gtaacttgaatgtcttcaccaaatg

SEQ ID NO: 662588 - DNA, 25 bp, Mus musculus
gtaacttgacacacaaccttcatac

SEQ ID NO: 662589 - DNA, 25 bp, Mus musculus
gtaacttgacactcaaccttcatac

SEQ ID NO: 662590 - DNA, 25 bp, Mus musculus
gtaacttgcgttatgaagatttcta

SEQ ID NO: 662591 - DNA, 25 bp, Mus musculus
gtaacttgcgttttgaagatttcta

SEQ ID NO: 662592 - DNA, 25 bp, Mus musculus
gtaacttgctcaagtcaaaatgctt

SEQ ID NO: 662593 - DNA, 25 bp, Mus musculus
gtaacttgctcactgtaccgccttg

SEQ ID NO: 662594 - DNA, 25 bp, Mus musculus
gtaacttgctcagtgtaccgccttg

SEQ ID NO: 662595 - DNA, 25 bp, Mus musculus
gtaacttgctcatgtcaaaatgctt

SEQ ID NO: 662596 - DNA, 25 bp, Mus musculus
gtaacttgctttaattattgtgggt

SEQ ID NO: 662597 - DNA, 25 bp, Mus musculus
gtaacttgcttttattattgtgggt

SEQ ID NO: 662598 - DNA, 25 bp, Mus musculus
gtaacttggattcctataacctgga

SEQ ID NO: 662599 - DNA, 25 bp, Mus musculus
gtaacttggattgctataacctgga

SEQ ID NO: 662600 - DNA, 25 bp, Mus musculus
gtaacttggcatctgtattgatagt

SEQ ID NO: 662601 - DNA, 25 bp, Mus musculus
gtaacttggcatgtgtattgatagt

SEQ ID NO: 662602 - DNA, 25 bp, Mus musculus
gtaacttggtttatcatgatccaat

SEQ ID NO: 662603 - DNA, 25 bp, Mus musculus
gtaacttggtttttcatgatccaat

SEQ ID NO: 662604 - DNA, 25 bp, Mus musculus
gtaacttgtagtaccaggaggcttt

SEQ ID NO: 662605 - DNA, 25 bp, Mus musculus
gtaacttgtagttccaggaggcttt

SEQ ID NO: 662606 - DNA, 25 bp, Mus musculus
gtaacttgtcaaaggtggagctgca

SEQ ID NO: 662607 - DNA, 25 bp, Mus musculus
gtaacttgtcaaccactgaaagctt

SEQ ID NO: 662608 - DNA, 25 bp, Mus musculus
gtaacttgtcaagcactgaaagctt

SEQ ID NO: 662609 - DNA, 25 bp, Mus musculus
gtaacttgtcaatggtggagctgca

SEQ ID NO: 662610 - DNA, 25 bp, Mus musculus
gtaacttgtcagattgtctatgaac

SEQ ID NO: 662611 - DNA, 25 bp, Mus musculus
gtaacttgtcagtttgtctatgaac

SEQ ID NO: 662612 - DNA, 25 bp, Mus musculus
gtaacttgtgaaattggcttgccgt

SEQ ID NO: 662613 - DNA, 25 bp, Mus musculus
gtaacttgtgaatttggcttgccgt

SEQ ID NO: 662614 - DNA, 25 bp, Mus musculus
gtaacttgtgatatcttctccttct

SEQ ID NO: 662615 - DNA, 25 bp, Mus musculus
gtaacttgtgatttcttctccttct

SEQ ID NO: 662616 - DNA, 25 bp, Mus musculus
gtaacttgtggacagctcttttggg

SEQ ID NO: 662617 - DNA, 25 bp, Mus musculus
gtaacttgtggagagctcttttggg

SEQ ID NO: 662618 - DNA, 25 bp, Mus musculus
gtaacttgtgtcatttagtgtactt

SEQ ID NO: 662619 - DNA, 25 bp, Mus musculus
gtaacttgtgtcttttagtgtactt

SEQ ID NO: 662620 - DNA, 25 bp, Mus musculus
gtaactttaccaaagtgtgcaggtg

SEQ ID NO: 662621 - DNA, 25 bp, Mus musculus
gtaactttaccatagtgtgcaggtg

SEQ ID NO: 662622 - DNA, 25 bp, Mus musculus
gtaactttagccatgaccttgaatc

SEQ ID NO: 662623 - DNA, 25 bp, Mus musculus
gtaactttagccttgaccttgaatc

SEQ ID NO: 662624 - DNA, 25 bp, Mus musculus
gtaactttatcccactgtattattt

SEQ ID NO: 662625 - DNA, 25 bp, Mus musculus
gtaactttatccgactgtattattt

SEQ ID NO: 662626 - DNA, 25 bp, Mus musculus
gtaactttcacaacaaatttcatat

SEQ ID NO: 662627 - DNA, 25 bp, Mus musculus
gtaactttcacatcaaatttcatat

SEQ ID NO: 662628 - DNA, 25 bp, Mus musculus
gtaactttccttctactcaattggg

SEQ ID NO: 662629 - DNA, 25 bp, Mus musculus
gtaactttccttgtactcaattggg

SEQ ID NO: 662630 - DNA, 25 bp, Mus musculus
gtaactttcgtacgaaactgctcgg

SEQ ID NO: 662631 - DNA, 25 bp, Mus musculus
gtaactttcgtaggaaactgctcgg

SEQ ID NO: 662632 - DNA, 25 bp, Mus musculus
gtaactttctaaaacagtggctctt

SEQ ID NO: 662633 - DNA, 25 bp, Mus musculus
gtaactttctaaatgactcttggaa

SEQ ID NO: 662634 - DNA, 25 bp, Mus musculus
gtaactttctaatacagtggctctt

SEQ ID NO: 662635 - DNA, 25 bp, Mus musculus
gtaactttctaattgactcttggaa

SEQ ID NO: 662636 - DNA, 25 bp, Mus musculus
gtaactttgattcccctgacataat

SEQ ID NO: 662637 - DNA, 25 bp, Mus musculus
gtaactttgattgccctgacataat

SEQ ID NO: 662638 - DNA, 25 bp, Mus musculus
gtaactttgctaactgagtgttcag

SEQ ID NO: 662639 - DNA, 25 bp, Mus musculus
gtaactttgctatctgagtgttcag

SEQ ID NO: 662640 - DNA, 25 bp, Mus musculus
gtaacttttctacaacttcccatcg

SEQ ID NO: 662641 - DNA, 25 bp, Mus musculus
gtaacttttctagaacttcccatcg

SEQ ID NO: 662642 - DNA, 25 bp, Mus musculus
gtaacttttcttaatgagcattctt

SEQ ID NO: 662643 - DNA, 25 bp, Mus musculus
gtaacttttctttatgagcattctt

SEQ ID NO: 662644 - DNA, 25 bp, Mus musculus
gtaactttttcactcaacagtccca

SEQ ID NO: 662645 - DNA, 25 bp, Mus musculus
gtaactttttcagtcaacagtccca

SEQ ID NO: 662646 - DNA, 25 bp, Mus musculus
gtaagaaaacccagtgctgctctaa

SEQ ID NO: 662647 - DNA, 25 bp, Mus musculus
gtaagaaaaccctgtgctgctctaa

SEQ ID NO: 662648 - DNA, 25 bp, Mus musculus
gtaagaaaagtcagggccccatgag

SEQ ID NO: 662649 - DNA, 25 bp, Mus musculus
gtaagaaaagtctgggccccatgag

SEQ ID NO: 662650 - DNA, 25 bp, Mus musculus
gtaagaaacacgatgccttgccctg

SEQ ID NO: 662651 - DNA, 25 bp, Mus musculus
gtaagaaacacgttgccttgccctg

SEQ ID NO: 662652 - DNA, 25 bp, Mus musculus
gtaagaaagagtatctgtccctgat

SEQ ID NO: 662653 - DNA, 25 bp, Mus musculus
gtaagaaagagtttctgtccctgat

SEQ ID NO: 662654 - DNA, 25 bp, Mus musculus
gtaagaaagcacaggccatcgacta

SEQ ID NO: 662655 - DNA, 25 bp, Mus musculus
gtaagaaagcactggccatcgacta

SEQ ID NO: 662656 - DNA, 25 bp, Mus musculus
gtaagaaaggccagcggacccacac

SEQ ID NO: 662657 - DNA, 25 bp, Mus musculus
gtaagaaaggcctgcggacccacac

SEQ ID NO: 662658 - DNA, 25 bp, Mus musculus
gtaagaaagtcacctcctcagaggt

SEQ ID NO: 662659 - DNA, 25 bp, Mus musculus
gtaagaaagtcagctcctcagaggt

SEQ ID NO: 662660 - DNA, 25 bp, Mus musculus
gtaagaaatcctcaggcttcctctc

SEQ ID NO: 662661 - DNA, 25 bp, Mus musculus
gtaagaaatcctgaggcttcctctc

SEQ ID NO: 662662 - DNA, 25 bp, Mus musculus
gtaagaacaagactctacgctatgg

SEQ ID NO: 662663 - DNA, 25 bp, Mus musculus
gtaagaacaagagtctacgctatgg

SEQ ID NO: 662664 - DNA, 25 bp, Mus musculus
gtaagaacagcaacgcctacctgga

SEQ ID NO: 662665 - DNA, 25 bp, Mus musculus
gtaagaacagcatcgcctacctgga

SEQ ID NO: 662666 - DNA, 25 bp, Mus musculus
gtaagaacatacattttctaacctg

SEQ ID NO: 662667 - DNA, 25 bp, Mus musculus
gtaagaacatactttttctaacctg

SEQ ID NO: 662668 - DNA, 25 bp, Mus musculus
gtaagaacatccaagactacatgaa

SEQ ID NO: 662669 - DNA, 25 bp, Mus musculus
gtaagaacatcctagactacatgaa

SEQ ID NO: 662670 - DNA, 25 bp, Mus musculus
gtaagaacctgtatgcacagatatt

SEQ ID NO: 662671 - DNA, 25 bp, Mus musculus
gtaagaacctgtttgcacagatatt

SEQ ID NO: 662672 - DNA, 25 bp, Mus musculus
gtaagaaccttcaggatgccctcac

SEQ ID NO: 662673 - DNA, 25 bp, Mus musculus
gtaagaaccttctggatgccctcac

SEQ ID NO: 662674 - DNA, 25 bp, Mus musculus
gtaagaactacaaaccaaatatatt

SEQ ID NO: 662675 - DNA, 25 bp, Mus musculus
gtaagaactacataccaaatatatt

SEQ ID NO: 662676 - DNA, 25 bp, Mus musculus
gtaagaactcacaaacaccaacctc

SEQ ID NO: 662677 - DNA, 25 bp, Mus musculus
gtaagaactcactaacaccaacctc

SEQ ID NO: 662678 - DNA, 25 bp, Mus musculus
gtaagaactcatcgaggagaggctc

SEQ ID NO: 662679 - DNA, 25 bp, Mus musculus
gtaagaactcatggaggagaggctc

SEQ ID NO: 662680 - DNA, 25 bp, Mus musculus
gtaagaactctacagctgtgaccat

SEQ ID NO: 662681 - DNA, 25 bp, Mus musculus
gtaagaactctagagctgtgaccat

SEQ ID NO: 662682 - DNA, 25 bp, Mus musculus
gtaagaactgtcacactgaacgccc

SEQ ID NO: 662683 - DNA, 25 bp, Mus musculus
gtaagaactgtctcactgaacgccc

SEQ ID NO: 662684 - DNA, 25 bp, Mus musculus
gtaagaactgtgatgctcttacatg

SEQ ID NO: 662685 - DNA, 25 bp, Mus musculus
gtaagaactgtgttgctcttacatg

SEQ ID NO: 662686 - DNA, 25 bp, Mus musculus
gtaagaagaaatctccagctcctgt

SEQ ID NO: 662687 - DNA, 25 bp, Mus musculus
gtaagaagaaatgtccagctcctgt

SEQ ID NO: 662688 - DNA, 25 bp, Mus musculus
gtaagaagacaaacactcccttgtg

SEQ ID NO: 662689 - DNA, 25 bp, Mus musculus
gtaagaagacaatcactcccttgtg

SEQ ID NO: 662690 - DNA, 25 bp, Mus musculus
gtaagaagactaaccgtgcatgaag

SEQ ID NO: 662691 - DNA, 25 bp, Mus musculus
gtaagaagactatccgtgcatgaag

SEQ ID NO: 662692 - DNA, 25 bp, Mus musculus
gtaagaagccagcagaccgcaggca

SEQ ID NO: 662693 - DNA, 25 bp, Mus musculus
gtaagaagccaggagaccgcaggca

SEQ ID NO: 662694 - DNA, 25 bp, Mus musculus
gtaagaagcctgacctgcatgagtc

SEQ ID NO: 662695 - DNA, 25 bp, Mus musculus
gtaagaagcctgtcctgcatgagtc

SEQ ID NO: 662696 - DNA, 25 bp, Mus musculus
gtaagaaggccaagtcagctcaagg

SEQ ID NO: 662697 - DNA, 25 bp, Mus musculus
gtaagaaggccatgtcagctcaagg

SEQ ID NO: 662698 - DNA, 25 bp, Mus musculus
gtaagaaggtctagcccactgtggg

SEQ ID NO: 662699 - DNA, 25 bp, Mus musculus
gtaagaaggtcttgcccactgtggg

SEQ ID NO: 662700 - DNA, 25 bp, Mus musculus
gtaagaagtgaaagtacctcacctt

SEQ ID NO: 662701 - DNA, 25 bp, Mus musculus
gtaagaagtgaatgtacctcacctt

SEQ ID NO: 662702 - DNA, 25 bp, Mus musculus
gtaagaagttcacatcacccttggc

SEQ ID NO: 662703 - DNA, 25 bp, Mus musculus
gtaagaagttcagatcacccttggc

SEQ ID NO: 662704 - DNA, 25 bp, Mus musculus
gtaagaatacccacaagcctggctt

SEQ ID NO: 662705 - DNA, 25 bp, Mus musculus
gtaagaataccctcaagcctggctt

SEQ ID NO: 662706 - DNA, 25 bp, Mus musculus
gtaagaatcgggaatctggcagaaa

SEQ ID NO: 662707 - DNA, 25 bp, Mus musculus
gtaagaatcgggtatctggcagaaa

SEQ ID NO: 662708 - DNA, 25 bp, Mus musculus
gtaagaatgcagaccagcctgaagt

SEQ ID NO: 662709 - DNA, 25 bp, Mus musculus
gtaagaatgcagtccagcctgaagt

SEQ ID NO: 662710 - DNA, 25 bp, Mus musculus
gtaagaatgccaccccaggctttgg

SEQ ID NO: 662711 - DNA, 25 bp, Mus musculus
gtaagaatgccagcccaggctttgg

SEQ ID NO: 662712 - DNA, 25 bp, Mus musculus
gtaagaatggacacgccgctgattt

SEQ ID NO: 662713 - DNA, 25 bp, Mus musculus
gtaagaatggactcgccgctgattt

SEQ ID NO: 662714 - DNA, 25 bp, Mus musculus
gtaagaatggccactgtctgccaaa

SEQ ID NO: 662715 - DNA, 25 bp, Mus musculus
gtaagaatggcctctgtctgccaaa

SEQ ID NO: 662716 - DNA, 25 bp, Mus musculus
gtaagaatggttcccgtaggctcac

SEQ ID NO: 662717 - DNA, 25 bp, Mus musculus
gtaagaatggttgccgtaggctcac

SEQ ID NO: 662718 - DNA, 25 bp, Mus musculus
gtaagaatgtataaccaacactcca

SEQ ID NO: 662719 - DNA, 25 bp, Mus musculus
gtaagaatgtattaccaacactcca

SEQ ID NO: 662720 - DNA, 25 bp, Mus musculus
gtaagaattcatcccacaactagag

SEQ ID NO: 662721 - DNA, 25 bp, Mus musculus
gtaagaattcatgccacaactagag

SEQ ID NO: 662722 - DNA, 25 bp, Mus musculus
gtaagaattcccaaacatccaggga

SEQ ID NO: 662723 - DNA, 25 bp, Mus musculus
gtaagaattcccctggtgacttcat

SEQ ID NO: 662724 - DNA, 25 bp, Mus musculus
gtaagaattcccgtggtgacttcat

SEQ ID NO: 662725 - DNA, 25 bp, Mus musculus
gtaagaattccctaacatccaggga

SEQ ID NO: 662726 - DNA, 25 bp, Mus musculus
gtaagaattgatcctgtcccaggaa

SEQ ID NO: 662727 - DNA, 25 bp, Mus musculus
gtaagaattgatgctgtcccaggaa

SEQ ID NO: 662728 - DNA, 25 bp, Mus musculus
gtaagaatttctctccaggcctcgc

SEQ ID NO: 662729 - DNA, 25 bp, Mus musculus
gtaagaatttctgtccaggcctcgc

SEQ ID NO: 662730 - DNA, 25 bp, Mus musculus
gtaagaatttgtacctgcaggccgg

SEQ ID NO: 662731 - DNA, 25 bp, Mus musculus
gtaagaatttgttcctgcaggccgg

SEQ ID NO: 662732 - DNA, 25 bp, Mus musculus
gtaagaattttccagctgcagtcaa

SEQ ID NO: 662733 - DNA, 25 bp, Mus musculus
gtaagaattttcgagctgcagtcaa

SEQ ID NO: 662734 - DNA, 25 bp, Mus musculus
gtaagacaagaaccctgaccgccca

SEQ ID NO: 662735 - DNA, 25 bp, Mus musculus
gtaagacaagaagcctgaccgccca

SEQ ID NO: 662736 - DNA, 25 bp, Mus musculus
gtaagacacaggaccacaactaatt

SEQ ID NO: 662737 - DNA, 25 bp, Mus musculus
gtaagacacaggtccacaactaatt

SEQ ID NO: 662738 - DNA, 25 bp, Mus musculus
gtaagacaccagctggttccaaggt

SEQ ID NO: 662739 - DNA, 25 bp, Mus musculus
gtaagacaccaggtggttccaaggt

SEQ ID NO: 662740 - DNA, 25 bp, Mus musculus
gtaagacacctaacttcaggcttgt

SEQ ID NO: 662741 - DNA, 25 bp, Mus musculus
gtaagacacctatcttcaggcttgt

SEQ ID NO: 662742 - DNA, 25 bp, Mus musculus
gtaagacactgtctgctgcttcgga

SEQ ID NO: 662743 - DNA, 25 bp, Mus musculus
gtaagacactgtgtgctgcttcgga

SEQ ID NO: 662744 - DNA, 25 bp, Mus musculus
gtaagacaggctccagctcttttcc

SEQ ID NO: 662745 - DNA, 25 bp, Mus musculus
gtaagacaggctgcagctcttttcc

SEQ ID NO: 662746 - DNA, 25 bp, Mus musculus
gtaagacagggccaatcatcatcat

SEQ ID NO: 662747 - DNA, 25 bp, Mus musculus
gtaagacagggcgaatcatcatcat

SEQ ID NO: 662748 - DNA, 25 bp, Mus musculus
gtaagacagtccattgccatcggag

SEQ ID NO: 662749 - DNA, 25 bp, Mus musculus
gtaagacagtcctttgccatcggag

SEQ ID NO: 662750 - DNA, 25 bp, Mus musculus
gtaagacatactccagttgattcga

SEQ ID NO: 662751 - DNA, 25 bp, Mus musculus
gtaagacatactgcagttgattcga

SEQ ID NO: 662752 - DNA, 25 bp, Mus musculus
gtaagacatcctcttatccctacac

SEQ ID NO: 662753 - DNA, 25 bp, Mus musculus
gtaagacatcctgttatccctacac

SEQ ID NO: 662754 - DNA, 25 bp, Mus musculus
gtaagacatggcctctttgtgccac

SEQ ID NO: 662755 - DNA, 25 bp, Mus musculus
gtaagacatggcgtctttgtgccac

SEQ ID NO: 662756 - DNA, 25 bp, Mus musculus
gtaagaccagcccagttcagtgatc

SEQ ID NO: 662757 - DNA, 25 bp, Mus musculus
gtaagaccagccgagttcagtgatc

SEQ ID NO: 662758 - DNA, 25 bp, Mus musculus
gtaagaccataaattagacactgca

SEQ ID NO: 662759 - DNA, 25 bp, Mus musculus
gtaagaccataatttagacactgca

SEQ ID NO: 662760 - DNA, 25 bp, Mus musculus
gtaagaccataccatttattccaat

SEQ ID NO: 662761 - DNA, 25 bp, Mus musculus
gtaagaccatacgatttattccaat

SEQ ID NO: 662762 - DNA, 25 bp, Mus musculus
gtaagaccatctcaaacttgacctt

SEQ ID NO: 662763 - DNA, 25 bp, Mus musculus
gtaagaccatctgaaacttgacctt

SEQ ID NO: 662764 - DNA, 25 bp, Mus musculus
gtaagaccatgcatgtgtccccaga

SEQ ID NO: 662765 - DNA, 25 bp, Mus musculus
gtaagaccatgcttgtgtccccaga

SEQ ID NO: 662766 - DNA, 25 bp, Mus musculus
gtaagaccattgctggctggctgct

SEQ ID NO: 662767 - DNA, 25 bp, Mus musculus
gtaagaccattggtggctggctgct

SEQ ID NO: 662768 - DNA, 25 bp, Mus musculus
gtaagacccatgcatcatcaacttc

SEQ ID NO: 662769 - DNA, 25 bp, Mus musculus
gtaagacccatggatcatcaacttc

SEQ ID NO: 662770 - DNA, 25 bp, Mus musculus
gtaagacccattctgattccgacat

SEQ ID NO: 662771 - DNA, 25 bp, Mus musculus
gtaagacccattgtgattccgacat

SEQ ID NO: 662772 - DNA, 25 bp, Mus musculus
gtaagaccctgtattacaaactatg

SEQ ID NO: 662773 - DNA, 25 bp, Mus musculus
gtaagaccctgttttacaaactatg

SEQ ID NO: 662774 - DNA, 25 bp, Mus musculus
gtaagaccgtctctgatattgatga

SEQ ID NO: 662775 - DNA, 25 bp, Mus musculus
gtaagaccgtctgtgatattgatga

SEQ ID NO: 662776 - DNA, 25 bp, Mus musculus
gtaagaccgtttcttactcaagctt

SEQ ID NO: 662777 - DNA, 25 bp, Mus musculus
gtaagaccgtttgttactcaagctt

SEQ ID NO: 662778 - DNA, 25 bp, Mus musculus
gtaagacctaagaccatttaagtgt

SEQ ID NO: 662779 - DNA, 25 bp, Mus musculus
gtaagacctaagtccatttaagtgt

SEQ ID NO: 662780 - DNA, 25 bp, Mus musculus
gtaagacctgtcactgctaatacga

SEQ ID NO: 662781 - DNA, 25 bp, Mus musculus
gtaagacctgtctctgctaatacga

SEQ ID NO: 662782 - DNA, 25 bp, Mus musculus
gtaagaccttgaatcctacatgtgg

SEQ ID NO: 662783 - DNA, 25 bp, Mus musculus
gtaagaccttgattcctacatgtgg

SEQ ID NO: 662784 - DNA, 25 bp, Mus musculus
gtaagacgccagattttgatttgtg

SEQ ID NO: 662785 - DNA, 25 bp, Mus musculus
gtaagacgccagtttttgatttgtg

SEQ ID NO: 662786 - DNA, 25 bp, Mus musculus
gtaagacgcctgataatgccgctct

SEQ ID NO: 662787 - DNA, 25 bp, Mus musculus
gtaagacgcctgttaatgccgctct

SEQ ID NO: 662788 - DNA, 25 bp, Mus musculus
gtaagacggaggaacacaaaatggc

SEQ ID NO: 662789 - DNA, 25 bp, Mus musculus
gtaagacggaggtacacaaaatggc

SEQ ID NO: 662790 - DNA, 25 bp, Mus musculus
gtaagactattacagtattgctatt

SEQ ID NO: 662791 - DNA, 25 bp, Mus musculus
gtaagactattagagtattgctatt

SEQ ID NO: 662792 - DNA, 25 bp, Mus musculus
gtaagactatttccagtaagctttt

SEQ ID NO: 662793 - DNA, 25 bp, Mus musculus
gtaagactatttgcagtaagctttt

SEQ ID NO: 662794 - DNA, 25 bp, Mus musculus
gtaagactctatatttcagggcttc

SEQ ID NO: 662795 - DNA, 25 bp, Mus musculus
gtaagactctatttttcagggcttc

SEQ ID NO: 662796 - DNA, 25 bp, Mus musculus
gtaagactcttgctgtatcgtgaca

SEQ ID NO: 662797 - DNA, 25 bp, Mus musculus
gtaagactcttggtgtatcgtgaca

SEQ ID NO: 662798 - DNA, 25 bp, Mus musculus
gtaagactgaatataccacctgctg

SEQ ID NO: 662799 - DNA, 25 bp, Mus musculus
gtaagactgaatttaccacctgctg

SEQ ID NO: 662800 - DNA, 25 bp, Mus musculus
gtaagactgacaatcttccctctgt

SEQ ID NO: 662801 - DNA, 25 bp, Mus musculus
gtaagactgacattcttccctctgt

SEQ ID NO: 662802 - DNA, 25 bp, Mus musculus
gtaagactgcccattaggactaagt

SEQ ID NO: 662803 - DNA, 25 bp, Mus musculus
gtaagactgccctttaggactaagt

SEQ ID NO: 662804 - DNA, 25 bp, Mus musculus
gtaagacttaatcgttccattgtat

SEQ ID NO: 662805 - DNA, 25 bp, Mus musculus
gtaagacttaatggttccattgtat

SEQ ID NO: 662806 - DNA, 25 bp, Mus musculus
gtaagacttctcaaagatcagctca

SEQ ID NO: 662807 - DNA, 25 bp, Mus musculus
gtaagacttctctaagatcagctca

SEQ ID NO: 662808 - DNA, 25 bp, Mus musculus
gtaagacttctgaaaccgtgcagga

SEQ ID NO: 662809 - DNA, 25 bp, Mus musculus
gtaagacttctgtaaccgtgcagga

SEQ ID NO: 662810 - DNA, 25 bp, Mus musculus
gtaagacttgacatgtactagtgtt

SEQ ID NO: 662811 - DNA, 25 bp, Mus musculus
gtaagacttgacttgtactagtgtt

SEQ ID NO: 662812 - DNA, 25 bp, Mus musculus
gtaagactttttcctgcatcataat

SEQ ID NO: 662813 - DNA, 25 bp, Mus musculus
gtaagactttttgctgcatcataat

SEQ ID NO: 662814 - DNA, 25 bp, Mus musculus
gtaagagaacatagccagcctttct

SEQ ID NO: 662815 - DNA, 25 bp, Mus musculus
gtaagagaacattgccagcctttct

SEQ ID NO: 662816 - DNA, 25 bp, Mus musculus
gtaagagaagctccttcccaacgtg

SEQ ID NO: 662817 - DNA, 25 bp, Mus musculus
gtaagagaagctgcttcccaacgtg

SEQ ID NO: 662818 - DNA, 25 bp, Mus musculus
gtaagagagttcctgatcacctgaa

SEQ ID NO: 662819 - DNA, 25 bp, Mus musculus
gtaagagagttcgtgatcacctgaa

SEQ ID NO: 662820 - DNA, 25 bp, Mus musculus
gtaagagatctcactgttgcctttg

SEQ ID NO: 662821 - DNA, 25 bp, Mus musculus
gtaagagatctctctgttgcctttg

SEQ ID NO: 662822 - DNA, 25 bp, Mus musculus
gtaagagattgactatcagtgcccc

SEQ ID NO: 662823 - DNA, 25 bp, Mus musculus
gtaagagattgagtatcagtgcccc

SEQ ID NO: 662824 - DNA, 25 bp, Mus musculus
gtaagagcaagccacaagccagata

SEQ ID NO: 662825 - DNA, 25 bp, Mus musculus
gtaagagcaagcgacaagccagata

SEQ ID NO: 662826 - DNA, 25 bp, Mus musculus
gtaagagcacaaaagctggcctcac

SEQ ID NO: 662827 - DNA, 25 bp, Mus musculus
gtaagagcacaatagctggcctcac

SEQ ID NO: 662828 - DNA, 25 bp, Mus musculus
gtaagagcacccagatcgagcctgt

SEQ ID NO: 662829 - DNA, 25 bp, Mus musculus
gtaagagcaccctgatcgagcctgt

SEQ ID NO: 662830 - DNA, 25 bp, Mus musculus
gtaagagcagccaaatgatcacctt

SEQ ID NO: 662831 - DNA, 25 bp, Mus musculus
gtaagagcagcctaatgatcacctt

SEQ ID NO: 662832 - DNA, 25 bp, Mus musculus
gtaagagccacacagaaccagacta

SEQ ID NO: 662833 - DNA, 25 bp, Mus musculus
gtaagagccacagagaaccagacta

SEQ ID NO: 662834 - DNA, 25 bp, Mus musculus
gtaagagccattcgcactgctgtcc

SEQ ID NO: 662835 - DNA, 25 bp, Mus musculus
gtaagagccattggcactgctgtcc

SEQ ID NO: 662836 - DNA, 25 bp, Mus musculus
gtaagagcccttaattgaacaaata

SEQ ID NO: 662837 - DNA, 25 bp, Mus musculus
gtaagagccctttattgaacaaata

SEQ ID NO: 662838 - DNA, 25 bp, Mus musculus
gtaagagctattaccaagccaggat

SEQ ID NO: 662839 - DNA, 25 bp, Mus musculus
gtaagagctatttccaagccaggat

SEQ ID NO: 662840 - DNA, 25 bp, Mus musculus
gtaagagctctcctgattaagttga

SEQ ID NO: 662841 - DNA, 25 bp, Mus musculus
gtaagagctctcgtgattaagttga

SEQ ID NO: 662842 - DNA, 25 bp, Mus musculus
gtaagagctcttatcttgccaaggt

SEQ ID NO: 662843 - DNA, 25 bp, Mus musculus
gtaagagctcttttcttgccaaggt

SEQ ID NO: 662844 - DNA, 25 bp, Mus musculus
gtaagagcttctagcttgttgccct

SEQ ID NO: 662845 - DNA, 25 bp, Mus musculus
gtaagagcttcttgcttgttgccct

SEQ ID NO: 662846 - DNA, 25 bp, Mus musculus
gtaagagctttgcttggcggtcaaa

SEQ ID NO: 662847 - DNA, 25 bp, Mus musculus
gtaagagctttggttggcggtcaaa

SEQ ID NO: 662848 - DNA, 25 bp, Mus musculus
gtaagaggcagtatttcaattcaac

SEQ ID NO: 662849 - DNA, 25 bp, Mus musculus
gtaagaggcagtttttcaattcaac

SEQ ID NO: 662850 - DNA, 25 bp, Mus musculus
gtaagagggttaccctagactagta

SEQ ID NO: 662851 - DNA, 25 bp, Mus musculus
gtaagagggttagcctagactagta

SEQ ID NO: 662852 - DNA, 25 bp, Mus musculus
gtaagaggtcaacattgctccaaat

SEQ ID NO: 662853 - DNA, 25 bp, Mus musculus
gtaagaggtcaagattgctccaaat

SEQ ID NO: 662854 - DNA, 25 bp, Mus musculus
gtaagaggtcctactcagtaactga

SEQ ID NO: 662855 - DNA, 25 bp, Mus musculus
gtaagaggtccttctcagtaactga

SEQ ID NO: 662856 - DNA, 25 bp, Mus musculus
gtaagaggtggaactaagcttgttt

SEQ ID NO: 662857 - DNA, 25 bp, Mus musculus
gtaagaggtggatctaagcttgttt

SEQ ID NO: 662858 - DNA, 25 bp, Mus musculus
gtaagagtaccaaggctcattcaca

SEQ ID NO: 662859 - DNA, 25 bp, Mus musculus
gtaagagtaccatggctcattcaca

SEQ ID NO: 662860 - DNA, 25 bp, Mus musculus
gtaagagtagctcaaaccccgtcac

SEQ ID NO: 662861 - DNA, 25 bp, Mus musculus
gtaagagtagctgaaaccccgtcac

SEQ ID NO: 662862 - DNA, 25 bp, Mus musculus
gtaagagtcattaaacacaggttat

SEQ ID NO: 662863 - DNA, 25 bp, Mus musculus
gtaagagtcatttaacacaggttat

SEQ ID NO: 662864 - DNA, 25 bp, Mus musculus
gtaagagtctcaagacaggctgaat

SEQ ID NO: 662865 - DNA, 25 bp, Mus musculus
gtaagagtctcatgacaggctgaat

SEQ ID NO: 662866 - DNA, 25 bp, Mus musculus
gtaagagtgaagagaacagctaatc

SEQ ID NO: 662867 - DNA, 25 bp, Mus musculus
gtaagagtgaagtgaacagctaatc

SEQ ID NO: 662868 - DNA, 25 bp, Mus musculus
gtaagagttcacaaccaggatttca

SEQ ID NO: 662869 - DNA, 25 bp, Mus musculus
gtaagagttcactaccaggatttca

SEQ ID NO: 662870 - DNA, 25 bp, Mus musculus
gtaagagttctcctaacaatttaga

SEQ ID NO: 662871 - DNA, 25 bp, Mus musculus
gtaagagttctcgtaacaatttaga

SEQ ID NO: 662872 - DNA, 25 bp, Mus musculus
gtaagagttgtaaaccctttgtcta

SEQ ID NO: 662873 - DNA, 25 bp, Mus musculus
gtaagagttgtataccctttgtcta

SEQ ID NO: 662874 - DNA, 25 bp, Mus musculus
gtaagataattcactgtcgcttctc

SEQ ID NO: 662875 - DNA, 25 bp, Mus musculus
gtaagataattctctgtcgcttctc

SEQ ID NO: 662876 - DNA, 25 bp, Mus musculus
gtaagatacacgcttccagatggaa

SEQ ID NO: 662877 - DNA, 25 bp, Mus musculus
gtaagatacacggttccagatggaa

SEQ ID NO: 662878 - DNA, 25 bp, Mus musculus
gtaagatagagtcgacaaatggtca

SEQ ID NO: 662879 - DNA, 25 bp, Mus musculus
gtaagatagagtggacaaatggtca

SEQ ID NO: 662880 - DNA, 25 bp, Mus musculus
gtaagatatatcctgcaccaaaatg

SEQ ID NO: 662881 - DNA, 25 bp, Mus musculus
gtaagatatatcgtgcaccaaaatg

SEQ ID NO: 662882 - DNA, 25 bp, Mus musculus
gtaagatattagcacaagctgcatg

SEQ ID NO: 662883 - DNA, 25 bp, Mus musculus
gtaagatattaggacaagctgcatg

SEQ ID NO: 662884 - DNA, 25 bp, Mus musculus
gtaagatcaaggctcccggttttgc

SEQ ID NO: 662885 - DNA, 25 bp, Mus musculus
gtaagatcaagggtcccggttttgc

SEQ ID NO: 662886 - DNA, 25 bp, Mus musculus
gtaagatcagacacatttggaagat

SEQ ID NO: 662887 - DNA, 25 bp, Mus musculus
gtaagatcagactcatttggaagat

SEQ ID NO: 662888 - DNA, 25 bp, Mus musculus
gtaagatccagcagattgccatgca

SEQ ID NO: 662889 - DNA, 25 bp, Mus musculus
gtaagatccagctgattgccatgca

SEQ ID NO: 662890 - DNA, 25 bp, Mus musculus
gtaagatcctgcaggaccctacaga

SEQ ID NO: 662891 - DNA, 25 bp, Mus musculus
gtaagatcctgctggaccctacaga

SEQ ID NO: 662892 - DNA, 25 bp, Mus musculus
gtaagatcctttaccaaactcaatt

SEQ ID NO: 662893 - DNA, 25 bp, Mus musculus
gtaagatccttttccaaactcaatt

SEQ ID NO: 662894 - DNA, 25 bp, Mus musculus
gtaagatcgcatccagctagggtcc

SEQ ID NO: 662895 - DNA, 25 bp, Mus musculus
gtaagatcgcatgcagctagggtcc

SEQ ID NO: 662896 - DNA, 25 bp, Mus musculus
gtaagatcgcttcgattggcaatga

SEQ ID NO: 662897 - DNA, 25 bp, Mus musculus
gtaagatcgcttggattggcaatga

SEQ ID NO: 662898 - DNA, 25 bp, Mus musculus
gtaagatctgacactttccaagaag

SEQ ID NO: 662899 - DNA, 25 bp, Mus musculus
gtaagatctgactctttccaagaag

SEQ ID NO: 662900 - DNA, 25 bp, Mus musculus
gtaagatgaacccatttctccactg

SEQ ID NO: 662901 - DNA, 25 bp, Mus musculus
gtaagatgaaccgatttctccactg

SEQ ID NO: 662902 - DNA, 25 bp, Mus musculus
gtaagatgacttacagacaacctgt

SEQ ID NO: 662903 - DNA, 25 bp, Mus musculus
gtaagatgactttcagacaacctgt

SEQ ID NO: 662904 - DNA, 25 bp, Mus musculus
gtaagatgagtgctaccctcagcct

SEQ ID NO: 662905 - DNA, 25 bp, Mus musculus
gtaagatgagtggtaccctcagcct

SEQ ID NO: 662906 - DNA, 25 bp, Mus musculus
gtaagatgatccactgatttctgat

SEQ ID NO: 662907 - DNA, 25 bp, Mus musculus
gtaagatgatcctctgatttctgat

SEQ ID NO: 662908 - DNA, 25 bp, Mus musculus
gtaagatgccatacacagtgtttgc

SEQ ID NO: 662909 - DNA, 25 bp, Mus musculus
gtaagatgccattcacagtgtttgc

SEQ ID NO: 662910 - DNA, 25 bp, Mus musculus
gtaagatgcctgctgtttgcaatag

SEQ ID NO: 662911 - DNA, 25 bp, Mus musculus
gtaagatgcctggtgtttgcaatag

SEQ ID NO: 662912 - DNA, 25 bp, Mus musculus
gtaagatgctctcggtcagccgcag

SEQ ID NO: 662913 - DNA, 25 bp, Mus musculus
gtaagatgctctgggtcagccgcag

SEQ ID NO: 662914 - DNA, 25 bp, Mus musculus
gtaagatggagtctggagctttcct

SEQ ID NO: 662915 - DNA, 25 bp, Mus musculus
gtaagatggagtgtggagctttcct

SEQ ID NO: 662916 - DNA, 25 bp, Mus musculus
gtaagatgtcctagtgagtccaaac

SEQ ID NO: 662917 - DNA, 25 bp, Mus musculus
gtaagatgtccttgtgagtccaaac

SEQ ID NO: 662918 - DNA, 25 bp, Mus musculus
gtaagatgtcttaccttcatgaaga

SEQ ID NO: 662919 - DNA, 25 bp, Mus musculus
gtaagatgtctttccttcatgaaga

SEQ ID NO: 662920 - DNA, 25 bp, Mus musculus
gtaagatgtgatcctgtctgccact

SEQ ID NO: 662921 - DNA, 25 bp, Mus musculus
gtaagatgtgatgctgtctgccact

SEQ ID NO: 662922 - DNA, 25 bp, Mus musculus
gtaagatgttaactctgaaaccaca

SEQ ID NO: 662923 - DNA, 25 bp, Mus musculus
gtaagatgttaagtctgaaaccaca

SEQ ID NO: 662924 - DNA, 25 bp, Mus musculus
gtaagatgttatagccactgggatg

SEQ ID NO: 662925 - DNA, 25 bp, Mus musculus
gtaagatgttattgccactgggatg

SEQ ID NO: 662926 - DNA, 25 bp, Mus musculus
gtaagattcaaactctgacccacta

SEQ ID NO: 662927 - DNA, 25 bp, Mus musculus
gtaagattcaaagtctgacccacta

SEQ ID NO: 662928 - DNA, 25 bp, Mus musculus
gtaagattcaatcgccaccgacacc

SEQ ID NO: 662929 - DNA, 25 bp, Mus musculus
gtaagattcaatggccaccgacacc

SEQ ID NO: 662930 - DNA, 25 bp, Mus musculus
gtaagattccatcgtgtgcagtgaa

SEQ ID NO: 662931 - DNA, 25 bp, Mus musculus
gtaagattccatggtgtgcagtgaa

SEQ ID NO: 662932 - DNA, 25 bp, Mus musculus
gtaagattcgggagcagatcccttt

SEQ ID NO: 662933 - DNA, 25 bp, Mus musculus
gtaagattcgggtgcagatcccttt

SEQ ID NO: 662934 - DNA, 25 bp, Mus musculus
gtaagattgcgcattgtgcttcagt

SEQ ID NO: 662935 - DNA, 25 bp, Mus musculus
gtaagattgcgctttgtgcttcagt

SEQ ID NO: 662936 - DNA, 25 bp, Mus musculus
gtaagattgcttcttcaaaccaaat

SEQ ID NO: 662937 - DNA, 25 bp, Mus musculus
gtaagattgcttgttcaaaccaaat

SEQ ID NO: 662938 - DNA, 25 bp, Mus musculus
gtaagatttctcatcacggtcctgt

SEQ ID NO: 662939 - DNA, 25 bp, Mus musculus
gtaagatttctcttcacggtcctgt

SEQ ID NO: 662940 - DNA, 25 bp, Mus musculus
gtaagatttcttactgagagcttct

SEQ ID NO: 662941 - DNA, 25 bp, Mus musculus
gtaagatttctttctgagagcttct

SEQ ID NO: 662942 - DNA, 25 bp, Mus musculus
gtaagcaacagaaaacacggctact

SEQ ID NO: 662943 - DNA, 25 bp, Mus musculus
gtaagcaacagataacacggctact

SEQ ID NO: 662944 - DNA, 25 bp, Mus musculus
gtaagcaactcactcatgtgttctt

SEQ ID NO: 662945 - DNA, 25 bp, Mus musculus
gtaagcaactcagtcatgtgttctt

SEQ ID NO: 662946 - DNA, 25 bp, Mus musculus
gtaagcaagctacctttttatggat

SEQ ID NO: 662947 - DNA, 25 bp, Mus musculus
gtaagcaagctagctttttatggat

SEQ ID NO: 662948 - DNA, 25 bp, Mus musculus
gtaagcaaggctatcccatatataa

SEQ ID NO: 662949 - DNA, 25 bp, Mus musculus
gtaagcaaggctttcccatatataa

SEQ ID NO: 662950 - DNA, 25 bp, Mus musculus
gtaagcaagtatctttctgtctgga

SEQ ID NO: 662951 - DNA, 25 bp, Mus musculus
gtaagcaagtatgtttctgtctgga

SEQ ID NO: 662952 - DNA, 25 bp, Mus musculus
gtaagcaattttctgacatgggatg

SEQ ID NO: 662953 - DNA, 25 bp, Mus musculus
gtaagcaattttgtgacatgggatg

SEQ ID NO: 662954 - DNA, 25 bp, Mus musculus
gtaagcacaataccacagtttctat

SEQ ID NO: 662955 - DNA, 25 bp, Mus musculus
gtaagcacaatagcacagtttctat

SEQ ID NO: 662956 - DNA, 25 bp, Mus musculus
gtaagcacacaaaggcaaccatgtt

SEQ ID NO: 662957 - DNA, 25 bp, Mus musculus
gtaagcacacaatggcaaccatgtt

SEQ ID NO: 662958 - DNA, 25 bp, Mus musculus
gtaagcacatctcccggtgaggtca

SEQ ID NO: 662959 - DNA, 25 bp, Mus musculus
gtaagcacatctgccggtgaggtca

SEQ ID NO: 662960 - DNA, 25 bp, Mus musculus
gtaagcacatgaatgcacaccatgt

SEQ ID NO: 662961 - DNA, 25 bp, Mus musculus
gtaagcacatgattgcacaccatgt

SEQ ID NO: 662962 - DNA, 25 bp, Mus musculus
gtaagcacatgccatcacactggta

SEQ ID NO: 662963 - DNA, 25 bp, Mus musculus
gtaagcacatgcgatcacactggta

SEQ ID NO: 662964 - DNA, 25 bp, Mus musculus
gtaagcacatggagtatttacaagt

SEQ ID NO: 662965 - DNA, 25 bp, Mus musculus
gtaagcacatggtgtatttacaagt

SEQ ID NO: 662966 - DNA, 25 bp, Mus musculus
gtaagcacccaacattagcagctga

SEQ ID NO: 662967 - DNA, 25 bp, Mus musculus
gtaagcacccaagattagcagctga

SEQ ID NO: 662968 - DNA, 25 bp, Mus musculus
gtaagcaccccgaatattttgtatt

SEQ ID NO: 662969 - DNA, 25 bp, Mus musculus
gtaagcaccccgtatattttgtatt

SEQ ID NO: 662970 - DNA, 25 bp, Mus musculus
gtaagcaccctacttaattctggac

SEQ ID NO: 662971 - DNA, 25 bp, Mus musculus
gtaagcaccctagttaattctggac

SEQ ID NO: 662972 - DNA, 25 bp, Mus musculus
gtaagcactgcaataggctctgtgt

SEQ ID NO: 662973 - DNA, 25 bp, Mus musculus
gtaagcactgcattaggctctgtgt

SEQ ID NO: 662974 - DNA, 25 bp, Mus musculus
gtaagcacttcaagtcaacagctac

SEQ ID NO: 662975 - DNA, 25 bp, Mus musculus
gtaagcacttcatgtcaacagctac

SEQ ID NO: 662976 - DNA, 25 bp, Mus musculus
gtaagcactttcagcaggcaaaaat

SEQ ID NO: 662977 - DNA, 25 bp, Mus musculus
gtaagcactttctgcaggcaaaaat

SEQ ID NO: 662978 - DNA, 25 bp, Mus musculus
gtaagcagaaggctgtggaccccat

SEQ ID NO: 662979 - DNA, 25 bp, Mus musculus
gtaagcagaagggtgtggaccccat

SEQ ID NO: 662980 - DNA, 25 bp, Mus musculus
gtaagcagaataatcaagggcatct

SEQ ID NO: 662981 - DNA, 25 bp, Mus musculus
gtaagcagaatattcaagggcatct

SEQ ID NO: 662982 - DNA, 25 bp, Mus musculus
gtaagcagcaatattcacaccatgt

SEQ ID NO: 662983 - DNA, 25 bp, Mus musculus
gtaagcagcaattttcacaccatgt

SEQ ID NO: 662984 - DNA, 25 bp, Mus musculus
gtaagcagcagccttctcagaataa

SEQ ID NO: 662985 - DNA, 25 bp, Mus musculus
gtaagcagcagcgttctcagaataa

SEQ ID NO: 662986 - DNA, 25 bp, Mus musculus
gtaagcagccagagtcttggaggca

SEQ ID NO: 662987 - DNA, 25 bp, Mus musculus
gtaagcagccagtgtcttggaggca

SEQ ID NO: 662988 - DNA, 25 bp, Mus musculus
gtaagcagccccatagagagctcat

SEQ ID NO: 662989 - DNA, 25 bp, Mus musculus
gtaagcagccccttagagagctcat

SEQ ID NO: 662990 - DNA, 25 bp, Mus musculus
gtaagcagccctagactgttagtgt

SEQ ID NO: 662991 - DNA, 25 bp, Mus musculus
gtaagcagcccttgactgttagtgt

SEQ ID NO: 662992 - DNA, 25 bp, Mus musculus
gtaagcagcgatctagtttcattaa

SEQ ID NO: 662993 - DNA, 25 bp, Mus musculus
gtaagcagcgatgtagtttcattaa

SEQ ID NO: 662994 - DNA, 25 bp, Mus musculus
gtaagcagcggtccctcttgtagca

SEQ ID NO: 662995 - DNA, 25 bp, Mus musculus
gtaagcagcggtgcctcttgtagca

SEQ ID NO: 662996 - DNA, 25 bp, Mus musculus
gtaagcaggattatctctacttgca

SEQ ID NO: 662997 - DNA, 25 bp, Mus musculus
gtaagcaggattttctctacttgca

SEQ ID NO: 662998 - DNA, 25 bp, Mus musculus
gtaagcaggtctatattgtcattca

SEQ ID NO: 662999 - DNA, 25 bp, Mus musculus
gtaagcaggtctttattgtcattca

SEQ ID NO: 663000 - DNA, 25 bp, Mus musculus
gtaagcaggtgtaggctgcagtttt

SEQ ID NO: 663001 - DNA, 25 bp, Mus musculus
gtaagcaggtgttggctgcagtttt

SEQ ID NO: 663002 - DNA, 25 bp, Mus musculus
gtaagcagtactctaggcaagcact

SEQ ID NO: 663003 - DNA, 25 bp, Mus musculus
gtaagcagtactgtaggcaagcact

SEQ ID NO: 663004 - DNA, 25 bp, Mus musculus
gtaagcagtccccactgatggagac

SEQ ID NO: 663005 - DNA, 25 bp, Mus musculus
gtaagcagtcccgactgatggagac

SEQ ID NO: 663006 - DNA, 25 bp, Mus musculus
gtaagcataactataccactgagtt

SEQ ID NO: 663007 - DNA, 25 bp, Mus musculus
gtaagcataactttaccactgagtt

SEQ ID NO: 663008 - DNA, 25 bp, Mus musculus
gtaagcataccaaactgtgagccaa

SEQ ID NO: 663009 - DNA, 25 bp, Mus musculus
gtaagcataccatactgtgagccaa

SEQ ID NO: 663010 - DNA, 25 bp, Mus musculus
gtaagcatagacaacaaccattagt

SEQ ID NO: 663011 - DNA, 25 bp, Mus musculus
gtaagcatagactacaaccattagt

SEQ ID NO: 663012 - DNA, 25 bp, Mus musculus
gtaagcatagccatatgccagtaat

SEQ ID NO: 663013 - DNA, 25 bp, Mus musculus
gtaagcatagccttatgccagtaat

SEQ ID NO: 663014 - DNA, 25 bp, Mus musculus
gtaagcatatatcatctcgatcctt

SEQ ID NO: 663015 - DNA, 25 bp, Mus musculus
gtaagcatatatgatctcgatcctt

SEQ ID NO: 663016 - DNA, 25 bp, Mus musculus
gtaagcatatgcaaggtatccgata

SEQ ID NO: 663017 - DNA, 25 bp, Mus musculus
gtaagcatatgctaggtatccgata

SEQ ID NO: 663018 - DNA, 25 bp, Mus musculus
gtaagcatatttctggcctgcactg

SEQ ID NO: 663019 - DNA, 25 bp, Mus musculus
gtaagcatatttgtggcctgcactg

SEQ ID NO: 663020 - DNA, 25 bp, Mus musculus
gtaagcatcaccaacggaggaaagg

SEQ ID NO: 663021 - DNA, 25 bp, Mus musculus
gtaagcatcacctacggaggaaagg

SEQ ID NO: 663022 - DNA, 25 bp, Mus musculus
gtaagcatccgtatacgttcggatc

SEQ ID NO: 663023 - DNA, 25 bp, Mus musculus
gtaagcatccgtttacgttcggatc

SEQ ID NO: 663024 - DNA, 25 bp, Mus musculus
gtaagcatctgtactagtgtgcaaa

SEQ ID NO: 663025 - DNA, 25 bp, Mus musculus
gtaagcatctgttctagtgtgcaaa

SEQ ID NO: 663026 - DNA, 25 bp, Mus musculus
gtaagcatgacaccccattgagagg

SEQ ID NO: 663027 - DNA, 25 bp, Mus musculus
gtaagcatgacagcccattgagagg

SEQ ID NO: 663028 - DNA, 25 bp, Mus musculus
gtaagcatgctgaacattgttttgt

SEQ ID NO: 663029 - DNA, 25 bp, Mus musculus
gtaagcatgctgtacattgttttgt

SEQ ID NO: 663030 - DNA, 25 bp, Mus musculus
gtaagcatgtgtccactgtgctaaa

SEQ ID NO: 663031 - DNA, 25 bp, Mus musculus
gtaagcatgtgtgcactgtgctaaa

SEQ ID NO: 663032 - DNA, 25 bp, Mus musculus
gtaagcattattacagaagtcctgt

SEQ ID NO: 663033 - DNA, 25 bp, Mus musculus
gtaagcattatttcagaagtcctgt

SEQ ID NO: 663034 - DNA, 25 bp, Mus musculus
gtaagcattctcacaaacttccttt

SEQ ID NO: 663035 - DNA, 25 bp, Mus musculus
gtaagcattctctcaaacttccttt

SEQ ID NO: 663036 - DNA, 25 bp, Mus musculus
gtaagcattcttaaccaggtatgac

SEQ ID NO: 663037 - DNA, 25 bp, Mus musculus
gtaagcattctttaccaggtatgac

SEQ ID NO: 663038 - DNA, 25 bp, Mus musculus
gtaagcatttctcaactccaagttc

SEQ ID NO: 663039 - DNA, 25 bp, Mus musculus
gtaagcatttctgaactccaagttc

SEQ ID NO: 663040 - DNA, 25 bp, Mus musculus
gtaagcatttttcatctgtctgtct

SEQ ID NO: 663041 - DNA, 25 bp, Mus musculus
gtaagcatttttgatctgtctgtct

SEQ ID NO: 663042 - DNA, 25 bp, Mus musculus
gtaagccaactacgaggccctgagt

SEQ ID NO: 663043 - DNA, 25 bp, Mus musculus
gtaagccaactaggaggccctgagt

SEQ ID NO: 663044 - DNA, 25 bp, Mus musculus
gtaagccaagccagcgagactgatt

SEQ ID NO: 663045 - DNA, 25 bp, Mus musculus
gtaagccaagcctgcgagactgatt

SEQ ID NO: 663046 - DNA, 25 bp, Mus musculus
gtaagccaaggactctgttccaaga

SEQ ID NO: 663047 - DNA, 25 bp, Mus musculus
gtaagccaaggagtctgttccaaga

SEQ ID NO: 663048 - DNA, 25 bp, Mus musculus
gtaagccaagtcatcctgaggttga

SEQ ID NO: 663049 - DNA, 25 bp, Mus musculus
gtaagccaagtcttcctgaggttga

SEQ ID NO: 663050 - DNA, 25 bp, Mus musculus
gtaagccaagtgatctacctttcag

SEQ ID NO: 663051 - DNA, 25 bp, Mus musculus
gtaagccaagtgttctacctttcag

SEQ ID NO: 663052 - DNA, 25 bp, Mus musculus
gtaagccaataccatgtcctgggaa

SEQ ID NO: 663053 - DNA, 25 bp, Mus musculus
gtaagccaatacgatgtcctgggaa

SEQ ID NO: 663054 - DNA, 25 bp, Mus musculus
gtaagccaccaaagcagaaccccat

SEQ ID NO: 663055 - DNA, 25 bp, Mus musculus
gtaagccaccaatgcagaaccccat

SEQ ID NO: 663056 - DNA, 25 bp, Mus musculus
gtaagccaccacagttctgacaaag

SEQ ID NO: 663057 - DNA, 25 bp, Mus musculus
gtaagccaccactgttctgacaaag

SEQ ID NO: 663058 - DNA, 25 bp, Mus musculus
gtaagccacctgcaaaaggacccga

SEQ ID NO: 663059 - DNA, 25 bp, Mus musculus
gtaagccacctggaaaaggacccga

SEQ ID NO: 663060 - DNA, 25 bp, Mus musculus
gtaagccacgttcgaagaccttctc

SEQ ID NO: 663061 - DNA, 25 bp, Mus musculus
gtaagccacgttggaagaccttctc

SEQ ID NO: 663062 - DNA, 25 bp, Mus musculus
gtaagccactgcactgtacagaact

SEQ ID NO: 663063 - DNA, 25 bp, Mus musculus
gtaagccactgctctgtacagaact

SEQ ID NO: 663064 - DNA, 25 bp, Mus musculus
gtaagccagcagctggtaccttgta

SEQ ID NO: 663065 - DNA, 25 bp, Mus musculus
gtaagccagcaggtggtaccttgta

SEQ ID NO: 663066 - DNA, 25 bp, Mus musculus
gtaagccagccaaaagctagtgaca

SEQ ID NO: 663067 - DNA, 25 bp, Mus musculus
gtaagccagccataagctagtgaca

SEQ ID NO: 663068 - DNA, 25 bp, Mus musculus
gtaagccaggcccatgcaatgaggc

SEQ ID NO: 663069 - DNA, 25 bp, Mus musculus
gtaagccaggccgatgcaatgaggc

SEQ ID NO: 663070 - DNA, 25 bp, Mus musculus
gtaagccaggtgaagctcgtgcact

SEQ ID NO: 663071 - DNA, 25 bp, Mus musculus
gtaagccaggtgtagctcgtgcact

SEQ ID NO: 663072 - DNA, 25 bp, Mus musculus
gtaagccagtccctgtggctaagaa

SEQ ID NO: 663073 - DNA, 25 bp, Mus musculus
gtaagccagtccgtgtggctaagaa

SEQ ID NO: 663074 - DNA, 25 bp, Mus musculus
gtaagccagtgtcgtatggccttta

SEQ ID NO: 663075 - DNA, 25 bp, Mus musculus
gtaagccagtgtggtatggccttta

SEQ ID NO: 663076 - DNA, 25 bp, Mus musculus
gtaagccagttaataaagagaccat

SEQ ID NO: 663077 - DNA, 25 bp, Mus musculus
gtaagccagttattaaagagaccat

SEQ ID NO: 663078 - DNA, 25 bp, Mus musculus
gtaagccatagtagcatctcagaag

SEQ ID NO: 663079 - DNA, 25 bp, Mus musculus
gtaagccatagttgcatctcagaag

SEQ ID NO: 663080 - DNA, 25 bp, Mus musculus
gtaagccattctaatacatcccctt

SEQ ID NO: 663081 - DNA, 25 bp, Mus musculus
gtaagccattcttatacatcccctt

SEQ ID NO: 663082 - DNA, 25 bp, Mus musculus
gtaagcccagcacatgcacaaattg

SEQ ID NO: 663083 - DNA, 25 bp, Mus musculus
gtaagcccagcagatgcacaaattg

SEQ ID NO: 663084 - DNA, 25 bp, Mus musculus
gtaagcccagcccttcggaggtggg

SEQ ID NO: 663085 - DNA, 25 bp, Mus musculus
gtaagcccagccgttcggaggtggg

SEQ ID NO: 663086 - DNA, 25 bp, Mus musculus
gtaagcccatgcaaaaaccccatca

SEQ ID NO: 663087 - DNA, 25 bp, Mus musculus
gtaagcccatgctaaaaccccatca

SEQ ID NO: 663088 - DNA, 25 bp, Mus musculus
gtaagcccgcataccctgaccagcc

SEQ ID NO: 663089 - DNA, 25 bp, Mus musculus
gtaagcccgcattccctgaccagcc

SEQ ID NO: 663090 - DNA, 25 bp, Mus musculus
gtaagcccgttgaatcctgagattc

SEQ ID NO: 663091 - DNA, 25 bp, Mus musculus
gtaagcccgttgtatcctgagattc

SEQ ID NO: 663092 - DNA, 25 bp, Mus musculus
gtaagccctagtaatggccaattat

SEQ ID NO: 663093 - DNA, 25 bp, Mus musculus
gtaagccctagttatggccaattat

SEQ ID NO: 663094 - DNA, 25 bp, Mus musculus
gtaagccctgaacgttattctgaga

SEQ ID NO: 663095 - DNA, 25 bp, Mus musculus
gtaagccctgaaggttattctgaga

SEQ ID NO: 663096 - DNA, 25 bp, Mus musculus
gtaagccctttgaaatacattcagt

SEQ ID NO: 663097 - DNA, 25 bp, Mus musculus
gtaagccctttgtaatacattcagt

SEQ ID NO: 663098 - DNA, 25 bp, Mus musculus
gtaagccgagctccagccaaggaga

SEQ ID NO: 663099 - DNA, 25 bp, Mus musculus
gtaagccgagctgcagccaaggaga

SEQ ID NO: 663100 - DNA, 25 bp, Mus musculus
gtaagccgagttatagacactgaat

SEQ ID NO: 663101 - DNA, 25 bp, Mus musculus
gtaagccgagttttagacactgaat

SEQ ID NO: 663102 - DNA, 25 bp, Mus musculus
gtaagcctaatgatagctctttttt

SEQ ID NO: 663103 - DNA, 25 bp, Mus musculus
gtaagcctaatgttagctctttttt

SEQ ID NO: 663104 - DNA, 25 bp, Mus musculus
gtaagcctatcccatccctgcaggg

SEQ ID NO: 663105 - DNA, 25 bp, Mus musculus
gtaagcctatccgatccctgcaggg

SEQ ID NO: 663106 - DNA, 25 bp, Mus musculus
gtaagcctctctactctgaaagttt

SEQ ID NO: 663107 - DNA, 25 bp, Mus musculus
gtaagcctctctcggtgctaaggtc

SEQ ID NO: 663108 - DNA, 25 bp, Mus musculus
gtaagcctctctgggtgctaaggtc

SEQ ID NO: 663109 - DNA, 25 bp, Mus musculus
gtaagcctctcttctctgaaagttt

SEQ ID NO: 663110 - DNA, 25 bp, Mus musculus
gtaagcctctgcctcagatgtttaa

SEQ ID NO: 663111 - DNA, 25 bp, Mus musculus
gtaagcctctgcgtcagatgtttaa

SEQ ID NO: 663112 - DNA, 25 bp, Mus musculus
gtaagcctgacaccctacgtttaac

SEQ ID NO: 663113 - DNA, 25 bp, Mus musculus
gtaagcctgacagcctacgtttaac

SEQ ID NO: 663114 - DNA, 25 bp, Mus musculus
gtaagcctgtccaatttaccagtct

SEQ ID NO: 663115 - DNA, 25 bp, Mus musculus
gtaagcctgtcctatttaccagtct

SEQ ID NO: 663116 - DNA, 25 bp, Mus musculus
gtaagccttaccacactagttggaa

SEQ ID NO: 663117 - DNA, 25 bp, Mus musculus
gtaagccttacctcactagttggaa

SEQ ID NO: 663118 - DNA, 25 bp, Mus musculus
gtaagccttctgcagattgagtcac

SEQ ID NO: 663119 - DNA, 25 bp, Mus musculus
gtaagccttctggagattgagtcac

SEQ ID NO: 663120 - DNA, 25 bp, Mus musculus
gtaagccttgaccttttgggaagct

SEQ ID NO: 663121 - DNA, 25 bp, Mus musculus
gtaagccttgacgttttgggaagct

SEQ ID NO: 663122 - DNA, 25 bp, Mus musculus
gtaagccttgcactacaggagtctt

SEQ ID NO: 663123 - DNA, 25 bp, Mus musculus
gtaagccttgcagtacaggagtctt

SEQ ID NO: 663124 - DNA, 25 bp, Mus musculus
gtaagccttgctacagtcatgaaga

SEQ ID NO: 663125 - DNA, 25 bp, Mus musculus
gtaagccttgcttcagtcatgaaga

SEQ ID NO: 663126 - DNA, 25 bp, Mus musculus
gtaagccttggtcttatgtcatggg

SEQ ID NO: 663127 - DNA, 25 bp, Mus musculus
gtaagccttggtgttatgtcatggg

SEQ ID NO: 663128 - DNA, 25 bp, Mus musculus
gtaagccttgtgcacaatcccattg

SEQ ID NO: 663129 - DNA, 25 bp, Mus musculus
gtaagccttgtggacaatcccattg

SEQ ID NO: 663130 - DNA, 25 bp, Mus musculus
gtaagcgcaacaaagtggtgatttt

SEQ ID NO: 663131 - DNA, 25 bp, Mus musculus
gtaagcgcaacatagtggtgatttt

SEQ ID NO: 663132 - DNA, 25 bp, Mus musculus
gtaagcgcctggactttatcctaag

SEQ ID NO: 663133 - DNA, 25 bp, Mus musculus
gtaagcgcctggtctttatcctaag

SEQ ID NO: 663134 - DNA, 25 bp, Mus musculus
gtaagcgcgccacacctgagtactt

SEQ ID NO: 663135 - DNA, 25 bp, Mus musculus
gtaagcgcgccagacctgagtactt

SEQ ID NO: 663136 - DNA, 25 bp, Mus musculus
gtaagcgcggacattgggtcagaaa

SEQ ID NO: 663137 - DNA, 25 bp, Mus musculus
gtaagcgcggactttgggtcagaaa

SEQ ID NO: 663138 - DNA, 25 bp, Mus musculus
gtaagcggaggccaggacactctaa

SEQ ID NO: 663139 - DNA, 25 bp, Mus musculus
gtaagcggaggcgaggacactctaa

SEQ ID NO: 663140 - DNA, 25 bp, Mus musculus
gtaagcggatatccttccaccttgt

SEQ ID NO: 663141 - DNA, 25 bp, Mus musculus
gtaagcggatatgcttccaccttgt

SEQ ID NO: 663142 - DNA, 25 bp, Mus musculus
gtaagcggctgtaagatgctgactt

SEQ ID NO: 663143 - DNA, 25 bp, Mus musculus
gtaagcggctgttagatgctgactt

SEQ ID NO: 663144 - DNA, 25 bp, Mus musculus
gtaagcgtcatcatttaactcttgt

SEQ ID NO: 663145 - DNA, 25 bp, Mus musculus
gtaagcgtcatcttttaactcttgt

SEQ ID NO: 663146 - DNA, 25 bp, Mus musculus
gtaagcgtttacatggaccattcca

SEQ ID NO: 663147 - DNA, 25 bp, Mus musculus
gtaagcgtttacttggaccattcca

SEQ ID NO: 663148 - DNA, 25 bp, Mus musculus
gtaagctaaaggacctgcctaggat

SEQ ID NO: 663149 - DNA, 25 bp, Mus musculus
gtaagctaaaggtcctgcctaggat

SEQ ID NO: 663150 - DNA, 25 bp, Mus musculus
gtaagctaatagcaccaggactgct

SEQ ID NO: 663151 - DNA, 25 bp, Mus musculus
gtaagctaataggaccaggactgct

SEQ ID NO: 663152 - DNA, 25 bp, Mus musculus
gtaagctacaacagccttggattta

SEQ ID NO: 663153 - DNA, 25 bp, Mus musculus
gtaagctacaactgccttggattta

SEQ ID NO: 663154 - DNA, 25 bp, Mus musculus
gtaagctacaatcccagtcctgttg

SEQ ID NO: 663155 - DNA, 25 bp, Mus musculus
gtaagctacaatgccagtcctgttg

SEQ ID NO: 663156 - DNA, 25 bp, Mus musculus
gtaagctaccaaacatttccagagt

SEQ ID NO: 663157 - DNA, 25 bp, Mus musculus
gtaagctaccaatcatttccagagt

SEQ ID NO: 663158 - DNA, 25 bp, Mus musculus
gtaagctaccttatttccagaatca

SEQ ID NO: 663159 - DNA, 25 bp, Mus musculus
gtaagctaccttttttccagaatca

SEQ ID NO: 663160 - DNA, 25 bp, Mus musculus
gtaagctacgtaattctcactgtga

SEQ ID NO: 663161 - DNA, 25 bp, Mus musculus
gtaagctacgtatttctcactgtga

SEQ ID NO: 663162 - DNA, 25 bp, Mus musculus
gtaagctactcaaagaactcctgtt

SEQ ID NO: 663163 - DNA, 25 bp, Mus musculus
gtaagctactcatagaactcctgtt

SEQ ID NO: 663164 - DNA, 25 bp, Mus musculus
gtaagctactgcaaggtccctggga

SEQ ID NO: 663165 - DNA, 25 bp, Mus musculus
gtaagctactgctaggtccctggga

SEQ ID NO: 663166 - DNA, 25 bp, Mus musculus
gtaagctaggttatcagccacaaaa

SEQ ID NO: 663167 - DNA, 25 bp, Mus musculus
gtaagctaggttccccacttgccca

SEQ ID NO: 663168 - DNA, 25 bp, Mus musculus
gtaagctaggttgcccacttgccca

SEQ ID NO: 663169 - DNA, 25 bp, Mus musculus
gtaagctaggttttcagccacaaaa

SEQ ID NO: 663170 - DNA, 25 bp, Mus musculus
gtaagctatagacgcgggctgcaac

SEQ ID NO: 663171 - DNA, 25 bp, Mus musculus
gtaagctatagaggcgggctgcaac

SEQ ID NO: 663172 - DNA, 25 bp, Mus musculus
gtaagctatgctatgtggattccca

SEQ ID NO: 663173 - DNA, 25 bp, Mus musculus
gtaagctatgctcattgataccatg

SEQ ID NO: 663174 - DNA, 25 bp, Mus musculus
gtaagctatgctgattgataccatg

SEQ ID NO: 663175 - DNA, 25 bp, Mus musculus
gtaagctatgctttgtggattccca

SEQ ID NO: 663176 - DNA, 25 bp, Mus musculus
gtaagctattggctcacagagaccc

SEQ ID NO: 663177 - DNA, 25 bp, Mus musculus
gtaagctattgggtcacagagaccc

SEQ ID NO: 663178 - DNA, 25 bp, Mus musculus
gtaagctatttcaggtacattttta

SEQ ID NO: 663179 - DNA, 25 bp, Mus musculus
gtaagctatttctggtacattttta

SEQ ID NO: 663180 - DNA, 25 bp, Mus musculus
gtaagctcactcaatctgataaaca

SEQ ID NO: 663181 - DNA, 25 bp, Mus musculus
gtaagctcactctatctgataaaca

SEQ ID NO: 663182 - DNA, 25 bp, Mus musculus
gtaagctcatacagcttccagagga

SEQ ID NO: 663183 - DNA, 25 bp, Mus musculus
gtaagctcatactgcttccagagga

SEQ ID NO: 663184 - DNA, 25 bp, Mus musculus
gtaagctccaggcatcctcaagcat

SEQ ID NO: 663185 - DNA, 25 bp, Mus musculus
gtaagctccagggatcctcaagcat

SEQ ID NO: 663186 - DNA, 25 bp, Mus musculus
gtaagctccagtccaagtctgtttg

SEQ ID NO: 663187 - DNA, 25 bp, Mus musculus
gtaagctccagtgcaagtctgtttg

SEQ ID NO: 663188 - DNA, 25 bp, Mus musculus
gtaagctccttcaccttaggaatta

SEQ ID NO: 663189 - DNA, 25 bp, Mus musculus
gtaagctccttctccttaggaatta

SEQ ID NO: 663190 - DNA, 25 bp, Mus musculus
gtaagctcgccacagtgactgctgc

SEQ ID NO: 663191 - DNA, 25 bp, Mus musculus
gtaagctcgccagagtgactgctgc

SEQ ID NO: 663192 - DNA, 25 bp, Mus musculus
gtaagctcggaacggcatccacgat

SEQ ID NO: 663193 - DNA, 25 bp, Mus musculus
gtaagctcggaagggcatccacgat

SEQ ID NO: 663194 - DNA, 25 bp, Mus musculus
gtaagctctagaatcaagacactac

SEQ ID NO: 663195 - DNA, 25 bp, Mus musculus
gtaagctctagattcaagacactac

SEQ ID NO: 663196 - DNA, 25 bp, Mus musculus
gtaagctctagtaggccgtcacaac

SEQ ID NO: 663197 - DNA, 25 bp, Mus musculus
gtaagctctagttggccgtcacaac

SEQ ID NO: 663198 - DNA, 25 bp, Mus musculus
gtaagctctctaagggcaggatttt

SEQ ID NO: 663199 - DNA, 25 bp, Mus musculus
gtaagctctctatgggcaggatttt

SEQ ID NO: 663200 - DNA, 25 bp, Mus musculus
gtaagctctcttaggatccacatat

SEQ ID NO: 663201 - DNA, 25 bp, Mus musculus
gtaagctctctttggatccacatat

SEQ ID NO: 663202 - DNA, 25 bp, Mus musculus
gtaagctctgctataggctgggatg

SEQ ID NO: 663203 - DNA, 25 bp, Mus musculus
gtaagctctgctttaggctgggatg

SEQ ID NO: 663204 - DNA, 25 bp, Mus musculus
gtaagctctggtaactcaatggatt

SEQ ID NO: 663205 - DNA, 25 bp, Mus musculus
gtaagctctggttactcaatggatt

SEQ ID NO: 663206 - DNA, 25 bp, Mus musculus
gtaagctctgtaccaggacccggtg

SEQ ID NO: 663207 - DNA, 25 bp, Mus musculus
gtaagctctgtagcaggacccggtg

SEQ ID NO: 663208 - DNA, 25 bp, Mus musculus
gtaagctcttaaaggacacaggtaa

SEQ ID NO: 663209 - DNA, 25 bp, Mus musculus
gtaagctcttaatggacacaggtaa

SEQ ID NO: 663210 - DNA, 25 bp, Mus musculus
gtaagctctttgaactccatttgta

SEQ ID NO: 663211 - DNA, 25 bp, Mus musculus
gtaagctctttgtactccatttgta

SEQ ID NO: 663212 - DNA, 25 bp, Mus musculus
gtaagctgaagaagtcaaattggca

SEQ ID NO: 663213 - DNA, 25 bp, Mus musculus
gtaagctgaagatgtcaaattggca

SEQ ID NO: 663214 - DNA, 25 bp, Mus musculus
gtaagctgaaggcttgcctccctga

SEQ ID NO: 663215 - DNA, 25 bp, Mus musculus
gtaagctgaagggttgcctccctga

SEQ ID NO: 663216 - DNA, 25 bp, Mus musculus
gtaagctgacctcaaatagaccaaa

SEQ ID NO: 663217 - DNA, 25 bp, Mus musculus
gtaagctgacctgaaatagaccaaa

SEQ ID NO: 663218 - DNA, 25 bp, Mus musculus
gtaagctgatccctgacaaaccatg

SEQ ID NO: 663219 - DNA, 25 bp, Mus musculus
gtaagctgatccgtgacaaaccatg

SEQ ID NO: 663220 - DNA, 25 bp, Mus musculus
gtaagctgccagattctttcttgac

SEQ ID NO: 663221 - DNA, 25 bp, Mus musculus
gtaagctgccagtttctttcttgac

SEQ ID NO: 663222 - DNA, 25 bp, Mus musculus
gtaagctgccttaggtcttcttttc

SEQ ID NO: 663223 - DNA, 25 bp, Mus musculus
gtaagctgcctttggtcttcttttc

SEQ ID NO: 663224 - DNA, 25 bp, Mus musculus
gtaagctgctctcactagcaatata

SEQ ID NO: 663225 - DNA, 25 bp, Mus musculus
gtaagctgctctgactagcaatata

SEQ ID NO: 663226 - DNA, 25 bp, Mus musculus
gtaagctggaaaactcaccttgtgt

SEQ ID NO: 663227 - DNA, 25 bp, Mus musculus
gtaagctggaaatctcaccttgtgt

SEQ ID NO: 663228 - DNA, 25 bp, Mus musculus
gtaagctggaacattcacagaatca

SEQ ID NO: 663229 - DNA, 25 bp, Mus musculus
gtaagctggaactttcacagaatca

SEQ ID NO: 663230 - DNA, 25 bp, Mus musculus
gtaagctggcaacgccctaacggtt

SEQ ID NO: 663231 - DNA, 25 bp, Mus musculus
gtaagctggcaaggccctaacggtt

SEQ ID NO: 663232 - DNA, 25 bp, Mus musculus
gtaagctggtttacagatgtttcca

SEQ ID NO: 663233 - DNA, 25 bp, Mus musculus
gtaagctggttttcagatgtttcca

SEQ ID NO: 663234 - DNA, 25 bp, Mus musculus
gtaagctgtaaacaaccaggcacct

SEQ ID NO: 663235 - DNA, 25 bp, Mus musculus
gtaagctgtaaagaaccaggcacct

SEQ ID NO: 663236 - DNA, 25 bp, Mus musculus
gtaagctgtcatctatttctgaaca

SEQ ID NO: 663237 - DNA, 25 bp, Mus musculus
gtaagctgtcatgtatttctgaaca

SEQ ID NO: 663238 - DNA, 25 bp, Mus musculus
gtaagctgtgtcaaaactaaggtct

SEQ ID NO: 663239 - DNA, 25 bp, Mus musculus
gtaagctgtgtctaaactaaggtct

SEQ ID NO: 663240 - DNA, 25 bp, Mus musculus
gtaagctgtttccaagcaccagaag

SEQ ID NO: 663241 - DNA, 25 bp, Mus musculus
gtaagctgtttcgaagcaccagaag

SEQ ID NO: 663242 - DNA, 25 bp, Mus musculus
gtaagcttacttcctgggctgctaa

SEQ ID NO: 663243 - DNA, 25 bp, Mus musculus
gtaagcttacttgctgggctgctaa

SEQ ID NO: 663244 - DNA, 25 bp, Mus musculus
gtaagcttcataatcatggccttcc

SEQ ID NO: 663245 - DNA, 25 bp, Mus musculus
gtaagcttcatattcatggccttcc

SEQ ID NO: 663246 - DNA, 25 bp, Mus musculus
gtaagcttcctgagatgtttgtcca

SEQ ID NO: 663247 - DNA, 25 bp, Mus musculus
gtaagcttcctgtgatgtttgtcca

SEQ ID NO: 663248 - DNA, 25 bp, Mus musculus
gtaagcttgcagatcctactgaggc

SEQ ID NO: 663249 - DNA, 25 bp, Mus musculus
gtaagcttgcagttcctactgaggc

SEQ ID NO: 663250 - DNA, 25 bp, Mus musculus
gtaagcttggtgacatgattctctg

SEQ ID NO: 663251 - DNA, 25 bp, Mus musculus
gtaagcttggtgtcatgattctctg

SEQ ID NO: 663252 - DNA, 25 bp, Mus musculus
gtaagctttatcactagcacctacg

SEQ ID NO: 663253 - DNA, 25 bp, Mus musculus
gtaagctttatctctagcacctacg

SEQ ID NO: 663254 - DNA, 25 bp, Mus musculus
gtaagctttcacagatgtaaccttc

SEQ ID NO: 663255 - DNA, 25 bp, Mus musculus
gtaagctttcactgatgtaaccttc

SEQ ID NO: 663256 - DNA, 25 bp, Mus musculus
gtaagctttctgaacaaacgttgtg

SEQ ID NO: 663257 - DNA, 25 bp, Mus musculus
gtaagctttctgtacaaacgttgtg

SEQ ID NO: 663258 - DNA, 25 bp, Mus musculus
gtaagctttggtatcagctgacctt

SEQ ID NO: 663259 - DNA, 25 bp, Mus musculus
gtaagctttggtttcagctgacctt

SEQ ID NO: 663260 - DNA, 25 bp, Mus musculus
gtaaggaacagccacattccagctc

SEQ ID NO: 663261 - DNA, 25 bp, Mus musculus
gtaaggaacagcgacattccagctc

SEQ ID NO: 663262 - DNA, 25 bp, Mus musculus
gtaaggaatatactttcctccaaat

SEQ ID NO: 663263 - DNA, 25 bp, Mus musculus
gtaaggaatatagtttcctccaaat

SEQ ID NO: 663264 - DNA, 25 bp, Mus musculus
gtaaggaatatgaggctttcttttc

SEQ ID NO: 663265 - DNA, 25 bp, Mus musculus
gtaaggaatatgtggctttcttttc

SEQ ID NO: 663266 - DNA, 25 bp, Mus musculus
gtaaggaatattcagagctctcata

SEQ ID NO: 663267 - DNA, 25 bp, Mus musculus
gtaaggaatattgagagctctcata

SEQ ID NO: 663268 - DNA, 25 bp, Mus musculus
gtaaggacaattccatgcttcccat

SEQ ID NO: 663269 - DNA, 25 bp, Mus musculus
gtaaggacaattgcatgcttcccat

SEQ ID NO: 663270 - DNA, 25 bp, Mus musculus
gtaaggacacgactgtgcggtcatt

SEQ ID NO: 663271 - DNA, 25 bp, Mus musculus
gtaaggacacgagtgtgcggtcatt

SEQ ID NO: 663272 - DNA, 25 bp, Mus musculus
gtaaggacacttagactggtagaac

SEQ ID NO: 663273 - DNA, 25 bp, Mus musculus
gtaaggacactttgactggtagaac

SEQ ID NO: 663274 - DNA, 25 bp, Mus musculus
gtaaggacagctccaagaatttttt

SEQ ID NO: 663275 - DNA, 25 bp, Mus musculus
gtaaggacagctgcaagaatttttt

SEQ ID NO: 663276 - DNA, 25 bp, Mus musculus
gtaaggacaggcaaacaggaatctt

SEQ ID NO: 663277 - DNA, 25 bp, Mus musculus
gtaaggacaggctaacaggaatctt

SEQ ID NO: 663278 - DNA, 25 bp, Mus musculus
gtaaggacctccagggactagcact

SEQ ID NO: 663279 - DNA, 25 bp, Mus musculus
gtaaggacctcctgggactagcact

SEQ ID NO: 663280 - DNA, 25 bp, Mus musculus
gtaaggacctcgctaggcctattgt

SEQ ID NO: 663281 - DNA, 25 bp, Mus musculus
gtaaggacctcggtaggcctattgt

SEQ ID NO: 663282 - DNA, 25 bp, Mus musculus
gtaaggagcagcctctgtaacttcc

SEQ ID NO: 663283 - DNA, 25 bp, Mus musculus
gtaaggagcagcgtctgtaacttcc

SEQ ID NO: 663284 - DNA, 25 bp, Mus musculus
gtaaggagggtaaggtatagtaaag

SEQ ID NO: 663285 - DNA, 25 bp, Mus musculus
gtaaggagggtatggtatagtaaag

SEQ ID NO: 663286 - DNA, 25 bp, Mus musculus
gtaaggatcactcttccattcagaa

SEQ ID NO: 663287 - DNA, 25 bp, Mus musculus
gtaaggatcactgttccattcagaa

SEQ ID NO: 663288 - DNA, 25 bp, Mus musculus
gtaaggatcagacctagggcccagt

SEQ ID NO: 663289 - DNA, 25 bp, Mus musculus
gtaaggatcagagctagggcccagt

SEQ ID NO: 663290 - DNA, 25 bp, Mus musculus
gtaaggatgctaccaaagacttttc

SEQ ID NO: 663291 - DNA, 25 bp, Mus musculus
gtaaggatgctagcaaagacttttc

SEQ ID NO: 663292 - DNA, 25 bp, Mus musculus
gtaaggatggcccttttctgttcca

SEQ ID NO: 663293 - DNA, 25 bp, Mus musculus
gtaaggatggccgttttctgttcca

SEQ ID NO: 663294 - DNA, 25 bp, Mus musculus
gtaaggatgttaatcacctcagctt

SEQ ID NO: 663295 - DNA, 25 bp, Mus musculus
gtaaggatgttattcacctcagctt

SEQ ID NO: 663296 - DNA, 25 bp, Mus musculus
gtaaggattcctctaatactgcttt

SEQ ID NO: 663297 - DNA, 25 bp, Mus musculus
gtaaggattcctgtaatactgcttt

SEQ ID NO: 663298 - DNA, 25 bp, Mus musculus
gtaaggcaaacgacacagaacatct

SEQ ID NO: 663299 - DNA, 25 bp, Mus musculus
gtaaggcaaacgtcacagaacatct

SEQ ID NO: 663300 - DNA, 25 bp, Mus musculus
gtaaggcaaactccttgtgctcctt

SEQ ID NO: 663301 - DNA, 25 bp, Mus musculus
gtaaggcaaactgcttgtgctcctt

SEQ ID NO: 663302 - DNA, 25 bp, Mus musculus
gtaaggcaaatgaattcactgtacc

SEQ ID NO: 663303 - DNA, 25 bp, Mus musculus
gtaaggcaaatgtattcactgtacc

SEQ ID NO: 663304 - DNA, 25 bp, Mus musculus
gtaaggcaacaccacacaatgctga

SEQ ID NO: 663305 - DNA, 25 bp, Mus musculus
gtaaggcaacacgacacaatgctga

SEQ ID NO: 663306 - DNA, 25 bp, Mus musculus
gtaaggcaagcaaacaccggatctg

SEQ ID NO: 663307 - DNA, 25 bp, Mus musculus
gtaaggcaagcatacaccggatctg

SEQ ID NO: 663308 - DNA, 25 bp, Mus musculus
gtaaggcaaggcattcttcgtagaa

SEQ ID NO: 663309 - DNA, 25 bp, Mus musculus
gtaaggcaaggctttcttcgtagaa

SEQ ID NO: 663310 - DNA, 25 bp, Mus musculus
gtaaggcacactaaactgtcaaatg

SEQ ID NO: 663311 - DNA, 25 bp, Mus musculus
gtaaggcacacttaactgtcaaatg

SEQ ID NO: 663312 - DNA, 25 bp, Mus musculus
gtaaggcacttcactctaagcctgg

SEQ ID NO: 663313 - DNA, 25 bp, Mus musculus
gtaaggcacttctctctaagcctgg

SEQ ID NO: 663314 - DNA, 25 bp, Mus musculus
gtaaggcactttctcaggctgggct

SEQ ID NO: 663315 - DNA, 25 bp, Mus musculus
gtaaggcactttgtcaggctgggct

SEQ ID NO: 663316 - DNA, 25 bp, Mus musculus
gtaaggcagcaaaataatttcctag

SEQ ID NO: 663317 - DNA, 25 bp, Mus musculus
gtaaggcagcaatataatttcctag

SEQ ID NO: 663318 - DNA, 25 bp, Mus musculus
gtaaggcagttcacctggcctggat

SEQ ID NO: 663319 - DNA, 25 bp, Mus musculus
gtaaggcagttctcctggcctggat

SEQ ID NO: 663320 - DNA, 25 bp, Mus musculus
gtaaggcatactcaggtcaagacat

SEQ ID NO: 663321 - DNA, 25 bp, Mus musculus
gtaaggcatactgaggtcaagacat

SEQ ID NO: 663322 - DNA, 25 bp, Mus musculus
gtaaggcatcctagctttgggacat

SEQ ID NO: 663323 - DNA, 25 bp, Mus musculus
gtaaggcatcctctcacaagcaatg

SEQ ID NO: 663324 - DNA, 25 bp, Mus musculus
gtaaggcatcctgtcacaagcaatg

SEQ ID NO: 663325 - DNA, 25 bp, Mus musculus
gtaaggcatccttgctttgggacat

SEQ ID NO: 663326 - DNA, 25 bp, Mus musculus
gtaaggcatctaagtggtcaacaac

SEQ ID NO: 663327 - DNA, 25 bp, Mus musculus
gtaaggcatctatgtggtcaacaac

SEQ ID NO: 663328 - DNA, 25 bp, Mus musculus
gtaaggcatctcaactcaagtcaat

SEQ ID NO: 663329 - DNA, 25 bp, Mus musculus
gtaaggcatctctactcaagtcaat

SEQ ID NO: 663330 - DNA, 25 bp, Mus musculus
gtaaggccacaactattgctctaat

SEQ ID NO: 663331 - DNA, 25 bp, Mus musculus
gtaaggccacaagtattgctctaat

SEQ ID NO: 663332 - DNA, 25 bp, Mus musculus
gtaaggccaccgactaagcaatgac

SEQ ID NO: 663333 - DNA, 25 bp, Mus musculus
gtaaggccaccgtctaagcaatgac

SEQ ID NO: 663334 - DNA, 25 bp, Mus musculus
gtaaggccagaaaggtctgcctgga

SEQ ID NO: 663335 - DNA, 25 bp, Mus musculus
gtaaggccagaatggtctgcctgga

SEQ ID NO: 663336 - DNA, 25 bp, Mus musculus
gtaaggccagccagacttgcaatgt

SEQ ID NO: 663337 - DNA, 25 bp, Mus musculus
gtaaggccagcctgacttgcaatgt

SEQ ID NO: 663338 - DNA, 25 bp, Mus musculus
gtaaggcccaagagttactggcgtt

SEQ ID NO: 663339 - DNA, 25 bp, Mus musculus
gtaaggcccaagtgttactggcgtt

SEQ ID NO: 663340 - DNA, 25 bp, Mus musculus
gtaaggccgaagaccatggatgtca

SEQ ID NO: 663341 - DNA, 25 bp, Mus musculus
gtaaggccgaagtccatggatgtca

SEQ ID NO: 663342 - DNA, 25 bp, Mus musculus
gtaaggccgtcgatcgtcggcgcca

SEQ ID NO: 663343 - DNA, 25 bp, Mus musculus
gtaaggccgtcgttcgtcggcgcca

SEQ ID NO: 663344 - DNA, 25 bp, Mus musculus
gtaaggcgttgcagctgacccggca

SEQ ID NO: 663345 - DNA, 25 bp, Mus musculus
gtaaggcgttgctgctgacccggca

SEQ ID NO: 663346 - DNA, 25 bp, Mus musculus
gtaaggctaagcctcctggtacctc

SEQ ID NO: 663347 - DNA, 25 bp, Mus musculus
gtaaggctaagcgtcctggtacctc

SEQ ID NO: 663348 - DNA, 25 bp, Mus musculus
gtaaggctctcacaacagctggaca

SEQ ID NO: 663349 - DNA, 25 bp, Mus musculus
gtaaggctctcagaacagctggaca

SEQ ID NO: 663350 - DNA, 25 bp, Mus musculus
gtaaggctgggcaagtgagtaccaa

SEQ ID NO: 663351 - DNA, 25 bp, Mus musculus
gtaaggctgggctagtgagtaccaa

SEQ ID NO: 663352 - DNA, 25 bp, Mus musculus
gtaaggctgtcacagttctcagtga

SEQ ID NO: 663353 - DNA, 25 bp, Mus musculus
gtaaggctgtcagagttctcagtga

SEQ ID NO: 663354 - DNA, 25 bp, Mus musculus
gtaaggctgtctaggcttaaaagca

SEQ ID NO: 663355 - DNA, 25 bp, Mus musculus
gtaaggctgtcttggcttaaaagca

SEQ ID NO: 663356 - DNA, 25 bp, Mus musculus
gtaaggctgttgaattcagaccatg

SEQ ID NO: 663357 - DNA, 25 bp, Mus musculus
gtaaggctgttgtattcagaccatg

SEQ ID NO: 663358 - DNA, 25 bp, Mus musculus
gtaagggaagcaataggcacagaaa

SEQ ID NO: 663359 - DNA, 25 bp, Mus musculus
gtaagggaagcattaggcacagaaa

SEQ ID NO: 663360 - DNA, 25 bp, Mus musculus
gtaagggaagccagaggcctcctgc

SEQ ID NO: 663361 - DNA, 25 bp, Mus musculus
gtaagggaagcctgaggcctcctgc

SEQ ID NO: 663362 - DNA, 25 bp, Mus musculus
gtaagggacagtcacctgctgtgaa

SEQ ID NO: 663363 - DNA, 25 bp, Mus musculus
gtaagggacagtgacctgctgtgaa

SEQ ID NO: 663364 - DNA, 25 bp, Mus musculus
gtaagggagtcgctgatcattcaaa

SEQ ID NO: 663365 - DNA, 25 bp, Mus musculus
gtaagggagtcggtgatcattcaaa

SEQ ID NO: 663366 - DNA, 25 bp, Mus musculus
gtaagggccagtaatcactgcatat

SEQ ID NO: 663367 - DNA, 25 bp, Mus musculus
gtaagggccagttatcactgcatat

SEQ ID NO: 663368 - DNA, 25 bp, Mus musculus
gtaagggcccacagcgagaagtagt

SEQ ID NO: 663369 - DNA, 25 bp, Mus musculus
gtaagggcccactgcgagaagtagt

SEQ ID NO: 663370 - DNA, 25 bp, Mus musculus
gtaagggccccacgtgccagttatg

SEQ ID NO: 663371 - DNA, 25 bp, Mus musculus
gtaagggccccaggtgccagttatg

SEQ ID NO: 663372 - DNA, 25 bp, Mus musculus
gtaagggccgtgacttatctaaaca

SEQ ID NO: 663373 - DNA, 25 bp, Mus musculus
gtaagggccgtgtcttatctaaaca

SEQ ID NO: 663374 - DNA, 25 bp, Mus musculus
gtaagggctggcaccatggcctcct

SEQ ID NO: 663375 - DNA, 25 bp, Mus musculus
gtaagggctggctccatggcctcct

SEQ ID NO: 663376 - DNA, 25 bp, Mus musculus
gtaagggtagttagaagaatctgcc

SEQ ID NO: 663377 - DNA, 25 bp, Mus musculus
gtaagggtagtttgaagaatctgcc

SEQ ID NO: 663378 - DNA, 25 bp, Mus musculus
gtaagggtctgtcctttacacagca

SEQ ID NO: 663379 - DNA, 25 bp, Mus musculus
gtaagggtctgtgctttacacagca

SEQ ID NO: 663380 - DNA, 25 bp, Mus musculus
gtaagggtgaacaggcctaagctcc

SEQ ID NO: 663381 - DNA, 25 bp, Mus musculus
gtaagggtgaactggcctaagctcc

SEQ ID NO: 663382 - DNA, 25 bp, Mus musculus
gtaagggtgttcaaatcactttgca

SEQ ID NO: 663383 - DNA, 25 bp, Mus musculus
gtaagggtgttctaatcactttgca

SEQ ID NO: 663384 - DNA, 25 bp, Mus musculus
gtaagggttgccagccaggagaacc

SEQ ID NO: 663385 - DNA, 25 bp, Mus musculus
gtaagggttgcctgccaggagaacc

SEQ ID NO: 663386 - DNA, 25 bp, Mus musculus
gtaagggtttacatttgtgattgat

SEQ ID NO: 663387 - DNA, 25 bp, Mus musculus
gtaagggtttacttttgtgattgat

SEQ ID NO: 663388 - DNA, 25 bp, Mus musculus
gtaaggtacaatatctcccatagct

SEQ ID NO: 663389 - DNA, 25 bp, Mus musculus
gtaaggtacaatttctcccatagct

SEQ ID NO: 663390 - DNA, 25 bp, Mus musculus
gtaaggtcactcctgaagtatgtta

SEQ ID NO: 663391 - DNA, 25 bp, Mus musculus
gtaaggtcactcgtgaagtatgtta

SEQ ID NO: 663392 - DNA, 25 bp, Mus musculus
gtaaggtcagtcatccactgtttcc

SEQ ID NO: 663393 - DNA, 25 bp, Mus musculus
gtaaggtcagtcctttcagtgacag

SEQ ID NO: 663394 - DNA, 25 bp, Mus musculus
gtaaggtcagtcgtttcagtgacag

SEQ ID NO: 663395 - DNA, 25 bp, Mus musculus
gtaaggtcagtcttccactgtttcc

SEQ ID NO: 663396 - DNA, 25 bp, Mus musculus
gtaaggtcctctctcaaaaagcata

SEQ ID NO: 663397 - DNA, 25 bp, Mus musculus
gtaaggtcctctgtcaaaaagcata

SEQ ID NO: 663398 - DNA, 25 bp, Mus musculus
gtaaggtcctgaattacagtggata

SEQ ID NO: 663399 - DNA, 25 bp, Mus musculus
gtaaggtcctgatttacagtggata

SEQ ID NO: 663400 - DNA, 25 bp, Mus musculus
gtaaggtcctgtatgaagtgctgct

SEQ ID NO: 663401 - DNA, 25 bp, Mus musculus
gtaaggtcctgtttgaagtgctgct

SEQ ID NO: 663402 - DNA, 25 bp, Mus musculus
gtaaggtctctgagcataatgaagt

SEQ ID NO: 663403 - DNA, 25 bp, Mus musculus
gtaaggtctctgtgcataatgaagt

SEQ ID NO: 663404 - DNA, 25 bp, Mus musculus
gtaaggtcttatcacttaaacccag

SEQ ID NO: 663405 - DNA, 25 bp, Mus musculus
gtaaggtcttatgacttaaacccag

SEQ ID NO: 663406 - DNA, 25 bp, Mus musculus
gtaaggtctttgagggtcatttcaa

SEQ ID NO: 663407 - DNA, 25 bp, Mus musculus
gtaaggtctttgtgggtcatttcaa

SEQ ID NO: 663408 - DNA, 25 bp, Mus musculus
gtaaggtgagccaagccagcacgcg

SEQ ID NO: 663409 - DNA, 25 bp, Mus musculus
gtaaggtgagcctagccagcacgcg

SEQ ID NO: 663410 - DNA, 25 bp, Mus musculus
gtaaggtgatcccaggatgcctgca

SEQ ID NO: 663411 - DNA, 25 bp, Mus musculus
gtaaggtgatccgaggatgcctgca

SEQ ID NO: 663412 - DNA, 25 bp, Mus musculus
gtaaggtgcaaaagaaggatcccaa

SEQ ID NO: 663413 - DNA, 25 bp, Mus musculus
gtaaggtgcaaatgaaggatcccaa

SEQ ID NO: 663414 - DNA, 25 bp, Mus musculus
gtaaggtgcaatacctatagaccag

SEQ ID NO: 663415 - DNA, 25 bp, Mus musculus
gtaaggtgcaattcctatagaccag

SEQ ID NO: 663416 - DNA, 25 bp, Mus musculus
gtaaggtgcaccacagtgagcctat

SEQ ID NO: 663417 - DNA, 25 bp, Mus musculus
gtaaggtgcacctcagtgagcctat

SEQ ID NO: 663418 - DNA, 25 bp, Mus musculus
gtaaggtgccatatacaggccttcc

SEQ ID NO: 663419 - DNA, 25 bp, Mus musculus
gtaaggtgccatttacaggccttcc

SEQ ID NO: 663420 - DNA, 25 bp, Mus musculus
gtaaggtgtgacagactactccctc

SEQ ID NO: 663421 - DNA, 25 bp, Mus musculus
gtaaggtgtgactgactactccctc

SEQ ID NO: 663422 - DNA, 25 bp, Mus musculus
gtaaggttacagattcagaggctat

SEQ ID NO: 663423 - DNA, 25 bp, Mus musculus
gtaaggttacagtttcagaggctat

SEQ ID NO: 663424 - DNA, 25 bp, Mus musculus
gtaaggttagatcctgttcaagaca

SEQ ID NO: 663425 - DNA, 25 bp, Mus musculus
gtaaggttagatgctgttcaagaca

SEQ ID NO: 663426 - DNA, 25 bp, Mus musculus
gtaaggttaggtacagcacactggg

SEQ ID NO: 663427 - DNA, 25 bp, Mus musculus
gtaaggttaggttcagcacactggg

SEQ ID NO: 663428 - DNA, 25 bp, Mus musculus
gtaaggttatctcaagccagggtct

SEQ ID NO: 663429 - DNA, 25 bp, Mus musculus
gtaaggttatctgaagccagggtct

SEQ ID NO: 663430 - DNA, 25 bp, Mus musculus
gtaaggttcaacagatcgcaggcca

SEQ ID NO: 663431 - DNA, 25 bp, Mus musculus
gtaaggttcaactgatcgcaggcca

SEQ ID NO: 663432 - DNA, 25 bp, Mus musculus
gtaaggttcactacgatcctgagaa

SEQ ID NO: 663433 - DNA, 25 bp, Mus musculus
gtaaggttcacttcgatcctgagaa

SEQ ID NO: 663434 - DNA, 25 bp, Mus musculus
gtaaggttcgtaatctagttcacag

SEQ ID NO: 663435 - DNA, 25 bp, Mus musculus
gtaaggttcgtattctagttcacag

SEQ ID NO: 663436 - DNA, 25 bp, Mus musculus
gtaaggtttgatcgtgtgcacactg

SEQ ID NO: 663437 - DNA, 25 bp, Mus musculus
gtaaggtttgatggtgtgcacactg

SEQ ID NO: 663438 - DNA, 25 bp, Mus musculus
gtaaggtttgctccacggtggtaca

SEQ ID NO: 663439 - DNA, 25 bp, Mus musculus
gtaaggtttgctgcacggtggtaca

SEQ ID NO: 663440 - DNA, 25 bp, Mus musculus
gtaagtaaatctacctgtctgccag

SEQ ID NO: 663441 - DNA, 25 bp, Mus musculus
gtaagtaaatcttcctgtctgccag

SEQ ID NO: 663442 - DNA, 25 bp, Mus musculus
gtaagtaacaacatgtggctctcaa

SEQ ID NO: 663443 - DNA, 25 bp, Mus musculus
gtaagtaacaacttgtggctctcaa

SEQ ID NO: 663444 - DNA, 25 bp, Mus musculus
gtaagtaacccacaatcagctattt

SEQ ID NO: 663445 - DNA, 25 bp, Mus musculus
gtaagtaacccagaatcagctattt

SEQ ID NO: 663446 - DNA, 25 bp, Mus musculus
gtaagtaactacacacctttgttat

SEQ ID NO: 663447 - DNA, 25 bp, Mus musculus
gtaagtaactactcacctttgttat

SEQ ID NO: 663448 - DNA, 25 bp, Mus musculus
gtaagtaatgcactggcctggcttt

SEQ ID NO: 663449 - DNA, 25 bp, Mus musculus
gtaagtaatgcagtggcctggcttt

SEQ ID NO: 663450 - DNA, 25 bp, Mus musculus
gtaagtacacatacccatggagatt

SEQ ID NO: 663451 - DNA, 25 bp, Mus musculus
gtaagtacacattcccatggagatt

SEQ ID NO: 663452 - DNA, 25 bp, Mus musculus
gtaagtacacctagatgttacagtg

SEQ ID NO: 663453 - DNA, 25 bp, Mus musculus
gtaagtacaccttgatgttacagtg

SEQ ID NO: 663454 - DNA, 25 bp, Mus musculus
gtaagtacacttaagactcaacgag

SEQ ID NO: 663455 - DNA, 25 bp, Mus musculus
gtaagtacactttagactcaacgag

SEQ ID NO: 663456 - DNA, 25 bp, Mus musculus
gtaagtaccattctggctgtccagt

SEQ ID NO: 663457 - DNA, 25 bp, Mus musculus
gtaagtaccattgtggctgtccagt

SEQ ID NO: 663458 - DNA, 25 bp, Mus musculus
gtaagtacccctcggaggtttgctg

SEQ ID NO: 663459 - DNA, 25 bp, Mus musculus
gtaagtacccctgggaggtttgctg

SEQ ID NO: 663460 - DNA, 25 bp, Mus musculus
gtaagtacctagactgcttgttttt

SEQ ID NO: 663461 - DNA, 25 bp, Mus musculus
gtaagtacctagtctgcttgttttt

SEQ ID NO: 663462 - DNA, 25 bp, Mus musculus
gtaagtacctgcatggttgagtcac

SEQ ID NO: 663463 - DNA, 25 bp, Mus musculus
gtaagtacctgcttggttgagtcac

SEQ ID NO: 663464 - DNA, 25 bp, Mus musculus
gtaagtactaggaggcatatgtgag

SEQ ID NO: 663465 - DNA, 25 bp, Mus musculus
gtaagtactaggtggcatatgtgag

SEQ ID NO: 663466 - DNA, 25 bp, Mus musculus
gtaagtagatctagctttgctttgt

SEQ ID NO: 663467 - DNA, 25 bp, Mus musculus
gtaagtagatcttgctttgctttgt

SEQ ID NO: 663468 - DNA, 25 bp, Mus musculus
gtaagtagccaccaggcacctcgca

SEQ ID NO: 663469 - DNA, 25 bp, Mus musculus
gtaagtagccacgaggcacctcgca

SEQ ID NO: 663470 - DNA, 25 bp, Mus musculus
gtaagtagcctaacagcatctaatt

SEQ ID NO: 663471 - DNA, 25 bp, Mus musculus
gtaagtagcctatcagcatctaatt

SEQ ID NO: 663472 - DNA, 25 bp, Mus musculus
gtaagtagtgctctgccagacctaa

SEQ ID NO: 663473 - DNA, 25 bp, Mus musculus
gtaagtagtgctgtgccagacctaa

SEQ ID NO: 663474 - DNA, 25 bp, Mus musculus
gtaagtatatctctgccaacctcca

SEQ ID NO: 663475 - DNA, 25 bp, Mus musculus
gtaagtatatctgtgccaacctcca

SEQ ID NO: 663476 - DNA, 25 bp, Mus musculus
gtaagtatatttccatcacactcag

SEQ ID NO: 663477 - DNA, 25 bp, Mus musculus
gtaagtatatttgcatcacactcag

SEQ ID NO: 663478 - DNA, 25 bp, Mus musculus
gtaagtatcactctggagactaaaa

SEQ ID NO: 663479 - DNA, 25 bp, Mus musculus
gtaagtatcactgtggagactaaaa

SEQ ID NO: 663480 - DNA, 25 bp, Mus musculus
gtaagtatcagaagatttccctaaa

SEQ ID NO: 663481 - DNA, 25 bp, Mus musculus
gtaagtatcagatgatttccctaaa

SEQ ID NO: 663482 - DNA, 25 bp, Mus musculus
gtaagtatcccaaagcacgtgttgt

SEQ ID NO: 663483 - DNA, 25 bp, Mus musculus
gtaagtatcccatagcacgtgttgt

SEQ ID NO: 663484 - DNA, 25 bp, Mus musculus
gtaagtatgcatagctccaaccgcc

SEQ ID NO: 663485 - DNA, 25 bp, Mus musculus
gtaagtatgcattgctccaaccgcc

SEQ ID NO: 663486 - DNA, 25 bp, Mus musculus
gtaagtatgcttctaacacacacac

SEQ ID NO: 663487 - DNA, 25 bp, Mus musculus
gtaagtatgcttgtaacacacacac

SEQ ID NO: 663488 - DNA, 25 bp, Mus musculus
gtaagtatgggcaaaggacctaata

SEQ ID NO: 663489 - DNA, 25 bp, Mus musculus
gtaagtatgggctaaggacctaata

SEQ ID NO: 663490 - DNA, 25 bp, Mus musculus
gtaagtatttttcacttacaggaat

SEQ ID NO: 663491 - DNA, 25 bp, Mus musculus
gtaagtatttttgacttacaggaat

SEQ ID NO: 663492 - DNA, 25 bp, Mus musculus
gtaagtcaactacaagatccttgca

SEQ ID NO: 663493 - DNA, 25 bp, Mus musculus
gtaagtcaactagaagatccttgca

SEQ ID NO: 663494 - DNA, 25 bp, Mus musculus
gtaagtcaagcaatcgtctaccctt

SEQ ID NO: 663495 - DNA, 25 bp, Mus musculus
gtaagtcaagcattcgtctaccctt

SEQ ID NO: 663496 - DNA, 25 bp, Mus musculus
gtaagtcactggagcccagctttga

SEQ ID NO: 663497 - DNA, 25 bp, Mus musculus
gtaagtcactggtgcccagctttga

SEQ ID NO: 663498 - DNA, 25 bp, Mus musculus
gtaagtcagggtctggccaagtatt

SEQ ID NO: 663499 - DNA, 25 bp, Mus musculus
gtaagtcagggtgtggccaagtatt

SEQ ID NO: 663500 - DNA, 25 bp, Mus musculus
gtaagtcagttaagttgcaacctaa

SEQ ID NO: 663501 - DNA, 25 bp, Mus musculus
gtaagtcagttatgttgcaacctaa

SEQ ID NO: 663502 - DNA, 25 bp, Mus musculus
gtaagtcataacatctcttcagatt

SEQ ID NO: 663503 - DNA, 25 bp, Mus musculus
gtaagtcataacttctcttcagatt

SEQ ID NO: 663504 - DNA, 25 bp, Mus musculus
gtaagtcatagaattcctcatcatt

SEQ ID NO: 663505 - DNA, 25 bp, Mus musculus
gtaagtcatagatttcctcatcatt

SEQ ID NO: 663506 - DNA, 25 bp, Mus musculus
gtaagtcatatgaaatgctccaaag

SEQ ID NO: 663507 - DNA, 25 bp, Mus musculus
gtaagtcatatgtaatgctccaaag

SEQ ID NO: 663508 - DNA, 25 bp, Mus musculus
gtaagtcatgtcacatggctgcctc

SEQ ID NO: 663509 - DNA, 25 bp, Mus musculus
gtaagtcatgtctcatggctgcctc

SEQ ID NO: 663510 - DNA, 25 bp, Mus musculus
gtaagtccagatctcgtcttctgat

SEQ ID NO: 663511 - DNA, 25 bp, Mus musculus
gtaagtccagatgtcgtcttctgat

SEQ ID NO: 663512 - DNA, 25 bp, Mus musculus
gtaagtccagctacagtggtcaaaa

SEQ ID NO: 663513 - DNA, 25 bp, Mus musculus
gtaagtccagcttcagtggtcaaaa

SEQ ID NO: 663514 - DNA, 25 bp, Mus musculus
gtaagtcccaagcaggccaagaata

SEQ ID NO: 663515 - DNA, 25 bp, Mus musculus
gtaagtcccaaggaggccaagaata

SEQ ID NO: 663516 - DNA, 25 bp, Mus musculus
gtaagtcccataatgaaacgtcaaa

SEQ ID NO: 663517 - DNA, 25 bp, Mus musculus
gtaagtcccatattgaaacgtcaaa

SEQ ID NO: 663518 - DNA, 25 bp, Mus musculus
gtaagtcctcagaacaggccatcag

SEQ ID NO: 663519 - DNA, 25 bp, Mus musculus
gtaagtcctcagcatccggatctga

SEQ ID NO: 663520 - DNA, 25 bp, Mus musculus
gtaagtcctcaggatccggatctga

SEQ ID NO: 663521 - DNA, 25 bp, Mus musculus
gtaagtcctcagtacaggccatcag

SEQ ID NO: 663522 - DNA, 25 bp, Mus musculus
gtaagtcctcttaagtcccatatag

SEQ ID NO: 663523 - DNA, 25 bp, Mus musculus
gtaagtcctctttagtcccatatag

SEQ ID NO: 663524 - DNA, 25 bp, Mus musculus
gtaagtccttgcaggttcagaccaa

SEQ ID NO: 663525 - DNA, 25 bp, Mus musculus
gtaagtccttgctggttcagaccaa

SEQ ID NO: 663526 - DNA, 25 bp, Mus musculus
gtaagtcgaactagtgaagcaaggt

SEQ ID NO: 663527 - DNA, 25 bp, Mus musculus
gtaagtcgaacttgtgaagcaaggt

SEQ ID NO: 663528 - DNA, 25 bp, Mus musculus
gtaagtcgatgtcaattgctgatag

SEQ ID NO: 663529 - DNA, 25 bp, Mus musculus
gtaagtcgatgtgaattgctgatag

SEQ ID NO: 663530 - DNA, 25 bp, Mus musculus
gtaagtctacacacctatgcacatc

SEQ ID NO: 663531 - DNA, 25 bp, Mus musculus
gtaagtctacactcctatgcacatc

SEQ ID NO: 663532 - DNA, 25 bp, Mus musculus
gtaagtctagtgatcgagtatttga

SEQ ID NO: 663533 - DNA, 25 bp, Mus musculus
gtaagtctagtgttcgagtatttga

SEQ ID NO: 663534 - DNA, 25 bp, Mus musculus
gtaagtctatccagtacacgtacat

SEQ ID NO: 663535 - DNA, 25 bp, Mus musculus
gtaagtctatcctgtacacgtacat

SEQ ID NO: 663536 - DNA, 25 bp, Mus musculus
gtaagtctatctcagagctgcccct

SEQ ID NO: 663537 - DNA, 25 bp, Mus musculus
gtaagtctatctgagagctgcccct

SEQ ID NO: 663538 - DNA, 25 bp, Mus musculus
gtaagtctcagcaccgagatgacag

SEQ ID NO: 663539 - DNA, 25 bp, Mus musculus
gtaagtctcagctccgagatgacag

SEQ ID NO: 663540 - DNA, 25 bp, Mus musculus
gtaagtctcatcagtctagacctct

SEQ ID NO: 663541 - DNA, 25 bp, Mus musculus
gtaagtctcatctgtctagacctct

SEQ ID NO: 663542 - DNA, 25 bp, Mus musculus
gtaagtctctgaatgttgccaccaa

SEQ ID NO: 663543 - DNA, 25 bp, Mus musculus
gtaagtctctgattgttgccaccaa

SEQ ID NO: 663544 - DNA, 25 bp, Mus musculus
gtaagtctctggaggatgtgaccaa

SEQ ID NO: 663545 - DNA, 25 bp, Mus musculus
gtaagtctctggtggatgtgaccaa

SEQ ID NO: 663546 - DNA, 25 bp, Mus musculus
gtaagtctgatcatgcttggttcca

SEQ ID NO: 663547 - DNA, 25 bp, Mus musculus
gtaagtctgatcttgcttggttcca

SEQ ID NO: 663548 - DNA, 25 bp, Mus musculus
gtaagtctgccaaaacaaatgccat

SEQ ID NO: 663549 - DNA, 25 bp, Mus musculus
gtaagtctgccataacaaatgccat

SEQ ID NO: 663550 - DNA, 25 bp, Mus musculus
gtaagtctgcttcggcagttcctgc

SEQ ID NO: 663551 - DNA, 25 bp, Mus musculus
gtaagtctgcttgggcagttcctgc

SEQ ID NO: 663552 - DNA, 25 bp, Mus musculus
gtaagtcttcaactacaatatacag

SEQ ID NO: 663553 - DNA, 25 bp, Mus musculus
gtaagtcttcaagtacaatatacag

SEQ ID NO: 663554 - DNA, 25 bp, Mus musculus
gtaagtcttcccctgttcttccttg

SEQ ID NO: 663555 - DNA, 25 bp, Mus musculus
gtaagtcttcccgtgttcttccttg

SEQ ID NO: 663556 - DNA, 25 bp, Mus musculus
gtaagtcttctcacagtgattgtca

SEQ ID NO: 663557 - DNA, 25 bp, Mus musculus
gtaagtcttctctcagtgattgtca

SEQ ID NO: 663558 - DNA, 25 bp, Mus musculus
gtaagtcttggacaagggtccttca

SEQ ID NO: 663559 - DNA, 25 bp, Mus musculus
gtaagtcttggagaagggtccttca

SEQ ID NO: 663560 - DNA, 25 bp, Mus musculus
gtaagtcttttcaagacatcctctt

SEQ ID NO: 663561 - DNA, 25 bp, Mus musculus
gtaagtcttttctagacatcctctt

SEQ ID NO: 663562 - DNA, 25 bp, Mus musculus
gtaagtgaaattatcttcctgtgct

SEQ ID NO: 663563 - DNA, 25 bp, Mus musculus
gtaagtgaaattttcttcctgtgct

SEQ ID NO: 663564 - DNA, 25 bp, Mus musculus
gtaagtgaatggacccttctgcaac

SEQ ID NO: 663565 - DNA, 25 bp, Mus musculus
gtaagtgaatggtcccttctgcaac

SEQ ID NO: 663566 - DNA, 25 bp, Mus musculus
gtaagtgaatgtccagagtcaaatc

SEQ ID NO: 663567 - DNA, 25 bp, Mus musculus
gtaagtgaatgtgcagagtcaaatc

SEQ ID NO: 663568 - DNA, 25 bp, Mus musculus
gtaagtgacaacagcctcctaggtg

SEQ ID NO: 663569 - DNA, 25 bp, Mus musculus
gtaagtgacaactgcctcctaggtg

SEQ ID NO: 663570 - DNA, 25 bp, Mus musculus
gtaagtgaccagcacggactgccta

SEQ ID NO: 663571 - DNA, 25 bp, Mus musculus
gtaagtgaccaggacggactgccta

SEQ ID NO: 663572 - DNA, 25 bp, Mus musculus
gtaagtgagggcactgccacgccta

SEQ ID NO: 663573 - DNA, 25 bp, Mus musculus
gtaagtgagggctctgccacgccta

SEQ ID NO: 663574 - DNA, 25 bp, Mus musculus
gtaagtgagtatcctcagaggccaa

SEQ ID NO: 663575 - DNA, 25 bp, Mus musculus
gtaagtgagtatgctcagaggccaa

SEQ ID NO: 663576 - DNA, 25 bp, Mus musculus
gtaagtgagtccattcaggtctcct

SEQ ID NO: 663577 - DNA, 25 bp, Mus musculus
gtaagtgagtcctttcaggtctcct

SEQ ID NO: 663578 - DNA, 25 bp, Mus musculus
gtaagtgagttcagggtcacaaact

SEQ ID NO: 663579 - DNA, 25 bp, Mus musculus
gtaagtgagttctgggtcacaaact

SEQ ID NO: 663580 - DNA, 25 bp, Mus musculus
gtaagtgatagaatcccagaataca

SEQ ID NO: 663581 - DNA, 25 bp, Mus musculus
gtaagtgatagattcccagaataca

SEQ ID NO: 663582 - DNA, 25 bp, Mus musculus
gtaagtgattctctgtgatccttca

SEQ ID NO: 663583 - DNA, 25 bp, Mus musculus
gtaagtgattctgtgtgatccttca

SEQ ID NO: 663584 - DNA, 25 bp, Mus musculus
gtaagtgattgaccggtttctgaat

SEQ ID NO: 663585 - DNA, 25 bp, Mus musculus
gtaagtgattgagcggtttctgaat

SEQ ID NO: 663586 - DNA, 25 bp, Mus musculus
gtaagtgccaagaaagctgtacagt

SEQ ID NO: 663587 - DNA, 25 bp, Mus musculus
gtaagtgccaagtaagctgtacagt

SEQ ID NO: 663588 - DNA, 25 bp, Mus musculus
gtaagtgccactagggctctttctc

SEQ ID NO: 663589 - DNA, 25 bp, Mus musculus
gtaagtgccacttgggctctttctc

SEQ ID NO: 663590 - DNA, 25 bp, Mus musculus
gtaagtgccaggctagactgcagat

SEQ ID NO: 663591 - DNA, 25 bp, Mus musculus
gtaagtgccagggtagactgcagat

SEQ ID NO: 663592 - DNA, 25 bp, Mus musculus
gtaagtgcccagcttatctgagaga

SEQ ID NO: 663593 - DNA, 25 bp, Mus musculus
gtaagtgcccaggttatctgagaga

SEQ ID NO: 663594 - DNA, 25 bp, Mus musculus
gtaagtgcccgactcctctctaggg

SEQ ID NO: 663595 - DNA, 25 bp, Mus musculus
gtaagtgcccgagtcctctctaggg

SEQ ID NO: 663596 - DNA, 25 bp, Mus musculus
gtaagtgccggcagccccgtgggct

SEQ ID NO: 663597 - DNA, 25 bp, Mus musculus
gtaagtgccggctgccccgtgggct

SEQ ID NO: 663598 - DNA, 25 bp, Mus musculus
gtaagtgcgcaaaggtcttttacat

SEQ ID NO: 663599 - DNA, 25 bp, Mus musculus
gtaagtgcgcaatggtcttttacat

SEQ ID NO: 663600 - DNA, 25 bp, Mus musculus
gtaagtgcggtccactttctatgtc

SEQ ID NO: 663601 - DNA, 25 bp, Mus musculus
gtaagtgcggtcgactttctatgtc

SEQ ID NO: 663602 - DNA, 25 bp, Mus musculus
gtaagtgctgacacgaaatgctatt

SEQ ID NO: 663603 - DNA, 25 bp, Mus musculus
gtaagtgctgactcgaaatgctatt

SEQ ID NO: 663604 - DNA, 25 bp, Mus musculus
gtaagtgctgagcttatttatcatc

SEQ ID NO: 663605 - DNA, 25 bp, Mus musculus
gtaagtgctgaggttatttatcatc

SEQ ID NO: 663606 - DNA, 25 bp, Mus musculus
gtaagtgctggtcctagatttgaca

SEQ ID NO: 663607 - DNA, 25 bp, Mus musculus
gtaagtgctggtgctagatttgaca

SEQ ID NO: 663608 - DNA, 25 bp, Mus musculus
gtaagtggatatatggctctgttat

SEQ ID NO: 663609 - DNA, 25 bp, Mus musculus
gtaagtggatatttggctctgttat

SEQ ID NO: 663610 - DNA, 25 bp, Mus musculus
gtaagtggccctcatgcgagtgaac

SEQ ID NO: 663611 - DNA, 25 bp, Mus musculus
gtaagtggccctgatgcgagtgaac

SEQ ID NO: 663612 - DNA, 25 bp, Mus musculus
gtaagtgggacaattgccaaatact

SEQ ID NO: 663613 - DNA, 25 bp, Mus musculus
gtaagtgggacatttgccaaatact

SEQ ID NO: 663614 - DNA, 25 bp, Mus musculus
gtaagtggtaccaactgagaaaatt

SEQ ID NO: 663615 - DNA, 25 bp, Mus musculus
gtaagtggtacctactgagaaaatt

SEQ ID NO: 663616 - DNA, 25 bp, Mus musculus
gtaagtggtccacccatgagttaca

SEQ ID NO: 663617 - DNA, 25 bp, Mus musculus
gtaagtggtccagccatgagttaca

SEQ ID NO: 663618 - DNA, 25 bp, Mus musculus
gtaagtgtcctactgccgagccata

SEQ ID NO: 663619 - DNA, 25 bp, Mus musculus
gtaagtgtcctagtgccgagccata

SEQ ID NO: 663620 - DNA, 25 bp, Mus musculus
gtaagtgtgatcaaccaagacaatc

SEQ ID NO: 663621 - DNA, 25 bp, Mus musculus
gtaagtgtgatctaccaagacaatc

SEQ ID NO: 663622 - DNA, 25 bp, Mus musculus
gtaagtgtgcacaagctggccgtcc

SEQ ID NO: 663623 - DNA, 25 bp, Mus musculus
gtaagtgtgcaccttaccatgtgtt

SEQ ID NO: 663624 - DNA, 25 bp, Mus musculus
gtaagtgtgcacgttaccatgtgtt

SEQ ID NO: 663625 - DNA, 25 bp, Mus musculus
gtaagtgtgcactagctggccgtcc

SEQ ID NO: 663626 - DNA, 25 bp, Mus musculus
gtaagtgtgcccaaatcttctgtgc

SEQ ID NO: 663627 - DNA, 25 bp, Mus musculus
gtaagtgtgccctaatcttctgtgc

SEQ ID NO: 663628 - DNA, 25 bp, Mus musculus
gtaagtgttctcacatgggcaattt

SEQ ID NO: 663629 - DNA, 25 bp, Mus musculus
gtaagtgttctctcatgggcaattt

SEQ ID NO: 663630 - DNA, 25 bp, Mus musculus
gtaagtgttgtgctcgatatcccaa

SEQ ID NO: 663631 - DNA, 25 bp, Mus musculus
gtaagtgttgtggtcgatatcccaa

SEQ ID NO: 663632 - DNA, 25 bp, Mus musculus
gtaagttaactcatcacccatattc

SEQ ID NO: 663633 - DNA, 25 bp, Mus musculus
gtaagttaactcttcacccatattc

SEQ ID NO: 663634 - DNA, 25 bp, Mus musculus
gtaagttacctgagcagtagagcat

SEQ ID NO: 663635 - DNA, 25 bp, Mus musculus
gtaagttacctgtgcagtagagcat

SEQ ID NO: 663636 - DNA, 25 bp, Mus musculus
gtaagttactccatggaaagatgca

SEQ ID NO: 663637 - DNA, 25 bp, Mus musculus
gtaagttactccttggaaagatgca

SEQ ID NO: 663638 - DNA, 25 bp, Mus musculus
gtaagttactgaatgtccatctatc

SEQ ID NO: 663639 - DNA, 25 bp, Mus musculus
gtaagttactgattgtccatctatc

SEQ ID NO: 663640 - DNA, 25 bp, Mus musculus
gtaagttacttcagtcccatgagat

SEQ ID NO: 663641 - DNA, 25 bp, Mus musculus
gtaagttacttcctgaactcagttt

SEQ ID NO: 663642 - DNA, 25 bp, Mus musculus
gtaagttacttcgtgaactcagttt

SEQ ID NO: 663643 - DNA, 25 bp, Mus musculus
gtaagttacttctgtcccatgagat

SEQ ID NO: 663644 - DNA, 25 bp, Mus musculus
gtaagttatagtattcctgaattgc

SEQ ID NO: 663645 - DNA, 25 bp, Mus musculus
gtaagttatagttttcctgaattgc

SEQ ID NO: 663646 - DNA, 25 bp, Mus musculus
gtaagttcaaagctcacattcaggg

SEQ ID NO: 663647 - DNA, 25 bp, Mus musculus
gtaagttcaaaggtcacattcaggg

SEQ ID NO: 663648 - DNA, 25 bp, Mus musculus
gtaagttcagacaagaaatccaagt

SEQ ID NO: 663649 - DNA, 25 bp, Mus musculus
gtaagttcagactagaaatccaagt

SEQ ID NO: 663650 - DNA, 25 bp, Mus musculus
gtaagttcagtgacgactcagacga

SEQ ID NO: 663651 - DNA, 25 bp, Mus musculus
gtaagttcagtgtcgactcagacga

SEQ ID NO: 663652 - DNA, 25 bp, Mus musculus
gtaagttcagttacataagcctaat

SEQ ID NO: 663653 - DNA, 25 bp, Mus musculus
gtaagttcagtttcataagcctaat

SEQ ID NO: 663654 - DNA, 25 bp, Mus musculus
gtaagttccatgagctgccagacga

SEQ ID NO: 663655 - DNA, 25 bp, Mus musculus
gtaagttccatgtgctgccagacga

SEQ ID NO: 663656 - DNA, 25 bp, Mus musculus
gtaagttccccaaagagctgagctc

SEQ ID NO: 663657 - DNA, 25 bp, Mus musculus
gtaagttccccatagagctgagctc

SEQ ID NO: 663658 - DNA, 25 bp, Mus musculus
gtaagttcctctataaactcctgag

SEQ ID NO: 663659 - DNA, 25 bp, Mus musculus
gtaagttcctctttaaactcctgag

SEQ ID NO: 663660 - DNA, 25 bp, Mus musculus
gtaagttccttccagttacaatatg

SEQ ID NO: 663661 - DNA, 25 bp, Mus musculus
gtaagttccttcgagttacaatatg

SEQ ID NO: 663662 - DNA, 25 bp, Mus musculus
gtaagttcgaatatccctgggacag

SEQ ID NO: 663663 - DNA, 25 bp, Mus musculus
gtaagttcgaatttccctgggacag

SEQ ID NO: 663664 - DNA, 25 bp, Mus musculus
gtaagttctaaaacgctgcccttgc

SEQ ID NO: 663665 - DNA, 25 bp, Mus musculus
gtaagttctaaatcgctgcccttgc

SEQ ID NO: 663666 - DNA, 25 bp, Mus musculus
gtaagttctaacaacctcgcgtggg

SEQ ID NO: 663667 - DNA, 25 bp, Mus musculus
gtaagttctaactacctcgcgtggg

SEQ ID NO: 663668 - DNA, 25 bp, Mus musculus
gtaagttctggaaactgtttatggt

SEQ ID NO: 663669 - DNA, 25 bp, Mus musculus
gtaagttctggatactgtttatggt

SEQ ID NO: 663670 - DNA, 25 bp, Mus musculus
gtaagttctggtaactttcactggt

SEQ ID NO: 663671 - DNA, 25 bp, Mus musculus
gtaagttctggttactttcactggt

SEQ ID NO: 663672 - DNA, 25 bp, Mus musculus
gtaagttcttaaacagttatcctca

SEQ ID NO: 663673 - DNA, 25 bp, Mus musculus
gtaagttcttaatcagttatcctca

SEQ ID NO: 663674 - DNA, 25 bp, Mus musculus
gtaagttcttgaataggctctcatt

SEQ ID NO: 663675 - DNA, 25 bp, Mus musculus
gtaagttcttgattaggctctcatt

SEQ ID NO: 663676 - DNA, 25 bp, Mus musculus
gtaagttgacttcgcaggtaatggt

SEQ ID NO: 663677 - DNA, 25 bp, Mus musculus
gtaagttgacttggcaggtaatggt

SEQ ID NO: 663678 - DNA, 25 bp, Mus musculus
gtaagttgccttcctaaagtgacag

SEQ ID NO: 663679 - DNA, 25 bp, Mus musculus
gtaagttgccttgctaaagtgacag

SEQ ID NO: 663680 - DNA, 25 bp, Mus musculus
gtaagttggccacatgccttgttaa

SEQ ID NO: 663681 - DNA, 25 bp, Mus musculus
gtaagttggccagatgccttgttaa

SEQ ID NO: 663682 - DNA, 25 bp, Mus musculus
gtaagttggtcaccctttaggttct

SEQ ID NO: 663683 - DNA, 25 bp, Mus musculus
gtaagttggtcagcctttaggttct

SEQ ID NO: 663684 - DNA, 25 bp, Mus musculus
gtaagttggtttctagagcttccat

SEQ ID NO: 663685 - DNA, 25 bp, Mus musculus
gtaagttggtttgtagagcttccat

SEQ ID NO: 663686 - DNA, 25 bp, Mus musculus
gtaagttgtgcaatcaaattaagat

SEQ ID NO: 663687 - DNA, 25 bp, Mus musculus
gtaagttgtgcattcaaattaagat

SEQ ID NO: 663688 - DNA, 25 bp, Mus musculus
gtaagtttagagatctgtatccaaa

SEQ ID NO: 663689 - DNA, 25 bp, Mus musculus
gtaagtttagagttctgtatccaaa

SEQ ID NO: 663690 - DNA, 25 bp, Mus musculus
gtaagtttagtgcaagctggccttg

SEQ ID NO: 663691 - DNA, 25 bp, Mus musculus
gtaagtttagtggaagctggccttg

SEQ ID NO: 663692 - DNA, 25 bp, Mus musculus
gtaagtttatctcgtgctgctacgt

SEQ ID NO: 663693 - DNA, 25 bp, Mus musculus
gtaagtttatctggtgctgctacgt

SEQ ID NO: 663694 - DNA, 25 bp, Mus musculus
gtaagtttccacaatcattcaaata

SEQ ID NO: 663695 - DNA, 25 bp, Mus musculus
gtaagtttccactatcattcaaata

SEQ ID NO: 663696 - DNA, 25 bp, Mus musculus
gtaagtttccataggatttggcaag

SEQ ID NO: 663697 - DNA, 25 bp, Mus musculus
gtaagtttccattggatttggcaag

SEQ ID NO: 663698 - DNA, 25 bp, Mus musculus
gtaagtttccttaatagcacagcaa

SEQ ID NO: 663699 - DNA, 25 bp, Mus musculus
gtaagtttcctttatagcacagcaa

SEQ ID NO: 663700 - DNA, 25 bp, Mus musculus
gtaagtttctacatccagttgggcc

SEQ ID NO: 663701 - DNA, 25 bp, Mus musculus
gtaagtttctacttccagttgggcc

SEQ ID NO: 663702 - DNA, 25 bp, Mus musculus
gtaagtttctgcaacagccaccgtg

SEQ ID NO: 663703 - DNA, 25 bp, Mus musculus
gtaagtttctgctacagccaccgtg

SEQ ID NO: 663704 - DNA, 25 bp, Mus musculus
gtaagtttctgtaccctttctatgc

SEQ ID NO: 663705 - DNA, 25 bp, Mus musculus
gtaagtttctgttccctttctatgc

SEQ ID NO: 663706 - DNA, 25 bp, Mus musculus
gtaagtttctttcagggcttgaccg

SEQ ID NO: 663707 - DNA, 25 bp, Mus musculus
gtaagtttctttgagggcttgaccg

SEQ ID NO: 663708 - DNA, 25 bp, Mus musculus
gtaagtttgatactgaccctgtttc

SEQ ID NO: 663709 - DNA, 25 bp, Mus musculus
gtaagtttgatagtgaccctgtttc

SEQ ID NO: 663710 - DNA, 25 bp, Mus musculus
gtaagtttgcctctaacaagccaga

SEQ ID NO: 663711 - DNA, 25 bp, Mus musculus
gtaagtttgcctgtaacaagccaga

SEQ ID NO: 663712 - DNA, 25 bp, Mus musculus
gtaagttttactccaaatgtgataa

SEQ ID NO: 663713 - DNA, 25 bp, Mus musculus
gtaagttttactgcaaatgtgataa

SEQ ID NO: 663714 - DNA, 25 bp, Mus musculus
gtaagttttcctccctaatgcctga

SEQ ID NO: 663715 - DNA, 25 bp, Mus musculus
gtaagttttcctgcctaatgcctga

SEQ ID NO: 663716 - DNA, 25 bp, Mus musculus
gtaagttttggtcccagtacattct

SEQ ID NO: 663717 - DNA, 25 bp, Mus musculus
gtaagttttggtgccagtacattct

SEQ ID NO: 663718 - DNA, 25 bp, Mus musculus
gtaagttttgttatgcctataatag

SEQ ID NO: 663719 - DNA, 25 bp, Mus musculus
gtaagttttgttttgcctataatag

SEQ ID NO: 663720 - DNA, 25 bp, Mus musculus
gtaagtttttccagcttatacagtt

SEQ ID NO: 663721 - DNA, 25 bp, Mus musculus
gtaagtttttcctgcttatacagtt

SEQ ID NO: 663722 - DNA, 25 bp, Mus musculus
gtaataaaagctagtccgggacctg

SEQ ID NO: 663723 - DNA, 25 bp, Mus musculus
gtaataaaagcttgtccgggacctg

SEQ ID NO: 663724 - DNA, 25 bp, Mus musculus
gtaataaacaccctaatgcagccag

SEQ ID NO: 663725 - DNA, 25 bp, Mus musculus
gtaataaacaccgtaatgcagccag

SEQ ID NO: 663726 - DNA, 25 bp, Mus musculus
gtaataaagccaataccattctgta

SEQ ID NO: 663727 - DNA, 25 bp, Mus musculus
gtaataaagccattaccattctgta

SEQ ID NO: 663728 - DNA, 25 bp, Mus musculus
gtaataaatgccacacagctagtga

SEQ ID NO: 663729 - DNA, 25 bp, Mus musculus
gtaataaatgcctcacagctagtga

SEQ ID NO: 663730 - DNA, 25 bp, Mus musculus
gtaataacagtcctcgtcatcgttg

SEQ ID NO: 663731 - DNA, 25 bp, Mus musculus
gtaataacagtcgtcgtcatcgttg

SEQ ID NO: 663732 - DNA, 25 bp, Mus musculus
gtaataaccataccttgttttgtga

SEQ ID NO: 663733 - DNA, 25 bp, Mus musculus
gtaataaccatagcttgttttgtga

SEQ ID NO: 663734 - DNA, 25 bp, Mus musculus
gtaataagctatcaggcctagccat

SEQ ID NO: 663735 - DNA, 25 bp, Mus musculus
gtaataagctatgaggcctagccat

SEQ ID NO: 663736 - DNA, 25 bp, Mus musculus
gtaataagttggatttctacacaat

SEQ ID NO: 663737 - DNA, 25 bp, Mus musculus
gtaataagttggttttctacacaat

SEQ ID NO: 663738 - DNA, 25 bp, Mus musculus
gtaataatcactatctctaaaactt

SEQ ID NO: 663739 - DNA, 25 bp, Mus musculus
gtaataatcactttctctaaaactt

SEQ ID NO: 663740 - DNA, 25 bp, Mus musculus
gtaataatcagacagcaccacttgc

SEQ ID NO: 663741 - DNA, 25 bp, Mus musculus
gtaataatcagagagcaccacttgc

SEQ ID NO: 663742 - DNA, 25 bp, Mus musculus
gtaataatgtacatgtaagcctaat

SEQ ID NO: 663743 - DNA, 25 bp, Mus musculus
gtaataatgtacttgtaagcctaat

SEQ ID NO: 663744 - DNA, 25 bp, Mus musculus
gtaataatgtgtaagtgttctcctt

SEQ ID NO: 663745 - DNA, 25 bp, Mus musculus
gtaataatgtgttagtgttctcctt

SEQ ID NO: 663746 - DNA, 25 bp, Mus musculus
gtaataattgagactgcctgggcat

SEQ ID NO: 663747 - DNA, 25 bp, Mus musculus
gtaataattgagtctgcctgggcat

SEQ ID NO: 663748 - DNA, 25 bp, Mus musculus
gtaatacaatttatgctgtcattca

SEQ ID NO: 663749 - DNA, 25 bp, Mus musculus
gtaatacaatttttgctgtcattca

SEQ ID NO: 663750 - DNA, 25 bp, Mus musculus
gtaatacacaccatatttcctccga

SEQ ID NO: 663751 - DNA, 25 bp, Mus musculus
gtaatacacaccttatttcctccga

SEQ ID NO: 663752 - DNA, 25 bp, Mus musculus
gtaatacaccttataacctctgaag

SEQ ID NO: 663753 - DNA, 25 bp, Mus musculus
gtaatacaccttttaacctctgaag

SEQ ID NO: 663754 - DNA, 25 bp, Mus musculus
gtaatacaggcccagtactttcttc

SEQ ID NO: 663755 - DNA, 25 bp, Mus musculus
gtaatacaggccgagtactttcttc

SEQ ID NO: 663756 - DNA, 25 bp, Mus musculus
gtaatacagtaactcgcctaccgcc

SEQ ID NO: 663757 - DNA, 25 bp, Mus musculus
gtaatacagtaagtcgcctaccgcc

SEQ ID NO: 663758 - DNA, 25 bp, Mus musculus
gtaatacatgcccatctagtctcaa

SEQ ID NO: 663759 - DNA, 25 bp, Mus musculus
gtaatacatgccgatctagtctcaa

SEQ ID NO: 663760 - DNA, 25 bp, Mus musculus
gtaatacattacattttcagtcttt

SEQ ID NO: 663761 - DNA, 25 bp, Mus musculus
gtaatacattactttttcagtcttt

SEQ ID NO: 663762 - DNA, 25 bp, Mus musculus
gtaataccacatactgcacagatgc

SEQ ID NO: 663763 - DNA, 25 bp, Mus musculus
gtaataccacattctgcacagatgc

SEQ ID NO: 663764 - DNA, 25 bp, Mus musculus
gtaataccagacctctaccaatttt

SEQ ID NO: 663765 - DNA, 25 bp, Mus musculus
gtaataccagacgtctaccaatttt

SEQ ID NO: 663766 - DNA, 25 bp, Mus musculus
gtaataccaggcagttgtcccagca

SEQ ID NO: 663767 - DNA, 25 bp, Mus musculus
gtaataccaggctgttgtcccagca

SEQ ID NO: 663768 - DNA, 25 bp, Mus musculus
gtaataccgataacatcaatgtaac

SEQ ID NO: 663769 - DNA, 25 bp, Mus musculus
gtaataccgatatcatcaatgtaac

SEQ ID NO: 663770 - DNA, 25 bp, Mus musculus
gtaatacctaccacaaggagcgatt

SEQ ID NO: 663771 - DNA, 25 bp, Mus musculus
gtaatacctacctcaaggagcgatt

SEQ ID NO: 663772 - DNA, 25 bp, Mus musculus
gtaatacctctcattgcaggctgtt

SEQ ID NO: 663773 - DNA, 25 bp, Mus musculus
gtaatacctctctttgcaggctgtt

SEQ ID NO: 663774 - DNA, 25 bp, Mus musculus
gtaatacctcttcagtacagtcagt

SEQ ID NO: 663775 - DNA, 25 bp, Mus musculus
gtaatacctcttcattgcagcgctg

SEQ ID NO: 663776 - DNA, 25 bp, Mus musculus
gtaatacctcttgagtacagtcagt

SEQ ID NO: 663777 - DNA, 25 bp, Mus musculus
gtaatacctcttgattgcagcgctg

SEQ ID NO: 663778 - DNA, 25 bp, Mus musculus
gtaatacctgttactctatgcataa

SEQ ID NO: 663779 - DNA, 25 bp, Mus musculus
gtaatacctgtttctctatgcataa

SEQ ID NO: 663780 - DNA, 25 bp, Mus musculus
gtaatacgctgcaacatttttggag

SEQ ID NO: 663781 - DNA, 25 bp, Mus musculus
gtaatacgctgctacatttttggag

SEQ ID NO: 663782 - DNA, 25 bp, Mus musculus
gtaatacggcacatccctgtcaggc

SEQ ID NO: 663783 - DNA, 25 bp, Mus musculus
gtaatacggcacttccctgtcaggc

SEQ ID NO: 663784 - DNA, 25 bp, Mus musculus
gtaatactattcaacttcttcgtac

SEQ ID NO: 663785 - DNA, 25 bp, Mus musculus
gtaatactattctacttcttcgtac

SEQ ID NO: 663786 - DNA, 25 bp, Mus musculus
gtaatactctgaaagacacctgtgt

SEQ ID NO: 663787 - DNA, 25 bp, Mus musculus
gtaatactctgatagacacctgtgt

SEQ ID NO: 663788 - DNA, 25 bp, Mus musculus
gtaatactcttgagatctgtcccag

SEQ ID NO: 663789 - DNA, 25 bp, Mus musculus
gtaatactcttgtgatctgtcccag

SEQ ID NO: 663790 - DNA, 25 bp, Mus musculus
gtaatactgaaccacctaacagctt

SEQ ID NO: 663791 - DNA, 25 bp, Mus musculus
gtaatactgaacgacctaacagctt

SEQ ID NO: 663792 - DNA, 25 bp, Mus musculus
gtaatactgactccatcgtgttaag

SEQ ID NO: 663793 - DNA, 25 bp, Mus musculus
gtaatactgactgcatcgtgttaag

SEQ ID NO: 663794 - DNA, 25 bp, Mus musculus
gtaatactgcacacgggagctgagg

SEQ ID NO: 663795 - DNA, 25 bp, Mus musculus
gtaatactgcactcgggagctgagg

SEQ ID NO: 663796 - DNA, 25 bp, Mus musculus
gtaatactggaactactacactgac

SEQ ID NO: 663797 - DNA, 25 bp, Mus musculus
gtaatactggaagtactacactgac

SEQ ID NO: 663798 - DNA, 25 bp, Mus musculus
gtaatactgggaagaatcaacacat

SEQ ID NO: 663799 - DNA, 25 bp, Mus musculus
gtaatactgggatgaatcaacacat

SEQ ID NO: 663800 - DNA, 25 bp, Mus musculus
gtaatactgtctaagttgagtcaca

SEQ ID NO: 663801 - DNA, 25 bp, Mus musculus
gtaatactgtcttagttgagtcaca

SEQ ID NO: 663802 - DNA, 25 bp, Mus musculus
gtaatacttagaaagcttgatgcta

SEQ ID NO: 663803 - DNA, 25 bp, Mus musculus
gtaatacttagatagcttgatgcta

SEQ ID NO: 663804 - DNA, 25 bp, Mus musculus
gtaatacttagcaacagtttctgac

SEQ ID NO: 663805 - DNA, 25 bp, Mus musculus
gtaatacttagctacagtttctgac

SEQ ID NO: 663806 - DNA, 25 bp, Mus musculus
gtaatacttatactgttcctgagaa

SEQ ID NO: 663807 - DNA, 25 bp, Mus musculus
gtaatacttatagtgttcctgagaa

SEQ ID NO: 663808 - DNA, 25 bp, Mus musculus
gtaatacttccacccaaaatacgca

SEQ ID NO: 663809 - DNA, 25 bp, Mus musculus
gtaatacttccagccaaaatacgca

SEQ ID NO: 663810 - DNA, 25 bp, Mus musculus
gtaatacttgaaaaagatatcctga

SEQ ID NO: 663811 - DNA, 25 bp, Mus musculus
gtaatacttgaaatggactgtccct

SEQ ID NO: 663812 - DNA, 25 bp, Mus musculus
gtaatacttgaataagatatcctga

SEQ ID NO: 663813 - DNA, 25 bp, Mus musculus
gtaatacttgaattggactgtccct

SEQ ID NO: 663814 - DNA, 25 bp, Mus musculus
gtaatagactttattggatccatgt

SEQ ID NO: 663815 - DNA, 25 bp, Mus musculus
gtaatagacttttttggatccatgt

SEQ ID NO: 663816 - DNA, 25 bp, Mus musculus
gtaatagagggaagctctgacatga

SEQ ID NO: 663817 - DNA, 25 bp, Mus musculus
gtaatagagggatgctctgacatga

SEQ ID NO: 663818 - DNA, 25 bp, Mus musculus
gtaatagcaacacaaccagcctggt

SEQ ID NO: 663819 - DNA, 25 bp, Mus musculus
gtaatagcaacagaaccagcctggt

SEQ ID NO: 663820 - DNA, 25 bp, Mus musculus
gtaatagcagcaatatccagtgacc

SEQ ID NO: 663821 - DNA, 25 bp, Mus musculus
gtaatagcagcattatccagtgacc

SEQ ID NO: 663822 - DNA, 25 bp, Mus musculus
gtaatagctgatctgatgtccccat

SEQ ID NO: 663823 - DNA, 25 bp, Mus musculus
gtaatagctgatgtgatgtccccat

SEQ ID NO: 663824 - DNA, 25 bp, Mus musculus
gtaatagctgcccttgtgttagtga

SEQ ID NO: 663825 - DNA, 25 bp, Mus musculus
gtaatagctgccgttgtgttagtga

SEQ ID NO: 663826 - DNA, 25 bp, Mus musculus
gtaatagcttcgcttactgtcacat

SEQ ID NO: 663827 - DNA, 25 bp, Mus musculus
gtaatagcttcggttactgtcacat

SEQ ID NO: 663828 - DNA, 25 bp, Mus musculus
gtaatagggattcttgctccgcccc

SEQ ID NO: 663829 - DNA, 25 bp, Mus musculus
gtaatagggattgttgctccgcccc

SEQ ID NO: 663830 - DNA, 25 bp, Mus musculus
gtaatagggccactacgaaatttgt

SEQ ID NO: 663831 - DNA, 25 bp, Mus musculus
gtaatagggccagtacgaaatttgt

SEQ ID NO: 663832 - DNA, 25 bp, Mus musculus
gtaataggtagcatcctcagccatg

SEQ ID NO: 663833 - DNA, 25 bp, Mus musculus
gtaataggtagcttcctcagccatg

SEQ ID NO: 663834 - DNA, 25 bp, Mus musculus
gtaatagtcaaaacaacccctgaag

SEQ ID NO: 663835 - DNA, 25 bp, Mus musculus
gtaatagtcaaatcaacccctgaag

SEQ ID NO: 663836 - DNA, 25 bp, Mus musculus
gtaatagtccctctgtgactgagat

SEQ ID NO: 663837 - DNA, 25 bp, Mus musculus
gtaatagtccctgtgtgactgagat

SEQ ID NO: 663838 - DNA, 25 bp, Mus musculus
gtaatagtcctaccactgattcacc

SEQ ID NO: 663839 - DNA, 25 bp, Mus musculus
gtaatagtcctagcactgattcacc

SEQ ID NO: 663840 - DNA, 25 bp, Mus musculus
gtaatagtcctcatgttactgccta

SEQ ID NO: 663841 - DNA, 25 bp, Mus musculus
gtaatagtcctcttgttactgccta

SEQ ID NO: 663842 - DNA, 25 bp, Mus musculus
gtaatagtgcttctctctgggagat

SEQ ID NO: 663843 - DNA, 25 bp, Mus musculus
gtaatagtgcttgtctctgggagat

SEQ ID NO: 663844 - DNA, 25 bp, Mus musculus
gtaatagtggataattcctggcccc

SEQ ID NO: 663845 - DNA, 25 bp, Mus musculus
gtaatagtggattattcctggcccc

SEQ ID NO: 663846 - DNA, 25 bp, Mus musculus
gtaatagtggtgctctcagttctca

SEQ ID NO: 663847 - DNA, 25 bp, Mus musculus
gtaatagtggtggtctcagttctca

SEQ ID NO: 663848 - DNA, 25 bp, Mus musculus
gtaatagtgtttcgcgccacatatg

SEQ ID NO: 663849 - DNA, 25 bp, Mus musculus
gtaatagtgtttggcgccacatatg

SEQ ID NO: 663850 - DNA, 25 bp, Mus musculus
gtaatagttcacatgtgcccataaa

SEQ ID NO: 663851 - DNA, 25 bp, Mus musculus
gtaatagttcacttgtgcccataaa

SEQ ID NO: 663852 - DNA, 25 bp, Mus musculus
gtaatagtttctactcagatttttg

SEQ ID NO: 663853 - DNA, 25 bp, Mus musculus
gtaatagtttcttctcagatttttg

SEQ ID NO: 663854 - DNA, 25 bp, Mus musculus
gtaatatacagtcgacatgcattca

SEQ ID NO: 663855 - DNA, 25 bp, Mus musculus
gtaatatacagtggacatgcattca

SEQ ID NO: 663856 - DNA, 25 bp, Mus musculus
gtaatatataacagtcctccttcca

SEQ ID NO: 663857 - DNA, 25 bp, Mus musculus
gtaatatataactgtcctccttcca

SEQ ID NO: 663858 - DNA, 25 bp, Mus musculus
gtaatatatccactgtagtgcttat

SEQ ID NO: 663859 - DNA, 25 bp, Mus musculus
gtaatatatccagtgtagtgcttat

SEQ ID NO: 663860 - DNA, 25 bp, Mus musculus
gtaatatatttgatcactgtgcaga

SEQ ID NO: 663861 - DNA, 25 bp, Mus musculus
gtaatatatttgttcactgtgcaga

SEQ ID NO: 663862 - DNA, 25 bp, Mus musculus
gtaatatcacctagttgctttccta

SEQ ID NO: 663863 - DNA, 25 bp, Mus musculus
gtaatatcaccttgttgctttccta

SEQ ID NO: 663864 - DNA, 25 bp, Mus musculus
gtaatatccctaaatcagcatttgt

SEQ ID NO: 663865 - DNA, 25 bp, Mus musculus
gtaatatccctatatcagcatttgt

SEQ ID NO: 663866 - DNA, 25 bp, Mus musculus
gtaatatccttgctataaaacatgt

SEQ ID NO: 663867 - DNA, 25 bp, Mus musculus
gtaatatccttggtataaaacatgt

SEQ ID NO: 663868 - DNA, 25 bp, Mus musculus
gtaatatcgatacagtgagcatttt

SEQ ID NO: 663869 - DNA, 25 bp, Mus musculus
gtaatatcgatagagtgagcatttt

SEQ ID NO: 663870 - DNA, 25 bp, Mus musculus
gtaatatcgctacatctatctccag

SEQ ID NO: 663871 - DNA, 25 bp, Mus musculus
gtaatatcgctagatctatctccag

SEQ ID NO: 663872 - DNA, 25 bp, Mus musculus
gtaatatctgtgagttagcattaac

SEQ ID NO: 663873 - DNA, 25 bp, Mus musculus
gtaatatctgtgtgttagcattaac

SEQ ID NO: 663874 - DNA, 25 bp, Mus musculus
gtaatatctttcaatcttgaccact

SEQ ID NO: 663875 - DNA, 25 bp, Mus musculus
gtaatatctttctatcttgaccact

SEQ ID NO: 663876 - DNA, 25 bp, Mus musculus
gtaatatgataccttctccagctct

SEQ ID NO: 663877 - DNA, 25 bp, Mus musculus
gtaatatgatacgttctccagctct

SEQ ID NO: 663878 - DNA, 25 bp, Mus musculus
gtaatatgcccacacctgaacaagg

SEQ ID NO: 663879 - DNA, 25 bp, Mus musculus
gtaatatgcccagacctgaacaagg

SEQ ID NO: 663880 - DNA, 25 bp, Mus musculus
gtaatatggaacctttacacttgtt

SEQ ID NO: 663881 - DNA, 25 bp, Mus musculus
gtaatatggaacgtttacacttgtt

SEQ ID NO: 663882 - DNA, 25 bp, Mus musculus
gtaatatgggtgaccctcgtggccc

SEQ ID NO: 663883 - DNA, 25 bp, Mus musculus
gtaatatgggtgtccctcgtggccc

SEQ ID NO: 663884 - DNA, 25 bp, Mus musculus
gtaatattatcccattgaagctagg

SEQ ID NO: 663885 - DNA, 25 bp, Mus musculus
gtaatattatccgattgaagctagg

SEQ ID NO: 663886 - DNA, 25 bp, Mus musculus
gtaatattcatacagccaccggctg

SEQ ID NO: 663887 - DNA, 25 bp, Mus musculus
gtaatattcatagagccaccggctg

SEQ ID NO: 663888 - DNA, 25 bp, Mus musculus
gtaatattccaaagttgttgttttt

SEQ ID NO: 663889 - DNA, 25 bp, Mus musculus
gtaatattccaatgttgttgttttt

SEQ ID NO: 663890 - DNA, 25 bp, Mus musculus
gtaatattcctgacggtgccacaga

SEQ ID NO: 663891 - DNA, 25 bp, Mus musculus
gtaatattcctgtcggtgccacaga

SEQ ID NO: 663892 - DNA, 25 bp, Mus musculus
gtaatattccttcctatgcacttgt

SEQ ID NO: 663893 - DNA, 25 bp, Mus musculus
gtaatattccttgctatgcacttgt

SEQ ID NO: 663894 - DNA, 25 bp, Mus musculus
gtaatattctacactttgccaagct

SEQ ID NO: 663895 - DNA, 25 bp, Mus musculus
gtaatattctactctttgccaagct

SEQ ID NO: 663896 - DNA, 25 bp, Mus musculus
gtaatattgccaactgcaaccttgt

SEQ ID NO: 663897 - DNA, 25 bp, Mus musculus
gtaatattgccatctgcaaccttgt

SEQ ID NO: 663898 - DNA, 25 bp, Mus musculus
gtaatattggcccttttcctcaatt

SEQ ID NO: 663899 - DNA, 25 bp, Mus musculus
gtaatattggccgttttcctcaatt

SEQ ID NO: 663900 - DNA, 25 bp, Mus musculus
gtaatatttaacagcgatcccctca

SEQ ID NO: 663901 - DNA, 25 bp, Mus musculus
gtaatatttaactgcgatcccctca

SEQ ID NO: 663902 - DNA, 25 bp, Mus musculus
gtaatatttattctctggatcctca

SEQ ID NO: 663903 - DNA, 25 bp, Mus musculus
gtaatatttattgtctggatcctca

SEQ ID NO: 663904 - DNA, 25 bp, Mus musculus
gtaatcaactttctacagactgatg

SEQ ID NO: 663905 - DNA, 25 bp, Mus musculus
gtaatcaactttgtacagactgatg

SEQ ID NO: 663906 - DNA, 25 bp, Mus musculus
gtaatcaagaatccctcatggcctt

SEQ ID NO: 663907 - DNA, 25 bp, Mus musculus
gtaatcaagaatgcctcatggcctt

SEQ ID NO: 663908 - DNA, 25 bp, Mus musculus
gtaatcacacataccagagacatca

SEQ ID NO: 663909 - DNA, 25 bp, Mus musculus
gtaatcacacattccagagacatca

SEQ ID NO: 663910 - DNA, 25 bp, Mus musculus
gtaatcacatggatccagcacctga

SEQ ID NO: 663911 - DNA, 25 bp, Mus musculus
gtaatcacatggttccagcacctga

SEQ ID NO: 663912 - DNA, 25 bp, Mus musculus
gtaatcaccactaagcatcacagct

SEQ ID NO: 663913 - DNA, 25 bp, Mus musculus
gtaatcaccacttagcatcacagct

SEQ ID NO: 663914 - DNA, 25 bp, Mus musculus
gtaatcaccctacactaggagcagg

SEQ ID NO: 663915 - DNA, 25 bp, Mus musculus
gtaatcaccctagactaggagcagg

SEQ ID NO: 663916 - DNA, 25 bp, Mus musculus
gtaatcaccgtcagtctgaattcac

SEQ ID NO: 663917 - DNA, 25 bp, Mus musculus
gtaatcaccgtctgtctgaattcac

SEQ ID NO: 663918 - DNA, 25 bp, Mus musculus
gtaatcacgaggctcacccactgag

SEQ ID NO: 663919 - DNA, 25 bp, Mus musculus
gtaatcacgagggtcacccactgag

SEQ ID NO: 663920 - DNA, 25 bp, Mus musculus
gtaatcacgcaaacgaagcagtccc

SEQ ID NO: 663921 - DNA, 25 bp, Mus musculus
gtaatcacgcaatcgaagcagtccc

SEQ ID NO: 663922 - DNA, 25 bp, Mus musculus
gtaatcacgtccacaatgaggctct

SEQ ID NO: 663923 - DNA, 25 bp, Mus musculus
gtaatcacgtcctcaatgaggctct

SEQ ID NO: 663924 - DNA, 25 bp, Mus musculus
gtaatcactgcaatggtactgtaat

SEQ ID NO: 663925 - DNA, 25 bp, Mus musculus
gtaatcactgcattggtactgtaat

SEQ ID NO: 663926 - DNA, 25 bp, Mus musculus
gtaatcactgccatactgcatccat

SEQ ID NO: 663927 - DNA, 25 bp, Mus musculus
gtaatcactgccttactgcatccat

SEQ ID NO: 663928 - DNA, 25 bp, Mus musculus
gtaatcactgctagccaaagctgat

SEQ ID NO: 663929 - DNA, 25 bp, Mus musculus
gtaatcactgcttgccaaagctgat

SEQ ID NO: 663930 - DNA, 25 bp, Mus musculus
gtaatcacttccctaaagacactgg

SEQ ID NO: 663931 - DNA, 25 bp, Mus musculus
gtaatcacttccgtaaagacactgg

SEQ ID NO: 663932 - DNA, 25 bp, Mus musculus
gtaatcactttcactttccttttgc

SEQ ID NO: 663933 - DNA, 25 bp, Mus musculus
gtaatcactttctctttccttttgc

SEQ ID NO: 663934 - DNA, 25 bp, Mus musculus
gtaatcagacacctgttttcctaaa

SEQ ID NO: 663935 - DNA, 25 bp, Mus musculus
gtaatcagacacgtgttttcctaaa

SEQ ID NO: 663936 - DNA, 25 bp, Mus musculus
gtaatcagaggcatcctgtctacct

SEQ ID NO: 663937 - DNA, 25 bp, Mus musculus
gtaatcagaggcttcctgtctacct

SEQ ID NO: 663938 - DNA, 25 bp, Mus musculus
gtaatcagatccaatgcaagctagc

SEQ ID NO: 663939 - DNA, 25 bp, Mus musculus
gtaatcagatcctatgcaagctagc

SEQ ID NO: 663940 - DNA, 25 bp, Mus musculus
gtaatcagatctctgctgggtcaga

SEQ ID NO: 663941 - DNA, 25 bp, Mus musculus
gtaatcagatctgtgctgggtcaga

SEQ ID NO: 663942 - DNA, 25 bp, Mus musculus
gtaatcaggattcaggacaataaaa

SEQ ID NO: 663943 - DNA, 25 bp, Mus musculus
gtaatcaggattgaggacaataaaa

SEQ ID NO: 663944 - DNA, 25 bp, Mus musculus
gtaatcagggtcacaaactccagct

SEQ ID NO: 663945 - DNA, 25 bp, Mus musculus
gtaatcagggtctcaaactccagct

SEQ ID NO: 663946 - DNA, 25 bp, Mus musculus
gtaatcagtacaccattttgttagt

SEQ ID NO: 663947 - DNA, 25 bp, Mus musculus
gtaatcagtacacccacccaaaggg

SEQ ID NO: 663948 - DNA, 25 bp, Mus musculus
gtaatcagtacagcattttgttagt

SEQ ID NO: 663949 - DNA, 25 bp, Mus musculus
gtaatcagtacagccacccaaaggg

SEQ ID NO: 663950 - DNA, 25 bp, Mus musculus
gtaatcagtagcctatgtgcttaca

SEQ ID NO: 663951 - DNA, 25 bp, Mus musculus
gtaatcagtagcgtatgtgcttaca

SEQ ID NO: 663952 - DNA, 25 bp, Mus musculus
gtaatcagtctaagaatcctcatct

SEQ ID NO: 663953 - DNA, 25 bp, Mus musculus
gtaatcagtctatgaatcctcatct

SEQ ID NO: 663954 - DNA, 25 bp, Mus musculus
gtaatcagtgaacggctgtgcacct

SEQ ID NO: 663955 - DNA, 25 bp, Mus musculus
gtaatcagtgaagggctgtgcacct

SEQ ID NO: 663956 - DNA, 25 bp, Mus musculus
gtaatcatgataatttgcacagcac

SEQ ID NO: 663957 - DNA, 25 bp, Mus musculus
gtaatcatgatattttgcacagcac

SEQ ID NO: 663958 - DNA, 25 bp, Mus musculus
gtaatcatgtctaatgatcctcatc

SEQ ID NO: 663959 - DNA, 25 bp, Mus musculus
gtaatcatgtcttatgatcctcatc

SEQ ID NO: 663960 - DNA, 25 bp, Mus musculus
gtaatcatgttcagctatgtctcat

SEQ ID NO: 663961 - DNA, 25 bp, Mus musculus
gtaatcatgttctgctatgtctcat

SEQ ID NO: 663962 - DNA, 25 bp, Mus musculus
gtaatcattagtagactgttgcctt

SEQ ID NO: 663963 - DNA, 25 bp, Mus musculus
gtaatcattagttgactgttgcctt

SEQ ID NO: 663964 - DNA, 25 bp, Mus musculus
gtaatcattcttacactattatact

SEQ ID NO: 663965 - DNA, 25 bp, Mus musculus
gtaatcattctttcactattatact

SEQ ID NO: 663966 - DNA, 25 bp, Mus musculus
gtaatcattggcacaggtcctgccc

SEQ ID NO: 663967 - DNA, 25 bp, Mus musculus
gtaatcattggctcaggtcctgccc

SEQ ID NO: 663968 - DNA, 25 bp, Mus musculus
gtaatcattgtgattccactcatct

SEQ ID NO: 663969 - DNA, 25 bp, Mus musculus
gtaatcattgtgtttccactcatct

SEQ ID NO: 663970 - DNA, 25 bp, Mus musculus
gtaatcatttatcttgggccttaaa

SEQ ID NO: 663971 - DNA, 25 bp, Mus musculus
gtaatcatttatgttgggccttaaa

SEQ ID NO: 663972 - DNA, 25 bp, Mus musculus
gtaatccaccttatcagctataagt

SEQ ID NO: 663973 - DNA, 25 bp, Mus musculus
gtaatccaccttttcagctataagt

SEQ ID NO: 663974 - DNA, 25 bp, Mus musculus
gtaatccagataattccggcaggct

SEQ ID NO: 663975 - DNA, 25 bp, Mus musculus
gtaatccagatatttccggcaggct

SEQ ID NO: 663976 - DNA, 25 bp, Mus musculus
gtaatccagatgacattagcctcaa

SEQ ID NO: 663977 - DNA, 25 bp, Mus musculus
gtaatccagatgtcattagcctcaa

SEQ ID NO: 663978 - DNA, 25 bp, Mus musculus
gtaatccagggaatttttcttgcat

SEQ ID NO: 663979 - DNA, 25 bp, Mus musculus
gtaatccagggattttttcttgcat

SEQ ID NO: 663980 - DNA, 25 bp, Mus musculus
gtaatccagggcatggctgacattt

SEQ ID NO: 663981 - DNA, 25 bp, Mus musculus
gtaatccagggcttggctgacattt

SEQ ID NO: 663982 - DNA, 25 bp, Mus musculus
gtaatccagtggaagattgttccac

SEQ ID NO: 663983 - DNA, 25 bp, Mus musculus
gtaatccagtggtagattgttccac

SEQ ID NO: 663984 - DNA, 25 bp, Mus musculus
gtaatccatctccaatgcggaaaag

SEQ ID NO: 663985 - DNA, 25 bp, Mus musculus
gtaatccatctcgaatgcggaaaag

SEQ ID NO: 663986 - DNA, 25 bp, Mus musculus
gtaatccatgaaccaaatcaacctt

SEQ ID NO: 663987 - DNA, 25 bp, Mus musculus
gtaatccatgaagcaaatcaacctt

SEQ ID NO: 663988 - DNA, 25 bp, Mus musculus
gtaatccatgacctaatgacctttc

SEQ ID NO: 663989 - DNA, 25 bp, Mus musculus
gtaatccatgacgtaatgacctttc

SEQ ID NO: 663990 - DNA, 25 bp, Mus musculus
gtaatccattctatagtgtgacaaa

SEQ ID NO: 663991 - DNA, 25 bp, Mus musculus
gtaatccattctttagtgtgacaaa

SEQ ID NO: 663992 - DNA, 25 bp, Mus musculus
gtaatcccaacaaaacatcctattg

SEQ ID NO: 663993 - DNA, 25 bp, Mus musculus
gtaatcccaacacccaagacaggat

SEQ ID NO: 663994 - DNA, 25 bp, Mus musculus
gtaatcccaacagccaagacaggat

SEQ ID NO: 663995 - DNA, 25 bp, Mus musculus
gtaatcccaacataacatcctattg

SEQ ID NO: 663996 - DNA, 25 bp, Mus musculus
gtaatcccagcaataaagtcctgat

SEQ ID NO: 663997 - DNA, 25 bp, Mus musculus
gtaatcccagcaccccaagcaggaa

SEQ ID NO: 663998 - DNA, 25 bp, Mus musculus
gtaatcccagcagcccaagcaggaa

SEQ ID NO: 663999 - DNA, 25 bp, Mus musculus
gtaatcccagcattaaagtcctgat

SEQ ID NO: 664000 - DNA, 25 bp, Mus musculus
gtaatcccagggatccctaccagct

SEQ ID NO: 664001 - DNA, 25 bp, Mus musculus
gtaatcccagggttccctaccagct

SEQ ID NO: 664002 - DNA, 25 bp, Mus musculus
gtaatcccagtcatagtggaggctg

SEQ ID NO: 664003 - DNA, 25 bp, Mus musculus
gtaatcccagtcttagtggaggctg

SEQ ID NO: 664004 - DNA, 25 bp, Mus musculus
gtaatcccatcgattcatggctaac

SEQ ID NO: 664005 - DNA, 25 bp, Mus musculus
gtaatcccatcgtttcatggctaac

SEQ ID NO: 664006 - DNA, 25 bp, Mus musculus
gtaatccccacacgtttgtctggag

SEQ ID NO: 664007 - DNA, 25 bp, Mus musculus
gtaatccccacaggtttgtctggag

SEQ ID NO: 664008 - DNA, 25 bp, Mus musculus
gtaatcccgaagacagggagcccat

SEQ ID NO: 664009 - DNA, 25 bp, Mus musculus
gtaatcccgaagtcagggagcccat

SEQ ID NO: 664010 - DNA, 25 bp, Mus musculus
gtaatcccgcagaatctacaaggtg

SEQ ID NO: 664011 - DNA, 25 bp, Mus musculus
gtaatcccgcagtatctacaaggtg

SEQ ID NO: 664012 - DNA, 25 bp, Mus musculus
gtaatcccggaaactagctgctgaa

SEQ ID NO: 664013 - DNA, 25 bp, Mus musculus
gtaatcccggaatctagctgctgaa

SEQ ID NO: 664014 - DNA, 25 bp, Mus musculus
gtaatccctagacgcatcttgcaca

SEQ ID NO: 664015 - DNA, 25 bp, Mus musculus
gtaatccctagaggcatcttgcaca

SEQ ID NO: 664016 - DNA, 25 bp, Mus musculus
gtaatcccttaaatgactattgtga

SEQ ID NO: 664017 - DNA, 25 bp, Mus musculus
gtaatcccttaattgactattgtga

SEQ ID NO: 664018 - DNA, 25 bp, Mus musculus
gtaatcccttatagatactcctgta

SEQ ID NO: 664019 - DNA, 25 bp, Mus musculus
gtaatcccttattgatactcctgta

SEQ ID NO: 664020 - DNA, 25 bp, Mus musculus
gtaatccgaggcagcgggtcctcct

SEQ ID NO: 664021 - DNA, 25 bp, Mus musculus
gtaatccgaggctgcgggtcctcct

SEQ ID NO: 664022 - DNA, 25 bp, Mus musculus
gtaatccgcgctacgggaaccacgt

SEQ ID NO: 664023 - DNA, 25 bp, Mus musculus
gtaatccgcgcttcgggaaccacgt

SEQ ID NO: 664024 - DNA, 25 bp, Mus musculus
gtaatcctaacactccagagattca

SEQ ID NO: 664025 - DNA, 25 bp, Mus musculus
gtaatcctaacagtccagagattca

SEQ ID NO: 664026 - DNA, 25 bp, Mus musculus
gtaatcctaaccaacactttggagg

SEQ ID NO: 664027 - DNA, 25 bp, Mus musculus
gtaatcctaaccattgcgaggctaa

SEQ ID NO: 664028 - DNA, 25 bp, Mus musculus
gtaatcctaacctacactttggagg

SEQ ID NO: 664029 - DNA, 25 bp, Mus musculus
gtaatcctaacctttgcgaggctaa

SEQ ID NO: 664030 - DNA, 25 bp, Mus musculus
gtaatcctacatacacatctttcca

SEQ ID NO: 664031 - DNA, 25 bp, Mus musculus
gtaatcctacattcacatctttcca

SEQ ID NO: 664032 - DNA, 25 bp, Mus musculus
gtaatcctagctaccttgaagctga

SEQ ID NO: 664033 - DNA, 25 bp, Mus musculus
gtaatcctagcttccttgaagctga

SEQ ID NO: 664034 - DNA, 25 bp, Mus musculus
gtaatcctaggacctcgagcactga

SEQ ID NO: 664035 - DNA, 25 bp, Mus musculus
gtaatcctaggagctcgagcactga

SEQ ID NO: 664036 - DNA, 25 bp, Mus musculus
gtaatcctggcaacagatggctaca

SEQ ID NO: 664037 - DNA, 25 bp, Mus musculus
gtaatcctggcatcagatggctaca

SEQ ID NO: 664038 - DNA, 25 bp, Mus musculus
gtaatcctgtggcttaacgactttt

SEQ ID NO: 664039 - DNA, 25 bp, Mus musculus
gtaatcctgtgggttaacgactttt

SEQ ID NO: 664040 - DNA, 25 bp, Mus musculus
gtaatccttcaaagtttgtgctcct

SEQ ID NO: 664041 - DNA, 25 bp, Mus musculus
gtaatccttcaatgtttgtgctcct

SEQ ID NO: 664042 - DNA, 25 bp, Mus musculus
gtaatccttgcaacccatgtagccc

SEQ ID NO: 664043 - DNA, 25 bp, Mus musculus
gtaatccttgcatcccatgtagccc

SEQ ID NO: 664044 - DNA, 25 bp, Mus musculus
gtaatccttgttcctttcctgatac

SEQ ID NO: 664045 - DNA, 25 bp, Mus musculus
gtaatccttgttgctttcctgatac

SEQ ID NO: 664046 - DNA, 25 bp, Mus musculus
gtaatccttttaatgcttcagcaag

SEQ ID NO: 664047 - DNA, 25 bp, Mus musculus
gtaatccttttattgcttcagcaag

SEQ ID NO: 664048 - DNA, 25 bp, Mus musculus
gtaatcgctgatactcagggtctct

SEQ ID NO: 664049 - DNA, 25 bp, Mus musculus
gtaatcgctgattctcagggtctct

SEQ ID NO: 664050 - DNA, 25 bp, Mus musculus
gtaatcgctttgatacttagggcgt

SEQ ID NO: 664051 - DNA, 25 bp, Mus musculus
gtaatcgctttgttacttagggcgt

SEQ ID NO: 664052 - DNA, 25 bp, Mus musculus
gtaatcgttgtaatcagtccctgga

SEQ ID NO: 664053 - DNA, 25 bp, Mus musculus
gtaatcgttgtattcagtccctgga

SEQ ID NO: 664054 - DNA, 25 bp, Mus musculus
gtaatctaaacacctctgaaatgct

SEQ ID NO: 664055 - DNA, 25 bp, Mus musculus
gtaatctaaacagctctgaaatgct

SEQ ID NO: 664056 - DNA, 25 bp, Mus musculus
gtaatctaacttagtcactgtgact

SEQ ID NO: 664057 - DNA, 25 bp, Mus musculus
gtaatctaactttgtcactgtgact

SEQ ID NO: 664058 - DNA, 25 bp, Mus musculus
gtaatctacctcatacactttgtag

SEQ ID NO: 664059 - DNA, 25 bp, Mus musculus
gtaatctacctcttacactttgtag

SEQ ID NO: 664060 - DNA, 25 bp, Mus musculus
gtaatctacgatatgactctgagtt

SEQ ID NO: 664061 - DNA, 25 bp, Mus musculus
gtaatctacgatttgactctgagtt

SEQ ID NO: 664062 - DNA, 25 bp, Mus musculus
gtaatctagcatcccaggcgtgagc

SEQ ID NO: 664063 - DNA, 25 bp, Mus musculus
gtaatctagcatgccaggcgtgagc

SEQ ID NO: 664064 - DNA, 25 bp, Mus musculus
gtaatctagctgaccagtgtttaca

SEQ ID NO: 664065 - DNA, 25 bp, Mus musculus
gtaatctagctgtccagtgtttaca

SEQ ID NO: 664066 - DNA, 25 bp, Mus musculus
gtaatctatcatctctgaacctatt

SEQ ID NO: 664067 - DNA, 25 bp, Mus musculus
gtaatctatcatgtctgaacctatt

SEQ ID NO: 664068 - DNA, 25 bp, Mus musculus
gtaatctatgtaactcagatagcaa

SEQ ID NO: 664069 - DNA, 25 bp, Mus musculus
gtaatctatgtatctcagatagcaa

SEQ ID NO: 664070 - DNA, 25 bp, Mus musculus
gtaatctcaattaggcaattttaat

SEQ ID NO: 664071 - DNA, 25 bp, Mus musculus
gtaatctcaatttggcaattttaat

SEQ ID NO: 664072 - DNA, 25 bp, Mus musculus
gtaatctcagaactctacaggtaga

SEQ ID NO: 664073 - DNA, 25 bp, Mus musculus
gtaatctcagaagtctacaggtaga

SEQ ID NO: 664074 - DNA, 25 bp, Mus musculus
gtaatctcagctacgtttcttaccg

SEQ ID NO: 664075 - DNA, 25 bp, Mus musculus
gtaatctcagcttcgtttcttaccg

SEQ ID NO: 664076 - DNA, 25 bp, Mus musculus
gtaatctcagtactcatatgcccaa

SEQ ID NO: 664077 - DNA, 25 bp, Mus musculus
gtaatctcagtagtcatatgcccaa

SEQ ID NO: 664078 - DNA, 25 bp, Mus musculus
gtaatctccagcaggctttgaggct

SEQ ID NO: 664079 - DNA, 25 bp, Mus musculus
gtaatctccagctggctttgaggct

SEQ ID NO: 664080 - DNA, 25 bp, Mus musculus
gtaatctccttcacatttgttgtga

SEQ ID NO: 664081 - DNA, 25 bp, Mus musculus
gtaatctccttctcatttgttgtga

SEQ ID NO: 664082 - DNA, 25 bp, Mus musculus
gtaatctcggtgcatttcatctgaa

SEQ ID NO: 664083 - DNA, 25 bp, Mus musculus
gtaatctcggtggatttcatctgaa

SEQ ID NO: 664084 - DNA, 25 bp, Mus musculus
gtaatctctaacaaaattccgagta

SEQ ID NO: 664085 - DNA, 25 bp, Mus musculus
gtaatctctaactaaattccgagta

SEQ ID NO: 664086 - DNA, 25 bp, Mus musculus
gtaatctctactaaggatgtgatat

SEQ ID NO: 664087 - DNA, 25 bp, Mus musculus
gtaatctctacttaggatgtgatat

SEQ ID NO: 664088 - DNA, 25 bp, Mus musculus
gtaatctctagaagacagcctggga

SEQ ID NO: 664089 - DNA, 25 bp, Mus musculus
gtaatctctagatgacagcctggga

SEQ ID NO: 664090 - DNA, 25 bp, Mus musculus
gtaatctctctgataaggaaattca

SEQ ID NO: 664091 - DNA, 25 bp, Mus musculus
gtaatctctctgttaaggaaattca

SEQ ID NO: 664092 - DNA, 25 bp, Mus musculus
gtaatctctttcctcttttggacac

SEQ ID NO: 664093 - DNA, 25 bp, Mus musculus
gtaatctctttcctgaataattctt

SEQ ID NO: 664094 - DNA, 25 bp, Mus musculus
gtaatctctttcgtcttttggacac

SEQ ID NO: 664095 - DNA, 25 bp, Mus musculus
gtaatctctttcgtgaataattctt

SEQ ID NO: 664096 - DNA, 25 bp, Mus musculus
gtaatctgcctaatagcatcatgtt

SEQ ID NO: 664097 - DNA, 25 bp, Mus musculus
gtaatctgcctattagcatcatgtt

SEQ ID NO: 664098 - DNA, 25 bp, Mus musculus
gtaatctgggtcacctcagacttgt

SEQ ID NO: 664099 - DNA, 25 bp, Mus musculus
gtaatctgggtctcctcagacttgt

SEQ ID NO: 664100 - DNA, 25 bp, Mus musculus
gtaatctgtactattttggcttaat

SEQ ID NO: 664101 - DNA, 25 bp, Mus musculus
gtaatctgtacttttttggcttaat

SEQ ID NO: 664102 - DNA, 25 bp, Mus musculus
gtaatctgtgaccttcttctggtta

SEQ ID NO: 664103 - DNA, 25 bp, Mus musculus
gtaatctgtgacgttcttctggtta

SEQ ID NO: 664104 - DNA, 25 bp, Mus musculus
gtaatctgttcgaaatttatcccgt

SEQ ID NO: 664105 - DNA, 25 bp, Mus musculus
gtaatctgttcgtaatttatcccgt

SEQ ID NO: 664106 - DNA, 25 bp, Mus musculus
gtaatcttactaccactttcttctt

SEQ ID NO: 664107 - DNA, 25 bp, Mus musculus
gtaatcttactagcactttcttctt

SEQ ID NO: 664108 - DNA, 25 bp, Mus musculus
gtaatcttagcacttcggagacaga

SEQ ID NO: 664109 - DNA, 25 bp, Mus musculus
gtaatcttagcagttcggagacaga

SEQ ID NO: 664110 - DNA, 25 bp, Mus musculus
gtaatcttagccctccagaggtaga

SEQ ID NO: 664111 - DNA, 25 bp, Mus musculus
gtaatcttagccgtccagaggtaga

SEQ ID NO: 664112 - DNA, 25 bp, Mus musculus
gtaatcttagctattcctgtgctca

SEQ ID NO: 664113 - DNA, 25 bp, Mus musculus
gtaatcttagcttttcctgtgctca

SEQ ID NO: 664114 - DNA, 25 bp, Mus musculus
gtaatcttataacctgccaggacca

SEQ ID NO: 664115 - DNA, 25 bp, Mus musculus
gtaatcttataagctgccaggacca

SEQ ID NO: 664116 - DNA, 25 bp, Mus musculus
gtaatcttatctcagctaggcagtg

SEQ ID NO: 664117 - DNA, 25 bp, Mus musculus
gtaatcttatctgagctaggcagtg

SEQ ID NO: 664118 - DNA, 25 bp, Mus musculus
gtaatcttattcaccctaaattgta

SEQ ID NO: 664119 - DNA, 25 bp, Mus musculus
gtaatcttattctccctaaattgta

SEQ ID NO: 664120 - DNA, 25 bp, Mus musculus
gtaatcttcaatatagctatttatg

SEQ ID NO: 664121 - DNA, 25 bp, Mus musculus
gtaatcttcaatttagctatttatg

SEQ ID NO: 664122 - DNA, 25 bp, Mus musculus
gtaatcttctacattaacacctcac

SEQ ID NO: 664123 - DNA, 25 bp, Mus musculus
gtaatcttctactttaacacctcac

SEQ ID NO: 664124 - DNA, 25 bp, Mus musculus
gtaatcttctcaactgaggcgcaaa

SEQ ID NO: 664125 - DNA, 25 bp, Mus musculus
gtaatcttctcatctgaggcgcaaa

SEQ ID NO: 664126 - DNA, 25 bp, Mus musculus
gtaatcttcttcaccgatgtacaga

SEQ ID NO: 664127 - DNA, 25 bp, Mus musculus
gtaatcttcttctccgatgtacaga

SEQ ID NO: 664128 - DNA, 25 bp, Mus musculus
gtaatcttgaaaacctggtcttcta

SEQ ID NO: 664129 - DNA, 25 bp, Mus musculus
gtaatcttgaaatcctggtcttcta

SEQ ID NO: 664130 - DNA, 25 bp, Mus musculus
gtaatcttggcactgttcgtagagg

SEQ ID NO: 664131 - DNA, 25 bp, Mus musculus
gtaatcttggcagtgttcgtagagg

SEQ ID NO: 664132 - DNA, 25 bp, Mus musculus
gtaatcttgtatctggtatctgcct

SEQ ID NO: 664133 - DNA, 25 bp, Mus musculus
gtaatcttgtatgtggtatctgcct

SEQ ID NO: 664134 - DNA, 25 bp, Mus musculus
gtaatctttaacatgctctgtgaga

SEQ ID NO: 664135 - DNA, 25 bp, Mus musculus
gtaatctttaacttgctctgtgaga

SEQ ID NO: 664136 - DNA, 25 bp, Mus musculus
gtaatctttcacactgttcacagac

SEQ ID NO: 664137 - DNA, 25 bp, Mus musculus
gtaatctttcacatatttgtttcct

SEQ ID NO: 664138 - DNA, 25 bp, Mus musculus
gtaatctttcactctgttcacagac

SEQ ID NO: 664139 - DNA, 25 bp, Mus musculus
gtaatctttcacttatttgtttcct

SEQ ID NO: 664140 - DNA, 25 bp, Mus musculus
gtaatctttccacttgggaggtgaa

SEQ ID NO: 664141 - DNA, 25 bp, Mus musculus
gtaatctttccagttgggaggtgaa

SEQ ID NO: 664142 - DNA, 25 bp, Mus musculus
gtaatctttccgatgctacaatgaa

SEQ ID NO: 664143 - DNA, 25 bp, Mus musculus
gtaatctttccgttgctacaatgaa

SEQ ID NO: 664144 - DNA, 25 bp, Mus musculus
gtaatctttcttacgctgtctcaca

SEQ ID NO: 664145 - DNA, 25 bp, Mus musculus
gtaatctttctttcgctgtctcaca

SEQ ID NO: 664146 - DNA, 25 bp, Mus musculus
gtaatctttgatcgtttccaccacc

SEQ ID NO: 664147 - DNA, 25 bp, Mus musculus
gtaatctttgatggtttccaccacc

SEQ ID NO: 664148 - DNA, 25 bp, Mus musculus
gtaatctttgtgctatcaactgtca

SEQ ID NO: 664149 - DNA, 25 bp, Mus musculus
gtaatctttgtggtatcaactgtca

SEQ ID NO: 664150 - DNA, 25 bp, Mus musculus
gtaatctttgttatcttgcttaggt

SEQ ID NO: 664151 - DNA, 25 bp, Mus musculus
gtaatctttgttttcttgcttaggt

SEQ ID NO: 664152 - DNA, 25 bp, Mus musculus
gtaatcttttcacttgacagtactt

SEQ ID NO: 664153 - DNA, 25 bp, Mus musculus
gtaatcttttcagttgacagtactt

SEQ ID NO: 664154 - DNA, 25 bp, Mus musculus
gtaatcttttctaaagctcacggaa

SEQ ID NO: 664155 - DNA, 25 bp, Mus musculus
gtaatcttttcttaagctcacggaa

SEQ ID NO: 664156 - DNA, 25 bp, Mus musculus
gtaatctttttacacctgcaagtcc

SEQ ID NO: 664157 - DNA, 25 bp, Mus musculus
gtaatctttttagacctgcaagtcc

SEQ ID NO: 664158 - DNA, 25 bp, Mus musculus
gtaatgaaaactcttctggcacaat

SEQ ID NO: 664159 - DNA, 25 bp, Mus musculus
gtaatgaaaactgttctggcacaat

SEQ ID NO: 664160 - DNA, 25 bp, Mus musculus
gtaatgaaatgtccaaatctgattg

SEQ ID NO: 664161 - DNA, 25 bp, Mus musculus
gtaatgaaatgtgcaaatctgattg

SEQ ID NO: 664162 - DNA, 25 bp, Mus musculus
gtaatgaagagcagtttgttttcta

SEQ ID NO: 664163 - DNA, 25 bp, Mus musculus
gtaatgaagagctgtttgttttcta

SEQ ID NO: 664164 - DNA, 25 bp, Mus musculus
gtaatgaagcatagtgcacacagag

SEQ ID NO: 664165 - DNA, 25 bp, Mus musculus
gtaatgaagcattgtgcacacagag

SEQ ID NO: 664166 - DNA, 25 bp, Mus musculus
gtaatgaaggtcacagtccacaggt

SEQ ID NO: 664167 - DNA, 25 bp, Mus musculus
gtaatgaaggtctcagtccacaggt

SEQ ID NO: 664168 - DNA, 25 bp, Mus musculus
gtaatgaagtgtacccacaacacag

SEQ ID NO: 664169 - DNA, 25 bp, Mus musculus
gtaatgaagtgttcccacaacacag

SEQ ID NO: 664170 - DNA, 25 bp, Mus musculus
gtaatgacagacaccttggctgaga

SEQ ID NO: 664171 - DNA, 25 bp, Mus musculus
gtaatgacagactccttggctgaga

SEQ ID NO: 664172 - DNA, 25 bp, Mus musculus
gtaatgacagtaatttcaactcttt

SEQ ID NO: 664173 - DNA, 25 bp, Mus musculus
gtaatgacagtattttcaactcttt

SEQ ID NO: 664174 - DNA, 25 bp, Mus musculus
gtaatgaccaataggacccctgaaa

SEQ ID NO: 664175 - DNA, 25 bp, Mus musculus
gtaatgaccaattggacccctgaaa

SEQ ID NO: 664176 - DNA, 25 bp, Mus musculus
gtaatgaccctcaaagccaaggcag

SEQ ID NO: 664177 - DNA, 25 bp, Mus musculus
gtaatgaccctctaagccaaggcag

SEQ ID NO: 664178 - DNA, 25 bp, Mus musculus
gtaatgaccgagagcgggtcaatga

SEQ ID NO: 664179 - DNA, 25 bp, Mus musculus
gtaatgaccgagtgcgggtcaatga

SEQ ID NO: 664180 - DNA, 25 bp, Mus musculus
gtaatgacctttagtacacagcata

SEQ ID NO: 664181 - DNA, 25 bp, Mus musculus
gtaatgaccttttgtacacagcata

SEQ ID NO: 664182 - DNA, 25 bp, Mus musculus
gtaatgacttccacaccaacaagcg

SEQ ID NO: 664183 - DNA, 25 bp, Mus musculus
gtaatgacttcctcaccaacaagcg

SEQ ID NO: 664184 - DNA, 25 bp, Mus musculus
gtaatgagataaccttcccttttct

SEQ ID NO: 664185 - DNA, 25 bp, Mus musculus
gtaatgagataagcttcccttttct

SEQ ID NO: 664186 - DNA, 25 bp, Mus musculus
gtaatgagatcactctgaccaactg

SEQ ID NO: 664187 - DNA, 25 bp, Mus musculus
gtaatgagatcagtctgaccaactg

SEQ ID NO: 664188 - DNA, 25 bp, Mus musculus
gtaatgagcagcaccctgtgagttt

SEQ ID NO: 664189 - DNA, 25 bp, Mus musculus
gtaatgagcagctccctgtgagttt

SEQ ID NO: 664190 - DNA, 25 bp, Mus musculus
gtaatgagcttacaaatgtgatcca

SEQ ID NO: 664191 - DNA, 25 bp, Mus musculus
gtaatgagcttagaaatgtgatcca

SEQ ID NO: 664192 - DNA, 25 bp, Mus musculus
gtaatgagctttatgtcacgtgact

SEQ ID NO: 664193 - DNA, 25 bp, Mus musculus
gtaatgagctttttgtcacgtgact

SEQ ID NO: 664194 - DNA, 25 bp, Mus musculus
gtaatgaggtgtagcagtgactgtc

SEQ ID NO: 664195 - DNA, 25 bp, Mus musculus
gtaatgaggtgttgcagtgactgtc

SEQ ID NO: 664196 - DNA, 25 bp, Mus musculus
gtaatgagtctgattgttgctacaa

SEQ ID NO: 664197 - DNA, 25 bp, Mus musculus
gtaatgagtctgtttgttgctacaa

SEQ ID NO: 664198 - DNA, 25 bp, Mus musculus
gtaatgatcacccttcaaagagttt

SEQ ID NO: 664199 - DNA, 25 bp, Mus musculus
gtaatgatcaccgttcaaagagttt

SEQ ID NO: 664200 - DNA, 25 bp, Mus musculus
gtaatgatccataacagggtgcact

SEQ ID NO: 664201 - DNA, 25 bp, Mus musculus
gtaatgatccattacagggtgcact

SEQ ID NO: 664202 - DNA, 25 bp, Mus musculus
gtaatgatctgtaggctttcctttc

SEQ ID NO: 664203 - DNA, 25 bp, Mus musculus
gtaatgatctgttggctttcctttc

SEQ ID NO: 664204 - DNA, 25 bp, Mus musculus
gtaatgatggttatacaggccaagg

SEQ ID NO: 664205 - DNA, 25 bp, Mus musculus
gtaatgatggttttacaggccaagg

SEQ ID NO: 664206 - DNA, 25 bp, Mus musculus
gtaatgattctaaattattgccaaa

SEQ ID NO: 664207 - DNA, 25 bp, Mus musculus
gtaatgattctatattattgccaaa

SEQ ID NO: 664208 - DNA, 25 bp, Mus musculus
gtaatgcaaacgattgtcgggtttt

SEQ ID NO: 664209 - DNA, 25 bp, Mus musculus
gtaatgcaaacgtttgtcgggtttt

SEQ ID NO: 664210 - DNA, 25 bp, Mus musculus
gtaatgcacatcatggctccatcaa

SEQ ID NO: 664211 - DNA, 25 bp, Mus musculus
gtaatgcacatcttggctccatcaa

SEQ ID NO: 664212 - DNA, 25 bp, Mus musculus
gtaatgcactctcctagtcggaaga

SEQ ID NO: 664213 - DNA, 25 bp, Mus musculus
gtaatgcactctgctagtcggaaga

SEQ ID NO: 664214 - DNA, 25 bp, Mus musculus
gtaatgcagcttcttggaggccaga

SEQ ID NO: 664215 - DNA, 25 bp, Mus musculus
gtaatgcagcttgttggaggccaga

SEQ ID NO: 664216 - DNA, 25 bp, Mus musculus
gtaatgcagtacctaccggaaacca

SEQ ID NO: 664217 - DNA, 25 bp, Mus musculus
gtaatgcagtacgtaccggaaacca

SEQ ID NO: 664218 - DNA, 25 bp, Mus musculus
gtaatgcatcctcccctagagaaag

SEQ ID NO: 664219 - DNA, 25 bp, Mus musculus
gtaatgcatcctgccctagagaaag

SEQ ID NO: 664220 - DNA, 25 bp, Mus musculus
gtaatgcattgtagttagacctaat

SEQ ID NO: 664221 - DNA, 25 bp, Mus musculus
gtaatgcattgtccttccgggtgat

SEQ ID NO: 664222 - DNA, 25 bp, Mus musculus
gtaatgcattgtgcttccgggtgat

SEQ ID NO: 664223 - DNA, 25 bp, Mus musculus
gtaatgcattgttgttagacctaat

SEQ ID NO: 664224 - DNA, 25 bp, Mus musculus
gtaatgccagcaccgagcatcccag

SEQ ID NO: 664225 - DNA, 25 bp, Mus musculus
gtaatgccagcagcgagcatcccag

SEQ ID NO: 664226 - DNA, 25 bp, Mus musculus
gtaatgccaggtcggactgcactgt

SEQ ID NO: 664227 - DNA, 25 bp, Mus musculus
gtaatgccaggtgggactgcactgt

SEQ ID NO: 664228 - DNA, 25 bp, Mus musculus
gtaatgcccagcctatatgtttcaa

SEQ ID NO: 664229 - DNA, 25 bp, Mus musculus
gtaatgcccagcgtatatgtttcaa

SEQ ID NO: 664230 - DNA, 25 bp, Mus musculus
gtaatgccccagctgtattctgttt

SEQ ID NO: 664231 - DNA, 25 bp, Mus musculus
gtaatgccccaggtgtattctgttt

SEQ ID NO: 664232 - DNA, 25 bp, Mus musculus
gtaatgcccctgaatgaacaagaag

SEQ ID NO: 664233 - DNA, 25 bp, Mus musculus
gtaatgcccctgtatgaacaagaag

SEQ ID NO: 664234 - DNA, 25 bp, Mus musculus
gtaatgccctttcaatgcaactttt

SEQ ID NO: 664235 - DNA, 25 bp, Mus musculus
gtaatgccctttgaatgcaactttt

SEQ ID NO: 664236 - DNA, 25 bp, Mus musculus
gtaatgccgctgagttggagagaaa

SEQ ID NO: 664237 - DNA, 25 bp, Mus musculus
gtaatgccgctgtgttggagagaaa

SEQ ID NO: 664238 - DNA, 25 bp, Mus musculus
gtaatgcctgggacaatgttacttc

SEQ ID NO: 664239 - DNA, 25 bp, Mus musculus
gtaatgcctgggtcaatgttacttc

SEQ ID NO: 664240 - DNA, 25 bp, Mus musculus
gtaatgccttttcctagtatgtctg

SEQ ID NO: 664241 - DNA, 25 bp, Mus musculus
gtaatgccttttgctagtatgtctg

SEQ ID NO: 664242 - DNA, 25 bp, Mus musculus
gtaatgcgaggtcctgcttctgtgt

SEQ ID NO: 664243 - DNA, 25 bp, Mus musculus
gtaatgcgaggtgctgcttctgtgt

SEQ ID NO: 664244 - DNA, 25 bp, Mus musculus
gtaatgcgctaaccagacgagagag

SEQ ID NO: 664245 - DNA, 25 bp, Mus musculus
gtaatgcgctaagcagacgagagag

SEQ ID NO: 664246 - DNA, 25 bp, Mus musculus
gtaatgctaaatctggtacctgaag

SEQ ID NO: 664247 - DNA, 25 bp, Mus musculus
gtaatgctaaatgtggtacctgaag

SEQ ID NO: 664248 - DNA, 25 bp, Mus musculus
gtaatgctaagtcccagatccaaat

SEQ ID NO: 664249 - DNA, 25 bp, Mus musculus
gtaatgctaagtgccagatccaaat

SEQ ID NO: 664250 - DNA, 25 bp, Mus musculus
gtaatgctatcaaatcagtatccag

SEQ ID NO: 664251 - DNA, 25 bp, Mus musculus
gtaatgctatcatatcagtatccag

SEQ ID NO: 664252 - DNA, 25 bp, Mus musculus
gtaatgctatcccagagtatttgat

SEQ ID NO: 664253 - DNA, 25 bp, Mus musculus
gtaatgctatccgagagtatttgat

SEQ ID NO: 664254 - DNA, 25 bp, Mus musculus
gtaatgctcgcacttattaaggttt

SEQ ID NO: 664255 - DNA, 25 bp, Mus musculus
gtaatgctcgcagttattaaggttt

SEQ ID NO: 664256 - DNA, 25 bp, Mus musculus
gtaatgctcgctagtgtggccgtca

SEQ ID NO: 664257 - DNA, 25 bp, Mus musculus
gtaatgctcgcttgtgtggccgtca

SEQ ID NO: 664258 - DNA, 25 bp, Mus musculus
gtaatgctgaaactcattccctgcc

SEQ ID NO: 664259 - DNA, 25 bp, Mus musculus
gtaatgctgaaagtcattccctgcc

SEQ ID NO: 664260 - DNA, 25 bp, Mus musculus
gtaatgctgattcagacaacagtga

SEQ ID NO: 664261 - DNA, 25 bp, Mus musculus
gtaatgctgattgagacaacagtga

SEQ ID NO: 664262 - DNA, 25 bp, Mus musculus
gtaatgctgctgagaacctaaggta

SEQ ID NO: 664263 - DNA, 25 bp, Mus musculus
gtaatgctgctgtgaacctaaggta

SEQ ID NO: 664264 - DNA, 25 bp, Mus musculus
gtaatgcttatgaggaagtttaacc

SEQ ID NO: 664265 - DNA, 25 bp, Mus musculus
gtaatgcttatgtggaagtttaacc

SEQ ID NO: 664266 - DNA, 25 bp, Mus musculus
gtaatgcttctaatcactataatga

SEQ ID NO: 664267 - DNA, 25 bp, Mus musculus
gtaatgcttctacgttcttctgtat

SEQ ID NO: 664268 - DNA, 25 bp, Mus musculus
gtaatgcttctaggttcttctgtat

SEQ ID NO: 664269 - DNA, 25 bp, Mus musculus
gtaatgcttctattcactataatga

SEQ ID NO: 664270 - DNA, 25 bp, Mus musculus
gtaatgcttgctaactccaagaatg

SEQ ID NO: 664271 - DNA, 25 bp, Mus musculus
gtaatgcttgcttactccaagaatg

SEQ ID NO: 664272 - DNA, 25 bp, Mus musculus
gtaatgcttgtacctgccatacttt

SEQ ID NO: 664273 - DNA, 25 bp, Mus musculus
gtaatgcttgtagctgccatacttt

SEQ ID NO: 664274 - DNA, 25 bp, Mus musculus
gtaatgctttacagctattgctaat

SEQ ID NO: 664275 - DNA, 25 bp, Mus musculus
gtaatgctttactgctattgctaat

SEQ ID NO: 664276 - DNA, 25 bp, Mus musculus
gtaatggaaaccaaacactcatctg

SEQ ID NO: 664277 - DNA, 25 bp, Mus musculus
gtaatggaaacctaacactcatctg

SEQ ID NO: 664278 - DNA, 25 bp, Mus musculus
gtaatggaacacatcttcaacatga

SEQ ID NO: 664279 - DNA, 25 bp, Mus musculus
gtaatggaacacttcttcaacatga

SEQ ID NO: 664280 - DNA, 25 bp, Mus musculus
gtaatggaagaaccctattaatatt

SEQ ID NO: 664281 - DNA, 25 bp, Mus musculus
gtaatggaagaagcctattaatatt

SEQ ID NO: 664282 - DNA, 25 bp, Mus musculus
gtaatggaagcacttctgcccattt

SEQ ID NO: 664283 - DNA, 25 bp, Mus musculus
gtaatggaagcagttctgcccattt

SEQ ID NO: 664284 - DNA, 25 bp, Mus musculus
gtaatggaagcccactgtcacaacc

SEQ ID NO: 664285 - DNA, 25 bp, Mus musculus
gtaatggaagccgactgtcacaacc

SEQ ID NO: 664286 - DNA, 25 bp, Mus musculus
gtaatggacccacacggaacttgta

SEQ ID NO: 664287 - DNA, 25 bp, Mus musculus
gtaatggacccagacggaacttgta

SEQ ID NO: 664288 - DNA, 25 bp, Mus musculus
gtaatggacgtcaacactgctctac

SEQ ID NO: 664289 - DNA, 25 bp, Mus musculus
gtaatggacgtcaaccctgcttttc

SEQ ID NO: 664290 - DNA, 25 bp, Mus musculus
gtaatggacgtctacactgctctac

SEQ ID NO: 664291 - DNA, 25 bp, Mus musculus
gtaatggacgtctaccctgcttttc

SEQ ID NO: 664292 - DNA, 25 bp, Mus musculus
gtaatggatctcatatttttcttta

SEQ ID NO: 664293 - DNA, 25 bp, Mus musculus
gtaatggatctcttatttttcttta

SEQ ID NO: 664294 - DNA, 25 bp, Mus musculus
gtaatggattctccagtttcttgag

SEQ ID NO: 664295 - DNA, 25 bp, Mus musculus
gtaatggattctgcagtttcttgag

SEQ ID NO: 664296 - DNA, 25 bp, Mus musculus
gtaatggcaactccatttctaagtt

SEQ ID NO: 664297 - DNA, 25 bp, Mus musculus
gtaatggcaactgcatttctaagtt

SEQ ID NO: 664298 - DNA, 25 bp, Mus musculus
gtaatggcacaaatgatttccctga

SEQ ID NO: 664299 - DNA, 25 bp, Mus musculus
gtaatggcacaattgatttccctga

SEQ ID NO: 664300 - DNA, 25 bp, Mus musculus
gtaatggcacacaagatctccccaa

SEQ ID NO: 664301 - DNA, 25 bp, Mus musculus
gtaatggcacactagatctccccaa

SEQ ID NO: 664302 - DNA, 25 bp, Mus musculus
gtaatggcacttatgcttgtttcac

SEQ ID NO: 664303 - DNA, 25 bp, Mus musculus
gtaatggcacttttgcttgtttcac

SEQ ID NO: 664304 - DNA, 25 bp, Mus musculus
gtaatggcatttaggttgccaccaa

SEQ ID NO: 664305 - DNA, 25 bp, Mus musculus
gtaatggcattttggttgccaccaa

SEQ ID NO: 664306 - DNA, 25 bp, Mus musculus
gtaatggcctacaacactgaagtct

SEQ ID NO: 664307 - DNA, 25 bp, Mus musculus
gtaatggcctactacactgaagtct

SEQ ID NO: 664308 - DNA, 25 bp, Mus musculus
gtaatggccttcaaagcactgcaag

SEQ ID NO: 664309 - DNA, 25 bp, Mus musculus
gtaatggccttctaagcactgcaag

SEQ ID NO: 664310 - DNA, 25 bp, Mus musculus
gtaatggctatcctactacaaatca

SEQ ID NO: 664311 - DNA, 25 bp, Mus musculus
gtaatggctatcgtactacaaatca

SEQ ID NO: 664312 - DNA, 25 bp, Mus musculus
gtaatggctcacacttgatcaagca

SEQ ID NO: 664313 - DNA, 25 bp, Mus musculus
gtaatggctcactcttgatcaagca

SEQ ID NO: 664314 - DNA, 25 bp, Mus musculus
gtaatggctcatcctctaaaatcaa

SEQ ID NO: 664315 - DNA, 25 bp, Mus musculus
gtaatggctcatgctctaaaatcaa

SEQ ID NO: 664316 - DNA, 25 bp, Mus musculus
gtaatggctgccacacaatgtgcat

SEQ ID NO: 664317 - DNA, 25 bp, Mus musculus
gtaatggctgcctcacaatgtgcat

SEQ ID NO: 664318 - DNA, 25 bp, Mus musculus
gtaatgggacctcatgtggccatga

SEQ ID NO: 664319 - DNA, 25 bp, Mus musculus
gtaatgggacctgatgtggccatga

SEQ ID NO: 664320 - DNA, 25 bp, Mus musculus
gtaatgggagttaggaacaatactt

SEQ ID NO: 664321 - DNA, 25 bp, Mus musculus
gtaatgggagtttggaacaatactt

SEQ ID NO: 664322 - DNA, 25 bp, Mus musculus
gtaatgggcctcaaaagttctgtat

SEQ ID NO: 664323 - DNA, 25 bp, Mus musculus
gtaatgggcctctaaagttctgtat

SEQ ID NO: 664324 - DNA, 25 bp, Mus musculus
gtaatgggggttatgcctggacaat

SEQ ID NO: 664325 - DNA, 25 bp, Mus musculus
gtaatgggggttttgcctggacaat

SEQ ID NO: 664326 - DNA, 25 bp, Mus musculus
gtaatggtcaccaattctctttcta

SEQ ID NO: 664327 - DNA, 25 bp, Mus musculus
gtaatggtcacctattctctttcta

SEQ ID NO: 664328 - DNA, 25 bp, Mus musculus
gtaatggtccctacttgcataattt

SEQ ID NO: 664329 - DNA, 25 bp, Mus musculus
gtaatggtcccttcttgcataattt

SEQ ID NO: 664330 - DNA, 25 bp, Mus musculus
gtaatggtgaagcattttcagttaa

SEQ ID NO: 664331 - DNA, 25 bp, Mus musculus
gtaatggtgaaggattttcagttaa

SEQ ID NO: 664332 - DNA, 25 bp, Mus musculus
gtaatggtgacccagcagcgagctc

SEQ ID NO: 664333 - DNA, 25 bp, Mus musculus
gtaatggtgaccgagcagcgagctc

SEQ ID NO: 664334 - DNA, 25 bp, Mus musculus
gtaatggtgtaaacccctgaaactg

SEQ ID NO: 664335 - DNA, 25 bp, Mus musculus
gtaatggtgtaatcccctgaaactg

SEQ ID NO: 664336 - DNA, 25 bp, Mus musculus
gtaatggttcttaccacttggtgga

SEQ ID NO: 664337 - DNA, 25 bp, Mus musculus
gtaatggttctttccacttggtgga

SEQ ID NO: 664338 - DNA, 25 bp, Mus musculus
gtaatggttgaacacacccctcagt

SEQ ID NO: 664339 - DNA, 25 bp, Mus musculus
gtaatggttgaagacacccctcagt

SEQ ID NO: 664340 - DNA, 25 bp, Mus musculus
gtaatggttgagatgccagactgat

SEQ ID NO: 664341 - DNA, 25 bp, Mus musculus
gtaatggttgagttgccagactgat

SEQ ID NO: 664342 - DNA, 25 bp, Mus musculus
gtaatggttttcaaatttcagtctt

SEQ ID NO: 664343 - DNA, 25 bp, Mus musculus
gtaatggttttctaatttcagtctt

SEQ ID NO: 664344 - DNA, 25 bp, Mus musculus
gtaatgtaaacacaccataaaccca

SEQ ID NO: 664345 - DNA, 25 bp, Mus musculus
gtaatgtaaacagaccataaaccca

SEQ ID NO: 664346 - DNA, 25 bp, Mus musculus
gtaatgtaactaattcttatctgaa

SEQ ID NO: 664347 - DNA, 25 bp, Mus musculus
gtaatgtaactatttcttatctgaa

SEQ ID NO: 664348 - DNA, 25 bp, Mus musculus
gtaatgtaatacagcactgtgtaat

SEQ ID NO: 664349 - DNA, 25 bp, Mus musculus
gtaatgtaatactgcactgtgtaat

SEQ ID NO: 664350 - DNA, 25 bp, Mus musculus
gtaatgtaccaacgtttcagcacag

SEQ ID NO: 664351 - DNA, 25 bp, Mus musculus
gtaatgtaccaaggtttcagcacag

SEQ ID NO: 664352 - DNA, 25 bp, Mus musculus
gtaatgtacgcacagccatgaccaa

SEQ ID NO: 664353 - DNA, 25 bp, Mus musculus
gtaatgtacgcagagccatgaccaa

SEQ ID NO: 664354 - DNA, 25 bp, Mus musculus
gtaatgtagcccatggtacctttat

SEQ ID NO: 664355 - DNA, 25 bp, Mus musculus
gtaatgtagcccttggtacctttat

SEQ ID NO: 664356 - DNA, 25 bp, Mus musculus
gtaatgtcacttaagcactagagtt

SEQ ID NO: 664357 - DNA, 25 bp, Mus musculus
gtaatgtcactttagcactagagtt

SEQ ID NO: 664358 - DNA, 25 bp, Mus musculus
gtaatgtccaatcattctttcccca

SEQ ID NO: 664359 - DNA, 25 bp, Mus musculus
gtaatgtccaatgattctttcccca

SEQ ID NO: 664360 - DNA, 25 bp, Mus musculus
gtaatgtccatcactactctggaga

SEQ ID NO: 664361 - DNA, 25 bp, Mus musculus
gtaatgtccatctctactctggaga

SEQ ID NO: 664362 - DNA, 25 bp, Mus musculus
gtaatgtcccttatgttcacagtaa

SEQ ID NO: 664363 - DNA, 25 bp, Mus musculus
gtaatgtcccttttgttcacagtaa

SEQ ID NO: 664364 - DNA, 25 bp, Mus musculus
gtaatgtccgccaaagggatgcagt

SEQ ID NO: 664365 - DNA, 25 bp, Mus musculus
gtaatgtccgcctaagggatgcagt

SEQ ID NO: 664366 - DNA, 25 bp, Mus musculus
gtaatgtcctaaagccatgttcagt

SEQ ID NO: 664367 - DNA, 25 bp, Mus musculus
gtaatgtcctaatgccatgttcagt

SEQ ID NO: 664368 - DNA, 25 bp, Mus musculus
gtaatgtcctctatcatagtctgtc

SEQ ID NO: 664369 - DNA, 25 bp, Mus musculus
gtaatgtcctctttcatagtctgtc

SEQ ID NO: 664370 - DNA, 25 bp, Mus musculus
gtaatgtctgagcaaccgagtttta

SEQ ID NO: 664371 - DNA, 25 bp, Mus musculus
gtaatgtctgaggaaccgagtttta

SEQ ID NO: 664372 - DNA, 25 bp, Mus musculus
gtaatgtctgtacatgctccgttat

SEQ ID NO: 664373 - DNA, 25 bp, Mus musculus
gtaatgtctgtagatgctccgttat

SEQ ID NO: 664374 - DNA, 25 bp, Mus musculus
gtaatgtgaagcacctggtcctctt

SEQ ID NO: 664375 - DNA, 25 bp, Mus musculus
gtaatgtgaagctcctggtcctctt

SEQ ID NO: 664376 - DNA, 25 bp, Mus musculus
gtaatgtgatctctctgcatgcatc

SEQ ID NO: 664377 - DNA, 25 bp, Mus musculus
gtaatgtgatctgtctgcatgcatc

SEQ ID NO: 664378 - DNA, 25 bp, Mus musculus
gtaatgtgccttatacacctgaggg

SEQ ID NO: 664379 - DNA, 25 bp, Mus musculus
gtaatgtgccttttacacctgaggg

SEQ ID NO: 664380 - DNA, 25 bp, Mus musculus
gtaatgtgggcacgcttcaatttta

SEQ ID NO: 664381 - DNA, 25 bp, Mus musculus
gtaatgtgggcaggcttcaatttta

SEQ ID NO: 664382 - DNA, 25 bp, Mus musculus
gtaatgtgtactatgattgttcaat

SEQ ID NO: 664383 - DNA, 25 bp, Mus musculus
gtaatgtgtactttgattgttcaat

SEQ ID NO: 664384 - DNA, 25 bp, Mus musculus
gtaatgtgtgccctgcatgctgcgc

SEQ ID NO: 664385 - DNA, 25 bp, Mus musculus
gtaatgtgtgccgtgcatgctgcgc

SEQ ID NO: 664386 - DNA, 25 bp, Mus musculus
gtaatgtgtgctaaacctatgtttt

SEQ ID NO: 664387 - DNA, 25 bp, Mus musculus
gtaatgtgtgcttaacctatgtttt

SEQ ID NO: 664388 - DNA, 25 bp, Mus musculus
gtaatgtgtgtaacttaaatatggg

SEQ ID NO: 664389 - DNA, 25 bp, Mus musculus
gtaatgtgtgtatcttaaatatggg

SEQ ID NO: 664390 - DNA, 25 bp, Mus musculus
gtaatgttacacacctgcttataca

SEQ ID NO: 664391 - DNA, 25 bp, Mus musculus
gtaatgttacactcctgcttataca

SEQ ID NO: 664392 - DNA, 25 bp, Mus musculus
gtaatgttatatccctttatcctag

SEQ ID NO: 664393 - DNA, 25 bp, Mus musculus
gtaatgttatatgcctttatcctag

SEQ ID NO: 664394 - DNA, 25 bp, Mus musculus
gtaatgttcaatattagagggctgt

SEQ ID NO: 664395 - DNA, 25 bp, Mus musculus
gtaatgttcaattttagagggctgt

SEQ ID NO: 664396 - DNA, 25 bp, Mus musculus
gtaatgttcctacccagctggagca

SEQ ID NO: 664397 - DNA, 25 bp, Mus musculus
gtaatgttcctagccagctggagca

SEQ ID NO: 664398 - DNA, 25 bp, Mus musculus
gtaatgttctttctacctttgtatg

SEQ ID NO: 664399 - DNA, 25 bp, Mus musculus
gtaatgttctttgtacctttgtatg

SEQ ID NO: 664400 - DNA, 25 bp, Mus musculus
gtaatgttgcaaatccgcccattgg

SEQ ID NO: 664401 - DNA, 25 bp, Mus musculus
gtaatgttgcaattccgcccattgg

SEQ ID NO: 664402 - DNA, 25 bp, Mus musculus
gtaatgttggatctatcacctctct

SEQ ID NO: 664403 - DNA, 25 bp, Mus musculus
gtaatgttggatgtatcacctctct

SEQ ID NO: 664404 - DNA, 25 bp, Mus musculus
gtaatgttgtgtatggtagttctca

SEQ ID NO: 664405 - DNA, 25 bp, Mus musculus
gtaatgttgtgtttggtagttctca

SEQ ID NO: 664406 - DNA, 25 bp, Mus musculus
gtaatgttttagactgccttttttg

SEQ ID NO: 664407 - DNA, 25 bp, Mus musculus
gtaatgttttagtctgccttttttg

SEQ ID NO: 664408 - DNA, 25 bp, Mus musculus
gtaatgtttttaagtcctctccttg

SEQ ID NO: 664409 - DNA, 25 bp, Mus musculus
gtaatgtttttatgtcctctccttg

SEQ ID NO: 664410 - DNA, 25 bp, Mus musculus
gtaattaaatgtcaagcctgtggat

SEQ ID NO: 664411 - DNA, 25 bp, Mus musculus
gtaattaaatgtgaagcctgtggat

SEQ ID NO: 664412 - DNA, 25 bp, Mus musculus
gtaattaagatccactcctggctga

SEQ ID NO: 664413 - DNA, 25 bp, Mus musculus
gtaattaagatcgactcctggctga

SEQ ID NO: 664414 - DNA, 25 bp, Mus musculus
gtaattaagcttccaggatcactac

SEQ ID NO: 664415 - DNA, 25 bp, Mus musculus
gtaattaagcttgcaggatcactac

SEQ ID NO: 664416 - DNA, 25 bp, Mus musculus
gtaattacagtcacagaatccaagt

SEQ ID NO: 664417 - DNA, 25 bp, Mus musculus
gtaattacagtctcagaatccaagt

SEQ ID NO: 664418 - DNA, 25 bp, Mus musculus
gtaattacagtgactacacgtgaca

SEQ ID NO: 664419 - DNA, 25 bp, Mus musculus
gtaattacagtgtctacacgtgaca

SEQ ID NO: 664420 - DNA, 25 bp, Mus musculus
gtaattaccaacaccctacacaagt

SEQ ID NO: 664421 - DNA, 25 bp, Mus musculus
gtaattaccaactccctacacaagt

SEQ ID NO: 664422 - DNA, 25 bp, Mus musculus
gtaattaccacacatctgaaagaag

SEQ ID NO: 664423 - DNA, 25 bp, Mus musculus
gtaattaccacagatctgaaagaag

SEQ ID NO: 664424 - DNA, 25 bp, Mus musculus
gtaattaccagcacagacgacggaa

SEQ ID NO: 664425 - DNA, 25 bp, Mus musculus
gtaattaccagctcagacgacggaa

SEQ ID NO: 664426 - DNA, 25 bp, Mus musculus
gtaattaccgaaaccagccgaggct

SEQ ID NO: 664427 - DNA, 25 bp, Mus musculus
gtaattaccgaatccagccgaggct

SEQ ID NO: 664428 - DNA, 25 bp, Mus musculus
gtaattactgacaacgctgcatttg

SEQ ID NO: 664429 - DNA, 25 bp, Mus musculus
gtaattactgactacgctgcatttg

SEQ ID NO: 664430 - DNA, 25 bp, Mus musculus
gtaattactgcccttcatgtggtcc

SEQ ID NO: 664431 - DNA, 25 bp, Mus musculus
gtaattactgccgttcatgtggtcc

SEQ ID NO: 664432 - DNA, 25 bp, Mus musculus
gtaattactgtaatatcagcacaca

SEQ ID NO: 664433 - DNA, 25 bp, Mus musculus
gtaattactgtattatcagcacaca

SEQ ID NO: 664434 - DNA, 25 bp, Mus musculus
gtaattacttcaaccttgtgtttga

SEQ ID NO: 664435 - DNA, 25 bp, Mus musculus
gtaattacttcatccttgtgtttga

SEQ ID NO: 664436 - DNA, 25 bp, Mus musculus
gtaattagacagacagccctttcag

SEQ ID NO: 664437 - DNA, 25 bp, Mus musculus
gtaattagacagtcagccctttcag

SEQ ID NO: 664438 - DNA, 25 bp, Mus musculus
gtaattagactcactgccagtgatg

SEQ ID NO: 664439 - DNA, 25 bp, Mus musculus
gtaattagactctctgccagtgatg

SEQ ID NO: 664440 - DNA, 25 bp, Mus musculus
gtaattagagctcaaccttgctgtg

SEQ ID NO: 664441 - DNA, 25 bp, Mus musculus
gtaattagagctgaaccttgctgtg

SEQ ID NO: 664442 - DNA, 25 bp, Mus musculus
gtaattaggctcaggacctgtccac

SEQ ID NO: 664443 - DNA, 25 bp, Mus musculus
gtaattaggctctggacctgtccac

SEQ ID NO: 664444 - DNA, 25 bp, Mus musculus
gtaattagtcttcagtgttccataa

SEQ ID NO: 664445 - DNA, 25 bp, Mus musculus
gtaattagtcttgagtgttccataa

SEQ ID NO: 664446 - DNA, 25 bp, Mus musculus
gtaattataaggactgttcacagct

SEQ ID NO: 664447 - DNA, 25 bp, Mus musculus
gtaattataaggtctgttcacagct

SEQ ID NO: 664448 - DNA, 25 bp, Mus musculus
gtaattatctttacaccttctatgt

SEQ ID NO: 664449 - DNA, 25 bp, Mus musculus
gtaattatcttttcaccttctatgt

SEQ ID NO: 664450 - DNA, 25 bp, Mus musculus
gtaattatggcgagctcggcgccac

SEQ ID NO: 664451 - DNA, 25 bp, Mus musculus
gtaattatggcgtgctcggcgccac

SEQ ID NO: 664452 - DNA, 25 bp, Mus musculus
gtaattcaacttactctaagtaacg

SEQ ID NO: 664453 - DNA, 25 bp, Mus musculus
gtaattcaactttctctaagtaacg

SEQ ID NO: 664454 - DNA, 25 bp, Mus musculus
gtaattcaagccatggtatcccaaa

SEQ ID NO: 664455 - DNA, 25 bp, Mus musculus
gtaattcaagccttggtatcccaaa

SEQ ID NO: 664456 - DNA, 25 bp, Mus musculus
gtaattcacaaccagctgttagaaa

SEQ ID NO: 664457 - DNA, 25 bp, Mus musculus
gtaattcacaacgagctgttagaaa

SEQ ID NO: 664458 - DNA, 25 bp, Mus musculus
gtaattcacagacatcaagagattg

SEQ ID NO: 664459 - DNA, 25 bp, Mus musculus
gtaattcacagagatcaagagattg

SEQ ID NO: 664460 - DNA, 25 bp, Mus musculus
gtaattcagacgacaaccttggcta

SEQ ID NO: 664461 - DNA, 25 bp, Mus musculus
gtaattcagacgtcaaccttggcta

SEQ ID NO: 664462 - DNA, 25 bp, Mus musculus
gtaattcagcgcacaggtgcctgag

SEQ ID NO: 664463 - DNA, 25 bp, Mus musculus
gtaattcagcgctcaggtgcctgag

SEQ ID NO: 664464 - DNA, 25 bp, Mus musculus
gtaattcaggaaacgtgccatcatt

SEQ ID NO: 664465 - DNA, 25 bp, Mus musculus
gtaattcaggaatcgtgccatcatt

SEQ ID NO: 664466 - DNA, 25 bp, Mus musculus
gtaattcaggacaaaaatcatccaa

SEQ ID NO: 664467 - DNA, 25 bp, Mus musculus
gtaattcaggactaaaatcatccaa

SEQ ID NO: 664468 - DNA, 25 bp, Mus musculus
gtaattcagtaaacttgccagcgtc

SEQ ID NO: 664469 - DNA, 25 bp, Mus musculus
gtaattcagtaatcttgccagcgtc

SEQ ID NO: 664470 - DNA, 25 bp, Mus musculus
gtaattcagtccattgtcctatgat

SEQ ID NO: 664471 - DNA, 25 bp, Mus musculus
gtaattcagtcctttgtcctatgat

SEQ ID NO: 664472 - DNA, 25 bp, Mus musculus
gtaattcataataccccaacatcgc

SEQ ID NO: 664473 - DNA, 25 bp, Mus musculus
gtaattcataattccccaacatcgc

SEQ ID NO: 664474 - DNA, 25 bp, Mus musculus
gtaattcatataatttgagaccaaa

SEQ ID NO: 664475 - DNA, 25 bp, Mus musculus
gtaattcatatattttgagaccaaa

SEQ ID NO: 664476 - DNA, 25 bp, Mus musculus
gtaattcatatgcaccatccccttc

SEQ ID NO: 664477 - DNA, 25 bp, Mus musculus
gtaattcatatggaccatccccttc

SEQ ID NO: 664478 - DNA, 25 bp, Mus musculus
gtaattcatcacagagtagcactgc

SEQ ID NO: 664479 - DNA, 25 bp, Mus musculus
gtaattcatcactgagtagcactgc

SEQ ID NO: 664480 - DNA, 25 bp, Mus musculus
gtaattcattgcagatccaccagga

SEQ ID NO: 664481 - DNA, 25 bp, Mus musculus
gtaattcattgctgatccaccagga

SEQ ID NO: 664482 - DNA, 25 bp, Mus musculus
gtaattcattgtagtttcattccta

SEQ ID NO: 664483 - DNA, 25 bp, Mus musculus
gtaattcattgttgtttcattccta

SEQ ID NO: 664484 - DNA, 25 bp, Mus musculus
gtaattcattttactgcagcacagg

SEQ ID NO: 664485 - DNA, 25 bp, Mus musculus
gtaattcatttttctgcagcacagg

SEQ ID NO: 664486 - DNA, 25 bp, Mus musculus
gtaattccagaaactcaggatatta

SEQ ID NO: 664487 - DNA, 25 bp, Mus musculus
gtaattccagaatctcaggatatta

SEQ ID NO: 664488 - DNA, 25 bp, Mus musculus
gtaattccagtaagtgcctattcaa

SEQ ID NO: 664489 - DNA, 25 bp, Mus musculus
gtaattccagtatgtgcctattcaa

SEQ ID NO: 664490 - DNA, 25 bp, Mus musculus
gtaattccagtcaaaatcctggcaa

SEQ ID NO: 664491 - DNA, 25 bp, Mus musculus
gtaattccagtctaaatcctggcaa

SEQ ID NO: 664492 - DNA, 25 bp, Mus musculus
gtaattcccaagagccatagtgatt

SEQ ID NO: 664493 - DNA, 25 bp, Mus musculus
gtaattcccaagtgccatagtgatt

SEQ ID NO: 664494 - DNA, 25 bp, Mus musculus
gtaattccccttagagacatggtgt

SEQ ID NO: 664495 - DNA, 25 bp, Mus musculus
gtaattcccctttgagacatggtgt

SEQ ID NO: 664496 - DNA, 25 bp, Mus musculus
gtaattccgttcacgagggcatgaa

SEQ ID NO: 664497 - DNA, 25 bp, Mus musculus
gtaattccgttctcgagggcatgaa

SEQ ID NO: 664498 - DNA, 25 bp, Mus musculus
gtaattcctaccagtaccgcctggt

SEQ ID NO: 664499 - DNA, 25 bp, Mus musculus
gtaattcctacctgtaccgcctggt

SEQ ID NO: 664500 - DNA, 25 bp, Mus musculus
gtaattcctcacatttcattcatca

SEQ ID NO: 664501 - DNA, 25 bp, Mus musculus
gtaattcctcacttttcattcatca

SEQ ID NO: 664502 - DNA, 25 bp, Mus musculus
gtaattcctcatcatgacattttgg

SEQ ID NO: 664503 - DNA, 25 bp, Mus musculus
gtaattcctcatccgtgctttgctc

SEQ ID NO: 664504 - DNA, 25 bp, Mus musculus
gtaattcctcatgatgacattttgg

SEQ ID NO: 664505 - DNA, 25 bp, Mus musculus
gtaattcctcatgcgtgctttgctc

SEQ ID NO: 664506 - DNA, 25 bp, Mus musculus
gtaattccttagcaaatagtcttag

SEQ ID NO: 664507 - DNA, 25 bp, Mus musculus
gtaattccttaggaaatagtcttag

SEQ ID NO: 664508 - DNA, 25 bp, Mus musculus
gtaattcgttatcaaccacctcaca

SEQ ID NO: 664509 - DNA, 25 bp, Mus musculus
gtaattcgttatgaaccacctcaca

SEQ ID NO: 664510 - DNA, 25 bp, Mus musculus
gtaattctaagacctcctcatccct

SEQ ID NO: 664511 - DNA, 25 bp, Mus musculus
gtaattctaagagctcctcatccct

SEQ ID NO: 664512 - DNA, 25 bp, Mus musculus
gtaattctaatactacctacatttt

SEQ ID NO: 664513 - DNA, 25 bp, Mus musculus
gtaattctaatagtacctacatttt

SEQ ID NO: 664514 - DNA, 25 bp, Mus musculus
gtaattctaatcattgcagctcaag

SEQ ID NO: 664515 - DNA, 25 bp, Mus musculus
gtaattctaatctttgcagctcaag

SEQ ID NO: 664516 - DNA, 25 bp, Mus musculus
gtaattctacaaccagtttagttca

SEQ ID NO: 664517 - DNA, 25 bp, Mus musculus
gtaattctacaagcagtttagttca

SEQ ID NO: 664518 - DNA, 25 bp, Mus musculus
gtaattctcagtacccgggaagcat

SEQ ID NO: 664519 - DNA, 25 bp, Mus musculus
gtaattctcagtatcttatcctggg

SEQ ID NO: 664520 - DNA, 25 bp, Mus musculus
gtaattctcagttcccgggaagcat

SEQ ID NO: 664521 - DNA, 25 bp, Mus musculus
gtaattctcagtttcttatcctggg

SEQ ID NO: 664522 - DNA, 25 bp, Mus musculus
gtaattctcatacgtgttttataac

SEQ ID NO: 664523 - DNA, 25 bp, Mus musculus
gtaattctcataggtgttttataac

SEQ ID NO: 664524 - DNA, 25 bp, Mus musculus
gtaattctcatgaaaaccccattaa

SEQ ID NO: 664525 - DNA, 25 bp, Mus musculus
gtaattctcatgtaaaccccattaa

SEQ ID NO: 664526 - DNA, 25 bp, Mus musculus
gtaattctcttgacataattccaag

SEQ ID NO: 664527 - DNA, 25 bp, Mus musculus
gtaattctcttgtcataattccaag

SEQ ID NO: 664528 - DNA, 25 bp, Mus musculus
gtaattctgaggaccacactgcgct

SEQ ID NO: 664529 - DNA, 25 bp, Mus musculus
gtaattctgaggtccacactgcgct

SEQ ID NO: 664530 - DNA, 25 bp, Mus musculus
gtaattctgagtattcctcctgaca

SEQ ID NO: 664531 - DNA, 25 bp, Mus musculus
gtaattctgagttttcctcctgaca

SEQ ID NO: 664532 - DNA, 25 bp, Mus musculus
gtaattctgcagaaattgatgatct

SEQ ID NO: 664533 - DNA, 25 bp, Mus musculus
gtaattctgcagtaattgatgatct

SEQ ID NO: 664534 - DNA, 25 bp, Mus musculus
gtaattctgccacctaaatactata

SEQ ID NO: 664535 - DNA, 25 bp, Mus musculus
gtaattctgccagctaaatactata

SEQ ID NO: 664536 - DNA, 25 bp, Mus musculus
gtaattctgggtaatagtcaaaatt

SEQ ID NO: 664537 - DNA, 25 bp, Mus musculus
gtaattctgggttatagtcaaaatt

SEQ ID NO: 664538 - DNA, 25 bp, Mus musculus
gtaattcttaccaaaacagccatat

SEQ ID NO: 664539 - DNA, 25 bp, Mus musculus
gtaattcttacctaaacagccatat

SEQ ID NO: 664540 - DNA, 25 bp, Mus musculus
gtaattcttccaacatctggactgt

SEQ ID NO: 664541 - DNA, 25 bp, Mus musculus
gtaattcttccatcatctggactgt

SEQ ID NO: 664542 - DNA, 25 bp, Mus musculus
gtaattcttctcataagccaagcaa

SEQ ID NO: 664543 - DNA, 25 bp, Mus musculus
gtaattcttctcttaagccaagcaa

SEQ ID NO: 664544 - DNA, 25 bp, Mus musculus
gtaattctttaaactagctcctttg

SEQ ID NO: 664545 - DNA, 25 bp, Mus musculus
gtaattctttaatctagctcctttg

SEQ ID NO: 664546 - DNA, 25 bp, Mus musculus
gtaattgaactgcatctcgggagat

SEQ ID NO: 664547 - DNA, 25 bp, Mus musculus
gtaattgaactggatctcgggagat

SEQ ID NO: 664548 - DNA, 25 bp, Mus musculus
gtaattgaccatcctcagacagcat

SEQ ID NO: 664549 - DNA, 25 bp, Mus musculus
gtaattgaccatgctcagacagcat

SEQ ID NO: 664550 - DNA, 25 bp, Mus musculus
gtaattgacgtgaatttgtcctata

SEQ ID NO: 664551 - DNA, 25 bp, Mus musculus
gtaattgacgtgtatttgtcctata

SEQ ID NO: 664552 - DNA, 25 bp, Mus musculus
gtaattgactttagtaatttgccaa

SEQ ID NO: 664553 - DNA, 25 bp, Mus musculus
gtaattgacttttgtaatttgccaa

SEQ ID NO: 664554 - DNA, 25 bp, Mus musculus
gtaattgagaccatacacagatttg

SEQ ID NO: 664555 - DNA, 25 bp, Mus musculus
gtaattgagaccttacacagatttg

SEQ ID NO: 664556 - DNA, 25 bp, Mus musculus
gtaattgatggtagttgccgtaata

SEQ ID NO: 664557 - DNA, 25 bp, Mus musculus
gtaattgatggttgttgccgtaata

SEQ ID NO: 664558 - DNA, 25 bp, Mus musculus
gtaattgcaaaacatggacatcatt

SEQ ID NO: 664559 - DNA, 25 bp, Mus musculus
gtaattgcaaaagatggacatcatt

SEQ ID NO: 664560 - DNA, 25 bp, Mus musculus
gtaattgcaataacgatttggaaac

SEQ ID NO: 664561 - DNA, 25 bp, Mus musculus
gtaattgcaatatcgatttggaaac

SEQ ID NO: 664562 - DNA, 25 bp, Mus musculus
gtaattgcatctcagctggtgaagc

SEQ ID NO: 664563 - DNA, 25 bp, Mus musculus
gtaattgcatctgagctggtgaagc

SEQ ID NO: 664564 - DNA, 25 bp, Mus musculus
gtaattgcattccggccagttaata

SEQ ID NO: 664565 - DNA, 25 bp, Mus musculus
gtaattgcattcgggccagttaata

SEQ ID NO: 664566 - DNA, 25 bp, Mus musculus
gtaattgctatgaacctaacagcta

SEQ ID NO: 664567 - DNA, 25 bp, Mus musculus
gtaattgctatgtacctaacagcta

SEQ ID NO: 664568 - DNA, 25 bp, Mus musculus
gtaattgctattcgtgagttgtgtc

SEQ ID NO: 664569 - DNA, 25 bp, Mus musculus
gtaattgctattggtgagttgtgtc

SEQ ID NO: 664570 - DNA, 25 bp, Mus musculus
gtaattgctcataccttaagactgg

SEQ ID NO: 664571 - DNA, 25 bp, Mus musculus
gtaattgctcattccttaagactgg

SEQ ID NO: 664572 - DNA, 25 bp, Mus musculus
gtaattgctcttaggagcacggcca

SEQ ID NO: 664573 - DNA, 25 bp, Mus musculus
gtaattgctctttggagcacggcca

SEQ ID NO: 664574 - DNA, 25 bp, Mus musculus
gtaattgctgcaactggccatgaac

SEQ ID NO: 664575 - DNA, 25 bp, Mus musculus
gtaattgctgcatctggccatgaac

SEQ ID NO: 664576 - DNA, 25 bp, Mus musculus
gtaattgctggaccattttcccaac

SEQ ID NO: 664577 - DNA, 25 bp, Mus musculus
gtaattgctggagcattttcccaac

SEQ ID NO: 664578 - DNA, 25 bp, Mus musculus
gtaattgcttgtactgttcggcgac

SEQ ID NO: 664579 - DNA, 25 bp, Mus musculus
gtaattgcttgttctgttcggcgac

SEQ ID NO: 664580 - DNA, 25 bp, Mus musculus
gtaattgctttaatctgtcagatct

SEQ ID NO: 664581 - DNA, 25 bp, Mus musculus
gtaattgctttattctgtcagatct

SEQ ID NO: 664582 - DNA, 25 bp, Mus musculus
gtaattgcttttcaaccagagtcag

SEQ ID NO: 664583 - DNA, 25 bp, Mus musculus
gtaattgcttttgaaccagagtcag

SEQ ID NO: 664584 - DNA, 25 bp, Mus musculus
gtaattggatgacatctgccaagat

SEQ ID NO: 664585 - DNA, 25 bp, Mus musculus
gtaattggatgagatctgccaagat

SEQ ID NO: 664586 - DNA, 25 bp, Mus musculus
gtaattggcttgatttagtgtgctt

SEQ ID NO: 664587 - DNA, 25 bp, Mus musculus
gtaattggcttgttttagtgtgctt

SEQ ID NO: 664588 - DNA, 25 bp, Mus musculus
gtaattgggctaaaccaacataatt

SEQ ID NO: 664589 - DNA, 25 bp, Mus musculus
gtaattgggctataccaacataatt

SEQ ID NO: 664590 - DNA, 25 bp, Mus musculus
gtaattggtctcagaagtttttgct

SEQ ID NO: 664591 - DNA, 25 bp, Mus musculus
gtaattggtctctgaagtttttgct

SEQ ID NO: 664592 - DNA, 25 bp, Mus musculus
gtaattggtcttcagtctacaggag

SEQ ID NO: 664593 - DNA, 25 bp, Mus musculus
gtaattggtcttgagtctacaggag

SEQ ID NO: 664594 - DNA, 25 bp, Mus musculus
gtaattgtaagaagatgccctgcct

SEQ ID NO: 664595 - DNA, 25 bp, Mus musculus
gtaattgtaagatgatgccctgcct

SEQ ID NO: 664596 - DNA, 25 bp, Mus musculus
gtaattgtagtcctggtcatcctgg

SEQ ID NO: 664597 - DNA, 25 bp, Mus musculus
gtaattgtagtcgtggtcatcctgg

SEQ ID NO: 664598 - DNA, 25 bp, Mus musculus
gtaattgtattcattgcatggacct

SEQ ID NO: 664599 - DNA, 25 bp, Mus musculus
gtaattgtattctttgcatggacct

SEQ ID NO: 664600 - DNA, 25 bp, Mus musculus
gtaattgtcatcatctaagccccaa

SEQ ID NO: 664601 - DNA, 25 bp, Mus musculus
gtaattgtcatcttctaagccccaa

SEQ ID NO: 664602 - DNA, 25 bp, Mus musculus
gtaattgtcattcagatcctagtat

SEQ ID NO: 664603 - DNA, 25 bp, Mus musculus
gtaattgtcattgagatcctagtat

SEQ ID NO: 664604 - DNA, 25 bp, Mus musculus
gtaattgtcctgactcatttgggaa

SEQ ID NO: 664605 - DNA, 25 bp, Mus musculus
gtaattgtcctgtctcatttgggaa

SEQ ID NO: 664606 - DNA, 25 bp, Mus musculus
gtaattgtcgagataccatctcacc

SEQ ID NO: 664607 - DNA, 25 bp, Mus musculus
gtaattgtcgagttaccatctcacc

SEQ ID NO: 664608 - DNA, 25 bp, Mus musculus
gtaattgtgggacccatgtcggtca

SEQ ID NO: 664609 - DNA, 25 bp, Mus musculus
gtaattgtgggagccatgtcggtca

SEQ ID NO: 664610 - DNA, 25 bp, Mus musculus
gtaattgtgtccattacatatgaca

SEQ ID NO: 664611 - DNA, 25 bp, Mus musculus
gtaattgtgtcctttacatatgaca

SEQ ID NO: 664612 - DNA, 25 bp, Mus musculus
gtaattgttgatctacccattgtac

SEQ ID NO: 664613 - DNA, 25 bp, Mus musculus
gtaattgttgatgtacccattgtac

SEQ ID NO: 664614 - DNA, 25 bp, Mus musculus
gtaattgttggcagaggtttggatc

SEQ ID NO: 664615 - DNA, 25 bp, Mus musculus
gtaattgttggctgaggtttggatc

SEQ ID NO: 664616 - DNA, 25 bp, Mus musculus
gtaatttaatttcttctaatgccgg

SEQ ID NO: 664617 - DNA, 25 bp, Mus musculus
gtaatttaatttgttctaatgccgg

SEQ ID NO: 664618 - DNA, 25 bp, Mus musculus
gtaatttacaacatagggcataatc

SEQ ID NO: 664619 - DNA, 25 bp, Mus musculus
gtaatttacaacttagggcataatc

SEQ ID NO: 664620 - DNA, 25 bp, Mus musculus
gtaatttactgtatacaaagggagg

SEQ ID NO: 664621 - DNA, 25 bp, Mus musculus
gtaatttactgtttacaaagggagg

SEQ ID NO: 664622 - DNA, 25 bp, Mus musculus
gtaatttataccagaacatgagcgt

SEQ ID NO: 664623 - DNA, 25 bp, Mus musculus
gtaatttatacctgaacatgagcgt

SEQ ID NO: 664624 - DNA, 25 bp, Mus musculus
gtaatttatattatcacacttcttg

SEQ ID NO: 664625 - DNA, 25 bp, Mus musculus
gtaatttatattctacaccctggaa

SEQ ID NO: 664626 - DNA, 25 bp, Mus musculus
gtaatttatattgtacaccctggaa

SEQ ID NO: 664627 - DNA, 25 bp, Mus musculus
gtaatttatattttcacacttcttg

SEQ ID NO: 664628 - DNA, 25 bp, Mus musculus
gtaatttatcgtcgcccagacgtga

SEQ ID NO: 664629 - DNA, 25 bp, Mus musculus
gtaatttatcgtggcccagacgtga

SEQ ID NO: 664630 - DNA, 25 bp, Mus musculus
gtaatttatcttctagcttctgctt

SEQ ID NO: 664631 - DNA, 25 bp, Mus musculus
gtaatttatcttgtagcttctgctt

SEQ ID NO: 664632 - DNA, 25 bp, Mus musculus
gtaatttatgctcctatcctctggg

SEQ ID NO: 664633 - DNA, 25 bp, Mus musculus
gtaatttatgctgctatcctctggg

SEQ ID NO: 664634 - DNA, 25 bp, Mus musculus
gtaatttattggactgaagctgctc

SEQ ID NO: 664635 - DNA, 25 bp, Mus musculus
gtaatttattggtctgaagctgctc

SEQ ID NO: 664636 - DNA, 25 bp, Mus musculus
gtaatttcaaaaacagagggctgga

SEQ ID NO: 664637 - DNA, 25 bp, Mus musculus
gtaatttcaaaatcagagggctgga

SEQ ID NO: 664638 - DNA, 25 bp, Mus musculus
gtaatttcaccaagacctgccaaac

SEQ ID NO: 664639 - DNA, 25 bp, Mus musculus
gtaatttcaccaagagtttaggagg

SEQ ID NO: 664640 - DNA, 25 bp, Mus musculus
gtaatttcaccatgacctgccaaac

SEQ ID NO: 664641 - DNA, 25 bp, Mus musculus
gtaatttcaccatgagtttaggagg

SEQ ID NO: 664642 - DNA, 25 bp, Mus musculus
gtaatttcagcccacatatagtcct

SEQ ID NO: 664643 - DNA, 25 bp, Mus musculus
gtaatttcagccgacatatagtcct

SEQ ID NO: 664644 - DNA, 25 bp, Mus musculus
gtaatttcattcatcctaatccatt

SEQ ID NO: 664645 - DNA, 25 bp, Mus musculus
gtaatttcattcttcctaatccatt

SEQ ID NO: 664646 - DNA, 25 bp, Mus musculus
gtaatttccctgatctcagaggtga

SEQ ID NO: 664647 - DNA, 25 bp, Mus musculus
gtaatttccctgttctcagaggtga

SEQ ID NO: 664648 - DNA, 25 bp, Mus musculus
gtaatttccggcaggtatcctcaga

SEQ ID NO: 664649 - DNA, 25 bp, Mus musculus
gtaatttccggctggtatcctcaga

SEQ ID NO: 664650 - DNA, 25 bp, Mus musculus
gtaatttcctaacacaatgttcaca

SEQ ID NO: 664651 - DNA, 25 bp, Mus musculus
gtaatttcctaagacaatgttcaca

SEQ ID NO: 664652 - DNA, 25 bp, Mus musculus
gtaatttccttaacacattggccta

SEQ ID NO: 664653 - DNA, 25 bp, Mus musculus
gtaatttccttatcacattggccta

SEQ ID NO: 664654 - DNA, 25 bp, Mus musculus
gtaatttctataaagttgctttctg

SEQ ID NO: 664655 - DNA, 25 bp, Mus musculus
gtaatttctatatagttgctttctg

SEQ ID NO: 664656 - DNA, 25 bp, Mus musculus
gtaatttctcagatctcatcaacat

SEQ ID NO: 664657 - DNA, 25 bp, Mus musculus
gtaatttctcagttctcatcaacat

SEQ ID NO: 664658 - DNA, 25 bp, Mus musculus
gtaatttctcctctcattatactaa

SEQ ID NO: 664659 - DNA, 25 bp, Mus musculus
gtaatttctcctgtcattatactaa

SEQ ID NO: 664660 - DNA, 25 bp, Mus musculus
gtaatttctctaccttgctaaacac

SEQ ID NO: 664661 - DNA, 25 bp, Mus musculus
gtaatttctctagcttgctaaacac

SEQ ID NO: 664662 - DNA, 25 bp, Mus musculus
gtaatttctgtgctgggatgatcaa

SEQ ID NO: 664663 - DNA, 25 bp, Mus musculus
gtaatttctgtggtgggatgatcaa

SEQ ID NO: 664664 - DNA, 25 bp, Mus musculus
gtaatttctgttatcctaaatcact

SEQ ID NO: 664665 - DNA, 25 bp, Mus musculus
gtaatttctgttttcctaaatcact

SEQ ID NO: 664666 - DNA, 25 bp, Mus musculus
gtaatttcttctagtttcctctctg

SEQ ID NO: 664667 - DNA, 25 bp, Mus musculus
gtaatttcttcttgtttcctctctg

SEQ ID NO: 664668 - DNA, 25 bp, Mus musculus
gtaatttcttgaccctaggaatgaa

SEQ ID NO: 664669 - DNA, 25 bp, Mus musculus
gtaatttcttgagcctaggaatgaa

SEQ ID NO: 664670 - DNA, 25 bp, Mus musculus
gtaatttcttttacatgcttttctg

SEQ ID NO: 664671 - DNA, 25 bp, Mus musculus
gtaatttcttttctatttacacatt

SEQ ID NO: 664672 - DNA, 25 bp, Mus musculus
gtaatttcttttgtatttacacatt

SEQ ID NO: 664673 - DNA, 25 bp, Mus musculus
gtaatttctttttcatgcttttctg

SEQ ID NO: 664674 - DNA, 25 bp, Mus musculus
gtaatttgcatgaatccatacctgg

SEQ ID NO: 664675 - DNA, 25 bp, Mus musculus
gtaatttgcatgtatccatacctgg

SEQ ID NO: 664676 - DNA, 25 bp, Mus musculus
gtaatttgccagaatttgcccttga

SEQ ID NO: 664677 - DNA, 25 bp, Mus musculus
gtaatttgccagtatttgcccttga

SEQ ID NO: 664678 - DNA, 25 bp, Mus musculus
gtaatttgcttgcagaagacacaca

SEQ ID NO: 664679 - DNA, 25 bp, Mus musculus
gtaatttgcttggagaagacacaca

SEQ ID NO: 664680 - DNA, 25 bp, Mus musculus
gtaatttggtgactcagaccatcct

SEQ ID NO: 664681 - DNA, 25 bp, Mus musculus
gtaatttggtgagtcagaccatcct

SEQ ID NO: 664682 - DNA, 25 bp, Mus musculus
gtaatttggttcacttcatacttta

SEQ ID NO: 664683 - DNA, 25 bp, Mus musculus
gtaatttggttctcttcatacttta

SEQ ID NO: 664684 - DNA, 25 bp, Mus musculus
gtaatttgtcttacaagtgaatcaa

SEQ ID NO: 664685 - DNA, 25 bp, Mus musculus
gtaatttgtctttcaagtgaatcaa

SEQ ID NO: 664686 - DNA, 25 bp, Mus musculus
gtaatttgttacagcctcatcgtct

SEQ ID NO: 664687 - DNA, 25 bp, Mus musculus
gtaatttgttactgcctcatcgtct

SEQ ID NO: 664688 - DNA, 25 bp, Mus musculus
gtaattttactcagcgctcacagtt

SEQ ID NO: 664689 - DNA, 25 bp, Mus musculus
gtaattttactctgcgctcacagtt

SEQ ID NO: 664690 - DNA, 25 bp, Mus musculus
gtaattttactgaagcaactgcatt

SEQ ID NO: 664691 - DNA, 25 bp, Mus musculus
gtaattttactgtagcaactgcatt

SEQ ID NO: 664692 - DNA, 25 bp, Mus musculus
gtaattttagtgagtcatagtccga

SEQ ID NO: 664693 - DNA, 25 bp, Mus musculus
gtaattttagtgtgtcatagtccga

SEQ ID NO: 664694 - DNA, 25 bp, Mus musculus
gtaattttagttcggctggaactca

SEQ ID NO: 664695 - DNA, 25 bp, Mus musculus
gtaattttagttgggctggaactca

SEQ ID NO: 664696 - DNA, 25 bp, Mus musculus
gtaattttcagaaccacatggattt

SEQ ID NO: 664697 - DNA, 25 bp, Mus musculus
gtaattttcagatccacatggattt

SEQ ID NO: 664698 - DNA, 25 bp, Mus musculus
gtaattttcggtatgcttgttctat

SEQ ID NO: 664699 - DNA, 25 bp, Mus musculus
gtaattttcggtttgcttgttctat

SEQ ID NO: 664700 - DNA, 25 bp, Mus musculus
gtaattttcgttacaaatgctgcaa

SEQ ID NO: 664701 - DNA, 25 bp, Mus musculus
gtaattttcgtttcaaatgctgcaa

SEQ ID NO: 664702 - DNA, 25 bp, Mus musculus
gtaattttctatcctcagctaagta

SEQ ID NO: 664703 - DNA, 25 bp, Mus musculus
gtaattttctatgctcagctaagta

SEQ ID NO: 664704 - DNA, 25 bp, Mus musculus
gtaattttctcacccttctttcagt

SEQ ID NO: 664705 - DNA, 25 bp, Mus musculus
gtaattttctcagccttctttcagt

SEQ ID NO: 664706 - DNA, 25 bp, Mus musculus
gtaattttgaagctctctgtataaa

SEQ ID NO: 664707 - DNA, 25 bp, Mus musculus
gtaattttgaaggtctctgtataaa

SEQ ID NO: 664708 - DNA, 25 bp, Mus musculus
gtaattttgagaccctgtccatctg

SEQ ID NO: 664709 - DNA, 25 bp, Mus musculus
gtaattttgagagcctgtccatctg

SEQ ID NO: 664710 - DNA, 25 bp, Mus musculus
gtaattttgcctcctttggtggtac

SEQ ID NO: 664711 - DNA, 25 bp, Mus musculus
gtaattttgcctgctttggtggtac

SEQ ID NO: 664712 - DNA, 25 bp, Mus musculus
gtaattttgctaccgtcatgacttg

SEQ ID NO: 664713 - DNA, 25 bp, Mus musculus
gtaattttgctagcgtcatgacttg

SEQ ID NO: 664714 - DNA, 25 bp, Mus musculus
gtaattttgcttagcctctgtgctt

SEQ ID NO: 664715 - DNA, 25 bp, Mus musculus
gtaattttgctttgcctctgtgctt

SEQ ID NO: 664716 - DNA, 25 bp, Mus musculus
gtaattttgttcctactttgtgttg

SEQ ID NO: 664717 - DNA, 25 bp, Mus musculus
gtaattttgttcctatccaattcac

SEQ ID NO: 664718 - DNA, 25 bp, Mus musculus
gtaattttgttcgtactttgtgttg

SEQ ID NO: 664719 - DNA, 25 bp, Mus musculus
gtaattttgttcgtatccaattcac

SEQ ID NO: 664720 - DNA, 25 bp, Mus musculus
gtaattttgttgagatgctctgtcc

SEQ ID NO: 664721 - DNA, 25 bp, Mus musculus
gtaattttgttgtgatgctctgtcc

SEQ ID NO: 664722 - DNA, 25 bp, Mus musculus
gtaatttttatcacaggctgccttg

SEQ ID NO: 664723 - DNA, 25 bp, Mus musculus
gtaatttttatctcaggctgccttg

SEQ ID NO: 664724 - DNA, 25 bp, Mus musculus
gtaatttttcaaaccagagtgatct

SEQ ID NO: 664725 - DNA, 25 bp, Mus musculus
gtaatttttcaacaaggacccaatg

SEQ ID NO: 664726 - DNA, 25 bp, Mus musculus
gtaatttttcaagaaggacccaatg

SEQ ID NO: 664727 - DNA, 25 bp, Mus musculus
gtaatttttcaatccagagtgatct

SEQ ID NO: 664728 - DNA, 25 bp, Mus musculus
gtaatttttctcacttaatcctatt

SEQ ID NO: 664729 - DNA, 25 bp, Mus musculus
gtaatttttctctcttaatcctatt

SEQ ID NO: 664730 - DNA, 25 bp, Mus musculus
gtacaaaacaacactgtggcaacag

SEQ ID NO: 664731 - DNA, 25 bp, Mus musculus
gtacaaaacaactctgtggcaacag

SEQ ID NO: 664732 - DNA, 25 bp, Mus musculus
gtacaaaacaatcactgcaccactg

SEQ ID NO: 664733 - DNA, 25 bp, Mus musculus
gtacaaaacaatgactgcaccactg

SEQ ID NO: 664734 - DNA, 25 bp, Mus musculus
gtacaaaacacaatcagccggcagg

SEQ ID NO: 664735 - DNA, 25 bp, Mus musculus
gtacaaaacacattcagccggcagg

SEQ ID NO: 664736 - DNA, 25 bp, Mus musculus
gtacaaaacactccaagggcccatg

SEQ ID NO: 664737 - DNA, 25 bp, Mus musculus
gtacaaaacactgcaagggcccatg

SEQ ID NO: 664738 - DNA, 25 bp, Mus musculus
gtacaaaaccacacaccagagctgt

SEQ ID NO: 664739 - DNA, 25 bp, Mus musculus
gtacaaaaccactcaccagagctgt

SEQ ID NO: 664740 - DNA, 25 bp, Mus musculus
gtacaaaagacaaattaccaggatg

SEQ ID NO: 664741 - DNA, 25 bp, Mus musculus
gtacaaaagacatattaccaggatg

SEQ ID NO: 664742 - DNA, 25 bp, Mus musculus
gtacaaaagtacagcccagcatact

SEQ ID NO: 664743 - DNA, 25 bp, Mus musculus
gtacaaaagtactgcccagcatact

SEQ ID NO: 664744 - DNA, 25 bp, Mus musculus
gtacaaacaacccatcaagatccac

SEQ ID NO: 664745 - DNA, 25 bp, Mus musculus
gtacaaacaaccgatcaagatccac

SEQ ID NO: 664746 - DNA, 25 bp, Mus musculus
gtacaaaccatgagccccattgaag

SEQ ID NO: 664747 - DNA, 25 bp, Mus musculus
gtacaaaccatgtgccccattgaag

SEQ ID NO: 664748 - DNA, 25 bp, Mus musculus
gtacaaacgagtaatcccctctcgg

SEQ ID NO: 664749 - DNA, 25 bp, Mus musculus
gtacaaacgagttatcccctctcgg

SEQ ID NO: 664750 - DNA, 25 bp, Mus musculus
gtacaaactagtctctgcagctgtg

SEQ ID NO: 664751 - DNA, 25 bp, Mus musculus
gtacaaactagtgtctgcagctgtg

SEQ ID NO: 664752 - DNA, 25 bp, Mus musculus
gtacaaactgaaaagcccaaggcca

SEQ ID NO: 664753 - DNA, 25 bp, Mus musculus
gtacaaactgaatagcccaaggcca

SEQ ID NO: 664754 - DNA, 25 bp, Mus musculus
gtacaaactgtaccctaatgcgcgg

SEQ ID NO: 664755 - DNA, 25 bp, Mus musculus
gtacaaactgtagcctaatgcgcgg

SEQ ID NO: 664756 - DNA, 25 bp, Mus musculus
gtacaaagaagcctgttcctgcgcg

SEQ ID NO: 664757 - DNA, 25 bp, Mus musculus
gtacaaagaagcgtgttcctgcgcg

SEQ ID NO: 664758 - DNA, 25 bp, Mus musculus
gtacaaagaagtctctgccaggccc

SEQ ID NO: 664759 - DNA, 25 bp, Mus musculus
gtacaaagaagtgtctgccaggccc

SEQ ID NO: 664760 - DNA, 25 bp, Mus musculus
gtacaaagacggcttcagcaccatc

SEQ ID NO: 664761 - DNA, 25 bp, Mus musculus
gtacaaagacgggttcagcaccatc

SEQ ID NO: 664762 - DNA, 25 bp, Mus musculus
gtacaaagaggcctccatactggga

SEQ ID NO: 664763 - DNA, 25 bp, Mus musculus
gtacaaagaggcgtccatactggga

SEQ ID NO: 664764 - DNA, 25 bp, Mus musculus
gtacaaagcagcacaaccatagggt

SEQ ID NO: 664765 - DNA, 25 bp, Mus musculus
gtacaaagcagctcaaccatagggt

SEQ ID NO: 664766 - DNA, 25 bp, Mus musculus
gtacaaagcatacgtcttcacgctc

SEQ ID NO: 664767 - DNA, 25 bp, Mus musculus
gtacaaagcataggtcttcacgctc

SEQ ID NO: 664768 - DNA, 25 bp, Mus musculus
gtacaaagcctgctgggtttaggaa

SEQ ID NO: 664769 - DNA, 25 bp, Mus musculus
gtacaaagcctggtgggtttaggaa

SEQ ID NO: 664770 - DNA, 25 bp, Mus musculus
gtacaaagctttccccagtaccaca

SEQ ID NO: 664771 - DNA, 25 bp, Mus musculus
gtacaaagctttgcccagtaccaca

SEQ ID NO: 664772 - DNA, 25 bp, Mus musculus
gtacaaagtatcctacaagttctga

SEQ ID NO: 664773 - DNA, 25 bp, Mus musculus
gtacaaagtatcgtacaagttctga

SEQ ID NO: 664774 - DNA, 25 bp, Mus musculus
gtacaaatactcaagccgagagcga

SEQ ID NO: 664775 - DNA, 25 bp, Mus musculus
gtacaaatactctagccgagagcga

SEQ ID NO: 664776 - DNA, 25 bp, Mus musculus
gtacaaataggcagtcacccgaaaa

SEQ ID NO: 664777 - DNA, 25 bp, Mus musculus
gtacaaataggctgtcacccgaaaa

SEQ ID NO: 664778 - DNA, 25 bp, Mus musculus
gtacaaatcttgcttgacaactggg

SEQ ID NO: 664779 - DNA, 25 bp, Mus musculus
gtacaaatcttggttgacaactggg

SEQ ID NO: 664780 - DNA, 25 bp, Mus musculus
gtacaaatgaacaatagatctccct

SEQ ID NO: 664781 - DNA, 25 bp, Mus musculus
gtacaaatgaactatagatctccct

SEQ ID NO: 664782 - DNA, 25 bp, Mus musculus
gtacaaatgcctacagaggctaaaa

SEQ ID NO: 664783 - DNA, 25 bp, Mus musculus
gtacaaatgcctatcagttatctga

SEQ ID NO: 664784 - DNA, 25 bp, Mus musculus
gtacaaatgccttcagaggctaaaa

SEQ ID NO: 664785 - DNA, 25 bp, Mus musculus
gtacaaatgcctttcagttatctga

SEQ ID NO: 664786 - DNA, 25 bp, Mus musculus
gtacaaatgctcattctttcagatt

SEQ ID NO: 664787 - DNA, 25 bp, Mus musculus
gtacaaatgctctttctttcagatt

SEQ ID NO: 664788 - DNA, 25 bp, Mus musculus
gtacaaatgtggaacccttgtctaa

SEQ ID NO: 664789 - DNA, 25 bp, Mus musculus
gtacaaatgtggtacccttgtctaa

SEQ ID NO: 664790 - DNA, 25 bp, Mus musculus
gtacaaatgtgtatctcagtgtggg

SEQ ID NO: 664791 - DNA, 25 bp, Mus musculus
gtacaaatgtgtttctcagtgtggg

SEQ ID NO: 664792 - DNA, 25 bp, Mus musculus
gtacaaattcaactgcctaggtatc

SEQ ID NO: 664793 - DNA, 25 bp, Mus musculus
gtacaaattcaagtgcctaggtatc

SEQ ID NO: 664794 - DNA, 25 bp, Mus musculus
gtacaaattccaagtttgtcttctg

SEQ ID NO: 664795 - DNA, 25 bp, Mus musculus
gtacaaattccatgtttgtcttctg

SEQ ID NO: 664796 - DNA, 25 bp, Mus musculus
gtacaaattccgaagcagccatctg

SEQ ID NO: 664797 - DNA, 25 bp, Mus musculus
gtacaaattccgtagcagccatctg

SEQ ID NO: 664798 - DNA, 25 bp, Mus musculus
gtacaaattcctaatttacatcaaa

SEQ ID NO: 664799 - DNA, 25 bp, Mus musculus
gtacaaattccttatttacatcaaa

SEQ ID NO: 664800 - DNA, 25 bp, Mus musculus
gtacaaattgcaaaactggcacgta

SEQ ID NO: 664801 - DNA, 25 bp, Mus musculus
gtacaaattgcataactggcacgta

SEQ ID NO: 664802 - DNA, 25 bp, Mus musculus
gtacaacaaacgctcattagatgat

SEQ ID NO: 664803 - DNA, 25 bp, Mus musculus
gtacaacaaacggtcattagatgat

SEQ ID NO: 664804 - DNA, 25 bp, Mus musculus
gtacaacaactaagacagggctgtc

SEQ ID NO: 664805 - DNA, 25 bp, Mus musculus
gtacaacaactatgacagggctgtc

SEQ ID NO: 664806 - DNA, 25 bp, Mus musculus
gtacaacaccataaatcccgaagct

SEQ ID NO: 664807 - DNA, 25 bp, Mus musculus
gtacaacaccattaatcccgaagct

SEQ ID NO: 664808 - DNA, 25 bp, Mus musculus
gtacaacactttaatgaagctgcaa

SEQ ID NO: 664809 - DNA, 25 bp, Mus musculus
gtacaacacttttatgaagctgcaa

SEQ ID NO: 664810 - DNA, 25 bp, Mus musculus
gtacaacagctacagagtctgcttc

SEQ ID NO: 664811 - DNA, 25 bp, Mus musculus
gtacaacagctagagagtctgcttc

SEQ ID NO: 664812 - DNA, 25 bp, Mus musculus
gtacaacaggacaagtctgcctaag

SEQ ID NO: 664813 - DNA, 25 bp, Mus musculus
gtacaacaggactagtctgcctaag

SEQ ID NO: 664814 - DNA, 25 bp, Mus musculus
gtacaacaggttacacttcacacgt

SEQ ID NO: 664815 - DNA, 25 bp, Mus musculus
gtacaacaggtttcacttcacacgt

SEQ ID NO: 664816 - DNA, 25 bp, Mus musculus
gtacaacatggaattcagtctagct

SEQ ID NO: 664817 - DNA, 25 bp, Mus musculus
gtacaacatggatttcagtctagct

SEQ ID NO: 664818 - DNA, 25 bp, Mus musculus
gtacaacattacaggacaggcaact

SEQ ID NO: 664819 - DNA, 25 bp, Mus musculus
gtacaacattactggacaggcaact

SEQ ID NO: 664820 - DNA, 25 bp, Mus musculus
gtacaacattgaaactattgctgca

SEQ ID NO: 664821 - DNA, 25 bp, Mus musculus
gtacaacattgatactattgctgca

SEQ ID NO: 664822 - DNA, 25 bp, Mus musculus
gtacaaccagctccccattttgtga

SEQ ID NO: 664823 - DNA, 25 bp, Mus musculus
gtacaaccagctgcccattttgtga

SEQ ID NO: 664824 - DNA, 25 bp, Mus musculus
gtacaaccatgactgcacaattaga

SEQ ID NO: 664825 - DNA, 25 bp, Mus musculus
gtacaaccatgagtgcacaattaga

SEQ ID NO: 664826 - DNA, 25 bp, Mus musculus
gtacaacccagaatgcaaggtgagc

SEQ ID NO: 664827 - DNA, 25 bp, Mus musculus
gtacaacccagattgcaaggtgagc

SEQ ID NO: 664828 - DNA, 25 bp, Mus musculus
gtacaacccaggagttctagctagt

SEQ ID NO: 664829 - DNA, 25 bp, Mus musculus
gtacaacccaggtgttctagctagt

SEQ ID NO: 664830 - DNA, 25 bp, Mus musculus
gtacaacccatgagtgcctagtgtt

SEQ ID NO: 664831 - DNA, 25 bp, Mus musculus
gtacaacccatgtgtgcctagtgtt

SEQ ID NO: 664832 - DNA, 25 bp, Mus musculus
gtacaaccctcacattctttagttt

SEQ ID NO: 664833 - DNA, 25 bp, Mus musculus
gtacaaccctcagattctttagttt

SEQ ID NO: 664834 - DNA, 25 bp, Mus musculus
gtacaacccttgctcttataactgg

SEQ ID NO: 664835 - DNA, 25 bp, Mus musculus
gtacaacccttggtcttataactgg

SEQ ID NO: 664836 - DNA, 25 bp, Mus musculus
gtacaacctgctatgaatttctaag

SEQ ID NO: 664837 - DNA, 25 bp, Mus musculus
gtacaacctgctttgaatttctaag

SEQ ID NO: 664838 - DNA, 25 bp, Mus musculus
gtacaacctggaacaattggagaat

SEQ ID NO: 664839 - DNA, 25 bp, Mus musculus
gtacaacctggatcaattggagaat

SEQ ID NO: 664840 - DNA, 25 bp, Mus musculus
gtacaacctggtctgaccgcggcat

SEQ ID NO: 664841 - DNA, 25 bp, Mus musculus
gtacaacctggtgtgaccgcggcat

SEQ ID NO: 664842 - DNA, 25 bp, Mus musculus
gtacaacctttgacttgagctggag

SEQ ID NO: 664843 - DNA, 25 bp, Mus musculus
gtacaacctttgtcttgagctggag

SEQ ID NO: 664844 - DNA, 25 bp, Mus musculus
gtacaacgaccccaaacgcgtgtcg

SEQ ID NO: 664845 - DNA, 25 bp, Mus musculus
gtacaacgacccgaaacgcgtgtcg

SEQ ID NO: 664846 - DNA, 25 bp, Mus musculus
gtacaacgcagaacccttggttggg

SEQ ID NO: 664847 - DNA, 25 bp, Mus musculus
gtacaacgcagatcccttggttggg

SEQ ID NO: 664848 - DNA, 25 bp, Mus musculus
gtacaacgtgttatctacgactcaa

SEQ ID NO: 664849 - DNA, 25 bp, Mus musculus
gtacaacgtgttcaaggcatttatg

SEQ ID NO: 664850 - DNA, 25 bp, Mus musculus
gtacaacgtgttgaaggcatttatg

SEQ ID NO: 664851 - DNA, 25 bp, Mus musculus
gtacaacgtgttttctacgactcaa

SEQ ID NO: 664852 - DNA, 25 bp, Mus musculus
gtacaacgttgaatcactcggcatg

SEQ ID NO: 664853 - DNA, 25 bp, Mus musculus
gtacaacgttgattcactcggcatg

SEQ ID NO: 664854 - DNA, 25 bp, Mus musculus
gtacaactatccacaacccaggttt

SEQ ID NO: 664855 - DNA, 25 bp, Mus musculus
gtacaactatcctcaacccaggttt

SEQ ID NO: 664856 - DNA, 25 bp, Mus musculus
gtacaactcaacacaatcttcttcc

SEQ ID NO: 664857 - DNA, 25 bp, Mus musculus
gtacaactcaactcaatcttcttcc

SEQ ID NO: 664858 - DNA, 25 bp, Mus musculus
gtacaactcaatctagttatgactc

SEQ ID NO: 664859 - DNA, 25 bp, Mus musculus
gtacaactcaatcttagagcaaagg

SEQ ID NO: 664860 - DNA, 25 bp, Mus musculus
gtacaactcaatgtagttatgactc

SEQ ID NO: 664861 - DNA, 25 bp, Mus musculus
gtacaactcaatgttagagcaaagg

SEQ ID NO: 664862 - DNA, 25 bp, Mus musculus
gtacaactcggaacgcaaacggttc

SEQ ID NO: 664863 - DNA, 25 bp, Mus musculus
gtacaactcggaccattcaagctgt

SEQ ID NO: 664864 - DNA, 25 bp, Mus musculus
gtacaactcggagcattcaagctgt

SEQ ID NO: 664865 - DNA, 25 bp, Mus musculus
gtacaactcggatcgcaaacggttc

SEQ ID NO: 664866 - DNA, 25 bp, Mus musculus
gtacaactgaagcttgatctatttt

SEQ ID NO: 664867 - DNA, 25 bp, Mus musculus
gtacaactgaaggttgatctatttt

SEQ ID NO: 664868 - DNA, 25 bp, Mus musculus
gtacaactgcaaagccacatcggta

SEQ ID NO: 664869 - DNA, 25 bp, Mus musculus
gtacaactgcaatgccacatcggta

SEQ ID NO: 664870 - DNA, 25 bp, Mus musculus
gtacaactgttcacttaggtcaaaa

SEQ ID NO: 664871 - DNA, 25 bp, Mus musculus
gtacaactgttctcttaggtcaaaa

SEQ ID NO: 664872 - DNA, 25 bp, Mus musculus
gtacaacttagacatgacaaacact

SEQ ID NO: 664873 - DNA, 25 bp, Mus musculus
gtacaacttagagatgacaaacact

SEQ ID NO: 664874 - DNA, 25 bp, Mus musculus
gtacaacttattctgctatattctt

SEQ ID NO: 664875 - DNA, 25 bp, Mus musculus
gtacaacttattgtgctatattctt

SEQ ID NO: 664876 - DNA, 25 bp, Mus musculus
gtacaacttcctccctgtagttaat

SEQ ID NO: 664877 - DNA, 25 bp, Mus musculus
gtacaacttcctgcctgtagttaat

SEQ ID NO: 664878 - DNA, 25 bp, Mus musculus
gtacaacttctaactgggagtggcc

SEQ ID NO: 664879 - DNA, 25 bp, Mus musculus
gtacaacttctatctgggagtggcc

SEQ ID NO: 664880 - DNA, 25 bp, Mus musculus
gtacaacttgccaatcatactcttg

SEQ ID NO: 664881 - DNA, 25 bp, Mus musculus
gtacaacttgcctatcatactcttg

SEQ ID NO: 664882 - DNA, 25 bp, Mus musculus
gtacaagaacaacctcagtgagagc

SEQ ID NO: 664883 - DNA, 25 bp, Mus musculus
gtacaagaacaagctcagtgagagc

SEQ ID NO: 664884 - DNA, 25 bp, Mus musculus
gtacaagaattaccatcagggactt

SEQ ID NO: 664885 - DNA, 25 bp, Mus musculus
gtacaagaattagcatcagggactt

SEQ ID NO: 664886 - DNA, 25 bp, Mus musculus
gtacaagacgccaagacttctttat

SEQ ID NO: 664887 - DNA, 25 bp, Mus musculus
gtacaagacgcctagacttctttat

SEQ ID NO: 664888 - DNA, 25 bp, Mus musculus
gtacaagagattaccatttttgtgt

SEQ ID NO: 664889 - DNA, 25 bp, Mus musculus
gtacaagagatttccatttttgtgt

SEQ ID NO: 664890 - DNA, 25 bp, Mus musculus
gtacaagagctgagcgcagaactgg

SEQ ID NO: 664891 - DNA, 25 bp, Mus musculus
gtacaagagctgtgcgcagaactgg

SEQ ID NO: 664892 - DNA, 25 bp, Mus musculus
gtacaagagcttctgaacacggatt

SEQ ID NO: 664893 - DNA, 25 bp, Mus musculus
gtacaagagcttgtgaacacggatt

SEQ ID NO: 664894 - DNA, 25 bp, Mus musculus
gtacaagatcttcacaactgccaga

SEQ ID NO: 664895 - DNA, 25 bp, Mus musculus
gtacaagatcttgacaactgccaga

SEQ ID NO: 664896 - DNA, 25 bp, Mus musculus
gtacaagcaagcacattcttctgcc

SEQ ID NO: 664897 - DNA, 25 bp, Mus musculus
gtacaagcaagctcattcttctgcc

SEQ ID NO: 664898 - DNA, 25 bp, Mus musculus
gtacaagcagaacggtgtattccca

SEQ ID NO: 664899 - DNA, 25 bp, Mus musculus
gtacaagcagaagggtgtattccca

SEQ ID NO: 664900 - DNA, 25 bp, Mus musculus
gtacaagcagaccatgattccgccg

SEQ ID NO: 664901 - DNA, 25 bp, Mus musculus
gtacaagcagacgatgattccgccg

SEQ ID NO: 664902 - DNA, 25 bp, Mus musculus
gtacaagcagatatcctcagtttta

SEQ ID NO: 664903 - DNA, 25 bp, Mus musculus
gtacaagcagatttcctcagtttta

SEQ ID NO: 664904 - DNA, 25 bp, Mus musculus
gtacaagccaagaggtctcatgtgg

SEQ ID NO: 664905 - DNA, 25 bp, Mus musculus
gtacaagccaagtggtctcatgtgg

SEQ ID NO: 664906 - DNA, 25 bp, Mus musculus
gtacaagccctgcatttgctacaga

SEQ ID NO: 664907 - DNA, 25 bp, Mus musculus
gtacaagccctggatttgctacaga

SEQ ID NO: 664908 - DNA, 25 bp, Mus musculus
gtacaaggaagacttgccagtcagt

SEQ ID NO: 664909 - DNA, 25 bp, Mus musculus
gtacaaggaagagttgccagtcagt

SEQ ID NO: 664910 - DNA, 25 bp, Mus musculus
gtacaaggagcacctaagctgcctc

SEQ ID NO: 664911 - DNA, 25 bp, Mus musculus
gtacaaggagcagctaagctgcctc

SEQ ID NO: 664912 - DNA, 25 bp, Mus musculus
gtacaaggcatcagctacatcctgg

SEQ ID NO: 664913 - DNA, 25 bp, Mus musculus
gtacaaggcatctgctacatcctgg

SEQ ID NO: 664914 - DNA, 25 bp, Mus musculus
gtacaaggccatctggtatgaccag

SEQ ID NO: 664915 - DNA, 25 bp, Mus musculus
gtacaaggccatgtggtatgaccag

SEQ ID NO: 664916 - DNA, 25 bp, Mus musculus
gtacaaggcgctccttgaagtcttg

SEQ ID NO: 664917 - DNA, 25 bp, Mus musculus
gtacaaggcgctgcttgaagtcttg

SEQ ID NO: 664918 - DNA, 25 bp, Mus musculus
gtacaagggactactactgtttata

SEQ ID NO: 664919 - DNA, 25 bp, Mus musculus
gtacaagggacttctactgtttata

SEQ ID NO: 664920 - DNA, 25 bp, Mus musculus
gtacaaggtgtaactagcatcttta

SEQ ID NO: 664921 - DNA, 25 bp, Mus musculus
gtacaaggtgtatctagcatcttta

SEQ ID NO: 664922 - DNA, 25 bp, Mus musculus
gtacaaggttgtagtcttcatttct

SEQ ID NO: 664923 - DNA, 25 bp, Mus musculus
gtacaaggttgttgtcttcatttct

SEQ ID NO: 664924 - DNA, 25 bp, Mus musculus
gtacaaggttttatggctccgcggg

SEQ ID NO: 664925 - DNA, 25 bp, Mus musculus
gtacaaggttttttggctccgcggg

SEQ ID NO: 664926 - DNA, 25 bp, Mus musculus
gtacaagtaactcactggctagcaa

SEQ ID NO: 664927 - DNA, 25 bp, Mus musculus
gtacaagtaactgactggctagcaa

SEQ ID NO: 664928 - DNA, 25 bp, Mus musculus
gtacaagtacatataaaaagtgcac

SEQ ID NO: 664929 - DNA, 25 bp, Mus musculus
gtacaagtacatttaaaaagtgcac

SEQ ID NO: 664930 - DNA, 25 bp, Mus musculus
gtacaagtactacccgcacctgtta

SEQ ID NO: 664931 - DNA, 25 bp, Mus musculus
gtacaagtactagccgcacctgtta

SEQ ID NO: 664932 - DNA, 25 bp, Mus musculus
gtacaagtcatcacgcagactggct

SEQ ID NO: 664933 - DNA, 25 bp, Mus musculus
gtacaagtcatctcgcagactggct

SEQ ID NO: 664934 - DNA, 25 bp, Mus musculus
gtacaagtcatgactctcaatttta

SEQ ID NO: 664935 - DNA, 25 bp, Mus musculus
gtacaagtcatgtctctcaatttta

SEQ ID NO: 664936 - DNA, 25 bp, Mus musculus
gtacaagtgcaactgggtcaaccaa

SEQ ID NO: 664937 - DNA, 25 bp, Mus musculus
gtacaagtgcaagtgggtcaaccaa

SEQ ID NO: 664938 - DNA, 25 bp, Mus musculus
gtacaagtgccaccatttgactaaa

SEQ ID NO: 664939 - DNA, 25 bp, Mus musculus
gtacaagtgccagcatttgactaaa

SEQ ID NO: 664940 - DNA, 25 bp, Mus musculus
gtacaagtgcttccagtagctaaaa

SEQ ID NO: 664941 - DNA, 25 bp, Mus musculus
gtacaagtgcttgcagtagctaaaa

SEQ ID NO: 664942 - DNA, 25 bp, Mus musculus
gtacaagtgtgaatttagatcgatt

SEQ ID NO: 664943 - DNA, 25 bp, Mus musculus
gtacaagtgtgattttagatcgatt

SEQ ID NO: 664944 - DNA, 25 bp, Mus musculus
gtacaagtgtggacccttatatttc

SEQ ID NO: 664945 - DNA, 25 bp, Mus musculus
gtacaagtgtggtcccttatatttc

SEQ ID NO: 664946 - DNA, 25 bp, Mus musculus
gtacaagtgttactgaacccactca

SEQ ID NO: 664947 - DNA, 25 bp, Mus musculus
gtacaagtgttagtgaacccactca

SEQ ID NO: 664948 - DNA, 25 bp, Mus musculus
gtacaagttctgaggaaatccatgt

SEQ ID NO: 664949 - DNA, 25 bp, Mus musculus
gtacaagttctgtggaaatccatgt

SEQ ID NO: 664950 - DNA, 25 bp, Mus musculus
gtacaagttcttacgcttggcctta

SEQ ID NO: 664951 - DNA, 25 bp, Mus musculus
gtacaagttcttcccttcagagctt

SEQ ID NO: 664952 - DNA, 25 bp, Mus musculus
gtacaagttcttgccttcagagctt

SEQ ID NO: 664953 - DNA, 25 bp, Mus musculus
gtacaagttctttcgcttggcctta

SEQ ID NO: 664954 - DNA, 25 bp, Mus musculus
gtacaataaagtacctctgcccttt

SEQ ID NO: 664955 - DNA, 25 bp, Mus musculus
gtacaataaagttcctctgcccttt

SEQ ID NO: 664956 - DNA, 25 bp, Mus musculus
gtacaataattgctcctgatggtgg

SEQ ID NO: 664957 - DNA, 25 bp, Mus musculus
gtacaataattggtcctgatggtgg

SEQ ID NO: 664958 - DNA, 25 bp, Mus musculus
gtacaatactttaagtgatcacctt

SEQ ID NO: 664959 - DNA, 25 bp, Mus musculus
gtacaatacttttagtgatcacctt

SEQ ID NO: 664960 - DNA, 25 bp, Mus musculus
gtacaatagggtcttgtccactgcc

SEQ ID NO: 664961 - DNA, 25 bp, Mus musculus
gtacaatagggtgttgtccactgcc

SEQ ID NO: 664962 - DNA, 25 bp, Mus musculus
gtacaatataacatctaaggcctgg

SEQ ID NO: 664963 - DNA, 25 bp, Mus musculus
gtacaatataaccactcctgttgat

SEQ ID NO: 664964 - DNA, 25 bp, Mus musculus
gtacaatataacgactcctgttgat

SEQ ID NO: 664965 - DNA, 25 bp, Mus musculus
gtacaatataacttctaaggcctgg

SEQ ID NO: 664966 - DNA, 25 bp, Mus musculus
gtacaatatcacactgtgcttcaat

SEQ ID NO: 664967 - DNA, 25 bp, Mus musculus
gtacaatatcactctgtgcttcaat

SEQ ID NO: 664968 - DNA, 25 bp, Mus musculus
gtacaatcactgatgacgagaaagt

SEQ ID NO: 664969 - DNA, 25 bp, Mus musculus
gtacaatcactgttgacgagaaagt

SEQ ID NO: 664970 - DNA, 25 bp, Mus musculus
gtacaatcagcaaacgctcctaacc

SEQ ID NO: 664971 - DNA, 25 bp, Mus musculus
gtacaatcagcatacgctcctaacc

SEQ ID NO: 664972 - DNA, 25 bp, Mus musculus
gtacaatcatgtcacctagagcaac

SEQ ID NO: 664973 - DNA, 25 bp, Mus musculus
gtacaatcatgtgacctagagcaac

SEQ ID NO: 664974 - DNA, 25 bp, Mus musculus
gtacaatcctccagaccacgatgtt

SEQ ID NO: 664975 - DNA, 25 bp, Mus musculus
gtacaatcctcctgaccacgatgtt

SEQ ID NO: 664976 - DNA, 25 bp, Mus musculus
gtacaatcctgtccatacagatgat

SEQ ID NO: 664977 - DNA, 25 bp, Mus musculus
gtacaatcctgtgcatacagatgat

SEQ ID NO: 664978 - DNA, 25 bp, Mus musculus
gtacaatcgcttagagaagcgtcac

SEQ ID NO: 664979 - DNA, 25 bp, Mus musculus
gtacaatcgctttgagaagcgtcac

SEQ ID NO: 664980 - DNA, 25 bp, Mus musculus
gtacaatgaagaactccgggcccag

SEQ ID NO: 664981 - DNA, 25 bp, Mus musculus
gtacaatgaagatctccgggcccag

SEQ ID NO: 664982 - DNA, 25 bp, Mus musculus
gtacaatgagaacactcggcgctcc

SEQ ID NO: 664983 - DNA, 25 bp, Mus musculus
gtacaatgagaagactcggcgctcc

SEQ ID NO: 664984 - DNA, 25 bp, Mus musculus
gtacaatgctatcctatggagcccc

SEQ ID NO: 664985 - DNA, 25 bp, Mus musculus
gtacaatgctatgctatggagcccc

SEQ ID NO: 664986 - DNA, 25 bp, Mus musculus
gtacaatgctggatgtctggttttg

SEQ ID NO: 664987 - DNA, 25 bp, Mus musculus
gtacaatgctggttgtctggttttg

SEQ ID NO: 664988 - DNA, 25 bp, Mus musculus
gtacaatggacccatctgatcctct

SEQ ID NO: 664989 - DNA, 25 bp, Mus musculus
gtacaatggaccgatctgatcctct

SEQ ID NO: 664990 - DNA, 25 bp, Mus musculus
gtacaatgggcaaggctatccaggt

SEQ ID NO: 664991 - DNA, 25 bp, Mus musculus
gtacaatgggcatggctatccaggt

SEQ ID NO: 664992 - DNA, 25 bp, Mus musculus
gtacaatgtgttattctccagtgct

SEQ ID NO: 664993 - DNA, 25 bp, Mus musculus
gtacaatgtgtttttctccagtgct

SEQ ID NO: 664994 - DNA, 25 bp, Mus musculus
gtacaatgttgtatacccttgcaaa

SEQ ID NO: 664995 - DNA, 25 bp, Mus musculus
gtacaatgttgtttacccttgcaaa

SEQ ID NO: 664996 - DNA, 25 bp, Mus musculus
gtacaattaaaactgcatattcctt

SEQ ID NO: 664997 - DNA, 25 bp, Mus musculus
gtacaattaaaagtgcatattcctt

SEQ ID NO: 664998 - DNA, 25 bp, Mus musculus
gtacaattaactcgtgatttcctca

SEQ ID NO: 664999 - DNA, 25 bp, Mus musculus
gtacaattaactggtgatttcctca

SEQ ID NO: 665000 - DNA, 25 bp, Mus musculus
gtacaattccatcagataaaaacac

SEQ ID NO: 665001 - DNA, 25 bp, Mus musculus
gtacaattccatgagataaaaacac

SEQ ID NO: 665002 - DNA, 25 bp, Mus musculus
gtacaattgagacgtactgctcatt

SEQ ID NO: 665003 - DNA, 25 bp, Mus musculus
gtacaattgagaggtactgctcatt

SEQ ID NO: 665004 - DNA, 25 bp, Mus musculus
gtacaatttagcataacaaatcaga

SEQ ID NO: 665005 - DNA, 25 bp, Mus musculus
gtacaatttagcttaacaaatcaga

SEQ ID NO: 665006 - DNA, 25 bp, Mus musculus
gtacaatttccactgcagtgcagcg

SEQ ID NO: 665007 - DNA, 25 bp, Mus musculus
gtacaatttccagtgcagtgcagcg

SEQ ID NO: 665008 - DNA, 25 bp, Mus musculus
gtacaatttctgctcatagatcccc

SEQ ID NO: 665009 - DNA, 25 bp, Mus musculus
gtacaatttctggtcatagatcccc

SEQ ID NO: 665010 - DNA, 25 bp, Mus musculus
gtacaatttgcaatcccataaggaa

SEQ ID NO: 665011 - DNA, 25 bp, Mus musculus
gtacaatttgcattcccataaggaa

SEQ ID NO: 665012 - DNA, 25 bp, Mus musculus
gtacaatttgtgcattggtctttaa

SEQ ID NO: 665013 - DNA, 25 bp, Mus musculus
gtacaatttgtggattggtctttaa

SEQ ID NO: 665014 - DNA, 25 bp, Mus musculus
gtacacaaaaacatggcacagggct

SEQ ID NO: 665015 - DNA, 25 bp, Mus musculus
gtacacaaaaacttggcacagggct

SEQ ID NO: 665016 - DNA, 25 bp, Mus musculus
gtacacaaagacaaatggaccctga

SEQ ID NO: 665017 - DNA, 25 bp, Mus musculus
gtacacaaagactaatggaccctga

SEQ ID NO: 665018 - DNA, 25 bp, Mus musculus
gtacacaaatgaacaaggactcctg

SEQ ID NO: 665019 - DNA, 25 bp, Mus musculus
gtacacaaatgatcaaggactcctg

SEQ ID NO: 665020 - DNA, 25 bp, Mus musculus
gtacacaacatacactgactgccct

SEQ ID NO: 665021 - DNA, 25 bp, Mus musculus
gtacacaacatagactgactgccct

SEQ ID NO: 665022 - DNA, 25 bp, Mus musculus
gtacacaacccgaactgactctaaa

SEQ ID NO: 665023 - DNA, 25 bp, Mus musculus
gtacacaacccgtactgactctaaa

SEQ ID NO: 665024 - DNA, 25 bp, Mus musculus
gtacacaacttccttaaagtcagat

SEQ ID NO: 665025 - DNA, 25 bp, Mus musculus
gtacacaacttcgttaaagtcagat

SEQ ID NO: 665026 - DNA, 25 bp, Mus musculus
gtacacaagcgtaagcgtgcctgtt

SEQ ID NO: 665027 - DNA, 25 bp, Mus musculus
gtacacaagcgttagcgtgcctgtt

SEQ ID NO: 665028 - DNA, 25 bp, Mus musculus
gtacacaagctgattcccctcaagg

SEQ ID NO: 665029 - DNA, 25 bp, Mus musculus
gtacacaagctgtttcccctcaagg

SEQ ID NO: 665030 - DNA, 25 bp, Mus musculus
gtacacaatgatctgtttcacagct

SEQ ID NO: 665031 - DNA, 25 bp, Mus musculus
gtacacaatgatgtgtttcacagct

SEQ ID NO: 665032 - DNA, 25 bp, Mus musculus
gtacacaatgcaccccgctttctgg

SEQ ID NO: 665033 - DNA, 25 bp, Mus musculus
gtacacaatgcagcccgctttctgg

SEQ ID NO: 665034 - DNA, 25 bp, Mus musculus
gtacacaattgaccatattccatgt

SEQ ID NO: 665035 - DNA, 25 bp, Mus musculus
gtacacaattgagcatattccatgt

SEQ ID NO: 665036 - DNA, 25 bp, Mus musculus
gtacacaatttaatccagctgcggg

SEQ ID NO: 665037 - DNA, 25 bp, Mus musculus
gtacacaatttattccagctgcggg

SEQ ID NO: 665038 - DNA, 25 bp, Mus musculus
gtacacaatttgatcctttctctag

SEQ ID NO: 665039 - DNA, 25 bp, Mus musculus
gtacacaatttgttcctttctctag

SEQ ID NO: 665040 - DNA, 25 bp, Mus musculus
gtacacacaaccctgtgacttagca

SEQ ID NO: 665041 - DNA, 25 bp, Mus musculus
gtacacacaaccgtgtgacttagca

SEQ ID NO: 665042 - DNA, 25 bp, Mus musculus
gtacacacacaaagttgaccctcaa

SEQ ID NO: 665043 - DNA, 25 bp, Mus musculus
gtacacacacaatgttgaccctcaa

SEQ ID NO: 665044 - DNA, 25 bp, Mus musculus
gtacacacagagcacttattcattt

SEQ ID NO: 665045 - DNA, 25 bp, Mus musculus
gtacacacagaggacttattcattt

SEQ ID NO: 665046 - DNA, 25 bp, Mus musculus
gtacacacagtgattcggaacccgc

SEQ ID NO: 665047 - DNA, 25 bp, Mus musculus
gtacacacagtgtttcggaacccgc

SEQ ID NO: 665048 - DNA, 25 bp, Mus musculus
gtacacaccttcaggtatgacaaga

SEQ ID NO: 665049 - DNA, 25 bp, Mus musculus
gtacacaccttctggtatgacaaga

SEQ ID NO: 665050 - DNA, 25 bp, Mus musculus
gtacacacgcacaagtacacatcgc

SEQ ID NO: 665051 - DNA, 25 bp, Mus musculus
gtacacacgcactagtacacatcgc

SEQ ID NO: 665052 - DNA, 25 bp, Mus musculus
gtacacacgcagctgtgtttcccaa

SEQ ID NO: 665053 - DNA, 25 bp, Mus musculus
gtacacacgcaggtgtgtttcccaa

SEQ ID NO: 665054 - DNA, 25 bp, Mus musculus
gtacacactcaaccactacttgctg

SEQ ID NO: 665055 - DNA, 25 bp, Mus musculus
gtacacactcaagcactacttgctg

SEQ ID NO: 665056 - DNA, 25 bp, Mus musculus
gtacacactcagaccacacatattc

SEQ ID NO: 665057 - DNA, 25 bp, Mus musculus
gtacacactcagtccacacatattc

SEQ ID NO: 665058 - DNA, 25 bp, Mus musculus
gtacacacttcgacaattattgtaa

SEQ ID NO: 665059 - DNA, 25 bp, Mus musculus
gtacacacttcgtcaattattgtaa

SEQ ID NO: 665060 - DNA, 25 bp, Mus musculus
gtacacagactcagttctcatccaa

SEQ ID NO: 665061 - DNA, 25 bp, Mus musculus
gtacacagactctgttctcatccaa

SEQ ID NO: 665062 - DNA, 25 bp, Mus musculus
gtacacagagagctacccctcagat

SEQ ID NO: 665063 - DNA, 25 bp, Mus musculus
gtacacagagaggtacccctcagat

SEQ ID NO: 665064 - DNA, 25 bp, Mus musculus
gtacacagatacatgtttctacagc

SEQ ID NO: 665065 - DNA, 25 bp, Mus musculus
gtacacagatacttgtttctacagc

SEQ ID NO: 665066 - DNA, 25 bp, Mus musculus
gtacacagattgaccggcagatgtt

SEQ ID NO: 665067 - DNA, 25 bp, Mus musculus
gtacacagattgtccggcagatgtt

SEQ ID NO: 665068 - DNA, 25 bp, Mus musculus
gtacacagcaggactctttctatga

SEQ ID NO: 665069 - DNA, 25 bp, Mus musculus
gtacacagcaggtctctttctatga

SEQ ID NO: 665070 - DNA, 25 bp, Mus musculus
gtacacagcagtcttgtgtcccttg

SEQ ID NO: 665071 - DNA, 25 bp, Mus musculus
gtacacagcagtgttgtgtcccttg

SEQ ID NO: 665072 - DNA, 25 bp, Mus musculus
gtacacagcgatagctcactcattg

SEQ ID NO: 665073 - DNA, 25 bp, Mus musculus
gtacacagcgattgctcactcattg

SEQ ID NO: 665074 - DNA, 25 bp, Mus musculus
gtacacaggcatcgagtcagagttt

SEQ ID NO: 665075 - DNA, 25 bp, Mus musculus
gtacacaggcatggagtcagagttt

SEQ ID NO: 665076 - DNA, 25 bp, Mus musculus
gtacacaggctgcatctaatctgca

SEQ ID NO: 665077 - DNA, 25 bp, Mus musculus
gtacacaggctggatctaatctgca

SEQ ID NO: 665078 - DNA, 25 bp, Mus musculus
gtacacaggtggcttctatgccgct

SEQ ID NO: 665079 - DNA, 25 bp, Mus musculus
gtacacaggtgggttctatgccgct

SEQ ID NO: 665080 - DNA, 25 bp, Mus musculus
gtacacagtagaagccagcaaggtt

SEQ ID NO: 665081 - DNA, 25 bp, Mus musculus
gtacacagtagatgccagcaaggtt

SEQ ID NO: 665082 - DNA, 25 bp, Mus musculus
gtacacagtcctattatacttgtct

SEQ ID NO: 665083 - DNA, 25 bp, Mus musculus
gtacacagtccttttatacttgtct

SEQ ID NO: 665084 - DNA, 25 bp, Mus musculus
gtacacagtgctctagtcccagtac

SEQ ID NO: 665085 - DNA, 25 bp, Mus musculus
gtacacagtgctgtagtcccagtac

SEQ ID NO: 665086 - DNA, 25 bp, Mus musculus
gtacacagtgtacagctcagtatag

SEQ ID NO: 665087 - DNA, 25 bp, Mus musculus
gtacacagtgtagagctcagtatag

SEQ ID NO: 665088 - DNA, 25 bp, Mus musculus
gtacacagttgaatctttctagagc

SEQ ID NO: 665089 - DNA, 25 bp, Mus musculus
gtacacagttgattctttctagagc

SEQ ID NO: 665090 - DNA, 25 bp, Mus musculus
gtacacagttgtcggtgaggcacta

SEQ ID NO: 665091 - DNA, 25 bp, Mus musculus
gtacacagttgtgggtgaggcacta

SEQ ID NO: 665092 - DNA, 25 bp, Mus musculus
gtacacataagcatcttgtttgttt

SEQ ID NO: 665093 - DNA, 25 bp, Mus musculus
gtacacataagcttcttgtttgttt

SEQ ID NO: 665094 - DNA, 25 bp, Mus musculus
gtacacataatgacctgtctgctct

SEQ ID NO: 665095 - DNA, 25 bp, Mus musculus
gtacacataatgtcctgtctgctct

SEQ ID NO: 665096 - DNA, 25 bp, Mus musculus
gtacacatacaacgcccaagaatct

SEQ ID NO: 665097 - DNA, 25 bp, Mus musculus
gtacacatacaaggcccaagaatct

SEQ ID NO: 665098 - DNA, 25 bp, Mus musculus
gtacacatagagagactcatggctt

SEQ ID NO: 665099 - DNA, 25 bp, Mus musculus
gtacacatagagtgactcatggctt

SEQ ID NO: 665100 - DNA, 25 bp, Mus musculus
gtacacatatgcaatcataccagta

SEQ ID NO: 665101 - DNA, 25 bp, Mus musculus
gtacacatatgctatcataccagta

SEQ ID NO: 665102 - DNA, 25 bp, Mus musculus
gtacacatcattcaaatccagcatg

SEQ ID NO: 665103 - DNA, 25 bp, Mus musculus
gtacacatcattgaaatccagcatg

SEQ ID NO: 665104 - DNA, 25 bp, Mus musculus
gtacacatccatcactatgcacgag

SEQ ID NO: 665105 - DNA, 25 bp, Mus musculus
gtacacatccatgactatgcacgag

SEQ ID NO: 665106 - DNA, 25 bp, Mus musculus
gtacacatcctacacaccgattttt

SEQ ID NO: 665107 - DNA, 25 bp, Mus musculus
gtacacatcctagacaccgattttt

SEQ ID NO: 665108 - DNA, 25 bp, Mus musculus
gtacacatccttcttcagttttctt

SEQ ID NO: 665109 - DNA, 25 bp, Mus musculus
gtacacatccttgttcagttttctt

SEQ ID NO: 665110 - DNA, 25 bp, Mus musculus
gtacacatcggtaataatgccccag

SEQ ID NO: 665111 - DNA, 25 bp, Mus musculus
gtacacatcggttataatgccccag

SEQ ID NO: 665112 - DNA, 25 bp, Mus musculus
gtacacatctatagcctcttctaat

SEQ ID NO: 665113 - DNA, 25 bp, Mus musculus
gtacacatctattgcctcttctaat

SEQ ID NO: 665114 - DNA, 25 bp, Mus musculus
gtacacatctgtattcaactcagga

SEQ ID NO: 665115 - DNA, 25 bp, Mus musculus
gtacacatctgttttcaactcagga

SEQ ID NO: 665116 - DNA, 25 bp, Mus musculus
gtacacatgaacagtgggcacaatg

SEQ ID NO: 665117 - DNA, 25 bp, Mus musculus
gtacacatgaactgtgggcacaatg

SEQ ID NO: 665118 - DNA, 25 bp, Mus musculus
gtacacatgcagaattctctctcgt

SEQ ID NO: 665119 - DNA, 25 bp, Mus musculus
gtacacatgcagtattctctctcgt

SEQ ID NO: 665120 - DNA, 25 bp, Mus musculus
gtacacatgtaaatttgcatattta

SEQ ID NO: 665121 - DNA, 25 bp, Mus musculus
gtacacatgtaattttgcatattta

SEQ ID NO: 665122 - DNA, 25 bp, Mus musculus
gtacacatgtctctctactgtgctt

SEQ ID NO: 665123 - DNA, 25 bp, Mus musculus
gtacacatgtctgtctactgtgctt

SEQ ID NO: 665124 - DNA, 25 bp, Mus musculus
gtacacattggccaagtgcttctgt

SEQ ID NO: 665125 - DNA, 25 bp, Mus musculus
gtacacattggcgaagtgcttctgt

SEQ ID NO: 665126 - DNA, 25 bp, Mus musculus
gtacacatttacatcagcagccaat

SEQ ID NO: 665127 - DNA, 25 bp, Mus musculus
gtacacatttacttcagcagccaat

SEQ ID NO: 665128 - DNA, 25 bp, Mus musculus
gtacacatttgcagcccacatggat

SEQ ID NO: 665129 - DNA, 25 bp, Mus musculus
gtacacatttgctgcccacatggat

SEQ ID NO: 665130 - DNA, 25 bp, Mus musculus
gtacaccaagctctattttcaggat

SEQ ID NO: 665131 - DNA, 25 bp, Mus musculus
gtacaccaagctgtattttcaggat

SEQ ID NO: 665132 - DNA, 25 bp, Mus musculus
gtacaccacacaactggcagtaatt

SEQ ID NO: 665133 - DNA, 25 bp, Mus musculus
gtacaccacacatctggcagtaatt

SEQ ID NO: 665134 - DNA, 25 bp, Mus musculus
gtacaccacaggatttgcaagctga

SEQ ID NO: 665135 - DNA, 25 bp, Mus musculus
gtacaccacaggttttgcaagctga

SEQ ID NO: 665136 - DNA, 25 bp, Mus musculus
gtacaccagaacctgaagccactgt

SEQ ID NO: 665137 - DNA, 25 bp, Mus musculus
gtacaccagaacgtgaagccactgt

SEQ ID NO: 665138 - DNA, 25 bp, Mus musculus
gtacaccagagtctacctgagagag

SEQ ID NO: 665139 - DNA, 25 bp, Mus musculus
gtacaccagagtctagactcccatg

SEQ ID NO: 665140 - DNA, 25 bp, Mus musculus
gtacaccagagtgtacctgagagag

SEQ ID NO: 665141 - DNA, 25 bp, Mus musculus
gtacaccagagtgtagactcccatg

SEQ ID NO: 665142 - DNA, 25 bp, Mus musculus
gtacaccagctaaacccgcttaggt

SEQ ID NO: 665143 - DNA, 25 bp, Mus musculus
gtacaccagctacctatcagcctaa

SEQ ID NO: 665144 - DNA, 25 bp, Mus musculus
gtacaccagctagctatcagcctaa

SEQ ID NO: 665145 - DNA, 25 bp, Mus musculus
gtacaccagctatacccgcttaggt

SEQ ID NO: 665146 - DNA, 25 bp, Mus musculus
gtacaccaggctcgcaaacctcaga

SEQ ID NO: 665147 - DNA, 25 bp, Mus musculus
gtacaccaggctggcaaacctcaga

SEQ ID NO: 665148 - DNA, 25 bp, Mus musculus
gtacaccataatataattcacacac

SEQ ID NO: 665149 - DNA, 25 bp, Mus musculus
gtacaccataatttaattcacacac

SEQ ID NO: 665150 - DNA, 25 bp, Mus musculus
gtacaccatgatcctcgggaacttc

SEQ ID NO: 665151 - DNA, 25 bp, Mus musculus
gtacaccatgatgctcgggaacttc

SEQ ID NO: 665152 - DNA, 25 bp, Mus musculus
gtacacccatgcacatacttaacgt

SEQ ID NO: 665153 - DNA, 25 bp, Mus musculus
gtacacccatgctcatacttaacgt

SEQ ID NO: 665154 - DNA, 25 bp, Mus musculus
gtacacccatgtaaagacacacatt

SEQ ID NO: 665155 - DNA, 25 bp, Mus musculus
gtacacccatgttaagacacacatt

SEQ ID NO: 665156 - DNA, 25 bp, Mus musculus
gtacacccatttattcactgacttg

SEQ ID NO: 665157 - DNA, 25 bp, Mus musculus
gtacacccattttttcactgacttg

SEQ ID NO: 665158 - DNA, 25 bp, Mus musculus
gtacaccccgcgaagctatgtaggg

SEQ ID NO: 665159 - DNA, 25 bp, Mus musculus
gtacaccccgcgtagctatgtaggg

SEQ ID NO: 665160 - DNA, 25 bp, Mus musculus
gtacaccccgctaggtagaatgtta

SEQ ID NO: 665161 - DNA, 25 bp, Mus musculus
gtacaccccgcttggtagaatgtta

SEQ ID NO: 665162 - DNA, 25 bp, Mus musculus
gtacaccctatccatctgtcaggag

SEQ ID NO: 665163 - DNA, 25 bp, Mus musculus
gtacaccctatcgatctgtcaggag

SEQ ID NO: 665164 - DNA, 25 bp, Mus musculus
gtacaccctgatatagcttcatttg

SEQ ID NO: 665165 - DNA, 25 bp, Mus musculus
gtacaccctgatttagcttcatttg

SEQ ID NO: 665166 - DNA, 25 bp, Mus musculus
gtacaccctggaagtcactattttg

SEQ ID NO: 665167 - DNA, 25 bp, Mus musculus
gtacaccctggatgtcactattttg

SEQ ID NO: 665168 - DNA, 25 bp, Mus musculus
gtacaccctggtcagagccaagact

SEQ ID NO: 665169 - DNA, 25 bp, Mus musculus
gtacaccctggtgagagccaagact

SEQ ID NO: 665170 - DNA, 25 bp, Mus musculus
gtacaccgggaaccaagcgtggctt

SEQ ID NO: 665171 - DNA, 25 bp, Mus musculus
gtacaccgggaagcaagcgtggctt

SEQ ID NO: 665172 - DNA, 25 bp, Mus musculus
gtacacctatacacagtgatacact

SEQ ID NO: 665173 - DNA, 25 bp, Mus musculus
gtacacctatactcagtgatacact

SEQ ID NO: 665174 - DNA, 25 bp, Mus musculus
gtacacctatggcaagcacatcctg

SEQ ID NO: 665175 - DNA, 25 bp, Mus musculus
gtacacctatgggaagcacatcctg

SEQ ID NO: 665176 - DNA, 25 bp, Mus musculus
gtacacctccgacctgatgctgggt

SEQ ID NO: 665177 - DNA, 25 bp, Mus musculus
gtacacctccgagctgatgctgggt

SEQ ID NO: 665178 - DNA, 25 bp, Mus musculus
gtacacctctccaggacctatcatg

SEQ ID NO: 665179 - DNA, 25 bp, Mus musculus
gtacacctctcctggacctatcatg

SEQ ID NO: 665180 - DNA, 25 bp, Mus musculus
gtacacctgctaaaagtctcagtag

SEQ ID NO: 665181 - DNA, 25 bp, Mus musculus
gtacacctgctataagtctcagtag

SEQ ID NO: 665182 - DNA, 25 bp, Mus musculus
gtacacctgggccttgtggacacag

SEQ ID NO: 665183 - DNA, 25 bp, Mus musculus
gtacacctgggcgttgtggacacag

SEQ ID NO: 665184 - DNA, 25 bp, Mus musculus
gtacaccttaggaactctaaggaag

SEQ ID NO: 665185 - DNA, 25 bp, Mus musculus
gtacaccttaggtactctaaggaag

SEQ ID NO: 665186 - DNA, 25 bp, Mus musculus
gtacaccttcatatatttgctttca

SEQ ID NO: 665187 - DNA, 25 bp, Mus musculus
gtacaccttcatttatttgctttca

SEQ ID NO: 665188 - DNA, 25 bp, Mus musculus
gtacaccttcttagggaatactact

SEQ ID NO: 665189 - DNA, 25 bp, Mus musculus
gtacaccttctttgggaatactact

SEQ ID NO: 665190 - DNA, 25 bp, Mus musculus
gtacacctttacagtgcagaggcct

SEQ ID NO: 665191 - DNA, 25 bp, Mus musculus
gtacacctttactgtgcagaggcct

SEQ ID NO: 665192 - DNA, 25 bp, Mus musculus
gtacacgaagaacttggcagtcatg

SEQ ID NO: 665193 - DNA, 25 bp, Mus musculus
gtacacgaagaagttggcagtcatg

SEQ ID NO: 665194 - DNA, 25 bp, Mus musculus
gtacacgaagttcccgtcggtctgt

SEQ ID NO: 665195 - DNA, 25 bp, Mus musculus
gtacacgaagttgccgtcggtctgt

SEQ ID NO: 665196 - DNA, 25 bp, Mus musculus
gtacacgaatggaggacacacaagc

SEQ ID NO: 665197 - DNA, 25 bp, Mus musculus
gtacacgaatggtggacacacaagc

SEQ ID NO: 665198 - DNA, 25 bp, Mus musculus
gtacacgacactagaagccgtggtt

SEQ ID NO: 665199 - DNA, 25 bp, Mus musculus
gtacacgacacttgaagccgtggtt

SEQ ID NO: 665200 - DNA, 25 bp, Mus musculus
gtacacgaggatcgctagtcttcct

SEQ ID NO: 665201 - DNA, 25 bp, Mus musculus
gtacacgaggatggctagtcttcct

SEQ ID NO: 665202 - DNA, 25 bp, Mus musculus
gtacacgatccgctgagcatccaaa

SEQ ID NO: 665203 - DNA, 25 bp, Mus musculus
gtacacgatccggtgagcatccaaa

SEQ ID NO: 665204 - DNA, 25 bp, Mus musculus
gtacacgcaacaaaaacctcaggag

SEQ ID NO: 665205 - DNA, 25 bp, Mus musculus
gtacacgcaacataaacctcaggag

SEQ ID NO: 665206 - DNA, 25 bp, Mus musculus
gtacacgcagctctgggctgtgcaa

SEQ ID NO: 665207 - DNA, 25 bp, Mus musculus
gtacacgcagctgtgggctgtgcaa

SEQ ID NO: 665208 - DNA, 25 bp, Mus musculus
gtacacgcatccagcaagcacttga

SEQ ID NO: 665209 - DNA, 25 bp, Mus musculus
gtacacgcatcctgcaagcacttga

SEQ ID NO: 665210 - DNA, 25 bp, Mus musculus
gtacacgcggtgagtgcacagacac

SEQ ID NO: 665211 - DNA, 25 bp, Mus musculus
gtacacgcggtgtgtgcacagacac

SEQ ID NO: 665212 - DNA, 25 bp, Mus musculus
gtacacggagttactgacaggcctg

SEQ ID NO: 665213 - DNA, 25 bp, Mus musculus
gtacacggagtttctgacaggcctg

SEQ ID NO: 665214 - DNA, 25 bp, Mus musculus
gtacacggccgaacaggtcctacag

SEQ ID NO: 665215 - DNA, 25 bp, Mus musculus
gtacacggccgatcaggtcctacag

SEQ ID NO: 665216 - DNA, 25 bp, Mus musculus
gtacacgggaaacattcctgaacaa

SEQ ID NO: 665217 - DNA, 25 bp, Mus musculus
gtacacgggaaagattcctgaacaa

SEQ ID NO: 665218 - DNA, 25 bp, Mus musculus
gtacacggtgctatttctattcctt

SEQ ID NO: 665219 - DNA, 25 bp, Mus musculus
gtacacggtgctttttctattcctt

SEQ ID NO: 665220 - DNA, 25 bp, Mus musculus
gtacacggttgaatgtcttgactca

SEQ ID NO: 665221 - DNA, 25 bp, Mus musculus
gtacacggttgattgtcttgactca

SEQ ID NO: 665222 - DNA, 25 bp, Mus musculus
gtacacggttgccatggaacccagt

SEQ ID NO: 665223 - DNA, 25 bp, Mus musculus
gtacacggttgcgatggaacccagt

SEQ ID NO: 665224 - DNA, 25 bp, Mus musculus
gtacacgtaagtcgcataaggatgc

SEQ ID NO: 665225 - DNA, 25 bp, Mus musculus
gtacacgtaagtggcataaggatgc

SEQ ID NO: 665226 - DNA, 25 bp, Mus musculus
gtacacgtagtgctgctctctactc

SEQ ID NO: 665227 - DNA, 25 bp, Mus musculus
gtacacgtagtggtgctctctactc

SEQ ID NO: 665228 - DNA, 25 bp, Mus musculus
gtacacgtgaacactttcactggtg

SEQ ID NO: 665229 - DNA, 25 bp, Mus musculus
gtacacgtgaactctttcactggtg

SEQ ID NO: 665230 - DNA, 25 bp, Mus musculus
gtacacgtgcaaaacctgcaggtga

SEQ ID NO: 665231 - DNA, 25 bp, Mus musculus
gtacacgtgcaatacctgcaggtga

SEQ ID NO: 665232 - DNA, 25 bp, Mus musculus
gtacacgtgcctcagaacaaaaact

SEQ ID NO: 665233 - DNA, 25 bp, Mus musculus
gtacacgtgcctgagaacaaaaact

SEQ ID NO: 665234 - DNA, 25 bp, Mus musculus
gtacacgtgtgtactatgcactcgc

SEQ ID NO: 665235 - DNA, 25 bp, Mus musculus
gtacacgtgtgtatgcatgccaaag

SEQ ID NO: 665236 - DNA, 25 bp, Mus musculus
gtacacgtgtgttctatgcactcgc

SEQ ID NO: 665237 - DNA, 25 bp, Mus musculus
gtacacgtgtgtttgcatgccaaag

SEQ ID NO: 665238 - DNA, 25 bp, Mus musculus
gtacacgtgtttccttttcactttc

SEQ ID NO: 665239 - DNA, 25 bp, Mus musculus
gtacacgtgtttgcttttcactttc

SEQ ID NO: 665240 - DNA, 25 bp, Mus musculus
gtacacgttctgacaactggtggca

SEQ ID NO: 665241 - DNA, 25 bp, Mus musculus
gtacacgttctgtcaactggtggca

SEQ ID NO: 665242 - DNA, 25 bp, Mus musculus
gtacactaactaagtcttgcccatc

SEQ ID NO: 665243 - DNA, 25 bp, Mus musculus
gtacactaactatgtcttgcccatc

SEQ ID NO: 665244 - DNA, 25 bp, Mus musculus
gtacactaatgcctgcacttgctgc

SEQ ID NO: 665245 - DNA, 25 bp, Mus musculus
gtacactaatgcgtgcacttgctgc

SEQ ID NO: 665246 - DNA, 25 bp, Mus musculus
gtacactaccgcatccatgggaaat

SEQ ID NO: 665247 - DNA, 25 bp, Mus musculus
gtacactaccgcttccatgggaaat

SEQ ID NO: 665248 - DNA, 25 bp, Mus musculus
gtacactactaaaattcactgtggg

SEQ ID NO: 665249 - DNA, 25 bp, Mus musculus
gtacactactaatattcactgtggg

SEQ ID NO: 665250 - DNA, 25 bp, Mus musculus
gtacactatagaaaccttcagacga

SEQ ID NO: 665251 - DNA, 25 bp, Mus musculus
gtacactatagataccttcagacga

SEQ ID NO: 665252 - DNA, 25 bp, Mus musculus
gtacactatcttattaagctacaag

SEQ ID NO: 665253 - DNA, 25 bp, Mus musculus
gtacactatctttttaagctacaag

SEQ ID NO: 665254 - DNA, 25 bp, Mus musculus
gtacactattaactcaccaggcatt

SEQ ID NO: 665255 - DNA, 25 bp, Mus musculus
gtacactattaagtcaccaggcatt

SEQ ID NO: 665256 - DNA, 25 bp, Mus musculus
gtacactcaaggctgggtagcttct

SEQ ID NO: 665257 - DNA, 25 bp, Mus musculus
gtacactcaagggtgggtagcttct

SEQ ID NO: 665258 - DNA, 25 bp, Mus musculus
gtacactcaatcactcttgttcttg

SEQ ID NO: 665259 - DNA, 25 bp, Mus musculus
gtacactcaatctctcttgttcttg

SEQ ID NO: 665260 - DNA, 25 bp, Mus musculus
gtacactcaccacaggaaaccacag

SEQ ID NO: 665261 - DNA, 25 bp, Mus musculus
gtacactcaccagaggaaaccacag

SEQ ID NO: 665262 - DNA, 25 bp, Mus musculus
gtacactcacctacatggacattta

SEQ ID NO: 665263 - DNA, 25 bp, Mus musculus
gtacactcaccttcatggacattta

SEQ ID NO: 665264 - DNA, 25 bp, Mus musculus
gtacactcactcacttaacattgtg

SEQ ID NO: 665265 - DNA, 25 bp, Mus musculus
gtacactcactctcttaacattgtg

SEQ ID NO: 665266 - DNA, 25 bp, Mus musculus
gtacactcacttaaactttgttttg

SEQ ID NO: 665267 - DNA, 25 bp, Mus musculus
gtacactcactttaactttgttttg

SEQ ID NO: 665268 - DNA, 25 bp, Mus musculus
gtacactcagagaaggcaagaccaa

SEQ ID NO: 665269 - DNA, 25 bp, Mus musculus
gtacactcagagtaggcaagaccaa

SEQ ID NO: 665270 - DNA, 25 bp, Mus musculus
gtacactcagcaaatgtgcctcttg

SEQ ID NO: 665271 - DNA, 25 bp, Mus musculus
gtacactcagcatatgtgcctcttg

SEQ ID NO: 665272 - DNA, 25 bp, Mus musculus
gtacactcagccactatgctagatg

SEQ ID NO: 665273 - DNA, 25 bp, Mus musculus
gtacactcagcctctatgctagatg

SEQ ID NO: 665274 - DNA, 25 bp, Mus musculus
gtacactcaggtactgagctagcct

SEQ ID NO: 665275 - DNA, 25 bp, Mus musculus
gtacactcaggttctgagctagcct

SEQ ID NO: 665276 - DNA, 25 bp, Mus musculus
gtacactcatctactgatgctgcgg

SEQ ID NO: 665277 - DNA, 25 bp, Mus musculus
gtacactcatcttctgatgctgcgg

SEQ ID NO: 665278 - DNA, 25 bp, Mus musculus
gtacactccaaaagttacttcttca

SEQ ID NO: 665279 - DNA, 25 bp, Mus musculus
gtacactccaaatgttacttcttca

SEQ ID NO: 665280 - DNA, 25 bp, Mus musculus
gtacactctgtactgttttaacaat

SEQ ID NO: 665281 - DNA, 25 bp, Mus musculus
gtacactctgtagtgttttaacaat

SEQ ID NO: 665282 - DNA, 25 bp, Mus musculus
gtacactctgttcgcttggtagggt

SEQ ID NO: 665283 - DNA, 25 bp, Mus musculus
gtacactctgttggcttggtagggt

SEQ ID NO: 665284 - DNA, 25 bp, Mus musculus
gtacactgaaataattttctccttg

SEQ ID NO: 665285 - DNA, 25 bp, Mus musculus
gtacactgaaatctcacttgcacaa

SEQ ID NO: 665286 - DNA, 25 bp, Mus musculus
gtacactgaaatgtcacttgcacaa

SEQ ID NO: 665287 - DNA, 25 bp, Mus musculus
gtacactgaaattattttctccttg

SEQ ID NO: 665288 - DNA, 25 bp, Mus musculus
gtacactgaactaacaaaaagcctt

SEQ ID NO: 665289 - DNA, 25 bp, Mus musculus
gtacactgaacttacaaaaagcctt

SEQ ID NO: 665290 - DNA, 25 bp, Mus musculus
gtacactgaataaaattctagctag

SEQ ID NO: 665291 - DNA, 25 bp, Mus musculus
gtacactgaatataattctagctag

SEQ ID NO: 665292 - DNA, 25 bp, Mus musculus
gtacactgacacctttaatgataca

SEQ ID NO: 665293 - DNA, 25 bp, Mus musculus
gtacactgacacgtttaatgataca

SEQ ID NO: 665294 - DNA, 25 bp, Mus musculus
gtacactgagaaaatgcgttggttt

SEQ ID NO: 665295 - DNA, 25 bp, Mus musculus
gtacactgagaatatgcgttggttt

SEQ ID NO: 665296 - DNA, 25 bp, Mus musculus
gtacactgcctgataacttgtgcac

SEQ ID NO: 665297 - DNA, 25 bp, Mus musculus
gtacactgcctgttaacttgtgcac

SEQ ID NO: 665298 - DNA, 25 bp, Mus musculus
gtacactggctcagtgtaaacagtg

SEQ ID NO: 665299 - DNA, 25 bp, Mus musculus
gtacactggctctgtgtaaacagtg

SEQ ID NO: 665300 - DNA, 25 bp, Mus musculus
gtacactggctgaaaatgatgctaa

SEQ ID NO: 665301 - DNA, 25 bp, Mus musculus
gtacactggctgtaaatgatgctaa

SEQ ID NO: 665302 - DNA, 25 bp, Mus musculus
gtacactgggttcaggtaccagtaa

SEQ ID NO: 665303 - DNA, 25 bp, Mus musculus
gtacactgggttgaggtaccagtaa

SEQ ID NO: 665304 - DNA, 25 bp, Mus musculus
gtacactggtacctcggtcgctgtt

SEQ ID NO: 665305 - DNA, 25 bp, Mus musculus
gtacactggtacgtcggtcgctgtt

SEQ ID NO: 665306 - DNA, 25 bp, Mus musculus
gtacactgtaacacactagaacctt

SEQ ID NO: 665307 - DNA, 25 bp, Mus musculus
gtacactgtaactcactagaacctt

SEQ ID NO: 665308 - DNA, 25 bp, Mus musculus
gtacactgtgcgaagttatattttc

SEQ ID NO: 665309 - DNA, 25 bp, Mus musculus
gtacactgtgcgtagttatattttc

SEQ ID NO: 665310 - DNA, 25 bp, Mus musculus
gtacactgtgctaccttgggaattt

SEQ ID NO: 665311 - DNA, 25 bp, Mus musculus
gtacactgtgcttccttgggaattt

SEQ ID NO: 665312 - DNA, 25 bp, Mus musculus
gtacactgtgtacctgggattcctt

SEQ ID NO: 665313 - DNA, 25 bp, Mus musculus
gtacactgtgtacttcctcatataa

SEQ ID NO: 665314 - DNA, 25 bp, Mus musculus
gtacactgtgtagctgggattcctt

SEQ ID NO: 665315 - DNA, 25 bp, Mus musculus
gtacactgtgtagttcctcatataa

SEQ ID NO: 665316 - DNA, 25 bp, Mus musculus
gtacactgtgttccaagagcacatg

SEQ ID NO: 665317 - DNA, 25 bp, Mus musculus
gtacactgtgttgcaagagcacatg

SEQ ID NO: 665318 - DNA, 25 bp, Mus musculus
gtacacttaagcctagaatttctct

SEQ ID NO: 665319 - DNA, 25 bp, Mus musculus
gtacacttaagcgtagaatttctct

SEQ ID NO: 665320 - DNA, 25 bp, Mus musculus
gtacacttagtgcttccagaactga

SEQ ID NO: 665321 - DNA, 25 bp, Mus musculus
gtacacttagtggttccagaactga

SEQ ID NO: 665322 - DNA, 25 bp, Mus musculus
gtacacttagttagtctgagaccct

SEQ ID NO: 665323 - DNA, 25 bp, Mus musculus
gtacacttagtttgtctgagaccct

SEQ ID NO: 665324 - DNA, 25 bp, Mus musculus
gtacacttccatattatgtattaat

SEQ ID NO: 665325 - DNA, 25 bp, Mus musculus
gtacacttccattttatgtattaat

SEQ ID NO: 665326 - DNA, 25 bp, Mus musculus
gtacacttctacagtctacgctaat

SEQ ID NO: 665327 - DNA, 25 bp, Mus musculus
gtacacttctactgtctacgctaat

SEQ ID NO: 665328 - DNA, 25 bp, Mus musculus
gtacacttgaccactgcattcatgt

SEQ ID NO: 665329 - DNA, 25 bp, Mus musculus
gtacacttgacctctgcattcatgt

SEQ ID NO: 665330 - DNA, 25 bp, Mus musculus
gtacacttgagaaaccctgagagct

SEQ ID NO: 665331 - DNA, 25 bp, Mus musculus
gtacacttgagataccctgagagct

SEQ ID NO: 665332 - DNA, 25 bp, Mus musculus
gtacacttgagtcccttggtttggc

SEQ ID NO: 665333 - DNA, 25 bp, Mus musculus
gtacacttgagtgccttggtttggc

SEQ ID NO: 665334 - DNA, 25 bp, Mus musculus
gtacacttggctagagcgctgggct

SEQ ID NO: 665335 - DNA, 25 bp, Mus musculus
gtacacttggcttgagcgctgggct

SEQ ID NO: 665336 - DNA, 25 bp, Mus musculus
gtacactttaccacccagggtgtgg

SEQ ID NO: 665337 - DNA, 25 bp, Mus musculus
gtacactttacctcccagggtgtgg

SEQ ID NO: 665338 - DNA, 25 bp, Mus musculus
gtacactttactcacttggctctga

SEQ ID NO: 665339 - DNA, 25 bp, Mus musculus
gtacactttactgacttggctctga

SEQ ID NO: 665340 - DNA, 25 bp, Mus musculus
gtacactttgagaatctttccacat

SEQ ID NO: 665341 - DNA, 25 bp, Mus musculus
gtacactttgagtatctttccacat

SEQ ID NO: 665342 - DNA, 25 bp, Mus musculus
gtacactttgccactgctataaaat

SEQ ID NO: 665343 - DNA, 25 bp, Mus musculus
gtacactttgcctctgctataaaat

SEQ ID NO: 665344 - DNA, 25 bp, Mus musculus
gtacacttttgtccacacgtcttta

SEQ ID NO: 665345 - DNA, 25 bp, Mus musculus
gtacacttttgtgcacacgtcttta

SEQ ID NO: 665346 - DNA, 25 bp, Mus musculus
gtacagaaacataccagagcccgcc

SEQ ID NO: 665347 - DNA, 25 bp, Mus musculus
gtacagaaacattccagagcccgcc

SEQ ID NO: 665348 - DNA, 25 bp, Mus musculus
gtacagaaatatatggtggcaaaac

SEQ ID NO: 665349 - DNA, 25 bp, Mus musculus
gtacagaaatatttggtggcaaaac

SEQ ID NO: 665350 - DNA, 25 bp, Mus musculus
gtacagaacacgatgtgcttcttct

SEQ ID NO: 665351 - DNA, 25 bp, Mus musculus
gtacagaacacgttgtgcttcttct

SEQ ID NO: 665352 - DNA, 25 bp, Mus musculus
gtacagaacttaatcccattcctag

SEQ ID NO: 665353 - DNA, 25 bp, Mus musculus
gtacagaacttattcccattcctag

SEQ ID NO: 665354 - DNA, 25 bp, Mus musculus
gtacagaacttcacatcagatcctt

SEQ ID NO: 665355 - DNA, 25 bp, Mus musculus
gtacagaacttctcatcagatcctt

SEQ ID NO: 665356 - DNA, 25 bp, Mus musculus
gtacagaagcctacagaccaggcag

SEQ ID NO: 665357 - DNA, 25 bp, Mus musculus
gtacagaagccttcagaccaggcag

SEQ ID NO: 665358 - DNA, 25 bp, Mus musculus
gtacagaaggaacccatcctgcctt

SEQ ID NO: 665359 - DNA, 25 bp, Mus musculus
gtacagaaggaagccatcctgcctt

SEQ ID NO: 665360 - DNA, 25 bp, Mus musculus
gtacagaagtcaagttttcaccaga

SEQ ID NO: 665361 - DNA, 25 bp, Mus musculus
gtacagaagtcatgttttcaccaga

SEQ ID NO: 665362 - DNA, 25 bp, Mus musculus
gtacagaatgaccaggtggcagctt

SEQ ID NO: 665363 - DNA, 25 bp, Mus musculus
gtacagaatgacgaggtggcagctt

SEQ ID NO: 665364 - DNA, 25 bp, Mus musculus
gtacagacacaaccgggccagcaaa

SEQ ID NO: 665365 - DNA, 25 bp, Mus musculus
gtacagacacaagcgggccagcaaa

SEQ ID NO: 665366 - DNA, 25 bp, Mus musculus
gtacagacagacactgactgcttct

SEQ ID NO: 665367 - DNA, 25 bp, Mus musculus
gtacagacagactctgactgcttct

SEQ ID NO: 665368 - DNA, 25 bp, Mus musculus
gtacagacagcaatccttgtccaac

SEQ ID NO: 665369 - DNA, 25 bp, Mus musculus
gtacagacagcattccttgtccaac

SEQ ID NO: 665370 - DNA, 25 bp, Mus musculus
gtacagacagctatcctttttgtaa

SEQ ID NO: 665371 - DNA, 25 bp, Mus musculus
gtacagacagctttcctttttgtaa

SEQ ID NO: 665372 - DNA, 25 bp, Mus musculus
gtacagacaggaagacagcccacat

SEQ ID NO: 665373 - DNA, 25 bp, Mus musculus
gtacagacaggacgaacgacacata

SEQ ID NO: 665374 - DNA, 25 bp, Mus musculus
gtacagacaggaggaacgacacata

SEQ ID NO: 665375 - DNA, 25 bp, Mus musculus
gtacagacaggatgacagcccacat

SEQ ID NO: 665376 - DNA, 25 bp, Mus musculus
gtacagacagtacctctaacttgta

SEQ ID NO: 665377 - DNA, 25 bp, Mus musculus
gtacagacagtagctctaacttgta

SEQ ID NO: 665378 - DNA, 25 bp, Mus musculus
gtacagacagtgacattaattcatt

SEQ ID NO: 665379 - DNA, 25 bp, Mus musculus
gtacagacagtgtcattaattcatt

SEQ ID NO: 665380 - DNA, 25 bp, Mus musculus
gtacagacagttccactacaccaaa

SEQ ID NO: 665381 - DNA, 25 bp, Mus musculus
gtacagacagttgcactacaccaaa

SEQ ID NO: 665382 - DNA, 25 bp, Mus musculus
gtacagaccccaagaccggatgcct

SEQ ID NO: 665383 - DNA, 25 bp, Mus musculus
gtacagaccccatgaccggatgcct

SEQ ID NO: 665384 - DNA, 25 bp, Mus musculus
gtacagacccctcgtgtctggtgaa

SEQ ID NO: 665385 - DNA, 25 bp, Mus musculus
gtacagacccctggtgtctggtgaa

SEQ ID NO: 665386 - DNA, 25 bp, Mus musculus
gtacagacctcaacagtttaaggca

SEQ ID NO: 665387 - DNA, 25 bp, Mus musculus
gtacagacctcatcagtttaaggca

SEQ ID NO: 665388 - DNA, 25 bp, Mus musculus
gtacagacctgaatatatagtgcat

SEQ ID NO: 665389 - DNA, 25 bp, Mus musculus
gtacagacctgattatatagtgcat

SEQ ID NO: 665390 - DNA, 25 bp, Mus musculus
gtacagacctgtaagtacaggctta

SEQ ID NO: 665391 - DNA, 25 bp, Mus musculus
gtacagacctgttagtacaggctta

SEQ ID NO: 665392 - DNA, 25 bp, Mus musculus
gtacagacgccacactgaggtggtt

SEQ ID NO: 665393 - DNA, 25 bp, Mus musculus
gtacagacgccagactgaggtggtt

SEQ ID NO: 665394 - DNA, 25 bp, Mus musculus
gtacagacggacatcaaacatggtt

SEQ ID NO: 665395 - DNA, 25 bp, Mus musculus
gtacagacggacttcaaacatggtt

SEQ ID NO: 665396 - DNA, 25 bp, Mus musculus
gtacagactatgacctacgacagtt

SEQ ID NO: 665397 - DNA, 25 bp, Mus musculus
gtacagactatgtcctacgacagtt

SEQ ID NO: 665398 - DNA, 25 bp, Mus musculus
gtacagactcaacaggcacaggtgg

SEQ ID NO: 665399 - DNA, 25 bp, Mus musculus
gtacagactcaagaggcacaggtgg

SEQ ID NO: 665400 - DNA, 25 bp, Mus musculus
gtacagactcagattttcttatgtt

SEQ ID NO: 665401 - DNA, 25 bp, Mus musculus
gtacagactcagtttttcttatgtt

SEQ ID NO: 665402 - DNA, 25 bp, Mus musculus
gtacagactgtgagatacaagtatg

SEQ ID NO: 665403 - DNA, 25 bp, Mus musculus
gtacagactgtgtgatacaagtatg

SEQ ID NO: 665404 - DNA, 25 bp, Mus musculus
gtacagactgttcttttcaagctac

SEQ ID NO: 665405 - DNA, 25 bp, Mus musculus
gtacagactgttgttttcaagctac

SEQ ID NO: 665406 - DNA, 25 bp, Mus musculus
gtacagacttcaaccaaatttactg

SEQ ID NO: 665407 - DNA, 25 bp, Mus musculus
gtacagacttcatccaaatttactg

SEQ ID NO: 665408 - DNA, 25 bp, Mus musculus
gtacagacttggattccctatcctc

SEQ ID NO: 665409 - DNA, 25 bp, Mus musculus
gtacagacttggtttccctatcctc

SEQ ID NO: 665410 - DNA, 25 bp, Mus musculus
gtacagactttcatctggcaacaga

SEQ ID NO: 665411 - DNA, 25 bp, Mus musculus
gtacagactttcttctggcaacaga

SEQ ID NO: 665412 - DNA, 25 bp, Mus musculus
gtacagagacccagtgcattgcgtg

SEQ ID NO: 665413 - DNA, 25 bp, Mus musculus
gtacagagaccctgtgcattgcgtg

SEQ ID NO: 665414 - DNA, 25 bp, Mus musculus
gtacagagacgaccttttatttcag

SEQ ID NO: 665415 - DNA, 25 bp, Mus musculus
gtacagagacgagcttttatttcag

SEQ ID NO: 665416 - DNA, 25 bp, Mus musculus
gtacagagcaatctctgagcactgt

SEQ ID NO: 665417 - DNA, 25 bp, Mus musculus
gtacagagcaatgtctgagcactgt

SEQ ID NO: 665418 - DNA, 25 bp, Mus musculus
gtacagagcccaagaatacctcaga

SEQ ID NO: 665419 - DNA, 25 bp, Mus musculus
gtacagagcccatgaatacctcaga

SEQ ID NO: 665420 - DNA, 25 bp, Mus musculus
gtacagagctcaccttaggctctaa

SEQ ID NO: 665421 - DNA, 25 bp, Mus musculus
gtacagagctcagcttaggctctaa

SEQ ID NO: 665422 - DNA, 25 bp, Mus musculus
gtacagagctccatcagagtactgg

SEQ ID NO: 665423 - DNA, 25 bp, Mus musculus
gtacagagctccttcagagtactgg

SEQ ID NO: 665424 - DNA, 25 bp, Mus musculus
gtacagagctgtcgtccaggtgcca

SEQ ID NO: 665425 - DNA, 25 bp, Mus musculus
gtacagagctgtggtccaggtgcca

SEQ ID NO: 665426 - DNA, 25 bp, Mus musculus
gtacagaggcacactgttcaacaga

SEQ ID NO: 665427 - DNA, 25 bp, Mus musculus
gtacagaggcactctgttcaacaga

SEQ ID NO: 665428 - DNA, 25 bp, Mus musculus
gtacagaggcatcacacccacttta

SEQ ID NO: 665429 - DNA, 25 bp, Mus musculus
gtacagaggcatgacacccacttta

SEQ ID NO: 665430 - DNA, 25 bp, Mus musculus
gtacagaggccacatgatagagttc

SEQ ID NO: 665431 - DNA, 25 bp, Mus musculus
gtacagaggccagatgatagagttc

SEQ ID NO: 665432 - DNA, 25 bp, Mus musculus
gtacagaggcgacatttaaatattt

SEQ ID NO: 665433 - DNA, 25 bp, Mus musculus
gtacagaggcgagatttaaatattt

SEQ ID NO: 665434 - DNA, 25 bp, Mus musculus
gtacagaggtttacactggttctat

SEQ ID NO: 665435 - DNA, 25 bp, Mus musculus
gtacagaggttttcactggttctat

SEQ ID NO: 665436 - DNA, 25 bp, Mus musculus
gtacagagtcataacccagtgtgaa

SEQ ID NO: 665437 - DNA, 25 bp, Mus musculus
gtacagagtcattacccagtgtgaa

SEQ ID NO: 665438 - DNA, 25 bp, Mus musculus
gtacagagtctaagcctggcatcac

SEQ ID NO: 665439 - DNA, 25 bp, Mus musculus
gtacagagtctatgcctggcatcac

SEQ ID NO: 665440 - DNA, 25 bp, Mus musculus
gtacagagtgctcattcagttcctg

SEQ ID NO: 665441 - DNA, 25 bp, Mus musculus
gtacagagtgctgattcagttcctg

SEQ ID NO: 665442 - DNA, 25 bp, Mus musculus
gtacagataccaccattaaagcaat

SEQ ID NO: 665443 - DNA, 25 bp, Mus musculus
gtacagataccagcattaaagcaat

SEQ ID NO: 665444 - DNA, 25 bp, Mus musculus
gtacagatagctcagtgcgcctatt

SEQ ID NO: 665445 - DNA, 25 bp, Mus musculus
gtacagatagctgagtgcgcctatt

SEQ ID NO: 665446 - DNA, 25 bp, Mus musculus
gtacagatatttcatagttccagtg

SEQ ID NO: 665447 - DNA, 25 bp, Mus musculus
gtacagatatttgatagttccagtg

SEQ ID NO: 665448 - DNA, 25 bp, Mus musculus
gtacagatcattctcaacaacccaa

SEQ ID NO: 665449 - DNA, 25 bp, Mus musculus
gtacagatcattgtcaacaacccaa

SEQ ID NO: 665450 - DNA, 25 bp, Mus musculus
gtacagatcctgactacaacatcgg

SEQ ID NO: 665451 - DNA, 25 bp, Mus musculus
gtacagatcctgtctacaacatcgg

SEQ ID NO: 665452 - DNA, 25 bp, Mus musculus
gtacagatctacagagaggcccaaa

SEQ ID NO: 665453 - DNA, 25 bp, Mus musculus
gtacagatctactgagaggcccaaa

SEQ ID NO: 665454 - DNA, 25 bp, Mus musculus
gtacagatcttgaattccagtgcca

SEQ ID NO: 665455 - DNA, 25 bp, Mus musculus
gtacagatcttgtattccagtgcca

SEQ ID NO: 665456 - DNA, 25 bp, Mus musculus
gtacagatgcacacatgaagccaca

SEQ ID NO: 665457 - DNA, 25 bp, Mus musculus
gtacagatgcactcatgaagccaca

SEQ ID NO: 665458 - DNA, 25 bp, Mus musculus
gtacagatgctgcaagacgccatca

SEQ ID NO: 665459 - DNA, 25 bp, Mus musculus
gtacagatgctggaagacgccatca

SEQ ID NO: 665460 - DNA, 25 bp, Mus musculus
gtacagattcatagcttatcccatg

SEQ ID NO: 665461 - DNA, 25 bp, Mus musculus
gtacagattcattgcttatcccatg

SEQ ID NO: 665462 - DNA, 25 bp, Mus musculus
gtacagatttgtacatttgtgtaat

SEQ ID NO: 665463 - DNA, 25 bp, Mus musculus
gtacagatttgttcatttgtgtaat

SEQ ID NO: 665464 - DNA, 25 bp, Mus musculus
gtacagatttttctatagctgatga

SEQ ID NO: 665465 - DNA, 25 bp, Mus musculus
gtacagatttttgtatagctgatga

SEQ ID NO: 665466 - DNA, 25 bp, Mus musculus
gtacagcaaagcctgacatttggat

SEQ ID NO: 665467 - DNA, 25 bp, Mus musculus
gtacagcaaagcgtgacatttggat

SEQ ID NO: 665468 - DNA, 25 bp, Mus musculus
gtacagcaatcaatagagactttca

SEQ ID NO: 665469 - DNA, 25 bp, Mus musculus
gtacagcaatcattagagactttca

SEQ ID NO: 665470 - DNA, 25 bp, Mus musculus
gtacagcaccggcactttggagtga

SEQ ID NO: 665471 - DNA, 25 bp, Mus musculus
gtacagcaccgggactttggagtga

SEQ ID NO: 665472 - DNA, 25 bp, Mus musculus
gtacagcacgcaattgaccaactta

SEQ ID NO: 665473 - DNA, 25 bp, Mus musculus
gtacagcacgcatttgaccaactta

SEQ ID NO: 665474 - DNA, 25 bp, Mus musculus
gtacagcacttccattaacttttga

SEQ ID NO: 665475 - DNA, 25 bp, Mus musculus
gtacagcacttcgattaacttttga

SEQ ID NO: 665476 - DNA, 25 bp, Mus musculus
gtacagcagaacatccatccagaaa

SEQ ID NO: 665477 - DNA, 25 bp, Mus musculus
gtacagcagaacttccatccagaaa

SEQ ID NO: 665478 - DNA, 25 bp, Mus musculus
gtacagcagagtcgcctacaggaca

SEQ ID NO: 665479 - DNA, 25 bp, Mus musculus
gtacagcagagtggcctacaggaca

SEQ ID NO: 665480 - DNA, 25 bp, Mus musculus
gtacagcagcctcatccggaatctg

SEQ ID NO: 665481 - DNA, 25 bp, Mus musculus
gtacagcagcctgatccggaatctg

SEQ ID NO: 665482 - DNA, 25 bp, Mus musculus
gtacagcagctcactttggcaaagt

SEQ ID NO: 665483 - DNA, 25 bp, Mus musculus
gtacagcagctctctttggcaaagt

SEQ ID NO: 665484 - DNA, 25 bp, Mus musculus
gtacagcagctgacaacgatggcaa

SEQ ID NO: 665485 - DNA, 25 bp, Mus musculus
gtacagcagctgtcaacgatggcaa

SEQ ID NO: 665486 - DNA, 25 bp, Mus musculus
gtacagcatcagacaacttctactt

SEQ ID NO: 665487 - DNA, 25 bp, Mus musculus
gtacagcatcagtcaacttctactt

SEQ ID NO: 665488 - DNA, 25 bp, Mus musculus
gtacagcatgtaatattctagggca

SEQ ID NO: 665489 - DNA, 25 bp, Mus musculus
gtacagcatgtattattctagggca

SEQ ID NO: 665490 - DNA, 25 bp, Mus musculus
gtacagcatgtgaccactccaagac

SEQ ID NO: 665491 - DNA, 25 bp, Mus musculus
gtacagcatgtgtccactccaagac

SEQ ID NO: 665492 - DNA, 25 bp, Mus musculus
gtacagcatgttacagacctccttg

SEQ ID NO: 665493 - DNA, 25 bp, Mus musculus
gtacagcatgtttcagacctccttg

SEQ ID NO: 665494 - DNA, 25 bp, Mus musculus
gtacagcatttaatggtgctcatct

SEQ ID NO: 665495 - DNA, 25 bp, Mus musculus
gtacagcatttattggtgctcatct

SEQ ID NO: 665496 - DNA, 25 bp, Mus musculus
gtacagccaagtcactgtgcagcgc

SEQ ID NO: 665497 - DNA, 25 bp, Mus musculus
gtacagccaagtgactgtgcagcgc

SEQ ID NO: 665498 - DNA, 25 bp, Mus musculus
gtacagccaatgaccttaagtgcat

SEQ ID NO: 665499 - DNA, 25 bp, Mus musculus
gtacagccaatgtccttaagtgcat

SEQ ID NO: 665500 - DNA, 25 bp, Mus musculus
gtacagccacccaaagggctatagt

SEQ ID NO: 665501 - DNA, 25 bp, Mus musculus
gtacagccaccctaagggctatagt

SEQ ID NO: 665502 - DNA, 25 bp, Mus musculus
gtacagccagagatcttgtgcgact

SEQ ID NO: 665503 - DNA, 25 bp, Mus musculus
gtacagccagagttcttgtgcgact

SEQ ID NO: 665504 - DNA, 25 bp, Mus musculus
gtacagcccagaaatgattgtgaga

SEQ ID NO: 665505 - DNA, 25 bp, Mus musculus
gtacagcccagatatgattgtgaga

SEQ ID NO: 665506 - DNA, 25 bp, Mus musculus
gtacagcccaggctctctgtattca

SEQ ID NO: 665507 - DNA, 25 bp, Mus musculus
gtacagcccagggtctctgtattca

SEQ ID NO: 665508 - DNA, 25 bp, Mus musculus
gtacagccccggaagaagcgtctca

SEQ ID NO: 665509 - DNA, 25 bp, Mus musculus
gtacagccccggtagaagcgtctca

SEQ ID NO: 665510 - DNA, 25 bp, Mus musculus
gtacagcccctgagctgagggcctg

SEQ ID NO: 665511 - DNA, 25 bp, Mus musculus
gtacagcccctgtgctgagggcctg

SEQ ID NO: 665512 - DNA, 25 bp, Mus musculus
gtacagccctggagagacccggaag

SEQ ID NO: 665513 - DNA, 25 bp, Mus musculus
gtacagccctggtgagacccggaag

SEQ ID NO: 665514 - DNA, 25 bp, Mus musculus
gtacagccgcatcgggttcacggct

SEQ ID NO: 665515 - DNA, 25 bp, Mus musculus
gtacagccgcatggggttcacggct

SEQ ID NO: 665516 - DNA, 25 bp, Mus musculus
gtacagccggagcttggacaacaat

SEQ ID NO: 665517 - DNA, 25 bp, Mus musculus
gtacagccggaggttggacaacaat

SEQ ID NO: 665518 - DNA, 25 bp, Mus musculus
gtacagcctcttaatgtcaacgttg

SEQ ID NO: 665519 - DNA, 25 bp, Mus musculus
gtacagcctctttatgtcaacgttg

SEQ ID NO: 665520 - DNA, 25 bp, Mus musculus
gtacagccttgcaggcggcgtcgac

SEQ ID NO: 665521 - DNA, 25 bp, Mus musculus
gtacagccttgctggcggcgtcgac

SEQ ID NO: 665522 - DNA, 25 bp, Mus musculus
gtacagccttggcagttctggaact

SEQ ID NO: 665523 - DNA, 25 bp, Mus musculus
gtacagccttgggagttctggaact

SEQ ID NO: 665524 - DNA, 25 bp, Mus musculus
gtacagcgctaaagtatttttcata

SEQ ID NO: 665525 - DNA, 25 bp, Mus musculus
gtacagcgctaatgtatttttcata

SEQ ID NO: 665526 - DNA, 25 bp, Mus musculus
gtacagcgtatcatggacacggaca

SEQ ID NO: 665527 - DNA, 25 bp, Mus musculus
gtacagcgtatcttggacacggaca

SEQ ID NO: 665528 - DNA, 25 bp, Mus musculus
gtacagcgtattcacgcaatactct

SEQ ID NO: 665529 - DNA, 25 bp, Mus musculus
gtacagcgtattgacgcaatactct

SEQ ID NO: 665530 - DNA, 25 bp, Mus musculus
gtacagcgtcatataggctttgcct

SEQ ID NO: 665531 - DNA, 25 bp, Mus musculus
gtacagcgtcatttaggctttgcct

SEQ ID NO: 665532 - DNA, 25 bp, Mus musculus
gtacagctaaagagtggaccccaga

SEQ ID NO: 665533 - DNA, 25 bp, Mus musculus
gtacagctaaagtgtggaccccaga

SEQ ID NO: 665534 - DNA, 25 bp, Mus musculus
gtacagctacagagatgactactac

SEQ ID NO: 665535 - DNA, 25 bp, Mus musculus
gtacagctacagtgatgactactac

SEQ ID NO: 665536 - DNA, 25 bp, Mus musculus
gtacagctacatatacatactcata

SEQ ID NO: 665537 - DNA, 25 bp, Mus musculus
gtacagctacatttacatactcata

SEQ ID NO: 665538 - DNA, 25 bp, Mus musculus
gtacagctaccgagcgggcgccact

SEQ ID NO: 665539 - DNA, 25 bp, Mus musculus
gtacagctaccgtgcgggcgccact

SEQ ID NO: 665540 - DNA, 25 bp, Mus musculus
gtacagctcaagaagggtcctttcc

SEQ ID NO: 665541 - DNA, 25 bp, Mus musculus
gtacagctcaagtagggtcctttcc

SEQ ID NO: 665542 - DNA, 25 bp, Mus musculus
gtacagctcaggactatactgggat

SEQ ID NO: 665543 - DNA, 25 bp, Mus musculus
gtacagctcaggtctatactgggat

SEQ ID NO: 665544 - DNA, 25 bp, Mus musculus
gtacagctcattccaggtatctgaa

SEQ ID NO: 665545 - DNA, 25 bp, Mus musculus
gtacagctcattgcaggtatctgaa

SEQ ID NO: 665546 - DNA, 25 bp, Mus musculus
gtacagctccataaagactgctcga

SEQ ID NO: 665547 - DNA, 25 bp, Mus musculus
gtacagctccattaagactgctcga

SEQ ID NO: 665548 - DNA, 25 bp, Mus musculus
gtacagctctccaaacttattcatg

SEQ ID NO: 665549 - DNA, 25 bp, Mus musculus
gtacagctctcctaacttattcatg

SEQ ID NO: 665550 - DNA, 25 bp, Mus musculus
gtacagctgtgtccgtgcatacaaa

SEQ ID NO: 665551 - DNA, 25 bp, Mus musculus
gtacagctgtgtgcgtgcatacaaa

SEQ ID NO: 665552 - DNA, 25 bp, Mus musculus
gtacagcttagaaggttagaacgat

SEQ ID NO: 665553 - DNA, 25 bp, Mus musculus
gtacagcttagaatccctctgagga

SEQ ID NO: 665554 - DNA, 25 bp, Mus musculus
gtacagcttagatggttagaacgat

SEQ ID NO: 665555 - DNA, 25 bp, Mus musculus
gtacagcttagattccctctgagga

SEQ ID NO: 665556 - DNA, 25 bp, Mus musculus
gtacaggaacacagtcccagaacta

SEQ ID NO: 665557 - DNA, 25 bp, Mus musculus
gtacaggaacactgtcccagaacta

SEQ ID NO: 665558 - DNA, 25 bp, Mus musculus
gtacaggaaccaaaggacatgactt

SEQ ID NO: 665559 - DNA, 25 bp, Mus musculus
gtacaggaaccataggacatgactt

SEQ ID NO: 665560 - DNA, 25 bp, Mus musculus
gtacaggaactgactgtgcaactta

SEQ ID NO: 665561 - DNA, 25 bp, Mus musculus
gtacaggaactgtctgtgcaactta

SEQ ID NO: 665562 - DNA, 25 bp, Mus musculus
gtacaggaagcacctgagttccttc

SEQ ID NO: 665563 - DNA, 25 bp, Mus musculus
gtacaggaagcagctgagttccttc

SEQ ID NO: 665564 - DNA, 25 bp, Mus musculus
gtacaggacagtagaacaccgtgga

SEQ ID NO: 665565 - DNA, 25 bp, Mus musculus
gtacaggacagttgaacaccgtgga

SEQ ID NO: 665566 - DNA, 25 bp, Mus musculus
gtacaggactttcctccagatcgtt

SEQ ID NO: 665567 - DNA, 25 bp, Mus musculus
gtacaggactttgctccagatcgtt

SEQ ID NO: 665568 - DNA, 25 bp, Mus musculus
gtacaggaggcaaggctctcaactg

SEQ ID NO: 665569 - DNA, 25 bp, Mus musculus
gtacaggaggcatggctctcaactg

SEQ ID NO: 665570 - DNA, 25 bp, Mus musculus
gtacaggagttcatgcaatgagcat

SEQ ID NO: 665571 - DNA, 25 bp, Mus musculus
gtacaggagttcttgcaatgagcat

SEQ ID NO: 665572 - DNA, 25 bp, Mus musculus
gtacaggataatagtcattacccaa

SEQ ID NO: 665573 - DNA, 25 bp, Mus musculus
gtacaggataattgtcattacccaa

SEQ ID NO: 665574 - DNA, 25 bp, Mus musculus
gtacaggatacgctgaatcggtaat

SEQ ID NO: 665575 - DNA, 25 bp, Mus musculus
gtacaggatacggtgaatcggtaat

SEQ ID NO: 665576 - DNA, 25 bp, Mus musculus
gtacaggatctgatgtgcttgaatg

SEQ ID NO: 665577 - DNA, 25 bp, Mus musculus
gtacaggatctgttgtgcttgaatg

SEQ ID NO: 665578 - DNA, 25 bp, Mus musculus
gtacaggatgtgagtcaggcgcaaa

SEQ ID NO: 665579 - DNA, 25 bp, Mus musculus
gtacaggatgtgtgtcaggcgcaaa

SEQ ID NO: 665580 - DNA, 25 bp, Mus musculus
gtacaggcaataagcatccctaagg

SEQ ID NO: 665581 - DNA, 25 bp, Mus musculus
gtacaggcaatatgcatccctaagg

SEQ ID NO: 665582 - DNA, 25 bp, Mus musculus
gtacaggcagcgatgcttctatcaa

SEQ ID NO: 665583 - DNA, 25 bp, Mus musculus
gtacaggcagcgttgcttctatcaa

SEQ ID NO: 665584 - DNA, 25 bp, Mus musculus
gtacaggcagtacatgaatcgaaaa

SEQ ID NO: 665585 - DNA, 25 bp, Mus musculus
gtacaggcagtagatgaatcgaaaa

SEQ ID NO: 665586 - DNA, 25 bp, Mus musculus
gtacaggcagtgagtctacttcgta

SEQ ID NO: 665587 - DNA, 25 bp, Mus musculus
gtacaggcagtgtgtctacttcgta

SEQ ID NO: 665588 - DNA, 25 bp, Mus musculus
gtacaggcatgacatcttgatgttc

SEQ ID NO: 665589 - DNA, 25 bp, Mus musculus
gtacaggcatgagatcttgatgttc

SEQ ID NO: 665590 - DNA, 25 bp, Mus musculus
gtacaggccattaagatcctaggaa

SEQ ID NO: 665591 - DNA, 25 bp, Mus musculus
gtacaggccatttagatcctaggaa

SEQ ID NO: 665592 - DNA, 25 bp, Mus musculus
gtacaggcccgtaaattcatttcat

SEQ ID NO: 665593 - DNA, 25 bp, Mus musculus
gtacaggcccgttaattcatttcat

SEQ ID NO: 665594 - DNA, 25 bp, Mus musculus
gtacaggcctcaacaaggacttaaa

SEQ ID NO: 665595 - DNA, 25 bp, Mus musculus
gtacaggcctcatcaaggacttaaa

SEQ ID NO: 665596 - DNA, 25 bp, Mus musculus
gtacaggcggccctggaaacaagtt

SEQ ID NO: 665597 - DNA, 25 bp, Mus musculus
gtacaggcggccgtggaaacaagtt

SEQ ID NO: 665598 - DNA, 25 bp, Mus musculus
gtacaggcggcgcacgcagtcttca

SEQ ID NO: 665599 - DNA, 25 bp, Mus musculus
gtacaggcggcggacgcagtcttca

SEQ ID NO: 665600 - DNA, 25 bp, Mus musculus
gtacaggctacaacattgcttacga

SEQ ID NO: 665601 - DNA, 25 bp, Mus musculus
gtacaggctacatcattgcttacga

SEQ ID NO: 665602 - DNA, 25 bp, Mus musculus
gtacaggctagaagacaaccagtat

SEQ ID NO: 665603 - DNA, 25 bp, Mus musculus
gtacaggctagacaggacttcataa

SEQ ID NO: 665604 - DNA, 25 bp, Mus musculus
gtacaggctagagaggacttcataa

SEQ ID NO: 665605 - DNA, 25 bp, Mus musculus
gtacaggctagatgacaaccagtat

SEQ ID NO: 665606 - DNA, 25 bp, Mus musculus
gtacaggctcttcagaaaccaaccg

SEQ ID NO: 665607 - DNA, 25 bp, Mus musculus
gtacaggctcttgagaaaccaaccg

SEQ ID NO: 665608 - DNA, 25 bp, Mus musculus
gtacaggctgagcatcccttattga

SEQ ID NO: 665609 - DNA, 25 bp, Mus musculus
gtacaggctgaggatcccttattga

SEQ ID NO: 665610 - DNA, 25 bp, Mus musculus
gtacaggctggacagatgctttctt

SEQ ID NO: 665611 - DNA, 25 bp, Mus musculus
gtacaggctggagagatgctttctt

SEQ ID NO: 665612 - DNA, 25 bp, Mus musculus
gtacaggcttcaaacgcactagcat

SEQ ID NO: 665613 - DNA, 25 bp, Mus musculus
gtacaggcttcatacgcactagcat

SEQ ID NO: 665614 - DNA, 25 bp, Mus musculus
gtacaggctttaaatcaagatttga

SEQ ID NO: 665615 - DNA, 25 bp, Mus musculus
gtacaggctttatatcaagatttga

SEQ ID NO: 665616 - DNA, 25 bp, Mus musculus
gtacagggaacaaggaataaaggaa

SEQ ID NO: 665617 - DNA, 25 bp, Mus musculus
gtacagggaacatggaataaaggaa

SEQ ID NO: 665618 - DNA, 25 bp, Mus musculus
gtacagggcccaactattggtgaat

SEQ ID NO: 665619 - DNA, 25 bp, Mus musculus
gtacagggcccatctattggtgaat

SEQ ID NO: 665620 - DNA, 25 bp, Mus musculus
gtacagggctgtaacatctggattt

SEQ ID NO: 665621 - DNA, 25 bp, Mus musculus
gtacagggctgttacatctggattt

SEQ ID NO: 665622 - DNA, 25 bp, Mus musculus
gtacagggcttgagcttctcgtgac

SEQ ID NO: 665623 - DNA, 25 bp, Mus musculus
gtacagggcttgtgcttctcgtgac

SEQ ID NO: 665624 - DNA, 25 bp, Mus musculus
gtacagggtcctacttaatagtgct

SEQ ID NO: 665625 - DNA, 25 bp, Mus musculus
gtacagggtccttcttaatagtgct

SEQ ID NO: 665626 - DNA, 25 bp, Mus musculus
gtacagggtgacagtcgttcttaca

SEQ ID NO: 665627 - DNA, 25 bp, Mus musculus
gtacagggtgactgtcgttcttaca

SEQ ID NO: 665628 - DNA, 25 bp, Mus musculus
gtacagggtgccagatagattggaa

SEQ ID NO: 665629 - DNA, 25 bp, Mus musculus
gtacagggtgcctgatagattggaa

SEQ ID NO: 665630 - DNA, 25 bp, Mus musculus
gtacagggttctatgttacctccat

SEQ ID NO: 665631 - DNA, 25 bp, Mus musculus
gtacagggttctttgttacctccat

SEQ ID NO: 665632 - DNA, 25 bp, Mus musculus
gtacagggtttaagtcaccaccttc

SEQ ID NO: 665633 - DNA, 25 bp, Mus musculus
gtacagggtttatgtcaccaccttc

SEQ ID NO: 665634 - DNA, 25 bp, Mus musculus
gtacaggtcaaaatgatcatcgttt

SEQ ID NO: 665635 - DNA, 25 bp, Mus musculus
gtacaggtcaaattgatcatcgttt

SEQ ID NO: 665636 - DNA, 25 bp, Mus musculus
gtacaggtgacgactttagtgttca

SEQ ID NO: 665637 - DNA, 25 bp, Mus musculus
gtacaggtgacgtctttagtgttca

SEQ ID NO: 665638 - DNA, 25 bp, Mus musculus
gtacaggtgactctgagcctcccag

SEQ ID NO: 665639 - DNA, 25 bp, Mus musculus
gtacaggtgactgtgagcctcccag

SEQ ID NO: 665640 - DNA, 25 bp, Mus musculus
gtacaggttacactgcttgaccact

SEQ ID NO: 665641 - DNA, 25 bp, Mus musculus
gtacaggttacagtgcttgaccact

SEQ ID NO: 665642 - DNA, 25 bp, Mus musculus
gtacaggttataagcccaggagtat

SEQ ID NO: 665643 - DNA, 25 bp, Mus musculus
gtacaggttatatgcccaggagtat

SEQ ID NO: 665644 - DNA, 25 bp, Mus musculus
gtacaggttccaatctcaaatataa

SEQ ID NO: 665645 - DNA, 25 bp, Mus musculus
gtacaggttccattctcaaatataa

SEQ ID NO: 665646 - DNA, 25 bp, Mus musculus
gtacaggttctaccttgcaaaggct

SEQ ID NO: 665647 - DNA, 25 bp, Mus musculus
gtacaggttctagcttgcaaaggct

SEQ ID NO: 665648 - DNA, 25 bp, Mus musculus
gtacaggttgagagcgcttatagac

SEQ ID NO: 665649 - DNA, 25 bp, Mus musculus
gtacaggttgagtgcgcttatagac

SEQ ID NO: 665650 - DNA, 25 bp, Mus musculus
gtacaggttgatacgtaatacattt

SEQ ID NO: 665651 - DNA, 25 bp, Mus musculus
gtacaggttgattcgtaatacattt

SEQ ID NO: 665652 - DNA, 25 bp, Mus musculus
gtacaggttgtgctagtcaccctta

SEQ ID NO: 665653 - DNA, 25 bp, Mus musculus
gtacaggttgtggtagtcaccctta

SEQ ID NO: 665654 - DNA, 25 bp, Mus musculus
gtacaggtttgcatgggcttcatct

SEQ ID NO: 665655 - DNA, 25 bp, Mus musculus
gtacaggtttgcttgggcttcatct

SEQ ID NO: 665656 - DNA, 25 bp, Mus musculus
gtacagtaaagacgcttccaagcat

SEQ ID NO: 665657 - DNA, 25 bp, Mus musculus
gtacagtaaagaggcttccaagcat

SEQ ID NO: 665658 - DNA, 25 bp, Mus musculus
gtacagtaacatccaagagcccttc

SEQ ID NO: 665659 - DNA, 25 bp, Mus musculus
gtacagtaacatgcaagagcccttc

SEQ ID NO: 665660 - DNA, 25 bp, Mus musculus
gtacagtactcgcattttaggaaat

SEQ ID NO: 665661 - DNA, 25 bp, Mus musculus
gtacagtactcggattttaggaaat

SEQ ID NO: 665662 - DNA, 25 bp, Mus musculus
gtacagtagcagatttttctcttaa

SEQ ID NO: 665663 - DNA, 25 bp, Mus musculus
gtacagtagcagttttttctcttaa

SEQ ID NO: 665664 - DNA, 25 bp, Mus musculus
gtacagtagcctcaatgggatcaca

SEQ ID NO: 665665 - DNA, 25 bp, Mus musculus
gtacagtagcctgaatgggatcaca

SEQ ID NO: 665666 - DNA, 25 bp, Mus musculus
gtacagtaggccaagtttcatccta

SEQ ID NO: 665667 - DNA, 25 bp, Mus musculus
gtacagtaggcctagtttcatccta

SEQ ID NO: 665668 - DNA, 25 bp, Mus musculus
gtacagtatcaaccactttcaagtc

SEQ ID NO: 665669 - DNA, 25 bp, Mus musculus
gtacagtatcaagcactttcaagtc

SEQ ID NO: 665670 - DNA, 25 bp, Mus musculus
gtacagtatgtaaagttggcccaca

SEQ ID NO: 665671 - DNA, 25 bp, Mus musculus
gtacagtatgtatagttggcccaca

SEQ ID NO: 665672 - DNA, 25 bp, Mus musculus
gtacagtattttccctactaagttg

SEQ ID NO: 665673 - DNA, 25 bp, Mus musculus
gtacagtattttgcctactaagttg

SEQ ID NO: 665674 - DNA, 25 bp, Mus musculus
gtacagtcaagtcacatgctagggt

SEQ ID NO: 665675 - DNA, 25 bp, Mus musculus
gtacagtcaagtgacatgctagggt

SEQ ID NO: 665676 - DNA, 25 bp, Mus musculus
gtacagtcaatacctggagcgccta

SEQ ID NO: 665677 - DNA, 25 bp, Mus musculus
gtacagtcaatagctggagcgccta

SEQ ID NO: 665678 - DNA, 25 bp, Mus musculus
gtacagtcactaaggaaatcagctt

SEQ ID NO: 665679 - DNA, 25 bp, Mus musculus
gtacagtcactatggaaatcagctt

SEQ ID NO: 665680 - DNA, 25 bp, Mus musculus
gtacagtcagccaagccagaaatag

SEQ ID NO: 665681 - DNA, 25 bp, Mus musculus
gtacagtcagcctagccagaaatag

SEQ ID NO: 665682 - DNA, 25 bp, Mus musculus
gtacagtcagctatcaaccgaccaa

SEQ ID NO: 665683 - DNA, 25 bp, Mus musculus
gtacagtcagctttcaaccgaccaa

SEQ ID NO: 665684 - DNA, 25 bp, Mus musculus
gtacagtcattcaagaaaccaccat

SEQ ID NO: 665685 - DNA, 25 bp, Mus musculus
gtacagtcattctagaaaccaccat

SEQ ID NO: 665686 - DNA, 25 bp, Mus musculus
gtacagtccgtcacattacttttta

SEQ ID NO: 665687 - DNA, 25 bp, Mus musculus
gtacagtccgtctcattacttttta

SEQ ID NO: 665688 - DNA, 25 bp, Mus musculus
gtacagtcgcaacacaaggtcttct

SEQ ID NO: 665689 - DNA, 25 bp, Mus musculus
gtacagtcgcaagacaaggtcttct

SEQ ID NO: 665690 - DNA, 25 bp, Mus musculus
gtacagtcgccaagagtcacagtga

SEQ ID NO: 665691 - DNA, 25 bp, Mus musculus
gtacagtcgccatgagtcacagtga

SEQ ID NO: 665692 - DNA, 25 bp, Mus musculus
gtacagtcgcctcaagaagctctga

SEQ ID NO: 665693 - DNA, 25 bp, Mus musculus
gtacagtcgcctgaagaagctctga

SEQ ID NO: 665694 - DNA, 25 bp, Mus musculus
gtacagtctctcagcagaacctggt

SEQ ID NO: 665695 - DNA, 25 bp, Mus musculus
gtacagtctctctgcagaacctggt

SEQ ID NO: 665696 - DNA, 25 bp, Mus musculus
gtacagtctctgaggcttggttgag

SEQ ID NO: 665697 - DNA, 25 bp, Mus musculus
gtacagtctctgtggcttggttgag

SEQ ID NO: 665698 - DNA, 25 bp, Mus musculus
gtacagtctcttattatctactaaa

SEQ ID NO: 665699 - DNA, 25 bp, Mus musculus
gtacagtctctttttatctactaaa

SEQ ID NO: 665700 - DNA, 25 bp, Mus musculus
gtacagtctgtacatacgtcctgga

SEQ ID NO: 665701 - DNA, 25 bp, Mus musculus
gtacagtctgtagatacgtcctgga

SEQ ID NO: 665702 - DNA, 25 bp, Mus musculus
gtacagtgacatcattgcaacccct

SEQ ID NO: 665703 - DNA, 25 bp, Mus musculus
gtacagtgacatgattgcaacccct

SEQ ID NO: 665704 - DNA, 25 bp, Mus musculus
gtacagtgccacatctaagaggaaa

SEQ ID NO: 665705 - DNA, 25 bp, Mus musculus
gtacagtgccacttctaagaggaaa

SEQ ID NO: 665706 - DNA, 25 bp, Mus musculus
gtacagtggaaacttgtaggcccat

SEQ ID NO: 665707 - DNA, 25 bp, Mus musculus
gtacagtggaaagttgtaggcccat

SEQ ID NO: 665708 - DNA, 25 bp, Mus musculus
gtacagtggactatcctgaagggct

SEQ ID NO: 665709 - DNA, 25 bp, Mus musculus
gtacagtggactttcctgaagggct

SEQ ID NO: 665710 - DNA, 25 bp, Mus musculus
gtacagtggctgagcacgtgcttca

SEQ ID NO: 665711 - DNA, 25 bp, Mus musculus
gtacagtggctgtgcacgtgcttca

SEQ ID NO: 665712 - DNA, 25 bp, Mus musculus
gtacagtgggatcttgcttcatctc

SEQ ID NO: 665713 - DNA, 25 bp, Mus musculus
gtacagtgggatgttgcttcatctc

SEQ ID NO: 665714 - DNA, 25 bp, Mus musculus
gtacagtggtgacaacattaaacgt

SEQ ID NO: 665715 - DNA, 25 bp, Mus musculus
gtacagtggtgagaacattaaacgt

SEQ ID NO: 665716 - DNA, 25 bp, Mus musculus
gtacagtggtgtccgttggttttat

SEQ ID NO: 665717 - DNA, 25 bp, Mus musculus
gtacagtggtgtgcgttggttttat

SEQ ID NO: 665718 - DNA, 25 bp, Mus musculus
gtacagtgtaccagatcagatccga

SEQ ID NO: 665719 - DNA, 25 bp, Mus musculus
gtacagtgtacctgatcagatccga

SEQ ID NO: 665720 - DNA, 25 bp, Mus musculus
gtacagtgtagcaggattgtttccg

SEQ ID NO: 665721 - DNA, 25 bp, Mus musculus
gtacagtgtagctggattgtttccg

SEQ ID NO: 665722 - DNA, 25 bp, Mus musculus
gtacagtgtgccagagtgggccaat

SEQ ID NO: 665723 - DNA, 25 bp, Mus musculus
gtacagtgtgcctgagtgggccaat

SEQ ID NO: 665724 - DNA, 25 bp, Mus musculus
gtacagtgtgtgacttgtgtcttca

SEQ ID NO: 665725 - DNA, 25 bp, Mus musculus
gtacagtgtgtgtcttgtgtcttca

SEQ ID NO: 665726 - DNA, 25 bp, Mus musculus
gtacagtgtgttacaaagtcttcca

SEQ ID NO: 665727 - DNA, 25 bp, Mus musculus
gtacagtgtgtttcaaagtcttcca

SEQ ID NO: 665728 - DNA, 25 bp, Mus musculus
gtacagtgttatatactccagttca

SEQ ID NO: 665729 - DNA, 25 bp, Mus musculus
gtacagtgttatttactccagttca

SEQ ID NO: 665730 - DNA, 25 bp, Mus musculus
gtacagtgtttaattggcatgcatc

SEQ ID NO: 665731 - DNA, 25 bp, Mus musculus
gtacagtgtttatttggcatgcatc

SEQ ID NO: 665732 - DNA, 25 bp, Mus musculus
gtacagtgtttgagagatgctcttt

SEQ ID NO: 665733 - DNA, 25 bp, Mus musculus
gtacagtgtttgcatatttctcatg

SEQ ID NO: 665734 - DNA, 25 bp, Mus musculus
gtacagtgtttggatatttctcatg

SEQ ID NO: 665735 - DNA, 25 bp, Mus musculus
gtacagtgtttgtgagatgctcttt

SEQ ID NO: 665736 - DNA, 25 bp, Mus musculus
gtacagttacagagttctttactta

SEQ ID NO: 665737 - DNA, 25 bp, Mus musculus
gtacagttacagctacaaccagtat

SEQ ID NO: 665738 - DNA, 25 bp, Mus musculus
gtacagttacaggtacaaccagtat

SEQ ID NO: 665739 - DNA, 25 bp, Mus musculus
gtacagttacagtgttctttactta

SEQ ID NO: 665740 - DNA, 25 bp, Mus musculus
gtacagttactaatacaccacgagt

SEQ ID NO: 665741 - DNA, 25 bp, Mus musculus
gtacagttactattacaccacgagt

SEQ ID NO: 665742 - DNA, 25 bp, Mus musculus
gtacagttacttcatgttcacccgt

SEQ ID NO: 665743 - DNA, 25 bp, Mus musculus
gtacagttacttgatgttcacccgt

SEQ ID NO: 665744 - DNA, 25 bp, Mus musculus
gtacagttagttccaagcgcagtaa

SEQ ID NO: 665745 - DNA, 25 bp, Mus musculus
gtacagttagttgcaagcgcagtaa

SEQ ID NO: 665746 - DNA, 25 bp, Mus musculus
gtacagttattcaagcttcctaaga

SEQ ID NO: 665747 - DNA, 25 bp, Mus musculus
gtacagttattctagcttcctaaga

SEQ ID NO: 665748 - DNA, 25 bp, Mus musculus
gtacagttcagaaccatgcgccgag

SEQ ID NO: 665749 - DNA, 25 bp, Mus musculus
gtacagttcagacaagactccttca

SEQ ID NO: 665750 - DNA, 25 bp, Mus musculus
gtacagttcagagaagactccttca

SEQ ID NO: 665751 - DNA, 25 bp, Mus musculus
gtacagttcagatccatgcgccgag

SEQ ID NO: 665752 - DNA, 25 bp, Mus musculus
gtacagttcctcatgaagttgcatt

SEQ ID NO: 665753 - DNA, 25 bp, Mus musculus
gtacagttcctcttgaagttgcatt

SEQ ID NO: 665754 - DNA, 25 bp, Mus musculus
gtacagttctaacagcagtgcgttc

SEQ ID NO: 665755 - DNA, 25 bp, Mus musculus
gtacagttctaagagcagtgcgttc

SEQ ID NO: 665756 - DNA, 25 bp, Mus musculus
gtacagttcttaatccgaggcagct

SEQ ID NO: 665757 - DNA, 25 bp, Mus musculus
gtacagttcttattccgaggcagct

SEQ ID NO: 665758 - DNA, 25 bp, Mus musculus
gtacagttggcactcacacatcaga

SEQ ID NO: 665759 - DNA, 25 bp, Mus musculus
gtacagttggcagtcacacatcaga

SEQ ID NO: 665760 - DNA, 25 bp, Mus musculus
gtacagttgtcacacgtgccataga

SEQ ID NO: 665761 - DNA, 25 bp, Mus musculus
gtacagttgtcagacgtgccataga

SEQ ID NO: 665762 - DNA, 25 bp, Mus musculus
gtacagttgttaattgtctataaat

SEQ ID NO: 665763 - DNA, 25 bp, Mus musculus
gtacagttgttatttgtctataaat

SEQ ID NO: 665764 - DNA, 25 bp, Mus musculus
gtacagttgttgctgaacattcaca

SEQ ID NO: 665765 - DNA, 25 bp, Mus musculus
gtacagttgttggtgaacattcaca

SEQ ID NO: 665766 - DNA, 25 bp, Mus musculus
gtacagtttcccaatctggccttgg

SEQ ID NO: 665767 - DNA, 25 bp, Mus musculus
gtacagtttccccagtaagacacca

SEQ ID NO: 665768 - DNA, 25 bp, Mus musculus
gtacagtttcccgagtaagacacca

SEQ ID NO: 665769 - DNA, 25 bp, Mus musculus
gtacagtttccctatctggccttgg

SEQ ID NO: 665770 - DNA, 25 bp, Mus musculus
gtacagtttggtagtgtttgaatta

SEQ ID NO: 665771 - DNA, 25 bp, Mus musculus
gtacagtttggttgtgtttgaatta

SEQ ID NO: 665772 - DNA, 25 bp, Mus musculus
gtacagttttagagactctcaccca

SEQ ID NO: 665773 - DNA, 25 bp, Mus musculus
gtacagttttagtgactctcaccca

SEQ ID NO: 665774 - DNA, 25 bp, Mus musculus
gtacagttttccattctcctggcta

SEQ ID NO: 665775 - DNA, 25 bp, Mus musculus
gtacagttttccctggaccactgga

SEQ ID NO: 665776 - DNA, 25 bp, Mus musculus
gtacagttttccgtggaccactgga

SEQ ID NO: 665777 - DNA, 25 bp, Mus musculus
gtacagttttcctttctcctggcta

SEQ ID NO: 665778 - DNA, 25 bp, Mus musculus
gtacagttttgccatacggatgaca

SEQ ID NO: 665779 - DNA, 25 bp, Mus musculus
gtacagttttgcgatacggatgaca

SEQ ID NO: 665780 - DNA, 25 bp, Mus musculus
gtacataaaatcaatggcggccaag

SEQ ID NO: 665781 - DNA, 25 bp, Mus musculus
gtacataaaatctatggcggccaag

SEQ ID NO: 665782 - DNA, 25 bp, Mus musculus
gtacataactggattcttttctaat

SEQ ID NO: 665783 - DNA, 25 bp, Mus musculus
gtacataactggtttcttttctaat

SEQ ID NO: 665784 - DNA, 25 bp, Mus musculus
gtacataactgtcactcaagaaggt

SEQ ID NO: 665785 - DNA, 25 bp, Mus musculus
gtacataactgtgactcaagaaggt

SEQ ID NO: 665786 - DNA, 25 bp, Mus musculus
gtacataagacacttccggtgtggt

SEQ ID NO: 665787 - DNA, 25 bp, Mus musculus
gtacataagacagttccggtgtggt

SEQ ID NO: 665788 - DNA, 25 bp, Mus musculus
gtacataaggcaagaccaacggcaa

SEQ ID NO: 665789 - DNA, 25 bp, Mus musculus
gtacataaggcatgaccaacggcaa

SEQ ID NO: 665790 - DNA, 25 bp, Mus musculus
gtacataatcccattcagtctgaat

SEQ ID NO: 665791 - DNA, 25 bp, Mus musculus
gtacataatccctttcagtctgaat

SEQ ID NO: 665792 - DNA, 25 bp, Mus musculus
gtacataatccgatgatgttgtcaa

SEQ ID NO: 665793 - DNA, 25 bp, Mus musculus
gtacataatccgatgcttaaccttt

SEQ ID NO: 665794 - DNA, 25 bp, Mus musculus
gtacataatccgttgatgttgtcaa

SEQ ID NO: 665795 - DNA, 25 bp, Mus musculus
gtacataatccgttgcttaaccttt

SEQ ID NO: 665796 - DNA, 25 bp, Mus musculus
gtacataatgccacggaccatggtg

SEQ ID NO: 665797 - DNA, 25 bp, Mus musculus
gtacataatgcctcggaccatggtg

SEQ ID NO: 665798 - DNA, 25 bp, Mus musculus
gtacataatgcgagcataccacttt

SEQ ID NO: 665799 - DNA, 25 bp, Mus musculus
gtacataatgcgtgcataccacttt

SEQ ID NO: 665800 - DNA, 25 bp, Mus musculus
gtacataattacaccctgcattgtt

SEQ ID NO: 665801 - DNA, 25 bp, Mus musculus
gtacataattactccctgcattgtt

SEQ ID NO: 665802 - DNA, 25 bp, Mus musculus
gtacataattctagctacgaacgtt

SEQ ID NO: 665803 - DNA, 25 bp, Mus musculus
gtacataattcttgctacgaacgtt

SEQ ID NO: 665804 - DNA, 25 bp, Mus musculus
gtacataattttaggcacataacat

SEQ ID NO: 665805 - DNA, 25 bp, Mus musculus
gtacataatttttggcacataacat

SEQ ID NO: 665806 - DNA, 25 bp, Mus musculus
gtacataccactatcctttaacatc

SEQ ID NO: 665807 - DNA, 25 bp, Mus musculus
gtacataccactttcctttaacatc

SEQ ID NO: 665808 - DNA, 25 bp, Mus musculus
gtacatacccacatagatgtgcata

SEQ ID NO: 665809 - DNA, 25 bp, Mus musculus
gtacatacccacttagatgtgcata

SEQ ID NO: 665810 - DNA, 25 bp, Mus musculus
gtacatacccagatgatgctgctgt

SEQ ID NO: 665811 - DNA, 25 bp, Mus musculus
gtacatacccagttgatgctgctgt

SEQ ID NO: 665812 - DNA, 25 bp, Mus musculus
gtacatacctctctttgcttattta

SEQ ID NO: 665813 - DNA, 25 bp, Mus musculus
gtacatacctctgtttgcttattta

SEQ ID NO: 665814 - DNA, 25 bp, Mus musculus
gtacatacctgtatgttccagtctc

SEQ ID NO: 665815 - DNA, 25 bp, Mus musculus
gtacatacctgtttgttccagtctc

SEQ ID NO: 665816 - DNA, 25 bp, Mus musculus
gtacatactctgagttagactcccc

SEQ ID NO: 665817 - DNA, 25 bp, Mus musculus
gtacatactctgtgttagactcccc

SEQ ID NO: 665818 - DNA, 25 bp, Mus musculus
gtacatacttagaccattaccgtta

SEQ ID NO: 665819 - DNA, 25 bp, Mus musculus
gtacatacttagcacagcacttggg

SEQ ID NO: 665820 - DNA, 25 bp, Mus musculus
gtacatacttaggacagcacttggg

SEQ ID NO: 665821 - DNA, 25 bp, Mus musculus
gtacatacttagtccattaccgtta

SEQ ID NO: 665822 - DNA, 25 bp, Mus musculus
gtacatacttcactttttcctgaaa

SEQ ID NO: 665823 - DNA, 25 bp, Mus musculus
gtacatacttcagtttttcctgaaa

SEQ ID NO: 665824 - DNA, 25 bp, Mus musculus
gtacatacttttagttttgcacatc

SEQ ID NO: 665825 - DNA, 25 bp, Mus musculus
gtacatactttttgttttgcacatc

SEQ ID NO: 665826 - DNA, 25 bp, Mus musculus
gtacatagaaacctctgacccagaa

SEQ ID NO: 665827 - DNA, 25 bp, Mus musculus
gtacatagaaacgtctgacccagaa

SEQ ID NO: 665828 - DNA, 25 bp, Mus musculus
gtacatagccacaagactatccctg

SEQ ID NO: 665829 - DNA, 25 bp, Mus musculus
gtacatagccactagactatccctg

SEQ ID NO: 665830 - DNA, 25 bp, Mus musculus
gtacataggtagcttccattttatt

SEQ ID NO: 665831 - DNA, 25 bp, Mus musculus
gtacataggtaggttccattttatt

SEQ ID NO: 665832 - DNA, 25 bp, Mus musculus
gtacatagtatccattaacccaggg

SEQ ID NO: 665833 - DNA, 25 bp, Mus musculus
gtacatagtatcgattaacccaggg

SEQ ID NO: 665834 - DNA, 25 bp, Mus musculus
gtacatagtccacagcatacctgac

SEQ ID NO: 665835 - DNA, 25 bp, Mus musculus
gtacatagtccagagcatacctgac

SEQ ID NO: 665836 - DNA, 25 bp, Mus musculus
gtacatagtccgcaaattattgtgg

SEQ ID NO: 665837 - DNA, 25 bp, Mus musculus
gtacatagtccggaaattattgtgg

SEQ ID NO: 665838 - DNA, 25 bp, Mus musculus
gtacatagttgtacggactaaatat

SEQ ID NO: 665839 - DNA, 25 bp, Mus musculus
gtacatagttgttcggactaaatat

SEQ ID NO: 665840 - DNA, 25 bp, Mus musculus
gtacatataaccacttaagcagctg

SEQ ID NO: 665841 - DNA, 25 bp, Mus musculus
gtacatataacctcttaagcagctg

SEQ ID NO: 665842 - DNA, 25 bp, Mus musculus
gtacatatacatacccagtcaaatt

SEQ ID NO: 665843 - DNA, 25 bp, Mus musculus
gtacatatacattcccagtcaaatt

SEQ ID NO: 665844 - DNA, 25 bp, Mus musculus
gtacatatcaagagagtgtgctgtt

SEQ ID NO: 665845 - DNA, 25 bp, Mus musculus
gtacatatcaagtgagtgtgctgtt

SEQ ID NO: 665846 - DNA, 25 bp, Mus musculus
gtacatatcgtgacggtagggctat

SEQ ID NO: 665847 - DNA, 25 bp, Mus musculus
gtacatatcgtgtcggtagggctat

SEQ ID NO: 665848 - DNA, 25 bp, Mus musculus
gtacatatctatataaagccaggag

SEQ ID NO: 665849 - DNA, 25 bp, Mus musculus
gtacatatctatcgagtgcgcctgc

SEQ ID NO: 665850 - DNA, 25 bp, Mus musculus
gtacatatctatggagtgcgcctgc

SEQ ID NO: 665851 - DNA, 25 bp, Mus musculus
gtacatatctatttaaagccaggag

SEQ ID NO: 665852 - DNA, 25 bp, Mus musculus
gtacatatctccctgtacatacgga

SEQ ID NO: 665853 - DNA, 25 bp, Mus musculus
gtacatatctccgtgtacatacgga

SEQ ID NO: 665854 - DNA, 25 bp, Mus musculus
gtacatatcttaattgttccttaca

SEQ ID NO: 665855 - DNA, 25 bp, Mus musculus
gtacatatcttatttgttccttaca

SEQ ID NO: 665856 - DNA, 25 bp, Mus musculus
gtacatatcttgctatatctttcca

SEQ ID NO: 665857 - DNA, 25 bp, Mus musculus
gtacatatcttggtatatctttcca

SEQ ID NO: 665858 - DNA, 25 bp, Mus musculus
gtacatatgcacacttatgcgcaca

SEQ ID NO: 665859 - DNA, 25 bp, Mus musculus
gtacatatgcactcttatgcgcaca

SEQ ID NO: 665860 - DNA, 25 bp, Mus musculus
gtacatatgtgtacagatgctcgca

SEQ ID NO: 665861 - DNA, 25 bp, Mus musculus
gtacatatgtgttcagatgctcgca

SEQ ID NO: 665862 - DNA, 25 bp, Mus musculus
gtacatattacaagccccagtggga

SEQ ID NO: 665863 - DNA, 25 bp, Mus musculus
gtacatattacatgccccagtggga

SEQ ID NO: 665864 - DNA, 25 bp, Mus musculus
gtacatattagccacaacagattgg

SEQ ID NO: 665865 - DNA, 25 bp, Mus musculus
gtacatattagcgacaacagattgg

SEQ ID NO: 665866 - DNA, 25 bp, Mus musculus
gtacatattattattagcatctcag

SEQ ID NO: 665867 - DNA, 25 bp, Mus musculus
gtacatattatttttagcatctcag

SEQ ID NO: 665868 - DNA, 25 bp, Mus musculus
gtacatattcacagtttgcagctga

SEQ ID NO: 665869 - DNA, 25 bp, Mus musculus
gtacatattcactgtttgcagctga

SEQ ID NO: 665870 - DNA, 25 bp, Mus musculus
gtacatattcgacttacttctccta

SEQ ID NO: 665871 - DNA, 25 bp, Mus musculus
gtacatattcgagttacttctccta

SEQ ID NO: 665872 - DNA, 25 bp, Mus musculus
gtacatattgacagcccacttttag

SEQ ID NO: 665873 - DNA, 25 bp, Mus musculus
gtacatattgacagtcagctttcag

SEQ ID NO: 665874 - DNA, 25 bp, Mus musculus
gtacatattgactgcccacttttag

SEQ ID NO: 665875 - DNA, 25 bp, Mus musculus
gtacatattgactgtcagctttcag

SEQ ID NO: 665876 - DNA, 25 bp, Mus musculus
gtacatatttcaaaccttgctcata

SEQ ID NO: 665877 - DNA, 25 bp, Mus musculus
gtacatatttcataccttgctcata

SEQ ID NO: 665878 - DNA, 25 bp, Mus musculus
gtacatatttgcaaagtgttgcttt

SEQ ID NO: 665879 - DNA, 25 bp, Mus musculus
gtacatatttgctaagtgttgcttt

SEQ ID NO: 665880 - DNA, 25 bp, Mus musculus
gtacatatttggcttctatctgaaa

SEQ ID NO: 665881 - DNA, 25 bp, Mus musculus
gtacatatttgggttctatctgaaa

SEQ ID NO: 665882 - DNA, 25 bp, Mus musculus
gtacatattttccacagatgacata

SEQ ID NO: 665883 - DNA, 25 bp, Mus musculus
gtacatattttcgacagatgacata

SEQ ID NO: 665884 - DNA, 25 bp, Mus musculus
gtacatcaaagcatttctaacccat

SEQ ID NO: 665885 - DNA, 25 bp, Mus musculus
gtacatcaaagcttttctaacccat

SEQ ID NO: 665886 - DNA, 25 bp, Mus musculus
gtacatcaaatgcattggtgtccaa

SEQ ID NO: 665887 - DNA, 25 bp, Mus musculus
gtacatcaaatggattggtgtccaa

SEQ ID NO: 665888 - DNA, 25 bp, Mus musculus
gtacatcaactaagaccagctggag

SEQ ID NO: 665889 - DNA, 25 bp, Mus musculus
gtacatcaactatgaccagctggag

SEQ ID NO: 665890 - DNA, 25 bp, Mus musculus
gtacatcaagaccaacaacatcctg

SEQ ID NO: 665891 - DNA, 25 bp, Mus musculus
gtacatcaagacgaacaacatcctg

SEQ ID NO: 665892 - DNA, 25 bp, Mus musculus
gtacatcaagtaaacaagggctgga

SEQ ID NO: 665893 - DNA, 25 bp, Mus musculus
gtacatcaagtatacaagggctgga

SEQ ID NO: 665894 - DNA, 25 bp, Mus musculus
gtacatcacatcaaggcctgacaga

SEQ ID NO: 665895 - DNA, 25 bp, Mus musculus
gtacatcacatctaggcctgacaga

SEQ ID NO: 665896 - DNA, 25 bp, Mus musculus
gtacatcactgtcgtcaggccatga

SEQ ID NO: 665897 - DNA, 25 bp, Mus musculus
gtacatcactgtggtcaggccatga

SEQ ID NO: 665898 - DNA, 25 bp, Mus musculus
gtacatcagcacctcacaagcagag

SEQ ID NO: 665899 - DNA, 25 bp, Mus musculus
gtacatcagcacgtcacaagcagag

SEQ ID NO: 665900 - DNA, 25 bp, Mus musculus
gtacatcagctacaaatacagccat

SEQ ID NO: 665901 - DNA, 25 bp, Mus musculus
gtacatcagctagaaatacagccat

SEQ ID NO: 665902 - DNA, 25 bp, Mus musculus
gtacatcagctcctgaagcagtgtg

SEQ ID NO: 665903 - DNA, 25 bp, Mus musculus
gtacatcagctcgtgaagcagtgtg

SEQ ID NO: 665904 - DNA, 25 bp, Mus musculus
gtacatcagtcaatgctgtcaccat

SEQ ID NO: 665905 - DNA, 25 bp, Mus musculus
gtacatcagtcattgctgtcaccat

SEQ ID NO: 665906 - DNA, 25 bp, Mus musculus
gtacatcatgtgagtaccaggtact

SEQ ID NO: 665907 - DNA, 25 bp, Mus musculus
gtacatcatgtgtgtaccaggtact

SEQ ID NO: 665908 - DNA, 25 bp, Mus musculus
gtacatcatgttatccaccgacaag

SEQ ID NO: 665909 - DNA, 25 bp, Mus musculus
gtacatcatgttttccaccgacaag

SEQ ID NO: 665910 - DNA, 25 bp, Mus musculus
gtacatccaagcctattaataaaat

SEQ ID NO: 665911 - DNA, 25 bp, Mus musculus
gtacatccaagcgtattaataaaat

SEQ ID NO: 665912 - DNA, 25 bp, Mus musculus
gtacatccaggtatagttgccccaa

SEQ ID NO: 665913 - DNA, 25 bp, Mus musculus
gtacatccaggtttagttgccccaa

SEQ ID NO: 665914 - DNA, 25 bp, Mus musculus
gtacatccatcacaaaaagctctca

SEQ ID NO: 665915 - DNA, 25 bp, Mus musculus
gtacatccatcagaaaaagctctca

SEQ ID NO: 665916 - DNA, 25 bp, Mus musculus
gtacatccatgcctgtatctgcacc

SEQ ID NO: 665917 - DNA, 25 bp, Mus musculus
gtacatccatgcgtgtatctgcacc

SEQ ID NO: 665918 - DNA, 25 bp, Mus musculus
gtacatcccaatcatacactcgtca

SEQ ID NO: 665919 - DNA, 25 bp, Mus musculus
gtacatcccaatgatacactcgtca

SEQ ID NO: 665920 - DNA, 25 bp, Mus musculus
gtacatcccataatctgtatgatct

SEQ ID NO: 665921 - DNA, 25 bp, Mus musculus
gtacatcccatattctgtatgatct

SEQ ID NO: 665922 - DNA, 25 bp, Mus musculus
gtacatccccagcttgacttaaatg

SEQ ID NO: 665923 - DNA, 25 bp, Mus musculus
gtacatccccaggttgacttaaatg

SEQ ID NO: 665924 - DNA, 25 bp, Mus musculus
gtacatccctctcagcagtttatgg

SEQ ID NO: 665925 - DNA, 25 bp, Mus musculus
gtacatccctctgagcagtttatgg

SEQ ID NO: 665926 - DNA, 25 bp, Mus musculus
gtacatccctgacaagcgggccagt

SEQ ID NO: 665927 - DNA, 25 bp, Mus musculus
gtacatccctgagaagcgggccagt

SEQ ID NO: 665928 - DNA, 25 bp, Mus musculus
gtacatccgaagcactccgacagag

SEQ ID NO: 665929 - DNA, 25 bp, Mus musculus
gtacatccgaaggactccgacagag

SEQ ID NO: 665930 - DNA, 25 bp, Mus musculus
gtacatccgtacatacctacaggac

SEQ ID NO: 665931 - DNA, 25 bp, Mus musculus
gtacatccgtacttacctacaggac

SEQ ID NO: 665932 - DNA, 25 bp, Mus musculus
gtacatcctggaaacactgctaaag

SEQ ID NO: 665933 - DNA, 25 bp, Mus musculus
gtacatcctggatacactgctaaag

SEQ ID NO: 665934 - DNA, 25 bp, Mus musculus
gtacatccttgaattcagtagcagt

SEQ ID NO: 665935 - DNA, 25 bp, Mus musculus
gtacatccttgatttcagtagcagt

SEQ ID NO: 665936 - DNA, 25 bp, Mus musculus
gtacatccttttaaatcagtttaca

SEQ ID NO: 665937 - DNA, 25 bp, Mus musculus
gtacatcctttttaatcagtttaca

SEQ ID NO: 665938 - DNA, 25 bp, Mus musculus
gtacatcggatgagtgtgtttagta

SEQ ID NO: 665939 - DNA, 25 bp, Mus musculus
gtacatcggatgtgtgtgtttagta

SEQ ID NO: 665940 - DNA, 25 bp, Mus musculus
gtacatcgtaaaaaggacttccttt

SEQ ID NO: 665941 - DNA, 25 bp, Mus musculus
gtacatcgtaaataggacttccttt

SEQ ID NO: 665942 - DNA, 25 bp, Mus musculus
gtacatcgtagtccaagacaccgag

SEQ ID NO: 665943 - DNA, 25 bp, Mus musculus
gtacatcgtagtgcaagacaccgag

SEQ ID NO: 665944 - DNA, 25 bp, Mus musculus
gtacatcgtatcatgcatggtggaa

SEQ ID NO: 665945 - DNA, 25 bp, Mus musculus
gtacatcgtatcttgcatggtggaa

SEQ ID NO: 665946 - DNA, 25 bp, Mus musculus
gtacatcgtcaccaagggtcagctc

SEQ ID NO: 665947 - DNA, 25 bp, Mus musculus
gtacatcgtcacgaagggtcagctc

SEQ ID NO: 665948 - DNA, 25 bp, Mus musculus
gtacatctacaccaccaaaacgctg

SEQ ID NO: 665949 - DNA, 25 bp, Mus musculus
gtacatctacacgaccaaaacgctg

SEQ ID NO: 665950 - DNA, 25 bp, Mus musculus
gtacatctacccctggcgaaggaat

SEQ ID NO: 665951 - DNA, 25 bp, Mus musculus
gtacatctacccgtggcgaaggaat

SEQ ID NO: 665952 - DNA, 25 bp, Mus musculus
gtacatctatctagaggcctgctgc

SEQ ID NO: 665953 - DNA, 25 bp, Mus musculus
gtacatctatcttgaggcctgctgc

SEQ ID NO: 665954 - DNA, 25 bp, Mus musculus
gtacatctctctcctatggacatat

SEQ ID NO: 665955 - DNA, 25 bp, Mus musculus
gtacatctctctgctatggacatat

SEQ ID NO: 665956 - DNA, 25 bp, Mus musculus
gtacatctctttcgaggaacgccaa

SEQ ID NO: 665957 - DNA, 25 bp, Mus musculus
gtacatctctttggaggaacgccaa

SEQ ID NO: 665958 - DNA, 25 bp, Mus musculus
gtacatctgagcacagggtggctct

SEQ ID NO: 665959 - DNA, 25 bp, Mus musculus
gtacatctgagctcagggtggctct

SEQ ID NO: 665960 - DNA, 25 bp, Mus musculus
gtacatctgattcaacaactgttca

SEQ ID NO: 665961 - DNA, 25 bp, Mus musculus
gtacatctgattgaacaactgttca

SEQ ID NO: 665962 - DNA, 25 bp, Mus musculus
gtacatctgctgaaacttcttgtat

SEQ ID NO: 665963 - DNA, 25 bp, Mus musculus
gtacatctgctgtaacttcttgtat

SEQ ID NO: 665964 - DNA, 25 bp, Mus musculus
gtacatctgcttatgtatgcactca

SEQ ID NO: 665965 - DNA, 25 bp, Mus musculus
gtacatctgcttttgtatgcactca

SEQ ID NO: 665966 - DNA, 25 bp, Mus musculus
gtacatctgtgaaaacgcctgtttt

SEQ ID NO: 665967 - DNA, 25 bp, Mus musculus
gtacatctgtgataacgcctgtttt

SEQ ID NO: 665968 - DNA, 25 bp, Mus musculus
gtacatctgtggcagactactcaca

SEQ ID NO: 665969 - DNA, 25 bp, Mus musculus
gtacatctgtgggagactactcaca

SEQ ID NO: 665970 - DNA, 25 bp, Mus musculus
gtacatctgttaatggatttctgga

SEQ ID NO: 665971 - DNA, 25 bp, Mus musculus
gtacatctgttattggatttctgga

SEQ ID NO: 665972 - DNA, 25 bp, Mus musculus
gtacatcttgacaacgctcatggct

SEQ ID NO: 665973 - DNA, 25 bp, Mus musculus
gtacatcttgactacgctcatggct

SEQ ID NO: 665974 - DNA, 25 bp, Mus musculus
gtacatcttgccaccaaattacaat

SEQ ID NO: 665975 - DNA, 25 bp, Mus musculus
gtacatcttgcctccaaattacaat

SEQ ID NO: 665976 - DNA, 25 bp, Mus musculus
gtacatcttggtcgctctgtacgga

SEQ ID NO: 665977 - DNA, 25 bp, Mus musculus
gtacatcttggtggctctgtacgga

SEQ ID NO: 665978 - DNA, 25 bp, Mus musculus
gtacatgaaagtccctactatcaat

SEQ ID NO: 665979 - DNA, 25 bp, Mus musculus
gtacatgaaagtgcctactatcaat

SEQ ID NO: 665980 - DNA, 25 bp, Mus musculus
gtacatgaaatccttcaggcagcaa

SEQ ID NO: 665981 - DNA, 25 bp, Mus musculus
gtacatgaaatcgttcaggcagcaa

SEQ ID NO: 665982 - DNA, 25 bp, Mus musculus
gtacatgaacacaatgtgacttcag

SEQ ID NO: 665983 - DNA, 25 bp, Mus musculus
gtacatgaacactatgtgacttcag

SEQ ID NO: 665984 - DNA, 25 bp, Mus musculus
gtacatgaaccacgccatactcttt

SEQ ID NO: 665985 - DNA, 25 bp, Mus musculus
gtacatgaaccaggccatactcttt

SEQ ID NO: 665986 - DNA, 25 bp, Mus musculus
gtacatgaagccacttgctttaatc

SEQ ID NO: 665987 - DNA, 25 bp, Mus musculus
gtacatgaagcctcttgctttaatc

SEQ ID NO: 665988 - DNA, 25 bp, Mus musculus
gtacatgacagacgcattagactat

SEQ ID NO: 665989 - DNA, 25 bp, Mus musculus
gtacatgacagaggcattagactat

SEQ ID NO: 665990 - DNA, 25 bp, Mus musculus
gtacatgacatgcagtgatcctcct

SEQ ID NO: 665991 - DNA, 25 bp, Mus musculus
gtacatgacatggagtgatcctcct

SEQ ID NO: 665992 - DNA, 25 bp, Mus musculus
gtacatgaccctcacaaattgcctc

SEQ ID NO: 665993 - DNA, 25 bp, Mus musculus
gtacatgaccctgacaaattgcctc

SEQ ID NO: 665994 - DNA, 25 bp, Mus musculus
gtacatgagagaccctgatgaccag

SEQ ID NO: 665995 - DNA, 25 bp, Mus musculus
gtacatgagagagcctgatgaccag

SEQ ID NO: 665996 - DNA, 25 bp, Mus musculus
gtacatgagcatagctacttcctca

SEQ ID NO: 665997 - DNA, 25 bp, Mus musculus
gtacatgagcatcctggcggccagt

SEQ ID NO: 665998 - DNA, 25 bp, Mus musculus
gtacatgagcatgctggcggccagt

SEQ ID NO: 665999 - DNA, 25 bp, Mus musculus
gtacatgagcattgctacttcctca

SEQ ID NO: 666000 - DNA, 25 bp, Mus musculus
gtacatgagtcaataactgttatca

SEQ ID NO: 666001 - DNA, 25 bp, Mus musculus
gtacatgagtcattaactgttatca

SEQ ID NO: 666002 - DNA, 25 bp, Mus musculus
gtacatgatatcatacattgctcac

SEQ ID NO: 666003 - DNA, 25 bp, Mus musculus
gtacatgatatcttacattgctcac

SEQ ID NO: 666004 - DNA, 25 bp, Mus musculus
gtacatgattctatccggagttgcc

SEQ ID NO: 666005 - DNA, 25 bp, Mus musculus
gtacatgattctttccggagttgcc

SEQ ID NO: 666006 - DNA, 25 bp, Mus musculus
gtacatgattggacaacccttgcaa

SEQ ID NO: 666007 - DNA, 25 bp, Mus musculus
gtacatgattggtcaacccttgcaa

SEQ ID NO: 666008 - DNA, 25 bp, Mus musculus
gtacatgcaaatcagctagtcccca

SEQ ID NO: 666009 - DNA, 25 bp, Mus musculus
gtacatgcaaatgagctagtcccca

SEQ ID NO: 666010 - DNA, 25 bp, Mus musculus
gtacatgcacatcggagggacatca

SEQ ID NO: 666011 - DNA, 25 bp, Mus musculus
gtacatgcacatgggagggacatca

SEQ ID NO: 666012 - DNA, 25 bp, Mus musculus
gtacatgcacgtcggcagttgccag

SEQ ID NO: 666013 - DNA, 25 bp, Mus musculus
gtacatgcacgtgggcagttgccag

SEQ ID NO: 666014 - DNA, 25 bp, Mus musculus
gtacatgcatgtagatgccggcaga

SEQ ID NO: 666015 - DNA, 25 bp, Mus musculus
gtacatgcatgttgatgccggcaga

SEQ ID NO: 666016 - DNA, 25 bp, Mus musculus
gtacatgccatcagtagcccttggt

SEQ ID NO: 666017 - DNA, 25 bp, Mus musculus
gtacatgccatctgtagcccttggt

SEQ ID NO: 666018 - DNA, 25 bp, Mus musculus
gtacatgcccagaactgattgccat

SEQ ID NO: 666019 - DNA, 25 bp, Mus musculus
gtacatgcccagtactgattgccat

SEQ ID NO: 666020 - DNA, 25 bp, Mus musculus
gtacatgccgtcagtcctctggtct

SEQ ID NO: 666021 - DNA, 25 bp, Mus musculus
gtacatgccgtctgtcctctggtct

SEQ ID NO: 666022 - DNA, 25 bp, Mus musculus
gtacatgcctctaaggaagactaat

SEQ ID NO: 666023 - DNA, 25 bp, Mus musculus
gtacatgcctcttaggaagactaat

SEQ ID NO: 666024 - DNA, 25 bp, Mus musculus
gtacatgcgtatatattgcttacat

SEQ ID NO: 666025 - DNA, 25 bp, Mus musculus
gtacatgcgtatttattgcttacat

SEQ ID NO: 666026 - DNA, 25 bp, Mus musculus
gtacatgctgagactctttcttaac

SEQ ID NO: 666027 - DNA, 25 bp, Mus musculus
gtacatgctgagtctctttcttaac

SEQ ID NO: 666028 - DNA, 25 bp, Mus musculus
gtacatggacgaccagtactggccc

SEQ ID NO: 666029 - DNA, 25 bp, Mus musculus
gtacatggacgagcagtactggccc

SEQ ID NO: 666030 - DNA, 25 bp, Mus musculus
gtacatggagaaagttcctcccctc

SEQ ID NO: 666031 - DNA, 25 bp, Mus musculus
gtacatggagaatgttcctcccctc

SEQ ID NO: 666032 - DNA, 25 bp, Mus musculus
gtacatggagggaacagctggtcaa

SEQ ID NO: 666033 - DNA, 25 bp, Mus musculus
gtacatggagggtacagctggtcaa

SEQ ID NO: 666034 - DNA, 25 bp, Mus musculus
gtacatggcacactcagatcttagt

SEQ ID NO: 666035 - DNA, 25 bp, Mus musculus
gtacatggcacagtcagatcttagt

SEQ ID NO: 666036 - DNA, 25 bp, Mus musculus
gtacatggctccattacctacacac

SEQ ID NO: 666037 - DNA, 25 bp, Mus musculus
gtacatggctcctttacctacacac

SEQ ID NO: 666038 - DNA, 25 bp, Mus musculus
gtacatgggactagcatttctcaca

SEQ ID NO: 666039 - DNA, 25 bp, Mus musculus
gtacatgggacttgcatttctcaca

SEQ ID NO: 666040 - DNA, 25 bp, Mus musculus
gtacatggtatgattctctctctcc

SEQ ID NO: 666041 - DNA, 25 bp, Mus musculus
gtacatggtatgtttctctctctcc

SEQ ID NO: 666042 - DNA, 25 bp, Mus musculus
gtacatggtgacagaacgtgcctca

SEQ ID NO: 666043 - DNA, 25 bp, Mus musculus
gtacatggtgactgaacgtgcctca

SEQ ID NO: 666044 - DNA, 25 bp, Mus musculus
gtacatggtgttaatggaggcctaa

SEQ ID NO: 666045 - DNA, 25 bp, Mus musculus
gtacatggtgtttatggaggcctaa

SEQ ID NO: 666046 - DNA, 25 bp, Mus musculus
gtacatggtttcaccaagagaaaga

SEQ ID NO: 666047 - DNA, 25 bp, Mus musculus
gtacatggtttctccaagagaaaga

SEQ ID NO: 666048 - DNA, 25 bp, Mus musculus
gtacatgtacaactcctcctgtcat

SEQ ID NO: 666049 - DNA, 25 bp, Mus musculus
gtacatgtacaagtcctcctgtcat

SEQ ID NO: 666050 - DNA, 25 bp, Mus musculus
gtacatgtacagagtccgtggctta

SEQ ID NO: 666051 - DNA, 25 bp, Mus musculus
gtacatgtacagtgtccgtggctta

SEQ ID NO: 666052 - DNA, 25 bp, Mus musculus
gtacatgtactacctgatcgagcac

SEQ ID NO: 666053 - DNA, 25 bp, Mus musculus
gtacatgtactagctgatcgagcac

SEQ ID NO: 666054 - DNA, 25 bp, Mus musculus
gtacatgtagataaagcactcataa

SEQ ID NO: 666055 - DNA, 25 bp, Mus musculus
gtacatgtagattaagcactcataa

SEQ ID NO: 666056 - DNA, 25 bp, Mus musculus
gtacatgtatcaccttctggatgat

SEQ ID NO: 666057 - DNA, 25 bp, Mus musculus
gtacatgtatcagcttctggatgat

SEQ ID NO: 666058 - DNA, 25 bp, Mus musculus
gtacatgtcaatcgtgcctaatatt

SEQ ID NO: 666059 - DNA, 25 bp, Mus musculus
gtacatgtcaatggtgcctaatatt

SEQ ID NO: 666060 - DNA, 25 bp, Mus musculus
gtacatgtcactcaaccccgacgtg

SEQ ID NO: 666061 - DNA, 25 bp, Mus musculus
gtacatgtcactgaaccccgacgtg

SEQ ID NO: 666062 - DNA, 25 bp, Mus musculus
gtacatgtcaggacatctctgggag

SEQ ID NO: 666063 - DNA, 25 bp, Mus musculus
gtacatgtcaggtcatctctgggag

SEQ ID NO: 666064 - DNA, 25 bp, Mus musculus
gtacatgtcattagcttcagtttat

SEQ ID NO: 666065 - DNA, 25 bp, Mus musculus
gtacatgtcatttgcttcagtttat

SEQ ID NO: 666066 - DNA, 25 bp, Mus musculus
gtacatgtccccattggaaaatgga

SEQ ID NO: 666067 - DNA, 25 bp, Mus musculus
gtacatgtcccctttggaaaatgga

SEQ ID NO: 666068 - DNA, 25 bp, Mus musculus
gtacatgtctatcgacctgagtctt

SEQ ID NO: 666069 - DNA, 25 bp, Mus musculus
gtacatgtctatggacctgagtctt

SEQ ID NO: 666070 - DNA, 25 bp, Mus musculus
gtacatgtctggctgtgggtttaca

SEQ ID NO: 666071 - DNA, 25 bp, Mus musculus
gtacatgtctgggtgtgggtttaca

SEQ ID NO: 666072 - DNA, 25 bp, Mus musculus
gtacatgtgcagattcctgaaggat

SEQ ID NO: 666073 - DNA, 25 bp, Mus musculus
gtacatgtgcagtttcctgaaggat

SEQ ID NO: 666074 - DNA, 25 bp, Mus musculus
gtacatgtgcctagactagcacttt

SEQ ID NO: 666075 - DNA, 25 bp, Mus musculus
gtacatgtgccttgactagcacttt

SEQ ID NO: 666076 - DNA, 25 bp, Mus musculus
gtacatgtgctaaaaacttggcttg

SEQ ID NO: 666077 - DNA, 25 bp, Mus musculus
gtacatgtgctataaacttggcttg

SEQ ID NO: 666078 - DNA, 25 bp, Mus musculus
gtacatgtgtacacgtgtgacgcac

SEQ ID NO: 666079 - DNA, 25 bp, Mus musculus
gtacatgtgtactcgtgtgacgcac

SEQ ID NO: 666080 - DNA, 25 bp, Mus musculus
gtacatgtgtatcagtagaaccctg

SEQ ID NO: 666081 - DNA, 25 bp, Mus musculus
gtacatgtgtatgagtagaaccctg

SEQ ID NO: 666082 - DNA, 25 bp, Mus musculus
gtacatgttaggatcctctcctgta

SEQ ID NO: 666083 - DNA, 25 bp, Mus musculus
gtacatgttaggttcctctcctgta

SEQ ID NO: 666084 - DNA, 25 bp, Mus musculus
gtacatgtttacactaagaatgaac

SEQ ID NO: 666085 - DNA, 25 bp, Mus musculus
gtacatgtttactctaagaatgaac

SEQ ID NO: 666086 - DNA, 25 bp, Mus musculus
gtacatgtttagactttccagttga

SEQ ID NO: 666087 - DNA, 25 bp, Mus musculus
gtacatgtttagcagcaccacgcca

SEQ ID NO: 666088 - DNA, 25 bp, Mus musculus
gtacatgtttaggagcaccacgcca

SEQ ID NO: 666089 - DNA, 25 bp, Mus musculus
gtacatgtttagtctttccagttga

SEQ ID NO: 666090 - DNA, 25 bp, Mus musculus
gtacatgtttctagatttctaaagc

SEQ ID NO: 666091 - DNA, 25 bp, Mus musculus
gtacatgtttcttgatttctaaagc

SEQ ID NO: 666092 - DNA, 25 bp, Mus musculus
gtacattaaccacaaatctgctctc

SEQ ID NO: 666093 - DNA, 25 bp, Mus musculus
gtacattaaccagaaatctgctctc

SEQ ID NO: 666094 - DNA, 25 bp, Mus musculus
gtacattaagaacatttggagcatt

SEQ ID NO: 666095 - DNA, 25 bp, Mus musculus
gtacattaagaagatttggagcatt

SEQ ID NO: 666096 - DNA, 25 bp, Mus musculus
gtacattaagacaacacatttggtg

SEQ ID NO: 666097 - DNA, 25 bp, Mus musculus
gtacattaagactacacatttggtg

SEQ ID NO: 666098 - DNA, 25 bp, Mus musculus
gtacattacaacagggcatcaggat

SEQ ID NO: 666099 - DNA, 25 bp, Mus musculus
gtacattacaactgggcatcaggat

SEQ ID NO: 666100 - DNA, 25 bp, Mus musculus
gtacattagcttatgtgacaaccaa

SEQ ID NO: 666101 - DNA, 25 bp, Mus musculus
gtacattagcttttgtgacaaccaa

SEQ ID NO: 666102 - DNA, 25 bp, Mus musculus
gtacattatcacaaaatgaactttg

SEQ ID NO: 666103 - DNA, 25 bp, Mus musculus
gtacattatcactaaatgaactttg

SEQ ID NO: 666104 - DNA, 25 bp, Mus musculus
gtacattatcccacatatattcatg

SEQ ID NO: 666105 - DNA, 25 bp, Mus musculus
gtacattatccctcatatattcatg

SEQ ID NO: 666106 - DNA, 25 bp, Mus musculus
gtacattatcctcttactgagctaa

SEQ ID NO: 666107 - DNA, 25 bp, Mus musculus
gtacattatcctgttactgagctaa

SEQ ID NO: 666108 - DNA, 25 bp, Mus musculus
gtacattattccatagtagcatgct

SEQ ID NO: 666109 - DNA, 25 bp, Mus musculus
gtacattattccttagtagcatgct

SEQ ID NO: 666110 - DNA, 25 bp, Mus musculus
gtacattatttcactcagtcctgga

SEQ ID NO: 666111 - DNA, 25 bp, Mus musculus
gtacattatttctctcagtcctgga

SEQ ID NO: 666112 - DNA, 25 bp, Mus musculus
gtacattcaacacaaggtccgcgtg

SEQ ID NO: 666113 - DNA, 25 bp, Mus musculus
gtacattcaacagaaggtccgcgtg

SEQ ID NO: 666114 - DNA, 25 bp, Mus musculus
gtacattcaagtatgaggtgaaccc

SEQ ID NO: 666115 - DNA, 25 bp, Mus musculus
gtacattcaagtttgaggtgaaccc

SEQ ID NO: 666116 - DNA, 25 bp, Mus musculus
gtacattcacagaactgaagggcgg

SEQ ID NO: 666117 - DNA, 25 bp, Mus musculus
gtacattcacagtactgaagggcgg

SEQ ID NO: 666118 - DNA, 25 bp, Mus musculus
gtacattcagaccacaaagcacctt

SEQ ID NO: 666119 - DNA, 25 bp, Mus musculus
gtacattcagacgacaaagcacctt

SEQ ID NO: 666120 - DNA, 25 bp, Mus musculus
gtacattcagtaatgttcagccatc

SEQ ID NO: 666121 - DNA, 25 bp, Mus musculus
gtacattcagtattgttcagccatc

SEQ ID NO: 666122 - DNA, 25 bp, Mus musculus
gtacattccattcgtaaattgccat

SEQ ID NO: 666123 - DNA, 25 bp, Mus musculus
gtacattccattggtaaattgccat

SEQ ID NO: 666124 - DNA, 25 bp, Mus musculus
gtacattccctacttgttgtgttgt

SEQ ID NO: 666125 - DNA, 25 bp, Mus musculus
gtacattccctagttgttgtgttgt

SEQ ID NO: 666126 - DNA, 25 bp, Mus musculus
gtacattcgcttcaagatttcacct

SEQ ID NO: 666127 - DNA, 25 bp, Mus musculus
gtacattcgcttgaagatttcacct

SEQ ID NO: 666128 - DNA, 25 bp, Mus musculus
gtacattctactacattagttacta

SEQ ID NO: 666129 - DNA, 25 bp, Mus musculus
gtacattctacttcattagttacta

SEQ ID NO: 666130 - DNA, 25 bp, Mus musculus
gtacattctctaacgaggctggcgg

SEQ ID NO: 666131 - DNA, 25 bp, Mus musculus
gtacattctctatcgaggctggcgg

SEQ ID NO: 666132 - DNA, 25 bp, Mus musculus
gtacattctgatctgctgtctctga

SEQ ID NO: 666133 - DNA, 25 bp, Mus musculus
gtacattctgatgtgctgtctctga

SEQ ID NO: 666134 - DNA, 25 bp, Mus musculus
gtacattctttactgtgctacataa

SEQ ID NO: 666135 - DNA, 25 bp, Mus musculus
gtacattctttagtgtgctacataa

SEQ ID NO: 666136 - DNA, 25 bp, Mus musculus
gtacattcttttctcagggactttt

SEQ ID NO: 666137 - DNA, 25 bp, Mus musculus
gtacattcttttgtcagggactttt

SEQ ID NO: 666138 - DNA, 25 bp, Mus musculus
gtacattgaaaaacagtgtctttgg

SEQ ID NO: 666139 - DNA, 25 bp, Mus musculus
gtacattgaaaatcagtgtctttgg

SEQ ID NO: 666140 - DNA, 25 bp, Mus musculus
gtacattgatttcttattggctttt

SEQ ID NO: 666141 - DNA, 25 bp, Mus musculus
gtacattgatttgttattggctttt

SEQ ID NO: 666142 - DNA, 25 bp, Mus musculus
gtacattgcacaaacccttgaatct

SEQ ID NO: 666143 - DNA, 25 bp, Mus musculus
gtacattgcacatacccttgaatct

SEQ ID NO: 666144 - DNA, 25 bp, Mus musculus
gtacattgcactacatccatattta

SEQ ID NO: 666145 - DNA, 25 bp, Mus musculus
gtacattgcacttcatccatattta

SEQ ID NO: 666146 - DNA, 25 bp, Mus musculus
gtacattgcagacaggaaaaaccag

SEQ ID NO: 666147 - DNA, 25 bp, Mus musculus
gtacattgcagagaggaaaaaccag

SEQ ID NO: 666148 - DNA, 25 bp, Mus musculus
gtacattgcataatgatatccagtt

SEQ ID NO: 666149 - DNA, 25 bp, Mus musculus
gtacattgcatattgatatccagtt

SEQ ID NO: 666150 - DNA, 25 bp, Mus musculus
gtacattgcatgaggctttaagatt

SEQ ID NO: 666151 - DNA, 25 bp, Mus musculus
gtacattgcatgtggctttaagatt

SEQ ID NO: 666152 - DNA, 25 bp, Mus musculus
gtacattgccataacccagggagga

SEQ ID NO: 666153 - DNA, 25 bp, Mus musculus
gtacattgccattacccagggagga

SEQ ID NO: 666154 - DNA, 25 bp, Mus musculus
gtacattgccttcagacgggcgaat

SEQ ID NO: 666155 - DNA, 25 bp, Mus musculus
gtacattgccttgagacgggcgaat

SEQ ID NO: 666156 - DNA, 25 bp, Mus musculus
gtacattgctttaatgcccacattt

SEQ ID NO: 666157 - DNA, 25 bp, Mus musculus
gtacattgcttttatgcccacattt

SEQ ID NO: 666158 - DNA, 25 bp, Mus musculus
gtacattggacaactagctgcactt

SEQ ID NO: 666159 - DNA, 25 bp, Mus musculus
gtacattggacatctagctgcactt

SEQ ID NO: 666160 - DNA, 25 bp, Mus musculus
gtacattggcagaaactacacacta

SEQ ID NO: 666161 - DNA, 25 bp, Mus musculus
gtacattggcagtaactacacacta

SEQ ID NO: 666162 - DNA, 25 bp, Mus musculus
gtacattggtacatcaagctgcttg

SEQ ID NO: 666163 - DNA, 25 bp, Mus musculus
gtacattggtacttcaagctgcttg

SEQ ID NO: 666164 - DNA, 25 bp, Mus musculus
gtacattgtagtagctaattcaggg

SEQ ID NO: 666165 - DNA, 25 bp, Mus musculus
gtacattgtagttgctaattcaggg

SEQ ID NO: 666166 - DNA, 25 bp, Mus musculus
gtacattgtcatcttgcactctttg

SEQ ID NO: 666167 - DNA, 25 bp, Mus musculus
gtacattgtcatgttgcactctttg

SEQ ID NO: 666168 - DNA, 25 bp, Mus musculus
gtacattgtcctatctcatttctta

SEQ ID NO: 666169 - DNA, 25 bp, Mus musculus
gtacattgtcctttctcatttctta

SEQ ID NO: 666170 - DNA, 25 bp, Mus musculus
gtacattgtctacgacattgctcag

SEQ ID NO: 666171 - DNA, 25 bp, Mus musculus
gtacattgtctaggacattgctcag

SEQ ID NO: 666172 - DNA, 25 bp, Mus musculus
gtacattgtcttatatacctcctga

SEQ ID NO: 666173 - DNA, 25 bp, Mus musculus
gtacattgtcttttatacctcctga

SEQ ID NO: 666174 - DNA, 25 bp, Mus musculus
gtacattgtgctatccttctttcca

SEQ ID NO: 666175 - DNA, 25 bp, Mus musculus
gtacattgtgctttccttctttcca

SEQ ID NO: 666176 - DNA, 25 bp, Mus musculus
gtacattgtgtcatgctcctgcaga

SEQ ID NO: 666177 - DNA, 25 bp, Mus musculus
gtacattgtgtcttgctcctgcaga

SEQ ID NO: 666178 - DNA, 25 bp, Mus musculus
gtacattgtttcaacttgtagataa

SEQ ID NO: 666179 - DNA, 25 bp, Mus musculus
gtacattgtttctacttgtagataa

SEQ ID NO: 666180 - DNA, 25 bp, Mus musculus
gtacatttacacctgaatttgacat

SEQ ID NO: 666181 - DNA, 25 bp, Mus musculus
gtacatttacacgtgaatttgacat

SEQ ID NO: 666182 - DNA, 25 bp, Mus musculus
gtacatttagatatggcttagccct

SEQ ID NO: 666183 - DNA, 25 bp, Mus musculus
gtacatttagatttggcttagccct

SEQ ID NO: 666184 - DNA, 25 bp, Mus musculus
gtacatttagctattgtgtggtcca

SEQ ID NO: 666185 - DNA, 25 bp, Mus musculus
gtacatttagcttttgtgtggtcca

SEQ ID NO: 666186 - DNA, 25 bp, Mus musculus
gtacatttatgtactgtaggccagc

SEQ ID NO: 666187 - DNA, 25 bp, Mus musculus
gtacatttatgttctgtaggccagc

SEQ ID NO: 666188 - DNA, 25 bp, Mus musculus
gtacatttatttctcagccaagaat

SEQ ID NO: 666189 - DNA, 25 bp, Mus musculus
gtacatttatttgtcagccaagaat

SEQ ID NO: 666190 - DNA, 25 bp, Mus musculus
gtacatttcaatattgctccatccc

SEQ ID NO: 666191 - DNA, 25 bp, Mus musculus
gtacatttcaattttgctccatccc

SEQ ID NO: 666192 - DNA, 25 bp, Mus musculus
gtacatttcactcgtgcactgtgta

SEQ ID NO: 666193 - DNA, 25 bp, Mus musculus
gtacatttcactctagacaggcatg

SEQ ID NO: 666194 - DNA, 25 bp, Mus musculus
gtacatttcactggtgcactgtgta

SEQ ID NO: 666195 - DNA, 25 bp, Mus musculus
gtacatttcactgtagacaggcatg

SEQ ID NO: 666196 - DNA, 25 bp, Mus musculus
gtacatttcatcatatggcacttaa

SEQ ID NO: 666197 - DNA, 25 bp, Mus musculus
gtacatttcatcttatggcacttaa

SEQ ID NO: 666198 - DNA, 25 bp, Mus musculus
gtacatttcctacaactgaagccag

SEQ ID NO: 666199 - DNA, 25 bp, Mus musculus
gtacatttcctagaactgaagccag

SEQ ID NO: 666200 - DNA, 25 bp, Mus musculus
gtacatttctgcatggttcattcct

SEQ ID NO: 666201 - DNA, 25 bp, Mus musculus
gtacatttctgcttggttcattcct

SEQ ID NO: 666202 - DNA, 25 bp, Mus musculus
gtacatttgagactttactgtccct

SEQ ID NO: 666203 - DNA, 25 bp, Mus musculus
gtacatttgagagtttactgtccct

SEQ ID NO: 666204 - DNA, 25 bp, Mus musculus
gtacatttgatcattcttctggcat

SEQ ID NO: 666205 - DNA, 25 bp, Mus musculus
gtacatttgatctttcttctggcat

SEQ ID NO: 666206 - DNA, 25 bp, Mus musculus
gtacatttgcagactagggcacgtt

SEQ ID NO: 666207 - DNA, 25 bp, Mus musculus
gtacatttgcagtctagggcacgtt

SEQ ID NO: 666208 - DNA, 25 bp, Mus musculus
gtacatttgcatagcttcagaaggt

SEQ ID NO: 666209 - DNA, 25 bp, Mus musculus
gtacatttgcattgcttcagaaggt

SEQ ID NO: 666210 - DNA, 25 bp, Mus musculus
gtacatttgcgacatcaaccatcaa

SEQ ID NO: 666211 - DNA, 25 bp, Mus musculus
gtacatttgcgagatcaaccatcaa

SEQ ID NO: 666212 - DNA, 25 bp, Mus musculus
gtacatttgctaccttgtagttttc

SEQ ID NO: 666213 - DNA, 25 bp, Mus musculus
gtacatttgctagcttgtagttttc

SEQ ID NO: 666214 - DNA, 25 bp, Mus musculus
gtacatttgctcaaacatactactt

SEQ ID NO: 666215 - DNA, 25 bp, Mus musculus
gtacatttgctctaacatactactt

SEQ ID NO: 666216 - DNA, 25 bp, Mus musculus
gtacatttgctgagccaggggatca

SEQ ID NO: 666217 - DNA, 25 bp, Mus musculus
gtacatttgctgtgccaggggatca

SEQ ID NO: 666218 - DNA, 25 bp, Mus musculus
gtacatttggagaaatgcctgaacc

SEQ ID NO: 666219 - DNA, 25 bp, Mus musculus
gtacatttggagacagacagctggc

SEQ ID NO: 666220 - DNA, 25 bp, Mus musculus
gtacatttggagtaatgcctgaacc

SEQ ID NO: 666221 - DNA, 25 bp, Mus musculus
gtacatttggagtcagacagctggc

SEQ ID NO: 666222 - DNA, 25 bp, Mus musculus
gtacatttgtagactgggtatctat

SEQ ID NO: 666223 - DNA, 25 bp, Mus musculus
gtacatttgtagtctgggtatctat

SEQ ID NO: 666224 - DNA, 25 bp, Mus musculus
gtacatttgtgacggttgggtctat

SEQ ID NO: 666225 - DNA, 25 bp, Mus musculus
gtacatttgtgagggttgggtctat

SEQ ID NO: 666226 - DNA, 25 bp, Mus musculus
gtacattttaaaaggccagcccagc

SEQ ID NO: 666227 - DNA, 25 bp, Mus musculus
gtacattttaaatggccagcccagc

SEQ ID NO: 666228 - DNA, 25 bp, Mus musculus
gtacattttaagaggtatcatctca

SEQ ID NO: 666229 - DNA, 25 bp, Mus musculus
gtacattttaagtggtatcatctca

SEQ ID NO: 666230 - DNA, 25 bp, Mus musculus
gtacattttagaatagcatcaggcc

SEQ ID NO: 666231 - DNA, 25 bp, Mus musculus
gtacattttagattagcatcaggcc

SEQ ID NO: 666232 - DNA, 25 bp, Mus musculus
gtacattttagcatgtctctagaag

SEQ ID NO: 666233 - DNA, 25 bp, Mus musculus
gtacattttagcttgtctctagaag

SEQ ID NO: 666234 - DNA, 25 bp, Mus musculus
gtacattttcataatatagtgttaa

SEQ ID NO: 666235 - DNA, 25 bp, Mus musculus
gtacattttcattatatagtgttaa

SEQ ID NO: 666236 - DNA, 25 bp, Mus musculus
gtacattttctgaagctaaatcata

SEQ ID NO: 666237 - DNA, 25 bp, Mus musculus
gtacattttctgtagctaaatcata

SEQ ID NO: 666238 - DNA, 25 bp, Mus musculus
gtacattttgcaacatttccaatat

SEQ ID NO: 666239 - DNA, 25 bp, Mus musculus
gtacattttgcatcatttccaatat

SEQ ID NO: 666240 - DNA, 25 bp, Mus musculus
gtacattttgctcctctgtccaata

SEQ ID NO: 666241 - DNA, 25 bp, Mus musculus
gtacattttgctgctctgtccaata

SEQ ID NO: 666242 - DNA, 25 bp, Mus musculus
gtacatttttcaccaactactgaga

SEQ ID NO: 666243 - DNA, 25 bp, Mus musculus
gtacatttttcagcaactactgaga

SEQ ID NO: 666244 - DNA, 25 bp, Mus musculus
gtacatttttgacatctggagaaga

SEQ ID NO: 666245 - DNA, 25 bp, Mus musculus
gtacatttttgagatctggagaaga

SEQ ID NO: 666246 - DNA, 25 bp, Mus musculus
gtacatttttgcagttatcttgacc

SEQ ID NO: 666247 - DNA, 25 bp, Mus musculus
gtacatttttgctgttatcttgacc

SEQ ID NO: 666248 - DNA, 25 bp, Mus musculus
gtacatttttgtcctatcattctgc

SEQ ID NO: 666249 - DNA, 25 bp, Mus musculus
gtacatttttgtgctatcattctgc

SEQ ID NO: 666250 - DNA, 25 bp, Mus musculus
gtaccaaaagtccacctctgaaatg

SEQ ID NO: 666251 - DNA, 25 bp, Mus musculus
gtaccaaaagtcgacctctgaaatg

SEQ ID NO: 666252 - DNA, 25 bp, Mus musculus
gtaccaaacagtaataatgctacat

SEQ ID NO: 666253 - DNA, 25 bp, Mus musculus
gtaccaaacagttataatgctacat

SEQ ID NO: 666254 - DNA, 25 bp, Mus musculus
gtaccaaactggctctagactcaca

SEQ ID NO: 666255 - DNA, 25 bp, Mus musculus
gtaccaaactgggtctagactcaca

SEQ ID NO: 666256 - DNA, 25 bp, Mus musculus
gtaccaaagcccaaattgactatga

SEQ ID NO: 666257 - DNA, 25 bp, Mus musculus
gtaccaaagccctaattgactatga

SEQ ID NO: 666258 - DNA, 25 bp, Mus musculus
gtaccaaaggtactgatctccgcaa

SEQ ID NO: 666259 - DNA, 25 bp, Mus musculus
gtaccaaaggtagtgatctccgcaa

SEQ ID NO: 666260 - DNA, 25 bp, Mus musculus
gtaccaaagtatatccccagctaca

SEQ ID NO: 666261 - DNA, 25 bp, Mus musculus
gtaccaaagtatttccccagctaca

SEQ ID NO: 666262 - DNA, 25 bp, Mus musculus
gtaccaaagttaaatcatgctccat

SEQ ID NO: 666263 - DNA, 25 bp, Mus musculus
gtaccaaagttatatcatgctccat

SEQ ID NO: 666264 - DNA, 25 bp, Mus musculus
gtaccaaatacacaccattttgcta

SEQ ID NO: 666265 - DNA, 25 bp, Mus musculus
gtaccaaatacagaccattttgcta

SEQ ID NO: 666266 - DNA, 25 bp, Mus musculus
gtaccaaatgctcagttgctgattc

SEQ ID NO: 666267 - DNA, 25 bp, Mus musculus
gtaccaaatgctcgttatgcttgat

SEQ ID NO: 666268 - DNA, 25 bp, Mus musculus
gtaccaaatgctgagttgctgattc

SEQ ID NO: 666269 - DNA, 25 bp, Mus musculus
gtaccaaatgctggttatgcttgat

SEQ ID NO: 666270 - DNA, 25 bp, Mus musculus
gtaccaaatgttcttcattcttcag

SEQ ID NO: 666271 - DNA, 25 bp, Mus musculus
gtaccaaatgttgttcattcttcag

SEQ ID NO: 666272 - DNA, 25 bp, Mus musculus
gtaccaacaccaaaaggcacctgag

SEQ ID NO: 666273 - DNA, 25 bp, Mus musculus
gtaccaacaccataaggcacctgag

SEQ ID NO: 666274 - DNA, 25 bp, Mus musculus
gtaccaacagagagggcagcaaata

SEQ ID NO: 666275 - DNA, 25 bp, Mus musculus
gtaccaacagagtgggcagcaaata

SEQ ID NO: 666276 - DNA, 25 bp, Mus musculus
gtaccaacaggccaagtgagcacag

SEQ ID NO: 666277 - DNA, 25 bp, Mus musculus
gtaccaacaggcgaagtgagcacag

SEQ ID NO: 666278 - DNA, 25 bp, Mus musculus
gtaccaacatatacactttgtgtgc

SEQ ID NO: 666279 - DNA, 25 bp, Mus musculus
gtaccaacatattcactttgtgtgc

SEQ ID NO: 666280 - DNA, 25 bp, Mus musculus
gtaccaacatgccagccactttcgg

SEQ ID NO: 666281 - DNA, 25 bp, Mus musculus
gtaccaacatgcgagccactttcgg

SEQ ID NO: 666282 - DNA, 25 bp, Mus musculus
gtaccaacccagaatggaccatgag

SEQ ID NO: 666283 - DNA, 25 bp, Mus musculus
gtaccaacccagtatggaccatgag

SEQ ID NO: 666284 - DNA, 25 bp, Mus musculus
gtaccaacctcgaattacgtatgtt

SEQ ID NO: 666285 - DNA, 25 bp, Mus musculus
gtaccaacctcgtattacgtatgtt

SEQ ID NO: 666286 - DNA, 25 bp, Mus musculus
gtaccaacgctactaggcctttgag

SEQ ID NO: 666287 - DNA, 25 bp, Mus musculus
gtaccaacgctagtaggcctttgag

SEQ ID NO: 666288 - DNA, 25 bp, Mus musculus
gtaccaacggccctgcgatgaggtt

SEQ ID NO: 666289 - DNA, 25 bp, Mus musculus
gtaccaacggccgtgcgatgaggtt

SEQ ID NO: 666290 - DNA, 25 bp, Mus musculus
gtaccaactgaaaggaagagggcta

SEQ ID NO: 666291 - DNA, 25 bp, Mus musculus
gtaccaactgaatggaagagggcta

SEQ ID NO: 666292 - DNA, 25 bp, Mus musculus
gtaccaactgatctatttacctgtc

SEQ ID NO: 666293 - DNA, 25 bp, Mus musculus
gtaccaactgatgtatttacctgtc

SEQ ID NO: 666294 - DNA, 25 bp, Mus musculus
gtaccaactggacactgacaaattc

SEQ ID NO: 666295 - DNA, 25 bp, Mus musculus
gtaccaactggagactgacaaattc

SEQ ID NO: 666296 - DNA, 25 bp, Mus musculus
gtaccaagaagcacttttggtccct

SEQ ID NO: 666297 - DNA, 25 bp, Mus musculus
gtaccaagaagctcttttggtccct

SEQ ID NO: 666298 - DNA, 25 bp, Mus musculus
gtaccaagacaccatgcattttatt

SEQ ID NO: 666299 - DNA, 25 bp, Mus musculus
gtaccaagacacgatgcattttatt

SEQ ID NO: 666300 - DNA, 25 bp, Mus musculus
gtaccaagcaaccatggcaggcact

SEQ ID NO: 666301 - DNA, 25 bp, Mus musculus
gtaccaagcaacgatggcaggcact

SEQ ID NO: 666302 - DNA, 25 bp, Mus musculus
gtaccaagctttctcactggtctgt

SEQ ID NO: 666303 - DNA, 25 bp, Mus musculus
gtaccaagctttgtcactggtctgt

SEQ ID NO: 666304 - DNA, 25 bp, Mus musculus
gtaccaaggaacatagcctcatgta

SEQ ID NO: 666305 - DNA, 25 bp, Mus musculus
gtaccaaggaacttagcctcatgta

SEQ ID NO: 666306 - DNA, 25 bp, Mus musculus
gtaccaaggcatatacggcagcagc

SEQ ID NO: 666307 - DNA, 25 bp, Mus musculus
gtaccaaggcatttacggcagcagc

SEQ ID NO: 666308 - DNA, 25 bp, Mus musculus
gtaccaaggccactggtcagaagtc

SEQ ID NO: 666309 - DNA, 25 bp, Mus musculus
gtaccaaggccagtggtcagaagtc

SEQ ID NO: 666310 - DNA, 25 bp, Mus musculus
gtaccaagtacaaggtgggctcact

SEQ ID NO: 666311 - DNA, 25 bp, Mus musculus
gtaccaagtacatggtgggctcact

SEQ ID NO: 666312 - DNA, 25 bp, Mus musculus
gtaccaagtcccacgagtctaagat

SEQ ID NO: 666313 - DNA, 25 bp, Mus musculus
gtaccaagtccctcgagtctaagat

SEQ ID NO: 666314 - DNA, 25 bp, Mus musculus
gtaccaagtctccaagagtctctca

SEQ ID NO: 666315 - DNA, 25 bp, Mus musculus
gtaccaagtctcgaagagtctctca

SEQ ID NO: 666316 - DNA, 25 bp, Mus musculus
gtaccaagtgttcaaggcacaccct

SEQ ID NO: 666317 - DNA, 25 bp, Mus musculus
gtaccaagtgttgaaggcacaccct

SEQ ID NO: 666318 - DNA, 25 bp, Mus musculus
gtaccaagttctaaacagctctgtc

SEQ ID NO: 666319 - DNA, 25 bp, Mus musculus
gtaccaagttcttaacagctctgtc

SEQ ID NO: 666320 - DNA, 25 bp, Mus musculus
gtaccaatacataggccaggatgtg

SEQ ID NO: 666321 - DNA, 25 bp, Mus musculus
gtaccaatacattggccaggatgtg

SEQ ID NO: 666322 - DNA, 25 bp, Mus musculus
gtaccaatcactagtcagactcact

SEQ ID NO: 666323 - DNA, 25 bp, Mus musculus
gtaccaatcacttgtcagactcact

SEQ ID NO: 666324 - DNA, 25 bp, Mus musculus
gtaccaatctctcagctagtgggat

SEQ ID NO: 666325 - DNA, 25 bp, Mus musculus
gtaccaatctctgagctagtgggat

SEQ ID NO: 666326 - DNA, 25 bp, Mus musculus
gtaccaatctggcacttttttcaca

SEQ ID NO: 666327 - DNA, 25 bp, Mus musculus
gtaccaatctgggacttttttcaca

SEQ ID NO: 666328 - DNA, 25 bp, Mus musculus
gtaccaatggctccgcagcttcagg

SEQ ID NO: 666329 - DNA, 25 bp, Mus musculus
gtaccaatggctgcgcagcttcagg

SEQ ID NO: 666330 - DNA, 25 bp, Mus musculus
gtaccaattataagctgaaacacct

SEQ ID NO: 666331 - DNA, 25 bp, Mus musculus
gtaccaattatatgctgaaacacct

SEQ ID NO: 666332 - DNA, 25 bp, Mus musculus
gtaccaattccacagcaatcacatg

SEQ ID NO: 666333 - DNA, 25 bp, Mus musculus
gtaccaattccagagcaatcacatg

SEQ ID NO: 666334 - DNA, 25 bp, Mus musculus
gtaccaattcttactaaatcttcct

SEQ ID NO: 666335 - DNA, 25 bp, Mus musculus
gtaccaattctttctaaatcttcct

SEQ ID NO: 666336 - DNA, 25 bp, Mus musculus
gtaccacaccagataaggagaagga

SEQ ID NO: 666337 - DNA, 25 bp, Mus musculus
gtaccacaccagttaaggagaagga

SEQ ID NO: 666338 - DNA, 25 bp, Mus musculus
gtaccacacctaccctaatatactt

SEQ ID NO: 666339 - DNA, 25 bp, Mus musculus
gtaccacacctagcctaatatactt

SEQ ID NO: 666340 - DNA, 25 bp, Mus musculus
gtaccacacggccattttcaaaggg

SEQ ID NO: 666341 - DNA, 25 bp, Mus musculus
gtaccacacggcgattttcaaaggg

SEQ ID NO: 666342 - DNA, 25 bp, Mus musculus
gtaccacactctccgtgttgagtgg

SEQ ID NO: 666343 - DNA, 25 bp, Mus musculus
gtaccacactctgcgtgttgagtgg

SEQ ID NO: 666344 - DNA, 25 bp, Mus musculus
gtaccacagacccaggacagttttg

SEQ ID NO: 666345 - DNA, 25 bp, Mus musculus
gtaccacagaccgaggacagttttg

SEQ ID NO: 666346 - DNA, 25 bp, Mus musculus
gtaccacagaggacttgttgattta

SEQ ID NO: 666347 - DNA, 25 bp, Mus musculus
gtaccacagaggtcttgttgattta

SEQ ID NO: 666348 - DNA, 25 bp, Mus musculus
gtaccacagagtagtgtcctcagtg

SEQ ID NO: 666349 - DNA, 25 bp, Mus musculus
gtaccacagagttgtgtcctcagtg

SEQ ID NO: 666350 - DNA, 25 bp, Mus musculus
gtaccacaggaacacctagtatctc

SEQ ID NO: 666351 - DNA, 25 bp, Mus musculus
gtaccacaggaagacctagtatctc

SEQ ID NO: 666352 - DNA, 25 bp, Mus musculus
gtaccacagtccatggattaccaga

SEQ ID NO: 666353 - DNA, 25 bp, Mus musculus
gtaccacagtccttggattaccaga

SEQ ID NO: 666354 - DNA, 25 bp, Mus musculus
gtaccacagtgccagccagtcatgt

SEQ ID NO: 666355 - DNA, 25 bp, Mus musculus
gtaccacagtgcgagccagtcatgt

SEQ ID NO: 666356 - DNA, 25 bp, Mus musculus
gtaccacagttaagtatagtttgca

SEQ ID NO: 666357 - DNA, 25 bp, Mus musculus
gtaccacagttatgtatagtttgca

SEQ ID NO: 666358 - DNA, 25 bp, Mus musculus
gtaccaccaaatacaatccactgtt

SEQ ID NO: 666359 - DNA, 25 bp, Mus musculus
gtaccaccaaattcaatccactgtt

SEQ ID NO: 666360 - DNA, 25 bp, Mus musculus
gtaccaccacagaaatagcgcctca

SEQ ID NO: 666361 - DNA, 25 bp, Mus musculus
gtaccaccacagtaatagcgcctca

SEQ ID NO: 666362 - DNA, 25 bp, Mus musculus
gtaccaccaccaccaataattgaca

SEQ ID NO: 666363 - DNA, 25 bp, Mus musculus
gtaccaccaccagcaataattgaca

SEQ ID NO: 666364 - DNA, 25 bp, Mus musculus
gtaccaccactaacaggatcaatcc

SEQ ID NO: 666365 - DNA, 25 bp, Mus musculus
gtaccaccactaataggatcaatcc

SEQ ID NO: 666366 - DNA, 25 bp, Mus musculus
gtaccaccactatcaggatcaatcc

SEQ ID NO: 666367 - DNA, 25 bp, Mus musculus
gtaccaccactattaggatcaatcc

SEQ ID NO: 666368 - DNA, 25 bp, Mus musculus
gtaccaccagtactgcgcaaaaaat

SEQ ID NO: 666369 - DNA, 25 bp, Mus musculus
gtaccaccagtagtgcgcaaaaaat

SEQ ID NO: 666370 - DNA, 25 bp, Mus musculus
gtaccacccactcctgtggatttga

SEQ ID NO: 666371 - DNA, 25 bp, Mus musculus
gtaccacccactgctgtggatttga

SEQ ID NO: 666372 - DNA, 25 bp, Mus musculus
gtaccaccccacagagcctatattt

SEQ ID NO: 666373 - DNA, 25 bp, Mus musculus
gtaccaccccactgagcctatattt

SEQ ID NO: 666374 - DNA, 25 bp, Mus musculus
gtaccacccgggacagtgagatact

SEQ ID NO: 666375 - DNA, 25 bp, Mus musculus
gtaccacccgggtcagtgagatact

SEQ ID NO: 666376 - DNA, 25 bp, Mus musculus
gtaccacccgtgactgtataaagaa

SEQ ID NO: 666377 - DNA, 25 bp, Mus musculus
gtaccacccgtgtctgtataaagaa

SEQ ID NO: 666378 - DNA, 25 bp, Mus musculus
gtaccaccctaaactaccatacttg

SEQ ID NO: 666379 - DNA, 25 bp, Mus musculus
gtaccaccctaatctaccatacttg

SEQ ID NO: 666380 - DNA, 25 bp, Mus musculus
gtaccaccctggaacaaacaaatga

SEQ ID NO: 666381 - DNA, 25 bp, Mus musculus
gtaccaccctggtacaaacaaatga

SEQ ID NO: 666382 - DNA, 25 bp, Mus musculus
gtaccaccggagcaaccacaggatt

SEQ ID NO: 666383 - DNA, 25 bp, Mus musculus
gtaccaccggaggaaccacaggatt

SEQ ID NO: 666384 - DNA, 25 bp, Mus musculus
gtaccacctctcagcagggagtgca

SEQ ID NO: 666385 - DNA, 25 bp, Mus musculus
gtaccacctctctgcagggagtgca

SEQ ID NO: 666386 - DNA, 25 bp, Mus musculus
gtaccacctctgagcgtcttagaag

SEQ ID NO: 666387 - DNA, 25 bp, Mus musculus
gtaccacctctgatgcttcagaaca

SEQ ID NO: 666388 - DNA, 25 bp, Mus musculus
gtaccacctctgtgcgtcttagaag

SEQ ID NO: 666389 - DNA, 25 bp, Mus musculus
gtaccacctctgttgcttcagaaca

SEQ ID NO: 666390 - DNA, 25 bp, Mus musculus
gtaccacctgctaatatcactgaag

SEQ ID NO: 666391 - DNA, 25 bp, Mus musculus
gtaccacctgcttatatcactgaag

SEQ ID NO: 666392 - DNA, 25 bp, Mus musculus
gtaccacctggaagactcttagaca

SEQ ID NO: 666393 - DNA, 25 bp, Mus musculus
gtaccacctggatgactcttagaca

SEQ ID NO: 666394 - DNA, 25 bp, Mus musculus
gtaccacctggcctcatgcaggaag

SEQ ID NO: 666395 - DNA, 25 bp, Mus musculus
gtaccacctggcgtcatgcaggaag

SEQ ID NO: 666396 - DNA, 25 bp, Mus musculus
gtaccacctgtcacacaggagacgt

SEQ ID NO: 666397 - DNA, 25 bp, Mus musculus
gtaccacctgtctcacaggagacgt

SEQ ID NO: 666398 - DNA, 25 bp, Mus musculus
gtaccacctttgaaacatctctgaa

SEQ ID NO: 666399 - DNA, 25 bp, Mus musculus
gtaccacctttgtaacatctctgaa

SEQ ID NO: 666400 - DNA, 25 bp, Mus musculus
gtaccacgccatcatgggtggcagt

SEQ ID NO: 666401 - DNA, 25 bp, Mus musculus
gtaccacgccatgatgggtggcagt

SEQ ID NO: 666402 - DNA, 25 bp, Mus musculus
gtaccacgctctaggcaagacccag

SEQ ID NO: 666403 - DNA, 25 bp, Mus musculus
gtaccacgctcttggcaagacccag

SEQ ID NO: 666404 - DNA, 25 bp, Mus musculus
gtaccacggagcaagtcttcacaag

SEQ ID NO: 666405 - DNA, 25 bp, Mus musculus
gtaccacggagctagtcttcacaag

SEQ ID NO: 666406 - DNA, 25 bp, Mus musculus
gtaccacgtacactttgggcagcag

SEQ ID NO: 666407 - DNA, 25 bp, Mus musculus
gtaccacgtacagtttgggcagcag

SEQ ID NO: 666408 - DNA, 25 bp, Mus musculus
gtaccactaataaatgttgagctcc

SEQ ID NO: 666409 - DNA, 25 bp, Mus musculus
gtaccactaatatatgttgagctcc

SEQ ID NO: 666410 - DNA, 25 bp, Mus musculus
gtaccactcattctgggcagctcca

SEQ ID NO: 666411 - DNA, 25 bp, Mus musculus
gtaccactcattgtgggcagctcca

SEQ ID NO: 666412 - DNA, 25 bp, Mus musculus
gtaccactcggccaaaaacagcagt

SEQ ID NO: 666413 - DNA, 25 bp, Mus musculus
gtaccactcggcgaaaaacagcagt

SEQ ID NO: 666414 - DNA, 25 bp, Mus musculus
gtaccactgaacaatgatgttccca

SEQ ID NO: 666415 - DNA, 25 bp, Mus musculus
gtaccactgaactatgatgttccca

SEQ ID NO: 666416 - DNA, 25 bp, Mus musculus
gtaccactgaatctgtacagagccg

SEQ ID NO: 666417 - DNA, 25 bp, Mus musculus
gtaccactgaatgtgtacagagccg

SEQ ID NO: 666418 - DNA, 25 bp, Mus musculus
gtaccactgagtcactagcatctga

SEQ ID NO: 666419 - DNA, 25 bp, Mus musculus
gtaccactgagtgactagcatctga

SEQ ID NO: 666420 - DNA, 25 bp, Mus musculus
gtaccactgctaagccttgtgtaag

SEQ ID NO: 666421 - DNA, 25 bp, Mus musculus
gtaccactgctatgccttgtgtaag

SEQ ID NO: 666422 - DNA, 25 bp, Mus musculus
gtaccactggaacggcttcgagttc

SEQ ID NO: 666423 - DNA, 25 bp, Mus musculus
gtaccactggaagggcttcgagttc

SEQ ID NO: 666424 - DNA, 25 bp, Mus musculus
gtaccactggagatctccagaccct

SEQ ID NO: 666425 - DNA, 25 bp, Mus musculus
gtaccactggagttctccagaccct

SEQ ID NO: 666426 - DNA, 25 bp, Mus musculus
gtaccactgtatctcaacctgatga

SEQ ID NO: 666427 - DNA, 25 bp, Mus musculus
gtaccactgtatgtcaacctgatga

SEQ ID NO: 666428 - DNA, 25 bp, Mus musculus
gtaccacttaccacagatgaagcct

SEQ ID NO: 666429 - DNA, 25 bp, Mus musculus
gtaccacttacctcagatgaagcct

SEQ ID NO: 666430 - DNA, 25 bp, Mus musculus
gtaccacttgccattcggaaaacct

SEQ ID NO: 666431 - DNA, 25 bp, Mus musculus
gtaccacttgcctttcggaaaacct

SEQ ID NO: 666432 - DNA, 25 bp, Mus musculus
gtaccacttgctatgtctcctggtt

SEQ ID NO: 666433 - DNA, 25 bp, Mus musculus
gtaccacttgctttgtctcctggtt

SEQ ID NO: 666434 - DNA, 25 bp, Mus musculus
gtaccacttgttaaagcgtttgtat

SEQ ID NO: 666435 - DNA, 25 bp, Mus musculus
gtaccacttgtttaagcgtttgtat

SEQ ID NO: 666436 - DNA, 25 bp, Mus musculus
gtaccactttcacctgggcttaggg

SEQ ID NO: 666437 - DNA, 25 bp, Mus musculus
gtaccactttcagctgggcttaggg

SEQ ID NO: 666438 - DNA, 25 bp, Mus musculus
gtaccactttctagatgtgatcggc

SEQ ID NO: 666439 - DNA, 25 bp, Mus musculus
gtaccactttcttgatgtgatcggc

SEQ ID NO: 666440 - DNA, 25 bp, Mus musculus
gtaccagaaaacagagggtcccagt

SEQ ID NO: 666441 - DNA, 25 bp, Mus musculus
gtaccagaaaactgagggtcccagt

SEQ ID NO: 666442 - DNA, 25 bp, Mus musculus
gtaccagaaacgaggtggcttgtga

SEQ ID NO: 666443 - DNA, 25 bp, Mus musculus
gtaccagaaacgtggtggcttgtga

SEQ ID NO: 666444 - DNA, 25 bp, Mus musculus
gtaccagaactactatgcccagtgg

SEQ ID NO: 666445 - DNA, 25 bp, Mus musculus
gtaccagaactagtatgcccagtgg

SEQ ID NO: 666446 - DNA, 25 bp, Mus musculus
gtaccagaactgatttaccagccaa

SEQ ID NO: 666447 - DNA, 25 bp, Mus musculus
gtaccagaactgttttaccagccaa

SEQ ID NO: 666448 - DNA, 25 bp, Mus musculus
gtaccagaaggaaccaatagctacc

SEQ ID NO: 666449 - DNA, 25 bp, Mus musculus
gtaccagaaggatccaatagctacc

SEQ ID NO: 666450 - DNA, 25 bp, Mus musculus
gtaccagacactccctttacaaaca

SEQ ID NO: 666451 - DNA, 25 bp, Mus musculus
gtaccagacactgcctttacaaaca

SEQ ID NO: 666452 - DNA, 25 bp, Mus musculus
gtaccagactcaaggttcttcgagg

SEQ ID NO: 666453 - DNA, 25 bp, Mus musculus
gtaccagactcatggttcttcgagg

SEQ ID NO: 666454 - DNA, 25 bp, Mus musculus
gtaccagactttcacacagaccagg

SEQ ID NO: 666455 - DNA, 25 bp, Mus musculus
gtaccagactttgacacagaccagg

SEQ ID NO: 666456 - DNA, 25 bp, Mus musculus
gtaccagagcatcataaggcagccg

SEQ ID NO: 666457 - DNA, 25 bp, Mus musculus
gtaccagagcatgataaggcagccg

SEQ ID NO: 666458 - DNA, 25 bp, Mus musculus
gtaccagagctgcaactgcgctgta

SEQ ID NO: 666459 - DNA, 25 bp, Mus musculus
gtaccagagctggaactgcgctgta

SEQ ID NO: 666460 - DNA, 25 bp, Mus musculus
gtaccagaggatacacagagtcaga

SEQ ID NO: 666461 - DNA, 25 bp, Mus musculus
gtaccagaggattcacagagtcaga

SEQ ID NO: 666462 - DNA, 25 bp, Mus musculus
gtaccagaggtgcttgcccaaggaa

SEQ ID NO: 666463 - DNA, 25 bp, Mus musculus
gtaccagaggtggttgcccaaggaa

SEQ ID NO: 666464 - DNA, 25 bp, Mus musculus
gtaccagagtcaccgccgaatcttg

SEQ ID NO: 666465 - DNA, 25 bp, Mus musculus
gtaccagagtcacggctcagtgcca

SEQ ID NO: 666466 - DNA, 25 bp, Mus musculus
gtaccagagtcagcgccgaatcttg

SEQ ID NO: 666467 - DNA, 25 bp, Mus musculus
gtaccagagtcagggctcagtgcca

SEQ ID NO: 666468 - DNA, 25 bp, Mus musculus
gtaccagcagtacggcatccttcaa

SEQ ID NO: 666469 - DNA, 25 bp, Mus musculus
gtaccagcagtagggcatccttcaa

SEQ ID NO: 666470 - DNA, 25 bp, Mus musculus
gtaccagcatgcaagggccatcttt

SEQ ID NO: 666471 - DNA, 25 bp, Mus musculus
gtaccagcatgctagggccatcttt

SEQ ID NO: 666472 - DNA, 25 bp, Mus musculus
gtaccagccaacaccaataaagcgg

SEQ ID NO: 666473 - DNA, 25 bp, Mus musculus
gtaccagccaactccaataaagcgg

SEQ ID NO: 666474 - DNA, 25 bp, Mus musculus
gtaccagccaataaccacaggagca

SEQ ID NO: 666475 - DNA, 25 bp, Mus musculus
gtaccagccaattaccacaggagca

SEQ ID NO: 666476 - DNA, 25 bp, Mus musculus
gtaccagccatcacatgctacggag

SEQ ID NO: 666477 - DNA, 25 bp, Mus musculus
gtaccagccatctcatgctacggag

SEQ ID NO: 666478 - DNA, 25 bp, Mus musculus
gtaccagctaatcagtggcttctcc

SEQ ID NO: 666479 - DNA, 25 bp, Mus musculus
gtaccagctaatgagtggcttctcc

SEQ ID NO: 666480 - DNA, 25 bp, Mus musculus
gtaccagctgttagtaacactccag

SEQ ID NO: 666481 - DNA, 25 bp, Mus musculus
gtaccagctgtttgtaacactccag

SEQ ID NO: 666482 - DNA, 25 bp, Mus musculus
gtaccagctttgctgaccatgtgcc

SEQ ID NO: 666483 - DNA, 25 bp, Mus musculus
gtaccagctttggtgaccatgtgcc

SEQ ID NO: 666484 - DNA, 25 bp, Mus musculus
gtaccaggaagaaatcccacaggaa

SEQ ID NO: 666485 - DNA, 25 bp, Mus musculus
gtaccaggaagactttgacccgctt

SEQ ID NO: 666486 - DNA, 25 bp, Mus musculus
gtaccaggaagagtttgacccgctt

SEQ ID NO: 666487 - DNA, 25 bp, Mus musculus
gtaccaggaagatatcccacaggaa

SEQ ID NO: 666488 - DNA, 25 bp, Mus musculus
gtaccaggacacatataagccccat

SEQ ID NO: 666489 - DNA, 25 bp, Mus musculus
gtaccaggacacttataagccccat

SEQ ID NO: 666490 - DNA, 25 bp, Mus musculus
gtaccaggacgccactgcggaggag

SEQ ID NO: 666491 - DNA, 25 bp, Mus musculus
gtaccaggacgcgactgcggaggag

SEQ ID NO: 666492 - DNA, 25 bp, Mus musculus
gtaccaggatgacggtccaccacca

SEQ ID NO: 666493 - DNA, 25 bp, Mus musculus
gtaccaggatgagggtccaccacca

SEQ ID NO: 666494 - DNA, 25 bp, Mus musculus
gtaccaggatggcttggtacccatg

SEQ ID NO: 666495 - DNA, 25 bp, Mus musculus
gtaccaggatgggttggtacccatg

SEQ ID NO: 666496 - DNA, 25 bp, Mus musculus
gtaccaggattcatcagcaagcgcc

SEQ ID NO: 666497 - DNA, 25 bp, Mus musculus
gtaccaggattcttcagcaagcgcc

SEQ ID NO: 666498 - DNA, 25 bp, Mus musculus
gtaccaggcaacagctccagttctc

SEQ ID NO: 666499 - DNA, 25 bp, Mus musculus
gtaccaggcaactgctccagttctc

SEQ ID NO: 666500 - DNA, 25 bp, Mus musculus
gtaccaggcaggatccattgggcca

SEQ ID NO: 666501 - DNA, 25 bp, Mus musculus
gtaccaggcaggttccattgggcca

SEQ ID NO: 666502 - DNA, 25 bp, Mus musculus
gtaccaggcatgaaccttgtctctc

SEQ ID NO: 666503 - DNA, 25 bp, Mus musculus
gtaccaggcatgtaccttgtctctc

SEQ ID NO: 666504 - DNA, 25 bp, Mus musculus
gtaccaggccagatccaggtgtaca

SEQ ID NO: 666505 - DNA, 25 bp, Mus musculus
gtaccaggccagttccaggtgtaca

SEQ ID NO: 666506 - DNA, 25 bp, Mus musculus
gtaccaggcctgatgattgcatatt

SEQ ID NO: 666507 - DNA, 25 bp, Mus musculus
gtaccaggcctgttgattgcatatt

SEQ ID NO: 666508 - DNA, 25 bp, Mus musculus
gtaccaggccttacttgaagtctgc

SEQ ID NO: 666509 - DNA, 25 bp, Mus musculus
gtaccaggcctttcttgaagtctgc

SEQ ID NO: 666510 - DNA, 25 bp, Mus musculus
gtaccaggcgctcaagatccatgca

SEQ ID NO: 666511 - DNA, 25 bp, Mus musculus
gtaccaggcgctgaagatccatgca

SEQ ID NO: 666512 - DNA, 25 bp, Mus musculus
gtaccaggctagatgagttacatta

SEQ ID NO: 666513 - DNA, 25 bp, Mus musculus
gtaccaggctagttgagttacatta

SEQ ID NO: 666514 - DNA, 25 bp, Mus musculus
gtaccaggctgcatcttaaactgag

SEQ ID NO: 666515 - DNA, 25 bp, Mus musculus
gtaccaggctgcttcttaaactgag

SEQ ID NO: 666516 - DNA, 25 bp, Mus musculus
gtaccaggctttacctcatttttgg

SEQ ID NO: 666517 - DNA, 25 bp, Mus musculus
gtaccaggctttatctgtcttctaa

SEQ ID NO: 666518 - DNA, 25 bp, Mus musculus
gtaccaggcttttcctcatttttgg

SEQ ID NO: 666519 - DNA, 25 bp, Mus musculus
gtaccaggctttttctgtcttctaa

SEQ ID NO: 666520 - DNA, 25 bp, Mus musculus
gtaccagggacacatgcaggcgcat

SEQ ID NO: 666521 - DNA, 25 bp, Mus musculus
gtaccagggacagatgcaggcgcat

SEQ ID NO: 666522 - DNA, 25 bp, Mus musculus
gtaccagggcccattggtccagaag

SEQ ID NO: 666523 - DNA, 25 bp, Mus musculus
gtaccagggccctttggtccagaag

SEQ ID NO: 666524 - DNA, 25 bp, Mus musculus
gtaccagggcttacagagatcaaag

SEQ ID NO: 666525 - DNA, 25 bp, Mus musculus
gtaccagggctttcagagatcaaag

SEQ ID NO: 666526 - DNA, 25 bp, Mus musculus
gtaccaggtcccagattctgtggca

SEQ ID NO: 666527 - DNA, 25 bp, Mus musculus
gtaccaggtccctgattctgtggca

SEQ ID NO: 666528 - DNA, 25 bp, Mus musculus
gtaccaggtctgatcttagccttga

SEQ ID NO: 666529 - DNA, 25 bp, Mus musculus
gtaccaggtctgttcttagccttga

SEQ ID NO: 666530 - DNA, 25 bp, Mus musculus
gtaccaggttttccatcttcactga

SEQ ID NO: 666531 - DNA, 25 bp, Mus musculus
gtaccaggttttgcatcttcactga

SEQ ID NO: 666532 - DNA, 25 bp, Mus musculus
gtaccagtaagaccccgagattagg

SEQ ID NO: 666533 - DNA, 25 bp, Mus musculus
gtaccagtaagagcccgagattagg

SEQ ID NO: 666534 - DNA, 25 bp, Mus musculus
gtaccagtactcaggacccctaaag

SEQ ID NO: 666535 - DNA, 25 bp, Mus musculus
gtaccagtactctggacccctaaag

SEQ ID NO: 666536 - DNA, 25 bp, Mus musculus
gtaccagtatgactatcaccgtgca

SEQ ID NO: 666537 - DNA, 25 bp, Mus musculus
gtaccagtatgagtatcaccgtgca

SEQ ID NO: 666538 - DNA, 25 bp, Mus musculus
gtaccagtcaacacagatctgtctc

SEQ ID NO: 666539 - DNA, 25 bp, Mus musculus
gtaccagtcaactcagatctgtctc

SEQ ID NO: 666540 - DNA, 25 bp, Mus musculus
gtaccagtcacgctgggatctgcat

SEQ ID NO: 666541 - DNA, 25 bp, Mus musculus
gtaccagtcacggtgggatctgcat

SEQ ID NO: 666542 - DNA, 25 bp, Mus musculus
gtaccagtcggacgctctgagaagc

SEQ ID NO: 666543 - DNA, 25 bp, Mus musculus
gtaccagtcggaggctctgagaagc

SEQ ID NO: 666544 - DNA, 25 bp, Mus musculus
gtaccagtgaagaggctcagccggc

SEQ ID NO: 666545 - DNA, 25 bp, Mus musculus
gtaccagtgaagatatgcagaccag

SEQ ID NO: 666546 - DNA, 25 bp, Mus musculus
gtaccagtgaagtggctcagccggc

SEQ ID NO: 666547 - DNA, 25 bp, Mus musculus
gtaccagtgaagttatgcagaccag

SEQ ID NO: 666548 - DNA, 25 bp, Mus musculus
gtaccagtgattcttctgaccagta

SEQ ID NO: 666549 - DNA, 25 bp, Mus musculus
gtaccagtgattgttctgaccagta

SEQ ID NO: 666550 - DNA, 25 bp, Mus musculus
gtaccagtggacatcgataccgaca

SEQ ID NO: 666551 - DNA, 25 bp, Mus musculus
gtaccagtggacttcgataccgaca

SEQ ID NO: 666552 - DNA, 25 bp, Mus musculus
gtaccagtgtagcatctgcaacaag

SEQ ID NO: 666553 - DNA, 25 bp, Mus musculus
gtaccagtgtaggatctgcaacaag

SEQ ID NO: 666554 - DNA, 25 bp, Mus musculus
gtaccagtgtcgactttgcttgaaa

SEQ ID NO: 666555 - DNA, 25 bp, Mus musculus
gtaccagtgtcgtctttgcttgaaa

SEQ ID NO: 666556 - DNA, 25 bp, Mus musculus
gtaccagtgtttaggcagttttata

SEQ ID NO: 666557 - DNA, 25 bp, Mus musculus
gtaccagtgttttggcagttttata

SEQ ID NO: 666558 - DNA, 25 bp, Mus musculus
gtaccagttatcaaactctgttttg

SEQ ID NO: 666559 - DNA, 25 bp, Mus musculus
gtaccagttatctaactctgttttg

SEQ ID NO: 666560 - DNA, 25 bp, Mus musculus
gtaccagttctgcacaagtgccact

SEQ ID NO: 666561 - DNA, 25 bp, Mus musculus
gtaccagttctggacaagtgccact

SEQ ID NO: 666562 - DNA, 25 bp, Mus musculus
gtaccagttgccatactatgacatg

SEQ ID NO: 666563 - DNA, 25 bp, Mus musculus
gtaccagttgcccattctggatcac

SEQ ID NO: 666564 - DNA, 25 bp, Mus musculus
gtaccagttgccgattctggatcac

SEQ ID NO: 666565 - DNA, 25 bp, Mus musculus
gtaccagttgccttactatgacatg

SEQ ID NO: 666566 - DNA, 25 bp, Mus musculus
gtaccagttgtaacctcaaaagcca

SEQ ID NO: 666567 - DNA, 25 bp, Mus musculus
gtaccagttgtatcctcaaaagcca

SEQ ID NO: 666568 - DNA, 25 bp, Mus musculus
gtaccataaaaacaccccatacatc

SEQ ID NO: 666569 - DNA, 25 bp, Mus musculus
gtaccataaaaagaccccatacatc

SEQ ID NO: 666570 - DNA, 25 bp, Mus musculus
gtaccataaacgctgctattctgag

SEQ ID NO: 666571 - DNA, 25 bp, Mus musculus
gtaccataaacggtgctattctgag

SEQ ID NO: 666572 - DNA, 25 bp, Mus musculus
gtaccataaataatcccatccagag

SEQ ID NO: 666573 - DNA, 25 bp, Mus musculus
gtaccataaatattcccatccagag

SEQ ID NO: 666574 - DNA, 25 bp, Mus musculus
gtaccatacccgaagaaattctctg

SEQ ID NO: 666575 - DNA, 25 bp, Mus musculus
gtaccatacccgtagaaattctctg

SEQ ID NO: 666576 - DNA, 25 bp, Mus musculus
gtaccatatccaatgtttagccaca

SEQ ID NO: 666577 - DNA, 25 bp, Mus musculus
gtaccatatccattgtttagccaca

SEQ ID NO: 666578 - DNA, 25 bp, Mus musculus
gtaccatatccgacagcaacagcag

SEQ ID NO: 666579 - DNA, 25 bp, Mus musculus
gtaccatatccgtcagcaacagcag

SEQ ID NO: 666580 - DNA, 25 bp, Mus musculus
gtaccatcagttctagaatcatttg

SEQ ID NO: 666581 - DNA, 25 bp, Mus musculus
gtaccatcagttgtagaatcatttg

SEQ ID NO: 666582 - DNA, 25 bp, Mus musculus
gtaccatcatgcaactcatgggctt

SEQ ID NO: 666583 - DNA, 25 bp, Mus musculus
gtaccatcatgctactcatgggctt

SEQ ID NO: 666584 - DNA, 25 bp, Mus musculus
gtaccatccatgagtcttcaaatta

SEQ ID NO: 666585 - DNA, 25 bp, Mus musculus
gtaccatccatgtgtcttcaaatta

SEQ ID NO: 666586 - DNA, 25 bp, Mus musculus
gtaccatccgataactttctgcaac

SEQ ID NO: 666587 - DNA, 25 bp, Mus musculus
gtaccatccgattactttctgcaac

SEQ ID NO: 666588 - DNA, 25 bp, Mus musculus
gtaccatctgtgactcttacaaagc

SEQ ID NO: 666589 - DNA, 25 bp, Mus musculus
gtaccatctgtgtctcttacaaagc

SEQ ID NO: 666590 - DNA, 25 bp, Mus musculus
gtaccatcttacagtgttcctgccc

SEQ ID NO: 666591 - DNA, 25 bp, Mus musculus
gtaccatcttactgtgttcctgccc

SEQ ID NO: 666592 - DNA, 25 bp, Mus musculus
gtaccatcttcaagtgtgactggca

SEQ ID NO: 666593 - DNA, 25 bp, Mus musculus
gtaccatcttcatgtgtgactggca

SEQ ID NO: 666594 - DNA, 25 bp, Mus musculus
gtaccatcttgaaaatttcccctta

SEQ ID NO: 666595 - DNA, 25 bp, Mus musculus
gtaccatcttgataatttcccctta

SEQ ID NO: 666596 - DNA, 25 bp, Mus musculus
gtaccatgacggatctttctgacga

SEQ ID NO: 666597 - DNA, 25 bp, Mus musculus
gtaccatgacggttctttctgacga

SEQ ID NO: 666598 - DNA, 25 bp, Mus musculus
gtaccatgcagaaactttcatgcag

SEQ ID NO: 666599 - DNA, 25 bp, Mus musculus
gtaccatgcagatactttcatgcag

SEQ ID NO: 666600 - DNA, 25 bp, Mus musculus
gtaccatgcgagctgactttgtaaa

SEQ ID NO: 666601 - DNA, 25 bp, Mus musculus
gtaccatgcgaggtgactttgtaaa

SEQ ID NO: 666602 - DNA, 25 bp, Mus musculus
gtaccatgcggtcatgaacgaccat

SEQ ID NO: 666603 - DNA, 25 bp, Mus musculus
gtaccatgcggtgatgaacgaccat

SEQ ID NO: 666604 - DNA, 25 bp, Mus musculus
gtaccatggaaaccagcacaggcta

SEQ ID NO: 666605 - DNA, 25 bp, Mus musculus
gtaccatggaaagcagcacaggcta

SEQ ID NO: 666606 - DNA, 25 bp, Mus musculus
gtaccatggattcagaaaaccacta

SEQ ID NO: 666607 - DNA, 25 bp, Mus musculus
gtaccatggattgagaaaaccacta

SEQ ID NO: 666608 - DNA, 25 bp, Mus musculus
gtaccatggctgatccaagcacata

SEQ ID NO: 666609 - DNA, 25 bp, Mus musculus
gtaccatggctgttccaagcacata

SEQ ID NO: 666610 - DNA, 25 bp, Mus musculus
gtaccatggtaaccttggctcttta

SEQ ID NO: 666611 - DNA, 25 bp, Mus musculus
gtaccatggtaagcttggctcttta

SEQ ID NO: 666612 - DNA, 25 bp, Mus musculus
gtaccatgtatgagggtcctcatcc

SEQ ID NO: 666613 - DNA, 25 bp, Mus musculus
gtaccatgtatgtgggtcctcatcc

SEQ ID NO: 666614 - DNA, 25 bp, Mus musculus
gtaccatgtattacaattgtctgtt

SEQ ID NO: 666615 - DNA, 25 bp, Mus musculus
gtaccatgtatttcaattgtctgtt

SEQ ID NO: 666616 - DNA, 25 bp, Mus musculus
gtaccatgtctgactatttaaaatt

SEQ ID NO: 666617 - DNA, 25 bp, Mus musculus
gtaccatgtctgtctatttaaaatt

SEQ ID NO: 666618 - DNA, 25 bp, Mus musculus
gtaccatgtgtaaacctggtggcca

SEQ ID NO: 666619 - DNA, 25 bp, Mus musculus
gtaccatgtgtatacctggtggcca

SEQ ID NO: 666620 - DNA, 25 bp, Mus musculus
gtaccatgttttcaagtagctagga

SEQ ID NO: 666621 - DNA, 25 bp, Mus musculus
gtaccatgttttgaagtagctagga

SEQ ID NO: 666622 - DNA, 25 bp, Mus musculus
gtaccattaactagattgttgataa

SEQ ID NO: 666623 - DNA, 25 bp, Mus musculus
gtaccattaacttgattgttgataa

SEQ ID NO: 666624 - DNA, 25 bp, Mus musculus
gtaccattagttacagtccttcagt

SEQ ID NO: 666625 - DNA, 25 bp, Mus musculus
gtaccattagtttcagtccttcagt

SEQ ID NO: 666626 - DNA, 25 bp, Mus musculus
gtaccattcactaacttgggaaaga

SEQ ID NO: 666627 - DNA, 25 bp, Mus musculus
gtaccattcacttacttgggaaaga

SEQ ID NO: 666628 - DNA, 25 bp, Mus musculus
gtaccattccttaattgtttttgtg

SEQ ID NO: 666629 - DNA, 25 bp, Mus musculus
gtaccattccttatgatgtctatga

SEQ ID NO: 666630 - DNA, 25 bp, Mus musculus
gtaccattcctttattgtttttgtg

SEQ ID NO: 666631 - DNA, 25 bp, Mus musculus
gtaccattccttttgatgtctatga

SEQ ID NO: 666632 - DNA, 25 bp, Mus musculus
gtaccattcgaccagaatcccaaat

SEQ ID NO: 666633 - DNA, 25 bp, Mus musculus
gtaccattcgacgagaatcccaaat

SEQ ID NO: 666634 - DNA, 25 bp, Mus musculus
gtaccattgcatctggttcctaaag

SEQ ID NO: 666635 - DNA, 25 bp, Mus musculus
gtaccattgcatgtggttcctaaag

SEQ ID NO: 666636 - DNA, 25 bp, Mus musculus
gtaccattggctactaagcaggtct

SEQ ID NO: 666637 - DNA, 25 bp, Mus musculus
gtaccattggcttctaagcaggtct

SEQ ID NO: 666638 - DNA, 25 bp, Mus musculus
gtaccattgtgcaaaacgctactga

SEQ ID NO: 666639 - DNA, 25 bp, Mus musculus
gtaccattgtgctaaacgctactga

SEQ ID NO: 666640 - DNA, 25 bp, Mus musculus
gtaccatttcagaaaacctgtctga

SEQ ID NO: 666641 - DNA, 25 bp, Mus musculus
gtaccatttcagactggaggctttt

SEQ ID NO: 666642 - DNA, 25 bp, Mus musculus
gtaccatttcagtaaacctgtctga

SEQ ID NO: 666643 - DNA, 25 bp, Mus musculus
gtaccatttcagtctggaggctttt

SEQ ID NO: 666644 - DNA, 25 bp, Mus musculus
gtaccatttgccacgaacgtttgga

SEQ ID NO: 666645 - DNA, 25 bp, Mus musculus
gtaccatttgcctcgaacgtttgga

SEQ ID NO: 666646 - DNA, 25 bp, Mus musculus
gtaccattttgcaaccagtttcatt

SEQ ID NO: 666647 - DNA, 25 bp, Mus musculus
gtaccattttgctaccagtttcatt

SEQ ID NO: 666648 - DNA, 25 bp, Mus musculus
gtaccattttggacatgtgaacatt

SEQ ID NO: 666649 - DNA, 25 bp, Mus musculus
gtaccattttggtcatgtgaacatt

SEQ ID NO: 666650 - DNA, 25 bp, Mus musculus
gtacccaaaactcatctgatgtccg

SEQ ID NO: 666651 - DNA, 25 bp, Mus musculus
gtacccaaaactgatctgatgtccg

SEQ ID NO: 666652 - DNA, 25 bp, Mus musculus
gtacccaaaagcagattcgcatcca

SEQ ID NO: 666653 - DNA, 25 bp, Mus musculus
gtacccaaaagctgattcgcatcca

SEQ ID NO: 666654 - DNA, 25 bp, Mus musculus
gtacccaaactgaggaactctgtat

SEQ ID NO: 666655 - DNA, 25 bp, Mus musculus
gtacccaaactgtggaactctgtat

SEQ ID NO: 666656 - DNA, 25 bp, Mus musculus
gtacccaaacttcagacctacaaca

SEQ ID NO: 666657 - DNA, 25 bp, Mus musculus
gtacccaaacttgagacctacaaca

SEQ ID NO: 666658 - DNA, 25 bp, Mus musculus
gtacccaaagtcattggcagcattt

SEQ ID NO: 666659 - DNA, 25 bp, Mus musculus
gtacccaaagtctttggcagcattt

SEQ ID NO: 666660 - DNA, 25 bp, Mus musculus
gtacccaacacaccaattattctca

SEQ ID NO: 666661 - DNA, 25 bp, Mus musculus
gtacccaacacagcaattattctca

SEQ ID NO: 666662 - DNA, 25 bp, Mus musculus
gtacccaagcctcaacatgagcatt

SEQ ID NO: 666663 - DNA, 25 bp, Mus musculus
gtacccaagcctgaacatgagcatt

SEQ ID NO: 666664 - DNA, 25 bp, Mus musculus
gtacccaatctgacttttaaagctt

SEQ ID NO: 666665 - DNA, 25 bp, Mus musculus
gtacccaatctgtcttttaaagctt

SEQ ID NO: 666666 - DNA, 25 bp, Mus musculus
gtacccaattgtagtggagccttag

SEQ ID NO: 666667 - DNA, 25 bp, Mus musculus
gtacccaattgttgtggagccttag

SEQ ID NO: 666668 - DNA, 25 bp, Mus musculus
gtacccacacacattaaaccagaga

SEQ ID NO: 666669 - DNA, 25 bp, Mus musculus
gtacccacacactttaaaccagaga

SEQ ID NO: 666670 - DNA, 25 bp, Mus musculus
gtacccacagaactgtttcgacgag

SEQ ID NO: 666671 - DNA, 25 bp, Mus musculus
gtacccacagaagtgtttcgacgag

SEQ ID NO: 666672 - DNA, 25 bp, Mus musculus
gtacccacagagaatgctaggtcat

SEQ ID NO: 666673 - DNA, 25 bp, Mus musculus
gtacccacagagtatgctaggtcat

SEQ ID NO: 666674 - DNA, 25 bp, Mus musculus
gtacccacagatcgtcttcattggc

SEQ ID NO: 666675 - DNA, 25 bp, Mus musculus
gtacccacagatggtcttcattggc

SEQ ID NO: 666676 - DNA, 25 bp, Mus musculus
gtacccacagtaactaatgtatgca

SEQ ID NO: 666677 - DNA, 25 bp, Mus musculus
gtacccacagtatctaatgtatgca

SEQ ID NO: 666678 - DNA, 25 bp, Mus musculus
gtacccaccaccaacagattgaggc

SEQ ID NO: 666679 - DNA, 25 bp, Mus musculus
gtacccaccacctacagattgaggc

SEQ ID NO: 666680 - DNA, 25 bp, Mus musculus
gtacccaccagacatgcttcttgta

SEQ ID NO: 666681 - DNA, 25 bp, Mus musculus
gtacccaccagagatgcttcttgta

SEQ ID NO: 666682 - DNA, 25 bp, Mus musculus
gtacccaccgtgcatactgcatgtg

SEQ ID NO: 666683 - DNA, 25 bp, Mus musculus
gtacccaccgtggatactgcatgtg

SEQ ID NO: 666684 - DNA, 25 bp, Mus musculus
gtacccacgattagaaaagactcag

SEQ ID NO: 666685 - DNA, 25 bp, Mus musculus
gtacccacgatttgaaaagactcag

SEQ ID NO: 666686 - DNA, 25 bp, Mus musculus
gtacccacggaacaagttctggatt

SEQ ID NO: 666687 - DNA, 25 bp, Mus musculus
gtacccacggaagaagttctggatt

SEQ ID NO: 666688 - DNA, 25 bp, Mus musculus
gtacccacgggaagtgctggatcca

SEQ ID NO: 666689 - DNA, 25 bp, Mus musculus
gtacccacgggatgtgctggatcca

SEQ ID NO: 666690 - DNA, 25 bp, Mus musculus
gtacccacggtaacatggcgtacat

SEQ ID NO: 666691 - DNA, 25 bp, Mus musculus
gtacccacggtatcatggcgtacat

SEQ ID NO: 666692 - DNA, 25 bp, Mus musculus
gtacccactataaacgtgctggttt

SEQ ID NO: 666693 - DNA, 25 bp, Mus musculus
gtacccactatatacgtgctggttt

SEQ ID NO: 666694 - DNA, 25 bp, Mus musculus
gtacccactctgagtctgctgatcc

SEQ ID NO: 666695 - DNA, 25 bp, Mus musculus
gtacccactctgtgtctgctgatcc

SEQ ID NO: 666696 - DNA, 25 bp, Mus musculus
gtacccactgatatccagaatcctg

SEQ ID NO: 666697 - DNA, 25 bp, Mus musculus
gtacccactgatttccagaatcctg

SEQ ID NO: 666698 - DNA, 25 bp, Mus musculus
gtacccactggcatagtgaaacaga

SEQ ID NO: 666699 - DNA, 25 bp, Mus musculus
gtacccactggcttagtgaaacaga

SEQ ID NO: 666700 - DNA, 25 bp, Mus musculus
gtacccagaagcatttatacttctc

SEQ ID NO: 666701 - DNA, 25 bp, Mus musculus
gtacccagaagcttttatacttctc

SEQ ID NO: 666702 - DNA, 25 bp, Mus musculus
gtacccagacctcatagctgagctt

SEQ ID NO: 666703 - DNA, 25 bp, Mus musculus
gtacccagacctgatagctgagctt

SEQ ID NO: 666704 - DNA, 25 bp, Mus musculus
gtacccagataccatggagtccaat

SEQ ID NO: 666705 - DNA, 25 bp, Mus musculus
gtacccagatacgatggagtccaat

SEQ ID NO: 666706 - DNA, 25 bp, Mus musculus
gtacccagatgcacagggctttgct

SEQ ID NO: 666707 - DNA, 25 bp, Mus musculus
gtacccagatgctcagggctttgct

SEQ ID NO: 666708 - DNA, 25 bp, Mus musculus
gtacccagcccaagccataaaggtg

SEQ ID NO: 666709 - DNA, 25 bp, Mus musculus
gtacccagcccatgccataaaggtg

SEQ ID NO: 666710 - DNA, 25 bp, Mus musculus
gtacccagctaaatgctgtcattta

SEQ ID NO: 666711 - DNA, 25 bp, Mus musculus
gtacccagctaattgctgtcattta

SEQ ID NO: 666712 - DNA, 25 bp, Mus musculus
gtacccagcttgacagcagctcctt

SEQ ID NO: 666713 - DNA, 25 bp, Mus musculus
gtacccagcttgtcagcagctcctt

SEQ ID NO: 666714 - DNA, 25 bp, Mus musculus
gtacccaggcccacagtcagtttga

SEQ ID NO: 666715 - DNA, 25 bp, Mus musculus
gtacccaggccctcagtcagtttga

SEQ ID NO: 666716 - DNA, 25 bp, Mus musculus
gtacccagggtcatgaacatgctaa

SEQ ID NO: 666717 - DNA, 25 bp, Mus musculus
gtacccagggtcttgaacatgctaa

SEQ ID NO: 666718 - DNA, 25 bp, Mus musculus
gtacccagtagaccctgtggtcctc

SEQ ID NO: 666719 - DNA, 25 bp, Mus musculus
gtacccagtagagcctgtggtcctc

SEQ ID NO: 666720 - DNA, 25 bp, Mus musculus
gtacccagtgacatatcacatgaga

SEQ ID NO: 666721 - DNA, 25 bp, Mus musculus
gtacccagtgacttatcacatgaga

SEQ ID NO: 666722 - DNA, 25 bp, Mus musculus
gtacccagtttgaagcaagcagttt

SEQ ID NO: 666723 - DNA, 25 bp, Mus musculus
gtacccagtttgtagcaagcagttt

SEQ ID NO: 666724 - DNA, 25 bp, Mus musculus
gtacccataacccatattcacatag

SEQ ID NO: 666725 - DNA, 25 bp, Mus musculus
gtacccataaccgatattcacatag

SEQ ID NO: 666726 - DNA, 25 bp, Mus musculus
gtacccatactacagatactttctc

SEQ ID NO: 666727 - DNA, 25 bp, Mus musculus
gtacccatactagagatactttctc

SEQ ID NO: 666728 - DNA, 25 bp, Mus musculus
gtacccatcaggagaccaggtgtct

SEQ ID NO: 666729 - DNA, 25 bp, Mus musculus
gtacccatcaggtgaccaggtgtct

SEQ ID NO: 666730 - DNA, 25 bp, Mus musculus
gtacccatcagtatgatcaccaagt

SEQ ID NO: 666731 - DNA, 25 bp, Mus musculus
gtacccatcagtttgatcaccaagt

SEQ ID NO: 666732 - DNA, 25 bp, Mus musculus
gtacccatcattctagagcagcttg

SEQ ID NO: 666733 - DNA, 25 bp, Mus musculus
gtacccatcattgtagagcagcttg

SEQ ID NO: 666734 - DNA, 25 bp, Mus musculus
gtacccatgcatcctgtactgttaa

SEQ ID NO: 666735 - DNA, 25 bp, Mus musculus
gtacccatgcatgctgtactgttaa

SEQ ID NO: 666736 - DNA, 25 bp, Mus musculus
gtacccatggaaactagccacttgt

SEQ ID NO: 666737 - DNA, 25 bp, Mus musculus
gtacccatggaatctagccacttgt

SEQ ID NO: 666738 - DNA, 25 bp, Mus musculus
gtacccatggccattgaatggttcg

SEQ ID NO: 666739 - DNA, 25 bp, Mus musculus
gtacccatggcctttgaatggttcg

SEQ ID NO: 666740 - DNA, 25 bp, Mus musculus
gtacccatgggtactcgtggtagag

SEQ ID NO: 666741 - DNA, 25 bp, Mus musculus
gtacccatgggttctcgtggtagag

SEQ ID NO: 666742 - DNA, 25 bp, Mus musculus
gtacccatggtacagctggcaacag

SEQ ID NO: 666743 - DNA, 25 bp, Mus musculus
gtacccatggtagagctggcaacag

SEQ ID NO: 666744 - DNA, 25 bp, Mus musculus
gtacccattaacaatcagagcattg

SEQ ID NO: 666745 - DNA, 25 bp, Mus musculus
gtacccattaactatcagagcattg

SEQ ID NO: 666746 - DNA, 25 bp, Mus musculus
gtacccattagaatttttggccaag

SEQ ID NO: 666747 - DNA, 25 bp, Mus musculus
gtacccattagattttttggccaag

SEQ ID NO: 666748 - DNA, 25 bp, Mus musculus
gtacccatttagcaactgaagacat

SEQ ID NO: 666749 - DNA, 25 bp, Mus musculus
gtacccatttaggaactgaagacat

SEQ ID NO: 666750 - DNA, 25 bp, Mus musculus
gtaccccaaactccactacagaggg

SEQ ID NO: 666751 - DNA, 25 bp, Mus musculus
gtaccccaaactgcactacagaggg

SEQ ID NO: 666752 - DNA, 25 bp, Mus musculus
gtaccccaaagcaatttcaatgtat

SEQ ID NO: 666753 - DNA, 25 bp, Mus musculus
gtaccccaaagctatttcaatgtat

SEQ ID NO: 666754 - DNA, 25 bp, Mus musculus
gtaccccaaatcacctatgttgaag

SEQ ID NO: 666755 - DNA, 25 bp, Mus musculus
gtaccccaaatctcctatgttgaag

SEQ ID NO: 666756 - DNA, 25 bp, Mus musculus
gtaccccaacagaggcaatttaagg

SEQ ID NO: 666757 - DNA, 25 bp, Mus musculus
gtaccccaacagtggcaatttaagg

SEQ ID NO: 666758 - DNA, 25 bp, Mus musculus
gtaccccacagaatccataggaatt

SEQ ID NO: 666759 - DNA, 25 bp, Mus musculus
gtaccccacagattccataggaatt

SEQ ID NO: 666760 - DNA, 25 bp, Mus musculus
gtaccccacatcaccaaaggacagg

SEQ ID NO: 666761 - DNA, 25 bp, Mus musculus
gtaccccacatctccaaaggacagg

SEQ ID NO: 666762 - DNA, 25 bp, Mus musculus
gtaccccagattccagctatttaaa

SEQ ID NO: 666763 - DNA, 25 bp, Mus musculus
gtaccccagattgcagctatttaaa

SEQ ID NO: 666764 - DNA, 25 bp, Mus musculus
gtaccccagtataatctctgttgat

SEQ ID NO: 666765 - DNA, 25 bp, Mus musculus
gtaccccagtattatctctgttgat

SEQ ID NO: 666766 - DNA, 25 bp, Mus musculus
gtaccccagtggatgtgaattaaat

SEQ ID NO: 666767 - DNA, 25 bp, Mus musculus
gtaccccagtggttgtgaattaaat

SEQ ID NO: 666768 - DNA, 25 bp, Mus musculus
gtaccccagttcaaatttgtccatt

SEQ ID NO: 666769 - DNA, 25 bp, Mus musculus
gtaccccagttctaatttgtccatt

SEQ ID NO: 666770 - DNA, 25 bp, Mus musculus
gtaccccataacattcacctaagat

SEQ ID NO: 666771 - DNA, 25 bp, Mus musculus
gtaccccataactttcacctaagat

SEQ ID NO: 666772 - DNA, 25 bp, Mus musculus
gtaccccatacaagctctacaaaga

SEQ ID NO: 666773 - DNA, 25 bp, Mus musculus
gtaccccatacatgctctacaaaga

SEQ ID NO: 666774 - DNA, 25 bp, Mus musculus
gtaccccattgcctgagcatagtat

SEQ ID NO: 666775 - DNA, 25 bp, Mus musculus
gtaccccattgcgtgagcatagtat

SEQ ID NO: 666776 - DNA, 25 bp, Mus musculus
gtaccccattgtaaaagagccgtgt

SEQ ID NO: 666777 - DNA, 25 bp, Mus musculus
gtaccccattgttaaagagccgtgt

SEQ ID NO: 666778 - DNA, 25 bp, Mus musculus
gtacccccatgaaattggtcaccat

SEQ ID NO: 666779 - DNA, 25 bp, Mus musculus
gtacccccatgatattggtcaccat

SEQ ID NO: 666780 - DNA, 25 bp, Mus musculus
gtaccccgcgagcattaagcagttg

SEQ ID NO: 666781 - DNA, 25 bp, Mus musculus
gtaccccgcgaggattaagcagttg

SEQ ID NO: 666782 - DNA, 25 bp, Mus musculus
gtaccccgtgccatgtgatgagccg

SEQ ID NO: 666783 - DNA, 25 bp, Mus musculus
gtaccccgtgccttgtgatgagccg

SEQ ID NO: 666784 - DNA, 25 bp, Mus musculus
gtaccccgttggcatcattggaaac

SEQ ID NO: 666785 - DNA, 25 bp, Mus musculus
gtaccccgttgggatcattggaaac

SEQ ID NO: 666786 - DNA, 25 bp, Mus musculus
gtacccctatcaaggatacccacag

SEQ ID NO: 666787 - DNA, 25 bp, Mus musculus
gtacccctatcatggatacccacag

SEQ ID NO: 666788 - DNA, 25 bp, Mus musculus
gtacccctatttcctgaaggctttt

SEQ ID NO: 666789 - DNA, 25 bp, Mus musculus
gtacccctatttgctgaaggctttt

SEQ ID NO: 666790 - DNA, 25 bp, Mus musculus
gtacccctctacataggtgggcaga

SEQ ID NO: 666791 - DNA, 25 bp, Mus musculus
gtacccctctacttaggtgggcaga

SEQ ID NO: 666792 - DNA, 25 bp, Mus musculus
gtacccctgaacactggcatattgg

SEQ ID NO: 666793 - DNA, 25 bp, Mus musculus
gtacccctgaactctggcatattgg

SEQ ID NO: 666794 - DNA, 25 bp, Mus musculus
gtacccctgcaaagagtatttccat

SEQ ID NO: 666795 - DNA, 25 bp, Mus musculus
gtacccctgcaatgagtatttccat

SEQ ID NO: 666796 - DNA, 25 bp, Mus musculus
gtacccctggtcaagtgggaggaat

SEQ ID NO: 666797 - DNA, 25 bp, Mus musculus
gtacccctggtctagtgggaggaat

SEQ ID NO: 666798 - DNA, 25 bp, Mus musculus
gtacccctggttccacagggtagat

SEQ ID NO: 666799 - DNA, 25 bp, Mus musculus
gtacccctggttgcacagggtagat

SEQ ID NO: 666800 - DNA, 25 bp, Mus musculus
gtacccctgtacaccttgcgggatg

SEQ ID NO: 666801 - DNA, 25 bp, Mus musculus
gtacccctgtactccttgcgggatg

SEQ ID NO: 666802 - DNA, 25 bp, Mus musculus
gtacccctgtgaaatctgtggcact

SEQ ID NO: 666803 - DNA, 25 bp, Mus musculus
gtacccctgtgatatctgtggcact

SEQ ID NO: 666804 - DNA, 25 bp, Mus musculus
gtacccctgttaatgatagactgct

SEQ ID NO: 666805 - DNA, 25 bp, Mus musculus
gtacccctgttattgatagactgct

SEQ ID NO: 666806 - DNA, 25 bp, Mus musculus
gtaccccttttcatctgaacattat

SEQ ID NO: 666807 - DNA, 25 bp, Mus musculus
gtaccccttttcttctgaacattat

SEQ ID NO: 666808 - DNA, 25 bp, Mus musculus
gtacccgaagatcagacacccatgt

SEQ ID NO: 666809 - DNA, 25 bp, Mus musculus
gtacccgaagatgagacacccatgt

SEQ ID NO: 666810 - DNA, 25 bp, Mus musculus
gtacccgaagccattgcctctggag

SEQ ID NO: 666811 - DNA, 25 bp, Mus musculus
gtacccgaagcctttgcctctggag

SEQ ID NO: 666812 - DNA, 25 bp, Mus musculus
gtacccgacggtagcatgtgagctt

SEQ ID NO: 666813 - DNA, 25 bp, Mus musculus
gtacccgacggttgcatgtgagctt

SEQ ID NO: 666814 - DNA, 25 bp, Mus musculus
gtacccgagcttagcgaccatgcaa

SEQ ID NO: 666815 - DNA, 25 bp, Mus musculus
gtacccgagctttgcgaccatgcaa

SEQ ID NO: 666816 - DNA, 25 bp, Mus musculus
gtacccgcctacagtttcaatggtt

SEQ ID NO: 666817 - DNA, 25 bp, Mus musculus
gtacccgcctactgtttcaatggtt

SEQ ID NO: 666818 - DNA, 25 bp, Mus musculus
gtacccgctagcaacctatcaaaag

SEQ ID NO: 666819 - DNA, 25 bp, Mus musculus
gtacccgctagctacctatcaaaag

SEQ ID NO: 666820 - DNA, 25 bp, Mus musculus
gtacccgctctgatgtatcagatca

SEQ ID NO: 666821 - DNA, 25 bp, Mus musculus
gtacccgctctgttgtatcagatca

SEQ ID NO: 666822 - DNA, 25 bp, Mus musculus
gtacccgcttccagatatgggcaga

SEQ ID NO: 666823 - DNA, 25 bp, Mus musculus
gtacccgcttcctgatatgggcaga

SEQ ID NO: 666824 - DNA, 25 bp, Mus musculus
gtacccggagatactaacagatgga

SEQ ID NO: 666825 - DNA, 25 bp, Mus musculus
gtacccggagattctaacagatgga

SEQ ID NO: 666826 - DNA, 25 bp, Mus musculus
gtacccggatcactgtttctagtaa

SEQ ID NO: 666827 - DNA, 25 bp, Mus musculus
gtacccggatcagtgtttctagtaa

SEQ ID NO: 666828 - DNA, 25 bp, Mus musculus
gtacccggctagaaattgtcactgt

SEQ ID NO: 666829 - DNA, 25 bp, Mus musculus
gtacccggctagtaattgtcactgt

SEQ ID NO: 666830 - DNA, 25 bp, Mus musculus
gtacccgggatcactggaccaaagt

SEQ ID NO: 666831 - DNA, 25 bp, Mus musculus
gtacccgggatctctggaccaaagt

SEQ ID NO: 666832 - DNA, 25 bp, Mus musculus
gtacccgtaagtatagctttacaag

SEQ ID NO: 666833 - DNA, 25 bp, Mus musculus
gtacccgtaagtttagctttacaag

SEQ ID NO: 666834 - DNA, 25 bp, Mus musculus
gtacccgtccctacagtgatctaca

SEQ ID NO: 666835 - DNA, 25 bp, Mus musculus
gtacccgtcccttcagtgatctaca

SEQ ID NO: 666836 - DNA, 25 bp, Mus musculus
gtacccgtctcaccattaaaggcgt

SEQ ID NO: 666837 - DNA, 25 bp, Mus musculus
gtacccgtctcagcattaaaggcgt

SEQ ID NO: 666838 - DNA, 25 bp, Mus musculus
gtacccgtctgcaggtgtctttaca

SEQ ID NO: 666839 - DNA, 25 bp, Mus musculus
gtacccgtctgctggtgtctttaca

SEQ ID NO: 666840 - DNA, 25 bp, Mus musculus
gtacccgtctgtcgtaatgcattgt

SEQ ID NO: 666841 - DNA, 25 bp, Mus musculus
gtacccgtctgtctgacattgacaa

SEQ ID NO: 666842 - DNA, 25 bp, Mus musculus
gtacccgtctgtggtaatgcattgt

SEQ ID NO: 666843 - DNA, 25 bp, Mus musculus
gtacccgtctgtgtgacattgacaa

SEQ ID NO: 666844 - DNA, 25 bp, Mus musculus
gtaccctacatcaactgtgtggatc

SEQ ID NO: 666845 - DNA, 25 bp, Mus musculus
gtaccctacatctactgtgtggatc

SEQ ID NO: 666846 - DNA, 25 bp, Mus musculus
gtaccctacgtgaaacaggaatcag

SEQ ID NO: 666847 - DNA, 25 bp, Mus musculus
gtaccctacgtgtaacaggaatcag

SEQ ID NO: 666848 - DNA, 25 bp, Mus musculus
gtaccctactcaattgatttcatgg

SEQ ID NO: 666849 - DNA, 25 bp, Mus musculus
gtaccctactcatttgatttcatgg

SEQ ID NO: 666850 - DNA, 25 bp, Mus musculus
gtaccctactgtaagttcgttgtgc

SEQ ID NO: 666851 - DNA, 25 bp, Mus musculus
gtaccctactgttagttcgttgtgc

SEQ ID NO: 666852 - DNA, 25 bp, Mus musculus
gtaccctaggtaatgaccagtggat

SEQ ID NO: 666853 - DNA, 25 bp, Mus musculus
gtaccctaggtattgaccagtggat

SEQ ID NO: 666854 - DNA, 25 bp, Mus musculus
gtaccctaggtgctaaagggtctgc

SEQ ID NO: 666855 - DNA, 25 bp, Mus musculus
gtaccctaggtggtaaagggtctgc

SEQ ID NO: 666856 - DNA, 25 bp, Mus musculus
gtaccctatagcatgtcatgtccat

SEQ ID NO: 666857 - DNA, 25 bp, Mus musculus
gtaccctatagcttgtcatgtccat

SEQ ID NO: 666858 - DNA, 25 bp, Mus musculus
gtaccctatgttaatcagccaccag

SEQ ID NO: 666859 - DNA, 25 bp, Mus musculus
gtaccctatgtttatcagccaccag

SEQ ID NO: 666860 - DNA, 25 bp, Mus musculus
gtaccctcaggtaattgtcgaccat

SEQ ID NO: 666861 - DNA, 25 bp, Mus musculus
gtaccctcaggttattgtcgaccat

SEQ ID NO: 666862 - DNA, 25 bp, Mus musculus
gtaccctccaacaaccttgagaaga

SEQ ID NO: 666863 - DNA, 25 bp, Mus musculus
gtaccctccaactaccttgagaaga

SEQ ID NO: 666864 - DNA, 25 bp, Mus musculus
gtaccctccaagcttgcttttgcag

SEQ ID NO: 666865 - DNA, 25 bp, Mus musculus
gtaccctccaaggttgcttttgcag

SEQ ID NO: 666866 - DNA, 25 bp, Mus musculus
gtaccctccgtacactggaagttga

SEQ ID NO: 666867 - DNA, 25 bp, Mus musculus
gtaccctccgtagactggaagttga

SEQ ID NO: 666868 - DNA, 25 bp, Mus musculus
gtaccctccttacttggttggtgtg

SEQ ID NO: 666869 - DNA, 25 bp, Mus musculus
gtaccctccttagttggttggtgtg

SEQ ID NO: 666870 - DNA, 25 bp, Mus musculus
gtaccctcggagatcactgatagca

SEQ ID NO: 666871 - DNA, 25 bp, Mus musculus
gtaccctcggagttcactgatagca

SEQ ID NO: 666872 - DNA, 25 bp, Mus musculus
gtaccctcgtgactcttaataaata

SEQ ID NO: 666873 - DNA, 25 bp, Mus musculus
gtaccctcgtgagtcttaataaata

SEQ ID NO: 666874 - DNA, 25 bp, Mus musculus
gtaccctctcacatatacctgaagt

SEQ ID NO: 666875 - DNA, 25 bp, Mus musculus
gtaccctctcacttatacctgaagt

SEQ ID NO: 666876 - DNA, 25 bp, Mus musculus
gtaccctctcttaggaagtaatgca

SEQ ID NO: 666877 - DNA, 25 bp, Mus musculus
gtaccctctctttggaagtaatgca

SEQ ID NO: 666878 - DNA, 25 bp, Mus musculus
gtaccctctggtaagcttcgtcact

SEQ ID NO: 666879 - DNA, 25 bp, Mus musculus
gtaccctctggttagcttcgtcact

SEQ ID NO: 666880 - DNA, 25 bp, Mus musculus
gtaccctctgtacactatcgtgttc

SEQ ID NO: 666881 - DNA, 25 bp, Mus musculus
gtaccctctgtagactatcgtgttc

SEQ ID NO: 666882 - DNA, 25 bp, Mus musculus
gtaccctcttaaataaccatgctta

SEQ ID NO: 666883 - DNA, 25 bp, Mus musculus
gtaccctcttaattaaccatgctta

SEQ ID NO: 666884 - DNA, 25 bp, Mus musculus
gtaccctgaaacactcgatggaaca

SEQ ID NO: 666885 - DNA, 25 bp, Mus musculus
gtaccctgaaactctcgatggaaca

SEQ ID NO: 666886 - DNA, 25 bp, Mus musculus
gtaccctgaacaatatttagcacat

SEQ ID NO: 666887 - DNA, 25 bp, Mus musculus
gtaccctgaacattatttagcacat

SEQ ID NO: 666888 - DNA, 25 bp, Mus musculus
gtaccctgagcaacgaccataacat

SEQ ID NO: 666889 - DNA, 25 bp, Mus musculus
gtaccctgagcatcgaccataacat

SEQ ID NO: 666890 - DNA, 25 bp, Mus musculus
gtaccctgccaaatacttagaatgt

SEQ ID NO: 666891 - DNA, 25 bp, Mus musculus
gtaccctgccaattacttagaatgt

SEQ ID NO: 666892 - DNA, 25 bp, Mus musculus
gtaccctggagcattgattttgcac

SEQ ID NO: 666893 - DNA, 25 bp, Mus musculus
gtaccctggagctttgattttgcac

SEQ ID NO: 666894 - DNA, 25 bp, Mus musculus
gtaccctgtgggaatgtttcatact

SEQ ID NO: 666895 - DNA, 25 bp, Mus musculus
gtaccctgtgggtatgtttcatact

SEQ ID NO: 666896 - DNA, 25 bp, Mus musculus
gtaccctgtgtgagttattcattgt

SEQ ID NO: 666897 - DNA, 25 bp, Mus musculus
gtaccctgtgtgtgttattcattgt

SEQ ID NO: 666898 - DNA, 25 bp, Mus musculus
gtacccttaatcaatatagttgatt

SEQ ID NO: 666899 - DNA, 25 bp, Mus musculus
gtacccttaatctatatagttgatt

SEQ ID NO: 666900 - DNA, 25 bp, Mus musculus
gtacccttcctactgacttctatta

SEQ ID NO: 666901 - DNA, 25 bp, Mus musculus
gtacccttcctagtgacttctatta

SEQ ID NO: 666902 - DNA, 25 bp, Mus musculus
gtacccttcctcacatacacaatct

SEQ ID NO: 666903 - DNA, 25 bp, Mus musculus
gtacccttcctctcatacacaatct

SEQ ID NO: 666904 - DNA, 25 bp, Mus musculus
gtacccttctagagcttctaatgac

SEQ ID NO: 666905 - DNA, 25 bp, Mus musculus
gtacccttctagtgcttctaatgac

SEQ ID NO: 666906 - DNA, 25 bp, Mus musculus
gtacccttctgacagtgcagtgtga

SEQ ID NO: 666907 - DNA, 25 bp, Mus musculus
gtacccttctgagagtgcagtgtga

SEQ ID NO: 666908 - DNA, 25 bp, Mus musculus
gtacccttgcagatatcggttccag

SEQ ID NO: 666909 - DNA, 25 bp, Mus musculus
gtacccttgcagttatcggttccag

SEQ ID NO: 666910 - DNA, 25 bp, Mus musculus
gtacccttgggacagagtattgccc

SEQ ID NO: 666911 - DNA, 25 bp, Mus musculus
gtacccttgggagagagtattgccc

SEQ ID NO: 666912 - DNA, 25 bp, Mus musculus
gtacccttgttaatggtgtgcccgt

SEQ ID NO: 666913 - DNA, 25 bp, Mus musculus
gtacccttgttattggtgtgcccgt

SEQ ID NO: 666914 - DNA, 25 bp, Mus musculus
gtaccctttaagagatccatctttt

SEQ ID NO: 666915 - DNA, 25 bp, Mus musculus
gtaccctttaagtgatccatctttt

SEQ ID NO: 666916 - DNA, 25 bp, Mus musculus
gtaccctttatcattatcagtatcg

SEQ ID NO: 666917 - DNA, 25 bp, Mus musculus
gtaccctttatctttatcagtatcg

SEQ ID NO: 666918 - DNA, 25 bp, Mus musculus
gtaccgaaaagcacaaagtctcttc

SEQ ID NO: 666919 - DNA, 25 bp, Mus musculus
gtaccgaaaagctcaaagtctcttc

SEQ ID NO: 666920 - DNA, 25 bp, Mus musculus
gtaccgaacgtgactgggtctccag

SEQ ID NO: 666921 - DNA, 25 bp, Mus musculus
gtaccgaacgtgtctgggtctccag

SEQ ID NO: 666922 - DNA, 25 bp, Mus musculus
gtaccgaatctaagtgtatacaccc

SEQ ID NO: 666923 - DNA, 25 bp, Mus musculus
gtaccgaatctatgtgtatacaccc

SEQ ID NO: 666924 - DNA, 25 bp, Mus musculus
gtaccgacaatgatttataacttag

SEQ ID NO: 666925 - DNA, 25 bp, Mus musculus
gtaccgacaatgttttataacttag

SEQ ID NO: 666926 - DNA, 25 bp, Mus musculus
gtaccgacctcaacatccaggagat

SEQ ID NO: 666927 - DNA, 25 bp, Mus musculus
gtaccgacctcatcatccaggagat

SEQ ID NO: 666928 - DNA, 25 bp, Mus musculus
gtaccgactttcagtggaaccaaat

SEQ ID NO: 666929 - DNA, 25 bp, Mus musculus
gtaccgactttctgtggaaccaaat

SEQ ID NO: 666930 - DNA, 25 bp, Mus musculus
gtaccgagaaccagaaggagcacag

SEQ ID NO: 666931 - DNA, 25 bp, Mus musculus
gtaccgagaacctgaaggagcacag

SEQ ID NO: 666932 - DNA, 25 bp, Mus musculus
gtaccgagagtcaccatggaaacct

SEQ ID NO: 666933 - DNA, 25 bp, Mus musculus
gtaccgagagtctccatggaaacct

SEQ ID NO: 666934 - DNA, 25 bp, Mus musculus
gtaccgagatggaagtccacgagtt

SEQ ID NO: 666935 - DNA, 25 bp, Mus musculus
gtaccgagatggtagtccacgagtt

SEQ ID NO: 666936 - DNA, 25 bp, Mus musculus
gtaccgagctgcatagattccataa

SEQ ID NO: 666937 - DNA, 25 bp, Mus musculus
gtaccgagctgcttagattccataa

SEQ ID NO: 666938 - DNA, 25 bp, Mus musculus
gtaccgagcttaatggacacctttg

SEQ ID NO: 666939 - DNA, 25 bp, Mus musculus
gtaccgagcttattggacacctttg

SEQ ID NO: 666940 - DNA, 25 bp, Mus musculus
gtaccgaggcatccttgacacacat

SEQ ID NO: 666941 - DNA, 25 bp, Mus musculus
gtaccgaggcatgcttgacacacat

SEQ ID NO: 666942 - DNA, 25 bp, Mus musculus
gtaccgagtggaagctttgactgta

SEQ ID NO: 666943 - DNA, 25 bp, Mus musculus
gtaccgagtggatgctttgactgta

SEQ ID NO: 666944 - DNA, 25 bp, Mus musculus
gtaccgatcagaaggaacctgagct

SEQ ID NO: 666945 - DNA, 25 bp, Mus musculus
gtaccgatcagatggaacctgagct

SEQ ID NO: 666946 - DNA, 25 bp, Mus musculus
gtaccgatcgctatcgtttgaggat

SEQ ID NO: 666947 - DNA, 25 bp, Mus musculus
gtaccgatcgctttcgtttgaggat

SEQ ID NO: 666948 - DNA, 25 bp, Mus musculus
gtaccgatctgtatctacgtatctt

SEQ ID NO: 666949 - DNA, 25 bp, Mus musculus
gtaccgatctgtttctacgtatctt

SEQ ID NO: 666950 - DNA, 25 bp, Mus musculus
gtaccgatgatgaggacacttgcca

SEQ ID NO: 666951 - DNA, 25 bp, Mus musculus
gtaccgatgatgtggacacttgcca

SEQ ID NO: 666952 - DNA, 25 bp, Mus musculus
gtaccgcagcatcatcctggctgag

SEQ ID NO: 666953 - DNA, 25 bp, Mus musculus
gtaccgcagcatgatcctggctgag

SEQ ID NO: 666954 - DNA, 25 bp, Mus musculus
gtaccgcaggtacagctgccaggct

SEQ ID NO: 666955 - DNA, 25 bp, Mus musculus
gtaccgcaggtagagctgccaggct

SEQ ID NO: 666956 - DNA, 25 bp, Mus musculus
gtaccgccatacacagctctggatt

SEQ ID NO: 666957 - DNA, 25 bp, Mus musculus
gtaccgccatactcagctctggatt

SEQ ID NO: 666958 - DNA, 25 bp, Mus musculus
gtaccgcccatcagtggtctaagga

SEQ ID NO: 666959 - DNA, 25 bp, Mus musculus
gtaccgcccatctgtggtctaagga

SEQ ID NO: 666960 - DNA, 25 bp, Mus musculus
gtaccgcccttcatactgggaacag

SEQ ID NO: 666961 - DNA, 25 bp, Mus musculus
gtaccgcccttcttactgggaacag

SEQ ID NO: 666962 - DNA, 25 bp, Mus musculus
gtaccgcctatgctggagtctttgg

SEQ ID NO: 666963 - DNA, 25 bp, Mus musculus
gtaccgcctatggtggagtctttgg

SEQ ID NO: 666964 - DNA, 25 bp, Mus musculus
gtaccgcgtccacggcatgatggat

SEQ ID NO: 666965 - DNA, 25 bp, Mus musculus
gtaccgcgtccagggcatgatggat

SEQ ID NO: 666966 - DNA, 25 bp, Mus musculus
gtaccgctaccactgagataggact

SEQ ID NO: 666967 - DNA, 25 bp, Mus musculus
gtaccgctaccagtgagataggact

SEQ ID NO: 666968 - DNA, 25 bp, Mus musculus
gtaccgctatttacactattatttc

SEQ ID NO: 666969 - DNA, 25 bp, Mus musculus
gtaccgctattttcactattatttc

SEQ ID NO: 666970 - DNA, 25 bp, Mus musculus
gtaccgctggctacccagtaggaga

SEQ ID NO: 666971 - DNA, 25 bp, Mus musculus
gtaccgctggcttcccagtaggaga

SEQ ID NO: 666972 - DNA, 25 bp, Mus musculus
gtaccgcttctcacaagcacaggag

SEQ ID NO: 666973 - DNA, 25 bp, Mus musculus
gtaccgcttctctcaagcacaggag

SEQ ID NO: 666974 - DNA, 25 bp, Mus musculus
gtaccggaagttcaccacagagagt

SEQ ID NO: 666975 - DNA, 25 bp, Mus musculus
gtaccggaagttgaccacagagagt

SEQ ID NO: 666976 - DNA, 25 bp, Mus musculus
gtaccggagagccttcagtgatcta

SEQ ID NO: 666977 - DNA, 25 bp, Mus musculus
gtaccggagagcgttcagtgatcta

SEQ ID NO: 666978 - DNA, 25 bp, Mus musculus
gtaccggagggtctatcgtctgcat

SEQ ID NO: 666979 - DNA, 25 bp, Mus musculus
gtaccggagggtgtatcgtctgcat

SEQ ID NO: 666980 - DNA, 25 bp, Mus musculus
gtaccggctacacgaacatgtgcgc

SEQ ID NO: 666981 - DNA, 25 bp, Mus musculus
gtaccggctacaggaacatgtgcgc

SEQ ID NO: 666982 - DNA, 25 bp, Mus musculus
gtaccggcttatctgtaaaggcaca

SEQ ID NO: 666983 - DNA, 25 bp, Mus musculus
gtaccggcttatgtgtaaaggcaca

SEQ ID NO: 666984 - DNA, 25 bp, Mus musculus
gtaccgggcatcattaacccatcgc

SEQ ID NO: 666985 - DNA, 25 bp, Mus musculus
gtaccgggcatctttaacccatcgc

SEQ ID NO: 666986 - DNA, 25 bp, Mus musculus
gtaccgggcgatccttgtgcctgag

SEQ ID NO: 666987 - DNA, 25 bp, Mus musculus
gtaccgggcgatgcttgtgcctgag

SEQ ID NO: 666988 - DNA, 25 bp, Mus musculus
gtaccggtcatcagacacctgtttg

SEQ ID NO: 666989 - DNA, 25 bp, Mus musculus
gtaccggtcatctgacacctgtttg

SEQ ID NO: 666990 - DNA, 25 bp, Mus musculus
gtaccggtgggaactgcacaggcta

SEQ ID NO: 666991 - DNA, 25 bp, Mus musculus
gtaccggtgggatctgcacaggcta

SEQ ID NO: 666992 - DNA, 25 bp, Mus musculus
gtaccggttctcatagatctctgag

SEQ ID NO: 666993 - DNA, 25 bp, Mus musculus
gtaccggttctcttagatctctgag

SEQ ID NO: 666994 - DNA, 25 bp, Mus musculus
gtaccgtacactatgtcgctgaaga

SEQ ID NO: 666995 - DNA, 25 bp, Mus musculus
gtaccgtacactttgtcgctgaaga

SEQ ID NO: 666996 - DNA, 25 bp, Mus musculus
gtaccgtaccggcacagcaagatga

SEQ ID NO: 666997 - DNA, 25 bp, Mus musculus
gtaccgtaccgggacagcaagatga

SEQ ID NO: 666998 - DNA, 25 bp, Mus musculus
gtaccgtacgatattatcttcttca

SEQ ID NO: 666999 - DNA, 25 bp, Mus musculus
gtaccgtacgattttatcttcttca

SEQ ID NO: 667000 - DNA, 25 bp, Mus musculus
gtaccgtactttcgattgttgtgct

SEQ ID NO: 667001 - DNA, 25 bp, Mus musculus
gtaccgtactttggattgttgtgct

SEQ ID NO: 667002 - DNA, 25 bp, Mus musculus
gtaccgtagtgacaacgctagtgct

SEQ ID NO: 667003 - DNA, 25 bp, Mus musculus
gtaccgtagtgagaacgctagtgct

SEQ ID NO: 667004 - DNA, 25 bp, Mus musculus
gtaccgtatcacactgcttgcaaag

SEQ ID NO: 667005 - DNA, 25 bp, Mus musculus
gtaccgtatcactctgcttgcaaag

SEQ ID NO: 667006 - DNA, 25 bp, Mus musculus
gtaccgtatctgaaggtgtcctgta

SEQ ID NO: 667007 - DNA, 25 bp, Mus musculus
gtaccgtatctgtaggtgtcctgta

SEQ ID NO: 667008 - DNA, 25 bp, Mus musculus
gtaccgtcagttctcctatctgtat

SEQ ID NO: 667009 - DNA, 25 bp, Mus musculus
gtaccgtcagttgtcctatctgtat

SEQ ID NO: 667010 - DNA, 25 bp, Mus musculus
gtaccgtcatcactcatagcaccag

SEQ ID NO: 667011 - DNA, 25 bp, Mus musculus
gtaccgtcatcagtcatagcaccag

SEQ ID NO: 667012 - DNA, 25 bp, Mus musculus
gtaccgtcatgacattgactgccag

SEQ ID NO: 667013 - DNA, 25 bp, Mus musculus
gtaccgtcatgagattgactgccag

SEQ ID NO: 667014 - DNA, 25 bp, Mus musculus
gtaccgtcgaggacagtcatcgtca

SEQ ID NO: 667015 - DNA, 25 bp, Mus musculus
gtaccgtcgaggtcagtcatcgtca

SEQ ID NO: 667016 - DNA, 25 bp, Mus musculus
gtaccgtcgcttcctttttgatata

SEQ ID NO: 667017 - DNA, 25 bp, Mus musculus
gtaccgtcgcttgctttttgatata

SEQ ID NO: 667018 - DNA, 25 bp, Mus musculus
gtaccgtggatacacagaacatgct

SEQ ID NO: 667019 - DNA, 25 bp, Mus musculus
gtaccgtggatagacagaacatgct

SEQ ID NO: 667020 - DNA, 25 bp, Mus musculus
gtaccgtgtacaagcattatctact

SEQ ID NO: 667021 - DNA, 25 bp, Mus musculus
gtaccgtgtacatgcattatctact

SEQ ID NO: 667022 - DNA, 25 bp, Mus musculus
gtaccgtgtacccagtgtttgtgaa

SEQ ID NO: 667023 - DNA, 25 bp, Mus musculus
gtaccgtgtaccgagtgtttgtgaa

SEQ ID NO: 667024 - DNA, 25 bp, Mus musculus
gtaccgtgttaactgctattcagtc

SEQ ID NO: 667025 - DNA, 25 bp, Mus musculus
gtaccgtgttaagtgctattcagtc

SEQ ID NO: 667026 - DNA, 25 bp, Mus musculus
gtaccgttctaccattttgtggact

SEQ ID NO: 667027 - DNA, 25 bp, Mus musculus
gtaccgttctacgattttgtggact

SEQ ID NO: 667028 - DNA, 25 bp, Mus musculus
gtaccgtttgctagtcatgcctgca

SEQ ID NO: 667029 - DNA, 25 bp, Mus musculus
gtaccgtttgcttgtcatgcctgca

SEQ ID NO: 667030 - DNA, 25 bp, Mus musculus
gtaccgtttttaagcatggtcacat

SEQ ID NO: 667031 - DNA, 25 bp, Mus musculus
gtaccgtttttatgcatggtcacat

SEQ ID NO: 667032 - DNA, 25 bp, Mus musculus
gtacctaaatgtattaagcaactga

SEQ ID NO: 667033 - DNA, 25 bp, Mus musculus
gtacctaaatgttttaagcaactga

SEQ ID NO: 667034 - DNA, 25 bp, Mus musculus
gtacctaaattaagaccatttggtt

SEQ ID NO: 667035 - DNA, 25 bp, Mus musculus
gtacctaaattatgaccatttggtt

SEQ ID NO: 667036 - DNA, 25 bp, Mus musculus
gtacctaagtagagatcccttgcct

SEQ ID NO: 667037 - DNA, 25 bp, Mus musculus
gtacctaagtagtgatcccttgcct

SEQ ID NO: 667038 - DNA, 25 bp, Mus musculus
gtacctaataggattgtgttgatat

SEQ ID NO: 667039 - DNA, 25 bp, Mus musculus
gtacctaataggtttgtgttgatat

SEQ ID NO: 667040 - DNA, 25 bp, Mus musculus
gtacctaatcctaataccctattga

SEQ ID NO: 667041 - DNA, 25 bp, Mus musculus
gtacctaatccttataccctattga

SEQ ID NO: 667042 - DNA, 25 bp, Mus musculus
gtacctacaagaatacctgcaagtg

SEQ ID NO: 667043 - DNA, 25 bp, Mus musculus
gtacctacaagattacctgcaagtg

SEQ ID NO: 667044 - DNA, 25 bp, Mus musculus
gtacctacaatgaaccagagtcttt

SEQ ID NO: 667045 - DNA, 25 bp, Mus musculus
gtacctacaatgtaccagagtcttt

SEQ ID NO: 667046 - DNA, 25 bp, Mus musculus
gtacctaccgtgaccatggttggaa

SEQ ID NO: 667047 - DNA, 25 bp, Mus musculus
gtacctaccgtgtccatggttggaa

SEQ ID NO: 667048 - DNA, 25 bp, Mus musculus
gtacctacctgaaacaagacttcgt

SEQ ID NO: 667049 - DNA, 25 bp, Mus musculus
gtacctacctgatacaagacttcgt

SEQ ID NO: 667050 - DNA, 25 bp, Mus musculus
gtacctacgccacgaacctttggag

SEQ ID NO: 667051 - DNA, 25 bp, Mus musculus
gtacctacgccaggaacctttggag

SEQ ID NO: 667052 - DNA, 25 bp, Mus musculus
gtacctacgctgcttttgaacctgt

SEQ ID NO: 667053 - DNA, 25 bp, Mus musculus
gtacctacgctggttttgaacctgt

SEQ ID NO: 667054 - DNA, 25 bp, Mus musculus
gtacctactggcattgggcttaaat

SEQ ID NO: 667055 - DNA, 25 bp, Mus musculus
gtacctactggctttgggcttaaat

SEQ ID NO: 667056 - DNA, 25 bp, Mus musculus
gtacctacttaacacaggtcaccta

SEQ ID NO: 667057 - DNA, 25 bp, Mus musculus
gtacctacttaagacaggtcaccta

SEQ ID NO: 667058 - DNA, 25 bp, Mus musculus
gtacctacttttaattcactgcaaa

SEQ ID NO: 667059 - DNA, 25 bp, Mus musculus
gtacctactttttattcactgcaaa

SEQ ID NO: 667060 - DNA, 25 bp, Mus musculus
gtacctagaactccggtccttttga

SEQ ID NO: 667061 - DNA, 25 bp, Mus musculus
gtacctagaactgcggtccttttga

SEQ ID NO: 667062 - DNA, 25 bp, Mus musculus
gtacctagactcaggcaagggtgga

SEQ ID NO: 667063 - DNA, 25 bp, Mus musculus
gtacctagactctggcaagggtgga

SEQ ID NO: 667064 - DNA, 25 bp, Mus musculus
gtacctagagccctttgtagtgctg

SEQ ID NO: 667065 - DNA, 25 bp, Mus musculus
gtacctagagccgtttgtagtgctg

SEQ ID NO: 667066 - DNA, 25 bp, Mus musculus
gtacctagagtgacagattcataga

SEQ ID NO: 667067 - DNA, 25 bp, Mus musculus
gtacctagagtgtcagattcataga

SEQ ID NO: 667068 - DNA, 25 bp, Mus musculus
gtacctagatgaatgagccaagcaa

SEQ ID NO: 667069 - DNA, 25 bp, Mus musculus
gtacctagatgattgagccaagcaa

SEQ ID NO: 667070 - DNA, 25 bp, Mus musculus
gtacctaggagacctgctaagccgt

SEQ ID NO: 667071 - DNA, 25 bp, Mus musculus
gtacctaggagagctgctaagccgt

SEQ ID NO: 667072 - DNA, 25 bp, Mus musculus
gtacctaggttgacaatccagttcc

SEQ ID NO: 667073 - DNA, 25 bp, Mus musculus
gtacctaggttgtcaatccagttcc

SEQ ID NO: 667074 - DNA, 25 bp, Mus musculus
gtacctagtcccaagagaaccaatg

SEQ ID NO: 667075 - DNA, 25 bp, Mus musculus
gtacctagtccctagagaaccaatg

SEQ ID NO: 667076 - DNA, 25 bp, Mus musculus
gtacctagtcctagcttgtttgttt

SEQ ID NO: 667077 - DNA, 25 bp, Mus musculus
gtacctagtccttgcttgtttgttt

SEQ ID NO: 667078 - DNA, 25 bp, Mus musculus
gtacctagtgcactactacggatgg

SEQ ID NO: 667079 - DNA, 25 bp, Mus musculus
gtacctagtgcagtactacggatgg

SEQ ID NO: 667080 - DNA, 25 bp, Mus musculus
gtacctatacaaaattcctggttaa

SEQ ID NO: 667081 - DNA, 25 bp, Mus musculus
gtacctatacaatattcctggttaa

SEQ ID NO: 667082 - DNA, 25 bp, Mus musculus
gtacctatacttcttagcactatca

SEQ ID NO: 667083 - DNA, 25 bp, Mus musculus
gtacctatacttgttagcactatca

SEQ ID NO: 667084 - DNA, 25 bp, Mus musculus
gtacctatcaggagcggtaatccgt

SEQ ID NO: 667085 - DNA, 25 bp, Mus musculus
gtacctatcaggtgcggtaatccgt

SEQ ID NO: 667086 - DNA, 25 bp, Mus musculus
gtacctatcggaagtgtgctctgca

SEQ ID NO: 667087 - DNA, 25 bp, Mus musculus
gtacctatcggatgtgtgctctgca

SEQ ID NO: 667088 - DNA, 25 bp, Mus musculus
gtacctatgaacaatccgagtcaag

SEQ ID NO: 667089 - DNA, 25 bp, Mus musculus
gtacctatgaactatccgagtcaag

SEQ ID NO: 667090 - DNA, 25 bp, Mus musculus
gtacctatgactcttgcctgcaaaa

SEQ ID NO: 667091 - DNA, 25 bp, Mus musculus
gtacctatgactgttgcctgcaaaa

SEQ ID NO: 667092 - DNA, 25 bp, Mus musculus
gtacctatggagattcttcatttgc

SEQ ID NO: 667093 - DNA, 25 bp, Mus musculus
gtacctatggagtttcttcatttgc

SEQ ID NO: 667094 - DNA, 25 bp, Mus musculus
gtacctatgtgtactatgacctttc

SEQ ID NO: 667095 - DNA, 25 bp, Mus musculus
gtacctatgtgttctatgacctttc

SEQ ID NO: 667096 - DNA, 25 bp, Mus musculus
gtacctcaaggaacattgcgcctcc

SEQ ID NO: 667097 - DNA, 25 bp, Mus musculus
gtacctcaaggacatcgctaagctt

SEQ ID NO: 667098 - DNA, 25 bp, Mus musculus
gtacctcaaggagatcgctaagctt

SEQ ID NO: 667099 - DNA, 25 bp, Mus musculus
gtacctcaaggatcattgcgcctcc

SEQ ID NO: 667100 - DNA, 25 bp, Mus musculus
gtacctcaaggtcttttaataatga

SEQ ID NO: 667101 - DNA, 25 bp, Mus musculus
gtacctcaaggtgttttaataatga

SEQ ID NO: 667102 - DNA, 25 bp, Mus musculus
gtacctcaagttaggtcaggctgca

SEQ ID NO: 667103 - DNA, 25 bp, Mus musculus
gtacctcaagtttggtcaggctgca

SEQ ID NO: 667104 - DNA, 25 bp, Mus musculus
gtacctcaatggagccagcgtgctg

SEQ ID NO: 667105 - DNA, 25 bp, Mus musculus
gtacctcaatggtgccagcgtgctg

SEQ ID NO: 667106 - DNA, 25 bp, Mus musculus
gtacctcacactattggctcctttg

SEQ ID NO: 667107 - DNA, 25 bp, Mus musculus
gtacctcacacttttggctcctttg

SEQ ID NO: 667108 - DNA, 25 bp, Mus musculus
gtacctcacattctgagacctcaca

SEQ ID NO: 667109 - DNA, 25 bp, Mus musculus
gtacctcacattgtgagacctcaca

SEQ ID NO: 667110 - DNA, 25 bp, Mus musculus
gtacctcaccagagggtattcggag

SEQ ID NO: 667111 - DNA, 25 bp, Mus musculus
gtacctcaccagtgggtattcggag

SEQ ID NO: 667112 - DNA, 25 bp, Mus musculus
gtacctcaccttaatgaaagcggct

SEQ ID NO: 667113 - DNA, 25 bp, Mus musculus
gtacctcacctttatgaaagcggct

SEQ ID NO: 667114 - DNA, 25 bp, Mus musculus
gtacctcactcaccagaacggaagt

SEQ ID NO: 667115 - DNA, 25 bp, Mus musculus
gtacctcactcagcagaacggaagt

SEQ ID NO: 667116 - DNA, 25 bp, Mus musculus
gtacctcagatgatttatcctctca

SEQ ID NO: 667117 - DNA, 25 bp, Mus musculus
gtacctcagatgttttatcctctca

SEQ ID NO: 667118 - DNA, 25 bp, Mus musculus
gtacctcaggagcatactgttcatg

SEQ ID NO: 667119 - DNA, 25 bp, Mus musculus
gtacctcaggagcattactggctaa

SEQ ID NO: 667120 - DNA, 25 bp, Mus musculus
gtacctcaggaggatactgttcatg

SEQ ID NO: 667121 - DNA, 25 bp, Mus musculus
gtacctcaggaggattactggctaa

SEQ ID NO: 667122 - DNA, 25 bp, Mus musculus
gtacctcagtctcaactcaaattaa

SEQ ID NO: 667123 - DNA, 25 bp, Mus musculus
gtacctcagtctgaactcaaattaa

SEQ ID NO: 667124 - DNA, 25 bp, Mus musculus
gtacctcagtgtccaatctgaacag

SEQ ID NO: 667125 - DNA, 25 bp, Mus musculus
gtacctcagtgtgcaatctgaacag

SEQ ID NO: 667126 - DNA, 25 bp, Mus musculus
gtacctcatatactagatgtttcct

SEQ ID NO: 667127 - DNA, 25 bp, Mus musculus
gtacctcatatagtagatgtttcct

SEQ ID NO: 667128 - DNA, 25 bp, Mus musculus
gtacctcatgaacccctgcttagca

SEQ ID NO: 667129 - DNA, 25 bp, Mus musculus
gtacctcatgaagccctgcttagca

SEQ ID NO: 667130 - DNA, 25 bp, Mus musculus
gtacctcatgccagtctggttgtgt

SEQ ID NO: 667131 - DNA, 25 bp, Mus musculus
gtacctcatgcctgtctggttgtgt

SEQ ID NO: 667132 - DNA, 25 bp, Mus musculus
gtacctcattacatctgtgtctaag

SEQ ID NO: 667133 - DNA, 25 bp, Mus musculus
gtacctcattacttctgtgtctaag

SEQ ID NO: 667134 - DNA, 25 bp, Mus musculus
gtacctcatttgagagtcatcgtca

SEQ ID NO: 667135 - DNA, 25 bp, Mus musculus
gtacctcatttgtgagtcatcgtca

SEQ ID NO: 667136 - DNA, 25 bp, Mus musculus
gtacctccagatcctctgtatgtca

SEQ ID NO: 667137 - DNA, 25 bp, Mus musculus
gtacctccagatgctctgtatgtca

SEQ ID NO: 667138 - DNA, 25 bp, Mus musculus
gtacctcccactagagttcccgaag

SEQ ID NO: 667139 - DNA, 25 bp, Mus musculus
gtacctcccacttgagttcccgaag

SEQ ID NO: 667140 - DNA, 25 bp, Mus musculus
gtacctcccctaaattcatcaatat

SEQ ID NO: 667141 - DNA, 25 bp, Mus musculus
gtacctcccctatattcatcaatat

SEQ ID NO: 667142 - DNA, 25 bp, Mus musculus
gtacctcccgtaaatgtgccattgt

SEQ ID NO: 667143 - DNA, 25 bp, Mus musculus
gtacctcccgtatatgtgccattgt

SEQ ID NO: 667144 - DNA, 25 bp, Mus musculus
gtacctccctgtatcctaatgcata

SEQ ID NO: 667145 - DNA, 25 bp, Mus musculus
gtacctccctgtttcctaatgcata

SEQ ID NO: 667146 - DNA, 25 bp, Mus musculus
gtacctcctaagacttactctttag

SEQ ID NO: 667147 - DNA, 25 bp, Mus musculus
gtacctcctaagtcttactctttag

SEQ ID NO: 667148 - DNA, 25 bp, Mus musculus
gtacctcctaggagcagtgactatg

SEQ ID NO: 667149 - DNA, 25 bp, Mus musculus
gtacctcctaggtgcagtgactatg

SEQ ID NO: 667150 - DNA, 25 bp, Mus musculus
gtacctcctgatacatttccatatt

SEQ ID NO: 667151 - DNA, 25 bp, Mus musculus
gtacctcctgattcatttccatatt

SEQ ID NO: 667152 - DNA, 25 bp, Mus musculus
gtacctcctgttagtgtgcgaagta

SEQ ID NO: 667153 - DNA, 25 bp, Mus musculus
gtacctcctgtttgtgtgcgaagta

SEQ ID NO: 667154 - DNA, 25 bp, Mus musculus
gtacctccttgaactacttcataac

SEQ ID NO: 667155 - DNA, 25 bp, Mus musculus
gtacctccttgatctacttcataac

SEQ ID NO: 667156 - DNA, 25 bp, Mus musculus
gtacctcctttacctgcaagagaga

SEQ ID NO: 667157 - DNA, 25 bp, Mus musculus
gtacctcctttagctgcaagagaga

SEQ ID NO: 667158 - DNA, 25 bp, Mus musculus
gtacctcgacatagcatcttaattt

SEQ ID NO: 667159 - DNA, 25 bp, Mus musculus
gtacctcgacattgcatcttaattt

SEQ ID NO: 667160 - DNA, 25 bp, Mus musculus
gtacctcgcggtagttttcgaactg

SEQ ID NO: 667161 - DNA, 25 bp, Mus musculus
gtacctcgcggttgttttcgaactg

SEQ ID NO: 667162 - DNA, 25 bp, Mus musculus
gtacctcgctagacttcactaacaa

SEQ ID NO: 667163 - DNA, 25 bp, Mus musculus
gtacctcgctagtcttcactaacaa

SEQ ID NO: 667164 - DNA, 25 bp, Mus musculus
gtacctcgctgtattttcaaataag

SEQ ID NO: 667165 - DNA, 25 bp, Mus musculus
gtacctcgctgttttttcaaataag

SEQ ID NO: 667166 - DNA, 25 bp, Mus musculus
gtacctcgttaacgctttccgagca

SEQ ID NO: 667167 - DNA, 25 bp, Mus musculus
gtacctcgttaaggctttccgagca

SEQ ID NO: 667168 - DNA, 25 bp, Mus musculus
gtacctcgttcaatgtgggagttaa

SEQ ID NO: 667169 - DNA, 25 bp, Mus musculus
gtacctcgttcattgtgggagttaa

SEQ ID NO: 667170 - DNA, 25 bp, Mus musculus
gtacctctacaacctggagccgaat

SEQ ID NO: 667171 - DNA, 25 bp, Mus musculus
gtacctctacaagctggagccgaat

SEQ ID NO: 667172 - DNA, 25 bp, Mus musculus
gtacctctacctctgttatgtgtga

SEQ ID NO: 667173 - DNA, 25 bp, Mus musculus
gtacctctacctgtgttatgtgtga

SEQ ID NO: 667174 - DNA, 25 bp, Mus musculus
gtacctctaggacaccacacagaaa

SEQ ID NO: 667175 - DNA, 25 bp, Mus musculus
gtacctctaggagaccacacagaaa

SEQ ID NO: 667176 - DNA, 25 bp, Mus musculus
gtacctctaggtccttttgggatgg

SEQ ID NO: 667177 - DNA, 25 bp, Mus musculus
gtacctctaggtgcttttgggatgg

SEQ ID NO: 667178 - DNA, 25 bp, Mus musculus
gtacctctcaagctagtgtttctag

SEQ ID NO: 667179 - DNA, 25 bp, Mus musculus
gtacctctcaaggtagtgtttctag

SEQ ID NO: 667180 - DNA, 25 bp, Mus musculus
gtacctctcaggatgtatctctaaa

SEQ ID NO: 667181 - DNA, 25 bp, Mus musculus
gtacctctcaggttgtatctctaaa

SEQ ID NO: 667182 - DNA, 25 bp, Mus musculus
gtacctctccatacatacatcagta

SEQ ID NO: 667183 - DNA, 25 bp, Mus musculus
gtacctctccattcatacatcagta

SEQ ID NO: 667184 - DNA, 25 bp, Mus musculus
gtacctctccttatgtaattacgtt

SEQ ID NO: 667185 - DNA, 25 bp, Mus musculus
gtacctctccttttgtaattacgtt

SEQ ID NO: 667186 - DNA, 25 bp, Mus musculus
gtacctctgaagatatttataatgt

SEQ ID NO: 667187 - DNA, 25 bp, Mus musculus
gtacctctgaagttatttataatgt

SEQ ID NO: 667188 - DNA, 25 bp, Mus musculus
gtacctctgccaagcatccttatgc

SEQ ID NO: 667189 - DNA, 25 bp, Mus musculus
gtacctctgccatgcatccttatgc

SEQ ID NO: 667190 - DNA, 25 bp, Mus musculus
gtacctctgcgtactaggactgtag

SEQ ID NO: 667191 - DNA, 25 bp, Mus musculus
gtacctctgcgttctaggactgtag

SEQ ID NO: 667192 - DNA, 25 bp, Mus musculus
gtacctctggccaatgtgacattga

SEQ ID NO: 667193 - DNA, 25 bp, Mus musculus
gtacctctggcctatgtgacattga

SEQ ID NO: 667194 - DNA, 25 bp, Mus musculus
gtacctctgtgtctctggtgacaga

SEQ ID NO: 667195 - DNA, 25 bp, Mus musculus
gtacctctgtgtgtctggtgacaga

SEQ ID NO: 667196 - DNA, 25 bp, Mus musculus
gtacctcttagcagtctctagtttg

SEQ ID NO: 667197 - DNA, 25 bp, Mus musculus
gtacctcttagctgtctctagtttg

SEQ ID NO: 667198 - DNA, 25 bp, Mus musculus
gtacctcttgaacaagatctgagtt

SEQ ID NO: 667199 - DNA, 25 bp, Mus musculus
gtacctcttgaagaagatctgagtt

SEQ ID NO: 667200 - DNA, 25 bp, Mus musculus
gtacctcttgttaacataatctgca

SEQ ID NO: 667201 - DNA, 25 bp, Mus musculus
gtacctcttgtttacataatctgca

SEQ ID NO: 667202 - DNA, 25 bp, Mus musculus
gtacctgaaactcaaggaggccttc

SEQ ID NO: 667203 - DNA, 25 bp, Mus musculus
gtacctgaaactgaaggaggccttc

SEQ ID NO: 667204 - DNA, 25 bp, Mus musculus
gtacctgaacggccatcagtcgaat

SEQ ID NO: 667205 - DNA, 25 bp, Mus musculus
gtacctgaacgggcatcagtcgaat

SEQ ID NO: 667206 - DNA, 25 bp, Mus musculus
gtacctgaacttcactacgggagaa

SEQ ID NO: 667207 - DNA, 25 bp, Mus musculus
gtacctgaacttgactacgggagaa

SEQ ID NO: 667208 - DNA, 25 bp, Mus musculus
gtacctgaagcgacacaatgctctg

SEQ ID NO: 667209 - DNA, 25 bp, Mus musculus
gtacctgaagcgtcacaatgctctg

SEQ ID NO: 667210 - DNA, 25 bp, Mus musculus
gtacctgaagtaagaccaacaccca

SEQ ID NO: 667211 - DNA, 25 bp, Mus musculus
gtacctgaagtatgaccaacaccca

SEQ ID NO: 667212 - DNA, 25 bp, Mus musculus
gtacctgaataccaagctggacctc

SEQ ID NO: 667213 - DNA, 25 bp, Mus musculus
gtacctgaatacgaagctggacctc

SEQ ID NO: 667214 - DNA, 25 bp, Mus musculus
gtacctgaatatctatagtgagtca

SEQ ID NO: 667215 - DNA, 25 bp, Mus musculus
gtacctgaatatgtatagtgagtca

SEQ ID NO: 667216 - DNA, 25 bp, Mus musculus
gtacctgacagacctgggacctgga

SEQ ID NO: 667217 - DNA, 25 bp, Mus musculus
gtacctgacagagctgggacctgga

SEQ ID NO: 667218 - DNA, 25 bp, Mus musculus
gtacctgagaataatgcaacgagcc

SEQ ID NO: 667219 - DNA, 25 bp, Mus musculus
gtacctgagaattatgcaacgagcc

SEQ ID NO: 667220 - DNA, 25 bp, Mus musculus
gtacctgagtaacatttctcataac

SEQ ID NO: 667221 - DNA, 25 bp, Mus musculus
gtacctgagtaagatttctcataac

SEQ ID NO: 667222 - DNA, 25 bp, Mus musculus
gtacctgagtcaagggatttaattt

SEQ ID NO: 667223 - DNA, 25 bp, Mus musculus
gtacctgagtcatgggatttaattt

SEQ ID NO: 667224 - DNA, 25 bp, Mus musculus
gtacctgatacaatcctctgtgcta

SEQ ID NO: 667225 - DNA, 25 bp, Mus musculus
gtacctgatacattcctctgtgcta

SEQ ID NO: 667226 - DNA, 25 bp, Mus musculus
gtacctgatgaactacatcctagac

SEQ ID NO: 667227 - DNA, 25 bp, Mus musculus
gtacctgatgaagtacatcctagac

SEQ ID NO: 667228 - DNA, 25 bp, Mus musculus
gtacctgatgatacgagtgactttc

SEQ ID NO: 667229 - DNA, 25 bp, Mus musculus
gtacctgatgattcgagtgactttc

SEQ ID NO: 667230 - DNA, 25 bp, Mus musculus
gtacctgattctacagaaaacctcc

SEQ ID NO: 667231 - DNA, 25 bp, Mus musculus
gtacctgattcttcagaaaacctcc

SEQ ID NO: 667232 - DNA, 25 bp, Mus musculus
gtacctgcaacccaagctatttagc

SEQ ID NO: 667233 - DNA, 25 bp, Mus musculus
gtacctgcaaccgaagctatttagc

SEQ ID NO: 667234 - DNA, 25 bp, Mus musculus
gtacctgcaagtaataagggactac

SEQ ID NO: 667235 - DNA, 25 bp, Mus musculus
gtacctgcaagttataagggactac

SEQ ID NO: 667236 - DNA, 25 bp, Mus musculus
gtacctgcacatacaattcatggat

SEQ ID NO: 667237 - DNA, 25 bp, Mus musculus
gtacctgcacattcaattcatggat

SEQ ID NO: 667238 - DNA, 25 bp, Mus musculus
gtacctgcagcaacatgattggaat

SEQ ID NO: 667239 - DNA, 25 bp, Mus musculus
gtacctgcagcatcatgattggaat

SEQ ID NO: 667240 - DNA, 25 bp, Mus musculus
gtacctgcatctattgtattttgta

SEQ ID NO: 667241 - DNA, 25 bp, Mus musculus
gtacctgcatcttttgtattttgta

SEQ ID NO: 667242 - DNA, 25 bp, Mus musculus
gtacctgcatgtatcaaaaccctta

SEQ ID NO: 667243 - DNA, 25 bp, Mus musculus
gtacctgcatgtttcaaaaccctta

SEQ ID NO: 667244 - DNA, 25 bp, Mus musculus
gtacctgccaagagtaagactgtca

SEQ ID NO: 667245 - DNA, 25 bp, Mus musculus
gtacctgccaagtgtaagactgtca

SEQ ID NO: 667246 - DNA, 25 bp, Mus musculus
gtacctgccagtccaagattaaaga

SEQ ID NO: 667247 - DNA, 25 bp, Mus musculus
gtacctgccagtgcaagattaaaga

SEQ ID NO: 667248 - DNA, 25 bp, Mus musculus
gtacctgccatactttatttaattt

SEQ ID NO: 667249 - DNA, 25 bp, Mus musculus
gtacctgccatagtttatttaattt

SEQ ID NO: 667250 - DNA, 25 bp, Mus musculus
gtacctgccgccctatgaaaggaca

SEQ ID NO: 667251 - DNA, 25 bp, Mus musculus
gtacctgccgccgtatgaaaggaca

SEQ ID NO: 667252 - DNA, 25 bp, Mus musculus
gtacctgccgtgaaacaaacagtca

SEQ ID NO: 667253 - DNA, 25 bp, Mus musculus
gtacctgccgtgtaacaaacagtca

SEQ ID NO: 667254 - DNA, 25 bp, Mus musculus
gtacctgcctacatctttattaaca

SEQ ID NO: 667255 - DNA, 25 bp, Mus musculus
gtacctgcctacttctttattaaca

SEQ ID NO: 667256 - DNA, 25 bp, Mus musculus
gtacctgcggctaaattgccagtaa

SEQ ID NO: 667257 - DNA, 25 bp, Mus musculus
gtacctgcggcttaattgccagtaa

SEQ ID NO: 667258 - DNA, 25 bp, Mus musculus
gtacctgctacaagccatgctctgg

SEQ ID NO: 667259 - DNA, 25 bp, Mus musculus
gtacctgctacatgccatgctctgg

SEQ ID NO: 667260 - DNA, 25 bp, Mus musculus
gtacctgctatgatttaccgttgat

SEQ ID NO: 667261 - DNA, 25 bp, Mus musculus
gtacctgctatgttttaccgttgat

SEQ ID NO: 667262 - DNA, 25 bp, Mus musculus
gtacctgctattaatggtcttttga

SEQ ID NO: 667263 - DNA, 25 bp, Mus musculus
gtacctgctatttatggtcttttga

SEQ ID NO: 667264 - DNA, 25 bp, Mus musculus
gtacctgctcttattgacttgctgt

SEQ ID NO: 667265 - DNA, 25 bp, Mus musculus
gtacctgctcttcgatattgtgggc

SEQ ID NO: 667266 - DNA, 25 bp, Mus musculus
gtacctgctcttggatattgtgggc

SEQ ID NO: 667267 - DNA, 25 bp, Mus musculus
gtacctgctctttttgacttgctgt

SEQ ID NO: 667268 - DNA, 25 bp, Mus musculus
gtacctgctgaacttgagtgccacg

SEQ ID NO: 667269 - DNA, 25 bp, Mus musculus
gtacctgctgaagttgagtgccacg

SEQ ID NO: 667270 - DNA, 25 bp, Mus musculus
gtacctgctgcaagacgacaagtgc

SEQ ID NO: 667271 - DNA, 25 bp, Mus musculus
gtacctgctgcacatgtgtctttgg

SEQ ID NO: 667272 - DNA, 25 bp, Mus musculus
gtacctgctgcagatgtgtctttgg

SEQ ID NO: 667273 - DNA, 25 bp, Mus musculus
gtacctgctgcatgacgacaagtgc

SEQ ID NO: 667274 - DNA, 25 bp, Mus musculus
gtacctgctggtaatggtggatcca

SEQ ID NO: 667275 - DNA, 25 bp, Mus musculus
gtacctgctggttatggtggatcca

SEQ ID NO: 667276 - DNA, 25 bp, Mus musculus
gtacctgcttcgaggagttgttccc

SEQ ID NO: 667277 - DNA, 25 bp, Mus musculus
gtacctgcttcgtggagttgttccc

SEQ ID NO: 667278 - DNA, 25 bp, Mus musculus
gtacctgcttgcaagaaaccaacag

SEQ ID NO: 667279 - DNA, 25 bp, Mus musculus
gtacctgcttgctagaaaccaacag

SEQ ID NO: 667280 - DNA, 25 bp, Mus musculus
gtacctggaaatatttgaagacatt

SEQ ID NO: 667281 - DNA, 25 bp, Mus musculus
gtacctggaaatttttgaagacatt

SEQ ID NO: 667282 - DNA, 25 bp, Mus musculus
gtacctggaactcgatgtgaacatc

SEQ ID NO: 667283 - DNA, 25 bp, Mus musculus
gtacctggaactggatgtgaacatc

SEQ ID NO: 667284 - DNA, 25 bp, Mus musculus
gtacctggaagtagcccatttaact

SEQ ID NO: 667285 - DNA, 25 bp, Mus musculus
gtacctggaagttgcccatttaact

SEQ ID NO: 667286 - DNA, 25 bp, Mus musculus
gtacctggaccacatggaagaccta

SEQ ID NO: 667287 - DNA, 25 bp, Mus musculus
gtacctggaccagatggaagaccta

SEQ ID NO: 667288 - DNA, 25 bp, Mus musculus
gtacctggagacctacaaggcgtat

SEQ ID NO: 667289 - DNA, 25 bp, Mus musculus
gtacctggagacgtacaaggcgtat

SEQ ID NO: 667290 - DNA, 25 bp, Mus musculus
gtacctggagctaagttcctggaac

SEQ ID NO: 667291 - DNA, 25 bp, Mus musculus
gtacctggagcttagttcctggaac

SEQ ID NO: 667292 - DNA, 25 bp, Mus musculus
gtacctggaggactccgatgacgat

SEQ ID NO: 667293 - DNA, 25 bp, Mus musculus
gtacctggaggagtccgatgacgat

SEQ ID NO: 667294 - DNA, 25 bp, Mus musculus
gtacctggatctcagcccaggactt

SEQ ID NO: 667295 - DNA, 25 bp, Mus musculus
gtacctggatctgagcccaggactt

SEQ ID NO: 667296 - DNA, 25 bp, Mus musculus
gtacctggatttctggcattctcat

SEQ ID NO: 667297 - DNA, 25 bp, Mus musculus
gtacctggatttgtggcattctcat

SEQ ID NO: 667298 - DNA, 25 bp, Mus musculus
gtacctggcacgcagtagatgctca

SEQ ID NO: 667299 - DNA, 25 bp, Mus musculus
gtacctggcacgctctaagagcatc

SEQ ID NO: 667300 - DNA, 25 bp, Mus musculus
gtacctggcacggagtagatgctca

SEQ ID NO: 667301 - DNA, 25 bp, Mus musculus
gtacctggcacggtctaagagcatc

SEQ ID NO: 667302 - DNA, 25 bp, Mus musculus
gtacctggcattcatggactacttc

SEQ ID NO: 667303 - DNA, 25 bp, Mus musculus
gtacctggcattgatggactacttc

SEQ ID NO: 667304 - DNA, 25 bp, Mus musculus
gtacctggcctgacgggcaggaatt

SEQ ID NO: 667305 - DNA, 25 bp, Mus musculus
gtacctggcctgtcgggcaggaatt

SEQ ID NO: 667306 - DNA, 25 bp, Mus musculus
gtacctggctctacatgtggctgct

SEQ ID NO: 667307 - DNA, 25 bp, Mus musculus
gtacctggctcttcatgtggctgct

SEQ ID NO: 667308 - DNA, 25 bp, Mus musculus
gtacctgggcatccatctatctaag

SEQ ID NO: 667309 - DNA, 25 bp, Mus musculus
gtacctgggcatcggtcagacttta

SEQ ID NO: 667310 - DNA, 25 bp, Mus musculus
gtacctgggcatgcatctatctaag

SEQ ID NO: 667311 - DNA, 25 bp, Mus musculus
gtacctgggcatgggtcagacttta

SEQ ID NO: 667312 - DNA, 25 bp, Mus musculus
gtacctgggtatatttgttgtcaat

SEQ ID NO: 667313 - DNA, 25 bp, Mus musculus
gtacctgggtatttttgttgtcaat

SEQ ID NO: 667314 - DNA, 25 bp, Mus musculus
gtacctgggtgcatttgcgtcctta

SEQ ID NO: 667315 - DNA, 25 bp, Mus musculus
gtacctgggtgcttttgcgtcctta

SEQ ID NO: 667316 - DNA, 25 bp, Mus musculus
gtacctgggttcaactaaagcgcca

SEQ ID NO: 667317 - DNA, 25 bp, Mus musculus
gtacctgggttctactaaagcgcca

SEQ ID NO: 667318 - DNA, 25 bp, Mus musculus
gtacctggtagaagagcctgttgct

SEQ ID NO: 667319 - DNA, 25 bp, Mus musculus
gtacctggtagatgagcctgttgct

SEQ ID NO: 667320 - DNA, 25 bp, Mus musculus
gtacctggtatacgcaccccatgta

SEQ ID NO: 667321 - DNA, 25 bp, Mus musculus
gtacctggtataggcaccccatgta

SEQ ID NO: 667322 - DNA, 25 bp, Mus musculus
gtacctggtgccagtcttgagactg

SEQ ID NO: 667323 - DNA, 25 bp, Mus musculus
gtacctggtgcctgtcttgagactg

SEQ ID NO: 667324 - DNA, 25 bp, Mus musculus
gtacctggtgtgagattctgctaca

SEQ ID NO: 667325 - DNA, 25 bp, Mus musculus
gtacctggtgtgctggaagtcacat

SEQ ID NO: 667326 - DNA, 25 bp, Mus musculus
gtacctggtgtggtggaagtcacat

SEQ ID NO: 667327 - DNA, 25 bp, Mus musculus
gtacctggtgtgtgattctgctaca

SEQ ID NO: 667328 - DNA, 25 bp, Mus musculus
gtacctggttggatcaggcccggaa

SEQ ID NO: 667329 - DNA, 25 bp, Mus musculus
gtacctggttggttcaggcccggaa

SEQ ID NO: 667330 - DNA, 25 bp, Mus musculus
gtacctgtaaggctcccataaatag

SEQ ID NO: 667331 - DNA, 25 bp, Mus musculus
gtacctgtaagggtcccataaatag

SEQ ID NO: 667332 - DNA, 25 bp, Mus musculus
gtacctgtactactgttaagacgtg

SEQ ID NO: 667333 - DNA, 25 bp, Mus musculus
gtacctgtactagtgttaagacgtg

SEQ ID NO: 667334 - DNA, 25 bp, Mus musculus
gtacctgtactcacagactgctgtt

SEQ ID NO: 667335 - DNA, 25 bp, Mus musculus
gtacctgtactctcagactgctgtt

SEQ ID NO: 667336 - DNA, 25 bp, Mus musculus
gtacctgtagctctcatgctttctt

SEQ ID NO: 667337 - DNA, 25 bp, Mus musculus
gtacctgtagctgtcatgctttctt

SEQ ID NO: 667338 - DNA, 25 bp, Mus musculus
gtacctgtatacatctgactgttgg

SEQ ID NO: 667339 - DNA, 25 bp, Mus musculus
gtacctgtatacttctgactgttgg

SEQ ID NO: 667340 - DNA, 25 bp, Mus musculus
gtacctgtatagagtggaggccaga

SEQ ID NO: 667341 - DNA, 25 bp, Mus musculus
gtacctgtatagtgtggaggccaga

SEQ ID NO: 667342 - DNA, 25 bp, Mus musculus
gtacctgtatctctccaatgggaaa

SEQ ID NO: 667343 - DNA, 25 bp, Mus musculus
gtacctgtatctgtccaatgggaaa

SEQ ID NO: 667344 - DNA, 25 bp, Mus musculus
gtacctgtatgccaggttcaagcag

SEQ ID NO: 667345 - DNA, 25 bp, Mus musculus
gtacctgtatgcgaggttcaagcag

SEQ ID NO: 667346 - DNA, 25 bp, Mus musculus
gtacctgtatgtccgtccaatttta

SEQ ID NO: 667347 - DNA, 25 bp, Mus musculus
gtacctgtatgtgcgtccaatttta

SEQ ID NO: 667348 - DNA, 25 bp, Mus musculus
gtacctgtcaacattgaactccagc

SEQ ID NO: 667349 - DNA, 25 bp, Mus musculus
gtacctgtcaactttgaactccagc

SEQ ID NO: 667350 - DNA, 25 bp, Mus musculus
gtacctgtcaatacccagagactac

SEQ ID NO: 667351 - DNA, 25 bp, Mus musculus
gtacctgtcaattcccagagactac

SEQ ID NO: 667352 - DNA, 25 bp, Mus musculus
gtacctgtcagtctgattcctcagc

SEQ ID NO: 667353 - DNA, 25 bp, Mus musculus
gtacctgtcagtgtgattcctcagc

SEQ ID NO: 667354 - DNA, 25 bp, Mus musculus
gtacctgtcatcagttacttctttt

SEQ ID NO: 667355 - DNA, 25 bp, Mus musculus
gtacctgtcatctgttacttctttt

SEQ ID NO: 667356 - DNA, 25 bp, Mus musculus
gtacctgtcattatttcacttctgt

SEQ ID NO: 667357 - DNA, 25 bp, Mus musculus
gtacctgtcattctttagatctcac

SEQ ID NO: 667358 - DNA, 25 bp, Mus musculus
gtacctgtcattgtttagatctcac

SEQ ID NO: 667359 - DNA, 25 bp, Mus musculus
gtacctgtcattttttcacttctgt

SEQ ID NO: 667360 - DNA, 25 bp, Mus musculus
gtacctgtctatctttttggtcatt

SEQ ID NO: 667361 - DNA, 25 bp, Mus musculus
gtacctgtctatgtttttggtcatt

SEQ ID NO: 667362 - DNA, 25 bp, Mus musculus
gtacctgtctggactgctagacctt

SEQ ID NO: 667363 - DNA, 25 bp, Mus musculus
gtacctgtctggtctgctagacctt

SEQ ID NO: 667364 - DNA, 25 bp, Mus musculus
gtacctgtgaaactctgcttcactg

SEQ ID NO: 667365 - DNA, 25 bp, Mus musculus
gtacctgtgaaagtctgcttcactg

SEQ ID NO: 667366 - DNA, 25 bp, Mus musculus
gtacctgtgactccagcaccttgtg

SEQ ID NO: 667367 - DNA, 25 bp, Mus musculus
gtacctgtgactgcagcaccttgtg

SEQ ID NO: 667368 - DNA, 25 bp, Mus musculus
gtacctgtgcctctgttgaaacaaa

SEQ ID NO: 667369 - DNA, 25 bp, Mus musculus
gtacctgtgcctgtgttgaaacaaa

SEQ ID NO: 667370 - DNA, 25 bp, Mus musculus
gtacctgtgctgatactacttgtag

SEQ ID NO: 667371 - DNA, 25 bp, Mus musculus
gtacctgtgctgttactacttgtag

SEQ ID NO: 667372 - DNA, 25 bp, Mus musculus
gtacctgtgtacacgactgaatagt

SEQ ID NO: 667373 - DNA, 25 bp, Mus musculus
gtacctgtgtactcgactgaatagt

SEQ ID NO: 667374 - DNA, 25 bp, Mus musculus
gtacctgttatgaggttcaagctca

SEQ ID NO: 667375 - DNA, 25 bp, Mus musculus
gtacctgttatgtggttcaagctca

SEQ ID NO: 667376 - DNA, 25 bp, Mus musculus
gtacctgttcatcccatgtgcttac

SEQ ID NO: 667377 - DNA, 25 bp, Mus musculus
gtacctgttcatgccatgtgcttac

SEQ ID NO: 667378 - DNA, 25 bp, Mus musculus
gtacctgttgcaacttagtgtgtgt

SEQ ID NO: 667379 - DNA, 25 bp, Mus musculus
gtacctgttgcatcttagtgtgtgt

SEQ ID NO: 667380 - DNA, 25 bp, Mus musculus
gtacctgtttacatcgataccggat

SEQ ID NO: 667381 - DNA, 25 bp, Mus musculus
gtacctgtttacttcgataccggat

SEQ ID NO: 667382 - DNA, 25 bp, Mus musculus
gtacctgtttgtaaattttgaagat

SEQ ID NO: 667383 - DNA, 25 bp, Mus musculus
gtacctgtttgttaattttgaagat

SEQ ID NO: 667384 - DNA, 25 bp, Mus musculus
gtaccttaataactcagtgatcacc

SEQ ID NO: 667385 - DNA, 25 bp, Mus musculus
gtaccttaataagtcagtgatcacc

SEQ ID NO: 667386 - DNA, 25 bp, Mus musculus
gtaccttaatgacaagaatttgctt

SEQ ID NO: 667387 - DNA, 25 bp, Mus musculus
gtaccttaatgagaagaatttgctt

SEQ ID NO: 667388 - DNA, 25 bp, Mus musculus
gtaccttactgactctcttgggaaa

SEQ ID NO: 667389 - DNA, 25 bp, Mus musculus
gtaccttactgagtctcttgggaaa

SEQ ID NO: 667390 - DNA, 25 bp, Mus musculus
gtaccttatatgaactctacactgg

SEQ ID NO: 667391 - DNA, 25 bp, Mus musculus
gtaccttatatgtactctacactgg

SEQ ID NO: 667392 - DNA, 25 bp, Mus musculus
gtaccttatcgcctagaaccttgaa

SEQ ID NO: 667393 - DNA, 25 bp, Mus musculus
gtaccttatcgcgtagaaccttgaa

SEQ ID NO: 667394 - DNA, 25 bp, Mus musculus
gtaccttatggcatatgctctgcta

SEQ ID NO: 667395 - DNA, 25 bp, Mus musculus
gtaccttatggcttatgctctgcta

SEQ ID NO: 667396 - DNA, 25 bp, Mus musculus
gtaccttcccctctgaactgaaaat

SEQ ID NO: 667397 - DNA, 25 bp, Mus musculus
gtaccttcccctgtgaactgaaaat

SEQ ID NO: 667398 - DNA, 25 bp, Mus musculus
gtaccttcctgaagacacatctgat

SEQ ID NO: 667399 - DNA, 25 bp, Mus musculus
gtaccttcctgatgacacatctgat

SEQ ID NO: 667400 - DNA, 25 bp, Mus musculus
gtaccttcgaacagatcaatgtcat

SEQ ID NO: 667401 - DNA, 25 bp, Mus musculus
gtaccttcgaactgatcaatgtcat

SEQ ID NO: 667402 - DNA, 25 bp, Mus musculus
gtaccttcgaggcactgtatttaac

SEQ ID NO: 667403 - DNA, 25 bp, Mus musculus
gtaccttcgagggactgtatttaac

SEQ ID NO: 667404 - DNA, 25 bp, Mus musculus
gtaccttcgtggagcagtttccaac

SEQ ID NO: 667405 - DNA, 25 bp, Mus musculus
gtaccttcgtggtgcagtttccaac

SEQ ID NO: 667406 - DNA, 25 bp, Mus musculus
gtaccttctcctcagaggattcttg

SEQ ID NO: 667407 - DNA, 25 bp, Mus musculus
gtaccttctcctgagaggattcttg

SEQ ID NO: 667408 - DNA, 25 bp, Mus musculus
gtaccttctctgacaaatgttaatg

SEQ ID NO: 667409 - DNA, 25 bp, Mus musculus
gtaccttctctgtcaaatgttaatg

SEQ ID NO: 667410 - DNA, 25 bp, Mus musculus
gtaccttctgaacgactgtgatcta

SEQ ID NO: 667411 - DNA, 25 bp, Mus musculus
gtaccttctgaaggactgtgatcta

SEQ ID NO: 667412 - DNA, 25 bp, Mus musculus
gtaccttctgtcaaaattatggttt

SEQ ID NO: 667413 - DNA, 25 bp, Mus musculus
gtaccttctgtctaaattatggttt

SEQ ID NO: 667414 - DNA, 25 bp, Mus musculus
gtaccttctgtgaggacagcatcgc

SEQ ID NO: 667415 - DNA, 25 bp, Mus musculus
gtaccttctgtgatttaagcactgt

SEQ ID NO: 667416 - DNA, 25 bp, Mus musculus
gtaccttctgtgtggacagcatcgc

SEQ ID NO: 667417 - DNA, 25 bp, Mus musculus
gtaccttctgtgttttaagcactgt

SEQ ID NO: 667418 - DNA, 25 bp, Mus musculus
gtaccttcttgaaacctctgggcag

SEQ ID NO: 667419 - DNA, 25 bp, Mus musculus
gtaccttcttgatacctctgggcag

SEQ ID NO: 667420 - DNA, 25 bp, Mus musculus
gtaccttctttcagaaactccctag

SEQ ID NO: 667421 - DNA, 25 bp, Mus musculus
gtaccttctttctgaaactccctag

SEQ ID NO: 667422 - DNA, 25 bp, Mus musculus
gtaccttgaaaaccctataactatg

SEQ ID NO: 667423 - DNA, 25 bp, Mus musculus
gtaccttgaaaagcctataactatg

SEQ ID NO: 667424 - DNA, 25 bp, Mus musculus
gtaccttgacagatggtaagactat

SEQ ID NO: 667425 - DNA, 25 bp, Mus musculus
gtaccttgacagttggtaagactat

SEQ ID NO: 667426 - DNA, 25 bp, Mus musculus
gtaccttgagaacacaaaacagttt

SEQ ID NO: 667427 - DNA, 25 bp, Mus musculus
gtaccttgagaagacaaaacagttt

SEQ ID NO: 667428 - DNA, 25 bp, Mus musculus
gtaccttgagctcattctggctgtc

SEQ ID NO: 667429 - DNA, 25 bp, Mus musculus
gtaccttgagctgattctggctgtc

SEQ ID NO: 667430 - DNA, 25 bp, Mus musculus
gtaccttgaggtcccggttcatagc

SEQ ID NO: 667431 - DNA, 25 bp, Mus musculus
gtaccttgaggtgccggttcatagc

SEQ ID NO: 667432 - DNA, 25 bp, Mus musculus
gtaccttgatctatcagaacagcaa

SEQ ID NO: 667433 - DNA, 25 bp, Mus musculus
gtaccttgatctttcagaacagcaa

SEQ ID NO: 667434 - DNA, 25 bp, Mus musculus
gtaccttgatgcagttaaagttcat

SEQ ID NO: 667435 - DNA, 25 bp, Mus musculus
gtaccttgatgctgttaaagttcat

SEQ ID NO: 667436 - DNA, 25 bp, Mus musculus
gtaccttgcattaccaagcaaccat

SEQ ID NO: 667437 - DNA, 25 bp, Mus musculus
gtaccttgcatttccaagcaaccat

SEQ ID NO: 667438 - DNA, 25 bp, Mus musculus
gtaccttgctaccacagtaagctga

SEQ ID NO: 667439 - DNA, 25 bp, Mus musculus
gtaccttgctacgacagtaagctga

SEQ ID NO: 667440 - DNA, 25 bp, Mus musculus
gtaccttgctatctgtatttgtcta

SEQ ID NO: 667441 - DNA, 25 bp, Mus musculus
gtaccttgctatgtgtatttgtcta

SEQ ID NO: 667442 - DNA, 25 bp, Mus musculus
gtaccttgctttcaattttcttgcc

SEQ ID NO: 667443 - DNA, 25 bp, Mus musculus
gtaccttgctttgaattttcttgcc

SEQ ID NO: 667444 - DNA, 25 bp, Mus musculus
gtaccttgtatgaaaccccacgtca

SEQ ID NO: 667445 - DNA, 25 bp, Mus musculus
gtaccttgtatgtaaccccacgtca

SEQ ID NO: 667446 - DNA, 25 bp, Mus musculus
gtaccttgtcacactgagcagatct

SEQ ID NO: 667447 - DNA, 25 bp, Mus musculus
gtaccttgtcactctgagcagatct

SEQ ID NO: 667448 - DNA, 25 bp, Mus musculus
gtaccttgtctgattcatgggtctc

SEQ ID NO: 667449 - DNA, 25 bp, Mus musculus
gtaccttgtctgtttcatgggtctc

SEQ ID NO: 667450 - DNA, 25 bp, Mus musculus
gtaccttgtggcctggtttgtaaat

SEQ ID NO: 667451 - DNA, 25 bp, Mus musculus
gtaccttgtggcgtggtttgtaaat

SEQ ID NO: 667452 - DNA, 25 bp, Mus musculus
gtaccttgtgttagacatgcaacca

SEQ ID NO: 667453 - DNA, 25 bp, Mus musculus
gtaccttgtgttctggttgactcca

SEQ ID NO: 667454 - DNA, 25 bp, Mus musculus
gtaccttgtgttgtggttgactcca

SEQ ID NO: 667455 - DNA, 25 bp, Mus musculus
gtaccttgtgtttgacatgcaacca

SEQ ID NO: 667456 - DNA, 25 bp, Mus musculus
gtaccttgttcaatttacctacatg

SEQ ID NO: 667457 - DNA, 25 bp, Mus musculus
gtaccttgttcattttacctacatg

SEQ ID NO: 667458 - DNA, 25 bp, Mus musculus
gtaccttgtttcatctttactcatg

SEQ ID NO: 667459 - DNA, 25 bp, Mus musculus
gtaccttgtttcttctttactcatg

SEQ ID NO: 667460 - DNA, 25 bp, Mus musculus
gtacctttacttattattcagctgg

SEQ ID NO: 667461 - DNA, 25 bp, Mus musculus
gtacctttactttttattcagctgg

SEQ ID NO: 667462 - DNA, 25 bp, Mus musculus
gtacctttatcaaagcacctgcagt

SEQ ID NO: 667463 - DNA, 25 bp, Mus musculus
gtacctttatcatagcacctgcagt

SEQ ID NO: 667464 - DNA, 25 bp, Mus musculus
gtacctttatgcctcgtgattgtga

SEQ ID NO: 667465 - DNA, 25 bp, Mus musculus
gtacctttatgcgtcgtgattgtga

SEQ ID NO: 667466 - DNA, 25 bp, Mus musculus
gtacctttcagtaatcagacatatc

SEQ ID NO: 667467 - DNA, 25 bp, Mus musculus
gtacctttcagttatcagacatatc

SEQ ID NO: 667468 - DNA, 25 bp, Mus musculus
gtacctttcattacacgccaaaggt

SEQ ID NO: 667469 - DNA, 25 bp, Mus musculus
gtacctttcatttcacgccaaaggt

SEQ ID NO: 667470 - DNA, 25 bp, Mus musculus
gtacctttccagacctaccctgaga

SEQ ID NO: 667471 - DNA, 25 bp, Mus musculus
gtacctttccagtcctaccctgaga

SEQ ID NO: 667472 - DNA, 25 bp, Mus musculus
gtacctttcgtcacagctatctgca

SEQ ID NO: 667473 - DNA, 25 bp, Mus musculus
gtacctttcgtctcagctatctgca

SEQ ID NO: 667474 - DNA, 25 bp, Mus musculus
gtacctttgaccaatgaacctggga

SEQ ID NO: 667475 - DNA, 25 bp, Mus musculus
gtacctttgacctatgaacctggga

SEQ ID NO: 667476 - DNA, 25 bp, Mus musculus
gtacctttgcagaatactccaaact

SEQ ID NO: 667477 - DNA, 25 bp, Mus musculus
gtacctttgcagtatactccaaact

SEQ ID NO: 667478 - DNA, 25 bp, Mus musculus
gtacctttgccccagtcattgtagg

SEQ ID NO: 667479 - DNA, 25 bp, Mus musculus
gtacctttgcccgagtcattgtagg

SEQ ID NO: 667480 - DNA, 25 bp, Mus musculus
gtacctttgctgagttgccaaacca

SEQ ID NO: 667481 - DNA, 25 bp, Mus musculus
gtacctttgctgtgttgccaaacca

SEQ ID NO: 667482 - DNA, 25 bp, Mus musculus
gtacctttggcaacatgttatggaa

SEQ ID NO: 667483 - DNA, 25 bp, Mus musculus
gtacctttggcatcatgttatggaa

SEQ ID NO: 667484 - DNA, 25 bp, Mus musculus
gtacctttggtactggtccctggca

SEQ ID NO: 667485 - DNA, 25 bp, Mus musculus
gtacctttggtagtggtccctggca

SEQ ID NO: 667486 - DNA, 25 bp, Mus musculus
gtacctttgtcaacacatcagtatg

SEQ ID NO: 667487 - DNA, 25 bp, Mus musculus
gtacctttgtcatcacatcagtatg

SEQ ID NO: 667488 - DNA, 25 bp, Mus musculus
gtacctttgtgaaaggattgaaacc

SEQ ID NO: 667489 - DNA, 25 bp, Mus musculus
gtacctttgtgataggattgaaacc

SEQ ID NO: 667490 - DNA, 25 bp, Mus musculus
gtaccttttactagatgaccatttt

SEQ ID NO: 667491 - DNA, 25 bp, Mus musculus
gtaccttttactatcctcctgagtg

SEQ ID NO: 667492 - DNA, 25 bp, Mus musculus
gtaccttttacttgatgaccatttt

SEQ ID NO: 667493 - DNA, 25 bp, Mus musculus
gtaccttttactttcctcctgagtg

SEQ ID NO: 667494 - DNA, 25 bp, Mus musculus
gtaccttttaggaccatctatcctt

SEQ ID NO: 667495 - DNA, 25 bp, Mus musculus
gtaccttttaggtccatctatcctt

SEQ ID NO: 667496 - DNA, 25 bp, Mus musculus
gtaccttttcatattttgactccca

SEQ ID NO: 667497 - DNA, 25 bp, Mus musculus
gtaccttttcattttttgactccca

SEQ ID NO: 667498 - DNA, 25 bp, Mus musculus
gtaccttttggtctagagctgctca

SEQ ID NO: 667499 - DNA, 25 bp, Mus musculus
gtaccttttggtgtagagctgctca

SEQ ID NO: 667500 - DNA, 25 bp, Mus musculus
gtacctttttacactgcactgtctg

SEQ ID NO: 667501 - DNA, 25 bp, Mus musculus
gtacctttttactctgcactgtctg

SEQ ID NO: 667502 - DNA, 25 bp, Mus musculus
gtacctttttgcatacaagctgaac

SEQ ID NO: 667503 - DNA, 25 bp, Mus musculus
gtacctttttgcttacaagctgaac

SEQ ID NO: 667504 - DNA, 25 bp, Mus musculus
gtacgaaaagctcgcggacgctgtc

SEQ ID NO: 667505 - DNA, 25 bp, Mus musculus
gtacgaaaagctggcggacgctgtc

SEQ ID NO: 667506 - DNA, 25 bp, Mus musculus
gtacgaaaattaccagccagggtct

SEQ ID NO: 667507 - DNA, 25 bp, Mus musculus
gtacgaaaattagcagccagggtct

SEQ ID NO: 667508 - DNA, 25 bp, Mus musculus
gtacgaaacttcatgcgcactatgt

SEQ ID NO: 667509 - DNA, 25 bp, Mus musculus
gtacgaaacttcttgcgcactatgt

SEQ ID NO: 667510 - DNA, 25 bp, Mus musculus
gtacgaaagttcactatcacatccc

SEQ ID NO: 667511 - DNA, 25 bp, Mus musculus
gtacgaaagttctctatcacatccc

SEQ ID NO: 667512 - DNA, 25 bp, Mus musculus
gtacgaacacacatggacctatata

SEQ ID NO: 667513 - DNA, 25 bp, Mus musculus
gtacgaacacacttggacctatata

SEQ ID NO: 667514 - DNA, 25 bp, Mus musculus
gtacgaagtgcacagtccaatctct

SEQ ID NO: 667515 - DNA, 25 bp, Mus musculus
gtacgaagtgcagagtccaatctct

SEQ ID NO: 667516 - DNA, 25 bp, Mus musculus
gtacgaattcctcactccagtagag

SEQ ID NO: 667517 - DNA, 25 bp, Mus musculus
gtacgaattcctgactccagtagag

SEQ ID NO: 667518 - DNA, 25 bp, Mus musculus
gtacgacaagatctgcaaggcggca

SEQ ID NO: 667519 - DNA, 25 bp, Mus musculus
gtacgacaagatgtgcaaggcggca

SEQ ID NO: 667520 - DNA, 25 bp, Mus musculus
gtacgacaagcaaatgtcaaccaat

SEQ ID NO: 667521 - DNA, 25 bp, Mus musculus
gtacgacaagcatatgtcaaccaat

SEQ ID NO: 667522 - DNA, 25 bp, Mus musculus
gtacgaccctcgaagcaacaagtgg

SEQ ID NO: 667523 - DNA, 25 bp, Mus musculus
gtacgaccctcgtagcaacaagtgg

SEQ ID NO: 667524 - DNA, 25 bp, Mus musculus
gtacgacctgagaagacatgatttt

SEQ ID NO: 667525 - DNA, 25 bp, Mus musculus
gtacgacctgagtagacatgatttt

SEQ ID NO: 667526 - DNA, 25 bp, Mus musculus
gtacgacggtgaaattcgagttcta

SEQ ID NO: 667527 - DNA, 25 bp, Mus musculus
gtacgacggtgatattcgagttcta

SEQ ID NO: 667528 - DNA, 25 bp, Mus musculus
gtacgactcatgaaaccagacaggt

SEQ ID NO: 667529 - DNA, 25 bp, Mus musculus
gtacgactcatgtaaccagacaggt

SEQ ID NO: 667530 - DNA, 25 bp, Mus musculus
gtacgactgcctcgattactactac

SEQ ID NO: 667531 - DNA, 25 bp, Mus musculus
gtacgactgcctggattactactac

SEQ ID NO: 667532 - DNA, 25 bp, Mus musculus
gtacgactgctcagtgatgccactg

SEQ ID NO: 667533 - DNA, 25 bp, Mus musculus
gtacgactgctctgtgatgccactg

SEQ ID NO: 667534 - DNA, 25 bp, Mus musculus
gtacgagaagaccacagttagcagt

SEQ ID NO: 667535 - DNA, 25 bp, Mus musculus
gtacgagaagacgacagttagcagt

SEQ ID NO: 667536 - DNA, 25 bp, Mus musculus
gtacgagaccaactacgggcccttg

SEQ ID NO: 667537 - DNA, 25 bp, Mus musculus
gtacgagaccaagtacgggcccttg

SEQ ID NO: 667538 - DNA, 25 bp, Mus musculus
gtacgagaccagacctgaacagctc

SEQ ID NO: 667539 - DNA, 25 bp, Mus musculus
gtacgagaccagtcctgaacagctc

SEQ ID NO: 667540 - DNA, 25 bp, Mus musculus
gtacgagagcttagcacgactgcat

SEQ ID NO: 667541 - DNA, 25 bp, Mus musculus
gtacgagagctttgcacgactgcat

SEQ ID NO: 667542 - DNA, 25 bp, Mus musculus
gtacgagcgagcatcgagaggccat

SEQ ID NO: 667543 - DNA, 25 bp, Mus musculus
gtacgagcgagcttcgagaggccat

SEQ ID NO: 667544 - DNA, 25 bp, Mus musculus
gtacgagctatgataaccaataaag

SEQ ID NO: 667545 - DNA, 25 bp, Mus musculus
gtacgagctatgttaaccaataaag

SEQ ID NO: 667546 - DNA, 25 bp, Mus musculus
gtacgagctcgaccgacgtttcaag

SEQ ID NO: 667547 - DNA, 25 bp, Mus musculus
gtacgagctcgagcgacgtttcaag

SEQ ID NO: 667548 - DNA, 25 bp, Mus musculus
gtacgagcttctcagcacctacatt

SEQ ID NO: 667549 - DNA, 25 bp, Mus musculus
gtacgagcttctgagcacctacatt

SEQ ID NO: 667550 - DNA, 25 bp, Mus musculus
gtacgaggacatacagactgctgat

SEQ ID NO: 667551 - DNA, 25 bp, Mus musculus
gtacgaggacattcagactgctgat

SEQ ID NO: 667552 - DNA, 25 bp, Mus musculus
gtacgagtacagcttccgcaccgag

SEQ ID NO: 667553 - DNA, 25 bp, Mus musculus
gtacgagtacaggttccgcaccgag

SEQ ID NO: 667554 - DNA, 25 bp, Mus musculus
gtacgagtcatcacaggtcgatcct

SEQ ID NO: 667555 - DNA, 25 bp, Mus musculus
gtacgagtcatctcaggtcgatcct

SEQ ID NO: 667556 - DNA, 25 bp, Mus musculus
gtacgagtctgcctatggaacacag

SEQ ID NO: 667557 - DNA, 25 bp, Mus musculus
gtacgagtctgcgtatggaacacag

SEQ ID NO: 667558 - DNA, 25 bp, Mus musculus
gtacgagtgcatcctgtgtgcctgc

SEQ ID NO: 667559 - DNA, 25 bp, Mus musculus
gtacgagtgcatgctgtgtgcctgc

SEQ ID NO: 667560 - DNA, 25 bp, Mus musculus
gtacgagtgctgcagatggctctca

SEQ ID NO: 667561 - DNA, 25 bp, Mus musculus
gtacgagtgctggagatggctctca

SEQ ID NO: 667562 - DNA, 25 bp, Mus musculus
gtacgagttgaacccacagtcattg

SEQ ID NO: 667563 - DNA, 25 bp, Mus musculus
gtacgagttgaagccacagtcattg

SEQ ID NO: 667564 - DNA, 25 bp, Mus musculus
gtacgataacttactggaacagaat

SEQ ID NO: 667565 - DNA, 25 bp, Mus musculus
gtacgataactttctggaacagaat

SEQ ID NO: 667566 - DNA, 25 bp, Mus musculus
gtacgatacaaacaaacaaggcttt

SEQ ID NO: 667567 - DNA, 25 bp, Mus musculus
gtacgatacaaagaaacaaggcttt

SEQ ID NO: 667568 - DNA, 25 bp, Mus musculus
gtacgatatcccatagagtgaccat

SEQ ID NO: 667569 - DNA, 25 bp, Mus musculus
gtacgatatcccttagagtgaccat

SEQ ID NO: 667570 - DNA, 25 bp, Mus musculus
gtacgatcgtacatgagtcagtttt

SEQ ID NO: 667571 - DNA, 25 bp, Mus musculus
gtacgatcgtacttgagtcagtttt

SEQ ID NO: 667572 - DNA, 25 bp, Mus musculus
gtacgatgtcatactgcagacttaa

SEQ ID NO: 667573 - DNA, 25 bp, Mus musculus
gtacgatgtcattctgcagacttaa

SEQ ID NO: 667574 - DNA, 25 bp, Mus musculus
gtacgatgtgctatgatcatatcta

SEQ ID NO: 667575 - DNA, 25 bp, Mus musculus
gtacgatgtgctttgatcatatcta

SEQ ID NO: 667576 - DNA, 25 bp, Mus musculus
gtacgattagtaagcccagccggaa

SEQ ID NO: 667577 - DNA, 25 bp, Mus musculus
gtacgattagtatgcccagccggaa

SEQ ID NO: 667578 - DNA, 25 bp, Mus musculus
gtacgattcaggcataattttatat

SEQ ID NO: 667579 - DNA, 25 bp, Mus musculus
gtacgattcagggataattttatat

SEQ ID NO: 667580 - DNA, 25 bp, Mus musculus
gtacgatttaagaagggcttctgct

SEQ ID NO: 667581 - DNA, 25 bp, Mus musculus
gtacgatttaagtagggcttctgct

SEQ ID NO: 667582 - DNA, 25 bp, Mus musculus
gtacgattttgacgaaacaggctgt

SEQ ID NO: 667583 - DNA, 25 bp, Mus musculus
gtacgattttgaggaaacaggctgt

SEQ ID NO: 667584 - DNA, 25 bp, Mus musculus
gtacgcaaaatcaagcagggcctgg

SEQ ID NO: 667585 - DNA, 25 bp, Mus musculus
gtacgcaaaatctagcagggcctgg

SEQ ID NO: 667586 - DNA, 25 bp, Mus musculus
gtacgcaaaggtccatctagatctt

SEQ ID NO: 667587 - DNA, 25 bp, Mus musculus
gtacgcaaaggtgcatctagatctt

SEQ ID NO: 667588 - DNA, 25 bp, Mus musculus
gtacgcaccaagagtcgtgaccgca

SEQ ID NO: 667589 - DNA, 25 bp, Mus musculus
gtacgcaccaagtgtcgtgaccgca

SEQ ID NO: 667590 - DNA, 25 bp, Mus musculus
gtacgcacggcacctgacattggaa

SEQ ID NO: 667591 - DNA, 25 bp, Mus musculus
gtacgcacggcagctgacattggaa

SEQ ID NO: 667592 - DNA, 25 bp, Mus musculus
gtacgcactgttcatctcctgcatt

SEQ ID NO: 667593 - DNA, 25 bp, Mus musculus
gtacgcactgttgatctcctgcatt

SEQ ID NO: 667594 - DNA, 25 bp, Mus musculus
gtacgcagaatgcacagtgtgtgtt

SEQ ID NO: 667595 - DNA, 25 bp, Mus musculus
gtacgcagaatggacagtgtgtgtt

SEQ ID NO: 667596 - DNA, 25 bp, Mus musculus
gtacgcagcaggaagtcaataaacg

SEQ ID NO: 667597 - DNA, 25 bp, Mus musculus
gtacgcagcaggtagtcaataaacg

SEQ ID NO: 667598 - DNA, 25 bp, Mus musculus
gtacgcagcctacgcgcagagcaag

SEQ ID NO: 667599 - DNA, 25 bp, Mus musculus
gtacgcagcctaggcgcagagcaag

SEQ ID NO: 667600 - DNA, 25 bp, Mus musculus
gtacgcagcgttccacggtggttac

SEQ ID NO: 667601 - DNA, 25 bp, Mus musculus
gtacgcagcgttgcacggtggttac

SEQ ID NO: 667602 - DNA, 25 bp, Mus musculus
gtacgcagtacaacgtctacgaaga

SEQ ID NO: 667603 - DNA, 25 bp, Mus musculus
gtacgcagtacatcgtctacgaaga

SEQ ID NO: 667604 - DNA, 25 bp, Mus musculus
gtacgcagtgggatcagcttgcatt

SEQ ID NO: 667605 - DNA, 25 bp, Mus musculus
gtacgcagtgggttcagcttgcatt

SEQ ID NO: 667606 - DNA, 25 bp, Mus musculus
gtacgcatctgtatgcacatgttgt

SEQ ID NO: 667607 - DNA, 25 bp, Mus musculus
gtacgcatctgtttgcacatgttgt

SEQ ID NO: 667608 - DNA, 25 bp, Mus musculus
gtacgccacagtatctgtatacgaa

SEQ ID NO: 667609 - DNA, 25 bp, Mus musculus
gtacgccacagtttctgtatacgaa

SEQ ID NO: 667610 - DNA, 25 bp, Mus musculus
gtacgccacgtgcaaccgagactac

SEQ ID NO: 667611 - DNA, 25 bp, Mus musculus
gtacgccacgtggaaccgagactac

SEQ ID NO: 667612 - DNA, 25 bp, Mus musculus
gtacgcccatctaaactgctaagtt

SEQ ID NO: 667613 - DNA, 25 bp, Mus musculus
gtacgcccatcttaactgctaagtt

SEQ ID NO: 667614 - DNA, 25 bp, Mus musculus
gtacgccccattcgcttggcacaag

SEQ ID NO: 667615 - DNA, 25 bp, Mus musculus
gtacgccccattggcttggcacaag

SEQ ID NO: 667616 - DNA, 25 bp, Mus musculus
gtacgccgcacgactggcagcagaa

SEQ ID NO: 667617 - DNA, 25 bp, Mus musculus
gtacgccgcacgtctggcagcagaa

SEQ ID NO: 667618 - DNA, 25 bp, Mus musculus
gtacgcctgattaggacattaatta

SEQ ID NO: 667619 - DNA, 25 bp, Mus musculus
gtacgcctgatttggacattaatta

SEQ ID NO: 667620 - DNA, 25 bp, Mus musculus
gtacgcctgcctcaagtgtggcaaa

SEQ ID NO: 667621 - DNA, 25 bp, Mus musculus
gtacgcctgcctgaagtgtggcaaa

SEQ ID NO: 667622 - DNA, 25 bp, Mus musculus
gtacgcctggaacattgcattgagt

SEQ ID NO: 667623 - DNA, 25 bp, Mus musculus
gtacgcctggaagattgcattgagt

SEQ ID NO: 667624 - DNA, 25 bp, Mus musculus
gtacgccttagtcactttaatgcct

SEQ ID NO: 667625 - DNA, 25 bp, Mus musculus
gtacgccttagtgactttaatgcct

SEQ ID NO: 667626 - DNA, 25 bp, Mus musculus
gtacgcgaacgcaggtgattccaaa

SEQ ID NO: 667627 - DNA, 25 bp, Mus musculus
gtacgcgaacgctggtgattccaaa

SEQ ID NO: 667628 - DNA, 25 bp, Mus musculus
gtacgcgatctccagagcacagatg

SEQ ID NO: 667629 - DNA, 25 bp, Mus musculus
gtacgcgatctcgagagcacagatg

SEQ ID NO: 667630 - DNA, 25 bp, Mus musculus
gtacgcgcacacactggttgaaaaa

SEQ ID NO: 667631 - DNA, 25 bp, Mus musculus
gtacgcgcacactctggttgaaaaa

SEQ ID NO: 667632 - DNA, 25 bp, Mus musculus
gtacgcgcagggaaccaggcccttg

SEQ ID NO: 667633 - DNA, 25 bp, Mus musculus
gtacgcgcagggtaccaggcccttg

SEQ ID NO: 667634 - DNA, 25 bp, Mus musculus
gtacgctcccttagaattagcagca

SEQ ID NO: 667635 - DNA, 25 bp, Mus musculus
gtacgctccctttgaattagcagca

SEQ ID NO: 667636 - DNA, 25 bp, Mus musculus
gtacgctcctcaaagtatcatttga

SEQ ID NO: 667637 - DNA, 25 bp, Mus musculus
gtacgctcctcatagtatcatttga

SEQ ID NO: 667638 - DNA, 25 bp, Mus musculus
gtacgctctatgatttctaagggct

SEQ ID NO: 667639 - DNA, 25 bp, Mus musculus
gtacgctctatgttttctaagggct

SEQ ID NO: 667640 - DNA, 25 bp, Mus musculus
gtacgctctcttatcagaatgtggt

SEQ ID NO: 667641 - DNA, 25 bp, Mus musculus
gtacgctctcttttcagaatgtggt

SEQ ID NO: 667642 - DNA, 25 bp, Mus musculus
gtacgctgacatacctgaagcacaa

SEQ ID NO: 667643 - DNA, 25 bp, Mus musculus
gtacgctgacattcctgaagcacaa

SEQ ID NO: 667644 - DNA, 25 bp, Mus musculus
gtacgctgagacagctattgccctg

SEQ ID NO: 667645 - DNA, 25 bp, Mus musculus
gtacgctgagactgctattgccctg

SEQ ID NO: 667646 - DNA, 25 bp, Mus musculus
gtacgctgcgttctcagagctgagt

SEQ ID NO: 667647 - DNA, 25 bp, Mus musculus
gtacgctgcgttgtcagagctgagt

SEQ ID NO: 667648 - DNA, 25 bp, Mus musculus
gtacgctggacgatgccacggatga

SEQ ID NO: 667649 - DNA, 25 bp, Mus musculus
gtacgctggacgttgccacggatga

SEQ ID NO: 667650 - DNA, 25 bp, Mus musculus
gtacgctgtagcattgtaacattgt

SEQ ID NO: 667651 - DNA, 25 bp, Mus musculus
gtacgctgtagctttgtaacattgt

SEQ ID NO: 667652 - DNA, 25 bp, Mus musculus
gtacgctgtttcaaacatttctttg

SEQ ID NO: 667653 - DNA, 25 bp, Mus musculus
gtacgctgtttctaacatttctttg

SEQ ID NO: 667654 - DNA, 25 bp, Mus musculus
gtacgcttacacagctgggcattta

SEQ ID NO: 667655 - DNA, 25 bp, Mus musculus
gtacgcttacactgctgggcattta

SEQ ID NO: 667656 - DNA, 25 bp, Mus musculus
gtacgcttcaacatagagggctaaa

SEQ ID NO: 667657 - DNA, 25 bp, Mus musculus
gtacgcttcaacttagagggctaaa

SEQ ID NO: 667658 - DNA, 25 bp, Mus musculus
gtacgcttcatactgtggtcctgtt

SEQ ID NO: 667659 - DNA, 25 bp, Mus musculus
gtacgcttcatagtgtggtcctgtt

SEQ ID NO: 667660 - DNA, 25 bp, Mus musculus
gtacgcttttgccacggctcatgta

SEQ ID NO: 667661 - DNA, 25 bp, Mus musculus
gtacgcttttgcgacggctcatgta

SEQ ID NO: 667662 - DNA, 25 bp, Mus musculus
gtacggactcttccagatcagtgac

SEQ ID NO: 667663 - DNA, 25 bp, Mus musculus
gtacggactcttgcagatcagtgac

SEQ ID NO: 667664 - DNA, 25 bp, Mus musculus
gtacggagaggtaattcagcttcaa

SEQ ID NO: 667665 - DNA, 25 bp, Mus musculus
gtacggagaggttattcagcttcaa

SEQ ID NO: 667666 - DNA, 25 bp, Mus musculus
gtacggagccctacagatagactta

SEQ ID NO: 667667 - DNA, 25 bp, Mus musculus
gtacggagcccttcagatagactta

SEQ ID NO: 667668 - DNA, 25 bp, Mus musculus
gtacggagcggcacattagcattgc

SEQ ID NO: 667669 - DNA, 25 bp, Mus musculus
gtacggagcggctcattagcattgc

SEQ ID NO: 667670 - DNA, 25 bp, Mus musculus
gtacggaggaatcccacctgcaatc

SEQ ID NO: 667671 - DNA, 25 bp, Mus musculus
gtacggaggaatgccacctgcaatc

SEQ ID NO: 667672 - DNA, 25 bp, Mus musculus
gtacggatgaagctatgaaccctca

SEQ ID NO: 667673 - DNA, 25 bp, Mus musculus
gtacggatgaaggtatgaaccctca

SEQ ID NO: 667674 - DNA, 25 bp, Mus musculus
gtacggcagttacattgggcagaat

SEQ ID NO: 667675 - DNA, 25 bp, Mus musculus
gtacggcagttagattgggcagaat

SEQ ID NO: 667676 - DNA, 25 bp, Mus musculus
gtacggcatgacattccataactga

SEQ ID NO: 667677 - DNA, 25 bp, Mus musculus
gtacggcatgactttccataactga

SEQ ID NO: 667678 - DNA, 25 bp, Mus musculus
gtacggccttggcatttacatcact

SEQ ID NO: 667679 - DNA, 25 bp, Mus musculus
gtacggccttgggatttacatcact

SEQ ID NO: 667680 - DNA, 25 bp, Mus musculus
gtacggcggctcatatgatactgac

SEQ ID NO: 667681 - DNA, 25 bp, Mus musculus
gtacggcggctcttatgatactgac

SEQ ID NO: 667682 - DNA, 25 bp, Mus musculus
gtacggctcctgacttatggatgaa

SEQ ID NO: 667683 - DNA, 25 bp, Mus musculus
gtacggctcctgtcttatggatgaa

SEQ ID NO: 667684 - DNA, 25 bp, Mus musculus
gtacggcttctcaccggtgtgacgc

SEQ ID NO: 667685 - DNA, 25 bp, Mus musculus
gtacggcttctctccggtgtgacgc

SEQ ID NO: 667686 - DNA, 25 bp, Mus musculus
gtacgggacactcgaggctttgaat

SEQ ID NO: 667687 - DNA, 25 bp, Mus musculus
gtacgggacactggaggctttgaat

SEQ ID NO: 667688 - DNA, 25 bp, Mus musculus
gtacgggacccgctatggtgcctcc

SEQ ID NO: 667689 - DNA, 25 bp, Mus musculus
gtacgggacccggtatggtgcctcc

SEQ ID NO: 667690 - DNA, 25 bp, Mus musculus
gtacgggatgttattcctactgtat

SEQ ID NO: 667691 - DNA, 25 bp, Mus musculus
gtacgggatgtttttcctactgtat

SEQ ID NO: 667692 - DNA, 25 bp, Mus musculus
gtacgggattctctcaggttaatat

SEQ ID NO: 667693 - DNA, 25 bp, Mus musculus
gtacgggattctgtcaggttaatat

SEQ ID NO: 667694 - DNA, 25 bp, Mus musculus
gtacgggccacaatccggacgaagg

SEQ ID NO: 667695 - DNA, 25 bp, Mus musculus
gtacgggccacattccggacgaagg

SEQ ID NO: 667696 - DNA, 25 bp, Mus musculus
gtacgggctcacaagagcacagctt

SEQ ID NO: 667697 - DNA, 25 bp, Mus musculus
gtacgggctcactagagcacagctt

SEQ ID NO: 667698 - DNA, 25 bp, Mus musculus
gtacgggctcctagtctgtaatggc

SEQ ID NO: 667699 - DNA, 25 bp, Mus musculus
gtacgggctccttgtctgtaatggc

SEQ ID NO: 667700 - DNA, 25 bp, Mus musculus
gtacgggtcgttatggtacacgagc

SEQ ID NO: 667701 - DNA, 25 bp, Mus musculus
gtacgggtcgttttggtacacgagc

SEQ ID NO: 667702 - DNA, 25 bp, Mus musculus
gtacggtcagttagcgtaaagaaga

SEQ ID NO: 667703 - DNA, 25 bp, Mus musculus
gtacggtcagtttgcgtaaagaaga

SEQ ID NO: 667704 - DNA, 25 bp, Mus musculus
gtacggtgagatagcctcgaccaca

SEQ ID NO: 667705 - DNA, 25 bp, Mus musculus
gtacggtgagattgcctcgaccaca

SEQ ID NO: 667706 - DNA, 25 bp, Mus musculus
gtacggtgtaccattcctaaggact

SEQ ID NO: 667707 - DNA, 25 bp, Mus musculus
gtacggtgtacctttcctaaggact

SEQ ID NO: 667708 - DNA, 25 bp, Mus musculus
gtacggttaatacccacgcctatat

SEQ ID NO: 667709 - DNA, 25 bp, Mus musculus
gtacggttaatagccacgcctatat

SEQ ID NO: 667710 - DNA, 25 bp, Mus musculus
gtacggttacttctctacctgaagt

SEQ ID NO: 667711 - DNA, 25 bp, Mus musculus
gtacggttacttgtctacctgaagt

SEQ ID NO: 667712 - DNA, 25 bp, Mus musculus
gtacggttcctcatgtattgagacc

SEQ ID NO: 667713 - DNA, 25 bp, Mus musculus
gtacggttcctcttgtattgagacc

SEQ ID NO: 667714 - DNA, 25 bp, Mus musculus
gtacggttgagcctgagtttcccac

SEQ ID NO: 667715 - DNA, 25 bp, Mus musculus
gtacggttgagcgtgagtttcccac

SEQ ID NO: 667716 - DNA, 25 bp, Mus musculus
gtacggtttacacatagcactgcat

SEQ ID NO: 667717 - DNA, 25 bp, Mus musculus
gtacggtttacagatagcactgcat

SEQ ID NO: 667718 - DNA, 25 bp, Mus musculus
gtacgtaaagaccaagtagaactga

SEQ ID NO: 667719 - DNA, 25 bp, Mus musculus
gtacgtaaagacgaagtagaactga

SEQ ID NO: 667720 - DNA, 25 bp, Mus musculus
gtacgtaactagaatcctgacatgt

SEQ ID NO: 667721 - DNA, 25 bp, Mus musculus
gtacgtaactagtatcctgacatgt

SEQ ID NO: 667722 - DNA, 25 bp, Mus musculus
gtacgtacaattatctgctaagcag

SEQ ID NO: 667723 - DNA, 25 bp, Mus musculus
gtacgtacaattttctgctaagcag

SEQ ID NO: 667724 - DNA, 25 bp, Mus musculus
gtacgtacactacactagccttgaa

SEQ ID NO: 667725 - DNA, 25 bp, Mus musculus
gtacgtacactagactagccttgaa

SEQ ID NO: 667726 - DNA, 25 bp, Mus musculus
gtacgtacacttctagctgccttca

SEQ ID NO: 667727 - DNA, 25 bp, Mus musculus
gtacgtacacttgtagctgccttca

SEQ ID NO: 667728 - DNA, 25 bp, Mus musculus
gtacgtacgccaagaagagacactg

SEQ ID NO: 667729 - DNA, 25 bp, Mus musculus
gtacgtacgccatgaagagacactg

SEQ ID NO: 667730 - DNA, 25 bp, Mus musculus
gtacgtacgcctaagtcactttaat

SEQ ID NO: 667731 - DNA, 25 bp, Mus musculus
gtacgtacgccttagtcactttaat

SEQ ID NO: 667732 - DNA, 25 bp, Mus musculus
gtacgtagccatccaggctgtgctg

SEQ ID NO: 667733 - DNA, 25 bp, Mus musculus
gtacgtagccatgcaggctgtgctg

SEQ ID NO: 667734 - DNA, 25 bp, Mus musculus
gtacgtagctgtaacatgtagggca

SEQ ID NO: 667735 - DNA, 25 bp, Mus musculus
gtacgtagctgttacatgtagggca

SEQ ID NO: 667736 - DNA, 25 bp, Mus musculus
gtacgtagcttactgcagagggttt

SEQ ID NO: 667737 - DNA, 25 bp, Mus musculus
gtacgtagcttagtgcagagggttt

SEQ ID NO: 667738 - DNA, 25 bp, Mus musculus
gtacgtagtctaacatctgctcggt

SEQ ID NO: 667739 - DNA, 25 bp, Mus musculus
gtacgtagtctatcatctgctcggt

SEQ ID NO: 667740 - DNA, 25 bp, Mus musculus
gtacgtagttttcccaaattatatg

SEQ ID NO: 667741 - DNA, 25 bp, Mus musculus
gtacgtagttttgccaaattatatg

SEQ ID NO: 667742 - DNA, 25 bp, Mus musculus
gtacgtatcacccaaaggctggctt

SEQ ID NO: 667743 - DNA, 25 bp, Mus musculus
gtacgtatcaccgaaaggctggctt

SEQ ID NO: 667744 - DNA, 25 bp, Mus musculus
gtacgtatccatattccataaactt

SEQ ID NO: 667745 - DNA, 25 bp, Mus musculus
gtacgtatccattttccataaactt

SEQ ID NO: 667746 - DNA, 25 bp, Mus musculus
gtacgtatcctaaaagtgttaccat

SEQ ID NO: 667747 - DNA, 25 bp, Mus musculus
gtacgtatcctataagtgttaccat

SEQ ID NO: 667748 - DNA, 25 bp, Mus musculus
gtacgtatctggcttatatctaaag

SEQ ID NO: 667749 - DNA, 25 bp, Mus musculus
gtacgtatctggcttgtatgtggaa

SEQ ID NO: 667750 - DNA, 25 bp, Mus musculus
gtacgtatctgggttatatctaaag

SEQ ID NO: 667751 - DNA, 25 bp, Mus musculus
gtacgtatctgggttgtatgtggaa

SEQ ID NO: 667752 - DNA, 25 bp, Mus musculus
gtacgtattctgctcacacgatcgg

SEQ ID NO: 667753 - DNA, 25 bp, Mus musculus
gtacgtattctggtcacacgatcgg

SEQ ID NO: 667754 - DNA, 25 bp, Mus musculus
gtacgtcactcaacattcaacagct

SEQ ID NO: 667755 - DNA, 25 bp, Mus musculus
gtacgtcactcatcattcaacagct

SEQ ID NO: 667756 - DNA, 25 bp, Mus musculus
gtacgtcagacaacatttaatcatt

SEQ ID NO: 667757 - DNA, 25 bp, Mus musculus
gtacgtcagacatcatttaatcatt

SEQ ID NO: 667758 - DNA, 25 bp, Mus musculus
gtacgtcagtcccagaaatagatgc

SEQ ID NO: 667759 - DNA, 25 bp, Mus musculus
gtacgtcagtccgagaaatagatgc

SEQ ID NO: 667760 - DNA, 25 bp, Mus musculus
gtacgtcatccaataagaacatcta

SEQ ID NO: 667761 - DNA, 25 bp, Mus musculus
gtacgtcatccattaagaacatcta

SEQ ID NO: 667762 - DNA, 25 bp, Mus musculus
gtacgtccaagccaaccctaggata

SEQ ID NO: 667763 - DNA, 25 bp, Mus musculus
gtacgtccaagcgaaccctaggata

SEQ ID NO: 667764 - DNA, 25 bp, Mus musculus
gtacgtccaggcatcaaataacttg

SEQ ID NO: 667765 - DNA, 25 bp, Mus musculus
gtacgtccaggcttcaaataacttg

SEQ ID NO: 667766 - DNA, 25 bp, Mus musculus
gtacgtcctcccacatgactaaatg

SEQ ID NO: 667767 - DNA, 25 bp, Mus musculus
gtacgtcctccctcatgactaaatg

SEQ ID NO: 667768 - DNA, 25 bp, Mus musculus
gtacgtctaagcaatatgccctact

SEQ ID NO: 667769 - DNA, 25 bp, Mus musculus
gtacgtctaagctatatgccctact

SEQ ID NO: 667770 - DNA, 25 bp, Mus musculus
gtacgtctatcaacaacactaattt

SEQ ID NO: 667771 - DNA, 25 bp, Mus musculus
gtacgtctatcatcaacactaattt

SEQ ID NO: 667772 - DNA, 25 bp, Mus musculus
gtacgtctgaatacacaaatcccaa

SEQ ID NO: 667773 - DNA, 25 bp, Mus musculus
gtacgtctgaattcacaaatcccaa

SEQ ID NO: 667774 - DNA, 25 bp, Mus musculus
gtacgtctgttgcaacctatttcta

SEQ ID NO: 667775 - DNA, 25 bp, Mus musculus
gtacgtctgttggaacctatttcta

SEQ ID NO: 667776 - DNA, 25 bp, Mus musculus
gtacgtcttcacaggaaaccttgtc

SEQ ID NO: 667777 - DNA, 25 bp, Mus musculus
gtacgtcttcactggaaaccttgtc

SEQ ID NO: 667778 - DNA, 25 bp, Mus musculus
gtacgtgacacactctttcttctct

SEQ ID NO: 667779 - DNA, 25 bp, Mus musculus
gtacgtgacacagtctttcttctct

SEQ ID NO: 667780 - DNA, 25 bp, Mus musculus
gtacgtgaccatactagtagccttg

SEQ ID NO: 667781 - DNA, 25 bp, Mus musculus
gtacgtgaccattctagtagccttg

SEQ ID NO: 667782 - DNA, 25 bp, Mus musculus
gtacgtgagactcaatctgggccca

SEQ ID NO: 667783 - DNA, 25 bp, Mus musculus
gtacgtgagactgaatctgggccca

SEQ ID NO: 667784 - DNA, 25 bp, Mus musculus
gtacgtgagcgcactcaagttgctc

SEQ ID NO: 667785 - DNA, 25 bp, Mus musculus
gtacgtgagcgctctcaagttgctc

SEQ ID NO: 667786 - DNA, 25 bp, Mus musculus
gtacgtgaggaacctgcccctcaac

SEQ ID NO: 667787 - DNA, 25 bp, Mus musculus
gtacgtgaggaagctgcccctcaac

SEQ ID NO: 667788 - DNA, 25 bp, Mus musculus
gtacgtgatcgtcggcaagcgcttc

SEQ ID NO: 667789 - DNA, 25 bp, Mus musculus
gtacgtgatcgtgggcaagcgcttc

SEQ ID NO: 667790 - DNA, 25 bp, Mus musculus
gtacgtgcaactatctgttgttcca

SEQ ID NO: 667791 - DNA, 25 bp, Mus musculus
gtacgtgcaactttctgttgttcca

SEQ ID NO: 667792 - DNA, 25 bp, Mus musculus
gtacgtgccatgcaagtctcttaat

SEQ ID NO: 667793 - DNA, 25 bp, Mus musculus
gtacgtgccatggaagtctcttaat

SEQ ID NO: 667794 - DNA, 25 bp, Mus musculus
gtacgtgcgccacactctatgagaa

SEQ ID NO: 667795 - DNA, 25 bp, Mus musculus
gtacgtgcgccagactctatgagaa

SEQ ID NO: 667796 - DNA, 25 bp, Mus musculus
gtacgtgctgcgagcaatcgcatgt

SEQ ID NO: 667797 - DNA, 25 bp, Mus musculus
gtacgtgctgcgtgcaatcgcatgt

SEQ ID NO: 667798 - DNA, 25 bp, Mus musculus
gtacgtgctgtgaagtgatctgaaa

SEQ ID NO: 667799 - DNA, 25 bp, Mus musculus
gtacgtgctgtgtagtgatctgaaa

SEQ ID NO: 667800 - DNA, 25 bp, Mus musculus
gtacgtggctataccattcctaaag

SEQ ID NO: 667801 - DNA, 25 bp, Mus musculus
gtacgtggctattccattcctaaag

SEQ ID NO: 667802 - DNA, 25 bp, Mus musculus
gtacgtggctcaacttgttagcaga

SEQ ID NO: 667803 - DNA, 25 bp, Mus musculus
gtacgtggctcatcttgttagcaga

SEQ ID NO: 667804 - DNA, 25 bp, Mus musculus
gtacgtgggcttaccaatgacaggc

SEQ ID NO: 667805 - DNA, 25 bp, Mus musculus
gtacgtgggctttccaatgacaggc

SEQ ID NO: 667806 - DNA, 25 bp, Mus musculus
gtacgtggtagacctgaggttcaaa

SEQ ID NO: 667807 - DNA, 25 bp, Mus musculus
gtacgtggtagagctgaggttcaaa

SEQ ID NO: 667808 - DNA, 25 bp, Mus musculus
gtacgtggtgtgcaaaaccccttag

SEQ ID NO: 667809 - DNA, 25 bp, Mus musculus
gtacgtggtgtggaaaaccccttag

SEQ ID NO: 667810 - DNA, 25 bp, Mus musculus
gtacgtgtacatctagtggctgcag

SEQ ID NO: 667811 - DNA, 25 bp, Mus musculus
gtacgtgtacatgtagtggctgcag

SEQ ID NO: 667812 - DNA, 25 bp, Mus musculus
gtacgtgtctagagaagccagtgct

SEQ ID NO: 667813 - DNA, 25 bp, Mus musculus
gtacgtgtctagtgaagccagtgct

SEQ ID NO: 667814 - DNA, 25 bp, Mus musculus
gtacgtgtctatagctgggtctcta

SEQ ID NO: 667815 - DNA, 25 bp, Mus musculus
gtacgtgtctattgctgggtctcta

SEQ ID NO: 667816 - DNA, 25 bp, Mus musculus
gtacgtgtctgtccgtgcaacataa

SEQ ID NO: 667817 - DNA, 25 bp, Mus musculus
gtacgtgtctgtgcgtgcaacataa

SEQ ID NO: 667818 - DNA, 25 bp, Mus musculus
gtacgtgtgcgtaaactaaacatat

SEQ ID NO: 667819 - DNA, 25 bp, Mus musculus
gtacgtgtgcgttaactaaacatat

SEQ ID NO: 667820 - DNA, 25 bp, Mus musculus
gtacgtgtgggcactctgcagagac

SEQ ID NO: 667821 - DNA, 25 bp, Mus musculus
gtacgtgtgggctctctgcagagac

SEQ ID NO: 667822 - DNA, 25 bp, Mus musculus
gtacgtgtgtacatcccttacagat

SEQ ID NO: 667823 - DNA, 25 bp, Mus musculus
gtacgtgtgtacttcccttacagat

SEQ ID NO: 667824 - DNA, 25 bp, Mus musculus
gtacgtgttatacaccactcagatc

SEQ ID NO: 667825 - DNA, 25 bp, Mus musculus
gtacgtgttatagaccactcagatc

SEQ ID NO: 667826 - DNA, 25 bp, Mus musculus
gtacgtgttttacaagccctggctc

SEQ ID NO: 667827 - DNA, 25 bp, Mus musculus
gtacgtgttttagaagccctggctc

SEQ ID NO: 667828 - DNA, 25 bp, Mus musculus
gtacgtgttttcagagccatgcata

SEQ ID NO: 667829 - DNA, 25 bp, Mus musculus
gtacgtgttttctgagccatgcata

SEQ ID NO: 667830 - DNA, 25 bp, Mus musculus
gtacgttaatatatttagcgcacag

SEQ ID NO: 667831 - DNA, 25 bp, Mus musculus
gtacgttaatatttttagcgcacag

SEQ ID NO: 667832 - DNA, 25 bp, Mus musculus
gtacgttacagcaagcgccaagcag

SEQ ID NO: 667833 - DNA, 25 bp, Mus musculus
gtacgttacagctagcgccaagcag

SEQ ID NO: 667834 - DNA, 25 bp, Mus musculus
gtacgttagaggatcttccacaagc

SEQ ID NO: 667835 - DNA, 25 bp, Mus musculus
gtacgttagaggttcttccacaagc

SEQ ID NO: 667836 - DNA, 25 bp, Mus musculus
gtacgttataatatcactatcacag

SEQ ID NO: 667837 - DNA, 25 bp, Mus musculus
gtacgttataatttcactatcacag

SEQ ID NO: 667838 - DNA, 25 bp, Mus musculus
gtacgttcattcaaatctctgggag

SEQ ID NO: 667839 - DNA, 25 bp, Mus musculus
gtacgttcattctaatctctgggag

SEQ ID NO: 667840 - DNA, 25 bp, Mus musculus
gtacgttcttaacacaaggagccca

SEQ ID NO: 667841 - DNA, 25 bp, Mus musculus
gtacgttcttaagacaaggagccca

SEQ ID NO: 667842 - DNA, 25 bp, Mus musculus
gtacgttcttaccttattttctctg

SEQ ID NO: 667843 - DNA, 25 bp, Mus musculus
gtacgttcttacgttattttctctg

SEQ ID NO: 667844 - DNA, 25 bp, Mus musculus
gtacgttgcatcaatcatggttatt

SEQ ID NO: 667845 - DNA, 25 bp, Mus musculus
gtacgttgcatctatcatggttatt

SEQ ID NO: 667846 - DNA, 25 bp, Mus musculus
gtacgttgctaactaccaccagctg

SEQ ID NO: 667847 - DNA, 25 bp, Mus musculus
gtacgttgctaagtaccaccagctg

SEQ ID NO: 667848 - DNA, 25 bp, Mus musculus
gtacgttggtacagcttttcacttg

SEQ ID NO: 667849 - DNA, 25 bp, Mus musculus
gtacgttggtactgcttttcacttg

SEQ ID NO: 667850 - DNA, 25 bp, Mus musculus
gtacgttgtttgcactgctgttaag

SEQ ID NO: 667851 - DNA, 25 bp, Mus musculus
gtacgttgtttggactgctgttaag

SEQ ID NO: 667852 - DNA, 25 bp, Mus musculus
gtacgtttaagtactaatttcacat

SEQ ID NO: 667853 - DNA, 25 bp, Mus musculus
gtacgtttaagttctaatttcacat

SEQ ID NO: 667854 - DNA, 25 bp, Mus musculus
gtacgtttatgtagactcatgttat

SEQ ID NO: 667855 - DNA, 25 bp, Mus musculus
gtacgtttatgttgactcatgttat

SEQ ID NO: 667856 - DNA, 25 bp, Mus musculus
gtacgtttcacaatactgggtcctg

SEQ ID NO: 667857 - DNA, 25 bp, Mus musculus
gtacgtttcacattactgggtcctg

SEQ ID NO: 667858 - DNA, 25 bp, Mus musculus
gtacgtttccatatcctactatgaa

SEQ ID NO: 667859 - DNA, 25 bp, Mus musculus
gtacgtttccatttcctactatgaa

SEQ ID NO: 667860 - DNA, 25 bp, Mus musculus
gtacgtttccggaatgcggctccct

SEQ ID NO: 667861 - DNA, 25 bp, Mus musculus
gtacgtttccggtatgcggctccct

SEQ ID NO: 667862 - DNA, 25 bp, Mus musculus
gtacgtttggtacatccttgaattc

SEQ ID NO: 667863 - DNA, 25 bp, Mus musculus
gtacgtttggtagatccttgaattc

SEQ ID NO: 667864 - DNA, 25 bp, Mus musculus
gtacgttttactcctgattgtttgt

SEQ ID NO: 667865 - DNA, 25 bp, Mus musculus
gtacgttttactgctgattgtttgt

SEQ ID NO: 667866 - DNA, 25 bp, Mus musculus
gtacgttttcagaggtctacagtaa

SEQ ID NO: 667867 - DNA, 25 bp, Mus musculus
gtacgttttcagtggtctacagtaa

SEQ ID NO: 667868 - DNA, 25 bp, Mus musculus
gtacgttttcatctgttgaagatga

SEQ ID NO: 667869 - DNA, 25 bp, Mus musculus
gtacgttttcatgtgttgaagatga

SEQ ID NO: 667870 - DNA, 25 bp, Mus musculus
gtactaaaaatccagtttcattatt

SEQ ID NO: 667871 - DNA, 25 bp, Mus musculus
gtactaaaaatcgagtttcattatt

SEQ ID NO: 667872 - DNA, 25 bp, Mus musculus
gtactaaaactcagtgtcacaacta

SEQ ID NO: 667873 - DNA, 25 bp, Mus musculus
gtactaaaactctgtgtcacaacta

SEQ ID NO: 667874 - DNA, 25 bp, Mus musculus
gtactaaaagctcctatggcctgta

SEQ ID NO: 667875 - DNA, 25 bp, Mus musculus
gtactaaaagctgctatggcctgta

SEQ ID NO: 667876 - DNA, 25 bp, Mus musculus
gtactaaagggtccttggatcatgt

SEQ ID NO: 667877 - DNA, 25 bp, Mus musculus
gtactaaagggtgcttggatcatgt

SEQ ID NO: 667878 - DNA, 25 bp, Mus musculus
gtactaaagtgcaatccgctgggcc

SEQ ID NO: 667879 - DNA, 25 bp, Mus musculus
gtactaaagtgctatccgctgggcc

SEQ ID NO: 667880 - DNA, 25 bp, Mus musculus
gtactaaatttaaccacatcactca

SEQ ID NO: 667881 - DNA, 25 bp, Mus musculus
gtactaaatttactgtgtgccactt

SEQ ID NO: 667882 - DNA, 25 bp, Mus musculus
gtactaaatttagtgtgtgccactt

SEQ ID NO: 667883 - DNA, 25 bp, Mus musculus
gtactaaatttatccacatcactca

SEQ ID NO: 667884 - DNA, 25 bp, Mus musculus
gtactaaattttcagctccctatga

SEQ ID NO: 667885 - DNA, 25 bp, Mus musculus
gtactaaattttgagctccctatga

SEQ ID NO: 667886 - DNA, 25 bp, Mus musculus
gtactaacacttatggcagaggcag

SEQ ID NO: 667887 - DNA, 25 bp, Mus musculus
gtactaacacttttggcagaggcag

SEQ ID NO: 667888 - DNA, 25 bp, Mus musculus
gtactaacagctccacagaaatgtg

SEQ ID NO: 667889 - DNA, 25 bp, Mus musculus
gtactaacagctgcacagaaatgtg

SEQ ID NO: 667890 - DNA, 25 bp, Mus musculus
gtactaactgcactccaagatggaa

SEQ ID NO: 667891 - DNA, 25 bp, Mus musculus
gtactaactgcagtccaagatggaa

SEQ ID NO: 667892 - DNA, 25 bp, Mus musculus
gtactaactgtacctatgaccgaat

SEQ ID NO: 667893 - DNA, 25 bp, Mus musculus
gtactaactgtagctatgaccgaat

SEQ ID NO: 667894 - DNA, 25 bp, Mus musculus
gtactaagacccaaattgcagcaag

SEQ ID NO: 667895 - DNA, 25 bp, Mus musculus
gtactaagaccctaattgcagcaag

SEQ ID NO: 667896 - DNA, 25 bp, Mus musculus
gtactaagactcacgttagcaggaa

SEQ ID NO: 667897 - DNA, 25 bp, Mus musculus
gtactaagactctcgttagcaggaa

SEQ ID NO: 667898 - DNA, 25 bp, Mus musculus
gtactaagggcaagcgagatcatat

SEQ ID NO: 667899 - DNA, 25 bp, Mus musculus
gtactaagggcatgcgagatcatat

SEQ ID NO: 667900 - DNA, 25 bp, Mus musculus
gtactaagttaaagccagtctggcc

SEQ ID NO: 667901 - DNA, 25 bp, Mus musculus
gtactaagttaatgccagtctggcc

SEQ ID NO: 667902 - DNA, 25 bp, Mus musculus
gtactaataggcatgtgtgactctt

SEQ ID NO: 667903 - DNA, 25 bp, Mus musculus
gtactaataggcttgtgtgactctt

SEQ ID NO: 667904 - DNA, 25 bp, Mus musculus
gtactaatatacatcctgggcccat

SEQ ID NO: 667905 - DNA, 25 bp, Mus musculus
gtactaatatacttcctgggcccat

SEQ ID NO: 667906 - DNA, 25 bp, Mus musculus
gtactaatgtggctggttttctctc

SEQ ID NO: 667907 - DNA, 25 bp, Mus musculus
gtactaatgtgggtggttttctctc

SEQ ID NO: 667908 - DNA, 25 bp, Mus musculus
gtactaattaagagagctatctcat

SEQ ID NO: 667909 - DNA, 25 bp, Mus musculus
gtactaattaagtgagctatctcat

SEQ ID NO: 667910 - DNA, 25 bp, Mus musculus
gtactaattacacccatgcatccct

SEQ ID NO: 667911 - DNA, 25 bp, Mus musculus
gtactaattacagccatgcatccct

SEQ ID NO: 667912 - DNA, 25 bp, Mus musculus
gtactacaccgacatggaccccgaa

SEQ ID NO: 667913 - DNA, 25 bp, Mus musculus
gtactacaccgagatggaccccgaa

SEQ ID NO: 667914 - DNA, 25 bp, Mus musculus
gtactacactgactttaacctctta

SEQ ID NO: 667915 - DNA, 25 bp, Mus musculus
gtactacactgagtttaacctctta

SEQ ID NO: 667916 - DNA, 25 bp, Mus musculus
gtactacagagaagcccgttcgtat

SEQ ID NO: 667917 - DNA, 25 bp, Mus musculus
gtactacagagatgcccgttcgtat

SEQ ID NO: 667918 - DNA, 25 bp, Mus musculus
gtactacagagtcagctttgccttt

SEQ ID NO: 667919 - DNA, 25 bp, Mus musculus
gtactacagagtgagctttgccttt

SEQ ID NO: 667920 - DNA, 25 bp, Mus musculus
gtactacagcatcaacagccccagt

SEQ ID NO: 667921 - DNA, 25 bp, Mus musculus
gtactacagcatctcatatctccag

SEQ ID NO: 667922 - DNA, 25 bp, Mus musculus
gtactacagcatgaacagccccagt

SEQ ID NO: 667923 - DNA, 25 bp, Mus musculus
gtactacagcatgtcatatctccag

SEQ ID NO: 667924 - DNA, 25 bp, Mus musculus
gtactacagcttccatatatttttt

SEQ ID NO: 667925 - DNA, 25 bp, Mus musculus
gtactacagcttgcatatatttttt

SEQ ID NO: 667926 - DNA, 25 bp, Mus musculus
gtactacagtcacaggagtcccctt

SEQ ID NO: 667927 - DNA, 25 bp, Mus musculus
gtactacagtcagaggagtcccctt

SEQ ID NO: 667928 - DNA, 25 bp, Mus musculus
gtactacagtccagtttacagatta

SEQ ID NO: 667929 - DNA, 25 bp, Mus musculus
gtactacagtcctgtttacagatta

SEQ ID NO: 667930 - DNA, 25 bp, Mus musculus
gtactacagttaagcatgttcggaa

SEQ ID NO: 667931 - DNA, 25 bp, Mus musculus
gtactacagttatgcatgttcggaa

SEQ ID NO: 667932 - DNA, 25 bp, Mus musculus
gtactacatactcgagtgtaacctc

SEQ ID NO: 667933 - DNA, 25 bp, Mus musculus
gtactacatactggagtgtaacctc

SEQ ID NO: 667934 - DNA, 25 bp, Mus musculus
gtactacatcccagaagtcttctac

SEQ ID NO: 667935 - DNA, 25 bp, Mus musculus
gtactacatccctgaagtcttctac

SEQ ID NO: 667936 - DNA, 25 bp, Mus musculus
gtactaccaaggatgatagcaggac

SEQ ID NO: 667937 - DNA, 25 bp, Mus musculus
gtactaccaaggttgatagcaggac

SEQ ID NO: 667938 - DNA, 25 bp, Mus musculus
gtactaccagatcaacagccagcca

SEQ ID NO: 667939 - DNA, 25 bp, Mus musculus
gtactaccagatgaacagccagcca

SEQ ID NO: 667940 - DNA, 25 bp, Mus musculus
gtactaccagctatcctaattgaag

SEQ ID NO: 667941 - DNA, 25 bp, Mus musculus
gtactaccagctttcctaattgaag

SEQ ID NO: 667942 - DNA, 25 bp, Mus musculus
gtactaccatgcactcatacatttt

SEQ ID NO: 667943 - DNA, 25 bp, Mus musculus
gtactaccatgctctcatacatttt

SEQ ID NO: 667944 - DNA, 25 bp, Mus musculus
gtactacccaaaacctccatgtaag

SEQ ID NO: 667945 - DNA, 25 bp, Mus musculus
gtactacccaaacacaaacgccttg

SEQ ID NO: 667946 - DNA, 25 bp, Mus musculus
gtactacccaaagacaaacgccttg

SEQ ID NO: 667947 - DNA, 25 bp, Mus musculus
gtactacccaaatcctccatgtaag

SEQ ID NO: 667948 - DNA, 25 bp, Mus musculus
gtactacccagacccaacagggaat

SEQ ID NO: 667949 - DNA, 25 bp, Mus musculus
gtactacccagagccaacagggaat

SEQ ID NO: 667950 - DNA, 25 bp, Mus musculus
gtactacccatcaagtctctcactg

SEQ ID NO: 667951 - DNA, 25 bp, Mus musculus
gtactacccatctagtctctcactg

SEQ ID NO: 667952 - DNA, 25 bp, Mus musculus
gtactaccccctagcacaataatag

SEQ ID NO: 667953 - DNA, 25 bp, Mus musculus
gtactacccccttgcacaataatag

SEQ ID NO: 667954 - DNA, 25 bp, Mus musculus
gtactacccgcgctggccaggaagt

SEQ ID NO: 667955 - DNA, 25 bp, Mus musculus
gtactacccgcggtggccaggaagt

SEQ ID NO: 667956 - DNA, 25 bp, Mus musculus
gtactaccgtatactagaacactgt

SEQ ID NO: 667957 - DNA, 25 bp, Mus musculus
gtactaccgtattctagaacactgt

SEQ ID NO: 667958 - DNA, 25 bp, Mus musculus
gtactacctgaccttgctatggaat

SEQ ID NO: 667959 - DNA, 25 bp, Mus musculus
gtactacctgacgttgctatggaat

SEQ ID NO: 667960 - DNA, 25 bp, Mus musculus
gtactaccttgtcagctgtgagtgc

SEQ ID NO: 667961 - DNA, 25 bp, Mus musculus
gtactaccttgtgagctgtgagtgc

SEQ ID NO: 667962 - DNA, 25 bp, Mus musculus
gtactacgatgcaatctgggccttt

SEQ ID NO: 667963 - DNA, 25 bp, Mus musculus
gtactacgatgctatctgggccttt

SEQ ID NO: 667964 - DNA, 25 bp, Mus musculus
gtactacgcagacttgtgtgctccc

SEQ ID NO: 667965 - DNA, 25 bp, Mus musculus
gtactacgcagagttgtgtgctccc

SEQ ID NO: 667966 - DNA, 25 bp, Mus musculus
gtactactacctaccaggcagtaac

SEQ ID NO: 667967 - DNA, 25 bp, Mus musculus
gtactactaccttccaggcagtaac

SEQ ID NO: 667968 - DNA, 25 bp, Mus musculus
gtactactagctcaaattatggttt

SEQ ID NO: 667969 - DNA, 25 bp, Mus musculus
gtactactagctgaaattatggttt

SEQ ID NO: 667970 - DNA, 25 bp, Mus musculus
gtactactattgaaggctcagctaa

SEQ ID NO: 667971 - DNA, 25 bp, Mus musculus
gtactactattgtaggctcagctaa

SEQ ID NO: 667972 - DNA, 25 bp, Mus musculus
gtactactccatctattacggttta

SEQ ID NO: 667973 - DNA, 25 bp, Mus musculus
gtactactccatgtattacggttta

SEQ ID NO: 667974 - DNA, 25 bp, Mus musculus
gtactactgctcagactacaaacag

SEQ ID NO: 667975 - DNA, 25 bp, Mus musculus
gtactactgctctgactacaaacag

SEQ ID NO: 667976 - DNA, 25 bp, Mus musculus
gtactactgcttaggctaatgatcc

SEQ ID NO: 667977 - DNA, 25 bp, Mus musculus
gtactactgctttggctaatgatcc

SEQ ID NO: 667978 - DNA, 25 bp, Mus musculus
gtactactgtgactcaaaagctgat

SEQ ID NO: 667979 - DNA, 25 bp, Mus musculus
gtactactgtgagtcaaaagctgat

SEQ ID NO: 667980 - DNA, 25 bp, Mus musculus
gtactactgtgcatgttgctggttt

SEQ ID NO: 667981 - DNA, 25 bp, Mus musculus
gtactactgtgcttgttgctggttt

SEQ ID NO: 667982 - DNA, 25 bp, Mus musculus
gtactacttacaatctggataattc

SEQ ID NO: 667983 - DNA, 25 bp, Mus musculus
gtactacttacattctggataattc

SEQ ID NO: 667984 - DNA, 25 bp, Mus musculus
gtactacttgcacataccacaacac

SEQ ID NO: 667985 - DNA, 25 bp, Mus musculus
gtactacttgcagataccacaacac

SEQ ID NO: 667986 - DNA, 25 bp, Mus musculus
gtactacttggcagaatttccatat

SEQ ID NO: 667987 - DNA, 25 bp, Mus musculus
gtactacttggctgaatttccatat

SEQ ID NO: 667988 - DNA, 25 bp, Mus musculus
gtactacttttcaaactacagcagg

SEQ ID NO: 667989 - DNA, 25 bp, Mus musculus
gtactacttttctaactacagcagg

SEQ ID NO: 667990 - DNA, 25 bp, Mus musculus
gtactagaaacaccggcaggacccc

SEQ ID NO: 667991 - DNA, 25 bp, Mus musculus
gtactagaaacagcggcaggacccc

SEQ ID NO: 667992 - DNA, 25 bp, Mus musculus
gtactagaacaacgaatcatcaaag

SEQ ID NO: 667993 - DNA, 25 bp, Mus musculus
gtactagaacaaggaatcatcaaag

SEQ ID NO: 667994 - DNA, 25 bp, Mus musculus
gtactagagccaacacctttatatt

SEQ ID NO: 667995 - DNA, 25 bp, Mus musculus
gtactagagccatcacctttatatt

SEQ ID NO: 667996 - DNA, 25 bp, Mus musculus
gtactagagcgaacactaggatctc

SEQ ID NO: 667997 - DNA, 25 bp, Mus musculus
gtactagagcgatcactaggatctc

SEQ ID NO: 667998 - DNA, 25 bp, Mus musculus
gtactagatcgcatatggccatctc

SEQ ID NO: 667999 - DNA, 25 bp, Mus musculus
gtactagatcgcttatggccatctc

SEQ ID NO: 668000 - DNA, 25 bp, Mus musculus
gtactagattatagccctcttctgg

SEQ ID NO: 668001 - DNA, 25 bp, Mus musculus
gtactagattattgccctcttctgg

SEQ ID NO: 668002 - DNA, 25 bp, Mus musculus
gtactagattcccacagaacatcta

SEQ ID NO: 668003 - DNA, 25 bp, Mus musculus
gtactagattccgacagaacatcta

SEQ ID NO: 668004 - DNA, 25 bp, Mus musculus
gtactagattttctccaccctggaa

SEQ ID NO: 668005 - DNA, 25 bp, Mus musculus
gtactagattttgtccaccctggaa

SEQ ID NO: 668006 - DNA, 25 bp, Mus musculus
gtactagcatttagagtcactgtca

SEQ ID NO: 668007 - DNA, 25 bp, Mus musculus
gtactagcattttgagtcactgtca

SEQ ID NO: 668008 - DNA, 25 bp, Mus musculus
gtactagccaggagaagacccactc

SEQ ID NO: 668009 - DNA, 25 bp, Mus musculus
gtactagccaggtgaagacccactc

SEQ ID NO: 668010 - DNA, 25 bp, Mus musculus
gtactagctacaatcaatgctgcag

SEQ ID NO: 668011 - DNA, 25 bp, Mus musculus
gtactagctacattcaatgctgcag

SEQ ID NO: 668012 - DNA, 25 bp, Mus musculus
gtactagctcctatccactaaatga

SEQ ID NO: 668013 - DNA, 25 bp, Mus musculus
gtactagctcctttccactaaatga

SEQ ID NO: 668014 - DNA, 25 bp, Mus musculus
gtactagctgaccaccctggcgagc

SEQ ID NO: 668015 - DNA, 25 bp, Mus musculus
gtactagctgacgaccctggcgagc

SEQ ID NO: 668016 - DNA, 25 bp, Mus musculus
gtactaggaaaactgcaccagcatc

SEQ ID NO: 668017 - DNA, 25 bp, Mus musculus
gtactaggaaaagtgcaccagcatc

SEQ ID NO: 668018 - DNA, 25 bp, Mus musculus
gtactaggaccacggatgtgcaccc

SEQ ID NO: 668019 - DNA, 25 bp, Mus musculus
gtactaggaccagggatgtgcaccc

SEQ ID NO: 668020 - DNA, 25 bp, Mus musculus
gtactaggacttccccgagatcaga

SEQ ID NO: 668021 - DNA, 25 bp, Mus musculus
gtactaggacttgcccgagatcaga

SEQ ID NO: 668022 - DNA, 25 bp, Mus musculus
gtactaggtaatcctgtaaccactt

SEQ ID NO: 668023 - DNA, 25 bp, Mus musculus
gtactaggtaatgctgtaaccactt

SEQ ID NO: 668024 - DNA, 25 bp, Mus musculus
gtactaggtattactgagcgactga

SEQ ID NO: 668025 - DNA, 25 bp, Mus musculus
gtactaggtatttctgagcgactga

SEQ ID NO: 668026 - DNA, 25 bp, Mus musculus
gtactaggtgtcatgtgtctggctg

SEQ ID NO: 668027 - DNA, 25 bp, Mus musculus
gtactaggtgtcttgtgtctggctg

SEQ ID NO: 668028 - DNA, 25 bp, Mus musculus
gtactaggttcaattgtgaagcccc

SEQ ID NO: 668029 - DNA, 25 bp, Mus musculus
gtactaggttcatttgtgaagcccc

SEQ ID NO: 668030 - DNA, 25 bp, Mus musculus
gtactagtaattctttttgcccact

SEQ ID NO: 668031 - DNA, 25 bp, Mus musculus
gtactagtaattgtttttgcccact

SEQ ID NO: 668032 - DNA, 25 bp, Mus musculus
gtactagtaggcacacaggcactgg

SEQ ID NO: 668033 - DNA, 25 bp, Mus musculus
gtactagtaggctcacaggcactgg

SEQ ID NO: 668034 - DNA, 25 bp, Mus musculus
gtactagtatatagccgtgcgtgaa

SEQ ID NO: 668035 - DNA, 25 bp, Mus musculus
gtactagtatattgccgtgcgtgaa

SEQ ID NO: 668036 - DNA, 25 bp, Mus musculus
gtactagtgattaacctgtgccgac

SEQ ID NO: 668037 - DNA, 25 bp, Mus musculus
gtactagtgatttacctgtgccgac

SEQ ID NO: 668038 - DNA, 25 bp, Mus musculus
gtactagtggtaatcctgggaccaa

SEQ ID NO: 668039 - DNA, 25 bp, Mus musculus
gtactagtggtattcctgggaccaa

SEQ ID NO: 668040 - DNA, 25 bp, Mus musculus
gtactagttcatcactggtaaagca

SEQ ID NO: 668041 - DNA, 25 bp, Mus musculus
gtactagttcatgactggtaaagca

SEQ ID NO: 668042 - DNA, 25 bp, Mus musculus
gtactataattcatctggatgggca

SEQ ID NO: 668043 - DNA, 25 bp, Mus musculus
gtactataattcttctggatgggca

SEQ ID NO: 668044 - DNA, 25 bp, Mus musculus
gtactatacggtcttaactatgcaa

SEQ ID NO: 668045 - DNA, 25 bp, Mus musculus
gtactatacggtgttaactatgcaa

SEQ ID NO: 668046 - DNA, 25 bp, Mus musculus
gtactatactaaaggcttcctgtta

SEQ ID NO: 668047 - DNA, 25 bp, Mus musculus
gtactatactaatggcttcctgtta

SEQ ID NO: 668048 - DNA, 25 bp, Mus musculus
gtactatactatcaatctccttgca

SEQ ID NO: 668049 - DNA, 25 bp, Mus musculus
gtactatactatgaatctccttgca

SEQ ID NO: 668050 - DNA, 25 bp, Mus musculus
gtactatagaatcctgccactgtct

SEQ ID NO: 668051 - DNA, 25 bp, Mus musculus
gtactatagaatgctgccactgtct

SEQ ID NO: 668052 - DNA, 25 bp, Mus musculus
gtactatagacaccaagcagcgtat

SEQ ID NO: 668053 - DNA, 25 bp, Mus musculus
gtactatagacagcaagcagcgtat

SEQ ID NO: 668054 - DNA, 25 bp, Mus musculus
gtactataggtgaactgtactgagc

SEQ ID NO: 668055 - DNA, 25 bp, Mus musculus
gtactataggtgtactgtactgagc

SEQ ID NO: 668056 - DNA, 25 bp, Mus musculus
gtactatccatacggattttacaga

SEQ ID NO: 668057 - DNA, 25 bp, Mus musculus
gtactatccatagggattttacaga

SEQ ID NO: 668058 - DNA, 25 bp, Mus musculus
gtactatcccagaaagtgttgacta

SEQ ID NO: 668059 - DNA, 25 bp, Mus musculus
gtactatcccagtaagtgttgacta

SEQ ID NO: 668060 - DNA, 25 bp, Mus musculus
gtactatcccatcgaagccctaact

SEQ ID NO: 668061 - DNA, 25 bp, Mus musculus
gtactatcccatggaagccctaact

SEQ ID NO: 668062 - DNA, 25 bp, Mus musculus
gtactatcctcaatggccactgaat

SEQ ID NO: 668063 - DNA, 25 bp, Mus musculus
gtactatcctcattggccactgaat

SEQ ID NO: 668064 - DNA, 25 bp, Mus musculus
gtactatccttgagagcatatcgcc

SEQ ID NO: 668065 - DNA, 25 bp, Mus musculus
gtactatccttgtgagcatatcgcc

SEQ ID NO: 668066 - DNA, 25 bp, Mus musculus
gtactatcctttcacagggttacca

SEQ ID NO: 668067 - DNA, 25 bp, Mus musculus
gtactatcctttgacagggttacca

SEQ ID NO: 668068 - DNA, 25 bp, Mus musculus
gtactatcgaaacttggtcatccag

SEQ ID NO: 668069 - DNA, 25 bp, Mus musculus
gtactatcgaaagttggtcatccag

SEQ ID NO: 668070 - DNA, 25 bp, Mus musculus
gtactatcggccagacctgacaata

SEQ ID NO: 668071 - DNA, 25 bp, Mus musculus
gtactatcggcctgacctgacaata

SEQ ID NO: 668072 - DNA, 25 bp, Mus musculus
gtactatctcacacagacagcagcg

SEQ ID NO: 668073 - DNA, 25 bp, Mus musculus
gtactatctcactcagacagcagcg

SEQ ID NO: 668074 - DNA, 25 bp, Mus musculus
gtactatctgaacataaactgcact

SEQ ID NO: 668075 - DNA, 25 bp, Mus musculus
gtactatctgaagataaactgcact

SEQ ID NO: 668076 - DNA, 25 bp, Mus musculus
gtactatctgtactgcctctgatgt

SEQ ID NO: 668077 - DNA, 25 bp, Mus musculus
gtactatctgtagtgcctctgatgt

SEQ ID NO: 668078 - DNA, 25 bp, Mus musculus
gtactatgaccacctgaatttaaat

SEQ ID NO: 668079 - DNA, 25 bp, Mus musculus
gtactatgaccagctgaatttaaat

SEQ ID NO: 668080 - DNA, 25 bp, Mus musculus
gtactatgatgtaacttcccttcct

SEQ ID NO: 668081 - DNA, 25 bp, Mus musculus
gtactatgatgttacttcccttcct

SEQ ID NO: 668082 - DNA, 25 bp, Mus musculus
gtactatgccttagtgtaagtctca

SEQ ID NO: 668083 - DNA, 25 bp, Mus musculus
gtactatgcctttgtgtaagtctca

SEQ ID NO: 668084 - DNA, 25 bp, Mus musculus
gtactatggctacttatggagcgaa

SEQ ID NO: 668085 - DNA, 25 bp, Mus musculus
gtactatggctagttatggagcgaa

SEQ ID NO: 668086 - DNA, 25 bp, Mus musculus
gtactatgggcaacttcagactcta

SEQ ID NO: 668087 - DNA, 25 bp, Mus musculus
gtactatgggcatcttcagactcta

SEQ ID NO: 668088 - DNA, 25 bp, Mus musculus
gtactatggtacatgtgcacacata

SEQ ID NO: 668089 - DNA, 25 bp, Mus musculus
gtactatggtacttgtgcacacata

SEQ ID NO: 668090 - DNA, 25 bp, Mus musculus
gtactatgtactattgagacttgat

SEQ ID NO: 668091 - DNA, 25 bp, Mus musculus
gtactatgtacttttgagacttgat

SEQ ID NO: 668092 - DNA, 25 bp, Mus musculus
gtactatgtaggattgactccatat

SEQ ID NO: 668093 - DNA, 25 bp, Mus musculus
gtactatgtaggtttgactccatat

SEQ ID NO: 668094 - DNA, 25 bp, Mus musculus
gtactatgtcagatccaccattgtt

SEQ ID NO: 668095 - DNA, 25 bp, Mus musculus
gtactatgtcagttccaccattgtt

SEQ ID NO: 668096 - DNA, 25 bp, Mus musculus
gtactatgtgtgagtgctccgccct

SEQ ID NO: 668097 - DNA, 25 bp, Mus musculus
gtactatgtgtgtgtgctccgccct

SEQ ID NO: 668098 - DNA, 25 bp, Mus musculus
gtactattcaatactcccgactgtg

SEQ ID NO: 668099 - DNA, 25 bp, Mus musculus
gtactattcaattctcccgactgtg

SEQ ID NO: 668100 - DNA, 25 bp, Mus musculus
gtactattcagtaatcccaccagaa

SEQ ID NO: 668101 - DNA, 25 bp, Mus musculus
gtactattcagttatcccaccagaa

SEQ ID NO: 668102 - DNA, 25 bp, Mus musculus
gtactattgaagatggaaccaaatc

SEQ ID NO: 668103 - DNA, 25 bp, Mus musculus
gtactattgaagttggaaccaaatc

SEQ ID NO: 668104 - DNA, 25 bp, Mus musculus
gtactattggtcaaatgcctgtgaa

SEQ ID NO: 668105 - DNA, 25 bp, Mus musculus
gtactattggtctaatgcctgtgaa

SEQ ID NO: 668106 - DNA, 25 bp, Mus musculus
gtactattgtcactgcactgctgtc

SEQ ID NO: 668107 - DNA, 25 bp, Mus musculus
gtactattgtcagtgcactgctgtc

SEQ ID NO: 668108 - DNA, 25 bp, Mus musculus
gtactattgtctaactatcacgtta

SEQ ID NO: 668109 - DNA, 25 bp, Mus musculus
gtactattgtcttactatcacgtta

SEQ ID NO: 668110 - DNA, 25 bp, Mus musculus
gtactatttatacttacttagcagt

SEQ ID NO: 668111 - DNA, 25 bp, Mus musculus
gtactatttatagttacttagcagt

SEQ ID NO: 668112 - DNA, 25 bp, Mus musculus
gtactatttattagagctggtggag

SEQ ID NO: 668113 - DNA, 25 bp, Mus musculus
gtactatttatttgagctggtggag

SEQ ID NO: 668114 - DNA, 25 bp, Mus musculus
gtactatttctccagacagtgcaaa

SEQ ID NO: 668115 - DNA, 25 bp, Mus musculus
gtactatttctcgagacagtgcaaa

SEQ ID NO: 668116 - DNA, 25 bp, Mus musculus
gtactatttttcaagcacagtcaaa

SEQ ID NO: 668117 - DNA, 25 bp, Mus musculus
gtactatttttctagcacagtcaaa

SEQ ID NO: 668118 - DNA, 25 bp, Mus musculus
gtactcaaaaggatcaggcatatgc

SEQ ID NO: 668119 - DNA, 25 bp, Mus musculus
gtactcaaaaggttcaggcatatgc

SEQ ID NO: 668120 - DNA, 25 bp, Mus musculus
gtactcaaactacgctttcacaggg

SEQ ID NO: 668121 - DNA, 25 bp, Mus musculus
gtactcaaactaggctttcacaggg

SEQ ID NO: 668122 - DNA, 25 bp, Mus musculus
gtactcaaagtgacaaagcctttca

SEQ ID NO: 668123 - DNA, 25 bp, Mus musculus
gtactcaaagtgtcaaagcctttca

SEQ ID NO: 668124 - DNA, 25 bp, Mus musculus
gtactcaaagttcttgatcatcagt

SEQ ID NO: 668125 - DNA, 25 bp, Mus musculus
gtactcaaagttgttgatcatcagt

SEQ ID NO: 668126 - DNA, 25 bp, Mus musculus
gtactcaaccccataagtctcagag

SEQ ID NO: 668127 - DNA, 25 bp, Mus musculus
gtactcaaccccttaagtctcagag

SEQ ID NO: 668128 - DNA, 25 bp, Mus musculus
gtactcaactcgctgtattccacgt

SEQ ID NO: 668129 - DNA, 25 bp, Mus musculus
gtactcaactcggtgtattccacgt

SEQ ID NO: 668130 - DNA, 25 bp, Mus musculus
gtactcaactttcggtggcgctcta

SEQ ID NO: 668131 - DNA, 25 bp, Mus musculus
gtactcaactttgggtggcgctcta

SEQ ID NO: 668132 - DNA, 25 bp, Mus musculus
gtactcaagtgcacaaacccacatt

SEQ ID NO: 668133 - DNA, 25 bp, Mus musculus
gtactcaagtgctcaaacccacatt

SEQ ID NO: 668134 - DNA, 25 bp, Mus musculus
gtactcaatccaagaagtcacacca

SEQ ID NO: 668135 - DNA, 25 bp, Mus musculus
gtactcaatccatgaagtcacacca

SEQ ID NO: 668136 - DNA, 25 bp, Mus musculus
gtactcaatctgatcgagtccagga

SEQ ID NO: 668137 - DNA, 25 bp, Mus musculus
gtactcaatctgttcgagtccagga

SEQ ID NO: 668138 - DNA, 25 bp, Mus musculus
gtactcaatgagcaccaaataaaat

SEQ ID NO: 668139 - DNA, 25 bp, Mus musculus
gtactcaatgaggaccaaataaaat

SEQ ID NO: 668140 - DNA, 25 bp, Mus musculus
gtactcaatggtatttctttcactg

SEQ ID NO: 668141 - DNA, 25 bp, Mus musculus
gtactcaatggtttttctttcactg

SEQ ID NO: 668142 - DNA, 25 bp, Mus musculus
gtactcaattagacaatctccctgc

SEQ ID NO: 668143 - DNA, 25 bp, Mus musculus
gtactcaattagtcaatctccctgc

SEQ ID NO: 668144 - DNA, 25 bp, Mus musculus
gtactcacacataacacgcaaaggg

SEQ ID NO: 668145 - DNA, 25 bp, Mus musculus
gtactcacacattacacgcaaaggg

SEQ ID NO: 668146 - DNA, 25 bp, Mus musculus
gtactcacactcataagcaccgtat

SEQ ID NO: 668147 - DNA, 25 bp, Mus musculus
gtactcacactcttaagcaccgtat

SEQ ID NO: 668148 - DNA, 25 bp, Mus musculus
gtactcacatggagggtcaccacta

SEQ ID NO: 668149 - DNA, 25 bp, Mus musculus
gtactcacatggtgggtcaccacta

SEQ ID NO: 668150 - DNA, 25 bp, Mus musculus
gtactcacatgtacatactcccatg

SEQ ID NO: 668151 - DNA, 25 bp, Mus musculus
gtactcacatgttcatactcccatg

SEQ ID NO: 668152 - DNA, 25 bp, Mus musculus
gtactcaccagaaaggcagctctaa

SEQ ID NO: 668153 - DNA, 25 bp, Mus musculus
gtactcaccagataggcagctctaa

SEQ ID NO: 668154 - DNA, 25 bp, Mus musculus
gtactcaccatgagatattactcag

SEQ ID NO: 668155 - DNA, 25 bp, Mus musculus
gtactcaccatgtgatattactcag

SEQ ID NO: 668156 - DNA, 25 bp, Mus musculus
gtactcaccgacaggttgtggatca

SEQ ID NO: 668157 - DNA, 25 bp, Mus musculus
gtactcaccgactggttgtggatca

SEQ ID NO: 668158 - DNA, 25 bp, Mus musculus
gtactcacctgaaagacagcgctcg

SEQ ID NO: 668159 - DNA, 25 bp, Mus musculus
gtactcacctgatagacagcgctcg

SEQ ID NO: 668160 - DNA, 25 bp, Mus musculus
gtactcacctttcatcaatacaaag

SEQ ID NO: 668161 - DNA, 25 bp, Mus musculus
gtactcacctttgatcaatacaaag

SEQ ID NO: 668162 - DNA, 25 bp, Mus musculus
gtactcactaacaagattaacctta

SEQ ID NO: 668163 - DNA, 25 bp, Mus musculus
gtactcactaactagattaacctta

SEQ ID NO: 668164 - DNA, 25 bp, Mus musculus
gtactcactacaaactcttcaaagg

SEQ ID NO: 668165 - DNA, 25 bp, Mus musculus
gtactcactacatactcttcaaagg

SEQ ID NO: 668166 - DNA, 25 bp, Mus musculus
gtactcactatcctgtccataaagt

SEQ ID NO: 668167 - DNA, 25 bp, Mus musculus
gtactcactatcgtgtccataaagt

SEQ ID NO: 668168 - DNA, 25 bp, Mus musculus
gtactcactcctaaagcattcctta

SEQ ID NO: 668169 - DNA, 25 bp, Mus musculus
gtactcactccttaagcattcctta

SEQ ID NO: 668170 - DNA, 25 bp, Mus musculus
gtactcactgacaagctcagaccag

SEQ ID NO: 668171 - DNA, 25 bp, Mus musculus
gtactcactgactagctcagaccag

SEQ ID NO: 668172 - DNA, 25 bp, Mus musculus
gtactcacttcacttctaaaggatt

SEQ ID NO: 668173 - DNA, 25 bp, Mus musculus
gtactcacttcagttctaaaggatt

SEQ ID NO: 668174 - DNA, 25 bp, Mus musculus
gtactcagaattctttgccttcgct

SEQ ID NO: 668175 - DNA, 25 bp, Mus musculus
gtactcagaattgtttgccttcgct

SEQ ID NO: 668176 - DNA, 25 bp, Mus musculus
gtactcagcataccagagaagatga

SEQ ID NO: 668177 - DNA, 25 bp, Mus musculus
gtactcagcatagcagagaagatga

SEQ ID NO: 668178 - DNA, 25 bp, Mus musculus
gtactcagcattatgacatctcctt

SEQ ID NO: 668179 - DNA, 25 bp, Mus musculus
gtactcagcattttgacatctcctt

SEQ ID NO: 668180 - DNA, 25 bp, Mus musculus
gtactcagccatctgtgttttgtct

SEQ ID NO: 668181 - DNA, 25 bp, Mus musculus
gtactcagccatgtgtgttttgtct

SEQ ID NO: 668182 - DNA, 25 bp, Mus musculus
gtactcagcccacaagagaattttt

SEQ ID NO: 668183 - DNA, 25 bp, Mus musculus
gtactcagcccacctattagactgt

SEQ ID NO: 668184 - DNA, 25 bp, Mus musculus
gtactcagcccagaagagaattttt

SEQ ID NO: 668185 - DNA, 25 bp, Mus musculus
gtactcagcccagctattagactgt

SEQ ID NO: 668186 - DNA, 25 bp, Mus musculus
gtactcagccctcctagagcatgag

SEQ ID NO: 668187 - DNA, 25 bp, Mus musculus
gtactcagccctgctagagcatgag

SEQ ID NO: 668188 - DNA, 25 bp, Mus musculus
gtactcagccggcacccagaatgtc

SEQ ID NO: 668189 - DNA, 25 bp, Mus musculus
gtactcagccgggacccagaatgtc

SEQ ID NO: 668190 - DNA, 25 bp, Mus musculus
gtactcagcgatctaacaccaaagg

SEQ ID NO: 668191 - DNA, 25 bp, Mus musculus
gtactcagcgatgtaacaccaaagg

SEQ ID NO: 668192 - DNA, 25 bp, Mus musculus
gtactcaggacacaatccagagatt

SEQ ID NO: 668193 - DNA, 25 bp, Mus musculus
gtactcaggacagaatccagagatt

SEQ ID NO: 668194 - DNA, 25 bp, Mus musculus
gtactcaggacgaatgcatcctcca

SEQ ID NO: 668195 - DNA, 25 bp, Mus musculus
gtactcaggacgtatgcatcctcca

SEQ ID NO: 668196 - DNA, 25 bp, Mus musculus
gtactcagggaaagccggtaaccat

SEQ ID NO: 668197 - DNA, 25 bp, Mus musculus
gtactcagggaatgccggtaaccat

SEQ ID NO: 668198 - DNA, 25 bp, Mus musculus
gtactcagtaagctcttcctgtgac

SEQ ID NO: 668199 - DNA, 25 bp, Mus musculus
gtactcagtaaggtcttcctgtgac

SEQ ID NO: 668200 - DNA, 25 bp, Mus musculus
gtactcagtcacctgattgcagatt

SEQ ID NO: 668201 - DNA, 25 bp, Mus musculus
gtactcagtcacgtgattgcagatt

SEQ ID NO: 668202 - DNA, 25 bp, Mus musculus
gtactcagtgtgatggcacgcacaa

SEQ ID NO: 668203 - DNA, 25 bp, Mus musculus
gtactcagtgtgttggcacgcacaa

SEQ ID NO: 668204 - DNA, 25 bp, Mus musculus
gtactcagttcaaatacttcatttc

SEQ ID NO: 668205 - DNA, 25 bp, Mus musculus
gtactcagttcatatacttcatttc

SEQ ID NO: 668206 - DNA, 25 bp, Mus musculus
gtactcagttgtctagaacttccaa

SEQ ID NO: 668207 - DNA, 25 bp, Mus musculus
gtactcagttgtgtagaacttccaa

SEQ ID NO: 668208 - DNA, 25 bp, Mus musculus
gtactcataactatgggagataaaa

SEQ ID NO: 668209 - DNA, 25 bp, Mus musculus
gtactcataactttgggagataaaa

SEQ ID NO: 668210 - DNA, 25 bp, Mus musculus
gtactcatctagcttcgtgctcaga

SEQ ID NO: 668211 - DNA, 25 bp, Mus musculus
gtactcatctaggttcgtgctcaga

SEQ ID NO: 668212 - DNA, 25 bp, Mus musculus
gtactcatctccaacacagagctag

SEQ ID NO: 668213 - DNA, 25 bp, Mus musculus
gtactcatctcctacacagagctag

SEQ ID NO: 668214 - DNA, 25 bp, Mus musculus
gtactcatttatcgtactggcatct

SEQ ID NO: 668215 - DNA, 25 bp, Mus musculus
gtactcatttatggtactggcatct

SEQ ID NO: 668216 - DNA, 25 bp, Mus musculus
gtactccaaatgatgctgtggcagc

SEQ ID NO: 668217 - DNA, 25 bp, Mus musculus
gtactccaaatgttgctgtggcagc

SEQ ID NO: 668218 - DNA, 25 bp, Mus musculus
gtactccacaaacttagctgcatct

SEQ ID NO: 668219 - DNA, 25 bp, Mus musculus
gtactccacaaagttagctgcatct

SEQ ID NO: 668220 - DNA, 25 bp, Mus musculus
gtactccacgatccattttaaagat

SEQ ID NO: 668221 - DNA, 25 bp, Mus musculus
gtactccacgatgcattttaaagat

SEQ ID NO: 668222 - DNA, 25 bp, Mus musculus
gtactccagaaaaatcaagccccat

SEQ ID NO: 668223 - DNA, 25 bp, Mus musculus
gtactccagaaatatcaagccccat

SEQ ID NO: 668224 - DNA, 25 bp, Mus musculus
gtactccagctgagagacttaagag

SEQ ID NO: 668225 - DNA, 25 bp, Mus musculus
gtactccagctgtgagacttaagag

SEQ ID NO: 668226 - DNA, 25 bp, Mus musculus
gtactccaggccatgaacacgtgca

SEQ ID NO: 668227 - DNA, 25 bp, Mus musculus
gtactccaggccttgaacacgtgca

SEQ ID NO: 668228 - DNA, 25 bp, Mus musculus
gtactccatacaagtttggtgatag

SEQ ID NO: 668229 - DNA, 25 bp, Mus musculus
gtactccatacatgtttggtgatag

SEQ ID NO: 668230 - DNA, 25 bp, Mus musculus
gtactccatcatctttaaattcaat

SEQ ID NO: 668231 - DNA, 25 bp, Mus musculus
gtactccatcatgtttaaattcaat

SEQ ID NO: 668232 - DNA, 25 bp, Mus musculus
gtactccatggcatgaagtctgtct

SEQ ID NO: 668233 - DNA, 25 bp, Mus musculus
gtactccatggcttgaagtctgtct

SEQ ID NO: 668234 - DNA, 25 bp, Mus musculus
gtactcccagacaggagcctagtat

SEQ ID NO: 668235 - DNA, 25 bp, Mus musculus
gtactcccagactggagcctagtat

SEQ ID NO: 668236 - DNA, 25 bp, Mus musculus
gtactcccagggatccagtctagtg

SEQ ID NO: 668237 - DNA, 25 bp, Mus musculus
gtactcccagggttccagtctagtg

SEQ ID NO: 668238 - DNA, 25 bp, Mus musculus
gtactcccagtcactttgaggaaga

SEQ ID NO: 668239 - DNA, 25 bp, Mus musculus
gtactcccagtctctttgaggaaga

SEQ ID NO: 668240 - DNA, 25 bp, Mus musculus
gtactccccgtcatccagctagaag

SEQ ID NO: 668241 - DNA, 25 bp, Mus musculus
gtactccccgtcttccagctagaag

SEQ ID NO: 668242 - DNA, 25 bp, Mus musculus
gtactccctgaaccacagtccaaga

SEQ ID NO: 668243 - DNA, 25 bp, Mus musculus
gtactccctgaagcacagtccaaga

SEQ ID NO: 668244 - DNA, 25 bp, Mus musculus
gtactcccttttcataagtttgtca

SEQ ID NO: 668245 - DNA, 25 bp, Mus musculus
gtactcccttttgataagtttgtca

SEQ ID NO: 668246 - DNA, 25 bp, Mus musculus
gtactccgtgtaactataggtctga

SEQ ID NO: 668247 - DNA, 25 bp, Mus musculus
gtactccgtgtatctataggtctga

SEQ ID NO: 668248 - DNA, 25 bp, Mus musculus
gtactcctaagtctttgtaaactag

SEQ ID NO: 668249 - DNA, 25 bp, Mus musculus
gtactcctaagtgtttgtaaactag

SEQ ID NO: 668250 - DNA, 25 bp, Mus musculus
gtactcctattgcatgtctccaaat

SEQ ID NO: 668251 - DNA, 25 bp, Mus musculus
gtactcctattggatgtctccaaat

SEQ ID NO: 668252 - DNA, 25 bp, Mus musculus
gtactcctcaggctgccaaggcaat

SEQ ID NO: 668253 - DNA, 25 bp, Mus musculus
gtactcctcagggtgccaaggcaat

SEQ ID NO: 668254 - DNA, 25 bp, Mus musculus
gtactcctcgcaactcgaaagttat

SEQ ID NO: 668255 - DNA, 25 bp, Mus musculus
gtactcctcgcatctcgaaagttat

SEQ ID NO: 668256 - DNA, 25 bp, Mus musculus
gtactcctctacattccaaagacat

SEQ ID NO: 668257 - DNA, 25 bp, Mus musculus
gtactcctctactttccaaagacat

SEQ ID NO: 668258 - DNA, 25 bp, Mus musculus
gtactcctgcctaccaagagcggga

SEQ ID NO: 668259 - DNA, 25 bp, Mus musculus
gtactcctgccttccaagagcggga

SEQ ID NO: 668260 - DNA, 25 bp, Mus musculus
gtactcctggaactcaagccttgtc

SEQ ID NO: 668261 - DNA, 25 bp, Mus musculus
gtactcctggaagtcaagccttgtc

SEQ ID NO: 668262 - DNA, 25 bp, Mus musculus
gtactcctgggacgctttcgatggc

SEQ ID NO: 668263 - DNA, 25 bp, Mus musculus
gtactcctgggaggctttcgatggc

SEQ ID NO: 668264 - DNA, 25 bp, Mus musculus
gtactcctgtccctgctattattat

SEQ ID NO: 668265 - DNA, 25 bp, Mus musculus
gtactcctgtccgtgctattattat

SEQ ID NO: 668266 - DNA, 25 bp, Mus musculus
gtactccttctgatgtggtgtgtca

SEQ ID NO: 668267 - DNA, 25 bp, Mus musculus
gtactccttctgttgtggtgtgtca

SEQ ID NO: 668268 - DNA, 25 bp, Mus musculus
gtactccttgctcgattgaacttca

SEQ ID NO: 668269 - DNA, 25 bp, Mus musculus
gtactccttgctggattgaacttca

SEQ ID NO: 668270 - DNA, 25 bp, Mus musculus
gtactcgcaaaacaaggatcattga

SEQ ID NO: 668271 - DNA, 25 bp, Mus musculus
gtactcgcaaaagaaggatcattga

SEQ ID NO: 668272 - DNA, 25 bp, Mus musculus
gtactcgcactaagatttttactca

SEQ ID NO: 668273 - DNA, 25 bp, Mus musculus
gtactcgcactatgatttttactca

SEQ ID NO: 668274 - DNA, 25 bp, Mus musculus
gtactcggagtcattcatttccaca

SEQ ID NO: 668275 - DNA, 25 bp, Mus musculus
gtactcggagtctttcatttccaca

SEQ ID NO: 668276 - DNA, 25 bp, Mus musculus
gtactcggatacactgaactctgat

SEQ ID NO: 668277 - DNA, 25 bp, Mus musculus
gtactcggatactctgaactctgat

SEQ ID NO: 668278 - DNA, 25 bp, Mus musculus
gtactcggatgcaggtgaacacttg

SEQ ID NO: 668279 - DNA, 25 bp, Mus musculus
gtactcggatgctggtgaacacttg

SEQ ID NO: 668280 - DNA, 25 bp, Mus musculus
gtactcgggtgtatgcagcgatctc

SEQ ID NO: 668281 - DNA, 25 bp, Mus musculus
gtactcgggtgtttgcagcgatctc

SEQ ID NO: 668282 - DNA, 25 bp, Mus musculus
gtactcggtaagcaaacatttcctt

SEQ ID NO: 668283 - DNA, 25 bp, Mus musculus
gtactcggtaaggaaacatttcctt

SEQ ID NO: 668284 - DNA, 25 bp, Mus musculus
gtactcggttatagtaggagctgaa

SEQ ID NO: 668285 - DNA, 25 bp, Mus musculus
gtactcggttattgtaggagctgaa

SEQ ID NO: 668286 - DNA, 25 bp, Mus musculus
gtactcgtacagatggcttcatgct

SEQ ID NO: 668287 - DNA, 25 bp, Mus musculus
gtactcgtacagttggcttcatgct

SEQ ID NO: 668288 - DNA, 25 bp, Mus musculus
gtactcgtgactacattgtgactgt

SEQ ID NO: 668289 - DNA, 25 bp, Mus musculus
gtactcgtgacttcattgtgactgt

SEQ ID NO: 668290 - DNA, 25 bp, Mus musculus
gtactcgtggctcccgattctgtta

SEQ ID NO: 668291 - DNA, 25 bp, Mus musculus
gtactcgtggctgccgattctgtta

SEQ ID NO: 668292 - DNA, 25 bp, Mus musculus
gtactcgtttgacaggctgggcaat

SEQ ID NO: 668293 - DNA, 25 bp, Mus musculus
gtactcgtttgagaggctgggcaat

SEQ ID NO: 668294 - DNA, 25 bp, Mus musculus
gtactctaaaatagcttccctgacg

SEQ ID NO: 668295 - DNA, 25 bp, Mus musculus
gtactctaaaattgcttccctgacg

SEQ ID NO: 668296 - DNA, 25 bp, Mus musculus
gtactctaagtgctgcaagcatttg

SEQ ID NO: 668297 - DNA, 25 bp, Mus musculus
gtactctaagtggtgcaagcatttg

SEQ ID NO: 668298 - DNA, 25 bp, Mus musculus
gtactctacacaaatgctgcaagcg

SEQ ID NO: 668299 - DNA, 25 bp, Mus musculus
gtactctacacatatgctgcaagcg

SEQ ID NO: 668300 - DNA, 25 bp, Mus musculus
gtactctacgaaatcataaaagaac

SEQ ID NO: 668301 - DNA, 25 bp, Mus musculus
gtactctacgaattcataaaagaac

SEQ ID NO: 668302 - DNA, 25 bp, Mus musculus
gtactctactcgagcttaaacacat

SEQ ID NO: 668303 - DNA, 25 bp, Mus musculus
gtactctactcgtgcttaaacacat

SEQ ID NO: 668304 - DNA, 25 bp, Mus musculus
gtactctagagtatgacggtctgta

SEQ ID NO: 668305 - DNA, 25 bp, Mus musculus
gtactctagagtcatcgccctgtgt

SEQ ID NO: 668306 - DNA, 25 bp, Mus musculus
gtactctagagtgatcgccctgtgt

SEQ ID NO: 668307 - DNA, 25 bp, Mus musculus
gtactctagagtttgacggtctgta

SEQ ID NO: 668308 - DNA, 25 bp, Mus musculus
gtactctaggataccaacactcatt

SEQ ID NO: 668309 - DNA, 25 bp, Mus musculus
gtactctaggattccaacactcatt

SEQ ID NO: 668310 - DNA, 25 bp, Mus musculus
gtactctagttccagatacaacctt

SEQ ID NO: 668311 - DNA, 25 bp, Mus musculus
gtactctagttcgagatacaacctt

SEQ ID NO: 668312 - DNA, 25 bp, Mus musculus
gtactctagtttacgggcggtgaga

SEQ ID NO: 668313 - DNA, 25 bp, Mus musculus
gtactctagttttcgggcggtgaga

SEQ ID NO: 668314 - DNA, 25 bp, Mus musculus
gtactctatagcaagaagtcaataa

SEQ ID NO: 668315 - DNA, 25 bp, Mus musculus
gtactctatagctagaagtcaataa

SEQ ID NO: 668316 - DNA, 25 bp, Mus musculus
gtactctatatgacttacctgtatt

SEQ ID NO: 668317 - DNA, 25 bp, Mus musculus
gtactctatatgtcttacctgtatt

SEQ ID NO: 668318 - DNA, 25 bp, Mus musculus
gtactctatctgaaagaacttcttt

SEQ ID NO: 668319 - DNA, 25 bp, Mus musculus
gtactctatctgtaagaacttcttt

SEQ ID NO: 668320 - DNA, 25 bp, Mus musculus
gtactctcaacgaagtcacagacag

SEQ ID NO: 668321 - DNA, 25 bp, Mus musculus
gtactctcaacgtagtcacagacag

SEQ ID NO: 668322 - DNA, 25 bp, Mus musculus
gtactctcaggaactattccaactt

SEQ ID NO: 668323 - DNA, 25 bp, Mus musculus
gtactctcaggatctattccaactt

SEQ ID NO: 668324 - DNA, 25 bp, Mus musculus
gtactctcatggctcctgtgcgcag

SEQ ID NO: 668325 - DNA, 25 bp, Mus musculus
gtactctcatgggtcctgtgcgcag

SEQ ID NO: 668326 - DNA, 25 bp, Mus musculus
gtactctcatttcatttgaaggtct

SEQ ID NO: 668327 - DNA, 25 bp, Mus musculus
gtactctcatttctaccagcacttt

SEQ ID NO: 668328 - DNA, 25 bp, Mus musculus
gtactctcatttgatttgaaggtct

SEQ ID NO: 668329 - DNA, 25 bp, Mus musculus
gtactctcatttgtaccagcacttt

SEQ ID NO: 668330 - DNA, 25 bp, Mus musculus
gtactctcccaaaccctacttaaat

SEQ ID NO: 668331 - DNA, 25 bp, Mus musculus
gtactctcccaatccctacttaaat

SEQ ID NO: 668332 - DNA, 25 bp, Mus musculus
gtactctcctatctatcttgacaga

SEQ ID NO: 668333 - DNA, 25 bp, Mus musculus
gtactctcctatgtatcttgacaga

SEQ ID NO: 668334 - DNA, 25 bp, Mus musculus
gtactctcctgcagatagttcactt

SEQ ID NO: 668335 - DNA, 25 bp, Mus musculus
gtactctcctgctgatagttcactt

SEQ ID NO: 668336 - DNA, 25 bp, Mus musculus
gtactctcctggaaggttacacttg

SEQ ID NO: 668337 - DNA, 25 bp, Mus musculus
gtactctcctggtaggttacacttg

SEQ ID NO: 668338 - DNA, 25 bp, Mus musculus
gtactctctattaagtccaggctag

SEQ ID NO: 668339 - DNA, 25 bp, Mus musculus
gtactctctatttagtccaggctag

SEQ ID NO: 668340 - DNA, 25 bp, Mus musculus
gtactctctcatatctagaatcttt

SEQ ID NO: 668341 - DNA, 25 bp, Mus musculus
gtactctctcatttctagaatcttt

SEQ ID NO: 668342 - DNA, 25 bp, Mus musculus
gtactctctctaacactcaagtgga

SEQ ID NO: 668343 - DNA, 25 bp, Mus musculus
gtactctctctatcactcaagtgga

SEQ ID NO: 668344 - DNA, 25 bp, Mus musculus
gtactctctgccctagatcaatggt

SEQ ID NO: 668345 - DNA, 25 bp, Mus musculus
gtactctctgccgtagatcaatggt

SEQ ID NO: 668346 - DNA, 25 bp, Mus musculus
gtactctgactgagctcatttttta

SEQ ID NO: 668347 - DNA, 25 bp, Mus musculus
gtactctgactgtgctcatttttta

SEQ ID NO: 668348 - DNA, 25 bp, Mus musculus
gtactctgatacactgaactctgat

SEQ ID NO: 668349 - DNA, 25 bp, Mus musculus
gtactctgatactctgaactctgat

SEQ ID NO: 668350 - DNA, 25 bp, Mus musculus
gtactctggaaacggcacatcacaa

SEQ ID NO: 668351 - DNA, 25 bp, Mus musculus
gtactctggaaagggcacatcacaa

SEQ ID NO: 668352 - DNA, 25 bp, Mus musculus
gtactctggaagacaaaagatcact

SEQ ID NO: 668353 - DNA, 25 bp, Mus musculus
gtactctggaagtcaaaagatcact

SEQ ID NO: 668354 - DNA, 25 bp, Mus musculus
gtactctggaggcaggtgaacctct

SEQ ID NO: 668355 - DNA, 25 bp, Mus musculus
gtactctggagggaggtgaacctct

SEQ ID NO: 668356 - DNA, 25 bp, Mus musculus
gtactctgggaaattgccactggaa

SEQ ID NO: 668357 - DNA, 25 bp, Mus musculus
gtactctgggaatttgccactggaa

SEQ ID NO: 668358 - DNA, 25 bp, Mus musculus
gtactctggtctcaatatctctcct

SEQ ID NO: 668359 - DNA, 25 bp, Mus musculus
gtactctggtctgaatatctctcct

SEQ ID NO: 668360 - DNA, 25 bp, Mus musculus
gtactctgtccaaattcacttatca

SEQ ID NO: 668361 - DNA, 25 bp, Mus musculus
gtactctgtccatattcacttatca

SEQ ID NO: 668362 - DNA, 25 bp, Mus musculus
gtactctgtgagcttaatatcccca

SEQ ID NO: 668363 - DNA, 25 bp, Mus musculus
gtactctgtgaggttaatatcccca

SEQ ID NO: 668364 - DNA, 25 bp, Mus musculus
gtactctgtgatatttctgttacat

SEQ ID NO: 668365 - DNA, 25 bp, Mus musculus
gtactctgtgatttttctgttacat

SEQ ID NO: 668366 - DNA, 25 bp, Mus musculus
gtactctgtgcaatggatggacctg

SEQ ID NO: 668367 - DNA, 25 bp, Mus musculus
gtactctgtgcattggatggacctg

SEQ ID NO: 668368 - DNA, 25 bp, Mus musculus
gtactctgtgtacgatatcaccatt

SEQ ID NO: 668369 - DNA, 25 bp, Mus musculus
gtactctgtgtaggatatcaccatt

SEQ ID NO: 668370 - DNA, 25 bp, Mus musculus
gtactctgtgtgacataggatatct

SEQ ID NO: 668371 - DNA, 25 bp, Mus musculus
gtactctgtgtgcatcggtggctcc

SEQ ID NO: 668372 - DNA, 25 bp, Mus musculus
gtactctgtgtggatcggtggctcc

SEQ ID NO: 668373 - DNA, 25 bp, Mus musculus
gtactctgtgtgtcataggatatct

SEQ ID NO: 668374 - DNA, 25 bp, Mus musculus
gtactctgtgttagttctagcaata

SEQ ID NO: 668375 - DNA, 25 bp, Mus musculus
gtactctgtgttcgcattatacgta

SEQ ID NO: 668376 - DNA, 25 bp, Mus musculus
gtactctgtgttggcattatacgta

SEQ ID NO: 668377 - DNA, 25 bp, Mus musculus
gtactctgtgtttgttctagcaata

SEQ ID NO: 668378 - DNA, 25 bp, Mus musculus
gtactctgttccaggtgacttgtaa

SEQ ID NO: 668379 - DNA, 25 bp, Mus musculus
gtactctgttcctggtgacttgtaa

SEQ ID NO: 668380 - DNA, 25 bp, Mus musculus
gtactcttaaatactgctgacagct

SEQ ID NO: 668381 - DNA, 25 bp, Mus musculus
gtactcttaaattctgctgacagct

SEQ ID NO: 668382 - DNA, 25 bp, Mus musculus
gtactcttaagaatctgtgccaggc

SEQ ID NO: 668383 - DNA, 25 bp, Mus musculus
gtactcttaagattctgtgccaggc

SEQ ID NO: 668384 - DNA, 25 bp, Mus musculus
gtactcttattcacttgcctaatag

SEQ ID NO: 668385 - DNA, 25 bp, Mus musculus
gtactcttattctcttgcctaatag

SEQ ID NO: 668386 - DNA, 25 bp, Mus musculus
gtactcttcaagagcacaaaagaat

SEQ ID NO: 668387 - DNA, 25 bp, Mus musculus
gtactcttcaagtgcacaaaagaat

SEQ ID NO: 668388 - DNA, 25 bp, Mus musculus
gtactcttccacagtgtttgcagca

SEQ ID NO: 668389 - DNA, 25 bp, Mus musculus
gtactcttccactgtgtttgcagca

SEQ ID NO: 668390 - DNA, 25 bp, Mus musculus
gtactcttcctaccgtgctcatgtt

SEQ ID NO: 668391 - DNA, 25 bp, Mus musculus
gtactcttcctagcgtgctcatgtt

SEQ ID NO: 668392 - DNA, 25 bp, Mus musculus
gtactcttcctgagattgttcttta

SEQ ID NO: 668393 - DNA, 25 bp, Mus musculus
gtactcttcctgtgattgttcttta

SEQ ID NO: 668394 - DNA, 25 bp, Mus musculus
gtactcttctgaaactgaacttgca

SEQ ID NO: 668395 - DNA, 25 bp, Mus musculus
gtactcttctgatactgaacttgca

SEQ ID NO: 668396 - DNA, 25 bp, Mus musculus
gtactcttgctccaacataaacagg

SEQ ID NO: 668397 - DNA, 25 bp, Mus musculus
gtactcttgctcgaacataaacagg

SEQ ID NO: 668398 - DNA, 25 bp, Mus musculus
gtactcttggttacatcatagtcag

SEQ ID NO: 668399 - DNA, 25 bp, Mus musculus
gtactcttggtttcatcatagtcag

SEQ ID NO: 668400 - DNA, 25 bp, Mus musculus
gtactcttgtccaggcattttagaa

SEQ ID NO: 668401 - DNA, 25 bp, Mus musculus
gtactcttgtcctggcattttagaa

SEQ ID NO: 668402 - DNA, 25 bp, Mus musculus
gtactgaaaagtctctgatgctcct

SEQ ID NO: 668403 - DNA, 25 bp, Mus musculus
gtactgaaaagtgtctgatgctcct

SEQ ID NO: 668404 - DNA, 25 bp, Mus musculus
gtactgaaattcctcttgagtgctc

SEQ ID NO: 668405 - DNA, 25 bp, Mus musculus
gtactgaaattcgtcttgagtgctc

SEQ ID NO: 668406 - DNA, 25 bp, Mus musculus
gtactgaagccaactgtaacatttg

SEQ ID NO: 668407 - DNA, 25 bp, Mus musculus
gtactgaagccatctgtaacatttg

SEQ ID NO: 668408 - DNA, 25 bp, Mus musculus
gtactgaagctacaacccaagggaa

SEQ ID NO: 668409 - DNA, 25 bp, Mus musculus
gtactgaagctagaacccaagggaa

SEQ ID NO: 668410 - DNA, 25 bp, Mus musculus
gtactgaagttcaatccactgaaga

SEQ ID NO: 668411 - DNA, 25 bp, Mus musculus
gtactgaagttctatccactgaaga

SEQ ID NO: 668412 - DNA, 25 bp, Mus musculus
gtactgaatctaaaggctgaaccgg

SEQ ID NO: 668413 - DNA, 25 bp, Mus musculus
gtactgaatctataggctgaaccgg

SEQ ID NO: 668414 - DNA, 25 bp, Mus musculus
gtactgaatgcgctgtttattaaca

SEQ ID NO: 668415 - DNA, 25 bp, Mus musculus
gtactgaatgcggtgtttattaaca

SEQ ID NO: 668416 - DNA, 25 bp, Mus musculus
gtactgacagataaatggctcgcct

SEQ ID NO: 668417 - DNA, 25 bp, Mus musculus
gtactgacagattaatggctcgcct

SEQ ID NO: 668418 - DNA, 25 bp, Mus musculus
gtactgacataaagtttaagcacat

SEQ ID NO: 668419 - DNA, 25 bp, Mus musculus
gtactgacataatgtttaagcacat

SEQ ID NO: 668420 - DNA, 25 bp, Mus musculus
gtactgacattacttacaacctagt

SEQ ID NO: 668421 - DNA, 25 bp, Mus musculus
gtactgacattagttacaacctagt

SEQ ID NO: 668422 - DNA, 25 bp, Mus musculus
gtactgacctgccacagatgcatta

SEQ ID NO: 668423 - DNA, 25 bp, Mus musculus
gtactgacctgcgacagatgcatta

SEQ ID NO: 668424 - DNA, 25 bp, Mus musculus
gtactgaccttcacattgaaaccac

SEQ ID NO: 668425 - DNA, 25 bp, Mus musculus
gtactgaccttctcattgaaaccac

SEQ ID NO: 668426 - DNA, 25 bp, Mus musculus
gtactgactctaatgcaccataatt

SEQ ID NO: 668427 - DNA, 25 bp, Mus musculus
gtactgactctattgcaccataatt

SEQ ID NO: 668428 - DNA, 25 bp, Mus musculus
gtactgactgctcccaatctgtgaa

SEQ ID NO: 668429 - DNA, 25 bp, Mus musculus
gtactgactgctgccaatctgtgaa

SEQ ID NO: 668430 - DNA, 25 bp, Mus musculus
gtactgagccctcaacatgcctgaa

SEQ ID NO: 668431 - DNA, 25 bp, Mus musculus
gtactgagccctgaacatgcctgaa

SEQ ID NO: 668432 - DNA, 25 bp, Mus musculus
gtactgagcggcagctaaaagtgtt

SEQ ID NO: 668433 - DNA, 25 bp, Mus musculus
gtactgagcggctgctaaaagtgtt

SEQ ID NO: 668434 - DNA, 25 bp, Mus musculus
gtactgagctttatgcacgtggatt

SEQ ID NO: 668435 - DNA, 25 bp, Mus musculus
gtactgagctttttgcacgtggatt

SEQ ID NO: 668436 - DNA, 25 bp, Mus musculus
gtactgaggaataacagcagaaaac

SEQ ID NO: 668437 - DNA, 25 bp, Mus musculus
gtactgaggaattacagcagaaaac

SEQ ID NO: 668438 - DNA, 25 bp, Mus musculus
gtactgaggcctctcactttggtca

SEQ ID NO: 668439 - DNA, 25 bp, Mus musculus
gtactgaggcctgtcactttggtca

SEQ ID NO: 668440 - DNA, 25 bp, Mus musculus
gtactgagggttcagcctctggaaa

SEQ ID NO: 668441 - DNA, 25 bp, Mus musculus
gtactgagggttgagcctctggaaa

SEQ ID NO: 668442 - DNA, 25 bp, Mus musculus
gtactgaggtgcctgccctgttcct

SEQ ID NO: 668443 - DNA, 25 bp, Mus musculus
gtactgaggtgcgtgccctgttcct

SEQ ID NO: 668444 - DNA, 25 bp, Mus musculus
gtactgagtacacagatatgactag

SEQ ID NO: 668445 - DNA, 25 bp, Mus musculus
gtactgagtacagagatatgactag

SEQ ID NO: 668446 - DNA, 25 bp, Mus musculus
gtactgagtactaactgcggtgcta

SEQ ID NO: 668447 - DNA, 25 bp, Mus musculus
gtactgagtacttactgcggtgcta

SEQ ID NO: 668448 - DNA, 25 bp, Mus musculus
gtactgagtcacattttagctttta

SEQ ID NO: 668449 - DNA, 25 bp, Mus musculus
gtactgagtcactttttagctttta

SEQ ID NO: 668450 - DNA, 25 bp, Mus musculus
gtactgagtttgataacgctccatg

SEQ ID NO: 668451 - DNA, 25 bp, Mus musculus
gtactgagtttgttaacgctccatg

SEQ ID NO: 668452 - DNA, 25 bp, Mus musculus
gtactgatctatccaagaccaattg

SEQ ID NO: 668453 - DNA, 25 bp, Mus musculus
gtactgatctatgcaagaccaattg

SEQ ID NO: 668454 - DNA, 25 bp, Mus musculus
gtactgatgatcatgcagctgaggc

SEQ ID NO: 668455 - DNA, 25 bp, Mus musculus
gtactgatgatcttgcagctgaggc

SEQ ID NO: 668456 - DNA, 25 bp, Mus musculus
gtactgatgggaatggctttcacac

SEQ ID NO: 668457 - DNA, 25 bp, Mus musculus
gtactgatgggattggctttcacac

SEQ ID NO: 668458 - DNA, 25 bp, Mus musculus
gtactgatgttcaatgtggcactga

SEQ ID NO: 668459 - DNA, 25 bp, Mus musculus
gtactgatgttctatgtggcactga

SEQ ID NO: 668460 - DNA, 25 bp, Mus musculus
gtactgatgtttcgcctgtaagcaa

SEQ ID NO: 668461 - DNA, 25 bp, Mus musculus
gtactgatgtttggcctgtaagcaa

SEQ ID NO: 668462 - DNA, 25 bp, Mus musculus
gtactgattcatctttcactagcag

SEQ ID NO: 668463 - DNA, 25 bp, Mus musculus
gtactgattcatgtttcactagcag

SEQ ID NO: 668464 - DNA, 25 bp, Mus musculus
gtactgattgcccatcttgagtgag

SEQ ID NO: 668465 - DNA, 25 bp, Mus musculus
gtactgattgccgatcttgagtgag

SEQ ID NO: 668466 - DNA, 25 bp, Mus musculus
gtactgcaaaagattctcccaagga

SEQ ID NO: 668467 - DNA, 25 bp, Mus musculus
gtactgcaaaagtttctcccaagga

SEQ ID NO: 668468 - DNA, 25 bp, Mus musculus
gtactgcaaacaacttctgggtctg

SEQ ID NO: 668469 - DNA, 25 bp, Mus musculus
gtactgcaaacatcttctgggtctg

SEQ ID NO: 668470 - DNA, 25 bp, Mus musculus
gtactgcaattaatgtaaccccaaa

SEQ ID NO: 668471 - DNA, 25 bp, Mus musculus
gtactgcaattattgtaaccccaaa

SEQ ID NO: 668472 - DNA, 25 bp, Mus musculus
gtactgcactgcacgtgatgagatc

SEQ ID NO: 668473 - DNA, 25 bp, Mus musculus
gtactgcactgctcgtgatgagatc

SEQ ID NO: 668474 - DNA, 25 bp, Mus musculus
gtactgcagccaaagttgttcactt

SEQ ID NO: 668475 - DNA, 25 bp, Mus musculus
gtactgcagccatagttgttcactt

SEQ ID NO: 668476 - DNA, 25 bp, Mus musculus
gtactgcaggtaccagccgtgttca

SEQ ID NO: 668477 - DNA, 25 bp, Mus musculus
gtactgcaggtagcagccgtgttca

SEQ ID NO: 668478 - DNA, 25 bp, Mus musculus
gtactgcatatcatttactgtatta

SEQ ID NO: 668479 - DNA, 25 bp, Mus musculus
gtactgcatatcttttactgtatta

SEQ ID NO: 668480 - DNA, 25 bp, Mus musculus
gtactgcatcaactggttacgtccc

SEQ ID NO: 668481 - DNA, 25 bp, Mus musculus
gtactgcatcaagtggttacgtccc

SEQ ID NO: 668482 - DNA, 25 bp, Mus musculus
gtactgcatttgattgtcactagct

SEQ ID NO: 668483 - DNA, 25 bp, Mus musculus
gtactgcatttgtttgtcactagct

SEQ ID NO: 668484 - DNA, 25 bp, Mus musculus
gtactgccaatgctcggatgcctga

SEQ ID NO: 668485 - DNA, 25 bp, Mus musculus
gtactgccaatggtcggatgcctga

SEQ ID NO: 668486 - DNA, 25 bp, Mus musculus
gtactgccacacacttctgaagttg

SEQ ID NO: 668487 - DNA, 25 bp, Mus musculus
gtactgccacactcttctgaagttg

SEQ ID NO: 668488 - DNA, 25 bp, Mus musculus
gtactgccatagcaccagaggtcag

SEQ ID NO: 668489 - DNA, 25 bp, Mus musculus
gtactgccataggaccagaggtcag

SEQ ID NO: 668490 - DNA, 25 bp, Mus musculus
gtactgccattcctaatgtattttt

SEQ ID NO: 668491 - DNA, 25 bp, Mus musculus
gtactgccattcgtaatgtattttt

SEQ ID NO: 668492 - DNA, 25 bp, Mus musculus
gtactgcccacacagttgttactga

SEQ ID NO: 668493 - DNA, 25 bp, Mus musculus
gtactgcccacagagttgttactga

SEQ ID NO: 668494 - DNA, 25 bp, Mus musculus
gtactgcccagcatacttacaaagt

SEQ ID NO: 668495 - DNA, 25 bp, Mus musculus
gtactgcccagcttacttacaaagt

SEQ ID NO: 668496 - DNA, 25 bp, Mus musculus
gtactgccgagtctcatctggtaaa

SEQ ID NO: 668497 - DNA, 25 bp, Mus musculus
gtactgccgagtgtcatctggtaaa

SEQ ID NO: 668498 - DNA, 25 bp, Mus musculus
gtactgcctagaaatagttatctga

SEQ ID NO: 668499 - DNA, 25 bp, Mus musculus
gtactgcctagatatagttatctga

SEQ ID NO: 668500 - DNA, 25 bp, Mus musculus
gtactgcgagtgaccaaggcttctg

SEQ ID NO: 668501 - DNA, 25 bp, Mus musculus
gtactgcgagtgtccaaggcttctg

SEQ ID NO: 668502 - DNA, 25 bp, Mus musculus
gtactgctacatccccgatgatgga

SEQ ID NO: 668503 - DNA, 25 bp, Mus musculus
gtactgctacatgcccgatgatgga

SEQ ID NO: 668504 - DNA, 25 bp, Mus musculus
gtactgctattaaccagtcatctta

SEQ ID NO: 668505 - DNA, 25 bp, Mus musculus
gtactgctattatccagtcatctta

SEQ ID NO: 668506 - DNA, 25 bp, Mus musculus
gtactgctccaactaatagtgccca

SEQ ID NO: 668507 - DNA, 25 bp, Mus musculus
gtactgctccaagtaatagtgccca

SEQ ID NO: 668508 - DNA, 25 bp, Mus musculus
gtactgctcttccttaagaccttaa

SEQ ID NO: 668509 - DNA, 25 bp, Mus musculus
gtactgctcttcgttaagaccttaa

SEQ ID NO: 668510 - DNA, 25 bp, Mus musculus
gtactgctcttgaattctgttctgt

SEQ ID NO: 668511 - DNA, 25 bp, Mus musculus
gtactgctcttgtattctgttctgt

SEQ ID NO: 668512 - DNA, 25 bp, Mus musculus
gtactgctgaacacagtgcttccat

SEQ ID NO: 668513 - DNA, 25 bp, Mus musculus
gtactgctgaactcagtgcttccat

SEQ ID NO: 668514 - DNA, 25 bp, Mus musculus
gtactgctgcgtaatctacatgtga

SEQ ID NO: 668515 - DNA, 25 bp, Mus musculus
gtactgctgcgttatctacatgtga

SEQ ID NO: 668516 - DNA, 25 bp, Mus musculus
gtactgctgggcaagtgtgctgaaa

SEQ ID NO: 668517 - DNA, 25 bp, Mus musculus
gtactgctgggctagtgtgctgaaa

SEQ ID NO: 668518 - DNA, 25 bp, Mus musculus
gtactgctggtgatcattgtgctcc

SEQ ID NO: 668519 - DNA, 25 bp, Mus musculus
gtactgctggtgttcattgtgctcc

SEQ ID NO: 668520 - DNA, 25 bp, Mus musculus
gtactgctgtcaaattcctcacaac

SEQ ID NO: 668521 - DNA, 25 bp, Mus musculus
gtactgctgtcatattcctcacaac

SEQ ID NO: 668522 - DNA, 25 bp, Mus musculus
gtactgcttataaatctagactcgt

SEQ ID NO: 668523 - DNA, 25 bp, Mus musculus
gtactgcttatatatctagactcgt

SEQ ID NO: 668524 - DNA, 25 bp, Mus musculus
gtactgcttcatagactgttaagtt

SEQ ID NO: 668525 - DNA, 25 bp, Mus musculus
gtactgcttcattgactgttaagtt

SEQ ID NO: 668526 - DNA, 25 bp, Mus musculus
gtactgcttctcagagatggcccca

SEQ ID NO: 668527 - DNA, 25 bp, Mus musculus
gtactgcttctctgagatggcccca

SEQ ID NO: 668528 - DNA, 25 bp, Mus musculus
gtactgcttgggatgtatctccaac

SEQ ID NO: 668529 - DNA, 25 bp, Mus musculus
gtactgcttgggttgtatctccaac

SEQ ID NO: 668530 - DNA, 25 bp, Mus musculus
gtactggaaacgcaatgccattctc

SEQ ID NO: 668531 - DNA, 25 bp, Mus musculus
gtactggaaacggaatgccattctc

SEQ ID NO: 668532 - DNA, 25 bp, Mus musculus
gtactggaactacagcactgcggat

SEQ ID NO: 668533 - DNA, 25 bp, Mus musculus
gtactggaactagagcactgcggat

SEQ ID NO: 668534 - DNA, 25 bp, Mus musculus
gtactggaaggcactctgcatgcca

SEQ ID NO: 668535 - DNA, 25 bp, Mus musculus
gtactggaaggctctctgcatgcca

SEQ ID NO: 668536 - DNA, 25 bp, Mus musculus
gtactggacaaaactgaccgtggtt

SEQ ID NO: 668537 - DNA, 25 bp, Mus musculus
gtactggacaaatctgaccgtggtt

SEQ ID NO: 668538 - DNA, 25 bp, Mus musculus
gtactggacaacctgctctatgcac

SEQ ID NO: 668539 - DNA, 25 bp, Mus musculus
gtactggacaacgtgctctatgcac

SEQ ID NO: 668540 - DNA, 25 bp, Mus musculus
gtactggaccctaattgtatagtta

SEQ ID NO: 668541 - DNA, 25 bp, Mus musculus
gtactggacccttattgtatagtta

SEQ ID NO: 668542 - DNA, 25 bp, Mus musculus
gtactggaccgcacaatatcgaaga

SEQ ID NO: 668543 - DNA, 25 bp, Mus musculus
gtactggaccgctcaatatcgaaga

SEQ ID NO: 668544 - DNA, 25 bp, Mus musculus
gtactggagcacacgttgaaaattg

SEQ ID NO: 668545 - DNA, 25 bp, Mus musculus
gtactggagcactcgttgaaaattg

SEQ ID NO: 668546 - DNA, 25 bp, Mus musculus
gtactggatactccgaggcatgctg

SEQ ID NO: 668547 - DNA, 25 bp, Mus musculus
gtactggatactgcgaggcatgctg

SEQ ID NO: 668548 - DNA, 25 bp, Mus musculus
gtactggatctcactgcatatattg

SEQ ID NO: 668549 - DNA, 25 bp, Mus musculus
gtactggatctctctgcatatattg

SEQ ID NO: 668550 - DNA, 25 bp, Mus musculus
gtactggattgtccgaaattcatgg

SEQ ID NO: 668551 - DNA, 25 bp, Mus musculus
gtactggattgtgcgaaattcatgg

SEQ ID NO: 668552 - DNA, 25 bp, Mus musculus
gtactggcaaccactaacctacttt

SEQ ID NO: 668553 - DNA, 25 bp, Mus musculus
gtactggcaacctctaacctacttt

SEQ ID NO: 668554 - DNA, 25 bp, Mus musculus
gtactggcaagaccgttttcgtggt

SEQ ID NO: 668555 - DNA, 25 bp, Mus musculus
gtactggcaagagcgttttcgtggt

SEQ ID NO: 668556 - DNA, 25 bp, Mus musculus
gtactggcacggagcgttaaccaca

SEQ ID NO: 668557 - DNA, 25 bp, Mus musculus
gtactggcacggtgcgttaaccaca

SEQ ID NO: 668558 - DNA, 25 bp, Mus musculus
gtactggcagtgcatgaacaatttc

SEQ ID NO: 668559 - DNA, 25 bp, Mus musculus
gtactggcagtggatgaacaatttc

SEQ ID NO: 668560 - DNA, 25 bp, Mus musculus
gtactggcccacacgtgtaatcata

SEQ ID NO: 668561 - DNA, 25 bp, Mus musculus
gtactggcccactcgtgtaatcata

SEQ ID NO: 668562 - DNA, 25 bp, Mus musculus
gtactggccctgctaatttctatca

SEQ ID NO: 668563 - DNA, 25 bp, Mus musculus
gtactggccctggtaatttctatca

SEQ ID NO: 668564 - DNA, 25 bp, Mus musculus
gtactggcctaaacctaagaccctg

SEQ ID NO: 668565 - DNA, 25 bp, Mus musculus
gtactggcctaatcctaagaccctg

SEQ ID NO: 668566 - DNA, 25 bp, Mus musculus
gtactggcctacagggttctgcagc

SEQ ID NO: 668567 - DNA, 25 bp, Mus musculus
gtactggcctactgggttctgcagc

SEQ ID NO: 668568 - DNA, 25 bp, Mus musculus
gtactggcgacacgctggactcagc

SEQ ID NO: 668569 - DNA, 25 bp, Mus musculus
gtactggcgacaggctggactcagc

SEQ ID NO: 668570 - DNA, 25 bp, Mus musculus
gtactggcggctatccaagtcaaca

SEQ ID NO: 668571 - DNA, 25 bp, Mus musculus
gtactggcggctttccaagtcaaca

SEQ ID NO: 668572 - DNA, 25 bp, Mus musculus
gtactggctagaaggtgggcattct

SEQ ID NO: 668573 - DNA, 25 bp, Mus musculus
gtactggctagatggtgggcattct

SEQ ID NO: 668574 - DNA, 25 bp, Mus musculus
gtactggctatcaacaaattattct

SEQ ID NO: 668575 - DNA, 25 bp, Mus musculus
gtactggctatctacaaattattct

SEQ ID NO: 668576 - DNA, 25 bp, Mus musculus
gtactggctttgcaggcaagcctga

SEQ ID NO: 668577 - DNA, 25 bp, Mus musculus
gtactggctttggaggcaagcctga

SEQ ID NO: 668578 - DNA, 25 bp, Mus musculus
gtactgggaacgcaaccgtgcagtc

SEQ ID NO: 668579 - DNA, 25 bp, Mus musculus
gtactgggaacggaaccgtgcagtc

SEQ ID NO: 668580 - DNA, 25 bp, Mus musculus
gtactgggactacaaccctggtctt

SEQ ID NO: 668581 - DNA, 25 bp, Mus musculus
gtactgggactagaaccctggtctt

SEQ ID NO: 668582 - DNA, 25 bp, Mus musculus
gtactgggagttcaactaggccctc

SEQ ID NO: 668583 - DNA, 25 bp, Mus musculus
gtactgggagttgaactaggccctc

SEQ ID NO: 668584 - DNA, 25 bp, Mus musculus
gtactgggatacaactcactgactt

SEQ ID NO: 668585 - DNA, 25 bp, Mus musculus
gtactgggatactactcactgactt

SEQ ID NO: 668586 - DNA, 25 bp, Mus musculus
gtactgggccaaattcgcaagaaat

SEQ ID NO: 668587 - DNA, 25 bp, Mus musculus
gtactgggccaatttcgcaagaaat

SEQ ID NO: 668588 - DNA, 25 bp, Mus musculus
gtactgggccagagtctgtcgttcc

SEQ ID NO: 668589 - DNA, 25 bp, Mus musculus
gtactgggccagtgtctgtcgttcc

SEQ ID NO: 668590 - DNA, 25 bp, Mus musculus
gtactgggcctaagttgaagcttca

SEQ ID NO: 668591 - DNA, 25 bp, Mus musculus
gtactgggcctatgttgaagcttca

SEQ ID NO: 668592 - DNA, 25 bp, Mus musculus
gtactgggcgtaagatctttgcagg

SEQ ID NO: 668593 - DNA, 25 bp, Mus musculus
gtactgggcgtatgatctttgcagg

SEQ ID NO: 668594 - DNA, 25 bp, Mus musculus
gtactgggctatctttggacgagac

SEQ ID NO: 668595 - DNA, 25 bp, Mus musculus
gtactgggctatgtttggacgagac

SEQ ID NO: 668596 - DNA, 25 bp, Mus musculus
gtactgggctcaaaaggcttcacct

SEQ ID NO: 668597 - DNA, 25 bp, Mus musculus
gtactgggctcataaggcttcacct

SEQ ID NO: 668598 - DNA, 25 bp, Mus musculus
gtactgggttgtatcaggacccctg

SEQ ID NO: 668599 - DNA, 25 bp, Mus musculus
gtactgggttgtttcaggacccctg

SEQ ID NO: 668600 - DNA, 25 bp, Mus musculus
gtactggtaacaactgagacccaac

SEQ ID NO: 668601 - DNA, 25 bp, Mus musculus
gtactggtaacatctgagacccaac

SEQ ID NO: 668602 - DNA, 25 bp, Mus musculus
gtactggtataaacagagcgctgag

SEQ ID NO: 668603 - DNA, 25 bp, Mus musculus
gtactggtataatcagagcgctgag

SEQ ID NO: 668604 - DNA, 25 bp, Mus musculus
gtactggtattactgagggctttac

SEQ ID NO: 668605 - DNA, 25 bp, Mus musculus
gtactggtattagtgagggctttac

SEQ ID NO: 668606 - DNA, 25 bp, Mus musculus
gtactggtggtaatttactactgtc

SEQ ID NO: 668607 - DNA, 25 bp, Mus musculus
gtactggtggtattttactactgtc

SEQ ID NO: 668608 - DNA, 25 bp, Mus musculus
gtactggtgtttacttgtgtcccca

SEQ ID NO: 668609 - DNA, 25 bp, Mus musculus
gtactggtgttttcttgtgtcccca

SEQ ID NO: 668610 - DNA, 25 bp, Mus musculus
gtactggttaacatggtattcttta

SEQ ID NO: 668611 - DNA, 25 bp, Mus musculus
gtactggttaacttggtattcttta

SEQ ID NO: 668612 - DNA, 25 bp, Mus musculus
gtactggttcacatttattgctgac

SEQ ID NO: 668613 - DNA, 25 bp, Mus musculus
gtactggttcacttttattgctgac

SEQ ID NO: 668614 - DNA, 25 bp, Mus musculus
gtactggttctgcatatcttctttg

SEQ ID NO: 668615 - DNA, 25 bp, Mus musculus
gtactggttctggatatcttctttg

SEQ ID NO: 668616 - DNA, 25 bp, Mus musculus
gtactggttcttaatagccattgta

SEQ ID NO: 668617 - DNA, 25 bp, Mus musculus
gtactggttctttatagccattgta

SEQ ID NO: 668618 - DNA, 25 bp, Mus musculus
gtactggttgataaacacagcttga

SEQ ID NO: 668619 - DNA, 25 bp, Mus musculus
gtactggttgattaacacagcttga

SEQ ID NO: 668620 - DNA, 25 bp, Mus musculus
gtactgtaaacaactacttctggga

SEQ ID NO: 668621 - DNA, 25 bp, Mus musculus
gtactgtaaacacagattgcttcag

SEQ ID NO: 668622 - DNA, 25 bp, Mus musculus
gtactgtaaacacgctttagtcatt

SEQ ID NO: 668623 - DNA, 25 bp, Mus musculus
gtactgtaaacagagattgcttcag

SEQ ID NO: 668624 - DNA, 25 bp, Mus musculus
gtactgtaaacaggctttagtcatt

SEQ ID NO: 668625 - DNA, 25 bp, Mus musculus
gtactgtaaacatctacttctggga

SEQ ID NO: 668626 - DNA, 25 bp, Mus musculus
gtactgtaacataggaaggcacttt

SEQ ID NO: 668627 - DNA, 25 bp, Mus musculus
gtactgtaacattggaaggcacttt

SEQ ID NO: 668628 - DNA, 25 bp, Mus musculus
gtactgtaatctattgttctcaatg

SEQ ID NO: 668629 - DNA, 25 bp, Mus musculus
gtactgtaatcttttgttctcaatg

SEQ ID NO: 668630 - DNA, 25 bp, Mus musculus
gtactgtacagtcctcatatactat

SEQ ID NO: 668631 - DNA, 25 bp, Mus musculus
gtactgtacagtgctcatatactat

SEQ ID NO: 668632 - DNA, 25 bp, Mus musculus
gtactgtactaaatcctacacggcc

SEQ ID NO: 668633 - DNA, 25 bp, Mus musculus
gtactgtactaattcctacacggcc

SEQ ID NO: 668634 - DNA, 25 bp, Mus musculus
gtactgtactaccaacaccctgaaa

SEQ ID NO: 668635 - DNA, 25 bp, Mus musculus
gtactgtactacgaacaccctgaaa

SEQ ID NO: 668636 - DNA, 25 bp, Mus musculus
gtactgtactatccttggaaagaac

SEQ ID NO: 668637 - DNA, 25 bp, Mus musculus
gtactgtactatgcttggaaagaac

SEQ ID NO: 668638 - DNA, 25 bp, Mus musculus
gtactgtactttcttcataggattg

SEQ ID NO: 668639 - DNA, 25 bp, Mus musculus
gtactgtactttgttcataggattg

SEQ ID NO: 668640 - DNA, 25 bp, Mus musculus
gtactgtagatacgacccagggctt

SEQ ID NO: 668641 - DNA, 25 bp, Mus musculus
gtactgtagataggacccagggctt

SEQ ID NO: 668642 - DNA, 25 bp, Mus musculus
gtactgtagatgaagctcaactgga

SEQ ID NO: 668643 - DNA, 25 bp, Mus musculus
gtactgtagatgtagctcaactgga

SEQ ID NO: 668644 - DNA, 25 bp, Mus musculus
gtactgtagcacaggctttgggcct

SEQ ID NO: 668645 - DNA, 25 bp, Mus musculus
gtactgtagcactggctttgggcct

SEQ ID NO: 668646 - DNA, 25 bp, Mus musculus
gtactgtagcgaatgaactatcccc

SEQ ID NO: 668647 - DNA, 25 bp, Mus musculus
gtactgtagcgattgaactatcccc

SEQ ID NO: 668648 - DNA, 25 bp, Mus musculus
gtactgtagtacatgctcctacctc

SEQ ID NO: 668649 - DNA, 25 bp, Mus musculus
gtactgtagtacttgctcctacctc

SEQ ID NO: 668650 - DNA, 25 bp, Mus musculus
gtactgtataatcgaggctgaccag

SEQ ID NO: 668651 - DNA, 25 bp, Mus musculus
gtactgtataatggaggctgaccag

SEQ ID NO: 668652 - DNA, 25 bp, Mus musculus
gtactgtatatactttaaccaagtg

SEQ ID NO: 668653 - DNA, 25 bp, Mus musculus
gtactgtatatagtttaaccaagtg

SEQ ID NO: 668654 - DNA, 25 bp, Mus musculus
gtactgtatattcctacctgtacat

SEQ ID NO: 668655 - DNA, 25 bp, Mus musculus
gtactgtatattgctacctgtacat

SEQ ID NO: 668656 - DNA, 25 bp, Mus musculus
gtactgtattgcattctacattttg

SEQ ID NO: 668657 - DNA, 25 bp, Mus musculus
gtactgtattgctttctacattttg

SEQ ID NO: 668658 - DNA, 25 bp, Mus musculus
gtactgtatttaagtcacgcaaagc

SEQ ID NO: 668659 - DNA, 25 bp, Mus musculus
gtactgtatttaatgtgtataacga

SEQ ID NO: 668660 - DNA, 25 bp, Mus musculus
gtactgtatttatgtcacgcaaagc

SEQ ID NO: 668661 - DNA, 25 bp, Mus musculus
gtactgtatttattgtgtataacga

SEQ ID NO: 668662 - DNA, 25 bp, Mus musculus
gtactgtatttcacatgctggattt

SEQ ID NO: 668663 - DNA, 25 bp, Mus musculus
gtactgtatttctcatgctggattt

SEQ ID NO: 668664 - DNA, 25 bp, Mus musculus
gtactgtcaaacctcaaatgctttc

SEQ ID NO: 668665 - DNA, 25 bp, Mus musculus
gtactgtcaaacgtcaaatgctttc

SEQ ID NO: 668666 - DNA, 25 bp, Mus musculus
gtactgtcactaagccctcaagata

SEQ ID NO: 668667 - DNA, 25 bp, Mus musculus
gtactgtcactacttactgtttgat

SEQ ID NO: 668668 - DNA, 25 bp, Mus musculus
gtactgtcactagttactgtttgat

SEQ ID NO: 668669 - DNA, 25 bp, Mus musculus
gtactgtcactatgccctcaagata

SEQ ID NO: 668670 - DNA, 25 bp, Mus musculus
gtactgtcactgatgtaaaggcaca

SEQ ID NO: 668671 - DNA, 25 bp, Mus musculus
gtactgtcactgttgtaaaggcaca

SEQ ID NO: 668672 - DNA, 25 bp, Mus musculus
gtactgtcagctattctagacttga

SEQ ID NO: 668673 - DNA, 25 bp, Mus musculus
gtactgtcagcttttctagacttga

SEQ ID NO: 668674 - DNA, 25 bp, Mus musculus
gtactgtcataaaatatcctatcaa

SEQ ID NO: 668675 - DNA, 25 bp, Mus musculus
gtactgtcataatatatcctatcaa

SEQ ID NO: 668676 - DNA, 25 bp, Mus musculus
gtactgtcatacacacatgctaggt

SEQ ID NO: 668677 - DNA, 25 bp, Mus musculus
gtactgtcatactcacatgctaggt

SEQ ID NO: 668678 - DNA, 25 bp, Mus musculus
gtactgtcatcaatacttttgcttt

SEQ ID NO: 668679 - DNA, 25 bp, Mus musculus
gtactgtcatcattacttttgcttt

SEQ ID NO: 668680 - DNA, 25 bp, Mus musculus
gtactgtccaatctgcttacatcaa

SEQ ID NO: 668681 - DNA, 25 bp, Mus musculus
gtactgtccaatgtgcttacatcaa

SEQ ID NO: 668682 - DNA, 25 bp, Mus musculus
gtactgtccagtccttatcttctta

SEQ ID NO: 668683 - DNA, 25 bp, Mus musculus
gtactgtccagtgcttatcttctta

SEQ ID NO: 668684 - DNA, 25 bp, Mus musculus
gtactgtcctcgctttataagggaa

SEQ ID NO: 668685 - DNA, 25 bp, Mus musculus
gtactgtcctcggtttataagggaa

SEQ ID NO: 668686 - DNA, 25 bp, Mus musculus
gtactgtccttcctgatgcgggcat

SEQ ID NO: 668687 - DNA, 25 bp, Mus musculus
gtactgtccttcgtgatgcgggcat

SEQ ID NO: 668688 - DNA, 25 bp, Mus musculus
gtactgtcgctgcatgcgtgtacac

SEQ ID NO: 668689 - DNA, 25 bp, Mus musculus
gtactgtcgctggatgcgtgtacac

SEQ ID NO: 668690 - DNA, 25 bp, Mus musculus
gtactgtctacaaggtcttaagcta

SEQ ID NO: 668691 - DNA, 25 bp, Mus musculus
gtactgtctacatggtcttaagcta

SEQ ID NO: 668692 - DNA, 25 bp, Mus musculus
gtactgtctactaggtaccatgcag

SEQ ID NO: 668693 - DNA, 25 bp, Mus musculus
gtactgtctacttggtaccatgcag

SEQ ID NO: 668694 - DNA, 25 bp, Mus musculus
gtactgtctagtcaaccgggcccga

SEQ ID NO: 668695 - DNA, 25 bp, Mus musculus
gtactgtctagtgaaccgggcccga

SEQ ID NO: 668696 - DNA, 25 bp, Mus musculus
gtactgtctcctaaactgatgtcac

SEQ ID NO: 668697 - DNA, 25 bp, Mus musculus
gtactgtctccttaactgatgtcac

SEQ ID NO: 668698 - DNA, 25 bp, Mus musculus
gtactgtctgttacttctcataatt

SEQ ID NO: 668699 - DNA, 25 bp, Mus musculus
gtactgtctgtttcttctcataatt

SEQ ID NO: 668700 - DNA, 25 bp, Mus musculus
gtactgtctttactattacttccct

SEQ ID NO: 668701 - DNA, 25 bp, Mus musculus
gtactgtctttagtattacttccct

SEQ ID NO: 668702 - DNA, 25 bp, Mus musculus
gtactgtgaaagaccttctgctgtc

SEQ ID NO: 668703 - DNA, 25 bp, Mus musculus
gtactgtgaaagtccttctgctgtc

SEQ ID NO: 668704 - DNA, 25 bp, Mus musculus
gtactgtgaacacgaacccatgcgt

SEQ ID NO: 668705 - DNA, 25 bp, Mus musculus
gtactgtgaacaggaacccatgcgt

SEQ ID NO: 668706 - DNA, 25 bp, Mus musculus
gtactgtgaccaagagtttccaatt

SEQ ID NO: 668707 - DNA, 25 bp, Mus musculus
gtactgtgaccatgagtttccaatt

SEQ ID NO: 668708 - DNA, 25 bp, Mus musculus
gtactgtgaggacgcaggcatccca

SEQ ID NO: 668709 - DNA, 25 bp, Mus musculus
gtactgtgaggaggcaggcatccca

SEQ ID NO: 668710 - DNA, 25 bp, Mus musculus
gtactgtgaggtccactaccacgag

SEQ ID NO: 668711 - DNA, 25 bp, Mus musculus
gtactgtgaggtgcactaccacgag

SEQ ID NO: 668712 - DNA, 25 bp, Mus musculus
gtactgtgctagatatacttactgt

SEQ ID NO: 668713 - DNA, 25 bp, Mus musculus
gtactgtgctagttatacttactgt

SEQ ID NO: 668714 - DNA, 25 bp, Mus musculus
gtactgtggaatcctaactctggaa

SEQ ID NO: 668715 - DNA, 25 bp, Mus musculus
gtactgtggaatgctaactctggaa

SEQ ID NO: 668716 - DNA, 25 bp, Mus musculus
gtactgtggagcaaagggagaccta

SEQ ID NO: 668717 - DNA, 25 bp, Mus musculus
gtactgtggagctaagggagaccta

SEQ ID NO: 668718 - DNA, 25 bp, Mus musculus
gtactgtggtagagcaaactggctg

SEQ ID NO: 668719 - DNA, 25 bp, Mus musculus
gtactgtggtagtgcaaactggctg

SEQ ID NO: 668720 - DNA, 25 bp, Mus musculus
gtactgtggtggatcgaatgagcat

SEQ ID NO: 668721 - DNA, 25 bp, Mus musculus
gtactgtggtggttcgaatgagcat

SEQ ID NO: 668722 - DNA, 25 bp, Mus musculus
gtactgtgtactatgacatgaatca

SEQ ID NO: 668723 - DNA, 25 bp, Mus musculus
gtactgtgtactttgacatgaatca

SEQ ID NO: 668724 - DNA, 25 bp, Mus musculus
gtactgtgtcagagccatttgtcct

SEQ ID NO: 668725 - DNA, 25 bp, Mus musculus
gtactgtgtcagtgccatttgtcct

SEQ ID NO: 668726 - DNA, 25 bp, Mus musculus
gtactgtgtcgtcccacagatctgt

SEQ ID NO: 668727 - DNA, 25 bp, Mus musculus
gtactgtgtcgtgccacagatctgt

SEQ ID NO: 668728 - DNA, 25 bp, Mus musculus
gtactgtgtctgaatgccatacgtt

SEQ ID NO: 668729 - DNA, 25 bp, Mus musculus
gtactgtgtctgtatgccatacgtt

SEQ ID NO: 668730 - DNA, 25 bp, Mus musculus
gtactgtgtcttagtgtaagtccta

SEQ ID NO: 668731 - DNA, 25 bp, Mus musculus
gtactgtgtcttcaaatttaatgga

SEQ ID NO: 668732 - DNA, 25 bp, Mus musculus
gtactgtgtcttgaaatttaatgga

SEQ ID NO: 668733 - DNA, 25 bp, Mus musculus
gtactgtgtctttgtgtaagtccta

SEQ ID NO: 668734 - DNA, 25 bp, Mus musculus
gtactgtgtgacaatgcatcatgca

SEQ ID NO: 668735 - DNA, 25 bp, Mus musculus
gtactgtgtgactatgcatcatgca

SEQ ID NO: 668736 - DNA, 25 bp, Mus musculus
gtactgtgtgatatgaactttttgt

SEQ ID NO: 668737 - DNA, 25 bp, Mus musculus
gtactgtgtgatttgaactttttgt

SEQ ID NO: 668738 - DNA, 25 bp, Mus musculus
gtactgtgtggtattctattcttcc

SEQ ID NO: 668739 - DNA, 25 bp, Mus musculus
gtactgtgtggttttctattcttcc

SEQ ID NO: 668740 - DNA, 25 bp, Mus musculus
gtactgtgttgacagaccctcggcc

SEQ ID NO: 668741 - DNA, 25 bp, Mus musculus
gtactgtgttgagagaccctcggcc

SEQ ID NO: 668742 - DNA, 25 bp, Mus musculus
gtactgtgtttaaggagaccgctgc

SEQ ID NO: 668743 - DNA, 25 bp, Mus musculus
gtactgtgtttatggagaccgctgc

SEQ ID NO: 668744 - DNA, 25 bp, Mus musculus
gtactgttaaagcatccattggcat

SEQ ID NO: 668745 - DNA, 25 bp, Mus musculus
gtactgttaaaggatccattggcat

SEQ ID NO: 668746 - DNA, 25 bp, Mus musculus
gtactgttactcatatgttcaagtt

SEQ ID NO: 668747 - DNA, 25 bp, Mus musculus
gtactgttactcttatgttcaagtt

SEQ ID NO: 668748 - DNA, 25 bp, Mus musculus
gtactgttacttaaggctccatttt

SEQ ID NO: 668749 - DNA, 25 bp, Mus musculus
gtactgttactttaggctccatttt

SEQ ID NO: 668750 - DNA, 25 bp, Mus musculus
gtactgttatttattggcagcaacc

SEQ ID NO: 668751 - DNA, 25 bp, Mus musculus
gtactgttattttttggcagcaacc

SEQ ID NO: 668752 - DNA, 25 bp, Mus musculus
gtactgttcaccaagagaccgtcat

SEQ ID NO: 668753 - DNA, 25 bp, Mus musculus
gtactgttcacctagagaccgtcat

SEQ ID NO: 668754 - DNA, 25 bp, Mus musculus
gtactgttcagtaatctaaggaaca

SEQ ID NO: 668755 - DNA, 25 bp, Mus musculus
gtactgttcagttatctaaggaaca

SEQ ID NO: 668756 - DNA, 25 bp, Mus musculus
gtactgttctgccatggaaaacaca

SEQ ID NO: 668757 - DNA, 25 bp, Mus musculus
gtactgttctgccttgaaaggctaa

SEQ ID NO: 668758 - DNA, 25 bp, Mus musculus
gtactgttctgcgatggaaaacaca

SEQ ID NO: 668759 - DNA, 25 bp, Mus musculus
gtactgttctgcgttgaaaggctaa

SEQ ID NO: 668760 - DNA, 25 bp, Mus musculus
gtactgttgaccataggctctgcag

SEQ ID NO: 668761 - DNA, 25 bp, Mus musculus
gtactgttgaccttaggctctgcag

SEQ ID NO: 668762 - DNA, 25 bp, Mus musculus
gtactgttgagcaggatacattttt

SEQ ID NO: 668763 - DNA, 25 bp, Mus musculus
gtactgttgagctggatacattttt

SEQ ID NO: 668764 - DNA, 25 bp, Mus musculus
gtactgttggttacaggatagcctt

SEQ ID NO: 668765 - DNA, 25 bp, Mus musculus
gtactgttggttctacatctcctgg

SEQ ID NO: 668766 - DNA, 25 bp, Mus musculus
gtactgttggttgtacatctcctgg

SEQ ID NO: 668767 - DNA, 25 bp, Mus musculus
gtactgttggtttcaggatagcctt

SEQ ID NO: 668768 - DNA, 25 bp, Mus musculus
gtactgtttcagatatttctcttta

SEQ ID NO: 668769 - DNA, 25 bp, Mus musculus
gtactgtttcagttatttctcttta

SEQ ID NO: 668770 - DNA, 25 bp, Mus musculus
gtactgtttcataagcttgtcctcc

SEQ ID NO: 668771 - DNA, 25 bp, Mus musculus
gtactgtttcattagcttgtcctcc

SEQ ID NO: 668772 - DNA, 25 bp, Mus musculus
gtactgtttgagaaagactaccttc

SEQ ID NO: 668773 - DNA, 25 bp, Mus musculus
gtactgtttgagtaagactaccttc

SEQ ID NO: 668774 - DNA, 25 bp, Mus musculus
gtacttaaactaagtgctccatcca

SEQ ID NO: 668775 - DNA, 25 bp, Mus musculus
gtacttaaactatgtgctccatcca

SEQ ID NO: 668776 - DNA, 25 bp, Mus musculus
gtacttaaatatattctctctcgtt

SEQ ID NO: 668777 - DNA, 25 bp, Mus musculus
gtacttaaatattttctctctcgtt

SEQ ID NO: 668778 - DNA, 25 bp, Mus musculus
gtacttaacagtaatacatgtctca

SEQ ID NO: 668779 - DNA, 25 bp, Mus musculus
gtacttaacagttatacatgtctca

SEQ ID NO: 668780 - DNA, 25 bp, Mus musculus
gtacttaacatactcagttgatctt

SEQ ID NO: 668781 - DNA, 25 bp, Mus musculus
gtacttaacatagtcagttgatctt

SEQ ID NO: 668782 - DNA, 25 bp, Mus musculus
gtacttaacattccttcagtgataa

SEQ ID NO: 668783 - DNA, 25 bp, Mus musculus
gtacttaacattgcttcagtgataa

SEQ ID NO: 668784 - DNA, 25 bp, Mus musculus
gtacttaactgtattctgagcagct

SEQ ID NO: 668785 - DNA, 25 bp, Mus musculus
gtacttaactgtattgacccatgaa

SEQ ID NO: 668786 - DNA, 25 bp, Mus musculus
gtacttaactgttttctgagcagct

SEQ ID NO: 668787 - DNA, 25 bp, Mus musculus
gtacttaactgttttgacccatgaa

SEQ ID NO: 668788 - DNA, 25 bp, Mus musculus
gtacttaagcagcagagacccctga

SEQ ID NO: 668789 - DNA, 25 bp, Mus musculus
gtacttaagcaggagagacccctga

SEQ ID NO: 668790 - DNA, 25 bp, Mus musculus
gtacttaaggaactgacacgggtgt

SEQ ID NO: 668791 - DNA, 25 bp, Mus musculus
gtacttaaggaagtgacacgggtgt

SEQ ID NO: 668792 - DNA, 25 bp, Mus musculus
gtacttaaggttcctcacatgtgat

SEQ ID NO: 668793 - DNA, 25 bp, Mus musculus
gtacttaaggttgctcacatgtgat

SEQ ID NO: 668794 - DNA, 25 bp, Mus musculus
gtacttaagtgtcgagacgcccagc

SEQ ID NO: 668795 - DNA, 25 bp, Mus musculus
gtacttaagtgtggagacgcccagc

SEQ ID NO: 668796 - DNA, 25 bp, Mus musculus
gtacttaatgatctgttagcagctg

SEQ ID NO: 668797 - DNA, 25 bp, Mus musculus
gtacttaatgatgtgttagcagctg

SEQ ID NO: 668798 - DNA, 25 bp, Mus musculus
gtacttaatgctaaatcttcctttg

SEQ ID NO: 668799 - DNA, 25 bp, Mus musculus
gtacttaatgcttaatcttcctttg

SEQ ID NO: 668800 - DNA, 25 bp, Mus musculus
gtacttaatgtgagccaactggaga

SEQ ID NO: 668801 - DNA, 25 bp, Mus musculus
gtacttaatgtgtgccaactggaga

SEQ ID NO: 668802 - DNA, 25 bp, Mus musculus
gtacttaatgttcgtggctagacta

SEQ ID NO: 668803 - DNA, 25 bp, Mus musculus
gtacttaatgttggtggctagacta

SEQ ID NO: 668804 - DNA, 25 bp, Mus musculus
gtacttaatttccttgattcttcaa

SEQ ID NO: 668805 - DNA, 25 bp, Mus musculus
gtacttaatttcgttgattcttcaa

SEQ ID NO: 668806 - DNA, 25 bp, Mus musculus
gtacttacaagcatttacctgggca

SEQ ID NO: 668807 - DNA, 25 bp, Mus musculus
gtacttacaagcttttacctgggca

SEQ ID NO: 668808 - DNA, 25 bp, Mus musculus
gtacttacaaggaggtcaaactgaa

SEQ ID NO: 668809 - DNA, 25 bp, Mus musculus
gtacttacaaggtggtcaaactgaa

SEQ ID NO: 668810 - DNA, 25 bp, Mus musculus
gtacttacaagtcttcctttgcttt

SEQ ID NO: 668811 - DNA, 25 bp, Mus musculus
gtacttacaagtgttcctttgcttt

SEQ ID NO: 668812 - DNA, 25 bp, Mus musculus
gtacttacatctactgaacactgta

SEQ ID NO: 668813 - DNA, 25 bp, Mus musculus
gtacttacatcttctgaacactgta

SEQ ID NO: 668814 - DNA, 25 bp, Mus musculus
gtacttaccaacaggtactcggcaa

SEQ ID NO: 668815 - DNA, 25 bp, Mus musculus
gtacttaccaactggtactcggcaa

SEQ ID NO: 668816 - DNA, 25 bp, Mus musculus
gtacttacccaacaagctgaggttt

SEQ ID NO: 668817 - DNA, 25 bp, Mus musculus
gtacttacccaagaagctgaggttt

SEQ ID NO: 668818 - DNA, 25 bp, Mus musculus
gtacttaccctgagataccctgtat

SEQ ID NO: 668819 - DNA, 25 bp, Mus musculus
gtacttaccctgtgataccctgtat

SEQ ID NO: 668820 - DNA, 25 bp, Mus musculus
gtacttaccgctaatctacatctac

SEQ ID NO: 668821 - DNA, 25 bp, Mus musculus
gtacttaccgcttatctacatctac

SEQ ID NO: 668822 - DNA, 25 bp, Mus musculus
gtacttacctggagagacatatgtc

SEQ ID NO: 668823 - DNA, 25 bp, Mus musculus
gtacttacctggtgagacatatgtc

SEQ ID NO: 668824 - DNA, 25 bp, Mus musculus
gtacttacctttctgaagggccact

SEQ ID NO: 668825 - DNA, 25 bp, Mus musculus
gtacttacctttgtgaagggccact

SEQ ID NO: 668826 - DNA, 25 bp, Mus musculus
gtacttacgataacaagaggccttg

SEQ ID NO: 668827 - DNA, 25 bp, Mus musculus
gtacttacgatatcaagaggccttg

SEQ ID NO: 668828 - DNA, 25 bp, Mus musculus
gtacttactatacctcctgagggaa

SEQ ID NO: 668829 - DNA, 25 bp, Mus musculus
gtacttactatagctcctgagggaa

SEQ ID NO: 668830 - DNA, 25 bp, Mus musculus
gtacttactgagctccatgtattaa

SEQ ID NO: 668831 - DNA, 25 bp, Mus musculus
gtacttactgaggtccatgtattaa

SEQ ID NO: 668832 - DNA, 25 bp, Mus musculus
gtacttactgtacagaaaccctatg

SEQ ID NO: 668833 - DNA, 25 bp, Mus musculus
gtacttactgtagagaaaccctatg

SEQ ID NO: 668834 - DNA, 25 bp, Mus musculus
gtacttacttatcagtttgcactag

SEQ ID NO: 668835 - DNA, 25 bp, Mus musculus
gtacttacttatgagtttgcactag

SEQ ID NO: 668836 - DNA, 25 bp, Mus musculus
gtacttactttgagtctgacacctg

SEQ ID NO: 668837 - DNA, 25 bp, Mus musculus
gtacttactttgtgtctgacacctg

SEQ ID NO: 668838 - DNA, 25 bp, Mus musculus
gtacttagacccatctgtattttct

SEQ ID NO: 668839 - DNA, 25 bp, Mus musculus
gtacttagacccttctgtattttct

SEQ ID NO: 668840 - DNA, 25 bp, Mus musculus
gtacttagacctcgctccgtacatg

SEQ ID NO: 668841 - DNA, 25 bp, Mus musculus
gtacttagacctggctccgtacatg

SEQ ID NO: 668842 - DNA, 25 bp, Mus musculus
gtacttagattaactccaccttcac

SEQ ID NO: 668843 - DNA, 25 bp, Mus musculus
gtacttagattatctccaccttcac

SEQ ID NO: 668844 - DNA, 25 bp, Mus musculus
gtacttagcaggattgctgagcctt

SEQ ID NO: 668845 - DNA, 25 bp, Mus musculus
gtacttagcaggtttgctgagcctt

SEQ ID NO: 668846 - DNA, 25 bp, Mus musculus
gtacttagcatacagccagagtcaa

SEQ ID NO: 668847 - DNA, 25 bp, Mus musculus
gtacttagcatagagccagagtcaa

SEQ ID NO: 668848 - DNA, 25 bp, Mus musculus
gtacttagcgtactcatgataatta

SEQ ID NO: 668849 - DNA, 25 bp, Mus musculus
gtacttagcgtagtcatgataatta

SEQ ID NO: 668850 - DNA, 25 bp, Mus musculus
gtacttagctgtcgaatctgtctta

SEQ ID NO: 668851 - DNA, 25 bp, Mus musculus
gtacttagctgtggaatctgtctta

SEQ ID NO: 668852 - DNA, 25 bp, Mus musculus
gtacttaggaagatttaccacatga

SEQ ID NO: 668853 - DNA, 25 bp, Mus musculus
gtacttaggaagttttaccacatga

SEQ ID NO: 668854 - DNA, 25 bp, Mus musculus
gtacttaggtaaaggaccggcatca

SEQ ID NO: 668855 - DNA, 25 bp, Mus musculus
gtacttaggtaatggaccggcatca

SEQ ID NO: 668856 - DNA, 25 bp, Mus musculus
gtacttagtaccatcattgtaagga

SEQ ID NO: 668857 - DNA, 25 bp, Mus musculus
gtacttagtaccttcattgtaagga

SEQ ID NO: 668858 - DNA, 25 bp, Mus musculus
gtacttagtcccacctattgtttat

SEQ ID NO: 668859 - DNA, 25 bp, Mus musculus
gtacttagtccctcctattgtttat

SEQ ID NO: 668860 - DNA, 25 bp, Mus musculus
gtacttagttctctaattcaaacca

SEQ ID NO: 668861 - DNA, 25 bp, Mus musculus
gtacttagttctgtaattcaaacca

SEQ ID NO: 668862 - DNA, 25 bp, Mus musculus
gtacttatacatagttaccaacttt

SEQ ID NO: 668863 - DNA, 25 bp, Mus musculus
gtacttatacattgttaccaacttt

SEQ ID NO: 668864 - DNA, 25 bp, Mus musculus
gtacttataggtaaaccttgcaaat

SEQ ID NO: 668865 - DNA, 25 bp, Mus musculus
gtacttataggtctaacgttaatga

SEQ ID NO: 668866 - DNA, 25 bp, Mus musculus
gtacttataggtgtaacgttaatga

SEQ ID NO: 668867 - DNA, 25 bp, Mus musculus
gtacttataggttaaccttgcaaat

SEQ ID NO: 668868 - DNA, 25 bp, Mus musculus
gtacttatcaaacagcagctgtctt

SEQ ID NO: 668869 - DNA, 25 bp, Mus musculus
gtacttatcaaagagcagctgtctt

SEQ ID NO: 668870 - DNA, 25 bp, Mus musculus
gtacttatcactaccaaggtctgtt

SEQ ID NO: 668871 - DNA, 25 bp, Mus musculus
gtacttatcacttccaaggtctgtt

SEQ ID NO: 668872 - DNA, 25 bp, Mus musculus
gtacttatccagaatgaacacagct

SEQ ID NO: 668873 - DNA, 25 bp, Mus musculus
gtacttatccagtatgaacacagct

SEQ ID NO: 668874 - DNA, 25 bp, Mus musculus
gtacttatggcaatctttgtaggaa

SEQ ID NO: 668875 - DNA, 25 bp, Mus musculus
gtacttatggcattctttgtaggaa

SEQ ID NO: 668876 - DNA, 25 bp, Mus musculus
gtacttattctactgttgctggctt

SEQ ID NO: 668877 - DNA, 25 bp, Mus musculus
gtacttattctagtgttgctggctt

SEQ ID NO: 668878 - DNA, 25 bp, Mus musculus
gtacttattctgactctgaattctt

SEQ ID NO: 668879 - DNA, 25 bp, Mus musculus
gtacttattctgtctctgaattctt

SEQ ID NO: 668880 - DNA, 25 bp, Mus musculus
gtacttatttccattgtgtggcgaa

SEQ ID NO: 668881 - DNA, 25 bp, Mus musculus
gtacttatttcctttgtgtggcgaa

SEQ ID NO: 668882 - DNA, 25 bp, Mus musculus
gtacttcaagaaccatctctactgc

SEQ ID NO: 668883 - DNA, 25 bp, Mus musculus
gtacttcaagaagcatctctactgc

SEQ ID NO: 668884 - DNA, 25 bp, Mus musculus
gtacttcaagtcaatcgggatgtct

SEQ ID NO: 668885 - DNA, 25 bp, Mus musculus
gtacttcaagtctatcgggatgtct

SEQ ID NO: 668886 - DNA, 25 bp, Mus musculus
gtacttcaccccaaggttgtgctta

SEQ ID NO: 668887 - DNA, 25 bp, Mus musculus
gtacttcacccctaggttgtgctta

SEQ ID NO: 668888 - DNA, 25 bp, Mus musculus
gtacttcactgtacagaccgtttta

SEQ ID NO: 668889 - DNA, 25 bp, Mus musculus
gtacttcactgttcagaccgtttta

SEQ ID NO: 668890 - DNA, 25 bp, Mus musculus
gtacttcagaccaagcgtatctcga

SEQ ID NO: 668891 - DNA, 25 bp, Mus musculus
gtacttcagacctagcgtatctcga

SEQ ID NO: 668892 - DNA, 25 bp, Mus musculus
gtacttcagcatcttttccatgttc

SEQ ID NO: 668893 - DNA, 25 bp, Mus musculus
gtacttcagcatgttttccatgttc

SEQ ID NO: 668894 - DNA, 25 bp, Mus musculus
gtacttcagcccatggaaagacatt

SEQ ID NO: 668895 - DNA, 25 bp, Mus musculus
gtacttcagcccttggaaagacatt

SEQ ID NO: 668896 - DNA, 25 bp, Mus musculus
gtacttcaggacaacctgctttgca

SEQ ID NO: 668897 - DNA, 25 bp, Mus musculus
gtacttcaggactacctgctttgca

SEQ ID NO: 668898 - DNA, 25 bp, Mus musculus
gtacttcaggagatgcctagcccta

SEQ ID NO: 668899 - DNA, 25 bp, Mus musculus
gtacttcaggagttgcctagcccta

SEQ ID NO: 668900 - DNA, 25 bp, Mus musculus
gtacttcagggcaagctgtcacagt

SEQ ID NO: 668901 - DNA, 25 bp, Mus musculus
gtacttcagggccagcgcgagataa

SEQ ID NO: 668902 - DNA, 25 bp, Mus musculus
gtacttcagggcgagcgcgagataa

SEQ ID NO: 668903 - DNA, 25 bp, Mus musculus
gtacttcagggctagctgtcacagt

SEQ ID NO: 668904 - DNA, 25 bp, Mus musculus
gtacttcaggttatattagatcatg

SEQ ID NO: 668905 - DNA, 25 bp, Mus musculus
gtacttcaggttttattagatcatg

SEQ ID NO: 668906 - DNA, 25 bp, Mus musculus
gtacttcatatacccatcatctttg

SEQ ID NO: 668907 - DNA, 25 bp, Mus musculus
gtacttcatatagccatcatctttg

SEQ ID NO: 668908 - DNA, 25 bp, Mus musculus
gtacttcatattccatagtgttaat

SEQ ID NO: 668909 - DNA, 25 bp, Mus musculus
gtacttcatattgcatagtgttaat

SEQ ID NO: 668910 - DNA, 25 bp, Mus musculus
gtacttcatccactcattgtttggt

SEQ ID NO: 668911 - DNA, 25 bp, Mus musculus
gtacttcatccagtcattgtttggt

SEQ ID NO: 668912 - DNA, 25 bp, Mus musculus
gtacttcatcccctattccacagta

SEQ ID NO: 668913 - DNA, 25 bp, Mus musculus
gtacttcatcccgtattccacagta

SEQ ID NO: 668914 - DNA, 25 bp, Mus musculus
gtacttcatgcacattgctcgggat

SEQ ID NO: 668915 - DNA, 25 bp, Mus musculus
gtacttcatgcagattgctcgggat

SEQ ID NO: 668916 - DNA, 25 bp, Mus musculus
gtacttcatggcatgacatagaggg

SEQ ID NO: 668917 - DNA, 25 bp, Mus musculus
gtacttcatggcttgacatagaggg

SEQ ID NO: 668918 - DNA, 25 bp, Mus musculus
gtacttcatgtgatggtgaccctcc

SEQ ID NO: 668919 - DNA, 25 bp, Mus musculus
gtacttcatgtgttggtgaccctcc

SEQ ID NO: 668920 - DNA, 25 bp, Mus musculus
gtacttcattggacctactgtggat

SEQ ID NO: 668921 - DNA, 25 bp, Mus musculus
gtacttcattggtcctactgtggat

SEQ ID NO: 668922 - DNA, 25 bp, Mus musculus
gtacttccacatcactgggtgttga

SEQ ID NO: 668923 - DNA, 25 bp, Mus musculus
gtacttccacatcatacaccagaga

SEQ ID NO: 668924 - DNA, 25 bp, Mus musculus
gtacttccacatgactgggtgttga

SEQ ID NO: 668925 - DNA, 25 bp, Mus musculus
gtacttccacatgatacaccagaga

SEQ ID NO: 668926 - DNA, 25 bp, Mus musculus
gtacttccacttcagggaggctatt

SEQ ID NO: 668927 - DNA, 25 bp, Mus musculus
gtacttccacttgagggaggctatt

SEQ ID NO: 668928 - DNA, 25 bp, Mus musculus
gtacttccagctctttctagttacc

SEQ ID NO: 668929 - DNA, 25 bp, Mus musculus
gtacttccagctgtttctagttacc

SEQ ID NO: 668930 - DNA, 25 bp, Mus musculus
gtacttccattaagccttggctgag

SEQ ID NO: 668931 - DNA, 25 bp, Mus musculus
gtacttccattatgccttggctgag

SEQ ID NO: 668932 - DNA, 25 bp, Mus musculus
gtacttcctaaacattgactgttgt

SEQ ID NO: 668933 - DNA, 25 bp, Mus musculus
gtacttcctaaagattgactgttgt

SEQ ID NO: 668934 - DNA, 25 bp, Mus musculus
gtacttcctcctactaactttatgg

SEQ ID NO: 668935 - DNA, 25 bp, Mus musculus
gtacttcctccttctaactttatgg

SEQ ID NO: 668936 - DNA, 25 bp, Mus musculus
gtacttcctctgcatagcaaccaga

SEQ ID NO: 668937 - DNA, 25 bp, Mus musculus
gtacttcctctggatagcaaccaga

SEQ ID NO: 668938 - DNA, 25 bp, Mus musculus
gtacttcctgataacaccctttgaa

SEQ ID NO: 668939 - DNA, 25 bp, Mus musculus
gtacttcctgattacaccctttgaa

SEQ ID NO: 668940 - DNA, 25 bp, Mus musculus
gtacttcctgccagtggtgacctgg

SEQ ID NO: 668941 - DNA, 25 bp, Mus musculus
gtacttcctgcctgtggtgacctgg

SEQ ID NO: 668942 - DNA, 25 bp, Mus musculus
gtacttcctgggatgtctatgagat

SEQ ID NO: 668943 - DNA, 25 bp, Mus musculus
gtacttcctgggttgtctatgagat

SEQ ID NO: 668944 - DNA, 25 bp, Mus musculus
gtacttcctggtctgatagccacta

SEQ ID NO: 668945 - DNA, 25 bp, Mus musculus
gtacttcctggtgtgatagccacta

SEQ ID NO: 668946 - DNA, 25 bp, Mus musculus
gtacttccttaacgttaagcactgt

SEQ ID NO: 668947 - DNA, 25 bp, Mus musculus
gtacttccttaaggttaagcactgt

SEQ ID NO: 668948 - DNA, 25 bp, Mus musculus
gtacttcgcagcaagggatgttact

SEQ ID NO: 668949 - DNA, 25 bp, Mus musculus
gtacttcgcagctagggatgttact

SEQ ID NO: 668950 - DNA, 25 bp, Mus musculus
gtacttcgccttatgtttaagctag

SEQ ID NO: 668951 - DNA, 25 bp, Mus musculus
gtacttcgccttttgtttaagctag

SEQ ID NO: 668952 - DNA, 25 bp, Mus musculus
gtacttcggcaacagagaacctaac

SEQ ID NO: 668953 - DNA, 25 bp, Mus musculus
gtacttcggcaagagagaacctaac

SEQ ID NO: 668954 - DNA, 25 bp, Mus musculus
gtacttcgggaaagtttatctgtga

SEQ ID NO: 668955 - DNA, 25 bp, Mus musculus
gtacttcgggaatgtttatctgtga

SEQ ID NO: 668956 - DNA, 25 bp, Mus musculus
gtacttcgtgaacgccagcagctgt

SEQ ID NO: 668957 - DNA, 25 bp, Mus musculus
gtacttcgtgaaggccagcagctgt

SEQ ID NO: 668958 - DNA, 25 bp, Mus musculus
gtacttctactaccaactacaagcg

SEQ ID NO: 668959 - DNA, 25 bp, Mus musculus
gtacttctactagcaactacaagcg

SEQ ID NO: 668960 - DNA, 25 bp, Mus musculus
gtacttctagctcggaagccccagg

SEQ ID NO: 668961 - DNA, 25 bp, Mus musculus
gtacttctagctgggaagccccagg

SEQ ID NO: 668962 - DNA, 25 bp, Mus musculus
gtacttctatgcaagcattcgctct

SEQ ID NO: 668963 - DNA, 25 bp, Mus musculus
gtacttctatgctagcattcgctct

SEQ ID NO: 668964 - DNA, 25 bp, Mus musculus
gtacttctcagtccagtcaggttga

SEQ ID NO: 668965 - DNA, 25 bp, Mus musculus
gtacttctcagtgcagtcaggttga

SEQ ID NO: 668966 - DNA, 25 bp, Mus musculus
gtacttctctacacattgaattttt

SEQ ID NO: 668967 - DNA, 25 bp, Mus musculus
gtacttctctactcattgaattttt

SEQ ID NO: 668968 - DNA, 25 bp, Mus musculus
gtacttctgaatacctctgcacaat

SEQ ID NO: 668969 - DNA, 25 bp, Mus musculus
gtacttctgaattcctctgcacaat

SEQ ID NO: 668970 - DNA, 25 bp, Mus musculus
gtacttctgagacccagtctggtaa

SEQ ID NO: 668971 - DNA, 25 bp, Mus musculus
gtacttctgagagccagtctggtaa

SEQ ID NO: 668972 - DNA, 25 bp, Mus musculus
gtacttctgattctatttgttcatc

SEQ ID NO: 668973 - DNA, 25 bp, Mus musculus
gtacttctgattgtatttgttcatc

SEQ ID NO: 668974 - DNA, 25 bp, Mus musculus
gtacttctgcctaccttgtgcggaa

SEQ ID NO: 668975 - DNA, 25 bp, Mus musculus
gtacttctgccttccttgtgcggaa

SEQ ID NO: 668976 - DNA, 25 bp, Mus musculus
gtacttctgcgtctgagctttgttc

SEQ ID NO: 668977 - DNA, 25 bp, Mus musculus
gtacttctgcgtgtgagctttgttc

SEQ ID NO: 668978 - DNA, 25 bp, Mus musculus
gtacttctgctgagggatgtctgat

SEQ ID NO: 668979 - DNA, 25 bp, Mus musculus
gtacttctgctgtgggatgtctgat

SEQ ID NO: 668980 - DNA, 25 bp, Mus musculus
gtacttctggctacagttctttctg

SEQ ID NO: 668981 - DNA, 25 bp, Mus musculus
gtacttctggcttcagttctttctg

SEQ ID NO: 668982 - DNA, 25 bp, Mus musculus
gtacttctggtcactgagctggagg

SEQ ID NO: 668983 - DNA, 25 bp, Mus musculus
gtacttctggtctctgagctggagg

SEQ ID NO: 668984 - DNA, 25 bp, Mus musculus
gtacttctgtgccaaattgagcatc

SEQ ID NO: 668985 - DNA, 25 bp, Mus musculus
gtacttctgtgcgaaattgagcatc

SEQ ID NO: 668986 - DNA, 25 bp, Mus musculus
gtacttcttcacacatgtaaacatg

SEQ ID NO: 668987 - DNA, 25 bp, Mus musculus
gtacttcttcactcatgtaaacatg

SEQ ID NO: 668988 - DNA, 25 bp, Mus musculus
gtacttcttcctagatgaacggctg

SEQ ID NO: 668989 - DNA, 25 bp, Mus musculus
gtacttcttccttgatgaacggctg

SEQ ID NO: 668990 - DNA, 25 bp, Mus musculus
gtacttcttgttctttctgcttcaa

SEQ ID NO: 668991 - DNA, 25 bp, Mus musculus
gtacttcttgttgtttctgcttcaa

SEQ ID NO: 668992 - DNA, 25 bp, Mus musculus
gtacttctttacctttcagaaagca

SEQ ID NO: 668993 - DNA, 25 bp, Mus musculus
gtacttctttacgtttcagaaagca

SEQ ID NO: 668994 - DNA, 25 bp, Mus musculus
gtacttctttgcctttttgtgcttg

SEQ ID NO: 668995 - DNA, 25 bp, Mus musculus
gtacttctttgcgtttttgtgcttg

SEQ ID NO: 668996 - DNA, 25 bp, Mus musculus
gtacttgaacatactatggtagagt

SEQ ID NO: 668997 - DNA, 25 bp, Mus musculus
gtacttgaacattctatggtagagt

SEQ ID NO: 668998 - DNA, 25 bp, Mus musculus
gtacttgaaccgcaagcactgcata

SEQ ID NO: 668999 - DNA, 25 bp, Mus musculus
gtacttgaaccggaagcactgcata

SEQ ID NO: 669000 - DNA, 25 bp, Mus musculus
gtacttgaactcagcctaactataa

SEQ ID NO: 669001 - DNA, 25 bp, Mus musculus
gtacttgaactctgcctaactataa

SEQ ID NO: 669002 - DNA, 25 bp, Mus musculus
gtacttgacccaatcgagggacctg

SEQ ID NO: 669003 - DNA, 25 bp, Mus musculus
gtacttgacccattcgagggacctg

SEQ ID NO: 669004 - DNA, 25 bp, Mus musculus
gtacttgactgtcccaatttgctgt

SEQ ID NO: 669005 - DNA, 25 bp, Mus musculus
gtacttgactgtgccaatttgctgt

SEQ ID NO: 669006 - DNA, 25 bp, Mus musculus
gtacttgacttgagcgacttcctta

SEQ ID NO: 669007 - DNA, 25 bp, Mus musculus
gtacttgacttgagcgatttaatag

SEQ ID NO: 669008 - DNA, 25 bp, Mus musculus
gtacttgacttgtgcgacttcctta

SEQ ID NO: 669009 - DNA, 25 bp, Mus musculus
gtacttgacttgtgcgatttaatag

SEQ ID NO: 669010 - DNA, 25 bp, Mus musculus
gtacttgagcccatgcctgtgaaga

SEQ ID NO: 669011 - DNA, 25 bp, Mus musculus
gtacttgagcccttgcctgtgaaga

SEQ ID NO: 669012 - DNA, 25 bp, Mus musculus
gtacttgagcttcgtgacagcgtca

SEQ ID NO: 669013 - DNA, 25 bp, Mus musculus
gtacttgagcttggtgacagcgtca

SEQ ID NO: 669014 - DNA, 25 bp, Mus musculus
gtacttgagggccttggctcccgca

SEQ ID NO: 669015 - DNA, 25 bp, Mus musculus
gtacttgagggcgttggctcccgca

SEQ ID NO: 669016 - DNA, 25 bp, Mus musculus
gtacttgagtccatattgttcctat

SEQ ID NO: 669017 - DNA, 25 bp, Mus musculus
gtacttgagtccttattgttcctat

SEQ ID NO: 669018 - DNA, 25 bp, Mus musculus
gtacttgatgagacgccctagaggt

SEQ ID NO: 669019 - DNA, 25 bp, Mus musculus
gtacttgatgagtcgccctagaggt

SEQ ID NO: 669020 - DNA, 25 bp, Mus musculus
gtacttgatgtgcactactctccca

SEQ ID NO: 669021 - DNA, 25 bp, Mus musculus
gtacttgatgtggactactctccca

SEQ ID NO: 669022 - DNA, 25 bp, Mus musculus
gtacttgatttgagtcttctctttc

SEQ ID NO: 669023 - DNA, 25 bp, Mus musculus
gtacttgatttgatgtgtgacttct

SEQ ID NO: 669024 - DNA, 25 bp, Mus musculus
gtacttgatttgtgtcttctctttc

SEQ ID NO: 669025 - DNA, 25 bp, Mus musculus
gtacttgatttgttgtgtgacttct

SEQ ID NO: 669026 - DNA, 25 bp, Mus musculus
gtacttgcagcaattttaaggaact

SEQ ID NO: 669027 - DNA, 25 bp, Mus musculus
gtacttgcagcatttttaaggaact

SEQ ID NO: 669028 - DNA, 25 bp, Mus musculus
gtacttgcatggagttgtgtgaact

SEQ ID NO: 669029 - DNA, 25 bp, Mus musculus
gtacttgcatggctgacttctcaaa

SEQ ID NO: 669030 - DNA, 25 bp, Mus musculus
gtacttgcatgggtgacttctcaaa

SEQ ID NO: 669031 - DNA, 25 bp, Mus musculus
gtacttgcatggtgttgtgtgaact

SEQ ID NO: 669032 - DNA, 25 bp, Mus musculus
gtacttgccatccaggtagctgaca

SEQ ID NO: 669033 - DNA, 25 bp, Mus musculus
gtacttgccatcgaggtagctgaca

SEQ ID NO: 669034 - DNA, 25 bp, Mus musculus
gtacttgccattctgaggtcagagt

SEQ ID NO: 669035 - DNA, 25 bp, Mus musculus
gtacttgccattgtgaggtcagagt

SEQ ID NO: 669036 - DNA, 25 bp, Mus musculus
gtacttgcccatcgaatgaatctca

SEQ ID NO: 669037 - DNA, 25 bp, Mus musculus
gtacttgcccatggaatgaatctca

SEQ ID NO: 669038 - DNA, 25 bp, Mus musculus
gtacttgccccaccattaagaaggg

SEQ ID NO: 669039 - DNA, 25 bp, Mus musculus
gtacttgccccagcattaagaaggg

SEQ ID NO: 669040 - DNA, 25 bp, Mus musculus
gtacttgcctcacagaacctcagag

SEQ ID NO: 669041 - DNA, 25 bp, Mus musculus
gtacttgcctcagagaacctcagag

SEQ ID NO: 669042 - DNA, 25 bp, Mus musculus
gtacttgcctctattaaatgctcag

SEQ ID NO: 669043 - DNA, 25 bp, Mus musculus
gtacttgcctcttttaaatgctcag

SEQ ID NO: 669044 - DNA, 25 bp, Mus musculus
gtacttgctagtcataacctgacat

SEQ ID NO: 669045 - DNA, 25 bp, Mus musculus
gtacttgctagtgataacctgacat

SEQ ID NO: 669046 - DNA, 25 bp, Mus musculus
gtacttgctatacaaccagaaactg

SEQ ID NO: 669047 - DNA, 25 bp, Mus musculus
gtacttgctatagaaccagaaactg

SEQ ID NO: 669048 - DNA, 25 bp, Mus musculus
gtacttgctatgaggagtccaggct

SEQ ID NO: 669049 - DNA, 25 bp, Mus musculus
gtacttgctatgtggagtccaggct

SEQ ID NO: 669050 - DNA, 25 bp, Mus musculus
gtacttgctcctcgcctgtgtgtat

SEQ ID NO: 669051 - DNA, 25 bp, Mus musculus
gtacttgctcctggcctgtgtgtat

SEQ ID NO: 669052 - DNA, 25 bp, Mus musculus
gtacttgctgctattaggctctcaa

SEQ ID NO: 669053 - DNA, 25 bp, Mus musculus
gtacttgctgcttttaggctctcaa

SEQ ID NO: 669054 - DNA, 25 bp, Mus musculus
gtacttgctggactcaaatacctgg

SEQ ID NO: 669055 - DNA, 25 bp, Mus musculus
gtacttgctggagtcaaatacctgg

SEQ ID NO: 669056 - DNA, 25 bp, Mus musculus
gtacttgctgggactcacctaagaa

SEQ ID NO: 669057 - DNA, 25 bp, Mus musculus
gtacttgctgggtctcacctaagaa

SEQ ID NO: 669058 - DNA, 25 bp, Mus musculus
gtacttgctgttatgcatgggtcat

SEQ ID NO: 669059 - DNA, 25 bp, Mus musculus
gtacttgctgttttgcatgggtcat

SEQ ID NO: 669060 - DNA, 25 bp, Mus musculus
gtacttgcttgaacagttttattgt

SEQ ID NO: 669061 - DNA, 25 bp, Mus musculus
gtacttgcttgatcagttttattgt

SEQ ID NO: 669062 - DNA, 25 bp, Mus musculus
gtacttgctttcagcagttaaacac

SEQ ID NO: 669063 - DNA, 25 bp, Mus musculus
gtacttgctttctgcagttaaacac

SEQ ID NO: 669064 - DNA, 25 bp, Mus musculus
gtacttgcttttcaaactgtagaat

SEQ ID NO: 669065 - DNA, 25 bp, Mus musculus
gtacttgcttttgaaactgtagaat

SEQ ID NO: 669066 - DNA, 25 bp, Mus musculus
gtacttggaaagacacttgtctcct

SEQ ID NO: 669067 - DNA, 25 bp, Mus musculus
gtacttggaaagtcacttgtctcct

SEQ ID NO: 669068 - DNA, 25 bp, Mus musculus
gtacttggaacacctacctgcacag

SEQ ID NO: 669069 - DNA, 25 bp, Mus musculus
gtacttggaacagctacctgcacag

SEQ ID NO: 669070 - DNA, 25 bp, Mus musculus
gtacttggaagtcaaggccagcttc

SEQ ID NO: 669071 - DNA, 25 bp, Mus musculus
gtacttggaagtgaaggccagcttc

SEQ ID NO: 669072 - DNA, 25 bp, Mus musculus
gtacttggacttcacttacttattt

SEQ ID NO: 669073 - DNA, 25 bp, Mus musculus
gtacttggacttgacttacttattt

SEQ ID NO: 669074 - DNA, 25 bp, Mus musculus
gtacttggatagcaattctctgatt

SEQ ID NO: 669075 - DNA, 25 bp, Mus musculus
gtacttggataggaattctctgatt

SEQ ID NO: 669076 - DNA, 25 bp, Mus musculus
gtacttggatcgctttgtctctaga

SEQ ID NO: 669077 - DNA, 25 bp, Mus musculus
gtacttggatcggtttgtctctaga

SEQ ID NO: 669078 - DNA, 25 bp, Mus musculus
gtacttggccatctccaccacgtga

SEQ ID NO: 669079 - DNA, 25 bp, Mus musculus
gtacttggccatgtccaccacgtga

SEQ ID NO: 669080 - DNA, 25 bp, Mus musculus
gtacttggctacacagattgtattt

SEQ ID NO: 669081 - DNA, 25 bp, Mus musculus
gtacttggctactcagattgtattt

SEQ ID NO: 669082 - DNA, 25 bp, Mus musculus
gtacttggctatctgcactgtttta

SEQ ID NO: 669083 - DNA, 25 bp, Mus musculus
gtacttggctatgtgcactgtttta

SEQ ID NO: 669084 - DNA, 25 bp, Mus musculus
gtacttggcttacttgggttgttat

SEQ ID NO: 669085 - DNA, 25 bp, Mus musculus
gtacttggcttagttgggttgttat

SEQ ID NO: 669086 - DNA, 25 bp, Mus musculus
gtacttggcttcatataagtgttta

SEQ ID NO: 669087 - DNA, 25 bp, Mus musculus
gtacttggcttcttataagtgttta

SEQ ID NO: 669088 - DNA, 25 bp, Mus musculus
gtacttgggatccaactccagttgt

SEQ ID NO: 669089 - DNA, 25 bp, Mus musculus
gtacttgggatcgaactccagttgt

SEQ ID NO: 669090 - DNA, 25 bp, Mus musculus
gtacttggtaagctggtttctttgc

SEQ ID NO: 669091 - DNA, 25 bp, Mus musculus
gtacttggtaaggtggtttctttgc

SEQ ID NO: 669092 - DNA, 25 bp, Mus musculus
gtacttggtaccatgaacgagtgga

SEQ ID NO: 669093 - DNA, 25 bp, Mus musculus
gtacttggtaccttgaacgagtgga

SEQ ID NO: 669094 - DNA, 25 bp, Mus musculus
gtacttggtcacaatttggactcta

SEQ ID NO: 669095 - DNA, 25 bp, Mus musculus
gtacttggtcactatttggactcta

SEQ ID NO: 669096 - DNA, 25 bp, Mus musculus
gtacttggtcccacatgtaagtgta

SEQ ID NO: 669097 - DNA, 25 bp, Mus musculus
gtacttggtccctcatgtaagtgta

SEQ ID NO: 669098 - DNA, 25 bp, Mus musculus
gtacttggtgggagcatttaacctt

SEQ ID NO: 669099 - DNA, 25 bp, Mus musculus
gtacttggtgggtgcatttaacctt

SEQ ID NO: 669100 - DNA, 25 bp, Mus musculus
gtacttggtgttagcagcctgtgca

SEQ ID NO: 669101 - DNA, 25 bp, Mus musculus
gtacttggtgtttgcagcctgtgca

SEQ ID NO: 669102 - DNA, 25 bp, Mus musculus
gtacttggttgtatggttagcctat

SEQ ID NO: 669103 - DNA, 25 bp, Mus musculus
gtacttggttgtttggttagcctat

SEQ ID NO: 669104 - DNA, 25 bp, Mus musculus
gtacttgtaaggatagtctccagca

SEQ ID NO: 669105 - DNA, 25 bp, Mus musculus
gtacttgtaaggttagtctccagca

SEQ ID NO: 669106 - DNA, 25 bp, Mus musculus
gtacttgtaggccatagtgcaggca

SEQ ID NO: 669107 - DNA, 25 bp, Mus musculus
gtacttgtaggcgatagtgcaggca

SEQ ID NO: 669108 - DNA, 25 bp, Mus musculus
gtacttgtcctgagaggagcatgca

SEQ ID NO: 669109 - DNA, 25 bp, Mus musculus
gtacttgtcctgtgaggagcatgca

SEQ ID NO: 669110 - DNA, 25 bp, Mus musculus
gtacttgtgaagacaccacgttttc

SEQ ID NO: 669111 - DNA, 25 bp, Mus musculus
gtacttgtgaagtcaccacgttttc

SEQ ID NO: 669112 - DNA, 25 bp, Mus musculus
gtacttgtgctgcagaacacttgaa

SEQ ID NO: 669113 - DNA, 25 bp, Mus musculus
gtacttgtgctggagaacacttgaa

SEQ ID NO: 669114 - DNA, 25 bp, Mus musculus
gtacttgtgggtatggtcactgatg

SEQ ID NO: 669115 - DNA, 25 bp, Mus musculus
gtacttgtgggtttggtcactgatg

SEQ ID NO: 669116 - DNA, 25 bp, Mus musculus
gtacttgtggtaactgcactcttca

SEQ ID NO: 669117 - DNA, 25 bp, Mus musculus
gtacttgtggtatctgcactcttca

SEQ ID NO: 669118 - DNA, 25 bp, Mus musculus
gtacttgttcacatgcactgacgag

SEQ ID NO: 669119 - DNA, 25 bp, Mus musculus
gtacttgttcacttgcactgacgag

SEQ ID NO: 669120 - DNA, 25 bp, Mus musculus
gtacttgttccacaaggctcgatcc

SEQ ID NO: 669121 - DNA, 25 bp, Mus musculus
gtacttgttccagaaggctcgatcc

SEQ ID NO: 669122 - DNA, 25 bp, Mus musculus
gtacttgttgcacccgacgtcgaag

SEQ ID NO: 669123 - DNA, 25 bp, Mus musculus
gtacttgttgcagccgacgtcgaag

SEQ ID NO: 669124 - DNA, 25 bp, Mus musculus
gtacttgttggaacccacatcgaag

SEQ ID NO: 669125 - DNA, 25 bp, Mus musculus
gtacttgttggatcccacatcgaag

SEQ ID NO: 669126 - DNA, 25 bp, Mus musculus
gtacttgttgttcgtctgtttggag

SEQ ID NO: 669127 - DNA, 25 bp, Mus musculus
gtacttgttgttggtctgtttggag

SEQ ID NO: 669128 - DNA, 25 bp, Mus musculus
gtactttaactcaggcttgcaggta

SEQ ID NO: 669129 - DNA, 25 bp, Mus musculus
gtactttaactctggcttgcaggta

SEQ ID NO: 669130 - DNA, 25 bp, Mus musculus
gtactttaatataggatactacctc

SEQ ID NO: 669131 - DNA, 25 bp, Mus musculus
gtactttaatattggatactacctc

SEQ ID NO: 669132 - DNA, 25 bp, Mus musculus
gtactttacggactgaatcatctca

SEQ ID NO: 669133 - DNA, 25 bp, Mus musculus
gtactttacggagtgaatcatctca

SEQ ID NO: 669134 - DNA, 25 bp, Mus musculus
gtactttacgtaagagcgcattcag

SEQ ID NO: 669135 - DNA, 25 bp, Mus musculus
gtactttacgtatgagcgcattcag

SEQ ID NO: 669136 - DNA, 25 bp, Mus musculus
gtactttactgtctccacataggtg

SEQ ID NO: 669137 - DNA, 25 bp, Mus musculus
gtactttactgtgtccacataggtg

SEQ ID NO: 669138 - DNA, 25 bp, Mus musculus
gtactttacttaaatcctctggaat

SEQ ID NO: 669139 - DNA, 25 bp, Mus musculus
gtactttacttatatcctctggaat

SEQ ID NO: 669140 - DNA, 25 bp, Mus musculus
gtactttagtagagcacctttgctt

SEQ ID NO: 669141 - DNA, 25 bp, Mus musculus
gtactttagtagtgcacctttgctt

SEQ ID NO: 669142 - DNA, 25 bp, Mus musculus
gtactttagtgacggagtgaccaaa

SEQ ID NO: 669143 - DNA, 25 bp, Mus musculus
gtactttagtgagggagtgaccaaa

SEQ ID NO: 669144 - DNA, 25 bp, Mus musculus
gtactttatatgacttacaggtctt

SEQ ID NO: 669145 - DNA, 25 bp, Mus musculus
gtactttatatgtcttacaggtctt

SEQ ID NO: 669146 - DNA, 25 bp, Mus musculus
gtactttatgcactctagctttgtg

SEQ ID NO: 669147 - DNA, 25 bp, Mus musculus
gtactttatgcagtctagctttgtg

SEQ ID NO: 669148 - DNA, 25 bp, Mus musculus
gtactttattcccatctctgttggt

SEQ ID NO: 669149 - DNA, 25 bp, Mus musculus
gtactttattccgatctctgttggt

SEQ ID NO: 669150 - DNA, 25 bp, Mus musculus
gtactttcaagccagaatccctcct

SEQ ID NO: 669151 - DNA, 25 bp, Mus musculus
gtactttcaagcgagaatccctcct

SEQ ID NO: 669152 - DNA, 25 bp, Mus musculus
gtactttcaagtagcctgttaccta

SEQ ID NO: 669153 - DNA, 25 bp, Mus musculus
gtactttcaagttgcctgttaccta

SEQ ID NO: 669154 - DNA, 25 bp, Mus musculus
gtactttcacatctgccgatactta

SEQ ID NO: 669155 - DNA, 25 bp, Mus musculus
gtactttcacatgtgccgatactta

SEQ ID NO: 669156 - DNA, 25 bp, Mus musculus
gtactttcaggaagggcggagccat

SEQ ID NO: 669157 - DNA, 25 bp, Mus musculus
gtactttcaggatgggcggagccat

SEQ ID NO: 669158 - DNA, 25 bp, Mus musculus
gtactttcccaaacagagcagcaca

SEQ ID NO: 669159 - DNA, 25 bp, Mus musculus
gtactttcccaatcagagcagcaca

SEQ ID NO: 669160 - DNA, 25 bp, Mus musculus
gtactttccgtgaataacctgctgt

SEQ ID NO: 669161 - DNA, 25 bp, Mus musculus
gtactttccgtgtataacctgctgt

SEQ ID NO: 669162 - DNA, 25 bp, Mus musculus
gtactttcctacaatttagcacttt

SEQ ID NO: 669163 - DNA, 25 bp, Mus musculus
gtactttcctactatttagcacttt

SEQ ID NO: 669164 - DNA, 25 bp, Mus musculus
gtactttcctttcgatgctttccat

SEQ ID NO: 669165 - DNA, 25 bp, Mus musculus
gtactttcctttggatgctttccat

SEQ ID NO: 669166 - DNA, 25 bp, Mus musculus
gtactttcggttagtttgccacagc

SEQ ID NO: 669167 - DNA, 25 bp, Mus musculus
gtactttcggtttgtttgccacagc

SEQ ID NO: 669168 - DNA, 25 bp, Mus musculus
gtactttctaacactgcaaagaatt

SEQ ID NO: 669169 - DNA, 25 bp, Mus musculus
gtactttctaactctgcaaagaatt

SEQ ID NO: 669170 - DNA, 25 bp, Mus musculus
gtactttctacacgtgaaccttttg

SEQ ID NO: 669171 - DNA, 25 bp, Mus musculus
gtactttctacaggtgaaccttttg

SEQ ID NO: 669172 - DNA, 25 bp, Mus musculus
gtactttctatgatgtgaattcttg

SEQ ID NO: 669173 - DNA, 25 bp, Mus musculus
gtactttctatgttgtgaattcttg

SEQ ID NO: 669174 - DNA, 25 bp, Mus musculus
gtactttctcacatgcaggaagcct

SEQ ID NO: 669175 - DNA, 25 bp, Mus musculus
gtactttctcacttgcaggaagcct

SEQ ID NO: 669176 - DNA, 25 bp, Mus musculus
gtactttctgtacttgggagggaat

SEQ ID NO: 669177 - DNA, 25 bp, Mus musculus
gtactttctgtagttgggagggaat

SEQ ID NO: 669178 - DNA, 25 bp, Mus musculus
gtactttcttacatgtctgtgcctt

SEQ ID NO: 669179 - DNA, 25 bp, Mus musculus
gtactttcttacttgtctgtgcctt

SEQ ID NO: 669180 - DNA, 25 bp, Mus musculus
gtactttcttcacccgagctttcat

SEQ ID NO: 669181 - DNA, 25 bp, Mus musculus
gtactttcttcagccgagctttcat

SEQ ID NO: 669182 - DNA, 25 bp, Mus musculus
gtactttcttggacatatctcagag

SEQ ID NO: 669183 - DNA, 25 bp, Mus musculus
gtactttcttggtcatatctcagag

SEQ ID NO: 669184 - DNA, 25 bp, Mus musculus
gtactttgaaagctcacctgccagg

SEQ ID NO: 669185 - DNA, 25 bp, Mus musculus
gtactttgaaaggtcacctgccagg

SEQ ID NO: 669186 - DNA, 25 bp, Mus musculus
gtactttgaggcattatactacctg

SEQ ID NO: 669187 - DNA, 25 bp, Mus musculus
gtactttgaggctttatactacctg

SEQ ID NO: 669188 - DNA, 25 bp, Mus musculus
gtactttgagttcgagtttgaggcc

SEQ ID NO: 669189 - DNA, 25 bp, Mus musculus
gtactttgagttggagtttgaggcc

SEQ ID NO: 669190 - DNA, 25 bp, Mus musculus
gtactttgcaaaagaaccttccgaa

SEQ ID NO: 669191 - DNA, 25 bp, Mus musculus
gtactttgcaaatgaaccttccgaa

SEQ ID NO: 669192 - DNA, 25 bp, Mus musculus
gtactttgcgctcccaacgaaggaa

SEQ ID NO: 669193 - DNA, 25 bp, Mus musculus
gtactttgcgctgccaacgaaggaa

SEQ ID NO: 669194 - DNA, 25 bp, Mus musculus
gtactttgctttcaagtattcatgt

SEQ ID NO: 669195 - DNA, 25 bp, Mus musculus
gtactttgctttgaagtattcatgt

SEQ ID NO: 669196 - DNA, 25 bp, Mus musculus
gtactttggtggaaatgtctctagc

SEQ ID NO: 669197 - DNA, 25 bp, Mus musculus
gtactttggtggtaatgtctctagc

SEQ ID NO: 669198 - DNA, 25 bp, Mus musculus
gtactttggttaaatgatgctttct

SEQ ID NO: 669199 - DNA, 25 bp, Mus musculus
gtactttggttatatgatgctttct

SEQ ID NO: 669200 - DNA, 25 bp, Mus musculus
gtactttgtaccattatgagatgtt

SEQ ID NO: 669201 - DNA, 25 bp, Mus musculus
gtactttgtacctttatgagatgtt

SEQ ID NO: 669202 - DNA, 25 bp, Mus musculus
gtactttgtcctagcagcctgtcag

SEQ ID NO: 669203 - DNA, 25 bp, Mus musculus
gtactttgtccttgcagcctgtcag

SEQ ID NO: 669204 - DNA, 25 bp, Mus musculus
gtactttgtgcaatcatttaatctt

SEQ ID NO: 669205 - DNA, 25 bp, Mus musculus
gtactttgtgcattcatttaatctt

SEQ ID NO: 669206 - DNA, 25 bp, Mus musculus
gtactttgttacacgaatcttacag

SEQ ID NO: 669207 - DNA, 25 bp, Mus musculus
gtactttgttactcgaatcttacag

SEQ ID NO: 669208 - DNA, 25 bp, Mus musculus
gtacttttaaatagcctcagtgata

SEQ ID NO: 669209 - DNA, 25 bp, Mus musculus
gtacttttaaattgcctcagtgata

SEQ ID NO: 669210 - DNA, 25 bp, Mus musculus
gtacttttacatccacttatttgtg

SEQ ID NO: 669211 - DNA, 25 bp, Mus musculus
gtacttttacatgcacttatttgtg

SEQ ID NO: 669212 - DNA, 25 bp, Mus musculus
gtacttttataaagcattgtctaga

SEQ ID NO: 669213 - DNA, 25 bp, Mus musculus
gtacttttataatgcattgtctaga

SEQ ID NO: 669214 - DNA, 25 bp, Mus musculus
gtacttttattgatcatctccattg

SEQ ID NO: 669215 - DNA, 25 bp, Mus musculus
gtacttttattgttcatctccattg

SEQ ID NO: 669216 - DNA, 25 bp, Mus musculus
gtacttttatttcacttatgttgga

SEQ ID NO: 669217 - DNA, 25 bp, Mus musculus
gtacttttatttgacttatgttgga

SEQ ID NO: 669218 - DNA, 25 bp, Mus musculus
gtacttttcaccagcatctttacta

SEQ ID NO: 669219 - DNA, 25 bp, Mus musculus
gtacttttcacctgcatctttacta

SEQ ID NO: 669220 - DNA, 25 bp, Mus musculus
gtacttttcatactgataagctcat

SEQ ID NO: 669221 - DNA, 25 bp, Mus musculus
gtacttttcatagtgataagctcat

SEQ ID NO: 669222 - DNA, 25 bp, Mus musculus
gtacttttcctgaaactactgagac

SEQ ID NO: 669223 - DNA, 25 bp, Mus musculus
gtacttttcctgtaactactgagac

SEQ ID NO: 669224 - DNA, 25 bp, Mus musculus
gtacttttgagaactttacctgaca

SEQ ID NO: 669225 - DNA, 25 bp, Mus musculus
gtacttttgagatctttacctgaca

SEQ ID NO: 669226 - DNA, 25 bp, Mus musculus
gtacttttgcagactctcatgtggt

SEQ ID NO: 669227 - DNA, 25 bp, Mus musculus
gtacttttgcagtctctcatgtggt

SEQ ID NO: 669228 - DNA, 25 bp, Mus musculus
gtacttttgggaaatttcaacttca

SEQ ID NO: 669229 - DNA, 25 bp, Mus musculus
gtacttttgggatatttcaacttca

SEQ ID NO: 669230 - DNA, 25 bp, Mus musculus
gtacttttgtgcaagttctggctaa

SEQ ID NO: 669231 - DNA, 25 bp, Mus musculus
gtacttttgtgctagttctggctaa

SEQ ID NO: 669232 - DNA, 25 bp, Mus musculus
gtactttttattcaactctgaactt

SEQ ID NO: 669233 - DNA, 25 bp, Mus musculus
gtactttttattgaactctgaactt

SEQ ID NO: 669234 - DNA, 25 bp, Mus musculus
gtacttttttcacagccagggtcaa

SEQ ID NO: 669235 - DNA, 25 bp, Mus musculus
gtacttttttcagagccagggtcaa

SEQ ID NO: 669236 - DNA, 25 bp, Mus musculus
gtacttttttggaccgagactgctc

SEQ ID NO: 669237 - DNA, 25 bp, Mus musculus
gtacttttttggtccgagactgctc

SEQ ID NO: 669238 - DNA, 25 bp, Mus musculus
gtagaaaaaattagcccccatgctt

SEQ ID NO: 669239 - DNA, 25 bp, Mus musculus
gtagaaaaaatttgcccccatgctt

SEQ ID NO: 669240 - DNA, 25 bp, Mus musculus
gtagaaaacagccacccaaccagac

SEQ ID NO: 669241 - DNA, 25 bp, Mus musculus
gtagaaaacagcgacccaaccagac

SEQ ID NO: 669242 - DNA, 25 bp, Mus musculus
gtagaaaacccacgcacttgctcat

SEQ ID NO: 669243 - DNA, 25 bp, Mus musculus
gtagaaaacccaggcacttgctcat

SEQ ID NO: 669244 - DNA, 25 bp, Mus musculus
gtagaaaactagacctcaagaatgc

SEQ ID NO: 669245 - DNA, 25 bp, Mus musculus
gtagaaaactagtcctcaagaatgc

SEQ ID NO: 669246 - DNA, 25 bp, Mus musculus
gtagaaaactgcagatcggcttgtc

SEQ ID NO: 669247 - DNA, 25 bp, Mus musculus
gtagaaaactgcattgtttgcccat

SEQ ID NO: 669248 - DNA, 25 bp, Mus musculus
gtagaaaactgctgatcggcttgtc

SEQ ID NO: 669249 - DNA, 25 bp, Mus musculus
gtagaaaactgctttgtttgcccat

SEQ ID NO: 669250 - DNA, 25 bp, Mus musculus
gtagaaaagaaaccagcccctatac

SEQ ID NO: 669251 - DNA, 25 bp, Mus musculus
gtagaaaagaaagcagcccctatac

SEQ ID NO: 669252 - DNA, 25 bp, Mus musculus
gtagaaaagcggacccatccatatt

SEQ ID NO: 669253 - DNA, 25 bp, Mus musculus
gtagaaaagcggtcccatccatatt

SEQ ID NO: 669254 - DNA, 25 bp, Mus musculus
gtagaaaagctcacagtaggtaata

SEQ ID NO: 669255 - DNA, 25 bp, Mus musculus
gtagaaaagctctcagtaggtaata

SEQ ID NO: 669256 - DNA, 25 bp, Mus musculus
gtagaaacacaaccatgagcaccgt

SEQ ID NO: 669257 - DNA, 25 bp, Mus musculus
gtagaaacacaagcatgagcaccgt

SEQ ID NO: 669258 - DNA, 25 bp, Mus musculus
gtagaaacacagaagggcttacctc

SEQ ID NO: 669259 - DNA, 25 bp, Mus musculus
gtagaaacacagtagggcttacctc

SEQ ID NO: 669260 - DNA, 25 bp, Mus musculus
gtagaaacaccaatgtcaagagttg

SEQ ID NO: 669261 - DNA, 25 bp, Mus musculus
gtagaaacaccattgtcaagagttg

SEQ ID NO: 669262 - DNA, 25 bp, Mus musculus
gtagaaaccaacatctcaggcgatt

SEQ ID NO: 669263 - DNA, 25 bp, Mus musculus
gtagaaaccaacttctcaggcgatt

SEQ ID NO: 669264 - DNA, 25 bp, Mus musculus
gtagaaacccctatggaatgaaaag

SEQ ID NO: 669265 - DNA, 25 bp, Mus musculus
gtagaaacccctttggaatgaaaag

SEQ ID NO: 669266 - DNA, 25 bp, Mus musculus
gtagaaacggagcttcaaacataca

SEQ ID NO: 669267 - DNA, 25 bp, Mus musculus
gtagaaacggaggttcaaacataca

SEQ ID NO: 669268 - DNA, 25 bp, Mus musculus
gtagaaacgtacacccaagatgggt

SEQ ID NO: 669269 - DNA, 25 bp, Mus musculus
gtagaaacgtactcccaagatgggt

SEQ ID NO: 669270 - DNA, 25 bp, Mus musculus
gtagaaactcagaacctgcagagaa

SEQ ID NO: 669271 - DNA, 25 bp, Mus musculus
gtagaaactcagtacctgcagagaa

SEQ ID NO: 669272 - DNA, 25 bp, Mus musculus
gtagaaactcatccaggctgccact

SEQ ID NO: 669273 - DNA, 25 bp, Mus musculus
gtagaaactcatgcaggctgccact

SEQ ID NO: 669274 - DNA, 25 bp, Mus musculus
gtagaaactgctcgccgagacctgc

SEQ ID NO: 669275 - DNA, 25 bp, Mus musculus
gtagaaactgctggccgagacctgc

SEQ ID NO: 669276 - DNA, 25 bp, Mus musculus
gtagaaacttcaaaaggcaggtggc

SEQ ID NO: 669277 - DNA, 25 bp, Mus musculus
gtagaaacttcataaggcaggtggc

SEQ ID NO: 669278 - DNA, 25 bp, Mus musculus
gtagaaacttgcagatgcccttctg

SEQ ID NO: 669279 - DNA, 25 bp, Mus musculus
gtagaaacttgctgatgcccttctg

SEQ ID NO: 669280 - DNA, 25 bp, Mus musculus
gtagaaagaccacacaacccatcct

SEQ ID NO: 669281 - DNA, 25 bp, Mus musculus
gtagaaagaccagacaacccatcct

SEQ ID NO: 669282 - DNA, 25 bp, Mus musculus
gtagaaagacccaccaaattactag

SEQ ID NO: 669283 - DNA, 25 bp, Mus musculus
gtagaaagaccctccaaattactag

SEQ ID NO: 669284 - DNA, 25 bp, Mus musculus
gtagaaagcattcttgagcccagaa

SEQ ID NO: 669285 - DNA, 25 bp, Mus musculus
gtagaaagcattgttgagcccagaa

SEQ ID NO: 669286 - DNA, 25 bp, Mus musculus
gtagaaagctctagtaatccctaga

SEQ ID NO: 669287 - DNA, 25 bp, Mus musculus
gtagaaagctcttgtaatccctaga

SEQ ID NO: 669288 - DNA, 25 bp, Mus musculus
gtagaaaggaccacatgtgccatcc

SEQ ID NO: 669289 - DNA, 25 bp, Mus musculus
gtagaaaggacctcatgtgccatcc

SEQ ID NO: 669290 - DNA, 25 bp, Mus musculus
gtagaaaggccactcacttcttgcc

SEQ ID NO: 669291 - DNA, 25 bp, Mus musculus
gtagaaaggccagtcacttcttgcc

SEQ ID NO: 669292 - DNA, 25 bp, Mus musculus
gtagaaaggctcagtggcataatat

SEQ ID NO: 669293 - DNA, 25 bp, Mus musculus
gtagaaaggctctgtggcataatat

SEQ ID NO: 669294 - DNA, 25 bp, Mus musculus
gtagaaaggtgtcctaacgtggcca

SEQ ID NO: 669295 - DNA, 25 bp, Mus musculus
gtagaaaggtgtgctaacgtggcca

SEQ ID NO: 669296 - DNA, 25 bp, Mus musculus
gtagaaagtatgcatctggctttga

SEQ ID NO: 669297 - DNA, 25 bp, Mus musculus
gtagaaagtatggatctggctttga

SEQ ID NO: 669298 - DNA, 25 bp, Mus musculus
gtagaaataagcatttcacaatatt

SEQ ID NO: 669299 - DNA, 25 bp, Mus musculus
gtagaaataagcttttcacaatatt

SEQ ID NO: 669300 - DNA, 25 bp, Mus musculus
gtagaaatcgttcccactctaagaa

SEQ ID NO: 669301 - DNA, 25 bp, Mus musculus
gtagaaatcgttgccactctaagaa

SEQ ID NO: 669302 - DNA, 25 bp, Mus musculus
gtagaaatgtctcctgggatggaaa

SEQ ID NO: 669303 - DNA, 25 bp, Mus musculus
gtagaaatgtctgctgggatggaaa

SEQ ID NO: 669304 - DNA, 25 bp, Mus musculus
gtagaaattacaatcgccagcttat

SEQ ID NO: 669305 - DNA, 25 bp, Mus musculus
gtagaaattacattcgccagcttat

SEQ ID NO: 669306 - DNA, 25 bp, Mus musculus
gtagaaattatcacaggtgacccaa

SEQ ID NO: 669307 - DNA, 25 bp, Mus musculus
gtagaaattatctcaggtgacccaa

SEQ ID NO: 669308 - DNA, 25 bp, Mus musculus
gtagaaattgacacagggcctggga

SEQ ID NO: 669309 - DNA, 25 bp, Mus musculus
gtagaaattgactcagggcctggga

SEQ ID NO: 669310 - DNA, 25 bp, Mus musculus
gtagaaatttctacctcctacattt

SEQ ID NO: 669311 - DNA, 25 bp, Mus musculus
gtagaaatttcttcctcctacattt

SEQ ID NO: 669312 - DNA, 25 bp, Mus musculus
gtagaacacctaatgggatcctgaa

SEQ ID NO: 669313 - DNA, 25 bp, Mus musculus
gtagaacacctattgggatcctgaa

SEQ ID NO: 669314 - DNA, 25 bp, Mus musculus
gtagaacagtctcctattcattttt

SEQ ID NO: 669315 - DNA, 25 bp, Mus musculus
gtagaacagtctgctattcattttt

SEQ ID NO: 669316 - DNA, 25 bp, Mus musculus
gtagaacatatgctagtggatcccc

SEQ ID NO: 669317 - DNA, 25 bp, Mus musculus
gtagaacatatggtagtggatcccc

SEQ ID NO: 669318 - DNA, 25 bp, Mus musculus
gtagaaccagacatccggtcaatct

SEQ ID NO: 669319 - DNA, 25 bp, Mus musculus
gtagaaccagacttccggtcaatct

SEQ ID NO: 669320 - DNA, 25 bp, Mus musculus
gtagaaccatctagcagggatccca

SEQ ID NO: 669321 - DNA, 25 bp, Mus musculus
gtagaaccatcttgcagggatccca

SEQ ID NO: 669322 - DNA, 25 bp, Mus musculus
gtagaaccattgataactttcatgt

SEQ ID NO: 669323 - DNA, 25 bp, Mus musculus
gtagaaccattgttaactttcatgt

SEQ ID NO: 669324 - DNA, 25 bp, Mus musculus
gtagaacccaagctccattgcagat

SEQ ID NO: 669325 - DNA, 25 bp, Mus musculus
gtagaacccaaggtccattgcagat

SEQ ID NO: 669326 - DNA, 25 bp, Mus musculus
gtagaacccagacgactccactatg

SEQ ID NO: 669327 - DNA, 25 bp, Mus musculus
gtagaacccagaggactccactatg

SEQ ID NO: 669328 - DNA, 25 bp, Mus musculus
gtagaacccatgatgtatacagttt

SEQ ID NO: 669329 - DNA, 25 bp, Mus musculus
gtagaacccatgttgtatacagttt

SEQ ID NO: 669330 - DNA, 25 bp, Mus musculus
gtagaaccctgaaggtcaactgcaa

SEQ ID NO: 669331 - DNA, 25 bp, Mus musculus
gtagaaccctgatggtcaactgcaa

SEQ ID NO: 669332 - DNA, 25 bp, Mus musculus
gtagaaccggacatgttgctcagaa

SEQ ID NO: 669333 - DNA, 25 bp, Mus musculus
gtagaaccggacttgttgctcagaa

SEQ ID NO: 669334 - DNA, 25 bp, Mus musculus
gtagaacctaccacctttctgataa

SEQ ID NO: 669335 - DNA, 25 bp, Mus musculus
gtagaacctacctcctttctgataa

SEQ ID NO: 669336 - DNA, 25 bp, Mus musculus
gtagaacctgagactttttgtggtt

SEQ ID NO: 669337 - DNA, 25 bp, Mus musculus
gtagaacctgagtctttttgtggtt

SEQ ID NO: 669338 - DNA, 25 bp, Mus musculus
gtagaacctgcactgtcctgactaa

SEQ ID NO: 669339 - DNA, 25 bp, Mus musculus
gtagaacctgcagtgtcctgactaa

SEQ ID NO: 669340 - DNA, 25 bp, Mus musculus
gtagaacctgccctgcttctagtcc

SEQ ID NO: 669341 - DNA, 25 bp, Mus musculus
gtagaacctgccgtgcttctagtcc

SEQ ID NO: 669342 - DNA, 25 bp, Mus musculus
gtagaacctgtgatgcctgctttaa

SEQ ID NO: 669343 - DNA, 25 bp, Mus musculus
gtagaacctgtgttgcctgctttaa

SEQ ID NO: 669344 - DNA, 25 bp, Mus musculus
gtagaacgagtcaaagctgtggcca

SEQ ID NO: 669345 - DNA, 25 bp, Mus musculus
gtagaacgagtctaagctgtggcca

SEQ ID NO: 669346 - DNA, 25 bp, Mus musculus
gtagaacgccttacgtggctagata

SEQ ID NO: 669347 - DNA, 25 bp, Mus musculus
gtagaacgcctttcgtggctagata

SEQ ID NO: 669348 - DNA, 25 bp, Mus musculus
gtagaacggcctattctagctctca

SEQ ID NO: 669349 - DNA, 25 bp, Mus musculus
gtagaacggccttttctagctctca

SEQ ID NO: 669350 - DNA, 25 bp, Mus musculus
gtagaactaaacagcactgaatgta

SEQ ID NO: 669351 - DNA, 25 bp, Mus musculus
gtagaactaaactgcactgaatgta

SEQ ID NO: 669352 - DNA, 25 bp, Mus musculus
gtagaactactgatgcttgcttgct

SEQ ID NO: 669353 - DNA, 25 bp, Mus musculus
gtagaactactgttgcttgcttgct

SEQ ID NO: 669354 - DNA, 25 bp, Mus musculus
gtagaactatgtctggtaacccaaa

SEQ ID NO: 669355 - DNA, 25 bp, Mus musculus
gtagaactatgtgtggtaacccaaa

SEQ ID NO: 669356 - DNA, 25 bp, Mus musculus
gtagaactcattatgctggctgaaa

SEQ ID NO: 669357 - DNA, 25 bp, Mus musculus
gtagaactcattttgctggctgaaa

SEQ ID NO: 669358 - DNA, 25 bp, Mus musculus
gtagaactcgctatcccgtcatata

SEQ ID NO: 669359 - DNA, 25 bp, Mus musculus
gtagaactcgctttcccgtcatata

SEQ ID NO: 669360 - DNA, 25 bp, Mus musculus
gtagaactcgtgaagttgagacaga

SEQ ID NO: 669361 - DNA, 25 bp, Mus musculus
gtagaactcgtgtagttgagacaga

SEQ ID NO: 669362 - DNA, 25 bp, Mus musculus
gtagaactgtaaaaccctctgtgat

SEQ ID NO: 669363 - DNA, 25 bp, Mus musculus
gtagaactgtaataccctctgtgat

SEQ ID NO: 669364 - DNA, 25 bp, Mus musculus
gtagaacttgtaactctcttcccca

SEQ ID NO: 669365 - DNA, 25 bp, Mus musculus
gtagaacttgtatctctcttcccca

SEQ ID NO: 669366 - DNA, 25 bp, Mus musculus
gtagaactttatccactcagacttt

SEQ ID NO: 669367 - DNA, 25 bp, Mus musculus
gtagaactttatgcactcagacttt

SEQ ID NO: 669368 - DNA, 25 bp, Mus musculus
gtagaactttctacagtcactagat

SEQ ID NO: 669369 - DNA, 25 bp, Mus musculus
gtagaactttcttcagtcactagat

SEQ ID NO: 669370 - DNA, 25 bp, Mus musculus
gtagaagaatctccatcagcccgca

SEQ ID NO: 669371 - DNA, 25 bp, Mus musculus
gtagaagaatctgcatcagcccgca

SEQ ID NO: 669372 - DNA, 25 bp, Mus musculus
gtagaagaattcagttttatcaccc

SEQ ID NO: 669373 - DNA, 25 bp, Mus musculus
gtagaagaattctgttttatcaccc

SEQ ID NO: 669374 - DNA, 25 bp, Mus musculus
gtagaagactgaagcaaatcctaaa

SEQ ID NO: 669375 - DNA, 25 bp, Mus musculus
gtagaagactgatgcaaatcctaaa

SEQ ID NO: 669376 - DNA, 25 bp, Mus musculus
gtagaagagagtatcaacaggctga

SEQ ID NO: 669377 - DNA, 25 bp, Mus musculus
gtagaagagagtttcaacaggctga

SEQ ID NO: 669378 - DNA, 25 bp, Mus musculus
gtagaagatacgaaagtgccgatta

SEQ ID NO: 669379 - DNA, 25 bp, Mus musculus
gtagaagatacgtaagtgccgatta

SEQ ID NO: 669380 - DNA, 25 bp, Mus musculus
gtagaagatactcttttacagacaa

SEQ ID NO: 669381 - DNA, 25 bp, Mus musculus
gtagaagatactgttttacagacaa

SEQ ID NO: 669382 - DNA, 25 bp, Mus musculus
gtagaagcacctctgaccactagaa

SEQ ID NO: 669383 - DNA, 25 bp, Mus musculus
gtagaagcacctgtgaccactagaa

SEQ ID NO: 669384 - DNA, 25 bp, Mus musculus
gtagaagccactccgtttttcccct

SEQ ID NO: 669385 - DNA, 25 bp, Mus musculus
gtagaagccactgcgtttttcccct

SEQ ID NO: 669386 - DNA, 25 bp, Mus musculus
gtagaagctgctctgactgcatgtc

SEQ ID NO: 669387 - DNA, 25 bp, Mus musculus
gtagaagctgctgtgactgcatgtc

SEQ ID NO: 669388 - DNA, 25 bp, Mus musculus
gtagaagctgtcactgaaaccccgg

SEQ ID NO: 669389 - DNA, 25 bp, Mus musculus
gtagaagctgtctctgaaaccccgg

SEQ ID NO: 669390 - DNA, 25 bp, Mus musculus
gtagaagctgttcggctttgtgccc

SEQ ID NO: 669391 - DNA, 25 bp, Mus musculus
gtagaagctgttgggctttgtgccc

SEQ ID NO: 669392 - DNA, 25 bp, Mus musculus
gtagaaggactcagggtgacaactg

SEQ ID NO: 669393 - DNA, 25 bp, Mus musculus
gtagaaggactctgggtgacaactg

SEQ ID NO: 669394 - DNA, 25 bp, Mus musculus
gtagaaggacttaccaccacagaaa

SEQ ID NO: 669395 - DNA, 25 bp, Mus musculus
gtagaaggactttccaccacagaaa

SEQ ID NO: 669396 - DNA, 25 bp, Mus musculus
gtagaaggatagctgtcacccgacc

SEQ ID NO: 669397 - DNA, 25 bp, Mus musculus
gtagaaggataggtgtcacccgacc

SEQ ID NO: 669398 - DNA, 25 bp, Mus musculus
gtagaaggcgtccagtacattgcag

SEQ ID NO: 669399 - DNA, 25 bp, Mus musculus
gtagaaggcgtcgagtacattgcag

SEQ ID NO: 669400 - DNA, 25 bp, Mus musculus
gtagaaggctatctcactgtgtgat

SEQ ID NO: 669401 - DNA, 25 bp, Mus musculus
gtagaaggctatgtcactgtgtgat

SEQ ID NO: 669402 - DNA, 25 bp, Mus musculus
gtagaaggctggcttcacattatta

SEQ ID NO: 669403 - DNA, 25 bp, Mus musculus
gtagaaggctgggttcacattatta

SEQ ID NO: 669404 - DNA, 25 bp, Mus musculus
gtagaaggctgtctgtgcctgtcct

SEQ ID NO: 669405 - DNA, 25 bp, Mus musculus
gtagaaggctgtgtgtgcctgtcct

SEQ ID NO: 669406 - DNA, 25 bp, Mus musculus
gtagaaggtcttaatttcccatagt

SEQ ID NO: 669407 - DNA, 25 bp, Mus musculus
gtagaaggtctttatttcccatagt

SEQ ID NO: 669408 - DNA, 25 bp, Mus musculus
gtagaaggttgaatgtcccagccaa

SEQ ID NO: 669409 - DNA, 25 bp, Mus musculus
gtagaaggttgattgtcccagccaa

SEQ ID NO: 669410 - DNA, 25 bp, Mus musculus
gtagaaggtttcactgtcatccctt

SEQ ID NO: 669411 - DNA, 25 bp, Mus musculus
gtagaaggtttctctgtcatccctt

SEQ ID NO: 669412 - DNA, 25 bp, Mus musculus
gtagaagtaacaaaccaactcctga

SEQ ID NO: 669413 - DNA, 25 bp, Mus musculus
gtagaagtaacataccaactcctga

SEQ ID NO: 669414 - DNA, 25 bp, Mus musculus
gtagaagtagagacctccccttaca

SEQ ID NO: 669415 - DNA, 25 bp, Mus musculus
gtagaagtagagtcctccccttaca

SEQ ID NO: 669416 - DNA, 25 bp, Mus musculus
gtagaagtagatccagctaagacac

SEQ ID NO: 669417 - DNA, 25 bp, Mus musculus
gtagaagtagatgcagctaagacac

SEQ ID NO: 669418 - DNA, 25 bp, Mus musculus
gtagaagtagccagtcctgacatct

SEQ ID NO: 669419 - DNA, 25 bp, Mus musculus
gtagaagtagcctgtcctgacatct

SEQ ID NO: 669420 - DNA, 25 bp, Mus musculus
gtagaagtcagcagccatgaaagtc

SEQ ID NO: 669421 - DNA, 25 bp, Mus musculus
gtagaagtcagctgccatgaaagtc

SEQ ID NO: 669422 - DNA, 25 bp, Mus musculus
gtagaagtccccattaaaggcgatg

SEQ ID NO: 669423 - DNA, 25 bp, Mus musculus
gtagaagtcccctttaaaggcgatg

SEQ ID NO: 669424 - DNA, 25 bp, Mus musculus
gtagaagtccctagtcttccaatag

SEQ ID NO: 669425 - DNA, 25 bp, Mus musculus
gtagaagtcccttgtcttccaatag

SEQ ID NO: 669426 - DNA, 25 bp, Mus musculus
gtagaagtctccctctcaataagta

SEQ ID NO: 669427 - DNA, 25 bp, Mus musculus
gtagaagtctccgtctcaataagta

SEQ ID NO: 669428 - DNA, 25 bp, Mus musculus
gtagaagtgtccaaacaggttgtgt

SEQ ID NO: 669429 - DNA, 25 bp, Mus musculus
gtagaagtgtcctaacaggttgtgt

SEQ ID NO: 669430 - DNA, 25 bp, Mus musculus
gtagaataaacaacactggcaaatt

SEQ ID NO: 669431 - DNA, 25 bp, Mus musculus
gtagaataaacatcactggcaaatt

SEQ ID NO: 669432 - DNA, 25 bp, Mus musculus
gtagaatacgatatgcttggagaat

SEQ ID NO: 669433 - DNA, 25 bp, Mus musculus
gtagaatacgatttgcttggagaat

SEQ ID NO: 669434 - DNA, 25 bp, Mus musculus
gtagaatactgcaactctgaggcct

SEQ ID NO: 669435 - DNA, 25 bp, Mus musculus
gtagaatactgctactctgaggcct

SEQ ID NO: 669436 - DNA, 25 bp, Mus musculus
gtagaatacttgaataccatccaca

SEQ ID NO: 669437 - DNA, 25 bp, Mus musculus
gtagaatacttgtataccatccaca

SEQ ID NO: 669438 - DNA, 25 bp, Mus musculus
gtagaatagagtccctactatgaca

SEQ ID NO: 669439 - DNA, 25 bp, Mus musculus
gtagaatagagtgcctactatgaca

SEQ ID NO: 669440 - DNA, 25 bp, Mus musculus
gtagaatcaactctcaccaaggtgg

SEQ ID NO: 669441 - DNA, 25 bp, Mus musculus
gtagaatcaactgtcaccaaggtgg

SEQ ID NO: 669442 - DNA, 25 bp, Mus musculus
gtagaatcattgcatcctgatgaca

SEQ ID NO: 669443 - DNA, 25 bp, Mus musculus
gtagaatcattggatcctgatgaca

SEQ ID NO: 669444 - DNA, 25 bp, Mus musculus
gtagaatccaagctctctcatgcca

SEQ ID NO: 669445 - DNA, 25 bp, Mus musculus
gtagaatccaaggtctctcatgcca

SEQ ID NO: 669446 - DNA, 25 bp, Mus musculus
gtagaatccacaattaaaaggccag

SEQ ID NO: 669447 - DNA, 25 bp, Mus musculus
gtagaatccacatttaaaaggccag

SEQ ID NO: 669448 - DNA, 25 bp, Mus musculus
gtagaatcccacaccaatcaaatat

SEQ ID NO: 669449 - DNA, 25 bp, Mus musculus
gtagaatcccactccaatcaaatat

SEQ ID NO: 669450 - DNA, 25 bp, Mus musculus
gtagaatccccgcagagatgtctgt

SEQ ID NO: 669451 - DNA, 25 bp, Mus musculus
gtagaatccccggagagatgtctgt

SEQ ID NO: 669452 - DNA, 25 bp, Mus musculus
gtagaatcctctaagaagctcggaa

SEQ ID NO: 669453 - DNA, 25 bp, Mus musculus
gtagaatcctcttagaagctcggaa

SEQ ID NO: 669454 - DNA, 25 bp, Mus musculus
gtagaatccttgagtgttcctcacc

SEQ ID NO: 669455 - DNA, 25 bp, Mus musculus
gtagaatccttgtgtgttcctcacc

SEQ ID NO: 669456 - DNA, 25 bp, Mus musculus
gtagaatcctttaggagcacacaca

SEQ ID NO: 669457 - DNA, 25 bp, Mus musculus
gtagaatccttttggagcacacaca

SEQ ID NO: 669458 - DNA, 25 bp, Mus musculus
gtagaatctcttcatgctatttttt

SEQ ID NO: 669459 - DNA, 25 bp, Mus musculus
gtagaatctcttgatgctatttttt

SEQ ID NO: 669460 - DNA, 25 bp, Mus musculus
gtagaatctgtacggcttcatccat

SEQ ID NO: 669461 - DNA, 25 bp, Mus musculus
gtagaatctgtagggcttcatccat

SEQ ID NO: 669462 - DNA, 25 bp, Mus musculus
gtagaatctgtcattccatccccag

SEQ ID NO: 669463 - DNA, 25 bp, Mus musculus
gtagaatctgtctttccatccccag

SEQ ID NO: 669464 - DNA, 25 bp, Mus musculus
gtagaatctgttataggaagtgcct

SEQ ID NO: 669465 - DNA, 25 bp, Mus musculus
gtagaatctgttttaggaagtgcct

SEQ ID NO: 669466 - DNA, 25 bp, Mus musculus
gtagaatcttctcctgacatacaag

SEQ ID NO: 669467 - DNA, 25 bp, Mus musculus
gtagaatcttctctgtttcttcaag

SEQ ID NO: 669468 - DNA, 25 bp, Mus musculus
gtagaatcttctgctgacatacaag

SEQ ID NO: 669469 - DNA, 25 bp, Mus musculus
gtagaatcttctgtgtttcttcaag

SEQ ID NO: 669470 - DNA, 25 bp, Mus musculus
gtagaatgatttcaacttagcttag

SEQ ID NO: 669471 - DNA, 25 bp, Mus musculus
gtagaatgatttgaacttagcttag

SEQ ID NO: 669472 - DNA, 25 bp, Mus musculus
gtagaatgcaccaatgttcccttct

SEQ ID NO: 669473 - DNA, 25 bp, Mus musculus
gtagaatgcacctatgttcccttct

SEQ ID NO: 669474 - DNA, 25 bp, Mus musculus
gtagaatgcggtcactattttcatt

SEQ ID NO: 669475 - DNA, 25 bp, Mus musculus
gtagaatgcggtgactattttcatt

SEQ ID NO: 669476 - DNA, 25 bp, Mus musculus
gtagaatgtgagctcatcagccttg

SEQ ID NO: 669477 - DNA, 25 bp, Mus musculus
gtagaatgtgaggtcatcagccttg

SEQ ID NO: 669478 - DNA, 25 bp, Mus musculus
gtagaatgtttccaggcgtttaaca

SEQ ID NO: 669479 - DNA, 25 bp, Mus musculus
gtagaatgtttcgaggcgtttaaca

SEQ ID NO: 669480 - DNA, 25 bp, Mus musculus
gtagaattacctcctttgtgtgttt

SEQ ID NO: 669481 - DNA, 25 bp, Mus musculus
gtagaattacctgctttgtgtgttt

SEQ ID NO: 669482 - DNA, 25 bp, Mus musculus
gtagaattatacatgtgctaggcac

SEQ ID NO: 669483 - DNA, 25 bp, Mus musculus
gtagaattatacttgtgctaggcac

SEQ ID NO: 669484 - DNA, 25 bp, Mus musculus
gtagaattcatcaaacctcccgagt

SEQ ID NO: 669485 - DNA, 25 bp, Mus musculus
gtagaattcatctaacctcccgagt

SEQ ID NO: 669486 - DNA, 25 bp, Mus musculus
gtagaattccaccagctgaaccgag

SEQ ID NO: 669487 - DNA, 25 bp, Mus musculus
gtagaattccacgagctgaaccgag

SEQ ID NO: 669488 - DNA, 25 bp, Mus musculus
gtagaattcctactgcattgagcaa

SEQ ID NO: 669489 - DNA, 25 bp, Mus musculus
gtagaattcctagtgcattgagcaa

SEQ ID NO: 669490 - DNA, 25 bp, Mus musculus
gtagaattcctgctgagtgtccctg

SEQ ID NO: 669491 - DNA, 25 bp, Mus musculus
gtagaattcctggtgagtgtccctg

SEQ ID NO: 669492 - DNA, 25 bp, Mus musculus
gtagaattccttagacagcttaatg

SEQ ID NO: 669493 - DNA, 25 bp, Mus musculus
gtagaattcctttgacagcttaatg

SEQ ID NO: 669494 - DNA, 25 bp, Mus musculus
gtagaatttcagattcttttagcct

SEQ ID NO: 669495 - DNA, 25 bp, Mus musculus
gtagaatttcagtttcttttagcct

SEQ ID NO: 669496 - DNA, 25 bp, Mus musculus
gtagaatttcctcctaaaagctgtg

SEQ ID NO: 669497 - DNA, 25 bp, Mus musculus
gtagaatttcctgctaaaagctgtg

SEQ ID NO: 669498 - DNA, 25 bp, Mus musculus
gtagaatttcttatttgatgcctgc

SEQ ID NO: 669499 - DNA, 25 bp, Mus musculus
gtagaatttcttttttgatgcctgc

SEQ ID NO: 669500 - DNA, 25 bp, Mus musculus
gtagaattttcgatctggtctctgt

SEQ ID NO: 669501 - DNA, 25 bp, Mus musculus
gtagaattttcgttctggtctctgt

SEQ ID NO: 669502 - DNA, 25 bp, Mus musculus
gtagacaaaccactgtagacaggct

SEQ ID NO: 669503 - DNA, 25 bp, Mus musculus
gtagacaaaccagtgtagacaggct

SEQ ID NO: 669504 - DNA, 25 bp, Mus musculus
gtagacaaagctcggtctcctactc

SEQ ID NO: 669505 - DNA, 25 bp, Mus musculus
gtagacaaagctgggtctcctactc

SEQ ID NO: 669506 - DNA, 25 bp, Mus musculus
gtagacaagccaaggtggcctcagt

SEQ ID NO: 669507 - DNA, 25 bp, Mus musculus
gtagacaagccatggtggcctcagt

SEQ ID NO: 669508 - DNA, 25 bp, Mus musculus
gtagacaagtggacactccagaggg

SEQ ID NO: 669509 - DNA, 25 bp, Mus musculus
gtagacaagtggtcactccagaggg

SEQ ID NO: 669510 - DNA, 25 bp, Mus musculus
gtagacaagtttataatccctctgt

SEQ ID NO: 669511 - DNA, 25 bp, Mus musculus
gtagacaagtttttaatccctctgt

SEQ ID NO: 669512 - DNA, 25 bp, Mus musculus
gtagacaatggtcggctagcctcag

SEQ ID NO: 669513 - DNA, 25 bp, Mus musculus
gtagacaatggtgggctagcctcag

SEQ ID NO: 669514 - DNA, 25 bp, Mus musculus
gtagacacaaaactggccggcacac

SEQ ID NO: 669515 - DNA, 25 bp, Mus musculus
gtagacacaaaagtggccggcacac

SEQ ID NO: 669516 - DNA, 25 bp, Mus musculus
gtagacacacatcgtgacaagccaa

SEQ ID NO: 669517 - DNA, 25 bp, Mus musculus
gtagacacacatggtgacaagccaa

SEQ ID NO: 669518 - DNA, 25 bp, Mus musculus
gtagacacacctatgtatgcaggga

SEQ ID NO: 669519 - DNA, 25 bp, Mus musculus
gtagacacacctttgtatgcaggga

SEQ ID NO: 669520 - DNA, 25 bp, Mus musculus
gtagacacacttacctgttagcaaa

SEQ ID NO: 669521 - DNA, 25 bp, Mus musculus
gtagacacactttcctgttagcaaa

SEQ ID NO: 669522 - DNA, 25 bp, Mus musculus
gtagacacagagctaactgctaaga

SEQ ID NO: 669523 - DNA, 25 bp, Mus musculus
gtagacacagaggtaactgctaaga

SEQ ID NO: 669524 - DNA, 25 bp, Mus musculus
gtagacacagtcacagtgaatctga

SEQ ID NO: 669525 - DNA, 25 bp, Mus musculus
gtagacacagtctcagtgaatctga

SEQ ID NO: 669526 - DNA, 25 bp, Mus musculus
gtagacacccggaagcaggaaccat

SEQ ID NO: 669527 - DNA, 25 bp, Mus musculus
gtagacacccggtagcaggaaccat

SEQ ID NO: 669528 - DNA, 25 bp, Mus musculus
gtagacaccgtgatgatatcactag

SEQ ID NO: 669529 - DNA, 25 bp, Mus musculus
gtagacaccgtgttgatatcactag

SEQ ID NO: 669530 - DNA, 25 bp, Mus musculus
gtagacaccttcagagtttagtttt

SEQ ID NO: 669531 - DNA, 25 bp, Mus musculus
gtagacaccttctgagtttagtttt

SEQ ID NO: 669532 - DNA, 25 bp, Mus musculus
gtagacacggctccagagtaaagca

SEQ ID NO: 669533 - DNA, 25 bp, Mus musculus
gtagacacggctgcagagtaaagca

SEQ ID NO: 669534 - DNA, 25 bp, Mus musculus
gtagacactgtgagcttccggtttc

SEQ ID NO: 669535 - DNA, 25 bp, Mus musculus
gtagacactgtgtgcttccggtttc

SEQ ID NO: 669536 - DNA, 25 bp, Mus musculus
gtagacagacgtagtggtgcacaac

SEQ ID NO: 669537 - DNA, 25 bp, Mus musculus
gtagacagacgttgtggtgcacaac

SEQ ID NO: 669538 - DNA, 25 bp, Mus musculus
gtagacagatgtcccttgaagcttt

SEQ ID NO: 669539 - DNA, 25 bp, Mus musculus
gtagacagatgtgccttgaagcttt

SEQ ID NO: 669540 - DNA, 25 bp, Mus musculus
gtagacagctgtctgccggacacca

SEQ ID NO: 669541 - DNA, 25 bp, Mus musculus
gtagacagctgtgtgccggacacca

SEQ ID NO: 669542 - DNA, 25 bp, Mus musculus
gtagacaggaagcaagacgaagatc

SEQ ID NO: 669543 - DNA, 25 bp, Mus musculus
gtagacaggaaggaagacgaagatc

SEQ ID NO: 669544 - DNA, 25 bp, Mus musculus
gtagacaggaccacacattgacctt

SEQ ID NO: 669545 - DNA, 25 bp, Mus musculus
gtagacaggacctcacattgacctt

SEQ ID NO: 669546 - DNA, 25 bp, Mus musculus
gtagacaggattccttgcacgtgga

SEQ ID NO: 669547 - DNA, 25 bp, Mus musculus
gtagacaggattgcttgcacgtgga

SEQ ID NO: 669548 - DNA, 25 bp, Mus musculus
gtagacaggcttccatttgatgagg

SEQ ID NO: 669549 - DNA, 25 bp, Mus musculus
gtagacaggcttgcatttgatgagg

SEQ ID NO: 669550 - DNA, 25 bp, Mus musculus
gtagacagggtacaagccatccttt

SEQ ID NO: 669551 - DNA, 25 bp, Mus musculus
gtagacagggtagaagccatccttt

SEQ ID NO: 669552 - DNA, 25 bp, Mus musculus
gtagacataactcctgttcctgaaa

SEQ ID NO: 669553 - DNA, 25 bp, Mus musculus
gtagacataactgctgttcctgaaa

SEQ ID NO: 669554 - DNA, 25 bp, Mus musculus
gtagacataataccactttcacaaa

SEQ ID NO: 669555 - DNA, 25 bp, Mus musculus
gtagacataatagcactttcacaaa

SEQ ID NO: 669556 - DNA, 25 bp, Mus musculus
gtagacatatttaattggtgtgctg

SEQ ID NO: 669557 - DNA, 25 bp, Mus musculus
gtagacatattttattggtgtgctg

SEQ ID NO: 669558 - DNA, 25 bp, Mus musculus
gtagacatcagaaagataccggagc

SEQ ID NO: 669559 - DNA, 25 bp, Mus musculus
gtagacatcagatagataccggagc

SEQ ID NO: 669560 - DNA, 25 bp, Mus musculus
gtagacatcccgatttcctacttaa

SEQ ID NO: 669561 - DNA, 25 bp, Mus musculus
gtagacatcccgttttcctacttaa

SEQ ID NO: 669562 - DNA, 25 bp, Mus musculus
gtagacatcgataccattaactgca

SEQ ID NO: 669563 - DNA, 25 bp, Mus musculus
gtagacatcgattccattaactgca

SEQ ID NO: 669564 - DNA, 25 bp, Mus musculus
gtagacatcgtcatgcctgaataga

SEQ ID NO: 669565 - DNA, 25 bp, Mus musculus
gtagacatcgtcttgcctgaataga

SEQ ID NO: 669566 - DNA, 25 bp, Mus musculus
gtagacatctcccatgttcatgtaa

SEQ ID NO: 669567 - DNA, 25 bp, Mus musculus
gtagacatctccgatgttcatgtaa

SEQ ID NO: 669568 - DNA, 25 bp, Mus musculus
gtagacatctgcctcatggctctgt

SEQ ID NO: 669569 - DNA, 25 bp, Mus musculus
gtagacatctgcgtcatggctctgt

SEQ ID NO: 669570 - DNA, 25 bp, Mus musculus
gtagacatgagtacccaagagacta

SEQ ID NO: 669571 - DNA, 25 bp, Mus musculus
gtagacatgagttcccaagagacta

SEQ ID NO: 669572 - DNA, 25 bp, Mus musculus
gtagacatgataccacacaccttta

SEQ ID NO: 669573 - DNA, 25 bp, Mus musculus
gtagacatgatagcacacaccttta

SEQ ID NO: 669574 - DNA, 25 bp, Mus musculus
gtagacatgcacacttctgaacgtt

SEQ ID NO: 669575 - DNA, 25 bp, Mus musculus
gtagacatgcactcttctgaacgtt

SEQ ID NO: 669576 - DNA, 25 bp, Mus musculus
gtagacatgctaattgactgtccat

SEQ ID NO: 669577 - DNA, 25 bp, Mus musculus
gtagacatgctatttgactgtccat

SEQ ID NO: 669578 - DNA, 25 bp, Mus musculus
gtagacatggtacctagtcaatggc

SEQ ID NO: 669579 - DNA, 25 bp, Mus musculus
gtagacatggtagctagtcaatggc

SEQ ID NO: 669580 - DNA, 25 bp, Mus musculus
gtagacatggtgaggtcacaggatt

SEQ ID NO: 669581 - DNA, 25 bp, Mus musculus
gtagacatggtgctggcatgcactt

SEQ ID NO: 669582 - DNA, 25 bp, Mus musculus
gtagacatggtggtggcatgcactt

SEQ ID NO: 669583 - DNA, 25 bp, Mus musculus
gtagacatggtgtggtcacaggatt

SEQ ID NO: 669584 - DNA, 25 bp, Mus musculus
gtagacatgtgactgctctttcctt

SEQ ID NO: 669585 - DNA, 25 bp, Mus musculus
gtagacatgtgagtgctctttcctt

SEQ ID NO: 669586 - DNA, 25 bp, Mus musculus
gtagacattcagacaaccatcctgg

SEQ ID NO: 669587 - DNA, 25 bp, Mus musculus
gtagacattcagtcaaccatcctgg

SEQ ID NO: 669588 - DNA, 25 bp, Mus musculus
gtagacattcctattgggccttact

SEQ ID NO: 669589 - DNA, 25 bp, Mus musculus
gtagacattccttttgggccttact

SEQ ID NO: 669590 - DNA, 25 bp, Mus musculus
gtagacattctaactgccagttaag

SEQ ID NO: 669591 - DNA, 25 bp, Mus musculus
gtagacattctatctgccagttaag

SEQ ID NO: 669592 - DNA, 25 bp, Mus musculus
gtagacattcttctacgcctgtcat

SEQ ID NO: 669593 - DNA, 25 bp, Mus musculus
gtagacattcttgtacgcctgtcat

SEQ ID NO: 669594 - DNA, 25 bp, Mus musculus
gtagacattgtcacagcagaatagt

SEQ ID NO: 669595 - DNA, 25 bp, Mus musculus
gtagacattgtctcagcagaatagt

SEQ ID NO: 669596 - DNA, 25 bp, Mus musculus
gtagaccaatatcctgagagtgtaa

SEQ ID NO: 669597 - DNA, 25 bp, Mus musculus
gtagaccaatatgctgagagtgtaa

SEQ ID NO: 669598 - DNA, 25 bp, Mus musculus
gtagaccaatgtcagtttgtataaa

SEQ ID NO: 669599 - DNA, 25 bp, Mus musculus
gtagaccaatgtgagtttgtataaa

SEQ ID NO: 669600 - DNA, 25 bp, Mus musculus
gtagaccaattaagatcatccccat

SEQ ID NO: 669601 - DNA, 25 bp, Mus musculus
gtagaccaattatgatcatccccat

SEQ ID NO: 669602 - DNA, 25 bp, Mus musculus
gtagaccaatttaacatgttctctg

SEQ ID NO: 669603 - DNA, 25 bp, Mus musculus
gtagaccaattttacatgttctctg

SEQ ID NO: 669604 - DNA, 25 bp, Mus musculus
gtagaccacagtaagctgctttttg

SEQ ID NO: 669605 - DNA, 25 bp, Mus musculus
gtagaccacagttagctgctttttg

SEQ ID NO: 669606 - DNA, 25 bp, Mus musculus
gtagaccagaaactccatatgtaga

SEQ ID NO: 669607 - DNA, 25 bp, Mus musculus
gtagaccagaaagtccatatgtaga

SEQ ID NO: 669608 - DNA, 25 bp, Mus musculus
gtagaccagctaatctcattgcctg

SEQ ID NO: 669609 - DNA, 25 bp, Mus musculus
gtagaccagctattctcattgcctg

SEQ ID NO: 669610 - DNA, 25 bp, Mus musculus
gtagaccaggctagatcctcctgtc

SEQ ID NO: 669611 - DNA, 25 bp, Mus musculus
gtagaccaggcttgatcctcctgtc

SEQ ID NO: 669612 - DNA, 25 bp, Mus musculus
gtagaccataatatcccacactgac

SEQ ID NO: 669613 - DNA, 25 bp, Mus musculus
gtagaccataatttcccacactgac

SEQ ID NO: 669614 - DNA, 25 bp, Mus musculus
gtagaccatctacaataccctattt

SEQ ID NO: 669615 - DNA, 25 bp, Mus musculus
gtagaccatctagaataccctattt

SEQ ID NO: 669616 - DNA, 25 bp, Mus musculus
gtagaccatttacctgctatgtgca

SEQ ID NO: 669617 - DNA, 25 bp, Mus musculus
gtagaccatttagctgctatgtgca

SEQ ID NO: 669618 - DNA, 25 bp, Mus musculus
gtagaccatttccagggatgccttg

SEQ ID NO: 669619 - DNA, 25 bp, Mus musculus
gtagaccatttcgagggatgccttg

SEQ ID NO: 669620 - DNA, 25 bp, Mus musculus
gtagaccattttagtctccgaggtt

SEQ ID NO: 669621 - DNA, 25 bp, Mus musculus
gtagaccatttttgtctccgaggtt

SEQ ID NO: 669622 - DNA, 25 bp, Mus musculus
gtagacccaaagaaacacatctcac

SEQ ID NO: 669623 - DNA, 25 bp, Mus musculus
gtagacccaaagtaacacatctcac

SEQ ID NO: 669624 - DNA, 25 bp, Mus musculus
gtagacccacagaacattagaacaa

SEQ ID NO: 669625 - DNA, 25 bp, Mus musculus
gtagacccacagtacattagaacaa

SEQ ID NO: 669626 - DNA, 25 bp, Mus musculus
gtagaccccattcagctggtggttt

SEQ ID NO: 669627 - DNA, 25 bp, Mus musculus
gtagaccccattgagctggtggttt

SEQ ID NO: 669628 - DNA, 25 bp, Mus musculus
gtagacccggagagaacccaagcta

SEQ ID NO: 669629 - DNA, 25 bp, Mus musculus
gtagacccggagtgaacccaagcta

SEQ ID NO: 669630 - DNA, 25 bp, Mus musculus
gtagaccctgccacttttgatgctt

SEQ ID NO: 669631 - DNA, 25 bp, Mus musculus
gtagaccctgcctcttttgatgctt

SEQ ID NO: 669632 - DNA, 25 bp, Mus musculus
gtagaccctggtcgtggaggctcct

SEQ ID NO: 669633 - DNA, 25 bp, Mus musculus
gtagaccctggtggtggaggctcct

SEQ ID NO: 669634 - DNA, 25 bp, Mus musculus
gtagaccctttcatctactactatg

SEQ ID NO: 669635 - DNA, 25 bp, Mus musculus
gtagaccctttcttctactactatg

SEQ ID NO: 669636 - DNA, 25 bp, Mus musculus
gtagaccgacgtaatcgcgctatac

SEQ ID NO: 669637 - DNA, 25 bp, Mus musculus
gtagaccgacgttatcgcgctatac

SEQ ID NO: 669638 - DNA, 25 bp, Mus musculus
gtagaccgagggacattcacatgag

SEQ ID NO: 669639 - DNA, 25 bp, Mus musculus
gtagaccgagggtcattcacatgag

SEQ ID NO: 669640 - DNA, 25 bp, Mus musculus
gtagaccgccaaaaagagtccttgt

SEQ ID NO: 669641 - DNA, 25 bp, Mus musculus
gtagaccgccaataagagtccttgt

SEQ ID NO: 669642 - DNA, 25 bp, Mus musculus
gtagaccggcgcatcttgcagaatg

SEQ ID NO: 669643 - DNA, 25 bp, Mus musculus
gtagaccggcgcttcttgcagaatg

SEQ ID NO: 669644 - DNA, 25 bp, Mus musculus
gtagaccgtttgacacatatccatg

SEQ ID NO: 669645 - DNA, 25 bp, Mus musculus
gtagaccgtttgtcacatatccatg

SEQ ID NO: 669646 - DNA, 25 bp, Mus musculus
gtagacctccctcctgtgttttgag

SEQ ID NO: 669647 - DNA, 25 bp, Mus musculus
gtagacctccctgctgtgttttgag

SEQ ID NO: 669648 - DNA, 25 bp, Mus musculus
gtagacctgaccaacacagttactg

SEQ ID NO: 669649 - DNA, 25 bp, Mus musculus
gtagacctgacctacacagttactg

SEQ ID NO: 669650 - DNA, 25 bp, Mus musculus
gtagacctgctcatgtgaggcagag

SEQ ID NO: 669651 - DNA, 25 bp, Mus musculus
gtagacctgctcttgtgaggcagag

SEQ ID NO: 669652 - DNA, 25 bp, Mus musculus
gtagacctggagactgcacggctgc

SEQ ID NO: 669653 - DNA, 25 bp, Mus musculus
gtagacctggagcaagcatgacctt

SEQ ID NO: 669654 - DNA, 25 bp, Mus musculus
gtagacctggaggaagcatgacctt

SEQ ID NO: 669655 - DNA, 25 bp, Mus musculus
gtagacctggagtctgcacggctgc

SEQ ID NO: 669656 - DNA, 25 bp, Mus musculus
gtagacctggcaatttctcttacaa

SEQ ID NO: 669657 - DNA, 25 bp, Mus musculus
gtagacctggcattttctcttacaa

SEQ ID NO: 669658 - DNA, 25 bp, Mus musculus
gtagacctggttaccggcagtgcat

SEQ ID NO: 669659 - DNA, 25 bp, Mus musculus
gtagacctggtttccggcagtgcat

SEQ ID NO: 669660 - DNA, 25 bp, Mus musculus
gtagacctgtcaatgttttatattg

SEQ ID NO: 669661 - DNA, 25 bp, Mus musculus
gtagacctgtcattgttttatattg

SEQ ID NO: 669662 - DNA, 25 bp, Mus musculus
gtagaccttagccaaatgtccttga

SEQ ID NO: 669663 - DNA, 25 bp, Mus musculus
gtagaccttagcgaaatgtccttga

SEQ ID NO: 669664 - DNA, 25 bp, Mus musculus
gtagacgaactcaaatgccaaccag

SEQ ID NO: 669665 - DNA, 25 bp, Mus musculus
gtagacgaactctaatgccaaccag

SEQ ID NO: 669666 - DNA, 25 bp, Mus musculus
gtagacgaccgcatgttgatgacat

SEQ ID NO: 669667 - DNA, 25 bp, Mus musculus
gtagacgaccgcttgttgatgacat

SEQ ID NO: 669668 - DNA, 25 bp, Mus musculus
gtagacgagctcaatgaagcctatt

SEQ ID NO: 669669 - DNA, 25 bp, Mus musculus
gtagacgagctctatgaagcctatt

SEQ ID NO: 669670 - DNA, 25 bp, Mus musculus
gtagacggaaagatttaccatccat

SEQ ID NO: 669671 - DNA, 25 bp, Mus musculus
gtagacggaaagttttaccatccat

SEQ ID NO: 669672 - DNA, 25 bp, Mus musculus
gtagacggaagcatgttcacccagt

SEQ ID NO: 669673 - DNA, 25 bp, Mus musculus
gtagacggaagcttgttcacccagt

SEQ ID NO: 669674 - DNA, 25 bp, Mus musculus
gtagacggagtgaaatgagctgcaa

SEQ ID NO: 669675 - DNA, 25 bp, Mus musculus
gtagacggagtgtaatgagctgcaa

SEQ ID NO: 669676 - DNA, 25 bp, Mus musculus
gtagacggtgataaggccaacggcc

SEQ ID NO: 669677 - DNA, 25 bp, Mus musculus
gtagacggtgattaggccaacggcc

SEQ ID NO: 669678 - DNA, 25 bp, Mus musculus
gtagacgtatagattattccatatt

SEQ ID NO: 669679 - DNA, 25 bp, Mus musculus
gtagacgtatagtttattccatatt

SEQ ID NO: 669680 - DNA, 25 bp, Mus musculus
gtagacgtcaccatacctacgaata

SEQ ID NO: 669681 - DNA, 25 bp, Mus musculus
gtagacgtcaccttacctacgaata

SEQ ID NO: 669682 - DNA, 25 bp, Mus musculus
gtagacgtcgccatgaaagtgaaga

SEQ ID NO: 669683 - DNA, 25 bp, Mus musculus
gtagacgtcgccttgaaagtgaaga

SEQ ID NO: 669684 - DNA, 25 bp, Mus musculus
gtagacgtgttcatcaaatgttaca

SEQ ID NO: 669685 - DNA, 25 bp, Mus musculus
gtagacgtgttcttcaaatgttaca

SEQ ID NO: 669686 - DNA, 25 bp, Mus musculus
gtagacgttcaacgccactgttggc

SEQ ID NO: 669687 - DNA, 25 bp, Mus musculus
gtagacgttcaaggccactgttggc

SEQ ID NO: 669688 - DNA, 25 bp, Mus musculus
gtagactaagcacccataaacatat

SEQ ID NO: 669689 - DNA, 25 bp, Mus musculus
gtagactaagcagccataaacatat

SEQ ID NO: 669690 - DNA, 25 bp, Mus musculus
gtagactaagttccgtatatggcat

SEQ ID NO: 669691 - DNA, 25 bp, Mus musculus
gtagactaagttgcgtatatggcat

SEQ ID NO: 669692 - DNA, 25 bp, Mus musculus
gtagactaccatagtgccgtgcaga

SEQ ID NO: 669693 - DNA, 25 bp, Mus musculus
gtagactaccattgtgccgtgcaga

SEQ ID NO: 669694 - DNA, 25 bp, Mus musculus
gtagactactaaaacattgagttgt

SEQ ID NO: 669695 - DNA, 25 bp, Mus musculus
gtagactactaatacattgagttgt

SEQ ID NO: 669696 - DNA, 25 bp, Mus musculus
gtagactagagaaccatgtgtgtct

SEQ ID NO: 669697 - DNA, 25 bp, Mus musculus
gtagactagagatccatgtgtgtct

SEQ ID NO: 669698 - DNA, 25 bp, Mus musculus
gtagactagcaaattgacctgttaa

SEQ ID NO: 669699 - DNA, 25 bp, Mus musculus
gtagactagcaatttgacctgttaa

SEQ ID NO: 669700 - DNA, 25 bp, Mus musculus
gtagactattcgaagcagctctccc

SEQ ID NO: 669701 - DNA, 25 bp, Mus musculus
gtagactattcgtagcagctctccc

SEQ ID NO: 669702 - DNA, 25 bp, Mus musculus
gtagactcagtcaggcactttgaat

SEQ ID NO: 669703 - DNA, 25 bp, Mus musculus
gtagactcagtctggcactttgaat

SEQ ID NO: 669704 - DNA, 25 bp, Mus musculus
gtagactccgaaaacatgaaagaac

SEQ ID NO: 669705 - DNA, 25 bp, Mus musculus
gtagactccgaatacatgaaagaac

SEQ ID NO: 669706 - DNA, 25 bp, Mus musculus
gtagactcctgccagatgggagcta

SEQ ID NO: 669707 - DNA, 25 bp, Mus musculus
gtagactcctgcgagatgggagcta

SEQ ID NO: 669708 - DNA, 25 bp, Mus musculus
gtagactcgaccacactttttattt

SEQ ID NO: 669709 - DNA, 25 bp, Mus musculus
gtagactcgacctcactttttattt

SEQ ID NO: 669710 - DNA, 25 bp, Mus musculus
gtagactctggaaacttacactgta

SEQ ID NO: 669711 - DNA, 25 bp, Mus musculus
gtagactctggatacttacactgta

SEQ ID NO: 669712 - DNA, 25 bp, Mus musculus
gtagactctgttagcatcactctgt

SEQ ID NO: 669713 - DNA, 25 bp, Mus musculus
gtagactctgtttgcatcactctgt

SEQ ID NO: 669714 - DNA, 25 bp, Mus musculus
gtagactctttactctcagtgactc

SEQ ID NO: 669715 - DNA, 25 bp, Mus musculus
gtagactctttagtctcagtgactc

SEQ ID NO: 669716 - DNA, 25 bp, Mus musculus
gtagactgacttcctgcatgacaga

SEQ ID NO: 669717 - DNA, 25 bp, Mus musculus
gtagactgacttgctgcatgacaga

SEQ ID NO: 669718 - DNA, 25 bp, Mus musculus
gtagactgatctattctgttaaaga

SEQ ID NO: 669719 - DNA, 25 bp, Mus musculus
gtagactgatcttttctgttaaaga

SEQ ID NO: 669720 - DNA, 25 bp, Mus musculus
gtagactgcaagctggtccacgaat

SEQ ID NO: 669721 - DNA, 25 bp, Mus musculus
gtagactgcaaggtggtccacgaat

SEQ ID NO: 669722 - DNA, 25 bp, Mus musculus
gtagactgcatcatgtttaccatac

SEQ ID NO: 669723 - DNA, 25 bp, Mus musculus
gtagactgcatcttgtttaccatac

SEQ ID NO: 669724 - DNA, 25 bp, Mus musculus
gtagactgcattcattacagcggga

SEQ ID NO: 669725 - DNA, 25 bp, Mus musculus
gtagactgcattgattacagcggga

SEQ ID NO: 669726 - DNA, 25 bp, Mus musculus
gtagactgccatactgtgtggtctt

SEQ ID NO: 669727 - DNA, 25 bp, Mus musculus
gtagactgccattctgtgtggtctt

SEQ ID NO: 669728 - DNA, 25 bp, Mus musculus
gtagactgcgctcactaaccagtca

SEQ ID NO: 669729 - DNA, 25 bp, Mus musculus
gtagactgcgctgactaaccagtca

SEQ ID NO: 669730 - DNA, 25 bp, Mus musculus
gtagactgggaacttccctttatat

SEQ ID NO: 669731 - DNA, 25 bp, Mus musculus
gtagactgggaagttccctttatat

SEQ ID NO: 669732 - DNA, 25 bp, Mus musculus
gtagactgtacaagtttaataactt

SEQ ID NO: 669733 - DNA, 25 bp, Mus musculus
gtagactgtacatgtttaataactt

SEQ ID NO: 669734 - DNA, 25 bp, Mus musculus
gtagactgtcagcatcctcacacag

SEQ ID NO: 669735 - DNA, 25 bp, Mus musculus
gtagactgtcaggatcctcacacag

SEQ ID NO: 669736 - DNA, 25 bp, Mus musculus
gtagactgtcccatgattgaaccta

SEQ ID NO: 669737 - DNA, 25 bp, Mus musculus
gtagactgtcccttgattgaaccta

SEQ ID NO: 669738 - DNA, 25 bp, Mus musculus
gtagacttaccaccttcagtttgtt

SEQ ID NO: 669739 - DNA, 25 bp, Mus musculus
gtagacttaccagcttcagtttgtt

SEQ ID NO: 669740 - DNA, 25 bp, Mus musculus
gtagacttagaacatcctctgtatc

SEQ ID NO: 669741 - DNA, 25 bp, Mus musculus
gtagacttagaagatcctctgtatc

SEQ ID NO: 669742 - DNA, 25 bp, Mus musculus
gtagacttagacagcatcggacttc

SEQ ID NO: 669743 - DNA, 25 bp, Mus musculus
gtagacttagactgcatcggacttc

SEQ ID NO: 669744 - DNA, 25 bp, Mus musculus
gtagacttagtcacttcaagcctgt

SEQ ID NO: 669745 - DNA, 25 bp, Mus musculus
gtagacttagtctcttcaagcctgt

SEQ ID NO: 669746 - DNA, 25 bp, Mus musculus
gtagacttatacatgacagtgactt

SEQ ID NO: 669747 - DNA, 25 bp, Mus musculus
gtagacttatacttgacagtgactt

SEQ ID NO: 669748 - DNA, 25 bp, Mus musculus
gtagacttatgaatttcccgaatgt

SEQ ID NO: 669749 - DNA, 25 bp, Mus musculus
gtagacttatgattttcccgaatgt

SEQ ID NO: 669750 - DNA, 25 bp, Mus musculus
gtagacttcaggatttacagtgtta

SEQ ID NO: 669751 - DNA, 25 bp, Mus musculus
gtagacttcaggttttacagtgtta

SEQ ID NO: 669752 - DNA, 25 bp, Mus musculus
gtagacttcataacatggctgtata

SEQ ID NO: 669753 - DNA, 25 bp, Mus musculus
gtagacttcatatcatggctgtata

SEQ ID NO: 669754 - DNA, 25 bp, Mus musculus
gtagacttcatgctagtgtttctta

SEQ ID NO: 669755 - DNA, 25 bp, Mus musculus
gtagacttcatggtagtgtttctta

SEQ ID NO: 669756 - DNA, 25 bp, Mus musculus
gtagacttccccagcatgtactggg

SEQ ID NO: 669757 - DNA, 25 bp, Mus musculus
gtagacttcccctgcatgtactggg

SEQ ID NO: 669758 - DNA, 25 bp, Mus musculus
gtagacttgatgagacttgatgatg

SEQ ID NO: 669759 - DNA, 25 bp, Mus musculus
gtagacttgatgtgacttgatgatg

SEQ ID NO: 669760 - DNA, 25 bp, Mus musculus
gtagacttggtgcacagagaaacat

SEQ ID NO: 669761 - DNA, 25 bp, Mus musculus
gtagacttggtggacagagaaacat

SEQ ID NO: 669762 - DNA, 25 bp, Mus musculus
gtagacttgtttatcatttgaggaa

SEQ ID NO: 669763 - DNA, 25 bp, Mus musculus
gtagacttgtttttcatttgaggaa

SEQ ID NO: 669764 - DNA, 25 bp, Mus musculus
gtagactttttgatcttttgcaata

SEQ ID NO: 669765 - DNA, 25 bp, Mus musculus
gtagactttttgttcttttgcaata

SEQ ID NO: 669766 - DNA, 25 bp, Mus musculus
gtagagaaaactccttcactgccag

SEQ ID NO: 669767 - DNA, 25 bp, Mus musculus
gtagagaaaactgcttcactgccag

SEQ ID NO: 669768 - DNA, 25 bp, Mus musculus
gtagagaaagctatgcagacactgc

SEQ ID NO: 669769 - DNA, 25 bp, Mus musculus
gtagagaaagctttgcagacactgc

SEQ ID NO: 669770 - DNA, 25 bp, Mus musculus
gtagagaacacgaacaccgctgcgc

SEQ ID NO: 669771 - DNA, 25 bp, Mus musculus
gtagagaacacgtacaccgctgcgc

SEQ ID NO: 669772 - DNA, 25 bp, Mus musculus
gtagagaagaatcccctcctctgca

SEQ ID NO: 669773 - DNA, 25 bp, Mus musculus
gtagagaagaatgccctcctctgca

SEQ ID NO: 669774 - DNA, 25 bp, Mus musculus
gtagagaagggcacaccacacccca

SEQ ID NO: 669775 - DNA, 25 bp, Mus musculus
gtagagaagggctcaccacacccca

SEQ ID NO: 669776 - DNA, 25 bp, Mus musculus
gtagagaatacaccatcccctggct

SEQ ID NO: 669777 - DNA, 25 bp, Mus musculus
gtagagaatacagcatcccctggct

SEQ ID NO: 669778 - DNA, 25 bp, Mus musculus
gtagagaataccaccccagaactgt

SEQ ID NO: 669779 - DNA, 25 bp, Mus musculus
gtagagaatacctccccagaactgt

SEQ ID NO: 669780 - DNA, 25 bp, Mus musculus
gtagagacagatccgcaggctttct

SEQ ID NO: 669781 - DNA, 25 bp, Mus musculus
gtagagacagatgcgcaggctttct

SEQ ID NO: 669782 - DNA, 25 bp, Mus musculus
gtagagacatgcatggaacccaata

SEQ ID NO: 669783 - DNA, 25 bp, Mus musculus
gtagagacatgcttggaacccaata

SEQ ID NO: 669784 - DNA, 25 bp, Mus musculus
gtagagaccaataactgtcccatag

SEQ ID NO: 669785 - DNA, 25 bp, Mus musculus
gtagagaccaattactgtcccatag

SEQ ID NO: 669786 - DNA, 25 bp, Mus musculus
gtagagacccttatcttgttctagt

SEQ ID NO: 669787 - DNA, 25 bp, Mus musculus
gtagagacccttttcttgttctagt

SEQ ID NO: 669788 - DNA, 25 bp, Mus musculus
gtagagacgttactgccttgttcta

SEQ ID NO: 669789 - DNA, 25 bp, Mus musculus
gtagagacgttagtgccttgttcta

SEQ ID NO: 669790 - DNA, 25 bp, Mus musculus
gtagagactctcacaatgcagcaac

SEQ ID NO: 669791 - DNA, 25 bp, Mus musculus
gtagagactctctcaatgcagcaac

SEQ ID NO: 669792 - DNA, 25 bp, Mus musculus
gtagagacttctctagtgctgccca

SEQ ID NO: 669793 - DNA, 25 bp, Mus musculus
gtagagacttctgtagtgctgccca

SEQ ID NO: 669794 - DNA, 25 bp, Mus musculus
gtagagagacccacctactgactga

SEQ ID NO: 669795 - DNA, 25 bp, Mus musculus
gtagagagaccctcctactgactga

SEQ ID NO: 669796 - DNA, 25 bp, Mus musculus
gtagagagacttacagcctggcacg

SEQ ID NO: 669797 - DNA, 25 bp, Mus musculus
gtagagagactttcagcctggcacg

SEQ ID NO: 669798 - DNA, 25 bp, Mus musculus
gtagagagaggtattttcaattatt

SEQ ID NO: 669799 - DNA, 25 bp, Mus musculus
gtagagagaggttttttcaattatt

SEQ ID NO: 669800 - DNA, 25 bp, Mus musculus
gtagagagatccaggctctctaaat

SEQ ID NO: 669801 - DNA, 25 bp, Mus musculus
gtagagagatcctggctctctaaat

SEQ ID NO: 669802 - DNA, 25 bp, Mus musculus
gtagagagcctcaagtaccaactgg

SEQ ID NO: 669803 - DNA, 25 bp, Mus musculus
gtagagagcctctagtaccaactgg

SEQ ID NO: 669804 - DNA, 25 bp, Mus musculus
gtagagagcggccttcctccagagc

SEQ ID NO: 669805 - DNA, 25 bp, Mus musculus
gtagagagcggcgttcctccagagc

SEQ ID NO: 669806 - DNA, 25 bp, Mus musculus
gtagagagctctatacctgagctat

SEQ ID NO: 669807 - DNA, 25 bp, Mus musculus
gtagagagctctttacctgagctat

SEQ ID NO: 669808 - DNA, 25 bp, Mus musculus
gtagagaggctaacttttattggag

SEQ ID NO: 669809 - DNA, 25 bp, Mus musculus
gtagagaggctatcttttattggag

SEQ ID NO: 669810 - DNA, 25 bp, Mus musculus
gtagagagggtccatcctggtactt

SEQ ID NO: 669811 - DNA, 25 bp, Mus musculus
gtagagagggtcgatcctggtactt

SEQ ID NO: 669812 - DNA, 25 bp, Mus musculus
gtagagatacatacgccaactggaa

SEQ ID NO: 669813 - DNA, 25 bp, Mus musculus
gtagagatacattcgccaactggaa

SEQ ID NO: 669814 - DNA, 25 bp, Mus musculus
gtagagatacctacatgtttaatta

SEQ ID NO: 669815 - DNA, 25 bp, Mus musculus
gtagagataccttcatgtttaatta

SEQ ID NO: 669816 - DNA, 25 bp, Mus musculus
gtagagataggcagagttcaacact

SEQ ID NO: 669817 - DNA, 25 bp, Mus musculus
gtagagataggctgagttcaacact

SEQ ID NO: 669818 - DNA, 25 bp, Mus musculus
gtagagatatgcagtccaggacaca

SEQ ID NO: 669819 - DNA, 25 bp, Mus musculus
gtagagatatgctgtccaggacaca

SEQ ID NO: 669820 - DNA, 25 bp, Mus musculus
gtagagatcttcctgagcatttggg

SEQ ID NO: 669821 - DNA, 25 bp, Mus musculus
gtagagatcttcgtgagcatttggg

SEQ ID NO: 669822 - DNA, 25 bp, Mus musculus
gtagagatgcacattgctcagtaat

SEQ ID NO: 669823 - DNA, 25 bp, Mus musculus
gtagagatgcactttgctcagtaat

SEQ ID NO: 669824 - DNA, 25 bp, Mus musculus
gtagagatgtcacatatgtccttca

SEQ ID NO: 669825 - DNA, 25 bp, Mus musculus
gtagagatgtcagatatgtccttca

SEQ ID NO: 669826 - DNA, 25 bp, Mus musculus
gtagagatgtgacaagccggccaaa

SEQ ID NO: 669827 - DNA, 25 bp, Mus musculus
gtagagatgtgagaagccggccaaa

SEQ ID NO: 669828 - DNA, 25 bp, Mus musculus
gtagagattgaacacccctgaagta

SEQ ID NO: 669829 - DNA, 25 bp, Mus musculus
gtagagattgaagacccctgaagta

SEQ ID NO: 669830 - DNA, 25 bp, Mus musculus
gtagagattgcccacgcagggtaaa

SEQ ID NO: 669831 - DNA, 25 bp, Mus musculus
gtagagattgccgacgcagggtaaa

SEQ ID NO: 669832 - DNA, 25 bp, Mus musculus
gtagagcaagacacatcgctcgcct

SEQ ID NO: 669833 - DNA, 25 bp, Mus musculus
gtagagcaagactcatcgctcgcct

SEQ ID NO: 669834 - DNA, 25 bp, Mus musculus
gtagagcaagcacaactgtaaccta

SEQ ID NO: 669835 - DNA, 25 bp, Mus musculus
gtagagcaagcactcaggtctgacc

SEQ ID NO: 669836 - DNA, 25 bp, Mus musculus
gtagagcaagcagaactgtaaccta

SEQ ID NO: 669837 - DNA, 25 bp, Mus musculus
gtagagcaagcagtcaggtctgacc

SEQ ID NO: 669838 - DNA, 25 bp, Mus musculus
gtagagcacatgatcaatcccagat

SEQ ID NO: 669839 - DNA, 25 bp, Mus musculus
gtagagcacatgttcaatcccagat

SEQ ID NO: 669840 - DNA, 25 bp, Mus musculus
gtagagcacctaacactttaacagc

SEQ ID NO: 669841 - DNA, 25 bp, Mus musculus
gtagagcacctatcactttaacagc

SEQ ID NO: 669842 - DNA, 25 bp, Mus musculus
gtagagcactttcctggcaggtcca

SEQ ID NO: 669843 - DNA, 25 bp, Mus musculus
gtagagcactttgctggcaggtcca

SEQ ID NO: 669844 - DNA, 25 bp, Mus musculus
gtagagcagcatcaagttacctagt

SEQ ID NO: 669845 - DNA, 25 bp, Mus musculus
gtagagcagcatgaagttacctagt

SEQ ID NO: 669846 - DNA, 25 bp, Mus musculus
gtagagcagtatatccctattctgt

SEQ ID NO: 669847 - DNA, 25 bp, Mus musculus
gtagagcagtatttccctattctgt

SEQ ID NO: 669848 - DNA, 25 bp, Mus musculus
gtagagcagtgtctctagtcctcca

SEQ ID NO: 669849 - DNA, 25 bp, Mus musculus
gtagagcagtgtgtctagtcctcca

SEQ ID NO: 669850 - DNA, 25 bp, Mus musculus
gtagagcattgcagcactatgactg

SEQ ID NO: 669851 - DNA, 25 bp, Mus musculus
gtagagcattgctgcactatgactg

SEQ ID NO: 669852 - DNA, 25 bp, Mus musculus
gtagagccagacaatagcacccggc

SEQ ID NO: 669853 - DNA, 25 bp, Mus musculus
gtagagccagactatagcacccggc

SEQ ID NO: 669854 - DNA, 25 bp, Mus musculus
gtagagccaggcaagggcacagcct

SEQ ID NO: 669855 - DNA, 25 bp, Mus musculus
gtagagccaggctagggcacagcct

SEQ ID NO: 669856 - DNA, 25 bp, Mus musculus
gtagagccagggactcacagtagaa

SEQ ID NO: 669857 - DNA, 25 bp, Mus musculus
gtagagccagggtctcacagtagaa

SEQ ID NO: 669858 - DNA, 25 bp, Mus musculus
gtagagccatacatcactgtttccc

SEQ ID NO: 669859 - DNA, 25 bp, Mus musculus
gtagagccatacttcactgtttccc

SEQ ID NO: 669860 - DNA, 25 bp, Mus musculus
gtagagcccaggaccatcagctgtg

SEQ ID NO: 669861 - DNA, 25 bp, Mus musculus
gtagagcccaggtccatcagctgtg

SEQ ID NO: 669862 - DNA, 25 bp, Mus musculus
gtagagccctagaatcctctagtga

SEQ ID NO: 669863 - DNA, 25 bp, Mus musculus
gtagagccctagtatcctctagtga

SEQ ID NO: 669864 - DNA, 25 bp, Mus musculus
gtagagccctgcaggctggaccagt

SEQ ID NO: 669865 - DNA, 25 bp, Mus musculus
gtagagccctgctggctggaccagt

SEQ ID NO: 669866 - DNA, 25 bp, Mus musculus
gtagagccgaggacaagcccaagtt

SEQ ID NO: 669867 - DNA, 25 bp, Mus musculus
gtagagccgaggtcaagcccaagtt

SEQ ID NO: 669868 - DNA, 25 bp, Mus musculus
gtagagcctactattaccatgtcgc

SEQ ID NO: 669869 - DNA, 25 bp, Mus musculus
gtagagcctacttttaccatgtcgc

SEQ ID NO: 669870 - DNA, 25 bp, Mus musculus
gtagagcctcctacaaacagagtag

SEQ ID NO: 669871 - DNA, 25 bp, Mus musculus
gtagagcctccttcaaacagagtag

SEQ ID NO: 669872 - DNA, 25 bp, Mus musculus
gtagagcctcgtctggtcatatgta

SEQ ID NO: 669873 - DNA, 25 bp, Mus musculus
gtagagcctcgtgtggtcatatgta

SEQ ID NO: 669874 - DNA, 25 bp, Mus musculus
gtagagcctggtccatatgcagaga

SEQ ID NO: 669875 - DNA, 25 bp, Mus musculus
gtagagcctggtgcatatgcagaga

SEQ ID NO: 669876 - DNA, 25 bp, Mus musculus
gtagagccttgaccgaacaccttcg

SEQ ID NO: 669877 - DNA, 25 bp, Mus musculus
gtagagccttgagcgaacaccttcg

SEQ ID NO: 669878 - DNA, 25 bp, Mus musculus
gtagagcggctgaccaaggagttct

SEQ ID NO: 669879 - DNA, 25 bp, Mus musculus
gtagagcggctgtccaaggagttct

SEQ ID NO: 669880 - DNA, 25 bp, Mus musculus
gtagagcggcttaaagacctgttgt

SEQ ID NO: 669881 - DNA, 25 bp, Mus musculus
gtagagcggctttaagacctgttgt

SEQ ID NO: 669882 - DNA, 25 bp, Mus musculus
gtagagctaataatgccttcctgcc

SEQ ID NO: 669883 - DNA, 25 bp, Mus musculus
gtagagctaatattgccttcctgcc

SEQ ID NO: 669884 - DNA, 25 bp, Mus musculus
gtagagctaggcatcgccttcaagg

SEQ ID NO: 669885 - DNA, 25 bp, Mus musculus
gtagagctaggcttcgccttcaagg

SEQ ID NO: 669886 - DNA, 25 bp, Mus musculus
gtagagctcaaaaccattcgttcaa

SEQ ID NO: 669887 - DNA, 25 bp, Mus musculus
gtagagctcaaatccattcgttcaa

SEQ ID NO: 669888 - DNA, 25 bp, Mus musculus
gtagagctcctgaggtactgttcca

SEQ ID NO: 669889 - DNA, 25 bp, Mus musculus
gtagagctcctgtggtactgttcca

SEQ ID NO: 669890 - DNA, 25 bp, Mus musculus
gtagagctctagattatagccatag

SEQ ID NO: 669891 - DNA, 25 bp, Mus musculus
gtagagctctagtttatagccatag

SEQ ID NO: 669892 - DNA, 25 bp, Mus musculus
gtagagctgccacgctgagcacgat

SEQ ID NO: 669893 - DNA, 25 bp, Mus musculus
gtagagctgccaggctgagcacgat

SEQ ID NO: 669894 - DNA, 25 bp, Mus musculus
gtagagctgcgaaccagacagcacc

SEQ ID NO: 669895 - DNA, 25 bp, Mus musculus
gtagagctgcgatccagacagcacc

SEQ ID NO: 669896 - DNA, 25 bp, Mus musculus
gtagagctgctcctgacaatagaat

SEQ ID NO: 669897 - DNA, 25 bp, Mus musculus
gtagagctgctcgtgacaatagaat

SEQ ID NO: 669898 - DNA, 25 bp, Mus musculus
gtagagctgttgcagtcactgaact

SEQ ID NO: 669899 - DNA, 25 bp, Mus musculus
gtagagctgttggagtcactgaact

SEQ ID NO: 669900 - DNA, 25 bp, Mus musculus
gtagagcttacaagtatttgttata

SEQ ID NO: 669901 - DNA, 25 bp, Mus musculus
gtagagcttacatgtatttgttata

SEQ ID NO: 669902 - DNA, 25 bp, Mus musculus
gtagagcttgggactctcagaccct

SEQ ID NO: 669903 - DNA, 25 bp, Mus musculus
gtagagcttgggtctctcagaccct

SEQ ID NO: 669904 - DNA, 25 bp, Mus musculus
gtagagcttggtaagagaatgcttt

SEQ ID NO: 669905 - DNA, 25 bp, Mus musculus
gtagagcttggttagagaatgcttt

SEQ ID NO: 669906 - DNA, 25 bp, Mus musculus
gtagagcttgttacatgtttccaaa

SEQ ID NO: 669907 - DNA, 25 bp, Mus musculus
gtagagcttgtttcatgtttccaaa

SEQ ID NO: 669908 - DNA, 25 bp, Mus musculus
gtagagctttccacatcctttggaa

SEQ ID NO: 669909 - DNA, 25 bp, Mus musculus
gtagagctttcctcatcctttggaa

SEQ ID NO: 669910 - DNA, 25 bp, Mus musculus
gtagagcttttgcacttgtatcaga

SEQ ID NO: 669911 - DNA, 25 bp, Mus musculus
gtagagcttttggacttgtatcaga

SEQ ID NO: 669912 - DNA, 25 bp, Mus musculus
gtagagctttttccgtggcattgta

SEQ ID NO: 669913 - DNA, 25 bp, Mus musculus
gtagagctttttgcgtggcattgta

SEQ ID NO: 669914 - DNA, 25 bp, Mus musculus
gtagaggaaagacccctgcttgcag

SEQ ID NO: 669915 - DNA, 25 bp, Mus musculus
gtagaggaaagagccctgcttgcag

SEQ ID NO: 669916 - DNA, 25 bp, Mus musculus
gtagaggaacggaagcccacgccca

SEQ ID NO: 669917 - DNA, 25 bp, Mus musculus
gtagaggaacggtagcccacgccca

SEQ ID NO: 669918 - DNA, 25 bp, Mus musculus
gtagaggaatgcatccagagtttaa

SEQ ID NO: 669919 - DNA, 25 bp, Mus musculus
gtagaggaatgcttccagagtttaa

SEQ ID NO: 669920 - DNA, 25 bp, Mus musculus
gtagaggacactcaagcacgcactc

SEQ ID NO: 669921 - DNA, 25 bp, Mus musculus
gtagaggacactgaagcacgcactc

SEQ ID NO: 669922 - DNA, 25 bp, Mus musculus
gtagaggacagtaacctgtctgtct

SEQ ID NO: 669923 - DNA, 25 bp, Mus musculus
gtagaggacagttacctgtctgtct

SEQ ID NO: 669924 - DNA, 25 bp, Mus musculus
gtagaggacatcagcagtcaactcc

SEQ ID NO: 669925 - DNA, 25 bp, Mus musculus
gtagaggacatctgcagtcaactcc

SEQ ID NO: 669926 - DNA, 25 bp, Mus musculus
gtagaggaccctacttcagttccta

SEQ ID NO: 669927 - DNA, 25 bp, Mus musculus
gtagaggacccttcttcagttccta

SEQ ID NO: 669928 - DNA, 25 bp, Mus musculus
gtagaggaccttcagcatctctttt

SEQ ID NO: 669929 - DNA, 25 bp, Mus musculus
gtagaggaccttgagcatctctttt

SEQ ID NO: 669930 - DNA, 25 bp, Mus musculus
gtagaggactaaagatcgctgcggt

SEQ ID NO: 669931 - DNA, 25 bp, Mus musculus
gtagaggactaatgatcgctgcggt

SEQ ID NO: 669932 - DNA, 25 bp, Mus musculus
gtagaggacttcactagcaggcagg

SEQ ID NO: 669933 - DNA, 25 bp, Mus musculus
gtagaggacttctctagcaggcagg

SEQ ID NO: 669934 - DNA, 25 bp, Mus musculus
gtagaggcaaccagatctgtttgag

SEQ ID NO: 669935 - DNA, 25 bp, Mus musculus
gtagaggcaacctgatctgtttgag

SEQ ID NO: 669936 - DNA, 25 bp, Mus musculus
gtagaggccaaacttcgaccttcag

SEQ ID NO: 669937 - DNA, 25 bp, Mus musculus
gtagaggccaaagttcgaccttcag

SEQ ID NO: 669938 - DNA, 25 bp, Mus musculus
gtagaggcccataagtcgtgcaaac

SEQ ID NO: 669939 - DNA, 25 bp, Mus musculus
gtagaggcccattagtcgtgcaaac

SEQ ID NO: 669940 - DNA, 25 bp, Mus musculus
gtagaggccctgaccactctggaag

SEQ ID NO: 669941 - DNA, 25 bp, Mus musculus
gtagaggccctgtccactctggaag

SEQ ID NO: 669942 - DNA, 25 bp, Mus musculus
gtagaggcctggcacaccctagtag

SEQ ID NO: 669943 - DNA, 25 bp, Mus musculus
gtagaggcctgggacaccctagtag

SEQ ID NO: 669944 - DNA, 25 bp, Mus musculus
gtagaggcctgtaagtccggctcct

SEQ ID NO: 669945 - DNA, 25 bp, Mus musculus
gtagaggcctgttagtccggctcct

SEQ ID NO: 669946 - DNA, 25 bp, Mus musculus
gtagaggctgttcagactgagatcc

SEQ ID NO: 669947 - DNA, 25 bp, Mus musculus
gtagaggctgttgagactgagatcc

SEQ ID NO: 669948 - DNA, 25 bp, Mus musculus
gtagaggcttcgcaaaccttcaaga

SEQ ID NO: 669949 - DNA, 25 bp, Mus musculus
gtagaggcttcggaaaccttcaaga

SEQ ID NO: 669950 - DNA, 25 bp, Mus musculus
gtagaggcttttcgagacccttctg

SEQ ID NO: 669951 - DNA, 25 bp, Mus musculus
gtagaggcttttggagacccttctg

SEQ ID NO: 669952 - DNA, 25 bp, Mus musculus
gtagagggcatcctttggcctgatc

SEQ ID NO: 669953 - DNA, 25 bp, Mus musculus
gtagagggcatcgtttggcctgatc

SEQ ID NO: 669954 - DNA, 25 bp, Mus musculus
gtagagggtatcacctatgaccagc

SEQ ID NO: 669955 - DNA, 25 bp, Mus musculus
gtagagggtatctcctatgaccagc

SEQ ID NO: 669956 - DNA, 25 bp, Mus musculus
gtagagggtttcatcatactcagaa

SEQ ID NO: 669957 - DNA, 25 bp, Mus musculus
gtagagggtttcttcatactcagaa

SEQ ID NO: 669958 - DNA, 25 bp, Mus musculus
gtagaggtcacaagaaggcatcaga

SEQ ID NO: 669959 - DNA, 25 bp, Mus musculus
gtagaggtcacatgaaggcatcaga

SEQ ID NO: 669960 - DNA, 25 bp, Mus musculus
gtagaggtcagaaacctgggtcatt

SEQ ID NO: 669961 - DNA, 25 bp, Mus musculus
gtagaggtcagatacctgggtcatt

SEQ ID NO: 669962 - DNA, 25 bp, Mus musculus
gtagaggtccccagtgcaaggcaaa

SEQ ID NO: 669963 - DNA, 25 bp, Mus musculus
gtagaggtcccctgtgcaaggcaaa

SEQ ID NO: 669964 - DNA, 25 bp, Mus musculus
gtagaggtctatcagctgtgactgc

SEQ ID NO: 669965 - DNA, 25 bp, Mus musculus
gtagaggtctatgagctgtgactgc

SEQ ID NO: 669966 - DNA, 25 bp, Mus musculus
gtagaggtctggaattgatcatcat

SEQ ID NO: 669967 - DNA, 25 bp, Mus musculus
gtagaggtctggtattgatcatcat

SEQ ID NO: 669968 - DNA, 25 bp, Mus musculus
gtagaggttataagggtcagcagaa

SEQ ID NO: 669969 - DNA, 25 bp, Mus musculus
gtagaggttatatgggtcagcagaa

SEQ ID NO: 669970 - DNA, 25 bp, Mus musculus
gtagaggttattcagaccttcaagc

SEQ ID NO: 669971 - DNA, 25 bp, Mus musculus
gtagaggttattgagaccttcaagc

SEQ ID NO: 669972 - DNA, 25 bp, Mus musculus
gtagaggttccccatgtcattcatc

SEQ ID NO: 669973 - DNA, 25 bp, Mus musculus
gtagaggttcccgatgtcattcatc

SEQ ID NO: 669974 - DNA, 25 bp, Mus musculus
gtagagtaatacaaagtaccaggtt

SEQ ID NO: 669975 - DNA, 25 bp, Mus musculus
gtagagtaatactaagtaccaggtt

SEQ ID NO: 669976 - DNA, 25 bp, Mus musculus
gtagagtacacactgatcttgccga

SEQ ID NO: 669977 - DNA, 25 bp, Mus musculus
gtagagtacacagtgatcttgccga

SEQ ID NO: 669978 - DNA, 25 bp, Mus musculus
gtagagtacattcgtgcgctgcagc

SEQ ID NO: 669979 - DNA, 25 bp, Mus musculus
gtagagtacattggtgcgctgcagc

SEQ ID NO: 669980 - DNA, 25 bp, Mus musculus
gtagagtacttgacttacataggca

SEQ ID NO: 669981 - DNA, 25 bp, Mus musculus
gtagagtacttgtcttacataggca

SEQ ID NO: 669982 - DNA, 25 bp, Mus musculus
gtagagtagaacagcccggtgagtg

SEQ ID NO: 669983 - DNA, 25 bp, Mus musculus
gtagagtagaactgcccggtgagtg

SEQ ID NO: 669984 - DNA, 25 bp, Mus musculus
gtagagtagccaagtgtgccaccat

SEQ ID NO: 669985 - DNA, 25 bp, Mus musculus
gtagagtagccatgtgtgccaccat

SEQ ID NO: 669986 - DNA, 25 bp, Mus musculus
gtagagtagccccacagcagtaggt

SEQ ID NO: 669987 - DNA, 25 bp, Mus musculus
gtagagtagcccgacagcagtaggt

SEQ ID NO: 669988 - DNA, 25 bp, Mus musculus
gtagagtatgaaaccaatgctgaga

SEQ ID NO: 669989 - DNA, 25 bp, Mus musculus
gtagagtatgaatccaatgctgaga

SEQ ID NO: 669990 - DNA, 25 bp, Mus musculus
gtagagtcacacctcccagctaggt

SEQ ID NO: 669991 - DNA, 25 bp, Mus musculus
gtagagtcacacgtcccagctaggt

SEQ ID NO: 669992 - DNA, 25 bp, Mus musculus
gtagagtcatgcatttctgtttata

SEQ ID NO: 669993 - DNA, 25 bp, Mus musculus
gtagagtcatgcttttctgtttata

SEQ ID NO: 669994 - DNA, 25 bp, Mus musculus
gtagagtccactctgtgctgctgtg

SEQ ID NO: 669995 - DNA, 25 bp, Mus musculus
gtagagtccactgtgtgctgctgtg

SEQ ID NO: 669996 - DNA, 25 bp, Mus musculus
gtagagtcccttagagctggctgta

SEQ ID NO: 669997 - DNA, 25 bp, Mus musculus
gtagagtccctttgagctggctgta

SEQ ID NO: 669998 - DNA, 25 bp, Mus musculus
gtagagtctgacatcgacgatgcca

SEQ ID NO: 669999 - DNA, 25 bp, Mus musculus
gtagagtctgacttcgacgatgcca

SEQ ID NO: 670000 - DNA, 25 bp, Mus musculus
gtagagtctgataggacatatcctt

SEQ ID NO: 670001 - DNA, 25 bp, Mus musculus
gtagagtctgattggacatatcctt

SEQ ID NO: 670002 - DNA, 25 bp, Mus musculus
gtagagtcttcaagctttttgagga

SEQ ID NO: 670003 - DNA, 25 bp, Mus musculus
gtagagtcttcaataaagccatcaa

SEQ ID NO: 670004 - DNA, 25 bp, Mus musculus
gtagagtcttcatgctttttgagga

SEQ ID NO: 670005 - DNA, 25 bp, Mus musculus
gtagagtcttcattaaagccatcaa

SEQ ID NO: 670006 - DNA, 25 bp, Mus musculus
gtagagtcttctccagatgtcaaaa

SEQ ID NO: 670007 - DNA, 25 bp, Mus musculus
gtagagtcttctgcagatgtcaaaa

SEQ ID NO: 670008 - DNA, 25 bp, Mus musculus
gtagagtgacacctcatatcccatc

SEQ ID NO: 670009 - DNA, 25 bp, Mus musculus
gtagagtgacacgtcatatcccatc

SEQ ID NO: 670010 - DNA, 25 bp, Mus musculus
gtagagtgccagagccaccggctga

SEQ ID NO: 670011 - DNA, 25 bp, Mus musculus
gtagagtgccagtgccaccggctga

SEQ ID NO: 670012 - DNA, 25 bp, Mus musculus
gtagagtgctcactgtggcagttta

SEQ ID NO: 670013 - DNA, 25 bp, Mus musculus
gtagagtgctcagtgtggcagttta

SEQ ID NO: 670014 - DNA, 25 bp, Mus musculus
gtagagtgtcttacttccttttgac

SEQ ID NO: 670015 - DNA, 25 bp, Mus musculus
gtagagtgtctttcttccttttgac

SEQ ID NO: 670016 - DNA, 25 bp, Mus musculus
gtagagtgttgtacatagccacaca

SEQ ID NO: 670017 - DNA, 25 bp, Mus musculus
gtagagtgttgttcatagccacaca

SEQ ID NO: 670018 - DNA, 25 bp, Mus musculus
gtagagttacacatcgggctgcaaa

SEQ ID NO: 670019 - DNA, 25 bp, Mus musculus
gtagagttacacttcgggctgcaaa

SEQ ID NO: 670020 - DNA, 25 bp, Mus musculus
gtagagttaggtctcggcttctaat

SEQ ID NO: 670021 - DNA, 25 bp, Mus musculus
gtagagttaggtgtcggcttctaat

SEQ ID NO: 670022 - DNA, 25 bp, Mus musculus
gtagagttcctcacgggagacacaa

SEQ ID NO: 670023 - DNA, 25 bp, Mus musculus
gtagagttcctctcgggagacacaa

SEQ ID NO: 670024 - DNA, 25 bp, Mus musculus
gtagagttctccacttgttttgtaa

SEQ ID NO: 670025 - DNA, 25 bp, Mus musculus
gtagagttctcctcttgttttgtaa

SEQ ID NO: 670026 - DNA, 25 bp, Mus musculus
gtagagttctctagcagggcaggta

SEQ ID NO: 670027 - DNA, 25 bp, Mus musculus
gtagagttctcttgcagggcaggta

SEQ ID NO: 670028 - DNA, 25 bp, Mus musculus
gtagagttgaccaggcttggagtct

SEQ ID NO: 670029 - DNA, 25 bp, Mus musculus
gtagagttgacctggcttggagtct

SEQ ID NO: 670030 - DNA, 25 bp, Mus musculus
gtagagtttctccaagattgcaaaa

SEQ ID NO: 670031 - DNA, 25 bp, Mus musculus
gtagagtttctcgaagattgcaaaa

SEQ ID NO: 670032 - DNA, 25 bp, Mus musculus
gtagagtttgcccattttatatatg

SEQ ID NO: 670033 - DNA, 25 bp, Mus musculus
gtagagtttgccgattttatatatg

SEQ ID NO: 670034 - DNA, 25 bp, Mus musculus
gtagagtttttcatatgaccgtcaa

SEQ ID NO: 670035 - DNA, 25 bp, Mus musculus
gtagagtttttcttatgaccgtcaa

SEQ ID NO: 670036 - DNA, 25 bp, Mus musculus
gtagataacaatctcacggctgttt

SEQ ID NO: 670037 - DNA, 25 bp, Mus musculus
gtagataacaatgtcacggctgttt

SEQ ID NO: 670038 - DNA, 25 bp, Mus musculus
gtagataacatcaggactgcccggc

SEQ ID NO: 670039 - DNA, 25 bp, Mus musculus
gtagataacatctggactgcccggc

SEQ ID NO: 670040 - DNA, 25 bp, Mus musculus
gtagataacctccatgggacaagtt

SEQ ID NO: 670041 - DNA, 25 bp, Mus musculus
gtagataacctcgatgggacaagtt

SEQ ID NO: 670042 - DNA, 25 bp, Mus musculus
gtagataacttgcaccctgatttaa

SEQ ID NO: 670043 - DNA, 25 bp, Mus musculus
gtagataacttggaccctgatttaa

SEQ ID NO: 670044 - DNA, 25 bp, Mus musculus
gtagataatgctagaactgagttga

SEQ ID NO: 670045 - DNA, 25 bp, Mus musculus
gtagataatgctatgccctgcacag

SEQ ID NO: 670046 - DNA, 25 bp, Mus musculus
gtagataatgcttgaactgagttga

SEQ ID NO: 670047 - DNA, 25 bp, Mus musculus
gtagataatgctttgccctgcacag

SEQ ID NO: 670048 - DNA, 25 bp, Mus musculus
gtagatacacaccactgccaggatt

SEQ ID NO: 670049 - DNA, 25 bp, Mus musculus
gtagatacacacgactgccaggatt

SEQ ID NO: 670050 - DNA, 25 bp, Mus musculus
gtagatacactgagccactttagag

SEQ ID NO: 670051 - DNA, 25 bp, Mus musculus
gtagatacactgtgccactttagag

SEQ ID NO: 670052 - DNA, 25 bp, Mus musculus
gtagatacagccaccatacatctct

SEQ ID NO: 670053 - DNA, 25 bp, Mus musculus
gtagatacagcctccatacatctct

SEQ ID NO: 670054 - DNA, 25 bp, Mus musculus
gtagatacatcacccgagtgcgcaa

SEQ ID NO: 670055 - DNA, 25 bp, Mus musculus
gtagatacatcagccgagtgcgcaa

SEQ ID NO: 670056 - DNA, 25 bp, Mus musculus
gtagatacatgaacctgccacttta

SEQ ID NO: 670057 - DNA, 25 bp, Mus musculus
gtagatacatgatcctgccacttta

SEQ ID NO: 670058 - DNA, 25 bp, Mus musculus
gtagataccaggcttacaccggaaa

SEQ ID NO: 670059 - DNA, 25 bp, Mus musculus
gtagataccagggttacaccggaaa

SEQ ID NO: 670060 - DNA, 25 bp, Mus musculus
gtagataccctaagccctgaagagg

SEQ ID NO: 670061 - DNA, 25 bp, Mus musculus
gtagataccctatgccctgaagagg

SEQ ID NO: 670062 - DNA, 25 bp, Mus musculus
gtagatacctccctgagtggctcaa

SEQ ID NO: 670063 - DNA, 25 bp, Mus musculus
gtagatacctccgtgagtggctcaa

SEQ ID NO: 670064 - DNA, 25 bp, Mus musculus
gtagatacgattattgaggcaaatc

SEQ ID NO: 670065 - DNA, 25 bp, Mus musculus
gtagatacgatttttgaggcaaatc

SEQ ID NO: 670066 - DNA, 25 bp, Mus musculus
gtagatactaaactcagacacttca

SEQ ID NO: 670067 - DNA, 25 bp, Mus musculus
gtagatactaaagtcagacacttca

SEQ ID NO: 670068 - DNA, 25 bp, Mus musculus
gtagatactacacagttctttgact

SEQ ID NO: 670069 - DNA, 25 bp, Mus musculus
gtagatactacagagttctttgact

SEQ ID NO: 670070 - DNA, 25 bp, Mus musculus
gtagatactcaaatacagccaacta

SEQ ID NO: 670071 - DNA, 25 bp, Mus musculus
gtagatactcaattacagccaacta

SEQ ID NO: 670072 - DNA, 25 bp, Mus musculus
gtagatagacttcgccaccgctgag

SEQ ID NO: 670073 - DNA, 25 bp, Mus musculus
gtagatagacttggccaccgctgag

SEQ ID NO: 670074 - DNA, 25 bp, Mus musculus
gtagatagcttaataccagttccaa

SEQ ID NO: 670075 - DNA, 25 bp, Mus musculus
gtagatagcttattaccagttccaa

SEQ ID NO: 670076 - DNA, 25 bp, Mus musculus
gtagatataaacatatgtgcacacg

SEQ ID NO: 670077 - DNA, 25 bp, Mus musculus
gtagatataaacttatgtgcacacg

SEQ ID NO: 670078 - DNA, 25 bp, Mus musculus
gtagatatacagcatcgccccaatc

SEQ ID NO: 670079 - DNA, 25 bp, Mus musculus
gtagatatacaggatcgccccaatc

SEQ ID NO: 670080 - DNA, 25 bp, Mus musculus
gtagatatatgccacagagtctgtg

SEQ ID NO: 670081 - DNA, 25 bp, Mus musculus
gtagatatatgcgacagagtctgtg

SEQ ID NO: 670082 - DNA, 25 bp, Mus musculus
gtagatatcaccactcagatcatta

SEQ ID NO: 670083 - DNA, 25 bp, Mus musculus
gtagatatcacctctcagatcatta

SEQ ID NO: 670084 - DNA, 25 bp, Mus musculus
gtagatatccttcagtacagcctgg

SEQ ID NO: 670085 - DNA, 25 bp, Mus musculus
gtagatatccttgagtacagcctgg

SEQ ID NO: 670086 - DNA, 25 bp, Mus musculus
gtagatatctcaaggtcatattttt

SEQ ID NO: 670087 - DNA, 25 bp, Mus musculus
gtagatatctcatggtcatattttt

SEQ ID NO: 670088 - DNA, 25 bp, Mus musculus
gtagatattaaacacctctccaggt

SEQ ID NO: 670089 - DNA, 25 bp, Mus musculus
gtagatattaaagacctctccaggt

SEQ ID NO: 670090 - DNA, 25 bp, Mus musculus
gtagatattcttaatgccacagatg

SEQ ID NO: 670091 - DNA, 25 bp, Mus musculus
gtagatattctttatgccacagatg

SEQ ID NO: 670092 - DNA, 25 bp, Mus musculus
gtagatattgatacattctccataa

SEQ ID NO: 670093 - DNA, 25 bp, Mus musculus
gtagatattgattcattctccataa

SEQ ID NO: 670094 - DNA, 25 bp, Mus musculus
gtagatatttataccaagtttgatg

SEQ ID NO: 670095 - DNA, 25 bp, Mus musculus
gtagatatttattccaagtttgatg

SEQ ID NO: 670096 - DNA, 25 bp, Mus musculus
gtagatcaacatatttaaaaggctt

SEQ ID NO: 670097 - DNA, 25 bp, Mus musculus
gtagatcaacatttttaaaaggctt

SEQ ID NO: 670098 - DNA, 25 bp, Mus musculus
gtagatcactctacactgtatgtat

SEQ ID NO: 670099 - DNA, 25 bp, Mus musculus
gtagatcactcttcactgtatgtat

SEQ ID NO: 670100 - DNA, 25 bp, Mus musculus
gtagatcactggatagtacgttttt

SEQ ID NO: 670101 - DNA, 25 bp, Mus musculus
gtagatcactggttagtacgttttt

SEQ ID NO: 670102 - DNA, 25 bp, Mus musculus
gtagatcagaggctcccaactgggc

SEQ ID NO: 670103 - DNA, 25 bp, Mus musculus
gtagatcagagggtcccaactgggc

SEQ ID NO: 670104 - DNA, 25 bp, Mus musculus
gtagatcagattctcagttcctcac

SEQ ID NO: 670105 - DNA, 25 bp, Mus musculus
gtagatcagattgtcagttcctcac

SEQ ID NO: 670106 - DNA, 25 bp, Mus musculus
gtagatcagcaaacactcaagcttt

SEQ ID NO: 670107 - DNA, 25 bp, Mus musculus
gtagatcagcaatcactcaagcttt

SEQ ID NO: 670108 - DNA, 25 bp, Mus musculus
gtagatcagtcactcattcataatt

SEQ ID NO: 670109 - DNA, 25 bp, Mus musculus
gtagatcagtcagtcattcataatt

SEQ ID NO: 670110 - DNA, 25 bp, Mus musculus
gtagatcatcagactcagggtctgt

SEQ ID NO: 670111 - DNA, 25 bp, Mus musculus
gtagatcatcagtctcagggtctgt

SEQ ID NO: 670112 - DNA, 25 bp, Mus musculus
gtagatcatggcatctcagtgttct

SEQ ID NO: 670113 - DNA, 25 bp, Mus musculus
gtagatcatggcttctcagtgttct

SEQ ID NO: 670114 - DNA, 25 bp, Mus musculus
gtagatcatgttcctcaattgcttt

SEQ ID NO: 670115 - DNA, 25 bp, Mus musculus
gtagatcatgttgctcaattgcttt

SEQ ID NO: 670116 - DNA, 25 bp, Mus musculus
gtagatccaatcaaccacttttgct

SEQ ID NO: 670117 - DNA, 25 bp, Mus musculus
gtagatccaatctaccacttttgct

SEQ ID NO: 670118 - DNA, 25 bp, Mus musculus
gtagatccagatcgtaagggcagat

SEQ ID NO: 670119 - DNA, 25 bp, Mus musculus
gtagatccagatggtaagggcagat

SEQ ID NO: 670120 - DNA, 25 bp, Mus musculus
gtagatccagttcttccagccgctt

SEQ ID NO: 670121 - DNA, 25 bp, Mus musculus
gtagatccagttgttccagccgctt

SEQ ID NO: 670122 - DNA, 25 bp, Mus musculus
gtagatccatctctaattggctttt

SEQ ID NO: 670123 - DNA, 25 bp, Mus musculus
gtagatccatctgtaattggctttt

SEQ ID NO: 670124 - DNA, 25 bp, Mus musculus
gtagatccattgactgttctattta

SEQ ID NO: 670125 - DNA, 25 bp, Mus musculus
gtagatccattgtctgttctattta

SEQ ID NO: 670126 - DNA, 25 bp, Mus musculus
gtagatcccaaaaaccgtgcagcga

SEQ ID NO: 670127 - DNA, 25 bp, Mus musculus
gtagatcccaaataccgtgcagcga

SEQ ID NO: 670128 - DNA, 25 bp, Mus musculus
gtagatcccctacacaaacacattc

SEQ ID NO: 670129 - DNA, 25 bp, Mus musculus
gtagatcccctagacaaacacattc

SEQ ID NO: 670130 - DNA, 25 bp, Mus musculus
gtagatccgtcacaccattaccgtg

SEQ ID NO: 670131 - DNA, 25 bp, Mus musculus
gtagatccgtcagaccattaccgtg

SEQ ID NO: 670132 - DNA, 25 bp, Mus musculus
gtagatcctactattgacaactcag

SEQ ID NO: 670133 - DNA, 25 bp, Mus musculus
gtagatcctacttttgacaactcag

SEQ ID NO: 670134 - DNA, 25 bp, Mus musculus
gtagatcctgaaaactgcagctctg

SEQ ID NO: 670135 - DNA, 25 bp, Mus musculus
gtagatcctgaatactgcagctctg

SEQ ID NO: 670136 - DNA, 25 bp, Mus musculus
gtagatcctgatcgttgtttgcacg

SEQ ID NO: 670137 - DNA, 25 bp, Mus musculus
gtagatcctgatggttgtttgcacg

SEQ ID NO: 670138 - DNA, 25 bp, Mus musculus
gtagatcggttccttaattcctcga

SEQ ID NO: 670139 - DNA, 25 bp, Mus musculus
gtagatcggttcgttaattcctcga

SEQ ID NO: 670140 - DNA, 25 bp, Mus musculus
gtagatctagttacaacctgccata

SEQ ID NO: 670141 - DNA, 25 bp, Mus musculus
gtagatctagtttcaacctgccata

SEQ ID NO: 670142 - DNA, 25 bp, Mus musculus
gtagatctcagaacatacaccatca

SEQ ID NO: 670143 - DNA, 25 bp, Mus musculus
gtagatctcagatcatacaccatca

SEQ ID NO: 670144 - DNA, 25 bp, Mus musculus
gtagatctcaggagatgcagagcag

SEQ ID NO: 670145 - DNA, 25 bp, Mus musculus
gtagatctcaggtgatgcagagcag

SEQ ID NO: 670146 - DNA, 25 bp, Mus musculus
gtagatctcctgatttagtctctgg

SEQ ID NO: 670147 - DNA, 25 bp, Mus musculus
gtagatctcctgttttagtctctgg

SEQ ID NO: 670148 - DNA, 25 bp, Mus musculus
gtagatctcttaaagcttccaaaca

SEQ ID NO: 670149 - DNA, 25 bp, Mus musculus
gtagatctcttatagcttccaaaca

SEQ ID NO: 670150 - DNA, 25 bp, Mus musculus
gtagatctgactacatttaaaggat

SEQ ID NO: 670151 - DNA, 25 bp, Mus musculus
gtagatctgacttcatttaaaggat

SEQ ID NO: 670152 - DNA, 25 bp, Mus musculus
gtagatctgcttccttgtcagaact

SEQ ID NO: 670153 - DNA, 25 bp, Mus musculus
gtagatctgcttgcttgtcagaact

SEQ ID NO: 670154 - DNA, 25 bp, Mus musculus
gtagatctgttccttagcttgcata

SEQ ID NO: 670155 - DNA, 25 bp, Mus musculus
gtagatctgttcgttagcttgcata

SEQ ID NO: 670156 - DNA, 25 bp, Mus musculus
gtagatcttaatcacaattgctaaa

SEQ ID NO: 670157 - DNA, 25 bp, Mus musculus
gtagatcttaatgacaattgctaaa

SEQ ID NO: 670158 - DNA, 25 bp, Mus musculus
gtagatcttacgaagctgcagcatc

SEQ ID NO: 670159 - DNA, 25 bp, Mus musculus
gtagatcttacgtagctgcagcatc

SEQ ID NO: 670160 - DNA, 25 bp, Mus musculus
gtagatcttcatattattgcgttag

SEQ ID NO: 670161 - DNA, 25 bp, Mus musculus
gtagatcttcattttattgcgttag

SEQ ID NO: 670162 - DNA, 25 bp, Mus musculus
gtagatctttcccatctcaactgag

SEQ ID NO: 670163 - DNA, 25 bp, Mus musculus
gtagatctttccgatctcaactgag

SEQ ID NO: 670164 - DNA, 25 bp, Mus musculus
gtagatctttgcactttgtatcaca

SEQ ID NO: 670165 - DNA, 25 bp, Mus musculus
gtagatctttgctctttgtatcaca

SEQ ID NO: 670166 - DNA, 25 bp, Mus musculus
gtagatcttttaaaccaactgctgg

SEQ ID NO: 670167 - DNA, 25 bp, Mus musculus
gtagatcttttataccaactgctgg

SEQ ID NO: 670168 - DNA, 25 bp, Mus musculus
gtagatcttttcaagcactgtcctt

SEQ ID NO: 670169 - DNA, 25 bp, Mus musculus
gtagatcttttctagcactgtcctt

SEQ ID NO: 670170 - DNA, 25 bp, Mus musculus
gtagatgaactcctgcgcttcaggc

SEQ ID NO: 670171 - DNA, 25 bp, Mus musculus
gtagatgaactcgtgcgcttcaggc

SEQ ID NO: 670172 - DNA, 25 bp, Mus musculus
gtagatgaagcacaccactgtgcca

SEQ ID NO: 670173 - DNA, 25 bp, Mus musculus
gtagatgaagcagaccactgtgcca

SEQ ID NO: 670174 - DNA, 25 bp, Mus musculus
gtagatgacgacatctggccctggc

SEQ ID NO: 670175 - DNA, 25 bp, Mus musculus
gtagatgacgacttctggccctggc

SEQ ID NO: 670176 - DNA, 25 bp, Mus musculus
gtagatgactctcagtgaccagctt

SEQ ID NO: 670177 - DNA, 25 bp, Mus musculus
gtagatgactctgagtgaccagctt

SEQ ID NO: 670178 - DNA, 25 bp, Mus musculus
gtagatgacttccattaaacaaatt

SEQ ID NO: 670179 - DNA, 25 bp, Mus musculus
gtagatgacttcgattaaacaaatt

SEQ ID NO: 670180 - DNA, 25 bp, Mus musculus
gtagatgagccaaatcctccaatag

SEQ ID NO: 670181 - DNA, 25 bp, Mus musculus
gtagatgagccatatcctccaatag

SEQ ID NO: 670182 - DNA, 25 bp, Mus musculus
gtagatgatctgatcttggctttca

SEQ ID NO: 670183 - DNA, 25 bp, Mus musculus
gtagatgatctgttcttggctttca

SEQ ID NO: 670184 - DNA, 25 bp, Mus musculus
gtagatgcaggaagacccttgtgta

SEQ ID NO: 670185 - DNA, 25 bp, Mus musculus
gtagatgcaggatgacccttgtgta

SEQ ID NO: 670186 - DNA, 25 bp, Mus musculus
gtagatgccagtcgacgcaccgctg

SEQ ID NO: 670187 - DNA, 25 bp, Mus musculus
gtagatgccagtggacgcaccgctg

SEQ ID NO: 670188 - DNA, 25 bp, Mus musculus
gtagatgccccaaggaacagatcct

SEQ ID NO: 670189 - DNA, 25 bp, Mus musculus
gtagatgccccatggaacagatcct

SEQ ID NO: 670190 - DNA, 25 bp, Mus musculus
gtagatgcgtttaactctttctggt

SEQ ID NO: 670191 - DNA, 25 bp, Mus musculus
gtagatgcgttttactctttctggt

SEQ ID NO: 670192 - DNA, 25 bp, Mus musculus
gtagatgctcacagacaatgctttt

SEQ ID NO: 670193 - DNA, 25 bp, Mus musculus
gtagatgctcactgacaatgctttt

SEQ ID NO: 670194 - DNA, 25 bp, Mus musculus
gtagatgctcagctccaggaactct

SEQ ID NO: 670195 - DNA, 25 bp, Mus musculus
gtagatgctcaggtccaggaactct

SEQ ID NO: 670196 - DNA, 25 bp, Mus musculus
gtagatgctcttatggctgattaaa

SEQ ID NO: 670197 - DNA, 25 bp, Mus musculus
gtagatgctcttcaggcttcattga

SEQ ID NO: 670198 - DNA, 25 bp, Mus musculus
gtagatgctcttgaggcttcattga

SEQ ID NO: 670199 - DNA, 25 bp, Mus musculus
gtagatgctcttttggctgattaaa

SEQ ID NO: 670200 - DNA, 25 bp, Mus musculus
gtagatgctgtcaatcttgctgccc

SEQ ID NO: 670201 - DNA, 25 bp, Mus musculus
gtagatgctgtctatcttgctgccc

SEQ ID NO: 670202 - DNA, 25 bp, Mus musculus
gtagatgctgtgaaatgacaaaccc

SEQ ID NO: 670203 - DNA, 25 bp, Mus musculus
gtagatgctgtgcagaaagactagc

SEQ ID NO: 670204 - DNA, 25 bp, Mus musculus
gtagatgctgtggagaaagactagc

SEQ ID NO: 670205 - DNA, 25 bp, Mus musculus
gtagatgctgtgtaatgacaaaccc

SEQ ID NO: 670206 - DNA, 25 bp, Mus musculus
gtagatgctttgctgacttgttcct

SEQ ID NO: 670207 - DNA, 25 bp, Mus musculus
gtagatgctttggtgacttgttcct

SEQ ID NO: 670208 - DNA, 25 bp, Mus musculus
gtagatggaaacctctaaaactata

SEQ ID NO: 670209 - DNA, 25 bp, Mus musculus
gtagatggaaacgtctaaaactata

SEQ ID NO: 670210 - DNA, 25 bp, Mus musculus
gtagatggaccaactctaggatttc

SEQ ID NO: 670211 - DNA, 25 bp, Mus musculus
gtagatggaccatctctaggatttc

SEQ ID NO: 670212 - DNA, 25 bp, Mus musculus
gtagatggagacacctggtcctcag

SEQ ID NO: 670213 - DNA, 25 bp, Mus musculus
gtagatggagactcctggtcctcag

SEQ ID NO: 670214 - DNA, 25 bp, Mus musculus
gtagatggatttagactccccagga

SEQ ID NO: 670215 - DNA, 25 bp, Mus musculus
gtagatggattttgactccccagga

SEQ ID NO: 670216 - DNA, 25 bp, Mus musculus
gtagatggcctcatactaatgtaaa

SEQ ID NO: 670217 - DNA, 25 bp, Mus musculus
gtagatggcctcttactaatgtaaa

SEQ ID NO: 670218 - DNA, 25 bp, Mus musculus
gtagatggctctcactcacggagga

SEQ ID NO: 670219 - DNA, 25 bp, Mus musculus
gtagatggctctgactcacggagga

SEQ ID NO: 670220 - DNA, 25 bp, Mus musculus
gtagatgggtctctatattggctcc

SEQ ID NO: 670221 - DNA, 25 bp, Mus musculus
gtagatgggtctgtatattggctcc

SEQ ID NO: 670222 - DNA, 25 bp, Mus musculus
gtagatggtctcagaatccagccag

SEQ ID NO: 670223 - DNA, 25 bp, Mus musculus
gtagatggtctctgaatccagccag

SEQ ID NO: 670224 - DNA, 25 bp, Mus musculus
gtagatggttcactactgctgggta

SEQ ID NO: 670225 - DNA, 25 bp, Mus musculus
gtagatggttcagtactgctgggta

SEQ ID NO: 670226 - DNA, 25 bp, Mus musculus
gtagatggtttccaccatcccaaag

SEQ ID NO: 670227 - DNA, 25 bp, Mus musculus
gtagatggtttcgaccatcccaaag

SEQ ID NO: 670228 - DNA, 25 bp, Mus musculus
gtagatgtacacattccagcaaatg

SEQ ID NO: 670229 - DNA, 25 bp, Mus musculus
gtagatgtacactttccagcaaatg

SEQ ID NO: 670230 - DNA, 25 bp, Mus musculus
gtagatgtacccaagtgttcctata

SEQ ID NO: 670231 - DNA, 25 bp, Mus musculus
gtagatgtaccctagtgttcctata

SEQ ID NO: 670232 - DNA, 25 bp, Mus musculus
gtagatgtatctacacgttgtaaat

SEQ ID NO: 670233 - DNA, 25 bp, Mus musculus
gtagatgtatcttcacgttgtaaat

SEQ ID NO: 670234 - DNA, 25 bp, Mus musculus
gtagatgtcactcaccagcgttgac

SEQ ID NO: 670235 - DNA, 25 bp, Mus musculus
gtagatgtcactgaccagcgttgac

SEQ ID NO: 670236 - DNA, 25 bp, Mus musculus
gtagatgtcatcctccggaaacaag

SEQ ID NO: 670237 - DNA, 25 bp, Mus musculus
gtagatgtcatcgtccggaaacaag

SEQ ID NO: 670238 - DNA, 25 bp, Mus musculus
gtagatgtctcacagttaaagtact

SEQ ID NO: 670239 - DNA, 25 bp, Mus musculus
gtagatgtctcagagttaaagtact

SEQ ID NO: 670240 - DNA, 25 bp, Mus musculus
gtagatgtctgaattctgcttagta

SEQ ID NO: 670241 - DNA, 25 bp, Mus musculus
gtagatgtctgatttctgcttagta

SEQ ID NO: 670242 - DNA, 25 bp, Mus musculus
gtagatgtctgcatgttttggcttc

SEQ ID NO: 670243 - DNA, 25 bp, Mus musculus
gtagatgtctgcttgttttggcttc

SEQ ID NO: 670244 - DNA, 25 bp, Mus musculus
gtagatgtctttaccaacctgggct

SEQ ID NO: 670245 - DNA, 25 bp, Mus musculus
gtagatgtcttttccaacctgggct

SEQ ID NO: 670246 - DNA, 25 bp, Mus musculus
gtagatgtgacacctatctcaattt

SEQ ID NO: 670247 - DNA, 25 bp, Mus musculus
gtagatgtgacagctatctcaattt

SEQ ID NO: 670248 - DNA, 25 bp, Mus musculus
gtagatgtgtccctgaagtctcatt

SEQ ID NO: 670249 - DNA, 25 bp, Mus musculus
gtagatgtgtccgtgaagtctcatt

SEQ ID NO: 670250 - DNA, 25 bp, Mus musculus
gtagatgtgtctcgaaaaggtgctt

SEQ ID NO: 670251 - DNA, 25 bp, Mus musculus
gtagatgtgtctggaaaaggtgctt

SEQ ID NO: 670252 - DNA, 25 bp, Mus musculus
gtagatgttacacaacgaatgggtc

SEQ ID NO: 670253 - DNA, 25 bp, Mus musculus
gtagatgttacagaacgaatgggtc

SEQ ID NO: 670254 - DNA, 25 bp, Mus musculus
gtagatgttactcgacctcatctct

SEQ ID NO: 670255 - DNA, 25 bp, Mus musculus
gtagatgttactggacctcatctct

SEQ ID NO: 670256 - DNA, 25 bp, Mus musculus
gtagatgttagcagccaaccacttg

SEQ ID NO: 670257 - DNA, 25 bp, Mus musculus
gtagatgttagctgccaaccacttg

SEQ ID NO: 670258 - DNA, 25 bp, Mus musculus
gtagatgtttacacaagggtgttct

SEQ ID NO: 670259 - DNA, 25 bp, Mus musculus
gtagatgtttactcaagggtgttct

SEQ ID NO: 670260 - DNA, 25 bp, Mus musculus
gtagatgtttcaatggctgtctgaa

SEQ ID NO: 670261 - DNA, 25 bp, Mus musculus
gtagatgtttcattggctgtctgaa

SEQ ID NO: 670262 - DNA, 25 bp, Mus musculus
gtagatgttttcatgatctaagcaa

SEQ ID NO: 670263 - DNA, 25 bp, Mus musculus
gtagatgttttcttgatctaagcaa

SEQ ID NO: 670264 - DNA, 25 bp, Mus musculus
gtagattaatacattccatgggttg

SEQ ID NO: 670265 - DNA, 25 bp, Mus musculus
gtagattaatactttccatgggttg

SEQ ID NO: 670266 - DNA, 25 bp, Mus musculus
gtagattcatttccttgatccagtt

SEQ ID NO: 670267 - DNA, 25 bp, Mus musculus
gtagattcatttgcttgatccagtt

SEQ ID NO: 670268 - DNA, 25 bp, Mus musculus
gtagattccatcattgttatcattt

SEQ ID NO: 670269 - DNA, 25 bp, Mus musculus
gtagattccatctttgttatcattt

SEQ ID NO: 670270 - DNA, 25 bp, Mus musculus
gtagattccctgcatactatcaatg

SEQ ID NO: 670271 - DNA, 25 bp, Mus musculus
gtagattccctggatactatcaatg

SEQ ID NO: 670272 - DNA, 25 bp, Mus musculus
gtagattccgaactcactctggcat

SEQ ID NO: 670273 - DNA, 25 bp, Mus musculus
gtagattccgaagtcactctggcat

SEQ ID NO: 670274 - DNA, 25 bp, Mus musculus
gtagattcgctcactgaagtgtcag

SEQ ID NO: 670275 - DNA, 25 bp, Mus musculus
gtagattcgctctctgaagtgtcag

SEQ ID NO: 670276 - DNA, 25 bp, Mus musculus
gtagattcggcccatgcaaaccatt

SEQ ID NO: 670277 - DNA, 25 bp, Mus musculus
gtagattcggccgatgcaaaccatt

SEQ ID NO: 670278 - DNA, 25 bp, Mus musculus
gtagattctcggattactattccca

SEQ ID NO: 670279 - DNA, 25 bp, Mus musculus
gtagattctcggtttactattccca

SEQ ID NO: 670280 - DNA, 25 bp, Mus musculus
gtagattctggaatcctcagctatt

SEQ ID NO: 670281 - DNA, 25 bp, Mus musculus
gtagattctggattcctcagctatt

SEQ ID NO: 670282 - DNA, 25 bp, Mus musculus
gtagattcttccacaggttgcccga

SEQ ID NO: 670283 - DNA, 25 bp, Mus musculus
gtagattcttcctcaggttgcccga

SEQ ID NO: 670284 - DNA, 25 bp, Mus musculus
gtagattgctttctctcagccatac

SEQ ID NO: 670285 - DNA, 25 bp, Mus musculus
gtagattgctttgtctcagccatac

SEQ ID NO: 670286 - DNA, 25 bp, Mus musculus
gtagattggactctgttctctgctt

SEQ ID NO: 670287 - DNA, 25 bp, Mus musculus
gtagattggactgtgttctctgctt

SEQ ID NO: 670288 - DNA, 25 bp, Mus musculus
gtagattggcccctacttctcctgc

SEQ ID NO: 670289 - DNA, 25 bp, Mus musculus
gtagattggcccgtacttctcctgc

SEQ ID NO: 670290 - DNA, 25 bp, Mus musculus
gtagattggcctacagatactccaa

SEQ ID NO: 670291 - DNA, 25 bp, Mus musculus
gtagattggccttcagatactccaa

SEQ ID NO: 670292 - DNA, 25 bp, Mus musculus
gtagatttaagcagccaaatgtccc

SEQ ID NO: 670293 - DNA, 25 bp, Mus musculus
gtagatttaagctgccaaatgtccc

SEQ ID NO: 670294 - DNA, 25 bp, Mus musculus
gtagatttaattacaagactcagtg

SEQ ID NO: 670295 - DNA, 25 bp, Mus musculus
gtagatttaatttcaagactcagtg

SEQ ID NO: 670296 - DNA, 25 bp, Mus musculus
gtagatttactcagtcacccatgtc

SEQ ID NO: 670297 - DNA, 25 bp, Mus musculus
gtagatttactctgtcacccatgtc

SEQ ID NO: 670298 - DNA, 25 bp, Mus musculus
gtagatttagagctttgaactttca

SEQ ID NO: 670299 - DNA, 25 bp, Mus musculus
gtagatttagaggtttgaactttca

SEQ ID NO: 670300 - DNA, 25 bp, Mus musculus
gtagatttagatcccctgagtgtcc

SEQ ID NO: 670301 - DNA, 25 bp, Mus musculus
gtagatttagatgccctgagtgtcc

SEQ ID NO: 670302 - DNA, 25 bp, Mus musculus
gtagatttatcaaagctgtgtttaa

SEQ ID NO: 670303 - DNA, 25 bp, Mus musculus
gtagatttatcatagctgtgtttaa

SEQ ID NO: 670304 - DNA, 25 bp, Mus musculus
gtagatttatctcttggttcatgat

SEQ ID NO: 670305 - DNA, 25 bp, Mus musculus
gtagatttatctgttggttcatgat

SEQ ID NO: 670306 - DNA, 25 bp, Mus musculus
gtagatttcacgatactcagtatgt

SEQ ID NO: 670307 - DNA, 25 bp, Mus musculus
gtagatttcacgttactcagtatgt

SEQ ID NO: 670308 - DNA, 25 bp, Mus musculus
gtagatttcagccaattctcaatac

SEQ ID NO: 670309 - DNA, 25 bp, Mus musculus
gtagatttcagcgaattctcaatac

SEQ ID NO: 670310 - DNA, 25 bp, Mus musculus
gtagatttccttaacatctgtcctt

SEQ ID NO: 670311 - DNA, 25 bp, Mus musculus
gtagatttccttcaaaccacatgag

SEQ ID NO: 670312 - DNA, 25 bp, Mus musculus
gtagatttccttctagttcactata

SEQ ID NO: 670313 - DNA, 25 bp, Mus musculus
gtagatttccttgaaaccacatgag

SEQ ID NO: 670314 - DNA, 25 bp, Mus musculus
gtagatttccttgtagttcactata

SEQ ID NO: 670315 - DNA, 25 bp, Mus musculus
gtagatttcctttacatctgtcctt

SEQ ID NO: 670316 - DNA, 25 bp, Mus musculus
gtagatttcggcatggttcaccctc

SEQ ID NO: 670317 - DNA, 25 bp, Mus musculus
gtagatttcggcttggttcaccctc

SEQ ID NO: 670318 - DNA, 25 bp, Mus musculus
gtagatttctaaaaccaaagacaga

SEQ ID NO: 670319 - DNA, 25 bp, Mus musculus
gtagatttctaataccaaagacaga

SEQ ID NO: 670320 - DNA, 25 bp, Mus musculus
gtagatttctggctgtgtcctaaag

SEQ ID NO: 670321 - DNA, 25 bp, Mus musculus
gtagatttctgggtgtgtcctaaag

SEQ ID NO: 670322 - DNA, 25 bp, Mus musculus
gtagatttgaccacccgtgttcaag

SEQ ID NO: 670323 - DNA, 25 bp, Mus musculus
gtagatttgacctcccgtgttcaag

SEQ ID NO: 670324 - DNA, 25 bp, Mus musculus
gtagatttgaggagtaaccccttag

SEQ ID NO: 670325 - DNA, 25 bp, Mus musculus
gtagatttgaggtgtaaccccttag

SEQ ID NO: 670326 - DNA, 25 bp, Mus musculus
gtagatttgcccacatatcagggtt

SEQ ID NO: 670327 - DNA, 25 bp, Mus musculus
gtagatttgccctcatatcagggtt

SEQ ID NO: 670328 - DNA, 25 bp, Mus musculus
gtagatttgctgatggtatgactcc

SEQ ID NO: 670329 - DNA, 25 bp, Mus musculus
gtagatttgctgttggtatgactcc

SEQ ID NO: 670330 - DNA, 25 bp, Mus musculus
gtagatttggctccccggaatttgc

SEQ ID NO: 670331 - DNA, 25 bp, Mus musculus
gtagatttggctgcccggaatttgc

SEQ ID NO: 670332 - DNA, 25 bp, Mus musculus
gtagatttgtgcactatgtgtgaga

SEQ ID NO: 670333 - DNA, 25 bp, Mus musculus
gtagatttgtgctctatgtgtgaga

SEQ ID NO: 670334 - DNA, 25 bp, Mus musculus
gtagattttcagcactagaaccatg

SEQ ID NO: 670335 - DNA, 25 bp, Mus musculus
gtagattttcaggactagaaccatg

SEQ ID NO: 670336 - DNA, 25 bp, Mus musculus
gtagattttcatagttctgcagaga

SEQ ID NO: 670337 - DNA, 25 bp, Mus musculus
gtagattttcattgttctgcagaga

SEQ ID NO: 670338 - DNA, 25 bp, Mus musculus
gtagattttcctcatgcttcaaaga

SEQ ID NO: 670339 - DNA, 25 bp, Mus musculus
gtagattttcctgatgcttcaaaga

SEQ ID NO: 670340 - DNA, 25 bp, Mus musculus
gtagattttctcatcactctgatac

SEQ ID NO: 670341 - DNA, 25 bp, Mus musculus
gtagattttctcttcactctgatac

SEQ ID NO: 670342 - DNA, 25 bp, Mus musculus
gtagattttgaaacgctcctctgta

SEQ ID NO: 670343 - DNA, 25 bp, Mus musculus
gtagattttgaatcgctcctctgta

SEQ ID NO: 670344 - DNA, 25 bp, Mus musculus
gtagattttgagacgcctgggtcca

SEQ ID NO: 670345 - DNA, 25 bp, Mus musculus
gtagattttgagtcgcctgggtcca

SEQ ID NO: 670346 - DNA, 25 bp, Mus musculus
gtagattttgtcaattcccacccac

SEQ ID NO: 670347 - DNA, 25 bp, Mus musculus
gtagattttgtctattcccacccac

SEQ ID NO: 670348 - DNA, 25 bp, Mus musculus
gtagattttgttaaccaccatgtga

SEQ ID NO: 670349 - DNA, 25 bp, Mus musculus
gtagattttgtttaccaccatgtga

SEQ ID NO: 670350 - DNA, 25 bp, Mus musculus
gtagatttttgccatagaccagtag

SEQ ID NO: 670351 - DNA, 25 bp, Mus musculus
gtagatttttgcgatagaccagtag

SEQ ID NO: 670352 - DNA, 25 bp, Mus musculus
gtagcaaaaaggactgatcgatcac

SEQ ID NO: 670353 - DNA, 25 bp, Mus musculus
gtagcaaaaaggtctgatcgatcac

SEQ ID NO: 670354 - DNA, 25 bp, Mus musculus
gtagcaaaacttaccctgatggttt

SEQ ID NO: 670355 - DNA, 25 bp, Mus musculus
gtagcaaaactttccctgatggttt

SEQ ID NO: 670356 - DNA, 25 bp, Mus musculus
gtagcaaacaaaactagctttactt

SEQ ID NO: 670357 - DNA, 25 bp, Mus musculus
gtagcaaacaaatctagctttactt

SEQ ID NO: 670358 - DNA, 25 bp, Mus musculus
gtagcaaacattcaggaggcctcca

SEQ ID NO: 670359 - DNA, 25 bp, Mus musculus
gtagcaaacattgaggaggcctcca

SEQ ID NO: 670360 - DNA, 25 bp, Mus musculus
gtagcaaacgacacagcgaccttct

SEQ ID NO: 670361 - DNA, 25 bp, Mus musculus
gtagcaaacgactcagcgaccttct

SEQ ID NO: 670362 - DNA, 25 bp, Mus musculus
gtagcaaagaaacaactctccaaag

SEQ ID NO: 670363 - DNA, 25 bp, Mus musculus
gtagcaaagaaagaactctccaaag

SEQ ID NO: 670364 - DNA, 25 bp, Mus musculus
gtagcaaagaatattatgacacatt

SEQ ID NO: 670365 - DNA, 25 bp, Mus musculus
gtagcaaagaattttatgacacatt

SEQ ID NO: 670366 - DNA, 25 bp, Mus musculus
gtagcaaagaccattcacactgcat

SEQ ID NO: 670367 - DNA, 25 bp, Mus musculus
gtagcaaagacctttcacactgcat

SEQ ID NO: 670368 - DNA, 25 bp, Mus musculus
gtagcaaagcttatacacaatttgt

SEQ ID NO: 670369 - DNA, 25 bp, Mus musculus
gtagcaaagcttttacacaatttgt

SEQ ID NO: 670370 - DNA, 25 bp, Mus musculus
gtagcaaagtacctagccttttcat

SEQ ID NO: 670371 - DNA, 25 bp, Mus musculus
gtagcaaagtacgtagccttttcat

SEQ ID NO: 670372 - DNA, 25 bp, Mus musculus
gtagcaaagtcacggacctgctcct

SEQ ID NO: 670373 - DNA, 25 bp, Mus musculus
gtagcaaagtcagggacctgctcct

SEQ ID NO: 670374 - DNA, 25 bp, Mus musculus
gtagcaaagtcccaggtcccgtgag

SEQ ID NO: 670375 - DNA, 25 bp, Mus musculus
gtagcaaagtccgaggtcccgtgag

SEQ ID NO: 670376 - DNA, 25 bp, Mus musculus
gtagcaacaaatatttgacaccaag

SEQ ID NO: 670377 - DNA, 25 bp, Mus musculus
gtagcaacaaatttttgacaccaag

SEQ ID NO: 670378 - DNA, 25 bp, Mus musculus
gtagcaacaacgcaacgacctggga

SEQ ID NO: 670379 - DNA, 25 bp, Mus musculus
gtagcaacaacggaacgacctggga

SEQ ID NO: 670380 - DNA, 25 bp, Mus musculus
gtagcaacaccacttgccaaagcag

SEQ ID NO: 670381 - DNA, 25 bp, Mus musculus
gtagcaacaccagttgccaaagcag

SEQ ID NO: 670382 - DNA, 25 bp, Mus musculus
gtagcaacagatagtattttcctat

SEQ ID NO: 670383 - DNA, 25 bp, Mus musculus
gtagcaacagattgtattttcctat

SEQ ID NO: 670384 - DNA, 25 bp, Mus musculus
gtagcaacccctcctcagaaactta

SEQ ID NO: 670385 - DNA, 25 bp, Mus musculus
gtagcaacccctgctcagaaactta

SEQ ID NO: 670386 - DNA, 25 bp, Mus musculus
gtagcaacgatcacacacatgttca

SEQ ID NO: 670387 - DNA, 25 bp, Mus musculus
gtagcaacgatctcacacatgttca

SEQ ID NO: 670388 - DNA, 25 bp, Mus musculus
gtagcaactgtacgatggcgccata

SEQ ID NO: 670389 - DNA, 25 bp, Mus musculus
gtagcaactgtaggatggcgccata

SEQ ID NO: 670390 - DNA, 25 bp, Mus musculus
gtagcaagcaaccaacattcctgtc

SEQ ID NO: 670391 - DNA, 25 bp, Mus musculus
gtagcaagcaacgaacattcctgtc

SEQ ID NO: 670392 - DNA, 25 bp, Mus musculus
gtagcaagccctacgtggttagaac

SEQ ID NO: 670393 - DNA, 25 bp, Mus musculus
gtagcaagcccttcgtggttagaac

SEQ ID NO: 670394 - DNA, 25 bp, Mus musculus
gtagcaagccgaagtaaaccctcag

SEQ ID NO: 670395 - DNA, 25 bp, Mus musculus
gtagcaagccgatgtaaaccctcag

SEQ ID NO: 670396 - DNA, 25 bp, Mus musculus
gtagcaagcctgctgtttatctggc

SEQ ID NO: 670397 - DNA, 25 bp, Mus musculus
gtagcaagcctggtgtttatctggc

SEQ ID NO: 670398 - DNA, 25 bp, Mus musculus
gtagcaagctatctctctttacata

SEQ ID NO: 670399 - DNA, 25 bp, Mus musculus
gtagcaagctatgtctctttacata

SEQ ID NO: 670400 - DNA, 25 bp, Mus musculus
gtagcaagctctaacatagaacttt

SEQ ID NO: 670401 - DNA, 25 bp, Mus musculus
gtagcaagctcttacatagaacttt

SEQ ID NO: 670402 - DNA, 25 bp, Mus musculus
gtagcaaggcggatttgtttatttg

SEQ ID NO: 670403 - DNA, 25 bp, Mus musculus
gtagcaaggcggttttgtttatttg

SEQ ID NO: 670404 - DNA, 25 bp, Mus musculus
gtagcaaggctaatagcattaccaa

SEQ ID NO: 670405 - DNA, 25 bp, Mus musculus
gtagcaaggctattagcattaccaa

SEQ ID NO: 670406 - DNA, 25 bp, Mus musculus
gtagcaaggtctcccaactctatgg

SEQ ID NO: 670407 - DNA, 25 bp, Mus musculus
gtagcaaggtctgccaactctatgg

SEQ ID NO: 670408 - DNA, 25 bp, Mus musculus
gtagcaagtacaattatccactgaa

SEQ ID NO: 670409 - DNA, 25 bp, Mus musculus
gtagcaagtacatttatccactgaa

SEQ ID NO: 670410 - DNA, 25 bp, Mus musculus
gtagcaagtagtagtaccccatctg

SEQ ID NO: 670411 - DNA, 25 bp, Mus musculus
gtagcaagtagttgtaccccatctg

SEQ ID NO: 670412 - DNA, 25 bp, Mus musculus
gtagcaagtcccacagcgtgaagca

SEQ ID NO: 670413 - DNA, 25 bp, Mus musculus
gtagcaagtccctcagcgtgaagca

SEQ ID NO: 670414 - DNA, 25 bp, Mus musculus
gtagcaagtcctaagcgtgggccaa

SEQ ID NO: 670415 - DNA, 25 bp, Mus musculus
gtagcaagtccttagcgtgggccaa

SEQ ID NO: 670416 - DNA, 25 bp, Mus musculus
gtagcaagtctgactcatcacaagg

SEQ ID NO: 670417 - DNA, 25 bp, Mus musculus
gtagcaagtctgtctcatcacaagg

SEQ ID NO: 670418 - DNA, 25 bp, Mus musculus
gtagcaagtggcagggtcccattaa

SEQ ID NO: 670419 - DNA, 25 bp, Mus musculus
gtagcaagtggctgggtcccattaa

SEQ ID NO: 670420 - DNA, 25 bp, Mus musculus
gtagcaagtgtgagtttccagacct

SEQ ID NO: 670421 - DNA, 25 bp, Mus musculus
gtagcaagtgtgtgtttccagacct

SEQ ID NO: 670422 - DNA, 25 bp, Mus musculus
gtagcaagttaaatctttccatttt

SEQ ID NO: 670423 - DNA, 25 bp, Mus musculus
gtagcaagttaattctttccatttt

SEQ ID NO: 670424 - DNA, 25 bp, Mus musculus
gtagcaagtttaccccaagagagac

SEQ ID NO: 670425 - DNA, 25 bp, Mus musculus
gtagcaagtttagcccaagagagac

SEQ ID NO: 670426 - DNA, 25 bp, Mus musculus
gtagcaataacgctgtgccgcccgc

SEQ ID NO: 670427 - DNA, 25 bp, Mus musculus
gtagcaataacggtgtgccgcccgc

SEQ ID NO: 670428 - DNA, 25 bp, Mus musculus
gtagcaataccgcatcactgaccaa

SEQ ID NO: 670429 - DNA, 25 bp, Mus musculus
gtagcaataccggatcactgaccaa

SEQ ID NO: 670430 - DNA, 25 bp, Mus musculus
gtagcaatcattatcctttgttatt

SEQ ID NO: 670431 - DNA, 25 bp, Mus musculus
gtagcaatcattttcctttgttatt

SEQ ID NO: 670432 - DNA, 25 bp, Mus musculus
gtagcaatctgtacatggtggtggt

SEQ ID NO: 670433 - DNA, 25 bp, Mus musculus
gtagcaatctgttcatggtggtggt

SEQ ID NO: 670434 - DNA, 25 bp, Mus musculus
gtagcaatgaccaatgttctcctgg

SEQ ID NO: 670435 - DNA, 25 bp, Mus musculus
gtagcaatgacctatgttctcctgg

SEQ ID NO: 670436 - DNA, 25 bp, Mus musculus
gtagcaatgcaaccacatcctctca

SEQ ID NO: 670437 - DNA, 25 bp, Mus musculus
gtagcaatgcaagcacatcctctca

SEQ ID NO: 670438 - DNA, 25 bp, Mus musculus
gtagcaatggtcatggccccaaatc

SEQ ID NO: 670439 - DNA, 25 bp, Mus musculus
gtagcaatggtcttggccccaaatc

SEQ ID NO: 670440 - DNA, 25 bp, Mus musculus
gtagcaatggttaagtatcaggtac

SEQ ID NO: 670441 - DNA, 25 bp, Mus musculus
gtagcaatggtttagtatcaggtac

SEQ ID NO: 670442 - DNA, 25 bp, Mus musculus
gtagcaatgtacactgactctctgt

SEQ ID NO: 670443 - DNA, 25 bp, Mus musculus
gtagcaatgtactctgactctctgt

SEQ ID NO: 670444 - DNA, 25 bp, Mus musculus
gtagcaattgctcagggaaagtcct

SEQ ID NO: 670445 - DNA, 25 bp, Mus musculus
gtagcaattgctgagggaaagtcct

SEQ ID NO: 670446 - DNA, 25 bp, Mus musculus
gtagcaatttccaccaagattaaaa

SEQ ID NO: 670447 - DNA, 25 bp, Mus musculus
gtagcaatttccatctttatgtgtt

SEQ ID NO: 670448 - DNA, 25 bp, Mus musculus
gtagcaatttcctccaagattaaaa

SEQ ID NO: 670449 - DNA, 25 bp, Mus musculus
gtagcaatttccttctttatgtgtt

SEQ ID NO: 670450 - DNA, 25 bp, Mus musculus
gtagcacaatgaaaccccatgccat

SEQ ID NO: 670451 - DNA, 25 bp, Mus musculus
gtagcacaatgaaagtatccccagt

SEQ ID NO: 670452 - DNA, 25 bp, Mus musculus
gtagcacaatgataccccatgccat

SEQ ID NO: 670453 - DNA, 25 bp, Mus musculus
gtagcacaatgatagtatccccagt

SEQ ID NO: 670454 - DNA, 25 bp, Mus musculus
gtagcacacaaaacctgtacacact

SEQ ID NO: 670455 - DNA, 25 bp, Mus musculus
gtagcacacaaatcctgtacacact

SEQ ID NO: 670456 - DNA, 25 bp, Mus musculus
gtagcacacactctaatctcaatac

SEQ ID NO: 670457 - DNA, 25 bp, Mus musculus
gtagcacacactgtaatctcaatac

SEQ ID NO: 670458 - DNA, 25 bp, Mus musculus
gtagcacaccaactcagattcaaag

SEQ ID NO: 670459 - DNA, 25 bp, Mus musculus
gtagcacaccaagtcagattcaaag

SEQ ID NO: 670460 - DNA, 25 bp, Mus musculus
gtagcacaccacaattttactaatg

SEQ ID NO: 670461 - DNA, 25 bp, Mus musculus
gtagcacaccactattttactaatg

SEQ ID NO: 670462 - DNA, 25 bp, Mus musculus
gtagcacacctcataggtatggaat

SEQ ID NO: 670463 - DNA, 25 bp, Mus musculus
gtagcacacctcttaggtatggaat

SEQ ID NO: 670464 - DNA, 25 bp, Mus musculus
gtagcacagaaaatgcaagccccta

SEQ ID NO: 670465 - DNA, 25 bp, Mus musculus
gtagcacagaaattgcaagccccta

SEQ ID NO: 670466 - DNA, 25 bp, Mus musculus
gtagcacagataacattcaacggaa

SEQ ID NO: 670467 - DNA, 25 bp, Mus musculus
gtagcacagatatcattcaacggaa

SEQ ID NO: 670468 - DNA, 25 bp, Mus musculus
gtagcacagattaggtaacttgacc

SEQ ID NO: 670469 - DNA, 25 bp, Mus musculus
gtagcacagatttggtaacttgacc

SEQ ID NO: 670470 - DNA, 25 bp, Mus musculus
gtagcacaggctcaatggctgctgt

SEQ ID NO: 670471 - DNA, 25 bp, Mus musculus
gtagcacaggctgaatggctgctgt

SEQ ID NO: 670472 - DNA, 25 bp, Mus musculus
gtagcacagtcgcaggtcaacagag

SEQ ID NO: 670473 - DNA, 25 bp, Mus musculus
gtagcacagtcggaggtcaacagag

SEQ ID NO: 670474 - DNA, 25 bp, Mus musculus
gtagcacagtttcgccaagggcaga

SEQ ID NO: 670475 - DNA, 25 bp, Mus musculus
gtagcacagtttggccaagggcaga

SEQ ID NO: 670476 - DNA, 25 bp, Mus musculus
gtagcacatagcaccagcacttaat

SEQ ID NO: 670477 - DNA, 25 bp, Mus musculus
gtagcacatagctccagcacttaat

SEQ ID NO: 670478 - DNA, 25 bp, Mus musculus
gtagcacatcttacaatcccttaat

SEQ ID NO: 670479 - DNA, 25 bp, Mus musculus
gtagcacatctttcaatcccttaat

SEQ ID NO: 670480 - DNA, 25 bp, Mus musculus
gtagcacatgacctaactgttgagt

SEQ ID NO: 670481 - DNA, 25 bp, Mus musculus
gtagcacatgacgtaactgttgagt

SEQ ID NO: 670482 - DNA, 25 bp, Mus musculus
gtagcacatgcaagaattgtgcctt

SEQ ID NO: 670483 - DNA, 25 bp, Mus musculus
gtagcacatgcacactttacagttg

SEQ ID NO: 670484 - DNA, 25 bp, Mus musculus
gtagcacatgcagactttacagttg

SEQ ID NO: 670485 - DNA, 25 bp, Mus musculus
gtagcacatgcatgaattgtgcctt

SEQ ID NO: 670486 - DNA, 25 bp, Mus musculus
gtagcacatgtaatgctcacctgcc

SEQ ID NO: 670487 - DNA, 25 bp, Mus musculus
gtagcacatgtattgctcacctgcc

SEQ ID NO: 670488 - DNA, 25 bp, Mus musculus
gtagcacattagaccttgataacgc

SEQ ID NO: 670489 - DNA, 25 bp, Mus musculus
gtagcacattagtccttgataacgc

SEQ ID NO: 670490 - DNA, 25 bp, Mus musculus
gtagcaccaagaatgaccctgtaac

SEQ ID NO: 670491 - DNA, 25 bp, Mus musculus
gtagcaccaagattgaccctgtaac

SEQ ID NO: 670492 - DNA, 25 bp, Mus musculus
gtagcaccatggcaaccttccaaaa

SEQ ID NO: 670493 - DNA, 25 bp, Mus musculus
gtagcaccatgggaaccttccaaaa

SEQ ID NO: 670494 - DNA, 25 bp, Mus musculus
gtagcaccattaaatacgtgtgtgt

SEQ ID NO: 670495 - DNA, 25 bp, Mus musculus
gtagcaccattatatacgtgtgtgt

SEQ ID NO: 670496 - DNA, 25 bp, Mus musculus
gtagcaccctgacagcagagctata

SEQ ID NO: 670497 - DNA, 25 bp, Mus musculus
gtagcaccctgagagcagagctata

SEQ ID NO: 670498 - DNA, 25 bp, Mus musculus
gtagcaccgaccacagcatctgaga

SEQ ID NO: 670499 - DNA, 25 bp, Mus musculus
gtagcaccgacctcagcatctgaga

SEQ ID NO: 670500 - DNA, 25 bp, Mus musculus
gtagcaccggagactgctggatgtc

SEQ ID NO: 670501 - DNA, 25 bp, Mus musculus
gtagcaccggagtctgctggatgtc

SEQ ID NO: 670502 - DNA, 25 bp, Mus musculus
gtagcaccgggcatttgatggacct

SEQ ID NO: 670503 - DNA, 25 bp, Mus musculus
gtagcaccgggcttttgatggacct

SEQ ID NO: 670504 - DNA, 25 bp, Mus musculus
gtagcacctacaaaggtaacttcag

SEQ ID NO: 670505 - DNA, 25 bp, Mus musculus
gtagcacctacataggtaacttcag

SEQ ID NO: 670506 - DNA, 25 bp, Mus musculus
gtagcacctattatccagacactgt

SEQ ID NO: 670507 - DNA, 25 bp, Mus musculus
gtagcacctattttccagacactgt

SEQ ID NO: 670508 - DNA, 25 bp, Mus musculus
gtagcacctgctcccaaatcatggg

SEQ ID NO: 670509 - DNA, 25 bp, Mus musculus
gtagcacctgctgccaaatcatggg

SEQ ID NO: 670510 - DNA, 25 bp, Mus musculus
gtagcaccttcccaagtggacagta

SEQ ID NO: 670511 - DNA, 25 bp, Mus musculus
gtagcaccttccgaagtggacagta

SEQ ID NO: 670512 - DNA, 25 bp, Mus musculus
gtagcaccttgaattccatgctgaa

SEQ ID NO: 670513 - DNA, 25 bp, Mus musculus
gtagcaccttgatttccatgctgaa

SEQ ID NO: 670514 - DNA, 25 bp, Mus musculus
gtagcacgactacaactttgattgg

SEQ ID NO: 670515 - DNA, 25 bp, Mus musculus
gtagcacgactagaactttgattgg

SEQ ID NO: 670516 - DNA, 25 bp, Mus musculus
gtagcacgagtcagttactataatt

SEQ ID NO: 670517 - DNA, 25 bp, Mus musculus
gtagcacgagtctgttactataatt

SEQ ID NO: 670518 - DNA, 25 bp, Mus musculus
gtagcacgatgaagttttacctctt

SEQ ID NO: 670519 - DNA, 25 bp, Mus musculus
gtagcacgatgatgttttacctctt

SEQ ID NO: 670520 - DNA, 25 bp, Mus musculus
gtagcacgcccgactggaaacaaag

SEQ ID NO: 670521 - DNA, 25 bp, Mus musculus
gtagcacgcccgtctggaaacaaag

SEQ ID NO: 670522 - DNA, 25 bp, Mus musculus
gtagcacgtaccagagagacacctg

SEQ ID NO: 670523 - DNA, 25 bp, Mus musculus
gtagcacgtacctgagagacacctg

SEQ ID NO: 670524 - DNA, 25 bp, Mus musculus
gtagcacgtgatcaagctgtcagtt

SEQ ID NO: 670525 - DNA, 25 bp, Mus musculus
gtagcacgtgatgaagctgtcagtt

SEQ ID NO: 670526 - DNA, 25 bp, Mus musculus
gtagcacgttctcttctcagaagtg

SEQ ID NO: 670527 - DNA, 25 bp, Mus musculus
gtagcacgttctgttctcagaagtg

SEQ ID NO: 670528 - DNA, 25 bp, Mus musculus
gtagcactactgaaatcaccagcat

SEQ ID NO: 670529 - DNA, 25 bp, Mus musculus
gtagcactactgtaatcaccagcat

SEQ ID NO: 670530 - DNA, 25 bp, Mus musculus
gtagcactagtgaagggttcctaca

SEQ ID NO: 670531 - DNA, 25 bp, Mus musculus
gtagcactagtgtagggttcctaca

SEQ ID NO: 670532 - DNA, 25 bp, Mus musculus
gtagcactattcatatcagccaggt

SEQ ID NO: 670533 - DNA, 25 bp, Mus musculus
gtagcactattcttatcagccaggt

SEQ ID NO: 670534 - DNA, 25 bp, Mus musculus
gtagcactcattacacactgacttg

SEQ ID NO: 670535 - DNA, 25 bp, Mus musculus
gtagcactcatttcacactgacttg

SEQ ID NO: 670536 - DNA, 25 bp, Mus musculus
gtagcactccctcccagagatggga

SEQ ID NO: 670537 - DNA, 25 bp, Mus musculus
gtagcactccctgccagagatggga

SEQ ID NO: 670538 - DNA, 25 bp, Mus musculus
gtagcactcctaatacattgcccat

SEQ ID NO: 670539 - DNA, 25 bp, Mus musculus
gtagcactcctattacattgcccat

SEQ ID NO: 670540 - DNA, 25 bp, Mus musculus
gtagcactctctccagatgattaaa

SEQ ID NO: 670541 - DNA, 25 bp, Mus musculus
gtagcactctctgcagatgattaaa

SEQ ID NO: 670542 - DNA, 25 bp, Mus musculus
gtagcactctgaccctatgttgtgg

SEQ ID NO: 670543 - DNA, 25 bp, Mus musculus
gtagcactctgagcctatgttgtgg

SEQ ID NO: 670544 - DNA, 25 bp, Mus musculus
gtagcactcttgaggacttttctga

SEQ ID NO: 670545 - DNA, 25 bp, Mus musculus
gtagcactcttgtggacttttctga

SEQ ID NO: 670546 - DNA, 25 bp, Mus musculus
gtagcactggaaactccacgtgcct

SEQ ID NO: 670547 - DNA, 25 bp, Mus musculus
gtagcactggaatctccacgtgcct

SEQ ID NO: 670548 - DNA, 25 bp, Mus musculus
gtagcactggatcacctagcctggg

SEQ ID NO: 670549 - DNA, 25 bp, Mus musculus
gtagcactggatgacctagcctggg

SEQ ID NO: 670550 - DNA, 25 bp, Mus musculus
gtagcactgtgtagggttacatcaa

SEQ ID NO: 670551 - DNA, 25 bp, Mus musculus
gtagcactgtgttgggttacatcaa

SEQ ID NO: 670552 - DNA, 25 bp, Mus musculus
gtagcacttaaaacttaatcactgc

SEQ ID NO: 670553 - DNA, 25 bp, Mus musculus
gtagcacttaaatcttaatcactgc

SEQ ID NO: 670554 - DNA, 25 bp, Mus musculus
gtagcactttggcaatcagcattta

SEQ ID NO: 670555 - DNA, 25 bp, Mus musculus
gtagcactttgggaatcagcattta

SEQ ID NO: 670556 - DNA, 25 bp, Mus musculus
gtagcagaaagcaggtgttcccact

SEQ ID NO: 670557 - DNA, 25 bp, Mus musculus
gtagcagaaagctggtgttcccact

SEQ ID NO: 670558 - DNA, 25 bp, Mus musculus
gtagcagaaggcataaaaattagat

SEQ ID NO: 670559 - DNA, 25 bp, Mus musculus
gtagcagaaggcttaaaaattagat

SEQ ID NO: 670560 - DNA, 25 bp, Mus musculus
gtagcagaagggaagacaccagcaa

SEQ ID NO: 670561 - DNA, 25 bp, Mus musculus
gtagcagaagggtagacaccagcaa

SEQ ID NO: 670562 - DNA, 25 bp, Mus musculus
gtagcagaattcacacaagccgttc

SEQ ID NO: 670563 - DNA, 25 bp, Mus musculus
gtagcagaattctcacaagccgttc

SEQ ID NO: 670564 - DNA, 25 bp, Mus musculus
gtagcagacattcacaatggccatt

SEQ ID NO: 670565 - DNA, 25 bp, Mus musculus
gtagcagacattgacaatggccatt

SEQ ID NO: 670566 - DNA, 25 bp, Mus musculus
gtagcagacgcactacctaaggcca

SEQ ID NO: 670567 - DNA, 25 bp, Mus musculus
gtagcagacgcagtacctaaggcca

SEQ ID NO: 670568 - DNA, 25 bp, Mus musculus
gtagcagacggaccgagccaaaagc

SEQ ID NO: 670569 - DNA, 25 bp, Mus musculus
gtagcagacggagcgagccaaaagc

SEQ ID NO: 670570 - DNA, 25 bp, Mus musculus
gtagcagagggcaggacctaataaa

SEQ ID NO: 670571 - DNA, 25 bp, Mus musculus
gtagcagagggctggacctaataaa

SEQ ID NO: 670572 - DNA, 25 bp, Mus musculus
gtagcagataagcatgcaactgaga

SEQ ID NO: 670573 - DNA, 25 bp, Mus musculus
gtagcagataaggatgcaactgaga

SEQ ID NO: 670574 - DNA, 25 bp, Mus musculus
gtagcagatgatccacacacatgat

SEQ ID NO: 670575 - DNA, 25 bp, Mus musculus
gtagcagatgatgcacacacatgat

SEQ ID NO: 670576 - DNA, 25 bp, Mus musculus
gtagcagatggcagctgccttagat

SEQ ID NO: 670577 - DNA, 25 bp, Mus musculus
gtagcagatggctgctgccttagat

SEQ ID NO: 670578 - DNA, 25 bp, Mus musculus
gtagcagcaacaaccagttcttaag

SEQ ID NO: 670579 - DNA, 25 bp, Mus musculus
gtagcagcaacactgtgcatgaaga

SEQ ID NO: 670580 - DNA, 25 bp, Mus musculus
gtagcagcaacagtgtgcatgaaga

SEQ ID NO: 670581 - DNA, 25 bp, Mus musculus
gtagcagcaacatccagttcttaag

SEQ ID NO: 670582 - DNA, 25 bp, Mus musculus
gtagcagcaagtcttacctttgtcc

SEQ ID NO: 670583 - DNA, 25 bp, Mus musculus
gtagcagcaagtgttacctttgtcc

SEQ ID NO: 670584 - DNA, 25 bp, Mus musculus
gtagcagcacaccagacgtctgaag

SEQ ID NO: 670585 - DNA, 25 bp, Mus musculus
gtagcagcacacgagacgtctgaag

SEQ ID NO: 670586 - DNA, 25 bp, Mus musculus
gtagcagcactaagcgcttactgta

SEQ ID NO: 670587 - DNA, 25 bp, Mus musculus
gtagcagcactatgcgcttactgta

SEQ ID NO: 670588 - DNA, 25 bp, Mus musculus
gtagcagcactgatctggatcacgc

SEQ ID NO: 670589 - DNA, 25 bp, Mus musculus
gtagcagcactgttctggatcacgc

SEQ ID NO: 670590 - DNA, 25 bp, Mus musculus
gtagcagcagacaatggcctcggca

SEQ ID NO: 670591 - DNA, 25 bp, Mus musculus
gtagcagcagactatggcctcggca

SEQ ID NO: 670592 - DNA, 25 bp, Mus musculus
gtagcagcagttattaagttccctt

SEQ ID NO: 670593 - DNA, 25 bp, Mus musculus
gtagcagcagtttttaagttccctt

SEQ ID NO: 670594 - DNA, 25 bp, Mus musculus
gtagcagccaagcacaaatcatttt

SEQ ID NO: 670595 - DNA, 25 bp, Mus musculus
gtagcagccaaggacaaatcatttt

SEQ ID NO: 670596 - DNA, 25 bp, Mus musculus
gtagcagccagcacataaactcctg

SEQ ID NO: 670597 - DNA, 25 bp, Mus musculus
gtagcagccagctcataaactcctg

SEQ ID NO: 670598 - DNA, 25 bp, Mus musculus
gtagcagccagtccgacagatacac

SEQ ID NO: 670599 - DNA, 25 bp, Mus musculus
gtagcagccagtgcgacagatacac

SEQ ID NO: 670600 - DNA, 25 bp, Mus musculus
gtagcagccctgcagactagcaagg

SEQ ID NO: 670601 - DNA, 25 bp, Mus musculus
gtagcagccctggagactagcaagg

SEQ ID NO: 670602 - DNA, 25 bp, Mus musculus
gtagcagccgctatagcacgggcat

SEQ ID NO: 670603 - DNA, 25 bp, Mus musculus
gtagcagccgctttagcacgggcat

SEQ ID NO: 670604 - DNA, 25 bp, Mus musculus
gtagcagcctgcagttattactcgt

SEQ ID NO: 670605 - DNA, 25 bp, Mus musculus
gtagcagcctgctgttattactcgt

SEQ ID NO: 670606 - DNA, 25 bp, Mus musculus
gtagcagcgatgatagtaatacaac

SEQ ID NO: 670607 - DNA, 25 bp, Mus musculus
gtagcagcgatgttagtaatacaac

SEQ ID NO: 670608 - DNA, 25 bp, Mus musculus
gtagcagcgctgagctcgggtttaa

SEQ ID NO: 670609 - DNA, 25 bp, Mus musculus
gtagcagcgctgtgctcgggtttaa

SEQ ID NO: 670610 - DNA, 25 bp, Mus musculus
gtagcagcgcttactgatttcatag

SEQ ID NO: 670611 - DNA, 25 bp, Mus musculus
gtagcagcgctttctgatttcatag

SEQ ID NO: 670612 - DNA, 25 bp, Mus musculus
gtagcagcgttaccagaaacaccaa

SEQ ID NO: 670613 - DNA, 25 bp, Mus musculus
gtagcagcgttagcagaaacaccaa

SEQ ID NO: 670614 - DNA, 25 bp, Mus musculus
gtagcagctacacctatggcccaat

SEQ ID NO: 670615 - DNA, 25 bp, Mus musculus
gtagcagctacagctatggcccaat

SEQ ID NO: 670616 - DNA, 25 bp, Mus musculus
gtagcagctaccaattcaagacgcc

SEQ ID NO: 670617 - DNA, 25 bp, Mus musculus
gtagcagctacctattcaagacgcc

SEQ ID NO: 670618 - DNA, 25 bp, Mus musculus
gtagcagctcctctaggtagtgtgc

SEQ ID NO: 670619 - DNA, 25 bp, Mus musculus
gtagcagctcctgtaggtagtgtgc

SEQ ID NO: 670620 - DNA, 25 bp, Mus musculus
gtagcagctctaagtaacccattct

SEQ ID NO: 670621 - DNA, 25 bp, Mus musculus
gtagcagctctatgtaacccattct

SEQ ID NO: 670622 - DNA, 25 bp, Mus musculus
gtagcagctgctctttcaggttctt

SEQ ID NO: 670623 - DNA, 25 bp, Mus musculus
gtagcagctgctgtttcaggttctt

SEQ ID NO: 670624 - DNA, 25 bp, Mus musculus
gtagcagcttccattcgaacctctt

SEQ ID NO: 670625 - DNA, 25 bp, Mus musculus
gtagcagcttcctttcgaacctctt

SEQ ID NO: 670626 - DNA, 25 bp, Mus musculus
gtagcaggaaaacttcccaccaccg

SEQ ID NO: 670627 - DNA, 25 bp, Mus musculus
gtagcaggaaaagttcccaccaccg

SEQ ID NO: 670628 - DNA, 25 bp, Mus musculus
gtagcaggaacgctagggccacctc

SEQ ID NO: 670629 - DNA, 25 bp, Mus musculus
gtagcaggaacggtagggccacctc

SEQ ID NO: 670630 - DNA, 25 bp, Mus musculus
gtagcaggacacatcttggcaaggt

SEQ ID NO: 670631 - DNA, 25 bp, Mus musculus
gtagcaggacacttcttggcaaggt

SEQ ID NO: 670632 - DNA, 25 bp, Mus musculus
gtagcaggatgaccggtcatacctc

SEQ ID NO: 670633 - DNA, 25 bp, Mus musculus
gtagcaggatgagcggtcatacctc

SEQ ID NO: 670634 - DNA, 25 bp, Mus musculus
gtagcaggcagtcagctgtgcccta

SEQ ID NO: 670635 - DNA, 25 bp, Mus musculus
gtagcaggcagtgagctgtgcccta

SEQ ID NO: 670636 - DNA, 25 bp, Mus musculus
gtagcaggccacaaacttggctcaa

SEQ ID NO: 670637 - DNA, 25 bp, Mus musculus
gtagcaggccactaacttggctcaa

SEQ ID NO: 670638 - DNA, 25 bp, Mus musculus
gtagcaggctccaaaatcgtcacct

SEQ ID NO: 670639 - DNA, 25 bp, Mus musculus
gtagcaggctcctaaatcgtcacct

SEQ ID NO: 670640 - DNA, 25 bp, Mus musculus
gtagcaggctctaccagacctgata

SEQ ID NO: 670641 - DNA, 25 bp, Mus musculus
gtagcaggctcttccagacctgata

SEQ ID NO: 670642 - DNA, 25 bp, Mus musculus
gtagcagggctgaacccatcagaac

SEQ ID NO: 670643 - DNA, 25 bp, Mus musculus
gtagcagggctgcagttaagctttt

SEQ ID NO: 670644 - DNA, 25 bp, Mus musculus
gtagcagggctggagttaagctttt

SEQ ID NO: 670645 - DNA, 25 bp, Mus musculus
gtagcagggctgtacccatcagaac

SEQ ID NO: 670646 - DNA, 25 bp, Mus musculus
gtagcaggtgacagctgagaccaaa

SEQ ID NO: 670647 - DNA, 25 bp, Mus musculus
gtagcaggtgactgctgagaccaaa

SEQ ID NO: 670648 - DNA, 25 bp, Mus musculus
gtagcaggtgcgcacacttccacag

SEQ ID NO: 670649 - DNA, 25 bp, Mus musculus
gtagcaggtgcggacacttccacag

SEQ ID NO: 670650 - DNA, 25 bp, Mus musculus
gtagcaggtgttaattacagatagt

SEQ ID NO: 670651 - DNA, 25 bp, Mus musculus
gtagcaggtgtttattacagatagt

SEQ ID NO: 670652 - DNA, 25 bp, Mus musculus
gtagcaggttatatccatgtgacac

SEQ ID NO: 670653 - DNA, 25 bp, Mus musculus
gtagcaggttatttccatgtgacac

SEQ ID NO: 670654 - DNA, 25 bp, Mus musculus
gtagcagtaggcaaatatgtcccaa

SEQ ID NO: 670655 - DNA, 25 bp, Mus musculus
gtagcagtaggctaatatgtcccaa

SEQ ID NO: 670656 - DNA, 25 bp, Mus musculus
gtagcagtcaacacattcttggaac

SEQ ID NO: 670657 - DNA, 25 bp, Mus musculus
gtagcagtcaactcattcttggaac

SEQ ID NO: 670658 - DNA, 25 bp, Mus musculus
gtagcagtcaccacatttttagggt

SEQ ID NO: 670659 - DNA, 25 bp, Mus musculus
gtagcagtcacctcatttttagggt

SEQ ID NO: 670660 - DNA, 25 bp, Mus musculus
gtagcagtcagcaaattagcacatg

SEQ ID NO: 670661 - DNA, 25 bp, Mus musculus
gtagcagtcagctaattagcacatg

SEQ ID NO: 670662 - DNA, 25 bp, Mus musculus
gtagcagtcagtctccagcatgaat

SEQ ID NO: 670663 - DNA, 25 bp, Mus musculus
gtagcagtcagtgtccagcatgaat

SEQ ID NO: 670664 - DNA, 25 bp, Mus musculus
gtagcagtcctgagtttgtaaacaa

SEQ ID NO: 670665 - DNA, 25 bp, Mus musculus
gtagcagtcctgtgtttgtaaacaa

SEQ ID NO: 670666 - DNA, 25 bp, Mus musculus
gtagcagtgaatagacttgagtcct

SEQ ID NO: 670667 - DNA, 25 bp, Mus musculus
gtagcagtgaattgacttgagtcct

SEQ ID NO: 670668 - DNA, 25 bp, Mus musculus
gtagcagtgaccagtagccagaaag

SEQ ID NO: 670669 - DNA, 25 bp, Mus musculus
gtagcagtgacctgtagccagaaag

SEQ ID NO: 670670 - DNA, 25 bp, Mus musculus
gtagcagtgatcaagggcttaccta

SEQ ID NO: 670671 - DNA, 25 bp, Mus musculus
gtagcagtgatctagggcttaccta

SEQ ID NO: 670672 - DNA, 25 bp, Mus musculus
gtagcagtgatgactttgtgcgcat

SEQ ID NO: 670673 - DNA, 25 bp, Mus musculus
gtagcagtgatgtctttgtgcgcat

SEQ ID NO: 670674 - DNA, 25 bp, Mus musculus
gtagcagtgcatcgagaccccttta

SEQ ID NO: 670675 - DNA, 25 bp, Mus musculus
gtagcagtgcatggagaccccttta

SEQ ID NO: 670676 - DNA, 25 bp, Mus musculus
gtagcagtgtacatccggtcgtttg

SEQ ID NO: 670677 - DNA, 25 bp, Mus musculus
gtagcagtgtacttccggtcgtttg

SEQ ID NO: 670678 - DNA, 25 bp, Mus musculus
gtagcagtgtttcccatcgagccca

SEQ ID NO: 670679 - DNA, 25 bp, Mus musculus
gtagcagtgtttgccatcgagccca

SEQ ID NO: 670680 - DNA, 25 bp, Mus musculus
gtagcagttatgattaatggccttg

SEQ ID NO: 670681 - DNA, 25 bp, Mus musculus
gtagcagttatgtttaatggccttg

SEQ ID NO: 670682 - DNA, 25 bp, Mus musculus
gtagcagttcatattctgaccaaca

SEQ ID NO: 670683 - DNA, 25 bp, Mus musculus
gtagcagttcattttctgaccaaca

SEQ ID NO: 670684 - DNA, 25 bp, Mus musculus
gtagcagttctgcagcacaaattaa

SEQ ID NO: 670685 - DNA, 25 bp, Mus musculus
gtagcagttctggagcacaaattaa

SEQ ID NO: 670686 - DNA, 25 bp, Mus musculus
gtagcagttcttaaatcagcagtat

SEQ ID NO: 670687 - DNA, 25 bp, Mus musculus
gtagcagttctttaatcagcagtat

SEQ ID NO: 670688 - DNA, 25 bp, Mus musculus
gtagcagttgccaggcagatgctaa

SEQ ID NO: 670689 - DNA, 25 bp, Mus musculus
gtagcagttgcctggcagatgctaa

SEQ ID NO: 670690 - DNA, 25 bp, Mus musculus
gtagcagtttgcacagagcccaagc

SEQ ID NO: 670691 - DNA, 25 bp, Mus musculus
gtagcagtttgctcagagcccaagc

SEQ ID NO: 670692 - DNA, 25 bp, Mus musculus
gtagcataaatgcacaatcccaatt

SEQ ID NO: 670693 - DNA, 25 bp, Mus musculus
gtagcataaatggacaatcccaatt

SEQ ID NO: 670694 - DNA, 25 bp, Mus musculus
gtagcataataaaacaacgactatt

SEQ ID NO: 670695 - DNA, 25 bp, Mus musculus
gtagcataataatacaacgactatt

SEQ ID NO: 670696 - DNA, 25 bp, Mus musculus
gtagcataatctactttgtcttaga

SEQ ID NO: 670697 - DNA, 25 bp, Mus musculus
gtagcataatcttctttgtcttaga

SEQ ID NO: 670698 - DNA, 25 bp, Mus musculus
gtagcatagactctccaggctgagt

SEQ ID NO: 670699 - DNA, 25 bp, Mus musculus
gtagcatagactgtccaggctgagt

SEQ ID NO: 670700 - DNA, 25 bp, Mus musculus
gtagcatagatactcaaagtaaagt

SEQ ID NO: 670701 - DNA, 25 bp, Mus musculus
gtagcatagatagtcaaagtaaagt

SEQ ID NO: 670702 - DNA, 25 bp, Mus musculus
gtagcatatcatctctgctcttctg

SEQ ID NO: 670703 - DNA, 25 bp, Mus musculus
gtagcatatcatgtctgctcttctg

SEQ ID NO: 670704 - DNA, 25 bp, Mus musculus
gtagcatatgctcccttaagtcagt

SEQ ID NO: 670705 - DNA, 25 bp, Mus musculus
gtagcatatgctgccttaagtcagt

SEQ ID NO: 670706 - DNA, 25 bp, Mus musculus
gtagcatatgtccagtgctccctgc

SEQ ID NO: 670707 - DNA, 25 bp, Mus musculus
gtagcatatgtcgagtgctccctgc

SEQ ID NO: 670708 - DNA, 25 bp, Mus musculus
gtagcatattctaattgcacagatc

SEQ ID NO: 670709 - DNA, 25 bp, Mus musculus
gtagcatattctagtattcccattc

SEQ ID NO: 670710 - DNA, 25 bp, Mus musculus
gtagcatattcttattgcacagatc

SEQ ID NO: 670711 - DNA, 25 bp, Mus musculus
gtagcatattcttgtattcccattc

SEQ ID NO: 670712 - DNA, 25 bp, Mus musculus
gtagcatattgaaccctatctgaag

SEQ ID NO: 670713 - DNA, 25 bp, Mus musculus
gtagcatattgatccctatctgaag

SEQ ID NO: 670714 - DNA, 25 bp, Mus musculus
gtagcatcacaaaagtcagtggtga

SEQ ID NO: 670715 - DNA, 25 bp, Mus musculus
gtagcatcacaatagtcagtggtga

SEQ ID NO: 670716 - DNA, 25 bp, Mus musculus
gtagcatcagctagcatttaagaaa

SEQ ID NO: 670717 - DNA, 25 bp, Mus musculus
gtagcatcagcttgcatttaagaaa

SEQ ID NO: 670718 - DNA, 25 bp, Mus musculus
gtagcatcatgaccatcttccatcc

SEQ ID NO: 670719 - DNA, 25 bp, Mus musculus
gtagcatcatgagcatcttccatcc

SEQ ID NO: 670720 - DNA, 25 bp, Mus musculus
gtagcatcattactgtttctcagtc

SEQ ID NO: 670721 - DNA, 25 bp, Mus musculus
gtagcatcattagtgtttctcagtc

SEQ ID NO: 670722 - DNA, 25 bp, Mus musculus
gtagcatccatacccctggtcagat

SEQ ID NO: 670723 - DNA, 25 bp, Mus musculus
gtagcatccatagccctggtcagat

SEQ ID NO: 670724 - DNA, 25 bp, Mus musculus
gtagcatcccatatgtaccaaaaca

SEQ ID NO: 670725 - DNA, 25 bp, Mus musculus
gtagcatcccatttgtaccaaaaca

SEQ ID NO: 670726 - DNA, 25 bp, Mus musculus
gtagcatccgaaacagtgactgttt

SEQ ID NO: 670727 - DNA, 25 bp, Mus musculus
gtagcatccgaatcagtgactgttt

SEQ ID NO: 670728 - DNA, 25 bp, Mus musculus
gtagcatcctggaaaggccgacttc

SEQ ID NO: 670729 - DNA, 25 bp, Mus musculus
gtagcatcctggtaaggccgacttc

SEQ ID NO: 670730 - DNA, 25 bp, Mus musculus
gtagcatcgaacacacctgaatggt

SEQ ID NO: 670731 - DNA, 25 bp, Mus musculus
gtagcatcgaactcacctgaatggt

SEQ ID NO: 670732 - DNA, 25 bp, Mus musculus
gtagcatcgagacttttacattatg

SEQ ID NO: 670733 - DNA, 25 bp, Mus musculus
gtagcatcgagagttttacattatg

SEQ ID NO: 670734 - DNA, 25 bp, Mus musculus
gtagcatctctacacatttgtacca

SEQ ID NO: 670735 - DNA, 25 bp, Mus musculus
gtagcatctctagacatttgtacca

SEQ ID NO: 670736 - DNA, 25 bp, Mus musculus
gtagcatctgaacattggccgtctc

SEQ ID NO: 670737 - DNA, 25 bp, Mus musculus
gtagcatctgaagattggccgtctc

SEQ ID NO: 670738 - DNA, 25 bp, Mus musculus
gtagcatctgctaaaagtttcaagc

SEQ ID NO: 670739 - DNA, 25 bp, Mus musculus
gtagcatctgcttaaagtttcaagc

SEQ ID NO: 670740 - DNA, 25 bp, Mus musculus
gtagcatcttagactttttcatgtt

SEQ ID NO: 670741 - DNA, 25 bp, Mus musculus
gtagcatcttagtctttttcatgtt

SEQ ID NO: 670742 - DNA, 25 bp, Mus musculus
gtagcatgaaccaccatgtttggca

SEQ ID NO: 670743 - DNA, 25 bp, Mus musculus
gtagcatgaacctccatgtttggca

SEQ ID NO: 670744 - DNA, 25 bp, Mus musculus
gtagcatgactcattaatcactgtt

SEQ ID NO: 670745 - DNA, 25 bp, Mus musculus
gtagcatgactctttaatcactgtt

SEQ ID NO: 670746 - DNA, 25 bp, Mus musculus
gtagcatgagctaccaagcccaagc

SEQ ID NO: 670747 - DNA, 25 bp, Mus musculus
gtagcatgagcttccaagcccaagc

SEQ ID NO: 670748 - DNA, 25 bp, Mus musculus
gtagcatgaggacagatacttcaaa

SEQ ID NO: 670749 - DNA, 25 bp, Mus musculus
gtagcatgaggagagatacttcaaa

SEQ ID NO: 670750 - DNA, 25 bp, Mus musculus
gtagcatgatgtctcctttgatcac

SEQ ID NO: 670751 - DNA, 25 bp, Mus musculus
gtagcatgatgtgtcctttgatcac

SEQ ID NO: 670752 - DNA, 25 bp, Mus musculus
gtagcatgcccaaatccctgggttt

SEQ ID NO: 670753 - DNA, 25 bp, Mus musculus
gtagcatgcccatatccctgggttt

SEQ ID NO: 670754 - DNA, 25 bp, Mus musculus
gtagcatggacaccgtctccagatg

SEQ ID NO: 670755 - DNA, 25 bp, Mus musculus
gtagcatggacagcgtctccagatg

SEQ ID NO: 670756 - DNA, 25 bp, Mus musculus
gtagcatggcatactctcagagctt

SEQ ID NO: 670757 - DNA, 25 bp, Mus musculus
gtagcatggcattctctcagagctt

SEQ ID NO: 670758 - DNA, 25 bp, Mus musculus
gtagcatggttaatgctattgttta

SEQ ID NO: 670759 - DNA, 25 bp, Mus musculus
gtagcatggttattgctattgttta

SEQ ID NO: 670760 - DNA, 25 bp, Mus musculus
gtagcatgtacacactttcttggga

SEQ ID NO: 670761 - DNA, 25 bp, Mus musculus
gtagcatgtacagactttcttggga

SEQ ID NO: 670762 - DNA, 25 bp, Mus musculus
gtagcatgtgttaccaaactgccaa

SEQ ID NO: 670763 - DNA, 25 bp, Mus musculus
gtagcatgtgtttccaaactgccaa

SEQ ID NO: 670764 - DNA, 25 bp, Mus musculus
gtagcatgttgcagtcagacgtctc

SEQ ID NO: 670765 - DNA, 25 bp, Mus musculus
gtagcatgttgctgtcagacgtctc

SEQ ID NO: 670766 - DNA, 25 bp, Mus musculus
gtagcattaagcacgggatctcttt

SEQ ID NO: 670767 - DNA, 25 bp, Mus musculus
gtagcattaagctcgggatctcttt

SEQ ID NO: 670768 - DNA, 25 bp, Mus musculus
gtagcattagctctttgtcctgtca

SEQ ID NO: 670769 - DNA, 25 bp, Mus musculus
gtagcattagctgtttgtcctgtca

SEQ ID NO: 670770 - DNA, 25 bp, Mus musculus
gtagcattatctcgtcaacattgta

SEQ ID NO: 670771 - DNA, 25 bp, Mus musculus
gtagcattatctggtcaacattgta

SEQ ID NO: 670772 - DNA, 25 bp, Mus musculus
gtagcattcaacagtgcactagaag

SEQ ID NO: 670773 - DNA, 25 bp, Mus musculus
gtagcattcaactgtgcactagaag

SEQ ID NO: 670774 - DNA, 25 bp, Mus musculus
gtagcattcacaagcagtgctgact

SEQ ID NO: 670775 - DNA, 25 bp, Mus musculus
gtagcattcacatgcagtgctgact

SEQ ID NO: 670776 - DNA, 25 bp, Mus musculus
gtagcattcagcactagaggacctt

SEQ ID NO: 670777 - DNA, 25 bp, Mus musculus
gtagcattcagctctagaggacctt

SEQ ID NO: 670778 - DNA, 25 bp, Mus musculus
gtagcattcattagtggtaggagtc

SEQ ID NO: 670779 - DNA, 25 bp, Mus musculus
gtagcattcatttgtggtaggagtc

SEQ ID NO: 670780 - DNA, 25 bp, Mus musculus
gtagcattccataatgtagacttca

SEQ ID NO: 670781 - DNA, 25 bp, Mus musculus
gtagcattccattatgtagacttca

SEQ ID NO: 670782 - DNA, 25 bp, Mus musculus
gtagcattgataagcagtgactgcc

SEQ ID NO: 670783 - DNA, 25 bp, Mus musculus
gtagcattgatatgcagtgactgcc

SEQ ID NO: 670784 - DNA, 25 bp, Mus musculus
gtagcattgcttaaccattgtgtat

SEQ ID NO: 670785 - DNA, 25 bp, Mus musculus
gtagcattgcttatatgtttcagtt

SEQ ID NO: 670786 - DNA, 25 bp, Mus musculus
gtagcattgctttaccattgtgtat

SEQ ID NO: 670787 - DNA, 25 bp, Mus musculus
gtagcattgcttttatgtttcagtt

SEQ ID NO: 670788 - DNA, 25 bp, Mus musculus
gtagcattggaaacaaggcctcctc

SEQ ID NO: 670789 - DNA, 25 bp, Mus musculus
gtagcattggaatcaaggcctcctc

SEQ ID NO: 670790 - DNA, 25 bp, Mus musculus
gtagcattggctattgctcagatgc

SEQ ID NO: 670791 - DNA, 25 bp, Mus musculus
gtagcattggcttttgctcagatgc

SEQ ID NO: 670792 - DNA, 25 bp, Mus musculus
gtagcattgtctaccagttggttca

SEQ ID NO: 670793 - DNA, 25 bp, Mus musculus
gtagcattgtcttccagttggttca

SEQ ID NO: 670794 - DNA, 25 bp, Mus musculus
gtagcattgttcatattgattatag

SEQ ID NO: 670795 - DNA, 25 bp, Mus musculus
gtagcattgttcttattgattatag

SEQ ID NO: 670796 - DNA, 25 bp, Mus musculus
gtagcatttcacatcgtgtacagtg

SEQ ID NO: 670797 - DNA, 25 bp, Mus musculus
gtagcatttcacttcgtgtacagtg

SEQ ID NO: 670798 - DNA, 25 bp, Mus musculus
gtagcatttctactgagaccagttt

SEQ ID NO: 670799 - DNA, 25 bp, Mus musculus
gtagcatttctagtgagaccagttt

SEQ ID NO: 670800 - DNA, 25 bp, Mus musculus
gtagcatttggccaacttaatgaat

SEQ ID NO: 670801 - DNA, 25 bp, Mus musculus
gtagcatttggccagttttagtgaa

SEQ ID NO: 670802 - DNA, 25 bp, Mus musculus
gtagcatttggcgaacttaatgaat

SEQ ID NO: 670803 - DNA, 25 bp, Mus musculus
gtagcatttggcgagttttagtgaa

SEQ ID NO: 670804 - DNA, 25 bp, Mus musculus
gtagcattttagataaggttgtgtt

SEQ ID NO: 670805 - DNA, 25 bp, Mus musculus
gtagcattttagttaaggttgtgtt

SEQ ID NO: 670806 - DNA, 25 bp, Mus musculus
gtagcattttcaatgacttcctctt

SEQ ID NO: 670807 - DNA, 25 bp, Mus musculus
gtagcattttcattgacttcctctt

SEQ ID NO: 670808 - DNA, 25 bp, Mus musculus
gtagcattttgacaccattaggaaa

SEQ ID NO: 670809 - DNA, 25 bp, Mus musculus
gtagcattttgagaccattaggaaa

SEQ ID NO: 670810 - DNA, 25 bp, Mus musculus
gtagccaaacctcgccaggagaaaa

SEQ ID NO: 670811 - DNA, 25 bp, Mus musculus
gtagccaaacctggccaggagaaaa

SEQ ID NO: 670812 - DNA, 25 bp, Mus musculus
gtagccaacatcattctgtcaggtc

SEQ ID NO: 670813 - DNA, 25 bp, Mus musculus
gtagccaacatctttctgtcaggtc

SEQ ID NO: 670814 - DNA, 25 bp, Mus musculus
gtagccaacttcctcaaaacattca

SEQ ID NO: 670815 - DNA, 25 bp, Mus musculus
gtagccaacttcgtcaaaacattca

SEQ ID NO: 670816 - DNA, 25 bp, Mus musculus
gtagccaagatgacttcagcacctg

SEQ ID NO: 670817 - DNA, 25 bp, Mus musculus
gtagccaagatgtcttcagcacctg

SEQ ID NO: 670818 - DNA, 25 bp, Mus musculus
gtagccaaggaccatcctacatcgg

SEQ ID NO: 670819 - DNA, 25 bp, Mus musculus
gtagccaaggacgatcctacatcgg

SEQ ID NO: 670820 - DNA, 25 bp, Mus musculus
gtagccaaggatccagacttggaga

SEQ ID NO: 670821 - DNA, 25 bp, Mus musculus
gtagccaaggatgcagacttggaga

SEQ ID NO: 670822 - DNA, 25 bp, Mus musculus
gtagccaagtccctgccctttttag

SEQ ID NO: 670823 - DNA, 25 bp, Mus musculus
gtagccaagtccgtgccctttttag

SEQ ID NO: 670824 - DNA, 25 bp, Mus musculus
gtagccaatagaacctcaccacgga

SEQ ID NO: 670825 - DNA, 25 bp, Mus musculus
gtagccaatagatcctcaccacgga

SEQ ID NO: 670826 - DNA, 25 bp, Mus musculus
gtagccaatcaccaagagcgtttta

SEQ ID NO: 670827 - DNA, 25 bp, Mus musculus
gtagccaatcacgaagagcgtttta

SEQ ID NO: 670828 - DNA, 25 bp, Mus musculus
gtagccaatcataacaggtgtctga

SEQ ID NO: 670829 - DNA, 25 bp, Mus musculus
gtagccaatcattacaggtgtctga

SEQ ID NO: 670830 - DNA, 25 bp, Mus musculus
gtagccaatcccctggagttggact

SEQ ID NO: 670831 - DNA, 25 bp, Mus musculus
gtagccaatcccgtggagttggact

SEQ ID NO: 670832 - DNA, 25 bp, Mus musculus
gtagccaattttccaatctcattca

SEQ ID NO: 670833 - DNA, 25 bp, Mus musculus
gtagccaattttgcaatctcattca

SEQ ID NO: 670834 - DNA, 25 bp, Mus musculus
gtagccacaaaaccgatctccgagc

SEQ ID NO: 670835 - DNA, 25 bp, Mus musculus
gtagccacaaaagcgatctccgagc

SEQ ID NO: 670836 - DNA, 25 bp, Mus musculus
gtagccacacagatccaacaagagg

SEQ ID NO: 670837 - DNA, 25 bp, Mus musculus
gtagccacacagattttcgacattg

SEQ ID NO: 670838 - DNA, 25 bp, Mus musculus
gtagccacacagttccaacaagagg

SEQ ID NO: 670839 - DNA, 25 bp, Mus musculus
gtagccacacagtttttcgacattg

SEQ ID NO: 670840 - DNA, 25 bp, Mus musculus
gtagccacacccaagagctagcagt

SEQ ID NO: 670841 - DNA, 25 bp, Mus musculus
gtagccacaccctagagctagcagt

SEQ ID NO: 670842 - DNA, 25 bp, Mus musculus
gtagccacactccagtcagtgggga

SEQ ID NO: 670843 - DNA, 25 bp, Mus musculus
gtagccacactcgagtcagtgggga

SEQ ID NO: 670844 - DNA, 25 bp, Mus musculus
gtagccacagatcccaatgctgcca

SEQ ID NO: 670845 - DNA, 25 bp, Mus musculus
gtagccacagatgccaatgctgcca

SEQ ID NO: 670846 - DNA, 25 bp, Mus musculus
gtagccacaggaaggctctagctat

SEQ ID NO: 670847 - DNA, 25 bp, Mus musculus
gtagccacaggatggctctagctat

SEQ ID NO: 670848 - DNA, 25 bp, Mus musculus
gtagccaccacaacctggactctga

SEQ ID NO: 670849 - DNA, 25 bp, Mus musculus
gtagccaccacatcctggactctga

SEQ ID NO: 670850 - DNA, 25 bp, Mus musculus
gtagccacctcacgtcctgaatctt

SEQ ID NO: 670851 - DNA, 25 bp, Mus musculus
gtagccacctcaggtcctgaatctt

SEQ ID NO: 670852 - DNA, 25 bp, Mus musculus
gtagccacgtagatgctgtgcagaa

SEQ ID NO: 670853 - DNA, 25 bp, Mus musculus
gtagccacgtagttgctgtgcagaa

SEQ ID NO: 670854 - DNA, 25 bp, Mus musculus
gtagccactagccagatgtgtcagt

SEQ ID NO: 670855 - DNA, 25 bp, Mus musculus
gtagccactagcgagatgtgtcagt

SEQ ID NO: 670856 - DNA, 25 bp, Mus musculus
gtagccactcgaagctaattcttcc

SEQ ID NO: 670857 - DNA, 25 bp, Mus musculus
gtagccactcgatgctaattcttcc

SEQ ID NO: 670858 - DNA, 25 bp, Mus musculus
gtagccactctgcacgtggtcacta

SEQ ID NO: 670859 - DNA, 25 bp, Mus musculus
gtagccactctggacgtggtcacta

SEQ ID NO: 670860 - DNA, 25 bp, Mus musculus
gtagccactgaacttcaagtccaca

SEQ ID NO: 670861 - DNA, 25 bp, Mus musculus
gtagccactgaagttcaagtccaca

SEQ ID NO: 670862 - DNA, 25 bp, Mus musculus
gtagccacttgacggcactttctgg

SEQ ID NO: 670863 - DNA, 25 bp, Mus musculus
gtagccacttgagggcactttctgg

SEQ ID NO: 670864 - DNA, 25 bp, Mus musculus
gtagccacttgtaatattctaggat

SEQ ID NO: 670865 - DNA, 25 bp, Mus musculus
gtagccacttgttatattctaggat

SEQ ID NO: 670866 - DNA, 25 bp, Mus musculus
gtagccagacttctgattcaggcac

SEQ ID NO: 670867 - DNA, 25 bp, Mus musculus
gtagccagacttgtgattcaggcac

SEQ ID NO: 670868 - DNA, 25 bp, Mus musculus
gtagccagagctacactttagtgac

SEQ ID NO: 670869 - DNA, 25 bp, Mus musculus
gtagccagagcttcactttagtgac

SEQ ID NO: 670870 - DNA, 25 bp, Mus musculus
gtagccagatgcagatactcccaac

SEQ ID NO: 670871 - DNA, 25 bp, Mus musculus
gtagccagatgctgatactcccaac

SEQ ID NO: 670872 - DNA, 25 bp, Mus musculus
gtagccagcaaacttgttcaaccct

SEQ ID NO: 670873 - DNA, 25 bp, Mus musculus
gtagccagcaaagttgttcaaccct

SEQ ID NO: 670874 - DNA, 25 bp, Mus musculus
gtagccagcactagctaatacatga

SEQ ID NO: 670875 - DNA, 25 bp, Mus musculus
gtagccagcacttgctaatacatga

SEQ ID NO: 670876 - DNA, 25 bp, Mus musculus
gtagccagcagtatggttcttgaac

SEQ ID NO: 670877 - DNA, 25 bp, Mus musculus
gtagccagcagtttggttcttgaac

SEQ ID NO: 670878 - DNA, 25 bp, Mus musculus
gtagccagcatactcgtgcttacaa

SEQ ID NO: 670879 - DNA, 25 bp, Mus musculus
gtagccagcatagtcgtgcttacaa

SEQ ID NO: 670880 - DNA, 25 bp, Mus musculus
gtagccagccagatacacaggtgca

SEQ ID NO: 670881 - DNA, 25 bp, Mus musculus
gtagccagccagttacacaggtgca

SEQ ID NO: 670882 - DNA, 25 bp, Mus musculus
gtagccagcgagcacctgtgacaga

SEQ ID NO: 670883 - DNA, 25 bp, Mus musculus
gtagccagcgaggacctgtgacaga

SEQ ID NO: 670884 - DNA, 25 bp, Mus musculus
gtagccagcttgagtaagacccctt

SEQ ID NO: 670885 - DNA, 25 bp, Mus musculus
gtagccagcttgtgtaagacccctt

SEQ ID NO: 670886 - DNA, 25 bp, Mus musculus
gtagccaggagacgctgagctcaat

SEQ ID NO: 670887 - DNA, 25 bp, Mus musculus
gtagccaggagaggctgagctcaat

SEQ ID NO: 670888 - DNA, 25 bp, Mus musculus
gtagccaggcttactgcacatacag

SEQ ID NO: 670889 - DNA, 25 bp, Mus musculus
gtagccaggctttctgcacatacag

SEQ ID NO: 670890 - DNA, 25 bp, Mus musculus
gtagccagggcacgttcagtgtaaa

SEQ ID NO: 670891 - DNA, 25 bp, Mus musculus
gtagccagggcaggttcagtgtaaa

SEQ ID NO: 670892 - DNA, 25 bp, Mus musculus
gtagccaggtaacctgttgtcccag

SEQ ID NO: 670893 - DNA, 25 bp, Mus musculus
gtagccaggtaagctgttgtcccag

SEQ ID NO: 670894 - DNA, 25 bp, Mus musculus
gtagccagtaagatcattgctgtga

SEQ ID NO: 670895 - DNA, 25 bp, Mus musculus
gtagccagtaagttcattgctgtga

SEQ ID NO: 670896 - DNA, 25 bp, Mus musculus
gtagccagtaggatcttactcagac

SEQ ID NO: 670897 - DNA, 25 bp, Mus musculus
gtagccagtaggttcttactcagac

SEQ ID NO: 670898 - DNA, 25 bp, Mus musculus
gtagccagtcctcactagttttggt

SEQ ID NO: 670899 - DNA, 25 bp, Mus musculus
gtagccagtcctcagccaaggagaa

SEQ ID NO: 670900 - DNA, 25 bp, Mus musculus
gtagccagtcctgactagttttggt

SEQ ID NO: 670901 - DNA, 25 bp, Mus musculus
gtagccagtcctgagccaaggagaa

SEQ ID NO: 670902 - DNA, 25 bp, Mus musculus
gtagccagtctgaaggcctgagcca

SEQ ID NO: 670903 - DNA, 25 bp, Mus musculus
gtagccagtctgtaggcctgagcca

SEQ ID NO: 670904 - DNA, 25 bp, Mus musculus
gtagccagtgatatgttgtccagaa

SEQ ID NO: 670905 - DNA, 25 bp, Mus musculus
gtagccagtgatcccatgtcaatct

SEQ ID NO: 670906 - DNA, 25 bp, Mus musculus
gtagccagtgatgccatgtcaatct

SEQ ID NO: 670907 - DNA, 25 bp, Mus musculus
gtagccagtgatttgttgtccagaa

SEQ ID NO: 670908 - DNA, 25 bp, Mus musculus
gtagccagtggccaggataccaaag

SEQ ID NO: 670909 - DNA, 25 bp, Mus musculus
gtagccagtggcgaggataccaaag

SEQ ID NO: 670910 - DNA, 25 bp, Mus musculus
gtagccatactgagttccagataaa

SEQ ID NO: 670911 - DNA, 25 bp, Mus musculus
gtagccatactgtgttccagataaa

SEQ ID NO: 670912 - DNA, 25 bp, Mus musculus
gtagccataggacctgacccagttt

SEQ ID NO: 670913 - DNA, 25 bp, Mus musculus
gtagccataggagctgacccagttt

SEQ ID NO: 670914 - DNA, 25 bp, Mus musculus
gtagccatatagcttatagttgtca

SEQ ID NO: 670915 - DNA, 25 bp, Mus musculus
gtagccatataggttatagttgtca

SEQ ID NO: 670916 - DNA, 25 bp, Mus musculus
gtagccatatgaaatcacatttcct

SEQ ID NO: 670917 - DNA, 25 bp, Mus musculus
gtagccatatgatatcacatttcct

SEQ ID NO: 670918 - DNA, 25 bp, Mus musculus
gtagccatctggaattttgctccat

SEQ ID NO: 670919 - DNA, 25 bp, Mus musculus
gtagccatctggtattttgctccat

SEQ ID NO: 670920 - DNA, 25 bp, Mus musculus
gtagccatcttcataccaaattcag

SEQ ID NO: 670921 - DNA, 25 bp, Mus musculus
gtagccatcttcttaccaaattcag

SEQ ID NO: 670922 - DNA, 25 bp, Mus musculus
gtagccatcttgcagttttcagaaa

SEQ ID NO: 670923 - DNA, 25 bp, Mus musculus
gtagccatcttggagttttcagaaa

SEQ ID NO: 670924 - DNA, 25 bp, Mus musculus
gtagccatggcgaacgaggaacaga

SEQ ID NO: 670925 - DNA, 25 bp, Mus musculus
gtagccatggcgtacgaggaacaga

SEQ ID NO: 670926 - DNA, 25 bp, Mus musculus
gtagccatggtaatcatctcatttg

SEQ ID NO: 670927 - DNA, 25 bp, Mus musculus
gtagccatggtattcatctcatttg

SEQ ID NO: 670928 - DNA, 25 bp, Mus musculus
gtagccatggtgaaggtgtctgtcc

SEQ ID NO: 670929 - DNA, 25 bp, Mus musculus
gtagccatggtgtaggtgtctgtcc

SEQ ID NO: 670930 - DNA, 25 bp, Mus musculus
gtagccattaaaagcatgaaccgag

SEQ ID NO: 670931 - DNA, 25 bp, Mus musculus
gtagccattaaatgcatgaaccgag

SEQ ID NO: 670932 - DNA, 25 bp, Mus musculus
gtagccattcttagtgtttccactg

SEQ ID NO: 670933 - DNA, 25 bp, Mus musculus
gtagccattctttgtgtttccactg

SEQ ID NO: 670934 - DNA, 25 bp, Mus musculus
gtagccattgagattccagactgcc

SEQ ID NO: 670935 - DNA, 25 bp, Mus musculus
gtagccattgagtttccagactgcc

SEQ ID NO: 670936 - DNA, 25 bp, Mus musculus
gtagccattgtacactagagagtaa

SEQ ID NO: 670937 - DNA, 25 bp, Mus musculus
gtagccattgtagactagagagtaa

SEQ ID NO: 670938 - DNA, 25 bp, Mus musculus
gtagccattgtgaataaaggatgac

SEQ ID NO: 670939 - DNA, 25 bp, Mus musculus
gtagccattgtgtataaaggatgac

SEQ ID NO: 670940 - DNA, 25 bp, Mus musculus
gtagccattttgctcattatgcagt

SEQ ID NO: 670941 - DNA, 25 bp, Mus musculus
gtagccattttggtcattatgcagt

SEQ ID NO: 670942 - DNA, 25 bp, Mus musculus
gtagccatttttcgtggattccgaa

SEQ ID NO: 670943 - DNA, 25 bp, Mus musculus
gtagccatttttggtggattccgaa

SEQ ID NO: 670944 - DNA, 25 bp, Mus musculus
gtagcccaaagaagagcattctaat

SEQ ID NO: 670945 - DNA, 25 bp, Mus musculus
gtagcccaaagatgagcattctaat

SEQ ID NO: 670946 - DNA, 25 bp, Mus musculus
gtagcccaagcaagctgatcttaaa

SEQ ID NO: 670947 - DNA, 25 bp, Mus musculus
gtagcccaagcatgctgatcttaaa

SEQ ID NO: 670948 - DNA, 25 bp, Mus musculus
gtagcccaagctactcttgaacttg

SEQ ID NO: 670949 - DNA, 25 bp, Mus musculus
gtagcccaagcttctcttgaacttg

SEQ ID NO: 670950 - DNA, 25 bp, Mus musculus
gtagcccaaggcaccctatggataa

SEQ ID NO: 670951 - DNA, 25 bp, Mus musculus
gtagcccaaggcagtaggaacaaac

SEQ ID NO: 670952 - DNA, 25 bp, Mus musculus
gtagcccaaggctccctatggataa

SEQ ID NO: 670953 - DNA, 25 bp, Mus musculus
gtagcccaaggctgtaggaacaaac

SEQ ID NO: 670954 - DNA, 25 bp, Mus musculus
gtagcccaaggtatccaacagaaaa

SEQ ID NO: 670955 - DNA, 25 bp, Mus musculus
gtagcccaaggtttccaacagaaaa

SEQ ID NO: 670956 - DNA, 25 bp, Mus musculus
gtagcccaagttcccctgaagctca

SEQ ID NO: 670957 - DNA, 25 bp, Mus musculus
gtagcccaagttgccctgaagctca

SEQ ID NO: 670958 - DNA, 25 bp, Mus musculus
gtagcccaatacagcatcttgttaa

SEQ ID NO: 670959 - DNA, 25 bp, Mus musculus
gtagcccaatactgcatcttgttaa

SEQ ID NO: 670960 - DNA, 25 bp, Mus musculus
gtagcccaatagaaatacacctgtt

SEQ ID NO: 670961 - DNA, 25 bp, Mus musculus
gtagcccaatagtaatacacctgtt

SEQ ID NO: 670962 - DNA, 25 bp, Mus musculus
gtagcccacagaccttagatatttc

SEQ ID NO: 670963 - DNA, 25 bp, Mus musculus
gtagcccacagagcttagatatttc

SEQ ID NO: 670964 - DNA, 25 bp, Mus musculus
gtagcccaccaaccttagacattgt

SEQ ID NO: 670965 - DNA, 25 bp, Mus musculus
gtagcccaccaagcttagacattgt

SEQ ID NO: 670966 - DNA, 25 bp, Mus musculus
gtagcccagagacaatcacagcctt

SEQ ID NO: 670967 - DNA, 25 bp, Mus musculus
gtagcccagagagaatcacagcctt

SEQ ID NO: 670968 - DNA, 25 bp, Mus musculus
gtagcccagattaatttcaattcaa

SEQ ID NO: 670969 - DNA, 25 bp, Mus musculus
gtagcccagatttatttcaattcaa

SEQ ID NO: 670970 - DNA, 25 bp, Mus musculus
gtagcccagcacaatgagagctcag

SEQ ID NO: 670971 - DNA, 25 bp, Mus musculus
gtagcccagcactatgagagctcag

SEQ ID NO: 670972 - DNA, 25 bp, Mus musculus
gtagcccagcagagacaggagtaca

SEQ ID NO: 670973 - DNA, 25 bp, Mus musculus
gtagcccagcagtgacaggagtaca

SEQ ID NO: 670974 - DNA, 25 bp, Mus musculus
gtagcccaggaacatcttgaacctg

SEQ ID NO: 670975 - DNA, 25 bp, Mus musculus
gtagcccaggaagatcttgaacctg

SEQ ID NO: 670976 - DNA, 25 bp, Mus musculus
gtagcccataggacagagcacataa

SEQ ID NO: 670977 - DNA, 25 bp, Mus musculus
gtagcccataggatttgtaggacta

SEQ ID NO: 670978 - DNA, 25 bp, Mus musculus
gtagcccataggtcagagcacataa

SEQ ID NO: 670979 - DNA, 25 bp, Mus musculus
gtagcccataggttttgtaggacta

SEQ ID NO: 670980 - DNA, 25 bp, Mus musculus
gtagcccatatccttccgtggaatg

SEQ ID NO: 670981 - DNA, 25 bp, Mus musculus
gtagcccatatcgttccgtggaatg

SEQ ID NO: 670982 - DNA, 25 bp, Mus musculus
gtagcccatttcatagggcaccgtg

SEQ ID NO: 670983 - DNA, 25 bp, Mus musculus
gtagcccatttcttagggcaccgtg

SEQ ID NO: 670984 - DNA, 25 bp, Mus musculus
gtagccccaattctctagcaagcct

SEQ ID NO: 670985 - DNA, 25 bp, Mus musculus
gtagccccaattgtctagcaagcct

SEQ ID NO: 670986 - DNA, 25 bp, Mus musculus
gtagcccctaagaattactcagaga

SEQ ID NO: 670987 - DNA, 25 bp, Mus musculus
gtagcccctaagtattactcagaga

SEQ ID NO: 670988 - DNA, 25 bp, Mus musculus
gtagccccttatcaaaacatatcct

SEQ ID NO: 670989 - DNA, 25 bp, Mus musculus
gtagccccttatgaaaacatatcct

SEQ ID NO: 670990 - DNA, 25 bp, Mus musculus
gtagcccctttcatgaaaatttgat

SEQ ID NO: 670991 - DNA, 25 bp, Mus musculus
gtagcccctttcttgaaaatttgat

SEQ ID NO: 670992 - DNA, 25 bp, Mus musculus
gtagcccgaattataagtactatag

SEQ ID NO: 670993 - DNA, 25 bp, Mus musculus
gtagcccgaattttaagtactatag

SEQ ID NO: 670994 - DNA, 25 bp, Mus musculus
gtagcccgactacgtcatttcagat

SEQ ID NO: 670995 - DNA, 25 bp, Mus musculus
gtagcccgactaggtcatttcagat

SEQ ID NO: 670996 - DNA, 25 bp, Mus musculus
gtagcccgaggcaaattctagctga

SEQ ID NO: 670997 - DNA, 25 bp, Mus musculus
gtagcccgaggctaattctagctga

SEQ ID NO: 670998 - DNA, 25 bp, Mus musculus
gtagcccggcaaagtctgagggcca

SEQ ID NO: 670999 - DNA, 25 bp, Mus musculus
gtagcccggcaatgtctgagggcca

SEQ ID NO: 671000 - DNA, 25 bp, Mus musculus
gtagcccggcagatgataagtgaaa

SEQ ID NO: 671001 - DNA, 25 bp, Mus musculus
gtagcccggcagttgataagtgaaa

SEQ ID NO: 671002 - DNA, 25 bp, Mus musculus
gtagcccggctaatcatggaagtac

SEQ ID NO: 671003 - DNA, 25 bp, Mus musculus
gtagcccggctattcatggaagtac

SEQ ID NO: 671004 - DNA, 25 bp, Mus musculus
gtagcccggtaaaatgtacacattt

SEQ ID NO: 671005 - DNA, 25 bp, Mus musculus
gtagcccggtaatatgtacacattt

SEQ ID NO: 671006 - DNA, 25 bp, Mus musculus
gtagccctaattatggagacacaga

SEQ ID NO: 671007 - DNA, 25 bp, Mus musculus
gtagccctaattttggagacacaga

SEQ ID NO: 671008 - DNA, 25 bp, Mus musculus
gtagccctactccttaaggatgctg

SEQ ID NO: 671009 - DNA, 25 bp, Mus musculus
gtagccctactcgttaaggatgctg

SEQ ID NO: 671010 - DNA, 25 bp, Mus musculus
gtagccctagcacagagtttaggca

SEQ ID NO: 671011 - DNA, 25 bp, Mus musculus
gtagccctagcagagagtttaggca

SEQ ID NO: 671012 - DNA, 25 bp, Mus musculus
gtagccctagctccctgggatctga

SEQ ID NO: 671013 - DNA, 25 bp, Mus musculus
gtagccctagctgcctgggatctga

SEQ ID NO: 671014 - DNA, 25 bp, Mus musculus
gtagccctatcactgagggatcgct

SEQ ID NO: 671015 - DNA, 25 bp, Mus musculus
gtagccctatcagtgagggatcgct

SEQ ID NO: 671016 - DNA, 25 bp, Mus musculus
gtagccctatgtacgtgtgacactg

SEQ ID NO: 671017 - DNA, 25 bp, Mus musculus
gtagccctatgttcgtgtgacactg

SEQ ID NO: 671018 - DNA, 25 bp, Mus musculus
gtagccctcatgatagactgttaat

SEQ ID NO: 671019 - DNA, 25 bp, Mus musculus
gtagccctcatgttagactgttaat

SEQ ID NO: 671020 - DNA, 25 bp, Mus musculus
gtagccctcattctaaagtgcttct

SEQ ID NO: 671021 - DNA, 25 bp, Mus musculus
gtagccctcattgtaaagtgcttct

SEQ ID NO: 671022 - DNA, 25 bp, Mus musculus
gtagccctcgaaaagtgtccagact

SEQ ID NO: 671023 - DNA, 25 bp, Mus musculus
gtagccctcgaatagtgtccagact

SEQ ID NO: 671024 - DNA, 25 bp, Mus musculus
gtagccctctagcacctgaaggaac

SEQ ID NO: 671025 - DNA, 25 bp, Mus musculus
gtagccctctaggacctgaaggaac

SEQ ID NO: 671026 - DNA, 25 bp, Mus musculus
gtagccctctctacttaggaatcaa

SEQ ID NO: 671027 - DNA, 25 bp, Mus musculus
gtagccctctcttcttaggaatcaa

SEQ ID NO: 671028 - DNA, 25 bp, Mus musculus
gtagccctgacccacacagatggag

SEQ ID NO: 671029 - DNA, 25 bp, Mus musculus
gtagccctgaccgacacagatggag

SEQ ID NO: 671030 - DNA, 25 bp, Mus musculus
gtagccctggttagcattgctttgt

SEQ ID NO: 671031 - DNA, 25 bp, Mus musculus
gtagccctggtttgcattgctttgt

SEQ ID NO: 671032 - DNA, 25 bp, Mus musculus
gtagccctgtgaaaatcccaagctt

SEQ ID NO: 671033 - DNA, 25 bp, Mus musculus
gtagccctgtgataatcccaagctt

SEQ ID NO: 671034 - DNA, 25 bp, Mus musculus
gtagccctgtttctcttggagctcc

SEQ ID NO: 671035 - DNA, 25 bp, Mus musculus
gtagccctgtttgtcttggagctcc

SEQ ID NO: 671036 - DNA, 25 bp, Mus musculus
gtagcccttcagcatttactgtgtg

SEQ ID NO: 671037 - DNA, 25 bp, Mus musculus
gtagcccttcaggatttactgtgtg

SEQ ID NO: 671038 - DNA, 25 bp, Mus musculus
gtagcccttcctcttagattacagt

SEQ ID NO: 671039 - DNA, 25 bp, Mus musculus
gtagcccttcctgttagattacagt

SEQ ID NO: 671040 - DNA, 25 bp, Mus musculus
gtagcccttgaccatataacagtag

SEQ ID NO: 671041 - DNA, 25 bp, Mus musculus
gtagcccttgacgatataacagtag

SEQ ID NO: 671042 - DNA, 25 bp, Mus musculus
gtagcccttgagaaccttgaaattg

SEQ ID NO: 671043 - DNA, 25 bp, Mus musculus
gtagcccttgagtaccttgaaattg

SEQ ID NO: 671044 - DNA, 25 bp, Mus musculus
gtagcccttgtcatcaagcagtgtc

SEQ ID NO: 671045 - DNA, 25 bp, Mus musculus
gtagcccttgtcttcaagcagtgtc

SEQ ID NO: 671046 - DNA, 25 bp, Mus musculus
gtagcccttttgcagcattcacatc

SEQ ID NO: 671047 - DNA, 25 bp, Mus musculus
gtagcccttttgcattagcacttca

SEQ ID NO: 671048 - DNA, 25 bp, Mus musculus
gtagcccttttggagcattcacatc

SEQ ID NO: 671049 - DNA, 25 bp, Mus musculus
gtagcccttttggattagcacttca

SEQ ID NO: 671050 - DNA, 25 bp, Mus musculus
gtagccgaagccattccgacaatga

SEQ ID NO: 671051 - DNA, 25 bp, Mus musculus
gtagccgaagcctttccgacaatga

SEQ ID NO: 671052 - DNA, 25 bp, Mus musculus
gtagccgaagttattgtatcaactg

SEQ ID NO: 671053 - DNA, 25 bp, Mus musculus
gtagccgaagtttttgtatcaactg

SEQ ID NO: 671054 - DNA, 25 bp, Mus musculus
gtagccgacgcccaagaggacaaga

SEQ ID NO: 671055 - DNA, 25 bp, Mus musculus
gtagccgacgccgaagaggacaaga

SEQ ID NO: 671056 - DNA, 25 bp, Mus musculus
gtagccgagagtctcattctctcca

SEQ ID NO: 671057 - DNA, 25 bp, Mus musculus
gtagccgagagtgtcattctctcca

SEQ ID NO: 671058 - DNA, 25 bp, Mus musculus
gtagccgaggaaatatctcacccct

SEQ ID NO: 671059 - DNA, 25 bp, Mus musculus
gtagccgaggaattatctcacccct

SEQ ID NO: 671060 - DNA, 25 bp, Mus musculus
gtagccgaggccaataaagactggt

SEQ ID NO: 671061 - DNA, 25 bp, Mus musculus
gtagccgaggcctataaagactggt

SEQ ID NO: 671062 - DNA, 25 bp, Mus musculus
gtagccgatccccttcacgaaggag

SEQ ID NO: 671063 - DNA, 25 bp, Mus musculus
gtagccgatcccgttcacgaaggag

SEQ ID NO: 671064 - DNA, 25 bp, Mus musculus
gtagccgcagtaactggtcgttcat

SEQ ID NO: 671065 - DNA, 25 bp, Mus musculus
gtagccgcagtatctggtcgttcat

SEQ ID NO: 671066 - DNA, 25 bp, Mus musculus
gtagccgcattcagactggaagaca

SEQ ID NO: 671067 - DNA, 25 bp, Mus musculus
gtagccgcattctgactggaagaca

SEQ ID NO: 671068 - DNA, 25 bp, Mus musculus
gtagccgcttggaaactagtctagt

SEQ ID NO: 671069 - DNA, 25 bp, Mus musculus
gtagccgcttggtaactagtctagt

SEQ ID NO: 671070 - DNA, 25 bp, Mus musculus
gtagccggaccaatccttatgatat

SEQ ID NO: 671071 - DNA, 25 bp, Mus musculus
gtagccggaccattccttatgatat

SEQ ID NO: 671072 - DNA, 25 bp, Mus musculus
gtagccggagtcatcctttgctttt

SEQ ID NO: 671073 - DNA, 25 bp, Mus musculus
gtagccggagtcttcctttgctttt

SEQ ID NO: 671074 - DNA, 25 bp, Mus musculus
gtagccgggaagatggtccactcca

SEQ ID NO: 671075 - DNA, 25 bp, Mus musculus
gtagccgggaagttggtccactcca

SEQ ID NO: 671076 - DNA, 25 bp, Mus musculus
gtagccggtatcctggctcaaggat

SEQ ID NO: 671077 - DNA, 25 bp, Mus musculus
gtagccggtatcgtggctcaaggat

SEQ ID NO: 671078 - DNA, 25 bp, Mus musculus
gtagccgtagacatagtccatctgt

SEQ ID NO: 671079 - DNA, 25 bp, Mus musculus
gtagccgtagacttagtccatctgt

SEQ ID NO: 671080 - DNA, 25 bp, Mus musculus
gtagccgtagcgagcttttaaaatt

SEQ ID NO: 671081 - DNA, 25 bp, Mus musculus
gtagccgtagcgtgcttttaaaatt

SEQ ID NO: 671082 - DNA, 25 bp, Mus musculus
gtagccgtatccctgagctgtggaa

SEQ ID NO: 671083 - DNA, 25 bp, Mus musculus
gtagccgtatccgtgagctgtggaa

SEQ ID NO: 671084 - DNA, 25 bp, Mus musculus
gtagccgtcactctaaaccagggag

SEQ ID NO: 671085 - DNA, 25 bp, Mus musculus
gtagccgtcactgtaaaccagggag

SEQ ID NO: 671086 - DNA, 25 bp, Mus musculus
gtagccgtcattaaagccacagaac

SEQ ID NO: 671087 - DNA, 25 bp, Mus musculus
gtagccgtcattcttgagcacccag

SEQ ID NO: 671088 - DNA, 25 bp, Mus musculus
gtagccgtcattgttgagcacccag

SEQ ID NO: 671089 - DNA, 25 bp, Mus musculus
gtagccgtcatttaagccacagaac

SEQ ID NO: 671090 - DNA, 25 bp, Mus musculus
gtagccgtggtactttgtatctgta

SEQ ID NO: 671091 - DNA, 25 bp, Mus musculus
gtagccgtggtagtttgtatctgta

SEQ ID NO: 671092 - DNA, 25 bp, Mus musculus
gtagcctaaatcctcaatactgttg

SEQ ID NO: 671093 - DNA, 25 bp, Mus musculus
gtagcctaaatcgtcaatactgttg

SEQ ID NO: 671094 - DNA, 25 bp, Mus musculus
gtagcctaaggcatccttggtgtgt

SEQ ID NO: 671095 - DNA, 25 bp, Mus musculus
gtagcctaaggcttccttggtgtgt

SEQ ID NO: 671096 - DNA, 25 bp, Mus musculus
gtagcctaagtgcatcttgaaccca

SEQ ID NO: 671097 - DNA, 25 bp, Mus musculus
gtagcctaagtggatcttgaaccca

SEQ ID NO: 671098 - DNA, 25 bp, Mus musculus
gtagcctaatacagatctctgatat

SEQ ID NO: 671099 - DNA, 25 bp, Mus musculus
gtagcctaatactgatctctgatat

SEQ ID NO: 671100 - DNA, 25 bp, Mus musculus
gtagcctacagacctggtctcagtg

SEQ ID NO: 671101 - DNA, 25 bp, Mus musculus
gtagcctacagagctggtctcagtg

SEQ ID NO: 671102 - DNA, 25 bp, Mus musculus
gtagcctacagtcctgtgactacat

SEQ ID NO: 671103 - DNA, 25 bp, Mus musculus
gtagcctacagtgctgtgactacat

SEQ ID NO: 671104 - DNA, 25 bp, Mus musculus
gtagcctaccaacattcagagggtg

SEQ ID NO: 671105 - DNA, 25 bp, Mus musculus
gtagcctaccaagattcagagggtg

SEQ ID NO: 671106 - DNA, 25 bp, Mus musculus
gtagcctacgttacaatcagatgtg

SEQ ID NO: 671107 - DNA, 25 bp, Mus musculus
gtagcctacgtttcaatcagatgtg

SEQ ID NO: 671108 - DNA, 25 bp, Mus musculus
gtagcctagcaaactctttatgtct

SEQ ID NO: 671109 - DNA, 25 bp, Mus musculus
gtagcctagcaacagtcagattcct

SEQ ID NO: 671110 - DNA, 25 bp, Mus musculus
gtagcctagcaagagtcagattcct

SEQ ID NO: 671111 - DNA, 25 bp, Mus musculus
gtagcctagcaatctctttatgtct

SEQ ID NO: 671112 - DNA, 25 bp, Mus musculus
gtagcctaggatatttagtgagttc

SEQ ID NO: 671113 - DNA, 25 bp, Mus musculus
gtagcctaggatttttagtgagttc

SEQ ID NO: 671114 - DNA, 25 bp, Mus musculus
gtagcctagggtaatctcaaaactt

SEQ ID NO: 671115 - DNA, 25 bp, Mus musculus
gtagcctagggttatctcaaaactt

SEQ ID NO: 671116 - DNA, 25 bp, Mus musculus
gtagcctagtaaccgttgtctgttg

SEQ ID NO: 671117 - DNA, 25 bp, Mus musculus
gtagcctagtaagcgttgtctgttg

SEQ ID NO: 671118 - DNA, 25 bp, Mus musculus
gtagcctagtacaatcatggtatta

SEQ ID NO: 671119 - DNA, 25 bp, Mus musculus
gtagcctagtactatcatggtatta

SEQ ID NO: 671120 - DNA, 25 bp, Mus musculus
gtagcctagtccaaggtcttaagtg

SEQ ID NO: 671121 - DNA, 25 bp, Mus musculus
gtagcctagtcctaggtcttaagtg

SEQ ID NO: 671122 - DNA, 25 bp, Mus musculus
gtagcctcaaccagtgcttttgtgc

SEQ ID NO: 671123 - DNA, 25 bp, Mus musculus
gtagcctcaacccactaagtgcaag

SEQ ID NO: 671124 - DNA, 25 bp, Mus musculus
gtagcctcaaccgactaagtgcaag

SEQ ID NO: 671125 - DNA, 25 bp, Mus musculus
gtagcctcaacctgtgcttttgtgc

SEQ ID NO: 671126 - DNA, 25 bp, Mus musculus
gtagcctcaagcctgaaatcctttt

SEQ ID NO: 671127 - DNA, 25 bp, Mus musculus
gtagcctcaagcgtgaaatcctttt

SEQ ID NO: 671128 - DNA, 25 bp, Mus musculus
gtagcctcaccactattttttagca

SEQ ID NO: 671129 - DNA, 25 bp, Mus musculus
gtagcctcaccagtattttttagca

SEQ ID NO: 671130 - DNA, 25 bp, Mus musculus
gtagcctcaggccagataacccagg

SEQ ID NO: 671131 - DNA, 25 bp, Mus musculus
gtagcctcaggcgagataacccagg

SEQ ID NO: 671132 - DNA, 25 bp, Mus musculus
gtagcctcagtaccaacaccttggg

SEQ ID NO: 671133 - DNA, 25 bp, Mus musculus
gtagcctcagtagcaacaccttggg

SEQ ID NO: 671134 - DNA, 25 bp, Mus musculus
gtagcctcatatccaaattttcaag

SEQ ID NO: 671135 - DNA, 25 bp, Mus musculus
gtagcctcatatgcaaattttcaag

SEQ ID NO: 671136 - DNA, 25 bp, Mus musculus
gtagcctccaaacctggtttcctgg

SEQ ID NO: 671137 - DNA, 25 bp, Mus musculus
gtagcctccaaagctggtttcctgg

SEQ ID NO: 671138 - DNA, 25 bp, Mus musculus
gtagcctccagtctcagtgggttca

SEQ ID NO: 671139 - DNA, 25 bp, Mus musculus
gtagcctccagtgtcagtgggttca

SEQ ID NO: 671140 - DNA, 25 bp, Mus musculus
gtagcctcccgtagaaggtgccaaa

SEQ ID NO: 671141 - DNA, 25 bp, Mus musculus
gtagcctcccgttgaaggtgccaaa

SEQ ID NO: 671142 - DNA, 25 bp, Mus musculus
gtagcctcctatcatgacccaggga

SEQ ID NO: 671143 - DNA, 25 bp, Mus musculus
gtagcctcctatgatgacccaggga

SEQ ID NO: 671144 - DNA, 25 bp, Mus musculus
gtagcctccttcagttagggtagaa

SEQ ID NO: 671145 - DNA, 25 bp, Mus musculus
gtagcctccttctgttagggtagaa

SEQ ID NO: 671146 - DNA, 25 bp, Mus musculus
gtagcctcgatacctagtgaatctt

SEQ ID NO: 671147 - DNA, 25 bp, Mus musculus
gtagcctcgatagctagtgaatctt

SEQ ID NO: 671148 - DNA, 25 bp, Mus musculus
gtagcctcgccacgcactgtctaga

SEQ ID NO: 671149 - DNA, 25 bp, Mus musculus
gtagcctcgccaggcactgtctaga

SEQ ID NO: 671150 - DNA, 25 bp, Mus musculus
gtagcctcggtgagtgagcacattt

SEQ ID NO: 671151 - DNA, 25 bp, Mus musculus
gtagcctcggtgtgtgagcacattt

SEQ ID NO: 671152 - DNA, 25 bp, Mus musculus
gtagcctcgtgtatgagcctgatga

SEQ ID NO: 671153 - DNA, 25 bp, Mus musculus
gtagcctcgtgtttgagcctgatga

SEQ ID NO: 671154 - DNA, 25 bp, Mus musculus
gtagcctctgtgagtgcgtaataaa

SEQ ID NO: 671155 - DNA, 25 bp, Mus musculus
gtagcctctgtgtgtgcgtaataaa

SEQ ID NO: 671156 - DNA, 25 bp, Mus musculus
gtagcctcttcgagtgttgtttctg

SEQ ID NO: 671157 - DNA, 25 bp, Mus musculus
gtagcctcttcgtgtgttgtttctg

SEQ ID NO: 671158 - DNA, 25 bp, Mus musculus
gtagcctcttgccacgatactataa

SEQ ID NO: 671159 - DNA, 25 bp, Mus musculus
gtagcctcttgcgacgatactataa

SEQ ID NO: 671160 - DNA, 25 bp, Mus musculus
gtagcctgaactcgagactgaagaa

SEQ ID NO: 671161 - DNA, 25 bp, Mus musculus
gtagcctgaactggagactgaagaa

SEQ ID NO: 671162 - DNA, 25 bp, Mus musculus
gtagcctgaatcatgcaattcctcg

SEQ ID NO: 671163 - DNA, 25 bp, Mus musculus
gtagcctgaatcttgcaattcctcg

SEQ ID NO: 671164 - DNA, 25 bp, Mus musculus
gtagcctgactaaaatacacagtta

SEQ ID NO: 671165 - DNA, 25 bp, Mus musculus
gtagcctgactaaagcaagcactgg

SEQ ID NO: 671166 - DNA, 25 bp, Mus musculus
gtagcctgactataatacacagtta

SEQ ID NO: 671167 - DNA, 25 bp, Mus musculus
gtagcctgactatagcaagcactgg

SEQ ID NO: 671168 - DNA, 25 bp, Mus musculus
gtagcctgactgctcttgaacccct

SEQ ID NO: 671169 - DNA, 25 bp, Mus musculus
gtagcctgactggtcttgaacccct

SEQ ID NO: 671170 - DNA, 25 bp, Mus musculus
gtagcctgagatcatttagacttat

SEQ ID NO: 671171 - DNA, 25 bp, Mus musculus
gtagcctgagatgatttagacttat

SEQ ID NO: 671172 - DNA, 25 bp, Mus musculus
gtagcctgaggacgccacgagcacc

SEQ ID NO: 671173 - DNA, 25 bp, Mus musculus
gtagcctgaggaggccacgagcacc

SEQ ID NO: 671174 - DNA, 25 bp, Mus musculus
gtagcctgatcgaacaacatcaatg

SEQ ID NO: 671175 - DNA, 25 bp, Mus musculus
gtagcctgatcgtacaacatcaatg

SEQ ID NO: 671176 - DNA, 25 bp, Mus musculus
gtagcctgatgtcagtaaatccttc

SEQ ID NO: 671177 - DNA, 25 bp, Mus musculus
gtagcctgatgtgagtaaatccttc

SEQ ID NO: 671178 - DNA, 25 bp, Mus musculus
gtagcctgattaagcaacccatcga

SEQ ID NO: 671179 - DNA, 25 bp, Mus musculus
gtagcctgattatgcaacccatcga

SEQ ID NO: 671180 - DNA, 25 bp, Mus musculus
gtagcctgcactccagaagacatca

SEQ ID NO: 671181 - DNA, 25 bp, Mus musculus
gtagcctgcactgcagaagacatca

SEQ ID NO: 671182 - DNA, 25 bp, Mus musculus
gtagcctgctataatcttctaccac

SEQ ID NO: 671183 - DNA, 25 bp, Mus musculus
gtagcctgctattatcttctaccac

SEQ ID NO: 671184 - DNA, 25 bp, Mus musculus
gtagcctgctcgcacatcagagatg

SEQ ID NO: 671185 - DNA, 25 bp, Mus musculus
gtagcctgctcggacatcagagatg

SEQ ID NO: 671186 - DNA, 25 bp, Mus musculus
gtagcctgctgtagtatagatgtca

SEQ ID NO: 671187 - DNA, 25 bp, Mus musculus
gtagcctgctgttgtatagatgtca

SEQ ID NO: 671188 - DNA, 25 bp, Mus musculus
gtagcctggcacatagaaagggtcc

SEQ ID NO: 671189 - DNA, 25 bp, Mus musculus
gtagcctggcacttagaaagggtcc

SEQ ID NO: 671190 - DNA, 25 bp, Mus musculus
gtagcctggcatcaggttacgattt

SEQ ID NO: 671191 - DNA, 25 bp, Mus musculus
gtagcctggcatcctgttcatgaag

SEQ ID NO: 671192 - DNA, 25 bp, Mus musculus
gtagcctggcatgaggttacgattt

SEQ ID NO: 671193 - DNA, 25 bp, Mus musculus
gtagcctggcatgctgttcatgaag

SEQ ID NO: 671194 - DNA, 25 bp, Mus musculus
gtagcctggctgaccacgaatatac

SEQ ID NO: 671195 - DNA, 25 bp, Mus musculus
gtagcctggctgtccacgaatatac

SEQ ID NO: 671196 - DNA, 25 bp, Mus musculus
gtagcctggcttacactgattatca

SEQ ID NO: 671197 - DNA, 25 bp, Mus musculus
gtagcctggcttagagctcataaag

SEQ ID NO: 671198 - DNA, 25 bp, Mus musculus
gtagcctggctttcactgattatca

SEQ ID NO: 671199 - DNA, 25 bp, Mus musculus
gtagcctggctttgagctcataaag

SEQ ID NO: 671200 - DNA, 25 bp, Mus musculus
gtagcctgtacacagcattgccaag

SEQ ID NO: 671201 - DNA, 25 bp, Mus musculus
gtagcctgtacagagcattgccaag

SEQ ID NO: 671202 - DNA, 25 bp, Mus musculus
gtagcctgtaggactgctttcacca

SEQ ID NO: 671203 - DNA, 25 bp, Mus musculus
gtagcctgtaggtctgctttcacca

SEQ ID NO: 671204 - DNA, 25 bp, Mus musculus
gtagcctgtgagatcacaaagcttc

SEQ ID NO: 671205 - DNA, 25 bp, Mus musculus
gtagcctgtgagttcacaaagcttc

SEQ ID NO: 671206 - DNA, 25 bp, Mus musculus
gtagcctgtgttagggccctgcccc

SEQ ID NO: 671207 - DNA, 25 bp, Mus musculus
gtagcctgtgtttgggccctgcccc

SEQ ID NO: 671208 - DNA, 25 bp, Mus musculus
gtagcctgttacctattcagagagt

SEQ ID NO: 671209 - DNA, 25 bp, Mus musculus
gtagcctgttacgtattcagagagt

SEQ ID NO: 671210 - DNA, 25 bp, Mus musculus
gtagcctgttcgctgtcccctttgg

SEQ ID NO: 671211 - DNA, 25 bp, Mus musculus
gtagcctgttcggtgtcccctttgg

SEQ ID NO: 671212 - DNA, 25 bp, Mus musculus
gtagccttaaggctgccagcatagc

SEQ ID NO: 671213 - DNA, 25 bp, Mus musculus
gtagccttaagggtgccagcatagc

SEQ ID NO: 671214 - DNA, 25 bp, Mus musculus
gtagccttcaatcacgatttgcctg

SEQ ID NO: 671215 - DNA, 25 bp, Mus musculus
gtagccttcaatgacgatttgcctg

SEQ ID NO: 671216 - DNA, 25 bp, Mus musculus
gtagccttcacaaggaaacagccca

SEQ ID NO: 671217 - DNA, 25 bp, Mus musculus
gtagccttcacatggaaacagccca

SEQ ID NO: 671218 - DNA, 25 bp, Mus musculus
gtagccttcagcagattggatgtaa

SEQ ID NO: 671219 - DNA, 25 bp, Mus musculus
gtagccttcagctgattggatgtaa

SEQ ID NO: 671220 - DNA, 25 bp, Mus musculus
gtagccttcctactgatcatttcag

SEQ ID NO: 671221 - DNA, 25 bp, Mus musculus
gtagccttcctagtgatcatttcag

SEQ ID NO: 671222 - DNA, 25 bp, Mus musculus
gtagccttcctcaattcaaaggata

SEQ ID NO: 671223 - DNA, 25 bp, Mus musculus
gtagccttcctctattcaaaggata

SEQ ID NO: 671224 - DNA, 25 bp, Mus musculus
gtagccttcctgcagagttcattat

SEQ ID NO: 671225 - DNA, 25 bp, Mus musculus
gtagccttcctggagagttcattat

SEQ ID NO: 671226 - DNA, 25 bp, Mus musculus
gtagccttctgcctgatagtgtcca

SEQ ID NO: 671227 - DNA, 25 bp, Mus musculus
gtagccttctgcgtgatagtgtcca

SEQ ID NO: 671228 - DNA, 25 bp, Mus musculus
gtagccttgacaaccatcctgtaat

SEQ ID NO: 671229 - DNA, 25 bp, Mus musculus
gtagccttgacatccatcctgtaat

SEQ ID NO: 671230 - DNA, 25 bp, Mus musculus
gtagccttggcacaatggcctcacg

SEQ ID NO: 671231 - DNA, 25 bp, Mus musculus
gtagccttggcagaatggcctcacg

SEQ ID NO: 671232 - DNA, 25 bp, Mus musculus
gtagccttgtatactacattcattt

SEQ ID NO: 671233 - DNA, 25 bp, Mus musculus
gtagccttgtattctacattcattt

SEQ ID NO: 671234 - DNA, 25 bp, Mus musculus
gtagccttgtcacagttgtatttta

SEQ ID NO: 671235 - DNA, 25 bp, Mus musculus
gtagccttgtcagagttgtatttta

SEQ ID NO: 671236 - DNA, 25 bp, Mus musculus
gtagccttgtggcttcgtgtccaac

SEQ ID NO: 671237 - DNA, 25 bp, Mus musculus
gtagccttgtgggttcgtgtccaac

SEQ ID NO: 671238 - DNA, 25 bp, Mus musculus
gtagcctttacaatttatcatcgtc

SEQ ID NO: 671239 - DNA, 25 bp, Mus musculus
gtagcctttacattttatcatcgtc

SEQ ID NO: 671240 - DNA, 25 bp, Mus musculus
gtagcctttactcggaaagctcatg

SEQ ID NO: 671241 - DNA, 25 bp, Mus musculus
gtagcctttactgggaaagctcatg

SEQ ID NO: 671242 - DNA, 25 bp, Mus musculus
gtagcctttggcagtagtcccagtt

SEQ ID NO: 671243 - DNA, 25 bp, Mus musculus
gtagcctttggctgtagtcccagtt

SEQ ID NO: 671244 - DNA, 25 bp, Mus musculus
gtagcctttgtgaaacaccagactg

SEQ ID NO: 671245 - DNA, 25 bp, Mus musculus
gtagcctttgtgctccctgatcaaa

SEQ ID NO: 671246 - DNA, 25 bp, Mus musculus
gtagcctttgtggtccctgatcaaa

SEQ ID NO: 671247 - DNA, 25 bp, Mus musculus
gtagcctttgtgtaacaccagactg

SEQ ID NO: 671248 - DNA, 25 bp, Mus musculus
gtagccttttccaatccacttccct

SEQ ID NO: 671249 - DNA, 25 bp, Mus musculus
gtagccttttcctatccacttccct

SEQ ID NO: 671250 - DNA, 25 bp, Mus musculus
gtagccttttctcagcactagcaaa

SEQ ID NO: 671251 - DNA, 25 bp, Mus musculus
gtagccttttctgagcactagcaaa

SEQ ID NO: 671252 - DNA, 25 bp, Mus musculus
gtagcgaagacacgttttctccacc

SEQ ID NO: 671253 - DNA, 25 bp, Mus musculus
gtagcgaagacaggttttctccacc

SEQ ID NO: 671254 - DNA, 25 bp, Mus musculus
gtagcgaatgaaaccgtcaacatct

SEQ ID NO: 671255 - DNA, 25 bp, Mus musculus
gtagcgaatgaatccgtcaacatct

SEQ ID NO: 671256 - DNA, 25 bp, Mus musculus
gtagcgaccacaagcactgagttga

SEQ ID NO: 671257 - DNA, 25 bp, Mus musculus
gtagcgaccacatgcactgagttga

SEQ ID NO: 671258 - DNA, 25 bp, Mus musculus
gtagcgactatgatagttgctctat

SEQ ID NO: 671259 - DNA, 25 bp, Mus musculus
gtagcgactatgttagttgctctat

SEQ ID NO: 671260 - DNA, 25 bp, Mus musculus
gtagcgagatacagtctaagggaaa

SEQ ID NO: 671261 - DNA, 25 bp, Mus musculus
gtagcgagatactgtctaagggaaa

SEQ ID NO: 671262 - DNA, 25 bp, Mus musculus
gtagcgagcagtccagattctcact

SEQ ID NO: 671263 - DNA, 25 bp, Mus musculus
gtagcgagcagtgcagattctcact

SEQ ID NO: 671264 - DNA, 25 bp, Mus musculus
gtagcgagtttcactttgcaagact

SEQ ID NO: 671265 - DNA, 25 bp, Mus musculus
gtagcgagtttctctttgcaagact

SEQ ID NO: 671266 - DNA, 25 bp, Mus musculus
gtagcgatatacctcattcccgttt

SEQ ID NO: 671267 - DNA, 25 bp, Mus musculus
gtagcgatatacgtcattcccgttt

SEQ ID NO: 671268 - DNA, 25 bp, Mus musculus
gtagcgatattgacagccttctaaa

SEQ ID NO: 671269 - DNA, 25 bp, Mus musculus
gtagcgatattgtcagccttctaaa

SEQ ID NO: 671270 - DNA, 25 bp, Mus musculus
gtagcgattgctatttagtctattt

SEQ ID NO: 671271 - DNA, 25 bp, Mus musculus
gtagcgattgctttttagtctattt

SEQ ID NO: 671272 - DNA, 25 bp, Mus musculus
gtagcgcaaggtcgagtttctccct

SEQ ID NO: 671273 - DNA, 25 bp, Mus musculus
gtagcgcaaggtggagtttctccct

SEQ ID NO: 671274 - DNA, 25 bp, Mus musculus
gtagcgcagacccattcctttccaa

SEQ ID NO: 671275 - DNA, 25 bp, Mus musculus
gtagcgcagaccgattcctttccaa

SEQ ID NO: 671276 - DNA, 25 bp, Mus musculus
gtagcgcattaccaatgaatactta

SEQ ID NO: 671277 - DNA, 25 bp, Mus musculus
gtagcgcattacgaatgaatactta

SEQ ID NO: 671278 - DNA, 25 bp, Mus musculus
gtagcgccaccaactgctacagaaa

SEQ ID NO: 671279 - DNA, 25 bp, Mus musculus
gtagcgccaccatctgctacagaaa

SEQ ID NO: 671280 - DNA, 25 bp, Mus musculus
gtagcgcccggcaaacaaagcatga

SEQ ID NO: 671281 - DNA, 25 bp, Mus musculus
gtagcgcccggctaacaaagcatga

SEQ ID NO: 671282 - DNA, 25 bp, Mus musculus
gtagcgcctgcactttgggtactag

SEQ ID NO: 671283 - DNA, 25 bp, Mus musculus
gtagcgcctgcagtttgggtactag

SEQ ID NO: 671284 - DNA, 25 bp, Mus musculus
gtagcgcggagtagtctagatagaa

SEQ ID NO: 671285 - DNA, 25 bp, Mus musculus
gtagcgcggagttgtctagatagaa

SEQ ID NO: 671286 - DNA, 25 bp, Mus musculus
gtagcgctgactcacaattgggact

SEQ ID NO: 671287 - DNA, 25 bp, Mus musculus
gtagcgctgactgacaattgggact

SEQ ID NO: 671288 - DNA, 25 bp, Mus musculus
gtagcgcttgtcattaagcaccttt

SEQ ID NO: 671289 - DNA, 25 bp, Mus musculus
gtagcgcttgtctttaagcaccttt

SEQ ID NO: 671290 - DNA, 25 bp, Mus musculus
gtagcggagctcaagactgtctgag

SEQ ID NO: 671291 - DNA, 25 bp, Mus musculus
gtagcggagctctagactgtctgag

SEQ ID NO: 671292 - DNA, 25 bp, Mus musculus
gtagcggattggacaaacgtatgta

SEQ ID NO: 671293 - DNA, 25 bp, Mus musculus
gtagcggattggtcaaacgtatgta

SEQ ID NO: 671294 - DNA, 25 bp, Mus musculus
gtagcggcattaactgggctctgat

SEQ ID NO: 671295 - DNA, 25 bp, Mus musculus
gtagcggcattatctgggctctgat

SEQ ID NO: 671296 - DNA, 25 bp, Mus musculus
gtagcggcccttcgtgcctgtctga

SEQ ID NO: 671297 - DNA, 25 bp, Mus musculus
gtagcggcccttggtgcctgtctga

SEQ ID NO: 671298 - DNA, 25 bp, Mus musculus
gtagcggccttgctaaagtgtatcc

SEQ ID NO: 671299 - DNA, 25 bp, Mus musculus
gtagcggccttggtaaagtgtatcc

SEQ ID NO: 671300 - DNA, 25 bp, Mus musculus
gtagcggggaatccctcctgactgt

SEQ ID NO: 671301 - DNA, 25 bp, Mus musculus
gtagcggggaatgcctcctgactgt

SEQ ID NO: 671302 - DNA, 25 bp, Mus musculus
gtagcgggtatacaatttgtacagt

SEQ ID NO: 671303 - DNA, 25 bp, Mus musculus
gtagcgggtatagaatttgtacagt

SEQ ID NO: 671304 - DNA, 25 bp, Mus musculus
gtagcggtcactctttgtttgattt

SEQ ID NO: 671305 - DNA, 25 bp, Mus musculus
gtagcggtcactgtttgtttgattt

SEQ ID NO: 671306 - DNA, 25 bp, Mus musculus
gtagcggtccacatggtataccaaa

SEQ ID NO: 671307 - DNA, 25 bp, Mus musculus
gtagcggtccacttggtataccaaa

SEQ ID NO: 671308 - DNA, 25 bp, Mus musculus
gtagcggtgccaccagttccagctt

SEQ ID NO: 671309 - DNA, 25 bp, Mus musculus
gtagcggtgccagcagttccagctt

SEQ ID NO: 671310 - DNA, 25 bp, Mus musculus
gtagcggtgcttcctgtgttccgca

SEQ ID NO: 671311 - DNA, 25 bp, Mus musculus
gtagcggtgcttgctgtgttccgca

SEQ ID NO: 671312 - DNA, 25 bp, Mus musculus
gtagcggttttgaactgtgaggaaa

SEQ ID NO: 671313 - DNA, 25 bp, Mus musculus
gtagcggttttgtactgtgaggaaa

SEQ ID NO: 671314 - DNA, 25 bp, Mus musculus
gtagcgtaccagcagttcttgacag

SEQ ID NO: 671315 - DNA, 25 bp, Mus musculus
gtagcgtaccaggagttcttgacag

SEQ ID NO: 671316 - DNA, 25 bp, Mus musculus
gtagcgtatattagttaagatgcgt

SEQ ID NO: 671317 - DNA, 25 bp, Mus musculus
gtagcgtatatttgttaagatgcgt

SEQ ID NO: 671318 - DNA, 25 bp, Mus musculus
gtagcgtatcccacttattatttta

SEQ ID NO: 671319 - DNA, 25 bp, Mus musculus
gtagcgtatccctcttattatttta

SEQ ID NO: 671320 - DNA, 25 bp, Mus musculus
gtagcgtcacaaacacaagttgtta

SEQ ID NO: 671321 - DNA, 25 bp, Mus musculus
gtagcgtcacaatcacaagttgtta

SEQ ID NO: 671322 - DNA, 25 bp, Mus musculus
gtagcgtcacttcaacagaaagcaa

SEQ ID NO: 671323 - DNA, 25 bp, Mus musculus
gtagcgtcacttgaacagaaagcaa

SEQ ID NO: 671324 - DNA, 25 bp, Mus musculus
gtagcgtcagagacagacccttaca

SEQ ID NO: 671325 - DNA, 25 bp, Mus musculus
gtagcgtcagagtcagacccttaca

SEQ ID NO: 671326 - DNA, 25 bp, Mus musculus
gtagcgtccatgaacttgtgttcaa

SEQ ID NO: 671327 - DNA, 25 bp, Mus musculus
gtagcgtccatgtacttgtgttcaa

SEQ ID NO: 671328 - DNA, 25 bp, Mus musculus
gtagcgtccccacgtggctgaagtt

SEQ ID NO: 671329 - DNA, 25 bp, Mus musculus
gtagcgtccccaggtggctgaagtt

SEQ ID NO: 671330 - DNA, 25 bp, Mus musculus
gtagcgtcctgcaggcactgagtaa

SEQ ID NO: 671331 - DNA, 25 bp, Mus musculus
gtagcgtcctgctggcactgagtaa

SEQ ID NO: 671332 - DNA, 25 bp, Mus musculus
gtagcgtcgcttagatcacacaggt

SEQ ID NO: 671333 - DNA, 25 bp, Mus musculus
gtagcgtcgctttgatcacacaggt

SEQ ID NO: 671334 - DNA, 25 bp, Mus musculus
gtagcgtctgtgacatgagacactt

SEQ ID NO: 671335 - DNA, 25 bp, Mus musculus
gtagcgtctgtgtcatgagacactt

SEQ ID NO: 671336 - DNA, 25 bp, Mus musculus
gtagcgtctttaccatcagcatgta

SEQ ID NO: 671337 - DNA, 25 bp, Mus musculus
gtagcgtctttagcatcagcatgta

SEQ ID NO: 671338 - DNA, 25 bp, Mus musculus
gtagcgtgtgcactgttctaggtta

SEQ ID NO: 671339 - DNA, 25 bp, Mus musculus
gtagcgtgtgcagtgttctaggtta

SEQ ID NO: 671340 - DNA, 25 bp, Mus musculus
gtagcgttcaggacactacagccaa

SEQ ID NO: 671341 - DNA, 25 bp, Mus musculus
gtagcgttcaggtcactacagccaa

SEQ ID NO: 671342 - DNA, 25 bp, Mus musculus
gtagcgtttccaagagcaaaatgtt

SEQ ID NO: 671343 - DNA, 25 bp, Mus musculus
gtagcgtttccatgagcaaaatgtt

SEQ ID NO: 671344 - DNA, 25 bp, Mus musculus
gtagctaaactcatcaacattcatg

SEQ ID NO: 671345 - DNA, 25 bp, Mus musculus
gtagctaaactcttcaacattcatg

SEQ ID NO: 671346 - DNA, 25 bp, Mus musculus
gtagctaacacacagctcttggtat

SEQ ID NO: 671347 - DNA, 25 bp, Mus musculus
gtagctaacacagagctcttggtat

SEQ ID NO: 671348 - DNA, 25 bp, Mus musculus
gtagctaacagtagggcttcacggg

SEQ ID NO: 671349 - DNA, 25 bp, Mus musculus
gtagctaacagttgggcttcacggg

SEQ ID NO: 671350 - DNA, 25 bp, Mus musculus
gtagctaagactctctcctggtacc

SEQ ID NO: 671351 - DNA, 25 bp, Mus musculus
gtagctaagactgtctcctggtacc

SEQ ID NO: 671352 - DNA, 25 bp, Mus musculus
gtagctaagagtatcctggtatcat

SEQ ID NO: 671353 - DNA, 25 bp, Mus musculus
gtagctaagagtttcctggtatcat

SEQ ID NO: 671354 - DNA, 25 bp, Mus musculus
gtagctaagcctattcgattctata

SEQ ID NO: 671355 - DNA, 25 bp, Mus musculus
gtagctaagccttttcgattctata

SEQ ID NO: 671356 - DNA, 25 bp, Mus musculus
gtagctaaggacacttgttgctctt

SEQ ID NO: 671357 - DNA, 25 bp, Mus musculus
gtagctaaggactcttgttgctctt

SEQ ID NO: 671358 - DNA, 25 bp, Mus musculus
gtagctaaggagatccatctggaat

SEQ ID NO: 671359 - DNA, 25 bp, Mus musculus
gtagctaaggagttccatctggaat

SEQ ID NO: 671360 - DNA, 25 bp, Mus musculus
gtagctaagggtccatgacaggcaa

SEQ ID NO: 671361 - DNA, 25 bp, Mus musculus
gtagctaagggtgcatgacaggcaa

SEQ ID NO: 671362 - DNA, 25 bp, Mus musculus
gtagctaagtagaagaacacttgcc

SEQ ID NO: 671363 - DNA, 25 bp, Mus musculus
gtagctaagtagtagaacacttgcc

SEQ ID NO: 671364 - DNA, 25 bp, Mus musculus
gtagctaagttaattgaggccaagt

SEQ ID NO: 671365 - DNA, 25 bp, Mus musculus
gtagctaagttatttgaggccaagt

SEQ ID NO: 671366 - DNA, 25 bp, Mus musculus
gtagctaagttgcttgtgtgatatc

SEQ ID NO: 671367 - DNA, 25 bp, Mus musculus
gtagctaagttggttgtgtgatatc

SEQ ID NO: 671368 - DNA, 25 bp, Mus musculus
gtagctaataaaaggcttgtccttt

SEQ ID NO: 671369 - DNA, 25 bp, Mus musculus
gtagctaataaatggcttgtccttt

SEQ ID NO: 671370 - DNA, 25 bp, Mus musculus
gtagctaatgtgaacccaggaggat

SEQ ID NO: 671371 - DNA, 25 bp, Mus musculus
gtagctaatgtgtacccaggaggat

SEQ ID NO: 671372 - DNA, 25 bp, Mus musculus
gtagctacagtgcagcgtttcctca

SEQ ID NO: 671373 - DNA, 25 bp, Mus musculus
gtagctacagtggagcgtttcctca

SEQ ID NO: 671374 - DNA, 25 bp, Mus musculus
gtagctacatcccaggtttcaagat

SEQ ID NO: 671375 - DNA, 25 bp, Mus musculus
gtagctacatccgaggtttcaagat

SEQ ID NO: 671376 - DNA, 25 bp, Mus musculus
gtagctacccagactacaaggaggg

SEQ ID NO: 671377 - DNA, 25 bp, Mus musculus
gtagctacccagtctacaaggaggg

SEQ ID NO: 671378 - DNA, 25 bp, Mus musculus
gtagctaccgatcggcacttttatc

SEQ ID NO: 671379 - DNA, 25 bp, Mus musculus
gtagctaccgatgggcacttttatc

SEQ ID NO: 671380 - DNA, 25 bp, Mus musculus
gtagctacgtggcatgtgctccaag

SEQ ID NO: 671381 - DNA, 25 bp, Mus musculus
gtagctacgtgggatgtgctccaag

SEQ ID NO: 671382 - DNA, 25 bp, Mus musculus
gtagctactactcctattcctggta

SEQ ID NO: 671383 - DNA, 25 bp, Mus musculus
gtagctactactgctattcctggta

SEQ ID NO: 671384 - DNA, 25 bp, Mus musculus
gtagctacttcaatgtttcagactg

SEQ ID NO: 671385 - DNA, 25 bp, Mus musculus
gtagctacttcattgtttcagactg

SEQ ID NO: 671386 - DNA, 25 bp, Mus musculus
gtagctagaaaaagctcttcgaaaa

SEQ ID NO: 671387 - DNA, 25 bp, Mus musculus
gtagctagaaaatgctcttcgaaaa

SEQ ID NO: 671388 - DNA, 25 bp, Mus musculus
gtagctagagatccagtcccaccaa

SEQ ID NO: 671389 - DNA, 25 bp, Mus musculus
gtagctagagatgcagtcccaccaa

SEQ ID NO: 671390 - DNA, 25 bp, Mus musculus
gtagctagagccatggaagtccagt

SEQ ID NO: 671391 - DNA, 25 bp, Mus musculus
gtagctagagccttggaagtccagt

SEQ ID NO: 671392 - DNA, 25 bp, Mus musculus
gtagctagagttatcaaatggcatg

SEQ ID NO: 671393 - DNA, 25 bp, Mus musculus
gtagctagagttttcaaatggcatg

SEQ ID NO: 671394 - DNA, 25 bp, Mus musculus
gtagctaggacaatcactgttgaaa

SEQ ID NO: 671395 - DNA, 25 bp, Mus musculus
gtagctaggacattcactgttgaaa

SEQ ID NO: 671396 - DNA, 25 bp, Mus musculus
gtagctaggattcggctaagcccca

SEQ ID NO: 671397 - DNA, 25 bp, Mus musculus
gtagctaggattgggctaagcccca

SEQ ID NO: 671398 - DNA, 25 bp, Mus musculus
gtagctaggtgacttcggtttccaa

SEQ ID NO: 671399 - DNA, 25 bp, Mus musculus
gtagctaggtgagttcggtttccaa

SEQ ID NO: 671400 - DNA, 25 bp, Mus musculus
gtagctagtaacatgccttatgttt

SEQ ID NO: 671401 - DNA, 25 bp, Mus musculus
gtagctagtaacttgccttatgttt

SEQ ID NO: 671402 - DNA, 25 bp, Mus musculus
gtagctagtatccaataacccaggg

SEQ ID NO: 671403 - DNA, 25 bp, Mus musculus
gtagctagtatcgaataacccaggg

SEQ ID NO: 671404 - DNA, 25 bp, Mus musculus
gtagctataacaatctcactaagga

SEQ ID NO: 671405 - DNA, 25 bp, Mus musculus
gtagctataacattctcactaagga

SEQ ID NO: 671406 - DNA, 25 bp, Mus musculus
gtagctatagatctgcaagcatcat

SEQ ID NO: 671407 - DNA, 25 bp, Mus musculus
gtagctatagatgtgcaagcatcat

SEQ ID NO: 671408 - DNA, 25 bp, Mus musculus
gtagctatagtcagttgccaccagg

SEQ ID NO: 671409 - DNA, 25 bp, Mus musculus
gtagctatagtctgttgccaccagg

SEQ ID NO: 671410 - DNA, 25 bp, Mus musculus
gtagctatccatctgtatcctggta

SEQ ID NO: 671411 - DNA, 25 bp, Mus musculus
gtagctatccatgtgtatcctggta

SEQ ID NO: 671412 - DNA, 25 bp, Mus musculus
gtagctatctatcatgtccttaagt

SEQ ID NO: 671413 - DNA, 25 bp, Mus musculus
gtagctatctatgatgtccttaagt

SEQ ID NO: 671414 - DNA, 25 bp, Mus musculus
gtagctatctggcaatggttttgga

SEQ ID NO: 671415 - DNA, 25 bp, Mus musculus
gtagctatctgggaatggttttgga

SEQ ID NO: 671416 - DNA, 25 bp, Mus musculus
gtagctatctgtataaatctcactc

SEQ ID NO: 671417 - DNA, 25 bp, Mus musculus
gtagctatctgtttaaatctcactc

SEQ ID NO: 671418 - DNA, 25 bp, Mus musculus
gtagctatcttcagtcatgctgaaa

SEQ ID NO: 671419 - DNA, 25 bp, Mus musculus
gtagctatcttctgtcatgctgaaa

SEQ ID NO: 671420 - DNA, 25 bp, Mus musculus
gtagctatgatgaggtctttttaat

SEQ ID NO: 671421 - DNA, 25 bp, Mus musculus
gtagctatgatgtggtctttttaat

SEQ ID NO: 671422 - DNA, 25 bp, Mus musculus
gtagctatgtgtatttcatggtaag

SEQ ID NO: 671423 - DNA, 25 bp, Mus musculus
gtagctatgtgtttttcatggtaag

SEQ ID NO: 671424 - DNA, 25 bp, Mus musculus
gtagctattactcagctctgcttac

SEQ ID NO: 671425 - DNA, 25 bp, Mus musculus
gtagctattactgagctctgcttac

SEQ ID NO: 671426 - DNA, 25 bp, Mus musculus
gtagctattattactaagtctgcat

SEQ ID NO: 671427 - DNA, 25 bp, Mus musculus
gtagctattatttctaagtctgcat

SEQ ID NO: 671428 - DNA, 25 bp, Mus musculus
gtagctattggaactttcctgcact

SEQ ID NO: 671429 - DNA, 25 bp, Mus musculus
gtagctattggatctttcctgcact

SEQ ID NO: 671430 - DNA, 25 bp, Mus musculus
gtagctattgtcagaacatcgaaag

SEQ ID NO: 671431 - DNA, 25 bp, Mus musculus
gtagctattgtctgaacatcgaaag

SEQ ID NO: 671432 - DNA, 25 bp, Mus musculus
gtagctattgttactgttggaccca

SEQ ID NO: 671433 - DNA, 25 bp, Mus musculus
gtagctattgtttctgttggaccca

SEQ ID NO: 671434 - DNA, 25 bp, Mus musculus
gtagctatttttctcgttgcatctt

SEQ ID NO: 671435 - DNA, 25 bp, Mus musculus
gtagctatttttgtcgttgcatctt

SEQ ID NO: 671436 - DNA, 25 bp, Mus musculus
gtagctcacaggattgacatttctt

SEQ ID NO: 671437 - DNA, 25 bp, Mus musculus
gtagctcacaggtttgacatttctt

SEQ ID NO: 671438 - DNA, 25 bp, Mus musculus
gtagctcacggaccgctggtgataa

SEQ ID NO: 671439 - DNA, 25 bp, Mus musculus
gtagctcacggagcgctggtgataa

SEQ ID NO: 671440 - DNA, 25 bp, Mus musculus
gtagctcactccatattctgagaca

SEQ ID NO: 671441 - DNA, 25 bp, Mus musculus
gtagctcactccttattctgagaca

SEQ ID NO: 671442 - DNA, 25 bp, Mus musculus
gtagctcactttcgccaagcttcat

SEQ ID NO: 671443 - DNA, 25 bp, Mus musculus
gtagctcactttggccaagcttcat

SEQ ID NO: 671444 - DNA, 25 bp, Mus musculus
gtagctcagaaaaatgattcaacag

SEQ ID NO: 671445 - DNA, 25 bp, Mus musculus
gtagctcagaaatatgattcaacag

SEQ ID NO: 671446 - DNA, 25 bp, Mus musculus
gtagctcagcagaagcacacgtttg

SEQ ID NO: 671447 - DNA, 25 bp, Mus musculus
gtagctcagcagtagcacacgtttg

SEQ ID NO: 671448 - DNA, 25 bp, Mus musculus
gtagctcagcccaaaaaaccgtgct

SEQ ID NO: 671449 - DNA, 25 bp, Mus musculus
gtagctcagccctaaaaaccgtgct

SEQ ID NO: 671450 - DNA, 25 bp, Mus musculus
gtagctcaggaaagagccaaccata

SEQ ID NO: 671451 - DNA, 25 bp, Mus musculus
gtagctcaggaatgagccaaccata

SEQ ID NO: 671452 - DNA, 25 bp, Mus musculus
gtagctcaggagaacaatgcatgct

SEQ ID NO: 671453 - DNA, 25 bp, Mus musculus
gtagctcaggagtacaatgcatgct

SEQ ID NO: 671454 - DNA, 25 bp, Mus musculus
gtagctcaggccaatgtatcagctc

SEQ ID NO: 671455 - DNA, 25 bp, Mus musculus
gtagctcaggcctatgtatcagctc

SEQ ID NO: 671456 - DNA, 25 bp, Mus musculus
gtagctcagggaaacttcttcatag

SEQ ID NO: 671457 - DNA, 25 bp, Mus musculus
gtagctcagggatacttcttcatag

SEQ ID NO: 671458 - DNA, 25 bp, Mus musculus
gtagctcagggtagaactgcagcat

SEQ ID NO: 671459 - DNA, 25 bp, Mus musculus
gtagctcagggttgaactgcagcat

SEQ ID NO: 671460 - DNA, 25 bp, Mus musculus
gtagctcagttgcacacgtattggt

SEQ ID NO: 671461 - DNA, 25 bp, Mus musculus
gtagctcagttggacacgtattggt

SEQ ID NO: 671462 - DNA, 25 bp, Mus musculus
gtagctcatagcagcaatgccttag

SEQ ID NO: 671463 - DNA, 25 bp, Mus musculus
gtagctcatagctgcaatgccttag

SEQ ID NO: 671464 - DNA, 25 bp, Mus musculus
gtagctcatcacctgttgtgttgtt

SEQ ID NO: 671465 - DNA, 25 bp, Mus musculus
gtagctcatcacgtgttgtgttgtt

SEQ ID NO: 671466 - DNA, 25 bp, Mus musculus
gtagctcatctcagggatgtgtctg

SEQ ID NO: 671467 - DNA, 25 bp, Mus musculus
gtagctcatctctgggatgtgtctg

SEQ ID NO: 671468 - DNA, 25 bp, Mus musculus
gtagctcatcttcagtgtgggccat

SEQ ID NO: 671469 - DNA, 25 bp, Mus musculus
gtagctcatcttgagtgtgggccat

SEQ ID NO: 671470 - DNA, 25 bp, Mus musculus
gtagctcatgagctctcttcccctg

SEQ ID NO: 671471 - DNA, 25 bp, Mus musculus
gtagctcatgaggtctcttcccctg

SEQ ID NO: 671472 - DNA, 25 bp, Mus musculus
gtagctcatgcccaaggtacatcaa

SEQ ID NO: 671473 - DNA, 25 bp, Mus musculus
gtagctcatgccgaaggtacatcaa

SEQ ID NO: 671474 - DNA, 25 bp, Mus musculus
gtagctcatttcacgaggagccgat

SEQ ID NO: 671475 - DNA, 25 bp, Mus musculus
gtagctcatttctcgaggagccgat

SEQ ID NO: 671476 - DNA, 25 bp, Mus musculus
gtagctccaagtcagacactgcatt

SEQ ID NO: 671477 - DNA, 25 bp, Mus musculus
gtagctccaagtgagacactgcatt

SEQ ID NO: 671478 - DNA, 25 bp, Mus musculus
gtagctccacacatagacatgtcgg

SEQ ID NO: 671479 - DNA, 25 bp, Mus musculus
gtagctccacacttagacatgtcgg

SEQ ID NO: 671480 - DNA, 25 bp, Mus musculus
gtagctccactgaagttgagcatcc

SEQ ID NO: 671481 - DNA, 25 bp, Mus musculus
gtagctccactgtagttgagcatcc

SEQ ID NO: 671482 - DNA, 25 bp, Mus musculus
gtagctccctgacacctatgaggac

SEQ ID NO: 671483 - DNA, 25 bp, Mus musculus
gtagctccctgagacctatgaggac

SEQ ID NO: 671484 - DNA, 25 bp, Mus musculus
gtagctcctaaacgtggtcgtccca

SEQ ID NO: 671485 - DNA, 25 bp, Mus musculus
gtagctcctaaaggtggtcgtccca

SEQ ID NO: 671486 - DNA, 25 bp, Mus musculus
gtagctcctctcataagaagaactg

SEQ ID NO: 671487 - DNA, 25 bp, Mus musculus
gtagctcctctcttaagaagaactg

SEQ ID NO: 671488 - DNA, 25 bp, Mus musculus
gtagctcctctgatccctttaagaa

SEQ ID NO: 671489 - DNA, 25 bp, Mus musculus
gtagctcctctgttccctttaagaa

SEQ ID NO: 671490 - DNA, 25 bp, Mus musculus
gtagctcctgaacaacgtagtaata

SEQ ID NO: 671491 - DNA, 25 bp, Mus musculus
gtagctcctgaagaacgtagtaata

SEQ ID NO: 671492 - DNA, 25 bp, Mus musculus
gtagctcctgagaattacagctgaa

SEQ ID NO: 671493 - DNA, 25 bp, Mus musculus
gtagctcctgagtattacagctgaa

SEQ ID NO: 671494 - DNA, 25 bp, Mus musculus
gtagctcgcggcagcatcgctcttg

SEQ ID NO: 671495 - DNA, 25 bp, Mus musculus
gtagctcgcggctgcatcgctcttg

SEQ ID NO: 671496 - DNA, 25 bp, Mus musculus
gtagctcgttctaaacaatggtcta

SEQ ID NO: 671497 - DNA, 25 bp, Mus musculus
gtagctcgttcttaacaatggtcta

SEQ ID NO: 671498 - DNA, 25 bp, Mus musculus
gtagctctaaataattcttcccagt

SEQ ID NO: 671499 - DNA, 25 bp, Mus musculus
gtagctctaaattattcttcccagt

SEQ ID NO: 671500 - DNA, 25 bp, Mus musculus
gtagctctagccatgctatactcaa

SEQ ID NO: 671501 - DNA, 25 bp, Mus musculus
gtagctctagccttgctatactcaa

SEQ ID NO: 671502 - DNA, 25 bp, Mus musculus
gtagctctagctcctaaaacatcca

SEQ ID NO: 671503 - DNA, 25 bp, Mus musculus
gtagctctagctgctaaaacatcca

SEQ ID NO: 671504 - DNA, 25 bp, Mus musculus
gtagctctcaccagcttaacaacag

SEQ ID NO: 671505 - DNA, 25 bp, Mus musculus
gtagctctcaccatcatttgaacaa

SEQ ID NO: 671506 - DNA, 25 bp, Mus musculus
gtagctctcacctgcttaacaacag

SEQ ID NO: 671507 - DNA, 25 bp, Mus musculus
gtagctctcaccttcatttgaacaa

SEQ ID NO: 671508 - DNA, 25 bp, Mus musculus
gtagctctcactatgacatgattct

SEQ ID NO: 671509 - DNA, 25 bp, Mus musculus
gtagctctcactttgacatgattct

SEQ ID NO: 671510 - DNA, 25 bp, Mus musculus
gtagctctcagaaaatttgggtcaa

SEQ ID NO: 671511 - DNA, 25 bp, Mus musculus
gtagctctcagataatttgggtcaa

SEQ ID NO: 671512 - DNA, 25 bp, Mus musculus
gtagctctcatccagctgattttca

SEQ ID NO: 671513 - DNA, 25 bp, Mus musculus
gtagctctcatcgagctgattttca

SEQ ID NO: 671514 - DNA, 25 bp, Mus musculus
gtagctctcatgcttccctaataaa

SEQ ID NO: 671515 - DNA, 25 bp, Mus musculus
gtagctctcatggttccctaataaa

SEQ ID NO: 671516 - DNA, 25 bp, Mus musculus
gtagctctcgtgagttattagccta

SEQ ID NO: 671517 - DNA, 25 bp, Mus musculus
gtagctctcgtgtgttattagccta

SEQ ID NO: 671518 - DNA, 25 bp, Mus musculus
gtagctctctgacttgatagcagta

SEQ ID NO: 671519 - DNA, 25 bp, Mus musculus
gtagctctctgagttgatagcagta

SEQ ID NO: 671520 - DNA, 25 bp, Mus musculus
gtagctctcttcagagtggtcgcat

SEQ ID NO: 671521 - DNA, 25 bp, Mus musculus
gtagctctcttctgagtggtcgcat

SEQ ID NO: 671522 - DNA, 25 bp, Mus musculus
gtagctctgactcgctcaatagacc

SEQ ID NO: 671523 - DNA, 25 bp, Mus musculus
gtagctctgactggctcaatagacc

SEQ ID NO: 671524 - DNA, 25 bp, Mus musculus
gtagctctgagacttcgtttcatag

SEQ ID NO: 671525 - DNA, 25 bp, Mus musculus
gtagctctgagagttcgtttcatag

SEQ ID NO: 671526 - DNA, 25 bp, Mus musculus
gtagctctgctaatacagattgctc

SEQ ID NO: 671527 - DNA, 25 bp, Mus musculus
gtagctctgctacaaaacggcccac

SEQ ID NO: 671528 - DNA, 25 bp, Mus musculus
gtagctctgctagaaaacggcccac

SEQ ID NO: 671529 - DNA, 25 bp, Mus musculus
gtagctctgctattacagattgctc

SEQ ID NO: 671530 - DNA, 25 bp, Mus musculus
gtagctctgcttagtgaaacctcag

SEQ ID NO: 671531 - DNA, 25 bp, Mus musculus
gtagctctgctttgtgaaacctcag

SEQ ID NO: 671532 - DNA, 25 bp, Mus musculus
gtagctctgggtccaagatcactca

SEQ ID NO: 671533 - DNA, 25 bp, Mus musculus
gtagctctgggtgcaagatcactca

SEQ ID NO: 671534 - DNA, 25 bp, Mus musculus
gtagctctggtaatcactttacctt

SEQ ID NO: 671535 - DNA, 25 bp, Mus musculus
gtagctctggtattcactttacctt

SEQ ID NO: 671536 - DNA, 25 bp, Mus musculus
gtagctctgtcactctgagttgtaa

SEQ ID NO: 671537 - DNA, 25 bp, Mus musculus
gtagctctgtcagtctgagttgtaa

SEQ ID NO: 671538 - DNA, 25 bp, Mus musculus
gtagctcttcaacggccaagggtca

SEQ ID NO: 671539 - DNA, 25 bp, Mus musculus
gtagctcttcaagggccaagggtca

SEQ ID NO: 671540 - DNA, 25 bp, Mus musculus
gtagctcttgaacccaccagttgga

SEQ ID NO: 671541 - DNA, 25 bp, Mus musculus
gtagctcttgaacgcccagtgcgtc

SEQ ID NO: 671542 - DNA, 25 bp, Mus musculus
gtagctcttgaagccaccagttgga

SEQ ID NO: 671543 - DNA, 25 bp, Mus musculus
gtagctcttgaaggcccagtgcgtc

SEQ ID NO: 671544 - DNA, 25 bp, Mus musculus
gtagctcttgcccaggatcatctga

SEQ ID NO: 671545 - DNA, 25 bp, Mus musculus
gtagctcttgccgaggatcatctga

SEQ ID NO: 671546 - DNA, 25 bp, Mus musculus
gtagctcttgtgaacggtcaggcat

SEQ ID NO: 671547 - DNA, 25 bp, Mus musculus
gtagctcttgtgtacggtcaggcat

SEQ ID NO: 671548 - DNA, 25 bp, Mus musculus
gtagctctttaaaagcacagcggtt

SEQ ID NO: 671549 - DNA, 25 bp, Mus musculus
gtagctctttaatagcacagcggtt

SEQ ID NO: 671550 - DNA, 25 bp, Mus musculus
gtagctcttttgcttgtcagacccc

SEQ ID NO: 671551 - DNA, 25 bp, Mus musculus
gtagctcttttggttgtcagacccc

SEQ ID NO: 671552 - DNA, 25 bp, Mus musculus
gtagctgaagagaagaggctctcta

SEQ ID NO: 671553 - DNA, 25 bp, Mus musculus
gtagctgaagagtagaggctctcta

SEQ ID NO: 671554 - DNA, 25 bp, Mus musculus
gtagctgaagccctgtgtccttaga

SEQ ID NO: 671555 - DNA, 25 bp, Mus musculus
gtagctgaagccgtgtgtccttaga

SEQ ID NO: 671556 - DNA, 25 bp, Mus musculus
gtagctgaagttcgaggctcctcct

SEQ ID NO: 671557 - DNA, 25 bp, Mus musculus
gtagctgaagttggaggctcctcct

SEQ ID NO: 671558 - DNA, 25 bp, Mus musculus
gtagctgaccgaacctgggaaacat

SEQ ID NO: 671559 - DNA, 25 bp, Mus musculus
gtagctgaccgatcctgggaaacat

SEQ ID NO: 671560 - DNA, 25 bp, Mus musculus
gtagctgaccgtcgtgcattaatct

SEQ ID NO: 671561 - DNA, 25 bp, Mus musculus
gtagctgaccgtggtgcattaatct

SEQ ID NO: 671562 - DNA, 25 bp, Mus musculus
gtagctgacctactaagcgggaccc

SEQ ID NO: 671563 - DNA, 25 bp, Mus musculus
gtagctgacctagtaagcgggaccc

SEQ ID NO: 671564 - DNA, 25 bp, Mus musculus
gtagctgaccttaaactgtagatct

SEQ ID NO: 671565 - DNA, 25 bp, Mus musculus
gtagctgaccttcacctgtatgcaa

SEQ ID NO: 671566 - DNA, 25 bp, Mus musculus
gtagctgaccttgacctgtatgcaa

SEQ ID NO: 671567 - DNA, 25 bp, Mus musculus
gtagctgacctttaactgtagatct

SEQ ID NO: 671568 - DNA, 25 bp, Mus musculus
gtagctgacggcagtgacttgcttc

SEQ ID NO: 671569 - DNA, 25 bp, Mus musculus
gtagctgacggctgtgacttgcttc

SEQ ID NO: 671570 - DNA, 25 bp, Mus musculus
gtagctgactggactttcagttccc

SEQ ID NO: 671571 - DNA, 25 bp, Mus musculus
gtagctgactggtctttcagttccc

SEQ ID NO: 671572 - DNA, 25 bp, Mus musculus
gtagctgagattattagtatgaatg

SEQ ID NO: 671573 - DNA, 25 bp, Mus musculus
gtagctgagatttttagtatgaatg

SEQ ID NO: 671574 - DNA, 25 bp, Mus musculus
gtagctgaggatctcaagttcctaa

SEQ ID NO: 671575 - DNA, 25 bp, Mus musculus
gtagctgaggatgtcaagttcctaa

SEQ ID NO: 671576 - DNA, 25 bp, Mus musculus
gtagctgagtatactgacttaggaa

SEQ ID NO: 671577 - DNA, 25 bp, Mus musculus
gtagctgagtattctgacttaggaa

SEQ ID NO: 671578 - DNA, 25 bp, Mus musculus
gtagctgagtctaaacacttctgtg

SEQ ID NO: 671579 - DNA, 25 bp, Mus musculus
gtagctgagtcttaacacttctgtg

SEQ ID NO: 671580 - DNA, 25 bp, Mus musculus
gtagctgataagaccacactgtact

SEQ ID NO: 671581 - DNA, 25 bp, Mus musculus
gtagctgataagtccacactgtact

SEQ ID NO: 671582 - DNA, 25 bp, Mus musculus
gtagctgatccaactaacatctttg

SEQ ID NO: 671583 - DNA, 25 bp, Mus musculus
gtagctgatccatctaacatctttg

SEQ ID NO: 671584 - DNA, 25 bp, Mus musculus
gtagctgatgctatgtttcactcaa

SEQ ID NO: 671585 - DNA, 25 bp, Mus musculus
gtagctgatgctttgtttcactcaa

SEQ ID NO: 671586 - DNA, 25 bp, Mus musculus
gtagctgatgtgaaccgtggactca

SEQ ID NO: 671587 - DNA, 25 bp, Mus musculus
gtagctgatgtgtaccgtggactca

SEQ ID NO: 671588 - DNA, 25 bp, Mus musculus
gtagctgattctcgaagcaacgttc

SEQ ID NO: 671589 - DNA, 25 bp, Mus musculus
gtagctgattctggaagcaacgttc

SEQ ID NO: 671590 - DNA, 25 bp, Mus musculus
gtagctgatttcatttgcactgcct

SEQ ID NO: 671591 - DNA, 25 bp, Mus musculus
gtagctgatttcttttgcactgcct

SEQ ID NO: 671592 - DNA, 25 bp, Mus musculus
gtagctgattttagtctccttgtcc

SEQ ID NO: 671593 - DNA, 25 bp, Mus musculus
gtagctgatttttgtctccttgtcc

SEQ ID NO: 671594 - DNA, 25 bp, Mus musculus
gtagctgcacaaagcatcttaggca

SEQ ID NO: 671595 - DNA, 25 bp, Mus musculus
gtagctgcacaatgcatcttaggca

SEQ ID NO: 671596 - DNA, 25 bp, Mus musculus
gtagctgcaccaatgtttgagctgt

SEQ ID NO: 671597 - DNA, 25 bp, Mus musculus
gtagctgcaccattgtttgagctgt

SEQ ID NO: 671598 - DNA, 25 bp, Mus musculus
gtagctgcagccaactgtgtactgt

SEQ ID NO: 671599 - DNA, 25 bp, Mus musculus
gtagctgcagcctactgtgtactgt

SEQ ID NO: 671600 - DNA, 25 bp, Mus musculus
gtagctgcagtgagctcttacacac

SEQ ID NO: 671601 - DNA, 25 bp, Mus musculus
gtagctgcagtgtgctcttacacac

SEQ ID NO: 671602 - DNA, 25 bp, Mus musculus
gtagctgcagttccctgcacaatat

SEQ ID NO: 671603 - DNA, 25 bp, Mus musculus
gtagctgcagttgcctgcacaatat

SEQ ID NO: 671604 - DNA, 25 bp, Mus musculus
gtagctgccaaaagtgcctttaatt

SEQ ID NO: 671605 - DNA, 25 bp, Mus musculus
gtagctgccaaatgtgcctttaatt

SEQ ID NO: 671606 - DNA, 25 bp, Mus musculus
gtagctgccagaatacatggatgcc

SEQ ID NO: 671607 - DNA, 25 bp, Mus musculus
gtagctgccagattacatggatgcc

SEQ ID NO: 671608 - DNA, 25 bp, Mus musculus
gtagctgccattatattctgtatct

SEQ ID NO: 671609 - DNA, 25 bp, Mus musculus
gtagctgccattttattctgtatct

SEQ ID NO: 671610 - DNA, 25 bp, Mus musculus
gtagctgcccagatgcatgtgtgga

SEQ ID NO: 671611 - DNA, 25 bp, Mus musculus
gtagctgcccagttgcatgtgtgga

SEQ ID NO: 671612 - DNA, 25 bp, Mus musculus
gtagctgcctagaatgctctgtata

SEQ ID NO: 671613 - DNA, 25 bp, Mus musculus
gtagctgcctagtatgctctgtata

SEQ ID NO: 671614 - DNA, 25 bp, Mus musculus
gtagctgcctctagtggaagataga

SEQ ID NO: 671615 - DNA, 25 bp, Mus musculus
gtagctgcctctctgtaagatgcca

SEQ ID NO: 671616 - DNA, 25 bp, Mus musculus
gtagctgcctctgtgtaagatgcca

SEQ ID NO: 671617 - DNA, 25 bp, Mus musculus
gtagctgcctcttgtggaagataga

SEQ ID NO: 671618 - DNA, 25 bp, Mus musculus
gtagctgcgtttaccaagtaactgt

SEQ ID NO: 671619 - DNA, 25 bp, Mus musculus
gtagctgcgttttccaagtaactgt

SEQ ID NO: 671620 - DNA, 25 bp, Mus musculus
gtagctgctaataatcttattggac

SEQ ID NO: 671621 - DNA, 25 bp, Mus musculus
gtagctgctaattatcttattggac

SEQ ID NO: 671622 - DNA, 25 bp, Mus musculus
gtagctgctacaatgctgaggatca

SEQ ID NO: 671623 - DNA, 25 bp, Mus musculus
gtagctgctacattgctgaggatca

SEQ ID NO: 671624 - DNA, 25 bp, Mus musculus
gtagctgctaggacacaaagggttt

SEQ ID NO: 671625 - DNA, 25 bp, Mus musculus
gtagctgctaggtcacaaagggttt

SEQ ID NO: 671626 - DNA, 25 bp, Mus musculus
gtagctgctgaactgcaagacagga

SEQ ID NO: 671627 - DNA, 25 bp, Mus musculus
gtagctgctgaagtgcaagacagga

SEQ ID NO: 671628 - DNA, 25 bp, Mus musculus
gtagctgctggtaattacccttttt

SEQ ID NO: 671629 - DNA, 25 bp, Mus musculus
gtagctgctggtacacattcttatt

SEQ ID NO: 671630 - DNA, 25 bp, Mus musculus
gtagctgctggttattacccttttt

SEQ ID NO: 671631 - DNA, 25 bp, Mus musculus
gtagctgctggttcacattcttatt

SEQ ID NO: 671632 - DNA, 25 bp, Mus musculus
gtagctgctgtcctgaatgacgacc

SEQ ID NO: 671633 - DNA, 25 bp, Mus musculus
gtagctgctgtcgtgaatgacgacc

SEQ ID NO: 671634 - DNA, 25 bp, Mus musculus
gtagctggaaccacttagtctttag

SEQ ID NO: 671635 - DNA, 25 bp, Mus musculus
gtagctggaacctcttagtctttag

SEQ ID NO: 671636 - DNA, 25 bp, Mus musculus
gtagctggaccactatttagcaaca

SEQ ID NO: 671637 - DNA, 25 bp, Mus musculus
gtagctggaccagtatttagcaaca

SEQ ID NO: 671638 - DNA, 25 bp, Mus musculus
gtagctggagagacacttcccagga

SEQ ID NO: 671639 - DNA, 25 bp, Mus musculus
gtagctggagagtcacttcccagga

SEQ ID NO: 671640 - DNA, 25 bp, Mus musculus
gtagctggcaataatctgaacatga

SEQ ID NO: 671641 - DNA, 25 bp, Mus musculus
gtagctggcaattatctgaacatga

SEQ ID NO: 671642 - DNA, 25 bp, Mus musculus
gtagctgggaccataggctcacaac

SEQ ID NO: 671643 - DNA, 25 bp, Mus musculus
gtagctgggaccttaggctcacaac

SEQ ID NO: 671644 - DNA, 25 bp, Mus musculus
gtagctgggctaacactggaagcat

SEQ ID NO: 671645 - DNA, 25 bp, Mus musculus
gtagctgggctatcactggaagcat

SEQ ID NO: 671646 - DNA, 25 bp, Mus musculus
gtagctggtaagaatgtggccctgt

SEQ ID NO: 671647 - DNA, 25 bp, Mus musculus
gtagctggtaagtatgtggccctgt

SEQ ID NO: 671648 - DNA, 25 bp, Mus musculus
gtagctggtcagagttcactcacag

SEQ ID NO: 671649 - DNA, 25 bp, Mus musculus
gtagctggtcagtgttcactcacag

SEQ ID NO: 671650 - DNA, 25 bp, Mus musculus
gtagctgtaaacctggccactggaa

SEQ ID NO: 671651 - DNA, 25 bp, Mus musculus
gtagctgtaaacgtggccactggaa

SEQ ID NO: 671652 - DNA, 25 bp, Mus musculus
gtagctgtaattcaggcaccccaag

SEQ ID NO: 671653 - DNA, 25 bp, Mus musculus
gtagctgtaattgaggcaccccaag

SEQ ID NO: 671654 - DNA, 25 bp, Mus musculus
gtagctgtactacaagcccaccaag

SEQ ID NO: 671655 - DNA, 25 bp, Mus musculus
gtagctgtactagaagcccaccaag

SEQ ID NO: 671656 - DNA, 25 bp, Mus musculus
gtagctgtacttctgatgactaaca

SEQ ID NO: 671657 - DNA, 25 bp, Mus musculus
gtagctgtacttgtgatgactaaca

SEQ ID NO: 671658 - DNA, 25 bp, Mus musculus
gtagctgtagtgaataaccttggcc

SEQ ID NO: 671659 - DNA, 25 bp, Mus musculus
gtagctgtagtgctcttcactagaa

SEQ ID NO: 671660 - DNA, 25 bp, Mus musculus
gtagctgtagtggtcttcactagaa

SEQ ID NO: 671661 - DNA, 25 bp, Mus musculus
gtagctgtagtgtataaccttggcc

SEQ ID NO: 671662 - DNA, 25 bp, Mus musculus
gtagctgtcagaacgtgtgtcatgt

SEQ ID NO: 671663 - DNA, 25 bp, Mus musculus
gtagctgtcagatcgtgtgtcatgt

SEQ ID NO: 671664 - DNA, 25 bp, Mus musculus
gtagctgtcagccacgtgtggctat

SEQ ID NO: 671665 - DNA, 25 bp, Mus musculus
gtagctgtcagcctcggtcttttgc

SEQ ID NO: 671666 - DNA, 25 bp, Mus musculus
gtagctgtcagcgacgtgtggctat

SEQ ID NO: 671667 - DNA, 25 bp, Mus musculus
gtagctgtcagcgtcggtcttttgc

SEQ ID NO: 671668 - DNA, 25 bp, Mus musculus
gtagctgtcatacatctctggtata

SEQ ID NO: 671669 - DNA, 25 bp, Mus musculus
gtagctgtcatagatctctggtata

SEQ ID NO: 671670 - DNA, 25 bp, Mus musculus
gtagctgtcatgctgcaatttgtct

SEQ ID NO: 671671 - DNA, 25 bp, Mus musculus
gtagctgtcatggtgcaatttgtct

SEQ ID NO: 671672 - DNA, 25 bp, Mus musculus
gtagctgtccatacagtgaacactt

SEQ ID NO: 671673 - DNA, 25 bp, Mus musculus
gtagctgtccattcagtgaacactt

SEQ ID NO: 671674 - DNA, 25 bp, Mus musculus
gtagctgtcccaccagagtggtgta

SEQ ID NO: 671675 - DNA, 25 bp, Mus musculus
gtagctgtcccagcagagtggtgta

SEQ ID NO: 671676 - DNA, 25 bp, Mus musculus
gtagctgtcggtactggtctttcct

SEQ ID NO: 671677 - DNA, 25 bp, Mus musculus
gtagctgtcggttctggtctttcct

SEQ ID NO: 671678 - DNA, 25 bp, Mus musculus
gtagctgtctccatagatgaaacct

SEQ ID NO: 671679 - DNA, 25 bp, Mus musculus
gtagctgtctccttagatgaaacct

SEQ ID NO: 671680 - DNA, 25 bp, Mus musculus
gtagctgtgaaaagtcaccgcacat

SEQ ID NO: 671681 - DNA, 25 bp, Mus musculus
gtagctgtgaaatgtcaccgcacat

SEQ ID NO: 671682 - DNA, 25 bp, Mus musculus
gtagctgtgaatctgacgtccacct

SEQ ID NO: 671683 - DNA, 25 bp, Mus musculus
gtagctgtgaatgtgacgtccacct

SEQ ID NO: 671684 - DNA, 25 bp, Mus musculus
gtagctgtgctcacaggatgctcac

SEQ ID NO: 671685 - DNA, 25 bp, Mus musculus
gtagctgtgctctcaggatgctcac

SEQ ID NO: 671686 - DNA, 25 bp, Mus musculus
gtagctgtggcacacttgagttgct

SEQ ID NO: 671687 - DNA, 25 bp, Mus musculus
gtagctgtggcagacttgagttgct

SEQ ID NO: 671688 - DNA, 25 bp, Mus musculus
gtagctgtggccatgccagaagagc

SEQ ID NO: 671689 - DNA, 25 bp, Mus musculus
gtagctgtggccttgccagaagagc

SEQ ID NO: 671690 - DNA, 25 bp, Mus musculus
gtagctgtgtagaccgcctgttggc

SEQ ID NO: 671691 - DNA, 25 bp, Mus musculus
gtagctgtgtagtccgcctgttggc

SEQ ID NO: 671692 - DNA, 25 bp, Mus musculus
gtagctgtgtgaacttacaaaccca

SEQ ID NO: 671693 - DNA, 25 bp, Mus musculus
gtagctgtgtgatcttacaaaccca

SEQ ID NO: 671694 - DNA, 25 bp, Mus musculus
gtagctgttcccctgcaagaacaag

SEQ ID NO: 671695 - DNA, 25 bp, Mus musculus
gtagctgttcccgtgcaagaacaag

SEQ ID NO: 671696 - DNA, 25 bp, Mus musculus
gtagctgttctcaccggaggctgag

SEQ ID NO: 671697 - DNA, 25 bp, Mus musculus
gtagctgttctctccggaggctgag

SEQ ID NO: 671698 - DNA, 25 bp, Mus musculus
gtagctgttctgcatgtgaatgctg

SEQ ID NO: 671699 - DNA, 25 bp, Mus musculus
gtagctgttctggatgtgaatgctg

SEQ ID NO: 671700 - DNA, 25 bp, Mus musculus
gtagctgtttaaagacactagtcct

SEQ ID NO: 671701 - DNA, 25 bp, Mus musculus
gtagctgtttaatgacactagtcct

SEQ ID NO: 671702 - DNA, 25 bp, Mus musculus
gtagctgttttccatattccatgtt

SEQ ID NO: 671703 - DNA, 25 bp, Mus musculus
gtagctgttttcgatattccatgtt

SEQ ID NO: 671704 - DNA, 25 bp, Mus musculus
gtagcttaagcaaataaaacctcaa

SEQ ID NO: 671705 - DNA, 25 bp, Mus musculus
gtagcttaagcatataaaacctcaa

SEQ ID NO: 671706 - DNA, 25 bp, Mus musculus
gtagcttaataactttttaccatgc

SEQ ID NO: 671707 - DNA, 25 bp, Mus musculus
gtagcttaataagtttttaccatgc

SEQ ID NO: 671708 - DNA, 25 bp, Mus musculus
gtagcttacactagctgctagctgg

SEQ ID NO: 671709 - DNA, 25 bp, Mus musculus
gtagcttacacttgctgctagctgg

SEQ ID NO: 671710 - DNA, 25 bp, Mus musculus
gtagcttagcatcagagagtcgcct

SEQ ID NO: 671711 - DNA, 25 bp, Mus musculus
gtagcttagcatgagagagtcgcct

SEQ ID NO: 671712 - DNA, 25 bp, Mus musculus
gtagcttaggaaatattatttggcc

SEQ ID NO: 671713 - DNA, 25 bp, Mus musculus
gtagcttaggaattattatttggcc

SEQ ID NO: 671714 - DNA, 25 bp, Mus musculus
gtagcttatcgaaatattacttagt

SEQ ID NO: 671715 - DNA, 25 bp, Mus musculus
gtagcttatcgatatattacttagt

SEQ ID NO: 671716 - DNA, 25 bp, Mus musculus
gtagcttatgtacaaatccactggt

SEQ ID NO: 671717 - DNA, 25 bp, Mus musculus
gtagcttatgtagaaatccactggt

SEQ ID NO: 671718 - DNA, 25 bp, Mus musculus
gtagcttatgtcaagacttcatttc

SEQ ID NO: 671719 - DNA, 25 bp, Mus musculus
gtagcttatgtctagacttcatttc

SEQ ID NO: 671720 - DNA, 25 bp, Mus musculus
gtagcttattataatggaacagact

SEQ ID NO: 671721 - DNA, 25 bp, Mus musculus
gtagcttattattatggaacagact

SEQ ID NO: 671722 - DNA, 25 bp, Mus musculus
gtagcttatttcatgtaccttgcag

SEQ ID NO: 671723 - DNA, 25 bp, Mus musculus
gtagcttatttcttgtaccttgcag

SEQ ID NO: 671724 - DNA, 25 bp, Mus musculus
gtagcttatttgacccagaattatc

SEQ ID NO: 671725 - DNA, 25 bp, Mus musculus
gtagcttatttgtcccagaattatc

SEQ ID NO: 671726 - DNA, 25 bp, Mus musculus
gtagcttcaacaaccatctcgtaac

SEQ ID NO: 671727 - DNA, 25 bp, Mus musculus
gtagcttcaacatccatctcgtaac

SEQ ID NO: 671728 - DNA, 25 bp, Mus musculus
gtagcttcaagaacttttctctgta

SEQ ID NO: 671729 - DNA, 25 bp, Mus musculus
gtagcttcaagatcttttctctgta

SEQ ID NO: 671730 - DNA, 25 bp, Mus musculus
gtagcttcactaactctgtatgtac

SEQ ID NO: 671731 - DNA, 25 bp, Mus musculus
gtagcttcactatctctgtatgtac

SEQ ID NO: 671732 - DNA, 25 bp, Mus musculus
gtagcttcagatctctttgcgccat

SEQ ID NO: 671733 - DNA, 25 bp, Mus musculus
gtagcttcagatgtctttgcgccat

SEQ ID NO: 671734 - DNA, 25 bp, Mus musculus
gtagcttcagccctgtgtcaaaaca

SEQ ID NO: 671735 - DNA, 25 bp, Mus musculus
gtagcttcagccgtgtgtcaaaaca

SEQ ID NO: 671736 - DNA, 25 bp, Mus musculus
gtagcttcaggaaccgtaggcaaaa

SEQ ID NO: 671737 - DNA, 25 bp, Mus musculus
gtagcttcaggatccgtaggcaaaa

SEQ ID NO: 671738 - DNA, 25 bp, Mus musculus
gtagcttcagtgaagcctctgcaat

SEQ ID NO: 671739 - DNA, 25 bp, Mus musculus
gtagcttcagtgtagcctctgcaat

SEQ ID NO: 671740 - DNA, 25 bp, Mus musculus
gtagcttcatagactcacctatatt

SEQ ID NO: 671741 - DNA, 25 bp, Mus musculus
gtagcttcatagtctcacctatatt

SEQ ID NO: 671742 - DNA, 25 bp, Mus musculus
gtagcttccaaacagtagtcctgaa

SEQ ID NO: 671743 - DNA, 25 bp, Mus musculus
gtagcttccaaagagtagtcctgaa

SEQ ID NO: 671744 - DNA, 25 bp, Mus musculus
gtagcttccataatctgtctttgtt

SEQ ID NO: 671745 - DNA, 25 bp, Mus musculus
gtagcttccatattctgtctttgtt

SEQ ID NO: 671746 - DNA, 25 bp, Mus musculus
gtagcttccatcacatgtgtttcca

SEQ ID NO: 671747 - DNA, 25 bp, Mus musculus
gtagcttccatctcatgtgtttcca

SEQ ID NO: 671748 - DNA, 25 bp, Mus musculus
gtagcttccatgatgctgagttagc

SEQ ID NO: 671749 - DNA, 25 bp, Mus musculus
gtagcttccatgttgctgagttagc

SEQ ID NO: 671750 - DNA, 25 bp, Mus musculus
gtagcttccccgagactaggaattt

SEQ ID NO: 671751 - DNA, 25 bp, Mus musculus
gtagcttccccgtgactaggaattt

SEQ ID NO: 671752 - DNA, 25 bp, Mus musculus
gtagcttccctcaatgattcttgat

SEQ ID NO: 671753 - DNA, 25 bp, Mus musculus
gtagcttccctctatgattcttgat

SEQ ID NO: 671754 - DNA, 25 bp, Mus musculus
gtagcttccgaaatgcagtttcatt

SEQ ID NO: 671755 - DNA, 25 bp, Mus musculus
gtagcttccgaaattgaaccgatta

SEQ ID NO: 671756 - DNA, 25 bp, Mus musculus
gtagcttccgaattgcagtttcatt

SEQ ID NO: 671757 - DNA, 25 bp, Mus musculus
gtagcttccgaatttgaaccgatta

SEQ ID NO: 671758 - DNA, 25 bp, Mus musculus
gtagcttcctagataaagacttggt

SEQ ID NO: 671759 - DNA, 25 bp, Mus musculus
gtagcttcctagttaaagacttggt

SEQ ID NO: 671760 - DNA, 25 bp, Mus musculus
gtagcttcctcgaaaatgatcctaa

SEQ ID NO: 671761 - DNA, 25 bp, Mus musculus
gtagcttcctcgtaaatgatcctaa

SEQ ID NO: 671762 - DNA, 25 bp, Mus musculus
gtagcttcctgaagcttgactaatt

SEQ ID NO: 671763 - DNA, 25 bp, Mus musculus
gtagcttcctgatgcttgactaatt

SEQ ID NO: 671764 - DNA, 25 bp, Mus musculus
gtagcttccttgctctgaggacgat

SEQ ID NO: 671765 - DNA, 25 bp, Mus musculus
gtagcttccttggtctgaggacgat

SEQ ID NO: 671766 - DNA, 25 bp, Mus musculus
gtagcttcctttcaaatactgcctc

SEQ ID NO: 671767 - DNA, 25 bp, Mus musculus
gtagcttcctttgaaatactgcctc

SEQ ID NO: 671768 - DNA, 25 bp, Mus musculus
gtagcttcgggcagtgcgttaccta

SEQ ID NO: 671769 - DNA, 25 bp, Mus musculus
gtagcttcgggctgtgcgttaccta

SEQ ID NO: 671770 - DNA, 25 bp, Mus musculus
gtagcttcgttgacatacacacata

SEQ ID NO: 671771 - DNA, 25 bp, Mus musculus
gtagcttcgttgtcatacacacata

SEQ ID NO: 671772 - DNA, 25 bp, Mus musculus
gtagcttctaccacttggaaagtat

SEQ ID NO: 671773 - DNA, 25 bp, Mus musculus
gtagcttctacctcttggaaagtat

SEQ ID NO: 671774 - DNA, 25 bp, Mus musculus
gtagcttctacgcagcaagtgacac

SEQ ID NO: 671775 - DNA, 25 bp, Mus musculus
gtagcttctacggagcaagtgacac

SEQ ID NO: 671776 - DNA, 25 bp, Mus musculus
gtagcttctccaagtaggattcctt

SEQ ID NO: 671777 - DNA, 25 bp, Mus musculus
gtagcttctccatgtaggattcctt

SEQ ID NO: 671778 - DNA, 25 bp, Mus musculus
gtagcttctgacattgccagtagac

SEQ ID NO: 671779 - DNA, 25 bp, Mus musculus
gtagcttctgactttgccagtagac

SEQ ID NO: 671780 - DNA, 25 bp, Mus musculus
gtagcttctgccctctactggttgt

SEQ ID NO: 671781 - DNA, 25 bp, Mus musculus
gtagcttctgccgtctactggttgt

SEQ ID NO: 671782 - DNA, 25 bp, Mus musculus
gtagcttctgctacttatcaggtta

SEQ ID NO: 671783 - DNA, 25 bp, Mus musculus
gtagcttctgcttcttatcaggtta

SEQ ID NO: 671784 - DNA, 25 bp, Mus musculus
gtagcttcttaaagagtttatttct

SEQ ID NO: 671785 - DNA, 25 bp, Mus musculus
gtagcttcttaaatccaatactaat

SEQ ID NO: 671786 - DNA, 25 bp, Mus musculus
gtagcttcttaatgagtttatttct

SEQ ID NO: 671787 - DNA, 25 bp, Mus musculus
gtagcttcttaattccaatactaat

SEQ ID NO: 671788 - DNA, 25 bp, Mus musculus
gtagcttcttagaggaggacttcct

SEQ ID NO: 671789 - DNA, 25 bp, Mus musculus
gtagcttcttagtggaggacttcct

SEQ ID NO: 671790 - DNA, 25 bp, Mus musculus
gtagcttcttgtagataactgtcag

SEQ ID NO: 671791 - DNA, 25 bp, Mus musculus
gtagcttcttgttgataactgtcag

SEQ ID NO: 671792 - DNA, 25 bp, Mus musculus
gtagcttgacatcattggcttcata

SEQ ID NO: 671793 - DNA, 25 bp, Mus musculus
gtagcttgacatgattggcttcata

SEQ ID NO: 671794 - DNA, 25 bp, Mus musculus
gtagcttgagctacatatgcagact

SEQ ID NO: 671795 - DNA, 25 bp, Mus musculus
gtagcttgagcttcatatgcagact

SEQ ID NO: 671796 - DNA, 25 bp, Mus musculus
gtagcttgagttatacccagcatcc

SEQ ID NO: 671797 - DNA, 25 bp, Mus musculus
gtagcttgagttttacccagcatcc

SEQ ID NO: 671798 - DNA, 25 bp, Mus musculus
gtagcttgatagataacaactgttg

SEQ ID NO: 671799 - DNA, 25 bp, Mus musculus
gtagcttgatagttaacaactgttg

SEQ ID NO: 671800 - DNA, 25 bp, Mus musculus
gtagcttgcatgcaactcagatttt

SEQ ID NO: 671801 - DNA, 25 bp, Mus musculus
gtagcttgcatggaactcagatttt

SEQ ID NO: 671802 - DNA, 25 bp, Mus musculus
gtagcttgctacactggaactcact

SEQ ID NO: 671803 - DNA, 25 bp, Mus musculus
gtagcttgctaccactaaacttaat

SEQ ID NO: 671804 - DNA, 25 bp, Mus musculus
gtagcttgctacgactaaacttaat

SEQ ID NO: 671805 - DNA, 25 bp, Mus musculus
gtagcttgctactctggaactcact

SEQ ID NO: 671806 - DNA, 25 bp, Mus musculus
gtagcttggaacacggagagcctcc

SEQ ID NO: 671807 - DNA, 25 bp, Mus musculus
gtagcttggaactcggagagcctcc

SEQ ID NO: 671808 - DNA, 25 bp, Mus musculus
gtagcttggacaccagaccctgagg

SEQ ID NO: 671809 - DNA, 25 bp, Mus musculus
gtagcttggacagcagaccctgagg

SEQ ID NO: 671810 - DNA, 25 bp, Mus musculus
gtagcttgggctccagcttctactc

SEQ ID NO: 671811 - DNA, 25 bp, Mus musculus
gtagcttgggctcgccttttggtat

SEQ ID NO: 671812 - DNA, 25 bp, Mus musculus
gtagcttgggctgcagcttctactc

SEQ ID NO: 671813 - DNA, 25 bp, Mus musculus
gtagcttgggctggccttttggtat

SEQ ID NO: 671814 - DNA, 25 bp, Mus musculus
gtagcttggtgccatggattatcct

SEQ ID NO: 671815 - DNA, 25 bp, Mus musculus
gtagcttggtgcgatggattatcct

SEQ ID NO: 671816 - DNA, 25 bp, Mus musculus
gtagcttgtaggaagtggtattctt

SEQ ID NO: 671817 - DNA, 25 bp, Mus musculus
gtagcttgtaggtagtggtattctt

SEQ ID NO: 671818 - DNA, 25 bp, Mus musculus
gtagcttgtagtcttgaattctctt

SEQ ID NO: 671819 - DNA, 25 bp, Mus musculus
gtagcttgtagtgttgaattctctt

SEQ ID NO: 671820 - DNA, 25 bp, Mus musculus
gtagcttgtcagattcaccatgcta

SEQ ID NO: 671821 - DNA, 25 bp, Mus musculus
gtagcttgtcagtttcaccatgcta

SEQ ID NO: 671822 - DNA, 25 bp, Mus musculus
gtagcttgttaccatgtgaatttgt

SEQ ID NO: 671823 - DNA, 25 bp, Mus musculus
gtagcttgttacgatgtgaatttgt

SEQ ID NO: 671824 - DNA, 25 bp, Mus musculus
gtagctttaacactagtgacccctg

SEQ ID NO: 671825 - DNA, 25 bp, Mus musculus
gtagctttaacagtagtgacccctg

SEQ ID NO: 671826 - DNA, 25 bp, Mus musculus
gtagctttaattagccttcctcaat

SEQ ID NO: 671827 - DNA, 25 bp, Mus musculus
gtagctttaatttgccttcctcaat

SEQ ID NO: 671828 - DNA, 25 bp, Mus musculus
gtagctttagctacactgtgaattc

SEQ ID NO: 671829 - DNA, 25 bp, Mus musculus
gtagctttagcttcactgtgaattc

SEQ ID NO: 671830 - DNA, 25 bp, Mus musculus
gtagctttagtacactcaggaaaaa

SEQ ID NO: 671831 - DNA, 25 bp, Mus musculus
gtagctttagtagactcaggaaaaa

SEQ ID NO: 671832 - DNA, 25 bp, Mus musculus
gtagctttattaccagcacttaaca

SEQ ID NO: 671833 - DNA, 25 bp, Mus musculus
gtagctttattagcagcacttaaca

SEQ ID NO: 671834 - DNA, 25 bp, Mus musculus
gtagctttatttctatttgcacctt

SEQ ID NO: 671835 - DNA, 25 bp, Mus musculus
gtagctttatttgtatttgcacctt

SEQ ID NO: 671836 - DNA, 25 bp, Mus musculus
gtagctttcagtaatcgacagttgt

SEQ ID NO: 671837 - DNA, 25 bp, Mus musculus
gtagctttcagtccggtgttaaatt

SEQ ID NO: 671838 - DNA, 25 bp, Mus musculus
gtagctttcagtgcggtgttaaatt

SEQ ID NO: 671839 - DNA, 25 bp, Mus musculus
gtagctttcagttatcgacagttgt

SEQ ID NO: 671840 - DNA, 25 bp, Mus musculus
gtagctttccagatggtttattgat

SEQ ID NO: 671841 - DNA, 25 bp, Mus musculus
gtagctttccagttggtttattgat

SEQ ID NO: 671842 - DNA, 25 bp, Mus musculus
gtagctttccctcctgcctttctta

SEQ ID NO: 671843 - DNA, 25 bp, Mus musculus
gtagctttccctgctgcctttctta

SEQ ID NO: 671844 - DNA, 25 bp, Mus musculus
gtagctttcctcacatttgacaatg

SEQ ID NO: 671845 - DNA, 25 bp, Mus musculus
gtagctttcctctcatttgacaatg

SEQ ID NO: 671846 - DNA, 25 bp, Mus musculus
gtagctttcctgatacaaattcctg

SEQ ID NO: 671847 - DNA, 25 bp, Mus musculus
gtagctttcctgttacaaattcctg

SEQ ID NO: 671848 - DNA, 25 bp, Mus musculus
gtagctttgaaccatgtccagacta

SEQ ID NO: 671849 - DNA, 25 bp, Mus musculus
gtagctttgaacgatgtccagacta

SEQ ID NO: 671850 - DNA, 25 bp, Mus musculus
gtagctttgagaaatcacttgttcc

SEQ ID NO: 671851 - DNA, 25 bp, Mus musculus
gtagctttgagatatcacttgttcc

SEQ ID NO: 671852 - DNA, 25 bp, Mus musculus
gtagctttgagcaatcctgttaact

SEQ ID NO: 671853 - DNA, 25 bp, Mus musculus
gtagctttgagctatcctgttaact

SEQ ID NO: 671854 - DNA, 25 bp, Mus musculus
gtagctttgagtccatccactgcca

SEQ ID NO: 671855 - DNA, 25 bp, Mus musculus
gtagctttgagtgcatccactgcca

SEQ ID NO: 671856 - DNA, 25 bp, Mus musculus
gtagctttgcagaaggagctggctt

SEQ ID NO: 671857 - DNA, 25 bp, Mus musculus
gtagctttgcagtaggagctggctt

SEQ ID NO: 671858 - DNA, 25 bp, Mus musculus
gtagctttgctgattctgggtcctt

SEQ ID NO: 671859 - DNA, 25 bp, Mus musculus
gtagctttgctgtttctgggtcctt

SEQ ID NO: 671860 - DNA, 25 bp, Mus musculus
gtagcttttaccctgagcatggtta

SEQ ID NO: 671861 - DNA, 25 bp, Mus musculus
gtagcttttaccgtgagcatggtta

SEQ ID NO: 671862 - DNA, 25 bp, Mus musculus
gtagcttttagcaagtagctgtgaa

SEQ ID NO: 671863 - DNA, 25 bp, Mus musculus
gtagcttttagctagtagctgtgaa

SEQ ID NO: 671864 - DNA, 25 bp, Mus musculus
gtagcttttaggaactgtcagcatg

SEQ ID NO: 671865 - DNA, 25 bp, Mus musculus
gtagcttttaggtactgtcagcatg

SEQ ID NO: 671866 - DNA, 25 bp, Mus musculus
gtagcttttagtaccaggaagtcag

SEQ ID NO: 671867 - DNA, 25 bp, Mus musculus
gtagcttttagtcttgcctatctta

SEQ ID NO: 671868 - DNA, 25 bp, Mus musculus
gtagcttttagtgttgcctatctta

SEQ ID NO: 671869 - DNA, 25 bp, Mus musculus
gtagcttttagttccaggaagtcag

SEQ ID NO: 671870 - DNA, 25 bp, Mus musculus
gtagcttttcaacagtttgtgtggt

SEQ ID NO: 671871 - DNA, 25 bp, Mus musculus
gtagcttttcaagagtttgtgtggt

SEQ ID NO: 671872 - DNA, 25 bp, Mus musculus
gtagcttttcagaagctatctacct

SEQ ID NO: 671873 - DNA, 25 bp, Mus musculus
gtagcttttcagtagctatctacct

SEQ ID NO: 671874 - DNA, 25 bp, Mus musculus
gtagcttttgatagttattggatct

SEQ ID NO: 671875 - DNA, 25 bp, Mus musculus
gtagcttttgattgttattggatct

SEQ ID NO: 671876 - DNA, 25 bp, Mus musculus
gtagcttttgcaacttcatggagaa

SEQ ID NO: 671877 - DNA, 25 bp, Mus musculus
gtagcttttgcatcttcatggagaa

SEQ ID NO: 671878 - DNA, 25 bp, Mus musculus
gtagcttttggtaagcttcgtcact

SEQ ID NO: 671879 - DNA, 25 bp, Mus musculus
gtagcttttggttagcttcgtcact

SEQ ID NO: 671880 - DNA, 25 bp, Mus musculus
gtaggaaaaaccattgccttcactg

SEQ ID NO: 671881 - DNA, 25 bp, Mus musculus
gtaggaaaaacctttgccttcactg

SEQ ID NO: 671882 - DNA, 25 bp, Mus musculus
gtaggaaaacgactgaccgtatgca

SEQ ID NO: 671883 - DNA, 25 bp, Mus musculus
gtaggaaaacgagtgaccgtatgca

SEQ ID NO: 671884 - DNA, 25 bp, Mus musculus
gtaggaaaagtccagcaaacatctg

SEQ ID NO: 671885 - DNA, 25 bp, Mus musculus
gtaggaaaagtcgagcaaacatctg

SEQ ID NO: 671886 - DNA, 25 bp, Mus musculus
gtaggaaatttgctctttgctctca

SEQ ID NO: 671887 - DNA, 25 bp, Mus musculus
gtaggaaatttggtctttgctctca

SEQ ID NO: 671888 - DNA, 25 bp, Mus musculus
gtaggaaattttatctcaccatgtc

SEQ ID NO: 671889 - DNA, 25 bp, Mus musculus
gtaggaaattttttctcaccatgtc

SEQ ID NO: 671890 - DNA, 25 bp, Mus musculus
gtaggaacacaaattttctcttctc

SEQ ID NO: 671891 - DNA, 25 bp, Mus musculus
gtaggaacacaatttttctcttctc

SEQ ID NO: 671892 - DNA, 25 bp, Mus musculus
gtaggaacagccacatggtcttcag

SEQ ID NO: 671893 - DNA, 25 bp, Mus musculus
gtaggaacagcctcatggtcttcag

SEQ ID NO: 671894 - DNA, 25 bp, Mus musculus
gtaggaacatggatcttaactttaa

SEQ ID NO: 671895 - DNA, 25 bp, Mus musculus
gtaggaacatggttcttaactttaa

SEQ ID NO: 671896 - DNA, 25 bp, Mus musculus
gtaggaacatttcgctttacttctt

SEQ ID NO: 671897 - DNA, 25 bp, Mus musculus
gtaggaacatttggctttacttctt

SEQ ID NO: 671898 - DNA, 25 bp, Mus musculus
gtaggaaccaaacccctgtgtgcct

SEQ ID NO: 671899 - DNA, 25 bp, Mus musculus
gtaggaaccaaagccctgtgtgcct

SEQ ID NO: 671900 - DNA, 25 bp, Mus musculus
gtaggaaccattctacgagctttgt

SEQ ID NO: 671901 - DNA, 25 bp, Mus musculus
gtaggaaccattgtacgagctttgt

SEQ ID NO: 671902 - DNA, 25 bp, Mus musculus
gtaggaaccttgaggctagggccca

SEQ ID NO: 671903 - DNA, 25 bp, Mus musculus
gtaggaaccttgtggctagggccca

SEQ ID NO: 671904 - DNA, 25 bp, Mus musculus
gtaggaactcatcccaagtacataa

SEQ ID NO: 671905 - DNA, 25 bp, Mus musculus
gtaggaactcatgccaagtacataa

SEQ ID NO: 671906 - DNA, 25 bp, Mus musculus
gtaggaactgctctttggttttagt

SEQ ID NO: 671907 - DNA, 25 bp, Mus musculus
gtaggaactgctgtttggttttagt

SEQ ID NO: 671908 - DNA, 25 bp, Mus musculus
gtaggaagagcacgccctaacccag

SEQ ID NO: 671909 - DNA, 25 bp, Mus musculus
gtaggaagagcaggccctaacccag

SEQ ID NO: 671910 - DNA, 25 bp, Mus musculus
gtaggaagagtccaggcctagtctt

SEQ ID NO: 671911 - DNA, 25 bp, Mus musculus
gtaggaagagtcgaggcctagtctt

SEQ ID NO: 671912 - DNA, 25 bp, Mus musculus
gtaggaagctacactattcatcaat

SEQ ID NO: 671913 - DNA, 25 bp, Mus musculus
gtaggaagctactctattcatcaat

SEQ ID NO: 671914 - DNA, 25 bp, Mus musculus
gtaggaagcttgagcccagagccct

SEQ ID NO: 671915 - DNA, 25 bp, Mus musculus
gtaggaagcttgtgcccagagccct

SEQ ID NO: 671916 - DNA, 25 bp, Mus musculus
gtaggaaggcttctcacatctttca

SEQ ID NO: 671917 - DNA, 25 bp, Mus musculus
gtaggaaggcttgtcacatctttca

SEQ ID NO: 671918 - DNA, 25 bp, Mus musculus
gtaggaatcaaaccctgccacctgc

SEQ ID NO: 671919 - DNA, 25 bp, Mus musculus
gtaggaatcaaagcctgccacctgc

SEQ ID NO: 671920 - DNA, 25 bp, Mus musculus
gtaggaatctctaacgtcatgcata

SEQ ID NO: 671921 - DNA, 25 bp, Mus musculus
gtaggaatctcttacgtcatgcata

SEQ ID NO: 671922 - DNA, 25 bp, Mus musculus
gtaggaatcttgacggtttctggaa

SEQ ID NO: 671923 - DNA, 25 bp, Mus musculus
gtaggaatcttgtcggtttctggaa

SEQ ID NO: 671924 - DNA, 25 bp, Mus musculus
gtaggaatggccactataggctcat

SEQ ID NO: 671925 - DNA, 25 bp, Mus musculus
gtaggaatggcctctataggctcat

SEQ ID NO: 671926 - DNA, 25 bp, Mus musculus
gtaggaatgttgctgatcataagaa

SEQ ID NO: 671927 - DNA, 25 bp, Mus musculus
gtaggaatgttggtgatcataagaa

SEQ ID NO: 671928 - DNA, 25 bp, Mus musculus
gtaggaattatgatagtacctgttc

SEQ ID NO: 671929 - DNA, 25 bp, Mus musculus
gtaggaattatgttagtacctgttc

SEQ ID NO: 671930 - DNA, 25 bp, Mus musculus
gtaggacaaacacacacttccccaa

SEQ ID NO: 671931 - DNA, 25 bp, Mus musculus
gtaggacaaacagacacttccccaa

SEQ ID NO: 671932 - DNA, 25 bp, Mus musculus
gtaggacaacagacgccagacttcc

SEQ ID NO: 671933 - DNA, 25 bp, Mus musculus
gtaggacaacagtcgccagacttcc

SEQ ID NO: 671934 - DNA, 25 bp, Mus musculus
gtaggacaccataatgcctcacgca

SEQ ID NO: 671935 - DNA, 25 bp, Mus musculus
gtaggacaccattatgcctcacgca

SEQ ID NO: 671936 - DNA, 25 bp, Mus musculus
gtaggacaccttaatgacaacatct

SEQ ID NO: 671937 - DNA, 25 bp, Mus musculus
gtaggacacctttatgacaacatct

SEQ ID NO: 671938 - DNA, 25 bp, Mus musculus
gtaggacagtgcagctcagggaata

SEQ ID NO: 671939 - DNA, 25 bp, Mus musculus
gtaggacagtgctgctcagggaata

SEQ ID NO: 671940 - DNA, 25 bp, Mus musculus
gtaggaccagatatcaacaccaata

SEQ ID NO: 671941 - DNA, 25 bp, Mus musculus
gtaggaccagatttcaacaccaata

SEQ ID NO: 671942 - DNA, 25 bp, Mus musculus
gtaggaccagggagtggcttcccaa

SEQ ID NO: 671943 - DNA, 25 bp, Mus musculus
gtaggaccagggtgtggcttcccaa

SEQ ID NO: 671944 - DNA, 25 bp, Mus musculus
gtaggaccattgatacatcctcata

SEQ ID NO: 671945 - DNA, 25 bp, Mus musculus
gtaggaccattgttacatcctcata

SEQ ID NO: 671946 - DNA, 25 bp, Mus musculus
gtaggacctcagattcaacatccaa

SEQ ID NO: 671947 - DNA, 25 bp, Mus musculus
gtaggacctcagcagttttataatc

SEQ ID NO: 671948 - DNA, 25 bp, Mus musculus
gtaggacctcaggagttttataatc

SEQ ID NO: 671949 - DNA, 25 bp, Mus musculus
gtaggacctcagtttcaacatccaa

SEQ ID NO: 671950 - DNA, 25 bp, Mus musculus
gtaggacctgcaagacattctcttt

SEQ ID NO: 671951 - DNA, 25 bp, Mus musculus
gtaggacctgcatgacattctcttt

SEQ ID NO: 671952 - DNA, 25 bp, Mus musculus
gtaggaccttgtccctgtcatataa

SEQ ID NO: 671953 - DNA, 25 bp, Mus musculus
gtaggaccttgtgcctgtcatataa

SEQ ID NO: 671954 - DNA, 25 bp, Mus musculus
gtaggacgagagaagacccatcaag

SEQ ID NO: 671955 - DNA, 25 bp, Mus musculus
gtaggacgagagtagacccatcaag

SEQ ID NO: 671956 - DNA, 25 bp, Mus musculus
gtaggacgccccactcatgagggtg

SEQ ID NO: 671957 - DNA, 25 bp, Mus musculus
gtaggacgcccctctcatgagggtg

SEQ ID NO: 671958 - DNA, 25 bp, Mus musculus
gtaggactcagtaaacctggataga

SEQ ID NO: 671959 - DNA, 25 bp, Mus musculus
gtaggactcagttaacctggataga

SEQ ID NO: 671960 - DNA, 25 bp, Mus musculus
gtaggactccatactcagtgacagg

SEQ ID NO: 671961 - DNA, 25 bp, Mus musculus
gtaggactccattctcagtgacagg

SEQ ID NO: 671962 - DNA, 25 bp, Mus musculus
gtaggactcgagataacccacattt

SEQ ID NO: 671963 - DNA, 25 bp, Mus musculus
gtaggactcgagttaacccacattt

SEQ ID NO: 671964 - DNA, 25 bp, Mus musculus
gtaggactctacagaaaatatgaag

SEQ ID NO: 671965 - DNA, 25 bp, Mus musculus
gtaggactctactgaaaatatgaag

SEQ ID NO: 671966 - DNA, 25 bp, Mus musculus
gtaggactctcaaaatctgaacttt

SEQ ID NO: 671967 - DNA, 25 bp, Mus musculus
gtaggactctcataatctgaacttt

SEQ ID NO: 671968 - DNA, 25 bp, Mus musculus
gtaggactgagcagaccttatttct

SEQ ID NO: 671969 - DNA, 25 bp, Mus musculus
gtaggactgagcataagaacacttc

SEQ ID NO: 671970 - DNA, 25 bp, Mus musculus
gtaggactgagctgaccttatttct

SEQ ID NO: 671971 - DNA, 25 bp, Mus musculus
gtaggactgagcttaagaacacttc

SEQ ID NO: 671972 - DNA, 25 bp, Mus musculus
gtaggactggaacatgccctagcca

SEQ ID NO: 671973 - DNA, 25 bp, Mus musculus
gtaggactggaagatgccctagcca

SEQ ID NO: 671974 - DNA, 25 bp, Mus musculus
gtaggactggttctgctaggcactc

SEQ ID NO: 671975 - DNA, 25 bp, Mus musculus
gtaggactggttgtgctaggcactc

SEQ ID NO: 671976 - DNA, 25 bp, Mus musculus
gtaggactgtacacccatttacatg

SEQ ID NO: 671977 - DNA, 25 bp, Mus musculus
gtaggactgtactcccatttacatg

SEQ ID NO: 671978 - DNA, 25 bp, Mus musculus
gtaggactgtagaactgtagaggaa

SEQ ID NO: 671979 - DNA, 25 bp, Mus musculus
gtaggactgtagtactgtagaggaa

SEQ ID NO: 671980 - DNA, 25 bp, Mus musculus
gtaggactgttcaggtattgtgtta

SEQ ID NO: 671981 - DNA, 25 bp, Mus musculus
gtaggactgttctggtattgtgtta

SEQ ID NO: 671982 - DNA, 25 bp, Mus musculus
gtaggacttaatattcctccgaaga

SEQ ID NO: 671983 - DNA, 25 bp, Mus musculus
gtaggacttaattttcctccgaaga

SEQ ID NO: 671984 - DNA, 25 bp, Mus musculus
gtaggacttcagaggccctttgata

SEQ ID NO: 671985 - DNA, 25 bp, Mus musculus
gtaggacttcagtggccctttgata

SEQ ID NO: 671986 - DNA, 25 bp, Mus musculus
gtaggacttctacggacaaacaact

SEQ ID NO: 671987 - DNA, 25 bp, Mus musculus
gtaggacttctagggacaaacaact

SEQ ID NO: 671988 - DNA, 25 bp, Mus musculus
gtaggacttctgatccatagtcagg

SEQ ID NO: 671989 - DNA, 25 bp, Mus musculus
gtaggacttctgttccatagtcagg

SEQ ID NO: 671990 - DNA, 25 bp, Mus musculus
gtaggacttgtgcatgcacctccat

SEQ ID NO: 671991 - DNA, 25 bp, Mus musculus
gtaggacttgtggatgcacctccat

SEQ ID NO: 671992 - DNA, 25 bp, Mus musculus
gtaggactttgcaagtccctatgct

SEQ ID NO: 671993 - DNA, 25 bp, Mus musculus
gtaggactttgctagtccctatgct

SEQ ID NO: 671994 - DNA, 25 bp, Mus musculus
gtaggagacaaaccttactggaaag

SEQ ID NO: 671995 - DNA, 25 bp, Mus musculus
gtaggagacaaagcttactggaaag

SEQ ID NO: 671996 - DNA, 25 bp, Mus musculus
gtaggagacagcactcaacttcacc

SEQ ID NO: 671997 - DNA, 25 bp, Mus musculus
gtaggagacagctctcaacttcacc

SEQ ID NO: 671998 - DNA, 25 bp, Mus musculus
gtaggagacagtcgcttgctcaaaa

SEQ ID NO: 671999 - DNA, 25 bp, Mus musculus
gtaggagacagtggcttgctcaaaa

SEQ ID NO: 672000 - DNA, 25 bp, Mus musculus
gtaggagaccgacgctgcatctctg

SEQ ID NO: 672001 - DNA, 25 bp, Mus musculus
gtaggagaccgaggctgcatctctg

SEQ ID NO: 672002 - DNA, 25 bp, Mus musculus
gtaggagagttgactccttggttaa

SEQ ID NO: 672003 - DNA, 25 bp, Mus musculus
gtaggagagttgtctccttggttaa

SEQ ID NO: 672004 - DNA, 25 bp, Mus musculus
gtaggagatctccaaaccccgggct

SEQ ID NO: 672005 - DNA, 25 bp, Mus musculus
gtaggagatctcgaaaccccgggct

SEQ ID NO: 672006 - DNA, 25 bp, Mus musculus
gtaggagatgacctgaatacccagt

SEQ ID NO: 672007 - DNA, 25 bp, Mus musculus
gtaggagatgacgtgaatacccagt

SEQ ID NO: 672008 - DNA, 25 bp, Mus musculus
gtaggagattatatgactgtgattt

SEQ ID NO: 672009 - DNA, 25 bp, Mus musculus
gtaggagattatttgactgtgattt

SEQ ID NO: 672010 - DNA, 25 bp, Mus musculus
gtaggagcactgcttcccactgtat

SEQ ID NO: 672011 - DNA, 25 bp, Mus musculus
gtaggagcactggttcccactgtat

SEQ ID NO: 672012 - DNA, 25 bp, Mus musculus
gtaggagcagttcactgtcttcctc

SEQ ID NO: 672013 - DNA, 25 bp, Mus musculus
gtaggagcagttgactgtcttcctc

SEQ ID NO: 672014 - DNA, 25 bp, Mus musculus
gtaggagcatgcaatgatctgtttc

SEQ ID NO: 672015 - DNA, 25 bp, Mus musculus
gtaggagcatgctatgatctgtttc

SEQ ID NO: 672016 - DNA, 25 bp, Mus musculus
gtaggagcattccaaggcttgccta

SEQ ID NO: 672017 - DNA, 25 bp, Mus musculus
gtaggagcattcgaaggcttgccta

SEQ ID NO: 672018 - DNA, 25 bp, Mus musculus
gtaggagccagtaaactttctgtta

SEQ ID NO: 672019 - DNA, 25 bp, Mus musculus
gtaggagccagttaactttctgtta

SEQ ID NO: 672020 - DNA, 25 bp, Mus musculus
gtaggagcctaactcttcttctctg

SEQ ID NO: 672021 - DNA, 25 bp, Mus musculus
gtaggagcctaagtcttcttctctg

SEQ ID NO: 672022 - DNA, 25 bp, Mus musculus
gtaggagctaacagcattaaatatg

SEQ ID NO: 672023 - DNA, 25 bp, Mus musculus
gtaggagctaactgcattaaatatg

SEQ ID NO: 672024 - DNA, 25 bp, Mus musculus
gtaggagctccacattctggtattg

SEQ ID NO: 672025 - DNA, 25 bp, Mus musculus
gtaggagctccagattctggtattg

SEQ ID NO: 672026 - DNA, 25 bp, Mus musculus
gtaggagctgaaatccatgctgagc

SEQ ID NO: 672027 - DNA, 25 bp, Mus musculus
gtaggagctgaattccatgctgagc

SEQ ID NO: 672028 - DNA, 25 bp, Mus musculus
gtaggagcttagactctcacatctc

SEQ ID NO: 672029 - DNA, 25 bp, Mus musculus
gtaggagcttagtctctcacatctc

SEQ ID NO: 672030 - DNA, 25 bp, Mus musculus
gtaggagcttgccatttctaaggaa

SEQ ID NO: 672031 - DNA, 25 bp, Mus musculus
gtaggagcttgcgatttctaaggaa

SEQ ID NO: 672032 - DNA, 25 bp, Mus musculus
gtaggaggacttcgtttattcatca

SEQ ID NO: 672033 - DNA, 25 bp, Mus musculus
gtaggaggacttggtttattcatca

SEQ ID NO: 672034 - DNA, 25 bp, Mus musculus
gtaggaggtatgaaactgtgtattt

SEQ ID NO: 672035 - DNA, 25 bp, Mus musculus
gtaggaggtatgtaactgtgtattt

SEQ ID NO: 672036 - DNA, 25 bp, Mus musculus
gtaggagtcagaactcagtacactt

SEQ ID NO: 672037 - DNA, 25 bp, Mus musculus
gtaggagtcagatctcagtacactt

SEQ ID NO: 672038 - DNA, 25 bp, Mus musculus
gtaggagtccttactgtcatgacac

SEQ ID NO: 672039 - DNA, 25 bp, Mus musculus
gtaggagtcctttctgtcatgacac

SEQ ID NO: 672040 - DNA, 25 bp, Mus musculus
gtaggagtctgacatcagtcaccag

SEQ ID NO: 672041 - DNA, 25 bp, Mus musculus
gtaggagtctgagatcagtcaccag

SEQ ID NO: 672042 - DNA, 25 bp, Mus musculus
gtaggagtggtgctcacacatctaa

SEQ ID NO: 672043 - DNA, 25 bp, Mus musculus
gtaggagtggtggtcacacatctaa

SEQ ID NO: 672044 - DNA, 25 bp, Mus musculus
gtaggagtggttctatatctgttaa

SEQ ID NO: 672045 - DNA, 25 bp, Mus musculus
gtaggagtggttgtatatctgttaa

SEQ ID NO: 672046 - DNA, 25 bp, Mus musculus
gtaggagttgtgcactttgcccaac

SEQ ID NO: 672047 - DNA, 25 bp, Mus musculus
gtaggagttgtggactttgcccaac

SEQ ID NO: 672048 - DNA, 25 bp, Mus musculus
gtaggagtttacagtaccacacaca

SEQ ID NO: 672049 - DNA, 25 bp, Mus musculus
gtaggagtttactgtaccacacaca

SEQ ID NO: 672050 - DNA, 25 bp, Mus musculus
gtaggataagtcacccttgggagtt

SEQ ID NO: 672051 - DNA, 25 bp, Mus musculus
gtaggataagtctcccttgggagtt

SEQ ID NO: 672052 - DNA, 25 bp, Mus musculus
gtaggatcaaacagcaatctgctta

SEQ ID NO: 672053 - DNA, 25 bp, Mus musculus
gtaggatcaaactgcaatctgctta

SEQ ID NO: 672054 - DNA, 25 bp, Mus musculus
gtaggatcatcacagttaggtctca

SEQ ID NO: 672055 - DNA, 25 bp, Mus musculus
gtaggatcatcagagttaggtctca

SEQ ID NO: 672056 - DNA, 25 bp, Mus musculus
gtaggatcatccagattgctaatca

SEQ ID NO: 672057 - DNA, 25 bp, Mus musculus
gtaggatcatcctgattgctaatca

SEQ ID NO: 672058 - DNA, 25 bp, Mus musculus
gtaggatcatggatcaagtgacaat

SEQ ID NO: 672059 - DNA, 25 bp, Mus musculus
gtaggatcatggttcaagtgacaat

SEQ ID NO: 672060 - DNA, 25 bp, Mus musculus
gtaggatcctctccagatttccact

SEQ ID NO: 672061 - DNA, 25 bp, Mus musculus
gtaggatcctctgcagatttccact

SEQ ID NO: 672062 - DNA, 25 bp, Mus musculus
gtaggatcctgtctcaagcacaccg

SEQ ID NO: 672063 - DNA, 25 bp, Mus musculus
gtaggatcctgtgtcaagcacaccg

SEQ ID NO: 672064 - DNA, 25 bp, Mus musculus
gtaggatctacacccttgtctgtgg

SEQ ID NO: 672065 - DNA, 25 bp, Mus musculus
gtaggatctacagccttgtctgtgg

SEQ ID NO: 672066 - DNA, 25 bp, Mus musculus
gtaggatctgaaactcattaagaga

SEQ ID NO: 672067 - DNA, 25 bp, Mus musculus
gtaggatctgaatctcattaagaga

SEQ ID NO: 672068 - DNA, 25 bp, Mus musculus
gtaggatgacgactgcacatttttt

SEQ ID NO: 672069 - DNA, 25 bp, Mus musculus
gtaggatgacgagtgcacatttttt

SEQ ID NO: 672070 - DNA, 25 bp, Mus musculus
gtaggatgagttatcttgcttcttc

SEQ ID NO: 672071 - DNA, 25 bp, Mus musculus
gtaggatgagttttcttgcttcttc

SEQ ID NO: 672072 - DNA, 25 bp, Mus musculus
gtaggatgcaagaaccaaaccaacc

SEQ ID NO: 672073 - DNA, 25 bp, Mus musculus
gtaggatgcaagtaccaaaccaacc

SEQ ID NO: 672074 - DNA, 25 bp, Mus musculus
gtaggatgcagcaccatgaactcat

SEQ ID NO: 672075 - DNA, 25 bp, Mus musculus
gtaggatgcagctccatgaactcat

SEQ ID NO: 672076 - DNA, 25 bp, Mus musculus
gtaggatgccataaagagtctgttt

SEQ ID NO: 672077 - DNA, 25 bp, Mus musculus
gtaggatgccattaagagtctgttt

SEQ ID NO: 672078 - DNA, 25 bp, Mus musculus
gtaggatggctgagctgtaccctca

SEQ ID NO: 672079 - DNA, 25 bp, Mus musculus
gtaggatggctgtgctgtaccctca

SEQ ID NO: 672080 - DNA, 25 bp, Mus musculus
gtaggatggtgcctttcagtttgta

SEQ ID NO: 672081 - DNA, 25 bp, Mus musculus
gtaggatggtgcgtttcagtttgta

SEQ ID NO: 672082 - DNA, 25 bp, Mus musculus
gtaggatggtttaatgcatatttca

SEQ ID NO: 672083 - DNA, 25 bp, Mus musculus
gtaggatggttttatgcatatttca

SEQ ID NO: 672084 - DNA, 25 bp, Mus musculus
gtaggatgtgtaccaggattccaaa

SEQ ID NO: 672085 - DNA, 25 bp, Mus musculus
gtaggatgtgtagcaggattccaaa

SEQ ID NO: 672086 - DNA, 25 bp, Mus musculus
gtaggatgtgtccagcactagtctg

SEQ ID NO: 672087 - DNA, 25 bp, Mus musculus
gtaggatgtgtcgagcactagtctg

SEQ ID NO: 672088 - DNA, 25 bp, Mus musculus
gtaggattacagcagcatatagcat

SEQ ID NO: 672089 - DNA, 25 bp, Mus musculus
gtaggattacaggagcatatagcat

SEQ ID NO: 672090 - DNA, 25 bp, Mus musculus
gtaggattagcgcttcttcagatga

SEQ ID NO: 672091 - DNA, 25 bp, Mus musculus
gtaggattagcggttcttcagatga

SEQ ID NO: 672092 - DNA, 25 bp, Mus musculus
gtaggattccctatgaattgtgtac

SEQ ID NO: 672093 - DNA, 25 bp, Mus musculus
gtaggattccctatttcatatagtt

SEQ ID NO: 672094 - DNA, 25 bp, Mus musculus
gtaggattccctcgagttaggcata

SEQ ID NO: 672095 - DNA, 25 bp, Mus musculus
gtaggattccctggagttaggcata

SEQ ID NO: 672096 - DNA, 25 bp, Mus musculus
gtaggattccctttgaattgtgtac

SEQ ID NO: 672097 - DNA, 25 bp, Mus musculus
gtaggattccctttttcatatagtt

SEQ ID NO: 672098 - DNA, 25 bp, Mus musculus
gtaggattccgaagccgaactggga

SEQ ID NO: 672099 - DNA, 25 bp, Mus musculus
gtaggattccgatgccgaactggga

SEQ ID NO: 672100 - DNA, 25 bp, Mus musculus
gtaggattcgtccaatcctggccag

SEQ ID NO: 672101 - DNA, 25 bp, Mus musculus
gtaggattcgtcgaatcctggccag

SEQ ID NO: 672102 - DNA, 25 bp, Mus musculus
gtaggattctaaatcttctcttgtt

SEQ ID NO: 672103 - DNA, 25 bp, Mus musculus
gtaggattctaattcttctcttgtt

SEQ ID NO: 672104 - DNA, 25 bp, Mus musculus
gtaggattgtgaattctgatgcagg

SEQ ID NO: 672105 - DNA, 25 bp, Mus musculus
gtaggattgtgatttctgatgcagg

SEQ ID NO: 672106 - DNA, 25 bp, Mus musculus
gtaggatttcttcacctgttgattg

SEQ ID NO: 672107 - DNA, 25 bp, Mus musculus
gtaggatttcttgacctgttgattg

SEQ ID NO: 672108 - DNA, 25 bp, Mus musculus
gtaggatttgctatggactcatgct

SEQ ID NO: 672109 - DNA, 25 bp, Mus musculus
gtaggatttgctttggactcatgct

SEQ ID NO: 672110 - DNA, 25 bp, Mus musculus
gtaggatttgtcagaaccccccata

SEQ ID NO: 672111 - DNA, 25 bp, Mus musculus
gtaggatttgtctgaaccccccata

SEQ ID NO: 672112 - DNA, 25 bp, Mus musculus
gtaggatttttaccacccatgtgtt

SEQ ID NO: 672113 - DNA, 25 bp, Mus musculus
gtaggatttttagcacccatgtgtt

SEQ ID NO: 672114 - DNA, 25 bp, Mus musculus
gtaggatttttcacgcgatcacaca

SEQ ID NO: 672115 - DNA, 25 bp, Mus musculus
gtaggatttttctcgcgatcacaca

SEQ ID NO: 672116 - DNA, 25 bp, Mus musculus
gtaggcaaactcacttctgactgat

SEQ ID NO: 672117 - DNA, 25 bp, Mus musculus
gtaggcaaactctcttctgactgat

SEQ ID NO: 672118 - DNA, 25 bp, Mus musculus
gtaggcaactcaaccattaggattt

SEQ ID NO: 672119 - DNA, 25 bp, Mus musculus
gtaggcaactcatccattaggattt

SEQ ID NO: 672120 - DNA, 25 bp, Mus musculus
gtaggcaactgtattcttagttaca

SEQ ID NO: 672121 - DNA, 25 bp, Mus musculus
gtaggcaactgttttcttagttaca

SEQ ID NO: 672122 - DNA, 25 bp, Mus musculus
gtaggcaagagcagacgagccctta

SEQ ID NO: 672123 - DNA, 25 bp, Mus musculus
gtaggcaagagctgacgagccctta

SEQ ID NO: 672124 - DNA, 25 bp, Mus musculus
gtaggcaaggccctcaagatggctt

SEQ ID NO: 672125 - DNA, 25 bp, Mus musculus
gtaggcaaggccgtcaagatggctt

SEQ ID NO: 672126 - DNA, 25 bp, Mus musculus
gtaggcaagttccttcatgtggagt

SEQ ID NO: 672127 - DNA, 25 bp, Mus musculus
gtaggcaagttcgttcatgtggagt

SEQ ID NO: 672128 - DNA, 25 bp, Mus musculus
gtaggcaatactacagattttaaca

SEQ ID NO: 672129 - DNA, 25 bp, Mus musculus
gtaggcaatacttcagattttaaca

SEQ ID NO: 672130 - DNA, 25 bp, Mus musculus
gtaggcacaggcctttctcactgaa

SEQ ID NO: 672131 - DNA, 25 bp, Mus musculus
gtaggcacaggcgtttctcactgaa

SEQ ID NO: 672132 - DNA, 25 bp, Mus musculus
gtaggcacattacagcactctgctc

SEQ ID NO: 672133 - DNA, 25 bp, Mus musculus
gtaggcacattagagcactctgctc

SEQ ID NO: 672134 - DNA, 25 bp, Mus musculus
gtaggcaccacaatctgatctggac

SEQ ID NO: 672135 - DNA, 25 bp, Mus musculus
gtaggcaccacattctgatctggac

SEQ ID NO: 672136 - DNA, 25 bp, Mus musculus
gtaggcacccatatacaacagattg

SEQ ID NO: 672137 - DNA, 25 bp, Mus musculus
gtaggcacccatttacaacagattg

SEQ ID NO: 672138 - DNA, 25 bp, Mus musculus
gtaggcacctacatagtgtatcttg

SEQ ID NO: 672139 - DNA, 25 bp, Mus musculus
gtaggcacctacttagtgtatcttg

SEQ ID NO: 672140 - DNA, 25 bp, Mus musculus
gtaggcaccttaactggagactgaa

SEQ ID NO: 672141 - DNA, 25 bp, Mus musculus
gtaggcaccttatctggagactgaa

SEQ ID NO: 672142 - DNA, 25 bp, Mus musculus
gtaggcactcctactgttggcttct

SEQ ID NO: 672143 - DNA, 25 bp, Mus musculus
gtaggcactccttctgttggcttct

SEQ ID NO: 672144 - DNA, 25 bp, Mus musculus
gtaggcactctaagcgggatcctgg

SEQ ID NO: 672145 - DNA, 25 bp, Mus musculus
gtaggcactctatgcgggatcctgg

SEQ ID NO: 672146 - DNA, 25 bp, Mus musculus
gtaggcactttcatattgcctggcc

SEQ ID NO: 672147 - DNA, 25 bp, Mus musculus
gtaggcactttcttattgcctggcc

SEQ ID NO: 672148 - DNA, 25 bp, Mus musculus
gtaggcagcaatatccttctcgtac

SEQ ID NO: 672149 - DNA, 25 bp, Mus musculus
gtaggcagcaatttccttctcgtac

SEQ ID NO: 672150 - DNA, 25 bp, Mus musculus
gtaggcagcagaattccatggagtc

SEQ ID NO: 672151 - DNA, 25 bp, Mus musculus
gtaggcagcagatttccatggagtc

SEQ ID NO: 672152 - DNA, 25 bp, Mus musculus
gtaggcagcatgaaagtcccaggaa

SEQ ID NO: 672153 - DNA, 25 bp, Mus musculus
gtaggcagcatgtaagtcccaggaa

SEQ ID NO: 672154 - DNA, 25 bp, Mus musculus
gtaggcagcattaagcccacataat

SEQ ID NO: 672155 - DNA, 25 bp, Mus musculus
gtaggcagcatttagcccacataat

SEQ ID NO: 672156 - DNA, 25 bp, Mus musculus
gtaggcagccatcaacaatctattt

SEQ ID NO: 672157 - DNA, 25 bp, Mus musculus
gtaggcagccatgaacaatctattt

SEQ ID NO: 672158 - DNA, 25 bp, Mus musculus
gtaggcagccctcgccaaagtgaca

SEQ ID NO: 672159 - DNA, 25 bp, Mus musculus
gtaggcagccctggccaaagtgaca

SEQ ID NO: 672160 - DNA, 25 bp, Mus musculus
gtaggcagcgtgaggcgtctcagag

SEQ ID NO: 672161 - DNA, 25 bp, Mus musculus
gtaggcagcgtgtggcgtctcagag

SEQ ID NO: 672162 - DNA, 25 bp, Mus musculus
gtaggcagctggattcttttgtagt

SEQ ID NO: 672163 - DNA, 25 bp, Mus musculus
gtaggcagctggtttcttttgtagt

SEQ ID NO: 672164 - DNA, 25 bp, Mus musculus
gtaggcagctttcgcccagaccagg

SEQ ID NO: 672165 - DNA, 25 bp, Mus musculus
gtaggcagctttggcccagaccagg

SEQ ID NO: 672166 - DNA, 25 bp, Mus musculus
gtaggcaggactatgttctctgagt

SEQ ID NO: 672167 - DNA, 25 bp, Mus musculus
gtaggcaggactttgttctctgagt

SEQ ID NO: 672168 - DNA, 25 bp, Mus musculus
gtaggcaggatgcttcctctcagcc

SEQ ID NO: 672169 - DNA, 25 bp, Mus musculus
gtaggcaggatggttcctctcagcc

SEQ ID NO: 672170 - DNA, 25 bp, Mus musculus
gtaggcaggcctcattatgtgaatt

SEQ ID NO: 672171 - DNA, 25 bp, Mus musculus
gtaggcaggcctgattatgtgaatt

SEQ ID NO: 672172 - DNA, 25 bp, Mus musculus
gtaggcaggctgacacagctttgct

SEQ ID NO: 672173 - DNA, 25 bp, Mus musculus
gtaggcaggctgtcacagctttgct

SEQ ID NO: 672174 - DNA, 25 bp, Mus musculus
gtaggcagggtcagtgactccctag

SEQ ID NO: 672175 - DNA, 25 bp, Mus musculus
gtaggcagggtctgtgactccctag

SEQ ID NO: 672176 - DNA, 25 bp, Mus musculus
gtaggcaggtatatcctcactctga

SEQ ID NO: 672177 - DNA, 25 bp, Mus musculus
gtaggcaggtatttcctcactctga

SEQ ID NO: 672178 - DNA, 25 bp, Mus musculus
gtaggcagtactcggagcccctgtc

SEQ ID NO: 672179 - DNA, 25 bp, Mus musculus
gtaggcagtactgggagcccctgtc

SEQ ID NO: 672180 - DNA, 25 bp, Mus musculus
gtaggcagtattaatctgtatgaag

SEQ ID NO: 672181 - DNA, 25 bp, Mus musculus
gtaggcagtatttatctgtatgaag

SEQ ID NO: 672182 - DNA, 25 bp, Mus musculus
gtaggcataacactggccattctct

SEQ ID NO: 672183 - DNA, 25 bp, Mus musculus
gtaggcataacagtggccattctct

SEQ ID NO: 672184 - DNA, 25 bp, Mus musculus
gtaggcataggaacccctctgtggg

SEQ ID NO: 672185 - DNA, 25 bp, Mus musculus
gtaggcataggatcccctctgtggg

SEQ ID NO: 672186 - DNA, 25 bp, Mus musculus
gtaggcatatacagcatctggctga

SEQ ID NO: 672187 - DNA, 25 bp, Mus musculus
gtaggcatatactgcatctggctga

SEQ ID NO: 672188 - DNA, 25 bp, Mus musculus
gtaggcatattgacatctaaaaata

SEQ ID NO: 672189 - DNA, 25 bp, Mus musculus
gtaggcatattgtcatctaaaaata

SEQ ID NO: 672190 - DNA, 25 bp, Mus musculus
gtaggcatcataacgccatggtaac

SEQ ID NO: 672191 - DNA, 25 bp, Mus musculus
gtaggcatcatatcgccatggtaac

SEQ ID NO: 672192 - DNA, 25 bp, Mus musculus
gtaggcatcgacacctatgaggacg

SEQ ID NO: 672193 - DNA, 25 bp, Mus musculus
gtaggcatcgactcctatgaggacg

SEQ ID NO: 672194 - DNA, 25 bp, Mus musculus
gtaggcatcgccaccacagtttcct

SEQ ID NO: 672195 - DNA, 25 bp, Mus musculus
gtaggcatcgcctccacagtttcct

SEQ ID NO: 672196 - DNA, 25 bp, Mus musculus
gtaggcatgaaaacacacaccattt

SEQ ID NO: 672197 - DNA, 25 bp, Mus musculus
gtaggcatgaaatcacacaccattt

SEQ ID NO: 672198 - DNA, 25 bp, Mus musculus
gtaggcatgcttacaaagcacatgt

SEQ ID NO: 672199 - DNA, 25 bp, Mus musculus
gtaggcatgctttcaaagcacatgt

SEQ ID NO: 672200 - DNA, 25 bp, Mus musculus
gtaggcatgttcacaaagggcttaa

SEQ ID NO: 672201 - DNA, 25 bp, Mus musculus
gtaggcatgttctcaaagggcttaa

SEQ ID NO: 672202 - DNA, 25 bp, Mus musculus
gtaggcattattatccccattttat

SEQ ID NO: 672203 - DNA, 25 bp, Mus musculus
gtaggcattattttccccattttat

SEQ ID NO: 672204 - DNA, 25 bp, Mus musculus
gtaggcattggtccacagaaaccct

SEQ ID NO: 672205 - DNA, 25 bp, Mus musculus
gtaggcattggtgcacagaaaccct

SEQ ID NO: 672206 - DNA, 25 bp, Mus musculus
gtaggcattgtcatcttgcagtttt

SEQ ID NO: 672207 - DNA, 25 bp, Mus musculus
gtaggcattgtcttcttgcagtttt

SEQ ID NO: 672208 - DNA, 25 bp, Mus musculus
gtaggcatttgcctattcttgaaga

SEQ ID NO: 672209 - DNA, 25 bp, Mus musculus
gtaggcatttgcgtattcttgaaga

SEQ ID NO: 672210 - DNA, 25 bp, Mus musculus
gtaggccaaacaatcgtacatataa

SEQ ID NO: 672211 - DNA, 25 bp, Mus musculus
gtaggccaaacattcgtacatataa

SEQ ID NO: 672212 - DNA, 25 bp, Mus musculus
gtaggccaaataaagccctccatag

SEQ ID NO: 672213 - DNA, 25 bp, Mus musculus
gtaggccaaatatagccctccatag

SEQ ID NO: 672214 - DNA, 25 bp, Mus musculus
gtaggccacagaaaactcagcagtt

SEQ ID NO: 672215 - DNA, 25 bp, Mus musculus
gtaggccacagataactcagcagtt

SEQ ID NO: 672216 - DNA, 25 bp, Mus musculus
gtaggccacatgacattattatgaa

SEQ ID NO: 672217 - DNA, 25 bp, Mus musculus
gtaggccacatgtcattattatgaa

SEQ ID NO: 672218 - DNA, 25 bp, Mus musculus
gtaggccaccatcctcgaaagaata

SEQ ID NO: 672219 - DNA, 25 bp, Mus musculus
gtaggccaccatgctcgaaagaata

SEQ ID NO: 672220 - DNA, 25 bp, Mus musculus
gtaggccaccttaacaattgcttaa

SEQ ID NO: 672221 - DNA, 25 bp, Mus musculus
gtaggccacctttacaattgcttaa

SEQ ID NO: 672222 - DNA, 25 bp, Mus musculus
gtaggccacttcatccgcgaattgg

SEQ ID NO: 672223 - DNA, 25 bp, Mus musculus
gtaggccacttcttccgcgaattgg

SEQ ID NO: 672224 - DNA, 25 bp, Mus musculus
gtaggccaggccagtgttccaagaa

SEQ ID NO: 672225 - DNA, 25 bp, Mus musculus
gtaggccaggcctgtgttccaagaa

SEQ ID NO: 672226 - DNA, 25 bp, Mus musculus
gtaggccagtatagatttcccttta

SEQ ID NO: 672227 - DNA, 25 bp, Mus musculus
gtaggccagtattgatttcccttta

SEQ ID NO: 672228 - DNA, 25 bp, Mus musculus
gtaggccagtggatatttatccatg

SEQ ID NO: 672229 - DNA, 25 bp, Mus musculus
gtaggccagtggttatttatccatg

SEQ ID NO: 672230 - DNA, 25 bp, Mus musculus
gtaggccatcaaaactcagagggtg

SEQ ID NO: 672231 - DNA, 25 bp, Mus musculus
gtaggccatcaatactcagagggtg

SEQ ID NO: 672232 - DNA, 25 bp, Mus musculus
gtaggccatgtgacacttcagatca

SEQ ID NO: 672233 - DNA, 25 bp, Mus musculus
gtaggccatgtgtcacttcagatca

SEQ ID NO: 672234 - DNA, 25 bp, Mus musculus
gtaggcccaggaagttccatagtta

SEQ ID NO: 672235 - DNA, 25 bp, Mus musculus
gtaggcccaggatgttccatagtta

SEQ ID NO: 672236 - DNA, 25 bp, Mus musculus
gtaggcccaggcaagtccttttagg

SEQ ID NO: 672237 - DNA, 25 bp, Mus musculus
gtaggcccaggctagtccttttagg

SEQ ID NO: 672238 - DNA, 25 bp, Mus musculus
gtaggcccataacgttgctagcaaa

SEQ ID NO: 672239 - DNA, 25 bp, Mus musculus
gtaggcccataaggttgctagcaaa

SEQ ID NO: 672240 - DNA, 25 bp, Mus musculus
gtaggccccagcattgtagcagggc

SEQ ID NO: 672241 - DNA, 25 bp, Mus musculus
gtaggccccagctttgtagcagggc

SEQ ID NO: 672242 - DNA, 25 bp, Mus musculus
gtaggcccgacaagtcaatccatga

SEQ ID NO: 672243 - DNA, 25 bp, Mus musculus
gtaggcccgacatgtcaatccatga

SEQ ID NO: 672244 - DNA, 25 bp, Mus musculus
gtaggcccggcgacaggaatgaata

SEQ ID NO: 672245 - DNA, 25 bp, Mus musculus
gtaggcccggcgtcaggaatgaata

SEQ ID NO: 672246 - DNA, 25 bp, Mus musculus
gtaggccgactaagggcttagcttt

SEQ ID NO: 672247 - DNA, 25 bp, Mus musculus
gtaggccgactatgggcttagcttt

SEQ ID NO: 672248 - DNA, 25 bp, Mus musculus
gtaggccgcctgatgggtaaccaga

SEQ ID NO: 672249 - DNA, 25 bp, Mus musculus
gtaggccgcctgttgggtaaccaga

SEQ ID NO: 672250 - DNA, 25 bp, Mus musculus
gtaggccggctacacagtcttacaa

SEQ ID NO: 672251 - DNA, 25 bp, Mus musculus
gtaggccggctagacagtcttacaa

SEQ ID NO: 672252 - DNA, 25 bp, Mus musculus
gtaggccgggaaatgcttttcttca

SEQ ID NO: 672253 - DNA, 25 bp, Mus musculus
gtaggccgggaattgcttttcttca

SEQ ID NO: 672254 - DNA, 25 bp, Mus musculus
gtaggcctagtgatatgtcacacaa

SEQ ID NO: 672255 - DNA, 25 bp, Mus musculus
gtaggcctagtgttatgtcacacaa

SEQ ID NO: 672256 - DNA, 25 bp, Mus musculus
gtaggcctcgatcagaccctcgagt

SEQ ID NO: 672257 - DNA, 25 bp, Mus musculus
gtaggcctcgatgagaccctcgagt

SEQ ID NO: 672258 - DNA, 25 bp, Mus musculus
gtaggcctgtcaaagcaatacccca

SEQ ID NO: 672259 - DNA, 25 bp, Mus musculus
gtaggcctgtcatagcaatacccca

SEQ ID NO: 672260 - DNA, 25 bp, Mus musculus
gtaggccttcaaatacctttgtatg

SEQ ID NO: 672261 - DNA, 25 bp, Mus musculus
gtaggccttcaattacctttgtatg

SEQ ID NO: 672262 - DNA, 25 bp, Mus musculus
gtaggccttgctaccaatggagatt

SEQ ID NO: 672263 - DNA, 25 bp, Mus musculus
gtaggccttgcttccaatggagatt

SEQ ID NO: 672264 - DNA, 25 bp, Mus musculus
gtaggcgacactcttcaggtgtatg

SEQ ID NO: 672265 - DNA, 25 bp, Mus musculus
gtaggcgacactgttcaggtgtatg

SEQ ID NO: 672266 - DNA, 25 bp, Mus musculus
gtaggcgattcaaaccgggataaca

SEQ ID NO: 672267 - DNA, 25 bp, Mus musculus
gtaggcgattcataccgggataaca

SEQ ID NO: 672268 - DNA, 25 bp, Mus musculus
gtaggcgcaaatctttgtgatcaca

SEQ ID NO: 672269 - DNA, 25 bp, Mus musculus
gtaggcgcaaatgtttgtgatcaca

SEQ ID NO: 672270 - DNA, 25 bp, Mus musculus
gtaggcgccattatcaaggaatcaa

SEQ ID NO: 672271 - DNA, 25 bp, Mus musculus
gtaggcgccattttcaaggaatcaa

SEQ ID NO: 672272 - DNA, 25 bp, Mus musculus
gtaggcgtatacatcagtatccatt

SEQ ID NO: 672273 - DNA, 25 bp, Mus musculus
gtaggcgtatacttcagtatccatt

SEQ ID NO: 672274 - DNA, 25 bp, Mus musculus
gtaggcgtctgaccaccaagcatag

SEQ ID NO: 672275 - DNA, 25 bp, Mus musculus
gtaggcgtctgagcaccaagcatag

SEQ ID NO: 672276 - DNA, 25 bp, Mus musculus
gtaggcgtgcaacataatgccccga

SEQ ID NO: 672277 - DNA, 25 bp, Mus musculus
gtaggcgtgcaagataatgccccga

SEQ ID NO: 672278 - DNA, 25 bp, Mus musculus
gtaggcgtgcagctgacattaccac

SEQ ID NO: 672279 - DNA, 25 bp, Mus musculus
gtaggcgtgcaggtgacattaccac

SEQ ID NO: 672280 - DNA, 25 bp, Mus musculus
gtaggctaaaacacagtcacaggga

SEQ ID NO: 672281 - DNA, 25 bp, Mus musculus
gtaggctaaaactcagtcacaggga

SEQ ID NO: 672282 - DNA, 25 bp, Mus musculus
gtaggctaaaagaggcttccaggct

SEQ ID NO: 672283 - DNA, 25 bp, Mus musculus
gtaggctaaaagtggcttccaggct

SEQ ID NO: 672284 - DNA, 25 bp, Mus musculus
gtaggctaagcacacggatccccag

SEQ ID NO: 672285 - DNA, 25 bp, Mus musculus
gtaggctaagcagacggatccccag

SEQ ID NO: 672286 - DNA, 25 bp, Mus musculus
gtaggctaatgtataaggccatcaa

SEQ ID NO: 672287 - DNA, 25 bp, Mus musculus
gtaggctaatgtttaaggccatcaa

SEQ ID NO: 672288 - DNA, 25 bp, Mus musculus
gtaggctaccacctaattgttccat

SEQ ID NO: 672289 - DNA, 25 bp, Mus musculus
gtaggctaccacgtaattgttccat

SEQ ID NO: 672290 - DNA, 25 bp, Mus musculus
gtaggctacctaacataactctctt

SEQ ID NO: 672291 - DNA, 25 bp, Mus musculus
gtaggctacctatcataactctctt

SEQ ID NO: 672292 - DNA, 25 bp, Mus musculus
gtaggctacttgaacgcttctgaga

SEQ ID NO: 672293 - DNA, 25 bp, Mus musculus
gtaggctacttgtacgcttctgaga

SEQ ID NO: 672294 - DNA, 25 bp, Mus musculus
gtaggctaggtaaccttgcaacagc

SEQ ID NO: 672295 - DNA, 25 bp, Mus musculus
gtaggctaggtatccttgcaacagc

SEQ ID NO: 672296 - DNA, 25 bp, Mus musculus
gtaggctatatactttcatacgttg

SEQ ID NO: 672297 - DNA, 25 bp, Mus musculus
gtaggctatatagtttcatacgttg

SEQ ID NO: 672298 - DNA, 25 bp, Mus musculus
gtaggctattttacttaggaggtga

SEQ ID NO: 672299 - DNA, 25 bp, Mus musculus
gtaggctatttttcttaggaggtga

SEQ ID NO: 672300 - DNA, 25 bp, Mus musculus
gtaggctcagaaagcaggcccagaa

SEQ ID NO: 672301 - DNA, 25 bp, Mus musculus
gtaggctcagaatgcaggcccagaa

SEQ ID NO: 672302 - DNA, 25 bp, Mus musculus
gtaggctcagagatctctagggcca

SEQ ID NO: 672303 - DNA, 25 bp, Mus musculus
gtaggctcagagttctctagggcca

SEQ ID NO: 672304 - DNA, 25 bp, Mus musculus
gtaggctcatgtcatggtctgatgt

SEQ ID NO: 672305 - DNA, 25 bp, Mus musculus
gtaggctcatgtgatggtctgatgt

SEQ ID NO: 672306 - DNA, 25 bp, Mus musculus
gtaggctccctacctggtaaactct

SEQ ID NO: 672307 - DNA, 25 bp, Mus musculus
gtaggctccctagctggtaaactct

SEQ ID NO: 672308 - DNA, 25 bp, Mus musculus
gtaggctcgtataggccaaaggatg

SEQ ID NO: 672309 - DNA, 25 bp, Mus musculus
gtaggctcgtattggccaaaggatg

SEQ ID NO: 672310 - DNA, 25 bp, Mus musculus
gtaggctctaatatgtcctgaaata

SEQ ID NO: 672311 - DNA, 25 bp, Mus musculus
gtaggctctaatttgtcctgaaata

SEQ ID NO: 672312 - DNA, 25 bp, Mus musculus
gtaggctctcttcaagggtactgca

SEQ ID NO: 672313 - DNA, 25 bp, Mus musculus
gtaggctctcttgaagggtactgca

SEQ ID NO: 672314 - DNA, 25 bp, Mus musculus
gtaggctcttcaacggtggtcagca

SEQ ID NO: 672315 - DNA, 25 bp, Mus musculus
gtaggctcttcatcggtggtcagca

SEQ ID NO: 672316 - DNA, 25 bp, Mus musculus
gtaggctgaaacatagtgtctggat

SEQ ID NO: 672317 - DNA, 25 bp, Mus musculus
gtaggctgaaacttagtgtctggat

SEQ ID NO: 672318 - DNA, 25 bp, Mus musculus
gtaggctgaacacccattaacatta

SEQ ID NO: 672319 - DNA, 25 bp, Mus musculus
gtaggctgaacagccattaacatta

SEQ ID NO: 672320 - DNA, 25 bp, Mus musculus
gtaggctgcacaatttttggctttg

SEQ ID NO: 672321 - DNA, 25 bp, Mus musculus
gtaggctgcacattttttggctttg

SEQ ID NO: 672322 - DNA, 25 bp, Mus musculus
gtaggctgcataaaccactgtgtgg

SEQ ID NO: 672323 - DNA, 25 bp, Mus musculus
gtaggctgcatataccactgtgtgg

SEQ ID NO: 672324 - DNA, 25 bp, Mus musculus
gtaggctgctgcatgtcagatctaa

SEQ ID NO: 672325 - DNA, 25 bp, Mus musculus
gtaggctgctgcttgtcagatctaa

SEQ ID NO: 672326 - DNA, 25 bp, Mus musculus
gtaggctgctggaactgatttcagt

SEQ ID NO: 672327 - DNA, 25 bp, Mus musculus
gtaggctgctggtactgatttcagt

SEQ ID NO: 672328 - DNA, 25 bp, Mus musculus
gtaggctgggttatgacacaactca

SEQ ID NO: 672329 - DNA, 25 bp, Mus musculus
gtaggctgggttttgacacaactca

SEQ ID NO: 672330 - DNA, 25 bp, Mus musculus
gtaggctgtattccagttggctttt

SEQ ID NO: 672331 - DNA, 25 bp, Mus musculus
gtaggctgtattgcagttggctttt

SEQ ID NO: 672332 - DNA, 25 bp, Mus musculus
gtaggctgtcaaatgttctccttag

SEQ ID NO: 672333 - DNA, 25 bp, Mus musculus
gtaggctgtcaattgttctccttag

SEQ ID NO: 672334 - DNA, 25 bp, Mus musculus
gtaggctgtccaataaaactaagtt

SEQ ID NO: 672335 - DNA, 25 bp, Mus musculus
gtaggctgtccattaaaactaagtt

SEQ ID NO: 672336 - DNA, 25 bp, Mus musculus
gtaggctgtgtgattgcggaaaata

SEQ ID NO: 672337 - DNA, 25 bp, Mus musculus
gtaggctgtgtgtttgcggaaaata

SEQ ID NO: 672338 - DNA, 25 bp, Mus musculus
gtaggcttacccataaggcgggcag

SEQ ID NO: 672339 - DNA, 25 bp, Mus musculus
gtaggcttacccttaaggcgggcag

SEQ ID NO: 672340 - DNA, 25 bp, Mus musculus
gtaggcttagagatctgggcagctt

SEQ ID NO: 672341 - DNA, 25 bp, Mus musculus
gtaggcttagagttctgggcagctt

SEQ ID NO: 672342 - DNA, 25 bp, Mus musculus
gtaggcttagttagtgtgttgtctc

SEQ ID NO: 672343 - DNA, 25 bp, Mus musculus
gtaggcttagtttgtgtgttgtctc

SEQ ID NO: 672344 - DNA, 25 bp, Mus musculus
gtaggcttattcatttaggacacaa

SEQ ID NO: 672345 - DNA, 25 bp, Mus musculus
gtaggcttattcttttaggacacaa

SEQ ID NO: 672346 - DNA, 25 bp, Mus musculus
gtaggcttatttccatctttatcca

SEQ ID NO: 672347 - DNA, 25 bp, Mus musculus
gtaggcttatttgcatctttatcca

SEQ ID NO: 672348 - DNA, 25 bp, Mus musculus
gtaggcttccacacatggcatggac

SEQ ID NO: 672349 - DNA, 25 bp, Mus musculus
gtaggcttccactcatggcatggac

SEQ ID NO: 672350 - DNA, 25 bp, Mus musculus
gtaggcttcctacactaacagacag

SEQ ID NO: 672351 - DNA, 25 bp, Mus musculus
gtaggcttcctagactaacagacag

SEQ ID NO: 672352 - DNA, 25 bp, Mus musculus
gtaggcttcggaatgctcaaggcta

SEQ ID NO: 672353 - DNA, 25 bp, Mus musculus
gtaggcttcggattgctcaaggcta

SEQ ID NO: 672354 - DNA, 25 bp, Mus musculus
gtaggcttctttacctttcagaact

SEQ ID NO: 672355 - DNA, 25 bp, Mus musculus
gtaggcttcttttcctttcagaact

SEQ ID NO: 672356 - DNA, 25 bp, Mus musculus
gtaggcttgcttatgctgtataaac

SEQ ID NO: 672357 - DNA, 25 bp, Mus musculus
gtaggcttgcttatgggacttcaca

SEQ ID NO: 672358 - DNA, 25 bp, Mus musculus
gtaggcttgcttttgctgtataaac

SEQ ID NO: 672359 - DNA, 25 bp, Mus musculus
gtaggcttgcttttgggacttcaca

SEQ ID NO: 672360 - DNA, 25 bp, Mus musculus
gtaggcttggagctcatcacatgct

SEQ ID NO: 672361 - DNA, 25 bp, Mus musculus
gtaggcttggaggtcatcacatgct

SEQ ID NO: 672362 - DNA, 25 bp, Mus musculus
gtaggcttgtggattagctgtctct

SEQ ID NO: 672363 - DNA, 25 bp, Mus musculus
gtaggcttgtggtttagctgtctct

SEQ ID NO: 672364 - DNA, 25 bp, Mus musculus
gtaggctttaaactgtcaccctcaa

SEQ ID NO: 672365 - DNA, 25 bp, Mus musculus
gtaggctttaaagtgtcaccctcaa

SEQ ID NO: 672366 - DNA, 25 bp, Mus musculus
gtaggctttagaccatcagataacc

SEQ ID NO: 672367 - DNA, 25 bp, Mus musculus
gtaggctttagagcatcagataacc

SEQ ID NO: 672368 - DNA, 25 bp, Mus musculus
gtaggctttcctagtataccagaaa

SEQ ID NO: 672369 - DNA, 25 bp, Mus musculus
gtaggctttccttgtataccagaaa

SEQ ID NO: 672370 - DNA, 25 bp, Mus musculus
gtaggctttcttaagcactgactac

SEQ ID NO: 672371 - DNA, 25 bp, Mus musculus
gtaggctttctttagcactgactac

SEQ ID NO: 672372 - DNA, 25 bp, Mus musculus
gtagggaacgctccaacagcatgtc

SEQ ID NO: 672373 - DNA, 25 bp, Mus musculus
gtagggaacgctgcaacagcatgtc

SEQ ID NO: 672374 - DNA, 25 bp, Mus musculus
gtagggaagacaatgagcagacagt

SEQ ID NO: 672375 - DNA, 25 bp, Mus musculus
gtagggaagacattgagcagacagt

SEQ ID NO: 672376 - DNA, 25 bp, Mus musculus
gtagggaaggctctttgcttttcca

SEQ ID NO: 672377 - DNA, 25 bp, Mus musculus
gtagggaaggctgtttgcttttcca

SEQ ID NO: 672378 - DNA, 25 bp, Mus musculus
gtagggaagtccactgaccaacagc

SEQ ID NO: 672379 - DNA, 25 bp, Mus musculus
gtagggaagtcctctgaccaacagc

SEQ ID NO: 672380 - DNA, 25 bp, Mus musculus
gtagggacaagtcgactcatactat

SEQ ID NO: 672381 - DNA, 25 bp, Mus musculus
gtagggacaagtggactcatactat

SEQ ID NO: 672382 - DNA, 25 bp, Mus musculus
gtagggacagcaactgcacctgcaa

SEQ ID NO: 672383 - DNA, 25 bp, Mus musculus
gtagggacagcatctgcacctgcaa

SEQ ID NO: 672384 - DNA, 25 bp, Mus musculus
gtagggacagtgctatccagatcag

SEQ ID NO: 672385 - DNA, 25 bp, Mus musculus
gtagggacagtggtatccagatcag

SEQ ID NO: 672386 - DNA, 25 bp, Mus musculus
gtagggacatacagagttgccaaaa

SEQ ID NO: 672387 - DNA, 25 bp, Mus musculus
gtagggacatactgagttgccaaaa

SEQ ID NO: 672388 - DNA, 25 bp, Mus musculus
gtagggaccacacttcctaagtcta

SEQ ID NO: 672389 - DNA, 25 bp, Mus musculus
gtagggaccacagttcctaagtcta

SEQ ID NO: 672390 - DNA, 25 bp, Mus musculus
gtagggacctgcagagccaaagttc

SEQ ID NO: 672391 - DNA, 25 bp, Mus musculus
gtagggacctgctgagccaaagttc

SEQ ID NO: 672392 - DNA, 25 bp, Mus musculus
gtagggactcacctgcatgaacaca

SEQ ID NO: 672393 - DNA, 25 bp, Mus musculus
gtagggactcacgtgcatgaacaca

SEQ ID NO: 672394 - DNA, 25 bp, Mus musculus
gtagggactccaacaccgaccggcg

SEQ ID NO: 672395 - DNA, 25 bp, Mus musculus
gtagggactccatcaccgaccggcg

SEQ ID NO: 672396 - DNA, 25 bp, Mus musculus
gtagggactcttccagcggtatata

SEQ ID NO: 672397 - DNA, 25 bp, Mus musculus
gtagggactcttgcagcggtatata

SEQ ID NO: 672398 - DNA, 25 bp, Mus musculus
gtagggactgcactacccaaaatgt

SEQ ID NO: 672399 - DNA, 25 bp, Mus musculus
gtagggactgcagtacccaaaatgt

SEQ ID NO: 672400 - DNA, 25 bp, Mus musculus
gtagggacttttccagataggcagt

SEQ ID NO: 672401 - DNA, 25 bp, Mus musculus
gtagggacttttgcagataggcagt

SEQ ID NO: 672402 - DNA, 25 bp, Mus musculus
gtagggagatgcacactcatctgtg

SEQ ID NO: 672403 - DNA, 25 bp, Mus musculus
gtagggagatgctcactcatctgtg

SEQ ID NO: 672404 - DNA, 25 bp, Mus musculus
gtagggatcattcaaatccatgtat

SEQ ID NO: 672405 - DNA, 25 bp, Mus musculus
gtagggatcattgaaatccatgtat

SEQ ID NO: 672406 - DNA, 25 bp, Mus musculus
gtagggatcccaacagtgagaactg

SEQ ID NO: 672407 - DNA, 25 bp, Mus musculus
gtagggatcccatcagtgagaactg

SEQ ID NO: 672408 - DNA, 25 bp, Mus musculus
gtagggatggctcgctctgtctctc

SEQ ID NO: 672409 - DNA, 25 bp, Mus musculus
gtagggatggctggctctgtctctc

SEQ ID NO: 672410 - DNA, 25 bp, Mus musculus
gtagggattaccagtgagctggcca

SEQ ID NO: 672411 - DNA, 25 bp, Mus musculus
gtagggattacctgtgagctggcca

SEQ ID NO: 672412 - DNA, 25 bp, Mus musculus
gtagggattatcctcaaatacacag

SEQ ID NO: 672413 - DNA, 25 bp, Mus musculus
gtagggattatcgtcaaatacacag

SEQ ID NO: 672414 - DNA, 25 bp, Mus musculus
gtagggattggtcaaaagctgtttt

SEQ ID NO: 672415 - DNA, 25 bp, Mus musculus
gtagggattggtgaaaagctgtttt

SEQ ID NO: 672416 - DNA, 25 bp, Mus musculus
gtagggatttctctcactgatgctg

SEQ ID NO: 672417 - DNA, 25 bp, Mus musculus
gtagggatttctgtcactgatgctg

SEQ ID NO: 672418 - DNA, 25 bp, Mus musculus
gtagggcaaagactgctttcatata

SEQ ID NO: 672419 - DNA, 25 bp, Mus musculus
gtagggcaaagagtgctttcatata

SEQ ID NO: 672420 - DNA, 25 bp, Mus musculus
gtagggcaagatacatacacatctg

SEQ ID NO: 672421 - DNA, 25 bp, Mus musculus
gtagggcaagattcatacacatctg

SEQ ID NO: 672422 - DNA, 25 bp, Mus musculus
gtagggcaatacctctgtctcttca

SEQ ID NO: 672423 - DNA, 25 bp, Mus musculus
gtagggcaatacgtctgtctcttca

SEQ ID NO: 672424 - DNA, 25 bp, Mus musculus
gtagggcacgtgaaacctgcatccc

SEQ ID NO: 672425 - DNA, 25 bp, Mus musculus
gtagggcacgtgtaacctgcatccc

SEQ ID NO: 672426 - DNA, 25 bp, Mus musculus
gtagggcagggtaatcttctcgtaa

SEQ ID NO: 672427 - DNA, 25 bp, Mus musculus
gtagggcagggttatcttctcgtaa

SEQ ID NO: 672428 - DNA, 25 bp, Mus musculus
gtagggcagtaaaccccataagcag

SEQ ID NO: 672429 - DNA, 25 bp, Mus musculus
gtagggcagtaatccccataagcag

SEQ ID NO: 672430 - DNA, 25 bp, Mus musculus
gtagggcatagcatttagtcgtcat

SEQ ID NO: 672431 - DNA, 25 bp, Mus musculus
gtagggcatagcttttagtcgtcat

SEQ ID NO: 672432 - DNA, 25 bp, Mus musculus
gtagggcatgctaaccaaggactga

SEQ ID NO: 672433 - DNA, 25 bp, Mus musculus
gtagggcatgcttaccaaggactga

SEQ ID NO: 672434 - DNA, 25 bp, Mus musculus
gtagggcatgggagcttctgaaata

SEQ ID NO: 672435 - DNA, 25 bp, Mus musculus
gtagggcatgggtgcttctgaaata

SEQ ID NO: 672436 - DNA, 25 bp, Mus musculus
gtagggcattttccaattctaacac

SEQ ID NO: 672437 - DNA, 25 bp, Mus musculus
gtagggcattttgcaattctaacac

SEQ ID NO: 672438 - DNA, 25 bp, Mus musculus
gtagggccaagcattgtgcattttg

SEQ ID NO: 672439 - DNA, 25 bp, Mus musculus
gtagggccaagctttgtgcattttg

SEQ ID NO: 672440 - DNA, 25 bp, Mus musculus
gtagggccatgcatggagtgcttaa

SEQ ID NO: 672441 - DNA, 25 bp, Mus musculus
gtagggccatgcttggagtgcttaa

SEQ ID NO: 672442 - DNA, 25 bp, Mus musculus
gtagggccttcaagagacatttcac

SEQ ID NO: 672443 - DNA, 25 bp, Mus musculus
gtagggccttcatgagacatttcac

SEQ ID NO: 672444 - DNA, 25 bp, Mus musculus
gtagggctaaggagcaccagggaaa

SEQ ID NO: 672445 - DNA, 25 bp, Mus musculus
gtagggctaaggtgcaccagggaaa

SEQ ID NO: 672446 - DNA, 25 bp, Mus musculus
gtagggctcagcatttcattcaata

SEQ ID NO: 672447 - DNA, 25 bp, Mus musculus
gtagggctcagcttttcattcaata

SEQ ID NO: 672448 - DNA, 25 bp, Mus musculus
gtagggctcataagatccccacctc

SEQ ID NO: 672449 - DNA, 25 bp, Mus musculus
gtagggctcatatgatccccacctc

SEQ ID NO: 672450 - DNA, 25 bp, Mus musculus
gtagggctccaacactagactttgt

SEQ ID NO: 672451 - DNA, 25 bp, Mus musculus
gtagggctccaagactagactttgt

SEQ ID NO: 672452 - DNA, 25 bp, Mus musculus
gtagggctcttgatcagtgtgctga

SEQ ID NO: 672453 - DNA, 25 bp, Mus musculus
gtagggctcttgttcagtgtgctga

SEQ ID NO: 672454 - DNA, 25 bp, Mus musculus
gtagggctgctgcacctttaccgag

SEQ ID NO: 672455 - DNA, 25 bp, Mus musculus
gtagggctgctggacctttaccgag

SEQ ID NO: 672456 - DNA, 25 bp, Mus musculus
gtagggctgtgacaacttctggtca

SEQ ID NO: 672457 - DNA, 25 bp, Mus musculus
gtagggctgtgagaacttctggtca

SEQ ID NO: 672458 - DNA, 25 bp, Mus musculus
gtagggcttagtcccagccacacag

SEQ ID NO: 672459 - DNA, 25 bp, Mus musculus
gtagggcttagtgccagccacacag

SEQ ID NO: 672460 - DNA, 25 bp, Mus musculus
gtagggcttcatccacttgacaaga

SEQ ID NO: 672461 - DNA, 25 bp, Mus musculus
gtagggcttcatgcacttgacaaga

SEQ ID NO: 672462 - DNA, 25 bp, Mus musculus
gtagggcttgaaactccaggcatag

SEQ ID NO: 672463 - DNA, 25 bp, Mus musculus
gtagggcttgaatctccaggcatag

SEQ ID NO: 672464 - DNA, 25 bp, Mus musculus
gtagggctttggaattggcttgtct

SEQ ID NO: 672465 - DNA, 25 bp, Mus musculus
gtagggctttggtattggcttgtct

SEQ ID NO: 672466 - DNA, 25 bp, Mus musculus
gtaggggtcatccagcccactagac

SEQ ID NO: 672467 - DNA, 25 bp, Mus musculus
gtaggggtcatcgagcccactagac

SEQ ID NO: 672468 - DNA, 25 bp, Mus musculus
gtagggtacacaagtgttctcataa

SEQ ID NO: 672469 - DNA, 25 bp, Mus musculus
gtagggtacacatgtgttctcataa

SEQ ID NO: 672470 - DNA, 25 bp, Mus musculus
gtagggtaccgtagaatactgcaac

SEQ ID NO: 672471 - DNA, 25 bp, Mus musculus
gtagggtaccgttgaatactgcaac

SEQ ID NO: 672472 - DNA, 25 bp, Mus musculus
gtagggtagaataatgcaaactcaa

SEQ ID NO: 672473 - DNA, 25 bp, Mus musculus
gtagggtagaattatgcaaactcaa

SEQ ID NO: 672474 - DNA, 25 bp, Mus musculus
gtagggtaggagactttctaaagat

SEQ ID NO: 672475 - DNA, 25 bp, Mus musculus
gtagggtaggagtctttctaaagat

SEQ ID NO: 672476 - DNA, 25 bp, Mus musculus
gtagggtatattcacagtagaaaac

SEQ ID NO: 672477 - DNA, 25 bp, Mus musculus
gtagggtatattgacagtagaaaac

SEQ ID NO: 672478 - DNA, 25 bp, Mus musculus
gtagggtatgccatatcccacaggg

SEQ ID NO: 672479 - DNA, 25 bp, Mus musculus
gtagggtatgccttatcccacaggg

SEQ ID NO: 672480 - DNA, 25 bp, Mus musculus
gtagggtatggcagttgataacaca

SEQ ID NO: 672481 - DNA, 25 bp, Mus musculus
gtagggtatggctgttgataacaca

SEQ ID NO: 672482 - DNA, 25 bp, Mus musculus
gtagggtcagcgagtcatgtgcccc

SEQ ID NO: 672483 - DNA, 25 bp, Mus musculus
gtagggtcagcgtgtcatgtgcccc

SEQ ID NO: 672484 - DNA, 25 bp, Mus musculus
gtagggtctcagcaatacgccaaca

SEQ ID NO: 672485 - DNA, 25 bp, Mus musculus
gtagggtctcagcttcaactgttaa

SEQ ID NO: 672486 - DNA, 25 bp, Mus musculus
gtagggtctcaggaatacgccaaca

SEQ ID NO: 672487 - DNA, 25 bp, Mus musculus
gtagggtctcaggttcaactgttaa

SEQ ID NO: 672488 - DNA, 25 bp, Mus musculus
gtagggtgacctactgtgtgactct

SEQ ID NO: 672489 - DNA, 25 bp, Mus musculus
gtagggtgaccttctgtgtgactct

SEQ ID NO: 672490 - DNA, 25 bp, Mus musculus
gtagggtgagtgatccagctcctca

SEQ ID NO: 672491 - DNA, 25 bp, Mus musculus
gtagggtgagtgttccagctcctca

SEQ ID NO: 672492 - DNA, 25 bp, Mus musculus
gtagggtgccaaacagataccagtt

SEQ ID NO: 672493 - DNA, 25 bp, Mus musculus
gtagggtgccaaccacatgtctctg

SEQ ID NO: 672494 - DNA, 25 bp, Mus musculus
gtagggtgccaagcacatgtctctg

SEQ ID NO: 672495 - DNA, 25 bp, Mus musculus
gtagggtgccaatcagataccagtt

SEQ ID NO: 672496 - DNA, 25 bp, Mus musculus
gtagggtgctccagttgtcaaaacc

SEQ ID NO: 672497 - DNA, 25 bp, Mus musculus
gtagggtgctcctgttgtcaaaacc

SEQ ID NO: 672498 - DNA, 25 bp, Mus musculus
gtagggtggcttacatttataccag

SEQ ID NO: 672499 - DNA, 25 bp, Mus musculus
gtagggtggctttcatttataccag

SEQ ID NO: 672500 - DNA, 25 bp, Mus musculus
gtagggtgtctcacaaccagatgtc

SEQ ID NO: 672501 - DNA, 25 bp, Mus musculus
gtagggtgtctctcaaccagatgtc

SEQ ID NO: 672502 - DNA, 25 bp, Mus musculus
gtagggtgtgaacccagagacacaa

SEQ ID NO: 672503 - DNA, 25 bp, Mus musculus
gtagggtgtgaagccagagacacaa

SEQ ID NO: 672504 - DNA, 25 bp, Mus musculus
gtagggttactcagaccttggagaa

SEQ ID NO: 672505 - DNA, 25 bp, Mus musculus
gtagggttactctgaccttggagaa

SEQ ID NO: 672506 - DNA, 25 bp, Mus musculus
gtagggttccgtatgtcttcctcag

SEQ ID NO: 672507 - DNA, 25 bp, Mus musculus
gtagggttccgtttgtcttcctcag

SEQ ID NO: 672508 - DNA, 25 bp, Mus musculus
gtagggttcctacagaggataatct

SEQ ID NO: 672509 - DNA, 25 bp, Mus musculus
gtagggttcctagagaggataatct

SEQ ID NO: 672510 - DNA, 25 bp, Mus musculus
gtagggttctacagttatgttgtct

SEQ ID NO: 672511 - DNA, 25 bp, Mus musculus
gtagggttctactgttatgttgtct

SEQ ID NO: 672512 - DNA, 25 bp, Mus musculus
gtagggttctagctacatcgttcta

SEQ ID NO: 672513 - DNA, 25 bp, Mus musculus
gtagggttctaggtacatcgttcta

SEQ ID NO: 672514 - DNA, 25 bp, Mus musculus
gtagggtttcatcagacctgggtcc

SEQ ID NO: 672515 - DNA, 25 bp, Mus musculus
gtagggtttcatgagacctgggtcc

SEQ ID NO: 672516 - DNA, 25 bp, Mus musculus
gtagggtttttgcactgtacagtgt

SEQ ID NO: 672517 - DNA, 25 bp, Mus musculus
gtagggtttttggactgtacagtgt

SEQ ID NO: 672518 - DNA, 25 bp, Mus musculus
gtaggtaaaatcaggtatactggat

SEQ ID NO: 672519 - DNA, 25 bp, Mus musculus
gtaggtaaaatctggtatactggat

SEQ ID NO: 672520 - DNA, 25 bp, Mus musculus
gtaggtaaacctagctgttctgaga

SEQ ID NO: 672521 - DNA, 25 bp, Mus musculus
gtaggtaaaccttgctgttctgaga

SEQ ID NO: 672522 - DNA, 25 bp, Mus musculus
gtaggtaacagacctaggcagatct

SEQ ID NO: 672523 - DNA, 25 bp, Mus musculus
gtaggtaacagagctaggcagatct

SEQ ID NO: 672524 - DNA, 25 bp, Mus musculus
gtaggtaacctaattatatactgct

SEQ ID NO: 672525 - DNA, 25 bp, Mus musculus
gtaggtaacctatttatatactgct

SEQ ID NO: 672526 - DNA, 25 bp, Mus musculus
gtaggtaagaaacagtttaggcact

SEQ ID NO: 672527 - DNA, 25 bp, Mus musculus
gtaggtaagaaagagtttaggcact

SEQ ID NO: 672528 - DNA, 25 bp, Mus musculus
gtaggtaagagtccacagagcttca

SEQ ID NO: 672529 - DNA, 25 bp, Mus musculus
gtaggtaagagtgcacagagcttca

SEQ ID NO: 672530 - DNA, 25 bp, Mus musculus
gtaggtaatcatacaggaatcctca

SEQ ID NO: 672531 - DNA, 25 bp, Mus musculus
gtaggtaatcattcaggaatcctca

SEQ ID NO: 672532 - DNA, 25 bp, Mus musculus
gtaggtaatttgcacacctctggct

SEQ ID NO: 672533 - DNA, 25 bp, Mus musculus
gtaggtaatttggacacctctggct

SEQ ID NO: 672534 - DNA, 25 bp, Mus musculus
gtaggtacacagagtgtgcttggat

SEQ ID NO: 672535 - DNA, 25 bp, Mus musculus
gtaggtacacagtgtgtgcttggat

SEQ ID NO: 672536 - DNA, 25 bp, Mus musculus
gtaggtacacggacagccaccatca

SEQ ID NO: 672537 - DNA, 25 bp, Mus musculus
gtaggtacacggtcagccaccatca

SEQ ID NO: 672538 - DNA, 25 bp, Mus musculus
gtaggtacagatagttcacatccca

SEQ ID NO: 672539 - DNA, 25 bp, Mus musculus
gtaggtacagattgttcacatccca

SEQ ID NO: 672540 - DNA, 25 bp, Mus musculus
gtaggtaccaaaataagctgctgct

SEQ ID NO: 672541 - DNA, 25 bp, Mus musculus
gtaggtaccaaattaagctgctgct

SEQ ID NO: 672542 - DNA, 25 bp, Mus musculus
gtaggtaccagccattgggacccag

SEQ ID NO: 672543 - DNA, 25 bp, Mus musculus
gtaggtaccagcgattgggacccag

SEQ ID NO: 672544 - DNA, 25 bp, Mus musculus
gtaggtaccctcatctgcagaaaat

SEQ ID NO: 672545 - DNA, 25 bp, Mus musculus
gtaggtaccctcttctgcagaaaat

SEQ ID NO: 672546 - DNA, 25 bp, Mus musculus
gtaggtacctggatgttcacagagc

SEQ ID NO: 672547 - DNA, 25 bp, Mus musculus
gtaggtacctggttgttcacagagc

SEQ ID NO: 672548 - DNA, 25 bp, Mus musculus
gtaggtacgcagatggcctggttat

SEQ ID NO: 672549 - DNA, 25 bp, Mus musculus
gtaggtacgcagttggcctggttat

SEQ ID NO: 672550 - DNA, 25 bp, Mus musculus
gtaggtactactactctgacatgca

SEQ ID NO: 672551 - DNA, 25 bp, Mus musculus
gtaggtactacttctctgacatgca

SEQ ID NO: 672552 - DNA, 25 bp, Mus musculus
gtaggtactagacgagtccctatcc

SEQ ID NO: 672553 - DNA, 25 bp, Mus musculus
gtaggtactagaggagtccctatcc

SEQ ID NO: 672554 - DNA, 25 bp, Mus musculus
gtaggtactgtaagttgtaacacaa

SEQ ID NO: 672555 - DNA, 25 bp, Mus musculus
gtaggtactgtaccatatggatata

SEQ ID NO: 672556 - DNA, 25 bp, Mus musculus
gtaggtactgtagcatatggatata

SEQ ID NO: 672557 - DNA, 25 bp, Mus musculus
gtaggtactgtatgttgtaacacaa

SEQ ID NO: 672558 - DNA, 25 bp, Mus musculus
gtaggtagaaaactacttcctctgt

SEQ ID NO: 672559 - DNA, 25 bp, Mus musculus
gtaggtagaaaagtacttcctctgt

SEQ ID NO: 672560 - DNA, 25 bp, Mus musculus
gtaggtagagctcttgttccttctg

SEQ ID NO: 672561 - DNA, 25 bp, Mus musculus
gtaggtagagctgttgttccttctg

SEQ ID NO: 672562 - DNA, 25 bp, Mus musculus
gtaggtagattgatctgagccctct

SEQ ID NO: 672563 - DNA, 25 bp, Mus musculus
gtaggtagattgttctgagccctct

SEQ ID NO: 672564 - DNA, 25 bp, Mus musculus
gtaggtagctgtagaatgccaacaa

SEQ ID NO: 672565 - DNA, 25 bp, Mus musculus
gtaggtagctgttgaatgccaacaa

SEQ ID NO: 672566 - DNA, 25 bp, Mus musculus
gtaggtaggaacagctgtttggttt

SEQ ID NO: 672567 - DNA, 25 bp, Mus musculus
gtaggtaggaactgctgtttggttt

SEQ ID NO: 672568 - DNA, 25 bp, Mus musculus
gtaggtaggactcatctgcagatgc

SEQ ID NO: 672569 - DNA, 25 bp, Mus musculus
gtaggtaggactgatctgcagatgc

SEQ ID NO: 672570 - DNA, 25 bp, Mus musculus
gtaggtaggatcagtggccccagaa

SEQ ID NO: 672571 - DNA, 25 bp, Mus musculus
gtaggtaggatctgtggccccagaa

SEQ ID NO: 672572 - DNA, 25 bp, Mus musculus
gtaggtagtccacttactcagcata

SEQ ID NO: 672573 - DNA, 25 bp, Mus musculus
gtaggtagtccagttactcagcata

SEQ ID NO: 672574 - DNA, 25 bp, Mus musculus
gtaggtagtgaccttcccatatctc

SEQ ID NO: 672575 - DNA, 25 bp, Mus musculus
gtaggtagtgacgttcccatatctc

SEQ ID NO: 672576 - DNA, 25 bp, Mus musculus
gtaggtagttcaagctgacctcgaa

SEQ ID NO: 672577 - DNA, 25 bp, Mus musculus
gtaggtagttcatgctgacctcgaa

SEQ ID NO: 672578 - DNA, 25 bp, Mus musculus
gtaggtatcattcacgttttgacga

SEQ ID NO: 672579 - DNA, 25 bp, Mus musculus
gtaggtatcattgacgttttgacga

SEQ ID NO: 672580 - DNA, 25 bp, Mus musculus
gtaggtatccaccaaaggctttcct

SEQ ID NO: 672581 - DNA, 25 bp, Mus musculus
gtaggtatccacgaaaggctttcct

SEQ ID NO: 672582 - DNA, 25 bp, Mus musculus
gtaggtattagcaggtgacaccata

SEQ ID NO: 672583 - DNA, 25 bp, Mus musculus
gtaggtattagctggtgacaccata

SEQ ID NO: 672584 - DNA, 25 bp, Mus musculus
gtaggtattcccatgactctttctg

SEQ ID NO: 672585 - DNA, 25 bp, Mus musculus
gtaggtattcccttgactctttctg

SEQ ID NO: 672586 - DNA, 25 bp, Mus musculus
gtaggtatttccaagacgccatagg

SEQ ID NO: 672587 - DNA, 25 bp, Mus musculus
gtaggtatttcctagacgccatagg

SEQ ID NO: 672588 - DNA, 25 bp, Mus musculus
gtaggtattttacgtccagggccat

SEQ ID NO: 672589 - DNA, 25 bp, Mus musculus
gtaggtattttaggtccagggccat

SEQ ID NO: 672590 - DNA, 25 bp, Mus musculus
gtaggtcaataaacttatggtgtgc

SEQ ID NO: 672591 - DNA, 25 bp, Mus musculus
gtaggtcaataatcttatggtgtgc

SEQ ID NO: 672592 - DNA, 25 bp, Mus musculus
gtaggtcacactaatatccaatgga

SEQ ID NO: 672593 - DNA, 25 bp, Mus musculus
gtaggtcacacttatatccaatgga

SEQ ID NO: 672594 - DNA, 25 bp, Mus musculus
gtaggtcacccaagccgcaatggag

SEQ ID NO: 672595 - DNA, 25 bp, Mus musculus
gtaggtcacccatgccgcaatggag

SEQ ID NO: 672596 - DNA, 25 bp, Mus musculus
gtaggtcacttgctagaactcgaag

SEQ ID NO: 672597 - DNA, 25 bp, Mus musculus
gtaggtcacttggtagaactcgaag

SEQ ID NO: 672598 - DNA, 25 bp, Mus musculus
gtaggtcagctaatttcaagttatc

SEQ ID NO: 672599 - DNA, 25 bp, Mus musculus
gtaggtcagctattttcaagttatc

SEQ ID NO: 672600 - DNA, 25 bp, Mus musculus
gtaggtcagtaaaagctgccctgag

SEQ ID NO: 672601 - DNA, 25 bp, Mus musculus
gtaggtcagtaatagctgccctgag

SEQ ID NO: 672602 - DNA, 25 bp, Mus musculus
gtaggtcagtagatcaatgactgct

SEQ ID NO: 672603 - DNA, 25 bp, Mus musculus
gtaggtcagtagttcaatgactgct

SEQ ID NO: 672604 - DNA, 25 bp, Mus musculus
gtaggtcatcacatacattcccagc

SEQ ID NO: 672605 - DNA, 25 bp, Mus musculus
gtaggtcatcacttacattcccagc

SEQ ID NO: 672606 - DNA, 25 bp, Mus musculus
gtaggtcatgctcctagctagtgtc

SEQ ID NO: 672607 - DNA, 25 bp, Mus musculus
gtaggtcatgctgctagctagtgtc

SEQ ID NO: 672608 - DNA, 25 bp, Mus musculus
gtaggtcatggtagtttcattcaca

SEQ ID NO: 672609 - DNA, 25 bp, Mus musculus
gtaggtcatggttgtttcattcaca

SEQ ID NO: 672610 - DNA, 25 bp, Mus musculus
gtaggtcatgtcaatctttttactt

SEQ ID NO: 672611 - DNA, 25 bp, Mus musculus
gtaggtcatgtctatctttttactt

SEQ ID NO: 672612 - DNA, 25 bp, Mus musculus
gtaggtcattaaattcaggctggca

SEQ ID NO: 672613 - DNA, 25 bp, Mus musculus
gtaggtcattaatttcaggctggca

SEQ ID NO: 672614 - DNA, 25 bp, Mus musculus
gtaggtcattcacctgaaaatgttg

SEQ ID NO: 672615 - DNA, 25 bp, Mus musculus
gtaggtcattcagctgaaaatgttg

SEQ ID NO: 672616 - DNA, 25 bp, Mus musculus
gtaggtcattgactcttatggattg

SEQ ID NO: 672617 - DNA, 25 bp, Mus musculus
gtaggtcattgagtcttatggattg

SEQ ID NO: 672618 - DNA, 25 bp, Mus musculus
gtaggtcatttgcaatccgaatact

SEQ ID NO: 672619 - DNA, 25 bp, Mus musculus
gtaggtcatttggaatccgaatact

SEQ ID NO: 672620 - DNA, 25 bp, Mus musculus
gtaggtccactacgccgactgataa

SEQ ID NO: 672621 - DNA, 25 bp, Mus musculus
gtaggtccactaggccgactgataa

SEQ ID NO: 672622 - DNA, 25 bp, Mus musculus
gtaggtccactcatttcagtttcaa

SEQ ID NO: 672623 - DNA, 25 bp, Mus musculus
gtaggtccactcttttcagtttcaa

SEQ ID NO: 672624 - DNA, 25 bp, Mus musculus
gtaggtccatatagccataatttta

SEQ ID NO: 672625 - DNA, 25 bp, Mus musculus
gtaggtccatattgccataatttta

SEQ ID NO: 672626 - DNA, 25 bp, Mus musculus
gtaggtcccggaaaagcggccatga

SEQ ID NO: 672627 - DNA, 25 bp, Mus musculus
gtaggtcccggataagcggccatga

SEQ ID NO: 672628 - DNA, 25 bp, Mus musculus
gtaggtccgaccaagacaagtgctg

SEQ ID NO: 672629 - DNA, 25 bp, Mus musculus
gtaggtccgacctagacaagtgctg

SEQ ID NO: 672630 - DNA, 25 bp, Mus musculus
gtaggtcctgcgcagaccgagttac

SEQ ID NO: 672631 - DNA, 25 bp, Mus musculus
gtaggtcctgcggagaccgagttac

SEQ ID NO: 672632 - DNA, 25 bp, Mus musculus
gtaggtctcactcttgtggtttgtt

SEQ ID NO: 672633 - DNA, 25 bp, Mus musculus
gtaggtctcactgttgtggtttgtt

SEQ ID NO: 672634 - DNA, 25 bp, Mus musculus
gtaggtctctacatgggccagttgg

SEQ ID NO: 672635 - DNA, 25 bp, Mus musculus
gtaggtctctacttgggccagttgg

SEQ ID NO: 672636 - DNA, 25 bp, Mus musculus
gtaggtctctatcagtggagattca

SEQ ID NO: 672637 - DNA, 25 bp, Mus musculus
gtaggtctctatgagtggagattca

SEQ ID NO: 672638 - DNA, 25 bp, Mus musculus
gtaggtctgacgaggcactgaaaca

SEQ ID NO: 672639 - DNA, 25 bp, Mus musculus
gtaggtctgacgtggcactgaaaca

SEQ ID NO: 672640 - DNA, 25 bp, Mus musculus
gtaggtctgactcttctacttttca

SEQ ID NO: 672641 - DNA, 25 bp, Mus musculus
gtaggtctgactgttctacttttca

SEQ ID NO: 672642 - DNA, 25 bp, Mus musculus
gtaggtctgcccactttcattgaac

SEQ ID NO: 672643 - DNA, 25 bp, Mus musculus
gtaggtctgccctctttcattgaac

SEQ ID NO: 672644 - DNA, 25 bp, Mus musculus
gtaggtcttgagaattgagcttaag

SEQ ID NO: 672645 - DNA, 25 bp, Mus musculus
gtaggtcttgagacggtcatgtcat

SEQ ID NO: 672646 - DNA, 25 bp, Mus musculus
gtaggtcttgagtattgagcttaag

SEQ ID NO: 672647 - DNA, 25 bp, Mus musculus
gtaggtcttgagtcggtcatgtcat

SEQ ID NO: 672648 - DNA, 25 bp, Mus musculus
gtaggtgaaagtaaacactcttagt

SEQ ID NO: 672649 - DNA, 25 bp, Mus musculus
gtaggtgaaagttaacactcttagt

SEQ ID NO: 672650 - DNA, 25 bp, Mus musculus
gtaggtgaagctctaagattgctcc

SEQ ID NO: 672651 - DNA, 25 bp, Mus musculus
gtaggtgaagctgtaagattgctcc

SEQ ID NO: 672652 - DNA, 25 bp, Mus musculus
gtaggtgagctaacacagtgtatct

SEQ ID NO: 672653 - DNA, 25 bp, Mus musculus
gtaggtgagctatcacagtgtatct

SEQ ID NO: 672654 - DNA, 25 bp, Mus musculus
gtaggtgaggctaccattgaaccct

SEQ ID NO: 672655 - DNA, 25 bp, Mus musculus
gtaggtgaggcttccattgaaccct

SEQ ID NO: 672656 - DNA, 25 bp, Mus musculus
gtaggtgatcaaccattgccttatc

SEQ ID NO: 672657 - DNA, 25 bp, Mus musculus
gtaggtgatcaagcattgccttatc

SEQ ID NO: 672658 - DNA, 25 bp, Mus musculus
gtaggtgatgagctctttcctccaa

SEQ ID NO: 672659 - DNA, 25 bp, Mus musculus
gtaggtgatgaggtctttcctccaa

SEQ ID NO: 672660 - DNA, 25 bp, Mus musculus
gtaggtgatgcccttgctgccgcac

SEQ ID NO: 672661 - DNA, 25 bp, Mus musculus
gtaggtgatgccgttgctgccgcac

SEQ ID NO: 672662 - DNA, 25 bp, Mus musculus
gtaggtgcaagccaggaccctgcta

SEQ ID NO: 672663 - DNA, 25 bp, Mus musculus
gtaggtgcaagcgaggaccctgcta

SEQ ID NO: 672664 - DNA, 25 bp, Mus musculus
gtaggtgcactgatctgctagagct

SEQ ID NO: 672665 - DNA, 25 bp, Mus musculus
gtaggtgcactgttctgctagagct

SEQ ID NO: 672666 - DNA, 25 bp, Mus musculus
gtaggtgcccatcagattcccatat

SEQ ID NO: 672667 - DNA, 25 bp, Mus musculus
gtaggtgcccatgagattcccatat

SEQ ID NO: 672668 - DNA, 25 bp, Mus musculus
gtaggtgccttcagcaaacaggaac

SEQ ID NO: 672669 - DNA, 25 bp, Mus musculus
gtaggtgccttctgcaaacaggaac

SEQ ID NO: 672670 - DNA, 25 bp, Mus musculus
gtaggtgcgcccaggccaaacagtg

SEQ ID NO: 672671 - DNA, 25 bp, Mus musculus
gtaggtgcgccctggccaaacagtg

SEQ ID NO: 672672 - DNA, 25 bp, Mus musculus
gtaggtgctatcatcacagtgactg

SEQ ID NO: 672673 - DNA, 25 bp, Mus musculus
gtaggtgctatcttcacagtgactg

SEQ ID NO: 672674 - DNA, 25 bp, Mus musculus
gtaggtgctcaaaaactgctgcatg

SEQ ID NO: 672675 - DNA, 25 bp, Mus musculus
gtaggtgctcaataactgctgcatg

SEQ ID NO: 672676 - DNA, 25 bp, Mus musculus
gtaggtgctcgcactagcaacacat

SEQ ID NO: 672677 - DNA, 25 bp, Mus musculus
gtaggtgctcgctctagcaacacat

SEQ ID NO: 672678 - DNA, 25 bp, Mus musculus
gtaggtgctctactcatgcaatcca

SEQ ID NO: 672679 - DNA, 25 bp, Mus musculus
gtaggtgctctagtcatgcaatcca

SEQ ID NO: 672680 - DNA, 25 bp, Mus musculus
gtaggtgctgttagcctcagccttt

SEQ ID NO: 672681 - DNA, 25 bp, Mus musculus
gtaggtgctgtttgcctcagccttt

SEQ ID NO: 672682 - DNA, 25 bp, Mus musculus
gtaggtggctaacaccatctgtctc

SEQ ID NO: 672683 - DNA, 25 bp, Mus musculus
gtaggtggctaagaccatctgtctc

SEQ ID NO: 672684 - DNA, 25 bp, Mus musculus
gtaggtgggatcacttatgaccctt

SEQ ID NO: 672685 - DNA, 25 bp, Mus musculus
gtaggtgggatctcttatgaccctt

SEQ ID NO: 672686 - DNA, 25 bp, Mus musculus
gtaggtggtgttctacttagctaac

SEQ ID NO: 672687 - DNA, 25 bp, Mus musculus
gtaggtggtgttgtacttagctaac

SEQ ID NO: 672688 - DNA, 25 bp, Mus musculus
gtaggtggtttaactttgacatctt

SEQ ID NO: 672689 - DNA, 25 bp, Mus musculus
gtaggtggtttatctttgacatctt

SEQ ID NO: 672690 - DNA, 25 bp, Mus musculus
gtaggtggtttccagtataaacaca

SEQ ID NO: 672691 - DNA, 25 bp, Mus musculus
gtaggtggtttcgagtataaacaca

SEQ ID NO: 672692 - DNA, 25 bp, Mus musculus
gtaggtgtacaaaacttattcttat

SEQ ID NO: 672693 - DNA, 25 bp, Mus musculus
gtaggtgtacaatacttattcttat

SEQ ID NO: 672694 - DNA, 25 bp, Mus musculus
gtaggtgtattacttcatgaacttg

SEQ ID NO: 672695 - DNA, 25 bp, Mus musculus
gtaggtgtattagttcatgaacttg

SEQ ID NO: 672696 - DNA, 25 bp, Mus musculus
gtaggtgtcagactcctgtaggacc

SEQ ID NO: 672697 - DNA, 25 bp, Mus musculus
gtaggtgtcagagtcctgtaggacc

SEQ ID NO: 672698 - DNA, 25 bp, Mus musculus
gtaggtgtcctgaacataattctaa

SEQ ID NO: 672699 - DNA, 25 bp, Mus musculus
gtaggtgtcctgtacataattctaa

SEQ ID NO: 672700 - DNA, 25 bp, Mus musculus
gtaggtgtgatgatatgcacaggat

SEQ ID NO: 672701 - DNA, 25 bp, Mus musculus
gtaggtgtgatgttatgcacaggat

SEQ ID NO: 672702 - DNA, 25 bp, Mus musculus
gtaggtgtgctacgtctatttgatc

SEQ ID NO: 672703 - DNA, 25 bp, Mus musculus
gtaggtgtgctaggtctatttgatc

SEQ ID NO: 672704 - DNA, 25 bp, Mus musculus
gtaggtgtggcactgttgaacttta

SEQ ID NO: 672705 - DNA, 25 bp, Mus musculus
gtaggtgtggcagtgttgaacttta

SEQ ID NO: 672706 - DNA, 25 bp, Mus musculus
gtaggtgttctgatagcttatttta

SEQ ID NO: 672707 - DNA, 25 bp, Mus musculus
gtaggtgttctgttagcttatttta

SEQ ID NO: 672708 - DNA, 25 bp, Mus musculus
gtaggtgttgatcaccagttactta

SEQ ID NO: 672709 - DNA, 25 bp, Mus musculus
gtaggtgttgatgaccagttactta

SEQ ID NO: 672710 - DNA, 25 bp, Mus musculus
gtaggtgtttctctgttatgtaagc

SEQ ID NO: 672711 - DNA, 25 bp, Mus musculus
gtaggtgtttctgtgttatgtaagc

SEQ ID NO: 672712 - DNA, 25 bp, Mus musculus
gtaggttaaccaatccttatctcct

SEQ ID NO: 672713 - DNA, 25 bp, Mus musculus
gtaggttaaccattccttatctcct

SEQ ID NO: 672714 - DNA, 25 bp, Mus musculus
gtaggttaagttatgttgctgttgg

SEQ ID NO: 672715 - DNA, 25 bp, Mus musculus
gtaggttaagttttgttgctgttgg

SEQ ID NO: 672716 - DNA, 25 bp, Mus musculus
gtaggttacgttcaaggcagcgtca

SEQ ID NO: 672717 - DNA, 25 bp, Mus musculus
gtaggttacgttgaaggcagcgtca

SEQ ID NO: 672718 - DNA, 25 bp, Mus musculus
gtaggttactctcttagatccaaaa

SEQ ID NO: 672719 - DNA, 25 bp, Mus musculus
gtaggttactctgttagatccaaaa

SEQ ID NO: 672720 - DNA, 25 bp, Mus musculus
gtaggttactgaactgccgggctga

SEQ ID NO: 672721 - DNA, 25 bp, Mus musculus
gtaggttactgatctgccgggctga

SEQ ID NO: 672722 - DNA, 25 bp, Mus musculus
gtaggttagactatcctgaactgca

SEQ ID NO: 672723 - DNA, 25 bp, Mus musculus
gtaggttagactttcctgaactgca

SEQ ID NO: 672724 - DNA, 25 bp, Mus musculus
gtaggttagcttagtttggatgagt

SEQ ID NO: 672725 - DNA, 25 bp, Mus musculus
gtaggttagctttgtttggatgagt

SEQ ID NO: 672726 - DNA, 25 bp, Mus musculus
gtaggttatatacatggatacagga

SEQ ID NO: 672727 - DNA, 25 bp, Mus musculus
gtaggttatatagatggatacagga

SEQ ID NO: 672728 - DNA, 25 bp, Mus musculus
gtaggttattcaagttgtttgcaac

SEQ ID NO: 672729 - DNA, 25 bp, Mus musculus
gtaggttattcatgttgtttgcaac

SEQ ID NO: 672730 - DNA, 25 bp, Mus musculus
gtaggttcaaagatcaccctataca

SEQ ID NO: 672731 - DNA, 25 bp, Mus musculus
gtaggttcaaagttcaccctataca

SEQ ID NO: 672732 - DNA, 25 bp, Mus musculus
gtaggttcaatcacagatccatcat

SEQ ID NO: 672733 - DNA, 25 bp, Mus musculus
gtaggttcaatctcagatccatcat

SEQ ID NO: 672734 - DNA, 25 bp, Mus musculus
gtaggttcacctataagcactgaag

SEQ ID NO: 672735 - DNA, 25 bp, Mus musculus
gtaggttcacctttaagcactgaag

SEQ ID NO: 672736 - DNA, 25 bp, Mus musculus
gtaggttcaggactggccctcagaa

SEQ ID NO: 672737 - DNA, 25 bp, Mus musculus
gtaggttcaggagtggccctcagaa

SEQ ID NO: 672738 - DNA, 25 bp, Mus musculus
gtaggttcatagaattaatcccagc

SEQ ID NO: 672739 - DNA, 25 bp, Mus musculus
gtaggttcatagtattaatcccagc

SEQ ID NO: 672740 - DNA, 25 bp, Mus musculus
gtaggttccactccctgacagatca

SEQ ID NO: 672741 - DNA, 25 bp, Mus musculus
gtaggttccactgcctgacagatca

SEQ ID NO: 672742 - DNA, 25 bp, Mus musculus
gtaggttcccagaagcatccagtta

SEQ ID NO: 672743 - DNA, 25 bp, Mus musculus
gtaggttcccagtagcatccagtta

SEQ ID NO: 672744 - DNA, 25 bp, Mus musculus
gtaggttcctgacctgggaatcctg

SEQ ID NO: 672745 - DNA, 25 bp, Mus musculus
gtaggttcctgagctgggaatcctg

SEQ ID NO: 672746 - DNA, 25 bp, Mus musculus
gtaggttccttgaacttgacatctg

SEQ ID NO: 672747 - DNA, 25 bp, Mus musculus
gtaggttccttgtacttgacatctg

SEQ ID NO: 672748 - DNA, 25 bp, Mus musculus
gtaggttcgaggacccacattgggc

SEQ ID NO: 672749 - DNA, 25 bp, Mus musculus
gtaggttcgaggtcccacattgggc

SEQ ID NO: 672750 - DNA, 25 bp, Mus musculus
gtaggttctctcatttcattcatct

SEQ ID NO: 672751 - DNA, 25 bp, Mus musculus
gtaggttctctcttttcattcatct

SEQ ID NO: 672752 - DNA, 25 bp, Mus musculus
gtaggttcttctaggaagatcttaa

SEQ ID NO: 672753 - DNA, 25 bp, Mus musculus
gtaggttcttcttggaagatcttaa

SEQ ID NO: 672754 - DNA, 25 bp, Mus musculus
gtaggttgaagcacagattctgata

SEQ ID NO: 672755 - DNA, 25 bp, Mus musculus
gtaggttgaagctcagattctgata

SEQ ID NO: 672756 - DNA, 25 bp, Mus musculus
gtaggttgatttaggccctgagttt

SEQ ID NO: 672757 - DNA, 25 bp, Mus musculus
gtaggttgattttggccctgagttt

SEQ ID NO: 672758 - DNA, 25 bp, Mus musculus
gtaggttgcagacaccaggctattt

SEQ ID NO: 672759 - DNA, 25 bp, Mus musculus
gtaggttgcagagaccaggctattt

SEQ ID NO: 672760 - DNA, 25 bp, Mus musculus
gtaggttgcgatccttgtcgcctga

SEQ ID NO: 672761 - DNA, 25 bp, Mus musculus
gtaggttgcgatgcttgtcgcctga

SEQ ID NO: 672762 - DNA, 25 bp, Mus musculus
gtaggttgctggaaatggcccactc

SEQ ID NO: 672763 - DNA, 25 bp, Mus musculus
gtaggttgctggtaatggcccactc

SEQ ID NO: 672764 - DNA, 25 bp, Mus musculus
gtaggttggactctggtcaccttga

SEQ ID NO: 672765 - DNA, 25 bp, Mus musculus
gtaggttggactgtggtcaccttga

SEQ ID NO: 672766 - DNA, 25 bp, Mus musculus
gtaggttgggctatcccatatcaat

SEQ ID NO: 672767 - DNA, 25 bp, Mus musculus
gtaggttgggctttcccatatcaat

SEQ ID NO: 672768 - DNA, 25 bp, Mus musculus
gtaggttgtactatgtgccttctta

SEQ ID NO: 672769 - DNA, 25 bp, Mus musculus
gtaggttgtactttgtgccttctta

SEQ ID NO: 672770 - DNA, 25 bp, Mus musculus
gtaggtttactaattattcggaatg

SEQ ID NO: 672771 - DNA, 25 bp, Mus musculus
gtaggtttactatttattcggaatg

SEQ ID NO: 672772 - DNA, 25 bp, Mus musculus
gtaggtttccaaatggctattgccg

SEQ ID NO: 672773 - DNA, 25 bp, Mus musculus
gtaggtttccaattggctattgccg

SEQ ID NO: 672774 - DNA, 25 bp, Mus musculus
gtaggtttcctaacatctctgtgtc

SEQ ID NO: 672775 - DNA, 25 bp, Mus musculus
gtaggtttcctatcatctctgtgtc

SEQ ID NO: 672776 - DNA, 25 bp, Mus musculus
gtaggtttgactccatatgaatata

SEQ ID NO: 672777 - DNA, 25 bp, Mus musculus
gtaggtttgactgcatatgaatata

SEQ ID NO: 672778 - DNA, 25 bp, Mus musculus
gtaggtttgatccacagtactgaat

SEQ ID NO: 672779 - DNA, 25 bp, Mus musculus
gtaggtttgatcgacagtactgaat

SEQ ID NO: 672780 - DNA, 25 bp, Mus musculus
gtaggtttgcttaagttcacatacg

SEQ ID NO: 672781 - DNA, 25 bp, Mus musculus
gtaggtttgctttagttcacatacg

SEQ ID NO: 672782 - DNA, 25 bp, Mus musculus
gtaggttttaacatcagtgtctctg

SEQ ID NO: 672783 - DNA, 25 bp, Mus musculus
gtaggttttaacttcagtgtctctg

SEQ ID NO: 672784 - DNA, 25 bp, Mus musculus
gtaggttttattaatacttcagaca

SEQ ID NO: 672785 - DNA, 25 bp, Mus musculus
gtaggttttatttatacttcagaca

SEQ ID NO: 672786 - DNA, 25 bp, Mus musculus
gtaggttttccaaatactcaggaga

SEQ ID NO: 672787 - DNA, 25 bp, Mus musculus
gtaggttttccatatactcaggaga

SEQ ID NO: 672788 - DNA, 25 bp, Mus musculus
gtaggttttcctcagcttgtgagat

SEQ ID NO: 672789 - DNA, 25 bp, Mus musculus
gtaggttttcctgagcttgtgagat

SEQ ID NO: 672790 - DNA, 25 bp, Mus musculus
gtaggtttttctccatgggtaggat

SEQ ID NO: 672791 - DNA, 25 bp, Mus musculus
gtaggtttttctgcatgggtaggat

SEQ ID NO: 672792 - DNA, 25 bp, Mus musculus
gtagtaaaaggccttgatatcttaa

SEQ ID NO: 672793 - DNA, 25 bp, Mus musculus
gtagtaaaaggcgttgatatcttaa

SEQ ID NO: 672794 - DNA, 25 bp, Mus musculus
gtagtaaacatcagcattttctcac

SEQ ID NO: 672795 - DNA, 25 bp, Mus musculus
gtagtaaacatctgcattttctcac

SEQ ID NO: 672796 - DNA, 25 bp, Mus musculus
gtagtaaagtgtatctcttccttgt

SEQ ID NO: 672797 - DNA, 25 bp, Mus musculus
gtagtaaagtgtttctcttccttgt

SEQ ID NO: 672798 - DNA, 25 bp, Mus musculus
gtagtaaatatcatagcaaactttt

SEQ ID NO: 672799 - DNA, 25 bp, Mus musculus
gtagtaaatatcttagcaaactttt

SEQ ID NO: 672800 - DNA, 25 bp, Mus musculus
gtagtaaatcctatgtttctcatgc

SEQ ID NO: 672801 - DNA, 25 bp, Mus musculus
gtagtaaatcctcatgtctgctcaa

SEQ ID NO: 672802 - DNA, 25 bp, Mus musculus
gtagtaaatcctgatgtctgctcaa

SEQ ID NO: 672803 - DNA, 25 bp, Mus musculus
gtagtaaatcctttgtttctcatgc

SEQ ID NO: 672804 - DNA, 25 bp, Mus musculus
gtagtaacactgctgacatcaccat

SEQ ID NO: 672805 - DNA, 25 bp, Mus musculus
gtagtaacactggtgacatcaccat

SEQ ID NO: 672806 - DNA, 25 bp, Mus musculus
gtagtaacagagactcaccccagaa

SEQ ID NO: 672807 - DNA, 25 bp, Mus musculus
gtagtaacagagtctcaccccagaa

SEQ ID NO: 672808 - DNA, 25 bp, Mus musculus
gtagtaacagtcatagtggtttcac

SEQ ID NO: 672809 - DNA, 25 bp, Mus musculus
gtagtaacagtcttagtggtttcac

SEQ ID NO: 672810 - DNA, 25 bp, Mus musculus
gtagtaacccacacgagagtgaccc

SEQ ID NO: 672811 - DNA, 25 bp, Mus musculus
gtagtaacccactcgagagtgaccc

SEQ ID NO: 672812 - DNA, 25 bp, Mus musculus
gtagtaaccctgcagagtcatcccg

SEQ ID NO: 672813 - DNA, 25 bp, Mus musculus
gtagtaaccctggagagtcatcccg

SEQ ID NO: 672814 - DNA, 25 bp, Mus musculus
gtagtaactatgcaaatacaaacaa

SEQ ID NO: 672815 - DNA, 25 bp, Mus musculus
gtagtaactatggaaatacaaacaa

SEQ ID NO: 672816 - DNA, 25 bp, Mus musculus
gtagtaactgttccacgtcacaaag

SEQ ID NO: 672817 - DNA, 25 bp, Mus musculus
gtagtaactgttgcacgtcacaaag

SEQ ID NO: 672818 - DNA, 25 bp, Mus musculus
gtagtaacttggcatctgtattgat

SEQ ID NO: 672819 - DNA, 25 bp, Mus musculus
gtagtaacttgggatctgtattgat

SEQ ID NO: 672820 - DNA, 25 bp, Mus musculus
gtagtaacttttcatctattaacca

SEQ ID NO: 672821 - DNA, 25 bp, Mus musculus
gtagtaacttttgatctattaacca

SEQ ID NO: 672822 - DNA, 25 bp, Mus musculus
gtagtaagacttcggcgattggatt

SEQ ID NO: 672823 - DNA, 25 bp, Mus musculus
gtagtaagacttgggcgattggatt

SEQ ID NO: 672824 - DNA, 25 bp, Mus musculus
gtagtaagatctcactgacgtgcag

SEQ ID NO: 672825 - DNA, 25 bp, Mus musculus
gtagtaagatctgactgacgtgcag

SEQ ID NO: 672826 - DNA, 25 bp, Mus musculus
gtagtaagccctatcccaggcatga

SEQ ID NO: 672827 - DNA, 25 bp, Mus musculus
gtagtaagccctttcccaggcatga

SEQ ID NO: 672828 - DNA, 25 bp, Mus musculus
gtagtaagccttcggtagcagacct

SEQ ID NO: 672829 - DNA, 25 bp, Mus musculus
gtagtaagccttgggtagcagacct

SEQ ID NO: 672830 - DNA, 25 bp, Mus musculus
gtagtaagctacctgatttcaagac

SEQ ID NO: 672831 - DNA, 25 bp, Mus musculus
gtagtaagctacgtgatttcaagac

SEQ ID NO: 672832 - DNA, 25 bp, Mus musculus
gtagtaaggtgcaagttggtcacat

SEQ ID NO: 672833 - DNA, 25 bp, Mus musculus
gtagtaaggtgctagttggtcacat

SEQ ID NO: 672834 - DNA, 25 bp, Mus musculus
gtagtaagtactctagtcctatggg

SEQ ID NO: 672835 - DNA, 25 bp, Mus musculus
gtagtaagtactgtagtcctatggg

SEQ ID NO: 672836 - DNA, 25 bp, Mus musculus
gtagtaagtatgacccagtctgcaa

SEQ ID NO: 672837 - DNA, 25 bp, Mus musculus
gtagtaagtatgtcccagtctgcaa

SEQ ID NO: 672838 - DNA, 25 bp, Mus musculus
gtagtaagtctgaagtccaaaacca

SEQ ID NO: 672839 - DNA, 25 bp, Mus musculus
gtagtaagtctgtagtccaaaacca

SEQ ID NO: 672840 - DNA, 25 bp, Mus musculus
gtagtaataagaagtgggatttcct

SEQ ID NO: 672841 - DNA, 25 bp, Mus musculus
gtagtaataagatgtgggatttcct

SEQ ID NO: 672842 - DNA, 25 bp, Mus musculus
gtagtaatcatccacgttttcctgc

SEQ ID NO: 672843 - DNA, 25 bp, Mus musculus
gtagtaatcatcgacgttttcctgc

SEQ ID NO: 672844 - DNA, 25 bp, Mus musculus
gtagtaatccaaagttgccgcctcc

SEQ ID NO: 672845 - DNA, 25 bp, Mus musculus
gtagtaatccaatgttgccgcctcc

SEQ ID NO: 672846 - DNA, 25 bp, Mus musculus
gtagtaatgtttagctagcctgact

SEQ ID NO: 672847 - DNA, 25 bp, Mus musculus
gtagtaatgttttgctagcctgact

SEQ ID NO: 672848 - DNA, 25 bp, Mus musculus
gtagtaattctaaagcttgaccaag

SEQ ID NO: 672849 - DNA, 25 bp, Mus musculus
gtagtaattctatagcttgaccaag

SEQ ID NO: 672850 - DNA, 25 bp, Mus musculus
gtagtaccatggattcacagatgta

SEQ ID NO: 672851 - DNA, 25 bp, Mus musculus
gtagtaccatggatttcctgggtaa

SEQ ID NO: 672852 - DNA, 25 bp, Mus musculus
gtagtaccatggtttcacagatgta

SEQ ID NO: 672853 - DNA, 25 bp, Mus musculus
gtagtaccatggttttcctgggtaa

SEQ ID NO: 672854 - DNA, 25 bp, Mus musculus
gtagtacccaggcttttatatcact

SEQ ID NO: 672855 - DNA, 25 bp, Mus musculus
gtagtacccagggttttatatcact

SEQ ID NO: 672856 - DNA, 25 bp, Mus musculus
gtagtacccctgaccaattatgcat

SEQ ID NO: 672857 - DNA, 25 bp, Mus musculus
gtagtacccctgtccaattatgcat

SEQ ID NO: 672858 - DNA, 25 bp, Mus musculus
gtagtacctgtgatgttcactggtg

SEQ ID NO: 672859 - DNA, 25 bp, Mus musculus
gtagtacctgtgttgttcactggtg

SEQ ID NO: 672860 - DNA, 25 bp, Mus musculus
gtagtaccttctacttaggaagaca

SEQ ID NO: 672861 - DNA, 25 bp, Mus musculus
gtagtaccttcttcttaggaagaca

SEQ ID NO: 672862 - DNA, 25 bp, Mus musculus
gtagtacctttcagttgacggcgtt

SEQ ID NO: 672863 - DNA, 25 bp, Mus musculus
gtagtacctttctgttgacggcgtt

SEQ ID NO: 672864 - DNA, 25 bp, Mus musculus
gtagtacctttgaccttgaattctt

SEQ ID NO: 672865 - DNA, 25 bp, Mus musculus
gtagtacctttgtccttgaattctt

SEQ ID NO: 672866 - DNA, 25 bp, Mus musculus
gtagtacgagtgaggttctgcaacc

SEQ ID NO: 672867 - DNA, 25 bp, Mus musculus
gtagtacgagtgtggttctgcaacc

SEQ ID NO: 672868 - DNA, 25 bp, Mus musculus
gtagtacgcataatgttccggactt

SEQ ID NO: 672869 - DNA, 25 bp, Mus musculus
gtagtacgcatattgttccggactt

SEQ ID NO: 672870 - DNA, 25 bp, Mus musculus
gtagtactgagccaccatgctttaa

SEQ ID NO: 672871 - DNA, 25 bp, Mus musculus
gtagtactgagcgaccatgctttaa

SEQ ID NO: 672872 - DNA, 25 bp, Mus musculus
gtagtacttattcaggaccccatgg

SEQ ID NO: 672873 - DNA, 25 bp, Mus musculus
gtagtacttattgaggaccccatgg

SEQ ID NO: 672874 - DNA, 25 bp, Mus musculus
gtagtacttgagcaagctggagaaa

SEQ ID NO: 672875 - DNA, 25 bp, Mus musculus
gtagtacttgaggaagctggagaaa

SEQ ID NO: 672876 - DNA, 25 bp, Mus musculus
gtagtactttcccataaaaatcagt

SEQ ID NO: 672877 - DNA, 25 bp, Mus musculus
gtagtactttccgataaaaatcagt

SEQ ID NO: 672878 - DNA, 25 bp, Mus musculus
gtagtagaaccacaggcgccttctt

SEQ ID NO: 672879 - DNA, 25 bp, Mus musculus
gtagtagaaccagaggcgccttctt

SEQ ID NO: 672880 - DNA, 25 bp, Mus musculus
gtagtagaactcatccagtcactgg

SEQ ID NO: 672881 - DNA, 25 bp, Mus musculus
gtagtagaactcttccagtcactgg

SEQ ID NO: 672882 - DNA, 25 bp, Mus musculus
gtagtagacagtacacttacacagg

SEQ ID NO: 672883 - DNA, 25 bp, Mus musculus
gtagtagacagttcacttacacagg

SEQ ID NO: 672884 - DNA, 25 bp, Mus musculus
gtagtagacatgcttgacgagaaac

SEQ ID NO: 672885 - DNA, 25 bp, Mus musculus
gtagtagacatggttgacgagaaac

SEQ ID NO: 672886 - DNA, 25 bp, Mus musculus
gtagtagaccaaccacgtgaacatt

SEQ ID NO: 672887 - DNA, 25 bp, Mus musculus
gtagtagaccaagcacgtgaacatt

SEQ ID NO: 672888 - DNA, 25 bp, Mus musculus
gtagtagactcacaaagataacaag

SEQ ID NO: 672889 - DNA, 25 bp, Mus musculus
gtagtagactcagaaagataacaag

SEQ ID NO: 672890 - DNA, 25 bp, Mus musculus
gtagtagactgtaacccttttgagg

SEQ ID NO: 672891 - DNA, 25 bp, Mus musculus
gtagtagactgttacccttttgagg

SEQ ID NO: 672892 - DNA, 25 bp, Mus musculus
gtagtagagattctcacgcattctg

SEQ ID NO: 672893 - DNA, 25 bp, Mus musculus
gtagtagagattgtcacgcattctg

SEQ ID NO: 672894 - DNA, 25 bp, Mus musculus
gtagtagagctcaagccatcaaatt

SEQ ID NO: 672895 - DNA, 25 bp, Mus musculus
gtagtagagctctagccatcaaatt

SEQ ID NO: 672896 - DNA, 25 bp, Mus musculus
gtagtagaggctcatggccctccta

SEQ ID NO: 672897 - DNA, 25 bp, Mus musculus
gtagtagaggctgatggccctccta

SEQ ID NO: 672898 - DNA, 25 bp, Mus musculus
gtagtagagtgtatgagctgaacca

SEQ ID NO: 672899 - DNA, 25 bp, Mus musculus
gtagtagagtgtttgagctgaacca

SEQ ID NO: 672900 - DNA, 25 bp, Mus musculus
gtagtagataaaaagcggcctcttt

SEQ ID NO: 672901 - DNA, 25 bp, Mus musculus
gtagtagataaatagcggcctcttt

SEQ ID NO: 672902 - DNA, 25 bp, Mus musculus
gtagtagatcacatctacccgcatt

SEQ ID NO: 672903 - DNA, 25 bp, Mus musculus
gtagtagatcacttctacccgcatt

SEQ ID NO: 672904 - DNA, 25 bp, Mus musculus
gtagtagattccacctaaccagaga

SEQ ID NO: 672905 - DNA, 25 bp, Mus musculus
gtagtagattcctcctaaccagaga

SEQ ID NO: 672906 - DNA, 25 bp, Mus musculus
gtagtagcaatgatttaatcagtaa

SEQ ID NO: 672907 - DNA, 25 bp, Mus musculus
gtagtagcaatgttttaatcagtaa

SEQ ID NO: 672908 - DNA, 25 bp, Mus musculus
gtagtagccaaaaacctgacagtaa

SEQ ID NO: 672909 - DNA, 25 bp, Mus musculus
gtagtagccaaactcacaacttgga

SEQ ID NO: 672910 - DNA, 25 bp, Mus musculus
gtagtagccaaagtcacaacttgga

SEQ ID NO: 672911 - DNA, 25 bp, Mus musculus
gtagtagccaaatacctgacagtaa

SEQ ID NO: 672912 - DNA, 25 bp, Mus musculus
gtagtagccactctctgtcagaatt

SEQ ID NO: 672913 - DNA, 25 bp, Mus musculus
gtagtagccactgtctgtcagaatt

SEQ ID NO: 672914 - DNA, 25 bp, Mus musculus
gtagtagccatactagtgtaacatt

SEQ ID NO: 672915 - DNA, 25 bp, Mus musculus
gtagtagccatagtagtgtaacatt

SEQ ID NO: 672916 - DNA, 25 bp, Mus musculus
gtagtagcctagatcggcagattta

SEQ ID NO: 672917 - DNA, 25 bp, Mus musculus
gtagtagcctagttcggcagattta

SEQ ID NO: 672918 - DNA, 25 bp, Mus musculus
gtagtagcctggaagactggattct

SEQ ID NO: 672919 - DNA, 25 bp, Mus musculus
gtagtagcctggtagactggattct

SEQ ID NO: 672920 - DNA, 25 bp, Mus musculus
gtagtagccttgatatttgacttaa

SEQ ID NO: 672921 - DNA, 25 bp, Mus musculus
gtagtagccttgttatttgacttaa

SEQ ID NO: 672922 - DNA, 25 bp, Mus musculus
gtagtagctacaattccttttgaag

SEQ ID NO: 672923 - DNA, 25 bp, Mus musculus
gtagtagctacatttccttttgaag

SEQ ID NO: 672924 - DNA, 25 bp, Mus musculus
gtagtagctcacattagctcctcca

SEQ ID NO: 672925 - DNA, 25 bp, Mus musculus
gtagtagctcactttagctcctcca

SEQ ID NO: 672926 - DNA, 25 bp, Mus musculus
gtagtagctgcaagcaaccataaat

SEQ ID NO: 672927 - DNA, 25 bp, Mus musculus
gtagtagctgcatgcaaccataaat

SEQ ID NO: 672928 - DNA, 25 bp, Mus musculus
gtagtagctgggacacactgtggca

SEQ ID NO: 672929 - DNA, 25 bp, Mus musculus
gtagtagctgggtcacactgtggca

SEQ ID NO: 672930 - DNA, 25 bp, Mus musculus
gtagtagcttatcacatatataata

SEQ ID NO: 672931 - DNA, 25 bp, Mus musculus
gtagtagcttatgacatatataata

SEQ ID NO: 672932 - DNA, 25 bp, Mus musculus
gtagtagggcccaagacaactccct

SEQ ID NO: 672933 - DNA, 25 bp, Mus musculus
gtagtagggccctagacaactccct

SEQ ID NO: 672934 - DNA, 25 bp, Mus musculus
gtagtaggtcccagtagccacagaa

SEQ ID NO: 672935 - DNA, 25 bp, Mus musculus
gtagtaggtccctgtagccacagaa

SEQ ID NO: 672936 - DNA, 25 bp, Mus musculus
gtagtaggtctcctgtgcctgagaa

SEQ ID NO: 672937 - DNA, 25 bp, Mus musculus
gtagtaggtctcgtgtgcctgagaa

SEQ ID NO: 672938 - DNA, 25 bp, Mus musculus
gtagtagtaactcatgtcccaaaat

SEQ ID NO: 672939 - DNA, 25 bp, Mus musculus
gtagtagtaactgatgtcccaaaat

SEQ ID NO: 672940 - DNA, 25 bp, Mus musculus
gtagtagtacaaatctcatccccag

SEQ ID NO: 672941 - DNA, 25 bp, Mus musculus
gtagtagtacaattctcatccccag

SEQ ID NO: 672942 - DNA, 25 bp, Mus musculus
gtagtagtacacagtatatttcctt

SEQ ID NO: 672943 - DNA, 25 bp, Mus musculus
gtagtagtacactgtatatttcctt

SEQ ID NO: 672944 - DNA, 25 bp, Mus musculus
gtagtagtcacacatttctatcctt

SEQ ID NO: 672945 - DNA, 25 bp, Mus musculus
gtagtagtcacagatttctatcctt

SEQ ID NO: 672946 - DNA, 25 bp, Mus musculus
gtagtagtcaccagttcctttctgt

SEQ ID NO: 672947 - DNA, 25 bp, Mus musculus
gtagtagtcacctgttcctttctgt

SEQ ID NO: 672948 - DNA, 25 bp, Mus musculus
gtagtagtcgatcacttgagttaca

SEQ ID NO: 672949 - DNA, 25 bp, Mus musculus
gtagtagtcgatgacttgagttaca

SEQ ID NO: 672950 - DNA, 25 bp, Mus musculus
gtagtagtcttccttatatgaatac

SEQ ID NO: 672951 - DNA, 25 bp, Mus musculus
gtagtagtcttcgttatatgaatac

SEQ ID NO: 672952 - DNA, 25 bp, Mus musculus
gtagtagtgcttcagtttctgtaaa

SEQ ID NO: 672953 - DNA, 25 bp, Mus musculus
gtagtagtgcttgagtttctgtaaa

SEQ ID NO: 672954 - DNA, 25 bp, Mus musculus
gtagtagtgggtcttagcttcctcc

SEQ ID NO: 672955 - DNA, 25 bp, Mus musculus
gtagtagtgggtgttagcttcctcc

SEQ ID NO: 672956 - DNA, 25 bp, Mus musculus
gtagtagttacaactatacacacac

SEQ ID NO: 672957 - DNA, 25 bp, Mus musculus
gtagtagttacatctatacacacac

SEQ ID NO: 672958 - DNA, 25 bp, Mus musculus
gtagtataacctcatcacctgctga

SEQ ID NO: 672959 - DNA, 25 bp, Mus musculus
gtagtataacctgatcacctgctga

SEQ ID NO: 672960 - DNA, 25 bp, Mus musculus
gtagtatacagaaggcttaaaggga

SEQ ID NO: 672961 - DNA, 25 bp, Mus musculus
gtagtatacagatggcttaaaggga

SEQ ID NO: 672962 - DNA, 25 bp, Mus musculus
gtagtataggatattttctctttag

SEQ ID NO: 672963 - DNA, 25 bp, Mus musculus
gtagtataggattttttctctttag

SEQ ID NO: 672964 - DNA, 25 bp, Mus musculus
gtagtatatccaagcatttaataac

SEQ ID NO: 672965 - DNA, 25 bp, Mus musculus
gtagtatatccatgcatttaataac

SEQ ID NO: 672966 - DNA, 25 bp, Mus musculus
gtagtatatctaactcctgtaagga

SEQ ID NO: 672967 - DNA, 25 bp, Mus musculus
gtagtatatctatctcctgtaagga

SEQ ID NO: 672968 - DNA, 25 bp, Mus musculus
gtagtatattccctttttctttgtg

SEQ ID NO: 672969 - DNA, 25 bp, Mus musculus
gtagtatattccgtttttctttgtg

SEQ ID NO: 672970 - DNA, 25 bp, Mus musculus
gtagtatcaagacggctcccaactg

SEQ ID NO: 672971 - DNA, 25 bp, Mus musculus
gtagtatcaagagggctcccaactg

SEQ ID NO: 672972 - DNA, 25 bp, Mus musculus
gtagtatccaaacataagtctgcat

SEQ ID NO: 672973 - DNA, 25 bp, Mus musculus
gtagtatccaaagataagtctgcat

SEQ ID NO: 672974 - DNA, 25 bp, Mus musculus
gtagtatccagaattccacacatcc

SEQ ID NO: 672975 - DNA, 25 bp, Mus musculus
gtagtatccagatttccacacatcc

SEQ ID NO: 672976 - DNA, 25 bp, Mus musculus
gtagtatcgcatagaagcagtcctt

SEQ ID NO: 672977 - DNA, 25 bp, Mus musculus
gtagtatcgcattgaagcagtcctt

SEQ ID NO: 672978 - DNA, 25 bp, Mus musculus
gtagtatctatcagttgacctctct

SEQ ID NO: 672979 - DNA, 25 bp, Mus musculus
gtagtatctatctgttgacctctct

SEQ ID NO: 672980 - DNA, 25 bp, Mus musculus
gtagtatctcagactttgcataaat

SEQ ID NO: 672981 - DNA, 25 bp, Mus musculus
gtagtatctcagtctttgcataaat

SEQ ID NO: 672982 - DNA, 25 bp, Mus musculus
gtagtatctccccacgtgttagtgg

SEQ ID NO: 672983 - DNA, 25 bp, Mus musculus
gtagtatctcccgacgtgttagtgg

SEQ ID NO: 672984 - DNA, 25 bp, Mus musculus
gtagtatcttgaactgtttttgaag

SEQ ID NO: 672985 - DNA, 25 bp, Mus musculus
gtagtatcttgatctgtttttgaag

SEQ ID NO: 672986 - DNA, 25 bp, Mus musculus
gtagtatcttttaataggctgcaat

SEQ ID NO: 672987 - DNA, 25 bp, Mus musculus
gtagtatctttttataggctgcaat

SEQ ID NO: 672988 - DNA, 25 bp, Mus musculus
gtagtatgaagtcccgagtacctaa

SEQ ID NO: 672989 - DNA, 25 bp, Mus musculus
gtagtatgaagtgccgagtacctaa

SEQ ID NO: 672990 - DNA, 25 bp, Mus musculus
gtagtatgactcacactcctatgga

SEQ ID NO: 672991 - DNA, 25 bp, Mus musculus
gtagtatgactctcactcctatgga

SEQ ID NO: 672992 - DNA, 25 bp, Mus musculus
gtagtatggcataatgtcatgactt

SEQ ID NO: 672993 - DNA, 25 bp, Mus musculus
gtagtatggcattatgtcatgactt

SEQ ID NO: 672994 - DNA, 25 bp, Mus musculus
gtagtatgtagaaatgtctcccagc

SEQ ID NO: 672995 - DNA, 25 bp, Mus musculus
gtagtatgtagatatgtctcccagc

SEQ ID NO: 672996 - DNA, 25 bp, Mus musculus
gtagtatgtctcctgggtctccata

SEQ ID NO: 672997 - DNA, 25 bp, Mus musculus
gtagtatgtctcgtgggtctccata

SEQ ID NO: 672998 - DNA, 25 bp, Mus musculus
gtagtatgtgttccatccagtttct

SEQ ID NO: 672999 - DNA, 25 bp, Mus musculus
gtagtatgtgttgcatccagtttct

SEQ ID NO: 673000 - DNA, 25 bp, Mus musculus
gtagtatgttggactctaccaccac

SEQ ID NO: 673001 - DNA, 25 bp, Mus musculus
gtagtatgttggtctctaccaccac

SEQ ID NO: 673002 - DNA, 25 bp, Mus musculus
gtagtattaaagctctccatttgaa

SEQ ID NO: 673003 - DNA, 25 bp, Mus musculus
gtagtattaaaggtctccatttgaa

SEQ ID NO: 673004 - DNA, 25 bp, Mus musculus
gtagtattacttcatgtcacccaga

SEQ ID NO: 673005 - DNA, 25 bp, Mus musculus
gtagtattacttgatgtcacccaga

SEQ ID NO: 673006 - DNA, 25 bp, Mus musculus
gtagtattcctcatgaactttctca

SEQ ID NO: 673007 - DNA, 25 bp, Mus musculus
gtagtattcctcttgaactttctca

SEQ ID NO: 673008 - DNA, 25 bp, Mus musculus
gtagtattgtgcacgcatgccagtt

SEQ ID NO: 673009 - DNA, 25 bp, Mus musculus
gtagtattgtgcactgatttgacca

SEQ ID NO: 673010 - DNA, 25 bp, Mus musculus
gtagtattgtgctcgcatgccagtt

SEQ ID NO: 673011 - DNA, 25 bp, Mus musculus
gtagtattgtgctctgatttgacca

SEQ ID NO: 673012 - DNA, 25 bp, Mus musculus
gtagtatttctgcatgtcttcctta

SEQ ID NO: 673013 - DNA, 25 bp, Mus musculus
gtagtatttctggatgtcttcctta

SEQ ID NO: 673014 - DNA, 25 bp, Mus musculus
gtagtattttgtctttggtgtttca

SEQ ID NO: 673015 - DNA, 25 bp, Mus musculus
gtagtattttgtgtttggtgtttca

SEQ ID NO: 673016 - DNA, 25 bp, Mus musculus
gtagtcaaataaacctagggccgat

SEQ ID NO: 673017 - DNA, 25 bp, Mus musculus
gtagtcaaataatcctagggccgat

SEQ ID NO: 673018 - DNA, 25 bp, Mus musculus
gtagtcaaccacaggatctcagttt

SEQ ID NO: 673019 - DNA, 25 bp, Mus musculus
gtagtcaaccactggatctcagttt

SEQ ID NO: 673020 - DNA, 25 bp, Mus musculus
gtagtcaaccgcactcatattgtag

SEQ ID NO: 673021 - DNA, 25 bp, Mus musculus
gtagtcaaccgctctcatattgtag

SEQ ID NO: 673022 - DNA, 25 bp, Mus musculus
gtagtcaacttcactttgcaaaact

SEQ ID NO: 673023 - DNA, 25 bp, Mus musculus
gtagtcaacttctctttgcaaaact

SEQ ID NO: 673024 - DNA, 25 bp, Mus musculus
gtagtcaagtctcaaattatttttc

SEQ ID NO: 673025 - DNA, 25 bp, Mus musculus
gtagtcaagtctgaaattatttttc

SEQ ID NO: 673026 - DNA, 25 bp, Mus musculus
gtagtcaataatacaggcttctctg

SEQ ID NO: 673027 - DNA, 25 bp, Mus musculus
gtagtcaataattcaggcttctctg

SEQ ID NO: 673028 - DNA, 25 bp, Mus musculus
gtagtcacagagatcatggatgtca

SEQ ID NO: 673029 - DNA, 25 bp, Mus musculus
gtagtcacagagttcatggatgtca

SEQ ID NO: 673030 - DNA, 25 bp, Mus musculus
gtagtcacatagcagcctttccagg

SEQ ID NO: 673031 - DNA, 25 bp, Mus musculus
gtagtcacataggagcctttccagg

SEQ ID NO: 673032 - DNA, 25 bp, Mus musculus
gtagtcacattccaaagccactggg

SEQ ID NO: 673033 - DNA, 25 bp, Mus musculus
gtagtcacattcgaaagccactggg

SEQ ID NO: 673034 - DNA, 25 bp, Mus musculus
gtagtcaccaccagagagagggcga

SEQ ID NO: 673035 - DNA, 25 bp, Mus musculus
gtagtcaccacctgagagagggcga

SEQ ID NO: 673036 - DNA, 25 bp, Mus musculus
gtagtcaccagaaacttcacgacaa

SEQ ID NO: 673037 - DNA, 25 bp, Mus musculus
gtagtcaccagatacttcacgacaa

SEQ ID NO: 673038 - DNA, 25 bp, Mus musculus
gtagtcaccattagtttctctgctg

SEQ ID NO: 673039 - DNA, 25 bp, Mus musculus
gtagtcaccatttgtttctctgctg

SEQ ID NO: 673040 - DNA, 25 bp, Mus musculus
gtagtcacctgtaagtctatgttgg

SEQ ID NO: 673041 - DNA, 25 bp, Mus musculus
gtagtcacctgttagtctatgttgg

SEQ ID NO: 673042 - DNA, 25 bp, Mus musculus
gtagtcacggctccagtgattgcca

SEQ ID NO: 673043 - DNA, 25 bp, Mus musculus
gtagtcacggctgcagtgattgcca

SEQ ID NO: 673044 - DNA, 25 bp, Mus musculus
gtagtcactgtgcattgacagactt

SEQ ID NO: 673045 - DNA, 25 bp, Mus musculus
gtagtcactgtggattgacagactt

SEQ ID NO: 673046 - DNA, 25 bp, Mus musculus
gtagtcagaccacttgtaacttagt

SEQ ID NO: 673047 - DNA, 25 bp, Mus musculus
gtagtcagaccagttgtaacttagt

SEQ ID NO: 673048 - DNA, 25 bp, Mus musculus
gtagtcagcgacagcccagattgct

SEQ ID NO: 673049 - DNA, 25 bp, Mus musculus
gtagtcagcgactgcccagattgct

SEQ ID NO: 673050 - DNA, 25 bp, Mus musculus
gtagtcaggattaccagatattatg

SEQ ID NO: 673051 - DNA, 25 bp, Mus musculus
gtagtcaggatttccagatattatg

SEQ ID NO: 673052 - DNA, 25 bp, Mus musculus
gtagtcaggctcatcctgggatgcc

SEQ ID NO: 673053 - DNA, 25 bp, Mus musculus
gtagtcaggctcttcctgggatgcc

SEQ ID NO: 673054 - DNA, 25 bp, Mus musculus
gtagtcaggctgagagagtaaaact

SEQ ID NO: 673055 - DNA, 25 bp, Mus musculus
gtagtcaggctgtgagagtaaaact

SEQ ID NO: 673056 - DNA, 25 bp, Mus musculus
gtagtcagggaaccattaccccatt

SEQ ID NO: 673057 - DNA, 25 bp, Mus musculus
gtagtcagggaagcattaccccatt

SEQ ID NO: 673058 - DNA, 25 bp, Mus musculus
gtagtcaggtgcacaacggagaata

SEQ ID NO: 673059 - DNA, 25 bp, Mus musculus
gtagtcaggtgctcaacggagaata

SEQ ID NO: 673060 - DNA, 25 bp, Mus musculus
gtagtcagtattactcactgggtga

SEQ ID NO: 673061 - DNA, 25 bp, Mus musculus
gtagtcagtatttctcactgggtga

SEQ ID NO: 673062 - DNA, 25 bp, Mus musculus
gtagtcagtcatagcttgctagcca

SEQ ID NO: 673063 - DNA, 25 bp, Mus musculus
gtagtcagtcattgcttgctagcca

SEQ ID NO: 673064 - DNA, 25 bp, Mus musculus
gtagtcatcaacacagctgtcctta

SEQ ID NO: 673065 - DNA, 25 bp, Mus musculus
gtagtcatcaactcagctgtcctta

SEQ ID NO: 673066 - DNA, 25 bp, Mus musculus
gtagtcatcaagactttcgacagaa

SEQ ID NO: 673067 - DNA, 25 bp, Mus musculus
gtagtcatcaagtctttcgacagaa

SEQ ID NO: 673068 - DNA, 25 bp, Mus musculus
gtagtcatccatcacaatgttctgt

SEQ ID NO: 673069 - DNA, 25 bp, Mus musculus
gtagtcatccatgacaatgttctgt

SEQ ID NO: 673070 - DNA, 25 bp, Mus musculus
gtagtcatctgccattactgttatt

SEQ ID NO: 673071 - DNA, 25 bp, Mus musculus
gtagtcatctgcgattactgttatt

SEQ ID NO: 673072 - DNA, 25 bp, Mus musculus
gtagtcatctggacaggcttccaaa

SEQ ID NO: 673073 - DNA, 25 bp, Mus musculus
gtagtcatctggtcaggcttccaaa

SEQ ID NO: 673074 - DNA, 25 bp, Mus musculus
gtagtcatcttaatacaaggtcaaa

SEQ ID NO: 673075 - DNA, 25 bp, Mus musculus
gtagtcatcttattacaaggtcaaa

SEQ ID NO: 673076 - DNA, 25 bp, Mus musculus
gtagtcatctttatgcctttgtgga

SEQ ID NO: 673077 - DNA, 25 bp, Mus musculus
gtagtcatctttttgcctttgtgga

SEQ ID NO: 673078 - DNA, 25 bp, Mus musculus
gtagtcatgattatcaggatctctt

SEQ ID NO: 673079 - DNA, 25 bp, Mus musculus
gtagtcatgattttcaggatctctt

SEQ ID NO: 673080 - DNA, 25 bp, Mus musculus
gtagtcatggatatacactctttca

SEQ ID NO: 673081 - DNA, 25 bp, Mus musculus
gtagtcatggatttacactctttca

SEQ ID NO: 673082 - DNA, 25 bp, Mus musculus
gtagtcatggtgaactgtggcctca

SEQ ID NO: 673083 - DNA, 25 bp, Mus musculus
gtagtcatggtgtactgtggcctca

SEQ ID NO: 673084 - DNA, 25 bp, Mus musculus
gtagtcattaacacacagtgtcctt

SEQ ID NO: 673085 - DNA, 25 bp, Mus musculus
gtagtcattaactcacagtgtcctt

SEQ ID NO: 673086 - DNA, 25 bp, Mus musculus
gtagtcattctgagtgttcttattt

SEQ ID NO: 673087 - DNA, 25 bp, Mus musculus
gtagtcattctgtgtgttcttattt

SEQ ID NO: 673088 - DNA, 25 bp, Mus musculus
gtagtcattcttccagactttagca

SEQ ID NO: 673089 - DNA, 25 bp, Mus musculus
gtagtcattcttgcagactttagca

SEQ ID NO: 673090 - DNA, 25 bp, Mus musculus
gtagtcattggtcatctcaagtcat

SEQ ID NO: 673091 - DNA, 25 bp, Mus musculus
gtagtcattggtgatctcaagtcat

SEQ ID NO: 673092 - DNA, 25 bp, Mus musculus
gtagtcatttatataccctggtagc

SEQ ID NO: 673093 - DNA, 25 bp, Mus musculus
gtagtcatttatttaccctggtagc

SEQ ID NO: 673094 - DNA, 25 bp, Mus musculus
gtagtcatttgaaccctgcattttt

SEQ ID NO: 673095 - DNA, 25 bp, Mus musculus
gtagtcatttgatccctgcattttt

SEQ ID NO: 673096 - DNA, 25 bp, Mus musculus
gtagtcatttggatgatcccacttg

SEQ ID NO: 673097 - DNA, 25 bp, Mus musculus
gtagtcatttggttgatcccacttg

SEQ ID NO: 673098 - DNA, 25 bp, Mus musculus
gtagtccaagtccttcggcagcgaa

SEQ ID NO: 673099 - DNA, 25 bp, Mus musculus
gtagtccaagtcgttcggcagcgaa

SEQ ID NO: 673100 - DNA, 25 bp, Mus musculus
gtagtccacatgaatgtaagactct

SEQ ID NO: 673101 - DNA, 25 bp, Mus musculus
gtagtccacatgtatgtaagactct

SEQ ID NO: 673102 - DNA, 25 bp, Mus musculus
gtagtccactgtaaagtcctgtgat

SEQ ID NO: 673103 - DNA, 25 bp, Mus musculus
gtagtccactgttaagtcctgtgat

SEQ ID NO: 673104 - DNA, 25 bp, Mus musculus
gtagtccagactaagctccagcttg

SEQ ID NO: 673105 - DNA, 25 bp, Mus musculus
gtagtccagacttagctccagcttg

SEQ ID NO: 673106 - DNA, 25 bp, Mus musculus
gtagtccagagtcgccttgcattca

SEQ ID NO: 673107 - DNA, 25 bp, Mus musculus
gtagtccagagtggccttgcattca

SEQ ID NO: 673108 - DNA, 25 bp, Mus musculus
gtagtccagtttctgactttgttca

SEQ ID NO: 673109 - DNA, 25 bp, Mus musculus
gtagtccagtttgtgactttgttca

SEQ ID NO: 673110 - DNA, 25 bp, Mus musculus
gtagtccatacaaattatggccatt

SEQ ID NO: 673111 - DNA, 25 bp, Mus musculus
gtagtccatacatattatggccatt

SEQ ID NO: 673112 - DNA, 25 bp, Mus musculus
gtagtccatttaataacagtaatca

SEQ ID NO: 673113 - DNA, 25 bp, Mus musculus
gtagtccatttattaacagtaatca

SEQ ID NO: 673114 - DNA, 25 bp, Mus musculus
gtagtcccaaagctgtagaacccaa

SEQ ID NO: 673115 - DNA, 25 bp, Mus musculus
gtagtcccaaaggtgtagaacccaa

SEQ ID NO: 673116 - DNA, 25 bp, Mus musculus
gtagtcccaccactgtattttactt

SEQ ID NO: 673117 - DNA, 25 bp, Mus musculus
gtagtcccaccagtgtattttactt

SEQ ID NO: 673118 - DNA, 25 bp, Mus musculus
gtagtcccagcaactgagaagtaga

SEQ ID NO: 673119 - DNA, 25 bp, Mus musculus
gtagtcccagcatctgagaagtaga

SEQ ID NO: 673120 - DNA, 25 bp, Mus musculus
gtagtcccagtgaacaacctttcca

SEQ ID NO: 673121 - DNA, 25 bp, Mus musculus
gtagtcccagtgtacaacctttcca

SEQ ID NO: 673122 - DNA, 25 bp, Mus musculus
gtagtcccctgaaacaaagccaaaa

SEQ ID NO: 673123 - DNA, 25 bp, Mus musculus
gtagtcccctgatacaaagccaaaa

SEQ ID NO: 673124 - DNA, 25 bp, Mus musculus
gtagtccccttaccatggaccagat

SEQ ID NO: 673125 - DNA, 25 bp, Mus musculus
gtagtccccttagcatggaccagat

SEQ ID NO: 673126 - DNA, 25 bp, Mus musculus
gtagtcccggaacaatgaagattta

SEQ ID NO: 673127 - DNA, 25 bp, Mus musculus
gtagtcccggaagaatgaagattta

SEQ ID NO: 673128 - DNA, 25 bp, Mus musculus
gtagtcccttcaaagctttgttaca

SEQ ID NO: 673129 - DNA, 25 bp, Mus musculus
gtagtcccttcatagctttgttaca

SEQ ID NO: 673130 - DNA, 25 bp, Mus musculus
gtagtccgcagcatcaagtagctct

SEQ ID NO: 673131 - DNA, 25 bp, Mus musculus
gtagtccgcagcttcaagtagctct

SEQ ID NO: 673132 - DNA, 25 bp, Mus musculus
gtagtcctaattatgtaccatggta

SEQ ID NO: 673133 - DNA, 25 bp, Mus musculus
gtagtcctaattttgtaccatggta

SEQ ID NO: 673134 - DNA, 25 bp, Mus musculus
gtagtcctatcaagttcccatagta

SEQ ID NO: 673135 - DNA, 25 bp, Mus musculus
gtagtcctatcatgttcccatagta

SEQ ID NO: 673136 - DNA, 25 bp, Mus musculus
gtagtcctcaacctgtaggtcttga

SEQ ID NO: 673137 - DNA, 25 bp, Mus musculus
gtagtcctcaacgtgtaggtcttga

SEQ ID NO: 673138 - DNA, 25 bp, Mus musculus
gtagtcctctttctccctgtggagc

SEQ ID NO: 673139 - DNA, 25 bp, Mus musculus
gtagtcctctttgtccctgtggagc

SEQ ID NO: 673140 - DNA, 25 bp, Mus musculus
gtagtcctgcaccatcttagataaa

SEQ ID NO: 673141 - DNA, 25 bp, Mus musculus
gtagtcctgcacgatcttagataaa

SEQ ID NO: 673142 - DNA, 25 bp, Mus musculus
gtagtcctgtatagcagttcctgta

SEQ ID NO: 673143 - DNA, 25 bp, Mus musculus
gtagtcctgtattgcagttcctgta

SEQ ID NO: 673144 - DNA, 25 bp, Mus musculus
gtagtccttatgaaacagaattgca

SEQ ID NO: 673145 - DNA, 25 bp, Mus musculus
gtagtccttatgtaacagaattgca

SEQ ID NO: 673146 - DNA, 25 bp, Mus musculus
gtagtccttattctgggtcatatcc

SEQ ID NO: 673147 - DNA, 25 bp, Mus musculus
gtagtccttattgtgggtcatatcc

SEQ ID NO: 673148 - DNA, 25 bp, Mus musculus
gtagtccttgcaatctggaggctaa

SEQ ID NO: 673149 - DNA, 25 bp, Mus musculus
gtagtccttgcattctggaggctaa

SEQ ID NO: 673150 - DNA, 25 bp, Mus musculus
gtagtccttgtgacccctggaagca

SEQ ID NO: 673151 - DNA, 25 bp, Mus musculus
gtagtccttgtgtcccctggaagca

SEQ ID NO: 673152 - DNA, 25 bp, Mus musculus
gtagtcgagaacagtatccgatgaa

SEQ ID NO: 673153 - DNA, 25 bp, Mus musculus
gtagtcgagaactgtatccgatgaa

SEQ ID NO: 673154 - DNA, 25 bp, Mus musculus
gtagtcgcactacagccccagcaga

SEQ ID NO: 673155 - DNA, 25 bp, Mus musculus
gtagtcgcactagagccccagcaga

SEQ ID NO: 673156 - DNA, 25 bp, Mus musculus
gtagtcgccatgaccttgtgctatg

SEQ ID NO: 673157 - DNA, 25 bp, Mus musculus
gtagtcgccatgtccttgtgctatg

SEQ ID NO: 673158 - DNA, 25 bp, Mus musculus
gtagtcgccgtgcctaccatggtga

SEQ ID NO: 673159 - DNA, 25 bp, Mus musculus
gtagtcgccgtggctaccatggtga

SEQ ID NO: 673160 - DNA, 25 bp, Mus musculus
gtagtcggaggcaccttaggtcttc

SEQ ID NO: 673161 - DNA, 25 bp, Mus musculus
gtagtcggaggctccttaggtcttc

SEQ ID NO: 673162 - DNA, 25 bp, Mus musculus
gtagtcgtccttatactgactgtca

SEQ ID NO: 673163 - DNA, 25 bp, Mus musculus
gtagtcgtccttttactgactgtca

SEQ ID NO: 673164 - DNA, 25 bp, Mus musculus
gtagtcgtgtcaaatttctgccaat

SEQ ID NO: 673165 - DNA, 25 bp, Mus musculus
gtagtcgtgtcatatttctgccaat

SEQ ID NO: 673166 - DNA, 25 bp, Mus musculus
gtagtctaacccatctgcatagtca

SEQ ID NO: 673167 - DNA, 25 bp, Mus musculus
gtagtctaacccttctgcatagtca

SEQ ID NO: 673168 - DNA, 25 bp, Mus musculus
gtagtctaacctcgttcagttttgg

SEQ ID NO: 673169 - DNA, 25 bp, Mus musculus
gtagtctaacctggttcagttttgg

SEQ ID NO: 673170 - DNA, 25 bp, Mus musculus
gtagtctacagaacccacaaagttc

SEQ ID NO: 673171 - DNA, 25 bp, Mus musculus
gtagtctacagatcccacaaagttc

SEQ ID NO: 673172 - DNA, 25 bp, Mus musculus
gtagtctacattaggcagtgaacag

SEQ ID NO: 673173 - DNA, 25 bp, Mus musculus
gtagtctacatttggcagtgaacag

SEQ ID NO: 673174 - DNA, 25 bp, Mus musculus
gtagtctactagcaatgttatttca

SEQ ID NO: 673175 - DNA, 25 bp, Mus musculus
gtagtctactaggaatgttatttca

SEQ ID NO: 673176 - DNA, 25 bp, Mus musculus
gtagtctaggctagtcttcagttca

SEQ ID NO: 673177 - DNA, 25 bp, Mus musculus
gtagtctaggctcggctaaaactca

SEQ ID NO: 673178 - DNA, 25 bp, Mus musculus
gtagtctaggctgggctaaaactca

SEQ ID NO: 673179 - DNA, 25 bp, Mus musculus
gtagtctaggcttgtcttcagttca

SEQ ID NO: 673180 - DNA, 25 bp, Mus musculus
gtagtctagtaaatcaccgtggttt

SEQ ID NO: 673181 - DNA, 25 bp, Mus musculus
gtagtctagtaattcaccgtggttt

SEQ ID NO: 673182 - DNA, 25 bp, Mus musculus
gtagtctagtgtctgttagctctct

SEQ ID NO: 673183 - DNA, 25 bp, Mus musculus
gtagtctagtgtgtgttagctctct

SEQ ID NO: 673184 - DNA, 25 bp, Mus musculus
gtagtctatactatccaagttttta

SEQ ID NO: 673185 - DNA, 25 bp, Mus musculus
gtagtctatactttccaagttttta

SEQ ID NO: 673186 - DNA, 25 bp, Mus musculus
gtagtctatagcatcttgtctgtgt

SEQ ID NO: 673187 - DNA, 25 bp, Mus musculus
gtagtctatagcttcttgtctgtgt

SEQ ID NO: 673188 - DNA, 25 bp, Mus musculus
gtagtctatgacaaccttaagggcc

SEQ ID NO: 673189 - DNA, 25 bp, Mus musculus
gtagtctatgactaccttaagggcc

SEQ ID NO: 673190 - DNA, 25 bp, Mus musculus
gtagtctatgatacctcactgccca

SEQ ID NO: 673191 - DNA, 25 bp, Mus musculus
gtagtctatgattcctcactgccca

SEQ ID NO: 673192 - DNA, 25 bp, Mus musculus
gtagtctatgtgaagcttccgacca

SEQ ID NO: 673193 - DNA, 25 bp, Mus musculus
gtagtctatgtgtagcttccgacca

SEQ ID NO: 673194 - DNA, 25 bp, Mus musculus
gtagtctcaacacttgggctcaagc

SEQ ID NO: 673195 - DNA, 25 bp, Mus musculus
gtagtctcaacagttgggctcaagc

SEQ ID NO: 673196 - DNA, 25 bp, Mus musculus
gtagtctcacccatagttcgatgaa

SEQ ID NO: 673197 - DNA, 25 bp, Mus musculus
gtagtctcacccttagttcgatgaa

SEQ ID NO: 673198 - DNA, 25 bp, Mus musculus
gtagtctcacttaaaaattccatgc

SEQ ID NO: 673199 - DNA, 25 bp, Mus musculus
gtagtctcactttaaaattccatgc

SEQ ID NO: 673200 - DNA, 25 bp, Mus musculus
gtagtctcagtgatcctatagcaag

SEQ ID NO: 673201 - DNA, 25 bp, Mus musculus
gtagtctcagtgttcctatagcaag

SEQ ID NO: 673202 - DNA, 25 bp, Mus musculus
gtagtctccagacgagtgtatttca

SEQ ID NO: 673203 - DNA, 25 bp, Mus musculus
gtagtctccagaggagtgtatttca

SEQ ID NO: 673204 - DNA, 25 bp, Mus musculus
gtagtctcccatactttaaatactg

SEQ ID NO: 673205 - DNA, 25 bp, Mus musculus
gtagtctcccattctttaaatactg

SEQ ID NO: 673206 - DNA, 25 bp, Mus musculus
gtagtctcgatacatcagtggattt

SEQ ID NO: 673207 - DNA, 25 bp, Mus musculus
gtagtctcgatagatcagtggattt

SEQ ID NO: 673208 - DNA, 25 bp, Mus musculus
gtagtctctagactttttgttccag

SEQ ID NO: 673209 - DNA, 25 bp, Mus musculus
gtagtctctagagtttttgttccag

SEQ ID NO: 673210 - DNA, 25 bp, Mus musculus
gtagtctctagcataaaagcatgtt

SEQ ID NO: 673211 - DNA, 25 bp, Mus musculus
gtagtctctagcttaaaagcatgtt

SEQ ID NO: 673212 - DNA, 25 bp, Mus musculus
gtagtctctctccagagcgttttaa

SEQ ID NO: 673213 - DNA, 25 bp, Mus musculus
gtagtctctctcgagagcgttttaa

SEQ ID NO: 673214 - DNA, 25 bp, Mus musculus
gtagtctctgatctatttcattcca

SEQ ID NO: 673215 - DNA, 25 bp, Mus musculus
gtagtctctgatgtatttcattcca

SEQ ID NO: 673216 - DNA, 25 bp, Mus musculus
gtagtctgacagaagcccttggata

SEQ ID NO: 673217 - DNA, 25 bp, Mus musculus
gtagtctgacagtagcccttggata

SEQ ID NO: 673218 - DNA, 25 bp, Mus musculus
gtagtctgcgcaaactttagggcca

SEQ ID NO: 673219 - DNA, 25 bp, Mus musculus
gtagtctgcgcatactttagggcca

SEQ ID NO: 673220 - DNA, 25 bp, Mus musculus
gtagtctgctttactgctaagaaaa

SEQ ID NO: 673221 - DNA, 25 bp, Mus musculus
gtagtctgctttatggtctatgaga

SEQ ID NO: 673222 - DNA, 25 bp, Mus musculus
gtagtctgcttttctgctaagaaaa

SEQ ID NO: 673223 - DNA, 25 bp, Mus musculus
gtagtctgctttttggtctatgaga

SEQ ID NO: 673224 - DNA, 25 bp, Mus musculus
gtagtctggttgctcagctaggaca

SEQ ID NO: 673225 - DNA, 25 bp, Mus musculus
gtagtctggttggtcagctaggaca

SEQ ID NO: 673226 - DNA, 25 bp, Mus musculus
gtagtctgtattcctatgcaccata

SEQ ID NO: 673227 - DNA, 25 bp, Mus musculus
gtagtctgtattgctatgcaccata

SEQ ID NO: 673228 - DNA, 25 bp, Mus musculus
gtagtctgtcaaccattgtatccta

SEQ ID NO: 673229 - DNA, 25 bp, Mus musculus
gtagtctgtcaagcattgtatccta

SEQ ID NO: 673230 - DNA, 25 bp, Mus musculus
gtagtctgtcatccactttacaaat

SEQ ID NO: 673231 - DNA, 25 bp, Mus musculus
gtagtctgtcatgcactttacaaat

SEQ ID NO: 673232 - DNA, 25 bp, Mus musculus
gtagtctgtgtgcataattttctca

SEQ ID NO: 673233 - DNA, 25 bp, Mus musculus
gtagtctgtgtggataattttctca

SEQ ID NO: 673234 - DNA, 25 bp, Mus musculus
gtagtctgttggaccaagaagccaa

SEQ ID NO: 673235 - DNA, 25 bp, Mus musculus
gtagtctgttggtccaagaagccaa

SEQ ID NO: 673236 - DNA, 25 bp, Mus musculus
gtagtctgttttagagtggccttgg

SEQ ID NO: 673237 - DNA, 25 bp, Mus musculus
gtagtctgtttttgagtggccttgg

SEQ ID NO: 673238 - DNA, 25 bp, Mus musculus
gtagtcttacatacctgattccttc

SEQ ID NO: 673239 - DNA, 25 bp, Mus musculus
gtagtcttacattcctgattccttc

SEQ ID NO: 673240 - DNA, 25 bp, Mus musculus
gtagtcttatcaccatccagtttta

SEQ ID NO: 673241 - DNA, 25 bp, Mus musculus
gtagtcttatcagcatccagtttta

SEQ ID NO: 673242 - DNA, 25 bp, Mus musculus
gtagtcttattcaggtaatctgaat

SEQ ID NO: 673243 - DNA, 25 bp, Mus musculus
gtagtcttattctggtaatctgaat

SEQ ID NO: 673244 - DNA, 25 bp, Mus musculus
gtagtcttcaaacttcatcactgag

SEQ ID NO: 673245 - DNA, 25 bp, Mus musculus
gtagtcttcaaagttcatcactgag

SEQ ID NO: 673246 - DNA, 25 bp, Mus musculus
gtagtcttcagaaggcattttctct

SEQ ID NO: 673247 - DNA, 25 bp, Mus musculus
gtagtcttcagatggcattttctct

SEQ ID NO: 673248 - DNA, 25 bp, Mus musculus
gtagtcttcaggcacatagccccaa

SEQ ID NO: 673249 - DNA, 25 bp, Mus musculus
gtagtcttcagggacatagccccaa

SEQ ID NO: 673250 - DNA, 25 bp, Mus musculus
gtagtcttccacaagtttctcacaa

SEQ ID NO: 673251 - DNA, 25 bp, Mus musculus
gtagtcttccactagtttctcacaa

SEQ ID NO: 673252 - DNA, 25 bp, Mus musculus
gtagtcttccttatatgaatacttg

SEQ ID NO: 673253 - DNA, 25 bp, Mus musculus
gtagtcttccttttatgaatacttg

SEQ ID NO: 673254 - DNA, 25 bp, Mus musculus
gtagtcttgcataaggacacagcct

SEQ ID NO: 673255 - DNA, 25 bp, Mus musculus
gtagtcttgcattaggacacagcct

SEQ ID NO: 673256 - DNA, 25 bp, Mus musculus
gtagtcttggcactagctgaaaaac

SEQ ID NO: 673257 - DNA, 25 bp, Mus musculus
gtagtcttggcagtagctgaaaaac

SEQ ID NO: 673258 - DNA, 25 bp, Mus musculus
gtagtcttggcgagccatctgctgt

SEQ ID NO: 673259 - DNA, 25 bp, Mus musculus
gtagtcttggcgtgccatctgctgt

SEQ ID NO: 673260 - DNA, 25 bp, Mus musculus
gtagtctttagacgtctttgtgtca

SEQ ID NO: 673261 - DNA, 25 bp, Mus musculus
gtagtctttagaggtctttgtgtca

SEQ ID NO: 673262 - DNA, 25 bp, Mus musculus
gtagtctttatgatggtcaccacct

SEQ ID NO: 673263 - DNA, 25 bp, Mus musculus
gtagtctttatgttggtcaccacct

SEQ ID NO: 673264 - DNA, 25 bp, Mus musculus
gtagtctttattcatgtctttccac

SEQ ID NO: 673265 - DNA, 25 bp, Mus musculus
gtagtctttattgatgtctttccac

SEQ ID NO: 673266 - DNA, 25 bp, Mus musculus
gtagtctttcagatgcaaggccagg

SEQ ID NO: 673267 - DNA, 25 bp, Mus musculus
gtagtctttcagttgcaaggccagg

SEQ ID NO: 673268 - DNA, 25 bp, Mus musculus
gtagtctttccaccggtttctgaag

SEQ ID NO: 673269 - DNA, 25 bp, Mus musculus
gtagtctttccagcggtttctgaag

SEQ ID NO: 673270 - DNA, 25 bp, Mus musculus
gtagtctttgtcaaggttgaatcca

SEQ ID NO: 673271 - DNA, 25 bp, Mus musculus
gtagtctttgtctaggttgaatcca

SEQ ID NO: 673272 - DNA, 25 bp, Mus musculus
gtagtgaaaccaagtaccctttgaa

SEQ ID NO: 673273 - DNA, 25 bp, Mus musculus
gtagtgaaaccatgtaccctttgaa

SEQ ID NO: 673274 - DNA, 25 bp, Mus musculus
gtagtgaacctaccccattagaaga

SEQ ID NO: 673275 - DNA, 25 bp, Mus musculus
gtagtgaacctagcccattagaaga

SEQ ID NO: 673276 - DNA, 25 bp, Mus musculus
gtagtgaaggccatcggttttaaag

SEQ ID NO: 673277 - DNA, 25 bp, Mus musculus
gtagtgaaggccttcggttttaaag

SEQ ID NO: 673278 - DNA, 25 bp, Mus musculus
gtagtgaagtcacgtctccattcaa

SEQ ID NO: 673279 - DNA, 25 bp, Mus musculus
gtagtgaagtcaggtctccattcaa

SEQ ID NO: 673280 - DNA, 25 bp, Mus musculus
gtagtgacaccaccggactctagag

SEQ ID NO: 673281 - DNA, 25 bp, Mus musculus
gtagtgacaccagcggactctagag

SEQ ID NO: 673282 - DNA, 25 bp, Mus musculus
gtagtgacagagattgagacagagt

SEQ ID NO: 673283 - DNA, 25 bp, Mus musculus
gtagtgacagagtttgagacagagt

SEQ ID NO: 673284 - DNA, 25 bp, Mus musculus
gtagtgacctttcacattgctgtgt

SEQ ID NO: 673285 - DNA, 25 bp, Mus musculus
gtagtgacctttgacattgctgtgt

SEQ ID NO: 673286 - DNA, 25 bp, Mus musculus
gtagtgactctcctgttttaatcaa

SEQ ID NO: 673287 - DNA, 25 bp, Mus musculus
gtagtgactctcgtgttttaatcaa

SEQ ID NO: 673288 - DNA, 25 bp, Mus musculus
gtagtgactgacactgggtccaaat

SEQ ID NO: 673289 - DNA, 25 bp, Mus musculus
gtagtgactgactctgggtccaaat

SEQ ID NO: 673290 - DNA, 25 bp, Mus musculus
gtagtgagaaacctccgccagcaat

SEQ ID NO: 673291 - DNA, 25 bp, Mus musculus
gtagtgagaaacgtccgccagcaat

SEQ ID NO: 673292 - DNA, 25 bp, Mus musculus
gtagtgagcaaccttggctacttgc

SEQ ID NO: 673293 - DNA, 25 bp, Mus musculus
gtagtgagcaacgttggctacttgc

SEQ ID NO: 673294 - DNA, 25 bp, Mus musculus
gtagtgagcatactttgggccttct

SEQ ID NO: 673295 - DNA, 25 bp, Mus musculus
gtagtgagcatagtttgggccttct

SEQ ID NO: 673296 - DNA, 25 bp, Mus musculus
gtagtgagccctaatttcaaaagca

SEQ ID NO: 673297 - DNA, 25 bp, Mus musculus
gtagtgagcccttatttcaaaagca

SEQ ID NO: 673298 - DNA, 25 bp, Mus musculus
gtagtgagtagtcagggacccacat

SEQ ID NO: 673299 - DNA, 25 bp, Mus musculus
gtagtgagtagtgagggacccacat

SEQ ID NO: 673300 - DNA, 25 bp, Mus musculus
gtagtgagtctgaagttcttcctgt

SEQ ID NO: 673301 - DNA, 25 bp, Mus musculus
gtagtgagtctgtagttcttcctgt

SEQ ID NO: 673302 - DNA, 25 bp, Mus musculus
gtagtgagtgaaattggaccccaaa

SEQ ID NO: 673303 - DNA, 25 bp, Mus musculus
gtagtgagtgaatttggaccccaaa

SEQ ID NO: 673304 - DNA, 25 bp, Mus musculus
gtagtgagtgtacttcctgacccag

SEQ ID NO: 673305 - DNA, 25 bp, Mus musculus
gtagtgagtgtagttcctgacccag

SEQ ID NO: 673306 - DNA, 25 bp, Mus musculus
gtagtgataggtcactgccggaaaa

SEQ ID NO: 673307 - DNA, 25 bp, Mus musculus
gtagtgataggtgactgccggaaaa

SEQ ID NO: 673308 - DNA, 25 bp, Mus musculus
gtagtgatatggacctctttttctc

SEQ ID NO: 673309 - DNA, 25 bp, Mus musculus
gtagtgatatggtcctctttttctc

SEQ ID NO: 673310 - DNA, 25 bp, Mus musculus
gtagtgatcagtatgcaagacttca

SEQ ID NO: 673311 - DNA, 25 bp, Mus musculus
gtagtgatcagtttgcaagacttca

SEQ ID NO: 673312 - DNA, 25 bp, Mus musculus
gtagtgatctctcgatctactcaag

SEQ ID NO: 673313 - DNA, 25 bp, Mus musculus
gtagtgatctctggatctactcaag

SEQ ID NO: 673314 - DNA, 25 bp, Mus musculus
gtagtgatctggctttactcacctc

SEQ ID NO: 673315 - DNA, 25 bp, Mus musculus
gtagtgatctgggtttactcacctc

SEQ ID NO: 673316 - DNA, 25 bp, Mus musculus
gtagtgatgaaccttgtaggcttta

SEQ ID NO: 673317 - DNA, 25 bp, Mus musculus
gtagtgatgaacgttgtaggcttta

SEQ ID NO: 673318 - DNA, 25 bp, Mus musculus
gtagtgattatcaattccttgttca

SEQ ID NO: 673319 - DNA, 25 bp, Mus musculus
gtagtgattatctattccttgttca

SEQ ID NO: 673320 - DNA, 25 bp, Mus musculus
gtagtgattccgaaagagctgattg

SEQ ID NO: 673321 - DNA, 25 bp, Mus musculus
gtagtgattccgtaagagctgattg

SEQ ID NO: 673322 - DNA, 25 bp, Mus musculus
gtagtgattctcatctatctctgtc

SEQ ID NO: 673323 - DNA, 25 bp, Mus musculus
gtagtgattctcttctatctctgtc

SEQ ID NO: 673324 - DNA, 25 bp, Mus musculus
gtagtgattgccagggacttccaca

SEQ ID NO: 673325 - DNA, 25 bp, Mus musculus
gtagtgattgcctgggacttccaca

SEQ ID NO: 673326 - DNA, 25 bp, Mus musculus
gtagtgatttctaccttcgctacta

SEQ ID NO: 673327 - DNA, 25 bp, Mus musculus
gtagtgatttcttccttcgctacta

SEQ ID NO: 673328 - DNA, 25 bp, Mus musculus
gtagtgatttgaagtgctctttgcc

SEQ ID NO: 673329 - DNA, 25 bp, Mus musculus
gtagtgatttgatgtgctctttgcc

SEQ ID NO: 673330 - DNA, 25 bp, Mus musculus
gtagtgcacaggatgcctagctgca

SEQ ID NO: 673331 - DNA, 25 bp, Mus musculus
gtagtgcacaggttgcctagctgca

SEQ ID NO: 673332 - DNA, 25 bp, Mus musculus
gtagtgcactccagtagccctagca

SEQ ID NO: 673333 - DNA, 25 bp, Mus musculus
gtagtgcactcctgtagccctagca

SEQ ID NO: 673334 - DNA, 25 bp, Mus musculus
gtagtgcagaatcaaagatccttaa

SEQ ID NO: 673335 - DNA, 25 bp, Mus musculus
gtagtgcagaatgaaagatccttaa

SEQ ID NO: 673336 - DNA, 25 bp, Mus musculus
gtagtgcagactagacttgagctca

SEQ ID NO: 673337 - DNA, 25 bp, Mus musculus
gtagtgcagacttgacttgagctca

SEQ ID NO: 673338 - DNA, 25 bp, Mus musculus
gtagtgcagattaactccagccgag

SEQ ID NO: 673339 - DNA, 25 bp, Mus musculus
gtagtgcagatttactccagccgag

SEQ ID NO: 673340 - DNA, 25 bp, Mus musculus
gtagtgcagctcatcacatctagaa

SEQ ID NO: 673341 - DNA, 25 bp, Mus musculus
gtagtgcagctcttcacatctagaa

SEQ ID NO: 673342 - DNA, 25 bp, Mus musculus
gtagtgcaggcgatttatacgactt

SEQ ID NO: 673343 - DNA, 25 bp, Mus musculus
gtagtgcaggcgttttatacgactt

SEQ ID NO: 673344 - DNA, 25 bp, Mus musculus
gtagtgcatataactacactcaccc

SEQ ID NO: 673345 - DNA, 25 bp, Mus musculus
gtagtgcatatatctacactcaccc

SEQ ID NO: 673346 - DNA, 25 bp, Mus musculus
gtagtgcatcctcataaggccacag

SEQ ID NO: 673347 - DNA, 25 bp, Mus musculus
gtagtgcatcctgataaggccacag

SEQ ID NO: 673348 - DNA, 25 bp, Mus musculus
gtagtgcatcgccttgccaaggaag

SEQ ID NO: 673349 - DNA, 25 bp, Mus musculus
gtagtgcatcgcgttgccaaggaag

SEQ ID NO: 673350 - DNA, 25 bp, Mus musculus
gtagtgcatgcaaaagattagtaaa

SEQ ID NO: 673351 - DNA, 25 bp, Mus musculus
gtagtgcatgcataagattagtaaa

SEQ ID NO: 673352 - DNA, 25 bp, Mus musculus
gtagtgccagggaaccagatagaaa

SEQ ID NO: 673353 - DNA, 25 bp, Mus musculus
gtagtgccagggtaccagatagaaa

SEQ ID NO: 673354 - DNA, 25 bp, Mus musculus
gtagtgccattgctgctaattcatg

SEQ ID NO: 673355 - DNA, 25 bp, Mus musculus
gtagtgccattggtgctaattcatg

SEQ ID NO: 673356 - DNA, 25 bp, Mus musculus
gtagtgcccacacttcccaaatgct

SEQ ID NO: 673357 - DNA, 25 bp, Mus musculus
gtagtgcccacagttcccaaatgct

SEQ ID NO: 673358 - DNA, 25 bp, Mus musculus
gtagtgccctcgactctgcaggaga

SEQ ID NO: 673359 - DNA, 25 bp, Mus musculus
gtagtgccctcgtctctgcaggaga

SEQ ID NO: 673360 - DNA, 25 bp, Mus musculus
gtagtgcctggtactggtaagtact

SEQ ID NO: 673361 - DNA, 25 bp, Mus musculus
gtagtgcctggttctggtaagtact

SEQ ID NO: 673362 - DNA, 25 bp, Mus musculus
gtagtgccttttaattggcctgaat

SEQ ID NO: 673363 - DNA, 25 bp, Mus musculus
gtagtgcctttttattggcctgaat

SEQ ID NO: 673364 - DNA, 25 bp, Mus musculus
gtagtgcgacacatcttgattctca

SEQ ID NO: 673365 - DNA, 25 bp, Mus musculus
gtagtgcgacacttcttgattctca

SEQ ID NO: 673366 - DNA, 25 bp, Mus musculus
gtagtgctcaaccagctgcgctact

SEQ ID NO: 673367 - DNA, 25 bp, Mus musculus
gtagtgctcaacgagctgcgctact

SEQ ID NO: 673368 - DNA, 25 bp, Mus musculus
gtagtgctccaaactggtgcctaaa

SEQ ID NO: 673369 - DNA, 25 bp, Mus musculus
gtagtgctccaatctggtgcctaaa

SEQ ID NO: 673370 - DNA, 25 bp, Mus musculus
gtagtgctccttaacacaaagcagg

SEQ ID NO: 673371 - DNA, 25 bp, Mus musculus
gtagtgctcctttacacaaagcagg

SEQ ID NO: 673372 - DNA, 25 bp, Mus musculus
gtagtgctctttcaagtacctgtaa

SEQ ID NO: 673373 - DNA, 25 bp, Mus musculus
gtagtgctctttgaagtacctgtaa

SEQ ID NO: 673374 - DNA, 25 bp, Mus musculus
gtagtgctgaatctctgctgtcaat

SEQ ID NO: 673375 - DNA, 25 bp, Mus musculus
gtagtgctgaatgtctgctgtcaat

SEQ ID NO: 673376 - DNA, 25 bp, Mus musculus
gtagtgctgagtatcacctggaaat

SEQ ID NO: 673377 - DNA, 25 bp, Mus musculus
gtagtgctgagtttcacctggaaat

SEQ ID NO: 673378 - DNA, 25 bp, Mus musculus
gtagtgctgcttaaaagcgccggat

SEQ ID NO: 673379 - DNA, 25 bp, Mus musculus
gtagtgctgctttaaagcgccggat

SEQ ID NO: 673380 - DNA, 25 bp, Mus musculus
gtagtgctgggaatagtcattgtat

SEQ ID NO: 673381 - DNA, 25 bp, Mus musculus
gtagtgctgggattagtcattgtat

SEQ ID NO: 673382 - DNA, 25 bp, Mus musculus
gtagtgctgtgtacctttaatacta

SEQ ID NO: 673383 - DNA, 25 bp, Mus musculus
gtagtgctgtgttcctttaatacta

SEQ ID NO: 673384 - DNA, 25 bp, Mus musculus
gtagtgcttcctatttctggcaaga

SEQ ID NO: 673385 - DNA, 25 bp, Mus musculus
gtagtgcttcctttttctggcaaga

SEQ ID NO: 673386 - DNA, 25 bp, Mus musculus
gtagtgcttctaactcaatatccta

SEQ ID NO: 673387 - DNA, 25 bp, Mus musculus
gtagtgcttctatctcaatatccta

SEQ ID NO: 673388 - DNA, 25 bp, Mus musculus
gtagtggacctcagttaagtttgta

SEQ ID NO: 673389 - DNA, 25 bp, Mus musculus
gtagtggacctctgttaagtttgta

SEQ ID NO: 673390 - DNA, 25 bp, Mus musculus
gtagtggactagcagagaaaatctt

SEQ ID NO: 673391 - DNA, 25 bp, Mus musculus
gtagtggactaggagagaaaatctt

SEQ ID NO: 673392 - DNA, 25 bp, Mus musculus
gtagtggagcccataaatgctttgt

SEQ ID NO: 673393 - DNA, 25 bp, Mus musculus
gtagtggagcccttaaatgctttgt

SEQ ID NO: 673394 - DNA, 25 bp, Mus musculus
gtagtggattttctggtgtattttc

SEQ ID NO: 673395 - DNA, 25 bp, Mus musculus
gtagtggattttgtggtgtattttc

SEQ ID NO: 673396 - DNA, 25 bp, Mus musculus
gtagtggcaaagcaggcctttagtt

SEQ ID NO: 673397 - DNA, 25 bp, Mus musculus
gtagtggcaaaggaggcctttagtt

SEQ ID NO: 673398 - DNA, 25 bp, Mus musculus
gtagtggcatttcccttctaactcc

SEQ ID NO: 673399 - DNA, 25 bp, Mus musculus
gtagtggcatttgccttctaactcc

SEQ ID NO: 673400 - DNA, 25 bp, Mus musculus
gtagtggccactcctattttacaga

SEQ ID NO: 673401 - DNA, 25 bp, Mus musculus
gtagtggccactgctattttacaga

SEQ ID NO: 673402 - DNA, 25 bp, Mus musculus
gtagtggccttcattaaagccagtt

SEQ ID NO: 673403 - DNA, 25 bp, Mus musculus
gtagtggccttctttaaagccagtt

SEQ ID NO: 673404 - DNA, 25 bp, Mus musculus
gtagtggctcaaactgtcaggtgtt

SEQ ID NO: 673405 - DNA, 25 bp, Mus musculus
gtagtggctcaatctgtcaggtgtt

SEQ ID NO: 673406 - DNA, 25 bp, Mus musculus
gtagtggctgcccaaagctattaat

SEQ ID NO: 673407 - DNA, 25 bp, Mus musculus
gtagtggctgccgaaagctattaat

SEQ ID NO: 673408 - DNA, 25 bp, Mus musculus
gtagtggctttcctgtagctccctt

SEQ ID NO: 673409 - DNA, 25 bp, Mus musculus
gtagtggctttcgtgtagctccctt

SEQ ID NO: 673410 - DNA, 25 bp, Mus musculus
gtagtgggactcatgctgcctgact

SEQ ID NO: 673411 - DNA, 25 bp, Mus musculus
gtagtgggactcttgctgcctgact

SEQ ID NO: 673412 - DNA, 25 bp, Mus musculus
gtagtgggacttatgtcacctaaag

SEQ ID NO: 673413 - DNA, 25 bp, Mus musculus
gtagtgggacttttgtcacctaaag

SEQ ID NO: 673414 - DNA, 25 bp, Mus musculus
gtagtgggagatatccagcttgaga

SEQ ID NO: 673415 - DNA, 25 bp, Mus musculus
gtagtgggagatttccagcttgaga

SEQ ID NO: 673416 - DNA, 25 bp, Mus musculus
gtagtgggttctcaacacccgcatc

SEQ ID NO: 673417 - DNA, 25 bp, Mus musculus
gtagtgggttctgaacacccgcatc

SEQ ID NO: 673418 - DNA, 25 bp, Mus musculus
gtagtgggtttaacagccctgcact

SEQ ID NO: 673419 - DNA, 25 bp, Mus musculus
gtagtgggtttatcagccctgcact

SEQ ID NO: 673420 - DNA, 25 bp, Mus musculus
gtagtggtgaatactgccctcaaaa

SEQ ID NO: 673421 - DNA, 25 bp, Mus musculus
gtagtggtgaattctgccctcaaaa

SEQ ID NO: 673422 - DNA, 25 bp, Mus musculus
gtagtggtggacactggttcatcct

SEQ ID NO: 673423 - DNA, 25 bp, Mus musculus
gtagtggtggactctggttcatcct

SEQ ID NO: 673424 - DNA, 25 bp, Mus musculus
gtagtggtggctctttgagtcttaa

SEQ ID NO: 673425 - DNA, 25 bp, Mus musculus
gtagtggtggctgtttgagtcttaa

SEQ ID NO: 673426 - DNA, 25 bp, Mus musculus
gtagtggtgtgtcgtcccttcagtc

SEQ ID NO: 673427 - DNA, 25 bp, Mus musculus
gtagtggtgtgtggtcccttcagtc

SEQ ID NO: 673428 - DNA, 25 bp, Mus musculus
gtagtggttacaaccttgactgtga

SEQ ID NO: 673429 - DNA, 25 bp, Mus musculus
gtagtggttacatccttgactgtga

SEQ ID NO: 673430 - DNA, 25 bp, Mus musculus
gtagtggttcataccagtaacccta

SEQ ID NO: 673431 - DNA, 25 bp, Mus musculus
gtagtggttcattccagtaacccta

SEQ ID NO: 673432 - DNA, 25 bp, Mus musculus
gtagtggttgtacatccaggagcct

SEQ ID NO: 673433 - DNA, 25 bp, Mus musculus
gtagtggttgtagatccaggagcct

SEQ ID NO: 673434 - DNA, 25 bp, Mus musculus
gtagtgtaacacattttctgtgatt

SEQ ID NO: 673435 - DNA, 25 bp, Mus musculus
gtagtgtaacactttttctgtgatt

SEQ ID NO: 673436 - DNA, 25 bp, Mus musculus
gtagtgtaagtcaggaccgcagcat

SEQ ID NO: 673437 - DNA, 25 bp, Mus musculus
gtagtgtaagtctggaccgcagcat

SEQ ID NO: 673438 - DNA, 25 bp, Mus musculus
gtagtgtacaccagtctcagagtga

SEQ ID NO: 673439 - DNA, 25 bp, Mus musculus
gtagtgtacacctgtctcagagtga

SEQ ID NO: 673440 - DNA, 25 bp, Mus musculus
gtagtgtagactcctctcaacccag

SEQ ID NO: 673441 - DNA, 25 bp, Mus musculus
gtagtgtagactgctctcaacccag

SEQ ID NO: 673442 - DNA, 25 bp, Mus musculus
gtagtgtagagcattgcagcactat

SEQ ID NO: 673443 - DNA, 25 bp, Mus musculus
gtagtgtagagcatttgcttcacat

SEQ ID NO: 673444 - DNA, 25 bp, Mus musculus
gtagtgtagagctttgcagcactat

SEQ ID NO: 673445 - DNA, 25 bp, Mus musculus
gtagtgtagagcttttgcttcacat

SEQ ID NO: 673446 - DNA, 25 bp, Mus musculus
gtagtgtagctgcacgtacgtcctg

SEQ ID NO: 673447 - DNA, 25 bp, Mus musculus
gtagtgtagctggacgtacgtcctg

SEQ ID NO: 673448 - DNA, 25 bp, Mus musculus
gtagtgtatacaagtcccttttaag

SEQ ID NO: 673449 - DNA, 25 bp, Mus musculus
gtagtgtatacatgtcccttttaag

SEQ ID NO: 673450 - DNA, 25 bp, Mus musculus
gtagtgtatgccatataggtgccat

SEQ ID NO: 673451 - DNA, 25 bp, Mus musculus
gtagtgtatgccttataggtgccat

SEQ ID NO: 673452 - DNA, 25 bp, Mus musculus
gtagtgtattccagcttatttctgt

SEQ ID NO: 673453 - DNA, 25 bp, Mus musculus
gtagtgtattcctgcttatttctgt

SEQ ID NO: 673454 - DNA, 25 bp, Mus musculus
gtagtgtcaaccactttccaaatga

SEQ ID NO: 673455 - DNA, 25 bp, Mus musculus
gtagtgtcaacctctttccaaatga

SEQ ID NO: 673456 - DNA, 25 bp, Mus musculus
gtagtgtcacttaagggcaggttta

SEQ ID NO: 673457 - DNA, 25 bp, Mus musculus
gtagtgtcactttagggcaggttta

SEQ ID NO: 673458 - DNA, 25 bp, Mus musculus
gtagtgtcagcaagtcagagtgcca

SEQ ID NO: 673459 - DNA, 25 bp, Mus musculus
gtagtgtcagcatgtcagagtgcca

SEQ ID NO: 673460 - DNA, 25 bp, Mus musculus
gtagtgtcagttcgccacaatgtcc

SEQ ID NO: 673461 - DNA, 25 bp, Mus musculus
gtagtgtcagttggccacaatgtcc

SEQ ID NO: 673462 - DNA, 25 bp, Mus musculus
gtagtgtcatggctctaagcctgta

SEQ ID NO: 673463 - DNA, 25 bp, Mus musculus
gtagtgtcatgggtctaagcctgta

SEQ ID NO: 673464 - DNA, 25 bp, Mus musculus
gtagtgtcatttcacagcggagtca

SEQ ID NO: 673465 - DNA, 25 bp, Mus musculus
gtagtgtcatttctcacaaggccgt

SEQ ID NO: 673466 - DNA, 25 bp, Mus musculus
gtagtgtcatttgacagcggagtca

SEQ ID NO: 673467 - DNA, 25 bp, Mus musculus
gtagtgtcatttgtcacaaggccgt

SEQ ID NO: 673468 - DNA, 25 bp, Mus musculus
gtagtgtccaaacgccaagggtctc

SEQ ID NO: 673469 - DNA, 25 bp, Mus musculus
gtagtgtccaaaggccaagggtctc

SEQ ID NO: 673470 - DNA, 25 bp, Mus musculus
gtagtgtctcatctgtgtgtaggca

SEQ ID NO: 673471 - DNA, 25 bp, Mus musculus
gtagtgtctcatgtgtgtgtaggca

SEQ ID NO: 673472 - DNA, 25 bp, Mus musculus
gtagtgtctgacaccttaaaccagg

SEQ ID NO: 673473 - DNA, 25 bp, Mus musculus
gtagtgtctgactccttaaaccagg

SEQ ID NO: 673474 - DNA, 25 bp, Mus musculus
gtagtgtcttacacttccatgtcac

SEQ ID NO: 673475 - DNA, 25 bp, Mus musculus
gtagtgtcttactcttccatgtcac

SEQ ID NO: 673476 - DNA, 25 bp, Mus musculus
gtagtgtgaattatacacagcaaga

SEQ ID NO: 673477 - DNA, 25 bp, Mus musculus
gtagtgtgaattttacacagcaaga

SEQ ID NO: 673478 - DNA, 25 bp, Mus musculus
gtagtgtgacttcagccttcatgtc

SEQ ID NO: 673479 - DNA, 25 bp, Mus musculus
gtagtgtgacttgagccttcatgtc

SEQ ID NO: 673480 - DNA, 25 bp, Mus musculus
gtagtgtgattcaagctgggaaaca

SEQ ID NO: 673481 - DNA, 25 bp, Mus musculus
gtagtgtgattctagctgggaaaca

SEQ ID NO: 673482 - DNA, 25 bp, Mus musculus
gtagtgtgcactctacctcatagta

SEQ ID NO: 673483 - DNA, 25 bp, Mus musculus
gtagtgtgcactgtacctcatagta

SEQ ID NO: 673484 - DNA, 25 bp, Mus musculus
gtagtgtgcattaggaagtgtccta

SEQ ID NO: 673485 - DNA, 25 bp, Mus musculus
gtagtgtgcatttggaagtgtccta

SEQ ID NO: 673486 - DNA, 25 bp, Mus musculus
gtagtgtgccccaagaagtggttat

SEQ ID NO: 673487 - DNA, 25 bp, Mus musculus
gtagtgtgcccctagaagtggttat

SEQ ID NO: 673488 - DNA, 25 bp, Mus musculus
gtagtgtgccgtcgcacatgccaca

SEQ ID NO: 673489 - DNA, 25 bp, Mus musculus
gtagtgtgccgtggcacatgccaca

SEQ ID NO: 673490 - DNA, 25 bp, Mus musculus
gtagtgtggagcactcggaagtcat

SEQ ID NO: 673491 - DNA, 25 bp, Mus musculus
gtagtgtggagctctcggaagtcat

SEQ ID NO: 673492 - DNA, 25 bp, Mus musculus
gtagtgtgtatgctatccactcccc

SEQ ID NO: 673493 - DNA, 25 bp, Mus musculus
gtagtgtgtatggtatccactcccc

SEQ ID NO: 673494 - DNA, 25 bp, Mus musculus
gtagtgtgtgcgatggtccatgata

SEQ ID NO: 673495 - DNA, 25 bp, Mus musculus
gtagtgtgtgcgttggtccatgata

SEQ ID NO: 673496 - DNA, 25 bp, Mus musculus
gtagtgtgtggcatcactagtgctg

SEQ ID NO: 673497 - DNA, 25 bp, Mus musculus
gtagtgtgtggcttcactagtgctg

SEQ ID NO: 673498 - DNA, 25 bp, Mus musculus
gtagtgtgttccacaagtttgggtt

SEQ ID NO: 673499 - DNA, 25 bp, Mus musculus
gtagtgtgttcctcaagtttgggtt

SEQ ID NO: 673500 - DNA, 25 bp, Mus musculus
gtagtgtgtttgacaatcctccagt

SEQ ID NO: 673501 - DNA, 25 bp, Mus musculus
gtagtgtgtttgtcaatcctccagt

SEQ ID NO: 673502 - DNA, 25 bp, Mus musculus
gtagtgttcatgaaaagcctgctgt

SEQ ID NO: 673503 - DNA, 25 bp, Mus musculus
gtagtgttcatgtaaagcctgctgt

SEQ ID NO: 673504 - DNA, 25 bp, Mus musculus
gtagtgttccatactgcatcttcat

SEQ ID NO: 673505 - DNA, 25 bp, Mus musculus
gtagtgttccattctgcatcttcat

SEQ ID NO: 673506 - DNA, 25 bp, Mus musculus
gtagtgttccctctgctatttctag

SEQ ID NO: 673507 - DNA, 25 bp, Mus musculus
gtagtgttccctgtgctatttctag

SEQ ID NO: 673508 - DNA, 25 bp, Mus musculus
gtagtgttctaaactgctaaaccat

SEQ ID NO: 673509 - DNA, 25 bp, Mus musculus
gtagtgttctaatctgctaaaccat

SEQ ID NO: 673510 - DNA, 25 bp, Mus musculus
gtagtgttctacatgtgacagacag

SEQ ID NO: 673511 - DNA, 25 bp, Mus musculus
gtagtgttctacttgtgacagacag

SEQ ID NO: 673512 - DNA, 25 bp, Mus musculus
gtagtgttgtatctgtttcctgttt

SEQ ID NO: 673513 - DNA, 25 bp, Mus musculus
gtagtgttgtatgtgtttcctgttt

SEQ ID NO: 673514 - DNA, 25 bp, Mus musculus
gtagtgttgtctaggctggtctcaa

SEQ ID NO: 673515 - DNA, 25 bp, Mus musculus
gtagtgttgtcttggctggtctcaa

SEQ ID NO: 673516 - DNA, 25 bp, Mus musculus
gtagtgtttcccaggcatgcacaaa

SEQ ID NO: 673517 - DNA, 25 bp, Mus musculus
gtagtgtttccctggcatgcacaaa

SEQ ID NO: 673518 - DNA, 25 bp, Mus musculus
gtagtgtttcttagagtgcacattt

SEQ ID NO: 673519 - DNA, 25 bp, Mus musculus
gtagtgtttctttgagtgcacattt

SEQ ID NO: 673520 - DNA, 25 bp, Mus musculus
gtagtgtttgtaattatcgcgccag

SEQ ID NO: 673521 - DNA, 25 bp, Mus musculus
gtagtgtttgtatttatcgcgccag

SEQ ID NO: 673522 - DNA, 25 bp, Mus musculus
gtagtgtttgttactgcttgcctca

SEQ ID NO: 673523 - DNA, 25 bp, Mus musculus
gtagtgtttgtttctgcttgcctca

SEQ ID NO: 673524 - DNA, 25 bp, Mus musculus
gtagttaaactaacctatatgccaa

SEQ ID NO: 673525 - DNA, 25 bp, Mus musculus
gtagttaaactatcctatatgccaa

SEQ ID NO: 673526 - DNA, 25 bp, Mus musculus
gtagttaaatacaaattcctgataa

SEQ ID NO: 673527 - DNA, 25 bp, Mus musculus
gtagttaaatactaattcctgataa

SEQ ID NO: 673528 - DNA, 25 bp, Mus musculus
gtagttaacagccttttacctagct

SEQ ID NO: 673529 - DNA, 25 bp, Mus musculus
gtagttaacagcgttttacctagct

SEQ ID NO: 673530 - DNA, 25 bp, Mus musculus
gtagttaaggacactgacctctcac

SEQ ID NO: 673531 - DNA, 25 bp, Mus musculus
gtagttaaggactctgacctctcac

SEQ ID NO: 673532 - DNA, 25 bp, Mus musculus
gtagttaagtagaacgtattccagt

SEQ ID NO: 673533 - DNA, 25 bp, Mus musculus
gtagttaagtagtacgtattccagt

SEQ ID NO: 673534 - DNA, 25 bp, Mus musculus
gtagttaatagtatgctcccagctg

SEQ ID NO: 673535 - DNA, 25 bp, Mus musculus
gtagttaatagtttgctcccagctg

SEQ ID NO: 673536 - DNA, 25 bp, Mus musculus
gtagttacactacttcttccaagaa

SEQ ID NO: 673537 - DNA, 25 bp, Mus musculus
gtagttacactagttcttccaagaa

SEQ ID NO: 673538 - DNA, 25 bp, Mus musculus
gtagttacacttagctcattctcca

SEQ ID NO: 673539 - DNA, 25 bp, Mus musculus
gtagttacactttgctcattctcca

SEQ ID NO: 673540 - DNA, 25 bp, Mus musculus
gtagttaccaataccatacctcagg

SEQ ID NO: 673541 - DNA, 25 bp, Mus musculus
gtagttaccaattccatacctcagg

SEQ ID NO: 673542 - DNA, 25 bp, Mus musculus
gtagttactcttagatacgcatttc

SEQ ID NO: 673543 - DNA, 25 bp, Mus musculus
gtagttactctttgatacgcatttc

SEQ ID NO: 673544 - DNA, 25 bp, Mus musculus
gtagttagagccctcattcatccgg

SEQ ID NO: 673545 - DNA, 25 bp, Mus musculus
gtagttagagccgtcattcatccgg

SEQ ID NO: 673546 - DNA, 25 bp, Mus musculus
gtagttagctaacccaaagcccagc

SEQ ID NO: 673547 - DNA, 25 bp, Mus musculus
gtagttagctaagccaaagcccagc

SEQ ID NO: 673548 - DNA, 25 bp, Mus musculus
gtagttagctctaaacactctccat

SEQ ID NO: 673549 - DNA, 25 bp, Mus musculus
gtagttagctcttaacactctccat

SEQ ID NO: 673550 - DNA, 25 bp, Mus musculus
gtagttatacaccatatgcctcatt

SEQ ID NO: 673551 - DNA, 25 bp, Mus musculus
gtagttatacacgatatgcctcatt

SEQ ID NO: 673552 - DNA, 25 bp, Mus musculus
gtagttatactgctgggccatcatc

SEQ ID NO: 673553 - DNA, 25 bp, Mus musculus
gtagttatactggtgggccatcatc

SEQ ID NO: 673554 - DNA, 25 bp, Mus musculus
gtagttatagctcacggtcatggga

SEQ ID NO: 673555 - DNA, 25 bp, Mus musculus
gtagttatagctgacggtcatggga

SEQ ID NO: 673556 - DNA, 25 bp, Mus musculus
gtagttatgcacaaactgtcttaaa

SEQ ID NO: 673557 - DNA, 25 bp, Mus musculus
gtagttatgcactaactgtcttaaa

SEQ ID NO: 673558 - DNA, 25 bp, Mus musculus
gtagttattcttctacttctgcatg

SEQ ID NO: 673559 - DNA, 25 bp, Mus musculus
gtagttattcttgtacttctgcatg

SEQ ID NO: 673560 - DNA, 25 bp, Mus musculus
gtagttcaaacaacgcatcctctga

SEQ ID NO: 673561 - DNA, 25 bp, Mus musculus
gtagttcaaacatcgcatcctctga

SEQ ID NO: 673562 - DNA, 25 bp, Mus musculus
gtagttcaaagacatttctcactct

SEQ ID NO: 673563 - DNA, 25 bp, Mus musculus
gtagttcaaagagatttctcactct

SEQ ID NO: 673564 - DNA, 25 bp, Mus musculus
gtagttcaaagtcctggtttctctc

SEQ ID NO: 673565 - DNA, 25 bp, Mus musculus
gtagttcaaagtgctggtttctctc

SEQ ID NO: 673566 - DNA, 25 bp, Mus musculus
gtagttcaaatacgaaattcagacc

SEQ ID NO: 673567 - DNA, 25 bp, Mus musculus
gtagttcaaataggaaattcagacc

SEQ ID NO: 673568 - DNA, 25 bp, Mus musculus
gtagttcaactcaaattcaggcatg

SEQ ID NO: 673569 - DNA, 25 bp, Mus musculus
gtagttcaactctaattcaggcatg

SEQ ID NO: 673570 - DNA, 25 bp, Mus musculus
gtagttcaaggtagtctttggacac

SEQ ID NO: 673571 - DNA, 25 bp, Mus musculus
gtagttcaaggttgtctttggacac

SEQ ID NO: 673572 - DNA, 25 bp, Mus musculus
gtagttcacattcatacatgcttag

SEQ ID NO: 673573 - DNA, 25 bp, Mus musculus
gtagttcacattgatacatgcttag

SEQ ID NO: 673574 - DNA, 25 bp, Mus musculus
gtagttcaccctctagagatagatg

SEQ ID NO: 673575 - DNA, 25 bp, Mus musculus
gtagttcaccctgtagagatagatg

SEQ ID NO: 673576 - DNA, 25 bp, Mus musculus
gtagttcacctacagatgccaaaaa

SEQ ID NO: 673577 - DNA, 25 bp, Mus musculus
gtagttcacctagagatgccaaaaa

SEQ ID NO: 673578 - DNA, 25 bp, Mus musculus
gtagttcactatagtagggcttacc

SEQ ID NO: 673579 - DNA, 25 bp, Mus musculus
gtagttcactattgtagggcttacc

SEQ ID NO: 673580 - DNA, 25 bp, Mus musculus
gtagttcactctaattttgggcttt

SEQ ID NO: 673581 - DNA, 25 bp, Mus musculus
gtagttcactcttattttgggcttt

SEQ ID NO: 673582 - DNA, 25 bp, Mus musculus
gtagttcagcctcggaagctcaccg

SEQ ID NO: 673583 - DNA, 25 bp, Mus musculus
gtagttcagcctgggaagctcaccg

SEQ ID NO: 673584 - DNA, 25 bp, Mus musculus
gtagttcagctaaagtgtttcttaa

SEQ ID NO: 673585 - DNA, 25 bp, Mus musculus
gtagttcagctatagtgtttcttaa

SEQ ID NO: 673586 - DNA, 25 bp, Mus musculus
gtagttcaggccatgattttgcagt

SEQ ID NO: 673587 - DNA, 25 bp, Mus musculus
gtagttcaggccttgattttgcagt

SEQ ID NO: 673588 - DNA, 25 bp, Mus musculus
gtagttcaggctagcccagatctta

SEQ ID NO: 673589 - DNA, 25 bp, Mus musculus
gtagttcaggcttgcccagatctta

SEQ ID NO: 673590 - DNA, 25 bp, Mus musculus
gtagttcagtcccactgactagtgt

SEQ ID NO: 673591 - DNA, 25 bp, Mus musculus
gtagttcagtccgactgactagtgt

SEQ ID NO: 673592 - DNA, 25 bp, Mus musculus
gtagttcataacatagtgttccttt

SEQ ID NO: 673593 - DNA, 25 bp, Mus musculus
gtagttcataacttagtgttccttt

SEQ ID NO: 673594 - DNA, 25 bp, Mus musculus
gtagttcattatatactctaggaca

SEQ ID NO: 673595 - DNA, 25 bp, Mus musculus
gtagttcattatttactctaggaca

SEQ ID NO: 673596 - DNA, 25 bp, Mus musculus
gtagttcattttagccagatggatc

SEQ ID NO: 673597 - DNA, 25 bp, Mus musculus
gtagttcatttttgccagatggatc

SEQ ID NO: 673598 - DNA, 25 bp, Mus musculus
gtagttccaaaaccagagtgcccaa

SEQ ID NO: 673599 - DNA, 25 bp, Mus musculus
gtagttccaaaagcagagtgcccaa

SEQ ID NO: 673600 - DNA, 25 bp, Mus musculus
gtagttccaaccacagatttatgcc

SEQ ID NO: 673601 - DNA, 25 bp, Mus musculus
gtagttccaacctcagatttatgcc

SEQ ID NO: 673602 - DNA, 25 bp, Mus musculus
gtagttccagcccatcaaggagatc

SEQ ID NO: 673603 - DNA, 25 bp, Mus musculus
gtagttccagccgatcaaggagatc

SEQ ID NO: 673604 - DNA, 25 bp, Mus musculus
gtagttccagtccagatcagacctg

SEQ ID NO: 673605 - DNA, 25 bp, Mus musculus
gtagttccagtcgagatcagacctg

SEQ ID NO: 673606 - DNA, 25 bp, Mus musculus
gtagttcccaccattatcacataaa

SEQ ID NO: 673607 - DNA, 25 bp, Mus musculus
gtagttcccacctttatcacataaa

SEQ ID NO: 673608 - DNA, 25 bp, Mus musculus
gtagttcccagcaccttctagggaa

SEQ ID NO: 673609 - DNA, 25 bp, Mus musculus
gtagttcccagctccttctagggaa

SEQ ID NO: 673610 - DNA, 25 bp, Mus musculus
gtagttcccatacacatctttgaat

SEQ ID NO: 673611 - DNA, 25 bp, Mus musculus
gtagttcccatagacatctttgaat

SEQ ID NO: 673612 - DNA, 25 bp, Mus musculus
gtagttcccattagatcgaagtaat

SEQ ID NO: 673613 - DNA, 25 bp, Mus musculus
gtagttcccatttgatcgaagtaat

SEQ ID NO: 673614 - DNA, 25 bp, Mus musculus
gtagttccccttagaggcctgctaa

SEQ ID NO: 673615 - DNA, 25 bp, Mus musculus
gtagttcccctttgaggcctgctaa

SEQ ID NO: 673616 - DNA, 25 bp, Mus musculus
gtagttcccggcacagtggtttcag

SEQ ID NO: 673617 - DNA, 25 bp, Mus musculus
gtagttcccggctcagtggtttcag

SEQ ID NO: 673618 - DNA, 25 bp, Mus musculus
gtagttccctgaaggcctacaacca

SEQ ID NO: 673619 - DNA, 25 bp, Mus musculus
gtagttccctgacactggctgatac

SEQ ID NO: 673620 - DNA, 25 bp, Mus musculus
gtagttccctgagactggctgatac

SEQ ID NO: 673621 - DNA, 25 bp, Mus musculus
gtagttccctgatggcctacaacca

SEQ ID NO: 673622 - DNA, 25 bp, Mus musculus
gtagttccgaacactgggttcctgc

SEQ ID NO: 673623 - DNA, 25 bp, Mus musculus
gtagttccgaactctgggttcctgc

SEQ ID NO: 673624 - DNA, 25 bp, Mus musculus
gtagttcctcagaacagcttgttat

SEQ ID NO: 673625 - DNA, 25 bp, Mus musculus
gtagttcctcagtacagcttgttat

SEQ ID NO: 673626 - DNA, 25 bp, Mus musculus
gtagttcctgcccttgagcttgtgc

SEQ ID NO: 673627 - DNA, 25 bp, Mus musculus
gtagttcctgccgttgagcttgtgc

SEQ ID NO: 673628 - DNA, 25 bp, Mus musculus
gtagttcgccaactacagacttctg

SEQ ID NO: 673629 - DNA, 25 bp, Mus musculus
gtagttcgccaagtacagacttctg

SEQ ID NO: 673630 - DNA, 25 bp, Mus musculus
gtagttcgtcaaaagaccctcactc

SEQ ID NO: 673631 - DNA, 25 bp, Mus musculus
gtagttcgtcaatagaccctcactc

SEQ ID NO: 673632 - DNA, 25 bp, Mus musculus
gtagttctaatcattcacctcatat

SEQ ID NO: 673633 - DNA, 25 bp, Mus musculus
gtagttctaatctttcacctcatat

SEQ ID NO: 673634 - DNA, 25 bp, Mus musculus
gtagttctagggaataaacctccat

SEQ ID NO: 673635 - DNA, 25 bp, Mus musculus
gtagttctagggtataaacctccat

SEQ ID NO: 673636 - DNA, 25 bp, Mus musculus
gtagttctctacagtttcatccatc

SEQ ID NO: 673637 - DNA, 25 bp, Mus musculus
gtagttctctactgtttcatccatc

SEQ ID NO: 673638 - DNA, 25 bp, Mus musculus
gtagttctctgtcttgatttgctgt

SEQ ID NO: 673639 - DNA, 25 bp, Mus musculus
gtagttctctgtgttgatttgctgt

SEQ ID NO: 673640 - DNA, 25 bp, Mus musculus
gtagttctcttcactagccttgcag

SEQ ID NO: 673641 - DNA, 25 bp, Mus musculus
gtagttctcttctctagccttgcag

SEQ ID NO: 673642 - DNA, 25 bp, Mus musculus
gtagttctgaggcttaacctctcca

SEQ ID NO: 673643 - DNA, 25 bp, Mus musculus
gtagttctgagggttaacctctcca

SEQ ID NO: 673644 - DNA, 25 bp, Mus musculus
gtagttctgataccttgctggagaa

SEQ ID NO: 673645 - DNA, 25 bp, Mus musculus
gtagttctgatagcttgctggagaa

SEQ ID NO: 673646 - DNA, 25 bp, Mus musculus
gtagttctgtagatagacttcataa

SEQ ID NO: 673647 - DNA, 25 bp, Mus musculus
gtagttctgtagttagacttcataa

SEQ ID NO: 673648 - DNA, 25 bp, Mus musculus
gtagttctgtatagctgagttcttt

SEQ ID NO: 673649 - DNA, 25 bp, Mus musculus
gtagttctgtattgctgagttcttt

SEQ ID NO: 673650 - DNA, 25 bp, Mus musculus
gtagttctgtgacctctgatgtcaa

SEQ ID NO: 673651 - DNA, 25 bp, Mus musculus
gtagttctgtgagctctgatgtcaa

SEQ ID NO: 673652 - DNA, 25 bp, Mus musculus
gtagttcttaatacattctggtgtg

SEQ ID NO: 673653 - DNA, 25 bp, Mus musculus
gtagttcttaatcgctccctactag

SEQ ID NO: 673654 - DNA, 25 bp, Mus musculus
gtagttcttaatggctccctactag

SEQ ID NO: 673655 - DNA, 25 bp, Mus musculus
gtagttcttaattcattctggtgtg

SEQ ID NO: 673656 - DNA, 25 bp, Mus musculus
gtagttcttcgtcggaaatcctctt

SEQ ID NO: 673657 - DNA, 25 bp, Mus musculus
gtagttcttcgtgggaaatcctctt

SEQ ID NO: 673658 - DNA, 25 bp, Mus musculus
gtagttcttgatactcgaaatgtgc

SEQ ID NO: 673659 - DNA, 25 bp, Mus musculus
gtagttcttgattctcgaaatgtgc

SEQ ID NO: 673660 - DNA, 25 bp, Mus musculus
gtagttcttgtactgatcttgcaga

SEQ ID NO: 673661 - DNA, 25 bp, Mus musculus
gtagttcttgtagtgatcttgcaga

SEQ ID NO: 673662 - DNA, 25 bp, Mus musculus
gtagttctttatcagggagtgttcc

SEQ ID NO: 673663 - DNA, 25 bp, Mus musculus
gtagttctttatgagggagtgttcc

SEQ ID NO: 673664 - DNA, 25 bp, Mus musculus
gtagttgacataagcgtagcccaga

SEQ ID NO: 673665 - DNA, 25 bp, Mus musculus
gtagttgacatacagctgcttctgt

SEQ ID NO: 673666 - DNA, 25 bp, Mus musculus
gtagttgacatagagctgcttctgt

SEQ ID NO: 673667 - DNA, 25 bp, Mus musculus
gtagttgacatatgcgtagcccaga

SEQ ID NO: 673668 - DNA, 25 bp, Mus musculus
gtagttgacattcaccgttctcttc

SEQ ID NO: 673669 - DNA, 25 bp, Mus musculus
gtagttgacattgaccgttctcttc

SEQ ID NO: 673670 - DNA, 25 bp, Mus musculus
gtagttgaccttactaattcatatt

SEQ ID NO: 673671 - DNA, 25 bp, Mus musculus
gtagttgacctttctaattcatatt

SEQ ID NO: 673672 - DNA, 25 bp, Mus musculus
gtagttgactgaaaactgcagttgt

SEQ ID NO: 673673 - DNA, 25 bp, Mus musculus
gtagttgactgataactgcagttgt

SEQ ID NO: 673674 - DNA, 25 bp, Mus musculus
gtagttgagcccacatatattctcc

SEQ ID NO: 673675 - DNA, 25 bp, Mus musculus
gtagttgagccccagttcggcctgt

SEQ ID NO: 673676 - DNA, 25 bp, Mus musculus
gtagttgagcccgagttcggcctgt

SEQ ID NO: 673677 - DNA, 25 bp, Mus musculus
gtagttgagccctcatatattctcc

SEQ ID NO: 673678 - DNA, 25 bp, Mus musculus
gtagttgatagtagcactcccagtc

SEQ ID NO: 673679 - DNA, 25 bp, Mus musculus
gtagttgatagttgcactcccagtc

SEQ ID NO: 673680 - DNA, 25 bp, Mus musculus
gtagttgatctcagcaggcagtaat

SEQ ID NO: 673681 - DNA, 25 bp, Mus musculus
gtagttgatctctgcaggcagtaat

SEQ ID NO: 673682 - DNA, 25 bp, Mus musculus
gtagttgatgttctttagccctgat

SEQ ID NO: 673683 - DNA, 25 bp, Mus musculus
gtagttgatgttgtttagccctgat

SEQ ID NO: 673684 - DNA, 25 bp, Mus musculus
gtagttgattgccttacctcttaat

SEQ ID NO: 673685 - DNA, 25 bp, Mus musculus
gtagttgattgcgttacctcttaat

SEQ ID NO: 673686 - DNA, 25 bp, Mus musculus
gtagttgattttcccctctaagagg

SEQ ID NO: 673687 - DNA, 25 bp, Mus musculus
gtagttgattttgccctctaagagg

SEQ ID NO: 673688 - DNA, 25 bp, Mus musculus
gtagttgcagccagactcttgagat

SEQ ID NO: 673689 - DNA, 25 bp, Mus musculus
gtagttgcagcctgactcttgagat

SEQ ID NO: 673690 - DNA, 25 bp, Mus musculus
gtagttgcatatcgaatgggactca

SEQ ID NO: 673691 - DNA, 25 bp, Mus musculus
gtagttgcatatggaatgggactca

SEQ ID NO: 673692 - DNA, 25 bp, Mus musculus
gtagttgcccaccacagggtttaca

SEQ ID NO: 673693 - DNA, 25 bp, Mus musculus
gtagttgcccacgacagggtttaca

SEQ ID NO: 673694 - DNA, 25 bp, Mus musculus
gtagttgccgaacttgtctgtctcc

SEQ ID NO: 673695 - DNA, 25 bp, Mus musculus
gtagttgccgaagttgtctgtctcc

SEQ ID NO: 673696 - DNA, 25 bp, Mus musculus
gtagttgccttactcatctttctgc

SEQ ID NO: 673697 - DNA, 25 bp, Mus musculus
gtagttgccttagtcatctttctgc

SEQ ID NO: 673698 - DNA, 25 bp, Mus musculus
gtagttgctaatctccctttgcaag

SEQ ID NO: 673699 - DNA, 25 bp, Mus musculus
gtagttgctaatgtccctttgcaag

SEQ ID NO: 673700 - DNA, 25 bp, Mus musculus
gtagttgctctgattaatattttta

SEQ ID NO: 673701 - DNA, 25 bp, Mus musculus
gtagttgctctgtttaatattttta

SEQ ID NO: 673702 - DNA, 25 bp, Mus musculus
gtagttgctgacactattaaacctc

SEQ ID NO: 673703 - DNA, 25 bp, Mus musculus
gtagttgctgactctattaaacctc

SEQ ID NO: 673704 - DNA, 25 bp, Mus musculus
gtagttgcttttatcattccacaga

SEQ ID NO: 673705 - DNA, 25 bp, Mus musculus
gtagttgcttttttcattccacaga

SEQ ID NO: 673706 - DNA, 25 bp, Mus musculus
gtagttggaatcaaaatcgtccgta

SEQ ID NO: 673707 - DNA, 25 bp, Mus musculus
gtagttggaatctaaatcgtccgta

SEQ ID NO: 673708 - DNA, 25 bp, Mus musculus
gtagttggcaagcacaagcccacct

SEQ ID NO: 673709 - DNA, 25 bp, Mus musculus
gtagttggcaaggacaagcccacct

SEQ ID NO: 673710 - DNA, 25 bp, Mus musculus
gtagttggcactcgaacctgcgata

SEQ ID NO: 673711 - DNA, 25 bp, Mus musculus
gtagttggcactggaacctgcgata

SEQ ID NO: 673712 - DNA, 25 bp, Mus musculus
gtagttggccaaaatttgtgctgta

SEQ ID NO: 673713 - DNA, 25 bp, Mus musculus
gtagttggccaatatttgtgctgta

SEQ ID NO: 673714 - DNA, 25 bp, Mus musculus
gtagttggccctattggcagaggat

SEQ ID NO: 673715 - DNA, 25 bp, Mus musculus
gtagttggcccttttggcagaggat

SEQ ID NO: 673716 - DNA, 25 bp, Mus musculus
gtagttggcgttcccaagtgactca

SEQ ID NO: 673717 - DNA, 25 bp, Mus musculus
gtagttggcgttgccaagtgactca

SEQ ID NO: 673718 - DNA, 25 bp, Mus musculus
gtagttggctgtccatggtacaaat

SEQ ID NO: 673719 - DNA, 25 bp, Mus musculus
gtagttggctgtgcatggtacaaat

SEQ ID NO: 673720 - DNA, 25 bp, Mus musculus
gtagttgggcatactagcccagtct

SEQ ID NO: 673721 - DNA, 25 bp, Mus musculus
gtagttgggcattctagcccagtct

SEQ ID NO: 673722 - DNA, 25 bp, Mus musculus
gtagttggtccacttgtacagcacg

SEQ ID NO: 673723 - DNA, 25 bp, Mus musculus
gtagttggtccagttgtacagcacg

SEQ ID NO: 673724 - DNA, 25 bp, Mus musculus
gtagttggtcttctaaatgtgcagt

SEQ ID NO: 673725 - DNA, 25 bp, Mus musculus
gtagttggtcttgtaaatgtgcagt

SEQ ID NO: 673726 - DNA, 25 bp, Mus musculus
gtagttggtgacactttctagtccc

SEQ ID NO: 673727 - DNA, 25 bp, Mus musculus
gtagttggtgactctttctagtccc

SEQ ID NO: 673728 - DNA, 25 bp, Mus musculus
gtagttggttctctcttcttaccat

SEQ ID NO: 673729 - DNA, 25 bp, Mus musculus
gtagttggttctgtcttcttaccat

SEQ ID NO: 673730 - DNA, 25 bp, Mus musculus
gtagttgtaacacggttgcatggct

SEQ ID NO: 673731 - DNA, 25 bp, Mus musculus
gtagttgtaacagggttgcatggct

SEQ ID NO: 673732 - DNA, 25 bp, Mus musculus
gtagttgtaatgaccactcccataa

SEQ ID NO: 673733 - DNA, 25 bp, Mus musculus
gtagttgtaatgtccactcccataa

SEQ ID NO: 673734 - DNA, 25 bp, Mus musculus
gtagttgtacaaattgcattcccat

SEQ ID NO: 673735 - DNA, 25 bp, Mus musculus
gtagttgtacaatttgcattcccat

SEQ ID NO: 673736 - DNA, 25 bp, Mus musculus
gtagttgtcaagcatttcctgtttc

SEQ ID NO: 673737 - DNA, 25 bp, Mus musculus
gtagttgtcaaggatttcctgtttc

SEQ ID NO: 673738 - DNA, 25 bp, Mus musculus
gtagttgtcaccaccctggacgagg

SEQ ID NO: 673739 - DNA, 25 bp, Mus musculus
gtagttgtcacctccctggacgagg

SEQ ID NO: 673740 - DNA, 25 bp, Mus musculus
gtagttgtcttcactttggtcaaga

SEQ ID NO: 673741 - DNA, 25 bp, Mus musculus
gtagttgtcttctctttggtcaaga

SEQ ID NO: 673742 - DNA, 25 bp, Mus musculus
gtagttgtggaaagcaggcctctgt

SEQ ID NO: 673743 - DNA, 25 bp, Mus musculus
gtagttgtggaatgcaggcctctgt

SEQ ID NO: 673744 - DNA, 25 bp, Mus musculus
gtagttgtggatcttcaccttctga

SEQ ID NO: 673745 - DNA, 25 bp, Mus musculus
gtagttgtggatgttcaccttctga

SEQ ID NO: 673746 - DNA, 25 bp, Mus musculus
gtagttgtgtatctaaacccctcca

SEQ ID NO: 673747 - DNA, 25 bp, Mus musculus
gtagttgtgtatgtaaacccctcca

SEQ ID NO: 673748 - DNA, 25 bp, Mus musculus
gtagttgtgtcacggacttgaagaa

SEQ ID NO: 673749 - DNA, 25 bp, Mus musculus
gtagttgtgtcagggacttgaagaa

SEQ ID NO: 673750 - DNA, 25 bp, Mus musculus
gtagttgttaaccattcttctcctt

SEQ ID NO: 673751 - DNA, 25 bp, Mus musculus
gtagttgttaacgattcttctcctt

SEQ ID NO: 673752 - DNA, 25 bp, Mus musculus
gtagttgttcagctctgtacttggt

SEQ ID NO: 673753 - DNA, 25 bp, Mus musculus
gtagttgttcaggtctgtacttggt

SEQ ID NO: 673754 - DNA, 25 bp, Mus musculus
gtagttgttcttcactgttaaccat

SEQ ID NO: 673755 - DNA, 25 bp, Mus musculus
gtagttgttcttgactgttaaccat

SEQ ID NO: 673756 - DNA, 25 bp, Mus musculus
gtagttgttttcattctccttgtaa

SEQ ID NO: 673757 - DNA, 25 bp, Mus musculus
gtagttgttttccttatacctcttg

SEQ ID NO: 673758 - DNA, 25 bp, Mus musculus
gtagttgttttcgttatacctcttg

SEQ ID NO: 673759 - DNA, 25 bp, Mus musculus
gtagttgttttctttctccttgtaa

SEQ ID NO: 673760 - DNA, 25 bp, Mus musculus
gtagtttaacctacctgactctgtc

SEQ ID NO: 673761 - DNA, 25 bp, Mus musculus
gtagtttaaccttcctgactctgtc

SEQ ID NO: 673762 - DNA, 25 bp, Mus musculus
gtagtttaagctcagatactcattt

SEQ ID NO: 673763 - DNA, 25 bp, Mus musculus
gtagtttaagctgagatactcattt

SEQ ID NO: 673764 - DNA, 25 bp, Mus musculus
gtagtttaagttacaggtgggcata

SEQ ID NO: 673765 - DNA, 25 bp, Mus musculus
gtagtttaagtttcaggtgggcata

SEQ ID NO: 673766 - DNA, 25 bp, Mus musculus
gtagtttaatgtcatccttctccaa

SEQ ID NO: 673767 - DNA, 25 bp, Mus musculus
gtagtttaatgtgatccttctccaa

SEQ ID NO: 673768 - DNA, 25 bp, Mus musculus
gtagtttacactctggcttgtgcaa

SEQ ID NO: 673769 - DNA, 25 bp, Mus musculus
gtagtttacactgtggcttgtgcaa

SEQ ID NO: 673770 - DNA, 25 bp, Mus musculus
gtagtttacataacccagatctttg

SEQ ID NO: 673771 - DNA, 25 bp, Mus musculus
gtagtttacatatcccagatctttg

SEQ ID NO: 673772 - DNA, 25 bp, Mus musculus
gtagtttactatatctgggcaattg

SEQ ID NO: 673773 - DNA, 25 bp, Mus musculus
gtagtttactatttctgggcaattg

SEQ ID NO: 673774 - DNA, 25 bp, Mus musculus
gtagtttactgtcatctagcttcct

SEQ ID NO: 673775 - DNA, 25 bp, Mus musculus
gtagtttactgtgatctagcttcct

SEQ ID NO: 673776 - DNA, 25 bp, Mus musculus
gtagtttagagtacttgctggcaat

SEQ ID NO: 673777 - DNA, 25 bp, Mus musculus
gtagtttagagttcttgctggcaat

SEQ ID NO: 673778 - DNA, 25 bp, Mus musculus
gtagtttagcgtacaccaagttcac

SEQ ID NO: 673779 - DNA, 25 bp, Mus musculus
gtagtttagcgttcaccaagttcac

SEQ ID NO: 673780 - DNA, 25 bp, Mus musculus
gtagtttaggcgatctttcacgtag

SEQ ID NO: 673781 - DNA, 25 bp, Mus musculus
gtagtttaggcgttctttcacgtag

SEQ ID NO: 673782 - DNA, 25 bp, Mus musculus
gtagtttatactaagcctctttggt

SEQ ID NO: 673783 - DNA, 25 bp, Mus musculus
gtagtttatacttagcctctttggt

SEQ ID NO: 673784 - DNA, 25 bp, Mus musculus
gtagtttatgtaatccagcagagga

SEQ ID NO: 673785 - DNA, 25 bp, Mus musculus
gtagtttatgtattccagcagagga

SEQ ID NO: 673786 - DNA, 25 bp, Mus musculus
gtagtttcaacgcttggaaagtgaa

SEQ ID NO: 673787 - DNA, 25 bp, Mus musculus
gtagtttcaacggttggaaagtgaa

SEQ ID NO: 673788 - DNA, 25 bp, Mus musculus
gtagtttcaataagagtcttgcttt

SEQ ID NO: 673789 - DNA, 25 bp, Mus musculus
gtagtttcaatatgagtcttgcttt

SEQ ID NO: 673790 - DNA, 25 bp, Mus musculus
gtagtttcaattctaaccactgctc

SEQ ID NO: 673791 - DNA, 25 bp, Mus musculus
gtagtttcaattgtaaccactgctc

SEQ ID NO: 673792 - DNA, 25 bp, Mus musculus
gtagtttcacacacttgccatctgt

SEQ ID NO: 673793 - DNA, 25 bp, Mus musculus
gtagtttcacactcttgccatctgt

SEQ ID NO: 673794 - DNA, 25 bp, Mus musculus
gtagtttcagctaccacccttgcaa

SEQ ID NO: 673795 - DNA, 25 bp, Mus musculus
gtagtttcagcttccacccttgcaa

SEQ ID NO: 673796 - DNA, 25 bp, Mus musculus
gtagtttcagtgaacacacacaaca

SEQ ID NO: 673797 - DNA, 25 bp, Mus musculus
gtagtttcagtgtacacacacaaca

SEQ ID NO: 673798 - DNA, 25 bp, Mus musculus
gtagtttcatctagtgactcttagt

SEQ ID NO: 673799 - DNA, 25 bp, Mus musculus
gtagtttcatcttgtgactcttagt

SEQ ID NO: 673800 - DNA, 25 bp, Mus musculus
gtagtttcatgcagtgtatgtacca

SEQ ID NO: 673801 - DNA, 25 bp, Mus musculus
gtagtttcatgctgtgtatgtacca

SEQ ID NO: 673802 - DNA, 25 bp, Mus musculus
gtagtttccagcacagaatcatcct

SEQ ID NO: 673803 - DNA, 25 bp, Mus musculus
gtagtttccagctcagaatcatcct

SEQ ID NO: 673804 - DNA, 25 bp, Mus musculus
gtagtttccagtcttcagtaaccat

SEQ ID NO: 673805 - DNA, 25 bp, Mus musculus
gtagtttccagtgttcagtaaccat

SEQ ID NO: 673806 - DNA, 25 bp, Mus musculus
gtagtttccctcatgtgttggtgtt

SEQ ID NO: 673807 - DNA, 25 bp, Mus musculus
gtagtttccctcttgtgttggtgtt

SEQ ID NO: 673808 - DNA, 25 bp, Mus musculus
gtagtttctctgaagtctcttttca

SEQ ID NO: 673809 - DNA, 25 bp, Mus musculus
gtagtttctctgtagtctcttttca

SEQ ID NO: 673810 - DNA, 25 bp, Mus musculus
gtagtttctggacgtttgtgcagta

SEQ ID NO: 673811 - DNA, 25 bp, Mus musculus
gtagtttctggactcctatctgaga

SEQ ID NO: 673812 - DNA, 25 bp, Mus musculus
gtagtttctggaggtttgtgcagta

SEQ ID NO: 673813 - DNA, 25 bp, Mus musculus
gtagtttctggagtcctatctgaga

SEQ ID NO: 673814 - DNA, 25 bp, Mus musculus
gtagtttcttaaaagcaagaactct

SEQ ID NO: 673815 - DNA, 25 bp, Mus musculus
gtagtttcttaatagcaagaactct

SEQ ID NO: 673816 - DNA, 25 bp, Mus musculus
gtagtttcttcaaattgtggacaaa

SEQ ID NO: 673817 - DNA, 25 bp, Mus musculus
gtagtttcttcatattgtggacaaa

SEQ ID NO: 673818 - DNA, 25 bp, Mus musculus
gtagtttcttgcctcgtctgtggac

SEQ ID NO: 673819 - DNA, 25 bp, Mus musculus
gtagtttcttgcgtcgtctgtggac

SEQ ID NO: 673820 - DNA, 25 bp, Mus musculus
gtagtttgaatacccaaccacccac

SEQ ID NO: 673821 - DNA, 25 bp, Mus musculus
gtagtttgaatagccaaccacccac

SEQ ID NO: 673822 - DNA, 25 bp, Mus musculus
gtagtttgattacattcattggtcc

SEQ ID NO: 673823 - DNA, 25 bp, Mus musculus
gtagtttgattagattcattggtcc

SEQ ID NO: 673824 - DNA, 25 bp, Mus musculus
gtagtttgccaactggaagttctct

SEQ ID NO: 673825 - DNA, 25 bp, Mus musculus
gtagtttgccaagtggaagttctct

SEQ ID NO: 673826 - DNA, 25 bp, Mus musculus
gtagtttgcctaagtctgagtttct

SEQ ID NO: 673827 - DNA, 25 bp, Mus musculus
gtagtttgcctatgtctgagtttct

SEQ ID NO: 673828 - DNA, 25 bp, Mus musculus
gtagtttgccttatttgatctgcaa

SEQ ID NO: 673829 - DNA, 25 bp, Mus musculus
gtagtttgccttttttgatctgcaa

SEQ ID NO: 673830 - DNA, 25 bp, Mus musculus
gtagtttgcttaatcgtccatttcc

SEQ ID NO: 673831 - DNA, 25 bp, Mus musculus
gtagtttgcttattcgtccatttcc

SEQ ID NO: 673832 - DNA, 25 bp, Mus musculus
gtagtttggcagagttaacagcata

SEQ ID NO: 673833 - DNA, 25 bp, Mus musculus
gtagtttggcagtgttaacagcata

SEQ ID NO: 673834 - DNA, 25 bp, Mus musculus
gtagtttggctaatatcgacatttt

SEQ ID NO: 673835 - DNA, 25 bp, Mus musculus
gtagtttggctattatcgacatttt

SEQ ID NO: 673836 - DNA, 25 bp, Mus musculus
gtagtttggtaaatatctagttaca

SEQ ID NO: 673837 - DNA, 25 bp, Mus musculus
gtagtttggtaattatctagttaca

SEQ ID NO: 673838 - DNA, 25 bp, Mus musculus
gtagtttgtgagcagttggattttt

SEQ ID NO: 673839 - DNA, 25 bp, Mus musculus
gtagtttgtgaggagttggattttt

SEQ ID NO: 673840 - DNA, 25 bp, Mus musculus
gtagttttaatcatgctaagtacaa

SEQ ID NO: 673841 - DNA, 25 bp, Mus musculus
gtagttttaatcttgctaagtacaa

SEQ ID NO: 673842 - DNA, 25 bp, Mus musculus
gtagttttagggatctctctgtctc

SEQ ID NO: 673843 - DNA, 25 bp, Mus musculus
gtagttttagggttctctctgtctc

SEQ ID NO: 673844 - DNA, 25 bp, Mus musculus
gtagttttattaaggaagccaggca

SEQ ID NO: 673845 - DNA, 25 bp, Mus musculus
gtagttttattatggaagccaggca

SEQ ID NO: 673846 - DNA, 25 bp, Mus musculus
gtagttttcaagagcctgttcatgg

SEQ ID NO: 673847 - DNA, 25 bp, Mus musculus
gtagttttcaagcagacacaaggcg

SEQ ID NO: 673848 - DNA, 25 bp, Mus musculus
gtagttttcaaggagacacaaggcg

SEQ ID NO: 673849 - DNA, 25 bp, Mus musculus
gtagttttcaagtgcctgttcatgg

SEQ ID NO: 673850 - DNA, 25 bp, Mus musculus
gtagttttcacaaggttgttgagtt

SEQ ID NO: 673851 - DNA, 25 bp, Mus musculus
gtagttttcacatggttgttgagtt

SEQ ID NO: 673852 - DNA, 25 bp, Mus musculus
gtagttttcagaaggataagcagga

SEQ ID NO: 673853 - DNA, 25 bp, Mus musculus
gtagttttcagatggataagcagga

SEQ ID NO: 673854 - DNA, 25 bp, Mus musculus
gtagttttccaacctggtggtcaga

SEQ ID NO: 673855 - DNA, 25 bp, Mus musculus
gtagttttccaagctggtggtcaga

SEQ ID NO: 673856 - DNA, 25 bp, Mus musculus
gtagttttccaccattataagcgct

SEQ ID NO: 673857 - DNA, 25 bp, Mus musculus
gtagttttccacgattataagcgct

SEQ ID NO: 673858 - DNA, 25 bp, Mus musculus
gtagttttcccaaagcaggcattca

SEQ ID NO: 673859 - DNA, 25 bp, Mus musculus
gtagttttcccatagcaggcattca

SEQ ID NO: 673860 - DNA, 25 bp, Mus musculus
gtagttttccctcttaatggttcag

SEQ ID NO: 673861 - DNA, 25 bp, Mus musculus
gtagttttccctgttaatggttcag

SEQ ID NO: 673862 - DNA, 25 bp, Mus musculus
gtagttttcgttctcatcctgtatt

SEQ ID NO: 673863 - DNA, 25 bp, Mus musculus
gtagttttcgttgtcatcctgtatt

SEQ ID NO: 673864 - DNA, 25 bp, Mus musculus
gtagttttctaaaccctgcagtttg

SEQ ID NO: 673865 - DNA, 25 bp, Mus musculus
gtagttttctaatccctgcagtttg

SEQ ID NO: 673866 - DNA, 25 bp, Mus musculus
gtagttttctggcactcattccatt

SEQ ID NO: 673867 - DNA, 25 bp, Mus musculus
gtagttttctgggactcattccatt

SEQ ID NO: 673868 - DNA, 25 bp, Mus musculus
gtagttttgaaactctcatgtatgt

SEQ ID NO: 673869 - DNA, 25 bp, Mus musculus
gtagttttgaaagtctcatgtatgt

SEQ ID NO: 673870 - DNA, 25 bp, Mus musculus
gtagttttgagccttcccagactct

SEQ ID NO: 673871 - DNA, 25 bp, Mus musculus
gtagttttgagcgttcccagactct

SEQ ID NO: 673872 - DNA, 25 bp, Mus musculus
gtagttttgtccattattctattga

SEQ ID NO: 673873 - DNA, 25 bp, Mus musculus
gtagttttgtcctttattctattga

SEQ ID NO: 673874 - DNA, 25 bp, Mus musculus
gtagttttgtgcatcctcagtatta

SEQ ID NO: 673875 - DNA, 25 bp, Mus musculus
gtagttttgtgcttcctcagtatta

SEQ ID NO: 673876 - DNA, 25 bp, Mus musculus
gtagtttttacaatgccctgtctgt

SEQ ID NO: 673877 - DNA, 25 bp, Mus musculus
gtagtttttacattgccctgtctgt

SEQ ID NO: 673878 - DNA, 25 bp, Mus musculus
gtagtttttcctatgatatttcaat

SEQ ID NO: 673879 - DNA, 25 bp, Mus musculus
gtagtttttcctttgatatttcaat

SEQ ID NO: 673880 - DNA, 25 bp, Mus musculus
gtagtttttcgcaatcaagaggaca

SEQ ID NO: 673881 - DNA, 25 bp, Mus musculus
gtagtttttcgctatcaagaggaca

SEQ ID NO: 673882 - DNA, 25 bp, Mus musculus
gtagtttttctcaaactgtacacaa

SEQ ID NO: 673883 - DNA, 25 bp, Mus musculus
gtagtttttctctaactgtacacaa

SEQ ID NO: 673884 - DNA, 25 bp, Mus musculus
gtagtttttgtgaattgctctgtaa

SEQ ID NO: 673885 - DNA, 25 bp, Mus musculus
gtagtttttgtgtattgctctgtaa

SEQ ID NO: 673886 - DNA, 25 bp, Mus musculus
gtagttttttgcctatgctaacaga

SEQ ID NO: 673887 - DNA, 25 bp, Mus musculus
gtagttttttgcgtatgctaacaga

SEQ ID NO: 673888 - DNA, 25 bp, Mus musculus
gtataaaaacctcagtcaccgatcc

SEQ ID NO: 673889 - DNA, 25 bp, Mus musculus
gtataaaaacctgagtcaccgatcc

SEQ ID NO: 673890 - DNA, 25 bp, Mus musculus
gtataaaacataaggctgggttcca

SEQ ID NO: 673891 - DNA, 25 bp, Mus musculus
gtataaaacatatggctgggttcca

SEQ ID NO: 673892 - DNA, 25 bp, Mus musculus
gtataaaaccttcatctctgctcct

SEQ ID NO: 673893 - DNA, 25 bp, Mus musculus
gtataaaaccttgatctctgctcct

SEQ ID NO: 673894 - DNA, 25 bp, Mus musculus
gtataaaagcacacctgtcattcgt

SEQ ID NO: 673895 - DNA, 25 bp, Mus musculus
gtataaaagcactcctgtcattcgt

SEQ ID NO: 673896 - DNA, 25 bp, Mus musculus
gtataaaagcagactcccctaagag

SEQ ID NO: 673897 - DNA, 25 bp, Mus musculus
gtataaaagcagtctcccctaagag

SEQ ID NO: 673898 - DNA, 25 bp, Mus musculus
gtataaaagtgccaaacctgccctc

SEQ ID NO: 673899 - DNA, 25 bp, Mus musculus
gtataaaagtgcgaaacctgccctc

SEQ ID NO: 673900 - DNA, 25 bp, Mus musculus
gtataaacaacaaatcatgcagaat

SEQ ID NO: 673901 - DNA, 25 bp, Mus musculus
gtataaacaacatatcatgcagaat

SEQ ID NO: 673902 - DNA, 25 bp, Mus musculus
gtataaacacctagcttactcctgt

SEQ ID NO: 673903 - DNA, 25 bp, Mus musculus
gtataaacaccttgcttactcctgt

SEQ ID NO: 673904 - DNA, 25 bp, Mus musculus
gtataaacacggacggctactctcc

SEQ ID NO: 673905 - DNA, 25 bp, Mus musculus
gtataaacacggtcggctactctcc

SEQ ID NO: 673906 - DNA, 25 bp, Mus musculus
gtataaacagtcctggcggtcctag

SEQ ID NO: 673907 - DNA, 25 bp, Mus musculus
gtataaacagtcgtggcggtcctag

SEQ ID NO: 673908 - DNA, 25 bp, Mus musculus
gtataaacatcacaagattttcttg

SEQ ID NO: 673909 - DNA, 25 bp, Mus musculus
gtataaacatcagaagattttcttg

SEQ ID NO: 673910 - DNA, 25 bp, Mus musculus
gtataaaccaccaaatcataaggat

SEQ ID NO: 673911 - DNA, 25 bp, Mus musculus
gtataaaccacctaatcataaggat

SEQ ID NO: 673912 - DNA, 25 bp, Mus musculus
gtataaaccaggacattctgtatat

SEQ ID NO: 673913 - DNA, 25 bp, Mus musculus
gtataaaccaggtcattctgtatat

SEQ ID NO: 673914 - DNA, 25 bp, Mus musculus
gtataaaccctgatgtatgctaagt

SEQ ID NO: 673915 - DNA, 25 bp, Mus musculus
gtataaaccctgttgtatgctaagt

SEQ ID NO: 673916 - DNA, 25 bp, Mus musculus
gtataaacctacacctggactggtg

SEQ ID NO: 673917 - DNA, 25 bp, Mus musculus
gtataaacctactcctggactggtg

SEQ ID NO: 673918 - DNA, 25 bp, Mus musculus
gtataaacctatcatcccaggtccc

SEQ ID NO: 673919 - DNA, 25 bp, Mus musculus
gtataaacctatgatcccaggtccc

SEQ ID NO: 673920 - DNA, 25 bp, Mus musculus
gtataaactgttcctcctaagctta

SEQ ID NO: 673921 - DNA, 25 bp, Mus musculus
gtataaactgttgctcctaagctta

SEQ ID NO: 673922 - DNA, 25 bp, Mus musculus
gtataaacttatcctgtaccaatgt

SEQ ID NO: 673923 - DNA, 25 bp, Mus musculus
gtataaacttatgctgtaccaatgt

SEQ ID NO: 673924 - DNA, 25 bp, Mus musculus
gtataaacttctatcatttgccaaa

SEQ ID NO: 673925 - DNA, 25 bp, Mus musculus
gtataaacttctttcatttgccaaa

SEQ ID NO: 673926 - DNA, 25 bp, Mus musculus
gtataaagagccagaatctaccctc

SEQ ID NO: 673927 - DNA, 25 bp, Mus musculus
gtataaagagcctgaatctaccctc

SEQ ID NO: 673928 - DNA, 25 bp, Mus musculus
gtataaagcccaatagactccatct

SEQ ID NO: 673929 - DNA, 25 bp, Mus musculus
gtataaagcccattagactccatct

SEQ ID NO: 673930 - DNA, 25 bp, Mus musculus
gtataaaggaaacggcagccgcatc

SEQ ID NO: 673931 - DNA, 25 bp, Mus musculus
gtataaaggaaagggcagccgcatc

SEQ ID NO: 673932 - DNA, 25 bp, Mus musculus
gtataaagtactccattatgccata

SEQ ID NO: 673933 - DNA, 25 bp, Mus musculus
gtataaagtactgcattatgccata

SEQ ID NO: 673934 - DNA, 25 bp, Mus musculus
gtataaatctcaatcttctacccac

SEQ ID NO: 673935 - DNA, 25 bp, Mus musculus
gtataaatctcattcttctacccac

SEQ ID NO: 673936 - DNA, 25 bp, Mus musculus
gtataaatcttaagtcccaccaggc

SEQ ID NO: 673937 - DNA, 25 bp, Mus musculus
gtataaatcttatgtcccaccaggc

SEQ ID NO: 673938 - DNA, 25 bp, Mus musculus
gtataaatgttaagactggtgttta

SEQ ID NO: 673939 - DNA, 25 bp, Mus musculus
gtataaatgttatgactggtgttta

SEQ ID NO: 673940 - DNA, 25 bp, Mus musculus
gtataaattatcagtccctccggag

SEQ ID NO: 673941 - DNA, 25 bp, Mus musculus
gtataaattatctgtccctccggag

SEQ ID NO: 673942 - DNA, 25 bp, Mus musculus
gtataaattcccacataggctcatg

SEQ ID NO: 673943 - DNA, 25 bp, Mus musculus
gtataaattccctcataggctcatg

SEQ ID NO: 673944 - DNA, 25 bp, Mus musculus
gtataaatttgacaacatcctgaaa

SEQ ID NO: 673945 - DNA, 25 bp, Mus musculus
gtataaatttgagaacatcctgaaa

SEQ ID NO: 673946 - DNA, 25 bp, Mus musculus
gtataacacagacgagttcatcaca

SEQ ID NO: 673947 - DNA, 25 bp, Mus musculus
gtataacacagaggagttcatcaca

SEQ ID NO: 673948 - DNA, 25 bp, Mus musculus
gtataacacgagatggccctggcag

SEQ ID NO: 673949 - DNA, 25 bp, Mus musculus
gtataacacgagttggccctggcag

SEQ ID NO: 673950 - DNA, 25 bp, Mus musculus
gtataacagactccctaaagacata

SEQ ID NO: 673951 - DNA, 25 bp, Mus musculus
gtataacagactgcctaaagacata

SEQ ID NO: 673952 - DNA, 25 bp, Mus musculus
gtataacagccactatagttcctga

SEQ ID NO: 673953 - DNA, 25 bp, Mus musculus
gtataacagccagtatagttcctga

SEQ ID NO: 673954 - DNA, 25 bp, Mus musculus
gtataacaggatactaaccacatgt

SEQ ID NO: 673955 - DNA, 25 bp, Mus musculus
gtataacaggattctaaccacatgt

SEQ ID NO: 673956 - DNA, 25 bp, Mus musculus
gtataacaggtcaacaagtgctctt

SEQ ID NO: 673957 - DNA, 25 bp, Mus musculus
gtataacaggtctacaagtgctctt

SEQ ID NO: 673958 - DNA, 25 bp, Mus musculus
gtataacagtttcaactcctttaga

SEQ ID NO: 673959 - DNA, 25 bp, Mus musculus
gtataacagtttgaactcctttaga

SEQ ID NO: 673960 - DNA, 25 bp, Mus musculus
gtataacatctactaaaacctgagt

SEQ ID NO: 673961 - DNA, 25 bp, Mus musculus
gtataacatctagtaaaacctgagt

SEQ ID NO: 673962 - DNA, 25 bp, Mus musculus
gtataacattttcatgctccacatc

SEQ ID NO: 673963 - DNA, 25 bp, Mus musculus
gtataacattttgatgctccacatc

SEQ ID NO: 673964 - DNA, 25 bp, Mus musculus
gtataaccaccacttagatttttct

SEQ ID NO: 673965 - DNA, 25 bp, Mus musculus
gtataaccaccagttagatttttct

SEQ ID NO: 673966 - DNA, 25 bp, Mus musculus
gtataaccctcccttcatcaggata

SEQ ID NO: 673967 - DNA, 25 bp, Mus musculus
gtataaccctccgttcatcaggata

SEQ ID NO: 673968 - DNA, 25 bp, Mus musculus
gtataacccttcagtaacccaggct

SEQ ID NO: 673969 - DNA, 25 bp, Mus musculus
gtataacccttctgtaacccaggct

SEQ ID NO: 673970 - DNA, 25 bp, Mus musculus
gtataaccgcaaactttctggctta

SEQ ID NO: 673971 - DNA, 25 bp, Mus musculus
gtataaccgcaatctttctggctta

SEQ ID NO: 673972 - DNA, 25 bp, Mus musculus
gtataaccgttaactcttgaaacat

SEQ ID NO: 673973 - DNA, 25 bp, Mus musculus
gtataaccgttatctcttgaaacat

SEQ ID NO: 673974 - DNA, 25 bp, Mus musculus
gtataacctagcagctcactgacct

SEQ ID NO: 673975 - DNA, 25 bp, Mus musculus
gtataacctagctgctcactgacct

SEQ ID NO: 673976 - DNA, 25 bp, Mus musculus
gtataacctgctaagtccattttta

SEQ ID NO: 673977 - DNA, 25 bp, Mus musculus
gtataacctgcttagtccattttta

SEQ ID NO: 673978 - DNA, 25 bp, Mus musculus
gtataacctggaactttctgcctta

SEQ ID NO: 673979 - DNA, 25 bp, Mus musculus
gtataacctggatctttctgcctta

SEQ ID NO: 673980 - DNA, 25 bp, Mus musculus
gtataaccttacactgggtggcttt

SEQ ID NO: 673981 - DNA, 25 bp, Mus musculus
gtataaccttactctgggtggcttt

SEQ ID NO: 673982 - DNA, 25 bp, Mus musculus
gtataactacctagtgctaactgag

SEQ ID NO: 673983 - DNA, 25 bp, Mus musculus
gtataactaccttgtgctaactgag

SEQ ID NO: 673984 - DNA, 25 bp, Mus musculus
gtataactatataaaatctcttgcg

SEQ ID NO: 673985 - DNA, 25 bp, Mus musculus
gtataactatattaaatctcttgcg

SEQ ID NO: 673986 - DNA, 25 bp, Mus musculus
gtataactcaataatttcgacaagg

SEQ ID NO: 673987 - DNA, 25 bp, Mus musculus
gtataactcaattatttcgacaagg

SEQ ID NO: 673988 - DNA, 25 bp, Mus musculus
gtataactcagtcttgtttgtttag

SEQ ID NO: 673989 - DNA, 25 bp, Mus musculus
gtataactcagtgttgtttgtttag

SEQ ID NO: 673990 - DNA, 25 bp, Mus musculus
gtataactccatctatgccatatgc

SEQ ID NO: 673991 - DNA, 25 bp, Mus musculus
gtataactccatgtatgccatatgc

SEQ ID NO: 673992 - DNA, 25 bp, Mus musculus
gtataactcgccatggaaacgcaca

SEQ ID NO: 673993 - DNA, 25 bp, Mus musculus
gtataactcgccttggaaacgcaca

SEQ ID NO: 673994 - DNA, 25 bp, Mus musculus
gtataactctacctgttcaaattca

SEQ ID NO: 673995 - DNA, 25 bp, Mus musculus
gtataactctacgtgttcaaattca

SEQ ID NO: 673996 - DNA, 25 bp, Mus musculus
gtataactgaaactccttccttttg

SEQ ID NO: 673997 - DNA, 25 bp, Mus musculus
gtataactgaaagtccttccttttg

SEQ ID NO: 673998 - DNA, 25 bp, Mus musculus
gtataactgctacatggcttttact

SEQ ID NO: 673999 - DNA, 25 bp, Mus musculus
gtataactgctagatggcttttact

SEQ ID NO: 674000 - DNA, 25 bp, Mus musculus
gtataactgctcctcctggcagaag

SEQ ID NO: 674001 - DNA, 25 bp, Mus musculus
gtataactgctcgtcctggcagaag

SEQ ID NO: 674002 - DNA, 25 bp, Mus musculus
gtataactgtagctagcacctcggc

SEQ ID NO: 674003 - DNA, 25 bp, Mus musculus
gtataactgtaggtagcacctcggc

SEQ ID NO: 674004 - DNA, 25 bp, Mus musculus
gtataacttaatactgggttgcttg

SEQ ID NO: 674005 - DNA, 25 bp, Mus musculus
gtataacttaattctgggttgcttg

SEQ ID NO: 674006 - DNA, 25 bp, Mus musculus
gtataactttatagtgccctagctg

SEQ ID NO: 674007 - DNA, 25 bp, Mus musculus
gtataactttattgtgccctagctg

SEQ ID NO: 674008 - DNA, 25 bp, Mus musculus
gtataagacacaatcgaccgctaca

SEQ ID NO: 674009 - DNA, 25 bp, Mus musculus
gtataagacacattcgaccgctaca

SEQ ID NO: 674010 - DNA, 25 bp, Mus musculus
gtataagacagcaacccagtatcat

SEQ ID NO: 674011 - DNA, 25 bp, Mus musculus
gtataagacagctacccagtatcat

SEQ ID NO: 674012 - DNA, 25 bp, Mus musculus
gtataagagataactccccttacct

SEQ ID NO: 674013 - DNA, 25 bp, Mus musculus
gtataagagatatctccccttacct

SEQ ID NO: 674014 - DNA, 25 bp, Mus musculus
gtataagaggtcactcttttccctc

SEQ ID NO: 674015 - DNA, 25 bp, Mus musculus
gtataagaggtctctcttttccctc

SEQ ID NO: 674016 - DNA, 25 bp, Mus musculus
gtataagatggtcatctctaaactg

SEQ ID NO: 674017 - DNA, 25 bp, Mus musculus
gtataagatggtgatctctaaactg

SEQ ID NO: 674018 - DNA, 25 bp, Mus musculus
gtataagcaaagaaccacacgcccc

SEQ ID NO: 674019 - DNA, 25 bp, Mus musculus
gtataagcaaagtaccacacgcccc

SEQ ID NO: 674020 - DNA, 25 bp, Mus musculus
gtataagcatgcatgccatagcata

SEQ ID NO: 674021 - DNA, 25 bp, Mus musculus
gtataagcatgcttgccatagcata

SEQ ID NO: 674022 - DNA, 25 bp, Mus musculus
gtataagccttgaactatgcataga

SEQ ID NO: 674023 - DNA, 25 bp, Mus musculus
gtataagccttgtactatgcataga

SEQ ID NO: 674024 - DNA, 25 bp, Mus musculus
gtataagcgctgactatagcagtgt

SEQ ID NO: 674025 - DNA, 25 bp, Mus musculus
gtataagcgctgtctatagcagtgt

SEQ ID NO: 674026 - DNA, 25 bp, Mus musculus
gtataagctgtgcagaaccccacct

SEQ ID NO: 674027 - DNA, 25 bp, Mus musculus
gtataagctgtggagaaccccacct

SEQ ID NO: 674028 - DNA, 25 bp, Mus musculus
gtataaggaggaatctcagagtcat

SEQ ID NO: 674029 - DNA, 25 bp, Mus musculus
gtataaggaggattctcagagtcat

SEQ ID NO: 674030 - DNA, 25 bp, Mus musculus
gtataaggagtcacccctccggata

SEQ ID NO: 674031 - DNA, 25 bp, Mus musculus
gtataaggagtctcccctccggata

SEQ ID NO: 674032 - DNA, 25 bp, Mus musculus
gtataaggctgaaaagctctcttct

SEQ ID NO: 674033 - DNA, 25 bp, Mus musculus
gtataaggctgataagctctcttct

SEQ ID NO: 674034 - DNA, 25 bp, Mus musculus
gtataaggttctcgtttagatgcta

SEQ ID NO: 674035 - DNA, 25 bp, Mus musculus
gtataaggttctggtttagatgcta

SEQ ID NO: 674036 - DNA, 25 bp, Mus musculus
gtataagtaatcactgcatgccaga

SEQ ID NO: 674037 - DNA, 25 bp, Mus musculus
gtataagtaatctctgcatgccaga

SEQ ID NO: 674038 - DNA, 25 bp, Mus musculus
gtataagtcggcagtgcctttgact

SEQ ID NO: 674039 - DNA, 25 bp, Mus musculus
gtataagtcggctgtgcctttgact

SEQ ID NO: 674040 - DNA, 25 bp, Mus musculus
gtataagtctgaaccagccacacca

SEQ ID NO: 674041 - DNA, 25 bp, Mus musculus
gtataagtctgaacccagcagcagc

SEQ ID NO: 674042 - DNA, 25 bp, Mus musculus
gtataagtctgatccagccacacca

SEQ ID NO: 674043 - DNA, 25 bp, Mus musculus
gtataagtctgatcccagcagcagc

SEQ ID NO: 674044 - DNA, 25 bp, Mus musculus
gtataagtgaggagattcctgtttt

SEQ ID NO: 674045 - DNA, 25 bp, Mus musculus
gtataagtgaggtgattcctgtttt

SEQ ID NO: 674046 - DNA, 25 bp, Mus musculus
gtataagtgtcacattttctagcaa

SEQ ID NO: 674047 - DNA, 25 bp, Mus musculus
gtataagtgtcagattttctagcaa

SEQ ID NO: 674048 - DNA, 25 bp, Mus musculus
gtataagtgtgcctatgtgctgtaa

SEQ ID NO: 674049 - DNA, 25 bp, Mus musculus
gtataagtgtgcgtatgtgctgtaa

SEQ ID NO: 674050 - DNA, 25 bp, Mus musculus
gtataagttactagagctcgggcag

SEQ ID NO: 674051 - DNA, 25 bp, Mus musculus
gtataagttacttgagctcgggcag

SEQ ID NO: 674052 - DNA, 25 bp, Mus musculus
gtataagtttacctcaatgaattgc

SEQ ID NO: 674053 - DNA, 25 bp, Mus musculus
gtataagtttacgtcaatgaattgc

SEQ ID NO: 674054 - DNA, 25 bp, Mus musculus
gtataataacaacatctctcctcag

SEQ ID NO: 674055 - DNA, 25 bp, Mus musculus
gtataataacaagatctctcctcag

SEQ ID NO: 674056 - DNA, 25 bp, Mus musculus
gtataatacacacctgggtccacct

SEQ ID NO: 674057 - DNA, 25 bp, Mus musculus
gtataatacacagctgggtccacct

SEQ ID NO: 674058 - DNA, 25 bp, Mus musculus
gtataatacagccttgagtagctca

SEQ ID NO: 674059 - DNA, 25 bp, Mus musculus
gtataatacagcgttgagtagctca

SEQ ID NO: 674060 - DNA, 25 bp, Mus musculus
gtataataccggatttctctttgca

SEQ ID NO: 674061 - DNA, 25 bp, Mus musculus
gtataataccggttttctctttgca

SEQ ID NO: 674062 - DNA, 25 bp, Mus musculus
gtataatactcacagcagctcacat

SEQ ID NO: 674063 - DNA, 25 bp, Mus musculus
gtataatactcagagcagctcacat

SEQ ID NO: 674064 - DNA, 25 bp, Mus musculus
gtataatagactaggctgtcctggc

SEQ ID NO: 674065 - DNA, 25 bp, Mus musculus
gtataatagacttggctgtcctggc

SEQ ID NO: 674066 - DNA, 25 bp, Mus musculus
gtataatagtcaatcgaagccatcg

SEQ ID NO: 674067 - DNA, 25 bp, Mus musculus
gtataatagtcattcgaagccatcg

SEQ ID NO: 674068 - DNA, 25 bp, Mus musculus
gtataatattagctttctggacaga

SEQ ID NO: 674069 - DNA, 25 bp, Mus musculus
gtataatattaggtttctggacaga

SEQ ID NO: 674070 - DNA, 25 bp, Mus musculus
gtataatcaattatagacacatctt

SEQ ID NO: 674071 - DNA, 25 bp, Mus musculus
gtataatcaattttagacacatctt

SEQ ID NO: 674072 - DNA, 25 bp, Mus musculus
gtataatcaccaacgtgtgcatgct

SEQ ID NO: 674073 - DNA, 25 bp, Mus musculus
gtataatcaccatcgtgtgcatgct

SEQ ID NO: 674074 - DNA, 25 bp, Mus musculus
gtataatcatccagtgacacatgct

SEQ ID NO: 674075 - DNA, 25 bp, Mus musculus
gtataatcatcctgtgacacatgct

SEQ ID NO: 674076 - DNA, 25 bp, Mus musculus
gtataatccccacttgacatctaga

SEQ ID NO: 674077 - DNA, 25 bp, Mus musculus
gtataatccccagttgacatctaga

SEQ ID NO: 674078 - DNA, 25 bp, Mus musculus
gtataatccctaatccatttactga

SEQ ID NO: 674079 - DNA, 25 bp, Mus musculus
gtataatccctattccatttactga

SEQ ID NO: 674080 - DNA, 25 bp, Mus musculus
gtataatcgacaacttttgcacctt

SEQ ID NO: 674081 - DNA, 25 bp, Mus musculus
gtataatcgacatcttttgcacctt

SEQ ID NO: 674082 - DNA, 25 bp, Mus musculus
gtataatctcccagtcaagttagca

SEQ ID NO: 674083 - DNA, 25 bp, Mus musculus
gtataatctccctgtcaagttagca

SEQ ID NO: 674084 - DNA, 25 bp, Mus musculus
gtataatctgctatagtgaacactt

SEQ ID NO: 674085 - DNA, 25 bp, Mus musculus
gtataatctgctttagtgaacactt

SEQ ID NO: 674086 - DNA, 25 bp, Mus musculus
gtataatctggtagtgtctggccct

SEQ ID NO: 674087 - DNA, 25 bp, Mus musculus
gtataatctggttgtgtctggccct

SEQ ID NO: 674088 - DNA, 25 bp, Mus musculus
gtataatctgtgaggagggcttcaa

SEQ ID NO: 674089 - DNA, 25 bp, Mus musculus
gtataatctgtgattacttgtaact

SEQ ID NO: 674090 - DNA, 25 bp, Mus musculus
gtataatctgtgtggagggcttcaa

SEQ ID NO: 674091 - DNA, 25 bp, Mus musculus
gtataatctgtgtttacttgtaact

SEQ ID NO: 674092 - DNA, 25 bp, Mus musculus
gtataatcttaaaatgcctgtctgt

SEQ ID NO: 674093 - DNA, 25 bp, Mus musculus
gtataatcttaatatgcctgtctgt

SEQ ID NO: 674094 - DNA, 25 bp, Mus musculus
gtataatgcagtaaagactacatgg

SEQ ID NO: 674095 - DNA, 25 bp, Mus musculus
gtataatgcagttaagactacatgg

SEQ ID NO: 674096 - DNA, 25 bp, Mus musculus
gtataatgctgtacttggtgctaaa

SEQ ID NO: 674097 - DNA, 25 bp, Mus musculus
gtataatgctgttcttggtgctaaa

SEQ ID NO: 674098 - DNA, 25 bp, Mus musculus
gtataatgggagacgcatcccgcct

SEQ ID NO: 674099 - DNA, 25 bp, Mus musculus
gtataatgggagtcgcatcccgcct

SEQ ID NO: 674100 - DNA, 25 bp, Mus musculus
gtataatggttcagcctggcgaaga

SEQ ID NO: 674101 - DNA, 25 bp, Mus musculus
gtataatggttctgcctggcgaaga

SEQ ID NO: 674102 - DNA, 25 bp, Mus musculus
gtataattacagagcccattgtgtg

SEQ ID NO: 674103 - DNA, 25 bp, Mus musculus
gtataattacagtgcccattgtgtg

SEQ ID NO: 674104 - DNA, 25 bp, Mus musculus
gtataattcaagaagtctccggact

SEQ ID NO: 674105 - DNA, 25 bp, Mus musculus
gtataattcaagtagtctccggact

SEQ ID NO: 674106 - DNA, 25 bp, Mus musculus
gtataattcactccatgagtctagg

SEQ ID NO: 674107 - DNA, 25 bp, Mus musculus
gtataattcactgcatgagtctagg

SEQ ID NO: 674108 - DNA, 25 bp, Mus musculus
gtataattcctgatgcctacgttct

SEQ ID NO: 674109 - DNA, 25 bp, Mus musculus
gtataattcctgttgcctacgttct

SEQ ID NO: 674110 - DNA, 25 bp, Mus musculus
gtataattcgttctatgaggcgtct

SEQ ID NO: 674111 - DNA, 25 bp, Mus musculus
gtataattcgttgtatgaggcgtct

SEQ ID NO: 674112 - DNA, 25 bp, Mus musculus
gtataattgaacatagggcagagca

SEQ ID NO: 674113 - DNA, 25 bp, Mus musculus
gtataattgaacttagggcagagca

SEQ ID NO: 674114 - DNA, 25 bp, Mus musculus
gtataattgctccattgagtcccca

SEQ ID NO: 674115 - DNA, 25 bp, Mus musculus
gtataattgctcgattgagtcccca

SEQ ID NO: 674116 - DNA, 25 bp, Mus musculus
gtataattgttcactcctttctggg

SEQ ID NO: 674117 - DNA, 25 bp, Mus musculus
gtataattgttctctcctttctggg

SEQ ID NO: 674118 - DNA, 25 bp, Mus musculus
gtataatttcatcccagctggtcat

SEQ ID NO: 674119 - DNA, 25 bp, Mus musculus
gtataatttcatgccagctggtcat

SEQ ID NO: 674120 - DNA, 25 bp, Mus musculus
gtatacaaagttactgtgagcacta

SEQ ID NO: 674121 - DNA, 25 bp, Mus musculus
gtatacaaagtttctgtgagcacta

SEQ ID NO: 674122 - DNA, 25 bp, Mus musculus
gtatacaaatccatagcagcagcac

SEQ ID NO: 674123 - DNA, 25 bp, Mus musculus
gtatacaaatccttagcagcagcac

SEQ ID NO: 674124 - DNA, 25 bp, Mus musculus
gtatacaaatttcagcagctaggat

SEQ ID NO: 674125 - DNA, 25 bp, Mus musculus
gtatacaaatttgagcagctaggat

SEQ ID NO: 674126 - DNA, 25 bp, Mus musculus
gtatacaacaacaaaaggcctgcca

SEQ ID NO: 674127 - DNA, 25 bp, Mus musculus
gtatacaacaactaaaggcctgcca

SEQ ID NO: 674128 - DNA, 25 bp, Mus musculus
gtatacaaggccacattgaacttaa

SEQ ID NO: 674129 - DNA, 25 bp, Mus musculus
gtatacaaggcctcattgaacttaa

SEQ ID NO: 674130 - DNA, 25 bp, Mus musculus
gtatacaattgtcctacctgaataa

SEQ ID NO: 674131 - DNA, 25 bp, Mus musculus
gtatacaattgtgctacctgaataa

SEQ ID NO: 674132 - DNA, 25 bp, Mus musculus
gtatacacacctaggtgctgagcat

SEQ ID NO: 674133 - DNA, 25 bp, Mus musculus
gtatacacaccttggtgctgagcat

SEQ ID NO: 674134 - DNA, 25 bp, Mus musculus
gtatacacattaaatcccgactctc

SEQ ID NO: 674135 - DNA, 25 bp, Mus musculus
gtatacacattaatgataggcagat

SEQ ID NO: 674136 - DNA, 25 bp, Mus musculus
gtatacacattatatcccgactctc

SEQ ID NO: 674137 - DNA, 25 bp, Mus musculus
gtatacacattattgataggcagat

SEQ ID NO: 674138 - DNA, 25 bp, Mus musculus
gtatacaccacactgcacgtgcatg

SEQ ID NO: 674139 - DNA, 25 bp, Mus musculus
gtatacaccacagtgcacgtgcatg

SEQ ID NO: 674140 - DNA, 25 bp, Mus musculus
gtatacacctttagcaggtcaccgg

SEQ ID NO: 674141 - DNA, 25 bp, Mus musculus
gtatacaccttttgcaggtcaccgg

SEQ ID NO: 674142 - DNA, 25 bp, Mus musculus
gtatacactactaaattttacattt

SEQ ID NO: 674143 - DNA, 25 bp, Mus musculus
gtatacactacttaattttacattt

SEQ ID NO: 674144 - DNA, 25 bp, Mus musculus
gtatacactgacaaaagcgcgtttt

SEQ ID NO: 674145 - DNA, 25 bp, Mus musculus
gtatacactgactaaagcgcgtttt

SEQ ID NO: 674146 - DNA, 25 bp, Mus musculus
gtatacactgttcaggcattcctcc

SEQ ID NO: 674147 - DNA, 25 bp, Mus musculus
gtatacactgttgaggcattcctcc

SEQ ID NO: 674148 - DNA, 25 bp, Mus musculus
gtatacacttggcatcaacatcttt

SEQ ID NO: 674149 - DNA, 25 bp, Mus musculus
gtatacacttgggatcaacatcttt

SEQ ID NO: 674150 - DNA, 25 bp, Mus musculus
gtatacacttttctggcatttgctc

SEQ ID NO: 674151 - DNA, 25 bp, Mus musculus
gtatacacttttgtggcatttgctc

SEQ ID NO: 674152 - DNA, 25 bp, Mus musculus
gtatacagaactcgcccaagctgac

SEQ ID NO: 674153 - DNA, 25 bp, Mus musculus
gtatacagaactggcccaagctgac

SEQ ID NO: 674154 - DNA, 25 bp, Mus musculus
gtatacagacacatctatgcatgca

SEQ ID NO: 674155 - DNA, 25 bp, Mus musculus
gtatacagacacttctatgcatgca

SEQ ID NO: 674156 - DNA, 25 bp, Mus musculus
gtatacagcctcagtatttgtgcct

SEQ ID NO: 674157 - DNA, 25 bp, Mus musculus
gtatacagcctctgtatttgtgcct

SEQ ID NO: 674158 - DNA, 25 bp, Mus musculus
gtatacaggacccatctgaaagcat

SEQ ID NO: 674159 - DNA, 25 bp, Mus musculus
gtatacaggaccgatctgaaagcat

SEQ ID NO: 674160 - DNA, 25 bp, Mus musculus
gtatacaggaggatggcagatattc

SEQ ID NO: 674161 - DNA, 25 bp, Mus musculus
gtatacaggaggttggcagatattc

SEQ ID NO: 674162 - DNA, 25 bp, Mus musculus
gtatacagggtcacattacgttgcc

SEQ ID NO: 674163 - DNA, 25 bp, Mus musculus
gtatacagggtctcattacgttgcc

SEQ ID NO: 674164 - DNA, 25 bp, Mus musculus
gtatacaggtgcaaatagacattta

SEQ ID NO: 674165 - DNA, 25 bp, Mus musculus
gtatacaggtgctaatagacattta

SEQ ID NO: 674166 - DNA, 25 bp, Mus musculus
gtatacagtgcaattagggattcag

SEQ ID NO: 674167 - DNA, 25 bp, Mus musculus
gtatacagtgcatttagggattcag

SEQ ID NO: 674168 - DNA, 25 bp, Mus musculus
gtatacagtgctacatcgacttgct

SEQ ID NO: 674169 - DNA, 25 bp, Mus musculus
gtatacagtgcttcatcgacttgct

SEQ ID NO: 674170 - DNA, 25 bp, Mus musculus
gtatacagtgtcataacttcatgtt

SEQ ID NO: 674171 - DNA, 25 bp, Mus musculus
gtatacagtgtcttaacttcatgtt

SEQ ID NO: 674172 - DNA, 25 bp, Mus musculus
gtatacagtgttcctgagatcagac

SEQ ID NO: 674173 - DNA, 25 bp, Mus musculus
gtatacagtgttgctgagatcagac

SEQ ID NO: 674174 - DNA, 25 bp, Mus musculus
gtatacagttttcagagccaggaat

SEQ ID NO: 674175 - DNA, 25 bp, Mus musculus
gtatacagttttgagagccaggaat

SEQ ID NO: 674176 - DNA, 25 bp, Mus musculus
gtatacataccaatgcttgtgcatg

SEQ ID NO: 674177 - DNA, 25 bp, Mus musculus
gtatacataccattgcttgtgcatg

SEQ ID NO: 674178 - DNA, 25 bp, Mus musculus
gtatacatacgcaactgtccaaata

SEQ ID NO: 674179 - DNA, 25 bp, Mus musculus
gtatacatacgctactgtccaaata

SEQ ID NO: 674180 - DNA, 25 bp, Mus musculus
gtatacatatacaccaagactacaa

SEQ ID NO: 674181 - DNA, 25 bp, Mus musculus
gtatacatatactccaagactacaa

SEQ ID NO: 674182 - DNA, 25 bp, Mus musculus
gtatacatatgtcagcctaaagaat

SEQ ID NO: 674183 - DNA, 25 bp, Mus musculus
gtatacatatgtgagcctaaagaat

SEQ ID NO: 674184 - DNA, 25 bp, Mus musculus
gtatacatcaataacatcacaggaa

SEQ ID NO: 674185 - DNA, 25 bp, Mus musculus
gtatacatcaattacatcacaggaa

SEQ ID NO: 674186 - DNA, 25 bp, Mus musculus
gtatacatcatgaggaggaccctca

SEQ ID NO: 674187 - DNA, 25 bp, Mus musculus
gtatacatcatgtggaggaccctca

SEQ ID NO: 674188 - DNA, 25 bp, Mus musculus
gtatacatcctcacactcctgtagt

SEQ ID NO: 674189 - DNA, 25 bp, Mus musculus
gtatacatcctctcactcctgtagt

SEQ ID NO: 674190 - DNA, 25 bp, Mus musculus
gtatacatctcacgaaaccatttcc

SEQ ID NO: 674191 - DNA, 25 bp, Mus musculus
gtatacatctcaggaaaccatttcc

SEQ ID NO: 674192 - DNA, 25 bp, Mus musculus
gtatacatgagaccctaagaggcct

SEQ ID NO: 674193 - DNA, 25 bp, Mus musculus
gtatacatgagagcctaagaggcct

SEQ ID NO: 674194 - DNA, 25 bp, Mus musculus
gtatacatggagaaccgggtactca

SEQ ID NO: 674195 - DNA, 25 bp, Mus musculus
gtatacatggagtaccgggtactca

SEQ ID NO: 674196 - DNA, 25 bp, Mus musculus
gtatacattacgctgccaatatgaa

SEQ ID NO: 674197 - DNA, 25 bp, Mus musculus
gtatacattacggtgccaatatgaa

SEQ ID NO: 674198 - DNA, 25 bp, Mus musculus
gtatacattcatactgcctaaactt

SEQ ID NO: 674199 - DNA, 25 bp, Mus musculus
gtatacattcattctgcctaaactt

SEQ ID NO: 674200 - DNA, 25 bp, Mus musculus
gtatacattccaaatgccccaagca

SEQ ID NO: 674201 - DNA, 25 bp, Mus musculus
gtatacattccatatgccccaagca

SEQ ID NO: 674202 - DNA, 25 bp, Mus musculus
gtatacattcccaactggatcacat

SEQ ID NO: 674203 - DNA, 25 bp, Mus musculus
gtatacattccctactggatcacat

SEQ ID NO: 674204 - DNA, 25 bp, Mus musculus
gtatacatttacatattgtcctgaa

SEQ ID NO: 674205 - DNA, 25 bp, Mus musculus
gtatacatttacttattgtcctgaa

SEQ ID NO: 674206 - DNA, 25 bp, Mus musculus
gtataccaaatcaaggcaccaatag

SEQ ID NO: 674207 - DNA, 25 bp, Mus musculus
gtataccaaatctaggcaccaatag

SEQ ID NO: 674208 - DNA, 25 bp, Mus musculus
gtataccaagcaagctgtggcacat

SEQ ID NO: 674209 - DNA, 25 bp, Mus musculus
gtataccaagcatgctgtggcacat

SEQ ID NO: 674210 - DNA, 25 bp, Mus musculus
gtataccaatgacccaagtggagtt

SEQ ID NO: 674211 - DNA, 25 bp, Mus musculus
gtataccaatgagccaagtggagtt

SEQ ID NO: 674212 - DNA, 25 bp, Mus musculus
gtataccacaatcccttatctgtcc

SEQ ID NO: 674213 - DNA, 25 bp, Mus musculus
gtataccacaatgccttatctgtcc

SEQ ID NO: 674214 - DNA, 25 bp, Mus musculus
gtataccacgagagattttggcttt

SEQ ID NO: 674215 - DNA, 25 bp, Mus musculus
gtataccacgagtgattttggcttt

SEQ ID NO: 674216 - DNA, 25 bp, Mus musculus
gtataccagaggactaacttatttt

SEQ ID NO: 674217 - DNA, 25 bp, Mus musculus
gtataccagaggtctaacttatttt

SEQ ID NO: 674218 - DNA, 25 bp, Mus musculus
gtataccaggtacttgtccaggcaa

SEQ ID NO: 674219 - DNA, 25 bp, Mus musculus
gtataccaggtagttgtccaggcaa

SEQ ID NO: 674220 - DNA, 25 bp, Mus musculus
gtataccatatgcatacctggttag

SEQ ID NO: 674221 - DNA, 25 bp, Mus musculus
gtataccatatggatacctggttag

SEQ ID NO: 674222 - DNA, 25 bp, Mus musculus
gtataccatattcacccacagtgga

SEQ ID NO: 674223 - DNA, 25 bp, Mus musculus
gtataccatattgacccacagtgga

SEQ ID NO: 674224 - DNA, 25 bp, Mus musculus
gtataccatgtaagtgcaggagcct

SEQ ID NO: 674225 - DNA, 25 bp, Mus musculus
gtataccatgtatgtgcaggagcct

SEQ ID NO: 674226 - DNA, 25 bp, Mus musculus
gtataccattctaaccacacaattg

SEQ ID NO: 674227 - DNA, 25 bp, Mus musculus
gtataccattcttaccacacaattg

SEQ ID NO: 674228 - DNA, 25 bp, Mus musculus
gtatacccacttacaagatactttt

SEQ ID NO: 674229 - DNA, 25 bp, Mus musculus
gtatacccactttcaagatactttt

SEQ ID NO: 674230 - DNA, 25 bp, Mus musculus
gtatacccagctatgcagaaactct

SEQ ID NO: 674231 - DNA, 25 bp, Mus musculus
gtatacccagctttgcagaaactct

SEQ ID NO: 674232 - DNA, 25 bp, Mus musculus
gtatacccagtacatttagaataat

SEQ ID NO: 674233 - DNA, 25 bp, Mus musculus
gtatacccagtagatttagaataat

SEQ ID NO: 674234 - DNA, 25 bp, Mus musculus
gtatacccgggaagatgtctcacat

SEQ ID NO: 674235 - DNA, 25 bp, Mus musculus
gtatacccgggatgatgtctcacat

SEQ ID NO: 674236 - DNA, 25 bp, Mus musculus
gtataccctcctaggatgacatttc

SEQ ID NO: 674237 - DNA, 25 bp, Mus musculus
gtataccctccttggatgacatttc

SEQ ID NO: 674238 - DNA, 25 bp, Mus musculus
gtataccctgctagagcctgagtag

SEQ ID NO: 674239 - DNA, 25 bp, Mus musculus
gtataccctgcttgagcctgagtag

SEQ ID NO: 674240 - DNA, 25 bp, Mus musculus
gtataccctttcaacagagttgcct

SEQ ID NO: 674241 - DNA, 25 bp, Mus musculus
gtataccctttctacagagttgcct

SEQ ID NO: 674242 - DNA, 25 bp, Mus musculus
gtatacccttttcctttttgaatgt

SEQ ID NO: 674243 - DNA, 25 bp, Mus musculus
gtatacccttttgctttttgaatgt

SEQ ID NO: 674244 - DNA, 25 bp, Mus musculus
gtataccgagaaccctgtctagaat

SEQ ID NO: 674245 - DNA, 25 bp, Mus musculus
gtataccgagaagcctgtctagaat

SEQ ID NO: 674246 - DNA, 25 bp, Mus musculus
gtataccgagggactttgggctgtc

SEQ ID NO: 674247 - DNA, 25 bp, Mus musculus
gtataccgagggtctttgggctgtc

SEQ ID NO: 674248 - DNA, 25 bp, Mus musculus
gtataccgtcacataaaaccccatg

SEQ ID NO: 674249 - DNA, 25 bp, Mus musculus
gtataccgtcacttaaaaccccatg

SEQ ID NO: 674250 - DNA, 25 bp, Mus musculus
gtatacctaagcaaaccacacgtgt

SEQ ID NO: 674251 - DNA, 25 bp, Mus musculus
gtatacctaagctaaccacacgtgt

SEQ ID NO: 674252 - DNA, 25 bp, Mus musculus
gtatacctacagctacagtgttgca

SEQ ID NO: 674253 - DNA, 25 bp, Mus musculus
gtatacctacaggtacagtgttgca

SEQ ID NO: 674254 - DNA, 25 bp, Mus musculus
gtatacctacttccgttacaatggc

SEQ ID NO: 674255 - DNA, 25 bp, Mus musculus
gtatacctacttgcgttacaatggc

SEQ ID NO: 674256 - DNA, 25 bp, Mus musculus
gtatacctcaatctttactactgta

SEQ ID NO: 674257 - DNA, 25 bp, Mus musculus
gtatacctcaatgtttactactgta

SEQ ID NO: 674258 - DNA, 25 bp, Mus musculus
gtatacctcgggaatcctcaggaaa

SEQ ID NO: 674259 - DNA, 25 bp, Mus musculus
gtatacctcgggtatcctcaggaaa

SEQ ID NO: 674260 - DNA, 25 bp, Mus musculus
gtatacctctcaagtgtgtatccca

SEQ ID NO: 674261 - DNA, 25 bp, Mus musculus
gtatacctctcatgtgtgtatccca

SEQ ID NO: 674262 - DNA, 25 bp, Mus musculus
gtatacctgactcaagttgttcttg

SEQ ID NO: 674263 - DNA, 25 bp, Mus musculus
gtatacctgactgaagttgttcttg

SEQ ID NO: 674264 - DNA, 25 bp, Mus musculus
gtatacctgggaacttggcacctac

SEQ ID NO: 674265 - DNA, 25 bp, Mus musculus
gtatacctgggatcttggcacctac

SEQ ID NO: 674266 - DNA, 25 bp, Mus musculus
gtatacctgtggactgtgacttgca

SEQ ID NO: 674267 - DNA, 25 bp, Mus musculus
gtatacctgtggtctgtgacttgca

SEQ ID NO: 674268 - DNA, 25 bp, Mus musculus
gtataccttaccatgaagatgcgac

SEQ ID NO: 674269 - DNA, 25 bp, Mus musculus
gtataccttaccttgaagatgcgac

SEQ ID NO: 674270 - DNA, 25 bp, Mus musculus
gtataccttcaaagatgggctgcag

SEQ ID NO: 674271 - DNA, 25 bp, Mus musculus
gtataccttcaatgatgggctgcag

SEQ ID NO: 674272 - DNA, 25 bp, Mus musculus
gtataccttctaattgtgatgagag

SEQ ID NO: 674273 - DNA, 25 bp, Mus musculus
gtataccttctatttgtgatgagag

SEQ ID NO: 674274 - DNA, 25 bp, Mus musculus
gtataccttggacggaagtccccag

SEQ ID NO: 674275 - DNA, 25 bp, Mus musculus
gtataccttggagggaagtccccag

SEQ ID NO: 674276 - DNA, 25 bp, Mus musculus
gtataccttgtcagagcaaccatgt

SEQ ID NO: 674277 - DNA, 25 bp, Mus musculus
gtataccttgtctgagcaaccatgt

SEQ ID NO: 674278 - DNA, 25 bp, Mus musculus
gtatacctttcacccagactttagc

SEQ ID NO: 674279 - DNA, 25 bp, Mus musculus
gtatacctttcagccagactttagc

SEQ ID NO: 674280 - DNA, 25 bp, Mus musculus
gtatacgacacaaaacatactgtta

SEQ ID NO: 674281 - DNA, 25 bp, Mus musculus
gtatacgacacataacatactgtta

SEQ ID NO: 674282 - DNA, 25 bp, Mus musculus
gtatacgagtatctacctacatcta

SEQ ID NO: 674283 - DNA, 25 bp, Mus musculus
gtatacgagtatgtacctacatcta

SEQ ID NO: 674284 - DNA, 25 bp, Mus musculus
gtatacgcgcctaccaaatcctaat

SEQ ID NO: 674285 - DNA, 25 bp, Mus musculus
gtatacgcgccttccaaatcctaat

SEQ ID NO: 674286 - DNA, 25 bp, Mus musculus
gtatacgcttccctgtcattgcttg

SEQ ID NO: 674287 - DNA, 25 bp, Mus musculus
gtatacgcttccgtgtcattgcttg

SEQ ID NO: 674288 - DNA, 25 bp, Mus musculus
gtatacggagttcggcaggttctct

SEQ ID NO: 674289 - DNA, 25 bp, Mus musculus
gtatacggagttgggcaggttctct

SEQ ID NO: 674290 - DNA, 25 bp, Mus musculus
gtatacgtactaatggattcaccat

SEQ ID NO: 674291 - DNA, 25 bp, Mus musculus
gtatacgtactattggattcaccat

SEQ ID NO: 674292 - DNA, 25 bp, Mus musculus
gtatacgtcgtgcaaatcacctgct

SEQ ID NO: 674293 - DNA, 25 bp, Mus musculus
gtatacgtcgtggaaatcacctgct

SEQ ID NO: 674294 - DNA, 25 bp, Mus musculus
gtatacgttcggatcggggaccaag

SEQ ID NO: 674295 - DNA, 25 bp, Mus musculus
gtatacgttcggttcggggaccaag

SEQ ID NO: 674296 - DNA, 25 bp, Mus musculus
gtatactacaccaaacatagcaagt

SEQ ID NO: 674297 - DNA, 25 bp, Mus musculus
gtatactacacctaacatagcaagt

SEQ ID NO: 674298 - DNA, 25 bp, Mus musculus
gtatactaggccatgatcagcacat

SEQ ID NO: 674299 - DNA, 25 bp, Mus musculus
gtatactaggccttgatcagcacat

SEQ ID NO: 674300 - DNA, 25 bp, Mus musculus
gtatactagtatatcacgtatctgt

SEQ ID NO: 674301 - DNA, 25 bp, Mus musculus
gtatactagtatatctggcagtgga

SEQ ID NO: 674302 - DNA, 25 bp, Mus musculus
gtatactagtatttcacgtatctgt

SEQ ID NO: 674303 - DNA, 25 bp, Mus musculus
gtatactagtatttctggcagtgga

SEQ ID NO: 674304 - DNA, 25 bp, Mus musculus
gtatactcaactcgatttatggaac

SEQ ID NO: 674305 - DNA, 25 bp, Mus musculus
gtatactcaactggatttatggaac

SEQ ID NO: 674306 - DNA, 25 bp, Mus musculus
gtatactcaatcctacatcacattt

SEQ ID NO: 674307 - DNA, 25 bp, Mus musculus
gtatactcaatcgtacatcacattt

SEQ ID NO: 674308 - DNA, 25 bp, Mus musculus
gtatactccttactaacaaactgga

SEQ ID NO: 674309 - DNA, 25 bp, Mus musculus
gtatactccttagtaacaaactgga

SEQ ID NO: 674310 - DNA, 25 bp, Mus musculus
gtatactctgtaagctgggatccca

SEQ ID NO: 674311 - DNA, 25 bp, Mus musculus
gtatactctgtaattggctttgtga

SEQ ID NO: 674312 - DNA, 25 bp, Mus musculus
gtatactctgtatgctgggatccca

SEQ ID NO: 674313 - DNA, 25 bp, Mus musculus
gtatactctgtatttggctttgtga

SEQ ID NO: 674314 - DNA, 25 bp, Mus musculus
gtatactcttgtatttcatcaacca

SEQ ID NO: 674315 - DNA, 25 bp, Mus musculus
gtatactcttgtttttcatcaacca

SEQ ID NO: 674316 - DNA, 25 bp, Mus musculus
gtatactctttcatatgatcatgca

SEQ ID NO: 674317 - DNA, 25 bp, Mus musculus
gtatactctttcttatgatcatgca

SEQ ID NO: 674318 - DNA, 25 bp, Mus musculus
gtatactctttgctacccatgatgg

SEQ ID NO: 674319 - DNA, 25 bp, Mus musculus
gtatactctttggtacccatgatgg

SEQ ID NO: 674320 - DNA, 25 bp, Mus musculus
gtatactgaaaccagcacattagtt

SEQ ID NO: 674321 - DNA, 25 bp, Mus musculus
gtatactgaaacgagcacattagtt

SEQ ID NO: 674322 - DNA, 25 bp, Mus musculus
gtatactgcaagacaggtcacacac

SEQ ID NO: 674323 - DNA, 25 bp, Mus musculus
gtatactgcaagtcaggtcacacac

SEQ ID NO: 674324 - DNA, 25 bp, Mus musculus
gtatactgcgacaaaaggacattta

SEQ ID NO: 674325 - DNA, 25 bp, Mus musculus
gtatactgcgactaaaggacattta

SEQ ID NO: 674326 - DNA, 25 bp, Mus musculus
gtatactggagcagagctgttcact

SEQ ID NO: 674327 - DNA, 25 bp, Mus musculus
gtatactggagctgagctgttcact

SEQ ID NO: 674328 - DNA, 25 bp, Mus musculus
gtatactggttcattggttgccact

SEQ ID NO: 674329 - DNA, 25 bp, Mus musculus
gtatactggttctttggttgccact

SEQ ID NO: 674330 - DNA, 25 bp, Mus musculus
gtatactgtaagaatagcctttgag

SEQ ID NO: 674331 - DNA, 25 bp, Mus musculus
gtatactgtaagtatagcctttgag

SEQ ID NO: 674332 - DNA, 25 bp, Mus musculus
gtatactgtactatgggcagggcaa

SEQ ID NO: 674333 - DNA, 25 bp, Mus musculus
gtatactgtactttgggcagggcaa

SEQ ID NO: 674334 - DNA, 25 bp, Mus musculus
gtatactgtatcagcagctttgtgt

SEQ ID NO: 674335 - DNA, 25 bp, Mus musculus
gtatactgtatccaataacccgcct

SEQ ID NO: 674336 - DNA, 25 bp, Mus musculus
gtatactgtatcgaataacccgcct

SEQ ID NO: 674337 - DNA, 25 bp, Mus musculus
gtatactgtatctgcagctttgtgt

SEQ ID NO: 674338 - DNA, 25 bp, Mus musculus
gtatactgtgctaccctgggacttt

SEQ ID NO: 674339 - DNA, 25 bp, Mus musculus
gtatactgtgcttccctgggacttt

SEQ ID NO: 674340 - DNA, 25 bp, Mus musculus
gtatactgttgaaccagctgtccgt

SEQ ID NO: 674341 - DNA, 25 bp, Mus musculus
gtatactgttgatccagctgtccgt

SEQ ID NO: 674342 - DNA, 25 bp, Mus musculus
gtatactgttgcattcttcaaacac

SEQ ID NO: 674343 - DNA, 25 bp, Mus musculus
gtatactgttgctttcttcaaacac

SEQ ID NO: 674344 - DNA, 25 bp, Mus musculus
gtatacttaataatttgctctcatg

SEQ ID NO: 674345 - DNA, 25 bp, Mus musculus
gtatacttaatattttgctctcatg

SEQ ID NO: 674346 - DNA, 25 bp, Mus musculus
gtatacttacacatccacctacggg

SEQ ID NO: 674347 - DNA, 25 bp, Mus musculus
gtatacttacacttccacctacggg

SEQ ID NO: 674348 - DNA, 25 bp, Mus musculus
gtatacttactaattctgttatcaa

SEQ ID NO: 674349 - DNA, 25 bp, Mus musculus
gtatacttactatttctgttatcaa

SEQ ID NO: 674350 - DNA, 25 bp, Mus musculus
gtatacttccaaagcttgatctctg

SEQ ID NO: 674351 - DNA, 25 bp, Mus musculus
gtatacttccaatgcttgatctctg

SEQ ID NO: 674352 - DNA, 25 bp, Mus musculus
gtatacttcccacatttccactgat

SEQ ID NO: 674353 - DNA, 25 bp, Mus musculus
gtatacttcccagatttccactgat

SEQ ID NO: 674354 - DNA, 25 bp, Mus musculus
gtatacttcgtacatttcagtggaa

SEQ ID NO: 674355 - DNA, 25 bp, Mus musculus
gtatacttcgtagatttcagtggaa

SEQ ID NO: 674356 - DNA, 25 bp, Mus musculus
gtatacttgtttatagtctctgagc

SEQ ID NO: 674357 - DNA, 25 bp, Mus musculus
gtatacttgtttttagtctctgagc

SEQ ID NO: 674358 - DNA, 25 bp, Mus musculus
gtatactttatcatcacatgtgggt

SEQ ID NO: 674359 - DNA, 25 bp, Mus musculus
gtatactttatcttcacatgtgggt

SEQ ID NO: 674360 - DNA, 25 bp, Mus musculus
gtatactttcagatatggcctctta

SEQ ID NO: 674361 - DNA, 25 bp, Mus musculus
gtatactttcagttatggcctctta

SEQ ID NO: 674362 - DNA, 25 bp, Mus musculus
gtatactttgaaacaggaagcgtct

SEQ ID NO: 674363 - DNA, 25 bp, Mus musculus
gtatactttgaatcaggaagcgtct

SEQ ID NO: 674364 - DNA, 25 bp, Mus musculus
gtatagaaattcatagcctgggagc

SEQ ID NO: 674365 - DNA, 25 bp, Mus musculus
gtatagaaattcttagcctgggagc

SEQ ID NO: 674366 - DNA, 25 bp, Mus musculus
gtatagaacccaatatgaagcccac

SEQ ID NO: 674367 - DNA, 25 bp, Mus musculus
gtatagaacccattatgaagcccac

SEQ ID NO: 674368 - DNA, 25 bp, Mus musculus
gtatagaactctaacattattttgt

SEQ ID NO: 674369 - DNA, 25 bp, Mus musculus
gtatagaactcttacattattttgt

SEQ ID NO: 674370 - DNA, 25 bp, Mus musculus
gtatagaatcggaccatatcagcct

SEQ ID NO: 674371 - DNA, 25 bp, Mus musculus
gtatagaatcggtccatatcagcct

SEQ ID NO: 674372 - DNA, 25 bp, Mus musculus
gtatagacactccagtttgggcact

SEQ ID NO: 674373 - DNA, 25 bp, Mus musculus
gtatagacactcgagtttgggcact

SEQ ID NO: 674374 - DNA, 25 bp, Mus musculus
gtatagacctgcaaatgtgcacaat

SEQ ID NO: 674375 - DNA, 25 bp, Mus musculus
gtatagacctgctaatgtgcacaat

SEQ ID NO: 674376 - DNA, 25 bp, Mus musculus
gtatagactggtcgactgccatgtg

SEQ ID NO: 674377 - DNA, 25 bp, Mus musculus
gtatagactggtggactgccatgtg

SEQ ID NO: 674378 - DNA, 25 bp, Mus musculus
gtatagactttcaccacttcacaga

SEQ ID NO: 674379 - DNA, 25 bp, Mus musculus
gtatagactttctccacttcacaga

SEQ ID NO: 674380 - DNA, 25 bp, Mus musculus
gtatagagctggactgttccacctt

SEQ ID NO: 674381 - DNA, 25 bp, Mus musculus
gtatagagctggtctgttccacctt

SEQ ID NO: 674382 - DNA, 25 bp, Mus musculus
gtatagagctttccagacttgcggc

SEQ ID NO: 674383 - DNA, 25 bp, Mus musculus
gtatagagctttgcagacttgcggc

SEQ ID NO: 674384 - DNA, 25 bp, Mus musculus
gtatagaggcaacgttttcacaaca

SEQ ID NO: 674385 - DNA, 25 bp, Mus musculus
gtatagaggcaaggttttcacaaca

SEQ ID NO: 674386 - DNA, 25 bp, Mus musculus
gtatagaggtacaccactttcccat

SEQ ID NO: 674387 - DNA, 25 bp, Mus musculus
gtatagaggtactccactttcccat

SEQ ID NO: 674388 - DNA, 25 bp, Mus musculus
gtatagagtctcaacactgattaca

SEQ ID NO: 674389 - DNA, 25 bp, Mus musculus
gtatagagtctctacactgattaca

SEQ ID NO: 674390 - DNA, 25 bp, Mus musculus
gtatagatagctcagcccaccttgt

SEQ ID NO: 674391 - DNA, 25 bp, Mus musculus
gtatagatagctgagcccaccttgt

SEQ ID NO: 674392 - DNA, 25 bp, Mus musculus
gtatagatagtcagggtttccctcc

SEQ ID NO: 674393 - DNA, 25 bp, Mus musculus
gtatagatagtctgggtttccctcc

SEQ ID NO: 674394 - DNA, 25 bp, Mus musculus
gtatagatcctgatcctatctctga

SEQ ID NO: 674395 - DNA, 25 bp, Mus musculus
gtatagatcctgttcctatctctga

SEQ ID NO: 674396 - DNA, 25 bp, Mus musculus
gtatagatcttgattttcgtgtaat

SEQ ID NO: 674397 - DNA, 25 bp, Mus musculus
gtatagatcttgtttttcgtgtaat

SEQ ID NO: 674398 - DNA, 25 bp, Mus musculus
gtatagatgcatatacaatgtacaa

SEQ ID NO: 674399 - DNA, 25 bp, Mus musculus
gtatagatgcatttacaatgtacaa

SEQ ID NO: 674400 - DNA, 25 bp, Mus musculus
gtatagattcctcggacctggtgga

SEQ ID NO: 674401 - DNA, 25 bp, Mus musculus
gtatagattcctgggacctggtgga

SEQ ID NO: 674402 - DNA, 25 bp, Mus musculus
gtatagattgggactagcttgcttc

SEQ ID NO: 674403 - DNA, 25 bp, Mus musculus
gtatagattgggtctagcttgcttc

SEQ ID NO: 674404 - DNA, 25 bp, Mus musculus
gtatagattgtcacatttgttaaga

SEQ ID NO: 674405 - DNA, 25 bp, Mus musculus
gtatagattgtctcatttgttaaga

SEQ ID NO: 674406 - DNA, 25 bp, Mus musculus
gtatagatttatagcctcacagctt

SEQ ID NO: 674407 - DNA, 25 bp, Mus musculus
gtatagatttattgcctcacagctt

SEQ ID NO: 674408 - DNA, 25 bp, Mus musculus
gtatagcaactgctggttagtgata

SEQ ID NO: 674409 - DNA, 25 bp, Mus musculus
gtatagcaactggtggttagtgata

SEQ ID NO: 674410 - DNA, 25 bp, Mus musculus
gtatagcaccttcttacagagtttt

SEQ ID NO: 674411 - DNA, 25 bp, Mus musculus
gtatagcaccttgttacagagtttt

SEQ ID NO: 674412 - DNA, 25 bp, Mus musculus
gtatagcagataatgtgtttcctag

SEQ ID NO: 674413 - DNA, 25 bp, Mus musculus
gtatagcagatattgtgtttcctag

SEQ ID NO: 674414 - DNA, 25 bp, Mus musculus
gtatagcagcacatttcatttatgg

SEQ ID NO: 674415 - DNA, 25 bp, Mus musculus
gtatagcagcacttttcatttatgg

SEQ ID NO: 674416 - DNA, 25 bp, Mus musculus
gtatagcataatagtcactcagagg

SEQ ID NO: 674417 - DNA, 25 bp, Mus musculus
gtatagcataattgtcactcagagg

SEQ ID NO: 674418 - DNA, 25 bp, Mus musculus
gtatagcatcatctagcgtctcagg

SEQ ID NO: 674419 - DNA, 25 bp, Mus musculus
gtatagcatcatgtagcgtctcagg

SEQ ID NO: 674420 - DNA, 25 bp, Mus musculus
gtatagcatttgagagatatattct

SEQ ID NO: 674421 - DNA, 25 bp, Mus musculus
gtatagcatttgtgagatatattct

SEQ ID NO: 674422 - DNA, 25 bp, Mus musculus
gtatagccaacaatcaacaagcttc

SEQ ID NO: 674423 - DNA, 25 bp, Mus musculus
gtatagccaacattcaacaagcttc

SEQ ID NO: 674424 - DNA, 25 bp, Mus musculus
gtatagccacataggtcagccttgg

SEQ ID NO: 674425 - DNA, 25 bp, Mus musculus
gtatagccacattggtcagccttgg

SEQ ID NO: 674426 - DNA, 25 bp, Mus musculus
gtatagccacttatgaactctggca

SEQ ID NO: 674427 - DNA, 25 bp, Mus musculus
gtatagccacttttgaactctggca

SEQ ID NO: 674428 - DNA, 25 bp, Mus musculus
gtatagccagaaagtccggtcaaaa

SEQ ID NO: 674429 - DNA, 25 bp, Mus musculus
gtatagccagaatgtccggtcaaaa

SEQ ID NO: 674430 - DNA, 25 bp, Mus musculus
gtatagccagggatggcttcctgaa

SEQ ID NO: 674431 - DNA, 25 bp, Mus musculus
gtatagccagggttggcttcctgaa

SEQ ID NO: 674432 - DNA, 25 bp, Mus musculus
gtatagccatacatccacacaatgt

SEQ ID NO: 674433 - DNA, 25 bp, Mus musculus
gtatagccatacttccacacaatgt

SEQ ID NO: 674434 - DNA, 25 bp, Mus musculus
gtatagccatataagttcacccaag

SEQ ID NO: 674435 - DNA, 25 bp, Mus musculus
gtatagccatattagttcacccaag

SEQ ID NO: 674436 - DNA, 25 bp, Mus musculus
gtatagccctctcaaaacgctgact

SEQ ID NO: 674437 - DNA, 25 bp, Mus musculus
gtatagccctctgaaaacgctgact

SEQ ID NO: 674438 - DNA, 25 bp, Mus musculus
gtatagccgtgtatcatcttgtaaa

SEQ ID NO: 674439 - DNA, 25 bp, Mus musculus
gtatagccgtgtttcatcttgtaaa

SEQ ID NO: 674440 - DNA, 25 bp, Mus musculus
gtatagcctattaacacatcacaat

SEQ ID NO: 674441 - DNA, 25 bp, Mus musculus
gtatagcctatttacacatcacaat

SEQ ID NO: 674442 - DNA, 25 bp, Mus musculus
gtatagcctcagcactttagaaggg

SEQ ID NO: 674443 - DNA, 25 bp, Mus musculus
gtatagcctcaggactttagaaggg

SEQ ID NO: 674444 - DNA, 25 bp, Mus musculus
gtatagcgctagataacactgtaat

SEQ ID NO: 674445 - DNA, 25 bp, Mus musculus
gtatagcgctagttaacactgtaat

SEQ ID NO: 674446 - DNA, 25 bp, Mus musculus
gtatagctatttcccacactgtaga

SEQ ID NO: 674447 - DNA, 25 bp, Mus musculus
gtatagctatttgccacactgtaga

SEQ ID NO: 674448 - DNA, 25 bp, Mus musculus
gtatagctcaagcacttcccaagat

SEQ ID NO: 674449 - DNA, 25 bp, Mus musculus
gtatagctcaaggacttcccaagat

SEQ ID NO: 674450 - DNA, 25 bp, Mus musculus
gtatagctccagattagtgttctta

SEQ ID NO: 674451 - DNA, 25 bp, Mus musculus
gtatagctccagtttagtgttctta

SEQ ID NO: 674452 - DNA, 25 bp, Mus musculus
gtatagctctccacactagagtttt

SEQ ID NO: 674453 - DNA, 25 bp, Mus musculus
gtatagctctcctcactagagtttt

SEQ ID NO: 674454 - DNA, 25 bp, Mus musculus
gtatagctgccccaaacttaatcct

SEQ ID NO: 674455 - DNA, 25 bp, Mus musculus
gtatagctgcccgaaacttaatcct

SEQ ID NO: 674456 - DNA, 25 bp, Mus musculus
gtatagctgcgacatgtttccccaa

SEQ ID NO: 674457 - DNA, 25 bp, Mus musculus
gtatagctgcgagatgtttccccaa

SEQ ID NO: 674458 - DNA, 25 bp, Mus musculus
gtatagctggctacttgaccttgac

SEQ ID NO: 674459 - DNA, 25 bp, Mus musculus
gtatagctggcttcttgaccttgac

SEQ ID NO: 674460 - DNA, 25 bp, Mus musculus
gtatagctgtgccacgagagcccag

SEQ ID NO: 674461 - DNA, 25 bp, Mus musculus
gtatagctgtgcgacgagagcccag

SEQ ID NO: 674462 - DNA, 25 bp, Mus musculus
gtatagcttagaatctctacaccta

SEQ ID NO: 674463 - DNA, 25 bp, Mus musculus
gtatagcttagattctctacaccta

SEQ ID NO: 674464 - DNA, 25 bp, Mus musculus
gtatagcttgtactctatcatccag

SEQ ID NO: 674465 - DNA, 25 bp, Mus musculus
gtatagcttgtagtctatcatccag

SEQ ID NO: 674466 - DNA, 25 bp, Mus musculus
gtatagcttgttaatcatcgcctct

SEQ ID NO: 674467 - DNA, 25 bp, Mus musculus
gtatagcttgtttatcatcgcctct

SEQ ID NO: 674468 - DNA, 25 bp, Mus musculus
gtataggaatatagttccctccccg

SEQ ID NO: 674469 - DNA, 25 bp, Mus musculus
gtataggaatattgttccctccccg

SEQ ID NO: 674470 - DNA, 25 bp, Mus musculus
gtataggacattatatcaccagaca

SEQ ID NO: 674471 - DNA, 25 bp, Mus musculus
gtataggacattttatcaccagaca

SEQ ID NO: 674472 - DNA, 25 bp, Mus musculus
gtataggattctaacccggagccag

SEQ ID NO: 674473 - DNA, 25 bp, Mus musculus
gtataggattcttacccggagccag

SEQ ID NO: 674474 - DNA, 25 bp, Mus musculus
gtataggattggagagatgctcagt

SEQ ID NO: 674475 - DNA, 25 bp, Mus musculus
gtataggattggtgagatgctcagt

SEQ ID NO: 674476 - DNA, 25 bp, Mus musculus
gtataggcatctacctcttcatttg

SEQ ID NO: 674477 - DNA, 25 bp, Mus musculus
gtataggcatcttcctcttcatttg

SEQ ID NO: 674478 - DNA, 25 bp, Mus musculus
gtataggccagcaggtggatctctg

SEQ ID NO: 674479 - DNA, 25 bp, Mus musculus
gtataggccagctggtggatctctg

SEQ ID NO: 674480 - DNA, 25 bp, Mus musculus
gtataggctatgattgggaagacaa

SEQ ID NO: 674481 - DNA, 25 bp, Mus musculus
gtataggctatgtttgggaagacaa

SEQ ID NO: 674482 - DNA, 25 bp, Mus musculus
gtataggcttgactgctgagtagac

SEQ ID NO: 674483 - DNA, 25 bp, Mus musculus
gtataggcttgagtgctgagtagac

SEQ ID NO: 674484 - DNA, 25 bp, Mus musculus
gtatagggtcaacaattcacattgt

SEQ ID NO: 674485 - DNA, 25 bp, Mus musculus
gtatagggtcaagaattcacattgt

SEQ ID NO: 674486 - DNA, 25 bp, Mus musculus
gtatagtagcatcagtcatttaaat

SEQ ID NO: 674487 - DNA, 25 bp, Mus musculus
gtatagtagcatgagtcatttaaat

SEQ ID NO: 674488 - DNA, 25 bp, Mus musculus
gtatagtagcttcggctgacacttg

SEQ ID NO: 674489 - DNA, 25 bp, Mus musculus
gtatagtagcttgggctgacacttg

SEQ ID NO: 674490 - DNA, 25 bp, Mus musculus
gtatagtaggctaggcttgctcaga

SEQ ID NO: 674491 - DNA, 25 bp, Mus musculus
gtatagtaggcttggcttgctcaga

SEQ ID NO: 674492 - DNA, 25 bp, Mus musculus
gtatagtattcgcgcacctgaggat

SEQ ID NO: 674493 - DNA, 25 bp, Mus musculus
gtatagtattcgggcacctgaggat

SEQ ID NO: 674494 - DNA, 25 bp, Mus musculus
gtatagtattttcatcggatgaaga

SEQ ID NO: 674495 - DNA, 25 bp, Mus musculus
gtatagtattttgatcggatgaaga

SEQ ID NO: 674496 - DNA, 25 bp, Mus musculus
gtatagtcaactccatcctgaagaa

SEQ ID NO: 674497 - DNA, 25 bp, Mus musculus
gtatagtcaactgcatcctgaagaa

SEQ ID NO: 674498 - DNA, 25 bp, Mus musculus
gtatagtcactcagacaagctcagt

SEQ ID NO: 674499 - DNA, 25 bp, Mus musculus
gtatagtcactctgacaagctcagt

SEQ ID NO: 674500 - DNA, 25 bp, Mus musculus
gtatagtcaggcagtctaccaccga

SEQ ID NO: 674501 - DNA, 25 bp, Mus musculus
gtatagtcaggctgtctaccaccga

SEQ ID NO: 674502 - DNA, 25 bp, Mus musculus
gtatagtccccaacactaatgtcag

SEQ ID NO: 674503 - DNA, 25 bp, Mus musculus
gtatagtccccatcactaatgtcag

SEQ ID NO: 674504 - DNA, 25 bp, Mus musculus
gtatagtcctctacctagtttgttt

SEQ ID NO: 674505 - DNA, 25 bp, Mus musculus
gtatagtcctcttcctagtttgttt

SEQ ID NO: 674506 - DNA, 25 bp, Mus musculus
gtatagtctcacagttttctcctaa

SEQ ID NO: 674507 - DNA, 25 bp, Mus musculus
gtatagtctcactgttttctcctaa

SEQ ID NO: 674508 - DNA, 25 bp, Mus musculus
gtatagtgatgaagctgcctcagct

SEQ ID NO: 674509 - DNA, 25 bp, Mus musculus
gtatagtgatgatgctgcctcagct

SEQ ID NO: 674510 - DNA, 25 bp, Mus musculus
gtatagtgcatgctctgtcctatca

SEQ ID NO: 674511 - DNA, 25 bp, Mus musculus
gtatagtgcatggtctgtcctatca

SEQ ID NO: 674512 - DNA, 25 bp, Mus musculus
gtatagtgccatccgggaccagtac

SEQ ID NO: 674513 - DNA, 25 bp, Mus musculus
gtatagtgccatgcgggaccagtac

SEQ ID NO: 674514 - DNA, 25 bp, Mus musculus
gtatagtggcagaaataacctattt

SEQ ID NO: 674515 - DNA, 25 bp, Mus musculus
gtatagtggcagtaataacctattt

SEQ ID NO: 674516 - DNA, 25 bp, Mus musculus
gtatagtgtaccacaattcacacga

SEQ ID NO: 674517 - DNA, 25 bp, Mus musculus
gtatagtgtacctcaattcacacga

SEQ ID NO: 674518 - DNA, 25 bp, Mus musculus
gtatagtgtcaaattccccaatctg

SEQ ID NO: 674519 - DNA, 25 bp, Mus musculus
gtatagtgtcaatttccccaatctg

SEQ ID NO: 674520 - DNA, 25 bp, Mus musculus
gtatagtgtctgacttgcctcagaa

SEQ ID NO: 674521 - DNA, 25 bp, Mus musculus
gtatagtgtctgtcttgcctcagaa

SEQ ID NO: 674522 - DNA, 25 bp, Mus musculus
gtatagtgtgttacactccacccaa

SEQ ID NO: 674523 - DNA, 25 bp, Mus musculus
gtatagtgtgtttcactccacccaa

SEQ ID NO: 674524 - DNA, 25 bp, Mus musculus
gtatagtgttcaaccttaaatgcat

SEQ ID NO: 674525 - DNA, 25 bp, Mus musculus
gtatagtgttcacagagttcttcac

SEQ ID NO: 674526 - DNA, 25 bp, Mus musculus
gtatagtgttcagagagttcttcac

SEQ ID NO: 674527 - DNA, 25 bp, Mus musculus
gtatagtgttcatccttaaatgcat

SEQ ID NO: 674528 - DNA, 25 bp, Mus musculus
gtatagtgttctacacttgaactaa

SEQ ID NO: 674529 - DNA, 25 bp, Mus musculus
gtatagtgttcttcacttgaactaa

SEQ ID NO: 674530 - DNA, 25 bp, Mus musculus
gtatagttaacacactaccgaatgt

SEQ ID NO: 674531 - DNA, 25 bp, Mus musculus
gtatagttaacagactaccgaatgt

SEQ ID NO: 674532 - DNA, 25 bp, Mus musculus
gtatagttactgatgttttcctcac

SEQ ID NO: 674533 - DNA, 25 bp, Mus musculus
gtatagttactgttgttttcctcac

SEQ ID NO: 674534 - DNA, 25 bp, Mus musculus
gtatagttatatattggcccacaaa

SEQ ID NO: 674535 - DNA, 25 bp, Mus musculus
gtatagttatattttggcccacaaa

SEQ ID NO: 674536 - DNA, 25 bp, Mus musculus
gtatagttccataaatcacgataat

SEQ ID NO: 674537 - DNA, 25 bp, Mus musculus
gtatagttccattaatcacgataat

SEQ ID NO: 674538 - DNA, 25 bp, Mus musculus
gtatagttcgcaatgaggttctgta

SEQ ID NO: 674539 - DNA, 25 bp, Mus musculus
gtatagttcgcattgaggttctgta

SEQ ID NO: 674540 - DNA, 25 bp, Mus musculus
gtatagttgaagctgcctgtctgca

SEQ ID NO: 674541 - DNA, 25 bp, Mus musculus
gtatagttgaaggtgcctgtctgca

SEQ ID NO: 674542 - DNA, 25 bp, Mus musculus
gtatagtttcttcaatgtcccaacc

SEQ ID NO: 674543 - DNA, 25 bp, Mus musculus
gtatagtttcttgaatgtcccaacc

SEQ ID NO: 674544 - DNA, 25 bp, Mus musculus
gtatagtttgcaagctttcaacagg

SEQ ID NO: 674545 - DNA, 25 bp, Mus musculus
gtatagtttgcatgctttcaacagg

SEQ ID NO: 674546 - DNA, 25 bp, Mus musculus
gtatagtttgtaaccaccatggcac

SEQ ID NO: 674547 - DNA, 25 bp, Mus musculus
gtatagtttgtatccaccatggcac

SEQ ID NO: 674548 - DNA, 25 bp, Mus musculus
gtatagttttacacggaaatgcctt

SEQ ID NO: 674549 - DNA, 25 bp, Mus musculus
gtatagttttacactctagtgccat

SEQ ID NO: 674550 - DNA, 25 bp, Mus musculus
gtatagttttaccatttgtcacagt

SEQ ID NO: 674551 - DNA, 25 bp, Mus musculus
gtatagttttacgatttgtcacagt

SEQ ID NO: 674552 - DNA, 25 bp, Mus musculus
gtatagttttactcggaaatgcctt

SEQ ID NO: 674553 - DNA, 25 bp, Mus musculus
gtatagttttactctctagtgccat

SEQ ID NO: 674554 - DNA, 25 bp, Mus musculus
gtatataaaagcaaatgtccgtcgt

SEQ ID NO: 674555 - DNA, 25 bp, Mus musculus
gtatataaaagctaatgtccgtcgt

SEQ ID NO: 674556 - DNA, 25 bp, Mus musculus
gtatataaacctctactgactttta

SEQ ID NO: 674557 - DNA, 25 bp, Mus musculus
gtatataaacctgtactgactttta

SEQ ID NO: 674558 - DNA, 25 bp, Mus musculus
gtatataaatgtaccataaactttt

SEQ ID NO: 674559 - DNA, 25 bp, Mus musculus
gtatataaatgttccataaactttt

SEQ ID NO: 674560 - DNA, 25 bp, Mus musculus
gtatataacctaccattctgattct

SEQ ID NO: 674561 - DNA, 25 bp, Mus musculus
gtatataacctagcattctgattct

SEQ ID NO: 674562 - DNA, 25 bp, Mus musculus
gtatataaccttcagaatggctttt

SEQ ID NO: 674563 - DNA, 25 bp, Mus musculus
gtatataaccttgagaatggctttt

SEQ ID NO: 674564 - DNA, 25 bp, Mus musculus
gtatataaggaccactttacagaat

SEQ ID NO: 674565 - DNA, 25 bp, Mus musculus
gtatataaggacgactttacagaat

SEQ ID NO: 674566 - DNA, 25 bp, Mus musculus
gtatataaggcccaaggagtatgtt

SEQ ID NO: 674567 - DNA, 25 bp, Mus musculus
gtatataaggccgaaggagtatgtt

SEQ ID NO: 674568 - DNA, 25 bp, Mus musculus
gtatataaggcgacttgcacagtgc

SEQ ID NO: 674569 - DNA, 25 bp, Mus musculus
gtatataaggcgtcttgcacagtgc

SEQ ID NO: 674570 - DNA, 25 bp, Mus musculus
gtatataatctacccttaacagtga

SEQ ID NO: 674571 - DNA, 25 bp, Mus musculus
gtatataatctagccttaacagtga

SEQ ID NO: 674572 - DNA, 25 bp, Mus musculus
gtatataatgcacaaacaccccttt

SEQ ID NO: 674573 - DNA, 25 bp, Mus musculus
gtatataatgcaccacctctcatat

SEQ ID NO: 674574 - DNA, 25 bp, Mus musculus
gtatataatgcagaaacaccccttt

SEQ ID NO: 674575 - DNA, 25 bp, Mus musculus
gtatataatgcagcacctctcatat

SEQ ID NO: 674576 - DNA, 25 bp, Mus musculus
gtatataattcactttggtcactat

SEQ ID NO: 674577 - DNA, 25 bp, Mus musculus
gtatataattcagtttggtcactat

SEQ ID NO: 674578 - DNA, 25 bp, Mus musculus
gtatatacagttcctagtaaagtat

SEQ ID NO: 674579 - DNA, 25 bp, Mus musculus
gtatatacagttgctagtaaagtat

SEQ ID NO: 674580 - DNA, 25 bp, Mus musculus
gtatatacccaccaatagacacgca

SEQ ID NO: 674581 - DNA, 25 bp, Mus musculus
gtatatacccacgaatagacacgca

SEQ ID NO: 674582 - DNA, 25 bp, Mus musculus
gtatataccgatatcctgaactgag

SEQ ID NO: 674583 - DNA, 25 bp, Mus musculus
gtatataccgatttcctgaactgag

SEQ ID NO: 674584 - DNA, 25 bp, Mus musculus
gtatatacctgactgtagttccaga

SEQ ID NO: 674585 - DNA, 25 bp, Mus musculus
gtatatacctgagtgtagttccaga

SEQ ID NO: 674586 - DNA, 25 bp, Mus musculus
gtatatacctttcactggacagccc

SEQ ID NO: 674587 - DNA, 25 bp, Mus musculus
gtatatacctttgactggacagccc

SEQ ID NO: 674588 - DNA, 25 bp, Mus musculus
gtatatacgacgagtcctactccaa

SEQ ID NO: 674589 - DNA, 25 bp, Mus musculus
gtatatacgacgtgtcctactccaa

SEQ ID NO: 674590 - DNA, 25 bp, Mus musculus
gtatatacggacatgtgttggagag

SEQ ID NO: 674591 - DNA, 25 bp, Mus musculus
gtatatacggacttgtgttggagag

SEQ ID NO: 674592 - DNA, 25 bp, Mus musculus
gtatatacggtgcttctcagagctc

SEQ ID NO: 674593 - DNA, 25 bp, Mus musculus
gtatatacggtggttctcagagctc

SEQ ID NO: 674594 - DNA, 25 bp, Mus musculus
gtatatactaataggtttctttcaa

SEQ ID NO: 674595 - DNA, 25 bp, Mus musculus
gtatatactaattggtttctttcaa

SEQ ID NO: 674596 - DNA, 25 bp, Mus musculus
gtatatactataccttgtgagttta

SEQ ID NO: 674597 - DNA, 25 bp, Mus musculus
gtatatactatagcttgtgagttta

SEQ ID NO: 674598 - DNA, 25 bp, Mus musculus
gtatatactcctcacataaacacag

SEQ ID NO: 674599 - DNA, 25 bp, Mus musculus
gtatatactcctgacataaacacag

SEQ ID NO: 674600 - DNA, 25 bp, Mus musculus
gtatatactctaccttcatgactta

SEQ ID NO: 674601 - DNA, 25 bp, Mus musculus
gtatatactctagcttcatgactta

SEQ ID NO: 674602 - DNA, 25 bp, Mus musculus
gtatatactgcaaaggtacgacatg

SEQ ID NO: 674603 - DNA, 25 bp, Mus musculus
gtatatactgcataggtacgacatg

SEQ ID NO: 674604 - DNA, 25 bp, Mus musculus
gtatatactgttcggatttgcttca

SEQ ID NO: 674605 - DNA, 25 bp, Mus musculus
gtatatactgttgggatttgcttca

SEQ ID NO: 674606 - DNA, 25 bp, Mus musculus
gtatatactttgagagcaatgtgct

SEQ ID NO: 674607 - DNA, 25 bp, Mus musculus
gtatatactttgtgagcaatgtgct

SEQ ID NO: 674608 - DNA, 25 bp, Mus musculus
gtatatagaactacattatggccaa

SEQ ID NO: 674609 - DNA, 25 bp, Mus musculus
gtatatagaacttcattatggccaa

SEQ ID NO: 674610 - DNA, 25 bp, Mus musculus
gtatatagatgcaatcactgctcaa

SEQ ID NO: 674611 - DNA, 25 bp, Mus musculus
gtatatagatgctatcactgctcaa

SEQ ID NO: 674612 - DNA, 25 bp, Mus musculus
gtatatagatgtatgcctggtcctt

SEQ ID NO: 674613 - DNA, 25 bp, Mus musculus
gtatatagatgtttgcctggtcctt

SEQ ID NO: 674614 - DNA, 25 bp, Mus musculus
gtatatagctgccaattagttcctc

SEQ ID NO: 674615 - DNA, 25 bp, Mus musculus
gtatatagctgcgaattagttcctc

SEQ ID NO: 674616 - DNA, 25 bp, Mus musculus
gtatatagttgtagtgcctggatct

SEQ ID NO: 674617 - DNA, 25 bp, Mus musculus
gtatatagttgttgtgcctggatct

SEQ ID NO: 674618 - DNA, 25 bp, Mus musculus
gtatatatacccactagattcctcc

SEQ ID NO: 674619 - DNA, 25 bp, Mus musculus
gtatatataccctctagattcctcc

SEQ ID NO: 674620 - DNA, 25 bp, Mus musculus
gtatatatataaccaccctgaacct

SEQ ID NO: 674621 - DNA, 25 bp, Mus musculus
gtatatatataagcaccctgaacct

SEQ ID NO: 674622 - DNA, 25 bp, Mus musculus
gtatatatcatacctatttccagag

SEQ ID NO: 674623 - DNA, 25 bp, Mus musculus
gtatatatcatagctatttccagag

SEQ ID NO: 674624 - DNA, 25 bp, Mus musculus
gtatatatccctcacagagaatgtc

SEQ ID NO: 674625 - DNA, 25 bp, Mus musculus
gtatatatccctgacagagaatgtc

SEQ ID NO: 674626 - DNA, 25 bp, Mus musculus
gtatatatgataaatgatgccctct

SEQ ID NO: 674627 - DNA, 25 bp, Mus musculus
gtatatatgatatatgatgccctct

SEQ ID NO: 674628 - DNA, 25 bp, Mus musculus
gtatatatgtccatactcagtgcat

SEQ ID NO: 674629 - DNA, 25 bp, Mus musculus
gtatatatgtccctgtagctctctc

SEQ ID NO: 674630 - DNA, 25 bp, Mus musculus
gtatatatgtccgtgtagctctctc

SEQ ID NO: 674631 - DNA, 25 bp, Mus musculus
gtatatatgtccttactcagtgcat

SEQ ID NO: 674632 - DNA, 25 bp, Mus musculus
gtatatatgtgtatacatgctcaca

SEQ ID NO: 674633 - DNA, 25 bp, Mus musculus
gtatatatgtgtttacatgctcaca

SEQ ID NO: 674634 - DNA, 25 bp, Mus musculus
gtatatattcccctcggtgaattca

SEQ ID NO: 674635 - DNA, 25 bp, Mus musculus
gtatatattcccgtcggtgaattca

SEQ ID NO: 674636 - DNA, 25 bp, Mus musculus
gtatatattctacggacccgttccg

SEQ ID NO: 674637 - DNA, 25 bp, Mus musculus
gtatatattctagggacccgttccg

SEQ ID NO: 674638 - DNA, 25 bp, Mus musculus
gtatatatttatcaccacagactat

SEQ ID NO: 674639 - DNA, 25 bp, Mus musculus
gtatatatttatgaccacagactat

SEQ ID NO: 674640 - DNA, 25 bp, Mus musculus
gtatatatttccaaacgctagtcca

SEQ ID NO: 674641 - DNA, 25 bp, Mus musculus
gtatatatttcctaacgctagtcca

SEQ ID NO: 674642 - DNA, 25 bp, Mus musculus
gtatatcaaatccactagccgggtg

SEQ ID NO: 674643 - DNA, 25 bp, Mus musculus
gtatatcaaatcgactagccgggtg

SEQ ID NO: 674644 - DNA, 25 bp, Mus musculus
gtatatcaacataatgagtccatca

SEQ ID NO: 674645 - DNA, 25 bp, Mus musculus
gtatatcaacattatgagtccatca

SEQ ID NO: 674646 - DNA, 25 bp, Mus musculus
gtatatcaacctacgactttttcag

SEQ ID NO: 674647 - DNA, 25 bp, Mus musculus
gtatatcaacctaggtacgcgtgtt

SEQ ID NO: 674648 - DNA, 25 bp, Mus musculus
gtatatcaaccttcgactttttcag

SEQ ID NO: 674649 - DNA, 25 bp, Mus musculus
gtatatcaaccttggtacgcgtgtt

SEQ ID NO: 674650 - DNA, 25 bp, Mus musculus
gtatatcaatttaccaacatcagct

SEQ ID NO: 674651 - DNA, 25 bp, Mus musculus
gtatatcaattttccaacatcagct

SEQ ID NO: 674652 - DNA, 25 bp, Mus musculus
gtatatcacatccagagatcctcca

SEQ ID NO: 674653 - DNA, 25 bp, Mus musculus
gtatatcacatcgagagatcctcca

SEQ ID NO: 674654 - DNA, 25 bp, Mus musculus
gtatatcaggtcctccttcctgtat

SEQ ID NO: 674655 - DNA, 25 bp, Mus musculus
gtatatcaggtcgtccttcctgtat

SEQ ID NO: 674656 - DNA, 25 bp, Mus musculus
gtatatcagtctcaagctgttccca

SEQ ID NO: 674657 - DNA, 25 bp, Mus musculus
gtatatcagtctgaagctgttccca

SEQ ID NO: 674658 - DNA, 25 bp, Mus musculus
gtatatcatagtcaagcagtgtcca

SEQ ID NO: 674659 - DNA, 25 bp, Mus musculus
gtatatcatagtgaagcagtgtcca

SEQ ID NO: 674660 - DNA, 25 bp, Mus musculus
gtatatccaatacttccaagcttct

SEQ ID NO: 674661 - DNA, 25 bp, Mus musculus
gtatatccaatagttccaagcttct

SEQ ID NO: 674662 - DNA, 25 bp, Mus musculus
gtatatccacctcaaatctgcacgg

SEQ ID NO: 674663 - DNA, 25 bp, Mus musculus
gtatatccacctgaaatctgcacgg

SEQ ID NO: 674664 - DNA, 25 bp, Mus musculus
gtatatccagccatgttttgagtat

SEQ ID NO: 674665 - DNA, 25 bp, Mus musculus
gtatatccagccttgttttgagtat

SEQ ID NO: 674666 - DNA, 25 bp, Mus musculus
gtatatccagcgaaacttgcctgaa

SEQ ID NO: 674667 - DNA, 25 bp, Mus musculus
gtatatccagcgtaacttgcctgaa

SEQ ID NO: 674668 - DNA, 25 bp, Mus musculus
gtatatcccatgaggtctgtgtgtg

SEQ ID NO: 674669 - DNA, 25 bp, Mus musculus
gtatatcccatgtggtctgtgtgtg

SEQ ID NO: 674670 - DNA, 25 bp, Mus musculus
gtatatcccgagacacacatggtgt

SEQ ID NO: 674671 - DNA, 25 bp, Mus musculus
gtatatcccgagtcacacatggtgt

SEQ ID NO: 674672 - DNA, 25 bp, Mus musculus
gtatatcccgtaattaactcatggt

SEQ ID NO: 674673 - DNA, 25 bp, Mus musculus
gtatatcccgtatttaactcatggt

SEQ ID NO: 674674 - DNA, 25 bp, Mus musculus
gtatatccgtttatggacccggctt

SEQ ID NO: 674675 - DNA, 25 bp, Mus musculus
gtatatccgtttttggacccggctt

SEQ ID NO: 674676 - DNA, 25 bp, Mus musculus
gtatatcctaacactgtcagaagac

SEQ ID NO: 674677 - DNA, 25 bp, Mus musculus
gtatatcctaactctgtcagaagac

SEQ ID NO: 674678 - DNA, 25 bp, Mus musculus
gtatatcctgttaatcagtgttgta

SEQ ID NO: 674679 - DNA, 25 bp, Mus musculus
gtatatcctgtttatcagtgttgta

SEQ ID NO: 674680 - DNA, 25 bp, Mus musculus
gtatatccttaacgactgggtgttt

SEQ ID NO: 674681 - DNA, 25 bp, Mus musculus
gtatatccttaaggactgggtgttt

SEQ ID NO: 674682 - DNA, 25 bp, Mus musculus
gtatatccttttctccatacagaag

SEQ ID NO: 674683 - DNA, 25 bp, Mus musculus
gtatatccttttgtccatacagaag

SEQ ID NO: 674684 - DNA, 25 bp, Mus musculus
gtatatcgaaatcaatgaccctttt

SEQ ID NO: 674685 - DNA, 25 bp, Mus musculus
gtatatcgaaatgaatgaccctttt

SEQ ID NO: 674686 - DNA, 25 bp, Mus musculus
gtatatcgggagcaacatttcagac

SEQ ID NO: 674687 - DNA, 25 bp, Mus musculus
gtatatcgggaggaacatttcagac

SEQ ID NO: 674688 - DNA, 25 bp, Mus musculus
gtatatctagccagcctgcactttg

SEQ ID NO: 674689 - DNA, 25 bp, Mus musculus
gtatatctagcctgcctgcactttg

SEQ ID NO: 674690 - DNA, 25 bp, Mus musculus
gtatatctgataagtcttttctaag

SEQ ID NO: 674691 - DNA, 25 bp, Mus musculus
gtatatctgatatgtcttttctaag

SEQ ID NO: 674692 - DNA, 25 bp, Mus musculus
gtatatctggatagtctaagacttg

SEQ ID NO: 674693 - DNA, 25 bp, Mus musculus
gtatatctggattgtctaagacttg

SEQ ID NO: 674694 - DNA, 25 bp, Mus musculus
gtatatctgggcaaggcaccccata

SEQ ID NO: 674695 - DNA, 25 bp, Mus musculus
gtatatctgggctaggcaccccata

SEQ ID NO: 674696 - DNA, 25 bp, Mus musculus
gtatatctgtaaagtttccctaata

SEQ ID NO: 674697 - DNA, 25 bp, Mus musculus
gtatatctgtaatgtttccctaata

SEQ ID NO: 674698 - DNA, 25 bp, Mus musculus
gtatatctgtttcctattagaccct

SEQ ID NO: 674699 - DNA, 25 bp, Mus musculus
gtatatctgtttgctattagaccct

SEQ ID NO: 674700 - DNA, 25 bp, Mus musculus
gtatatcttcatagtgtggaccata

SEQ ID NO: 674701 - DNA, 25 bp, Mus musculus
gtatatcttcattgtgtggaccata

SEQ ID NO: 674702 - DNA, 25 bp, Mus musculus
gtatatctttaacccagtttttgtg

SEQ ID NO: 674703 - DNA, 25 bp, Mus musculus
gtatatctttaagccagtttttgtg

SEQ ID NO: 674704 - DNA, 25 bp, Mus musculus
gtatatctttatcggctagtgtggt

SEQ ID NO: 674705 - DNA, 25 bp, Mus musculus
gtatatctttatgggctagtgtggt

SEQ ID NO: 674706 - DNA, 25 bp, Mus musculus
gtatatcttttaagatcacatttct

SEQ ID NO: 674707 - DNA, 25 bp, Mus musculus
gtatatcttttatgatcacatttct

SEQ ID NO: 674708 - DNA, 25 bp, Mus musculus
gtatatgacatactgcctacaggct

SEQ ID NO: 674709 - DNA, 25 bp, Mus musculus
gtatatgacatagtgcctacaggct

SEQ ID NO: 674710 - DNA, 25 bp, Mus musculus
gtatatgactctctcttttggactt

SEQ ID NO: 674711 - DNA, 25 bp, Mus musculus
gtatatgactctgtcttttggactt

SEQ ID NO: 674712 - DNA, 25 bp, Mus musculus
gtatatgagatcagccattagtttt

SEQ ID NO: 674713 - DNA, 25 bp, Mus musculus
gtatatgagatctgccattagtttt

SEQ ID NO: 674714 - DNA, 25 bp, Mus musculus
gtatatgagctaatcccagttcttt

SEQ ID NO: 674715 - DNA, 25 bp, Mus musculus
gtatatgagctattcccagttcttt

SEQ ID NO: 674716 - DNA, 25 bp, Mus musculus
gtatatgagcttaagttcctgtcta

SEQ ID NO: 674717 - DNA, 25 bp, Mus musculus
gtatatgagctttagttcctgtcta

SEQ ID NO: 674718 - DNA, 25 bp, Mus musculus
gtatatgagtgcatgtacacacatg

SEQ ID NO: 674719 - DNA, 25 bp, Mus musculus
gtatatgagtgcttgtacacacatg

SEQ ID NO: 674720 - DNA, 25 bp, Mus musculus
gtatatgatgtgcctttaatacgtg

SEQ ID NO: 674721 - DNA, 25 bp, Mus musculus
gtatatgatgtggctttaatacgtg

SEQ ID NO: 674722 - DNA, 25 bp, Mus musculus
gtatatgatttgaaaacctggatga

SEQ ID NO: 674723 - DNA, 25 bp, Mus musculus
gtatatgatttgtaaacctggatga

SEQ ID NO: 674724 - DNA, 25 bp, Mus musculus
gtatatgcaattaggaaaaccgaat

SEQ ID NO: 674725 - DNA, 25 bp, Mus musculus
gtatatgcaatttggaaaaccgaat

SEQ ID NO: 674726 - DNA, 25 bp, Mus musculus
gtatatgcacacacgctgttctgta

SEQ ID NO: 674727 - DNA, 25 bp, Mus musculus
gtatatgcacactcgctgttctgta

SEQ ID NO: 674728 - DNA, 25 bp, Mus musculus
gtatatgcacagagtccacagaggt

SEQ ID NO: 674729 - DNA, 25 bp, Mus musculus
gtatatgcacagtgtccacagaggt

SEQ ID NO: 674730 - DNA, 25 bp, Mus musculus
gtatatgccagaacgcctgcgaaaa

SEQ ID NO: 674731 - DNA, 25 bp, Mus musculus
gtatatgccagatcgcctgcgaaaa

SEQ ID NO: 674732 - DNA, 25 bp, Mus musculus
gtatatgccgcactatcagtcttca

SEQ ID NO: 674733 - DNA, 25 bp, Mus musculus
gtatatgccgcagtatcagtcttca

SEQ ID NO: 674734 - DNA, 25 bp, Mus musculus
gtatatgcctttcttgaaaccgtta

SEQ ID NO: 674735 - DNA, 25 bp, Mus musculus
gtatatgcctttgttgaaaccgtta

SEQ ID NO: 674736 - DNA, 25 bp, Mus musculus
gtatatgcggatcctgattgcctgc

SEQ ID NO: 674737 - DNA, 25 bp, Mus musculus
gtatatgcggatgctgattgcctgc

SEQ ID NO: 674738 - DNA, 25 bp, Mus musculus
gtatatgctgacctaaaagacacca

SEQ ID NO: 674739 - DNA, 25 bp, Mus musculus
gtatatgctgacgtaaaagacacca

SEQ ID NO: 674740 - DNA, 25 bp, Mus musculus
gtatatgctgccactaatccaaggg

SEQ ID NO: 674741 - DNA, 25 bp, Mus musculus
gtatatgctgcctctaatccaaggg

SEQ ID NO: 674742 - DNA, 25 bp, Mus musculus
gtatatgcttcaaaacaccatgttg

SEQ ID NO: 674743 - DNA, 25 bp, Mus musculus
gtatatgcttcataacaccatgttg

SEQ ID NO: 674744 - DNA, 25 bp, Mus musculus
gtatatggaagaacttgtgtcatca

SEQ ID NO: 674745 - DNA, 25 bp, Mus musculus
gtatatggaagatcttgtgtcatca

SEQ ID NO: 674746 - DNA, 25 bp, Mus musculus
gtatatggaccacacggagacccac

SEQ ID NO: 674747 - DNA, 25 bp, Mus musculus
gtatatggaccagacggagacccac

SEQ ID NO: 674748 - DNA, 25 bp, Mus musculus
gtatatggaggtaatcacacattaa

SEQ ID NO: 674749 - DNA, 25 bp, Mus musculus
gtatatggaggttatcacacattaa

SEQ ID NO: 674750 - DNA, 25 bp, Mus musculus
gtatatggattcattgcctatatgt

SEQ ID NO: 674751 - DNA, 25 bp, Mus musculus
gtatatggattctttgcctatatgt

SEQ ID NO: 674752 - DNA, 25 bp, Mus musculus
gtatatggcattctcaagtcttgat

SEQ ID NO: 674753 - DNA, 25 bp, Mus musculus
gtatatggcattgtcaagtcttgat

SEQ ID NO: 674754 - DNA, 25 bp, Mus musculus
gtatatggccccaattcgtgaataa

SEQ ID NO: 674755 - DNA, 25 bp, Mus musculus
gtatatggcccctattcgtgaataa

SEQ ID NO: 674756 - DNA, 25 bp, Mus musculus
gtatatggctatcctactatcatgg

SEQ ID NO: 674757 - DNA, 25 bp, Mus musculus
gtatatggctatgctactatcatgg

SEQ ID NO: 674758 - DNA, 25 bp, Mus musculus
gtatatgggagtagcatcccttaat

SEQ ID NO: 674759 - DNA, 25 bp, Mus musculus
gtatatgggagttgcatcccttaat

SEQ ID NO: 674760 - DNA, 25 bp, Mus musculus
gtatatgggtgtatctcagcatgct

SEQ ID NO: 674761 - DNA, 25 bp, Mus musculus
gtatatgggtgtttctcagcatgct

SEQ ID NO: 674762 - DNA, 25 bp, Mus musculus
gtatatggtaggaggctagccccag

SEQ ID NO: 674763 - DNA, 25 bp, Mus musculus
gtatatggtaggtggctagccccag

SEQ ID NO: 674764 - DNA, 25 bp, Mus musculus
gtatatggtattagtcctctgggtt

SEQ ID NO: 674765 - DNA, 25 bp, Mus musculus
gtatatggtatttgtcctctgggtt

SEQ ID NO: 674766 - DNA, 25 bp, Mus musculus
gtatatgtaaacaacttgccgtcaa

SEQ ID NO: 674767 - DNA, 25 bp, Mus musculus
gtatatgtaaactacttgccgtcaa

SEQ ID NO: 674768 - DNA, 25 bp, Mus musculus
gtatatgtaatcaacacagtgggaa

SEQ ID NO: 674769 - DNA, 25 bp, Mus musculus
gtatatgtaatctacacagtgggaa

SEQ ID NO: 674770 - DNA, 25 bp, Mus musculus
gtatatgtaccaagtatctgcaata

SEQ ID NO: 674771 - DNA, 25 bp, Mus musculus
gtatatgtaccaatttgctaccagt

SEQ ID NO: 674772 - DNA, 25 bp, Mus musculus
gtatatgtaccatgtatctgcaata

SEQ ID NO: 674773 - DNA, 25 bp, Mus musculus
gtatatgtaccattttgctaccagt

SEQ ID NO: 674774 - DNA, 25 bp, Mus musculus
gtatatgtactcactagtttctttt

SEQ ID NO: 674775 - DNA, 25 bp, Mus musculus
gtatatgtactctctagtttctttt

SEQ ID NO: 674776 - DNA, 25 bp, Mus musculus
gtatatgtatggaacaaacccagac

SEQ ID NO: 674777 - DNA, 25 bp, Mus musculus
gtatatgtatggtacaaacccagac

SEQ ID NO: 674778 - DNA, 25 bp, Mus musculus
gtatatgtattcaccaatgtgtgtg

SEQ ID NO: 674779 - DNA, 25 bp, Mus musculus
gtatatgtattctccaatgtgtgtg

SEQ ID NO: 674780 - DNA, 25 bp, Mus musculus
gtatatgtcacacagccaggctttg

SEQ ID NO: 674781 - DNA, 25 bp, Mus musculus
gtatatgtcacagagccaggctttg

SEQ ID NO: 674782 - DNA, 25 bp, Mus musculus
gtatatgtccatattgcattttatt

SEQ ID NO: 674783 - DNA, 25 bp, Mus musculus
gtatatgtccattttgcattttatt

SEQ ID NO: 674784 - DNA, 25 bp, Mus musculus
gtatatgtccttcatgctcagccca

SEQ ID NO: 674785 - DNA, 25 bp, Mus musculus
gtatatgtccttgatgctcagccca

SEQ ID NO: 674786 - DNA, 25 bp, Mus musculus
gtatatgtctatctctgggatccag

SEQ ID NO: 674787 - DNA, 25 bp, Mus musculus
gtatatgtctatgtctgggatccag

SEQ ID NO: 674788 - DNA, 25 bp, Mus musculus
gtatatgtctgtcctttgggtgcct

SEQ ID NO: 674789 - DNA, 25 bp, Mus musculus
gtatatgtctgtgctttgggtgcct

SEQ ID NO: 674790 - DNA, 25 bp, Mus musculus
gtatatgtgaataatatcccatcaa

SEQ ID NO: 674791 - DNA, 25 bp, Mus musculus
gtatatgtgaattatatcccatcaa

SEQ ID NO: 674792 - DNA, 25 bp, Mus musculus
gtatatgtgcagacgtgacaagata

SEQ ID NO: 674793 - DNA, 25 bp, Mus musculus
gtatatgtgcagtcgtgacaagata

SEQ ID NO: 674794 - DNA, 25 bp, Mus musculus
gtatatgtgcttatgttcagtatca

SEQ ID NO: 674795 - DNA, 25 bp, Mus musculus
gtatatgtgcttttgttcagtatca

SEQ ID NO: 674796 - DNA, 25 bp, Mus musculus
gtatatgtgtaccagtgctcttcaa

SEQ ID NO: 674797 - DNA, 25 bp, Mus musculus
gtatatgtgtacgagtgctcttcaa

SEQ ID NO: 674798 - DNA, 25 bp, Mus musculus
gtatatgtgtctcccatgagtcgtg

SEQ ID NO: 674799 - DNA, 25 bp, Mus musculus
gtatatgtgtctgccatgagtcgtg

SEQ ID NO: 674800 - DNA, 25 bp, Mus musculus
gtatatgtgtgcacagctaagaaga

SEQ ID NO: 674801 - DNA, 25 bp, Mus musculus
gtatatgtgtgctcagctaagaaga

SEQ ID NO: 674802 - DNA, 25 bp, Mus musculus
gtatatgttaggacaagcgcacccc

SEQ ID NO: 674803 - DNA, 25 bp, Mus musculus
gtatatgttaggtcaagcgcacccc

SEQ ID NO: 674804 - DNA, 25 bp, Mus musculus
gtatatgttatgagatggctccctt

SEQ ID NO: 674805 - DNA, 25 bp, Mus musculus
gtatatgttatgtgatggctccctt

SEQ ID NO: 674806 - DNA, 25 bp, Mus musculus
gtatatgttcagactaccctctaat

SEQ ID NO: 674807 - DNA, 25 bp, Mus musculus
gtatatgttcagtctaccctctaat

SEQ ID NO: 674808 - DNA, 25 bp, Mus musculus
gtatatgttgttagtcaggggggag

SEQ ID NO: 674809 - DNA, 25 bp, Mus musculus
gtatatgttgttctgttggctgacc

SEQ ID NO: 674810 - DNA, 25 bp, Mus musculus
gtatatgttgttgtgttggctgacc

SEQ ID NO: 674811 - DNA, 25 bp, Mus musculus
gtatatgttgtttgtcaggggggag

SEQ ID NO: 674812 - DNA, 25 bp, Mus musculus
gtatatgtttcaccaactttgtaga

SEQ ID NO: 674813 - DNA, 25 bp, Mus musculus
gtatatgtttcagcaactttgtaga

SEQ ID NO: 674814 - DNA, 25 bp, Mus musculus
gtatattaactaaggagagtcgaga

SEQ ID NO: 674815 - DNA, 25 bp, Mus musculus
gtatattaactatggagagtcgaga

SEQ ID NO: 674816 - DNA, 25 bp, Mus musculus
gtatattaactgctcaagaactggt

SEQ ID NO: 674817 - DNA, 25 bp, Mus musculus
gtatattaactggtcaagaactggt

SEQ ID NO: 674818 - DNA, 25 bp, Mus musculus
gtatattaaggccatatcaccagtt

SEQ ID NO: 674819 - DNA, 25 bp, Mus musculus
gtatattaaggcgatatcaccagtt

SEQ ID NO: 674820 - DNA, 25 bp, Mus musculus
gtatattacactccattcattaaga

SEQ ID NO: 674821 - DNA, 25 bp, Mus musculus
gtatattacactgcattcattaaga

SEQ ID NO: 674822 - DNA, 25 bp, Mus musculus
gtatattacccaatgagatgcagtg

SEQ ID NO: 674823 - DNA, 25 bp, Mus musculus
gtatattacccattgagatgcagtg

SEQ ID NO: 674824 - DNA, 25 bp, Mus musculus
gtatattacgtgaaatgtgaagtta

SEQ ID NO: 674825 - DNA, 25 bp, Mus musculus
gtatattacgtgtaatgtgaagtta

SEQ ID NO: 674826 - DNA, 25 bp, Mus musculus
gtatattactcaagaatttgcctaa

SEQ ID NO: 674827 - DNA, 25 bp, Mus musculus
gtatattactcatgaatttgcctaa

SEQ ID NO: 674828 - DNA, 25 bp, Mus musculus
gtatattactgtctcacagcccaac

SEQ ID NO: 674829 - DNA, 25 bp, Mus musculus
gtatattactgtgtcacagcccaac

SEQ ID NO: 674830 - DNA, 25 bp, Mus musculus
gtatattagctaaagaactggttgt

SEQ ID NO: 674831 - DNA, 25 bp, Mus musculus
gtatattagctatagaactggttgt

SEQ ID NO: 674832 - DNA, 25 bp, Mus musculus
gtatattagtacagtgcatggtgct

SEQ ID NO: 674833 - DNA, 25 bp, Mus musculus
gtatattagtacctgtggaaccaca

SEQ ID NO: 674834 - DNA, 25 bp, Mus musculus
gtatattagtacgtgtggaaccaca

SEQ ID NO: 674835 - DNA, 25 bp, Mus musculus
gtatattagtactgtgcatggtgct

SEQ ID NO: 674836 - DNA, 25 bp, Mus musculus
gtatattatccaaacatgcacgcat

SEQ ID NO: 674837 - DNA, 25 bp, Mus musculus
gtatattatccatacatgcacgcat

SEQ ID NO: 674838 - DNA, 25 bp, Mus musculus
gtatattatgttcctttgtgttgaa

SEQ ID NO: 674839 - DNA, 25 bp, Mus musculus
gtatattatgttgctttgtgttgaa

SEQ ID NO: 674840 - DNA, 25 bp, Mus musculus
gtatattattaccaactgctttaac

SEQ ID NO: 674841 - DNA, 25 bp, Mus musculus
gtatattattacgaactgctttaac

SEQ ID NO: 674842 - DNA, 25 bp, Mus musculus
gtatattattccaattatctcactt

SEQ ID NO: 674843 - DNA, 25 bp, Mus musculus
gtatattattcctattatctcactt

SEQ ID NO: 674844 - DNA, 25 bp, Mus musculus
gtatattattttcacttgattctta

SEQ ID NO: 674845 - DNA, 25 bp, Mus musculus
gtatattattttgacttgattctta

SEQ ID NO: 674846 - DNA, 25 bp, Mus musculus
gtatattcactgagcacaacagctt

SEQ ID NO: 674847 - DNA, 25 bp, Mus musculus
gtatattcactgtgcacaacagctt

SEQ ID NO: 674848 - DNA, 25 bp, Mus musculus
gtatattcagaacacttgcccctca

SEQ ID NO: 674849 - DNA, 25 bp, Mus musculus
gtatattcagaagacttgcccctca

SEQ ID NO: 674850 - DNA, 25 bp, Mus musculus
gtatattcagagatcacattttttc

SEQ ID NO: 674851 - DNA, 25 bp, Mus musculus
gtatattcagagttcacattttttc

SEQ ID NO: 674852 - DNA, 25 bp, Mus musculus
gtatattcatgactctgtcacttta

SEQ ID NO: 674853 - DNA, 25 bp, Mus musculus
gtatattcatgagtctgtcacttta

SEQ ID NO: 674854 - DNA, 25 bp, Mus musculus
gtatattccaagctattcatccact

SEQ ID NO: 674855 - DNA, 25 bp, Mus musculus
gtatattccaaggtattcatccact

SEQ ID NO: 674856 - DNA, 25 bp, Mus musculus
gtatattccgttagattcacctaca

SEQ ID NO: 674857 - DNA, 25 bp, Mus musculus
gtatattccgtttgattcacctaca

SEQ ID NO: 674858 - DNA, 25 bp, Mus musculus
gtatattcctacatagctgtccaat

SEQ ID NO: 674859 - DNA, 25 bp, Mus musculus
gtatattcctacttagctgtccaat

SEQ ID NO: 674860 - DNA, 25 bp, Mus musculus
gtatattccttgatgtactgcattg

SEQ ID NO: 674861 - DNA, 25 bp, Mus musculus
gtatattccttgttgtactgcattg

SEQ ID NO: 674862 - DNA, 25 bp, Mus musculus
gtatattcctttagtggcatccatg

SEQ ID NO: 674863 - DNA, 25 bp, Mus musculus
gtatattccttttgtggcatccatg

SEQ ID NO: 674864 - DNA, 25 bp, Mus musculus
gtatattctaccattcttatcaagt

SEQ ID NO: 674865 - DNA, 25 bp, Mus musculus
gtatattctacctttcttatcaagt

SEQ ID NO: 674866 - DNA, 25 bp, Mus musculus
gtatattctcacaaatcacctcttc

SEQ ID NO: 674867 - DNA, 25 bp, Mus musculus
gtatattctcactaatcacctcttc

SEQ ID NO: 674868 - DNA, 25 bp, Mus musculus
gtatattctcatcaggtggtgcaca

SEQ ID NO: 674869 - DNA, 25 bp, Mus musculus
gtatattctcatgaggtggtgcaca

SEQ ID NO: 674870 - DNA, 25 bp, Mus musculus
gtatattctgggaccatcccttcaa

SEQ ID NO: 674871 - DNA, 25 bp, Mus musculus
gtatattctgggtccatcccttcaa

SEQ ID NO: 674872 - DNA, 25 bp, Mus musculus
gtatattcttctcccaaacattttt

SEQ ID NO: 674873 - DNA, 25 bp, Mus musculus
gtatattcttctgccaaacattttt

SEQ ID NO: 674874 - DNA, 25 bp, Mus musculus
gtatattctttaatggcatcaaggt

SEQ ID NO: 674875 - DNA, 25 bp, Mus musculus
gtatattctttattggcatcaaggt

SEQ ID NO: 674876 - DNA, 25 bp, Mus musculus
gtatattgccttattgctggaaaat

SEQ ID NO: 674877 - DNA, 25 bp, Mus musculus
gtatattgcctttttgctggaaaat

SEQ ID NO: 674878 - DNA, 25 bp, Mus musculus
gtatattgcgtgactcatctgtgaa

SEQ ID NO: 674879 - DNA, 25 bp, Mus musculus
gtatattgcgtgtctcatctgtgaa

SEQ ID NO: 674880 - DNA, 25 bp, Mus musculus
gtatattgctacctgtacatatgta

SEQ ID NO: 674881 - DNA, 25 bp, Mus musculus
gtatattgctacgtgtacatatgta

SEQ ID NO: 674882 - DNA, 25 bp, Mus musculus
gtatattgcttcactccagccttga

SEQ ID NO: 674883 - DNA, 25 bp, Mus musculus
gtatattgcttctctccagccttga

SEQ ID NO: 674884 - DNA, 25 bp, Mus musculus
gtatattggctgataactttattat

SEQ ID NO: 674885 - DNA, 25 bp, Mus musculus
gtatattggctgttaactttattat

SEQ ID NO: 674886 - DNA, 25 bp, Mus musculus
gtatattgtactctgtgtgtgcgtg

SEQ ID NO: 674887 - DNA, 25 bp, Mus musculus
gtatattgtactgtgtgtgtgcgtg

SEQ ID NO: 674888 - DNA, 25 bp, Mus musculus
gtatattgttccattctgtgctgaa

SEQ ID NO: 674889 - DNA, 25 bp, Mus musculus
gtatattgttcctttctgtgctgaa

SEQ ID NO: 674890 - DNA, 25 bp, Mus musculus
gtatatttaccaactatgggctcaa

SEQ ID NO: 674891 - DNA, 25 bp, Mus musculus
gtatatttaccatctatgggctcaa

SEQ ID NO: 674892 - DNA, 25 bp, Mus musculus
gtatatttaggtccgatatctgtat

SEQ ID NO: 674893 - DNA, 25 bp, Mus musculus
gtatatttaggtgcgatatctgtat

SEQ ID NO: 674894 - DNA, 25 bp, Mus musculus
gtatatttatagagctcatctttga

SEQ ID NO: 674895 - DNA, 25 bp, Mus musculus
gtatatttatagtgctcatctttga

SEQ ID NO: 674896 - DNA, 25 bp, Mus musculus
gtatatttattaagcgccttccaga

SEQ ID NO: 674897 - DNA, 25 bp, Mus musculus
gtatatttattatgcgccttccaga

SEQ ID NO: 674898 - DNA, 25 bp, Mus musculus
gtatatttcagtcttgcttattgtg

SEQ ID NO: 674899 - DNA, 25 bp, Mus musculus
gtatatttcagtgttgcttattgtg

SEQ ID NO: 674900 - DNA, 25 bp, Mus musculus
gtatatttcataactcttgagcact

SEQ ID NO: 674901 - DNA, 25 bp, Mus musculus
gtatatttcatatctcttgagcact

SEQ ID NO: 674902 - DNA, 25 bp, Mus musculus
gtatatttctacagccattcttggg

SEQ ID NO: 674903 - DNA, 25 bp, Mus musculus
gtatatttctactgccattcttggg

SEQ ID NO: 674904 - DNA, 25 bp, Mus musculus
gtatatttctagaacggcacatgag

SEQ ID NO: 674905 - DNA, 25 bp, Mus musculus
gtatatttctagtacggcacatgag

SEQ ID NO: 674906 - DNA, 25 bp, Mus musculus
gtatatttctgtccattttctcaaa

SEQ ID NO: 674907 - DNA, 25 bp, Mus musculus
gtatatttctgtgcattttctcaaa

SEQ ID NO: 674908 - DNA, 25 bp, Mus musculus
gtatatttgataacacatcttttgt

SEQ ID NO: 674909 - DNA, 25 bp, Mus musculus
gtatatttgatatcacatcttttgt

SEQ ID NO: 674910 - DNA, 25 bp, Mus musculus
gtatatttgcctatttgatcattgg

SEQ ID NO: 674911 - DNA, 25 bp, Mus musculus
gtatatttgcctttttgatcattgg

SEQ ID NO: 674912 - DNA, 25 bp, Mus musculus
gtatatttgttactaactcagatca

SEQ ID NO: 674913 - DNA, 25 bp, Mus musculus
gtatatttgttagtaactcagatca

SEQ ID NO: 674914 - DNA, 25 bp, Mus musculus
gtatattttaccagacttttgcaag

SEQ ID NO: 674915 - DNA, 25 bp, Mus musculus
gtatattttacctgacttttgcaag

SEQ ID NO: 674916 - DNA, 25 bp, Mus musculus
gtatattttactcacttttttcatt

SEQ ID NO: 674917 - DNA, 25 bp, Mus musculus
gtatattttactgacttttttcatt

SEQ ID NO: 674918 - DNA, 25 bp, Mus musculus
gtatattttcccacattttctatcc

SEQ ID NO: 674919 - DNA, 25 bp, Mus musculus
gtatattttccctcattttctatcc

SEQ ID NO: 674920 - DNA, 25 bp, Mus musculus
gtatattttccgaattgcagagctt

SEQ ID NO: 674921 - DNA, 25 bp, Mus musculus
gtatattttccgtattgcagagctt

SEQ ID NO: 674922 - DNA, 25 bp, Mus musculus
gtatattttctgacgacctgtaacc

SEQ ID NO: 674923 - DNA, 25 bp, Mus musculus
gtatattttctgtcgacctgtaacc

SEQ ID NO: 674924 - DNA, 25 bp, Mus musculus
gtatattttgacattcagctcttca

SEQ ID NO: 674925 - DNA, 25 bp, Mus musculus
gtatattttgaccatgttgaactag

SEQ ID NO: 674926 - DNA, 25 bp, Mus musculus
gtatattttgacgatgttgaactag

SEQ ID NO: 674927 - DNA, 25 bp, Mus musculus
gtatattttgactttcagctcttca

SEQ ID NO: 674928 - DNA, 25 bp, Mus musculus
gtatattttgtgatctttagtcaga

SEQ ID NO: 674929 - DNA, 25 bp, Mus musculus
gtatattttgtgttctttagtcaga

SEQ ID NO: 674930 - DNA, 25 bp, Mus musculus
gtatcaaaatggactgttcatatca

SEQ ID NO: 674931 - DNA, 25 bp, Mus musculus
gtatcaaaatggtctgttcatatca

SEQ ID NO: 674932 - DNA, 25 bp, Mus musculus
gtatcaaaccctctgtggcagcttt

SEQ ID NO: 674933 - DNA, 25 bp, Mus musculus
gtatcaaaccctgtgtggcagcttt

SEQ ID NO: 674934 - DNA, 25 bp, Mus musculus
gtatcaaactgccattttttccggt

SEQ ID NO: 674935 - DNA, 25 bp, Mus musculus
gtatcaaactgcgattttttccggt

SEQ ID NO: 674936 - DNA, 25 bp, Mus musculus
gtatcaaagactcacctcaccttgc

SEQ ID NO: 674937 - DNA, 25 bp, Mus musculus
gtatcaaagactgacctcaccttgc

SEQ ID NO: 674938 - DNA, 25 bp, Mus musculus
gtatcaaagcctattactcttcttg

SEQ ID NO: 674939 - DNA, 25 bp, Mus musculus
gtatcaaagccttttactcttcttg

SEQ ID NO: 674940 - DNA, 25 bp, Mus musculus
gtatcaaaggtacccctgactgcca

SEQ ID NO: 674941 - DNA, 25 bp, Mus musculus
gtatcaaaggtagccctgactgcca

SEQ ID NO: 674942 - DNA, 25 bp, Mus musculus
gtatcaaagttgctgcttctttccc

SEQ ID NO: 674943 - DNA, 25 bp, Mus musculus
gtatcaaagttggtgcttctttccc

SEQ ID NO: 674944 - DNA, 25 bp, Mus musculus
gtatcaaattctattgctcgctaag

SEQ ID NO: 674945 - DNA, 25 bp, Mus musculus
gtatcaaattcttttgctcgctaag

SEQ ID NO: 674946 - DNA, 25 bp, Mus musculus
gtatcaacaactatttaaccttaga

SEQ ID NO: 674947 - DNA, 25 bp, Mus musculus
gtatcaacaactttttaaccttaga

SEQ ID NO: 674948 - DNA, 25 bp, Mus musculus
gtatcaacacaaagtgttcggttta

SEQ ID NO: 674949 - DNA, 25 bp, Mus musculus
gtatcaacacaatgtgttcggttta

SEQ ID NO: 674950 - DNA, 25 bp, Mus musculus
gtatcaacacatattcaaaagcaaa

SEQ ID NO: 674951 - DNA, 25 bp, Mus musculus
gtatcaacacattttcaaaagcaaa

SEQ ID NO: 674952 - DNA, 25 bp, Mus musculus
gtatcaacagaccagtttggcagat

SEQ ID NO: 674953 - DNA, 25 bp, Mus musculus
gtatcaacagacgagtttggcagat

SEQ ID NO: 674954 - DNA, 25 bp, Mus musculus
gtatcaacagcgcaacgagccattc

SEQ ID NO: 674955 - DNA, 25 bp, Mus musculus
gtatcaacagcggaacgagccattc

SEQ ID NO: 674956 - DNA, 25 bp, Mus musculus
gtatcaacagtcagaacagctctct

SEQ ID NO: 674957 - DNA, 25 bp, Mus musculus
gtatcaacagtctgaacagctctct

SEQ ID NO: 674958 - DNA, 25 bp, Mus musculus
gtatcaacccagattatgctgtgtt

SEQ ID NO: 674959 - DNA, 25 bp, Mus musculus
gtatcaacccagtttatgctgtgtt

SEQ ID NO: 674960 - DNA, 25 bp, Mus musculus
gtatcaaccccaacaatggaacggt

SEQ ID NO: 674961 - DNA, 25 bp, Mus musculus
gtatcaaccccatcaatggaacggt

SEQ ID NO: 674962 - DNA, 25 bp, Mus musculus
gtatcaacccctcagacagtgtcaa

SEQ ID NO: 674963 - DNA, 25 bp, Mus musculus
gtatcaacccctgagacagtgtcaa

SEQ ID NO: 674964 - DNA, 25 bp, Mus musculus
gtatcaactattcctgtatgtcaag

SEQ ID NO: 674965 - DNA, 25 bp, Mus musculus
gtatcaactattgctgtatgtcaag

SEQ ID NO: 674966 - DNA, 25 bp, Mus musculus
gtatcaactcatatcttctcataaa

SEQ ID NO: 674967 - DNA, 25 bp, Mus musculus
gtatcaactcatttcttctcataaa

SEQ ID NO: 674968 - DNA, 25 bp, Mus musculus
gtatcaactgatcctttagcatctt

SEQ ID NO: 674969 - DNA, 25 bp, Mus musculus
gtatcaactgatgctttagcatctt

SEQ ID NO: 674970 - DNA, 25 bp, Mus musculus
gtatcaactgtcaccgtgacttaga

SEQ ID NO: 674971 - DNA, 25 bp, Mus musculus
gtatcaactgtctccgtgacttaga

SEQ ID NO: 674972 - DNA, 25 bp, Mus musculus
gtatcaagaaccctcaaggctcagg

SEQ ID NO: 674973 - DNA, 25 bp, Mus musculus
gtatcaagaaccgtcaaggctcagg

SEQ ID NO: 674974 - DNA, 25 bp, Mus musculus
gtatcaagcattcaggccattttat

SEQ ID NO: 674975 - DNA, 25 bp, Mus musculus
gtatcaagcattgaggccattttat

SEQ ID NO: 674976 - DNA, 25 bp, Mus musculus
gtatcaagtaaactcacccagtggg

SEQ ID NO: 674977 - DNA, 25 bp, Mus musculus
gtatcaagtaaagtcacccagtggg

SEQ ID NO: 674978 - DNA, 25 bp, Mus musculus
gtatcaagtatcatctaactgtagg

SEQ ID NO: 674979 - DNA, 25 bp, Mus musculus
gtatcaagtatcttctaactgtagg

SEQ ID NO: 674980 - DNA, 25 bp, Mus musculus
gtatcaagtccacgtaaaacattcc

SEQ ID NO: 674981 - DNA, 25 bp, Mus musculus
gtatcaagtccaggtaaaacattcc

SEQ ID NO: 674982 - DNA, 25 bp, Mus musculus
gtatcaagttgaaaagaggtggact

SEQ ID NO: 674983 - DNA, 25 bp, Mus musculus
gtatcaagttgataagaggtggact

SEQ ID NO: 674984 - DNA, 25 bp, Mus musculus
gtatcaataccaaatagcttctgtt

SEQ ID NO: 674985 - DNA, 25 bp, Mus musculus
gtatcaataccatatagcttctgtt

SEQ ID NO: 674986 - DNA, 25 bp, Mus musculus
gtatcaataggcagatgcaggcagc

SEQ ID NO: 674987 - DNA, 25 bp, Mus musculus
gtatcaataggctgatgcaggcagc

SEQ ID NO: 674988 - DNA, 25 bp, Mus musculus
gtatcaatattgatcttttagtctt

SEQ ID NO: 674989 - DNA, 25 bp, Mus musculus
gtatcaatattgttcttttagtctt

SEQ ID NO: 674990 - DNA, 25 bp, Mus musculus
gtatcaatcattatgcctgagtctg

SEQ ID NO: 674991 - DNA, 25 bp, Mus musculus
gtatcaatcattttgcctgagtctg

SEQ ID NO: 674992 - DNA, 25 bp, Mus musculus
gtatcaatcccacaacctgtttcag

SEQ ID NO: 674993 - DNA, 25 bp, Mus musculus
gtatcaatcccagaacctgtttcag

SEQ ID NO: 674994 - DNA, 25 bp, Mus musculus
gtatcaatcttaacttcagctgcgc

SEQ ID NO: 674995 - DNA, 25 bp, Mus musculus
gtatcaatcttatcttcagctgcgc

SEQ ID NO: 674996 - DNA, 25 bp, Mus musculus
gtatcaatgcagacaagaaccttgg

SEQ ID NO: 674997 - DNA, 25 bp, Mus musculus
gtatcaatgcagtcaagaaccttgg

SEQ ID NO: 674998 - DNA, 25 bp, Mus musculus
gtatcaatgggcctagtcatttttc

SEQ ID NO: 674999 - DNA, 25 bp, Mus musculus
gtatcaatgggcgtagtcatttttc

SEQ ID NO: 675000 - DNA, 25 bp, Mus musculus
gtatcacaaaaacactgctctgcac

SEQ ID NO: 675001 - DNA, 25 bp, Mus musculus
gtatcacaaaaagactgctctgcac

SEQ ID NO: 675002 - DNA, 25 bp, Mus musculus
gtatcacaacgtactgtctaactgg

SEQ ID NO: 675003 - DNA, 25 bp, Mus musculus
gtatcacaacgttctgtctaactgg

SEQ ID NO: 675004 - DNA, 25 bp, Mus musculus
gtatcacaatctcccttttagccat

SEQ ID NO: 675005 - DNA, 25 bp, Mus musculus
gtatcacaatctgccttttagccat

SEQ ID NO: 675006 - DNA, 25 bp, Mus musculus
gtatcacacagcacaaccagtgtct

SEQ ID NO: 675007 - DNA, 25 bp, Mus musculus
gtatcacacagctcaaccagtgtct

SEQ ID NO: 675008 - DNA, 25 bp, Mus musculus
gtatcacaccgtagtatataccagt

SEQ ID NO: 675009 - DNA, 25 bp, Mus musculus
gtatcacaccgttgtatataccagt

SEQ ID NO: 675010 - DNA, 25 bp, Mus musculus
gtatcacactagattccaaggtcag

SEQ ID NO: 675011 - DNA, 25 bp, Mus musculus
gtatcacactagtttccaaggtcag

SEQ ID NO: 675012 - DNA, 25 bp, Mus musculus
gtatcacagcctacggtgattccag

SEQ ID NO: 675013 - DNA, 25 bp, Mus musculus
gtatcacagccttcggtgattccag

SEQ ID NO: 675014 - DNA, 25 bp, Mus musculus
gtatcacataagctttgtctcgtag

SEQ ID NO: 675015 - DNA, 25 bp, Mus musculus
gtatcacataaggtttgtctcgtag

SEQ ID NO: 675016 - DNA, 25 bp, Mus musculus
gtatcacatacaagtggtcagctct

SEQ ID NO: 675017 - DNA, 25 bp, Mus musculus
gtatcacatacactgcctggcactt

SEQ ID NO: 675018 - DNA, 25 bp, Mus musculus
gtatcacatacagtgcctggcactt

SEQ ID NO: 675019 - DNA, 25 bp, Mus musculus
gtatcacatacatgtggtcagctct

SEQ ID NO: 675020 - DNA, 25 bp, Mus musculus
gtatcacataggcaatccctgacca

SEQ ID NO: 675021 - DNA, 25 bp, Mus musculus
gtatcacatagggaatccctgacca

SEQ ID NO: 675022 - DNA, 25 bp, Mus musculus
gtatcacatgaaacttgggctttta

SEQ ID NO: 675023 - DNA, 25 bp, Mus musculus
gtatcacatgaatcttgggctttta

SEQ ID NO: 675024 - DNA, 25 bp, Mus musculus
gtatcacattccaccttacacagtt

SEQ ID NO: 675025 - DNA, 25 bp, Mus musculus
gtatcacattcctccttacacagtt

SEQ ID NO: 675026 - DNA, 25 bp, Mus musculus
gtatcaccaccgagctcaaacgtta

SEQ ID NO: 675027 - DNA, 25 bp, Mus musculus
gtatcaccaccgtgctcaaacgtta

SEQ ID NO: 675028 - DNA, 25 bp, Mus musculus
gtatcaccatgccagtctgtgattg

SEQ ID NO: 675029 - DNA, 25 bp, Mus musculus
gtatcaccatgcgagtctgtgattg

SEQ ID NO: 675030 - DNA, 25 bp, Mus musculus
gtatcacccacactgacttaggcct

SEQ ID NO: 675031 - DNA, 25 bp, Mus musculus
gtatcacccacagtgacttaggcct

SEQ ID NO: 675032 - DNA, 25 bp, Mus musculus
gtatcaccggctcgagttgtgtttt

SEQ ID NO: 675033 - DNA, 25 bp, Mus musculus
gtatcaccggctggagttgtgtttt

SEQ ID NO: 675034 - DNA, 25 bp, Mus musculus
gtatcacctcaccagtatgtctcag

SEQ ID NO: 675035 - DNA, 25 bp, Mus musculus
gtatcacctcacgagtatgtctcag

SEQ ID NO: 675036 - DNA, 25 bp, Mus musculus
gtatcacctcagctcgaagttcctt

SEQ ID NO: 675037 - DNA, 25 bp, Mus musculus
gtatcacctcaggtcgaagttcctt

SEQ ID NO: 675038 - DNA, 25 bp, Mus musculus
gtatcacctgacatatccagaaatt

SEQ ID NO: 675039 - DNA, 25 bp, Mus musculus
gtatcacctgacttatccagaaatt

SEQ ID NO: 675040 - DNA, 25 bp, Mus musculus
gtatcacctgataggttaatcctca

SEQ ID NO: 675041 - DNA, 25 bp, Mus musculus
gtatcacctgattggttaatcctca

SEQ ID NO: 675042 - DNA, 25 bp, Mus musculus
gtatcaccttctatagtgggttcta

SEQ ID NO: 675043 - DNA, 25 bp, Mus musculus
gtatcaccttctttagtgggttcta

SEQ ID NO: 675044 - DNA, 25 bp, Mus musculus
gtatcacgtacaattaagaggcatt

SEQ ID NO: 675045 - DNA, 25 bp, Mus musculus
gtatcacgtacatttaagaggcatt

SEQ ID NO: 675046 - DNA, 25 bp, Mus musculus
gtatcacgtgctatgttcaactcgt

SEQ ID NO: 675047 - DNA, 25 bp, Mus musculus
gtatcacgtgctttgttcaactcgt

SEQ ID NO: 675048 - DNA, 25 bp, Mus musculus
gtatcacgtgtcagtgaaggatcat

SEQ ID NO: 675049 - DNA, 25 bp, Mus musculus
gtatcacgtgtctgtgaaggatcat

SEQ ID NO: 675050 - DNA, 25 bp, Mus musculus
gtatcacgtgtgcttggtgcctaaa

SEQ ID NO: 675051 - DNA, 25 bp, Mus musculus
gtatcacgtgtggttggtgcctaaa

SEQ ID NO: 675052 - DNA, 25 bp, Mus musculus
gtatcactaaataatcccggctggc

SEQ ID NO: 675053 - DNA, 25 bp, Mus musculus
gtatcactaaattatcccggctggc

SEQ ID NO: 675054 - DNA, 25 bp, Mus musculus
gtatcactccatacttcctgaaggg

SEQ ID NO: 675055 - DNA, 25 bp, Mus musculus
gtatcactccattcttcctgaaggg

SEQ ID NO: 675056 - DNA, 25 bp, Mus musculus
gtatcactcctaacagtcgagcagg

SEQ ID NO: 675057 - DNA, 25 bp, Mus musculus
gtatcactcctatcagtcgagcagg

SEQ ID NO: 675058 - DNA, 25 bp, Mus musculus
gtatcactctgcaacacttagtctt

SEQ ID NO: 675059 - DNA, 25 bp, Mus musculus
gtatcactctgcatactagctcttt

SEQ ID NO: 675060 - DNA, 25 bp, Mus musculus
gtatcactctgctacacttagtctt

SEQ ID NO: 675061 - DNA, 25 bp, Mus musculus
gtatcactctgcttactagctcttt

SEQ ID NO: 675062 - DNA, 25 bp, Mus musculus
gtatcactgggcaaacatctgctca

SEQ ID NO: 675063 - DNA, 25 bp, Mus musculus
gtatcactgggctaacatctgctca

SEQ ID NO: 675064 - DNA, 25 bp, Mus musculus
gtatcactgtccaccttagtttttg

SEQ ID NO: 675065 - DNA, 25 bp, Mus musculus
gtatcactgtcctccttagtttttg

SEQ ID NO: 675066 - DNA, 25 bp, Mus musculus
gtatcactgtgacgaagtttctttt

SEQ ID NO: 675067 - DNA, 25 bp, Mus musculus
gtatcactgtgaggaagtttctttt

SEQ ID NO: 675068 - DNA, 25 bp, Mus musculus
gtatcactgttcctgtggctagagc

SEQ ID NO: 675069 - DNA, 25 bp, Mus musculus
gtatcactgttcgtgtggctagagc

SEQ ID NO: 675070 - DNA, 25 bp, Mus musculus
gtatcacttcagaaattgtaagcat

SEQ ID NO: 675071 - DNA, 25 bp, Mus musculus
gtatcacttcagtaattgtaagcat

SEQ ID NO: 675072 - DNA, 25 bp, Mus musculus
gtatcacttgtaccttattggccct

SEQ ID NO: 675073 - DNA, 25 bp, Mus musculus
gtatcacttgtagcttattggccct

SEQ ID NO: 675074 - DNA, 25 bp, Mus musculus
gtatcactttttctgccaagggaca

SEQ ID NO: 675075 - DNA, 25 bp, Mus musculus
gtatcactttttgtgccaagggaca

SEQ ID NO: 675076 - DNA, 25 bp, Mus musculus
gtatcagaaatgcaacggtgccaca

SEQ ID NO: 675077 - DNA, 25 bp, Mus musculus
gtatcagaaatggaacggtgccaca

SEQ ID NO: 675078 - DNA, 25 bp, Mus musculus
gtatcagaatgtatctaaagctttc

SEQ ID NO: 675079 - DNA, 25 bp, Mus musculus
gtatcagaatgtcatccaactgtat

SEQ ID NO: 675080 - DNA, 25 bp, Mus musculus
gtatcagaatgtgatccaactgtat

SEQ ID NO: 675081 - DNA, 25 bp, Mus musculus
gtatcagaatgtttctaaagctttc

SEQ ID NO: 675082 - DNA, 25 bp, Mus musculus
gtatcagacacacagcaagcgccag

SEQ ID NO: 675083 - DNA, 25 bp, Mus musculus
gtatcagacacagagcaagcgccag

SEQ ID NO: 675084 - DNA, 25 bp, Mus musculus
gtatcagacaggaactccagtagct

SEQ ID NO: 675085 - DNA, 25 bp, Mus musculus
gtatcagacaggtactccagtagct

SEQ ID NO: 675086 - DNA, 25 bp, Mus musculus
gtatcagactgtactgttccgtgag

SEQ ID NO: 675087 - DNA, 25 bp, Mus musculus
gtatcagactgttctgttccgtgag

SEQ ID NO: 675088 - DNA, 25 bp, Mus musculus
gtatcagagaacagcagttgccttt

SEQ ID NO: 675089 - DNA, 25 bp, Mus musculus
gtatcagagaactgcagttgccttt

SEQ ID NO: 675090 - DNA, 25 bp, Mus musculus
gtatcagagcatactggctgcagca

SEQ ID NO: 675091 - DNA, 25 bp, Mus musculus
gtatcagagcattctggctgcagca

SEQ ID NO: 675092 - DNA, 25 bp, Mus musculus
gtatcagagcccagcgtgtctaatt

SEQ ID NO: 675093 - DNA, 25 bp, Mus musculus
gtatcagagccctgcgtgtctaatt

SEQ ID NO: 675094 - DNA, 25 bp, Mus musculus
gtatcagatacgacacagcagccat

SEQ ID NO: 675095 - DNA, 25 bp, Mus musculus
gtatcagatacgtcacagcagccat

SEQ ID NO: 675096 - DNA, 25 bp, Mus musculus
gtatcagatatccagcagtctttct

SEQ ID NO: 675097 - DNA, 25 bp, Mus musculus
gtatcagatatcgagcagtctttct

SEQ ID NO: 675098 - DNA, 25 bp, Mus musculus
gtatcagatctgccgtggaattggt

SEQ ID NO: 675099 - DNA, 25 bp, Mus musculus
gtatcagatctggcgtggaattggt

SEQ ID NO: 675100 - DNA, 25 bp, Mus musculus
gtatcagcatgcactggttccgaga

SEQ ID NO: 675101 - DNA, 25 bp, Mus musculus
gtatcagcatgctctggttccgaga

SEQ ID NO: 675102 - DNA, 25 bp, Mus musculus
gtatcagcattaatttgggcgtggc

SEQ ID NO: 675103 - DNA, 25 bp, Mus musculus
gtatcagcattactggcagaacttt

SEQ ID NO: 675104 - DNA, 25 bp, Mus musculus
gtatcagcattagtggcagaacttt

SEQ ID NO: 675105 - DNA, 25 bp, Mus musculus
gtatcagcattattttgggcgtggc

SEQ ID NO: 675106 - DNA, 25 bp, Mus musculus
gtatcagcatttcaattgggcctca

SEQ ID NO: 675107 - DNA, 25 bp, Mus musculus
gtatcagcatttgaattgggcctca

SEQ ID NO: 675108 - DNA, 25 bp, Mus musculus
gtatcagcccacattgtacttaagt

SEQ ID NO: 675109 - DNA, 25 bp, Mus musculus
gtatcagcccactttgtacttaagt

SEQ ID NO: 675110 - DNA, 25 bp, Mus musculus
gtatcagcccttagtacttagaagt

SEQ ID NO: 675111 - DNA, 25 bp, Mus musculus
gtatcagccctttgtacttagaagt

SEQ ID NO: 675112 - DNA, 25 bp, Mus musculus
gtatcagccgagcaacatcaagcgc

SEQ ID NO: 675113 - DNA, 25 bp, Mus musculus
gtatcagccgaggaacatcaagcgc

SEQ ID NO: 675114 - DNA, 25 bp, Mus musculus
gtatcagctagcatcgggacagaaa

SEQ ID NO: 675115 - DNA, 25 bp, Mus musculus
gtatcagctagcttcgggacagaaa

SEQ ID NO: 675116 - DNA, 25 bp, Mus musculus
gtatcagctagtaacatgttctatt

SEQ ID NO: 675117 - DNA, 25 bp, Mus musculus
gtatcagctagttacatgttctatt

SEQ ID NO: 675118 - DNA, 25 bp, Mus musculus
gtatcagctcaaaaaccgggcccag

SEQ ID NO: 675119 - DNA, 25 bp, Mus musculus
gtatcagctcaataaccgggcccag

SEQ ID NO: 675120 - DNA, 25 bp, Mus musculus
gtatcagctcctaagtatatctgtt

SEQ ID NO: 675121 - DNA, 25 bp, Mus musculus
gtatcagctcctctgctaatgtttt

SEQ ID NO: 675122 - DNA, 25 bp, Mus musculus
gtatcagctcctgtgctaatgtttt

SEQ ID NO: 675123 - DNA, 25 bp, Mus musculus
gtatcagctccttagtatatctgtt

SEQ ID NO: 675124 - DNA, 25 bp, Mus musculus
gtatcagctgacagcggcaacgtat

SEQ ID NO: 675125 - DNA, 25 bp, Mus musculus
gtatcagctgactgcggcaacgtat

SEQ ID NO: 675126 - DNA, 25 bp, Mus musculus
gtatcagctgccaaaatgtcaattg

SEQ ID NO: 675127 - DNA, 25 bp, Mus musculus
gtatcagctgcctaaatgtcaattg

SEQ ID NO: 675128 - DNA, 25 bp, Mus musculus
gtatcagctgtgatgggcatgtgaa

SEQ ID NO: 675129 - DNA, 25 bp, Mus musculus
gtatcagctgtgttgggcatgtgaa

SEQ ID NO: 675130 - DNA, 25 bp, Mus musculus
gtatcagcttttcgactcattaatt

SEQ ID NO: 675131 - DNA, 25 bp, Mus musculus
gtatcagcttttggactcattaatt

SEQ ID NO: 675132 - DNA, 25 bp, Mus musculus
gtatcaggaaacacaccaatggtga

SEQ ID NO: 675133 - DNA, 25 bp, Mus musculus
gtatcaggaaactcaccaatggtga

SEQ ID NO: 675134 - DNA, 25 bp, Mus musculus
gtatcaggcaggaatttcctgtacc

SEQ ID NO: 675135 - DNA, 25 bp, Mus musculus
gtatcaggcaggtatttcctgtacc

SEQ ID NO: 675136 - DNA, 25 bp, Mus musculus
gtatcagggattaactatctgctga

SEQ ID NO: 675137 - DNA, 25 bp, Mus musculus
gtatcagggatttactatctgctga

SEQ ID NO: 675138 - DNA, 25 bp, Mus musculus
gtatcagggcttcatatacctgggt

SEQ ID NO: 675139 - DNA, 25 bp, Mus musculus
gtatcagggcttgatatacctgggt

SEQ ID NO: 675140 - DNA, 25 bp, Mus musculus
gtatcaggtacaaactgttcccatt

SEQ ID NO: 675141 - DNA, 25 bp, Mus musculus
gtatcaggtacatactgttcccatt

SEQ ID NO: 675142 - DNA, 25 bp, Mus musculus
gtatcaggtcatagcttttcattct

SEQ ID NO: 675143 - DNA, 25 bp, Mus musculus
gtatcaggtcattgcttttcattct

SEQ ID NO: 675144 - DNA, 25 bp, Mus musculus
gtatcaggttatcggttgtacatat

SEQ ID NO: 675145 - DNA, 25 bp, Mus musculus
gtatcaggttatgggttgtacatat

SEQ ID NO: 675146 - DNA, 25 bp, Mus musculus
gtatcagtaattcttccaggcatgg

SEQ ID NO: 675147 - DNA, 25 bp, Mus musculus
gtatcagtaattgttccaggcatgg

SEQ ID NO: 675148 - DNA, 25 bp, Mus musculus
gtatcagtatctagattacttccta

SEQ ID NO: 675149 - DNA, 25 bp, Mus musculus
gtatcagtatcttgattacttccta

SEQ ID NO: 675150 - DNA, 25 bp, Mus musculus
gtatcagtcaaccatggcatccacc

SEQ ID NO: 675151 - DNA, 25 bp, Mus musculus
gtatcagtcaacgatggcatccacc

SEQ ID NO: 675152 - DNA, 25 bp, Mus musculus
gtatcagtcacactatcaggagcaa

SEQ ID NO: 675153 - DNA, 25 bp, Mus musculus
gtatcagtcacagtatcaggagcaa

SEQ ID NO: 675154 - DNA, 25 bp, Mus musculus
gtatcagtcaccagctgaatcagta

SEQ ID NO: 675155 - DNA, 25 bp, Mus musculus
gtatcagtcacctgctgaatcagta

SEQ ID NO: 675156 - DNA, 25 bp, Mus musculus
gtatcagtcagacgacacaatgttc

SEQ ID NO: 675157 - DNA, 25 bp, Mus musculus
gtatcagtcagaggacacaatgttc

SEQ ID NO: 675158 - DNA, 25 bp, Mus musculus
gtatcagtcatcagcttctttctta

SEQ ID NO: 675159 - DNA, 25 bp, Mus musculus
gtatcagtcatctgcttctttctta

SEQ ID NO: 675160 - DNA, 25 bp, Mus musculus
gtatcagtccttagctgagcctaga

SEQ ID NO: 675161 - DNA, 25 bp, Mus musculus
gtatcagtcctttgctgagcctaga

SEQ ID NO: 675162 - DNA, 25 bp, Mus musculus
gtatcagtcggtacttaacttgtaa

SEQ ID NO: 675163 - DNA, 25 bp, Mus musculus
gtatcagtcggttcttaacttgtaa

SEQ ID NO: 675164 - DNA, 25 bp, Mus musculus
gtatcagtctatcatacactccgca

SEQ ID NO: 675165 - DNA, 25 bp, Mus musculus
gtatcagtctatgatacactccgca

SEQ ID NO: 675166 - DNA, 25 bp, Mus musculus
gtatcagtgacaaacaggcccaggt

SEQ ID NO: 675167 - DNA, 25 bp, Mus musculus
gtatcagtgacatacaggcccaggt

SEQ ID NO: 675168 - DNA, 25 bp, Mus musculus
gtatcagtgagcagacctaccagct

SEQ ID NO: 675169 - DNA, 25 bp, Mus musculus
gtatcagtgagctgacctaccagct

SEQ ID NO: 675170 - DNA, 25 bp, Mus musculus
gtatcagtgcctccccaggaagaag

SEQ ID NO: 675171 - DNA, 25 bp, Mus musculus
gtatcagtgcctgcccaggaagaag

SEQ ID NO: 675172 - DNA, 25 bp, Mus musculus
gtatcagttccgcaatctggcagaa

SEQ ID NO: 675173 - DNA, 25 bp, Mus musculus
gtatcagttccggaatctggcagaa

SEQ ID NO: 675174 - DNA, 25 bp, Mus musculus
gtatcagttcctatggacttgtgtc

SEQ ID NO: 675175 - DNA, 25 bp, Mus musculus
gtatcagttcctttggacttgtgtc

SEQ ID NO: 675176 - DNA, 25 bp, Mus musculus
gtatcagttgagctttgcagtcttc

SEQ ID NO: 675177 - DNA, 25 bp, Mus musculus
gtatcagttgaggtttgcagtcttc

SEQ ID NO: 675178 - DNA, 25 bp, Mus musculus
gtatcagtttccaataatttaagtg

SEQ ID NO: 675179 - DNA, 25 bp, Mus musculus
gtatcagtttcctataatttaagtg

SEQ ID NO: 675180 - DNA, 25 bp, Mus musculus
gtatcataatggacatgcggaattt

SEQ ID NO: 675181 - DNA, 25 bp, Mus musculus
gtatcataatggtcatgcggaattt

SEQ ID NO: 675182 - DNA, 25 bp, Mus musculus
gtatcatactttatcccatatcctt

SEQ ID NO: 675183 - DNA, 25 bp, Mus musculus
gtatcatactttttcccatatcctt

SEQ ID NO: 675184 - DNA, 25 bp, Mus musculus
gtatcatagatgctcaggctgcaga

SEQ ID NO: 675185 - DNA, 25 bp, Mus musculus
gtatcatagatggtcaggctgcaga

SEQ ID NO: 675186 - DNA, 25 bp, Mus musculus
gtatcatagcagaacctggcagaca

SEQ ID NO: 675187 - DNA, 25 bp, Mus musculus
gtatcatagcagtacctggcagaca

SEQ ID NO: 675188 - DNA, 25 bp, Mus musculus
gtatcatagtatatctgggttttgt

SEQ ID NO: 675189 - DNA, 25 bp, Mus musculus
gtatcatagtatttctgggttttgt

SEQ ID NO: 675190 - DNA, 25 bp, Mus musculus
gtatcatagtgcactcaacagacag

SEQ ID NO: 675191 - DNA, 25 bp, Mus musculus
gtatcatagtgctctcaacagacag

SEQ ID NO: 675192 - DNA, 25 bp, Mus musculus
gtatcatatatcacctccaagtctc

SEQ ID NO: 675193 - DNA, 25 bp, Mus musculus
gtatcatatatctcctccaagtctc

SEQ ID NO: 675194 - DNA, 25 bp, Mus musculus
gtatcatatgctcaaacctggacac

SEQ ID NO: 675195 - DNA, 25 bp, Mus musculus
gtatcatatgctgaaacctggacac

SEQ ID NO: 675196 - DNA, 25 bp, Mus musculus
gtatcatatggcaacctggtacctg

SEQ ID NO: 675197 - DNA, 25 bp, Mus musculus
gtatcatatggctacctggtacctg

SEQ ID NO: 675198 - DNA, 25 bp, Mus musculus
gtatcatattgacaccacaggccac

SEQ ID NO: 675199 - DNA, 25 bp, Mus musculus
gtatcatattgagaccacaggccac

SEQ ID NO: 675200 - DNA, 25 bp, Mus musculus
gtatcatcaccaacgagtctcaggt

SEQ ID NO: 675201 - DNA, 25 bp, Mus musculus
gtatcatcaccatcgagtctcaggt

SEQ ID NO: 675202 - DNA, 25 bp, Mus musculus
gtatcatcactcaccatgtctaaaa

SEQ ID NO: 675203 - DNA, 25 bp, Mus musculus
gtatcatcactctccatgtctaaaa

SEQ ID NO: 675204 - DNA, 25 bp, Mus musculus
gtatcatcacttatcctgcggtgac

SEQ ID NO: 675205 - DNA, 25 bp, Mus musculus
gtatcatcacttttcctgcggtgac

SEQ ID NO: 675206 - DNA, 25 bp, Mus musculus
gtatcatcagtccagttgccaaagc

SEQ ID NO: 675207 - DNA, 25 bp, Mus musculus
gtatcatcagtcgagttgccaaagc

SEQ ID NO: 675208 - DNA, 25 bp, Mus musculus
gtatcatcagttcctgctataccct

SEQ ID NO: 675209 - DNA, 25 bp, Mus musculus
gtatcatcagttgctgctataccct

SEQ ID NO: 675210 - DNA, 25 bp, Mus musculus
gtatcatcataacccagtagccgtg

SEQ ID NO: 675211 - DNA, 25 bp, Mus musculus
gtatcatcataagccagtagccgtg

SEQ ID NO: 675212 - DNA, 25 bp, Mus musculus
gtatcatcatcacatagcttatagg

SEQ ID NO: 675213 - DNA, 25 bp, Mus musculus
gtatcatcatcagatagcttatagg

SEQ ID NO: 675214 - DNA, 25 bp, Mus musculus
gtatcatcatttcgtttcaacgtct

SEQ ID NO: 675215 - DNA, 25 bp, Mus musculus
gtatcatcatttggtttcaacgtct

SEQ ID NO: 675216 - DNA, 25 bp, Mus musculus
gtatcatccactccatgaaccatgg

SEQ ID NO: 675217 - DNA, 25 bp, Mus musculus
gtatcatccactgcatgaaccatgg

SEQ ID NO: 675218 - DNA, 25 bp, Mus musculus
gtatcatccctacactgacctttct

SEQ ID NO: 675219 - DNA, 25 bp, Mus musculus
gtatcatccctagactgacctttct

SEQ ID NO: 675220 - DNA, 25 bp, Mus musculus
gtatcatcctgtatggccagagcat

SEQ ID NO: 675221 - DNA, 25 bp, Mus musculus
gtatcatcctgtttggccagagcat

SEQ ID NO: 675222 - DNA, 25 bp, Mus musculus
gtatcatctctgattgagaactcaa

SEQ ID NO: 675223 - DNA, 25 bp, Mus musculus
gtatcatctctgtttgagaactcaa

SEQ ID NO: 675224 - DNA, 25 bp, Mus musculus
gtatcatctggcatgcaaacacagt

SEQ ID NO: 675225 - DNA, 25 bp, Mus musculus
gtatcatctggcttgcaaacacagt

SEQ ID NO: 675226 - DNA, 25 bp, Mus musculus
gtatcatcttgtccttcaatactgt

SEQ ID NO: 675227 - DNA, 25 bp, Mus musculus
gtatcatcttgtgcttcaatactgt

SEQ ID NO: 675228 - DNA, 25 bp, Mus musculus
gtatcatctttcatgccttttctat

SEQ ID NO: 675229 - DNA, 25 bp, Mus musculus
gtatcatctttcttgccttttctat

SEQ ID NO: 675230 - DNA, 25 bp, Mus musculus
gtatcatcttttccaactatggtaa

SEQ ID NO: 675231 - DNA, 25 bp, Mus musculus
gtatcatcttttgcaactatggtaa

SEQ ID NO: 675232 - DNA, 25 bp, Mus musculus
gtatcatgagacaagagtgcctatg

SEQ ID NO: 675233 - DNA, 25 bp, Mus musculus
gtatcatgagactagagtgcctatg

SEQ ID NO: 675234 - DNA, 25 bp, Mus musculus
gtatcatgcctaatctcaaaatttt

SEQ ID NO: 675235 - DNA, 25 bp, Mus musculus
gtatcatgcctattctcaaaatttt

SEQ ID NO: 675236 - DNA, 25 bp, Mus musculus
gtatcatgctacataacttttgtgc

SEQ ID NO: 675237 - DNA, 25 bp, Mus musculus
gtatcatgctacttaacttttgtgc

SEQ ID NO: 675238 - DNA, 25 bp, Mus musculus
gtatcatgctgcagtattacactga

SEQ ID NO: 675239 - DNA, 25 bp, Mus musculus
gtatcatgctgctgtattacactga

SEQ ID NO: 675240 - DNA, 25 bp, Mus musculus
gtatcatggaccactctatatctcc

SEQ ID NO: 675241 - DNA, 25 bp, Mus musculus
gtatcatggacctctctatatctcc

SEQ ID NO: 675242 - DNA, 25 bp, Mus musculus
gtatcatggcagcattcattctctg

SEQ ID NO: 675243 - DNA, 25 bp, Mus musculus
gtatcatggcaggattcattctctg

SEQ ID NO: 675244 - DNA, 25 bp, Mus musculus
gtatcatgtaagaagctgctttctt

SEQ ID NO: 675245 - DNA, 25 bp, Mus musculus
gtatcatgtaagtagctgctttctt

SEQ ID NO: 675246 - DNA, 25 bp, Mus musculus
gtatcatgtatgaagcaaccgtggg

SEQ ID NO: 675247 - DNA, 25 bp, Mus musculus
gtatcatgtatgtagcaaccgtggg

SEQ ID NO: 675248 - DNA, 25 bp, Mus musculus
gtatcatgtcagaatgtaataaaga

SEQ ID NO: 675249 - DNA, 25 bp, Mus musculus
gtatcatgtcagtatgtaataaaga

SEQ ID NO: 675250 - DNA, 25 bp, Mus musculus
gtatcatgtccccattggctaagaa

SEQ ID NO: 675251 - DNA, 25 bp, Mus musculus
gtatcatgtcccgattggctaagaa

SEQ ID NO: 675252 - DNA, 25 bp, Mus musculus
gtatcatgtcttcattagcaacagg

SEQ ID NO: 675253 - DNA, 25 bp, Mus musculus
gtatcatgtcttgattagcaacagg

SEQ ID NO: 675254 - DNA, 25 bp, Mus musculus
gtatcatgtgttatccctccatatt

SEQ ID NO: 675255 - DNA, 25 bp, Mus musculus
gtatcatgtgttttccctccatatt

SEQ ID NO: 675256 - DNA, 25 bp, Mus musculus
gtatcatgttttcactgacgagttc

SEQ ID NO: 675257 - DNA, 25 bp, Mus musculus
gtatcatgttttgactgacgagttc

SEQ ID NO: 675258 - DNA, 25 bp, Mus musculus
gtatcattacccagagcgagctgga

SEQ ID NO: 675259 - DNA, 25 bp, Mus musculus
gtatcattaccctgagcgagctgga

SEQ ID NO: 675260 - DNA, 25 bp, Mus musculus
gtatcattatccacggcttcatcga

SEQ ID NO: 675261 - DNA, 25 bp, Mus musculus
gtatcattatcctcggcttcatcga

SEQ ID NO: 675262 - DNA, 25 bp, Mus musculus
gtatcattcatgatggtagccacaa

SEQ ID NO: 675263 - DNA, 25 bp, Mus musculus
gtatcattcatgttggtagccacaa

SEQ ID NO: 675264 - DNA, 25 bp, Mus musculus
gtatcattcattaccgacaccagga

SEQ ID NO: 675265 - DNA, 25 bp, Mus musculus
gtatcattcatttccgacaccagga

SEQ ID NO: 675266 - DNA, 25 bp, Mus musculus
gtatcattccctaaatcccatgttt

SEQ ID NO: 675267 - DNA, 25 bp, Mus musculus
gtatcattcccttaatcccatgttt

SEQ ID NO: 675268 - DNA, 25 bp, Mus musculus
gtatcattctacagcatccaatctc

SEQ ID NO: 675269 - DNA, 25 bp, Mus musculus
gtatcattctactgcatccaatctc

SEQ ID NO: 675270 - DNA, 25 bp, Mus musculus
gtatcattgacaaggtgtccacctg

SEQ ID NO: 675271 - DNA, 25 bp, Mus musculus
gtatcattgacatggtgtccacctg

SEQ ID NO: 675272 - DNA, 25 bp, Mus musculus
gtatcattgaccagtgtcttcagag

SEQ ID NO: 675273 - DNA, 25 bp, Mus musculus
gtatcattgacctgtgtcttcagag

SEQ ID NO: 675274 - DNA, 25 bp, Mus musculus
gtatcattgagtacaattccatgca

SEQ ID NO: 675275 - DNA, 25 bp, Mus musculus
gtatcattgagttcaattccatgca

SEQ ID NO: 675276 - DNA, 25 bp, Mus musculus
gtatcattgcacaacattgcatagt

SEQ ID NO: 675277 - DNA, 25 bp, Mus musculus
gtatcattgcactacattgcatagt

SEQ ID NO: 675278 - DNA, 25 bp, Mus musculus
gtatcattgtatattctatatggca

SEQ ID NO: 675279 - DNA, 25 bp, Mus musculus
gtatcattgtattttctatatggca

SEQ ID NO: 675280 - DNA, 25 bp, Mus musculus
gtatcatttcccctcaaagtttcaa

SEQ ID NO: 675281 - DNA, 25 bp, Mus musculus
gtatcatttcccgtcaaagtttcaa

SEQ ID NO: 675282 - DNA, 25 bp, Mus musculus
gtatcatttcgtctgttttgtggag

SEQ ID NO: 675283 - DNA, 25 bp, Mus musculus
gtatcatttcgtgtgttttgtggag

SEQ ID NO: 675284 - DNA, 25 bp, Mus musculus
gtatcatttgccaccagttgtcatt

SEQ ID NO: 675285 - DNA, 25 bp, Mus musculus
gtatcatttgcctccagttgtcatt

SEQ ID NO: 675286 - DNA, 25 bp, Mus musculus
gtatccaaagataagtctgcatttg

SEQ ID NO: 675287 - DNA, 25 bp, Mus musculus
gtatccaaagattagtctgcatttg

SEQ ID NO: 675288 - DNA, 25 bp, Mus musculus
gtatccaaccatcgcccaggtggct

SEQ ID NO: 675289 - DNA, 25 bp, Mus musculus
gtatccaaccatggcccaggtggct

SEQ ID NO: 675290 - DNA, 25 bp, Mus musculus
gtatccaacgtacatgagaccctag

SEQ ID NO: 675291 - DNA, 25 bp, Mus musculus
gtatccaacgtagatgagaccctag

SEQ ID NO: 675292 - DNA, 25 bp, Mus musculus
gtatccaaggaacttgttatctggc

SEQ ID NO: 675293 - DNA, 25 bp, Mus musculus
gtatccaaggaagttgttatctggc

SEQ ID NO: 675294 - DNA, 25 bp, Mus musculus
gtatccaatggcacttctgctatgg

SEQ ID NO: 675295 - DNA, 25 bp, Mus musculus
gtatccaatggctcttctgctatgg

SEQ ID NO: 675296 - DNA, 25 bp, Mus musculus
gtatccaattaaagttttcctgagg

SEQ ID NO: 675297 - DNA, 25 bp, Mus musculus
gtatccaattaatgttttcctgagg

SEQ ID NO: 675298 - DNA, 25 bp, Mus musculus
gtatccacagggacaagtaccggta

SEQ ID NO: 675299 - DNA, 25 bp, Mus musculus
gtatccacagggtcaagtaccggta

SEQ ID NO: 675300 - DNA, 25 bp, Mus musculus
gtatccacagtcagggagccaacac

SEQ ID NO: 675301 - DNA, 25 bp, Mus musculus
gtatccacagtctgggagccaacac

SEQ ID NO: 675302 - DNA, 25 bp, Mus musculus
gtatccacattgctcagattgcctg

SEQ ID NO: 675303 - DNA, 25 bp, Mus musculus
gtatccacattggtcagattgcctg

SEQ ID NO: 675304 - DNA, 25 bp, Mus musculus
gtatccaccaagctgttttggctca

SEQ ID NO: 675305 - DNA, 25 bp, Mus musculus
gtatccaccaaggtgttttggctca

SEQ ID NO: 675306 - DNA, 25 bp, Mus musculus
gtatccaccaccctcaagtggaaat

SEQ ID NO: 675307 - DNA, 25 bp, Mus musculus
gtatccaccaccgtcaagtggaaat

SEQ ID NO: 675308 - DNA, 25 bp, Mus musculus
gtatccacctatccttcatttttat

SEQ ID NO: 675309 - DNA, 25 bp, Mus musculus
gtatccacctatgcttcatttttat

SEQ ID NO: 675310 - DNA, 25 bp, Mus musculus
gtatccactgatagctagaagcaaa

SEQ ID NO: 675311 - DNA, 25 bp, Mus musculus
gtatccactgattgctagaagcaaa

SEQ ID NO: 675312 - DNA, 25 bp, Mus musculus
gtatccactgctctttatcattcaa

SEQ ID NO: 675313 - DNA, 25 bp, Mus musculus
gtatccactgctgtttatcattcaa

SEQ ID NO: 675314 - DNA, 25 bp, Mus musculus
gtatccacttgtaactggagtgctt

SEQ ID NO: 675315 - DNA, 25 bp, Mus musculus
gtatccacttgttactggagtgctt

SEQ ID NO: 675316 - DNA, 25 bp, Mus musculus
gtatccagaatcagttctaccctac

SEQ ID NO: 675317 - DNA, 25 bp, Mus musculus
gtatccagaatctgttctaccctac

SEQ ID NO: 675318 - DNA, 25 bp, Mus musculus
gtatccagacacacttaaagtggta

SEQ ID NO: 675319 - DNA, 25 bp, Mus musculus
gtatccagacactcttaaagtggta

SEQ ID NO: 675320 - DNA, 25 bp, Mus musculus
gtatccagagacctagcaaacttat

SEQ ID NO: 675321 - DNA, 25 bp, Mus musculus
gtatccagagacgtagcaaacttat

SEQ ID NO: 675322 - DNA, 25 bp, Mus musculus
gtatccagaggaccactgttgacca

SEQ ID NO: 675323 - DNA, 25 bp, Mus musculus
gtatccagaggagcactgttgacca

SEQ ID NO: 675324 - DNA, 25 bp, Mus musculus
gtatccaggacaaaccaagctattt

SEQ ID NO: 675325 - DNA, 25 bp, Mus musculus
gtatccaggacataccaagctattt

SEQ ID NO: 675326 - DNA, 25 bp, Mus musculus
gtatccaggactcggcttcaggaat

SEQ ID NO: 675327 - DNA, 25 bp, Mus musculus
gtatccaggactgggcttcaggaat

SEQ ID NO: 675328 - DNA, 25 bp, Mus musculus
gtatccaggagcatctatatagacc

SEQ ID NO: 675329 - DNA, 25 bp, Mus musculus
gtatccaggagcttctatatagacc

SEQ ID NO: 675330 - DNA, 25 bp, Mus musculus
gtatccagggagctacacggcgtac

SEQ ID NO: 675331 - DNA, 25 bp, Mus musculus
gtatccagggaggtacacggcgtac

SEQ ID NO: 675332 - DNA, 25 bp, Mus musculus
gtatccagtattcctgaggctgaaa

SEQ ID NO: 675333 - DNA, 25 bp, Mus musculus
gtatccagtattgctgaggctgaaa

SEQ ID NO: 675334 - DNA, 25 bp, Mus musculus
gtatccagtcacattgctgaaggtg

SEQ ID NO: 675335 - DNA, 25 bp, Mus musculus
gtatccagtcactttgctgaaggtg

SEQ ID NO: 675336 - DNA, 25 bp, Mus musculus
gtatccagtctgatacgatcagctc

SEQ ID NO: 675337 - DNA, 25 bp, Mus musculus
gtatccagtctgttacgatcagctc

SEQ ID NO: 675338 - DNA, 25 bp, Mus musculus
gtatccagtgcaacaccagaacctg

SEQ ID NO: 675339 - DNA, 25 bp, Mus musculus
gtatccagtgcatcaccagaacctg

SEQ ID NO: 675340 - DNA, 25 bp, Mus musculus
gtatccagttacacttacaggctaa

SEQ ID NO: 675341 - DNA, 25 bp, Mus musculus
gtatccagttactcttacaggctaa

SEQ ID NO: 675342 - DNA, 25 bp, Mus musculus
gtatccatacatccgcacagaagcg

SEQ ID NO: 675343 - DNA, 25 bp, Mus musculus
gtatccatacatgcgcacagaagcg

SEQ ID NO: 675344 - DNA, 25 bp, Mus musculus
gtatccatatttatctgagaagccc

SEQ ID NO: 675345 - DNA, 25 bp, Mus musculus
gtatccatatttttctgagaagccc

SEQ ID NO: 675346 - DNA, 25 bp, Mus musculus
gtatccatccaaccgcaagccagaa

SEQ ID NO: 675347 - DNA, 25 bp, Mus musculus
gtatccatccaagcgcaagccagaa

SEQ ID NO: 675348 - DNA, 25 bp, Mus musculus
gtatccatcttgatcatcaaaccct

SEQ ID NO: 675349 - DNA, 25 bp, Mus musculus
gtatccatcttgttcatcaaaccct

SEQ ID NO: 675350 - DNA, 25 bp, Mus musculus
gtatccatgcaactctttaatcatg

SEQ ID NO: 675351 - DNA, 25 bp, Mus musculus
gtatccatgcaagtctttaatcatg

SEQ ID NO: 675352 - DNA, 25 bp, Mus musculus
gtatccatgcacacagctatcactg

SEQ ID NO: 675353 - DNA, 25 bp, Mus musculus
gtatccatgcactcagctatcactg

SEQ ID NO: 675354 - DNA, 25 bp, Mus musculus
gtatccatgctgacgtgaaacacta

SEQ ID NO: 675355 - DNA, 25 bp, Mus musculus
gtatccatgctgtcgtgaaacacta

SEQ ID NO: 675356 - DNA, 25 bp, Mus musculus
gtatccatgggcctctaaaccagtg

SEQ ID NO: 675357 - DNA, 25 bp, Mus musculus
gtatccatgggcgtctaaaccagtg

SEQ ID NO: 675358 - DNA, 25 bp, Mus musculus
gtatccatgtacatctcctgttaat

SEQ ID NO: 675359 - DNA, 25 bp, Mus musculus
gtatccatgtacttctcctgttaat

SEQ ID NO: 675360 - DNA, 25 bp, Mus musculus
gtatccatgtcaccataagcagtgg

SEQ ID NO: 675361 - DNA, 25 bp, Mus musculus
gtatccatgtcagcataagcagtgg

SEQ ID NO: 675362 - DNA, 25 bp, Mus musculus
gtatccatgtgactgtctgtttaaa

SEQ ID NO: 675363 - DNA, 25 bp, Mus musculus
gtatccatgtgagtgtctgtttaaa

SEQ ID NO: 675364 - DNA, 25 bp, Mus musculus
gtatccattaagcttattcagtatt

SEQ ID NO: 675365 - DNA, 25 bp, Mus musculus
gtatccattaaggttattcagtatt

SEQ ID NO: 675366 - DNA, 25 bp, Mus musculus
gtatccattaccattcagcattcat

SEQ ID NO: 675367 - DNA, 25 bp, Mus musculus
gtatccattacctttcagcattcat

SEQ ID NO: 675368 - DNA, 25 bp, Mus musculus
gtatccattgttcacttttgcatat

SEQ ID NO: 675369 - DNA, 25 bp, Mus musculus
gtatccattgttgacttttgcatat

SEQ ID NO: 675370 - DNA, 25 bp, Mus musculus
gtatccatttatcacagacacattt

SEQ ID NO: 675371 - DNA, 25 bp, Mus musculus
gtatccatttatgacagacacattt

SEQ ID NO: 675372 - DNA, 25 bp, Mus musculus
gtatccatttccacgtttagtttag

SEQ ID NO: 675373 - DNA, 25 bp, Mus musculus
gtatccatttcctcgtttagtttag

SEQ ID NO: 675374 - DNA, 25 bp, Mus musculus
gtatccatttctcagaaaattgtat

SEQ ID NO: 675375 - DNA, 25 bp, Mus musculus
gtatccatttctgagaaaattgtat

SEQ ID NO: 675376 - DNA, 25 bp, Mus musculus
gtatccattttcagttatgatgcct

SEQ ID NO: 675377 - DNA, 25 bp, Mus musculus
gtatccattttctgttatgatgcct

SEQ ID NO: 675378 - DNA, 25 bp, Mus musculus
gtatcccaaaagagtctatttaaat

SEQ ID NO: 675379 - DNA, 25 bp, Mus musculus
gtatcccaaaagtgtctatttaaat

SEQ ID NO: 675380 - DNA, 25 bp, Mus musculus
gtatcccaaagcaaccagaaaaagt

SEQ ID NO: 675381 - DNA, 25 bp, Mus musculus
gtatcccaaagctaccagaaaaagt

SEQ ID NO: 675382 - DNA, 25 bp, Mus musculus
gtatcccaaatccagcatcaggttt

SEQ ID NO: 675383 - DNA, 25 bp, Mus musculus
gtatcccaaatcgagcatcaggttt

SEQ ID NO: 675384 - DNA, 25 bp, Mus musculus
gtatcccaacatccttattcagtgt

SEQ ID NO: 675385 - DNA, 25 bp, Mus musculus
gtatcccaacatgcttattcagtgt

SEQ ID NO: 675386 - DNA, 25 bp, Mus musculus
gtatcccaagggatactttgtccag

SEQ ID NO: 675387 - DNA, 25 bp, Mus musculus
gtatcccaagggttactttgtccag

SEQ ID NO: 675388 - DNA, 25 bp, Mus musculus
gtatcccacagtagtagtttgtaaa

SEQ ID NO: 675389 - DNA, 25 bp, Mus musculus
gtatcccacagttgtagtttgtaaa

SEQ ID NO: 675390 - DNA, 25 bp, Mus musculus
gtatcccaccacattgctgaaaata

SEQ ID NO: 675391 - DNA, 25 bp, Mus musculus
gtatcccaccactttgctgaaaata

SEQ ID NO: 675392 - DNA, 25 bp, Mus musculus
gtatcccacgccagctggcaaaaat

SEQ ID NO: 675393 - DNA, 25 bp, Mus musculus
gtatcccacgcctgctggcaaaaat

SEQ ID NO: 675394 - DNA, 25 bp, Mus musculus
gtatcccactttactatgtaaactt

SEQ ID NO: 675395 - DNA, 25 bp, Mus musculus
gtatcccacttttctatgtaaactt

SEQ ID NO: 675396 - DNA, 25 bp, Mus musculus
gtatcccagactaatcttcatggtt

SEQ ID NO: 675397 - DNA, 25 bp, Mus musculus
gtatcccagactatgcaactgatgg

SEQ ID NO: 675398 - DNA, 25 bp, Mus musculus
gtatcccagacttatcttcatggtt

SEQ ID NO: 675399 - DNA, 25 bp, Mus musculus
gtatcccagactttgcaactgatgg

SEQ ID NO: 675400 - DNA, 25 bp, Mus musculus
gtatcccagagactttatgcccttg

SEQ ID NO: 675401 - DNA, 25 bp, Mus musculus
gtatcccagagagtttatgcccttg

SEQ ID NO: 675402 - DNA, 25 bp, Mus musculus
gtatcccagatacctggtgtgatgc

SEQ ID NO: 675403 - DNA, 25 bp, Mus musculus
gtatcccagatagctggtgtgatgc

SEQ ID NO: 675404 - DNA, 25 bp, Mus musculus
gtatcccagcccaaggtggaccaag

SEQ ID NO: 675405 - DNA, 25 bp, Mus musculus
gtatcccagccctaggtggaccaag

SEQ ID NO: 675406 - DNA, 25 bp, Mus musculus
gtatcccaggaacatccattttaag

SEQ ID NO: 675407 - DNA, 25 bp, Mus musculus
gtatcccaggaagatccattttaag

SEQ ID NO: 675408 - DNA, 25 bp, Mus musculus
gtatcccaggataacaaacatttga

SEQ ID NO: 675409 - DNA, 25 bp, Mus musculus
gtatcccaggatacctgttgcttta

SEQ ID NO: 675410 - DNA, 25 bp, Mus musculus
gtatcccaggattacaaacatttga

SEQ ID NO: 675411 - DNA, 25 bp, Mus musculus
gtatcccaggattcctgttgcttta

SEQ ID NO: 675412 - DNA, 25 bp, Mus musculus
gtatcccaggctaggatcctgtgga

SEQ ID NO: 675413 - DNA, 25 bp, Mus musculus
gtatcccaggcttggatcctgtgga

SEQ ID NO: 675414 - DNA, 25 bp, Mus musculus
gtatcccagtacaaaaaggctgtaa

SEQ ID NO: 675415 - DNA, 25 bp, Mus musculus
gtatcccagtactaaaaggctgtaa

SEQ ID NO: 675416 - DNA, 25 bp, Mus musculus
gtatcccagtcaaacaacacatatg

SEQ ID NO: 675417 - DNA, 25 bp, Mus musculus
gtatcccagtcatacaacacatatg

SEQ ID NO: 675418 - DNA, 25 bp, Mus musculus
gtatcccagtctacaagtgaagttg

SEQ ID NO: 675419 - DNA, 25 bp, Mus musculus
gtatcccagtcttcaagtgaagttg

SEQ ID NO: 675420 - DNA, 25 bp, Mus musculus
gtatcccagttacagatgcaccact

SEQ ID NO: 675421 - DNA, 25 bp, Mus musculus
gtatcccagttacctctatgtgttg

SEQ ID NO: 675422 - DNA, 25 bp, Mus musculus
gtatcccagttagagatgcaccact

SEQ ID NO: 675423 - DNA, 25 bp, Mus musculus
gtatcccagttagctctatgtgttg

SEQ ID NO: 675424 - DNA, 25 bp, Mus musculus
gtatcccagttgaacactacagata

SEQ ID NO: 675425 - DNA, 25 bp, Mus musculus
gtatcccagttgtacactacagata

SEQ ID NO: 675426 - DNA, 25 bp, Mus musculus
gtatcccataccaaggtctgattct

SEQ ID NO: 675427 - DNA, 25 bp, Mus musculus
gtatcccatacctaggtctgattct

SEQ ID NO: 675428 - DNA, 25 bp, Mus musculus
gtatcccatcaaacaagtctttagt

SEQ ID NO: 675429 - DNA, 25 bp, Mus musculus
gtatcccatcaatcaagtctttagt

SEQ ID NO: 675430 - DNA, 25 bp, Mus musculus
gtatcccatcacagcattagagagg

SEQ ID NO: 675431 - DNA, 25 bp, Mus musculus
gtatcccatcactgcattagagagg

SEQ ID NO: 675432 - DNA, 25 bp, Mus musculus
gtatcccattgaattcctttcattc

SEQ ID NO: 675433 - DNA, 25 bp, Mus musculus
gtatcccattgatttcctttcattc

SEQ ID NO: 675434 - DNA, 25 bp, Mus musculus
gtatcccatttgatccttatgtaag

SEQ ID NO: 675435 - DNA, 25 bp, Mus musculus
gtatcccatttgttccttatgtaag

SEQ ID NO: 675436 - DNA, 25 bp, Mus musculus
gtatccccaaaacagtatgtccgtg

SEQ ID NO: 675437 - DNA, 25 bp, Mus musculus
gtatccccaaaagagtatgtccgtg

SEQ ID NO: 675438 - DNA, 25 bp, Mus musculus
gtatccccaacactacattttctag

SEQ ID NO: 675439 - DNA, 25 bp, Mus musculus
gtatccccaacagtacattttctag

SEQ ID NO: 675440 - DNA, 25 bp, Mus musculus
gtatccccaactccacttggcgaaa

SEQ ID NO: 675441 - DNA, 25 bp, Mus musculus
gtatccccaactgcacttggcgaaa

SEQ ID NO: 675442 - DNA, 25 bp, Mus musculus
gtatccccagtgatagccaaagtct

SEQ ID NO: 675443 - DNA, 25 bp, Mus musculus
gtatccccagtgttagccaaagtct

SEQ ID NO: 675444 - DNA, 25 bp, Mus musculus
gtatccccatgtatgttatagcttg

SEQ ID NO: 675445 - DNA, 25 bp, Mus musculus
gtatccccatgtttgttatagcttg

SEQ ID NO: 675446 - DNA, 25 bp, Mus musculus
gtatccccattcagggcttatactt

SEQ ID NO: 675447 - DNA, 25 bp, Mus musculus
gtatccccattctgggcttatactt

SEQ ID NO: 675448 - DNA, 25 bp, Mus musculus
gtatcccccatgaagttaattcaag

SEQ ID NO: 675449 - DNA, 25 bp, Mus musculus
gtatcccccatgtagttaattcaag

SEQ ID NO: 675450 - DNA, 25 bp, Mus musculus
gtatcccctcaaacctacatggtgg

SEQ ID NO: 675451 - DNA, 25 bp, Mus musculus
gtatcccctcaatcctacatggtgg

SEQ ID NO: 675452 - DNA, 25 bp, Mus musculus
gtatccccttgcagtagtatctggt

SEQ ID NO: 675453 - DNA, 25 bp, Mus musculus
gtatccccttgctgtagtatctggt

SEQ ID NO: 675454 - DNA, 25 bp, Mus musculus
gtatcccgaagcctgaactacagtc

SEQ ID NO: 675455 - DNA, 25 bp, Mus musculus
gtatcccgaagcgtgaactacagtc

SEQ ID NO: 675456 - DNA, 25 bp, Mus musculus
gtatcccgcagcattacaaggaagt

SEQ ID NO: 675457 - DNA, 25 bp, Mus musculus
gtatcccgcagctttacaaggaagt

SEQ ID NO: 675458 - DNA, 25 bp, Mus musculus
gtatcccgctatatttagtctagat

SEQ ID NO: 675459 - DNA, 25 bp, Mus musculus
gtatcccgctatttttagtctagat

SEQ ID NO: 675460 - DNA, 25 bp, Mus musculus
gtatccctactgagtgatggacgga

SEQ ID NO: 675461 - DNA, 25 bp, Mus musculus
gtatccctactgtgtgatggacgga

SEQ ID NO: 675462 - DNA, 25 bp, Mus musculus
gtatccctcagaccttgtcctacat

SEQ ID NO: 675463 - DNA, 25 bp, Mus musculus
gtatccctcagagcttgtcctacat

SEQ ID NO: 675464 - DNA, 25 bp, Mus musculus
gtatccctcaggcatcaatgagact

SEQ ID NO: 675465 - DNA, 25 bp, Mus musculus
gtatccctcagggatcaatgagact

SEQ ID NO: 675466 - DNA, 25 bp, Mus musculus
gtatccctcagtatacaataggcca

SEQ ID NO: 675467 - DNA, 25 bp, Mus musculus
gtatccctcagtttacaataggcca

SEQ ID NO: 675468 - DNA, 25 bp, Mus musculus
gtatccctcccactatgatgtattg

SEQ ID NO: 675469 - DNA, 25 bp, Mus musculus
gtatccctcccagtatgatgtattg

SEQ ID NO: 675470 - DNA, 25 bp, Mus musculus
gtatccctctcactcttaactagac

SEQ ID NO: 675471 - DNA, 25 bp, Mus musculus
gtatccctctcagtcttaactagac

SEQ ID NO: 675472 - DNA, 25 bp, Mus musculus
gtatccctgaatcgattcacactgt

SEQ ID NO: 675473 - DNA, 25 bp, Mus musculus
gtatccctgaatggattcacactgt

SEQ ID NO: 675474 - DNA, 25 bp, Mus musculus
gtatccctgagcaacttcaattgca

SEQ ID NO: 675475 - DNA, 25 bp, Mus musculus
gtatccctgagctacttcaattgca

SEQ ID NO: 675476 - DNA, 25 bp, Mus musculus
gtatccctgcaaagtcagcatttgg

SEQ ID NO: 675477 - DNA, 25 bp, Mus musculus
gtatccctgcaatgtcagcatttgg

SEQ ID NO: 675478 - DNA, 25 bp, Mus musculus
gtatccctgcagaattgagcatcct

SEQ ID NO: 675479 - DNA, 25 bp, Mus musculus
gtatccctgcagtattgagcatcct

SEQ ID NO: 675480 - DNA, 25 bp, Mus musculus
gtatccctgggaactaaccattcag

SEQ ID NO: 675481 - DNA, 25 bp, Mus musculus
gtatccctgggatctaaccattcag

SEQ ID NO: 675482 - DNA, 25 bp, Mus musculus
gtatccctgtgcaaactcccatgtt

SEQ ID NO: 675483 - DNA, 25 bp, Mus musculus
gtatccctgtgcctgggtctacata

SEQ ID NO: 675484 - DNA, 25 bp, Mus musculus
gtatccctgtgcgtgggtctacata

SEQ ID NO: 675485 - DNA, 25 bp, Mus musculus
gtatccctgtgctaactcccatgtt

SEQ ID NO: 675486 - DNA, 25 bp, Mus musculus
gtatcccttagtaatatctggtctt

SEQ ID NO: 675487 - DNA, 25 bp, Mus musculus
gtatcccttagttatatctggtctt

SEQ ID NO: 675488 - DNA, 25 bp, Mus musculus
gtatcccttgaacaggctttacaaa

SEQ ID NO: 675489 - DNA, 25 bp, Mus musculus
gtatcccttgaagaggctttacaaa

SEQ ID NO: 675490 - DNA, 25 bp, Mus musculus
gtatcccttgcaacaaggtctgctt

SEQ ID NO: 675491 - DNA, 25 bp, Mus musculus
gtatcccttgcatcaaggtctgctt

SEQ ID NO: 675492 - DNA, 25 bp, Mus musculus
gtatccgaagggattacttctcaga

SEQ ID NO: 675493 - DNA, 25 bp, Mus musculus
gtatccgaagggtttacttctcaga

SEQ ID NO: 675494 - DNA, 25 bp, Mus musculus
gtatccgaagttcctcgaggaccgt

SEQ ID NO: 675495 - DNA, 25 bp, Mus musculus
gtatccgaagttgctcgaggaccgt

SEQ ID NO: 675496 - DNA, 25 bp, Mus musculus
gtatccgatttcatcaaggacacac

SEQ ID NO: 675497 - DNA, 25 bp, Mus musculus
gtatccgatttcttcaaggacacac

SEQ ID NO: 675498 - DNA, 25 bp, Mus musculus
gtatccgccaggaagcaagtaaaac

SEQ ID NO: 675499 - DNA, 25 bp, Mus musculus
gtatccgccaggtagcaagtaaaac

SEQ ID NO: 675500 - DNA, 25 bp, Mus musculus
gtatccgggaccacatgaacaccag

SEQ ID NO: 675501 - DNA, 25 bp, Mus musculus
gtatccgggacctcatgaacaccag

SEQ ID NO: 675502 - DNA, 25 bp, Mus musculus
gtatccggtttgaccagtgattgtt

SEQ ID NO: 675503 - DNA, 25 bp, Mus musculus
gtatccggtttgtccagtgattgtt

SEQ ID NO: 675504 - DNA, 25 bp, Mus musculus
gtatccgtattgcagagtgatatat

SEQ ID NO: 675505 - DNA, 25 bp, Mus musculus
gtatccgtattggagagtgatatat

SEQ ID NO: 675506 - DNA, 25 bp, Mus musculus
gtatccgtgattacaggcgattgaa

SEQ ID NO: 675507 - DNA, 25 bp, Mus musculus
gtatccgtgatttcaggcgattgaa

SEQ ID NO: 675508 - DNA, 25 bp, Mus musculus
gtatccgtgcttcctttggtaatat

SEQ ID NO: 675509 - DNA, 25 bp, Mus musculus
gtatccgtgcttgctttggtaatat

SEQ ID NO: 675510 - DNA, 25 bp, Mus musculus
gtatccgtggaaattcactgccaac

SEQ ID NO: 675511 - DNA, 25 bp, Mus musculus
gtatccgtggaatttcactgccaac

SEQ ID NO: 675512 - DNA, 25 bp, Mus musculus
gtatcctaacttccccatattctaa

SEQ ID NO: 675513 - DNA, 25 bp, Mus musculus
gtatcctaacttgcccatattctaa

SEQ ID NO: 675514 - DNA, 25 bp, Mus musculus
gtatcctaaggcagccagccctcat

SEQ ID NO: 675515 - DNA, 25 bp, Mus musculus
gtatcctaaggctgccagccctcat

SEQ ID NO: 675516 - DNA, 25 bp, Mus musculus
gtatcctaatagatgttcttggtgc

SEQ ID NO: 675517 - DNA, 25 bp, Mus musculus
gtatcctaatagttgttcttggtgc

SEQ ID NO: 675518 - DNA, 25 bp, Mus musculus
gtatcctaattaacctcagggtcaa

SEQ ID NO: 675519 - DNA, 25 bp, Mus musculus
gtatcctaattatcctcagggtcaa

SEQ ID NO: 675520 - DNA, 25 bp, Mus musculus
gtatcctaattcctggtcacttgtc

SEQ ID NO: 675521 - DNA, 25 bp, Mus musculus
gtatcctaattcgtggtcacttgtc

SEQ ID NO: 675522 - DNA, 25 bp, Mus musculus
gtatcctaccataaactgctaacaa

SEQ ID NO: 675523 - DNA, 25 bp, Mus musculus
gtatcctaccattaactgctaacaa

SEQ ID NO: 675524 - DNA, 25 bp, Mus musculus
gtatcctactaaatgcacttatgct

SEQ ID NO: 675525 - DNA, 25 bp, Mus musculus
gtatcctactaattgcacttatgct

SEQ ID NO: 675526 - DNA, 25 bp, Mus musculus
gtatcctagcaaccagactttgaag

SEQ ID NO: 675527 - DNA, 25 bp, Mus musculus
gtatcctagcaagcagactttgaag

SEQ ID NO: 675528 - DNA, 25 bp, Mus musculus
gtatcctaggtactctctatttgca

SEQ ID NO: 675529 - DNA, 25 bp, Mus musculus
gtatcctaggtagtctctatttgca

SEQ ID NO: 675530 - DNA, 25 bp, Mus musculus
gtatcctagttcatgtacatccgaa

SEQ ID NO: 675531 - DNA, 25 bp, Mus musculus
gtatcctagttcttgtacatccgaa

SEQ ID NO: 675532 - DNA, 25 bp, Mus musculus
gtatcctatgacagagccttagcca

SEQ ID NO: 675533 - DNA, 25 bp, Mus musculus
gtatcctatgactgagccttagcca

SEQ ID NO: 675534 - DNA, 25 bp, Mus musculus
gtatcctatgctaaatttgtagtag

SEQ ID NO: 675535 - DNA, 25 bp, Mus musculus
gtatcctatgcttaatttgtagtag

SEQ ID NO: 675536 - DNA, 25 bp, Mus musculus
gtatcctatgtaagaatgtctccac

SEQ ID NO: 675537 - DNA, 25 bp, Mus musculus
gtatcctatgtatgaatgtctccac

SEQ ID NO: 675538 - DNA, 25 bp, Mus musculus
gtatcctcaagtcatcaaatgtttt

SEQ ID NO: 675539 - DNA, 25 bp, Mus musculus
gtatcctcaagtgatcaaatgtttt

SEQ ID NO: 675540 - DNA, 25 bp, Mus musculus
gtatcctcaatacagcttggcttgt

SEQ ID NO: 675541 - DNA, 25 bp, Mus musculus
gtatcctcaatagagcttggcttgt

SEQ ID NO: 675542 - DNA, 25 bp, Mus musculus
gtatcctcacaaactggtcttctaa

SEQ ID NO: 675543 - DNA, 25 bp, Mus musculus
gtatcctcacaatctggtcttctaa

SEQ ID NO: 675544 - DNA, 25 bp, Mus musculus
gtatcctcaccaatccttgcttgta

SEQ ID NO: 675545 - DNA, 25 bp, Mus musculus
gtatcctcaccattccttgcttgta

SEQ ID NO: 675546 - DNA, 25 bp, Mus musculus
gtatcctcatcaaccttttttcata

SEQ ID NO: 675547 - DNA, 25 bp, Mus musculus
gtatcctcatcatccttttttcata

SEQ ID NO: 675548 - DNA, 25 bp, Mus musculus
gtatcctcatctataaaggcagcct

SEQ ID NO: 675549 - DNA, 25 bp, Mus musculus
gtatcctcatctttaaaggcagcct

SEQ ID NO: 675550 - DNA, 25 bp, Mus musculus
gtatcctcatggatctttgaccttc

SEQ ID NO: 675551 - DNA, 25 bp, Mus musculus
gtatcctcatggttctttgaccttc

SEQ ID NO: 675552 - DNA, 25 bp, Mus musculus
gtatcctcattgcagaaccgtgaag

SEQ ID NO: 675553 - DNA, 25 bp, Mus musculus
gtatcctcattggagaaccgtgaag

SEQ ID NO: 675554 - DNA, 25 bp, Mus musculus
gtatcctccagcacagtggcaagtg

SEQ ID NO: 675555 - DNA, 25 bp, Mus musculus
gtatcctccagctcagtggcaagtg

SEQ ID NO: 675556 - DNA, 25 bp, Mus musculus
gtatcctccagtcaatcgaaaatat

SEQ ID NO: 675557 - DNA, 25 bp, Mus musculus
gtatcctccagtgaatcgaaaatat

SEQ ID NO: 675558 - DNA, 25 bp, Mus musculus
gtatcctccatgatagtacgtcctc

SEQ ID NO: 675559 - DNA, 25 bp, Mus musculus
gtatcctccatgttagtacgtcctc

SEQ ID NO: 675560 - DNA, 25 bp, Mus musculus
gtatcctcctcaaaacctggtgaag

SEQ ID NO: 675561 - DNA, 25 bp, Mus musculus
gtatcctcctcataacctggtgaag

SEQ ID NO: 675562 - DNA, 25 bp, Mus musculus
gtatcctctaagaatcattttgtga

SEQ ID NO: 675563 - DNA, 25 bp, Mus musculus
gtatcctctaagtatcattttgtga

SEQ ID NO: 675564 - DNA, 25 bp, Mus musculus
gtatcctctccaacaaggcaggagg

SEQ ID NO: 675565 - DNA, 25 bp, Mus musculus
gtatcctctccatcaaggcaggagg

SEQ ID NO: 675566 - DNA, 25 bp, Mus musculus
gtatcctctccgaatctgatgaaca

SEQ ID NO: 675567 - DNA, 25 bp, Mus musculus
gtatcctctccgtatctgatgaaca

SEQ ID NO: 675568 - DNA, 25 bp, Mus musculus
gtatcctctctcactcgtgttcaag

SEQ ID NO: 675569 - DNA, 25 bp, Mus musculus
gtatcctctctctctcgtgttcaag

SEQ ID NO: 675570 - DNA, 25 bp, Mus musculus
gtatcctctgacaccaggtctgcat

SEQ ID NO: 675571 - DNA, 25 bp, Mus musculus
gtatcctctgactccaggtctgcat

SEQ ID NO: 675572 - DNA, 25 bp, Mus musculus
gtatcctctgagaacttcagtgcca

SEQ ID NO: 675573 - DNA, 25 bp, Mus musculus
gtatcctctgagcaagtttatccac

SEQ ID NO: 675574 - DNA, 25 bp, Mus musculus
gtatcctctgaggaagtttatccac

SEQ ID NO: 675575 - DNA, 25 bp, Mus musculus
gtatcctctgagtacttcagtgcca

SEQ ID NO: 675576 - DNA, 25 bp, Mus musculus
gtatcctctgtgctgtgtgaataac

SEQ ID NO: 675577 - DNA, 25 bp, Mus musculus
gtatcctctgtggtgtgtgaataac

SEQ ID NO: 675578 - DNA, 25 bp, Mus musculus
gtatcctgaaccaagttgctcacaa

SEQ ID NO: 675579 - DNA, 25 bp, Mus musculus
gtatcctgaacctagttgctcacaa

SEQ ID NO: 675580 - DNA, 25 bp, Mus musculus
gtatcctgaagtccgacaccactgt

SEQ ID NO: 675581 - DNA, 25 bp, Mus musculus
gtatcctgaagtgcgacaccactgt

SEQ ID NO: 675582 - DNA, 25 bp, Mus musculus
gtatcctgaccgagaaggcttttca

SEQ ID NO: 675583 - DNA, 25 bp, Mus musculus
gtatcctgaccgtgaaggcttttca

SEQ ID NO: 675584 - DNA, 25 bp, Mus musculus
gtatcctgatccaggtgtcagaact

SEQ ID NO: 675585 - DNA, 25 bp, Mus musculus
gtatcctgatcctggtgtcagaact

SEQ ID NO: 675586 - DNA, 25 bp, Mus musculus
gtatcctgcactcagcctgagcctg

SEQ ID NO: 675587 - DNA, 25 bp, Mus musculus
gtatcctgcactgagcctgagcctg

SEQ ID NO: 675588 - DNA, 25 bp, Mus musculus
gtatcctgcatgatgaacaaggagg

SEQ ID NO: 675589 - DNA, 25 bp, Mus musculus
gtatcctgcatgttgaacaaggagg

SEQ ID NO: 675590 - DNA, 25 bp, Mus musculus
gtatcctgcctgactgttatgcaaa

SEQ ID NO: 675591 - DNA, 25 bp, Mus musculus
gtatcctgcctgtctgttatgcaaa

SEQ ID NO: 675592 - DNA, 25 bp, Mus musculus
gtatcctggaaacgatgccattcaa

SEQ ID NO: 675593 - DNA, 25 bp, Mus musculus
gtatcctggaaaggatgccattcaa

SEQ ID NO: 675594 - DNA, 25 bp, Mus musculus
gtatcctggaagacattctcttgta

SEQ ID NO: 675595 - DNA, 25 bp, Mus musculus
gtatcctggaagtcattctcttgta

SEQ ID NO: 675596 - DNA, 25 bp, Mus musculus
gtatcctggcatcgttcttttgcaa

SEQ ID NO: 675597 - DNA, 25 bp, Mus musculus
gtatcctggcatggttcttttgcaa

SEQ ID NO: 675598 - DNA, 25 bp, Mus musculus
gtatcctggctgaatcagtgtctaa

SEQ ID NO: 675599 - DNA, 25 bp, Mus musculus
gtatcctggctgtatcagtgtctaa

SEQ ID NO: 675600 - DNA, 25 bp, Mus musculus
gtatcctggttgcatagcacacact

SEQ ID NO: 675601 - DNA, 25 bp, Mus musculus
gtatcctggttggatagcacacact

SEQ ID NO: 675602 - DNA, 25 bp, Mus musculus
gtatcctgtatcagtgaattgcttt

SEQ ID NO: 675603 - DNA, 25 bp, Mus musculus
gtatcctgtatctgtgaattgcttt

SEQ ID NO: 675604 - DNA, 25 bp, Mus musculus
gtatcctgtgccagtaactaatcaa

SEQ ID NO: 675605 - DNA, 25 bp, Mus musculus
gtatcctgtgcctgtaactaatcaa

SEQ ID NO: 675606 - DNA, 25 bp, Mus musculus
gtatcctgtgggagaatagagacac

SEQ ID NO: 675607 - DNA, 25 bp, Mus musculus
gtatcctgtgggtgaatagagacac

SEQ ID NO: 675608 - DNA, 25 bp, Mus musculus
gtatcctgtggtatatgcactctga

SEQ ID NO: 675609 - DNA, 25 bp, Mus musculus
gtatcctgtggtttatgcactctga

SEQ ID NO: 675610 - DNA, 25 bp, Mus musculus
gtatcctgtgttcagattcggaata

SEQ ID NO: 675611 - DNA, 25 bp, Mus musculus
gtatcctgtgttgagattcggaata

SEQ ID NO: 675612 - DNA, 25 bp, Mus musculus
gtatccttaaaccttgcaaacatca

SEQ ID NO: 675613 - DNA, 25 bp, Mus musculus
gtatccttaaacgttgcaaacatca

SEQ ID NO: 675614 - DNA, 25 bp, Mus musculus
gtatccttacaaaagaccttgtatg

SEQ ID NO: 675615 - DNA, 25 bp, Mus musculus
gtatccttacaatagaccttgtatg

SEQ ID NO: 675616 - DNA, 25 bp, Mus musculus
gtatccttaggaattactccctgga

SEQ ID NO: 675617 - DNA, 25 bp, Mus musculus
gtatccttaggatttactccctgga

SEQ ID NO: 675618 - DNA, 25 bp, Mus musculus
gtatccttagtcaacagttactgtt

SEQ ID NO: 675619 - DNA, 25 bp, Mus musculus
gtatccttagtctacagttactgtt

SEQ ID NO: 675620 - DNA, 25 bp, Mus musculus
gtatccttccagagagtctatgcat

SEQ ID NO: 675621 - DNA, 25 bp, Mus musculus
gtatccttccagtgagtctatgcat

SEQ ID NO: 675622 - DNA, 25 bp, Mus musculus
gtatccttctagaacttgtactttc

SEQ ID NO: 675623 - DNA, 25 bp, Mus musculus
gtatccttctagtacttgtactttc

SEQ ID NO: 675624 - DNA, 25 bp, Mus musculus
gtatccttctatactggaggacttt

SEQ ID NO: 675625 - DNA, 25 bp, Mus musculus
gtatccttctattctggaggacttt

SEQ ID NO: 675626 - DNA, 25 bp, Mus musculus
gtatccttggccacaaccaaaggtt

SEQ ID NO: 675627 - DNA, 25 bp, Mus musculus
gtatccttggcctcaaccaaaggtt

SEQ ID NO: 675628 - DNA, 25 bp, Mus musculus
gtatccttgggtctgtggtcctttc

SEQ ID NO: 675629 - DNA, 25 bp, Mus musculus
gtatccttgggtgtgtggtcctttc

SEQ ID NO: 675630 - DNA, 25 bp, Mus musculus
gtatccttggtcaatctcaagaaaa

SEQ ID NO: 675631 - DNA, 25 bp, Mus musculus
gtatccttggtctatctcaagaaaa

SEQ ID NO: 675632 - DNA, 25 bp, Mus musculus
gtatccttggttccacagagcatca

SEQ ID NO: 675633 - DNA, 25 bp, Mus musculus
gtatccttggttgcacagagcatca

SEQ ID NO: 675634 - DNA, 25 bp, Mus musculus
gtatccttgtacagtagtcttgacg

SEQ ID NO: 675635 - DNA, 25 bp, Mus musculus
gtatccttgtactgtagtcttgacg

SEQ ID NO: 675636 - DNA, 25 bp, Mus musculus
gtatcctttatgagtactgcttatg

SEQ ID NO: 675637 - DNA, 25 bp, Mus musculus
gtatcctttatgtgtactgcttatg

SEQ ID NO: 675638 - DNA, 25 bp, Mus musculus
gtatcctttcatcgagttattactg

SEQ ID NO: 675639 - DNA, 25 bp, Mus musculus
gtatcctttcatggagttattactg

SEQ ID NO: 675640 - DNA, 25 bp, Mus musculus
gtatcctttctcaatgtagtggcct

SEQ ID NO: 675641 - DNA, 25 bp, Mus musculus
gtatcctttctctatgtagtggcct

SEQ ID NO: 675642 - DNA, 25 bp, Mus musculus
gtatcctttggtctaattgctttat

SEQ ID NO: 675643 - DNA, 25 bp, Mus musculus
gtatcctttggtgtaattgctttat

SEQ ID NO: 675644 - DNA, 25 bp, Mus musculus
gtatcctttgttcagtagctttgtc

SEQ ID NO: 675645 - DNA, 25 bp, Mus musculus
gtatcctttgttgagtagctttgtc

SEQ ID NO: 675646 - DNA, 25 bp, Mus musculus
gtatccttttacagaacacttagct

SEQ ID NO: 675647 - DNA, 25 bp, Mus musculus
gtatccttttactgaacacttagct

SEQ ID NO: 675648 - DNA, 25 bp, Mus musculus
gtatccttttggcatcagctgtacc

SEQ ID NO: 675649 - DNA, 25 bp, Mus musculus
gtatccttttgggatcagctgtacc

SEQ ID NO: 675650 - DNA, 25 bp, Mus musculus
gtatcgaagcgtccacaagaaccct

SEQ ID NO: 675651 - DNA, 25 bp, Mus musculus
gtatcgaagcgtgcacaagaaccct

SEQ ID NO: 675652 - DNA, 25 bp, Mus musculus
gtatcgacagaactgggctgactct

SEQ ID NO: 675653 - DNA, 25 bp, Mus musculus
gtatcgacagaagtgggctgactct

SEQ ID NO: 675654 - DNA, 25 bp, Mus musculus
gtatcgacatgtacgccatgggcct

SEQ ID NO: 675655 - DNA, 25 bp, Mus musculus
gtatcgacatgttcgccatgggcct

SEQ ID NO: 675656 - DNA, 25 bp, Mus musculus
gtatcgaccattataaacccatatg

SEQ ID NO: 675657 - DNA, 25 bp, Mus musculus
gtatcgaccattttaaacccatatg

SEQ ID NO: 675658 - DNA, 25 bp, Mus musculus
gtatcgactgttatattagttgtct

SEQ ID NO: 675659 - DNA, 25 bp, Mus musculus
gtatcgactgttttattagttgtct

SEQ ID NO: 675660 - DNA, 25 bp, Mus musculus
gtatcgagaagccacctcttaggta

SEQ ID NO: 675661 - DNA, 25 bp, Mus musculus
gtatcgagaagcgacctcttaggta

SEQ ID NO: 675662 - DNA, 25 bp, Mus musculus
gtatcgatcataaaacaagtcaata

SEQ ID NO: 675663 - DNA, 25 bp, Mus musculus
gtatcgatcatataacaagtcaata

SEQ ID NO: 675664 - DNA, 25 bp, Mus musculus
gtatcgatgaagagcaaggccctca

SEQ ID NO: 675665 - DNA, 25 bp, Mus musculus
gtatcgatgaagtgcaaggccctca

SEQ ID NO: 675666 - DNA, 25 bp, Mus musculus
gtatcgatgactagacctctattcc

SEQ ID NO: 675667 - DNA, 25 bp, Mus musculus
gtatcgatgacttgacctctattcc

SEQ ID NO: 675668 - DNA, 25 bp, Mus musculus
gtatcgatgcctattttggtgcaaa

SEQ ID NO: 675669 - DNA, 25 bp, Mus musculus
gtatcgatgccttttttggtgcaaa

SEQ ID NO: 675670 - DNA, 25 bp, Mus musculus
gtatcgatgtgaccggcaccagtca

SEQ ID NO: 675671 - DNA, 25 bp, Mus musculus
gtatcgatgtgagcggcaccagtca

SEQ ID NO: 675672 - DNA, 25 bp, Mus musculus
gtatcgattcgacggcaccgggttt

SEQ ID NO: 675673 - DNA, 25 bp, Mus musculus
gtatcgattcgagggcaccgggttt

SEQ ID NO: 675674 - DNA, 25 bp, Mus musculus
gtatcgatttcacacaccttttaaa

SEQ ID NO: 675675 - DNA, 25 bp, Mus musculus
gtatcgatttcagacaccttttaaa

SEQ ID NO: 675676 - DNA, 25 bp, Mus musculus
gtatcgccagcacgaatcaggccgt

SEQ ID NO: 675677 - DNA, 25 bp, Mus musculus
gtatcgccagcaggaatcaggccgt

SEQ ID NO: 675678 - DNA, 25 bp, Mus musculus
gtatcgccagggactccgacgaagg

SEQ ID NO: 675679 - DNA, 25 bp, Mus musculus
gtatcgccagggtctccgacgaagg

SEQ ID NO: 675680 - DNA, 25 bp, Mus musculus
gtatcgcgagagatgggcgggccga

SEQ ID NO: 675681 - DNA, 25 bp, Mus musculus
gtatcgcgagagttgggcgggccga

SEQ ID NO: 675682 - DNA, 25 bp, Mus musculus
gtatcgcgggtgcaaatgtacctgc

SEQ ID NO: 675683 - DNA, 25 bp, Mus musculus
gtatcgcgggtggaaatgtacctgc

SEQ ID NO: 675684 - DNA, 25 bp, Mus musculus
gtatcgctgagcatgtcatgttcca

SEQ ID NO: 675685 - DNA, 25 bp, Mus musculus
gtatcgctgagcttgtcatgttcca

SEQ ID NO: 675686 - DNA, 25 bp, Mus musculus
gtatcgctgcgtcgtgaagcctatg

SEQ ID NO: 675687 - DNA, 25 bp, Mus musculus
gtatcgctgcgtggtgaagcctatg

SEQ ID NO: 675688 - DNA, 25 bp, Mus musculus
gtatcgctggaccacggatcgcaaa

SEQ ID NO: 675689 - DNA, 25 bp, Mus musculus
gtatcgctggacgacggatcgcaaa

SEQ ID NO: 675690 - DNA, 25 bp, Mus musculus
gtatcggaaacactcatcatccctg

SEQ ID NO: 675691 - DNA, 25 bp, Mus musculus
gtatcggaaacagtcatcatccctg

SEQ ID NO: 675692 - DNA, 25 bp, Mus musculus
gtatcggaaaccagacatgacgcct

SEQ ID NO: 675693 - DNA, 25 bp, Mus musculus
gtatcggaaacctgacatgacgcct

SEQ ID NO: 675694 - DNA, 25 bp, Mus musculus
gtatcggaacatcggcacagccagg

SEQ ID NO: 675695 - DNA, 25 bp, Mus musculus
gtatcggaacatgggcacagccagg

SEQ ID NO: 675696 - DNA, 25 bp, Mus musculus
gtatcggatggtcgcatacctgagc

SEQ ID NO: 675697 - DNA, 25 bp, Mus musculus
gtatcggatggtggcatacctgagc

SEQ ID NO: 675698 - DNA, 25 bp, Mus musculus
gtatcggcacaacggatttcttttt

SEQ ID NO: 675699 - DNA, 25 bp, Mus musculus
gtatcggcacaagggatttcttttt

SEQ ID NO: 675700 - DNA, 25 bp, Mus musculus
gtatcgggtgccaaagaacttcgtg

SEQ ID NO: 675701 - DNA, 25 bp, Mus musculus
gtatcgggtgcctaagaacttcgtg

SEQ ID NO: 675702 - DNA, 25 bp, Mus musculus
gtatcggtaggcatcgtaactgttg

SEQ ID NO: 675703 - DNA, 25 bp, Mus musculus
gtatcggtaggcttcgtaactgttg

SEQ ID NO: 675704 - DNA, 25 bp, Mus musculus
gtatcggtcacactgagttgtctgt

SEQ ID NO: 675705 - DNA, 25 bp, Mus musculus
gtatcggtcacagtgagttgtctgt

SEQ ID NO: 675706 - DNA, 25 bp, Mus musculus
gtatcggtgattactgcacccgtca

SEQ ID NO: 675707 - DNA, 25 bp, Mus musculus
gtatcggtgatttctgcacccgtca

SEQ ID NO: 675708 - DNA, 25 bp, Mus musculus
gtatcggtgtgaacatggtgaccta

SEQ ID NO: 675709 - DNA, 25 bp, Mus musculus
gtatcggtgtgatcatggtgaccta

SEQ ID NO: 675710 - DNA, 25 bp, Mus musculus
gtatcggttcccaccatcctatata

SEQ ID NO: 675711 - DNA, 25 bp, Mus musculus
gtatcggttccctccatcctatata

SEQ ID NO: 675712 - DNA, 25 bp, Mus musculus
gtatcgtaagttattggtagcacca

SEQ ID NO: 675713 - DNA, 25 bp, Mus musculus
gtatcgtaagtttttggtagcacca

SEQ ID NO: 675714 - DNA, 25 bp, Mus musculus
gtatcgtacgagctctatgggcttc

SEQ ID NO: 675715 - DNA, 25 bp, Mus musculus
gtatcgtacgaggtctatgggcttc

SEQ ID NO: 675716 - DNA, 25 bp, Mus musculus
gtatcgtatagcagtattgaatcat

SEQ ID NO: 675717 - DNA, 25 bp, Mus musculus
gtatcgtatagctgtattgaatcat

SEQ ID NO: 675718 - DNA, 25 bp, Mus musculus
gtatcgtatgctataatctccaaat

SEQ ID NO: 675719 - DNA, 25 bp, Mus musculus
gtatcgtatgctttaatctccaaat

SEQ ID NO: 675720 - DNA, 25 bp, Mus musculus
gtatcgtgaggtcccacagactcct

SEQ ID NO: 675721 - DNA, 25 bp, Mus musculus
gtatcgtgaggtgccacagactcct

SEQ ID NO: 675722 - DNA, 25 bp, Mus musculus
gtatcgtgctcaagcggcatggcat

SEQ ID NO: 675723 - DNA, 25 bp, Mus musculus
gtatcgtgctcatgcggcatggcat

SEQ ID NO: 675724 - DNA, 25 bp, Mus musculus
gtatcgtgctgtctgagcctgtgtt

SEQ ID NO: 675725 - DNA, 25 bp, Mus musculus
gtatcgtgctgtgtgagcctgtgtt

SEQ ID NO: 675726 - DNA, 25 bp, Mus musculus
gtatcgtggactcccagaggacagc

SEQ ID NO: 675727 - DNA, 25 bp, Mus musculus
gtatcgtggactgccagaggacagc

SEQ ID NO: 675728 - DNA, 25 bp, Mus musculus
gtatcgtgttggactaatgacacta

SEQ ID NO: 675729 - DNA, 25 bp, Mus musculus
gtatcgtgttggtctaatgacacta

SEQ ID NO: 675730 - DNA, 25 bp, Mus musculus
gtatcgttattaaaagcacatctaa

SEQ ID NO: 675731 - DNA, 25 bp, Mus musculus
gtatcgttattataagcacatctaa

SEQ ID NO: 675732 - DNA, 25 bp, Mus musculus
gtatctaaacgcatgcttgcttctg

SEQ ID NO: 675733 - DNA, 25 bp, Mus musculus
gtatctaaacgcttgcttgcttctg

SEQ ID NO: 675734 - DNA, 25 bp, Mus musculus
gtatctaaactgactctcttctttg

SEQ ID NO: 675735 - DNA, 25 bp, Mus musculus
gtatctaaactgtctctcttctttg

SEQ ID NO: 675736 - DNA, 25 bp, Mus musculus
gtatctaataaaacaggcagcaatc

SEQ ID NO: 675737 - DNA, 25 bp, Mus musculus
gtatctaataaatcaggcagcaatc

SEQ ID NO: 675738 - DNA, 25 bp, Mus musculus
gtatctaatattagctttttcccct

SEQ ID NO: 675739 - DNA, 25 bp, Mus musculus
gtatctaatatttgctttttcccct

SEQ ID NO: 675740 - DNA, 25 bp, Mus musculus
gtatctaatgccacaagcaaatctg

SEQ ID NO: 675741 - DNA, 25 bp, Mus musculus
gtatctaatgcctcaagcaaatctg

SEQ ID NO: 675742 - DNA, 25 bp, Mus musculus
gtatctacaacaaaaaggctataaa

SEQ ID NO: 675743 - DNA, 25 bp, Mus musculus
gtatctacaacataaaggctataaa

SEQ ID NO: 675744 - DNA, 25 bp, Mus musculus
gtatctacacgaatgccttctgatt

SEQ ID NO: 675745 - DNA, 25 bp, Mus musculus
gtatctacacgattgccttctgatt

SEQ ID NO: 675746 - DNA, 25 bp, Mus musculus
gtatctacagcaagctccggatgtt

SEQ ID NO: 675747 - DNA, 25 bp, Mus musculus
gtatctacagcatgctccggatgtt

SEQ ID NO: 675748 - DNA, 25 bp, Mus musculus
gtatctacagctaggaaggtccttc

SEQ ID NO: 675749 - DNA, 25 bp, Mus musculus
gtatctacagcttggaaggtccttc

SEQ ID NO: 675750 - DNA, 25 bp, Mus musculus
gtatctacatctccactagaatcct

SEQ ID NO: 675751 - DNA, 25 bp, Mus musculus
gtatctacatctgcactagaatcct

SEQ ID NO: 675752 - DNA, 25 bp, Mus musculus
gtatctacattgctaccttcaaaga

SEQ ID NO: 675753 - DNA, 25 bp, Mus musculus
gtatctacattggtaccttcaaaga

SEQ ID NO: 675754 - DNA, 25 bp, Mus musculus
gtatctaccatgcaagtgctggctc

SEQ ID NO: 675755 - DNA, 25 bp, Mus musculus
gtatctaccatggaagtgctggctc

SEQ ID NO: 675756 - DNA, 25 bp, Mus musculus
gtatctacctcactggtcaagtatt

SEQ ID NO: 675757 - DNA, 25 bp, Mus musculus
gtatctacctcagtggtcaagtatt

SEQ ID NO: 675758 - DNA, 25 bp, Mus musculus
gtatctacctgtagctttcaaacta

SEQ ID NO: 675759 - DNA, 25 bp, Mus musculus
gtatctacctgttgctttcaaacta

SEQ ID NO: 675760 - DNA, 25 bp, Mus musculus
gtatctacctttcattggaagaaca

SEQ ID NO: 675761 - DNA, 25 bp, Mus musculus
gtatctacctttgattggaagaaca

SEQ ID NO: 675762 - DNA, 25 bp, Mus musculus
gtatctactagacattgcctttgat

SEQ ID NO: 675763 - DNA, 25 bp, Mus musculus
gtatctactagagattgcctttgat

SEQ ID NO: 675764 - DNA, 25 bp, Mus musculus
gtatctactgcactgtgtctgcttt

SEQ ID NO: 675765 - DNA, 25 bp, Mus musculus
gtatctactgcagtgtgtctgcttt

SEQ ID NO: 675766 - DNA, 25 bp, Mus musculus
gtatctactgtaagtgcagaccatg

SEQ ID NO: 675767 - DNA, 25 bp, Mus musculus
gtatctactgtatgtgcagaccatg

SEQ ID NO: 675768 - DNA, 25 bp, Mus musculus
gtatctactgtgctttctgccagga

SEQ ID NO: 675769 - DNA, 25 bp, Mus musculus
gtatctactgtggtttctgccagga

SEQ ID NO: 675770 - DNA, 25 bp, Mus musculus
gtatctagcaggatcgaagcgcact

SEQ ID NO: 675771 - DNA, 25 bp, Mus musculus
gtatctagcaggttcgaagcgcact

SEQ ID NO: 675772 - DNA, 25 bp, Mus musculus
gtatctagctctctacccacaaaga

SEQ ID NO: 675773 - DNA, 25 bp, Mus musculus
gtatctagctctgtacccacaaaga

SEQ ID NO: 675774 - DNA, 25 bp, Mus musculus
gtatctaggcagctaggctttactt

SEQ ID NO: 675775 - DNA, 25 bp, Mus musculus
gtatctaggcaggtaggctttactt

SEQ ID NO: 675776 - DNA, 25 bp, Mus musculus
gtatctaggcttctaatttgtctgc

SEQ ID NO: 675777 - DNA, 25 bp, Mus musculus
gtatctaggcttgtaatttgtctgc

SEQ ID NO: 675778 - DNA, 25 bp, Mus musculus
gtatctagggacaatttattgagct

SEQ ID NO: 675779 - DNA, 25 bp, Mus musculus
gtatctagggactatttattgagct

SEQ ID NO: 675780 - DNA, 25 bp, Mus musculus
gtatctagggcaaaatccagcagga

SEQ ID NO: 675781 - DNA, 25 bp, Mus musculus
gtatctagggcataatccagcagga

SEQ ID NO: 675782 - DNA, 25 bp, Mus musculus
gtatctagtactcgactgtgtcccc

SEQ ID NO: 675783 - DNA, 25 bp, Mus musculus
gtatctagtactggactgtgtcccc

SEQ ID NO: 675784 - DNA, 25 bp, Mus musculus
gtatctagtatacacacgcactttg

SEQ ID NO: 675785 - DNA, 25 bp, Mus musculus
gtatctagtatagacacgcactttg

SEQ ID NO: 675786 - DNA, 25 bp, Mus musculus
gtatctagtattagttgtatcccat

SEQ ID NO: 675787 - DNA, 25 bp, Mus musculus
gtatctagtattcaaaaatgcctgc

SEQ ID NO: 675788 - DNA, 25 bp, Mus musculus
gtatctagtattgaaaaatgcctgc

SEQ ID NO: 675789 - DNA, 25 bp, Mus musculus
gtatctagtatttgttgtatcccat

SEQ ID NO: 675790 - DNA, 25 bp, Mus musculus
gtatctagtccccaccaattttgtc

SEQ ID NO: 675791 - DNA, 25 bp, Mus musculus
gtatctagtcccgaccaattttgtc

SEQ ID NO: 675792 - DNA, 25 bp, Mus musculus
gtatctataacacacctgctttacc

SEQ ID NO: 675793 - DNA, 25 bp, Mus musculus
gtatctataacagacctgctttacc

SEQ ID NO: 675794 - DNA, 25 bp, Mus musculus
gtatctatatatagcatacctgtat

SEQ ID NO: 675795 - DNA, 25 bp, Mus musculus
gtatctatatattgcatacctgtat

SEQ ID NO: 675796 - DNA, 25 bp, Mus musculus
gtatctatattcaatcttccaccat

SEQ ID NO: 675797 - DNA, 25 bp, Mus musculus
gtatctatattctatcttccaccat

SEQ ID NO: 675798 - DNA, 25 bp, Mus musculus
gtatctatcagacaagcctcattct

SEQ ID NO: 675799 - DNA, 25 bp, Mus musculus
gtatctatcagagaagcctcattct

SEQ ID NO: 675800 - DNA, 25 bp, Mus musculus
gtatctatcaggaagtcacactaaa

SEQ ID NO: 675801 - DNA, 25 bp, Mus musculus
gtatctatcaggtagtcacactaaa

SEQ ID NO: 675802 - DNA, 25 bp, Mus musculus
gtatctatcagtatcactgagctag

SEQ ID NO: 675803 - DNA, 25 bp, Mus musculus
gtatctatcagtttcactgagctag

SEQ ID NO: 675804 - DNA, 25 bp, Mus musculus
gtatctatccatcggtaatgctcag

SEQ ID NO: 675805 - DNA, 25 bp, Mus musculus
gtatctatccatgggtaatgctcag

SEQ ID NO: 675806 - DNA, 25 bp, Mus musculus
gtatctatcgccatctctatttaat

SEQ ID NO: 675807 - DNA, 25 bp, Mus musculus
gtatctatcgccttctctatttaat

SEQ ID NO: 675808 - DNA, 25 bp, Mus musculus
gtatctatctatcatgccccaggaa

SEQ ID NO: 675809 - DNA, 25 bp, Mus musculus
gtatctatctatctaagcctgtcct

SEQ ID NO: 675810 - DNA, 25 bp, Mus musculus
gtatctatctatgatgccccaggaa

SEQ ID NO: 675811 - DNA, 25 bp, Mus musculus
gtatctatctatgtaagcctgtcct

SEQ ID NO: 675812 - DNA, 25 bp, Mus musculus
gtatctatctgtattgaacctggct

SEQ ID NO: 675813 - DNA, 25 bp, Mus musculus
gtatctatctgttttgaacctggct

SEQ ID NO: 675814 - DNA, 25 bp, Mus musculus
gtatctatctttctgctggtgacca

SEQ ID NO: 675815 - DNA, 25 bp, Mus musculus
gtatctatctttgtgctggtgacca

SEQ ID NO: 675816 - DNA, 25 bp, Mus musculus
gtatctatgagcaaatggcatccac

SEQ ID NO: 675817 - DNA, 25 bp, Mus musculus
gtatctatgagctaatggcatccac

SEQ ID NO: 675818 - DNA, 25 bp, Mus musculus
gtatctatgggcagcgtgagccaga

SEQ ID NO: 675819 - DNA, 25 bp, Mus musculus
gtatctatgggctgcgtgagccaga

SEQ ID NO: 675820 - DNA, 25 bp, Mus musculus
gtatctatggtcaaggaactgcttt

SEQ ID NO: 675821 - DNA, 25 bp, Mus musculus
gtatctatggtctaggaactgcttt

SEQ ID NO: 675822 - DNA, 25 bp, Mus musculus
gtatctatggttccacaccagaatc

SEQ ID NO: 675823 - DNA, 25 bp, Mus musculus
gtatctatggttgcacaccagaatc

SEQ ID NO: 675824 - DNA, 25 bp, Mus musculus
gtatctattaccataagttctgtgt

SEQ ID NO: 675825 - DNA, 25 bp, Mus musculus
gtatctattaccttaagttctgtgt

SEQ ID NO: 675826 - DNA, 25 bp, Mus musculus
gtatctattactatcacctgatctc

SEQ ID NO: 675827 - DNA, 25 bp, Mus musculus
gtatctattactttcacctgatctc

SEQ ID NO: 675828 - DNA, 25 bp, Mus musculus
gtatctattctgaccataaagtcta

SEQ ID NO: 675829 - DNA, 25 bp, Mus musculus
gtatctattctgtccataaagtcta

SEQ ID NO: 675830 - DNA, 25 bp, Mus musculus
gtatctattgacacctactggaaat

SEQ ID NO: 675831 - DNA, 25 bp, Mus musculus
gtatctattgactcctactggaaat

SEQ ID NO: 675832 - DNA, 25 bp, Mus musculus
gtatctattgttcctccttcagaca

SEQ ID NO: 675833 - DNA, 25 bp, Mus musculus
gtatctattgttgctccttcagaca

SEQ ID NO: 675834 - DNA, 25 bp, Mus musculus
gtatctatttacagtgcatgtctca

SEQ ID NO: 675835 - DNA, 25 bp, Mus musculus
gtatctatttactgtgcatgtctca

SEQ ID NO: 675836 - DNA, 25 bp, Mus musculus
gtatctatttcaaaaactgctggta

SEQ ID NO: 675837 - DNA, 25 bp, Mus musculus
gtatctatttcataaactgctggta

SEQ ID NO: 675838 - DNA, 25 bp, Mus musculus
gtatctatttccatgcactcatcag

SEQ ID NO: 675839 - DNA, 25 bp, Mus musculus
gtatctatttccttgcactcatcag

SEQ ID NO: 675840 - DNA, 25 bp, Mus musculus
gtatctatttctctctgaactcact

SEQ ID NO: 675841 - DNA, 25 bp, Mus musculus
gtatctatttctgtctgaactcact

SEQ ID NO: 675842 - DNA, 25 bp, Mus musculus
gtatctattttgagtagacatcgtc

SEQ ID NO: 675843 - DNA, 25 bp, Mus musculus
gtatctattttgtgtagacatcgtc

SEQ ID NO: 675844 - DNA, 25 bp, Mus musculus
gtatctcaacagagtactttcttgt

SEQ ID NO: 675845 - DNA, 25 bp, Mus musculus
gtatctcaacagtgtactttcttgt

SEQ ID NO: 675846 - DNA, 25 bp, Mus musculus
gtatctcaagacagcctttaaccta

SEQ ID NO: 675847 - DNA, 25 bp, Mus musculus
gtatctcaagactgcctttaaccta

SEQ ID NO: 675848 - DNA, 25 bp, Mus musculus
gtatctcaagtcactgaatcctcag

SEQ ID NO: 675849 - DNA, 25 bp, Mus musculus
gtatctcaagtctctgaatcctcag

SEQ ID NO: 675850 - DNA, 25 bp, Mus musculus
gtatctcacaccactaatcgaagca

SEQ ID NO: 675851 - DNA, 25 bp, Mus musculus
gtatctcacacctctaatcgaagca

SEQ ID NO: 675852 - DNA, 25 bp, Mus musculus
gtatctcacagcagtgtctatggga

SEQ ID NO: 675853 - DNA, 25 bp, Mus musculus
gtatctcacagctgtgtctatggga

SEQ ID NO: 675854 - DNA, 25 bp, Mus musculus
gtatctcacattccacataccgagg

SEQ ID NO: 675855 - DNA, 25 bp, Mus musculus
gtatctcacattgcacataccgagg

SEQ ID NO: 675856 - DNA, 25 bp, Mus musculus
gtatctcactttactgttcaaggct

SEQ ID NO: 675857 - DNA, 25 bp, Mus musculus
gtatctcacttttctgttcaaggct

SEQ ID NO: 675858 - DNA, 25 bp, Mus musculus
gtatctcagggaattaacatttttc

SEQ ID NO: 675859 - DNA, 25 bp, Mus musculus
gtatctcagggatttaacatttttc

SEQ ID NO: 675860 - DNA, 25 bp, Mus musculus
gtatctcaggtacatttttctccaa

SEQ ID NO: 675861 - DNA, 25 bp, Mus musculus
gtatctcaggtagatttttctccaa

SEQ ID NO: 675862 - DNA, 25 bp, Mus musculus
gtatctcaggttaaactgtcagctg

SEQ ID NO: 675863 - DNA, 25 bp, Mus musculus
gtatctcaggtttaactgtcagctg

SEQ ID NO: 675864 - DNA, 25 bp, Mus musculus
gtatctcagtataacccatgtgttt

SEQ ID NO: 675865 - DNA, 25 bp, Mus musculus
gtatctcagtatctgtatattatcc

SEQ ID NO: 675866 - DNA, 25 bp, Mus musculus
gtatctcagtatgtgtatattatcc

SEQ ID NO: 675867 - DNA, 25 bp, Mus musculus
gtatctcagtattacccatgtgttt

SEQ ID NO: 675868 - DNA, 25 bp, Mus musculus
gtatctcagtctaaggtctcatgct

SEQ ID NO: 675869 - DNA, 25 bp, Mus musculus
gtatctcagtctcggaagtctccat

SEQ ID NO: 675870 - DNA, 25 bp, Mus musculus
gtatctcagtctgggaagtctccat

SEQ ID NO: 675871 - DNA, 25 bp, Mus musculus
gtatctcagtcttaggtctcatgct

SEQ ID NO: 675872 - DNA, 25 bp, Mus musculus
gtatctcagtgaaggagcgcacagt

SEQ ID NO: 675873 - DNA, 25 bp, Mus musculus
gtatctcagtgatggagcgcacagt

SEQ ID NO: 675874 - DNA, 25 bp, Mus musculus
gtatctcagtgtcccggtctgtaaa

SEQ ID NO: 675875 - DNA, 25 bp, Mus musculus
gtatctcagtgtgccggtctgtaaa

SEQ ID NO: 675876 - DNA, 25 bp, Mus musculus
gtatctcagttacacctcgatcttt

SEQ ID NO: 675877 - DNA, 25 bp, Mus musculus
gtatctcagttagacctcgatcttt

SEQ ID NO: 675878 - DNA, 25 bp, Mus musculus
gtatctcagttgataactccatgaa

SEQ ID NO: 675879 - DNA, 25 bp, Mus musculus
gtatctcagttgttaactccatgaa

SEQ ID NO: 675880 - DNA, 25 bp, Mus musculus
gtatctcagtttagtgaaaggtaaa

SEQ ID NO: 675881 - DNA, 25 bp, Mus musculus
gtatctcagttttgtgaaaggtaaa

SEQ ID NO: 675882 - DNA, 25 bp, Mus musculus
gtatctcatcatctgaatatagtgt

SEQ ID NO: 675883 - DNA, 25 bp, Mus musculus
gtatctcatcatgtgaatatagtgt

SEQ ID NO: 675884 - DNA, 25 bp, Mus musculus
gtatctcatcttatcctgcttaaag

SEQ ID NO: 675885 - DNA, 25 bp, Mus musculus
gtatctcatcttttcctgcttaaag

SEQ ID NO: 675886 - DNA, 25 bp, Mus musculus
gtatctccaacaaattccctacagt

SEQ ID NO: 675887 - DNA, 25 bp, Mus musculus
gtatctccaacatattccctacagt

SEQ ID NO: 675888 - DNA, 25 bp, Mus musculus
gtatctccaattccttcaactgtaa

SEQ ID NO: 675889 - DNA, 25 bp, Mus musculus
gtatctccaattgcttcaactgtaa

SEQ ID NO: 675890 - DNA, 25 bp, Mus musculus
gtatctccagaaagttattttccat

SEQ ID NO: 675891 - DNA, 25 bp, Mus musculus
gtatctccagaactccattcgaact

SEQ ID NO: 675892 - DNA, 25 bp, Mus musculus
gtatctccagaagtccattcgaact

SEQ ID NO: 675893 - DNA, 25 bp, Mus musculus
gtatctccagaatgttattttccat

SEQ ID NO: 675894 - DNA, 25 bp, Mus musculus
gtatctccagacagtggcgtcagac

SEQ ID NO: 675895 - DNA, 25 bp, Mus musculus
gtatctccagactgtggcgtcagac

SEQ ID NO: 675896 - DNA, 25 bp, Mus musculus
gtatctccagagctccttgggacta

SEQ ID NO: 675897 - DNA, 25 bp, Mus musculus
gtatctccagaggtccttgggacta

SEQ ID NO: 675898 - DNA, 25 bp, Mus musculus
gtatctccagtcctttgcacgggtg

SEQ ID NO: 675899 - DNA, 25 bp, Mus musculus
gtatctccagtcgtttgcacgggtg

SEQ ID NO: 675900 - DNA, 25 bp, Mus musculus
gtatctccatctacatatggatctg

SEQ ID NO: 675901 - DNA, 25 bp, Mus musculus
gtatctccatcttcatatggatctg

SEQ ID NO: 675902 - DNA, 25 bp, Mus musculus
gtatctccatgtatactgctagaaa

SEQ ID NO: 675903 - DNA, 25 bp, Mus musculus
gtatctccatgtttactgctagaaa

SEQ ID NO: 675904 - DNA, 25 bp, Mus musculus
gtatctccattgatagtaccatcag

SEQ ID NO: 675905 - DNA, 25 bp, Mus musculus
gtatctccattgttagtaccatcag

SEQ ID NO: 675906 - DNA, 25 bp, Mus musculus
gtatctcccaagcttcaagttctgg

SEQ ID NO: 675907 - DNA, 25 bp, Mus musculus
gtatctcccaaggttcaagttctgg

SEQ ID NO: 675908 - DNA, 25 bp, Mus musculus
gtatctcccagaagtgtgcagtcca

SEQ ID NO: 675909 - DNA, 25 bp, Mus musculus
gtatctcccagatgtgtgcagtcca

SEQ ID NO: 675910 - DNA, 25 bp, Mus musculus
gtatctcccagtccaaggagaacct

SEQ ID NO: 675911 - DNA, 25 bp, Mus musculus
gtatctcccagtgcaaggagaacct

SEQ ID NO: 675912 - DNA, 25 bp, Mus musculus
gtatctcccataataaagacttcat

SEQ ID NO: 675913 - DNA, 25 bp, Mus musculus
gtatctcccatattaaagacttcat

SEQ ID NO: 675914 - DNA, 25 bp, Mus musculus
gtatctccccacaactgatgaatgg

SEQ ID NO: 675915 - DNA, 25 bp, Mus musculus
gtatctccccactactgatgaatgg

SEQ ID NO: 675916 - DNA, 25 bp, Mus musculus
gtatctcccgtcaacagggcctggg

SEQ ID NO: 675917 - DNA, 25 bp, Mus musculus
gtatctcccgtctacagggcctggg

SEQ ID NO: 675918 - DNA, 25 bp, Mus musculus
gtatctccctttctgaagacaagtg

SEQ ID NO: 675919 - DNA, 25 bp, Mus musculus
gtatctccctttgtgaagacaagtg

SEQ ID NO: 675920 - DNA, 25 bp, Mus musculus
gtatctccgtctacagagatgccag

SEQ ID NO: 675921 - DNA, 25 bp, Mus musculus
gtatctccgtcttcagagatgccag

SEQ ID NO: 675922 - DNA, 25 bp, Mus musculus
gtatctcctagcactcattcataaa

SEQ ID NO: 675923 - DNA, 25 bp, Mus musculus
gtatctcctagctctcattcataaa

SEQ ID NO: 675924 - DNA, 25 bp, Mus musculus
gtatctcctcctaggaacactcttg

SEQ ID NO: 675925 - DNA, 25 bp, Mus musculus
gtatctcctccttggaacactcttg

SEQ ID NO: 675926 - DNA, 25 bp, Mus musculus
gtatctcctcgcattttgaaagttc

SEQ ID NO: 675927 - DNA, 25 bp, Mus musculus
gtatctcctcgctttttgaaagttc

SEQ ID NO: 675928 - DNA, 25 bp, Mus musculus
gtatctcctgcccttgttgttagtg

SEQ ID NO: 675929 - DNA, 25 bp, Mus musculus
gtatctcctgccgttgttgttagtg

SEQ ID NO: 675930 - DNA, 25 bp, Mus musculus
gtatctccttacctgtacacttctt

SEQ ID NO: 675931 - DNA, 25 bp, Mus musculus
gtatctccttacgtgtacacttctt

SEQ ID NO: 675932 - DNA, 25 bp, Mus musculus
gtatctccttagatgcagctgcata

SEQ ID NO: 675933 - DNA, 25 bp, Mus musculus
gtatctccttagttgcagctgcata

SEQ ID NO: 675934 - DNA, 25 bp, Mus musculus
gtatctcgcctgcatttgaacatgg

SEQ ID NO: 675935 - DNA, 25 bp, Mus musculus
gtatctcgcctggatttgaacatgg

SEQ ID NO: 675936 - DNA, 25 bp, Mus musculus
gtatctcgctcaatcagtggtctaa

SEQ ID NO: 675937 - DNA, 25 bp, Mus musculus
gtatctcgctcattcagtggtctaa

SEQ ID NO: 675938 - DNA, 25 bp, Mus musculus
gtatctcggagcagggtatttttgg

SEQ ID NO: 675939 - DNA, 25 bp, Mus musculus
gtatctcggagctgggtatttttgg

SEQ ID NO: 675940 - DNA, 25 bp, Mus musculus
gtatctcggcccaaattgtgggttt

SEQ ID NO: 675941 - DNA, 25 bp, Mus musculus
gtatctcggccctaattgtgggttt

SEQ ID NO: 675942 - DNA, 25 bp, Mus musculus
gtatctcgtctccatcacttgagag

SEQ ID NO: 675943 - DNA, 25 bp, Mus musculus
gtatctcgtctcgatcacttgagag

SEQ ID NO: 675944 - DNA, 25 bp, Mus musculus
gtatctctacatagccctatctgtc

SEQ ID NO: 675945 - DNA, 25 bp, Mus musculus
gtatctctacattgccctatctgtc

SEQ ID NO: 675946 - DNA, 25 bp, Mus musculus
gtatctctacctcgaggagcctttg

SEQ ID NO: 675947 - DNA, 25 bp, Mus musculus
gtatctctacctggaggagcctttg

SEQ ID NO: 675948 - DNA, 25 bp, Mus musculus
gtatctctactgagtagtccatttt

SEQ ID NO: 675949 - DNA, 25 bp, Mus musculus
gtatctctactgtgtagtccatttt

SEQ ID NO: 675950 - DNA, 25 bp, Mus musculus
gtatctctatgcagtactttaacac

SEQ ID NO: 675951 - DNA, 25 bp, Mus musculus
gtatctctatgctgtactttaacac

SEQ ID NO: 675952 - DNA, 25 bp, Mus musculus
gtatctctattcagcattactgtct

SEQ ID NO: 675953 - DNA, 25 bp, Mus musculus
gtatctctattctgcattactgtct

SEQ ID NO: 675954 - DNA, 25 bp, Mus musculus
gtatctctccagaggccacttacag

SEQ ID NO: 675955 - DNA, 25 bp, Mus musculus
gtatctctccagtggccacttacag

SEQ ID NO: 675956 - DNA, 25 bp, Mus musculus
gtatctctcctaaccctgaatgtga

SEQ ID NO: 675957 - DNA, 25 bp, Mus musculus
gtatctctcctatccctgaatgtga

SEQ ID NO: 675958 - DNA, 25 bp, Mus musculus
gtatctctctggatacatctacaca

SEQ ID NO: 675959 - DNA, 25 bp, Mus musculus
gtatctctctggttacatctacaca

SEQ ID NO: 675960 - DNA, 25 bp, Mus musculus
gtatctctctgtcgaattacactgt

SEQ ID NO: 675961 - DNA, 25 bp, Mus musculus
gtatctctctgtcgattattctaat

SEQ ID NO: 675962 - DNA, 25 bp, Mus musculus
gtatctctctgtggaattacactgt

SEQ ID NO: 675963 - DNA, 25 bp, Mus musculus
gtatctctctgtggattattctaat

SEQ ID NO: 675964 - DNA, 25 bp, Mus musculus
gtatctctgacaccttgggaatctc

SEQ ID NO: 675965 - DNA, 25 bp, Mus musculus
gtatctctgacagcttgggaatctc

SEQ ID NO: 675966 - DNA, 25 bp, Mus musculus
gtatctctgagaacaagcctaccct

SEQ ID NO: 675967 - DNA, 25 bp, Mus musculus
gtatctctgagaacaccgatgctaa

SEQ ID NO: 675968 - DNA, 25 bp, Mus musculus
gtatctctgagatcaagcctaccct

SEQ ID NO: 675969 - DNA, 25 bp, Mus musculus
gtatctctgagatcaccgatgctaa

SEQ ID NO: 675970 - DNA, 25 bp, Mus musculus
gtatctctgctcacagttctgggca

SEQ ID NO: 675971 - DNA, 25 bp, Mus musculus
gtatctctgctctcagttctgggca

SEQ ID NO: 675972 - DNA, 25 bp, Mus musculus
gtatctctggacaagcctaggctgt

SEQ ID NO: 675973 - DNA, 25 bp, Mus musculus
gtatctctggactagcctaggctgt

SEQ ID NO: 675974 - DNA, 25 bp, Mus musculus
gtatctctggagacaatcgctacta

SEQ ID NO: 675975 - DNA, 25 bp, Mus musculus
gtatctctggagtcaatcgctacta

SEQ ID NO: 675976 - DNA, 25 bp, Mus musculus
gtatctctgtatatgagccacccta

SEQ ID NO: 675977 - DNA, 25 bp, Mus musculus
gtatctctgtatttgagccacccta

SEQ ID NO: 675978 - DNA, 25 bp, Mus musculus
gtatctctgtgcatcacaagtgtgt

SEQ ID NO: 675979 - DNA, 25 bp, Mus musculus
gtatctctgtgcttcacaagtgtgt

SEQ ID NO: 675980 - DNA, 25 bp, Mus musculus
gtatctcttagaagggctctgcgct

SEQ ID NO: 675981 - DNA, 25 bp, Mus musculus
gtatctcttagatgggctctgcgct

SEQ ID NO: 675982 - DNA, 25 bp, Mus musculus
gtatctcttcctacataaactcctt

SEQ ID NO: 675983 - DNA, 25 bp, Mus musculus
gtatctcttccttcataaactcctt

SEQ ID NO: 675984 - DNA, 25 bp, Mus musculus
gtatctcttctaatgtaagctttcc

SEQ ID NO: 675985 - DNA, 25 bp, Mus musculus
gtatctcttctattgtaagctttcc

SEQ ID NO: 675986 - DNA, 25 bp, Mus musculus
gtatctcttggtactgtatctttaa

SEQ ID NO: 675987 - DNA, 25 bp, Mus musculus
gtatctcttggttctgtatctttaa

SEQ ID NO: 675988 - DNA, 25 bp, Mus musculus
gtatctctttgccttgtggtcctaa

SEQ ID NO: 675989 - DNA, 25 bp, Mus musculus
gtatctctttgcgttgtggtcctaa

SEQ ID NO: 675990 - DNA, 25 bp, Mus musculus
gtatctgaaatgctccagaatccaa

SEQ ID NO: 675991 - DNA, 25 bp, Mus musculus
gtatctgaaatggtccagaatccaa

SEQ ID NO: 675992 - DNA, 25 bp, Mus musculus
gtatctgaacaaacatctctctggc

SEQ ID NO: 675993 - DNA, 25 bp, Mus musculus
gtatctgaacaatcatctctctggc

SEQ ID NO: 675994 - DNA, 25 bp, Mus musculus
gtatctgaacacagccctctattta

SEQ ID NO: 675995 - DNA, 25 bp, Mus musculus
gtatctgaacacagtcatcccttat

SEQ ID NO: 675996 - DNA, 25 bp, Mus musculus
gtatctgaacactgccctctattta

SEQ ID NO: 675997 - DNA, 25 bp, Mus musculus
gtatctgaacactgtcatcccttat

SEQ ID NO: 675998 - DNA, 25 bp, Mus musculus
gtatctgaaccacccttcagggcag

SEQ ID NO: 675999 - DNA, 25 bp, Mus musculus
gtatctgaaccagccttcagggcag

SEQ ID NO: 676000 - DNA, 25 bp, Mus musculus
gtatctgacaggatgcctacttagt

SEQ ID NO: 676001 - DNA, 25 bp, Mus musculus
gtatctgacaggttgcctacttagt

SEQ ID NO: 676002 - DNA, 25 bp, Mus musculus
gtatctgacctcaagtgtgctctga

SEQ ID NO: 676003 - DNA, 25 bp, Mus musculus
gtatctgacctctagtgtgctctga

SEQ ID NO: 676004 - DNA, 25 bp, Mus musculus
gtatctgacctgacgaaaccaattt

SEQ ID NO: 676005 - DNA, 25 bp, Mus musculus
gtatctgacctgtcgaaaccaattt

SEQ ID NO: 676006 - DNA, 25 bp, Mus musculus
gtatctgaccttcttccttgaagat

SEQ ID NO: 676007 - DNA, 25 bp, Mus musculus
gtatctgaccttgttccttgaagat

SEQ ID NO: 676008 - DNA, 25 bp, Mus musculus
gtatctgactcacaagtttgcctct

SEQ ID NO: 676009 - DNA, 25 bp, Mus musculus
gtatctgactcagaagtttgcctct

SEQ ID NO: 676010 - DNA, 25 bp, Mus musculus
gtatctgactggactggcaatttga

SEQ ID NO: 676011 - DNA, 25 bp, Mus musculus
gtatctgactggtctggcaatttga

SEQ ID NO: 676012 - DNA, 25 bp, Mus musculus
gtatctgagcaacagcctatgggag

SEQ ID NO: 676013 - DNA, 25 bp, Mus musculus
gtatctgagcaagagcctatgggag

SEQ ID NO: 676014 - DNA, 25 bp, Mus musculus
gtatctgagccaaaggcacatcctg

SEQ ID NO: 676015 - DNA, 25 bp, Mus musculus
gtatctgagccacagtctctcaaaa

SEQ ID NO: 676016 - DNA, 25 bp, Mus musculus
gtatctgagccagagtctctcaaaa

SEQ ID NO: 676017 - DNA, 25 bp, Mus musculus
gtatctgagccataggcacatcctg

SEQ ID NO: 676018 - DNA, 25 bp, Mus musculus
gtatctgagcttcttattttttata

SEQ ID NO: 676019 - DNA, 25 bp, Mus musculus
gtatctgagcttgttattttttata

SEQ ID NO: 676020 - DNA, 25 bp, Mus musculus
gtatctgaggtaatccctgcattaa

SEQ ID NO: 676021 - DNA, 25 bp, Mus musculus
gtatctgaggtattccctgcattaa

SEQ ID NO: 676022 - DNA, 25 bp, Mus musculus
gtatctgaggtccataactttctgt

SEQ ID NO: 676023 - DNA, 25 bp, Mus musculus
gtatctgaggtcgataactttctgt

SEQ ID NO: 676024 - DNA, 25 bp, Mus musculus
gtatctgatccgcactgagacacaa

SEQ ID NO: 676025 - DNA, 25 bp, Mus musculus
gtatctgatccggactgagacacaa

SEQ ID NO: 676026 - DNA, 25 bp, Mus musculus
gtatctgatcctcggtttcactgtc

SEQ ID NO: 676027 - DNA, 25 bp, Mus musculus
gtatctgatcctgggtttcactgtc

SEQ ID NO: 676028 - DNA, 25 bp, Mus musculus
gtatctgatgatattggcattagcc

SEQ ID NO: 676029 - DNA, 25 bp, Mus musculus
gtatctgatgattttggcattagcc

SEQ ID NO: 676030 - DNA, 25 bp, Mus musculus
gtatctgatttgactctggagtccc

SEQ ID NO: 676031 - DNA, 25 bp, Mus musculus
gtatctgatttgtctctggagtccc

SEQ ID NO: 676032 - DNA, 25 bp, Mus musculus
gtatctgcaaaaacttataatcctc

SEQ ID NO: 676033 - DNA, 25 bp, Mus musculus
gtatctgcaaaatcttataatcctc

SEQ ID NO: 676034 - DNA, 25 bp, Mus musculus
gtatctgcaaccacgttgacaactc

SEQ ID NO: 676035 - DNA, 25 bp, Mus musculus
gtatctgcaacctcgttgacaactc

SEQ ID NO: 676036 - DNA, 25 bp, Mus musculus
gtatctgcacatagaccagcggttg

SEQ ID NO: 676037 - DNA, 25 bp, Mus musculus
gtatctgcacattgaccagcggttg

SEQ ID NO: 676038 - DNA, 25 bp, Mus musculus
gtatctgcaccaattgtctctattt

SEQ ID NO: 676039 - DNA, 25 bp, Mus musculus
gtatctgcaccatttgtctctattt

SEQ ID NO: 676040 - DNA, 25 bp, Mus musculus
gtatctgcacccatttgttcttatt

SEQ ID NO: 676041 - DNA, 25 bp, Mus musculus
gtatctgcaccccacgggcggaaaa

SEQ ID NO: 676042 - DNA, 25 bp, Mus musculus
gtatctgcacccgacgggcggaaaa

SEQ ID NO: 676043 - DNA, 25 bp, Mus musculus
gtatctgcacccttttgttcttatt

SEQ ID NO: 676044 - DNA, 25 bp, Mus musculus
gtatctgcaccgatgtctgcaaaaa

SEQ ID NO: 676045 - DNA, 25 bp, Mus musculus
gtatctgcaccgttgtctgcaaaaa

SEQ ID NO: 676046 - DNA, 25 bp, Mus musculus
gtatctgcactacgtcttactgtgt

SEQ ID NO: 676047 - DNA, 25 bp, Mus musculus
gtatctgcactaggtcttactgtgt

SEQ ID NO: 676048 - DNA, 25 bp, Mus musculus
gtatctgcatacattttctatataa

SEQ ID NO: 676049 - DNA, 25 bp, Mus musculus
gtatctgcatactttttctatataa

SEQ ID NO: 676050 - DNA, 25 bp, Mus musculus
gtatctgcatagattcagggcccat

SEQ ID NO: 676051 - DNA, 25 bp, Mus musculus
gtatctgcatagtttcagggcccat

SEQ ID NO: 676052 - DNA, 25 bp, Mus musculus
gtatctgcatttatcacggccataa

SEQ ID NO: 676053 - DNA, 25 bp, Mus musculus
gtatctgcatttttcacggccataa

SEQ ID NO: 676054 - DNA, 25 bp, Mus musculus
gtatctgcgctcacatataagctat

SEQ ID NO: 676055 - DNA, 25 bp, Mus musculus
gtatctgcgctctcatataagctat

SEQ ID NO: 676056 - DNA, 25 bp, Mus musculus
gtatctgctctgaactgtggatgcc

SEQ ID NO: 676057 - DNA, 25 bp, Mus musculus
gtatctgctctgcaaaccatctaga

SEQ ID NO: 676058 - DNA, 25 bp, Mus musculus
gtatctgctctggaaaccatctaga

SEQ ID NO: 676059 - DNA, 25 bp, Mus musculus
gtatctgctctgtactgtggatgcc

SEQ ID NO: 676060 - DNA, 25 bp, Mus musculus
gtatctgctgtaaaagtccctgtgg

SEQ ID NO: 676061 - DNA, 25 bp, Mus musculus
gtatctgctgtataagtccctgtgg

SEQ ID NO: 676062 - DNA, 25 bp, Mus musculus
gtatctgcttacaccttgtttgcaa

SEQ ID NO: 676063 - DNA, 25 bp, Mus musculus
gtatctgcttactccttgtttgcaa

SEQ ID NO: 676064 - DNA, 25 bp, Mus musculus
gtatctgcttatatacaatctttga

SEQ ID NO: 676065 - DNA, 25 bp, Mus musculus
gtatctgcttatttacaatctttga

SEQ ID NO: 676066 - DNA, 25 bp, Mus musculus
gtatctgcttctaggccagtacgat

SEQ ID NO: 676067 - DNA, 25 bp, Mus musculus
gtatctgcttcttggccagtacgat

SEQ ID NO: 676068 - DNA, 25 bp, Mus musculus
gtatctgcttgtcatcttgccagaa

SEQ ID NO: 676069 - DNA, 25 bp, Mus musculus
gtatctgcttgtgatcttgccagaa

SEQ ID NO: 676070 - DNA, 25 bp, Mus musculus
gtatctgctttcattaaggcatcct

SEQ ID NO: 676071 - DNA, 25 bp, Mus musculus
gtatctgctttctttaaggcatcct

SEQ ID NO: 676072 - DNA, 25 bp, Mus musculus
gtatctggaaaccttcggatcctgg

SEQ ID NO: 676073 - DNA, 25 bp, Mus musculus
gtatctggaaacgttcggatcctgg

SEQ ID NO: 676074 - DNA, 25 bp, Mus musculus
gtatctggagttaagattctagacc

SEQ ID NO: 676075 - DNA, 25 bp, Mus musculus
gtatctggagtttagattctagacc

SEQ ID NO: 676076 - DNA, 25 bp, Mus musculus
gtatctggatttaacctctctgacg

SEQ ID NO: 676077 - DNA, 25 bp, Mus musculus
gtatctggatttattgctgcagcta

SEQ ID NO: 676078 - DNA, 25 bp, Mus musculus
gtatctggattttacctctctgacg

SEQ ID NO: 676079 - DNA, 25 bp, Mus musculus
gtatctggattttttgctgcagcta

SEQ ID NO: 676080 - DNA, 25 bp, Mus musculus
gtatctggcagcctaaactctgctt

SEQ ID NO: 676081 - DNA, 25 bp, Mus musculus
gtatctggcagcgtaaactctgctt

SEQ ID NO: 676082 - DNA, 25 bp, Mus musculus
gtatctggcttaaatctaaagactg

SEQ ID NO: 676083 - DNA, 25 bp, Mus musculus
gtatctggcttatatctaaagactg

SEQ ID NO: 676084 - DNA, 25 bp, Mus musculus
gtatctggcttgaatgtggaagact

SEQ ID NO: 676085 - DNA, 25 bp, Mus musculus
gtatctggcttgtatgtggaagact

SEQ ID NO: 676086 - DNA, 25 bp, Mus musculus
gtatctgggtttatcacgcttttat

SEQ ID NO: 676087 - DNA, 25 bp, Mus musculus
gtatctgggtttttcacgcttttat

SEQ ID NO: 676088 - DNA, 25 bp, Mus musculus
gtatctggtgacaagtcctgttcta

SEQ ID NO: 676089 - DNA, 25 bp, Mus musculus
gtatctggtgactagtcctgttcta

SEQ ID NO: 676090 - DNA, 25 bp, Mus musculus
gtatctggtgtcagctgaagaccat

SEQ ID NO: 676091 - DNA, 25 bp, Mus musculus
gtatctggtgtctgctgaagaccat

SEQ ID NO: 676092 - DNA, 25 bp, Mus musculus
gtatctgtaagaaccataagccgtt

SEQ ID NO: 676093 - DNA, 25 bp, Mus musculus
gtatctgtaagatccataagccgtt

SEQ ID NO: 676094 - DNA, 25 bp, Mus musculus
gtatctgtaattctgactgagccta

SEQ ID NO: 676095 - DNA, 25 bp, Mus musculus
gtatctgtaattgtgactgagccta

SEQ ID NO: 676096 - DNA, 25 bp, Mus musculus
gtatctgtagtcacttgatgctatg

SEQ ID NO: 676097 - DNA, 25 bp, Mus musculus
gtatctgtagtcatatctgccttca

SEQ ID NO: 676098 - DNA, 25 bp, Mus musculus
gtatctgtagtctcttgatgctatg

SEQ ID NO: 676099 - DNA, 25 bp, Mus musculus
gtatctgtagtcttatctgccttca

SEQ ID NO: 676100 - DNA, 25 bp, Mus musculus
gtatctgtagttccagcttagacaa

SEQ ID NO: 676101 - DNA, 25 bp, Mus musculus
gtatctgtagttgcagcttagacaa

SEQ ID NO: 676102 - DNA, 25 bp, Mus musculus
gtatctgtatttcttgactccttcc

SEQ ID NO: 676103 - DNA, 25 bp, Mus musculus
gtatctgtatttgttgactccttcc

SEQ ID NO: 676104 - DNA, 25 bp, Mus musculus
gtatctgtcactctggcaaactggt

SEQ ID NO: 676105 - DNA, 25 bp, Mus musculus
gtatctgtcactgtggcaaactggt

SEQ ID NO: 676106 - DNA, 25 bp, Mus musculus
gtatctgtccagatgtcatcctgtg

SEQ ID NO: 676107 - DNA, 25 bp, Mus musculus
gtatctgtccagttgtcatcctgtg

SEQ ID NO: 676108 - DNA, 25 bp, Mus musculus
gtatctgtcggtatgcaaaagtaat

SEQ ID NO: 676109 - DNA, 25 bp, Mus musculus
gtatctgtcggtttgcaaaagtaat

SEQ ID NO: 676110 - DNA, 25 bp, Mus musculus
gtatctgtctagacctatttttcat

SEQ ID NO: 676111 - DNA, 25 bp, Mus musculus
gtatctgtctagtcctatttttcat

SEQ ID NO: 676112 - DNA, 25 bp, Mus musculus
gtatctgtcttaacttttgcatgct

SEQ ID NO: 676113 - DNA, 25 bp, Mus musculus
gtatctgtcttatcttttgcatgct

SEQ ID NO: 676114 - DNA, 25 bp, Mus musculus
gtatctgtgaacagatttctccaag

SEQ ID NO: 676115 - DNA, 25 bp, Mus musculus
gtatctgtgaactgatttctccaag

SEQ ID NO: 676116 - DNA, 25 bp, Mus musculus
gtatctgtgaagactggatgcctga

SEQ ID NO: 676117 - DNA, 25 bp, Mus musculus
gtatctgtgaagtctggatgcctga

SEQ ID NO: 676118 - DNA, 25 bp, Mus musculus
gtatctgtgattaatgtttctttga

SEQ ID NO: 676119 - DNA, 25 bp, Mus musculus
gtatctgtgattacaaccaccatca

SEQ ID NO: 676120 - DNA, 25 bp, Mus musculus
gtatctgtgatttatgtttctttga

SEQ ID NO: 676121 - DNA, 25 bp, Mus musculus
gtatctgtgatttcaaccaccatca

SEQ ID NO: 676122 - DNA, 25 bp, Mus musculus
gtatctgtgtgtcgccaagccagtg

SEQ ID NO: 676123 - DNA, 25 bp, Mus musculus
gtatctgtgtgtcgcttaggagcct

SEQ ID NO: 676124 - DNA, 25 bp, Mus musculus
gtatctgtgtgtggccaagccagtg

SEQ ID NO: 676125 - DNA, 25 bp, Mus musculus
gtatctgtgtgtggcttaggagcct

SEQ ID NO: 676126 - DNA, 25 bp, Mus musculus
gtatctgttcatcctggttgacata

SEQ ID NO: 676127 - DNA, 25 bp, Mus musculus
gtatctgttcatgctggttgacata

SEQ ID NO: 676128 - DNA, 25 bp, Mus musculus
gtatctgttccaacatctggatcat

SEQ ID NO: 676129 - DNA, 25 bp, Mus musculus
gtatctgttccatcatctggatcat

SEQ ID NO: 676130 - DNA, 25 bp, Mus musculus
gtatctgttctcataatgtatttat

SEQ ID NO: 676131 - DNA, 25 bp, Mus musculus
gtatctgttctcttaatgtatttat

SEQ ID NO: 676132 - DNA, 25 bp, Mus musculus
gtatctgttctgagttctcaatgga

SEQ ID NO: 676133 - DNA, 25 bp, Mus musculus
gtatctgttctgtgttctcaatgga

SEQ ID NO: 676134 - DNA, 25 bp, Mus musculus
gtatctgttgcaaaacatagcctag

SEQ ID NO: 676135 - DNA, 25 bp, Mus musculus
gtatctgttgcataacatagcctag

SEQ ID NO: 676136 - DNA, 25 bp, Mus musculus
gtatctgtttgtcccggtgtatagt

SEQ ID NO: 676137 - DNA, 25 bp, Mus musculus
gtatctgtttgtgccggtgtatagt

SEQ ID NO: 676138 - DNA, 25 bp, Mus musculus
gtatcttaaatcaaatgtgtgcctg

SEQ ID NO: 676139 - DNA, 25 bp, Mus musculus
gtatcttaaatctaatgtgtgcctg

SEQ ID NO: 676140 - DNA, 25 bp, Mus musculus
gtatcttaactcaaggcactgggct

SEQ ID NO: 676141 - DNA, 25 bp, Mus musculus
gtatcttaactctaggcactgggct

SEQ ID NO: 676142 - DNA, 25 bp, Mus musculus
gtatcttaacttctgagtgcaccag

SEQ ID NO: 676143 - DNA, 25 bp, Mus musculus
gtatcttaacttgtgagtgcaccag

SEQ ID NO: 676144 - DNA, 25 bp, Mus musculus
gtatcttacagaagtcctcagcaca

SEQ ID NO: 676145 - DNA, 25 bp, Mus musculus
gtatcttacagatgtcctcagcaca

SEQ ID NO: 676146 - DNA, 25 bp, Mus musculus
gtatcttacagcattgtaccccatt

SEQ ID NO: 676147 - DNA, 25 bp, Mus musculus
gtatcttacagctttgtaccccatt

SEQ ID NO: 676148 - DNA, 25 bp, Mus musculus
gtatcttacattactgccacagaaa

SEQ ID NO: 676149 - DNA, 25 bp, Mus musculus
gtatcttacatttctgccacagaaa

SEQ ID NO: 676150 - DNA, 25 bp, Mus musculus
gtatcttaccaacaccagctaattt

SEQ ID NO: 676151 - DNA, 25 bp, Mus musculus
gtatcttaccaagaccagctaattt

SEQ ID NO: 676152 - DNA, 25 bp, Mus musculus
gtatcttagggcaagactgcagact

SEQ ID NO: 676153 - DNA, 25 bp, Mus musculus
gtatcttagggctagactgcagact

SEQ ID NO: 676154 - DNA, 25 bp, Mus musculus
gtatcttaggtaccatagtcccttc

SEQ ID NO: 676155 - DNA, 25 bp, Mus musculus
gtatcttaggtagcatagtcccttc

SEQ ID NO: 676156 - DNA, 25 bp, Mus musculus
gtatcttataagacatcccctgagt

SEQ ID NO: 676157 - DNA, 25 bp, Mus musculus
gtatcttataagtcatcccctgagt

SEQ ID NO: 676158 - DNA, 25 bp, Mus musculus
gtatcttatagtccagagccttcgt

SEQ ID NO: 676159 - DNA, 25 bp, Mus musculus
gtatcttatagtgcagagccttcgt

SEQ ID NO: 676160 - DNA, 25 bp, Mus musculus
gtatcttatgccaactcgtgtgtca

SEQ ID NO: 676161 - DNA, 25 bp, Mus musculus
gtatcttatgcctactcgtgtgtca

SEQ ID NO: 676162 - DNA, 25 bp, Mus musculus
gtatcttcaacaagatttctctgtc

SEQ ID NO: 676163 - DNA, 25 bp, Mus musculus
gtatcttcaacatgatttctctgtc

SEQ ID NO: 676164 - DNA, 25 bp, Mus musculus
gtatcttcaatgatagcctgtcatt

SEQ ID NO: 676165 - DNA, 25 bp, Mus musculus
gtatcttcaatgttagcctgtcatt

SEQ ID NO: 676166 - DNA, 25 bp, Mus musculus
gtatcttcagcaccagaacctttcg

SEQ ID NO: 676167 - DNA, 25 bp, Mus musculus
gtatcttcagcagcagaacctttcg

SEQ ID NO: 676168 - DNA, 25 bp, Mus musculus
gtatcttcagcccaggagtgactga

SEQ ID NO: 676169 - DNA, 25 bp, Mus musculus
gtatcttcagccgaggagtgactga

SEQ ID NO: 676170 - DNA, 25 bp, Mus musculus
gtatcttcaggaaccctagactctt

SEQ ID NO: 676171 - DNA, 25 bp, Mus musculus
gtatcttcaggatccctagactctt

SEQ ID NO: 676172 - DNA, 25 bp, Mus musculus
gtatcttcagtcaagacaactcttg

SEQ ID NO: 676173 - DNA, 25 bp, Mus musculus
gtatcttcagtctagacaactcttg

SEQ ID NO: 676174 - DNA, 25 bp, Mus musculus
gtatcttcatacattcgaccagatt

SEQ ID NO: 676175 - DNA, 25 bp, Mus musculus
gtatcttcatactttcgaccagatt

SEQ ID NO: 676176 - DNA, 25 bp, Mus musculus
gtatcttcatgcatgtgaatcatct

SEQ ID NO: 676177 - DNA, 25 bp, Mus musculus
gtatcttcatgcttgtgaatcatct

SEQ ID NO: 676178 - DNA, 25 bp, Mus musculus
gtatcttcccagaacatttcagaaa

SEQ ID NO: 676179 - DNA, 25 bp, Mus musculus
gtatcttcccagtacatttcagaaa

SEQ ID NO: 676180 - DNA, 25 bp, Mus musculus
gtatcttccgaaaccatttggtgca

SEQ ID NO: 676181 - DNA, 25 bp, Mus musculus
gtatcttccgaatccatttggtgca

SEQ ID NO: 676182 - DNA, 25 bp, Mus musculus
gtatcttccgataccctggatggaa

SEQ ID NO: 676183 - DNA, 25 bp, Mus musculus
gtatcttccgattccctggatggaa

SEQ ID NO: 676184 - DNA, 25 bp, Mus musculus
gtatcttccggaactctttgtacat

SEQ ID NO: 676185 - DNA, 25 bp, Mus musculus
gtatcttccggatctctttgtacat

SEQ ID NO: 676186 - DNA, 25 bp, Mus musculus
gtatcttcctccaggtatctgtcat

SEQ ID NO: 676187 - DNA, 25 bp, Mus musculus
gtatcttcctcctggtatctgtcat

SEQ ID NO: 676188 - DNA, 25 bp, Mus musculus
gtatcttcctgaataacattaagca

SEQ ID NO: 676189 - DNA, 25 bp, Mus musculus
gtatcttcctgattaacattaagca

SEQ ID NO: 676190 - DNA, 25 bp, Mus musculus
gtatcttccttacagtctggcctga

SEQ ID NO: 676191 - DNA, 25 bp, Mus musculus
gtatcttccttagagtctggcctga

SEQ ID NO: 676192 - DNA, 25 bp, Mus musculus
gtatcttctataaccttacagctcc

SEQ ID NO: 676193 - DNA, 25 bp, Mus musculus
gtatcttctatatccttacagctcc

SEQ ID NO: 676194 - DNA, 25 bp, Mus musculus
gtatcttctcacaactttgcaaatc

SEQ ID NO: 676195 - DNA, 25 bp, Mus musculus
gtatcttctcactactttgcaaatc

SEQ ID NO: 676196 - DNA, 25 bp, Mus musculus
gtatcttctcctctgctttcagata

SEQ ID NO: 676197 - DNA, 25 bp, Mus musculus
gtatcttctcctgtgctttcagata

SEQ ID NO: 676198 - DNA, 25 bp, Mus musculus
gtatcttctgaacgtgtccacactg

SEQ ID NO: 676199 - DNA, 25 bp, Mus musculus
gtatcttctgaaggtgtccacactg

SEQ ID NO: 676200 - DNA, 25 bp, Mus musculus
gtatcttctgagctgttcaggacct

SEQ ID NO: 676201 - DNA, 25 bp, Mus musculus
gtatcttctgaggtgttcaggacct

SEQ ID NO: 676202 - DNA, 25 bp, Mus musculus
gtatcttctgtaacccataaacagg

SEQ ID NO: 676203 - DNA, 25 bp, Mus musculus
gtatcttctgtatcccataaacagg

SEQ ID NO: 676204 - DNA, 25 bp, Mus musculus
gtatcttgactgatgtctgtcttgt

SEQ ID NO: 676205 - DNA, 25 bp, Mus musculus
gtatcttgactgttgtctgtcttgt

SEQ ID NO: 676206 - DNA, 25 bp, Mus musculus
gtatcttgatgcatgatgcactgtg

SEQ ID NO: 676207 - DNA, 25 bp, Mus musculus
gtatcttgatgcttgatgcactgtg

SEQ ID NO: 676208 - DNA, 25 bp, Mus musculus
gtatcttgcaggacaaggctacact

SEQ ID NO: 676209 - DNA, 25 bp, Mus musculus
gtatcttgcaggtcaaggctacact

SEQ ID NO: 676210 - DNA, 25 bp, Mus musculus
gtatcttgccaaacaaaccatgatt

SEQ ID NO: 676211 - DNA, 25 bp, Mus musculus
gtatcttgccaatcaaaccatgatt

SEQ ID NO: 676212 - DNA, 25 bp, Mus musculus
gtatcttgctgtacaatgcctgtga

SEQ ID NO: 676213 - DNA, 25 bp, Mus musculus
gtatcttgctgttcaatgcctgtga

SEQ ID NO: 676214 - DNA, 25 bp, Mus musculus
gtatcttggcacctgaggacaaagt

SEQ ID NO: 676215 - DNA, 25 bp, Mus musculus
gtatcttggcacgtgaggacaaagt

SEQ ID NO: 676216 - DNA, 25 bp, Mus musculus
gtatcttgggttatcccatgaccat

SEQ ID NO: 676217 - DNA, 25 bp, Mus musculus
gtatcttgggttttcccatgaccat

SEQ ID NO: 676218 - DNA, 25 bp, Mus musculus
gtatcttggtatctcggtactcttt

SEQ ID NO: 676219 - DNA, 25 bp, Mus musculus
gtatcttggtatgtcggtactcttt

SEQ ID NO: 676220 - DNA, 25 bp, Mus musculus
gtatcttgtacaaacctttttccaa

SEQ ID NO: 676221 - DNA, 25 bp, Mus musculus
gtatcttgtacatacctttttccaa

SEQ ID NO: 676222 - DNA, 25 bp, Mus musculus
gtatcttgtgaactcatcgatctgc

SEQ ID NO: 676223 - DNA, 25 bp, Mus musculus
gtatcttgtgaagtcatcgatctgc

SEQ ID NO: 676224 - DNA, 25 bp, Mus musculus
gtatcttgttctatgtatgggactg

SEQ ID NO: 676225 - DNA, 25 bp, Mus musculus
gtatcttgttctttgtatgggactg

SEQ ID NO: 676226 - DNA, 25 bp, Mus musculus
gtatctttacatacgatgtgtgtca

SEQ ID NO: 676227 - DNA, 25 bp, Mus musculus
gtatctttacattcgatgtgtgtca

SEQ ID NO: 676228 - DNA, 25 bp, Mus musculus
gtatctttagttacattcagatttg

SEQ ID NO: 676229 - DNA, 25 bp, Mus musculus
gtatctttagtttcattcagatttg

SEQ ID NO: 676230 - DNA, 25 bp, Mus musculus
gtatctttatagcatcagccacttg

SEQ ID NO: 676231 - DNA, 25 bp, Mus musculus
gtatctttataggatcagccacttg

SEQ ID NO: 676232 - DNA, 25 bp, Mus musculus
gtatctttcacccatatcactgatg

SEQ ID NO: 676233 - DNA, 25 bp, Mus musculus
gtatctttcaccgatatcactgatg

SEQ ID NO: 676234 - DNA, 25 bp, Mus musculus
gtatctttcaggaaggagcacacaa

SEQ ID NO: 676235 - DNA, 25 bp, Mus musculus
gtatctttcaggtaggagcacacaa

SEQ ID NO: 676236 - DNA, 25 bp, Mus musculus
gtatctttcagtaatctcctgcttg

SEQ ID NO: 676237 - DNA, 25 bp, Mus musculus
gtatctttcagttatctcctgcttg

SEQ ID NO: 676238 - DNA, 25 bp, Mus musculus
gtatctttctatcaactcatgtctc

SEQ ID NO: 676239 - DNA, 25 bp, Mus musculus
gtatctttctatgaactcatgtctc

SEQ ID NO: 676240 - DNA, 25 bp, Mus musculus
gtatctttctctaggcctgggactt

SEQ ID NO: 676241 - DNA, 25 bp, Mus musculus
gtatctttctcttggcctgggactt

SEQ ID NO: 676242 - DNA, 25 bp, Mus musculus
gtatctttcttccagacatgctgaa

SEQ ID NO: 676243 - DNA, 25 bp, Mus musculus
gtatctttcttcgagacatgctgaa

SEQ ID NO: 676244 - DNA, 25 bp, Mus musculus
gtatctttgaatctgcaagtatgta

SEQ ID NO: 676245 - DNA, 25 bp, Mus musculus
gtatctttgaatgtgcaagtatgta

SEQ ID NO: 676246 - DNA, 25 bp, Mus musculus
gtatctttgattatatccatccctg

SEQ ID NO: 676247 - DNA, 25 bp, Mus musculus
gtatctttgattttatccatccctg

SEQ ID NO: 676248 - DNA, 25 bp, Mus musculus
gtatctttggatattgatcagtgtt

SEQ ID NO: 676249 - DNA, 25 bp, Mus musculus
gtatctttggattttgatcagtgtt

SEQ ID NO: 676250 - DNA, 25 bp, Mus musculus
gtatctttgtatctatctctgtatc

SEQ ID NO: 676251 - DNA, 25 bp, Mus musculus
gtatctttgtatgtatctctgtatc

SEQ ID NO: 676252 - DNA, 25 bp, Mus musculus
gtatctttgtgcaagcagctcccgg

SEQ ID NO: 676253 - DNA, 25 bp, Mus musculus
gtatctttgtgctagcagctcccgg

SEQ ID NO: 676254 - DNA, 25 bp, Mus musculus
gtatctttgtttatgatctgcttgt

SEQ ID NO: 676255 - DNA, 25 bp, Mus musculus
gtatctttgtttttgatctgcttgt

SEQ ID NO: 676256 - DNA, 25 bp, Mus musculus
gtatcttttagtagctatatgaagc

SEQ ID NO: 676257 - DNA, 25 bp, Mus musculus
gtatcttttagttgctatatgaagc

SEQ ID NO: 676258 - DNA, 25 bp, Mus musculus
gtatcttttcaactgcaggttgtgc

SEQ ID NO: 676259 - DNA, 25 bp, Mus musculus
gtatcttttcaagtgcaggttgtgc

SEQ ID NO: 676260 - DNA, 25 bp, Mus musculus
gtatcttttgacaggccagattctc

SEQ ID NO: 676261 - DNA, 25 bp, Mus musculus
gtatcttttgactggccagattctc

SEQ ID NO: 676262 - DNA, 25 bp, Mus musculus
gtatcttttgcaagtagcttcctta

SEQ ID NO: 676263 - DNA, 25 bp, Mus musculus
gtatcttttgcatgtagcttcctta

SEQ ID NO: 676264 - DNA, 25 bp, Mus musculus
gtatcttttgctacatctgtcttta

SEQ ID NO: 676265 - DNA, 25 bp, Mus musculus
gtatcttttgcttcatctgtcttta

SEQ ID NO: 676266 - DNA, 25 bp, Mus musculus
gtatcttttgggatcaccacagcga

SEQ ID NO: 676267 - DNA, 25 bp, Mus musculus
gtatcttttgggttcaccacagcga

SEQ ID NO: 676268 - DNA, 25 bp, Mus musculus
gtatcttttggtatcgtcatgccag

SEQ ID NO: 676269 - DNA, 25 bp, Mus musculus
gtatcttttggtttcgtcatgccag

SEQ ID NO: 676270 - DNA, 25 bp, Mus musculus
gtatcttttgtcattgaggttcctg

SEQ ID NO: 676271 - DNA, 25 bp, Mus musculus
gtatcttttgtctttgaggttcctg

SEQ ID NO: 676272 - DNA, 25 bp, Mus musculus
gtatctttttgcacccctaatatga

SEQ ID NO: 676273 - DNA, 25 bp, Mus musculus
gtatctttttgctcccctaatatga

SEQ ID NO: 676274 - DNA, 25 bp, Mus musculus
gtatgaaacaaaatcaccctgcttt

SEQ ID NO: 676275 - DNA, 25 bp, Mus musculus
gtatgaaacaaattcaccctgcttt

SEQ ID NO: 676276 - DNA, 25 bp, Mus musculus
gtatgaaatgcaaaaagcccatcac

SEQ ID NO: 676277 - DNA, 25 bp, Mus musculus
gtatgaaatgcataaagcccatcac

SEQ ID NO: 676278 - DNA, 25 bp, Mus musculus
gtatgaaatgttcgcccagacactg

SEQ ID NO: 676279 - DNA, 25 bp, Mus musculus
gtatgaaatgttggcccagacactg

SEQ ID NO: 676280 - DNA, 25 bp, Mus musculus
gtatgaaattctcagcccttgattt

SEQ ID NO: 676281 - DNA, 25 bp, Mus musculus
gtatgaaattctgagcccttgattt

SEQ ID NO: 676282 - DNA, 25 bp, Mus musculus
gtatgaacaaacacctacaccatgc

SEQ ID NO: 676283 - DNA, 25 bp, Mus musculus
gtatgaacaaactcctacaccatgc

SEQ ID NO: 676284 - DNA, 25 bp, Mus musculus
gtatgaacacaccttcatagttgct

SEQ ID NO: 676285 - DNA, 25 bp, Mus musculus
gtatgaacacacgttcatagttgct

SEQ ID NO: 676286 - DNA, 25 bp, Mus musculus
gtatgaacagctctgcgaccggcag

SEQ ID NO: 676287 - DNA, 25 bp, Mus musculus
gtatgaacagctgtgcgaccggcag

SEQ ID NO: 676288 - DNA, 25 bp, Mus musculus
gtatgaacgtttactttgagctaat

SEQ ID NO: 676289 - DNA, 25 bp, Mus musculus
gtatgaacgttttctttgagctaat

SEQ ID NO: 676290 - DNA, 25 bp, Mus musculus
gtatgaagacatccaccgggacctg

SEQ ID NO: 676291 - DNA, 25 bp, Mus musculus
gtatgaagacatgcaccgggacctg

SEQ ID NO: 676292 - DNA, 25 bp, Mus musculus
gtatgaagacttaagtttgcaccca

SEQ ID NO: 676293 - DNA, 25 bp, Mus musculus
gtatgaagactttagtttgcaccca

SEQ ID NO: 676294 - DNA, 25 bp, Mus musculus
gtatgaagatggacggcgcaagcct

SEQ ID NO: 676295 - DNA, 25 bp, Mus musculus
gtatgaagatggtcggcgcaagcct

SEQ ID NO: 676296 - DNA, 25 bp, Mus musculus
gtatgaagccctagcagagctcgat

SEQ ID NO: 676297 - DNA, 25 bp, Mus musculus
gtatgaagcccttgcagagctcgat

SEQ ID NO: 676298 - DNA, 25 bp, Mus musculus
gtatgaagccgacctcatcatcatg

SEQ ID NO: 676299 - DNA, 25 bp, Mus musculus
gtatgaagccgagctcatcatcatg

SEQ ID NO: 676300 - DNA, 25 bp, Mus musculus
gtatgaagcgcgatgcacatccgta

SEQ ID NO: 676301 - DNA, 25 bp, Mus musculus
gtatgaagcgcgttgcacatccgta

SEQ ID NO: 676302 - DNA, 25 bp, Mus musculus
gtatgaagctttcccagatggctgt

SEQ ID NO: 676303 - DNA, 25 bp, Mus musculus
gtatgaagctttgccagatggctgt

SEQ ID NO: 676304 - DNA, 25 bp, Mus musculus
gtatgaaggatcacactgtgtctgg

SEQ ID NO: 676305 - DNA, 25 bp, Mus musculus
gtatgaaggatctcactgtgtctgg

SEQ ID NO: 676306 - DNA, 25 bp, Mus musculus
gtatgaaggctccttttgcacattc

SEQ ID NO: 676307 - DNA, 25 bp, Mus musculus
gtatgaaggctcgttttgcacattc

SEQ ID NO: 676308 - DNA, 25 bp, Mus musculus
gtatgaaggtgcctatcacgtcctc

SEQ ID NO: 676309 - DNA, 25 bp, Mus musculus
gtatgaaggtgcgtatcacgtcctc

SEQ ID NO: 676310 - DNA, 25 bp, Mus musculus
gtatgaaggtttcctggccgtcgcc

SEQ ID NO: 676311 - DNA, 25 bp, Mus musculus
gtatgaaggtttgctggccgtcgcc

SEQ ID NO: 676312 - DNA, 25 bp, Mus musculus
gtatgaagtggaagctaccattctt

SEQ ID NO: 676313 - DNA, 25 bp, Mus musculus
gtatgaagtggatgctaccattctt

SEQ ID NO: 676314 - DNA, 25 bp, Mus musculus
gtatgaatacgcctgctatgcttcc

SEQ ID NO: 676315 - DNA, 25 bp, Mus musculus
gtatgaatacgcgtgctatgcttcc

SEQ ID NO: 676316 - DNA, 25 bp, Mus musculus
gtatgaatagtcctaagcctagatt

SEQ ID NO: 676317 - DNA, 25 bp, Mus musculus
gtatgaatagtcgtaagcctagatt

SEQ ID NO: 676318 - DNA, 25 bp, Mus musculus
gtatgaatatgaccacctgaaccaa

SEQ ID NO: 676319 - DNA, 25 bp, Mus musculus
gtatgaatatgagcacctgaaccaa

SEQ ID NO: 676320 - DNA, 25 bp, Mus musculus
gtatgaatattaaccttgatgcttt

SEQ ID NO: 676321 - DNA, 25 bp, Mus musculus
gtatgaatattatccttgatgcttt

SEQ ID NO: 676322 - DNA, 25 bp, Mus musculus
gtatgaatcagactgtgccatgact

SEQ ID NO: 676323 - DNA, 25 bp, Mus musculus
gtatgaatcagagtgtgccatgact

SEQ ID NO: 676324 - DNA, 25 bp, Mus musculus
gtatgaatcctaatttgtgagaaca

SEQ ID NO: 676325 - DNA, 25 bp, Mus musculus
gtatgaatcctattttgtgagaaca

SEQ ID NO: 676326 - DNA, 25 bp, Mus musculus
gtatgaatggttagtactgtatata

SEQ ID NO: 676327 - DNA, 25 bp, Mus musculus
gtatgaatggtttgtactgtatata

SEQ ID NO: 676328 - DNA, 25 bp, Mus musculus
gtatgaatgtaaacttgatgctcta

SEQ ID NO: 676329 - DNA, 25 bp, Mus musculus
gtatgaatgtaatcttgatgctcta

SEQ ID NO: 676330 - DNA, 25 bp, Mus musculus
gtatgaatgtctaacccacggtgag

SEQ ID NO: 676331 - DNA, 25 bp, Mus musculus
gtatgaatgtcttacccacggtgag

SEQ ID NO: 676332 - DNA, 25 bp, Mus musculus
gtatgaattctacaaccctataata

SEQ ID NO: 676333 - DNA, 25 bp, Mus musculus
gtatgaattctagaaccctataata

SEQ ID NO: 676334 - DNA, 25 bp, Mus musculus
gtatgaattcttctgcccacacatg

SEQ ID NO: 676335 - DNA, 25 bp, Mus musculus
gtatgaattcttgtgcccacacatg

SEQ ID NO: 676336 - DNA, 25 bp, Mus musculus
gtatgaattgccatttgaccgccat

SEQ ID NO: 676337 - DNA, 25 bp, Mus musculus
gtatgaattgccttttgaccgccat

SEQ ID NO: 676338 - DNA, 25 bp, Mus musculus
gtatgaatttgaatagctcccacta

SEQ ID NO: 676339 - DNA, 25 bp, Mus musculus
gtatgaatttgattagctcccacta

SEQ ID NO: 676340 - DNA, 25 bp, Mus musculus
gtatgacaacatctccaccatggtg

SEQ ID NO: 676341 - DNA, 25 bp, Mus musculus
gtatgacaacatgtccaccatggtg

SEQ ID NO: 676342 - DNA, 25 bp, Mus musculus
gtatgacaacccacctgaaggctca

SEQ ID NO: 676343 - DNA, 25 bp, Mus musculus
gtatgacaaccctcctgaaggctca

SEQ ID NO: 676344 - DNA, 25 bp, Mus musculus
gtatgacaagctctatcactgcctt

SEQ ID NO: 676345 - DNA, 25 bp, Mus musculus
gtatgacaagctgtatcactgcctt

SEQ ID NO: 676346 - DNA, 25 bp, Mus musculus
gtatgacacgctcttgctaaagatg

SEQ ID NO: 676347 - DNA, 25 bp, Mus musculus
gtatgacacgctgttgctaaagatg

SEQ ID NO: 676348 - DNA, 25 bp, Mus musculus
gtatgacactagaactcctttagga

SEQ ID NO: 676349 - DNA, 25 bp, Mus musculus
gtatgacactagtactcctttagga

SEQ ID NO: 676350 - DNA, 25 bp, Mus musculus
gtatgacatgcgagtatcaccttct

SEQ ID NO: 676351 - DNA, 25 bp, Mus musculus
gtatgacatgcgtgtatcaccttct

SEQ ID NO: 676352 - DNA, 25 bp, Mus musculus
gtatgacatgggatagcacaccact

SEQ ID NO: 676353 - DNA, 25 bp, Mus musculus
gtatgacatgggttagcacaccact

SEQ ID NO: 676354 - DNA, 25 bp, Mus musculus
gtatgaccaggtccaaaggagacat

SEQ ID NO: 676355 - DNA, 25 bp, Mus musculus
gtatgaccaggtgcaaaggagacat

SEQ ID NO: 676356 - DNA, 25 bp, Mus musculus
gtatgaccagttaacctgcccagat

SEQ ID NO: 676357 - DNA, 25 bp, Mus musculus
gtatgaccagtttacctgcccagat

SEQ ID NO: 676358 - DNA, 25 bp, Mus musculus
gtatgacccaagcttgtccgtgatc

SEQ ID NO: 676359 - DNA, 25 bp, Mus musculus
gtatgacccaaggttgtccgtgatc

SEQ ID NO: 676360 - DNA, 25 bp, Mus musculus
gtatgaccgatgaccacacgtgtaa

SEQ ID NO: 676361 - DNA, 25 bp, Mus musculus
gtatgaccgatgtccacacgtgtaa

SEQ ID NO: 676362 - DNA, 25 bp, Mus musculus
gtatgaccggctagctggaaatgtt

SEQ ID NO: 676363 - DNA, 25 bp, Mus musculus
gtatgaccggcttgctggaaatgtt

SEQ ID NO: 676364 - DNA, 25 bp, Mus musculus
gtatgacctctgcaaaagggttgtt

SEQ ID NO: 676365 - DNA, 25 bp, Mus musculus
gtatgacctctggaaaagggttgtt

SEQ ID NO: 676366 - DNA, 25 bp, Mus musculus
gtatgacctgccattatgacctgta

SEQ ID NO: 676367 - DNA, 25 bp, Mus musculus
gtatgacctgcctttatgacctgta

SEQ ID NO: 676368 - DNA, 25 bp, Mus musculus
gtatgacctgtgagtcccgaaaaga

SEQ ID NO: 676369 - DNA, 25 bp, Mus musculus
gtatgacctgtgtgtcccgaaaaga

SEQ ID NO: 676370 - DNA, 25 bp, Mus musculus
gtatgacgaggtccggaagctcatt

SEQ ID NO: 676371 - DNA, 25 bp, Mus musculus
gtatgacgaggtgcggaagctcatt

SEQ ID NO: 676372 - DNA, 25 bp, Mus musculus
gtatgacgttatcaaggttgaccag

SEQ ID NO: 676373 - DNA, 25 bp, Mus musculus
gtatgacgttatgaaggttgaccag

SEQ ID NO: 676374 - DNA, 25 bp, Mus musculus
gtatgactacatatcaacataaatg

SEQ ID NO: 676375 - DNA, 25 bp, Mus musculus
gtatgactacatcaaaactctgctg

SEQ ID NO: 676376 - DNA, 25 bp, Mus musculus
gtatgactacatgaaaactctgctg

SEQ ID NO: 676377 - DNA, 25 bp, Mus musculus
gtatgactacatttcaacataaatg

SEQ ID NO: 676378 - DNA, 25 bp, Mus musculus
gtatgactatccatctatatccctg

SEQ ID NO: 676379 - DNA, 25 bp, Mus musculus
gtatgactatccttctatatccctg

SEQ ID NO: 676380 - DNA, 25 bp, Mus musculus
gtatgactatgtagacaggtccagt

SEQ ID NO: 676381 - DNA, 25 bp, Mus musculus
gtatgactatgttgacaggtccagt

SEQ ID NO: 676382 - DNA, 25 bp, Mus musculus
gtatgactcacacttctatatttgc

SEQ ID NO: 676383 - DNA, 25 bp, Mus musculus
gtatgactcacagttctatatttgc

SEQ ID NO: 676384 - DNA, 25 bp, Mus musculus
gtatgactcatcagatctggagctg

SEQ ID NO: 676385 - DNA, 25 bp, Mus musculus
gtatgactcatctgatctggagctg

SEQ ID NO: 676386 - DNA, 25 bp, Mus musculus
gtatgactccatcaagaactcgggc

SEQ ID NO: 676387 - DNA, 25 bp, Mus musculus
gtatgactccatgaagaactcgggc

SEQ ID NO: 676388 - DNA, 25 bp, Mus musculus
gtatgactctacaactcagtggaaa

SEQ ID NO: 676389 - DNA, 25 bp, Mus musculus
gtatgactctactactcagtggaaa

SEQ ID NO: 676390 - DNA, 25 bp, Mus musculus
gtatgactcttgatgacggtcttaa

SEQ ID NO: 676391 - DNA, 25 bp, Mus musculus
gtatgactcttgttgacggtcttaa

SEQ ID NO: 676392 - DNA, 25 bp, Mus musculus
gtatgactgattccaaatgctccaa

SEQ ID NO: 676393 - DNA, 25 bp, Mus musculus
gtatgactgattgcaaatgctccaa

SEQ ID NO: 676394 - DNA, 25 bp, Mus musculus
gtatgactgcacctggaacaccacc

SEQ ID NO: 676395 - DNA, 25 bp, Mus musculus
gtatgactgcacgtggaacaccacc

SEQ ID NO: 676396 - DNA, 25 bp, Mus musculus
gtatgactgcttacctcaagagaca

SEQ ID NO: 676397 - DNA, 25 bp, Mus musculus
gtatgactgctttcctcaagagaca

SEQ ID NO: 676398 - DNA, 25 bp, Mus musculus
gtatgactgggcaccatgtctgagc

SEQ ID NO: 676399 - DNA, 25 bp, Mus musculus
gtatgactgggctccatgtctgagc

SEQ ID NO: 676400 - DNA, 25 bp, Mus musculus
gtatgactgtagagccctacctgga

SEQ ID NO: 676401 - DNA, 25 bp, Mus musculus
gtatgactgtagtgccctacctgga

SEQ ID NO: 676402 - DNA, 25 bp, Mus musculus
gtatgactgtcacttctagactaga

SEQ ID NO: 676403 - DNA, 25 bp, Mus musculus
gtatgactgtcagttctagactaga

SEQ ID NO: 676404 - DNA, 25 bp, Mus musculus
gtatgacttaatcacggagctcaat

SEQ ID NO: 676405 - DNA, 25 bp, Mus musculus
gtatgacttaatgacggagctcaat

SEQ ID NO: 676406 - DNA, 25 bp, Mus musculus
gtatgacttactctcttcccttgta

SEQ ID NO: 676407 - DNA, 25 bp, Mus musculus
gtatgacttactgtcttcccttgta

SEQ ID NO: 676408 - DNA, 25 bp, Mus musculus
gtatgacttcagataaaatgctatt

SEQ ID NO: 676409 - DNA, 25 bp, Mus musculus
gtatgacttcagttaaaatgctatt

SEQ ID NO: 676410 - DNA, 25 bp, Mus musculus
gtatgacttgagcatctcctgacaa

SEQ ID NO: 676411 - DNA, 25 bp, Mus musculus
gtatgacttgaggatctcctgacaa

SEQ ID NO: 676412 - DNA, 25 bp, Mus musculus
gtatgacttggaagaagggccaata

SEQ ID NO: 676413 - DNA, 25 bp, Mus musculus
gtatgacttggatgaagggccaata

SEQ ID NO: 676414 - DNA, 25 bp, Mus musculus
gtatgacttgttacctatccgtcta

SEQ ID NO: 676415 - DNA, 25 bp, Mus musculus
gtatgacttgtttcctatccgtcta

SEQ ID NO: 676416 - DNA, 25 bp, Mus musculus
gtatgactttagcattttctctttc

SEQ ID NO: 676417 - DNA, 25 bp, Mus musculus
gtatgactttaggattttctctttc

SEQ ID NO: 676418 - DNA, 25 bp, Mus musculus
gtatgactttatagtcactgcctca

SEQ ID NO: 676419 - DNA, 25 bp, Mus musculus
gtatgactttattgtcactgcctca

SEQ ID NO: 676420 - DNA, 25 bp, Mus musculus
gtatgactttcactcttgcttcttt

SEQ ID NO: 676421 - DNA, 25 bp, Mus musculus
gtatgactttcagtcttgcttcttt

SEQ ID NO: 676422 - DNA, 25 bp, Mus musculus
gtatgagaacaacgatgcgcatgtg

SEQ ID NO: 676423 - DNA, 25 bp, Mus musculus
gtatgagaacaaggatgcgcatgtg

SEQ ID NO: 676424 - DNA, 25 bp, Mus musculus
gtatgagaactcatggcctattggg

SEQ ID NO: 676425 - DNA, 25 bp, Mus musculus
gtatgagaactcttggcctattggg

SEQ ID NO: 676426 - DNA, 25 bp, Mus musculus
gtatgagacactataattgacaata

SEQ ID NO: 676427 - DNA, 25 bp, Mus musculus
gtatgagacactttaattgacaata

SEQ ID NO: 676428 - DNA, 25 bp, Mus musculus
gtatgagacattctagctcctctct

SEQ ID NO: 676429 - DNA, 25 bp, Mus musculus
gtatgagacattgtagctcctctct

SEQ ID NO: 676430 - DNA, 25 bp, Mus musculus
gtatgagaccatcgcaagaaagcat

SEQ ID NO: 676431 - DNA, 25 bp, Mus musculus
gtatgagaccatggcaagaaagcat

SEQ ID NO: 676432 - DNA, 25 bp, Mus musculus
gtatgagactacaatcttccggaat

SEQ ID NO: 676433 - DNA, 25 bp, Mus musculus
gtatgagactactatcttccggaat

SEQ ID NO: 676434 - DNA, 25 bp, Mus musculus
gtatgagactctcctctggcatgtc

SEQ ID NO: 676435 - DNA, 25 bp, Mus musculus
gtatgagactctgctctggcatgtc

SEQ ID NO: 676436 - DNA, 25 bp, Mus musculus
gtatgagatcagacttactttttta

SEQ ID NO: 676437 - DNA, 25 bp, Mus musculus
gtatgagatcagtcttactttttta

SEQ ID NO: 676438 - DNA, 25 bp, Mus musculus
gtatgagatgctctacgggctgcct

SEQ ID NO: 676439 - DNA, 25 bp, Mus musculus
gtatgagatgctgtacgggctgcct

SEQ ID NO: 676440 - DNA, 25 bp, Mus musculus
gtatgagcacatctaactggcagac

SEQ ID NO: 676441 - DNA, 25 bp, Mus musculus
gtatgagcacatgtaactggcagac

SEQ ID NO: 676442 - DNA, 25 bp, Mus musculus
gtatgagcaccgaaccagctgtctg

SEQ ID NO: 676443 - DNA, 25 bp, Mus musculus
gtatgagcaccgtaccagctgtctg

SEQ ID NO: 676444 - DNA, 25 bp, Mus musculus
gtatgagcagaacccagccgacctc

SEQ ID NO: 676445 - DNA, 25 bp, Mus musculus
gtatgagcagaagccagccgacctc

SEQ ID NO: 676446 - DNA, 25 bp, Mus musculus
gtatgagcagagagtactccttact

SEQ ID NO: 676447 - DNA, 25 bp, Mus musculus
gtatgagcagagtgtactccttact

SEQ ID NO: 676448 - DNA, 25 bp, Mus musculus
gtatgagcagtgaacctgaccaatt

SEQ ID NO: 676449 - DNA, 25 bp, Mus musculus
gtatgagcagtgtacctgaccaatt

SEQ ID NO: 676450 - DNA, 25 bp, Mus musculus
gtatgagccaagcacacctgtgaat

SEQ ID NO: 676451 - DNA, 25 bp, Mus musculus
gtatgagccaaggacacctgtgaat

SEQ ID NO: 676452 - DNA, 25 bp, Mus musculus
gtatgagccacccatgtctggccag

SEQ ID NO: 676453 - DNA, 25 bp, Mus musculus
gtatgagccaccgatgtctggccag

SEQ ID NO: 676454 - DNA, 25 bp, Mus musculus
gtatgagccattagttcagtcccca

SEQ ID NO: 676455 - DNA, 25 bp, Mus musculus
gtatgagccatttgttcagtcccca

SEQ ID NO: 676456 - DNA, 25 bp, Mus musculus
gtatgagccctgaggtcatggcctg

SEQ ID NO: 676457 - DNA, 25 bp, Mus musculus
gtatgagccctgtggtcatggcctg

SEQ ID NO: 676458 - DNA, 25 bp, Mus musculus
gtatgagcgcatacagtatttccga

SEQ ID NO: 676459 - DNA, 25 bp, Mus musculus
gtatgagcgcattcagtatttccga

SEQ ID NO: 676460 - DNA, 25 bp, Mus musculus
gtatgagctactcgcttgcacatct

SEQ ID NO: 676461 - DNA, 25 bp, Mus musculus
gtatgagctactggcttgcacatct

SEQ ID NO: 676462 - DNA, 25 bp, Mus musculus
gtatgagctcttacgaagcgttatg

SEQ ID NO: 676463 - DNA, 25 bp, Mus musculus
gtatgagctctttcgaagcgttatg

SEQ ID NO: 676464 - DNA, 25 bp, Mus musculus
gtatgagcttgacaccagtggctta

SEQ ID NO: 676465 - DNA, 25 bp, Mus musculus
gtatgagcttgagaccagtggctta

SEQ ID NO: 676466 - DNA, 25 bp, Mus musculus
gtatgaggactaatgccagaagcat

SEQ ID NO: 676467 - DNA, 25 bp, Mus musculus
gtatgaggactattgccagaagcat

SEQ ID NO: 676468 - DNA, 25 bp, Mus musculus
gtatgaggcaaacttctgctccatc

SEQ ID NO: 676469 - DNA, 25 bp, Mus musculus
gtatgaggcaaagttctgctccatc

SEQ ID NO: 676470 - DNA, 25 bp, Mus musculus
gtatgaggcattctaatggctatca

SEQ ID NO: 676471 - DNA, 25 bp, Mus musculus
gtatgaggcattgtaatggctatca

SEQ ID NO: 676472 - DNA, 25 bp, Mus musculus
gtatgaggcgtcaggaagaactgct

SEQ ID NO: 676473 - DNA, 25 bp, Mus musculus
gtatgaggcgtctggaagaactgct

SEQ ID NO: 676474 - DNA, 25 bp, Mus musculus
gtatgaggctacagggacacctttc

SEQ ID NO: 676475 - DNA, 25 bp, Mus musculus
gtatgaggctactgggacacctttc

SEQ ID NO: 676476 - DNA, 25 bp, Mus musculus
gtatgaggtcatcccctggaagata

SEQ ID NO: 676477 - DNA, 25 bp, Mus musculus
gtatgaggtcatgccctggaagata

SEQ ID NO: 676478 - DNA, 25 bp, Mus musculus
gtatgaggtctcagctacccagcag

SEQ ID NO: 676479 - DNA, 25 bp, Mus musculus
gtatgaggtctctgctacccagcag

SEQ ID NO: 676480 - DNA, 25 bp, Mus musculus
gtatgagtacaccagtcagctctta

SEQ ID NO: 676481 - DNA, 25 bp, Mus musculus
gtatgagtacacgagtcagctctta

SEQ ID NO: 676482 - DNA, 25 bp, Mus musculus
gtatgagtagctctcacagtcctca

SEQ ID NO: 676483 - DNA, 25 bp, Mus musculus
gtatgagtagctgtcacagtcctca

SEQ ID NO: 676484 - DNA, 25 bp, Mus musculus
gtatgagtagttcatgcacagttaa

SEQ ID NO: 676485 - DNA, 25 bp, Mus musculus
gtatgagtagttgatgcacagttaa

SEQ ID NO: 676486 - DNA, 25 bp, Mus musculus
gtatgagtatcaacagccacaaagc

SEQ ID NO: 676487 - DNA, 25 bp, Mus musculus
gtatgagtatcatcagccacaaagc

SEQ ID NO: 676488 - DNA, 25 bp, Mus musculus
gtatgagtatgacagcagccaggat

SEQ ID NO: 676489 - DNA, 25 bp, Mus musculus
gtatgagtatgagagcagccaggat

SEQ ID NO: 676490 - DNA, 25 bp, Mus musculus
gtatgagtcagaatctagagtcttt

SEQ ID NO: 676491 - DNA, 25 bp, Mus musculus
gtatgagtcagattctagagtcttt

SEQ ID NO: 676492 - DNA, 25 bp, Mus musculus
gtatgagtccacaaagactgggtta

SEQ ID NO: 676493 - DNA, 25 bp, Mus musculus
gtatgagtccactaagactgggtta

SEQ ID NO: 676494 - DNA, 25 bp, Mus musculus
gtatgagtcctcaggtgagctttta

SEQ ID NO: 676495 - DNA, 25 bp, Mus musculus
gtatgagtcctctggtgagctttta

SEQ ID NO: 676496 - DNA, 25 bp, Mus musculus
gtatgagtccttcctgtacaggaag

SEQ ID NO: 676497 - DNA, 25 bp, Mus musculus
gtatgagtccttgctgtacaggaag

SEQ ID NO: 676498 - DNA, 25 bp, Mus musculus
gtatgagtgttcagtacgtgtacat

SEQ ID NO: 676499 - DNA, 25 bp, Mus musculus
gtatgagtgttctgtacgtgtacat

SEQ ID NO: 676500 - DNA, 25 bp, Mus musculus
gtatgagttctgagcgtccacaact

SEQ ID NO: 676501 - DNA, 25 bp, Mus musculus
gtatgagttctgtgcgtccacaact

SEQ ID NO: 676502 - DNA, 25 bp, Mus musculus
gtatgagttcttattcatcatggct

SEQ ID NO: 676503 - DNA, 25 bp, Mus musculus
gtatgagttctttttcatcatggct

SEQ ID NO: 676504 - DNA, 25 bp, Mus musculus
gtatgagttgtaagtgttctcactc

SEQ ID NO: 676505 - DNA, 25 bp, Mus musculus
gtatgagttgtatgtgttctcactc

SEQ ID NO: 676506 - DNA, 25 bp, Mus musculus
gtatgagttgttctttctagcggat

SEQ ID NO: 676507 - DNA, 25 bp, Mus musculus
gtatgagttgttgtttctagcggat

SEQ ID NO: 676508 - DNA, 25 bp, Mus musculus
gtatgataagaccttttagaagatt

SEQ ID NO: 676509 - DNA, 25 bp, Mus musculus
gtatgataagacgttttagaagatt

SEQ ID NO: 676510 - DNA, 25 bp, Mus musculus
gtatgataagccaaggaagtacact

SEQ ID NO: 676511 - DNA, 25 bp, Mus musculus
gtatgataagcctaggaagtacact

SEQ ID NO: 676512 - DNA, 25 bp, Mus musculus
gtatgatacagaactcttttggcat

SEQ ID NO: 676513 - DNA, 25 bp, Mus musculus
gtatgatacagatctcttttggcat

SEQ ID NO: 676514 - DNA, 25 bp, Mus musculus
gtatgatagcccaggcccaggacct

SEQ ID NO: 676515 - DNA, 25 bp, Mus musculus
gtatgatagccctggcccaggacct

SEQ ID NO: 676516 - DNA, 25 bp, Mus musculus
gtatgatatcataagtagagagctc

SEQ ID NO: 676517 - DNA, 25 bp, Mus musculus
gtatgatatcattagtagagagctc

SEQ ID NO: 676518 - DNA, 25 bp, Mus musculus
gtatgatatctgatatcactgtcag

SEQ ID NO: 676519 - DNA, 25 bp, Mus musculus
gtatgatatctgttatcactgtcag

SEQ ID NO: 676520 - DNA, 25 bp, Mus musculus
gtatgatatttcattcggtgtttga

SEQ ID NO: 676521 - DNA, 25 bp, Mus musculus
gtatgatatttctttcggtgtttga

SEQ ID NO: 676522 - DNA, 25 bp, Mus musculus
gtatgatcagccctgtctcacaagg

SEQ ID NO: 676523 - DNA, 25 bp, Mus musculus
gtatgatcagccgtgtctcacaagg

SEQ ID NO: 676524 - DNA, 25 bp, Mus musculus
gtatgatcatgaacctctcatcctc

SEQ ID NO: 676525 - DNA, 25 bp, Mus musculus
gtatgatcatgatcctctcatcctc

SEQ ID NO: 676526 - DNA, 25 bp, Mus musculus
gtatgatccaacaggccttgtcaga

SEQ ID NO: 676527 - DNA, 25 bp, Mus musculus
gtatgatccaactggccttgtcaga

SEQ ID NO: 676528 - DNA, 25 bp, Mus musculus
gtatgatccttcatggaaatggcat

SEQ ID NO: 676529 - DNA, 25 bp, Mus musculus
gtatgatccttcttggaaatggcat

SEQ ID NO: 676530 - DNA, 25 bp, Mus musculus
gtatgatcgaccaggcacatcaaga

SEQ ID NO: 676531 - DNA, 25 bp, Mus musculus
gtatgatcgacctggcacatcaaga

SEQ ID NO: 676532 - DNA, 25 bp, Mus musculus
gtatgatcgaggcactctgttgcaa

SEQ ID NO: 676533 - DNA, 25 bp, Mus musculus
gtatgatcgagggactctgttgcaa

SEQ ID NO: 676534 - DNA, 25 bp, Mus musculus
gtatgatctgaaactctggcaaact

SEQ ID NO: 676535 - DNA, 25 bp, Mus musculus
gtatgatctgaatctctggcaaact

SEQ ID NO: 676536 - DNA, 25 bp, Mus musculus
gtatgatctttgcaggaccaagggc

SEQ ID NO: 676537 - DNA, 25 bp, Mus musculus
gtatgatctttggaggaccaagggc

SEQ ID NO: 676538 - DNA, 25 bp, Mus musculus
gtatgatgactacacccaggtaatc

SEQ ID NO: 676539 - DNA, 25 bp, Mus musculus
gtatgatgactagacccaggtaatc

SEQ ID NO: 676540 - DNA, 25 bp, Mus musculus
gtatgatgcaagagacagtcattta

SEQ ID NO: 676541 - DNA, 25 bp, Mus musculus
gtatgatgcaagtgacagtcattta

SEQ ID NO: 676542 - DNA, 25 bp, Mus musculus
gtatgatgcacaaaacaagcttctc

SEQ ID NO: 676543 - DNA, 25 bp, Mus musculus
gtatgatgcacataacaagcttctc

SEQ ID NO: 676544 - DNA, 25 bp, Mus musculus
gtatgatgcctaaaaactgtcccgc

SEQ ID NO: 676545 - DNA, 25 bp, Mus musculus
gtatgatgcctataaactgtcccgc

SEQ ID NO: 676546 - DNA, 25 bp, Mus musculus
gtatgatgctaacaccgaatggttc

SEQ ID NO: 676547 - DNA, 25 bp, Mus musculus
gtatgatgctaagaccgaatggttc

SEQ ID NO: 676548 - DNA, 25 bp, Mus musculus
gtatgatgctgacgacgatgagaac

SEQ ID NO: 676549 - DNA, 25 bp, Mus musculus
gtatgatgctgaggacgatgagaac

SEQ ID NO: 676550 - DNA, 25 bp, Mus musculus
gtatgatgcttgacctgtttgtttt

SEQ ID NO: 676551 - DNA, 25 bp, Mus musculus
gtatgatgcttgtcctgtttgtttt

SEQ ID NO: 676552 - DNA, 25 bp, Mus musculus
gtatgatggtgacacttccctgtgt

SEQ ID NO: 676553 - DNA, 25 bp, Mus musculus
gtatgatggtgagacttccctgtgt

SEQ ID NO: 676554 - DNA, 25 bp, Mus musculus
gtatgatggttaaacctcgtgccca

SEQ ID NO: 676555 - DNA, 25 bp, Mus musculus
gtatgatggttatacctcgtgccca

SEQ ID NO: 676556 - DNA, 25 bp, Mus musculus
gtatgatgtcacatcctattgaaat

SEQ ID NO: 676557 - DNA, 25 bp, Mus musculus
gtatgatgtcacttcctattgaaat

SEQ ID NO: 676558 - DNA, 25 bp, Mus musculus
gtatgatgtcatccaacaagaggtt

SEQ ID NO: 676559 - DNA, 25 bp, Mus musculus
gtatgatgtcatgcaacaagaggtt

SEQ ID NO: 676560 - DNA, 25 bp, Mus musculus
gtatgatgtgctcatccacctgact

SEQ ID NO: 676561 - DNA, 25 bp, Mus musculus
gtatgatgtgctgatccacctgact

SEQ ID NO: 676562 - DNA, 25 bp, Mus musculus
gtatgattaaaacctcgcgtagact

SEQ ID NO: 676563 - DNA, 25 bp, Mus musculus
gtatgattaaaagctcgcgtagact

SEQ ID NO: 676564 - DNA, 25 bp, Mus musculus
gtatgattaactccatctgtgctgt

SEQ ID NO: 676565 - DNA, 25 bp, Mus musculus
gtatgattaactgcatctgtgctgt

SEQ ID NO: 676566 - DNA, 25 bp, Mus musculus
gtatgattatagctcaggaattact

SEQ ID NO: 676567 - DNA, 25 bp, Mus musculus
gtatgattataggtcaggaattact

SEQ ID NO: 676568 - DNA, 25 bp, Mus musculus
gtatgattatggatactgtatcaga

SEQ ID NO: 676569 - DNA, 25 bp, Mus musculus
gtatgattatggttactgtatcaga

SEQ ID NO: 676570 - DNA, 25 bp, Mus musculus
gtatgattcaaaaccatttcttaga

SEQ ID NO: 676571 - DNA, 25 bp, Mus musculus
gtatgattcaaatccatttcttaga

SEQ ID NO: 676572 - DNA, 25 bp, Mus musculus
gtatgattcaccattgcactactgc

SEQ ID NO: 676573 - DNA, 25 bp, Mus musculus
gtatgattcacctttgcactactgc

SEQ ID NO: 676574 - DNA, 25 bp, Mus musculus
gtatgattcaggcttcttgactgaa

SEQ ID NO: 676575 - DNA, 25 bp, Mus musculus
gtatgattcagggttcttgactgaa

SEQ ID NO: 676576 - DNA, 25 bp, Mus musculus
gtatgattcagtatgtctagaagtc

SEQ ID NO: 676577 - DNA, 25 bp, Mus musculus
gtatgattcagtttgtctagaagtc

SEQ ID NO: 676578 - DNA, 25 bp, Mus musculus
gtatgattcatcaacatggcttttt

SEQ ID NO: 676579 - DNA, 25 bp, Mus musculus
gtatgattcatctacatggcttttt

SEQ ID NO: 676580 - DNA, 25 bp, Mus musculus
gtatgattctctaaaaagtgtgttg

SEQ ID NO: 676581 - DNA, 25 bp, Mus musculus
gtatgattctcttaaaagtgtgttg

SEQ ID NO: 676582 - DNA, 25 bp, Mus musculus
gtatgattcttcaggtttattcgga

SEQ ID NO: 676583 - DNA, 25 bp, Mus musculus
gtatgattcttctggtttattcgga

SEQ ID NO: 676584 - DNA, 25 bp, Mus musculus
gtatgatttactctctttgggagag

SEQ ID NO: 676585 - DNA, 25 bp, Mus musculus
gtatgatttactgtctttgggagag

SEQ ID NO: 676586 - DNA, 25 bp, Mus musculus
gtatgatttcatatcagaatctgac

SEQ ID NO: 676587 - DNA, 25 bp, Mus musculus
gtatgatttcatttcagaatctgac

SEQ ID NO: 676588 - DNA, 25 bp, Mus musculus
gtatgcaaaactcatcttgtccttt

SEQ ID NO: 676589 - DNA, 25 bp, Mus musculus
gtatgcaaaactgatcttgtccttt

SEQ ID NO: 676590 - DNA, 25 bp, Mus musculus
gtatgcaaacacatgatccctttcc

SEQ ID NO: 676591 - DNA, 25 bp, Mus musculus
gtatgcaaacacttgatccctttcc

SEQ ID NO: 676592 - DNA, 25 bp, Mus musculus
gtatgcaacaataaggtccccacaa

SEQ ID NO: 676593 - DNA, 25 bp, Mus musculus
gtatgcaacaattaggtccccacaa

SEQ ID NO: 676594 - DNA, 25 bp, Mus musculus
gtatgcaacgtactagacgccagtt

SEQ ID NO: 676595 - DNA, 25 bp, Mus musculus
gtatgcaacgtagtagacgccagtt

SEQ ID NO: 676596 - DNA, 25 bp, Mus musculus
gtatgcaactggcaagctgccatca

SEQ ID NO: 676597 - DNA, 25 bp, Mus musculus
gtatgcaactgggaagctgccatca

SEQ ID NO: 676598 - DNA, 25 bp, Mus musculus
gtatgcaatagtctttccactgaga

SEQ ID NO: 676599 - DNA, 25 bp, Mus musculus
gtatgcaatagtgtttccactgaga

SEQ ID NO: 676600 - DNA, 25 bp, Mus musculus
gtatgcaatatcaacctccagtgta

SEQ ID NO: 676601 - DNA, 25 bp, Mus musculus
gtatgcaatatctacctccagtgta

SEQ ID NO: 676602 - DNA, 25 bp, Mus musculus
gtatgcaatgccatgcccagactta

SEQ ID NO: 676603 - DNA, 25 bp, Mus musculus
gtatgcaatgccttgcccagactta

SEQ ID NO: 676604 - DNA, 25 bp, Mus musculus
gtatgcaatgctcgccatgggtgta

SEQ ID NO: 676605 - DNA, 25 bp, Mus musculus
gtatgcaatgctggccatgggtgta

SEQ ID NO: 676606 - DNA, 25 bp, Mus musculus
gtatgcaatgttcctgtatgtttct

SEQ ID NO: 676607 - DNA, 25 bp, Mus musculus
gtatgcaatgttgctgtatgtttct

SEQ ID NO: 676608 - DNA, 25 bp, Mus musculus
gtatgcaattgaacttcatgctttt

SEQ ID NO: 676609 - DNA, 25 bp, Mus musculus
gtatgcaattgatcttcatgctttt

SEQ ID NO: 676610 - DNA, 25 bp, Mus musculus
gtatgcacaaacatctgcactcacg

SEQ ID NO: 676611 - DNA, 25 bp, Mus musculus
gtatgcacaaacctccagcttcaat

SEQ ID NO: 676612 - DNA, 25 bp, Mus musculus
gtatgcacaaacgtccagcttcaat

SEQ ID NO: 676613 - DNA, 25 bp, Mus musculus
gtatgcacaaacttctgcactcacg

SEQ ID NO: 676614 - DNA, 25 bp, Mus musculus
gtatgcacactacatgcttgcctgg

SEQ ID NO: 676615 - DNA, 25 bp, Mus musculus
gtatgcacactagatgcttgcctgg

SEQ ID NO: 676616 - DNA, 25 bp, Mus musculus
gtatgcacacttcagttttttggtt

SEQ ID NO: 676617 - DNA, 25 bp, Mus musculus
gtatgcacacttgagttttttggtt

SEQ ID NO: 676618 - DNA, 25 bp, Mus musculus
gtatgcacagagcagacagactaat

SEQ ID NO: 676619 - DNA, 25 bp, Mus musculus
gtatgcacagaggagacagactaat

SEQ ID NO: 676620 - DNA, 25 bp, Mus musculus
gtatgcacagcacacatgctacata

SEQ ID NO: 676621 - DNA, 25 bp, Mus musculus
gtatgcacagcagacatgctacata

SEQ ID NO: 676622 - DNA, 25 bp, Mus musculus
gtatgcacatcaacaacttgcagca

SEQ ID NO: 676623 - DNA, 25 bp, Mus musculus
gtatgcacatcatcaacttgcagca

SEQ ID NO: 676624 - DNA, 25 bp, Mus musculus
gtatgcacatttcgacaacaggtac

SEQ ID NO: 676625 - DNA, 25 bp, Mus musculus
gtatgcacatttggacaacaggtac

SEQ ID NO: 676626 - DNA, 25 bp, Mus musculus
gtatgcaccagaacatctagctgtt

SEQ ID NO: 676627 - DNA, 25 bp, Mus musculus
gtatgcaccagatcatctagctgtt

SEQ ID NO: 676628 - DNA, 25 bp, Mus musculus
gtatgcacccaccaagatcctctat

SEQ ID NO: 676629 - DNA, 25 bp, Mus musculus
gtatgcacccacgaagatcctctat

SEQ ID NO: 676630 - DNA, 25 bp, Mus musculus
gtatgcacgcatattcacagtaatt

SEQ ID NO: 676631 - DNA, 25 bp, Mus musculus
gtatgcacgcattttcacagtaatt

SEQ ID NO: 676632 - DNA, 25 bp, Mus musculus
gtatgcactaatcaagcacacactg

SEQ ID NO: 676633 - DNA, 25 bp, Mus musculus
gtatgcactaatgaagcacacactg

SEQ ID NO: 676634 - DNA, 25 bp, Mus musculus
gtatgcactattaagaggaccatga

SEQ ID NO: 676635 - DNA, 25 bp, Mus musculus
gtatgcactatttagaggaccatga

SEQ ID NO: 676636 - DNA, 25 bp, Mus musculus
gtatgcactcaaatccaagctgact

SEQ ID NO: 676637 - DNA, 25 bp, Mus musculus
gtatgcactcaattccaagctgact

SEQ ID NO: 676638 - DNA, 25 bp, Mus musculus
gtatgcactggacagtattctcaga

SEQ ID NO: 676639 - DNA, 25 bp, Mus musculus
gtatgcactggagagtattctcaga

SEQ ID NO: 676640 - DNA, 25 bp, Mus musculus
gtatgcactttaacaaacacagctg

SEQ ID NO: 676641 - DNA, 25 bp, Mus musculus
gtatgcactttatcaaacacagctg

SEQ ID NO: 676642 - DNA, 25 bp, Mus musculus
gtatgcagagccattcttctgttga

SEQ ID NO: 676643 - DNA, 25 bp, Mus musculus
gtatgcagagcctttcttctgttga

SEQ ID NO: 676644 - DNA, 25 bp, Mus musculus
gtatgcagcacaatcagccgatggt

SEQ ID NO: 676645 - DNA, 25 bp, Mus musculus
gtatgcagcacattcagccgatggt

SEQ ID NO: 676646 - DNA, 25 bp, Mus musculus
gtatgcagcattcacatctctttct

SEQ ID NO: 676647 - DNA, 25 bp, Mus musculus
gtatgcagcattgacatctctttct

SEQ ID NO: 676648 - DNA, 25 bp, Mus musculus
gtatgcagccgtcaattttgtctca

SEQ ID NO: 676649 - DNA, 25 bp, Mus musculus
gtatgcagccgtgaattttgtctca

SEQ ID NO: 676650 - DNA, 25 bp, Mus musculus
gtatgcagcgcaaggtgctctatcg

SEQ ID NO: 676651 - DNA, 25 bp, Mus musculus
gtatgcagcgcatggtgctctatcg

SEQ ID NO: 676652 - DNA, 25 bp, Mus musculus
gtatgcagctagacgggacaacttc

SEQ ID NO: 676653 - DNA, 25 bp, Mus musculus
gtatgcagctagtcgggacaacttc

SEQ ID NO: 676654 - DNA, 25 bp, Mus musculus
gtatgcagcttgacatctggaagat

SEQ ID NO: 676655 - DNA, 25 bp, Mus musculus
gtatgcagcttgtcatctggaagat

SEQ ID NO: 676656 - DNA, 25 bp, Mus musculus
gtatgcaggttaacttttccttttg

SEQ ID NO: 676657 - DNA, 25 bp, Mus musculus
gtatgcaggttatcttttccttttg

SEQ ID NO: 676658 - DNA, 25 bp, Mus musculus
gtatgcagtattcgagacagctaca

SEQ ID NO: 676659 - DNA, 25 bp, Mus musculus
gtatgcagtattggagacagctaca

SEQ ID NO: 676660 - DNA, 25 bp, Mus musculus
gtatgcagtggtagcctacaatctg

SEQ ID NO: 676661 - DNA, 25 bp, Mus musculus
gtatgcagtggttgcctacaatctg

SEQ ID NO: 676662 - DNA, 25 bp, Mus musculus
gtatgcatagtgctcctacacttag

SEQ ID NO: 676663 - DNA, 25 bp, Mus musculus
gtatgcatagtggtcctacacttag

SEQ ID NO: 676664 - DNA, 25 bp, Mus musculus
gtatgcatatgcattctggttccta

SEQ ID NO: 676665 - DNA, 25 bp, Mus musculus
gtatgcatatgctttctggttccta

SEQ ID NO: 676666 - DNA, 25 bp, Mus musculus
gtatgcatcaacagactcagtattc

SEQ ID NO: 676667 - DNA, 25 bp, Mus musculus
gtatgcatcaactgactcagtattc

SEQ ID NO: 676668 - DNA, 25 bp, Mus musculus
gtatgcatcactagggttggttgag

SEQ ID NO: 676669 - DNA, 25 bp, Mus musculus
gtatgcatcacttgggttggttgag

SEQ ID NO: 676670 - DNA, 25 bp, Mus musculus
gtatgcatcagtacccaagagcact

SEQ ID NO: 676671 - DNA, 25 bp, Mus musculus
gtatgcatcagttcccaagagcact

SEQ ID NO: 676672 - DNA, 25 bp, Mus musculus
gtatgcatctcaattactgttgaac

SEQ ID NO: 676673 - DNA, 25 bp, Mus musculus
gtatgcatctcatttactgttgaac

SEQ ID NO: 676674 - DNA, 25 bp, Mus musculus
gtatgcatcttacccttgaatttga

SEQ ID NO: 676675 - DNA, 25 bp, Mus musculus
gtatgcatcttagccttgaatttga

SEQ ID NO: 676676 - DNA, 25 bp, Mus musculus
gtatgcatgaatactaggaagctag

SEQ ID NO: 676677 - DNA, 25 bp, Mus musculus
gtatgcatgaattctaggaagctag

SEQ ID NO: 676678 - DNA, 25 bp, Mus musculus
gtatgcatgctgaagggccagacca

SEQ ID NO: 676679 - DNA, 25 bp, Mus musculus
gtatgcatgctgtagggccagacca

SEQ ID NO: 676680 - DNA, 25 bp, Mus musculus
gtatgcatgcttaagagtctatatt

SEQ ID NO: 676681 - DNA, 25 bp, Mus musculus
gtatgcatgctttagagtctatatt

SEQ ID NO: 676682 - DNA, 25 bp, Mus musculus
gtatgcatggttacctgtggtagtc

SEQ ID NO: 676683 - DNA, 25 bp, Mus musculus
gtatgcatggtttcctgtggtagtc

SEQ ID NO: 676684 - DNA, 25 bp, Mus musculus
gtatgcattcacaaagtcttccttt

SEQ ID NO: 676685 - DNA, 25 bp, Mus musculus
gtatgcattcactaagtcttccttt

SEQ ID NO: 676686 - DNA, 25 bp, Mus musculus
gtatgcattgtacagccagagcaga

SEQ ID NO: 676687 - DNA, 25 bp, Mus musculus
gtatgcattgtagagccagagcaga

SEQ ID NO: 676688 - DNA, 25 bp, Mus musculus
gtatgcatttgtcaggagcccaacc

SEQ ID NO: 676689 - DNA, 25 bp, Mus musculus
gtatgcatttgtgaggagcccaacc

SEQ ID NO: 676690 - DNA, 25 bp, Mus musculus
gtatgccaaagaaacgctatccttg

SEQ ID NO: 676691 - DNA, 25 bp, Mus musculus
gtatgccaaagatacgctatccttg

SEQ ID NO: 676692 - DNA, 25 bp, Mus musculus
gtatgccaacaactaccacattttc

SEQ ID NO: 676693 - DNA, 25 bp, Mus musculus
gtatgccaacaagtaccacattttc

SEQ ID NO: 676694 - DNA, 25 bp, Mus musculus
gtatgccaagatctgctttgaggat

SEQ ID NO: 676695 - DNA, 25 bp, Mus musculus
gtatgccaagatgtgctttgaggat

SEQ ID NO: 676696 - DNA, 25 bp, Mus musculus
gtatgccaaggtaaccctcagtaag

SEQ ID NO: 676697 - DNA, 25 bp, Mus musculus
gtatgccaaggttaccctcagtaag

SEQ ID NO: 676698 - DNA, 25 bp, Mus musculus
gtatgccaagtacatcaagaactaa

SEQ ID NO: 676699 - DNA, 25 bp, Mus musculus
gtatgccaagtagatcaagaactaa

SEQ ID NO: 676700 - DNA, 25 bp, Mus musculus
gtatgccaatccaatctggcttggt

SEQ ID NO: 676701 - DNA, 25 bp, Mus musculus
gtatgccaatcctatctggcttggt

SEQ ID NO: 676702 - DNA, 25 bp, Mus musculus
gtatgccacagtccctttatggcca

SEQ ID NO: 676703 - DNA, 25 bp, Mus musculus
gtatgccacagtgcctttatggcca

SEQ ID NO: 676704 - DNA, 25 bp, Mus musculus
gtatgccactaaattcatgagtcct

SEQ ID NO: 676705 - DNA, 25 bp, Mus musculus
gtatgccactaatttcatgagtcct

SEQ ID NO: 676706 - DNA, 25 bp, Mus musculus
gtatgccagataccactgagttcaa

SEQ ID NO: 676707 - DNA, 25 bp, Mus musculus
gtatgccagatacctcaagatggtt

SEQ ID NO: 676708 - DNA, 25 bp, Mus musculus
gtatgccagatagcactgagttcaa

SEQ ID NO: 676709 - DNA, 25 bp, Mus musculus
gtatgccagatagctcaagatggtt

SEQ ID NO: 676710 - DNA, 25 bp, Mus musculus
gtatgccagcaactttcttctttaa

SEQ ID NO: 676711 - DNA, 25 bp, Mus musculus
gtatgccagcaagtttcttctttaa

SEQ ID NO: 676712 - DNA, 25 bp, Mus musculus
gtatgccagcgcaccagggctgtgt

SEQ ID NO: 676713 - DNA, 25 bp, Mus musculus
gtatgccagcgctccagggctgtgt

SEQ ID NO: 676714 - DNA, 25 bp, Mus musculus
gtatgccagctcctgagttagcaaa

SEQ ID NO: 676715 - DNA, 25 bp, Mus musculus
gtatgccagctcgtgagttagcaaa

SEQ ID NO: 676716 - DNA, 25 bp, Mus musculus
gtatgccagcttactcatgggaaca

SEQ ID NO: 676717 - DNA, 25 bp, Mus musculus
gtatgccagctttctcatgggaaca

SEQ ID NO: 676718 - DNA, 25 bp, Mus musculus
gtatgccaggccagacacgtttgac

SEQ ID NO: 676719 - DNA, 25 bp, Mus musculus
gtatgccaggcctgacacgtttgac

SEQ ID NO: 676720 - DNA, 25 bp, Mus musculus
gtatgccagtctagagagggccctg

SEQ ID NO: 676721 - DNA, 25 bp, Mus musculus
gtatgccagtcttgagagggccctg

SEQ ID NO: 676722 - DNA, 25 bp, Mus musculus
gtatgccagtttccgactggagcca

SEQ ID NO: 676723 - DNA, 25 bp, Mus musculus
gtatgccagtttgcgactggagcca

SEQ ID NO: 676724 - DNA, 25 bp, Mus musculus
gtatgccatcatagagtcccagacg

SEQ ID NO: 676725 - DNA, 25 bp, Mus musculus
gtatgccatcattgagtcccagacg

SEQ ID NO: 676726 - DNA, 25 bp, Mus musculus
gtatgccatgcacagagccagttta

SEQ ID NO: 676727 - DNA, 25 bp, Mus musculus
gtatgccatgcagagagccagttta

SEQ ID NO: 676728 - DNA, 25 bp, Mus musculus
gtatgccatgtgagtcactaaccag

SEQ ID NO: 676729 - DNA, 25 bp, Mus musculus
gtatgccatgtgatgctaccttaca

SEQ ID NO: 676730 - DNA, 25 bp, Mus musculus
gtatgccatgtgtgtcactaaccag

SEQ ID NO: 676731 - DNA, 25 bp, Mus musculus
gtatgccatgtgttgctaccttaca

SEQ ID NO: 676732 - DNA, 25 bp, Mus musculus
gtatgcccaaccaggacctggttat

SEQ ID NO: 676733 - DNA, 25 bp, Mus musculus
gtatgcccaacctggacctggttat

SEQ ID NO: 676734 - DNA, 25 bp, Mus musculus
gtatgcccaaggaatcagcaggcca

SEQ ID NO: 676735 - DNA, 25 bp, Mus musculus
gtatgcccaaggtatcagcaggcca

SEQ ID NO: 676736 - DNA, 25 bp, Mus musculus
gtatgcccaccgaggtaattcacac

SEQ ID NO: 676737 - DNA, 25 bp, Mus musculus
gtatgcccaccgtggtaattcacac

SEQ ID NO: 676738 - DNA, 25 bp, Mus musculus
gtatgcccacgtctactgcctgggt

SEQ ID NO: 676739 - DNA, 25 bp, Mus musculus
gtatgcccacgtgtactgcctgggt

SEQ ID NO: 676740 - DNA, 25 bp, Mus musculus
gtatgcccagccaaaacaataattt

SEQ ID NO: 676741 - DNA, 25 bp, Mus musculus
gtatgcccagcctaaacaataattt

SEQ ID NO: 676742 - DNA, 25 bp, Mus musculus
gtatgcccaggaaacaggtccattt

SEQ ID NO: 676743 - DNA, 25 bp, Mus musculus
gtatgcccaggatacaggtccattt

SEQ ID NO: 676744 - DNA, 25 bp, Mus musculus
gtatgcccatacattctttaagaag

SEQ ID NO: 676745 - DNA, 25 bp, Mus musculus
gtatgcccatactttctttaagaag

SEQ ID NO: 676746 - DNA, 25 bp, Mus musculus
gtatgcccctgtctgtaaaattttg

SEQ ID NO: 676747 - DNA, 25 bp, Mus musculus
gtatgcccctgtgtgtaaaattttg

SEQ ID NO: 676748 - DNA, 25 bp, Mus musculus
gtatgccctccaattttggacttta

SEQ ID NO: 676749 - DNA, 25 bp, Mus musculus
gtatgccctccatttttggacttta

SEQ ID NO: 676750 - DNA, 25 bp, Mus musculus
gtatgccctgaacattcttggcctt

SEQ ID NO: 676751 - DNA, 25 bp, Mus musculus
gtatgccctgaagattcttggcctt

SEQ ID NO: 676752 - DNA, 25 bp, Mus musculus
gtatgccgctagagtggccaatgca

SEQ ID NO: 676753 - DNA, 25 bp, Mus musculus
gtatgccgctagtgtggccaatgca

SEQ ID NO: 676754 - DNA, 25 bp, Mus musculus
gtatgccggatacttgctctgcctg

SEQ ID NO: 676755 - DNA, 25 bp, Mus musculus
gtatgccggatagttgctctgcctg

SEQ ID NO: 676756 - DNA, 25 bp, Mus musculus
gtatgccggttaagtgccattccca

SEQ ID NO: 676757 - DNA, 25 bp, Mus musculus
gtatgccggttatgtgccattccca

SEQ ID NO: 676758 - DNA, 25 bp, Mus musculus
gtatgccgtcagaagaccctttcag

SEQ ID NO: 676759 - DNA, 25 bp, Mus musculus
gtatgccgtcagtagaccctttcag

SEQ ID NO: 676760 - DNA, 25 bp, Mus musculus
gtatgcctaatcattcattaaaatg

SEQ ID NO: 676761 - DNA, 25 bp, Mus musculus
gtatgcctaatctttcattaaaatg

SEQ ID NO: 676762 - DNA, 25 bp, Mus musculus
gtatgcctagtgattacattcctaa

SEQ ID NO: 676763 - DNA, 25 bp, Mus musculus
gtatgcctagtgtttacattcctaa

SEQ ID NO: 676764 - DNA, 25 bp, Mus musculus
gtatgcctatttacagatccctttt

SEQ ID NO: 676765 - DNA, 25 bp, Mus musculus
gtatgcctattttcagatccctttt

SEQ ID NO: 676766 - DNA, 25 bp, Mus musculus
gtatgcctctaacaagcactctgaa

SEQ ID NO: 676767 - DNA, 25 bp, Mus musculus
gtatgcctctaagaagcactctgaa

SEQ ID NO: 676768 - DNA, 25 bp, Mus musculus
gtatgcctctggacgtaccacgggc

SEQ ID NO: 676769 - DNA, 25 bp, Mus musculus
gtatgcctctggtcgtaccacgggc

SEQ ID NO: 676770 - DNA, 25 bp, Mus musculus
gtatgcctctgtctcttaactttcc

SEQ ID NO: 676771 - DNA, 25 bp, Mus musculus
gtatgcctctgtgtcttaactttcc

SEQ ID NO: 676772 - DNA, 25 bp, Mus musculus
gtatgcctgcttcactccagaaaat

SEQ ID NO: 676773 - DNA, 25 bp, Mus musculus
gtatgcctgcttgactccagaaaat

SEQ ID NO: 676774 - DNA, 25 bp, Mus musculus
gtatgcctggaaaacactaccaatt

SEQ ID NO: 676775 - DNA, 25 bp, Mus musculus
gtatgcctggaatacactaccaatt

SEQ ID NO: 676776 - DNA, 25 bp, Mus musculus
gtatgcctgggactgattgaaacaa

SEQ ID NO: 676777 - DNA, 25 bp, Mus musculus
gtatgcctgggagtgattgaaacaa

SEQ ID NO: 676778 - DNA, 25 bp, Mus musculus
gtatgcctggtaccacatgaattct

SEQ ID NO: 676779 - DNA, 25 bp, Mus musculus
gtatgcctggtagcacatgaattct

SEQ ID NO: 676780 - DNA, 25 bp, Mus musculus
gtatgcctggtgatcaaggaggtca

SEQ ID NO: 676781 - DNA, 25 bp, Mus musculus
gtatgcctggtgttcaaggaggtca

SEQ ID NO: 676782 - DNA, 25 bp, Mus musculus
gtatgcctgtcaacaggtattccag

SEQ ID NO: 676783 - DNA, 25 bp, Mus musculus
gtatgcctgtcatcaggtattccag

SEQ ID NO: 676784 - DNA, 25 bp, Mus musculus
gtatgcctgtttagtgtgcactatt

SEQ ID NO: 676785 - DNA, 25 bp, Mus musculus
gtatgcctgttttgtgtgcactatt

SEQ ID NO: 676786 - DNA, 25 bp, Mus musculus
gtatgccttactcaacaaaactttt

SEQ ID NO: 676787 - DNA, 25 bp, Mus musculus
gtatgccttactgaacaaaactttt

SEQ ID NO: 676788 - DNA, 25 bp, Mus musculus
gtatgccttgaaaacaggtgtgtat

SEQ ID NO: 676789 - DNA, 25 bp, Mus musculus
gtatgccttgaatacaggtgtgtat

SEQ ID NO: 676790 - DNA, 25 bp, Mus musculus
gtatgcctttagaacattgtgcctg

SEQ ID NO: 676791 - DNA, 25 bp, Mus musculus
gtatgcctttagtacattgtgcctg

SEQ ID NO: 676792 - DNA, 25 bp, Mus musculus
gtatgcctttatcttatcatctgct

SEQ ID NO: 676793 - DNA, 25 bp, Mus musculus
gtatgcctttatgttatcatctgct

SEQ ID NO: 676794 - DNA, 25 bp, Mus musculus
gtatgcgacgtaaagccactagaaa

SEQ ID NO: 676795 - DNA, 25 bp, Mus musculus
gtatgcgacgtatagccactagaaa

SEQ ID NO: 676796 - DNA, 25 bp, Mus musculus
gtatgcgagtacctaaacaagccag

SEQ ID NO: 676797 - DNA, 25 bp, Mus musculus
gtatgcgagtacgtaaacaagccag

SEQ ID NO: 676798 - DNA, 25 bp, Mus musculus
gtatgcgattatacttgccctgcac

SEQ ID NO: 676799 - DNA, 25 bp, Mus musculus
gtatgcgattattcttgccctgcac

SEQ ID NO: 676800 - DNA, 25 bp, Mus musculus
gtatgcgcacaccagagttagcctt

SEQ ID NO: 676801 - DNA, 25 bp, Mus musculus
gtatgcgcacacgagagttagcctt

SEQ ID NO: 676802 - DNA, 25 bp, Mus musculus
gtatgcgcatgtacagctggctttg

SEQ ID NO: 676803 - DNA, 25 bp, Mus musculus
gtatgcgcatgttcagctggctttg

SEQ ID NO: 676804 - DNA, 25 bp, Mus musculus
gtatgcgccagacttgctcaagcac

SEQ ID NO: 676805 - DNA, 25 bp, Mus musculus
gtatgcgccagagttgctcaagcac

SEQ ID NO: 676806 - DNA, 25 bp, Mus musculus
gtatgcggagttatctgatcataat

SEQ ID NO: 676807 - DNA, 25 bp, Mus musculus
gtatgcggagttttctgatcataat

SEQ ID NO: 676808 - DNA, 25 bp, Mus musculus
gtatgcgtaattcatcccagtctga

SEQ ID NO: 676809 - DNA, 25 bp, Mus musculus
gtatgcgtaattgatcccagtctga

SEQ ID NO: 676810 - DNA, 25 bp, Mus musculus
gtatgcgtattactggcagcctgtt

SEQ ID NO: 676811 - DNA, 25 bp, Mus musculus
gtatgcgtattagtggcagcctgtt

SEQ ID NO: 676812 - DNA, 25 bp, Mus musculus
gtatgcgtcatacaaaatatttgtg

SEQ ID NO: 676813 - DNA, 25 bp, Mus musculus
gtatgcgtcatagaaaatatttgtg

SEQ ID NO: 676814 - DNA, 25 bp, Mus musculus
gtatgcgtccatagcagacactcat

SEQ ID NO: 676815 - DNA, 25 bp, Mus musculus
gtatgcgtccattgcagacactcat

SEQ ID NO: 676816 - DNA, 25 bp, Mus musculus
gtatgcgtgtcccagcctcagacga

SEQ ID NO: 676817 - DNA, 25 bp, Mus musculus
gtatgcgtgtccgagcctcagacga

SEQ ID NO: 676818 - DNA, 25 bp, Mus musculus
gtatgctaacaaagtcctctctggg

SEQ ID NO: 676819 - DNA, 25 bp, Mus musculus
gtatgctaacaatgtcctctctggg

SEQ ID NO: 676820 - DNA, 25 bp, Mus musculus
gtatgctaccgtacagattggcttt

SEQ ID NO: 676821 - DNA, 25 bp, Mus musculus
gtatgctaccgttcagattggcttt

SEQ ID NO: 676822 - DNA, 25 bp, Mus musculus
gtatgctactttatatgtttccttt

SEQ ID NO: 676823 - DNA, 25 bp, Mus musculus
gtatgctactttttatgtttccttt

SEQ ID NO: 676824 - DNA, 25 bp, Mus musculus
gtatgctaggtaatatccataacta

SEQ ID NO: 676825 - DNA, 25 bp, Mus musculus
gtatgctaggtattatccataacta

SEQ ID NO: 676826 - DNA, 25 bp, Mus musculus
gtatgctaggtgatgccctcagaag

SEQ ID NO: 676827 - DNA, 25 bp, Mus musculus
gtatgctaggtgttgccctcagaag

SEQ ID NO: 676828 - DNA, 25 bp, Mus musculus
gtatgctagtttagaatgccctaaa

SEQ ID NO: 676829 - DNA, 25 bp, Mus musculus
gtatgctagttttgaatgccctaaa

SEQ ID NO: 676830 - DNA, 25 bp, Mus musculus
gtatgctataagcataaatgctggt

SEQ ID NO: 676831 - DNA, 25 bp, Mus musculus
gtatgctataaggataaatgctggt

SEQ ID NO: 676832 - DNA, 25 bp, Mus musculus
gtatgctatagacatttccctttgt

SEQ ID NO: 676833 - DNA, 25 bp, Mus musculus
gtatgctatagagatttccctttgt

SEQ ID NO: 676834 - DNA, 25 bp, Mus musculus
gtatgctatatcctctttagcctca

SEQ ID NO: 676835 - DNA, 25 bp, Mus musculus
gtatgctatatcgtctttagcctca

SEQ ID NO: 676836 - DNA, 25 bp, Mus musculus
gtatgctattaacaagtttgctgaa

SEQ ID NO: 676837 - DNA, 25 bp, Mus musculus
gtatgctattaagaagtttgctgaa

SEQ ID NO: 676838 - DNA, 25 bp, Mus musculus
gtatgctcaatgacacagcgcttgc

SEQ ID NO: 676839 - DNA, 25 bp, Mus musculus
gtatgctcaatgtcacagcgcttgc

SEQ ID NO: 676840 - DNA, 25 bp, Mus musculus
gtatgctcactaagctaaatattta

SEQ ID NO: 676841 - DNA, 25 bp, Mus musculus
gtatgctcactatgctaaatattta

SEQ ID NO: 676842 - DNA, 25 bp, Mus musculus
gtatgctcccctatttcatgaagtt

SEQ ID NO: 676843 - DNA, 25 bp, Mus musculus
gtatgctcccctttttcatgaagtt

SEQ ID NO: 676844 - DNA, 25 bp, Mus musculus
gtatgctcctaaatacctgctcaag

SEQ ID NO: 676845 - DNA, 25 bp, Mus musculus
gtatgctcctaattacctgctcaag

SEQ ID NO: 676846 - DNA, 25 bp, Mus musculus
gtatgctcctgacgtgtcaccagag

SEQ ID NO: 676847 - DNA, 25 bp, Mus musculus
gtatgctcctgaggtgtcaccagag

SEQ ID NO: 676848 - DNA, 25 bp, Mus musculus
gtatgctctgacatcttaattttct

SEQ ID NO: 676849 - DNA, 25 bp, Mus musculus
gtatgctctgacttcttaattttct

SEQ ID NO: 676850 - DNA, 25 bp, Mus musculus
gtatgctctgcaagaatcacagaac

SEQ ID NO: 676851 - DNA, 25 bp, Mus musculus
gtatgctctgcatgaatcacagaac

SEQ ID NO: 676852 - DNA, 25 bp, Mus musculus
gtatgctctggccaactgttatcag

SEQ ID NO: 676853 - DNA, 25 bp, Mus musculus
gtatgctctggcgaactgttatcag

SEQ ID NO: 676854 - DNA, 25 bp, Mus musculus
gtatgctctgttatgtgacttaaaa

SEQ ID NO: 676855 - DNA, 25 bp, Mus musculus
gtatgctctgttttgtgacttaaaa

SEQ ID NO: 676856 - DNA, 25 bp, Mus musculus
gtatgctctttgagtcaggacagga

SEQ ID NO: 676857 - DNA, 25 bp, Mus musculus
gtatgctctttgtgtcaggacagga

SEQ ID NO: 676858 - DNA, 25 bp, Mus musculus
gtatgctgcacaagcttggcttcga

SEQ ID NO: 676859 - DNA, 25 bp, Mus musculus
gtatgctgcacatgcttggcttcga

SEQ ID NO: 676860 - DNA, 25 bp, Mus musculus
gtatgctgccagagtaagatctgac

SEQ ID NO: 676861 - DNA, 25 bp, Mus musculus
gtatgctgccagtgtaagatctgac

SEQ ID NO: 676862 - DNA, 25 bp, Mus musculus
gtatgctgctcactgcatgttttag

SEQ ID NO: 676863 - DNA, 25 bp, Mus musculus
gtatgctgctcagtgcatgttttag

SEQ ID NO: 676864 - DNA, 25 bp, Mus musculus
gtatgctgtaacctcatctacttct

SEQ ID NO: 676865 - DNA, 25 bp, Mus musculus
gtatgctgtaacgtcatctacttct

SEQ ID NO: 676866 - DNA, 25 bp, Mus musculus
gtatgctgtagacaacattggccca

SEQ ID NO: 676867 - DNA, 25 bp, Mus musculus
gtatgctgtagagaacattggccca

SEQ ID NO: 676868 - DNA, 25 bp, Mus musculus
gtatgctgtccaagccaagtatgga

SEQ ID NO: 676869 - DNA, 25 bp, Mus musculus
gtatgctgtccatgccaagtatgga

SEQ ID NO: 676870 - DNA, 25 bp, Mus musculus
gtatgctgtcccaaaatatcgctga

SEQ ID NO: 676871 - DNA, 25 bp, Mus musculus
gtatgctgtccctaaatatcgctga

SEQ ID NO: 676872 - DNA, 25 bp, Mus musculus
gtatgctgtctcaaatgactgaaag

SEQ ID NO: 676873 - DNA, 25 bp, Mus musculus
gtatgctgtctctaatgactgaaag

SEQ ID NO: 676874 - DNA, 25 bp, Mus musculus
gtatgctgtgcgaaatctcactgaa

SEQ ID NO: 676875 - DNA, 25 bp, Mus musculus
gtatgctgtgcgtaatctcactgaa

SEQ ID NO: 676876 - DNA, 25 bp, Mus musculus
gtatgctgtgtgattgattgggtat

SEQ ID NO: 676877 - DNA, 25 bp, Mus musculus
gtatgctgtgtgtttgattgggtat

SEQ ID NO: 676878 - DNA, 25 bp, Mus musculus
gtatgctgttaacccaagtcttcac

SEQ ID NO: 676879 - DNA, 25 bp, Mus musculus
gtatgctgttaagccaagtcttcac

SEQ ID NO: 676880 - DNA, 25 bp, Mus musculus
gtatgctgttctcttacactatcca

SEQ ID NO: 676881 - DNA, 25 bp, Mus musculus
gtatgctgttctgttacactatcca

SEQ ID NO: 676882 - DNA, 25 bp, Mus musculus
gtatgctgttgaccgtgttttgctg

SEQ ID NO: 676883 - DNA, 25 bp, Mus musculus
gtatgctgttgagcgtgttttgctg

SEQ ID NO: 676884 - DNA, 25 bp, Mus musculus
gtatgcttacatactgatggctgaa

SEQ ID NO: 676885 - DNA, 25 bp, Mus musculus
gtatgcttacattctgatggctgaa

SEQ ID NO: 676886 - DNA, 25 bp, Mus musculus
gtatgcttactaccactaggtgcta

SEQ ID NO: 676887 - DNA, 25 bp, Mus musculus
gtatgcttactagcactaggtgcta

SEQ ID NO: 676888 - DNA, 25 bp, Mus musculus
gtatgcttactcaacagcacctggt

SEQ ID NO: 676889 - DNA, 25 bp, Mus musculus
gtatgcttactctacagcacctggt

SEQ ID NO: 676890 - DNA, 25 bp, Mus musculus
gtatgcttagggatattttgttctg

SEQ ID NO: 676891 - DNA, 25 bp, Mus musculus
gtatgcttagggttattttgttctg

SEQ ID NO: 676892 - DNA, 25 bp, Mus musculus
gtatgcttcaggacatgcggacgtt

SEQ ID NO: 676893 - DNA, 25 bp, Mus musculus
gtatgcttcaggtcatgcggacgtt

SEQ ID NO: 676894 - DNA, 25 bp, Mus musculus
gtatgcttcataactgctttacaga

SEQ ID NO: 676895 - DNA, 25 bp, Mus musculus
gtatgcttcatatctgctttacaga

SEQ ID NO: 676896 - DNA, 25 bp, Mus musculus
gtatgcttcttgattttatgttaat

SEQ ID NO: 676897 - DNA, 25 bp, Mus musculus
gtatgcttcttgtttttatgttaat

SEQ ID NO: 676898 - DNA, 25 bp, Mus musculus
gtatgcttctttccatagatgctaa

SEQ ID NO: 676899 - DNA, 25 bp, Mus musculus
gtatgcttctttgcatagatgctaa

SEQ ID NO: 676900 - DNA, 25 bp, Mus musculus
gtatgcttgaccatttgtaaaattt

SEQ ID NO: 676901 - DNA, 25 bp, Mus musculus
gtatgcttgaccttttgtaaaattt

SEQ ID NO: 676902 - DNA, 25 bp, Mus musculus
gtatgcttgatgcactaagaactta

SEQ ID NO: 676903 - DNA, 25 bp, Mus musculus
gtatgcttgatggactaagaactta

SEQ ID NO: 676904 - DNA, 25 bp, Mus musculus
gtatgcttgcatacctgagtgtgtg

SEQ ID NO: 676905 - DNA, 25 bp, Mus musculus
gtatgcttgcatcctgatagataat

SEQ ID NO: 676906 - DNA, 25 bp, Mus musculus
gtatgcttgcatgctgatagataat

SEQ ID NO: 676907 - DNA, 25 bp, Mus musculus
gtatgcttgcattcctgagtgtgtg

SEQ ID NO: 676908 - DNA, 25 bp, Mus musculus
gtatgcttgcgcctgacagtacagc

SEQ ID NO: 676909 - DNA, 25 bp, Mus musculus
gtatgcttgcgcgtgacagtacagc

SEQ ID NO: 676910 - DNA, 25 bp, Mus musculus
gtatgcttggaaataccggtcacag

SEQ ID NO: 676911 - DNA, 25 bp, Mus musculus
gtatgcttggaattaccggtcacag

SEQ ID NO: 676912 - DNA, 25 bp, Mus musculus
gtatgcttgggtacctaactctgga

SEQ ID NO: 676913 - DNA, 25 bp, Mus musculus
gtatgcttgggttcctaactctgga

SEQ ID NO: 676914 - DNA, 25 bp, Mus musculus
gtatgcttgtaaatttttccatatt

SEQ ID NO: 676915 - DNA, 25 bp, Mus musculus
gtatgcttgtaattttttccatatt

SEQ ID NO: 676916 - DNA, 25 bp, Mus musculus
gtatgcttgtagatcttactacaca

SEQ ID NO: 676917 - DNA, 25 bp, Mus musculus
gtatgcttgtagttcttactacaca

SEQ ID NO: 676918 - DNA, 25 bp, Mus musculus
gtatgctttcttcacccaaggcaga

SEQ ID NO: 676919 - DNA, 25 bp, Mus musculus
gtatgctttcttgacccaaggcaga

SEQ ID NO: 676920 - DNA, 25 bp, Mus musculus
gtatgctttgcaaatgagttgccat

SEQ ID NO: 676921 - DNA, 25 bp, Mus musculus
gtatgctttgcatatgagttgccat

SEQ ID NO: 676922 - DNA, 25 bp, Mus musculus
gtatgctttggtatatctactccat

SEQ ID NO: 676923 - DNA, 25 bp, Mus musculus
gtatgctttggtttatctactccat

SEQ ID NO: 676924 - DNA, 25 bp, Mus musculus
gtatgctttgttctctcaaaagagt

SEQ ID NO: 676925 - DNA, 25 bp, Mus musculus
gtatgctttgttgtctcaaaagagt

SEQ ID NO: 676926 - DNA, 25 bp, Mus musculus
gtatgcttttcgctgtgacacaatt

SEQ ID NO: 676927 - DNA, 25 bp, Mus musculus
gtatgcttttcggtgtgacacaatt

SEQ ID NO: 676928 - DNA, 25 bp, Mus musculus
gtatgcttttgaccttggttctcat

SEQ ID NO: 676929 - DNA, 25 bp, Mus musculus
gtatgcttttgagcttggttctcat

SEQ ID NO: 676930 - DNA, 25 bp, Mus musculus
gtatggaaacagctacttccccttg

SEQ ID NO: 676931 - DNA, 25 bp, Mus musculus
gtatggaaacaggtacttccccttg

SEQ ID NO: 676932 - DNA, 25 bp, Mus musculus
gtatggaaactgacggagggattca

SEQ ID NO: 676933 - DNA, 25 bp, Mus musculus
gtatggaaactgtcggagggattca

SEQ ID NO: 676934 - DNA, 25 bp, Mus musculus
gtatggaaatccacctagagcctgt

SEQ ID NO: 676935 - DNA, 25 bp, Mus musculus
gtatggaaatcctcctagagcctgt

SEQ ID NO: 676936 - DNA, 25 bp, Mus musculus
gtatggaacacgaggagaacctaaa

SEQ ID NO: 676937 - DNA, 25 bp, Mus musculus
gtatggaacacgtggagaacctaaa

SEQ ID NO: 676938 - DNA, 25 bp, Mus musculus
gtatggaaccaacatcgactctatt

SEQ ID NO: 676939 - DNA, 25 bp, Mus musculus
gtatggaaccaagatcgactctatt

SEQ ID NO: 676940 - DNA, 25 bp, Mus musculus
gtatggaactacacctttgccagca

SEQ ID NO: 676941 - DNA, 25 bp, Mus musculus
gtatggaactactcctttgccagca

SEQ ID NO: 676942 - DNA, 25 bp, Mus musculus
gtatggaactgtaagacttgctgca

SEQ ID NO: 676943 - DNA, 25 bp, Mus musculus
gtatggaactgttagacttgctgca

SEQ ID NO: 676944 - DNA, 25 bp, Mus musculus
gtatggaagcttcctaggacctgaa

SEQ ID NO: 676945 - DNA, 25 bp, Mus musculus
gtatggaagcttgctaggacctgaa

SEQ ID NO: 676946 - DNA, 25 bp, Mus musculus
gtatggaaggatcactctgcggtca

SEQ ID NO: 676947 - DNA, 25 bp, Mus musculus
gtatggaaggatgactctgcggtca

SEQ ID NO: 676948 - DNA, 25 bp, Mus musculus
gtatggaaggccaagccatgcccca

SEQ ID NO: 676949 - DNA, 25 bp, Mus musculus
gtatggaaggcctagccatgcccca

SEQ ID NO: 676950 - DNA, 25 bp, Mus musculus
gtatggaaggcgcatcctcatctct

SEQ ID NO: 676951 - DNA, 25 bp, Mus musculus
gtatggaaggcggatcctcatctct

SEQ ID NO: 676952 - DNA, 25 bp, Mus musculus
gtatggaaggctaaagtgacaaccc

SEQ ID NO: 676953 - DNA, 25 bp, Mus musculus
gtatggaaggcttaagtgacaaccc

SEQ ID NO: 676954 - DNA, 25 bp, Mus musculus
gtatggaagtatcacctatcaataa

SEQ ID NO: 676955 - DNA, 25 bp, Mus musculus
gtatggaagtatgacctatcaataa

SEQ ID NO: 676956 - DNA, 25 bp, Mus musculus
gtatggaatcagatttaccctgtgc

SEQ ID NO: 676957 - DNA, 25 bp, Mus musculus
gtatggaatcagttttaccctgtgc

SEQ ID NO: 676958 - DNA, 25 bp, Mus musculus
gtatggaatggaagtccagctcaaa

SEQ ID NO: 676959 - DNA, 25 bp, Mus musculus
gtatggaatggatgtccagctcaaa

SEQ ID NO: 676960 - DNA, 25 bp, Mus musculus
gtatggaatggtagtggcttaagaa

SEQ ID NO: 676961 - DNA, 25 bp, Mus musculus
gtatggaatggttgtggcttaagaa

SEQ ID NO: 676962 - DNA, 25 bp, Mus musculus
gtatggaattgtcggtccagtgtaa

SEQ ID NO: 676963 - DNA, 25 bp, Mus musculus
gtatggaattgtgggtccagtgtaa

SEQ ID NO: 676964 - DNA, 25 bp, Mus musculus
gtatggacatagagaccagtattgt

SEQ ID NO: 676965 - DNA, 25 bp, Mus musculus
gtatggacatagtgaccagtattgt

SEQ ID NO: 676966 - DNA, 25 bp, Mus musculus
gtatggacattgagctgcacattct

SEQ ID NO: 676967 - DNA, 25 bp, Mus musculus
gtatggacattgtgctgcacattct

SEQ ID NO: 676968 - DNA, 25 bp, Mus musculus
gtatggaccagaccatcttcccaaa

SEQ ID NO: 676969 - DNA, 25 bp, Mus musculus
gtatggaccagagcatcttcccaaa

SEQ ID NO: 676970 - DNA, 25 bp, Mus musculus
gtatggaccatgagaccctatttca

SEQ ID NO: 676971 - DNA, 25 bp, Mus musculus
gtatggaccatgtgaccctatttca

SEQ ID NO: 676972 - DNA, 25 bp, Mus musculus
gtatggacctaaaactttgctaatg

SEQ ID NO: 676973 - DNA, 25 bp, Mus musculus
gtatggacctaatactttgctaatg

SEQ ID NO: 676974 - DNA, 25 bp, Mus musculus
gtatggactatcagtatggtgcccc

SEQ ID NO: 676975 - DNA, 25 bp, Mus musculus
gtatggactatctgtatggtgcccc

SEQ ID NO: 676976 - DNA, 25 bp, Mus musculus
gtatggactccgcaacaaacgtgag

SEQ ID NO: 676977 - DNA, 25 bp, Mus musculus
gtatggactccggaacaaacgtgag

SEQ ID NO: 676978 - DNA, 25 bp, Mus musculus
gtatggacttgacatggcttcattg

SEQ ID NO: 676979 - DNA, 25 bp, Mus musculus
gtatggacttgagatggcttcattg

SEQ ID NO: 676980 - DNA, 25 bp, Mus musculus
gtatggagaccaaactcagatcatt

SEQ ID NO: 676981 - DNA, 25 bp, Mus musculus
gtatggagaccatactcagatcatt

SEQ ID NO: 676982 - DNA, 25 bp, Mus musculus
gtatggagagcgctgttcctcctta

SEQ ID NO: 676983 - DNA, 25 bp, Mus musculus
gtatggagagcggtgttcctcctta

SEQ ID NO: 676984 - DNA, 25 bp, Mus musculus
gtatggagttcactccttatcagca

SEQ ID NO: 676985 - DNA, 25 bp, Mus musculus
gtatggagttcagtccttatcagca

SEQ ID NO: 676986 - DNA, 25 bp, Mus musculus
gtatggagttttacacatggctttg

SEQ ID NO: 676987 - DNA, 25 bp, Mus musculus
gtatggagtttttcacatggctttg

SEQ ID NO: 676988 - DNA, 25 bp, Mus musculus
gtatggatacaaattccccacttcc

SEQ ID NO: 676989 - DNA, 25 bp, Mus musculus
gtatggatacaatttccccacttcc

SEQ ID NO: 676990 - DNA, 25 bp, Mus musculus
gtatggatacggatcccgaaacgat

SEQ ID NO: 676991 - DNA, 25 bp, Mus musculus
gtatggatacggttcccgaaacgat

SEQ ID NO: 676992 - DNA, 25 bp, Mus musculus
gtatggatacttatctgttgacaaa

SEQ ID NO: 676993 - DNA, 25 bp, Mus musculus
gtatggatacttttctgttgacaaa

SEQ ID NO: 676994 - DNA, 25 bp, Mus musculus
gtatggatcgcacgtctattataat

SEQ ID NO: 676995 - DNA, 25 bp, Mus musculus
gtatggatcgcaggtctattataat

SEQ ID NO: 676996 - DNA, 25 bp, Mus musculus
gtatggatcttacccgggacaaaat

SEQ ID NO: 676997 - DNA, 25 bp, Mus musculus
gtatggatcttagccgggacaaaat

SEQ ID NO: 676998 - DNA, 25 bp, Mus musculus
gtatggatgcatacacaacagataa

SEQ ID NO: 676999 - DNA, 25 bp, Mus musculus
gtatggatgcattcacaacagataa

SEQ ID NO: 677000 - DNA, 25 bp, Mus musculus
gtatggattcctaggaaaacctcaa

SEQ ID NO: 677001 - DNA, 25 bp, Mus musculus
gtatggattccttggaaaacctcaa

SEQ ID NO: 677002 - DNA, 25 bp, Mus musculus
gtatggattctgatagctgggatca

SEQ ID NO: 677003 - DNA, 25 bp, Mus musculus
gtatggattctgttagctgggatca

SEQ ID NO: 677004 - DNA, 25 bp, Mus musculus
gtatggattgtcatactttactgct

SEQ ID NO: 677005 - DNA, 25 bp, Mus musculus
gtatggattgtcttactttactgct

SEQ ID NO: 677006 - DNA, 25 bp, Mus musculus
gtatggcaaagtatcctgttcttat

SEQ ID NO: 677007 - DNA, 25 bp, Mus musculus
gtatggcaaagtttcctgttcttat

SEQ ID NO: 677008 - DNA, 25 bp, Mus musculus
gtatggcaacccatggactgcagtg

SEQ ID NO: 677009 - DNA, 25 bp, Mus musculus
gtatggcaacccttggactgcagtg

SEQ ID NO: 677010 - DNA, 25 bp, Mus musculus
gtatggcacattatctagacccagc

SEQ ID NO: 677011 - DNA, 25 bp, Mus musculus
gtatggcacattttctagacccagc

SEQ ID NO: 677012 - DNA, 25 bp, Mus musculus
gtatggcagcatagccaggagccta

SEQ ID NO: 677013 - DNA, 25 bp, Mus musculus
gtatggcagcattgccaggagccta

SEQ ID NO: 677014 - DNA, 25 bp, Mus musculus
gtatggcagcccatgaagatttgag

SEQ ID NO: 677015 - DNA, 25 bp, Mus musculus
gtatggcagcccttgaagatttgag

SEQ ID NO: 677016 - DNA, 25 bp, Mus musculus
gtatggcaggcaatattatcaaggg

SEQ ID NO: 677017 - DNA, 25 bp, Mus musculus
gtatggcaggcattattatcaaggg

SEQ ID NO: 677018 - DNA, 25 bp, Mus musculus
gtatggcagtgtctttaatgaggct

SEQ ID NO: 677019 - DNA, 25 bp, Mus musculus
gtatggcagtgtgtttaatgaggct

SEQ ID NO: 677020 - DNA, 25 bp, Mus musculus
gtatggcatcatacttctggcagaa

SEQ ID NO: 677021 - DNA, 25 bp, Mus musculus
gtatggcatcattcttctggcagaa

SEQ ID NO: 677022 - DNA, 25 bp, Mus musculus
gtatggcatctgcagttgtcagtca

SEQ ID NO: 677023 - DNA, 25 bp, Mus musculus
gtatggcatctggagttgtcagtca

SEQ ID NO: 677024 - DNA, 25 bp, Mus musculus
gtatggcatcttacagagaacacgc

SEQ ID NO: 677025 - DNA, 25 bp, Mus musculus
gtatggcatctttcagagaacacgc

SEQ ID NO: 677026 - DNA, 25 bp, Mus musculus
gtatggcatttcaggctctaagact

SEQ ID NO: 677027 - DNA, 25 bp, Mus musculus
gtatggcatttctggctctaagact

SEQ ID NO: 677028 - DNA, 25 bp, Mus musculus
gtatggccaccaagcgtactgtcaa

SEQ ID NO: 677029 - DNA, 25 bp, Mus musculus
gtatggccaccatgcgtactgtcaa

SEQ ID NO: 677030 - DNA, 25 bp, Mus musculus
gtatggccactacggatttttctca

SEQ ID NO: 677031 - DNA, 25 bp, Mus musculus
gtatggccactagggatttttctca

SEQ ID NO: 677032 - DNA, 25 bp, Mus musculus
gtatggccactgatgattttgtcaa

SEQ ID NO: 677033 - DNA, 25 bp, Mus musculus
gtatggccactgttgattttgtcaa

SEQ ID NO: 677034 - DNA, 25 bp, Mus musculus
gtatggccagccatggagccagcag

SEQ ID NO: 677035 - DNA, 25 bp, Mus musculus
gtatggccagccttggagccagcag

SEQ ID NO: 677036 - DNA, 25 bp, Mus musculus
gtatggccaggccttacagcttatg

SEQ ID NO: 677037 - DNA, 25 bp, Mus musculus
gtatggccaggcgttacagcttatg

SEQ ID NO: 677038 - DNA, 25 bp, Mus musculus
gtatggccatgcaatgacagccgtc

SEQ ID NO: 677039 - DNA, 25 bp, Mus musculus
gtatggccatgctatgacagccgtc

SEQ ID NO: 677040 - DNA, 25 bp, Mus musculus
gtatggccatggactctgttgaaca

SEQ ID NO: 677041 - DNA, 25 bp, Mus musculus
gtatggccatggtctctgttgaaca

SEQ ID NO: 677042 - DNA, 25 bp, Mus musculus
gtatggccattaaccagtttaaagc

SEQ ID NO: 677043 - DNA, 25 bp, Mus musculus
gtatggccattatccagtttaaagc

SEQ ID NO: 677044 - DNA, 25 bp, Mus musculus
gtatggcctatgctgcagtaatgca

SEQ ID NO: 677045 - DNA, 25 bp, Mus musculus
gtatggcctatggtgcagtaatgca

SEQ ID NO: 677046 - DNA, 25 bp, Mus musculus
gtatggcctgtgctatatagccatg

SEQ ID NO: 677047 - DNA, 25 bp, Mus musculus
gtatggcctgtggtatatagccatg

SEQ ID NO: 677048 - DNA, 25 bp, Mus musculus
gtatggccttgtaggcataggtaca

SEQ ID NO: 677049 - DNA, 25 bp, Mus musculus
gtatggccttgttggcataggtaca

SEQ ID NO: 677050 - DNA, 25 bp, Mus musculus
gtatggcctttcatagctatgatct

SEQ ID NO: 677051 - DNA, 25 bp, Mus musculus
gtatggcctttcttagctatgatct

SEQ ID NO: 677052 - DNA, 25 bp, Mus musculus
gtatggcctttgatttttgcataga

SEQ ID NO: 677053 - DNA, 25 bp, Mus musculus
gtatggcctttgttttttgcataga

SEQ ID NO: 677054 - DNA, 25 bp, Mus musculus
gtatggcgaactcgaacctgcccaa

SEQ ID NO: 677055 - DNA, 25 bp, Mus musculus
gtatggcgaactggaacctgcccaa

SEQ ID NO: 677056 - DNA, 25 bp, Mus musculus
gtatggcggacaaaccatctgacct

SEQ ID NO: 677057 - DNA, 25 bp, Mus musculus
gtatggcggacataccatctgacct

SEQ ID NO: 677058 - DNA, 25 bp, Mus musculus
gtatggcggtatctacatcccacct

SEQ ID NO: 677059 - DNA, 25 bp, Mus musculus
gtatggcggtatgtacatcccacct

SEQ ID NO: 677060 - DNA, 25 bp, Mus musculus
gtatggcgtgttagtgagtatgtat

SEQ ID NO: 677061 - DNA, 25 bp, Mus musculus
gtatggcgtgtttgtgagtatgtat

SEQ ID NO: 677062 - DNA, 25 bp, Mus musculus
gtatggctaatcagcgtcatgctga

SEQ ID NO: 677063 - DNA, 25 bp, Mus musculus
gtatggctaatctgcgtcatgctga

SEQ ID NO: 677064 - DNA, 25 bp, Mus musculus
gtatggctacagcttagaccggaca

SEQ ID NO: 677065 - DNA, 25 bp, Mus musculus
gtatggctacaggttagaccggaca

SEQ ID NO: 677066 - DNA, 25 bp, Mus musculus
gtatggctactcactaagaccttgt

SEQ ID NO: 677067 - DNA, 25 bp, Mus musculus
gtatggctactctctaagaccttgt

SEQ ID NO: 677068 - DNA, 25 bp, Mus musculus
gtatggctatgtccccagaactgca

SEQ ID NO: 677069 - DNA, 25 bp, Mus musculus
gtatggctatgtgcccagaactgca

SEQ ID NO: 677070 - DNA, 25 bp, Mus musculus
gtatggctcaacagccgggaaggaa

SEQ ID NO: 677071 - DNA, 25 bp, Mus musculus
gtatggctcaactgccgggaaggaa

SEQ ID NO: 677072 - DNA, 25 bp, Mus musculus
gtatggctcacaaactccagggtat

SEQ ID NO: 677073 - DNA, 25 bp, Mus musculus
gtatggctcacatactccagggtat

SEQ ID NO: 677074 - DNA, 25 bp, Mus musculus
gtatggctcagtctactttacagtt

SEQ ID NO: 677075 - DNA, 25 bp, Mus musculus
gtatggctcagtgtactttacagtt

SEQ ID NO: 677076 - DNA, 25 bp, Mus musculus
gtatggctccatcctgaaacgcggg

SEQ ID NO: 677077 - DNA, 25 bp, Mus musculus
gtatggctccatgctgaaacgcggg

SEQ ID NO: 677078 - DNA, 25 bp, Mus musculus
gtatggctcgagagtaggacctgac

SEQ ID NO: 677079 - DNA, 25 bp, Mus musculus
gtatggctcgagtgtaggacctgac

SEQ ID NO: 677080 - DNA, 25 bp, Mus musculus
gtatggctgcatacaccagaccaga

SEQ ID NO: 677081 - DNA, 25 bp, Mus musculus
gtatggctgcattcaccagaccaga

SEQ ID NO: 677082 - DNA, 25 bp, Mus musculus
gtatggctgcctatgtgtgatcccc

SEQ ID NO: 677083 - DNA, 25 bp, Mus musculus
gtatggctgcctttgtgtgatcccc

SEQ ID NO: 677084 - DNA, 25 bp, Mus musculus
gtatggctggagaaatcgccacccc

SEQ ID NO: 677085 - DNA, 25 bp, Mus musculus
gtatggctggagtaatcgccacccc

SEQ ID NO: 677086 - DNA, 25 bp, Mus musculus
gtatggctgtcaactgcgtctgaca

SEQ ID NO: 677087 - DNA, 25 bp, Mus musculus
gtatggctgtcatctgcgtctgaca

SEQ ID NO: 677088 - DNA, 25 bp, Mus musculus
gtatggcttcacacgcttggtaact

SEQ ID NO: 677089 - DNA, 25 bp, Mus musculus
gtatggcttcactcgcttggtaact

SEQ ID NO: 677090 - DNA, 25 bp, Mus musculus
gtatggcttcagactgccacaggta

SEQ ID NO: 677091 - DNA, 25 bp, Mus musculus
gtatggcttcagtctgccacaggta

SEQ ID NO: 677092 - DNA, 25 bp, Mus musculus
gtatggcttcctaatacgaattatt

SEQ ID NO: 677093 - DNA, 25 bp, Mus musculus
gtatggcttccttatacgaattatt

SEQ ID NO: 677094 - DNA, 25 bp, Mus musculus
gtatggcttgccagagtaaactctg

SEQ ID NO: 677095 - DNA, 25 bp, Mus musculus
gtatggcttgcctgagtaaactctg

SEQ ID NO: 677096 - DNA, 25 bp, Mus musculus
gtatggcttgctagagaaatatctt

SEQ ID NO: 677097 - DNA, 25 bp, Mus musculus
gtatggcttgcttgagaaatatctt

SEQ ID NO: 677098 - DNA, 25 bp, Mus musculus
gtatggcttgtacatctgaagtcag

SEQ ID NO: 677099 - DNA, 25 bp, Mus musculus
gtatggcttgtacccagatggcgca

SEQ ID NO: 677100 - DNA, 25 bp, Mus musculus
gtatggcttgtagatctgaagtcag

SEQ ID NO: 677101 - DNA, 25 bp, Mus musculus
gtatggcttgtagccagatggcgca

SEQ ID NO: 677102 - DNA, 25 bp, Mus musculus
gtatggcttgtgcaacgtcgtcacc

SEQ ID NO: 677103 - DNA, 25 bp, Mus musculus
gtatggcttgtggaacgtcgtcacc

SEQ ID NO: 677104 - DNA, 25 bp, Mus musculus
gtatggctttatcaactcggctctt

SEQ ID NO: 677105 - DNA, 25 bp, Mus musculus
gtatggctttatgaactcggctctt

SEQ ID NO: 677106 - DNA, 25 bp, Mus musculus
gtatggcttttaagttcttagaaac

SEQ ID NO: 677107 - DNA, 25 bp, Mus musculus
gtatggcttttatgttcttagaaac

SEQ ID NO: 677108 - DNA, 25 bp, Mus musculus
gtatgggaaacacatcggctccctc

SEQ ID NO: 677109 - DNA, 25 bp, Mus musculus
gtatgggaaacagatcggctccctc

SEQ ID NO: 677110 - DNA, 25 bp, Mus musculus
gtatgggaagcaacgcctagcaatg

SEQ ID NO: 677111 - DNA, 25 bp, Mus musculus
gtatgggaagcatcgcctagcaatg

SEQ ID NO: 677112 - DNA, 25 bp, Mus musculus
gtatgggaatatagctccgagcact

SEQ ID NO: 677113 - DNA, 25 bp, Mus musculus
gtatgggaatattgctccgagcact

SEQ ID NO: 677114 - DNA, 25 bp, Mus musculus
gtatgggactatcgtctttattatg

SEQ ID NO: 677115 - DNA, 25 bp, Mus musculus
gtatgggactatggtctttattatg

SEQ ID NO: 677116 - DNA, 25 bp, Mus musculus
gtatgggatcgtacctatgggtaga

SEQ ID NO: 677117 - DNA, 25 bp, Mus musculus
gtatgggatcgttcctatgggtaga

SEQ ID NO: 677118 - DNA, 25 bp, Mus musculus
gtatgggcacacacgagcttacaga

SEQ ID NO: 677119 - DNA, 25 bp, Mus musculus
gtatgggcacactcgagcttacaga

SEQ ID NO: 677120 - DNA, 25 bp, Mus musculus
gtatgggcacctattcataggacca

SEQ ID NO: 677121 - DNA, 25 bp, Mus musculus
gtatgggcaccttttcataggacca

SEQ ID NO: 677122 - DNA, 25 bp, Mus musculus
gtatgggcaggaatgcagatctctt

SEQ ID NO: 677123 - DNA, 25 bp, Mus musculus
gtatgggcaggattgcagatctctt

SEQ ID NO: 677124 - DNA, 25 bp, Mus musculus
gtatgggccttgaacaggtatcaca

SEQ ID NO: 677125 - DNA, 25 bp, Mus musculus
gtatgggccttgtacaggtatcaca

SEQ ID NO: 677126 - DNA, 25 bp, Mus musculus
gtatgggcggtcaagagactacagt

SEQ ID NO: 677127 - DNA, 25 bp, Mus musculus
gtatgggcggtctagagactacagt

SEQ ID NO: 677128 - DNA, 25 bp, Mus musculus
gtatgggctccgaatttgtgaaaat

SEQ ID NO: 677129 - DNA, 25 bp, Mus musculus
gtatgggctccgtatttgtgaaaat

SEQ ID NO: 677130 - DNA, 25 bp, Mus musculus
gtatgggcttacacctcaggagact

SEQ ID NO: 677131 - DNA, 25 bp, Mus musculus
gtatgggcttactcctcaggagact

SEQ ID NO: 677132 - DNA, 25 bp, Mus musculus
gtatgggcttagaatacctcaacta

SEQ ID NO: 677133 - DNA, 25 bp, Mus musculus
gtatgggcttagtatacctcaacta

SEQ ID NO: 677134 - DNA, 25 bp, Mus musculus
gtatgggtagataatgccgaagctc

SEQ ID NO: 677135 - DNA, 25 bp, Mus musculus
gtatgggtagattatgccgaagctc

SEQ ID NO: 677136 - DNA, 25 bp, Mus musculus
gtatgggtattgagcttgcctgtat

SEQ ID NO: 677137 - DNA, 25 bp, Mus musculus
gtatgggtattgtgcttgcctgtat

SEQ ID NO: 677138 - DNA, 25 bp, Mus musculus
gtatgggtcttacaaacatgcctga

SEQ ID NO: 677139 - DNA, 25 bp, Mus musculus
gtatgggtcttagaaacatgcctga

SEQ ID NO: 677140 - DNA, 25 bp, Mus musculus
gtatgggtgattactcggttttatt

SEQ ID NO: 677141 - DNA, 25 bp, Mus musculus
gtatgggtgatttctcggttttatt

SEQ ID NO: 677142 - DNA, 25 bp, Mus musculus
gtatgggtgcttacatgggacactt

SEQ ID NO: 677143 - DNA, 25 bp, Mus musculus
gtatgggtgctttcatgggacactt

SEQ ID NO: 677144 - DNA, 25 bp, Mus musculus
gtatggtaactcctagctactcaga

SEQ ID NO: 677145 - DNA, 25 bp, Mus musculus
gtatggtaactcgtagctactcaga

SEQ ID NO: 677146 - DNA, 25 bp, Mus musculus
gtatggtacaatagagtgcctgtga

SEQ ID NO: 677147 - DNA, 25 bp, Mus musculus
gtatggtacaattgagtgcctgtga

SEQ ID NO: 677148 - DNA, 25 bp, Mus musculus
gtatggtacatgagtgggagagcct

SEQ ID NO: 677149 - DNA, 25 bp, Mus musculus
gtatggtacatgtgtgggagagcct

SEQ ID NO: 677150 - DNA, 25 bp, Mus musculus
gtatggtaccatcgaaggagcactg

SEQ ID NO: 677151 - DNA, 25 bp, Mus musculus
gtatggtaccatggaaggagcactg

SEQ ID NO: 677152 - DNA, 25 bp, Mus musculus
gtatggtaccgactttaaatcacag

SEQ ID NO: 677153 - DNA, 25 bp, Mus musculus
gtatggtaccgagtttaaatcacag

SEQ ID NO: 677154 - DNA, 25 bp, Mus musculus
gtatggtactagcacaccactgcat

SEQ ID NO: 677155 - DNA, 25 bp, Mus musculus
gtatggtactaggacaccactgcat

SEQ ID NO: 677156 - DNA, 25 bp, Mus musculus
gtatggtagatgagcccctgactgg

SEQ ID NO: 677157 - DNA, 25 bp, Mus musculus
gtatggtagatgtgcccctgactgg

SEQ ID NO: 677158 - DNA, 25 bp, Mus musculus
gtatggtaggctattgtgaccactt

SEQ ID NO: 677159 - DNA, 25 bp, Mus musculus
gtatggtaggcttttgtgaccactt

SEQ ID NO: 677160 - DNA, 25 bp, Mus musculus
gtatggtagtggagactgtctctca

SEQ ID NO: 677161 - DNA, 25 bp, Mus musculus
gtatggtagtggtgactgtctctca

SEQ ID NO: 677162 - DNA, 25 bp, Mus musculus
gtatggtagttcacactggatgcta

SEQ ID NO: 677163 - DNA, 25 bp, Mus musculus
gtatggtagttctcactggatgcta

SEQ ID NO: 677164 - DNA, 25 bp, Mus musculus
gtatggtcaacaaattgctcacaga

SEQ ID NO: 677165 - DNA, 25 bp, Mus musculus
gtatggtcaacatattgctcacaga

SEQ ID NO: 677166 - DNA, 25 bp, Mus musculus
gtatggtcacatccattctgtcaat

SEQ ID NO: 677167 - DNA, 25 bp, Mus musculus
gtatggtcacatgcattctgtcaat

SEQ ID NO: 677168 - DNA, 25 bp, Mus musculus
gtatggtcaccaccggaatggacat

SEQ ID NO: 677169 - DNA, 25 bp, Mus musculus
gtatggtcaccagcggaatggacat

SEQ ID NO: 677170 - DNA, 25 bp, Mus musculus
gtatggtccactatgttaacacttt

SEQ ID NO: 677171 - DNA, 25 bp, Mus musculus
gtatggtccactttgttaacacttt

SEQ ID NO: 677172 - DNA, 25 bp, Mus musculus
gtatggtccatacgtgtcccagctg

SEQ ID NO: 677173 - DNA, 25 bp, Mus musculus
gtatggtccataggtgtcccagctg

SEQ ID NO: 677174 - DNA, 25 bp, Mus musculus
gtatggtccattaaaaaccctgcac

SEQ ID NO: 677175 - DNA, 25 bp, Mus musculus
gtatggtccatttaaaaccctgcac

SEQ ID NO: 677176 - DNA, 25 bp, Mus musculus
gtatggtcgaggaaccagcttctcc

SEQ ID NO: 677177 - DNA, 25 bp, Mus musculus
gtatggtcgaggtaccagcttctcc

SEQ ID NO: 677178 - DNA, 25 bp, Mus musculus
gtatggtctcatacagtggtttgta

SEQ ID NO: 677179 - DNA, 25 bp, Mus musculus
gtatggtctcattcagtggtttgta

SEQ ID NO: 677180 - DNA, 25 bp, Mus musculus
gtatggtgaccacaataaagttgtt

SEQ ID NO: 677181 - DNA, 25 bp, Mus musculus
gtatggtgaccagaataaagttgtt

SEQ ID NO: 677182 - DNA, 25 bp, Mus musculus
gtatggtgccccatttttggcggcc

SEQ ID NO: 677183 - DNA, 25 bp, Mus musculus
gtatggtgccccttttttggcggcc

SEQ ID NO: 677184 - DNA, 25 bp, Mus musculus
gtatggtgctagagcttagcgtcat

SEQ ID NO: 677185 - DNA, 25 bp, Mus musculus
gtatggtgctagtgcttagcgtcat

SEQ ID NO: 677186 - DNA, 25 bp, Mus musculus
gtatggtggactaacctttctttca

SEQ ID NO: 677187 - DNA, 25 bp, Mus musculus
gtatggtggacttacctttctttca

SEQ ID NO: 677188 - DNA, 25 bp, Mus musculus
gtatggtggccaacagaaagctgtc

SEQ ID NO: 677189 - DNA, 25 bp, Mus musculus
gtatggtggccatcagaaagctgtc

SEQ ID NO: 677190 - DNA, 25 bp, Mus musculus
gtatggtgtcacctctgatgtgcta

SEQ ID NO: 677191 - DNA, 25 bp, Mus musculus
gtatggtgtcacgtctgatgtgcta

SEQ ID NO: 677192 - DNA, 25 bp, Mus musculus
gtatggtgttcaaattattgtgtcc

SEQ ID NO: 677193 - DNA, 25 bp, Mus musculus
gtatggtgttcacattcctgggcga

SEQ ID NO: 677194 - DNA, 25 bp, Mus musculus
gtatggtgttcagattcctgggcga

SEQ ID NO: 677195 - DNA, 25 bp, Mus musculus
gtatggtgttcatattattgtgtcc

SEQ ID NO: 677196 - DNA, 25 bp, Mus musculus
gtatggtgttgactccagacacaca

SEQ ID NO: 677197 - DNA, 25 bp, Mus musculus
gtatggtgttgagtccagacacaca

SEQ ID NO: 677198 - DNA, 25 bp, Mus musculus
gtatggttacacacctaaagctttc

SEQ ID NO: 677199 - DNA, 25 bp, Mus musculus
gtatggttacactcctaaagctttc

SEQ ID NO: 677200 - DNA, 25 bp, Mus musculus
gtatggttactcagtcgggagctcc

SEQ ID NO: 677201 - DNA, 25 bp, Mus musculus
gtatggttactctgtcgggagctcc

SEQ ID NO: 677202 - DNA, 25 bp, Mus musculus
gtatggttagtgactgtaccaccca

SEQ ID NO: 677203 - DNA, 25 bp, Mus musculus
gtatggttagtgtctgtaccaccca

SEQ ID NO: 677204 - DNA, 25 bp, Mus musculus
gtatggtttcatagccctatctatt

SEQ ID NO: 677205 - DNA, 25 bp, Mus musculus
gtatggtttcattgccctatctatt

SEQ ID NO: 677206 - DNA, 25 bp, Mus musculus
gtatggtttccaagtgctccaggga

SEQ ID NO: 677207 - DNA, 25 bp, Mus musculus
gtatggtttccatgtgctccaggga

SEQ ID NO: 677208 - DNA, 25 bp, Mus musculus
gtatggtttctcagttctacaatat

SEQ ID NO: 677209 - DNA, 25 bp, Mus musculus
gtatggtttctctgttctacaatat

SEQ ID NO: 677210 - DNA, 25 bp, Mus musculus
gtatggtttgggacagttttcatct

SEQ ID NO: 677211 - DNA, 25 bp, Mus musculus
gtatggtttgggtcagttttcatct

SEQ ID NO: 677212 - DNA, 25 bp, Mus musculus
gtatggtttgtgaactctacattca

SEQ ID NO: 677213 - DNA, 25 bp, Mus musculus
gtatggtttgtgtactctacattca

SEQ ID NO: 677214 - DNA, 25 bp, Mus musculus
gtatggttttatcttcatcatggat

SEQ ID NO: 677215 - DNA, 25 bp, Mus musculus
gtatggttttatgttcatcatggat

SEQ ID NO: 677216 - DNA, 25 bp, Mus musculus
gtatggttttgacaataggctttta

SEQ ID NO: 677217 - DNA, 25 bp, Mus musculus
gtatggttttgagaataggctttta

SEQ ID NO: 677218 - DNA, 25 bp, Mus musculus
gtatgtaaaaacacaatcacccttt

SEQ ID NO: 677219 - DNA, 25 bp, Mus musculus
gtatgtaaaaactcaatcacccttt

SEQ ID NO: 677220 - DNA, 25 bp, Mus musculus
gtatgtaaaaccatcgctttccctc

SEQ ID NO: 677221 - DNA, 25 bp, Mus musculus
gtatgtaaaaccttcgctttccctc

SEQ ID NO: 677222 - DNA, 25 bp, Mus musculus
gtatgtaaaccaccagctatgctta

SEQ ID NO: 677223 - DNA, 25 bp, Mus musculus
gtatgtaaaccagcagctatgctta

SEQ ID NO: 677224 - DNA, 25 bp, Mus musculus
gtatgtaaattaccctcctgatgtt

SEQ ID NO: 677225 - DNA, 25 bp, Mus musculus
gtatgtaaattagcctcctgatgtt

SEQ ID NO: 677226 - DNA, 25 bp, Mus musculus
gtatgtaacatgaagacacctgcca

SEQ ID NO: 677227 - DNA, 25 bp, Mus musculus
gtatgtaacatgtagacacctgcca

SEQ ID NO: 677228 - DNA, 25 bp, Mus musculus
gtatgtaacctaccatgtttgctcc

SEQ ID NO: 677229 - DNA, 25 bp, Mus musculus
gtatgtaacctagcatgtttgctcc

SEQ ID NO: 677230 - DNA, 25 bp, Mus musculus
gtatgtaagattaaaaccagtagtt

SEQ ID NO: 677231 - DNA, 25 bp, Mus musculus
gtatgtaagatttaaaccagtagtt

SEQ ID NO: 677232 - DNA, 25 bp, Mus musculus
gtatgtaagcatctgctcccatgcc

SEQ ID NO: 677233 - DNA, 25 bp, Mus musculus
gtatgtaagcatgtgctcccatgcc

SEQ ID NO: 677234 - DNA, 25 bp, Mus musculus
gtatgtaaggacactcacagccctc

SEQ ID NO: 677235 - DNA, 25 bp, Mus musculus
gtatgtaaggactctcacagccctc

SEQ ID NO: 677236 - DNA, 25 bp, Mus musculus
gtatgtaagttaaccaatcgcatta

SEQ ID NO: 677237 - DNA, 25 bp, Mus musculus
gtatgtaagttatccaatcgcatta

SEQ ID NO: 677238 - DNA, 25 bp, Mus musculus
gtatgtaatcacatggacttccttt

SEQ ID NO: 677239 - DNA, 25 bp, Mus musculus
gtatgtaatcacttggacttccttt

SEQ ID NO: 677240 - DNA, 25 bp, Mus musculus
gtatgtaatggtcgttttgtcccat

SEQ ID NO: 677241 - DNA, 25 bp, Mus musculus
gtatgtaatggtggttttgtcccat

SEQ ID NO: 677242 - DNA, 25 bp, Mus musculus
gtatgtacacacagactaattttgt

SEQ ID NO: 677243 - DNA, 25 bp, Mus musculus
gtatgtacacacagtggcactcctg

SEQ ID NO: 677244 - DNA, 25 bp, Mus musculus
gtatgtacacactgactaattttgt

SEQ ID NO: 677245 - DNA, 25 bp, Mus musculus
gtatgtacacactgtggcactcctg

SEQ ID NO: 677246 - DNA, 25 bp, Mus musculus
gtatgtacacatacatgcaaacagg

SEQ ID NO: 677247 - DNA, 25 bp, Mus musculus
gtatgtacacatcccttcaagttgt

SEQ ID NO: 677248 - DNA, 25 bp, Mus musculus
gtatgtacacatgccttcaagttgt

SEQ ID NO: 677249 - DNA, 25 bp, Mus musculus
gtatgtacacattcatgcaaacagg

SEQ ID NO: 677250 - DNA, 25 bp, Mus musculus
gtatgtacagctacttttggtctcg

SEQ ID NO: 677251 - DNA, 25 bp, Mus musculus
gtatgtacagcttcttttggtctcg

SEQ ID NO: 677252 - DNA, 25 bp, Mus musculus
gtatgtacaggccatcgtctcagtc

SEQ ID NO: 677253 - DNA, 25 bp, Mus musculus
gtatgtacaggcgatcgtctcagtc

SEQ ID NO: 677254 - DNA, 25 bp, Mus musculus
gtatgtacaggtcctcatctgtggc

SEQ ID NO: 677255 - DNA, 25 bp, Mus musculus
gtatgtacaggtgctcatctgtggc

SEQ ID NO: 677256 - DNA, 25 bp, Mus musculus
gtatgtacatccatgcctgtatctg

SEQ ID NO: 677257 - DNA, 25 bp, Mus musculus
gtatgtacatccttgcctgtatctg

SEQ ID NO: 677258 - DNA, 25 bp, Mus musculus
gtatgtacattgctgctgctttgta

SEQ ID NO: 677259 - DNA, 25 bp, Mus musculus
gtatgtacattggtgctgctttgta

SEQ ID NO: 677260 - DNA, 25 bp, Mus musculus
gtatgtaccaggctcagcccatatg

SEQ ID NO: 677261 - DNA, 25 bp, Mus musculus
gtatgtaccagggtcagcccatatg

SEQ ID NO: 677262 - DNA, 25 bp, Mus musculus
gtatgtaccatgctaccagggatcc

SEQ ID NO: 677263 - DNA, 25 bp, Mus musculus
gtatgtaccatggtaccagggatcc

SEQ ID NO: 677264 - DNA, 25 bp, Mus musculus
gtatgtacccttcttattctgcatg

SEQ ID NO: 677265 - DNA, 25 bp, Mus musculus
gtatgtacccttgttattctgcatg

SEQ ID NO: 677266 - DNA, 25 bp, Mus musculus
gtatgtaccgtgctccagtgactaa

SEQ ID NO: 677267 - DNA, 25 bp, Mus musculus
gtatgtaccgtggtccagtgactaa

SEQ ID NO: 677268 - DNA, 25 bp, Mus musculus
gtatgtacctataataaaccctttg

SEQ ID NO: 677269 - DNA, 25 bp, Mus musculus
gtatgtacctattataaaccctttg

SEQ ID NO: 677270 - DNA, 25 bp, Mus musculus
gtatgtacctgacaagaacctgtga

SEQ ID NO: 677271 - DNA, 25 bp, Mus musculus
gtatgtacctgagaagaacctgtga

SEQ ID NO: 677272 - DNA, 25 bp, Mus musculus
gtatgtacgtgactgaggtccctat

SEQ ID NO: 677273 - DNA, 25 bp, Mus musculus
gtatgtacgtgagtgaggtccctat

SEQ ID NO: 677274 - DNA, 25 bp, Mus musculus
gtatgtactagtccttctaccacaa

SEQ ID NO: 677275 - DNA, 25 bp, Mus musculus
gtatgtactagtgcttctaccacaa

SEQ ID NO: 677276 - DNA, 25 bp, Mus musculus
gtatgtactgttcaccataggtgga

SEQ ID NO: 677277 - DNA, 25 bp, Mus musculus
gtatgtactgttgaccataggtgga

SEQ ID NO: 677278 - DNA, 25 bp, Mus musculus
gtatgtacttccagtctggattgca

SEQ ID NO: 677279 - DNA, 25 bp, Mus musculus
gtatgtacttcctgtctggattgca

SEQ ID NO: 677280 - DNA, 25 bp, Mus musculus
gtatgtagaaagctccatgtttctt

SEQ ID NO: 677281 - DNA, 25 bp, Mus musculus
gtatgtagaaaggtccatgtttctt

SEQ ID NO: 677282 - DNA, 25 bp, Mus musculus
gtatgtagacctatgtaggctctaa

SEQ ID NO: 677283 - DNA, 25 bp, Mus musculus
gtatgtagacctttgtaggctctaa

SEQ ID NO: 677284 - DNA, 25 bp, Mus musculus
gtatgtagcaaactgcttgcctcaa

SEQ ID NO: 677285 - DNA, 25 bp, Mus musculus
gtatgtagcaaagtgcttgcctcaa

SEQ ID NO: 677286 - DNA, 25 bp, Mus musculus
gtatgtagcaatctggcccagggca

SEQ ID NO: 677287 - DNA, 25 bp, Mus musculus
gtatgtagcaatgtggcccagggca

SEQ ID NO: 677288 - DNA, 25 bp, Mus musculus
gtatgtagcactcctgtgtgctctc

SEQ ID NO: 677289 - DNA, 25 bp, Mus musculus
gtatgtagcactgctgtgtgctctc

SEQ ID NO: 677290 - DNA, 25 bp, Mus musculus
gtatgtagccgtatatttctgtcca

SEQ ID NO: 677291 - DNA, 25 bp, Mus musculus
gtatgtagccgtttatttctgtcca

SEQ ID NO: 677292 - DNA, 25 bp, Mus musculus
gtatgtagctcactccttattctga

SEQ ID NO: 677293 - DNA, 25 bp, Mus musculus
gtatgtagctcagtccttattctga

SEQ ID NO: 677294 - DNA, 25 bp, Mus musculus
gtatgtaggcctcccgtcatacatg

SEQ ID NO: 677295 - DNA, 25 bp, Mus musculus
gtatgtaggcctgccgtcatacatg

SEQ ID NO: 677296 - DNA, 25 bp, Mus musculus
gtatgtaggcttactggtttgtttc

SEQ ID NO: 677297 - DNA, 25 bp, Mus musculus
gtatgtaggctttctggtttgtttc

SEQ ID NO: 677298 - DNA, 25 bp, Mus musculus
gtatgtagtccactggcaactgtgt

SEQ ID NO: 677299 - DNA, 25 bp, Mus musculus
gtatgtagtccagtggcaactgtgt

SEQ ID NO: 677300 - DNA, 25 bp, Mus musculus
gtatgtagttctcccaagatggtca

SEQ ID NO: 677301 - DNA, 25 bp, Mus musculus
gtatgtagttctgccaagatggtca

SEQ ID NO: 677302 - DNA, 25 bp, Mus musculus
gtatgtagttttctctcaagtgttt

SEQ ID NO: 677303 - DNA, 25 bp, Mus musculus
gtatgtagttttgtctcaagtgttt

SEQ ID NO: 677304 - DNA, 25 bp, Mus musculus
gtatgtataaaccaaccgcgtcctg

SEQ ID NO: 677305 - DNA, 25 bp, Mus musculus
gtatgtataaacgaaccgcgtcctg

SEQ ID NO: 677306 - DNA, 25 bp, Mus musculus
gtatgtataagtactgtgacagtac

SEQ ID NO: 677307 - DNA, 25 bp, Mus musculus
gtatgtataagttctgtgacagtac

SEQ ID NO: 677308 - DNA, 25 bp, Mus musculus
gtatgtatatgtctaaagtttgtga

SEQ ID NO: 677309 - DNA, 25 bp, Mus musculus
gtatgtatatgtgtaaagtttgtga

SEQ ID NO: 677310 - DNA, 25 bp, Mus musculus
gtatgtatccatacgtaaatatgtt

SEQ ID NO: 677311 - DNA, 25 bp, Mus musculus
gtatgtatccattcgtaaatatgtt

SEQ ID NO: 677312 - DNA, 25 bp, Mus musculus
gtatgtatctagagttggcctgcaa

SEQ ID NO: 677313 - DNA, 25 bp, Mus musculus
gtatgtatctagtgttggcctgcaa

SEQ ID NO: 677314 - DNA, 25 bp, Mus musculus
gtatgtatctctcaagagccttttt

SEQ ID NO: 677315 - DNA, 25 bp, Mus musculus
gtatgtatctctgaagagccttttt

SEQ ID NO: 677316 - DNA, 25 bp, Mus musculus
gtatgtatctgaattatcttttgga

SEQ ID NO: 677317 - DNA, 25 bp, Mus musculus
gtatgtatctgatttatcttttgga

SEQ ID NO: 677318 - DNA, 25 bp, Mus musculus
gtatgtatgactctctcttgttttg

SEQ ID NO: 677319 - DNA, 25 bp, Mus musculus
gtatgtatgactgtctcttgttttg

SEQ ID NO: 677320 - DNA, 25 bp, Mus musculus
gtatgtatgcaaacacagccctgct

SEQ ID NO: 677321 - DNA, 25 bp, Mus musculus
gtatgtatgcaatcacagccctgct

SEQ ID NO: 677322 - DNA, 25 bp, Mus musculus
gtatgtatgcatcgttatttgtcaa

SEQ ID NO: 677323 - DNA, 25 bp, Mus musculus
gtatgtatgcatggttatttgtcaa

SEQ ID NO: 677324 - DNA, 25 bp, Mus musculus
gtatgtatgccaaggatgtatgcct

SEQ ID NO: 677325 - DNA, 25 bp, Mus musculus
gtatgtatgccatggatgtatgcct

SEQ ID NO: 677326 - DNA, 25 bp, Mus musculus
gtatgtatgcgtctatacacatgca

SEQ ID NO: 677327 - DNA, 25 bp, Mus musculus
gtatgtatgcgtgtatacacatgca

SEQ ID NO: 677328 - DNA, 25 bp, Mus musculus
gtatgtatgcttctaatgagagatg

SEQ ID NO: 677329 - DNA, 25 bp, Mus musculus
gtatgtatgcttgtaatgagagatg

SEQ ID NO: 677330 - DNA, 25 bp, Mus musculus
gtatgtatggaaacatgcccacaca

SEQ ID NO: 677331 - DNA, 25 bp, Mus musculus
gtatgtatggaatcatgcccacaca

SEQ ID NO: 677332 - DNA, 25 bp, Mus musculus
gtatgtatgtcactccctggaattc

SEQ ID NO: 677333 - DNA, 25 bp, Mus musculus
gtatgtatgtcagtccctggaattc

SEQ ID NO: 677334 - DNA, 25 bp, Mus musculus
gtatgtatgtgcagaacccttagag

SEQ ID NO: 677335 - DNA, 25 bp, Mus musculus
gtatgtatgtgctgaacccttagag

SEQ ID NO: 677336 - DNA, 25 bp, Mus musculus
gtatgtatgtggcatctctctctca

SEQ ID NO: 677337 - DNA, 25 bp, Mus musculus
gtatgtatgtggctataccatgtat

SEQ ID NO: 677338 - DNA, 25 bp, Mus musculus
gtatgtatgtgggatctctctctca

SEQ ID NO: 677339 - DNA, 25 bp, Mus musculus
gtatgtatgtgggtataccatgtat

SEQ ID NO: 677340 - DNA, 25 bp, Mus musculus
gtatgtatgtgtacttgtacccctt

SEQ ID NO: 677341 - DNA, 25 bp, Mus musculus
gtatgtatgtgttcttgtacccctt

SEQ ID NO: 677342 - DNA, 25 bp, Mus musculus
gtatgtattcacaagcacttattga

SEQ ID NO: 677343 - DNA, 25 bp, Mus musculus
gtatgtattcactagcacttattga

SEQ ID NO: 677344 - DNA, 25 bp, Mus musculus
gtatgtattgaacacacagacgcca

SEQ ID NO: 677345 - DNA, 25 bp, Mus musculus
gtatgtattgaagacacagacgcca

SEQ ID NO: 677346 - DNA, 25 bp, Mus musculus
gtatgtatttacatcccgaagaata

SEQ ID NO: 677347 - DNA, 25 bp, Mus musculus
gtatgtatttacttcccgaagaata

SEQ ID NO: 677348 - DNA, 25 bp, Mus musculus
gtatgtatttatagcttgaacttct

SEQ ID NO: 677349 - DNA, 25 bp, Mus musculus
gtatgtatttattgcttgaacttct

SEQ ID NO: 677350 - DNA, 25 bp, Mus musculus
gtatgtatttttaatgggtccctat

SEQ ID NO: 677351 - DNA, 25 bp, Mus musculus
gtatgtattttttatgggtccctat

SEQ ID NO: 677352 - DNA, 25 bp, Mus musculus
gtatgtcaacttaaggaacctgatg

SEQ ID NO: 677353 - DNA, 25 bp, Mus musculus
gtatgtcaactttaggaacctgatg

SEQ ID NO: 677354 - DNA, 25 bp, Mus musculus
gtatgtcaatagcacaagcctctaa

SEQ ID NO: 677355 - DNA, 25 bp, Mus musculus
gtatgtcaataggacaagcctctaa

SEQ ID NO: 677356 - DNA, 25 bp, Mus musculus
gtatgtcaccaaagtcttctctgga

SEQ ID NO: 677357 - DNA, 25 bp, Mus musculus
gtatgtcaccaatgtcttctctgga

SEQ ID NO: 677358 - DNA, 25 bp, Mus musculus
gtatgtcactcacttaggaggcgga

SEQ ID NO: 677359 - DNA, 25 bp, Mus musculus
gtatgtcactcagttaggaggcgga

SEQ ID NO: 677360 - DNA, 25 bp, Mus musculus
gtatgtcactccatgtgtccttttg

SEQ ID NO: 677361 - DNA, 25 bp, Mus musculus
gtatgtcactccttgtgtccttttg

SEQ ID NO: 677362 - DNA, 25 bp, Mus musculus
gtatgtcacttaatttcacgtagcc

SEQ ID NO: 677363 - DNA, 25 bp, Mus musculus
gtatgtcacttattttcacgtagcc

SEQ ID NO: 677364 - DNA, 25 bp, Mus musculus
gtatgtcagaccacatcactacatc

SEQ ID NO: 677365 - DNA, 25 bp, Mus musculus
gtatgtcagacctcatcactacatc

SEQ ID NO: 677366 - DNA, 25 bp, Mus musculus
gtatgtcagagtcctagtgcttcct

SEQ ID NO: 677367 - DNA, 25 bp, Mus musculus
gtatgtcagagtgctagtgcttcct

SEQ ID NO: 677368 - DNA, 25 bp, Mus musculus
gtatgtcagcagagagggatcctgt

SEQ ID NO: 677369 - DNA, 25 bp, Mus musculus
gtatgtcagcagtgagggatcctgt

SEQ ID NO: 677370 - DNA, 25 bp, Mus musculus
gtatgtcaggataagtttagccaat

SEQ ID NO: 677371 - DNA, 25 bp, Mus musculus
gtatgtcaggattagtttagccaat

SEQ ID NO: 677372 - DNA, 25 bp, Mus musculus
gtatgtcaggcactcccaggaaggt

SEQ ID NO: 677373 - DNA, 25 bp, Mus musculus
gtatgtcaggcagtcccaggaaggt

SEQ ID NO: 677374 - DNA, 25 bp, Mus musculus
gtatgtcaggttatttctagtcgtt

SEQ ID NO: 677375 - DNA, 25 bp, Mus musculus
gtatgtcaggttttttctagtcgtt

SEQ ID NO: 677376 - DNA, 25 bp, Mus musculus
gtatgtcagtgacatatctgcttat

SEQ ID NO: 677377 - DNA, 25 bp, Mus musculus
gtatgtcagtgagatatctgcttat

SEQ ID NO: 677378 - DNA, 25 bp, Mus musculus
gtatgtcatcaacaagggctgcaat

SEQ ID NO: 677379 - DNA, 25 bp, Mus musculus
gtatgtcatcaagaagggctgcaat

SEQ ID NO: 677380 - DNA, 25 bp, Mus musculus
gtatgtcattagcagggttctttta

SEQ ID NO: 677381 - DNA, 25 bp, Mus musculus
gtatgtcattaggagggttctttta

SEQ ID NO: 677382 - DNA, 25 bp, Mus musculus
gtatgtcattgcacaagactgccag

SEQ ID NO: 677383 - DNA, 25 bp, Mus musculus
gtatgtcattgctcaagactgccag

SEQ ID NO: 677384 - DNA, 25 bp, Mus musculus
gtatgtccacacacagaaatagctg

SEQ ID NO: 677385 - DNA, 25 bp, Mus musculus
gtatgtccacactcagaaatagctg

SEQ ID NO: 677386 - DNA, 25 bp, Mus musculus
gtatgtccagctccaaggtacctga

SEQ ID NO: 677387 - DNA, 25 bp, Mus musculus
gtatgtccagctgcaaggtacctga

SEQ ID NO: 677388 - DNA, 25 bp, Mus musculus
gtatgtccaggaactctcctttgta

SEQ ID NO: 677389 - DNA, 25 bp, Mus musculus
gtatgtccaggatctctcctttgta

SEQ ID NO: 677390 - DNA, 25 bp, Mus musculus
gtatgtccatcacatgcatgcaatg

SEQ ID NO: 677391 - DNA, 25 bp, Mus musculus
gtatgtccatcagatgcatgcaatg

SEQ ID NO: 677392 - DNA, 25 bp, Mus musculus
gtatgtccatttatgttcaggtaca

SEQ ID NO: 677393 - DNA, 25 bp, Mus musculus
gtatgtccatttttgttcaggtaca

SEQ ID NO: 677394 - DNA, 25 bp, Mus musculus
gtatgtcccagcacacgtagaccag

SEQ ID NO: 677395 - DNA, 25 bp, Mus musculus
gtatgtcccagctcacgtagaccag

SEQ ID NO: 677396 - DNA, 25 bp, Mus musculus
gtatgtcccagtatgtctgtatatt

SEQ ID NO: 677397 - DNA, 25 bp, Mus musculus
gtatgtcccagtttgtctgtatatt

SEQ ID NO: 677398 - DNA, 25 bp, Mus musculus
gtatgtcccctgagcagagcacaag

SEQ ID NO: 677399 - DNA, 25 bp, Mus musculus
gtatgtcccctgtgcagagcacaag

SEQ ID NO: 677400 - DNA, 25 bp, Mus musculus
gtatgtccctgtcagacgtttttgt

SEQ ID NO: 677401 - DNA, 25 bp, Mus musculus
gtatgtccctgtgagacgtttttgt

SEQ ID NO: 677402 - DNA, 25 bp, Mus musculus
gtatgtcctatccttgaacccatgt

SEQ ID NO: 677403 - DNA, 25 bp, Mus musculus
gtatgtcctatcgttgaacccatgt

SEQ ID NO: 677404 - DNA, 25 bp, Mus musculus
gtatgtccttcaaaccctgatttgg

SEQ ID NO: 677405 - DNA, 25 bp, Mus musculus
gtatgtccttcataccctgatttgg

SEQ ID NO: 677406 - DNA, 25 bp, Mus musculus
gtatgtcctttcaaaactagtttgt

SEQ ID NO: 677407 - DNA, 25 bp, Mus musculus
gtatgtcctttctaaactagtttgt

SEQ ID NO: 677408 - DNA, 25 bp, Mus musculus
gtatgtcgccttattctgaacatgg

SEQ ID NO: 677409 - DNA, 25 bp, Mus musculus
gtatgtcgcctttttctgaacatgg

SEQ ID NO: 677410 - DNA, 25 bp, Mus musculus
gtatgtcggcataccagagtgcatc

SEQ ID NO: 677411 - DNA, 25 bp, Mus musculus
gtatgtcggcattccagagtgcatc

SEQ ID NO: 677412 - DNA, 25 bp, Mus musculus
gtatgtctaacaagggcagcgtcat

SEQ ID NO: 677413 - DNA, 25 bp, Mus musculus
gtatgtctaacacccactgacgcga

SEQ ID NO: 677414 - DNA, 25 bp, Mus musculus
gtatgtctaacagccactgacgcga

SEQ ID NO: 677415 - DNA, 25 bp, Mus musculus
gtatgtctaacatgggcagcgtcat

SEQ ID NO: 677416 - DNA, 25 bp, Mus musculus
gtatgtctaatacctcaccaagaag

SEQ ID NO: 677417 - DNA, 25 bp, Mus musculus
gtatgtctaatagctcaccaagaag

SEQ ID NO: 677418 - DNA, 25 bp, Mus musculus
gtatgtctcaacaagatgtgtcctt

SEQ ID NO: 677419 - DNA, 25 bp, Mus musculus
gtatgtctcaacactagcatgatat

SEQ ID NO: 677420 - DNA, 25 bp, Mus musculus
gtatgtctcaactagatgtgtcctt

SEQ ID NO: 677421 - DNA, 25 bp, Mus musculus
gtatgtctcaactctagcatgatat

SEQ ID NO: 677422 - DNA, 25 bp, Mus musculus
gtatgtctcaggctgaatttgacaa

SEQ ID NO: 677423 - DNA, 25 bp, Mus musculus
gtatgtctcaggctgtcctagatta

SEQ ID NO: 677424 - DNA, 25 bp, Mus musculus
gtatgtctcagggtgaatttgacaa

SEQ ID NO: 677425 - DNA, 25 bp, Mus musculus
gtatgtctcagggtgtcctagatta

SEQ ID NO: 677426 - DNA, 25 bp, Mus musculus
gtatgtctcatcctaaaagcccttg

SEQ ID NO: 677427 - DNA, 25 bp, Mus musculus
gtatgtctcatcgtaaaagcccttg

SEQ ID NO: 677428 - DNA, 25 bp, Mus musculus
gtatgtctcgccagattgagctctg

SEQ ID NO: 677429 - DNA, 25 bp, Mus musculus
gtatgtctcgcctgattgagctctg

SEQ ID NO: 677430 - DNA, 25 bp, Mus musculus
gtatgtctcgtgcatccgaggagtt

SEQ ID NO: 677431 - DNA, 25 bp, Mus musculus
gtatgtctcgtggatccgaggagtt

SEQ ID NO: 677432 - DNA, 25 bp, Mus musculus
gtatgtctctccagtgtgcttatat

SEQ ID NO: 677433 - DNA, 25 bp, Mus musculus
gtatgtctctcctgtgtgcttatat

SEQ ID NO: 677434 - DNA, 25 bp, Mus musculus
gtatgtctctttagagccagcagcc

SEQ ID NO: 677435 - DNA, 25 bp, Mus musculus
gtatgtctcttttgagccagcagcc

SEQ ID NO: 677436 - DNA, 25 bp, Mus musculus
gtatgtctgaagcttccagatctct

SEQ ID NO: 677437 - DNA, 25 bp, Mus musculus
gtatgtctgaaggttccagatctct

SEQ ID NO: 677438 - DNA, 25 bp, Mus musculus
gtatgtctgcgaagtgagtgttcaa

SEQ ID NO: 677439 - DNA, 25 bp, Mus musculus
gtatgtctgcgatgtgagtgttcaa

SEQ ID NO: 677440 - DNA, 25 bp, Mus musculus
gtatgtctgcttcttgcgtttaagc

SEQ ID NO: 677441 - DNA, 25 bp, Mus musculus
gtatgtctgcttgttgcgtttaagc

SEQ ID NO: 677442 - DNA, 25 bp, Mus musculus
gtatgtctgggcattctctgtggct

SEQ ID NO: 677443 - DNA, 25 bp, Mus musculus
gtatgtctgggctttctctgtggct

SEQ ID NO: 677444 - DNA, 25 bp, Mus musculus
gtatgtctgtgcagagtctctggag

SEQ ID NO: 677445 - DNA, 25 bp, Mus musculus
gtatgtctgtgctgagtctctggag

SEQ ID NO: 677446 - DNA, 25 bp, Mus musculus
gtatgtcttacaaaggccctgcctt

SEQ ID NO: 677447 - DNA, 25 bp, Mus musculus
gtatgtcttacataggccctgcctt

SEQ ID NO: 677448 - DNA, 25 bp, Mus musculus
gtatgtcttgacacaggcctacagt

SEQ ID NO: 677449 - DNA, 25 bp, Mus musculus
gtatgtcttgactcaggcctacagt

SEQ ID NO: 677450 - DNA, 25 bp, Mus musculus
gtatgtcttgctaagaacttgctga

SEQ ID NO: 677451 - DNA, 25 bp, Mus musculus
gtatgtcttgcttagaacttgctga

SEQ ID NO: 677452 - DNA, 25 bp, Mus musculus
gtatgtctttacaggttagttactt

SEQ ID NO: 677453 - DNA, 25 bp, Mus musculus
gtatgtctttactggttagttactt

SEQ ID NO: 677454 - DNA, 25 bp, Mus musculus
gtatgtctttctcaagtttcggtta

SEQ ID NO: 677455 - DNA, 25 bp, Mus musculus
gtatgtctttctccacaatacaggg

SEQ ID NO: 677456 - DNA, 25 bp, Mus musculus
gtatgtctttctgaagtttcggtta

SEQ ID NO: 677457 - DNA, 25 bp, Mus musculus
gtatgtctttctgcacaatacaggg

SEQ ID NO: 677458 - DNA, 25 bp, Mus musculus
gtatgtgaaaatcccgagtccaaaa

SEQ ID NO: 677459 - DNA, 25 bp, Mus musculus
gtatgtgaaaatgccgagtccaaaa

SEQ ID NO: 677460 - DNA, 25 bp, Mus musculus
gtatgtgaaacacccgttcgtacag

SEQ ID NO: 677461 - DNA, 25 bp, Mus musculus
gtatgtgaaacagccgttcgtacag

SEQ ID NO: 677462 - DNA, 25 bp, Mus musculus
gtatgtgaacaaatattcttgcttt

SEQ ID NO: 677463 - DNA, 25 bp, Mus musculus
gtatgtgaacaattattcttgcttt

SEQ ID NO: 677464 - DNA, 25 bp, Mus musculus
gtatgtgaacaccatcgggcaccgg

SEQ ID NO: 677465 - DNA, 25 bp, Mus musculus
gtatgtgaacacgatcgggcaccgg

SEQ ID NO: 677466 - DNA, 25 bp, Mus musculus
gtatgtgaacctaaaggcccgagat

SEQ ID NO: 677467 - DNA, 25 bp, Mus musculus
gtatgtgaaccttaaggcccgagat

SEQ ID NO: 677468 - DNA, 25 bp, Mus musculus
gtatgtgaactgagcccgggatgat

SEQ ID NO: 677469 - DNA, 25 bp, Mus musculus
gtatgtgaactgcattcagcagacc

SEQ ID NO: 677470 - DNA, 25 bp, Mus musculus
gtatgtgaactggattcagcagacc

SEQ ID NO: 677471 - DNA, 25 bp, Mus musculus
gtatgtgaactgtgcccgggatgat

SEQ ID NO: 677472 - DNA, 25 bp, Mus musculus
gtatgtgaagaccacatggccaaat

SEQ ID NO: 677473 - DNA, 25 bp, Mus musculus
gtatgtgaagacgacatggccaaat

SEQ ID NO: 677474 - DNA, 25 bp, Mus musculus
gtatgtgaaggtccatcacttcccc

SEQ ID NO: 677475 - DNA, 25 bp, Mus musculus
gtatgtgaaggtgcatcacttcccc

SEQ ID NO: 677476 - DNA, 25 bp, Mus musculus
gtatgtgaagtgctaggctagtatt

SEQ ID NO: 677477 - DNA, 25 bp, Mus musculus
gtatgtgaagtggtaggctagtatt

SEQ ID NO: 677478 - DNA, 25 bp, Mus musculus
gtatgtgaagttccgagacagctcg

SEQ ID NO: 677479 - DNA, 25 bp, Mus musculus
gtatgtgaagttgcgagacagctcg

SEQ ID NO: 677480 - DNA, 25 bp, Mus musculus
gtatgtgacacaagcctacaggatt

SEQ ID NO: 677481 - DNA, 25 bp, Mus musculus
gtatgtgacacatgcctacaggatt

SEQ ID NO: 677482 - DNA, 25 bp, Mus musculus
gtatgtgaccttagatggcatctta

SEQ ID NO: 677483 - DNA, 25 bp, Mus musculus
gtatgtgacctttgatggcatctta

SEQ ID NO: 677484 - DNA, 25 bp, Mus musculus
gtatgtgactatatgtatctctaca

SEQ ID NO: 677485 - DNA, 25 bp, Mus musculus
gtatgtgactatttgtatctctaca

SEQ ID NO: 677486 - DNA, 25 bp, Mus musculus
gtatgtgagagcatctcccagcaga

SEQ ID NO: 677487 - DNA, 25 bp, Mus musculus
gtatgtgagagcttctcccagcaga

SEQ ID NO: 677488 - DNA, 25 bp, Mus musculus
gtatgtgagtgacgcccacctggat

SEQ ID NO: 677489 - DNA, 25 bp, Mus musculus
gtatgtgagtgaggcccacctggat

SEQ ID NO: 677490 - DNA, 25 bp, Mus musculus
gtatgtgagtgtctttcttcccatt

SEQ ID NO: 677491 - DNA, 25 bp, Mus musculus
gtatgtgagtgtgtttcttcccatt

SEQ ID NO: 677492 - DNA, 25 bp, Mus musculus
gtatgtgataccacagtctggcctt

SEQ ID NO: 677493 - DNA, 25 bp, Mus musculus
gtatgtgatacctcagtctggcctt

SEQ ID NO: 677494 - DNA, 25 bp, Mus musculus
gtatgtgatactcaagtagcttgtg

SEQ ID NO: 677495 - DNA, 25 bp, Mus musculus
gtatgtgatactgaagtagcttgtg

SEQ ID NO: 677496 - DNA, 25 bp, Mus musculus
gtatgtgatattataatccaccctt

SEQ ID NO: 677497 - DNA, 25 bp, Mus musculus
gtatgtgatattttaatccaccctt

SEQ ID NO: 677498 - DNA, 25 bp, Mus musculus
gtatgtgatcttcatgggcagcaaa

SEQ ID NO: 677499 - DNA, 25 bp, Mus musculus
gtatgtgatcttgatgggcagcaaa

SEQ ID NO: 677500 - DNA, 25 bp, Mus musculus
gtatgtgatggaacttcctttttta

SEQ ID NO: 677501 - DNA, 25 bp, Mus musculus
gtatgtgatggatcttcctttttta

SEQ ID NO: 677502 - DNA, 25 bp, Mus musculus
gtatgtgcaaatccgctctcatgct

SEQ ID NO: 677503 - DNA, 25 bp, Mus musculus
gtatgtgcaaatgcgctctcatgct

SEQ ID NO: 677504 - DNA, 25 bp, Mus musculus
gtatgtgcaccacgttggcagagtt

SEQ ID NO: 677505 - DNA, 25 bp, Mus musculus
gtatgtgcaccaggttggcagagtt

SEQ ID NO: 677506 - DNA, 25 bp, Mus musculus
gtatgtgcacccaccgattgcccat

SEQ ID NO: 677507 - DNA, 25 bp, Mus musculus
gtatgtgcaccctccgattgcccat

SEQ ID NO: 677508 - DNA, 25 bp, Mus musculus
gtatgtgcagtaccatatgcctggt

SEQ ID NO: 677509 - DNA, 25 bp, Mus musculus
gtatgtgcagtagcatatgcctggt

SEQ ID NO: 677510 - DNA, 25 bp, Mus musculus
gtatgtgcatagagtgtcacacaca

SEQ ID NO: 677511 - DNA, 25 bp, Mus musculus
gtatgtgcatagtgtgtcacacaca

SEQ ID NO: 677512 - DNA, 25 bp, Mus musculus
gtatgtgcatgcaggtgcctgtcga

SEQ ID NO: 677513 - DNA, 25 bp, Mus musculus
gtatgtgcatgctggtgcctgtcga

SEQ ID NO: 677514 - DNA, 25 bp, Mus musculus
gtatgtgcatggactctttgataat

SEQ ID NO: 677515 - DNA, 25 bp, Mus musculus
gtatgtgcatggtctctttgataat

SEQ ID NO: 677516 - DNA, 25 bp, Mus musculus
gtatgtgccaaaatcacacgatgtg

SEQ ID NO: 677517 - DNA, 25 bp, Mus musculus
gtatgtgccaaattcacacgatgtg

SEQ ID NO: 677518 - DNA, 25 bp, Mus musculus
gtatgtgcccatcccgaagctgagc

SEQ ID NO: 677519 - DNA, 25 bp, Mus musculus
gtatgtgcccatgccgaagctgagc

SEQ ID NO: 677520 - DNA, 25 bp, Mus musculus
gtatgtgcccccaaatggatgagag

SEQ ID NO: 677521 - DNA, 25 bp, Mus musculus
gtatgtgccccctaatggatgagag

SEQ ID NO: 677522 - DNA, 25 bp, Mus musculus
gtatgtgccctcatctatgtacaca

SEQ ID NO: 677523 - DNA, 25 bp, Mus musculus
gtatgtgccctcttctatgtacaca

SEQ ID NO: 677524 - DNA, 25 bp, Mus musculus
gtatgtgccgtccaagatgtcgtca

SEQ ID NO: 677525 - DNA, 25 bp, Mus musculus
gtatgtgccgtcgaagatgtcgtca

SEQ ID NO: 677526 - DNA, 25 bp, Mus musculus
gtatgtgccttgaaacatcccttgc

SEQ ID NO: 677527 - DNA, 25 bp, Mus musculus
gtatgtgccttgtaacatcccttgc

SEQ ID NO: 677528 - DNA, 25 bp, Mus musculus
gtatgtgcgccaaaacaaatgaata

SEQ ID NO: 677529 - DNA, 25 bp, Mus musculus
gtatgtgcgccataacaaatgaata

SEQ ID NO: 677530 - DNA, 25 bp, Mus musculus
gtatgtgctcaacagctgcatttga

SEQ ID NO: 677531 - DNA, 25 bp, Mus musculus
gtatgtgctcaaccgcttgtgcaaa

SEQ ID NO: 677532 - DNA, 25 bp, Mus musculus
gtatgtgctcaagagctgcatttga

SEQ ID NO: 677533 - DNA, 25 bp, Mus musculus
gtatgtgctcaagcgcttgtgcaaa

SEQ ID NO: 677534 - DNA, 25 bp, Mus musculus
gtatgtgctcccacattttaaacat

SEQ ID NO: 677535 - DNA, 25 bp, Mus musculus
gtatgtgctccctcattttaaacat

SEQ ID NO: 677536 - DNA, 25 bp, Mus musculus
gtatgtgctctgacactaagctgta

SEQ ID NO: 677537 - DNA, 25 bp, Mus musculus
gtatgtgctctgtcactaagctgta

SEQ ID NO: 677538 - DNA, 25 bp, Mus musculus
gtatgtgctgacaggatcatggcat

SEQ ID NO: 677539 - DNA, 25 bp, Mus musculus
gtatgtgctgactggatcatggcat

SEQ ID NO: 677540 - DNA, 25 bp, Mus musculus
gtatgtgctgatacgagtccactta

SEQ ID NO: 677541 - DNA, 25 bp, Mus musculus
gtatgtgctgattcgagtccactta

SEQ ID NO: 677542 - DNA, 25 bp, Mus musculus
gtatgtgctgcaaagaagtctgtgc

SEQ ID NO: 677543 - DNA, 25 bp, Mus musculus
gtatgtgctgcatagaagtctgtgc

SEQ ID NO: 677544 - DNA, 25 bp, Mus musculus
gtatgtgctgcgattgtccagacaa

SEQ ID NO: 677545 - DNA, 25 bp, Mus musculus
gtatgtgctgcgtttgtccagacaa

SEQ ID NO: 677546 - DNA, 25 bp, Mus musculus
gtatgtgcttggaagcacctgcagc

SEQ ID NO: 677547 - DNA, 25 bp, Mus musculus
gtatgtgcttggtagcacctgcagc

SEQ ID NO: 677548 - DNA, 25 bp, Mus musculus
gtatgtggaaaacgctgtgtttgaa

SEQ ID NO: 677549 - DNA, 25 bp, Mus musculus
gtatgtggaaaaggctgtgtttgaa

SEQ ID NO: 677550 - DNA, 25 bp, Mus musculus
gtatgtggaatccttttccttttga

SEQ ID NO: 677551 - DNA, 25 bp, Mus musculus
gtatgtggaatcgttttccttttga

SEQ ID NO: 677552 - DNA, 25 bp, Mus musculus
gtatgtggactaagcccaggaactc

SEQ ID NO: 677553 - DNA, 25 bp, Mus musculus
gtatgtggactatgcccaggaactc

SEQ ID NO: 677554 - DNA, 25 bp, Mus musculus
gtatgtggacttagaggccctggct

SEQ ID NO: 677555 - DNA, 25 bp, Mus musculus
gtatgtggactttgaggccctggct

SEQ ID NO: 677556 - DNA, 25 bp, Mus musculus
gtatgtggagagcactcctgatccc

SEQ ID NO: 677557 - DNA, 25 bp, Mus musculus
gtatgtggagaggactcctgatccc

SEQ ID NO: 677558 - DNA, 25 bp, Mus musculus
gtatgtggaggcaccgtccatcgtc

SEQ ID NO: 677559 - DNA, 25 bp, Mus musculus
gtatgtggaggctccgtccatcgtc

SEQ ID NO: 677560 - DNA, 25 bp, Mus musculus
gtatgtggatcaattaagacctcta

SEQ ID NO: 677561 - DNA, 25 bp, Mus musculus
gtatgtggatcatttaagacctcta

SEQ ID NO: 677562 - DNA, 25 bp, Mus musculus
gtatgtggattgcatgcccaccgag

SEQ ID NO: 677563 - DNA, 25 bp, Mus musculus
gtatgtggattggatgcccaccgag

SEQ ID NO: 677564 - DNA, 25 bp, Mus musculus
gtatgtggcagcaagtaagcacttt

SEQ ID NO: 677565 - DNA, 25 bp, Mus musculus
gtatgtggcagctagtaagcacttt

SEQ ID NO: 677566 - DNA, 25 bp, Mus musculus
gtatgtggctaaaccagtgtatgat

SEQ ID NO: 677567 - DNA, 25 bp, Mus musculus
gtatgtggctaatccagtgtatgat

SEQ ID NO: 677568 - DNA, 25 bp, Mus musculus
gtatgtggctgcatgccgagcaaat

SEQ ID NO: 677569 - DNA, 25 bp, Mus musculus
gtatgtggctgcttgccgagcaaat

SEQ ID NO: 677570 - DNA, 25 bp, Mus musculus
gtatgtgggaaacttaccccagcta

SEQ ID NO: 677571 - DNA, 25 bp, Mus musculus
gtatgtgggaaagttaccccagcta

SEQ ID NO: 677572 - DNA, 25 bp, Mus musculus
gtatgtgggcttccatgatcagctt

SEQ ID NO: 677573 - DNA, 25 bp, Mus musculus
gtatgtgggcttgcatgatcagctt

SEQ ID NO: 677574 - DNA, 25 bp, Mus musculus
gtatgtggtataccactccattccg

SEQ ID NO: 677575 - DNA, 25 bp, Mus musculus
gtatgtggtatagcactccattccg

SEQ ID NO: 677576 - DNA, 25 bp, Mus musculus
gtatgtggtatcaatgtagttttac

SEQ ID NO: 677577 - DNA, 25 bp, Mus musculus
gtatgtggtatctatgtagttttac

SEQ ID NO: 677578 - DNA, 25 bp, Mus musculus
gtatgtggtattcctcactgtgtgg

SEQ ID NO: 677579 - DNA, 25 bp, Mus musculus
gtatgtggtattgctcactgtgtgg

SEQ ID NO: 677580 - DNA, 25 bp, Mus musculus
gtatgtggtcccatgctcaaaaagc

SEQ ID NO: 677581 - DNA, 25 bp, Mus musculus
gtatgtggtcccttgctcaaaaagc

SEQ ID NO: 677582 - DNA, 25 bp, Mus musculus
gtatgtggtttcctcagtcctaaac

SEQ ID NO: 677583 - DNA, 25 bp, Mus musculus
gtatgtggtttcctccaaggaattc

SEQ ID NO: 677584 - DNA, 25 bp, Mus musculus
gtatgtggtttcgtcagtcctaaac

SEQ ID NO: 677585 - DNA, 25 bp, Mus musculus
gtatgtggtttcgtccaaggaattc

SEQ ID NO: 677586 - DNA, 25 bp, Mus musculus
gtatgtgtaaaaccagattcagatt

SEQ ID NO: 677587 - DNA, 25 bp, Mus musculus
gtatgtgtaaaagcagattcagatt

SEQ ID NO: 677588 - DNA, 25 bp, Mus musculus
gtatgtgtacctcatctatggcatg

SEQ ID NO: 677589 - DNA, 25 bp, Mus musculus
gtatgtgtacctccaactctctttg

SEQ ID NO: 677590 - DNA, 25 bp, Mus musculus
gtatgtgtacctgatctatggcatg

SEQ ID NO: 677591 - DNA, 25 bp, Mus musculus
gtatgtgtacctgcaactctctttg

SEQ ID NO: 677592 - DNA, 25 bp, Mus musculus
gtatgtgtagacaagctctcgctct

SEQ ID NO: 677593 - DNA, 25 bp, Mus musculus
gtatgtgtagactagctctcgctct

SEQ ID NO: 677594 - DNA, 25 bp, Mus musculus
gtatgtgtagatatccttgtagttc

SEQ ID NO: 677595 - DNA, 25 bp, Mus musculus
gtatgtgtagatttccttgtagttc

SEQ ID NO: 677596 - DNA, 25 bp, Mus musculus
gtatgtgtatgacccttgtcgtaga

SEQ ID NO: 677597 - DNA, 25 bp, Mus musculus
gtatgtgtatgagccttgtcgtaga

SEQ ID NO: 677598 - DNA, 25 bp, Mus musculus
gtatgtgtatgtctccactcagtga

SEQ ID NO: 677599 - DNA, 25 bp, Mus musculus
gtatgtgtatgtgtccactcagtga

SEQ ID NO: 677600 - DNA, 25 bp, Mus musculus
gtatgtgtcaatctccgtgcatgtg

SEQ ID NO: 677601 - DNA, 25 bp, Mus musculus
gtatgtgtcaatgtccgtgcatgtg

SEQ ID NO: 677602 - DNA, 25 bp, Mus musculus
gtatgtgtcagccttcagtggtcca

SEQ ID NO: 677603 - DNA, 25 bp, Mus musculus
gtatgtgtcagcgttcagtggtcca

SEQ ID NO: 677604 - DNA, 25 bp, Mus musculus
gtatgtgtcattcattctttgagta

SEQ ID NO: 677605 - DNA, 25 bp, Mus musculus
gtatgtgtcattgattctttgagta

SEQ ID NO: 677606 - DNA, 25 bp, Mus musculus
gtatgtgtccaaaaggtttttgtac

SEQ ID NO: 677607 - DNA, 25 bp, Mus musculus
gtatgtgtccaataggtttttgtac

SEQ ID NO: 677608 - DNA, 25 bp, Mus musculus
gtatgtgtccacacagtgactgtct

SEQ ID NO: 677609 - DNA, 25 bp, Mus musculus
gtatgtgtccactcagtgactgtct

SEQ ID NO: 677610 - DNA, 25 bp, Mus musculus
gtatgtgtccagaatgtacgatttt

SEQ ID NO: 677611 - DNA, 25 bp, Mus musculus
gtatgtgtccagtatgtacgatttt

SEQ ID NO: 677612 - DNA, 25 bp, Mus musculus
gtatgtgtccggcttgcacttgaac

SEQ ID NO: 677613 - DNA, 25 bp, Mus musculus
gtatgtgtccgggttgcacttgaac

SEQ ID NO: 677614 - DNA, 25 bp, Mus musculus
gtatgtgtctacatctggaaaagat

SEQ ID NO: 677615 - DNA, 25 bp, Mus musculus
gtatgtgtctacttctggaaaagat

SEQ ID NO: 677616 - DNA, 25 bp, Mus musculus
gtatgtgtgaataaacctttagcat

SEQ ID NO: 677617 - DNA, 25 bp, Mus musculus
gtatgtgtgaattaacctttagcat

SEQ ID NO: 677618 - DNA, 25 bp, Mus musculus
gtatgtgtgactcaagagctctaat

SEQ ID NO: 677619 - DNA, 25 bp, Mus musculus
gtatgtgtgactgaagagctctaat

SEQ ID NO: 677620 - DNA, 25 bp, Mus musculus
gtatgtgtgaggctctaccgtgctc

SEQ ID NO: 677621 - DNA, 25 bp, Mus musculus
gtatgtgtgagggtctaccgtgctc

SEQ ID NO: 677622 - DNA, 25 bp, Mus musculus
gtatgtgtgagtacttttcaaactg

SEQ ID NO: 677623 - DNA, 25 bp, Mus musculus
gtatgtgtgagttcttttcaaactg

SEQ ID NO: 677624 - DNA, 25 bp, Mus musculus
gtatgtgtgcacctgtttaaatgta

SEQ ID NO: 677625 - DNA, 25 bp, Mus musculus
gtatgtgtgcacgtgtttaaatgta

SEQ ID NO: 677626 - DNA, 25 bp, Mus musculus
gtatgtgtgcagatttaactgaatc

SEQ ID NO: 677627 - DNA, 25 bp, Mus musculus
gtatgtgtgcagttttaactgaatc

SEQ ID NO: 677628 - DNA, 25 bp, Mus musculus
gtatgtgtgcttatacaacttgttc

SEQ ID NO: 677629 - DNA, 25 bp, Mus musculus
gtatgtgtgcttttacaacttgttc

SEQ ID NO: 677630 - DNA, 25 bp, Mus musculus
gtatgtgtggctagttatatctcag

SEQ ID NO: 677631 - DNA, 25 bp, Mus musculus
gtatgtgtggcttgttatatctcag

SEQ ID NO: 677632 - DNA, 25 bp, Mus musculus
gtatgtgtgggcataagtaggtaca

SEQ ID NO: 677633 - DNA, 25 bp, Mus musculus
gtatgtgtgggcttaagtaggtaca

SEQ ID NO: 677634 - DNA, 25 bp, Mus musculus
gtatgtgtggtacctctgccactga

SEQ ID NO: 677635 - DNA, 25 bp, Mus musculus
gtatgtgtggtagctctgccactga

SEQ ID NO: 677636 - DNA, 25 bp, Mus musculus
gtatgtgtgtaaatggtcaggaaaa

SEQ ID NO: 677637 - DNA, 25 bp, Mus musculus
gtatgtgtgtaattggtcaggaaaa

SEQ ID NO: 677638 - DNA, 25 bp, Mus musculus
gtatgtgtgtacacaggacagaatc

SEQ ID NO: 677639 - DNA, 25 bp, Mus musculus
gtatgtgtgtactcaggacagaatc

SEQ ID NO: 677640 - DNA, 25 bp, Mus musculus
gtatgtgtgtatactgagcttctat

SEQ ID NO: 677641 - DNA, 25 bp, Mus musculus
gtatgtgtgtatctcctgaactctc

SEQ ID NO: 677642 - DNA, 25 bp, Mus musculus
gtatgtgtgtatgtcctgaactctc

SEQ ID NO: 677643 - DNA, 25 bp, Mus musculus
gtatgtgtgtattctgagcttctat

SEQ ID NO: 677644 - DNA, 25 bp, Mus musculus
gtatgtgtgttaagactggcctaag

SEQ ID NO: 677645 - DNA, 25 bp, Mus musculus
gtatgtgtgttatgactggcctaag

SEQ ID NO: 677646 - DNA, 25 bp, Mus musculus
gtatgtgttgcaatcatgtgtaaat

SEQ ID NO: 677647 - DNA, 25 bp, Mus musculus
gtatgtgttgcattcatgtgtaaat

SEQ ID NO: 677648 - DNA, 25 bp, Mus musculus
gtatgtgtttgaagccttttctata

SEQ ID NO: 677649 - DNA, 25 bp, Mus musculus
gtatgtgtttgatgccttttctata

SEQ ID NO: 677650 - DNA, 25 bp, Mus musculus
gtatgtgtttttagctccctatttt

SEQ ID NO: 677651 - DNA, 25 bp, Mus musculus
gtatgtgttttttgctccctatttt

SEQ ID NO: 677652 - DNA, 25 bp, Mus musculus
gtatgttaaataccccaaagagttg

SEQ ID NO: 677653 - DNA, 25 bp, Mus musculus
gtatgttaaatagcccaaagagttg

SEQ ID NO: 677654 - DNA, 25 bp, Mus musculus
gtatgttaaccaagcctagctgctg

SEQ ID NO: 677655 - DNA, 25 bp, Mus musculus
gtatgttaaccatgcctagctgctg

SEQ ID NO: 677656 - DNA, 25 bp, Mus musculus
gtatgttacaaacgcaactgttctt

SEQ ID NO: 677657 - DNA, 25 bp, Mus musculus
gtatgttacaaaggcaactgttctt

SEQ ID NO: 677658 - DNA, 25 bp, Mus musculus
gtatgttaccatacagctgacatgt

SEQ ID NO: 677659 - DNA, 25 bp, Mus musculus
gtatgttaccattcagctgacatgt

SEQ ID NO: 677660 - DNA, 25 bp, Mus musculus
gtatgttactgtccacaccattaat

SEQ ID NO: 677661 - DNA, 25 bp, Mus musculus
gtatgttactgtgcacaccattaat

SEQ ID NO: 677662 - DNA, 25 bp, Mus musculus
gtatgttagaatattttctgtgcac

SEQ ID NO: 677663 - DNA, 25 bp, Mus musculus
gtatgttagaattttttctgtgcac

SEQ ID NO: 677664 - DNA, 25 bp, Mus musculus
gtatgttagtttctatctggcagac

SEQ ID NO: 677665 - DNA, 25 bp, Mus musculus
gtatgttagtttgtatctggcagac

SEQ ID NO: 677666 - DNA, 25 bp, Mus musculus
gtatgttatatcatcctgtagcttc

SEQ ID NO: 677667 - DNA, 25 bp, Mus musculus
gtatgttatatcttcctgtagcttc

SEQ ID NO: 677668 - DNA, 25 bp, Mus musculus
gtatgttcaagtccccatgtttata

SEQ ID NO: 677669 - DNA, 25 bp, Mus musculus
gtatgttcaagtgcccatgtttata

SEQ ID NO: 677670 - DNA, 25 bp, Mus musculus
gtatgttcacaaccacttagcatgt

SEQ ID NO: 677671 - DNA, 25 bp, Mus musculus
gtatgttcacaagcacttagcatgt

SEQ ID NO: 677672 - DNA, 25 bp, Mus musculus
gtatgttcacagaatagctgccact

SEQ ID NO: 677673 - DNA, 25 bp, Mus musculus
gtatgttcacagtatagctgccact

SEQ ID NO: 677674 - DNA, 25 bp, Mus musculus
gtatgttcacccagacaccattcct

SEQ ID NO: 677675 - DNA, 25 bp, Mus musculus
gtatgttcaccctgacaccattcct

SEQ ID NO: 677676 - DNA, 25 bp, Mus musculus
gtatgttcacttcatcttggagctc

SEQ ID NO: 677677 - DNA, 25 bp, Mus musculus
gtatgttcacttgatcttggagctc

SEQ ID NO: 677678 - DNA, 25 bp, Mus musculus
gtatgttcagagacttgaccaggga

SEQ ID NO: 677679 - DNA, 25 bp, Mus musculus
gtatgttcagagtcttgaccaggga

SEQ ID NO: 677680 - DNA, 25 bp, Mus musculus
gtatgttcaggaacggcctttccct

SEQ ID NO: 677681 - DNA, 25 bp, Mus musculus
gtatgttcaggatcggcctttccct

SEQ ID NO: 677682 - DNA, 25 bp, Mus musculus
gtatgttcctccactggtcagaatt

SEQ ID NO: 677683 - DNA, 25 bp, Mus musculus
gtatgttcctcctctggtcagaatt

SEQ ID NO: 677684 - DNA, 25 bp, Mus musculus
gtatgttcgggaaaacttcactccc

SEQ ID NO: 677685 - DNA, 25 bp, Mus musculus
gtatgttcgggataacttcactccc

SEQ ID NO: 677686 - DNA, 25 bp, Mus musculus
gtatgttctcaaagatcttcactca

SEQ ID NO: 677687 - DNA, 25 bp, Mus musculus
gtatgttctcaatgatcttcactca

SEQ ID NO: 677688 - DNA, 25 bp, Mus musculus
gtatgttctcagaatgcatcactag

SEQ ID NO: 677689 - DNA, 25 bp, Mus musculus
gtatgttctcagtatgcatcactag

SEQ ID NO: 677690 - DNA, 25 bp, Mus musculus
gtatgttctctgaggtaaactgtcc

SEQ ID NO: 677691 - DNA, 25 bp, Mus musculus
gtatgttctctgtggtaaactgtcc

SEQ ID NO: 677692 - DNA, 25 bp, Mus musculus
gtatgttctgtaactggcagcgtaa

SEQ ID NO: 677693 - DNA, 25 bp, Mus musculus
gtatgttctgtatctggcagcgtaa

SEQ ID NO: 677694 - DNA, 25 bp, Mus musculus
gtatgttcttctacactggctaaat

SEQ ID NO: 677695 - DNA, 25 bp, Mus musculus
gtatgttcttcttcactggctaaat

SEQ ID NO: 677696 - DNA, 25 bp, Mus musculus
gtatgttctttgcatttaatctaag

SEQ ID NO: 677697 - DNA, 25 bp, Mus musculus
gtatgttctttggatttaatctaag

SEQ ID NO: 677698 - DNA, 25 bp, Mus musculus
gtatgttgaattaattgttggctgg

SEQ ID NO: 677699 - DNA, 25 bp, Mus musculus
gtatgttgaatttattgttggctgg

SEQ ID NO: 677700 - DNA, 25 bp, Mus musculus
gtatgttgacagcttggagatatcc

SEQ ID NO: 677701 - DNA, 25 bp, Mus musculus
gtatgttgacaggttggagatatcc

SEQ ID NO: 677702 - DNA, 25 bp, Mus musculus
gtatgttgagatatgcccaggtgtg

SEQ ID NO: 677703 - DNA, 25 bp, Mus musculus
gtatgttgagatttgcccaggtgtg

SEQ ID NO: 677704 - DNA, 25 bp, Mus musculus
gtatgttgagtcagaaaatgtcacc

SEQ ID NO: 677705 - DNA, 25 bp, Mus musculus
gtatgttgagtctgaaaatgtcacc

SEQ ID NO: 677706 - DNA, 25 bp, Mus musculus
gtatgttgatatcccatgtgtacaa

SEQ ID NO: 677707 - DNA, 25 bp, Mus musculus
gtatgttgatatgccatgtgtacaa

SEQ ID NO: 677708 - DNA, 25 bp, Mus musculus
gtatgttgatcaccccaagactctc

SEQ ID NO: 677709 - DNA, 25 bp, Mus musculus
gtatgttgatcagcccaagactctc

SEQ ID NO: 677710 - DNA, 25 bp, Mus musculus
gtatgttgattgattggtttctttc

SEQ ID NO: 677711 - DNA, 25 bp, Mus musculus
gtatgttgattgtttggtttctttc

SEQ ID NO: 677712 - DNA, 25 bp, Mus musculus
gtatgttgcaatactttgcttcctt

SEQ ID NO: 677713 - DNA, 25 bp, Mus musculus
gtatgttgcaattctttgcttcctt

SEQ ID NO: 677714 - DNA, 25 bp, Mus musculus
gtatgttgcatcattgaggccagca

SEQ ID NO: 677715 - DNA, 25 bp, Mus musculus
gtatgttgcatctttgaggccagca

SEQ ID NO: 677716 - DNA, 25 bp, Mus musculus
gtatgttgccatctgtaagcctttg

SEQ ID NO: 677717 - DNA, 25 bp, Mus musculus
gtatgttgccatgtgtaagcctttg

SEQ ID NO: 677718 - DNA, 25 bp, Mus musculus
gtatgttgcctgaactgatctcaaa

SEQ ID NO: 677719 - DNA, 25 bp, Mus musculus
gtatgttgcctgtactgatctcaaa

SEQ ID NO: 677720 - DNA, 25 bp, Mus musculus
gtatgttgcgcaacacttgtgtagt

SEQ ID NO: 677721 - DNA, 25 bp, Mus musculus
gtatgttgcgcatcacttgtgtagt

SEQ ID NO: 677722 - DNA, 25 bp, Mus musculus
gtatgttgctctcttcacgaagtat

SEQ ID NO: 677723 - DNA, 25 bp, Mus musculus
gtatgttgctctgttcacgaagtat

SEQ ID NO: 677724 - DNA, 25 bp, Mus musculus
gtatgttgggatatcactctcttaa

SEQ ID NO: 677725 - DNA, 25 bp, Mus musculus
gtatgttgggatttcactctcttaa

SEQ ID NO: 677726 - DNA, 25 bp, Mus musculus
gtatgttgtacaattttgctgttat

SEQ ID NO: 677727 - DNA, 25 bp, Mus musculus
gtatgttgtacatttttgctgttat

SEQ ID NO: 677728 - DNA, 25 bp, Mus musculus
gtatgttgtattagccttccagtta

SEQ ID NO: 677729 - DNA, 25 bp, Mus musculus
gtatgttgtatttgccttccagtta

SEQ ID NO: 677730 - DNA, 25 bp, Mus musculus
gtatgttgtcaacttccacatgcga

SEQ ID NO: 677731 - DNA, 25 bp, Mus musculus
gtatgttgtcaagttccacatgcga

SEQ ID NO: 677732 - DNA, 25 bp, Mus musculus
gtatgttgtctcagtatgactctcc

SEQ ID NO: 677733 - DNA, 25 bp, Mus musculus
gtatgttgtctctgtatgactctcc

SEQ ID NO: 677734 - DNA, 25 bp, Mus musculus
gtatgttgtggcatttaatcatttc

SEQ ID NO: 677735 - DNA, 25 bp, Mus musculus
gtatgttgtggcttttaatcatttc

SEQ ID NO: 677736 - DNA, 25 bp, Mus musculus
gtatgttgtgggagcttgctatagc

SEQ ID NO: 677737 - DNA, 25 bp, Mus musculus
gtatgttgtgggtgcttgctatagc

SEQ ID NO: 677738 - DNA, 25 bp, Mus musculus
gtatgtttaacccagcttttccaca

SEQ ID NO: 677739 - DNA, 25 bp, Mus musculus
gtatgtttaaccgagcttttccaca

SEQ ID NO: 677740 - DNA, 25 bp, Mus musculus
gtatgtttacttatgcaaggctcag

SEQ ID NO: 677741 - DNA, 25 bp, Mus musculus
gtatgtttacttttgcaaggctcag

SEQ ID NO: 677742 - DNA, 25 bp, Mus musculus
gtatgtttaggcatcagtttccatg

SEQ ID NO: 677743 - DNA, 25 bp, Mus musculus
gtatgtttaggcttcagtttccatg

SEQ ID NO: 677744 - DNA, 25 bp, Mus musculus
gtatgtttccaaaggcttcatgtat

SEQ ID NO: 677745 - DNA, 25 bp, Mus musculus
gtatgtttccaatggcttcatgtat

SEQ ID NO: 677746 - DNA, 25 bp, Mus musculus
gtatgtttcccacatatgcagagtg

SEQ ID NO: 677747 - DNA, 25 bp, Mus musculus
gtatgtttcccagatatgcagagtg

SEQ ID NO: 677748 - DNA, 25 bp, Mus musculus
gtatgtttctcgaggtgtgcttcat

SEQ ID NO: 677749 - DNA, 25 bp, Mus musculus
gtatgtttctcgtggtgtgcttcat

SEQ ID NO: 677750 - DNA, 25 bp, Mus musculus
gtatgtttctgaattcagtgacaca

SEQ ID NO: 677751 - DNA, 25 bp, Mus musculus
gtatgtttctgatttcagtgacaca

SEQ ID NO: 677752 - DNA, 25 bp, Mus musculus
gtatgtttcttaaactctttcttca

SEQ ID NO: 677753 - DNA, 25 bp, Mus musculus
gtatgtttcttaactgtgtatacag

SEQ ID NO: 677754 - DNA, 25 bp, Mus musculus
gtatgtttcttactactttgaccag

SEQ ID NO: 677755 - DNA, 25 bp, Mus musculus
gtatgtttcttagtactttgaccag

SEQ ID NO: 677756 - DNA, 25 bp, Mus musculus
gtatgtttcttatactctttcttca

SEQ ID NO: 677757 - DNA, 25 bp, Mus musculus
gtatgtttcttatctgtgtatacag

SEQ ID NO: 677758 - DNA, 25 bp, Mus musculus
gtatgtttctttagtatgttggctt

SEQ ID NO: 677759 - DNA, 25 bp, Mus musculus
gtatgtttcttttgtatgttggctt

SEQ ID NO: 677760 - DNA, 25 bp, Mus musculus
gtatgtttgcaaatcgtgccgatca

SEQ ID NO: 677761 - DNA, 25 bp, Mus musculus
gtatgtttgcaattcgtgccgatca

SEQ ID NO: 677762 - DNA, 25 bp, Mus musculus
gtatgtttgcctagagtgggttaaa

SEQ ID NO: 677763 - DNA, 25 bp, Mus musculus
gtatgtttgccttgagtgggttaaa

SEQ ID NO: 677764 - DNA, 25 bp, Mus musculus
gtatgtttgcgtcttggcagaaaac

SEQ ID NO: 677765 - DNA, 25 bp, Mus musculus
gtatgtttgcgtgttggcagaaaac

SEQ ID NO: 677766 - DNA, 25 bp, Mus musculus
gtatgtttggagcatgctgctactt

SEQ ID NO: 677767 - DNA, 25 bp, Mus musculus
gtatgtttggaggatgctgctactt

SEQ ID NO: 677768 - DNA, 25 bp, Mus musculus
gtatgtttgggcagtgtccacgctg

SEQ ID NO: 677769 - DNA, 25 bp, Mus musculus
gtatgtttgggctgtgtccacgctg

SEQ ID NO: 677770 - DNA, 25 bp, Mus musculus
gtatgtttgtacagctttcttaatt

SEQ ID NO: 677771 - DNA, 25 bp, Mus musculus
gtatgtttgtactgctttcttaatt

SEQ ID NO: 677772 - DNA, 25 bp, Mus musculus
gtatgtttgtcaatttcttctttgc

SEQ ID NO: 677773 - DNA, 25 bp, Mus musculus
gtatgtttgtcattttcttctttgc

SEQ ID NO: 677774 - DNA, 25 bp, Mus musculus
gtatgtttgtgactggcgtctgcta

SEQ ID NO: 677775 - DNA, 25 bp, Mus musculus
gtatgtttgtgagtggcgtctgcta

SEQ ID NO: 677776 - DNA, 25 bp, Mus musculus
gtatgtttgttcactctgcacaggc

SEQ ID NO: 677777 - DNA, 25 bp, Mus musculus
gtatgtttgttctctctgcacaggc

SEQ ID NO: 677778 - DNA, 25 bp, Mus musculus
gtatgttttcccaagtccaatcccg

SEQ ID NO: 677779 - DNA, 25 bp, Mus musculus
gtatgttttccctagtccaatcccg

SEQ ID NO: 677780 - DNA, 25 bp, Mus musculus
gtatgttttcctcttatttgtgttt

SEQ ID NO: 677781 - DNA, 25 bp, Mus musculus
gtatgttttcctgttatttgtgttt

SEQ ID NO: 677782 - DNA, 25 bp, Mus musculus
gtatgttttctgattcgttgtctga

SEQ ID NO: 677783 - DNA, 25 bp, Mus musculus
gtatgttttctgtttcgttgtctga

SEQ ID NO: 677784 - DNA, 25 bp, Mus musculus
gtatgttttcttcaccatgtaacca

SEQ ID NO: 677785 - DNA, 25 bp, Mus musculus
gtatgttttcttgaccatgtaacca

SEQ ID NO: 677786 - DNA, 25 bp, Mus musculus
gtatgttttggcaacacttccagtg

SEQ ID NO: 677787 - DNA, 25 bp, Mus musculus
gtatgttttggctacacttccagtg

SEQ ID NO: 677788 - DNA, 25 bp, Mus musculus
gtatgttttggtatctgctctttaa

SEQ ID NO: 677789 - DNA, 25 bp, Mus musculus
gtatgttttggtttctgctctttaa

SEQ ID NO: 677790 - DNA, 25 bp, Mus musculus
gtatgtttttacatggattctcact

SEQ ID NO: 677791 - DNA, 25 bp, Mus musculus
gtatgtttttacttggattctcact

SEQ ID NO: 677792 - DNA, 25 bp, Mus musculus
gtatgttttttcacatctgcagcat

SEQ ID NO: 677793 - DNA, 25 bp, Mus musculus
gtatgttttttctcatctgcagcat

SEQ ID NO: 677794 - DNA, 25 bp, Mus musculus
gtattaaacgatctggcaaagcatt

SEQ ID NO: 677795 - DNA, 25 bp, Mus musculus
gtattaaacgatgtggcaaagcatt

SEQ ID NO: 677796 - DNA, 25 bp, Mus musculus
gtattaaagatgcacaggtttttgt

SEQ ID NO: 677797 - DNA, 25 bp, Mus musculus
gtattaaagatggacaggtttttgt

SEQ ID NO: 677798 - DNA, 25 bp, Mus musculus
gtattaaagcgcatgatttcaacga

SEQ ID NO: 677799 - DNA, 25 bp, Mus musculus
gtattaaagcgcttgatttcaacga

SEQ ID NO: 677800 - DNA, 25 bp, Mus musculus
gtattaaatactctagtctcaagac

SEQ ID NO: 677801 - DNA, 25 bp, Mus musculus
gtattaaatactgtagtctcaagac

SEQ ID NO: 677802 - DNA, 25 bp, Mus musculus
gtattaaatgcccaccacgaatgat

SEQ ID NO: 677803 - DNA, 25 bp, Mus musculus
gtattaaatgccgaccacgaatgat

SEQ ID NO: 677804 - DNA, 25 bp, Mus musculus
gtattaacaaagaccaccctggctt

SEQ ID NO: 677805 - DNA, 25 bp, Mus musculus
gtattaacaaagtccaccctggctt

SEQ ID NO: 677806 - DNA, 25 bp, Mus musculus
gtattaacacagagatacctcgctt

SEQ ID NO: 677807 - DNA, 25 bp, Mus musculus
gtattaacacagtgatacctcgctt

SEQ ID NO: 677808 - DNA, 25 bp, Mus musculus
gtattaacacggaggcctgcctggc

SEQ ID NO: 677809 - DNA, 25 bp, Mus musculus
gtattaacacggtggcctgcctggc

SEQ ID NO: 677810 - DNA, 25 bp, Mus musculus
gtattaacagttccatgctcggttg

SEQ ID NO: 677811 - DNA, 25 bp, Mus musculus
gtattaacagttgcatgctcggttg

SEQ ID NO: 677812 - DNA, 25 bp, Mus musculus
gtattaacctttcctgtccatgtaa

SEQ ID NO: 677813 - DNA, 25 bp, Mus musculus
gtattaacctttgctgtccatgtaa

SEQ ID NO: 677814 - DNA, 25 bp, Mus musculus
gtattaacgtaaccaccggtgtctt

SEQ ID NO: 677815 - DNA, 25 bp, Mus musculus
gtattaacgtaagcaccggtgtctt

SEQ ID NO: 677816 - DNA, 25 bp, Mus musculus
gtattaactcataccggccatatca

SEQ ID NO: 677817 - DNA, 25 bp, Mus musculus
gtattaactcattccggccatatca

SEQ ID NO: 677818 - DNA, 25 bp, Mus musculus
gtattaactcctcgtgctttgtact

SEQ ID NO: 677819 - DNA, 25 bp, Mus musculus
gtattaactcctggtgctttgtact

SEQ ID NO: 677820 - DNA, 25 bp, Mus musculus
gtattaactcgcatctggcattgtc

SEQ ID NO: 677821 - DNA, 25 bp, Mus musculus
gtattaactcgcttctggcattgtc

SEQ ID NO: 677822 - DNA, 25 bp, Mus musculus
gtattaactctcatggtagcctgca

SEQ ID NO: 677823 - DNA, 25 bp, Mus musculus
gtattaactctcttggtagcctgca

SEQ ID NO: 677824 - DNA, 25 bp, Mus musculus
gtattaagaccactggcctcgtttt

SEQ ID NO: 677825 - DNA, 25 bp, Mus musculus
gtattaagaccagtggcctcgtttt

SEQ ID NO: 677826 - DNA, 25 bp, Mus musculus
gtattaagagccaaggcccacgact

SEQ ID NO: 677827 - DNA, 25 bp, Mus musculus
gtattaagagcctaggcccacgact

SEQ ID NO: 677828 - DNA, 25 bp, Mus musculus
gtattaagccatactaggccagcaa

SEQ ID NO: 677829 - DNA, 25 bp, Mus musculus
gtattaagccattctaggccagcaa

SEQ ID NO: 677830 - DNA, 25 bp, Mus musculus
gtattaagggctaatctgttccacc

SEQ ID NO: 677831 - DNA, 25 bp, Mus musculus
gtattaagggcttatctgttccacc

SEQ ID NO: 677832 - DNA, 25 bp, Mus musculus
gtattaagtactatgtattctggaa

SEQ ID NO: 677833 - DNA, 25 bp, Mus musculus
gtattaagtactttgtattctggaa

SEQ ID NO: 677834 - DNA, 25 bp, Mus musculus
gtattaagtatgcacgttcacagcg

SEQ ID NO: 677835 - DNA, 25 bp, Mus musculus
gtattaagtatggacgttcacagcg

SEQ ID NO: 677836 - DNA, 25 bp, Mus musculus
gtattaataactccatcagcataga

SEQ ID NO: 677837 - DNA, 25 bp, Mus musculus
gtattaataactgcatcagcataga

SEQ ID NO: 677838 - DNA, 25 bp, Mus musculus
gtattaataatccactcttacattt

SEQ ID NO: 677839 - DNA, 25 bp, Mus musculus
gtattaataatcgactcttacattt

SEQ ID NO: 677840 - DNA, 25 bp, Mus musculus
gtattaatagaaccttagcctggga

SEQ ID NO: 677841 - DNA, 25 bp, Mus musculus
gtattaatagaagcttagcctggga

SEQ ID NO: 677842 - DNA, 25 bp, Mus musculus
gtattaatctcactttatgctggaa

SEQ ID NO: 677843 - DNA, 25 bp, Mus musculus
gtattaatctcagtttatgctggaa

SEQ ID NO: 677844 - DNA, 25 bp, Mus musculus
gtattaatgtaacagcacaagcttt

SEQ ID NO: 677845 - DNA, 25 bp, Mus musculus
gtattaatgtaaccactcagaagat

SEQ ID NO: 677846 - DNA, 25 bp, Mus musculus
gtattaatgtaagagcacaagcttt

SEQ ID NO: 677847 - DNA, 25 bp, Mus musculus
gtattaatgtaagcactcagaagat

SEQ ID NO: 677848 - DNA, 25 bp, Mus musculus
gtattaatgttgagcacccaaatta

SEQ ID NO: 677849 - DNA, 25 bp, Mus musculus
gtattaatgttgtgcacccaaatta

SEQ ID NO: 677850 - DNA, 25 bp, Mus musculus
gtattaattcatcacaccttgcaaa

SEQ ID NO: 677851 - DNA, 25 bp, Mus musculus
gtattaattcatctgccactgtcaa

SEQ ID NO: 677852 - DNA, 25 bp, Mus musculus
gtattaattcatgacaccttgcaaa

SEQ ID NO: 677853 - DNA, 25 bp, Mus musculus
gtattaattcatgtgccactgtcaa

SEQ ID NO: 677854 - DNA, 25 bp, Mus musculus
gtattaattccaaagacttccctgt

SEQ ID NO: 677855 - DNA, 25 bp, Mus musculus
gtattaattccatagacttccctgt

SEQ ID NO: 677856 - DNA, 25 bp, Mus musculus
gtattaattctgaacctgcttccat

SEQ ID NO: 677857 - DNA, 25 bp, Mus musculus
gtattaattctgtacctgcttccat

SEQ ID NO: 677858 - DNA, 25 bp, Mus musculus
gtattaattggcatccaatcctggt

SEQ ID NO: 677859 - DNA, 25 bp, Mus musculus
gtattaattggcttccaatcctggt

SEQ ID NO: 677860 - DNA, 25 bp, Mus musculus
gtattacaaactcaggaatcctata

SEQ ID NO: 677861 - DNA, 25 bp, Mus musculus
gtattacaaactgaggaatcctata

SEQ ID NO: 677862 - DNA, 25 bp, Mus musculus
gtattacaaattctttcgacaccat

SEQ ID NO: 677863 - DNA, 25 bp, Mus musculus
gtattacaaattgtttcgacaccat

SEQ ID NO: 677864 - DNA, 25 bp, Mus musculus
gtattacacatgaacatgcgagtga

SEQ ID NO: 677865 - DNA, 25 bp, Mus musculus
gtattacacatgtacatgcgagtga

SEQ ID NO: 677866 - DNA, 25 bp, Mus musculus
gtattacagcccataggattttcca

SEQ ID NO: 677867 - DNA, 25 bp, Mus musculus
gtattacagcccttaggattttcca

SEQ ID NO: 677868 - DNA, 25 bp, Mus musculus
gtattacagcttatcacggtatttt

SEQ ID NO: 677869 - DNA, 25 bp, Mus musculus
gtattacagcttttcacggtatttt

SEQ ID NO: 677870 - DNA, 25 bp, Mus musculus
gtattacattatactcgcactgaag

SEQ ID NO: 677871 - DNA, 25 bp, Mus musculus
gtattacattattctcgcactgaag

SEQ ID NO: 677872 - DNA, 25 bp, Mus musculus
gtattacattgtaggcttgacgatt

SEQ ID NO: 677873 - DNA, 25 bp, Mus musculus
gtattacattgttggcttgacgatt

SEQ ID NO: 677874 - DNA, 25 bp, Mus musculus
gtattaccaattcccttaggatggg

SEQ ID NO: 677875 - DNA, 25 bp, Mus musculus
gtattaccaattcttccctccctat

SEQ ID NO: 677876 - DNA, 25 bp, Mus musculus
gtattaccaattgccttaggatggg

SEQ ID NO: 677877 - DNA, 25 bp, Mus musculus
gtattaccaattgttccctccctat

SEQ ID NO: 677878 - DNA, 25 bp, Mus musculus
gtattaccatgacccaaggcagaga

SEQ ID NO: 677879 - DNA, 25 bp, Mus musculus
gtattaccatgagccaaggcagaga

SEQ ID NO: 677880 - DNA, 25 bp, Mus musculus
gtattaccatgtcttctcttaggaa

SEQ ID NO: 677881 - DNA, 25 bp, Mus musculus
gtattaccatgtgttctcttaggaa

SEQ ID NO: 677882 - DNA, 25 bp, Mus musculus
gtattacccaccaaagacatcagaa

SEQ ID NO: 677883 - DNA, 25 bp, Mus musculus
gtattacccacctaagacatcagaa

SEQ ID NO: 677884 - DNA, 25 bp, Mus musculus
gtattacccctgcatgataggaatt

SEQ ID NO: 677885 - DNA, 25 bp, Mus musculus
gtattacccctggatgataggaatt

SEQ ID NO: 677886 - DNA, 25 bp, Mus musculus
gtattaccgaagactgggagcataa

SEQ ID NO: 677887 - DNA, 25 bp, Mus musculus
gtattaccgaagtctgggagcataa

SEQ ID NO: 677888 - DNA, 25 bp, Mus musculus
gtattacctcatatgagccacttgg

SEQ ID NO: 677889 - DNA, 25 bp, Mus musculus
gtattacctcatttgagccacttgg

SEQ ID NO: 677890 - DNA, 25 bp, Mus musculus
gtattacctgagcagggcatctgga

SEQ ID NO: 677891 - DNA, 25 bp, Mus musculus
gtattacctgaggagggcatctgga

SEQ ID NO: 677892 - DNA, 25 bp, Mus musculus
gtattacgccataaagaactgctct

SEQ ID NO: 677893 - DNA, 25 bp, Mus musculus
gtattacgccattaagaactgctct

SEQ ID NO: 677894 - DNA, 25 bp, Mus musculus
gtattacgctttccatcttacaggc

SEQ ID NO: 677895 - DNA, 25 bp, Mus musculus
gtattacgctttgcatcttacaggc

SEQ ID NO: 677896 - DNA, 25 bp, Mus musculus
gtattacgtagcactactcaaatca

SEQ ID NO: 677897 - DNA, 25 bp, Mus musculus
gtattacgtagctctactcaaatca

SEQ ID NO: 677898 - DNA, 25 bp, Mus musculus
gtattacgttttccatatctgattc

SEQ ID NO: 677899 - DNA, 25 bp, Mus musculus
gtattacgttttgcatatctgattc

SEQ ID NO: 677900 - DNA, 25 bp, Mus musculus
gtattactaacacgtctacagccca

SEQ ID NO: 677901 - DNA, 25 bp, Mus musculus
gtattactaacaggtctacagccca

SEQ ID NO: 677902 - DNA, 25 bp, Mus musculus
gtattactatagcatgcctctcaga

SEQ ID NO: 677903 - DNA, 25 bp, Mus musculus
gtattactataggatgcctctcaga

SEQ ID NO: 677904 - DNA, 25 bp, Mus musculus
gtattactatcaagccttgtatgtc

SEQ ID NO: 677905 - DNA, 25 bp, Mus musculus
gtattactatcatgccttgtatgtc

SEQ ID NO: 677906 - DNA, 25 bp, Mus musculus
gtattactatccactcttgaaccta

SEQ ID NO: 677907 - DNA, 25 bp, Mus musculus
gtattactatcctctcttgaaccta

SEQ ID NO: 677908 - DNA, 25 bp, Mus musculus
gtattactattaacgccaattttca

SEQ ID NO: 677909 - DNA, 25 bp, Mus musculus
gtattactattatcgccaattttca

SEQ ID NO: 677910 - DNA, 25 bp, Mus musculus
gtattactgccaagcttgtataaat

SEQ ID NO: 677911 - DNA, 25 bp, Mus musculus
gtattactgccatgcttgtataaat

SEQ ID NO: 677912 - DNA, 25 bp, Mus musculus
gtattactgcctcctgccttgagtt

SEQ ID NO: 677913 - DNA, 25 bp, Mus musculus
gtattactgcctgctgccttgagtt

SEQ ID NO: 677914 - DNA, 25 bp, Mus musculus
gtattactgcttatgattttattat

SEQ ID NO: 677915 - DNA, 25 bp, Mus musculus
gtattactgcttcaataattctctg

SEQ ID NO: 677916 - DNA, 25 bp, Mus musculus
gtattactgcttgaataattctctg

SEQ ID NO: 677917 - DNA, 25 bp, Mus musculus
gtattactgcttttgattttattat

SEQ ID NO: 677918 - DNA, 25 bp, Mus musculus
gtattactgtaactggcacttagga

SEQ ID NO: 677919 - DNA, 25 bp, Mus musculus
gtattactgtaagtggcacttagga

SEQ ID NO: 677920 - DNA, 25 bp, Mus musculus
gtattactgtgtctcgtgctgtctt

SEQ ID NO: 677921 - DNA, 25 bp, Mus musculus
gtattactgtgtctgtagtccatgt

SEQ ID NO: 677922 - DNA, 25 bp, Mus musculus
gtattactgtgtgtcgtgctgtctt

SEQ ID NO: 677923 - DNA, 25 bp, Mus musculus
gtattactgtgtgtgtagtccatgt

SEQ ID NO: 677924 - DNA, 25 bp, Mus musculus
gtattagacattattagcccataat

SEQ ID NO: 677925 - DNA, 25 bp, Mus musculus
gtattagacatttttagcccataat

SEQ ID NO: 677926 - DNA, 25 bp, Mus musculus
gtattagagctcatcctgactagtt

SEQ ID NO: 677927 - DNA, 25 bp, Mus musculus
gtattagagctcttcctgactagtt

SEQ ID NO: 677928 - DNA, 25 bp, Mus musculus
gtattagatatgatgaccaggaggg

SEQ ID NO: 677929 - DNA, 25 bp, Mus musculus
gtattagatatgttgaccaggaggg

SEQ ID NO: 677930 - DNA, 25 bp, Mus musculus
gtattagatgggacccactgcagct

SEQ ID NO: 677931 - DNA, 25 bp, Mus musculus
gtattagatgggtcccactgcagct

SEQ ID NO: 677932 - DNA, 25 bp, Mus musculus
gtattagcaaggcaaacaagtgcct

SEQ ID NO: 677933 - DNA, 25 bp, Mus musculus
gtattagcaagggaaacaagtgcct

SEQ ID NO: 677934 - DNA, 25 bp, Mus musculus
gtattagcaggaaagtcccacccgc

SEQ ID NO: 677935 - DNA, 25 bp, Mus musculus
gtattagcaggatagtcccacccgc

SEQ ID NO: 677936 - DNA, 25 bp, Mus musculus
gtattagcatccattgaggcaagtg

SEQ ID NO: 677937 - DNA, 25 bp, Mus musculus
gtattagcatcctttgaggcaagtg

SEQ ID NO: 677938 - DNA, 25 bp, Mus musculus
gtattagcgactaacctgtcactat

SEQ ID NO: 677939 - DNA, 25 bp, Mus musculus
gtattagcgacttacctgtcactat

SEQ ID NO: 677940 - DNA, 25 bp, Mus musculus
gtattagcgagtacgtggcaatgtt

SEQ ID NO: 677941 - DNA, 25 bp, Mus musculus
gtattagcgagttcgtggcaatgtt

SEQ ID NO: 677942 - DNA, 25 bp, Mus musculus
gtattagctgccaatttcagacact

SEQ ID NO: 677943 - DNA, 25 bp, Mus musculus
gtattagctgccattgacagtgata

SEQ ID NO: 677944 - DNA, 25 bp, Mus musculus
gtattagctgcctatttcagacact

SEQ ID NO: 677945 - DNA, 25 bp, Mus musculus
gtattagctgcctttgacagtgata

SEQ ID NO: 677946 - DNA, 25 bp, Mus musculus
gtattagggaacacagctcacttct

SEQ ID NO: 677947 - DNA, 25 bp, Mus musculus
gtattagggaactcagctcacttct

SEQ ID NO: 677948 - DNA, 25 bp, Mus musculus
gtattagggtacagcattcttcctt

SEQ ID NO: 677949 - DNA, 25 bp, Mus musculus
gtattagggtactgcattcttcctt

SEQ ID NO: 677950 - DNA, 25 bp, Mus musculus
gtattaggtatgcactgttccactg

SEQ ID NO: 677951 - DNA, 25 bp, Mus musculus
gtattaggtatggactgttccactg

SEQ ID NO: 677952 - DNA, 25 bp, Mus musculus
gtattagtcagcatcacacaccctt

SEQ ID NO: 677953 - DNA, 25 bp, Mus musculus
gtattagtcagcttcacacaccctt

SEQ ID NO: 677954 - DNA, 25 bp, Mus musculus
gtattagtgactacttcagcaaaat

SEQ ID NO: 677955 - DNA, 25 bp, Mus musculus
gtattagtgacttcttcagcaaaat

SEQ ID NO: 677956 - DNA, 25 bp, Mus musculus
gtattagtgataattttttagtagt

SEQ ID NO: 677957 - DNA, 25 bp, Mus musculus
gtattagtgatatttttttagtagt

SEQ ID NO: 677958 - DNA, 25 bp, Mus musculus
gtattagtgcatcaccctggaacag

SEQ ID NO: 677959 - DNA, 25 bp, Mus musculus
gtattagtgcatgaccctggaacag

SEQ ID NO: 677960 - DNA, 25 bp, Mus musculus
gtattagtgctacctattaattttt

SEQ ID NO: 677961 - DNA, 25 bp, Mus musculus
gtattagtgctagctattaattttt

SEQ ID NO: 677962 - DNA, 25 bp, Mus musculus
gtattagttctaagtgttatttatt

SEQ ID NO: 677963 - DNA, 25 bp, Mus musculus
gtattagttctatgtgttatttatt

SEQ ID NO: 677964 - DNA, 25 bp, Mus musculus
gtattataaccacctgctgagccct

SEQ ID NO: 677965 - DNA, 25 bp, Mus musculus
gtattataaccagctgctgagccct

SEQ ID NO: 677966 - DNA, 25 bp, Mus musculus
gtattataagtacccagacaaccag

SEQ ID NO: 677967 - DNA, 25 bp, Mus musculus
gtattataagtagccagacaaccag

SEQ ID NO: 677968 - DNA, 25 bp, Mus musculus
gtattatacaatcatgtctgaccca

SEQ ID NO: 677969 - DNA, 25 bp, Mus musculus
gtattatacaatgatgtctgaccca

SEQ ID NO: 677970 - DNA, 25 bp, Mus musculus
gtattatacagtcaccagcggagat

SEQ ID NO: 677971 - DNA, 25 bp, Mus musculus
gtattatacagtgaccagcggagat

SEQ ID NO: 677972 - DNA, 25 bp, Mus musculus
gtattatagctccttgtgcacttgt

SEQ ID NO: 677973 - DNA, 25 bp, Mus musculus
gtattatagctcgttgtgcacttgt

SEQ ID NO: 677974 - DNA, 25 bp, Mus musculus
gtattataggctcctgcatttttac

SEQ ID NO: 677975 - DNA, 25 bp, Mus musculus
gtattataggctgctgcatttttac

SEQ ID NO: 677976 - DNA, 25 bp, Mus musculus
gtattatatacaagcacaacagggc

SEQ ID NO: 677977 - DNA, 25 bp, Mus musculus
gtattatatacatgcacaacagggc

SEQ ID NO: 677978 - DNA, 25 bp, Mus musculus
gtattatattcaattgtttcactat

SEQ ID NO: 677979 - DNA, 25 bp, Mus musculus
gtattatattcatttgtttcactat

SEQ ID NO: 677980 - DNA, 25 bp, Mus musculus
gtattatcaaggacatttgttacgg

SEQ ID NO: 677981 - DNA, 25 bp, Mus musculus
gtattatcaaggctctaatccggga

SEQ ID NO: 677982 - DNA, 25 bp, Mus musculus
gtattatcaagggtctaatccggga

SEQ ID NO: 677983 - DNA, 25 bp, Mus musculus
gtattatcaaggtcatttgttacgg

SEQ ID NO: 677984 - DNA, 25 bp, Mus musculus
gtattatccctactacggcaaactc

SEQ ID NO: 677985 - DNA, 25 bp, Mus musculus
gtattatccctagtacggcaaactc

SEQ ID NO: 677986 - DNA, 25 bp, Mus musculus
gtattatcctttcgacaacaccaca

SEQ ID NO: 677987 - DNA, 25 bp, Mus musculus
gtattatcctttggacaacaccaca

SEQ ID NO: 677988 - DNA, 25 bp, Mus musculus
gtattatctaaaccttcaccttgga

SEQ ID NO: 677989 - DNA, 25 bp, Mus musculus
gtattatctaaagcttcaccttgga

SEQ ID NO: 677990 - DNA, 25 bp, Mus musculus
gtattatctaatccttcctgtgcct

SEQ ID NO: 677991 - DNA, 25 bp, Mus musculus
gtattatctaatcgactgttacata

SEQ ID NO: 677992 - DNA, 25 bp, Mus musculus
gtattatctaatgcttcctgtgcct

SEQ ID NO: 677993 - DNA, 25 bp, Mus musculus
gtattatctaatggactgttacata

SEQ ID NO: 677994 - DNA, 25 bp, Mus musculus
gtattatctattctaagtctcaaca

SEQ ID NO: 677995 - DNA, 25 bp, Mus musculus
gtattatctattgtaagtctcaaca

SEQ ID NO: 677996 - DNA, 25 bp, Mus musculus
gtattatctgccaaaatcttgtttt

SEQ ID NO: 677997 - DNA, 25 bp, Mus musculus
gtattatctgcctaaatcttgtttt

SEQ ID NO: 677998 - DNA, 25 bp, Mus musculus
gtattatgacacatcactctgaccc

SEQ ID NO: 677999 - DNA, 25 bp, Mus musculus
gtattatgacacttcactctgaccc

SEQ ID NO: 678000 - DNA, 25 bp, Mus musculus
gtattatgacctcacctggctgagc

SEQ ID NO: 678001 - DNA, 25 bp, Mus musculus
gtattatgacctgacctggctgagc

SEQ ID NO: 678002 - DNA, 25 bp, Mus musculus
gtattatgctctattatcgtttaaa

SEQ ID NO: 678003 - DNA, 25 bp, Mus musculus
gtattatgctcttttatcgtttaaa

SEQ ID NO: 678004 - DNA, 25 bp, Mus musculus
gtattatgggatagctacctgtata

SEQ ID NO: 678005 - DNA, 25 bp, Mus musculus
gtattatgggattgctacctgtata

SEQ ID NO: 678006 - DNA, 25 bp, Mus musculus
gtattatgggcaactcttctttcga

SEQ ID NO: 678007 - DNA, 25 bp, Mus musculus
gtattatgggcatctcttctttcga

SEQ ID NO: 678008 - DNA, 25 bp, Mus musculus
gtattatgggctcactctgggtcta

SEQ ID NO: 678009 - DNA, 25 bp, Mus musculus
gtattatgggctgactctgggtcta

SEQ ID NO: 678010 - DNA, 25 bp, Mus musculus
gtattatgtagcatctgccagtctc

SEQ ID NO: 678011 - DNA, 25 bp, Mus musculus
gtattatgtagcttctgccagtctc

SEQ ID NO: 678012 - DNA, 25 bp, Mus musculus
gtattatgtgccaactgtgacccag

SEQ ID NO: 678013 - DNA, 25 bp, Mus musculus
gtattatgtgcctactgtgacccag

SEQ ID NO: 678014 - DNA, 25 bp, Mus musculus
gtattatgtgttattgatggaatct

SEQ ID NO: 678015 - DNA, 25 bp, Mus musculus
gtattatgtgtttttgatggaatct

SEQ ID NO: 678016 - DNA, 25 bp, Mus musculus
gtattatgttcaactcaggtgccaa

SEQ ID NO: 678017 - DNA, 25 bp, Mus musculus
gtattatgttcatctcaggtgccaa

SEQ ID NO: 678018 - DNA, 25 bp, Mus musculus
gtattatgttgccatcatatagtgt

SEQ ID NO: 678019 - DNA, 25 bp, Mus musculus
gtattatgttgcgatcatatagtgt

SEQ ID NO: 678020 - DNA, 25 bp, Mus musculus
gtattatgttgtagctgtgaccagt

SEQ ID NO: 678021 - DNA, 25 bp, Mus musculus
gtattatgttgttgctgtgaccagt

SEQ ID NO: 678022 - DNA, 25 bp, Mus musculus
gtattattattcactagcaccctag

SEQ ID NO: 678023 - DNA, 25 bp, Mus musculus
gtattattattctctagcaccctag

SEQ ID NO: 678024 - DNA, 25 bp, Mus musculus
gtattattcaccctgttaatcccac

SEQ ID NO: 678025 - DNA, 25 bp, Mus musculus
gtattattcaccgtgttaatcccac

SEQ ID NO: 678026 - DNA, 25 bp, Mus musculus
gtattattctcacacaatcttgtac

SEQ ID NO: 678027 - DNA, 25 bp, Mus musculus
gtattattctcagacaatcttgtac

SEQ ID NO: 678028 - DNA, 25 bp, Mus musculus
gtattattgctcagtatgtgttctt

SEQ ID NO: 678029 - DNA, 25 bp, Mus musculus
gtattattgctctgtatgtgttctt

SEQ ID NO: 678030 - DNA, 25 bp, Mus musculus
gtattattgcttaggcctcagaaag

SEQ ID NO: 678031 - DNA, 25 bp, Mus musculus
gtattattgctttggcctcagaaag

SEQ ID NO: 678032 - DNA, 25 bp, Mus musculus
gtattattgggtagcccatctgcca

SEQ ID NO: 678033 - DNA, 25 bp, Mus musculus
gtattattgggttgcccatctgcca

SEQ ID NO: 678034 - DNA, 25 bp, Mus musculus
gtattattggtccatttctcaggga

SEQ ID NO: 678035 - DNA, 25 bp, Mus musculus
gtattattggtcgatttctcaggga

SEQ ID NO: 678036 - DNA, 25 bp, Mus musculus
gtattattggttatatgctccctaa

SEQ ID NO: 678037 - DNA, 25 bp, Mus musculus
gtattattggttttatgctccctaa

SEQ ID NO: 678038 - DNA, 25 bp, Mus musculus
gtattattgtctattcttcctttct

SEQ ID NO: 678039 - DNA, 25 bp, Mus musculus
gtattattgtcttttcttcctttct

SEQ ID NO: 678040 - DNA, 25 bp, Mus musculus
gtattattgttgatgacccacctct

SEQ ID NO: 678041 - DNA, 25 bp, Mus musculus
gtattattgttgttgacccacctct

SEQ ID NO: 678042 - DNA, 25 bp, Mus musculus
gtattatttagcaacccactgtgtt

SEQ ID NO: 678043 - DNA, 25 bp, Mus musculus
gtattatttagctacccactgtgtt

SEQ ID NO: 678044 - DNA, 25 bp, Mus musculus
gtattatttattcctctcctcagga

SEQ ID NO: 678045 - DNA, 25 bp, Mus musculus
gtattatttattgctctcctcagga

SEQ ID NO: 678046 - DNA, 25 bp, Mus musculus
gtattatttcatatgctatcccaaa

SEQ ID NO: 678047 - DNA, 25 bp, Mus musculus
gtattatttcatttgctatcccaaa

SEQ ID NO: 678048 - DNA, 25 bp, Mus musculus
gtattatttggcattctactctgaa

SEQ ID NO: 678049 - DNA, 25 bp, Mus musculus
gtattatttggcctcaggtgcaagg

SEQ ID NO: 678050 - DNA, 25 bp, Mus musculus
gtattatttggcgtcaggtgcaagg

SEQ ID NO: 678051 - DNA, 25 bp, Mus musculus
gtattatttggctttctactctgaa

SEQ ID NO: 678052 - DNA, 25 bp, Mus musculus
gtattattttagcagcctccatatc

SEQ ID NO: 678053 - DNA, 25 bp, Mus musculus
gtattattttaggagcctccatatc

SEQ ID NO: 678054 - DNA, 25 bp, Mus musculus
gtattcaaaagaactgagctcctct

SEQ ID NO: 678055 - DNA, 25 bp, Mus musculus
gtattcaaaagatctgagctcctct

SEQ ID NO: 678056 - DNA, 25 bp, Mus musculus
gtattcaaagaactgctacacagct

SEQ ID NO: 678057 - DNA, 25 bp, Mus musculus
gtattcaaagaagtgctacacagct

SEQ ID NO: 678058 - DNA, 25 bp, Mus musculus
gtattcaacaaacctaatcattctc

SEQ ID NO: 678059 - DNA, 25 bp, Mus musculus
gtattcaacaaacctcatgtgccaa

SEQ ID NO: 678060 - DNA, 25 bp, Mus musculus
gtattcaacaaagctaatcattctc

SEQ ID NO: 678061 - DNA, 25 bp, Mus musculus
gtattcaacaaagctcatgtgccaa

SEQ ID NO: 678062 - DNA, 25 bp, Mus musculus
gtattcaacactcgaggagttacaa

SEQ ID NO: 678063 - DNA, 25 bp, Mus musculus
gtattcaacactggaggagttacaa

SEQ ID NO: 678064 - DNA, 25 bp, Mus musculus
gtattcaaccgtaagtgctaccacc

SEQ ID NO: 678065 - DNA, 25 bp, Mus musculus
gtattcaaccgttagtgctaccacc

SEQ ID NO: 678066 - DNA, 25 bp, Mus musculus
gtattcaagggcaccatcgattgtg

SEQ ID NO: 678067 - DNA, 25 bp, Mus musculus
gtattcaagggctccatcgattgtg

SEQ ID NO: 678068 - DNA, 25 bp, Mus musculus
gtattcaataatctctgtgctctaa

SEQ ID NO: 678069 - DNA, 25 bp, Mus musculus
gtattcaataatgtctgtgctctaa

SEQ ID NO: 678070 - DNA, 25 bp, Mus musculus
gtattcaatcacactatgtacagta

SEQ ID NO: 678071 - DNA, 25 bp, Mus musculus
gtattcaatcactctatgtacagta

SEQ ID NO: 678072 - DNA, 25 bp, Mus musculus
gtattcaatcagactcttggtgcct

SEQ ID NO: 678073 - DNA, 25 bp, Mus musculus
gtattcaatcagtctcttggtgcct

SEQ ID NO: 678074 - DNA, 25 bp, Mus musculus
gtattcaatcttaccagtgctgacc

SEQ ID NO: 678075 - DNA, 25 bp, Mus musculus
gtattcaatctttccagtgctgacc

SEQ ID NO: 678076 - DNA, 25 bp, Mus musculus
gtattcaatgtcaacagaggcttct

SEQ ID NO: 678077 - DNA, 25 bp, Mus musculus
gtattcaatgtctacagaggcttct

SEQ ID NO: 678078 - DNA, 25 bp, Mus musculus
gtattcaattgtcactctgtcagtc

SEQ ID NO: 678079 - DNA, 25 bp, Mus musculus
gtattcaattgtgactctgtcagtc

SEQ ID NO: 678080 - DNA, 25 bp, Mus musculus
gtattcacaaccctcaagcaaatca

SEQ ID NO: 678081 - DNA, 25 bp, Mus musculus
gtattcacaaccgtcaagcaaatca

SEQ ID NO: 678082 - DNA, 25 bp, Mus musculus
gtattcacaactcctggacactggt

SEQ ID NO: 678083 - DNA, 25 bp, Mus musculus
gtattcacaactgctggacactggt

SEQ ID NO: 678084 - DNA, 25 bp, Mus musculus
gtattcacacctcctgagtgatcat

SEQ ID NO: 678085 - DNA, 25 bp, Mus musculus
gtattcacacctgctgagtgatcat

SEQ ID NO: 678086 - DNA, 25 bp, Mus musculus
gtattcacacgcaaacaggacacca

SEQ ID NO: 678087 - DNA, 25 bp, Mus musculus
gtattcacacgctaacaggacacca

SEQ ID NO: 678088 - DNA, 25 bp, Mus musculus
gtattcacactgatttgggcattaa

SEQ ID NO: 678089 - DNA, 25 bp, Mus musculus
gtattcacactgttttgggcattaa

SEQ ID NO: 678090 - DNA, 25 bp, Mus musculus
gtattcacatacacactaactcaag

SEQ ID NO: 678091 - DNA, 25 bp, Mus musculus
gtattcacatactcactaactcaag

SEQ ID NO: 678092 - DNA, 25 bp, Mus musculus
gtattcacattactcctggagtcca

SEQ ID NO: 678093 - DNA, 25 bp, Mus musculus
gtattcacattagtcctggagtcca

SEQ ID NO: 678094 - DNA, 25 bp, Mus musculus
gtattcaccaaaatccagagcttca

SEQ ID NO: 678095 - DNA, 25 bp, Mus musculus
gtattcaccaaattccagagcttca

SEQ ID NO: 678096 - DNA, 25 bp, Mus musculus
gtattcaccgtaactctgaagctcg

SEQ ID NO: 678097 - DNA, 25 bp, Mus musculus
gtattcaccgtatctctgaagctcg

SEQ ID NO: 678098 - DNA, 25 bp, Mus musculus
gtattcacctaccaaagacacactc

SEQ ID NO: 678099 - DNA, 25 bp, Mus musculus
gtattcacctacgaaagacacactc

SEQ ID NO: 678100 - DNA, 25 bp, Mus musculus
gtattcacgggaaagccactggact

SEQ ID NO: 678101 - DNA, 25 bp, Mus musculus
gtattcacgggatagccactggact

SEQ ID NO: 678102 - DNA, 25 bp, Mus musculus
gtattcactcctaatctgtactgag

SEQ ID NO: 678103 - DNA, 25 bp, Mus musculus
gtattcactccttatctgtactgag

SEQ ID NO: 678104 - DNA, 25 bp, Mus musculus
gtattcactgatcgctttggtcatt

SEQ ID NO: 678105 - DNA, 25 bp, Mus musculus
gtattcactgatggctttggtcatt

SEQ ID NO: 678106 - DNA, 25 bp, Mus musculus
gtattcactgccctctgatatgaca

SEQ ID NO: 678107 - DNA, 25 bp, Mus musculus
gtattcactgccgtctgatatgaca

SEQ ID NO: 678108 - DNA, 25 bp, Mus musculus
gtattcacttggactggtacccagg

SEQ ID NO: 678109 - DNA, 25 bp, Mus musculus
gtattcacttggtctggtacccagg

SEQ ID NO: 678110 - DNA, 25 bp, Mus musculus
gtattcagaaatatcatcctagcct

SEQ ID NO: 678111 - DNA, 25 bp, Mus musculus
gtattcagaaatttcatcctagcct

SEQ ID NO: 678112 - DNA, 25 bp, Mus musculus
gtattcagacccagccttgcctaag

SEQ ID NO: 678113 - DNA, 25 bp, Mus musculus
gtattcagaccctgccttgcctaag

SEQ ID NO: 678114 - DNA, 25 bp, Mus musculus
gtattcagagcaaataatttcccag

SEQ ID NO: 678115 - DNA, 25 bp, Mus musculus
gtattcagagcatataatttcccag

SEQ ID NO: 678116 - DNA, 25 bp, Mus musculus
gtattcagatatcagctgccttgtg

SEQ ID NO: 678117 - DNA, 25 bp, Mus musculus
gtattcagatatgagctgccttgtg

SEQ ID NO: 678118 - DNA, 25 bp, Mus musculus
gtattcagattcaggttgccgtctg

SEQ ID NO: 678119 - DNA, 25 bp, Mus musculus
gtattcagattctggttgccgtctg

SEQ ID NO: 678120 - DNA, 25 bp, Mus musculus
gtattcagcacaagctaagcagttt

SEQ ID NO: 678121 - DNA, 25 bp, Mus musculus
gtattcagcacatgctaagcagttt

SEQ ID NO: 678122 - DNA, 25 bp, Mus musculus
gtattcagctcacggacaggattct

SEQ ID NO: 678123 - DNA, 25 bp, Mus musculus
gtattcagctcagggacaggattct

SEQ ID NO: 678124 - DNA, 25 bp, Mus musculus
gtattcagcttgcacagctcagagg

SEQ ID NO: 678125 - DNA, 25 bp, Mus musculus
gtattcagcttggacagctcagagg

SEQ ID NO: 678126 - DNA, 25 bp, Mus musculus
gtattcaggcttacatgaacatcat

SEQ ID NO: 678127 - DNA, 25 bp, Mus musculus
gtattcaggctttcatgaacatcat

SEQ ID NO: 678128 - DNA, 25 bp, Mus musculus
gtattcagtagacgcttcagcatct

SEQ ID NO: 678129 - DNA, 25 bp, Mus musculus
gtattcagtagaggcttcagcatct

SEQ ID NO: 678130 - DNA, 25 bp, Mus musculus
gtattcatacagatctttcagagga

SEQ ID NO: 678131 - DNA, 25 bp, Mus musculus
gtattcatacagttctttcagagga

SEQ ID NO: 678132 - DNA, 25 bp, Mus musculus
gtattcatacttaggttgcttcaga

SEQ ID NO: 678133 - DNA, 25 bp, Mus musculus
gtattcatactttggttgcttcaga

SEQ ID NO: 678134 - DNA, 25 bp, Mus musculus
gtattcatcacaatccatcagtctg

SEQ ID NO: 678135 - DNA, 25 bp, Mus musculus
gtattcatcacattccatcagtctg

SEQ ID NO: 678136 - DNA, 25 bp, Mus musculus
gtattcatcagacgttcgatccatt

SEQ ID NO: 678137 - DNA, 25 bp, Mus musculus
gtattcatcagaggttcgatccatt

SEQ ID NO: 678138 - DNA, 25 bp, Mus musculus
gtattcatcatgattagccttcgga

SEQ ID NO: 678139 - DNA, 25 bp, Mus musculus
gtattcatcatgtttagccttcgga

SEQ ID NO: 678140 - DNA, 25 bp, Mus musculus
gtattcatccctatctgttcagata

SEQ ID NO: 678141 - DNA, 25 bp, Mus musculus
gtattcatccctttctgttcagata

SEQ ID NO: 678142 - DNA, 25 bp, Mus musculus
gtattcatcctacagttattttgtt

SEQ ID NO: 678143 - DNA, 25 bp, Mus musculus
gtattcatcctagagttattttgtt

SEQ ID NO: 678144 - DNA, 25 bp, Mus musculus
gtattcatctgcagacactggcttt

SEQ ID NO: 678145 - DNA, 25 bp, Mus musculus
gtattcatctgctgacactggcttt

SEQ ID NO: 678146 - DNA, 25 bp, Mus musculus
gtattcatgaaaaccctgcagtggg

SEQ ID NO: 678147 - DNA, 25 bp, Mus musculus
gtattcatgaaatccctgcagtggg

SEQ ID NO: 678148 - DNA, 25 bp, Mus musculus
gtattcatgctgaaatgacacccaa

SEQ ID NO: 678149 - DNA, 25 bp, Mus musculus
gtattcatgctgtaatgacacccaa

SEQ ID NO: 678150 - DNA, 25 bp, Mus musculus
gtattcatgttaacattgggtgcaa

SEQ ID NO: 678151 - DNA, 25 bp, Mus musculus
gtattcatgttatcattgggtgcaa

SEQ ID NO: 678152 - DNA, 25 bp, Mus musculus
gtattcattattcttatcacgtcaa

SEQ ID NO: 678153 - DNA, 25 bp, Mus musculus
gtattcattattgttatcacgtcaa

SEQ ID NO: 678154 - DNA, 25 bp, Mus musculus
gtattcattcacatgcaactgtttt

SEQ ID NO: 678155 - DNA, 25 bp, Mus musculus
gtattcattcacttgcaactgtttt

SEQ ID NO: 678156 - DNA, 25 bp, Mus musculus
gtattcattcagcttggaacccact

SEQ ID NO: 678157 - DNA, 25 bp, Mus musculus
gtattcattcaggttggaacccact

SEQ ID NO: 678158 - DNA, 25 bp, Mus musculus
gtattcattcttacagtcacccttt

SEQ ID NO: 678159 - DNA, 25 bp, Mus musculus
gtattcattcttagacatgcattgt

SEQ ID NO: 678160 - DNA, 25 bp, Mus musculus
gtattcattctttcagtcacccttt

SEQ ID NO: 678161 - DNA, 25 bp, Mus musculus
gtattcattctttgacatgcattgt

SEQ ID NO: 678162 - DNA, 25 bp, Mus musculus
gtattcatttagatacccagttgta

SEQ ID NO: 678163 - DNA, 25 bp, Mus musculus
gtattcatttagttacccagttgta

SEQ ID NO: 678164 - DNA, 25 bp, Mus musculus
gtattcatttataaatccttttagg

SEQ ID NO: 678165 - DNA, 25 bp, Mus musculus
gtattcatttattaatccttttagg

SEQ ID NO: 678166 - DNA, 25 bp, Mus musculus
gtattcatttgcagtctttgtattt

SEQ ID NO: 678167 - DNA, 25 bp, Mus musculus
gtattcatttgctgtctttgtattt

SEQ ID NO: 678168 - DNA, 25 bp, Mus musculus
gtattcattttcaaccacagttccc

SEQ ID NO: 678169 - DNA, 25 bp, Mus musculus
gtattcattttctaccacagttccc

SEQ ID NO: 678170 - DNA, 25 bp, Mus musculus
gtattcatttttcctaaaggcctgt

SEQ ID NO: 678171 - DNA, 25 bp, Mus musculus
gtattcatttttgctaaaggcctgt

SEQ ID NO: 678172 - DNA, 25 bp, Mus musculus
gtattccaagagagccttaccaaag

SEQ ID NO: 678173 - DNA, 25 bp, Mus musculus
gtattccaagagtgccttaccaaag

SEQ ID NO: 678174 - DNA, 25 bp, Mus musculus
gtattccacaaacactgccttgctt

SEQ ID NO: 678175 - DNA, 25 bp, Mus musculus
gtattccacaaagactgccttgctt

SEQ ID NO: 678176 - DNA, 25 bp, Mus musculus
gtattccaccccatttttcattaat

SEQ ID NO: 678177 - DNA, 25 bp, Mus musculus
gtattccaccccttttttcattaat

SEQ ID NO: 678178 - DNA, 25 bp, Mus musculus
gtattccaccttcaaagcggtctgt

SEQ ID NO: 678179 - DNA, 25 bp, Mus musculus
gtattccaccttgaaagcggtctgt

SEQ ID NO: 678180 - DNA, 25 bp, Mus musculus
gtattccactgaatttccattttcc

SEQ ID NO: 678181 - DNA, 25 bp, Mus musculus
gtattccactgattttccattttcc

SEQ ID NO: 678182 - DNA, 25 bp, Mus musculus
gtattccacttaattgtctcctaat

SEQ ID NO: 678183 - DNA, 25 bp, Mus musculus
gtattccacttatttgtctcctaat

SEQ ID NO: 678184 - DNA, 25 bp, Mus musculus
gtattccagactagtcactgacttc

SEQ ID NO: 678185 - DNA, 25 bp, Mus musculus
gtattccagacttgtcactgacttc

SEQ ID NO: 678186 - DNA, 25 bp, Mus musculus
gtattccagagcacgatgaggcaga

SEQ ID NO: 678187 - DNA, 25 bp, Mus musculus
gtattccagagctcgatgaggcaga

SEQ ID NO: 678188 - DNA, 25 bp, Mus musculus
gtattccagttaccagggctcaagg

SEQ ID NO: 678189 - DNA, 25 bp, Mus musculus
gtattccagttagcagggctcaagg

SEQ ID NO: 678190 - DNA, 25 bp, Mus musculus
gtattccatggtcaatgagtgctct

SEQ ID NO: 678191 - DNA, 25 bp, Mus musculus
gtattccatggtgaatgagtgctct

SEQ ID NO: 678192 - DNA, 25 bp, Mus musculus
gtattccatgtaactcagtcactaa

SEQ ID NO: 678193 - DNA, 25 bp, Mus musculus
gtattccatgtatctcagtcactaa

SEQ ID NO: 678194 - DNA, 25 bp, Mus musculus
gtattccatttaaaaccataatcta

SEQ ID NO: 678195 - DNA, 25 bp, Mus musculus
gtattccatttataaccataatcta

SEQ ID NO: 678196 - DNA, 25 bp, Mus musculus
gtattcccaaacaccagacactgga

SEQ ID NO: 678197 - DNA, 25 bp, Mus musculus
gtattcccaaactccagacactgga

SEQ ID NO: 678198 - DNA, 25 bp, Mus musculus
gtattcccaaagaccatatgctagg

SEQ ID NO: 678199 - DNA, 25 bp, Mus musculus
gtattcccaaagtccatatgctagg

SEQ ID NO: 678200 - DNA, 25 bp, Mus musculus
gtattcccacaaagagtatattgaa

SEQ ID NO: 678201 - DNA, 25 bp, Mus musculus
gtattcccacaatgagtatattgaa

SEQ ID NO: 678202 - DNA, 25 bp, Mus musculus
gtattcccagacctgttgggaggat

SEQ ID NO: 678203 - DNA, 25 bp, Mus musculus
gtattcccagacgtgttgggaggat

SEQ ID NO: 678204 - DNA, 25 bp, Mus musculus
gtattcccaggaccttgctgagttt

SEQ ID NO: 678205 - DNA, 25 bp, Mus musculus
gtattcccaggagcttgctgagttt

SEQ ID NO: 678206 - DNA, 25 bp, Mus musculus
gtattcccatgtctgtcaattgttg

SEQ ID NO: 678207 - DNA, 25 bp, Mus musculus
gtattcccatgtgtgtcaattgttg

SEQ ID NO: 678208 - DNA, 25 bp, Mus musculus
gtattccccaaacaaattcctgcag

SEQ ID NO: 678209 - DNA, 25 bp, Mus musculus
gtattccccaaacactcaggtggag

SEQ ID NO: 678210 - DNA, 25 bp, Mus musculus
gtattccccaaagaaattcctgcag

SEQ ID NO: 678211 - DNA, 25 bp, Mus musculus
gtattccccaaagactcaggtggag

SEQ ID NO: 678212 - DNA, 25 bp, Mus musculus
gtattccccagcatatatcttctaa

SEQ ID NO: 678213 - DNA, 25 bp, Mus musculus
gtattccccagcttatatcttctaa

SEQ ID NO: 678214 - DNA, 25 bp, Mus musculus
gtattccccttcagcaacatcagta

SEQ ID NO: 678215 - DNA, 25 bp, Mus musculus
gtattccccttctgcaacatcagta

SEQ ID NO: 678216 - DNA, 25 bp, Mus musculus
gtattcccggagagatgcagacaag

SEQ ID NO: 678217 - DNA, 25 bp, Mus musculus
gtattcccggagtgatgcagacaag

SEQ ID NO: 678218 - DNA, 25 bp, Mus musculus
gtattccctcaacatcaacagcctg

SEQ ID NO: 678219 - DNA, 25 bp, Mus musculus
gtattccctcaagatcaacagcctg

SEQ ID NO: 678220 - DNA, 25 bp, Mus musculus
gtattccctgagagacaccatctga

SEQ ID NO: 678221 - DNA, 25 bp, Mus musculus
gtattccctgagtgacaccatctga

SEQ ID NO: 678222 - DNA, 25 bp, Mus musculus
gtattccctggtacaactagattca

SEQ ID NO: 678223 - DNA, 25 bp, Mus musculus
gtattccctggttcaactagattca

SEQ ID NO: 678224 - DNA, 25 bp, Mus musculus
gtattccctgtaaatcgatttacaa

SEQ ID NO: 678225 - DNA, 25 bp, Mus musculus
gtattccctgtatatcgatttacaa

SEQ ID NO: 678226 - DNA, 25 bp, Mus musculus
gtattccctgtgagttagctgatga

SEQ ID NO: 678227 - DNA, 25 bp, Mus musculus
gtattccctgtgtgttagctgatga

SEQ ID NO: 678228 - DNA, 25 bp, Mus musculus
gtattcccttaaacactgaaggaca

SEQ ID NO: 678229 - DNA, 25 bp, Mus musculus
gtattcccttaatcactgaaggaca

SEQ ID NO: 678230 - DNA, 25 bp, Mus musculus
gtattccgctcgaggagactacttc

SEQ ID NO: 678231 - DNA, 25 bp, Mus musculus
gtattccgctcgtggagactacttc

SEQ ID NO: 678232 - DNA, 25 bp, Mus musculus
gtattccggtgaagaaacctttcat

SEQ ID NO: 678233 - DNA, 25 bp, Mus musculus
gtattccggtgatgaaacctttcat

SEQ ID NO: 678234 - DNA, 25 bp, Mus musculus
gtattcctaagcactgacagtcgat

SEQ ID NO: 678235 - DNA, 25 bp, Mus musculus
gtattcctaagctctgacagtcgat

SEQ ID NO: 678236 - DNA, 25 bp, Mus musculus
gtattcctaatgacttcagttagag

SEQ ID NO: 678237 - DNA, 25 bp, Mus musculus
gtattcctaatgtcttcagttagag

SEQ ID NO: 678238 - DNA, 25 bp, Mus musculus
gtattcctagttactaactccgtca

SEQ ID NO: 678239 - DNA, 25 bp, Mus musculus
gtattcctagtttctaactccgtca

SEQ ID NO: 678240 - DNA, 25 bp, Mus musculus
gtattcctatcaccattcctttcaa

SEQ ID NO: 678241 - DNA, 25 bp, Mus musculus
gtattcctatcagcattcctttcaa

SEQ ID NO: 678242 - DNA, 25 bp, Mus musculus
gtattcctatccaaatgcactgaga

SEQ ID NO: 678243 - DNA, 25 bp, Mus musculus
gtattcctatcctaatgcactgaga

SEQ ID NO: 678244 - DNA, 25 bp, Mus musculus
gtattcctcagcatatatctcctaa

SEQ ID NO: 678245 - DNA, 25 bp, Mus musculus
gtattcctcagcttatatctcctaa

SEQ ID NO: 678246 - DNA, 25 bp, Mus musculus
gtattcctcattatttacaatggca

SEQ ID NO: 678247 - DNA, 25 bp, Mus musculus
gtattcctcattttttacaatggca

SEQ ID NO: 678248 - DNA, 25 bp, Mus musculus
gtattcctccttcaatgaacatcgg

SEQ ID NO: 678249 - DNA, 25 bp, Mus musculus
gtattcctccttgaatgaacatcgg

SEQ ID NO: 678250 - DNA, 25 bp, Mus musculus
gtattcctctaccagaagtcacatg

SEQ ID NO: 678251 - DNA, 25 bp, Mus musculus
gtattcctctacgagaagtcacatg

SEQ ID NO: 678252 - DNA, 25 bp, Mus musculus
gtattcctctgacttgtgaagccaa

SEQ ID NO: 678253 - DNA, 25 bp, Mus musculus
gtattcctctgagttgtgaagccaa

SEQ ID NO: 678254 - DNA, 25 bp, Mus musculus
gtattcctgatcactctaaggcttt

SEQ ID NO: 678255 - DNA, 25 bp, Mus musculus
gtattcctgatctctctaaggcttt

SEQ ID NO: 678256 - DNA, 25 bp, Mus musculus
gtattcctgattaccatgtggtttg

SEQ ID NO: 678257 - DNA, 25 bp, Mus musculus
gtattcctgatttccatgtggtttg

SEQ ID NO: 678258 - DNA, 25 bp, Mus musculus
gtattcctgcagaacagaccagaga

SEQ ID NO: 678259 - DNA, 25 bp, Mus musculus
gtattcctgcagtacagaccagaga

SEQ ID NO: 678260 - DNA, 25 bp, Mus musculus
gtattcctgcatcgtaaatctggta

SEQ ID NO: 678261 - DNA, 25 bp, Mus musculus
gtattcctgcatggtaaatctggta

SEQ ID NO: 678262 - DNA, 25 bp, Mus musculus
gtattcctgcttcccttgaagatga

SEQ ID NO: 678263 - DNA, 25 bp, Mus musculus
gtattcctgcttgccttgaagatga

SEQ ID NO: 678264 - DNA, 25 bp, Mus musculus
gtattcctggacatgtgtcgtctgg

SEQ ID NO: 678265 - DNA, 25 bp, Mus musculus
gtattcctggacttgtgtcgtctgg

SEQ ID NO: 678266 - DNA, 25 bp, Mus musculus
gtattcctgttacatttactatgat

SEQ ID NO: 678267 - DNA, 25 bp, Mus musculus
gtattcctgttagatttactatgat

SEQ ID NO: 678268 - DNA, 25 bp, Mus musculus
gtattccttcaaacataggtctttt

SEQ ID NO: 678269 - DNA, 25 bp, Mus musculus
gtattccttcaatcataggtctttt

SEQ ID NO: 678270 - DNA, 25 bp, Mus musculus
gtattccttgctccggtcggagaag

SEQ ID NO: 678271 - DNA, 25 bp, Mus musculus
gtattccttgctgcggtcggagaag

SEQ ID NO: 678272 - DNA, 25 bp, Mus musculus
gtattccttgtgctagtggtcatag

SEQ ID NO: 678273 - DNA, 25 bp, Mus musculus
gtattccttgtggtagtggtcatag

SEQ ID NO: 678274 - DNA, 25 bp, Mus musculus
gtattccttgttagctgtggttaat

SEQ ID NO: 678275 - DNA, 25 bp, Mus musculus
gtattccttgtttgctgtggttaat

SEQ ID NO: 678276 - DNA, 25 bp, Mus musculus
gtattcctttccatgtgtctgtgca

SEQ ID NO: 678277 - DNA, 25 bp, Mus musculus
gtattcctttccttgtgtctgtgca

SEQ ID NO: 678278 - DNA, 25 bp, Mus musculus
gtattcctttggcagttctgagtct

SEQ ID NO: 678279 - DNA, 25 bp, Mus musculus
gtattcctttgggagttctgagtct

SEQ ID NO: 678280 - DNA, 25 bp, Mus musculus
gtattcctttttcagggccagtata

SEQ ID NO: 678281 - DNA, 25 bp, Mus musculus
gtattcctttttgagggccagtata

SEQ ID NO: 678282 - DNA, 25 bp, Mus musculus
gtattcgacgcaccagaattctgtt

SEQ ID NO: 678283 - DNA, 25 bp, Mus musculus
gtattcgacgcagcagaattctgtt

SEQ ID NO: 678284 - DNA, 25 bp, Mus musculus
gtattcgaggcaataacattcggta

SEQ ID NO: 678285 - DNA, 25 bp, Mus musculus
gtattcgaggcattaacattcggta

SEQ ID NO: 678286 - DNA, 25 bp, Mus musculus
gtattcgcctggcaatttttctcag

SEQ ID NO: 678287 - DNA, 25 bp, Mus musculus
gtattcgcctgggaatttttctcag

SEQ ID NO: 678288 - DNA, 25 bp, Mus musculus
gtattcgctgtgatcatggtctaga

SEQ ID NO: 678289 - DNA, 25 bp, Mus musculus
gtattcgctgtgttcatggtctaga

SEQ ID NO: 678290 - DNA, 25 bp, Mus musculus
gtattcgctttacaagacacttgga

SEQ ID NO: 678291 - DNA, 25 bp, Mus musculus
gtattcgctttagaagacacttgga

SEQ ID NO: 678292 - DNA, 25 bp, Mus musculus
gtattcggacggaagagccttactt

SEQ ID NO: 678293 - DNA, 25 bp, Mus musculus
gtattcggacggtagagccttactt

SEQ ID NO: 678294 - DNA, 25 bp, Mus musculus
gtattcggcattattctcttcctta

SEQ ID NO: 678295 - DNA, 25 bp, Mus musculus
gtattcggcatttttctcttcctta

SEQ ID NO: 678296 - DNA, 25 bp, Mus musculus
gtattcgggcataaggatagcctgt

SEQ ID NO: 678297 - DNA, 25 bp, Mus musculus
gtattcgggcattaggatagcctgt

SEQ ID NO: 678298 - DNA, 25 bp, Mus musculus
gtattcggtcaactggagtttctaa

SEQ ID NO: 678299 - DNA, 25 bp, Mus musculus
gtattcggtcaagtggagtttctaa

SEQ ID NO: 678300 - DNA, 25 bp, Mus musculus
gtattcggtcatccgacaatgcctt

SEQ ID NO: 678301 - DNA, 25 bp, Mus musculus
gtattcggtcatgcgacaatgcctt

SEQ ID NO: 678302 - DNA, 25 bp, Mus musculus
gtattcggtggcagattccaggaca

SEQ ID NO: 678303 - DNA, 25 bp, Mus musculus
gtattcggtggctgattccaggaca

SEQ ID NO: 678304 - DNA, 25 bp, Mus musculus
gtattcgtaaagagcaccgtgtcag

SEQ ID NO: 678305 - DNA, 25 bp, Mus musculus
gtattcgtaaagtgcaccgtgtcag

SEQ ID NO: 678306 - DNA, 25 bp, Mus musculus
gtattcgtgataaagtcctccaggt

SEQ ID NO: 678307 - DNA, 25 bp, Mus musculus
gtattcgtgatatagtcctccaggt

SEQ ID NO: 678308 - DNA, 25 bp, Mus musculus
gtattcgtgatcagaatgccagcca

SEQ ID NO: 678309 - DNA, 25 bp, Mus musculus
gtattcgtgatctgaatgccagcca

SEQ ID NO: 678310 - DNA, 25 bp, Mus musculus
gtattcgtgcgtaagtgacctgtta

SEQ ID NO: 678311 - DNA, 25 bp, Mus musculus
gtattcgtgcgttagtgacctgtta

SEQ ID NO: 678312 - DNA, 25 bp, Mus musculus
gtattcgttcatatcactaagattg

SEQ ID NO: 678313 - DNA, 25 bp, Mus musculus
gtattcgttcatttcactaagattg

SEQ ID NO: 678314 - DNA, 25 bp, Mus musculus
gtattcgttgttaggacatgtcttg

SEQ ID NO: 678315 - DNA, 25 bp, Mus musculus
gtattcgttgtttggacatgtcttg

SEQ ID NO: 678316 - DNA, 25 bp, Mus musculus
gtattctaaatgacctcatgcttca

SEQ ID NO: 678317 - DNA, 25 bp, Mus musculus
gtattctaaatgatcactgacgtta

SEQ ID NO: 678318 - DNA, 25 bp, Mus musculus
gtattctaaatgtcctcatgcttca

SEQ ID NO: 678319 - DNA, 25 bp, Mus musculus
gtattctaaatgttcactgacgtta

SEQ ID NO: 678320 - DNA, 25 bp, Mus musculus
gtattctaagtcagtcgtagctgct

SEQ ID NO: 678321 - DNA, 25 bp, Mus musculus
gtattctaagtctgtcgtagctgct

SEQ ID NO: 678322 - DNA, 25 bp, Mus musculus
gtattctaagttaatgtggatccat

SEQ ID NO: 678323 - DNA, 25 bp, Mus musculus
gtattctaagttaccgtgagccttc

SEQ ID NO: 678324 - DNA, 25 bp, Mus musculus
gtattctaagtttatgtggatccat

SEQ ID NO: 678325 - DNA, 25 bp, Mus musculus
gtattctaagtttccgtgagccttc

SEQ ID NO: 678326 - DNA, 25 bp, Mus musculus
gtattctaatgtcgattccactccc

SEQ ID NO: 678327 - DNA, 25 bp, Mus musculus
gtattctaatgtggattccactccc

SEQ ID NO: 678328 - DNA, 25 bp, Mus musculus
gtattctacattctctttgggtata

SEQ ID NO: 678329 - DNA, 25 bp, Mus musculus
gtattctacattgtctttgggtata

SEQ ID NO: 678330 - DNA, 25 bp, Mus musculus
gtattctactatatggttctggtgt

SEQ ID NO: 678331 - DNA, 25 bp, Mus musculus
gtattctactatttggttctggtgt

SEQ ID NO: 678332 - DNA, 25 bp, Mus musculus
gtattctactctaagctgggtttcc

SEQ ID NO: 678333 - DNA, 25 bp, Mus musculus
gtattctactcttagctgggtttcc

SEQ ID NO: 678334 - DNA, 25 bp, Mus musculus
gtattctagagccttgcctggccag

SEQ ID NO: 678335 - DNA, 25 bp, Mus musculus
gtattctagagcgttgcctggccag

SEQ ID NO: 678336 - DNA, 25 bp, Mus musculus
gtattctaggatatcttgtgttctt

SEQ ID NO: 678337 - DNA, 25 bp, Mus musculus
gtattctaggatttcttgtgttctt

SEQ ID NO: 678338 - DNA, 25 bp, Mus musculus
gtattctataccactgagctgtcta

SEQ ID NO: 678339 - DNA, 25 bp, Mus musculus
gtattctatacctctgagctgtcta

SEQ ID NO: 678340 - DNA, 25 bp, Mus musculus
gtattctatcagatctgccactgtg

SEQ ID NO: 678341 - DNA, 25 bp, Mus musculus
gtattctatcagttctgccactgtg

SEQ ID NO: 678342 - DNA, 25 bp, Mus musculus
gtattctatcctcggtggttcccgt

SEQ ID NO: 678343 - DNA, 25 bp, Mus musculus
gtattctatcctgggtggttcccgt

SEQ ID NO: 678344 - DNA, 25 bp, Mus musculus
gtattctcagaaacagcacagtgtg

SEQ ID NO: 678345 - DNA, 25 bp, Mus musculus
gtattctcagaatcagcacagtgtg

SEQ ID NO: 678346 - DNA, 25 bp, Mus musculus
gtattctcagacatccatatgtgta

SEQ ID NO: 678347 - DNA, 25 bp, Mus musculus
gtattctcagacttccatatgtgta

SEQ ID NO: 678348 - DNA, 25 bp, Mus musculus
gtattctcagataagtcacgcgcaa

SEQ ID NO: 678349 - DNA, 25 bp, Mus musculus
gtattctcagatctatttcccaaac

SEQ ID NO: 678350 - DNA, 25 bp, Mus musculus
gtattctcagatgtatttcccaaac

SEQ ID NO: 678351 - DNA, 25 bp, Mus musculus
gtattctcagattagtcacgcgcaa

SEQ ID NO: 678352 - DNA, 25 bp, Mus musculus
gtattctcagtcatccatgggtgta

SEQ ID NO: 678353 - DNA, 25 bp, Mus musculus
gtattctcagtcttccatgggtgta

SEQ ID NO: 678354 - DNA, 25 bp, Mus musculus
gtattctcatcacattggccccaaa

SEQ ID NO: 678355 - DNA, 25 bp, Mus musculus
gtattctcatcagattggccccaaa

SEQ ID NO: 678356 - DNA, 25 bp, Mus musculus
gtattctcggaccttgggaaacagc

SEQ ID NO: 678357 - DNA, 25 bp, Mus musculus
gtattctcggacgttgggaaacagc

SEQ ID NO: 678358 - DNA, 25 bp, Mus musculus
gtattctctacaagctaatatggtt

SEQ ID NO: 678359 - DNA, 25 bp, Mus musculus
gtattctctacatgctaatatggtt

SEQ ID NO: 678360 - DNA, 25 bp, Mus musculus
gtattctctagtacagtttgaacaa

SEQ ID NO: 678361 - DNA, 25 bp, Mus musculus
gtattctctagttcagtttgaacaa

SEQ ID NO: 678362 - DNA, 25 bp, Mus musculus
gtattctctccaccggcaagggaaa

SEQ ID NO: 678363 - DNA, 25 bp, Mus musculus
gtattctctccagcggcaagggaaa

SEQ ID NO: 678364 - DNA, 25 bp, Mus musculus
gtattctctgacagtatttctagca

SEQ ID NO: 678365 - DNA, 25 bp, Mus musculus
gtattctctgactgtatttctagca

SEQ ID NO: 678366 - DNA, 25 bp, Mus musculus
gtattctctgttctgatattacata

SEQ ID NO: 678367 - DNA, 25 bp, Mus musculus
gtattctctgttgtgatattacata

SEQ ID NO: 678368 - DNA, 25 bp, Mus musculus
gtattctcttgtaagcagaagcatg

SEQ ID NO: 678369 - DNA, 25 bp, Mus musculus
gtattctcttgtacaaaagccttat

SEQ ID NO: 678370 - DNA, 25 bp, Mus musculus
gtattctcttgttagcagaagcatg

SEQ ID NO: 678371 - DNA, 25 bp, Mus musculus
gtattctcttgttcaaaagccttat

SEQ ID NO: 678372 - DNA, 25 bp, Mus musculus
gtattctgaagaattcactccacag

SEQ ID NO: 678373 - DNA, 25 bp, Mus musculus
gtattctgaagatttcactccacag

SEQ ID NO: 678374 - DNA, 25 bp, Mus musculus
gtattctgacttcccattgacagga

SEQ ID NO: 678375 - DNA, 25 bp, Mus musculus
gtattctgacttgccattgacagga

SEQ ID NO: 678376 - DNA, 25 bp, Mus musculus
gtattctgatgtattccccttgaag

SEQ ID NO: 678377 - DNA, 25 bp, Mus musculus
gtattctgatgttttccccttgaag

SEQ ID NO: 678378 - DNA, 25 bp, Mus musculus
gtattctgccaaacataattttata

SEQ ID NO: 678379 - DNA, 25 bp, Mus musculus
gtattctgccaatcataattttata

SEQ ID NO: 678380 - DNA, 25 bp, Mus musculus
gtattctgcctaatgtttgcttctg

SEQ ID NO: 678381 - DNA, 25 bp, Mus musculus
gtattctgcctattgtttgcttctg

SEQ ID NO: 678382 - DNA, 25 bp, Mus musculus
gtattctgctatcccatcaggcaac

SEQ ID NO: 678383 - DNA, 25 bp, Mus musculus
gtattctgctatgccatcaggcaac

SEQ ID NO: 678384 - DNA, 25 bp, Mus musculus
gtattctgtaatactaagcatgtat

SEQ ID NO: 678385 - DNA, 25 bp, Mus musculus
gtattctgtaattctaagcatgtat

SEQ ID NO: 678386 - DNA, 25 bp, Mus musculus
gtattctgtaccatcatggcaggcg

SEQ ID NO: 678387 - DNA, 25 bp, Mus musculus
gtattctgtaccttcatggcaggcg

SEQ ID NO: 678388 - DNA, 25 bp, Mus musculus
gtattctgtcccctatggtgctgta

SEQ ID NO: 678389 - DNA, 25 bp, Mus musculus
gtattctgtcccgtatggtgctgta

SEQ ID NO: 678390 - DNA, 25 bp, Mus musculus
gtattctgtgtcaaattcaaggtat

SEQ ID NO: 678391 - DNA, 25 bp, Mus musculus
gtattctgtgtctaattcaaggtat

SEQ ID NO: 678392 - DNA, 25 bp, Mus musculus
gtattctgttgaccgtttccttaaa

SEQ ID NO: 678393 - DNA, 25 bp, Mus musculus
gtattctgttgagcgtttccttaaa

SEQ ID NO: 678394 - DNA, 25 bp, Mus musculus
gtattctgtttaagtctctctgttt

SEQ ID NO: 678395 - DNA, 25 bp, Mus musculus
gtattctgtttatgtctctctgttt

SEQ ID NO: 678396 - DNA, 25 bp, Mus musculus
gtattcttagaactcaacaacccga

SEQ ID NO: 678397 - DNA, 25 bp, Mus musculus
gtattcttagaacttcaatccgcac

SEQ ID NO: 678398 - DNA, 25 bp, Mus musculus
gtattcttagaagtcaacaacccga

SEQ ID NO: 678399 - DNA, 25 bp, Mus musculus
gtattcttagaagttcaatccgcac

SEQ ID NO: 678400 - DNA, 25 bp, Mus musculus
gtattcttatgccttttcaatatat

SEQ ID NO: 678401 - DNA, 25 bp, Mus musculus
gtattcttatgcgttttcaatatat

SEQ ID NO: 678402 - DNA, 25 bp, Mus musculus
gtattcttattcagcatgcaacagg

SEQ ID NO: 678403 - DNA, 25 bp, Mus musculus
gtattcttattctgcatgcaacagg

SEQ ID NO: 678404 - DNA, 25 bp, Mus musculus
gtattcttcacaagctctccagtaa

SEQ ID NO: 678405 - DNA, 25 bp, Mus musculus
gtattcttcacatgctctccagtaa

SEQ ID NO: 678406 - DNA, 25 bp, Mus musculus
gtattcttcactagtatgtgtatag

SEQ ID NO: 678407 - DNA, 25 bp, Mus musculus
gtattcttcacttgtatgtgtatag

SEQ ID NO: 678408 - DNA, 25 bp, Mus musculus
gtattcttccctccaatcatattca

SEQ ID NO: 678409 - DNA, 25 bp, Mus musculus
gtattcttccctgcaatcatattca

SEQ ID NO: 678410 - DNA, 25 bp, Mus musculus
gtattcttcgctcacggcactggaa

SEQ ID NO: 678411 - DNA, 25 bp, Mus musculus
gtattcttcgctgacggcactggaa

SEQ ID NO: 678412 - DNA, 25 bp, Mus musculus
gtattcttctaacctgtatgctcta

SEQ ID NO: 678413 - DNA, 25 bp, Mus musculus
gtattcttctaagctgtatgctcta

SEQ ID NO: 678414 - DNA, 25 bp, Mus musculus
gtattcttctatagacctgcatttg

SEQ ID NO: 678415 - DNA, 25 bp, Mus musculus
gtattcttctattgacctgcatttg

SEQ ID NO: 678416 - DNA, 25 bp, Mus musculus
gtattcttctcacatgtgactggta

SEQ ID NO: 678417 - DNA, 25 bp, Mus musculus
gtattcttctcagatgtgactggta

SEQ ID NO: 678418 - DNA, 25 bp, Mus musculus
gtattcttctctactcttgataata

SEQ ID NO: 678419 - DNA, 25 bp, Mus musculus
gtattcttctcttctcttgataata

SEQ ID NO: 678420 - DNA, 25 bp, Mus musculus
gtattcttctgtaattgtcctgcat

SEQ ID NO: 678421 - DNA, 25 bp, Mus musculus
gtattcttctgttattgtcctgcat

SEQ ID NO: 678422 - DNA, 25 bp, Mus musculus
gtattcttgcaaattccaacagcct

SEQ ID NO: 678423 - DNA, 25 bp, Mus musculus
gtattcttgcaatttccaacagcct

SEQ ID NO: 678424 - DNA, 25 bp, Mus musculus
gtattcttgctcctgtttgctattt

SEQ ID NO: 678425 - DNA, 25 bp, Mus musculus
gtattcttgctcgtgtttgctattt

SEQ ID NO: 678426 - DNA, 25 bp, Mus musculus
gtattcttgcttactgtttctctta

SEQ ID NO: 678427 - DNA, 25 bp, Mus musculus
gtattcttgctttctgtttctctta

SEQ ID NO: 678428 - DNA, 25 bp, Mus musculus
gtattcttggacaaacgttcagcat

SEQ ID NO: 678429 - DNA, 25 bp, Mus musculus
gtattcttggactaacgttcagcat

SEQ ID NO: 678430 - DNA, 25 bp, Mus musculus
gtattcttggatcccggacatactg

SEQ ID NO: 678431 - DNA, 25 bp, Mus musculus
gtattcttggatgccggacatactg

SEQ ID NO: 678432 - DNA, 25 bp, Mus musculus
gtattcttggcacgtggcattctag

SEQ ID NO: 678433 - DNA, 25 bp, Mus musculus
gtattcttggcaggtggcattctag

SEQ ID NO: 678434 - DNA, 25 bp, Mus musculus
gtattcttggctcgctgttcagatg

SEQ ID NO: 678435 - DNA, 25 bp, Mus musculus
gtattcttggctggctgttcagatg

SEQ ID NO: 678436 - DNA, 25 bp, Mus musculus
gtattcttgtatctcagttttgtga

SEQ ID NO: 678437 - DNA, 25 bp, Mus musculus
gtattcttgtatgtcagttttgtga

SEQ ID NO: 678438 - DNA, 25 bp, Mus musculus
gtattctttaggaagcagctttacc

SEQ ID NO: 678439 - DNA, 25 bp, Mus musculus
gtattctttaggtagcagctttacc

SEQ ID NO: 678440 - DNA, 25 bp, Mus musculus
gtattctttatacccactctgatta

SEQ ID NO: 678441 - DNA, 25 bp, Mus musculus
gtattctttatagccactctgatta

SEQ ID NO: 678442 - DNA, 25 bp, Mus musculus
gtattctttatgcaatgttttcact

SEQ ID NO: 678443 - DNA, 25 bp, Mus musculus
gtattctttatgctttgtctatgta

SEQ ID NO: 678444 - DNA, 25 bp, Mus musculus
gtattctttatggaatgttttcact

SEQ ID NO: 678445 - DNA, 25 bp, Mus musculus
gtattctttatggtttgtctatgta

SEQ ID NO: 678446 - DNA, 25 bp, Mus musculus
gtattctttattagctttgttccct

SEQ ID NO: 678447 - DNA, 25 bp, Mus musculus
gtattctttatttgctttgttccct

SEQ ID NO: 678448 - DNA, 25 bp, Mus musculus
gtattctttcagatctgccactgtg

SEQ ID NO: 678449 - DNA, 25 bp, Mus musculus
gtattctttcagttctgccactgtg

SEQ ID NO: 678450 - DNA, 25 bp, Mus musculus
gtattctttccaagcagttattaga

SEQ ID NO: 678451 - DNA, 25 bp, Mus musculus
gtattctttccatgcagttattaga

SEQ ID NO: 678452 - DNA, 25 bp, Mus musculus
gtattctttgacagtggaccatttg

SEQ ID NO: 678453 - DNA, 25 bp, Mus musculus
gtattctttgactgtggaccatttg

SEQ ID NO: 678454 - DNA, 25 bp, Mus musculus
gtattctttgcaaggaccttgtaca

SEQ ID NO: 678455 - DNA, 25 bp, Mus musculus
gtattctttgcatggaccttgtaca

SEQ ID NO: 678456 - DNA, 25 bp, Mus musculus
gtattctttgtgagcatgttgttta

SEQ ID NO: 678457 - DNA, 25 bp, Mus musculus
gtattctttgtgtgcatgttgttta

SEQ ID NO: 678458 - DNA, 25 bp, Mus musculus
gtattcttttatatgaatccctgga

SEQ ID NO: 678459 - DNA, 25 bp, Mus musculus
gtattcttttatttgaatccctgga

SEQ ID NO: 678460 - DNA, 25 bp, Mus musculus
gtattcttttgaacttttacatatt

SEQ ID NO: 678461 - DNA, 25 bp, Mus musculus
gtattcttttgatcttttacatatt

SEQ ID NO: 678462 - DNA, 25 bp, Mus musculus
gtattcttttgtagctagcttcatc

SEQ ID NO: 678463 - DNA, 25 bp, Mus musculus
gtattcttttgttgctagcttcatc

SEQ ID NO: 678464 - DNA, 25 bp, Mus musculus
gtattgaaagaaccttgcattcctg

SEQ ID NO: 678465 - DNA, 25 bp, Mus musculus
gtattgaaagaagcttgcattcctg

SEQ ID NO: 678466 - DNA, 25 bp, Mus musculus
gtattgaaataaacgtgcctacaat

SEQ ID NO: 678467 - DNA, 25 bp, Mus musculus
gtattgaaataatcgtgcctacaat

SEQ ID NO: 678468 - DNA, 25 bp, Mus musculus
gtattgaacacaccgcttgaagaca

SEQ ID NO: 678469 - DNA, 25 bp, Mus musculus
gtattgaacacagcgcttgaagaca

SEQ ID NO: 678470 - DNA, 25 bp, Mus musculus
gtattgaactgaacgagcctccact

SEQ ID NO: 678471 - DNA, 25 bp, Mus musculus
gtattgaactgatcgagcctccact

SEQ ID NO: 678472 - DNA, 25 bp, Mus musculus
gtattgaaggccagtgccaccatgc

SEQ ID NO: 678473 - DNA, 25 bp, Mus musculus
gtattgaaggcctgtgccaccatgc

SEQ ID NO: 678474 - DNA, 25 bp, Mus musculus
gtattgaataatatgctacatttgt

SEQ ID NO: 678475 - DNA, 25 bp, Mus musculus
gtattgaataatttgctacatttgt

SEQ ID NO: 678476 - DNA, 25 bp, Mus musculus
gtattgacagctaaaatggcagaca

SEQ ID NO: 678477 - DNA, 25 bp, Mus musculus
gtattgacagcttaaatggcagaca

SEQ ID NO: 678478 - DNA, 25 bp, Mus musculus
gtattgacagtcacaaatgacattg

SEQ ID NO: 678479 - DNA, 25 bp, Mus musculus
gtattgacagtctcaaatgacattg

SEQ ID NO: 678480 - DNA, 25 bp, Mus musculus
gtattgaccaaccagtaatcctatt

SEQ ID NO: 678481 - DNA, 25 bp, Mus musculus
gtattgaccaacgagtaatcctatt

SEQ ID NO: 678482 - DNA, 25 bp, Mus musculus
gtattgacccttctgcatctggtgg

SEQ ID NO: 678483 - DNA, 25 bp, Mus musculus
gtattgacccttgtgcatctggtgg

SEQ ID NO: 678484 - DNA, 25 bp, Mus musculus
gtattgaccgcactccacagggaaa

SEQ ID NO: 678485 - DNA, 25 bp, Mus musculus
gtattgaccgcagtccacagggaaa

SEQ ID NO: 678486 - DNA, 25 bp, Mus musculus
gtattgaccttgaccgtgtttgatt

SEQ ID NO: 678487 - DNA, 25 bp, Mus musculus
gtattgaccttgtccgtgtttgatt

SEQ ID NO: 678488 - DNA, 25 bp, Mus musculus
gtattgactaacacacccagggaga

SEQ ID NO: 678489 - DNA, 25 bp, Mus musculus
gtattgactaactcacccagggaga

SEQ ID NO: 678490 - DNA, 25 bp, Mus musculus
gtattgactcctaattcagctacag

SEQ ID NO: 678491 - DNA, 25 bp, Mus musculus
gtattgactccttattcagctacag

SEQ ID NO: 678492 - DNA, 25 bp, Mus musculus
gtattgactctgagcccgcagttaa

SEQ ID NO: 678493 - DNA, 25 bp, Mus musculus
gtattgactctgtgcccgcagttaa

SEQ ID NO: 678494 - DNA, 25 bp, Mus musculus
gtattgactgctcagatatttactg

SEQ ID NO: 678495 - DNA, 25 bp, Mus musculus
gtattgactgctcttatagagtacc

SEQ ID NO: 678496 - DNA, 25 bp, Mus musculus
gtattgactgctgagatatttactg

SEQ ID NO: 678497 - DNA, 25 bp, Mus musculus
gtattgactgctgttatagagtacc

SEQ ID NO: 678498 - DNA, 25 bp, Mus musculus
gtattgagacccatatgtagcctag

SEQ ID NO: 678499 - DNA, 25 bp, Mus musculus
gtattgagacccttatgtagcctag

SEQ ID NO: 678500 - DNA, 25 bp, Mus musculus
gtattgagacctctaccttttactt

SEQ ID NO: 678501 - DNA, 25 bp, Mus musculus
gtattgagacctgtaccttttactt

SEQ ID NO: 678502 - DNA, 25 bp, Mus musculus
gtattgagagttcacctctccctgt

SEQ ID NO: 678503 - DNA, 25 bp, Mus musculus
gtattgagagttgacctctccctgt

SEQ ID NO: 678504 - DNA, 25 bp, Mus musculus
gtattgagcctcagagtgctgcttc

SEQ ID NO: 678505 - DNA, 25 bp, Mus musculus
gtattgagcctctgagtgctgcttc

SEQ ID NO: 678506 - DNA, 25 bp, Mus musculus
gtattgagctccagggtcagctgtc

SEQ ID NO: 678507 - DNA, 25 bp, Mus musculus
gtattgagctcctgggtcagctgtc

SEQ ID NO: 678508 - DNA, 25 bp, Mus musculus
gtattgagcttgagttgcttcctgt

SEQ ID NO: 678509 - DNA, 25 bp, Mus musculus
gtattgagcttgtgttgcttcctgt

SEQ ID NO: 678510 - DNA, 25 bp, Mus musculus
gtattgagctttattattcctcaca

SEQ ID NO: 678511 - DNA, 25 bp, Mus musculus
gtattgagcttttttattcctcaca

SEQ ID NO: 678512 - DNA, 25 bp, Mus musculus
gtattgaggccaatgaagccctagt

SEQ ID NO: 678513 - DNA, 25 bp, Mus musculus
gtattgaggccattgaagccctagt

SEQ ID NO: 678514 - DNA, 25 bp, Mus musculus
gtattgagggtactggcttagccat

SEQ ID NO: 678515 - DNA, 25 bp, Mus musculus
gtattgagggtagtggcttagccat

SEQ ID NO: 678516 - DNA, 25 bp, Mus musculus
gtattgagtaccagacgtctccaca

SEQ ID NO: 678517 - DNA, 25 bp, Mus musculus
gtattgagtacctgacgtctccaca

SEQ ID NO: 678518 - DNA, 25 bp, Mus musculus
gtattgagtcctagtgtcatcgtca

SEQ ID NO: 678519 - DNA, 25 bp, Mus musculus
gtattgagtccttgtgtcatcgtca

SEQ ID NO: 678520 - DNA, 25 bp, Mus musculus
gtattgagtggacaccctttggcac

SEQ ID NO: 678521 - DNA, 25 bp, Mus musculus
gtattgagtggagaccctttggcac

SEQ ID NO: 678522 - DNA, 25 bp, Mus musculus
gtattgatacatagggctacactca

SEQ ID NO: 678523 - DNA, 25 bp, Mus musculus
gtattgatacattgggctacactca

SEQ ID NO: 678524 - DNA, 25 bp, Mus musculus
gtattgatccctagaactgaaagaa

SEQ ID NO: 678525 - DNA, 25 bp, Mus musculus
gtattgatcccttgaactgaaagaa

SEQ ID NO: 678526 - DNA, 25 bp, Mus musculus
gtattgatggctagctcattgttaa

SEQ ID NO: 678527 - DNA, 25 bp, Mus musculus
gtattgatggcttgctcattgttaa

SEQ ID NO: 678528 - DNA, 25 bp, Mus musculus
gtattgattccaaagcacaaattga

SEQ ID NO: 678529 - DNA, 25 bp, Mus musculus
gtattgattccacgggccatgcagg

SEQ ID NO: 678530 - DNA, 25 bp, Mus musculus
gtattgattccaggggccatgcagg

SEQ ID NO: 678531 - DNA, 25 bp, Mus musculus
gtattgattccatagcacaaattga

SEQ ID NO: 678532 - DNA, 25 bp, Mus musculus
gtattgattgttatttcctggttat

SEQ ID NO: 678533 - DNA, 25 bp, Mus musculus
gtattgattgttttttcctggttat

SEQ ID NO: 678534 - DNA, 25 bp, Mus musculus
gtattgatttctaatgcgttgcgag

SEQ ID NO: 678535 - DNA, 25 bp, Mus musculus
gtattgatttcttatgcgttgcgag

SEQ ID NO: 678536 - DNA, 25 bp, Mus musculus
gtattgattttcactacatatttaa

SEQ ID NO: 678537 - DNA, 25 bp, Mus musculus
gtattgattttctctacatatttaa

SEQ ID NO: 678538 - DNA, 25 bp, Mus musculus
gtattgcaaataccaccaccaacaa

SEQ ID NO: 678539 - DNA, 25 bp, Mus musculus
gtattgcaaatagcaccaccaacaa

SEQ ID NO: 678540 - DNA, 25 bp, Mus musculus
gtattgcaacctcctatttagcctt

SEQ ID NO: 678541 - DNA, 25 bp, Mus musculus
gtattgcaacctgctatttagcctt

SEQ ID NO: 678542 - DNA, 25 bp, Mus musculus
gtattgcactgaaacccttatttgt

SEQ ID NO: 678543 - DNA, 25 bp, Mus musculus
gtattgcactgatacccttatttgt

SEQ ID NO: 678544 - DNA, 25 bp, Mus musculus
gtattgcacttactagctttcaatt

SEQ ID NO: 678545 - DNA, 25 bp, Mus musculus
gtattgcacttagtagctttcaatt

SEQ ID NO: 678546 - DNA, 25 bp, Mus musculus
gtattgcagcccatactggacaggg

SEQ ID NO: 678547 - DNA, 25 bp, Mus musculus
gtattgcagcccttactggacaggg

SEQ ID NO: 678548 - DNA, 25 bp, Mus musculus
gtattgcagctcatattcaccatca

SEQ ID NO: 678549 - DNA, 25 bp, Mus musculus
gtattgcagctcttattcaccatca

SEQ ID NO: 678550 - DNA, 25 bp, Mus musculus
gtattgcagtctccttcctaaaatc

SEQ ID NO: 678551 - DNA, 25 bp, Mus musculus
gtattgcagtctgcttcctaaaatc

SEQ ID NO: 678552 - DNA, 25 bp, Mus musculus
gtattgcataacacactgagaaaga

SEQ ID NO: 678553 - DNA, 25 bp, Mus musculus
gtattgcataactcactgagaaaga

SEQ ID NO: 678554 - DNA, 25 bp, Mus musculus
gtattgcatccacgtgtcagctcag

SEQ ID NO: 678555 - DNA, 25 bp, Mus musculus
gtattgcatccaggtgtcagctcag

SEQ ID NO: 678556 - DNA, 25 bp, Mus musculus
gtattgcatcttagatatgtgtctt

SEQ ID NO: 678557 - DNA, 25 bp, Mus musculus
gtattgcatctttgatatgtgtctt

SEQ ID NO: 678558 - DNA, 25 bp, Mus musculus
gtattgcatgaaacaagttcccttt

SEQ ID NO: 678559 - DNA, 25 bp, Mus musculus
gtattgcatgaatcaagttcccttt

SEQ ID NO: 678560 - DNA, 25 bp, Mus musculus
gtattgcatgtgagtatcagttggt

SEQ ID NO: 678561 - DNA, 25 bp, Mus musculus
gtattgcatgtgtgtatcagttggt

SEQ ID NO: 678562 - DNA, 25 bp, Mus musculus
gtattgccaagaccttgaagctcga

SEQ ID NO: 678563 - DNA, 25 bp, Mus musculus
gtattgccaagagcttgaagctcga

SEQ ID NO: 678564 - DNA, 25 bp, Mus musculus
gtattgccactcagtgcttctcttg

SEQ ID NO: 678565 - DNA, 25 bp, Mus musculus
gtattgccactctgtgcttctcttg

SEQ ID NO: 678566 - DNA, 25 bp, Mus musculus
gtattgccccacagtgggctaggtc

SEQ ID NO: 678567 - DNA, 25 bp, Mus musculus
gtattgccccactgtgggctaggtc

SEQ ID NO: 678568 - DNA, 25 bp, Mus musculus
gtattgcccgatccaatgagaaaaa

SEQ ID NO: 678569 - DNA, 25 bp, Mus musculus
gtattgcccgatgcaatgagaaaaa

SEQ ID NO: 678570 - DNA, 25 bp, Mus musculus
gtattgccggctacaccaaggagag

SEQ ID NO: 678571 - DNA, 25 bp, Mus musculus
gtattgccggcttcaccaaggagag

SEQ ID NO: 678572 - DNA, 25 bp, Mus musculus
gtattgcctatcaagtaggtagaaa

SEQ ID NO: 678573 - DNA, 25 bp, Mus musculus
gtattgcctatctagtaggtagaaa

SEQ ID NO: 678574 - DNA, 25 bp, Mus musculus
gtattgcctattcttcaagtacaca

SEQ ID NO: 678575 - DNA, 25 bp, Mus musculus
gtattgcctattgttcaagtacaca

SEQ ID NO: 678576 - DNA, 25 bp, Mus musculus
gtattgcctcttatacaaatctctg

SEQ ID NO: 678577 - DNA, 25 bp, Mus musculus
gtattgcctcttttacaaatctctg

SEQ ID NO: 678578 - DNA, 25 bp, Mus musculus
gtattgccttttatgcctatatcta

SEQ ID NO: 678579 - DNA, 25 bp, Mus musculus
gtattgccttttttgcctatatcta

SEQ ID NO: 678580 - DNA, 25 bp, Mus musculus
gtattgcgccgcaagaggtgaaatt

SEQ ID NO: 678581 - DNA, 25 bp, Mus musculus
gtattgcgccgctagaggtgaaatt

SEQ ID NO: 678582 - DNA, 25 bp, Mus musculus
gtattgcggacacgaccatccagga

SEQ ID NO: 678583 - DNA, 25 bp, Mus musculus
gtattgcggacaggaccatccagga

SEQ ID NO: 678584 - DNA, 25 bp, Mus musculus
gtattgctactcaagtcatttacag

SEQ ID NO: 678585 - DNA, 25 bp, Mus musculus
gtattgctactctagtcatttacag

SEQ ID NO: 678586 - DNA, 25 bp, Mus musculus
gtattgctcatgagggctgctgtaa

SEQ ID NO: 678587 - DNA, 25 bp, Mus musculus
gtattgctcatgtgggctgctgtaa

SEQ ID NO: 678588 - DNA, 25 bp, Mus musculus
gtattgctctccatatactataaat

SEQ ID NO: 678589 - DNA, 25 bp, Mus musculus
gtattgctctccttatactataaat

SEQ ID NO: 678590 - DNA, 25 bp, Mus musculus
gtattgctgtgcaaatcattgtttt

SEQ ID NO: 678591 - DNA, 25 bp, Mus musculus
gtattgctgtgctaatcattgtttt

SEQ ID NO: 678592 - DNA, 25 bp, Mus musculus
gtattgctgttccaacaatgtcaag

SEQ ID NO: 678593 - DNA, 25 bp, Mus musculus
gtattgctgttcgaacaatgtcaag

SEQ ID NO: 678594 - DNA, 25 bp, Mus musculus
gtattgcttaggatcaaccgaccag

SEQ ID NO: 678595 - DNA, 25 bp, Mus musculus
gtattgcttaggttcaaccgaccag

SEQ ID NO: 678596 - DNA, 25 bp, Mus musculus
gtattgcttataacgatacttgaag

SEQ ID NO: 678597 - DNA, 25 bp, Mus musculus
gtattgcttatatcgatacttgaag

SEQ ID NO: 678598 - DNA, 25 bp, Mus musculus
gtattgcttgagatcctacggttaa

SEQ ID NO: 678599 - DNA, 25 bp, Mus musculus
gtattgcttgagttcctacggttaa

SEQ ID NO: 678600 - DNA, 25 bp, Mus musculus
gtattgctttcgcagaggaccataa

SEQ ID NO: 678601 - DNA, 25 bp, Mus musculus
gtattgctttcggagaggaccataa

SEQ ID NO: 678602 - DNA, 25 bp, Mus musculus
gtattgctttgtagtcatctgggct

SEQ ID NO: 678603 - DNA, 25 bp, Mus musculus
gtattgctttgttgtcatctgggct

SEQ ID NO: 678604 - DNA, 25 bp, Mus musculus
gtattggaaacacagctcttgaaat

SEQ ID NO: 678605 - DNA, 25 bp, Mus musculus
gtattggaaacagagctcttgaaat

SEQ ID NO: 678606 - DNA, 25 bp, Mus musculus
gtattggacacaatgtcccttcaga

SEQ ID NO: 678607 - DNA, 25 bp, Mus musculus
gtattggacacattgtcccttcaga

SEQ ID NO: 678608 - DNA, 25 bp, Mus musculus
gtattggacactctccttataggat

SEQ ID NO: 678609 - DNA, 25 bp, Mus musculus
gtattggacactgtccttataggat

SEQ ID NO: 678610 - DNA, 25 bp, Mus musculus
gtattggacatcattttgctgtgtt

SEQ ID NO: 678611 - DNA, 25 bp, Mus musculus
gtattggacatctttttgctgtgtt

SEQ ID NO: 678612 - DNA, 25 bp, Mus musculus
gtattggagagccacccctcccaag

SEQ ID NO: 678613 - DNA, 25 bp, Mus musculus
gtattggagagcgacccctcccaag

SEQ ID NO: 678614 - DNA, 25 bp, Mus musculus
gtattggagtgcagggatgtcccac

SEQ ID NO: 678615 - DNA, 25 bp, Mus musculus
gtattggagtgctgggatgtcccac

SEQ ID NO: 678616 - DNA, 25 bp, Mus musculus
gtattggatcacctatctcaggagt

SEQ ID NO: 678617 - DNA, 25 bp, Mus musculus
gtattggatcacgtatctcaggagt

SEQ ID NO: 678618 - DNA, 25 bp, Mus musculus
gtattggatgccaatactaagcccc

SEQ ID NO: 678619 - DNA, 25 bp, Mus musculus
gtattggatgcctatactaagcccc

SEQ ID NO: 678620 - DNA, 25 bp, Mus musculus
gtattggattagaacatgcatagac

SEQ ID NO: 678621 - DNA, 25 bp, Mus musculus
gtattggattagtacatgcatagac

SEQ ID NO: 678622 - DNA, 25 bp, Mus musculus
gtattggccaagcatacagagccta

SEQ ID NO: 678623 - DNA, 25 bp, Mus musculus
gtattggccaaggatacagagccta

SEQ ID NO: 678624 - DNA, 25 bp, Mus musculus
gtattggcccttcagagttaacatt

SEQ ID NO: 678625 - DNA, 25 bp, Mus musculus
gtattggcccttgagagttaacatt

SEQ ID NO: 678626 - DNA, 25 bp, Mus musculus
gtattggcggcgaccagtagctttc

SEQ ID NO: 678627 - DNA, 25 bp, Mus musculus
gtattggcggcgtccagtagctttc

SEQ ID NO: 678628 - DNA, 25 bp, Mus musculus
gtattggcttctaccttaggataat

SEQ ID NO: 678629 - DNA, 25 bp, Mus musculus
gtattggcttcttccttaggataat

SEQ ID NO: 678630 - DNA, 25 bp, Mus musculus
gtattggcttggcagtctagctcag

SEQ ID NO: 678631 - DNA, 25 bp, Mus musculus
gtattggcttgggagtctagctcag

SEQ ID NO: 678632 - DNA, 25 bp, Mus musculus
gtattggctttgatgacttttagaa

SEQ ID NO: 678633 - DNA, 25 bp, Mus musculus
gtattggctttgttgacttttagaa

SEQ ID NO: 678634 - DNA, 25 bp, Mus musculus
gtattgggaaccatgccgggccaat

SEQ ID NO: 678635 - DNA, 25 bp, Mus musculus
gtattgggaaccttgccgggccaat

SEQ ID NO: 678636 - DNA, 25 bp, Mus musculus
gtattgggacaacatcaacttactg

SEQ ID NO: 678637 - DNA, 25 bp, Mus musculus
gtattgggacaagatcaacttactg

SEQ ID NO: 678638 - DNA, 25 bp, Mus musculus
gtattgggcaaaccctactcctact

SEQ ID NO: 678639 - DNA, 25 bp, Mus musculus
gtattgggcaaagcctactcctact

SEQ ID NO: 678640 - DNA, 25 bp, Mus musculus
gtattgggccagcactacagcacag

SEQ ID NO: 678641 - DNA, 25 bp, Mus musculus
gtattgggccaggactacagcacag

SEQ ID NO: 678642 - DNA, 25 bp, Mus musculus
gtattgggccttatgtatctatcga

SEQ ID NO: 678643 - DNA, 25 bp, Mus musculus
gtattgggccttttgtatctatcga

SEQ ID NO: 678644 - DNA, 25 bp, Mus musculus
gtattgggtacactcctggtttaca

SEQ ID NO: 678645 - DNA, 25 bp, Mus musculus
gtattgggtacagtcctggtttaca

SEQ ID NO: 678646 - DNA, 25 bp, Mus musculus
gtattgggtacgagactgactgtct

SEQ ID NO: 678647 - DNA, 25 bp, Mus musculus
gtattgggtacgtgactgactgtct

SEQ ID NO: 678648 - DNA, 25 bp, Mus musculus
gtattgggtgctacatgttccgcat

SEQ ID NO: 678649 - DNA, 25 bp, Mus musculus
gtattgggtgcttcatgttccgcat

SEQ ID NO: 678650 - DNA, 25 bp, Mus musculus
gtattgggtggaaatcatcatctca

SEQ ID NO: 678651 - DNA, 25 bp, Mus musculus
gtattgggtggatatcatcatctca

SEQ ID NO: 678652 - DNA, 25 bp, Mus musculus
gtattgggtttcataattctttggt

SEQ ID NO: 678653 - DNA, 25 bp, Mus musculus
gtattgggtttcttaattctttggt

SEQ ID NO: 678654 - DNA, 25 bp, Mus musculus
gtattggtaatgagagccactacgt

SEQ ID NO: 678655 - DNA, 25 bp, Mus musculus
gtattggtaatgtgagccactacgt

SEQ ID NO: 678656 - DNA, 25 bp, Mus musculus
gtattggtacatcgcaggacacagc

SEQ ID NO: 678657 - DNA, 25 bp, Mus musculus
gtattggtacatggcaggacacagc

SEQ ID NO: 678658 - DNA, 25 bp, Mus musculus
gtattggtagctatgtcacttttgc

SEQ ID NO: 678659 - DNA, 25 bp, Mus musculus
gtattggtagctttgtcacttttgc

SEQ ID NO: 678660 - DNA, 25 bp, Mus musculus
gtattggtagtaatcactccttctt

SEQ ID NO: 678661 - DNA, 25 bp, Mus musculus
gtattggtagtattcactccttctt

SEQ ID NO: 678662 - DNA, 25 bp, Mus musculus
gtattggtccatcttacatatgttg

SEQ ID NO: 678663 - DNA, 25 bp, Mus musculus
gtattggtccatgttacatatgttg

SEQ ID NO: 678664 - DNA, 25 bp, Mus musculus
gtattggtggaaacgctgcagtgaa

SEQ ID NO: 678665 - DNA, 25 bp, Mus musculus
gtattggtggaatcgctgcagtgaa

SEQ ID NO: 678666 - DNA, 25 bp, Mus musculus
gtattggtggtgctagcacctatta

SEQ ID NO: 678667 - DNA, 25 bp, Mus musculus
gtattggtggtggtagcacctatta

SEQ ID NO: 678668 - DNA, 25 bp, Mus musculus
gtattggttaatcagcaaccatgaa

SEQ ID NO: 678669 - DNA, 25 bp, Mus musculus
gtattggttaatgagcaaccatgaa

SEQ ID NO: 678670 - DNA, 25 bp, Mus musculus
gtattggttactagagatatgatta

SEQ ID NO: 678671 - DNA, 25 bp, Mus musculus
gtattggttacttgagatatgatta

SEQ ID NO: 678672 - DNA, 25 bp, Mus musculus
gtattggttcctattggcacttgta

SEQ ID NO: 678673 - DNA, 25 bp, Mus musculus
gtattggttccttttggcacttgta

SEQ ID NO: 678674 - DNA, 25 bp, Mus musculus
gtattggttgccaatggtgttctag

SEQ ID NO: 678675 - DNA, 25 bp, Mus musculus
gtattggttgcctatggtgttctag

SEQ ID NO: 678676 - DNA, 25 bp, Mus musculus
gtattggttggactgctcatggatt

SEQ ID NO: 678677 - DNA, 25 bp, Mus musculus
gtattggttggagtgctcatggatt

SEQ ID NO: 678678 - DNA, 25 bp, Mus musculus
gtattggtttcacaccagcctgtag

SEQ ID NO: 678679 - DNA, 25 bp, Mus musculus
gtattggtttcagaccagcctgtag

SEQ ID NO: 678680 - DNA, 25 bp, Mus musculus
gtattggtttccacagaaccattgt

SEQ ID NO: 678681 - DNA, 25 bp, Mus musculus
gtattggtttcctcagaaccattgt

SEQ ID NO: 678682 - DNA, 25 bp, Mus musculus
gtattggtttgccatgagaactcaa

SEQ ID NO: 678683 - DNA, 25 bp, Mus musculus
gtattggtttgcgatgagaactcaa

SEQ ID NO: 678684 - DNA, 25 bp, Mus musculus
gtattgtaaaccacttcaaccccag

SEQ ID NO: 678685 - DNA, 25 bp, Mus musculus
gtattgtaaacctcttcaaccccag

SEQ ID NO: 678686 - DNA, 25 bp, Mus musculus
gtattgtaactgactggcatattta

SEQ ID NO: 678687 - DNA, 25 bp, Mus musculus
gtattgtaactgtctggcatattta

SEQ ID NO: 678688 - DNA, 25 bp, Mus musculus
gtattgtacattctttcctgttgtt

SEQ ID NO: 678689 - DNA, 25 bp, Mus musculus
gtattgtacattgtttcctgttgtt

SEQ ID NO: 678690 - DNA, 25 bp, Mus musculus
gtattgtactgccattcctaatgta

SEQ ID NO: 678691 - DNA, 25 bp, Mus musculus
gtattgtactgcgattcctaatgta

SEQ ID NO: 678692 - DNA, 25 bp, Mus musculus
gtattgtagaaacccattcctccat

SEQ ID NO: 678693 - DNA, 25 bp, Mus musculus
gtattgtagaaagccattcctccat

SEQ ID NO: 678694 - DNA, 25 bp, Mus musculus
gtattgtagaccatttacctctcat

SEQ ID NO: 678695 - DNA, 25 bp, Mus musculus
gtattgtagaccttttacctctcat

SEQ ID NO: 678696 - DNA, 25 bp, Mus musculus
gtattgtataccacgattccatggg

SEQ ID NO: 678697 - DNA, 25 bp, Mus musculus
gtattgtatacctcgattccatggg

SEQ ID NO: 678698 - DNA, 25 bp, Mus musculus
gtattgtatgaacttcccgggccct

SEQ ID NO: 678699 - DNA, 25 bp, Mus musculus
gtattgtatgaagttcccgggccct

SEQ ID NO: 678700 - DNA, 25 bp, Mus musculus
gtattgtattttatctccataatta

SEQ ID NO: 678701 - DNA, 25 bp, Mus musculus
gtattgtattttttctccataatta

SEQ ID NO: 678702 - DNA, 25 bp, Mus musculus
gtattgtcaacgatcacccatgttg

SEQ ID NO: 678703 - DNA, 25 bp, Mus musculus
gtattgtcaacgttcacccatgttg

SEQ ID NO: 678704 - DNA, 25 bp, Mus musculus
gtattgtcaactcacagaaatgcct

SEQ ID NO: 678705 - DNA, 25 bp, Mus musculus
gtattgtcaactgacagaaatgcct

SEQ ID NO: 678706 - DNA, 25 bp, Mus musculus
gtattgtcaaggctaccgcctaact

SEQ ID NO: 678707 - DNA, 25 bp, Mus musculus
gtattgtcaagggtaccgcctaact

SEQ ID NO: 678708 - DNA, 25 bp, Mus musculus
gtattgtcagacatttgaccgtgaa

SEQ ID NO: 678709 - DNA, 25 bp, Mus musculus
gtattgtcagacttttgaccgtgaa

SEQ ID NO: 678710 - DNA, 25 bp, Mus musculus
gtattgtcaggtctatctccttgtt

SEQ ID NO: 678711 - DNA, 25 bp, Mus musculus
gtattgtcaggtgtatctccttgtt

SEQ ID NO: 678712 - DNA, 25 bp, Mus musculus
gtattgtcatcgcatccagttgtca

SEQ ID NO: 678713 - DNA, 25 bp, Mus musculus
gtattgtcatcggatccagttgtca

SEQ ID NO: 678714 - DNA, 25 bp, Mus musculus
gtattgtccaaaaccagtagctgtc

SEQ ID NO: 678715 - DNA, 25 bp, Mus musculus
gtattgtccaaatccagtagctgtc

SEQ ID NO: 678716 - DNA, 25 bp, Mus musculus
gtattgtccactcaacaccaagcat

SEQ ID NO: 678717 - DNA, 25 bp, Mus musculus
gtattgtccactgaacaccaagcat

SEQ ID NO: 678718 - DNA, 25 bp, Mus musculus
gtattgtccatgcagaagcttttct

SEQ ID NO: 678719 - DNA, 25 bp, Mus musculus
gtattgtccatggagaagcttttct

SEQ ID NO: 678720 - DNA, 25 bp, Mus musculus
gtattgtccctgattagctgattcc

SEQ ID NO: 678721 - DNA, 25 bp, Mus musculus
gtattgtccctgtttagctgattcc

SEQ ID NO: 678722 - DNA, 25 bp, Mus musculus
gtattgtcccttccacatttagtgt

SEQ ID NO: 678723 - DNA, 25 bp, Mus musculus
gtattgtcccttgcacatttagtgt

SEQ ID NO: 678724 - DNA, 25 bp, Mus musculus
gtattgtcctatcctgaagtcttcc

SEQ ID NO: 678725 - DNA, 25 bp, Mus musculus
gtattgtcctatgctgaagtcttcc

SEQ ID NO: 678726 - DNA, 25 bp, Mus musculus
gtattgtcgcaacaatcatgcatgg

SEQ ID NO: 678727 - DNA, 25 bp, Mus musculus
gtattgtcgcaagaatcatgcatgg

SEQ ID NO: 678728 - DNA, 25 bp, Mus musculus
gtattgtcggaactctacactgggt

SEQ ID NO: 678729 - DNA, 25 bp, Mus musculus
gtattgtcggaagtctacactgggt

SEQ ID NO: 678730 - DNA, 25 bp, Mus musculus
gtattgtctcagctttagtcaccag

SEQ ID NO: 678731 - DNA, 25 bp, Mus musculus
gtattgtctcaggtttagtcaccag

SEQ ID NO: 678732 - DNA, 25 bp, Mus musculus
gtattgtgaatcacctcattcccac

SEQ ID NO: 678733 - DNA, 25 bp, Mus musculus
gtattgtgaatctcctcattcccac

SEQ ID NO: 678734 - DNA, 25 bp, Mus musculus
gtattgtgcactcatttgaccattg

SEQ ID NO: 678735 - DNA, 25 bp, Mus musculus
gtattgtgcactgatttgaccattg

SEQ ID NO: 678736 - DNA, 25 bp, Mus musculus
gtattgtgccttctattaaaatttt

SEQ ID NO: 678737 - DNA, 25 bp, Mus musculus
gtattgtgccttgtattaaaatttt

SEQ ID NO: 678738 - DNA, 25 bp, Mus musculus
gtattgtggactctggagccaagct

SEQ ID NO: 678739 - DNA, 25 bp, Mus musculus
gtattgtggactgtggagccaagct

SEQ ID NO: 678740 - DNA, 25 bp, Mus musculus
gtattgtggcatctcagtggaccat

SEQ ID NO: 678741 - DNA, 25 bp, Mus musculus
gtattgtggcatgtcagtggaccat

SEQ ID NO: 678742 - DNA, 25 bp, Mus musculus
gtattgtggctgattgcccagagca

SEQ ID NO: 678743 - DNA, 25 bp, Mus musculus
gtattgtggctgtttgcccagagca

SEQ ID NO: 678744 - DNA, 25 bp, Mus musculus
gtattgtggtctagtcaagccgctg

SEQ ID NO: 678745 - DNA, 25 bp, Mus musculus
gtattgtggtcttgtcaagccgctg

SEQ ID NO: 678746 - DNA, 25 bp, Mus musculus
gtattgtgtcaacttggttttccta

SEQ ID NO: 678747 - DNA, 25 bp, Mus musculus
gtattgtgtcaagttggttttccta

SEQ ID NO: 678748 - DNA, 25 bp, Mus musculus
gtattgtgtgacatcaattgctatg

SEQ ID NO: 678749 - DNA, 25 bp, Mus musculus
gtattgtgtgacttcaattgctatg

SEQ ID NO: 678750 - DNA, 25 bp, Mus musculus
gtattgtgtgctcctgtgactagag

SEQ ID NO: 678751 - DNA, 25 bp, Mus musculus
gtattgtgtgctgctgtgactagag

SEQ ID NO: 678752 - DNA, 25 bp, Mus musculus
gtattgttccacagacacctatggt

SEQ ID NO: 678753 - DNA, 25 bp, Mus musculus
gtattgttccactgacacctatggt

SEQ ID NO: 678754 - DNA, 25 bp, Mus musculus
gtattgttcccacttggcaaatttg

SEQ ID NO: 678755 - DNA, 25 bp, Mus musculus
gtattgttcccagttggcaaatttg

SEQ ID NO: 678756 - DNA, 25 bp, Mus musculus
gtattgttccctattaggtgatgat

SEQ ID NO: 678757 - DNA, 25 bp, Mus musculus
gtattgttcccttttaggtgatgat

SEQ ID NO: 678758 - DNA, 25 bp, Mus musculus
gtattgttctgaaacatgccagtgt

SEQ ID NO: 678759 - DNA, 25 bp, Mus musculus
gtattgttctgatacatgccagtgt

SEQ ID NO: 678760 - DNA, 25 bp, Mus musculus
gtattgttctttcatatttctatgt

SEQ ID NO: 678761 - DNA, 25 bp, Mus musculus
gtattgttctttgatatttctatgt

SEQ ID NO: 678762 - DNA, 25 bp, Mus musculus
gtattgttggacactttgcattgta

SEQ ID NO: 678763 - DNA, 25 bp, Mus musculus
gtattgttggactctttgcattgta

SEQ ID NO: 678764 - DNA, 25 bp, Mus musculus
gtattgttgtaaaaggacacccaag

SEQ ID NO: 678765 - DNA, 25 bp, Mus musculus
gtattgttgtaataggacacccaag

SEQ ID NO: 678766 - DNA, 25 bp, Mus musculus
gtattgttgttcatactaaccaaag

SEQ ID NO: 678767 - DNA, 25 bp, Mus musculus
gtattgttgttcttactaaccaaag

SEQ ID NO: 678768 - DNA, 25 bp, Mus musculus
gtattgtttataactgtaccccaaa

SEQ ID NO: 678769 - DNA, 25 bp, Mus musculus
gtattgtttatatctgtaccccaaa

SEQ ID NO: 678770 - DNA, 25 bp, Mus musculus
gtatttaaaaccagggcggtcagca

SEQ ID NO: 678771 - DNA, 25 bp, Mus musculus
gtatttaaaacctgggcggtcagca

SEQ ID NO: 678772 - DNA, 25 bp, Mus musculus
gtatttaaaacgacacgtaccatgt

SEQ ID NO: 678773 - DNA, 25 bp, Mus musculus
gtatttaaaacgtcacgtaccatgt

SEQ ID NO: 678774 - DNA, 25 bp, Mus musculus
gtatttaaaccacgtccgggctgca

SEQ ID NO: 678775 - DNA, 25 bp, Mus musculus
gtatttaaaccaggtccgggctgca

SEQ ID NO: 678776 - DNA, 25 bp, Mus musculus
gtatttaaacgcacacactaagtac

SEQ ID NO: 678777 - DNA, 25 bp, Mus musculus
gtatttaaacgctcacactaagtac

SEQ ID NO: 678778 - DNA, 25 bp, Mus musculus
gtatttaaactacacctatctggtt

SEQ ID NO: 678779 - DNA, 25 bp, Mus musculus
gtatttaaactagacctatctggtt

SEQ ID NO: 678780 - DNA, 25 bp, Mus musculus
gtatttaaatacacgagtacaggat

SEQ ID NO: 678781 - DNA, 25 bp, Mus musculus
gtatttaaatactcgagtacaggat

SEQ ID NO: 678782 - DNA, 25 bp, Mus musculus
gtatttaaatatacctcctgccatt

SEQ ID NO: 678783 - DNA, 25 bp, Mus musculus
gtatttaaatattcctcctgccatt

SEQ ID NO: 678784 - DNA, 25 bp, Mus musculus
gtatttaaatccaccatagtaacta

SEQ ID NO: 678785 - DNA, 25 bp, Mus musculus
gtatttaaatcctccatagtaacta

SEQ ID NO: 678786 - DNA, 25 bp, Mus musculus
gtatttaacccgagctttacagaat

SEQ ID NO: 678787 - DNA, 25 bp, Mus musculus
gtatttaacccgtgctttacagaat

SEQ ID NO: 678788 - DNA, 25 bp, Mus musculus
gtatttaagaatactctttggtcgt

SEQ ID NO: 678789 - DNA, 25 bp, Mus musculus
gtatttaagaattctctttggtcgt

SEQ ID NO: 678790 - DNA, 25 bp, Mus musculus
gtatttaagacgaactcctgctgtg

SEQ ID NO: 678791 - DNA, 25 bp, Mus musculus
gtatttaagacgtactcctgctgtg

SEQ ID NO: 678792 - DNA, 25 bp, Mus musculus
gtatttaagatgcaaagtctacatg

SEQ ID NO: 678793 - DNA, 25 bp, Mus musculus
gtatttaagatggaaagtctacatg

SEQ ID NO: 678794 - DNA, 25 bp, Mus musculus
gtatttaagcttacacttggcacag

SEQ ID NO: 678795 - DNA, 25 bp, Mus musculus
gtatttaagctttcacttggcacag

SEQ ID NO: 678796 - DNA, 25 bp, Mus musculus
gtatttaagtccagagagcagccct

SEQ ID NO: 678797 - DNA, 25 bp, Mus musculus
gtatttaagtcctgagagcagccct

SEQ ID NO: 678798 - DNA, 25 bp, Mus musculus
gtatttaatatcacgggctctgcta

SEQ ID NO: 678799 - DNA, 25 bp, Mus musculus
gtatttaatatctcgggctctgcta

SEQ ID NO: 678800 - DNA, 25 bp, Mus musculus
gtatttaattccaacactctgaact

SEQ ID NO: 678801 - DNA, 25 bp, Mus musculus
gtatttaattcctacactctgaact

SEQ ID NO: 678802 - DNA, 25 bp, Mus musculus
gtatttacaatccttctgcatcctc

SEQ ID NO: 678803 - DNA, 25 bp, Mus musculus
gtatttacaatcgttctgcatcctc

SEQ ID NO: 678804 - DNA, 25 bp, Mus musculus
gtatttacaatgattcgttttgttg

SEQ ID NO: 678805 - DNA, 25 bp, Mus musculus
gtatttacaatgtttcgttttgttg

SEQ ID NO: 678806 - DNA, 25 bp, Mus musculus
gtatttacaccacatgcctacaatg

SEQ ID NO: 678807 - DNA, 25 bp, Mus musculus
gtatttacaccagatgcctacaatg

SEQ ID NO: 678808 - DNA, 25 bp, Mus musculus
gtatttacagcaagccattccgtgt

SEQ ID NO: 678809 - DNA, 25 bp, Mus musculus
gtatttacagcatgccattccgtgt

SEQ ID NO: 678810 - DNA, 25 bp, Mus musculus
gtatttacagccattgttacaagtt

SEQ ID NO: 678811 - DNA, 25 bp, Mus musculus
gtatttacagcctttgttacaagtt

SEQ ID NO: 678812 - DNA, 25 bp, Mus musculus
gtatttacagctatatgatcttcat

SEQ ID NO: 678813 - DNA, 25 bp, Mus musculus
gtatttacagctttatgatcttcat

SEQ ID NO: 678814 - DNA, 25 bp, Mus musculus
gtatttacagtaactttgtccattc

SEQ ID NO: 678815 - DNA, 25 bp, Mus musculus
gtatttacagtatctttgtccattc

SEQ ID NO: 678816 - DNA, 25 bp, Mus musculus
gtatttacagttaccagagtttgac

SEQ ID NO: 678817 - DNA, 25 bp, Mus musculus
gtatttacagtttccagagtttgac

SEQ ID NO: 678818 - DNA, 25 bp, Mus musculus
gtatttacataactgctgtctcatt

SEQ ID NO: 678819 - DNA, 25 bp, Mus musculus
gtatttacataagtgctgtctcatt

SEQ ID NO: 678820 - DNA, 25 bp, Mus musculus
gtatttacatacattctatccctcc

SEQ ID NO: 678821 - DNA, 25 bp, Mus musculus
gtatttacatactttctatccctcc

SEQ ID NO: 678822 - DNA, 25 bp, Mus musculus
gtatttacattgacctttatcctgt

SEQ ID NO: 678823 - DNA, 25 bp, Mus musculus
gtatttacattgtcctttatcctgt

SEQ ID NO: 678824 - DNA, 25 bp, Mus musculus
gtatttaccattatgccaagacctt

SEQ ID NO: 678825 - DNA, 25 bp, Mus musculus
gtatttaccattttgccaagacctt

SEQ ID NO: 678826 - DNA, 25 bp, Mus musculus
gtatttacctccagcttggtttatt

SEQ ID NO: 678827 - DNA, 25 bp, Mus musculus
gtatttacctcctgcttggtttatt

SEQ ID NO: 678828 - DNA, 25 bp, Mus musculus
gtatttacgaaactgcacctggaat

SEQ ID NO: 678829 - DNA, 25 bp, Mus musculus
gtatttacgaaagtgcacctggaat

SEQ ID NO: 678830 - DNA, 25 bp, Mus musculus
gtatttacgcagctctttacttctt

SEQ ID NO: 678831 - DNA, 25 bp, Mus musculus
gtatttacgcaggtctttacttctt

SEQ ID NO: 678832 - DNA, 25 bp, Mus musculus
gtatttacggttcaaactgccagtt

SEQ ID NO: 678833 - DNA, 25 bp, Mus musculus
gtatttacggttgaaactgccagtt

SEQ ID NO: 678834 - DNA, 25 bp, Mus musculus
gtatttactctaattgtttagcata

SEQ ID NO: 678835 - DNA, 25 bp, Mus musculus
gtatttactctaccctatcacttta

SEQ ID NO: 678836 - DNA, 25 bp, Mus musculus
gtatttactctagcctatcacttta

SEQ ID NO: 678837 - DNA, 25 bp, Mus musculus
gtatttactctatttgtttagcata

SEQ ID NO: 678838 - DNA, 25 bp, Mus musculus
gtatttactctcaaactgctttgtc

SEQ ID NO: 678839 - DNA, 25 bp, Mus musculus
gtatttactctctaactgctttgtc

SEQ ID NO: 678840 - DNA, 25 bp, Mus musculus
gtatttagaagcatattactctcat

SEQ ID NO: 678841 - DNA, 25 bp, Mus musculus
gtatttagaagcttattactctcat

SEQ ID NO: 678842 - DNA, 25 bp, Mus musculus
gtatttagacacctcacaccagcgg

SEQ ID NO: 678843 - DNA, 25 bp, Mus musculus
gtatttagacacgtcacaccagcgg

SEQ ID NO: 678844 - DNA, 25 bp, Mus musculus
gtatttagagaccacgtggaaattt

SEQ ID NO: 678845 - DNA, 25 bp, Mus musculus
gtatttagagacgacgtggaaattt

SEQ ID NO: 678846 - DNA, 25 bp, Mus musculus
gtatttagcaggagctgttggctca

SEQ ID NO: 678847 - DNA, 25 bp, Mus musculus
gtatttagcaggtgctgttggctca

SEQ ID NO: 678848 - DNA, 25 bp, Mus musculus
gtatttagcctactccagatttcag

SEQ ID NO: 678849 - DNA, 25 bp, Mus musculus
gtatttagcctagtccagatttcag

SEQ ID NO: 678850 - DNA, 25 bp, Mus musculus
gtatttagcttaacaatctcttcac

SEQ ID NO: 678851 - DNA, 25 bp, Mus musculus
gtatttagcttatcaatctcttcac

SEQ ID NO: 678852 - DNA, 25 bp, Mus musculus
gtatttagcttccagagcgcctgtc

SEQ ID NO: 678853 - DNA, 25 bp, Mus musculus
gtatttagcttcgagagcgcctgtc

SEQ ID NO: 678854 - DNA, 25 bp, Mus musculus
gtatttagctttcatcttccttaga

SEQ ID NO: 678855 - DNA, 25 bp, Mus musculus
gtatttagctttgatcttccttaga

SEQ ID NO: 678856 - DNA, 25 bp, Mus musculus
gtatttagtaatatcttctcaggta

SEQ ID NO: 678857 - DNA, 25 bp, Mus musculus
gtatttagtaatttcttctcaggta

SEQ ID NO: 678858 - DNA, 25 bp, Mus musculus
gtatttagtggaaaaggcctccctg

SEQ ID NO: 678859 - DNA, 25 bp, Mus musculus
gtatttagtggataaggcctccctg

SEQ ID NO: 678860 - DNA, 25 bp, Mus musculus
gtatttagtggcatccttggttata

SEQ ID NO: 678861 - DNA, 25 bp, Mus musculus
gtatttagtggcttccttggttata

SEQ ID NO: 678862 - DNA, 25 bp, Mus musculus
gtatttagtgtcaagagtggccaga

SEQ ID NO: 678863 - DNA, 25 bp, Mus musculus
gtatttagtgtctagagtggccaga

SEQ ID NO: 678864 - DNA, 25 bp, Mus musculus
gtatttataaaacatcttttcccat

SEQ ID NO: 678865 - DNA, 25 bp, Mus musculus
gtatttataaaagatcttttcccat

SEQ ID NO: 678866 - DNA, 25 bp, Mus musculus
gtatttataactaaaaaccagctag

SEQ ID NO: 678867 - DNA, 25 bp, Mus musculus
gtatttataacttaaaaccagctag

SEQ ID NO: 678868 - DNA, 25 bp, Mus musculus
gtatttatacaactgcaggcgctca

SEQ ID NO: 678869 - DNA, 25 bp, Mus musculus
gtatttatacaagtgcaggcgctca

SEQ ID NO: 678870 - DNA, 25 bp, Mus musculus
gtatttatactaacccagagggatt

SEQ ID NO: 678871 - DNA, 25 bp, Mus musculus
gtatttatactatcccagagggatt

SEQ ID NO: 678872 - DNA, 25 bp, Mus musculus
gtatttatagtgcaccagaagccag

SEQ ID NO: 678873 - DNA, 25 bp, Mus musculus
gtatttatagtggaccagaagccag

SEQ ID NO: 678874 - DNA, 25 bp, Mus musculus
gtatttatcatccatacaaacagat

SEQ ID NO: 678875 - DNA, 25 bp, Mus musculus
gtatttatcatcgatacaaacagat

SEQ ID NO: 678876 - DNA, 25 bp, Mus musculus
gtatttatccaaccaaaccagactg

SEQ ID NO: 678877 - DNA, 25 bp, Mus musculus
gtatttatccaagcaaaccagactg

SEQ ID NO: 678878 - DNA, 25 bp, Mus musculus
gtatttatccagaatctcctgtggg

SEQ ID NO: 678879 - DNA, 25 bp, Mus musculus
gtatttatccagtatctcctgtggg

SEQ ID NO: 678880 - DNA, 25 bp, Mus musculus
gtatttatcttgaatttccccactg

SEQ ID NO: 678881 - DNA, 25 bp, Mus musculus
gtatttatcttgtatttccccactg

SEQ ID NO: 678882 - DNA, 25 bp, Mus musculus
gtatttatgcacaaaagggctcaga

SEQ ID NO: 678883 - DNA, 25 bp, Mus musculus
gtatttatgcactaaagggctcaga

SEQ ID NO: 678884 - DNA, 25 bp, Mus musculus
gtatttatgccacaaaagggcctca

SEQ ID NO: 678885 - DNA, 25 bp, Mus musculus
gtatttatgccagaaaagggcctca

SEQ ID NO: 678886 - DNA, 25 bp, Mus musculus
gtatttatgcttctgtcttacaatt

SEQ ID NO: 678887 - DNA, 25 bp, Mus musculus
gtatttatgcttgtgtcttacaatt

SEQ ID NO: 678888 - DNA, 25 bp, Mus musculus
gtatttatggctatttgctgtactg

SEQ ID NO: 678889 - DNA, 25 bp, Mus musculus
gtatttatggctttttgctgtactg

SEQ ID NO: 678890 - DNA, 25 bp, Mus musculus
gtatttatgggtctggtccccgatt

SEQ ID NO: 678891 - DNA, 25 bp, Mus musculus
gtatttatgggtgtggtccccgatt

SEQ ID NO: 678892 - DNA, 25 bp, Mus musculus
gtatttatgtacctcttgcacactc

SEQ ID NO: 678893 - DNA, 25 bp, Mus musculus
gtatttatgtacgtcttgcacactc

SEQ ID NO: 678894 - DNA, 25 bp, Mus musculus
gtatttatgtcactaaaatcctaac

SEQ ID NO: 678895 - DNA, 25 bp, Mus musculus
gtatttatgtcagtaaaatcctaac

SEQ ID NO: 678896 - DNA, 25 bp, Mus musculus
gtatttatgtccctgctgattcacc

SEQ ID NO: 678897 - DNA, 25 bp, Mus musculus
gtatttatgtccgtgctgattcacc

SEQ ID NO: 678898 - DNA, 25 bp, Mus musculus
gtatttattagtcacccaccattaa

SEQ ID NO: 678899 - DNA, 25 bp, Mus musculus
gtatttattagtgacccaccattaa

SEQ ID NO: 678900 - DNA, 25 bp, Mus musculus
gtatttattatcatagtgctcggaa

SEQ ID NO: 678901 - DNA, 25 bp, Mus musculus
gtatttattatcttagtgctcggaa

SEQ ID NO: 678902 - DNA, 25 bp, Mus musculus
gtatttattcccctttaggttgcag

SEQ ID NO: 678903 - DNA, 25 bp, Mus musculus
gtatttattcccgtttaggttgcag

SEQ ID NO: 678904 - DNA, 25 bp, Mus musculus
gtatttattctgatggttttggccc

SEQ ID NO: 678905 - DNA, 25 bp, Mus musculus
gtatttattctgttggttttggccc

SEQ ID NO: 678906 - DNA, 25 bp, Mus musculus
gtatttatttaactctgagccttcc

SEQ ID NO: 678907 - DNA, 25 bp, Mus musculus
gtatttatttaagtctgagccttcc

SEQ ID NO: 678908 - DNA, 25 bp, Mus musculus
gtatttatttgcatgctttcctctc

SEQ ID NO: 678909 - DNA, 25 bp, Mus musculus
gtatttatttgcttgctttcctctc

SEQ ID NO: 678910 - DNA, 25 bp, Mus musculus
gtatttcaaaagatcagactctgtt

SEQ ID NO: 678911 - DNA, 25 bp, Mus musculus
gtatttcaaaagttcagactctgtt

SEQ ID NO: 678912 - DNA, 25 bp, Mus musculus
gtatttcaaaggaggctggtccatt

SEQ ID NO: 678913 - DNA, 25 bp, Mus musculus
gtatttcaaaggtggctggtccatt

SEQ ID NO: 678914 - DNA, 25 bp, Mus musculus
gtatttcaacgtatgctttcgataa

SEQ ID NO: 678915 - DNA, 25 bp, Mus musculus
gtatttcaacgtttgctttcgataa

SEQ ID NO: 678916 - DNA, 25 bp, Mus musculus
gtatttcaatacacagacaaacctg

SEQ ID NO: 678917 - DNA, 25 bp, Mus musculus
gtatttcaatactcagacaaacctg

SEQ ID NO: 678918 - DNA, 25 bp, Mus musculus
gtatttcaatagcaactgtggacct

SEQ ID NO: 678919 - DNA, 25 bp, Mus musculus
gtatttcaataggaactgtggacct

SEQ ID NO: 678920 - DNA, 25 bp, Mus musculus
gtatttcaatgcagagcccctgagt

SEQ ID NO: 678921 - DNA, 25 bp, Mus musculus
gtatttcaatgctgagcccctgagt

SEQ ID NO: 678922 - DNA, 25 bp, Mus musculus
gtatttcaatgtacttttacacgag

SEQ ID NO: 678923 - DNA, 25 bp, Mus musculus
gtatttcaatgttcttttacacgag

SEQ ID NO: 678924 - DNA, 25 bp, Mus musculus
gtatttcagaatcaacccaggcttt

SEQ ID NO: 678925 - DNA, 25 bp, Mus musculus
gtatttcagaatgaacccaggcttt

SEQ ID NO: 678926 - DNA, 25 bp, Mus musculus
gtatttcagccacgagtgatgccac

SEQ ID NO: 678927 - DNA, 25 bp, Mus musculus
gtatttcagccaggagtgatgccac

SEQ ID NO: 678928 - DNA, 25 bp, Mus musculus
gtatttcaggctacggttgaccagg

SEQ ID NO: 678929 - DNA, 25 bp, Mus musculus
gtatttcaggcttcggttgaccagg

SEQ ID NO: 678930 - DNA, 25 bp, Mus musculus
gtatttcagtgtagtttctgagacc

SEQ ID NO: 678931 - DNA, 25 bp, Mus musculus
gtatttcagtgttgtttctgagacc

SEQ ID NO: 678932 - DNA, 25 bp, Mus musculus
gtatttcatactcaagtacaggctt

SEQ ID NO: 678933 - DNA, 25 bp, Mus musculus
gtatttcatactcggatcatctgtg

SEQ ID NO: 678934 - DNA, 25 bp, Mus musculus
gtatttcatactgaagtacaggctt

SEQ ID NO: 678935 - DNA, 25 bp, Mus musculus
gtatttcatactgggatcatctgtg

SEQ ID NO: 678936 - DNA, 25 bp, Mus musculus
gtatttcatgagcttgctgatactt

SEQ ID NO: 678937 - DNA, 25 bp, Mus musculus
gtatttcatgaggttgctgatactt

SEQ ID NO: 678938 - DNA, 25 bp, Mus musculus
gtatttcattctcactgcgatctac

SEQ ID NO: 678939 - DNA, 25 bp, Mus musculus
gtatttcattctgactgcgatctac

SEQ ID NO: 678940 - DNA, 25 bp, Mus musculus
gtatttcatttgatcttatcacttg

SEQ ID NO: 678941 - DNA, 25 bp, Mus musculus
gtatttcatttgttcttatcacttg

SEQ ID NO: 678942 - DNA, 25 bp, Mus musculus
gtatttccaaggaagaatgattccc

SEQ ID NO: 678943 - DNA, 25 bp, Mus musculus
gtatttccaaggtagaatgattccc

SEQ ID NO: 678944 - DNA, 25 bp, Mus musculus
gtatttccaattacttgttcatgta

SEQ ID NO: 678945 - DNA, 25 bp, Mus musculus
gtatttccaatttcttgttcatgta

SEQ ID NO: 678946 - DNA, 25 bp, Mus musculus
gtatttccactcacctgtctatttt

SEQ ID NO: 678947 - DNA, 25 bp, Mus musculus
gtatttccactctcctgtctatttt

SEQ ID NO: 678948 - DNA, 25 bp, Mus musculus
gtatttccagatctctcttgaggca

SEQ ID NO: 678949 - DNA, 25 bp, Mus musculus
gtatttccagatgtctcttgaggca

SEQ ID NO: 678950 - DNA, 25 bp, Mus musculus
gtatttccagctcagttttccccat

SEQ ID NO: 678951 - DNA, 25 bp, Mus musculus
gtatttccagctgagttttccccat

SEQ ID NO: 678952 - DNA, 25 bp, Mus musculus
gtatttccatccctacttcatcact

SEQ ID NO: 678953 - DNA, 25 bp, Mus musculus
gtatttccatccgtacttcatcact

SEQ ID NO: 678954 - DNA, 25 bp, Mus musculus
gtatttccattgataggtctcaggt

SEQ ID NO: 678955 - DNA, 25 bp, Mus musculus
gtatttccattgttaggtctcaggt

SEQ ID NO: 678956 - DNA, 25 bp, Mus musculus
gtatttcccgcgcaacctcggagag

SEQ ID NO: 678957 - DNA, 25 bp, Mus musculus
gtatttcccgcggaacctcggagag

SEQ ID NO: 678958 - DNA, 25 bp, Mus musculus
gtatttccgactagtcctttgattg

SEQ ID NO: 678959 - DNA, 25 bp, Mus musculus
gtatttccgacttgtcctttgattg

SEQ ID NO: 678960 - DNA, 25 bp, Mus musculus
gtatttcctaatacacagctcatgt

SEQ ID NO: 678961 - DNA, 25 bp, Mus musculus
gtatttcctaattcacagctcatgt

SEQ ID NO: 678962 - DNA, 25 bp, Mus musculus
gtatttcctatcaggttcttttaag

SEQ ID NO: 678963 - DNA, 25 bp, Mus musculus
gtatttcctatctggttcttttaag

SEQ ID NO: 678964 - DNA, 25 bp, Mus musculus
gtatttcctcagagagcatcttgtt

SEQ ID NO: 678965 - DNA, 25 bp, Mus musculus
gtatttcctcagtgagcatcttgtt

SEQ ID NO: 678966 - DNA, 25 bp, Mus musculus
gtatttcctcggagtttatgaacag

SEQ ID NO: 678967 - DNA, 25 bp, Mus musculus
gtatttcctcggtgtttatgaacag

SEQ ID NO: 678968 - DNA, 25 bp, Mus musculus
gtatttcctgaactaaatcaacctg

SEQ ID NO: 678969 - DNA, 25 bp, Mus musculus
gtatttcctgaagtaaatcaacctg

SEQ ID NO: 678970 - DNA, 25 bp, Mus musculus
gtatttcctgatagtggatcccagt

SEQ ID NO: 678971 - DNA, 25 bp, Mus musculus
gtatttcctgattgtggatcccagt

SEQ ID NO: 678972 - DNA, 25 bp, Mus musculus
gtatttcctggtatagccctgagtg

SEQ ID NO: 678973 - DNA, 25 bp, Mus musculus
gtatttcctggtttagccctgagtg

SEQ ID NO: 678974 - DNA, 25 bp, Mus musculus
gtatttcctgtgagcaataccagat

SEQ ID NO: 678975 - DNA, 25 bp, Mus musculus
gtatttcctgtgtgcaataccagat

SEQ ID NO: 678976 - DNA, 25 bp, Mus musculus
gtatttccttccaacaataagcatt

SEQ ID NO: 678977 - DNA, 25 bp, Mus musculus
gtatttccttcctacaataagcatt

SEQ ID NO: 678978 - DNA, 25 bp, Mus musculus
gtatttccttgtcaatcttatttgg

SEQ ID NO: 678979 - DNA, 25 bp, Mus musculus
gtatttccttgtgaatcttatttgg

SEQ ID NO: 678980 - DNA, 25 bp, Mus musculus
gtatttcctttccagtaccttcact

SEQ ID NO: 678981 - DNA, 25 bp, Mus musculus
gtatttcctttcgagtaccttcact

SEQ ID NO: 678982 - DNA, 25 bp, Mus musculus
gtatttcgaatccattttcgtgcaa

SEQ ID NO: 678983 - DNA, 25 bp, Mus musculus
gtatttcgaatcgattttcgtgcaa

SEQ ID NO: 678984 - DNA, 25 bp, Mus musculus
gtatttcgacaacctaaactgaaaa

SEQ ID NO: 678985 - DNA, 25 bp, Mus musculus
gtatttcgacaagctaaactgaaaa

SEQ ID NO: 678986 - DNA, 25 bp, Mus musculus
gtatttcgatttctggagtcctgac

SEQ ID NO: 678987 - DNA, 25 bp, Mus musculus
gtatttcgatttgtggagtcctgac

SEQ ID NO: 678988 - DNA, 25 bp, Mus musculus
gtatttcgccatcaatgtcttgacc

SEQ ID NO: 678989 - DNA, 25 bp, Mus musculus
gtatttcgccatgaatgtcttgacc

SEQ ID NO: 678990 - DNA, 25 bp, Mus musculus
gtatttcggtgacaatgatctctag

SEQ ID NO: 678991 - DNA, 25 bp, Mus musculus
gtatttcggtgagaatgatctctag

SEQ ID NO: 678992 - DNA, 25 bp, Mus musculus
gtatttctaaatctccaatgtcctt

SEQ ID NO: 678993 - DNA, 25 bp, Mus musculus
gtatttctaaatgtccaatgtcctt

SEQ ID NO: 678994 - DNA, 25 bp, Mus musculus
gtatttctaaggcatgtagctcatt

SEQ ID NO: 678995 - DNA, 25 bp, Mus musculus
gtatttctaagggatgtagctcatt

SEQ ID NO: 678996 - DNA, 25 bp, Mus musculus
gtatttctacagactcacagctttt

SEQ ID NO: 678997 - DNA, 25 bp, Mus musculus
gtatttctacagtctcacagctttt

SEQ ID NO: 678998 - DNA, 25 bp, Mus musculus
gtatttctacataggccaggcaagt

SEQ ID NO: 678999 - DNA, 25 bp, Mus musculus
gtatttctacattggccaggcaagt

SEQ ID NO: 679000 - DNA, 25 bp, Mus musculus
gtatttctagaccacagagttggtt

SEQ ID NO: 679001 - DNA, 25 bp, Mus musculus
gtatttctagacgacagagttggtt

SEQ ID NO: 679002 - DNA, 25 bp, Mus musculus
gtatttctagtcctacttgtgtgac

SEQ ID NO: 679003 - DNA, 25 bp, Mus musculus
gtatttctagtcgtacttgtgtgac

SEQ ID NO: 679004 - DNA, 25 bp, Mus musculus
gtatttctcaaactcagtgcatgat

SEQ ID NO: 679005 - DNA, 25 bp, Mus musculus
gtatttctcaaagtcagtgcatgat

SEQ ID NO: 679006 - DNA, 25 bp, Mus musculus
gtatttctcattacagatgcccatt

SEQ ID NO: 679007 - DNA, 25 bp, Mus musculus
gtatttctcattactgtcttgcatg

SEQ ID NO: 679008 - DNA, 25 bp, Mus musculus
gtatttctcatttcagatgcccatt

SEQ ID NO: 679009 - DNA, 25 bp, Mus musculus
gtatttctcatttctgtcttgcatg

SEQ ID NO: 679010 - DNA, 25 bp, Mus musculus
gtatttctccagagataggtactcc

SEQ ID NO: 679011 - DNA, 25 bp, Mus musculus
gtatttctccagtgataggtactcc

SEQ ID NO: 679012 - DNA, 25 bp, Mus musculus
gtatttctccctattgtatcaactt

SEQ ID NO: 679013 - DNA, 25 bp, Mus musculus
gtatttctcccttttgtatcaactt

SEQ ID NO: 679014 - DNA, 25 bp, Mus musculus
gtatttctcctgacaactcataatc

SEQ ID NO: 679015 - DNA, 25 bp, Mus musculus
gtatttctcctgcacgatgctggga

SEQ ID NO: 679016 - DNA, 25 bp, Mus musculus
gtatttctcctggacgatgctggga

SEQ ID NO: 679017 - DNA, 25 bp, Mus musculus
gtatttctcctgtcaactcataatc

SEQ ID NO: 679018 - DNA, 25 bp, Mus musculus
gtatttctcgacattatgtcccact

SEQ ID NO: 679019 - DNA, 25 bp, Mus musculus
gtatttctcgactttatgtcccact

SEQ ID NO: 679020 - DNA, 25 bp, Mus musculus
gtatttctctttccttcaagttaca

SEQ ID NO: 679021 - DNA, 25 bp, Mus musculus
gtatttctctttgcttcaagttaca

SEQ ID NO: 679022 - DNA, 25 bp, Mus musculus
gtatttctgaaaccgagtctttatt

SEQ ID NO: 679023 - DNA, 25 bp, Mus musculus
gtatttctgaaagcgagtctttatt

SEQ ID NO: 679024 - DNA, 25 bp, Mus musculus
gtatttctgaagcatccgaagagtt

SEQ ID NO: 679025 - DNA, 25 bp, Mus musculus
gtatttctgaaggatccgaagagtt

SEQ ID NO: 679026 - DNA, 25 bp, Mus musculus
gtatttctgaggaaacccctgtcca

SEQ ID NO: 679027 - DNA, 25 bp, Mus musculus
gtatttctgaggtaacccctgtcca

SEQ ID NO: 679028 - DNA, 25 bp, Mus musculus
gtatttctgatcagcatatcttcaa

SEQ ID NO: 679029 - DNA, 25 bp, Mus musculus
gtatttctgatctgcatatcttcaa

SEQ ID NO: 679030 - DNA, 25 bp, Mus musculus
gtatttctgctaataagcattcgct

SEQ ID NO: 679031 - DNA, 25 bp, Mus musculus
gtatttctgctattaagcattcgct

SEQ ID NO: 679032 - DNA, 25 bp, Mus musculus
gtatttctgctgacttaggctgcca

SEQ ID NO: 679033 - DNA, 25 bp, Mus musculus
gtatttctgctgtcttaggctgcca

SEQ ID NO: 679034 - DNA, 25 bp, Mus musculus
gtatttctgcttcttgtgatctgta

SEQ ID NO: 679035 - DNA, 25 bp, Mus musculus
gtatttctgcttgttgtgatctgta

SEQ ID NO: 679036 - DNA, 25 bp, Mus musculus
gtatttctggagatcttttacataa

SEQ ID NO: 679037 - DNA, 25 bp, Mus musculus
gtatttctggagttcttttacataa

SEQ ID NO: 679038 - DNA, 25 bp, Mus musculus
gtatttctggtcagtgaaaacaatt

SEQ ID NO: 679039 - DNA, 25 bp, Mus musculus
gtatttctggtctgtgaaaacaatt

SEQ ID NO: 679040 - DNA, 25 bp, Mus musculus
gtatttctggttaacatctctgctt

SEQ ID NO: 679041 - DNA, 25 bp, Mus musculus
gtatttctggtttacatctctgctt

SEQ ID NO: 679042 - DNA, 25 bp, Mus musculus
gtatttctgtataccgagcagggtc

SEQ ID NO: 679043 - DNA, 25 bp, Mus musculus
gtatttctgtatctaactgcaagtc

SEQ ID NO: 679044 - DNA, 25 bp, Mus musculus
gtatttctgtatgtaactgcaagtc

SEQ ID NO: 679045 - DNA, 25 bp, Mus musculus
gtatttctgtattccgagcagggtc

SEQ ID NO: 679046 - DNA, 25 bp, Mus musculus
gtatttctgtgcacataatcctatt

SEQ ID NO: 679047 - DNA, 25 bp, Mus musculus
gtatttctgtgctcataatcctatt

SEQ ID NO: 679048 - DNA, 25 bp, Mus musculus
gtatttcttcataaggcctttaaca

SEQ ID NO: 679049 - DNA, 25 bp, Mus musculus
gtatttcttcattaggcctttaaca

SEQ ID NO: 679050 - DNA, 25 bp, Mus musculus
gtatttcttcctcagagagtagcca

SEQ ID NO: 679051 - DNA, 25 bp, Mus musculus
gtatttcttcctgagagagtagcca

SEQ ID NO: 679052 - DNA, 25 bp, Mus musculus
gtatttcttgtgatagttttgaaca

SEQ ID NO: 679053 - DNA, 25 bp, Mus musculus
gtatttcttgtgttagttttgaaca

SEQ ID NO: 679054 - DNA, 25 bp, Mus musculus
gtatttctttccatgagattcttta

SEQ ID NO: 679055 - DNA, 25 bp, Mus musculus
gtatttctttccttgagattcttta

SEQ ID NO: 679056 - DNA, 25 bp, Mus musculus
gtatttctttggatgttcaacacag

SEQ ID NO: 679057 - DNA, 25 bp, Mus musculus
gtatttctttggttgttcaacacag

SEQ ID NO: 679058 - DNA, 25 bp, Mus musculus
gtatttctttgtacttccttgcatt

SEQ ID NO: 679059 - DNA, 25 bp, Mus musculus
gtatttctttgttcttccttgcatt

SEQ ID NO: 679060 - DNA, 25 bp, Mus musculus
gtatttcttttcataccaagctgga

SEQ ID NO: 679061 - DNA, 25 bp, Mus musculus
gtatttcttttcttaccaagctgga

SEQ ID NO: 679062 - DNA, 25 bp, Mus musculus
gtatttgacaagactttagaacttt

SEQ ID NO: 679063 - DNA, 25 bp, Mus musculus
gtatttgacaagtctttagaacttt

SEQ ID NO: 679064 - DNA, 25 bp, Mus musculus
gtatttgaccaaatttgtgtgtcta

SEQ ID NO: 679065 - DNA, 25 bp, Mus musculus
gtatttgaccaattttgtgtgtcta

SEQ ID NO: 679066 - DNA, 25 bp, Mus musculus
gtatttgactagatttcaaccaaga

SEQ ID NO: 679067 - DNA, 25 bp, Mus musculus
gtatttgactagttttcaaccaaga

SEQ ID NO: 679068 - DNA, 25 bp, Mus musculus
gtatttgagatgactctggcccact

SEQ ID NO: 679069 - DNA, 25 bp, Mus musculus
gtatttgagatgtctctggcccact

SEQ ID NO: 679070 - DNA, 25 bp, Mus musculus
gtatttgagcctaaagattttgatc

SEQ ID NO: 679071 - DNA, 25 bp, Mus musculus
gtatttgagccttaagattttgatc

SEQ ID NO: 679072 - DNA, 25 bp, Mus musculus
gtatttgagtttaatgcacgttcta

SEQ ID NO: 679073 - DNA, 25 bp, Mus musculus
gtatttgagttttatgcacgttcta

SEQ ID NO: 679074 - DNA, 25 bp, Mus musculus
gtatttgatatgcatggcctacaac

SEQ ID NO: 679075 - DNA, 25 bp, Mus musculus
gtatttgatatggatggcctacaac

SEQ ID NO: 679076 - DNA, 25 bp, Mus musculus
gtatttgatcatccttttcacctaa

SEQ ID NO: 679077 - DNA, 25 bp, Mus musculus
gtatttgatcatgcttttcacctaa

SEQ ID NO: 679078 - DNA, 25 bp, Mus musculus
gtatttgatggaaatccgtgtgtat

SEQ ID NO: 679079 - DNA, 25 bp, Mus musculus
gtatttgatggatatccgtgtgtat

SEQ ID NO: 679080 - DNA, 25 bp, Mus musculus
gtatttgatgttatccgaggttttg

SEQ ID NO: 679081 - DNA, 25 bp, Mus musculus
gtatttgatgttttccgaggttttg

SEQ ID NO: 679082 - DNA, 25 bp, Mus musculus
gtatttgattaccaagtccaggctg

SEQ ID NO: 679083 - DNA, 25 bp, Mus musculus
gtatttgattacctcccttatactt

SEQ ID NO: 679084 - DNA, 25 bp, Mus musculus
gtatttgattacgaagtccaggctg

SEQ ID NO: 679085 - DNA, 25 bp, Mus musculus
gtatttgattacgtcccttatactt

SEQ ID NO: 679086 - DNA, 25 bp, Mus musculus
gtatttgattcccaagtgtctcata

SEQ ID NO: 679087 - DNA, 25 bp, Mus musculus
gtatttgattccgaagtgtctcata

SEQ ID NO: 679088 - DNA, 25 bp, Mus musculus
gtatttgattctaattaggctctta

SEQ ID NO: 679089 - DNA, 25 bp, Mus musculus
gtatttgattcttattaggctctta

SEQ ID NO: 679090 - DNA, 25 bp, Mus musculus
gtatttgattttatacacccatgaa

SEQ ID NO: 679091 - DNA, 25 bp, Mus musculus
gtatttgattttttacacccatgaa

SEQ ID NO: 679092 - DNA, 25 bp, Mus musculus
gtatttgcaaatccaacactgagtt

SEQ ID NO: 679093 - DNA, 25 bp, Mus musculus
gtatttgcaaatgcaacactgagtt

SEQ ID NO: 679094 - DNA, 25 bp, Mus musculus
gtatttgcaatccattaaccttcat

SEQ ID NO: 679095 - DNA, 25 bp, Mus musculus
gtatttgcaatcgattaaccttcat

SEQ ID NO: 679096 - DNA, 25 bp, Mus musculus
gtatttgcacccagttctatgtata

SEQ ID NO: 679097 - DNA, 25 bp, Mus musculus
gtatttgcaccctgttctatgtata

SEQ ID NO: 679098 - DNA, 25 bp, Mus musculus
gtatttgcagcacggactcagaaca

SEQ ID NO: 679099 - DNA, 25 bp, Mus musculus
gtatttgcagcagggactcagaaca

SEQ ID NO: 679100 - DNA, 25 bp, Mus musculus
gtatttgcatgcctgtgatacacat

SEQ ID NO: 679101 - DNA, 25 bp, Mus musculus
gtatttgcatgcgtgtgatacacat

SEQ ID NO: 679102 - DNA, 25 bp, Mus musculus
gtatttgcatggatatctgggcaca

SEQ ID NO: 679103 - DNA, 25 bp, Mus musculus
gtatttgcatggttatctgggcaca

SEQ ID NO: 679104 - DNA, 25 bp, Mus musculus
gtatttgccaagcttctacggtcca

SEQ ID NO: 679105 - DNA, 25 bp, Mus musculus
gtatttgccaaggttctacggtcca

SEQ ID NO: 679106 - DNA, 25 bp, Mus musculus
gtatttgccatcaaactggactgtg

SEQ ID NO: 679107 - DNA, 25 bp, Mus musculus
gtatttgccatcagtcattcattat

SEQ ID NO: 679108 - DNA, 25 bp, Mus musculus
gtatttgccatcctgtttgtctata

SEQ ID NO: 679109 - DNA, 25 bp, Mus musculus
gtatttgccatcgtgtttgtctata

SEQ ID NO: 679110 - DNA, 25 bp, Mus musculus
gtatttgccatctaactggactgtg

SEQ ID NO: 679111 - DNA, 25 bp, Mus musculus
gtatttgccatctgtcattcattat

SEQ ID NO: 679112 - DNA, 25 bp, Mus musculus
gtatttgccgtgattgagtgagact

SEQ ID NO: 679113 - DNA, 25 bp, Mus musculus
gtatttgccgtgtttgagtgagact

SEQ ID NO: 679114 - DNA, 25 bp, Mus musculus
gtatttgccttaaatcgtgaacaag

SEQ ID NO: 679115 - DNA, 25 bp, Mus musculus
gtatttgccttatatcgtgaacaag

SEQ ID NO: 679116 - DNA, 25 bp, Mus musculus
gtatttgcgagtaaaccaccttcca

SEQ ID NO: 679117 - DNA, 25 bp, Mus musculus
gtatttgcgagttaaccaccttcca

SEQ ID NO: 679118 - DNA, 25 bp, Mus musculus
gtatttgctacactagtgcagctta

SEQ ID NO: 679119 - DNA, 25 bp, Mus musculus
gtatttgctacagtagtgcagctta

SEQ ID NO: 679120 - DNA, 25 bp, Mus musculus
gtatttgctactaagatggcccaca

SEQ ID NO: 679121 - DNA, 25 bp, Mus musculus
gtatttgctacttagatggcccaca

SEQ ID NO: 679122 - DNA, 25 bp, Mus musculus
gtatttgctcccatctgacttcata

SEQ ID NO: 679123 - DNA, 25 bp, Mus musculus
gtatttgctcccttctgacttcata

SEQ ID NO: 679124 - DNA, 25 bp, Mus musculus
gtatttgctgacatggacctgctac

SEQ ID NO: 679125 - DNA, 25 bp, Mus musculus
gtatttgctgacttggacctgctac

SEQ ID NO: 679126 - DNA, 25 bp, Mus musculus
gtatttgctgccaaactgtgctgac

SEQ ID NO: 679127 - DNA, 25 bp, Mus musculus
gtatttgctgcctaactgtgctgac

SEQ ID NO: 679128 - DNA, 25 bp, Mus musculus
gtatttgctgctagattatttcatt

SEQ ID NO: 679129 - DNA, 25 bp, Mus musculus
gtatttgctgcttgattatttcatt

SEQ ID NO: 679130 - DNA, 25 bp, Mus musculus
gtatttgctggtacacaagctgact

SEQ ID NO: 679131 - DNA, 25 bp, Mus musculus
gtatttgctggtcaattgctgctca

SEQ ID NO: 679132 - DNA, 25 bp, Mus musculus
gtatttgctggtgaattgctgctca

SEQ ID NO: 679133 - DNA, 25 bp, Mus musculus
gtatttgctggttcacaagctgact

SEQ ID NO: 679134 - DNA, 25 bp, Mus musculus
gtatttgctgtcacgtatgtgcctg

SEQ ID NO: 679135 - DNA, 25 bp, Mus musculus
gtatttgctgtcagcctattggacc

SEQ ID NO: 679136 - DNA, 25 bp, Mus musculus
gtatttgctgtctcgtatgtgcctg

SEQ ID NO: 679137 - DNA, 25 bp, Mus musculus
gtatttgctgtctgcctattggacc

SEQ ID NO: 679138 - DNA, 25 bp, Mus musculus
gtatttgctttaactacctgctgct

SEQ ID NO: 679139 - DNA, 25 bp, Mus musculus
gtatttgctttatctacctgctgct

SEQ ID NO: 679140 - DNA, 25 bp, Mus musculus
gtatttgctttcagagtccctccta

SEQ ID NO: 679141 - DNA, 25 bp, Mus musculus
gtatttgctttctgagtccctccta

SEQ ID NO: 679142 - DNA, 25 bp, Mus musculus
gtatttggaacacactgcagcaggt

SEQ ID NO: 679143 - DNA, 25 bp, Mus musculus
gtatttggaacagactgcagcaggt

SEQ ID NO: 679144 - DNA, 25 bp, Mus musculus
gtatttggagaacattgatggccta

SEQ ID NO: 679145 - DNA, 25 bp, Mus musculus
gtatttggagaagattgatggccta

SEQ ID NO: 679146 - DNA, 25 bp, Mus musculus
gtatttggatacagacctatgacat

SEQ ID NO: 679147 - DNA, 25 bp, Mus musculus
gtatttggatactgacctatgacat

SEQ ID NO: 679148 - DNA, 25 bp, Mus musculus
gtatttggatggaaggtcccttggt

SEQ ID NO: 679149 - DNA, 25 bp, Mus musculus
gtatttggatggtaggtcccttggt

SEQ ID NO: 679150 - DNA, 25 bp, Mus musculus
gtatttggatgtctgcttcggcctt

SEQ ID NO: 679151 - DNA, 25 bp, Mus musculus
gtatttggatgtgtgcttcggcctt

SEQ ID NO: 679152 - DNA, 25 bp, Mus musculus
gtatttggcctcaccataagcgaag

SEQ ID NO: 679153 - DNA, 25 bp, Mus musculus
gtatttggcctctccataagcgaag

SEQ ID NO: 679154 - DNA, 25 bp, Mus musculus
gtatttggcctgctgatattaacat

SEQ ID NO: 679155 - DNA, 25 bp, Mus musculus
gtatttggcctggtgatattaacat

SEQ ID NO: 679156 - DNA, 25 bp, Mus musculus
gtatttggctcccagaatctgacca

SEQ ID NO: 679157 - DNA, 25 bp, Mus musculus
gtatttggctccgagaatctgacca

SEQ ID NO: 679158 - DNA, 25 bp, Mus musculus
gtatttggctgtccagttgacccaa

SEQ ID NO: 679159 - DNA, 25 bp, Mus musculus
gtatttggctgtgcagttgacccaa

SEQ ID NO: 679160 - DNA, 25 bp, Mus musculus
gtatttggtaataagttactccagg

SEQ ID NO: 679161 - DNA, 25 bp, Mus musculus
gtatttggtaatatcccattagcat

SEQ ID NO: 679162 - DNA, 25 bp, Mus musculus
gtatttggtaattagttactccagg

SEQ ID NO: 679163 - DNA, 25 bp, Mus musculus
gtatttggtaatttcccattagcat

SEQ ID NO: 679164 - DNA, 25 bp, Mus musculus
gtatttggtacaatttggacacagt

SEQ ID NO: 679165 - DNA, 25 bp, Mus musculus
gtatttggtacattttggacacagt

SEQ ID NO: 679166 - DNA, 25 bp, Mus musculus
gtatttggtcagacattggcctgtt

SEQ ID NO: 679167 - DNA, 25 bp, Mus musculus
gtatttggtcagtcattggcctgtt

SEQ ID NO: 679168 - DNA, 25 bp, Mus musculus
gtatttggtcctctttgatattaca

SEQ ID NO: 679169 - DNA, 25 bp, Mus musculus
gtatttggtcctgtttgatattaca

SEQ ID NO: 679170 - DNA, 25 bp, Mus musculus
gtatttggttttctagctgcacatc

SEQ ID NO: 679171 - DNA, 25 bp, Mus musculus
gtatttggttttgtagctgcacatc

SEQ ID NO: 679172 - DNA, 25 bp, Mus musculus
gtatttgtacagcactacctcgtgg

SEQ ID NO: 679173 - DNA, 25 bp, Mus musculus
gtatttgtacaggactacctcgtgg

SEQ ID NO: 679174 - DNA, 25 bp, Mus musculus
gtatttgtaggaccgctaccacctg

SEQ ID NO: 679175 - DNA, 25 bp, Mus musculus
gtatttgtaggagcgctaccacctg

SEQ ID NO: 679176 - DNA, 25 bp, Mus musculus
gtatttgtatacacacccacgacta

SEQ ID NO: 679177 - DNA, 25 bp, Mus musculus
gtatttgtatactcacccacgacta

SEQ ID NO: 679178 - DNA, 25 bp, Mus musculus
gtatttgtatgtcatcctccggctg

SEQ ID NO: 679179 - DNA, 25 bp, Mus musculus
gtatttgtatgtgatcctccggctg

SEQ ID NO: 679180 - DNA, 25 bp, Mus musculus
gtatttgtattcaccatattctgga

SEQ ID NO: 679181 - DNA, 25 bp, Mus musculus
gtatttgtattctccatattctgga

SEQ ID NO: 679182 - DNA, 25 bp, Mus musculus
gtatttgtcacaactctgggagaaa

SEQ ID NO: 679183 - DNA, 25 bp, Mus musculus
gtatttgtcacatctctgggagaaa

SEQ ID NO: 679184 - DNA, 25 bp, Mus musculus
gtatttgtcaggcaccgatagaacc

SEQ ID NO: 679185 - DNA, 25 bp, Mus musculus
gtatttgtcagggaccgatagaacc

SEQ ID NO: 679186 - DNA, 25 bp, Mus musculus
gtatttgtcatgataacttcctatt

SEQ ID NO: 679187 - DNA, 25 bp, Mus musculus
gtatttgtcatgttaacttcctatt

SEQ ID NO: 679188 - DNA, 25 bp, Mus musculus
gtatttgtccaaatcctgggctcct

SEQ ID NO: 679189 - DNA, 25 bp, Mus musculus
gtatttgtccaattcctgggctcct

SEQ ID NO: 679190 - DNA, 25 bp, Mus musculus
gtatttgtcctcagggttcttatag

SEQ ID NO: 679191 - DNA, 25 bp, Mus musculus
gtatttgtcctctgggttcttatag

SEQ ID NO: 679192 - DNA, 25 bp, Mus musculus
gtatttgtctgcatcatgacgttct

SEQ ID NO: 679193 - DNA, 25 bp, Mus musculus
gtatttgtctgcttcatgacgttct

SEQ ID NO: 679194 - DNA, 25 bp, Mus musculus
gtatttgtgacccatgttattctgt

SEQ ID NO: 679195 - DNA, 25 bp, Mus musculus
gtatttgtgaccgatgttattctgt

SEQ ID NO: 679196 - DNA, 25 bp, Mus musculus
gtatttgtgggcaatgtgactcatt

SEQ ID NO: 679197 - DNA, 25 bp, Mus musculus
gtatttgtgggctatgtgactcatt

SEQ ID NO: 679198 - DNA, 25 bp, Mus musculus
gtatttgtgtctcaagctggccccg

SEQ ID NO: 679199 - DNA, 25 bp, Mus musculus
gtatttgtgtctgaagctggccccg

SEQ ID NO: 679200 - DNA, 25 bp, Mus musculus
gtatttgtgtgcacgctttagtgaa

SEQ ID NO: 679201 - DNA, 25 bp, Mus musculus
gtatttgtgtgctcgctttagtgaa

SEQ ID NO: 679202 - DNA, 25 bp, Mus musculus
gtatttgtgtgtcctatacctctta

SEQ ID NO: 679203 - DNA, 25 bp, Mus musculus
gtatttgtgtgtgctatacctctta

SEQ ID NO: 679204 - DNA, 25 bp, Mus musculus
gtatttgttacacgtgttacatcct

SEQ ID NO: 679205 - DNA, 25 bp, Mus musculus
gtatttgttacaggtgttacatcct

SEQ ID NO: 679206 - DNA, 25 bp, Mus musculus
gtatttgttaccatgaggcacgtag

SEQ ID NO: 679207 - DNA, 25 bp, Mus musculus
gtatttgttaccttgaggcacgtag

SEQ ID NO: 679208 - DNA, 25 bp, Mus musculus
gtatttgttagccttgcttctaagc

SEQ ID NO: 679209 - DNA, 25 bp, Mus musculus
gtatttgttagcgttgcttctaagc

SEQ ID NO: 679210 - DNA, 25 bp, Mus musculus
gtatttgttatacttccctttgatt

SEQ ID NO: 679211 - DNA, 25 bp, Mus musculus
gtatttgttatagttccctttgatt

SEQ ID NO: 679212 - DNA, 25 bp, Mus musculus
gtatttgttgaaatccttgattatt

SEQ ID NO: 679213 - DNA, 25 bp, Mus musculus
gtatttgttgaattccttgattatt

SEQ ID NO: 679214 - DNA, 25 bp, Mus musculus
gtatttgtttacatcttcccaggga

SEQ ID NO: 679215 - DNA, 25 bp, Mus musculus
gtatttgtttacttcttcccaggga

SEQ ID NO: 679216 - DNA, 25 bp, Mus musculus
gtatttgtttgcaatgccacagaga

SEQ ID NO: 679217 - DNA, 25 bp, Mus musculus
gtatttgtttgctatgccacagaga

SEQ ID NO: 679218 - DNA, 25 bp, Mus musculus
gtatttgttttcaagcaccacagag

SEQ ID NO: 679219 - DNA, 25 bp, Mus musculus
gtatttgttttctagcaccacagag

SEQ ID NO: 679220 - DNA, 25 bp, Mus musculus
gtattttaaactcagacactctcag

SEQ ID NO: 679221 - DNA, 25 bp, Mus musculus
gtattttaaactgagacactctcag

SEQ ID NO: 679222 - DNA, 25 bp, Mus musculus
gtattttaaatcaatcggtctgggt

SEQ ID NO: 679223 - DNA, 25 bp, Mus musculus
gtattttaaatctatcggtctgggt

SEQ ID NO: 679224 - DNA, 25 bp, Mus musculus
gtattttaaccaaagctgccagcgt

SEQ ID NO: 679225 - DNA, 25 bp, Mus musculus
gtattttaaccatagctgccagcgt

SEQ ID NO: 679226 - DNA, 25 bp, Mus musculus
gtattttaactccaccacactattg

SEQ ID NO: 679227 - DNA, 25 bp, Mus musculus
gtattttaactcgaccacactattg

SEQ ID NO: 679228 - DNA, 25 bp, Mus musculus
gtattttaagttcaacactggctac

SEQ ID NO: 679229 - DNA, 25 bp, Mus musculus
gtattttaagttgaacactggctac

SEQ ID NO: 679230 - DNA, 25 bp, Mus musculus
gtattttaatatagctccttgatat

SEQ ID NO: 679231 - DNA, 25 bp, Mus musculus
gtattttaatattgctccttgatat

SEQ ID NO: 679232 - DNA, 25 bp, Mus musculus
gtattttaatccagtaccaaatctg

SEQ ID NO: 679233 - DNA, 25 bp, Mus musculus
gtattttaatcctgtaccaaatctg

SEQ ID NO: 679234 - DNA, 25 bp, Mus musculus
gtattttacaggcagtctcttgtca

SEQ ID NO: 679235 - DNA, 25 bp, Mus musculus
gtattttacagggagtctcttgtca

SEQ ID NO: 679236 - DNA, 25 bp, Mus musculus
gtattttaccatagactgtttcatt

SEQ ID NO: 679237 - DNA, 25 bp, Mus musculus
gtattttaccattgactgtttcatt

SEQ ID NO: 679238 - DNA, 25 bp, Mus musculus
gtattttactacaggttatgggtct

SEQ ID NO: 679239 - DNA, 25 bp, Mus musculus
gtattttactactggttatgggtct

SEQ ID NO: 679240 - DNA, 25 bp, Mus musculus
gtattttactggacatgactttagc

SEQ ID NO: 679241 - DNA, 25 bp, Mus musculus
gtattttactggagcactggccaag

SEQ ID NO: 679242 - DNA, 25 bp, Mus musculus
gtattttactggtcatgactttagc

SEQ ID NO: 679243 - DNA, 25 bp, Mus musculus
gtattttactggtgcactggccaag

SEQ ID NO: 679244 - DNA, 25 bp, Mus musculus
gtattttactgtaccatgttggtgt

SEQ ID NO: 679245 - DNA, 25 bp, Mus musculus
gtattttactgtacttatccataag

SEQ ID NO: 679246 - DNA, 25 bp, Mus musculus
gtattttactgtatattgatgaaca

SEQ ID NO: 679247 - DNA, 25 bp, Mus musculus
gtattttactgttccatgttggtgt

SEQ ID NO: 679248 - DNA, 25 bp, Mus musculus
gtattttactgttcttatccataag

SEQ ID NO: 679249 - DNA, 25 bp, Mus musculus
gtattttactgtttattgatgaaca

SEQ ID NO: 679250 - DNA, 25 bp, Mus musculus
gtattttagattccacccattgtga

SEQ ID NO: 679251 - DNA, 25 bp, Mus musculus
gtattttagattgcacccattgtga

SEQ ID NO: 679252 - DNA, 25 bp, Mus musculus
gtattttagctaatttagtaggatt

SEQ ID NO: 679253 - DNA, 25 bp, Mus musculus
gtattttagctattttagtaggatt

SEQ ID NO: 679254 - DNA, 25 bp, Mus musculus
gtattttagtacatcaagcgaccag

SEQ ID NO: 679255 - DNA, 25 bp, Mus musculus
gtattttagtacttcaagcgaccag

SEQ ID NO: 679256 - DNA, 25 bp, Mus musculus
gtattttagtctacgtttctctgtc

SEQ ID NO: 679257 - DNA, 25 bp, Mus musculus
gtattttagtcttcgtttctctgtc

SEQ ID NO: 679258 - DNA, 25 bp, Mus musculus
gtattttatacgcaacgtacatgct

SEQ ID NO: 679259 - DNA, 25 bp, Mus musculus
gtattttatacggaacgtacatgct

SEQ ID NO: 679260 - DNA, 25 bp, Mus musculus
gtattttatcatcacaactccagag

SEQ ID NO: 679261 - DNA, 25 bp, Mus musculus
gtattttatcatgacaactccagag

SEQ ID NO: 679262 - DNA, 25 bp, Mus musculus
gtattttatgtaacctgtgcacatg

SEQ ID NO: 679263 - DNA, 25 bp, Mus musculus
gtattttatgtatcctgtgcacatg

SEQ ID NO: 679264 - DNA, 25 bp, Mus musculus
gtattttattatactccctcgactt

SEQ ID NO: 679265 - DNA, 25 bp, Mus musculus
gtattttattattctccctcgactt

SEQ ID NO: 679266 - DNA, 25 bp, Mus musculus
gtattttattccctccagctttgaa

SEQ ID NO: 679267 - DNA, 25 bp, Mus musculus
gtattttattccgtccagctttgaa

SEQ ID NO: 679268 - DNA, 25 bp, Mus musculus
gtattttattctaatcatttgtcac

SEQ ID NO: 679269 - DNA, 25 bp, Mus musculus
gtattttattcttatcatttgtcac

SEQ ID NO: 679270 - DNA, 25 bp, Mus musculus
gtattttcaacacgacagtttcagt

SEQ ID NO: 679271 - DNA, 25 bp, Mus musculus
gtattttcaacaggacagtttcagt

SEQ ID NO: 679272 - DNA, 25 bp, Mus musculus
gtattttcaagcaggatgcgcgtct

SEQ ID NO: 679273 - DNA, 25 bp, Mus musculus
gtattttcaagctggatgcgcgtct

SEQ ID NO: 679274 - DNA, 25 bp, Mus musculus
gtattttcacaaagtcctgcagcca

SEQ ID NO: 679275 - DNA, 25 bp, Mus musculus
gtattttcacaatgtcctgcagcca

SEQ ID NO: 679276 - DNA, 25 bp, Mus musculus
gtattttcacatatagaactccaga

SEQ ID NO: 679277 - DNA, 25 bp, Mus musculus
gtattttcacatttagaactccaga

SEQ ID NO: 679278 - DNA, 25 bp, Mus musculus
gtattttcactgcagtatcttgtac

SEQ ID NO: 679279 - DNA, 25 bp, Mus musculus
gtattttcactggagtatcttgtac

SEQ ID NO: 679280 - DNA, 25 bp, Mus musculus
gtattttcacttctctcatctaaga

SEQ ID NO: 679281 - DNA, 25 bp, Mus musculus
gtattttcacttgtctcatctaaga

SEQ ID NO: 679282 - DNA, 25 bp, Mus musculus
gtattttcagcactactaccgaaag

SEQ ID NO: 679283 - DNA, 25 bp, Mus musculus
gtattttcagcagtactaccgaaag

SEQ ID NO: 679284 - DNA, 25 bp, Mus musculus
gtattttcataaccatttactagaa

SEQ ID NO: 679285 - DNA, 25 bp, Mus musculus
gtattttcataagcatttactagaa

SEQ ID NO: 679286 - DNA, 25 bp, Mus musculus
gtattttcattcataggaagaacta

SEQ ID NO: 679287 - DNA, 25 bp, Mus musculus
gtattttcattcttaggaagaacta

SEQ ID NO: 679288 - DNA, 25 bp, Mus musculus
gtattttcatttcaatctgtctatt

SEQ ID NO: 679289 - DNA, 25 bp, Mus musculus
gtattttcatttgaatctgtctatt

SEQ ID NO: 679290 - DNA, 25 bp, Mus musculus
gtattttccacaaattctgactgta

SEQ ID NO: 679291 - DNA, 25 bp, Mus musculus
gtattttccacatattctgactgta

SEQ ID NO: 679292 - DNA, 25 bp, Mus musculus
gtattttccaccattgaacctgtca

SEQ ID NO: 679293 - DNA, 25 bp, Mus musculus
gtattttccacctttgaacctgtca

SEQ ID NO: 679294 - DNA, 25 bp, Mus musculus
gtattttccatccaacagcagtttg

SEQ ID NO: 679295 - DNA, 25 bp, Mus musculus
gtattttccatcgaacagcagtttg

SEQ ID NO: 679296 - DNA, 25 bp, Mus musculus
gtattttccattctcatttctgcta

SEQ ID NO: 679297 - DNA, 25 bp, Mus musculus
gtattttccattgtcatttctgcta

SEQ ID NO: 679298 - DNA, 25 bp, Mus musculus
gtattttcctaaagtcttcctaatg

SEQ ID NO: 679299 - DNA, 25 bp, Mus musculus
gtattttcctaatgtcttcctaatg

SEQ ID NO: 679300 - DNA, 25 bp, Mus musculus
gtattttcctctctaacagcttttt

SEQ ID NO: 679301 - DNA, 25 bp, Mus musculus
gtattttcctctgtaacagcttttt

SEQ ID NO: 679302 - DNA, 25 bp, Mus musculus
gtattttcctgactagatttctgag

SEQ ID NO: 679303 - DNA, 25 bp, Mus musculus
gtattttcctgagtagatttctgag

SEQ ID NO: 679304 - DNA, 25 bp, Mus musculus
gtattttcctttcagaagttccaag

SEQ ID NO: 679305 - DNA, 25 bp, Mus musculus
gtattttcctttgagaagttccaag

SEQ ID NO: 679306 - DNA, 25 bp, Mus musculus
gtattttctccacttcttaagctgt

SEQ ID NO: 679307 - DNA, 25 bp, Mus musculus
gtattttctccagttcttaagctgt

SEQ ID NO: 679308 - DNA, 25 bp, Mus musculus
gtattttctcccaagtttctatcat

SEQ ID NO: 679309 - DNA, 25 bp, Mus musculus
gtattttctccctagtttctatcat

SEQ ID NO: 679310 - DNA, 25 bp, Mus musculus
gtattttctctaagcgatggatgta

SEQ ID NO: 679311 - DNA, 25 bp, Mus musculus
gtattttctctatgcgatggatgta

SEQ ID NO: 679312 - DNA, 25 bp, Mus musculus
gtattttctctgaccctaagacttg

SEQ ID NO: 679313 - DNA, 25 bp, Mus musculus
gtattttctctgtccctaagacttg

SEQ ID NO: 679314 - DNA, 25 bp, Mus musculus
gtattttctgaccacataaaggctt

SEQ ID NO: 679315 - DNA, 25 bp, Mus musculus
gtattttctgacgacataaaggctt

SEQ ID NO: 679316 - DNA, 25 bp, Mus musculus
gtattttctgatctgagcttgttaa

SEQ ID NO: 679317 - DNA, 25 bp, Mus musculus
gtattttctgatgtgagcttgttaa

SEQ ID NO: 679318 - DNA, 25 bp, Mus musculus
gtattttctgccacctatcattatc

SEQ ID NO: 679319 - DNA, 25 bp, Mus musculus
gtattttctgcctcctatcattatc

SEQ ID NO: 679320 - DNA, 25 bp, Mus musculus
gtattttctgctaagatctgtacct

SEQ ID NO: 679321 - DNA, 25 bp, Mus musculus
gtattttctgctcgcttcaacagtc

SEQ ID NO: 679322 - DNA, 25 bp, Mus musculus
gtattttctgctggcttcaacagtc

SEQ ID NO: 679323 - DNA, 25 bp, Mus musculus
gtattttctgcttagatctgtacct

SEQ ID NO: 679324 - DNA, 25 bp, Mus musculus
gtattttcttcgagcaaagttgtat

SEQ ID NO: 679325 - DNA, 25 bp, Mus musculus
gtattttcttcgtgcaaagttgtat

SEQ ID NO: 679326 - DNA, 25 bp, Mus musculus
gtattttctttactcgtatcccagg

SEQ ID NO: 679327 - DNA, 25 bp, Mus musculus
gtattttctttagtcgtatcccagg

SEQ ID NO: 679328 - DNA, 25 bp, Mus musculus
gtattttgacagagggaaccctgcc

SEQ ID NO: 679329 - DNA, 25 bp, Mus musculus
gtattttgacagtgggaaccctgcc

SEQ ID NO: 679330 - DNA, 25 bp, Mus musculus
gtattttgagagcatccctttgttc

SEQ ID NO: 679331 - DNA, 25 bp, Mus musculus
gtattttgagaggatccctttgttc

SEQ ID NO: 679332 - DNA, 25 bp, Mus musculus
gtattttgagctaccctaatgagtt

SEQ ID NO: 679333 - DNA, 25 bp, Mus musculus
gtattttgagcttccctaatgagtt

SEQ ID NO: 679334 - DNA, 25 bp, Mus musculus
gtattttgatacactgtatgtgtac

SEQ ID NO: 679335 - DNA, 25 bp, Mus musculus
gtattttgatactctgtatgtgtac

SEQ ID NO: 679336 - DNA, 25 bp, Mus musculus
gtattttgcaatcgtcttcttaggt

SEQ ID NO: 679337 - DNA, 25 bp, Mus musculus
gtattttgcaatggtcttcttaggt

SEQ ID NO: 679338 - DNA, 25 bp, Mus musculus
gtattttgcctactgcatggtctga

SEQ ID NO: 679339 - DNA, 25 bp, Mus musculus
gtattttgcctagtgcatggtctga

SEQ ID NO: 679340 - DNA, 25 bp, Mus musculus
gtattttgctcacactttacacata

SEQ ID NO: 679341 - DNA, 25 bp, Mus musculus
gtattttgctcagactttacacata

SEQ ID NO: 679342 - DNA, 25 bp, Mus musculus
gtattttgcttaatgaaggcctcag

SEQ ID NO: 679343 - DNA, 25 bp, Mus musculus
gtattttgcttattgaaggcctcag

SEQ ID NO: 679344 - DNA, 25 bp, Mus musculus
gtattttggaacaagatgcactgaa

SEQ ID NO: 679345 - DNA, 25 bp, Mus musculus
gtattttggaactagatgcactgaa

SEQ ID NO: 679346 - DNA, 25 bp, Mus musculus
gtattttggaagcttccccagtgtg

SEQ ID NO: 679347 - DNA, 25 bp, Mus musculus
gtattttggaaggttccccagtgtg

SEQ ID NO: 679348 - DNA, 25 bp, Mus musculus
gtattttgtaatcacgcgccaggaa

SEQ ID NO: 679349 - DNA, 25 bp, Mus musculus
gtattttgtaatgacgcgccaggaa

SEQ ID NO: 679350 - DNA, 25 bp, Mus musculus
gtattttgtagcagtcatcttccta

SEQ ID NO: 679351 - DNA, 25 bp, Mus musculus
gtattttgtagctgtcatcttccta

SEQ ID NO: 679352 - DNA, 25 bp, Mus musculus
gtattttgtatcagtacaggacaaa

SEQ ID NO: 679353 - DNA, 25 bp, Mus musculus
gtattttgtatctgtacaggacaaa

SEQ ID NO: 679354 - DNA, 25 bp, Mus musculus
gtattttgtctcctttagaccattt

SEQ ID NO: 679355 - DNA, 25 bp, Mus musculus
gtattttgtctcgtttagaccattt

SEQ ID NO: 679356 - DNA, 25 bp, Mus musculus
gtattttgtcttactaacctggaat

SEQ ID NO: 679357 - DNA, 25 bp, Mus musculus
gtattttgtctttctaacctggaat

SEQ ID NO: 679358 - DNA, 25 bp, Mus musculus
gtattttgtggtactcactgcttct

SEQ ID NO: 679359 - DNA, 25 bp, Mus musculus
gtattttgtggttctcactgcttct

SEQ ID NO: 679360 - DNA, 25 bp, Mus musculus
gtattttgttaccatcttctcagtt

SEQ ID NO: 679361 - DNA, 25 bp, Mus musculus
gtattttgttacgatcttctcagtt

SEQ ID NO: 679362 - DNA, 25 bp, Mus musculus
gtattttgttggacagtactgggct

SEQ ID NO: 679363 - DNA, 25 bp, Mus musculus
gtattttgttggtcagtactgggct

SEQ ID NO: 679364 - DNA, 25 bp, Mus musculus
gtatttttaactccacagggcactt

SEQ ID NO: 679365 - DNA, 25 bp, Mus musculus
gtatttttaactgcacagggcactt

SEQ ID NO: 679366 - DNA, 25 bp, Mus musculus
gtatttttaagtccacaggtctcca

SEQ ID NO: 679367 - DNA, 25 bp, Mus musculus
gtatttttaagtgcacaggtctcca

SEQ ID NO: 679368 - DNA, 25 bp, Mus musculus
gtatttttaattcctggtccatggg

SEQ ID NO: 679369 - DNA, 25 bp, Mus musculus
gtatttttaattgctggtccatggg

SEQ ID NO: 679370 - DNA, 25 bp, Mus musculus
gtatttttagtcattaaggcttatg

SEQ ID NO: 679371 - DNA, 25 bp, Mus musculus
gtatttttagtctttaaggcttatg

SEQ ID NO: 679372 - DNA, 25 bp, Mus musculus
gtatttttatcactgtcttcctagg

SEQ ID NO: 679373 - DNA, 25 bp, Mus musculus
gtatttttatcagtgtcttcctagg

SEQ ID NO: 679374 - DNA, 25 bp, Mus musculus
gtatttttcactagcatattgccaa

SEQ ID NO: 679375 - DNA, 25 bp, Mus musculus
gtatttttcactctccttgtatttg

SEQ ID NO: 679376 - DNA, 25 bp, Mus musculus
gtatttttcactgtccttgtatttg

SEQ ID NO: 679377 - DNA, 25 bp, Mus musculus
gtatttttcacttgcatattgccaa

SEQ ID NO: 679378 - DNA, 25 bp, Mus musculus
gtatttttcataaaacttagttcag

SEQ ID NO: 679379 - DNA, 25 bp, Mus musculus
gtatttttcatataacttagttcag

SEQ ID NO: 679380 - DNA, 25 bp, Mus musculus
gtatttttcattactctggacatat

SEQ ID NO: 679381 - DNA, 25 bp, Mus musculus
gtatttttcatttctctggacatat

SEQ ID NO: 679382 - DNA, 25 bp, Mus musculus
gtatttttccaaatctattgttgct

SEQ ID NO: 679383 - DNA, 25 bp, Mus musculus
gtatttttccaaccacagcatggtt

SEQ ID NO: 679384 - DNA, 25 bp, Mus musculus
gtatttttccaagcacagcatggtt

SEQ ID NO: 679385 - DNA, 25 bp, Mus musculus
gtatttttccaattctattgttgct

SEQ ID NO: 679386 - DNA, 25 bp, Mus musculus
gtatttttctatccaatgggtgtct

SEQ ID NO: 679387 - DNA, 25 bp, Mus musculus
gtatttttctatgcaatgggtgtct

SEQ ID NO: 679388 - DNA, 25 bp, Mus musculus
gtatttttctcaaactcactattta

SEQ ID NO: 679389 - DNA, 25 bp, Mus musculus
gtatttttctcatactcactattta

SEQ ID NO: 679390 - DNA, 25 bp, Mus musculus
gtatttttctgcatcttaattcctg

SEQ ID NO: 679391 - DNA, 25 bp, Mus musculus
gtatttttctgccactgccaattta

SEQ ID NO: 679392 - DNA, 25 bp, Mus musculus
gtatttttctgcgactgccaattta

SEQ ID NO: 679393 - DNA, 25 bp, Mus musculus
gtatttttctgcttcttaattcctg

SEQ ID NO: 679394 - DNA, 25 bp, Mus musculus
gtatttttgagaccaggtccccagg

SEQ ID NO: 679395 - DNA, 25 bp, Mus musculus
gtatttttgagagcaggtccccagg

SEQ ID NO: 679396 - DNA, 25 bp, Mus musculus
gtatttttgatcctgtaggtaccat

SEQ ID NO: 679397 - DNA, 25 bp, Mus musculus
gtatttttgatcgtgtaggtaccat

SEQ ID NO: 679398 - DNA, 25 bp, Mus musculus
gtatttttgatgatccattatgttt

SEQ ID NO: 679399 - DNA, 25 bp, Mus musculus
gtatttttgatgttccattatgttt

SEQ ID NO: 679400 - DNA, 25 bp, Mus musculus
gtatttttgcagcttctattttcca

SEQ ID NO: 679401 - DNA, 25 bp, Mus musculus
gtatttttgcaggttctattttcca

SEQ ID NO: 679402 - DNA, 25 bp, Mus musculus
gtatttttgccgaactcacttggga

SEQ ID NO: 679403 - DNA, 25 bp, Mus musculus
gtatttttgccgtactcacttggga

SEQ ID NO: 679404 - DNA, 25 bp, Mus musculus
gtatttttggatcctgcaccgtgcc

SEQ ID NO: 679405 - DNA, 25 bp, Mus musculus
gtatttttggatgctgcaccgtgcc

SEQ ID NO: 679406 - DNA, 25 bp, Mus musculus
gtatttttggttagccacttcctgc

SEQ ID NO: 679407 - DNA, 25 bp, Mus musculus
gtatttttggtttgccacttcctgc

SEQ ID NO: 679408 - DNA, 25 bp, Mus musculus
gtatttttgtcaactggtgttccct

SEQ ID NO: 679409 - DNA, 25 bp, Mus musculus
gtatttttgtcatctggtgttccct

SEQ ID NO: 679410 - DNA, 25 bp, Mus musculus
gtatttttgtctcaccttaatggaa

SEQ ID NO: 679411 - DNA, 25 bp, Mus musculus
gtatttttgtctgaccttaatggaa

SEQ ID NO: 679412 - DNA, 25 bp, Mus musculus
gtatttttgttgctcccagtacatt

SEQ ID NO: 679413 - DNA, 25 bp, Mus musculus
gtatttttgttggtcccagtacatt

SEQ ID NO: 679414 - DNA, 25 bp, Mus musculus
gtattttttacgattcagttgatag

SEQ ID NO: 679415 - DNA, 25 bp, Mus musculus
gtattttttacgtttcagttgatag

SEQ ID NO: 679416 - DNA, 25 bp, Mus musculus
gtattttttcatcaagggtgacact

SEQ ID NO: 679417 - DNA, 25 bp, Mus musculus
gtattttttcatgaagggtgacact

SEQ ID NO: 679418 - DNA, 25 bp, Mus musculus
gtattttttcctagtgagatgtatt

SEQ ID NO: 679419 - DNA, 25 bp, Mus musculus
gtattttttccttgtgagatgtatt

SEQ ID NO: 679420 - DNA, 25 bp, Mus musculus
gtattttttgaacctcccaagtgag

SEQ ID NO: 679421 - DNA, 25 bp, Mus musculus
gtattttttgaagctcccaagtgag

SEQ ID NO: 679422 - DNA, 25 bp, Mus musculus
gtattttttgacatgtaactctata

SEQ ID NO: 679423 - DNA, 25 bp, Mus musculus
gtattttttgacttgtaactctata

SEQ ID NO: 679424 - DNA, 25 bp, Mus musculus
gtattttttgagacccaggtaactg

SEQ ID NO: 679425 - DNA, 25 bp, Mus musculus
gtattttttgagtcccaggtaactg

SEQ ID NO: 679426 - DNA, 25 bp, Mus musculus
gtattttttgctaacaagcaacccg

SEQ ID NO: 679427 - DNA, 25 bp, Mus musculus
gtattttttgctagccttttggata

SEQ ID NO: 679428 - DNA, 25 bp, Mus musculus
gtattttttgcttacaagcaacccg

SEQ ID NO: 679429 - DNA, 25 bp, Mus musculus
gtattttttgcttgccttttggata

SEQ ID NO: 679430 - DNA, 25 bp, Mus musculus
gtcaaaaaagctcatatgctattgt

SEQ ID NO: 679431 - DNA, 25 bp, Mus musculus
gtcaaaaaagctgatatgctattgt

SEQ ID NO: 679432 - DNA, 25 bp, Mus musculus
gtcaaaaactccaaagcttagcatt

SEQ ID NO: 679433 - DNA, 25 bp, Mus musculus
gtcaaaaactcctaagcttagcatt

SEQ ID NO: 679434 - DNA, 25 bp, Mus musculus
gtcaaaaactgtagggacaccctga

SEQ ID NO: 679435 - DNA, 25 bp, Mus musculus
gtcaaaaactgttgggacaccctga

SEQ ID NO: 679436 - DNA, 25 bp, Mus musculus
gtcaaaaaggctctgcgggttctcc

SEQ ID NO: 679437 - DNA, 25 bp, Mus musculus
gtcaaaaaggctgtgcgggttctcc

SEQ ID NO: 679438 - DNA, 25 bp, Mus musculus
gtcaaaaatcttactccatttcggg

SEQ ID NO: 679439 - DNA, 25 bp, Mus musculus
gtcaaaaatctttctccatttcggg

SEQ ID NO: 679440 - DNA, 25 bp, Mus musculus
gtcaaaaatgagactttaagagcaa

SEQ ID NO: 679441 - DNA, 25 bp, Mus musculus
gtcaaaaatgagtctttaagagcaa

SEQ ID NO: 679442 - DNA, 25 bp, Mus musculus
gtcaaaacatccaggctcggtgagt

SEQ ID NO: 679443 - DNA, 25 bp, Mus musculus
gtcaaaacatcctggctcggtgagt

SEQ ID NO: 679444 - DNA, 25 bp, Mus musculus
gtcaaaacattaccaagtccaccct

SEQ ID NO: 679445 - DNA, 25 bp, Mus musculus
gtcaaaacattagcaagtccaccct

SEQ ID NO: 679446 - DNA, 25 bp, Mus musculus
gtcaaaacctatcctctggaatctt

SEQ ID NO: 679447 - DNA, 25 bp, Mus musculus
gtcaaaacctatgctctggaatctt

SEQ ID NO: 679448 - DNA, 25 bp, Mus musculus
gtcaaaacctcacagcagtccactg

SEQ ID NO: 679449 - DNA, 25 bp, Mus musculus
gtcaaaacctcagagcagtccactg

SEQ ID NO: 679450 - DNA, 25 bp, Mus musculus
gtcaaaacgatgaggaccaaccagt

SEQ ID NO: 679451 - DNA, 25 bp, Mus musculus
gtcaaaacgatgtggaccaaccagt

SEQ ID NO: 679452 - DNA, 25 bp, Mus musculus
gtcaaaactgttccataacatttgt

SEQ ID NO: 679453 - DNA, 25 bp, Mus musculus
gtcaaaactgttgcataacatttgt

SEQ ID NO: 679454 - DNA, 25 bp, Mus musculus
gtcaaaagaccacctatatgtaact

SEQ ID NO: 679455 - DNA, 25 bp, Mus musculus
gtcaaaagaccagctatatgtaact

SEQ ID NO: 679456 - DNA, 25 bp, Mus musculus
gtcaaaagcgtcatcttcaaaggtg

SEQ ID NO: 679457 - DNA, 25 bp, Mus musculus
gtcaaaagcgtcttcttcaaaggtg

SEQ ID NO: 679458 - DNA, 25 bp, Mus musculus
gtcaaaagcttgctccggtaacagc

SEQ ID NO: 679459 - DNA, 25 bp, Mus musculus
gtcaaaagcttggtccggtaacagc

SEQ ID NO: 679460 - DNA, 25 bp, Mus musculus
gtcaaaaggtttcctctccagaaac

SEQ ID NO: 679461 - DNA, 25 bp, Mus musculus
gtcaaaaggtttgctctccagaaac

SEQ ID NO: 679462 - DNA, 25 bp, Mus musculus
gtcaaaagtgacaacctctctggag

SEQ ID NO: 679463 - DNA, 25 bp, Mus musculus
gtcaaaagtgactacctctctggag

SEQ ID NO: 679464 - DNA, 25 bp, Mus musculus
gtcaaaagtgcacgtcttgtccaat

SEQ ID NO: 679465 - DNA, 25 bp, Mus musculus
gtcaaaagtgcaggtcttgtccaat

SEQ ID NO: 679466 - DNA, 25 bp, Mus musculus
gtcaaaagttacacagcaggcatcg

SEQ ID NO: 679467 - DNA, 25 bp, Mus musculus
gtcaaaagttactcagcaggcatcg

SEQ ID NO: 679468 - DNA, 25 bp, Mus musculus
gtcaaaatcatgacagcttcctaaa

SEQ ID NO: 679469 - DNA, 25 bp, Mus musculus
gtcaaaatcatgtcagcttcctaaa

SEQ ID NO: 679470 - DNA, 25 bp, Mus musculus
gtcaaaatcccgcagtcatcattag

SEQ ID NO: 679471 - DNA, 25 bp, Mus musculus
gtcaaaatcccggagtcatcattag

SEQ ID NO: 679472 - DNA, 25 bp, Mus musculus
gtcaaaatgggaagtggactgaacc

SEQ ID NO: 679473 - DNA, 25 bp, Mus musculus
gtcaaaatgggatgtggactgaacc

SEQ ID NO: 679474 - DNA, 25 bp, Mus musculus
gtcaaaatggtcacagctttccgct

SEQ ID NO: 679475 - DNA, 25 bp, Mus musculus
gtcaaaatggtctcagctttccgct

SEQ ID NO: 679476 - DNA, 25 bp, Mus musculus
gtcaaaatggtgaatctatctgatt

SEQ ID NO: 679477 - DNA, 25 bp, Mus musculus
gtcaaaatggtgtatctatctgatt

SEQ ID NO: 679478 - DNA, 25 bp, Mus musculus
gtcaaaatgtgacgactttcaagat

SEQ ID NO: 679479 - DNA, 25 bp, Mus musculus
gtcaaaatgtgaggactttcaagat

SEQ ID NO: 679480 - DNA, 25 bp, Mus musculus
gtcaaaattgacaacctccttcagg

SEQ ID NO: 679481 - DNA, 25 bp, Mus musculus
gtcaaaattgactacctccttcagg

SEQ ID NO: 679482 - DNA, 25 bp, Mus musculus
gtcaaaattggaacctcgggtttat

SEQ ID NO: 679483 - DNA, 25 bp, Mus musculus
gtcaaaattggatcctcgggtttat

SEQ ID NO: 679484 - DNA, 25 bp, Mus musculus
gtcaaaattttaactgccactgtag

SEQ ID NO: 679485 - DNA, 25 bp, Mus musculus
gtcaaaattttatctgccactgtag

SEQ ID NO: 679486 - DNA, 25 bp, Mus musculus
gtcaaacaatccacttgcatctgat

SEQ ID NO: 679487 - DNA, 25 bp, Mus musculus
gtcaaacaatcctcttgcatctgat

SEQ ID NO: 679488 - DNA, 25 bp, Mus musculus
gtcaaacacaacctggaggtgcacc

SEQ ID NO: 679489 - DNA, 25 bp, Mus musculus
gtcaaacacaacgtggaggtgcacc

SEQ ID NO: 679490 - DNA, 25 bp, Mus musculus
gtcaaacaccccaactgaagaagct

SEQ ID NO: 679491 - DNA, 25 bp, Mus musculus
gtcaaacacccctactgaagaagct

SEQ ID NO: 679492 - DNA, 25 bp, Mus musculus
gtcaaacacgcaccctttccagaga

SEQ ID NO: 679493 - DNA, 25 bp, Mus musculus
gtcaaacacgcagcctttccagaga

SEQ ID NO: 679494 - DNA, 25 bp, Mus musculus
gtcaaacagcatctttgtggtcccc

SEQ ID NO: 679495 - DNA, 25 bp, Mus musculus
gtcaaacagcatgtttgtggtcccc

SEQ ID NO: 679496 - DNA, 25 bp, Mus musculus
gtcaaacagccgctccaaaaaattc

SEQ ID NO: 679497 - DNA, 25 bp, Mus musculus
gtcaaacagccggtccaaaaaattc

SEQ ID NO: 679498 - DNA, 25 bp, Mus musculus
gtcaaacaggaacacagacgtacct

SEQ ID NO: 679499 - DNA, 25 bp, Mus musculus
gtcaaacaggaagacagacgtacct

SEQ ID NO: 679500 - DNA, 25 bp, Mus musculus
gtcaaacagtgtctccaaatgctcc

SEQ ID NO: 679501 - DNA, 25 bp, Mus musculus
gtcaaacagtgtgtccaaatgctcc

SEQ ID NO: 679502 - DNA, 25 bp, Mus musculus
gtcaaacatctgcattccctgtcat

SEQ ID NO: 679503 - DNA, 25 bp, Mus musculus
gtcaaacatctggattccctgtcat

SEQ ID NO: 679504 - DNA, 25 bp, Mus musculus
gtcaaacattgactatcctaaagga

SEQ ID NO: 679505 - DNA, 25 bp, Mus musculus
gtcaaacattgagtatcctaaagga

SEQ ID NO: 679506 - DNA, 25 bp, Mus musculus
gtcaaaccaggtattgtccggcaat

SEQ ID NO: 679507 - DNA, 25 bp, Mus musculus
gtcaaaccaggttttgtccggcaat

SEQ ID NO: 679508 - DNA, 25 bp, Mus musculus
gtcaaacccaatagtggtccacagt

SEQ ID NO: 679509 - DNA, 25 bp, Mus musculus
gtcaaacccaattgtggtccacagt

SEQ ID NO: 679510 - DNA, 25 bp, Mus musculus
gtcaaacccctcaatatttgatgaa

SEQ ID NO: 679511 - DNA, 25 bp, Mus musculus
gtcaaacccctctatatttgatgaa

SEQ ID NO: 679512 - DNA, 25 bp, Mus musculus
gtcaaaccctctaggtgtggtggtg

SEQ ID NO: 679513 - DNA, 25 bp, Mus musculus
gtcaaaccctcttggtgtggtggtg

SEQ ID NO: 679514 - DNA, 25 bp, Mus musculus
gtcaaaccctgtagacagcagtgtc

SEQ ID NO: 679515 - DNA, 25 bp, Mus musculus
gtcaaaccctgttgacagcagtgtc

SEQ ID NO: 679516 - DNA, 25 bp, Mus musculus
gtcaaacctagacaaggccccaaga

SEQ ID NO: 679517 - DNA, 25 bp, Mus musculus
gtcaaacctagagaaggccccaaga

SEQ ID NO: 679518 - DNA, 25 bp, Mus musculus
gtcaaacctgaaccttgggccttaa

SEQ ID NO: 679519 - DNA, 25 bp, Mus musculus
gtcaaacctgaagcttgggccttaa

SEQ ID NO: 679520 - DNA, 25 bp, Mus musculus
gtcaaacctttaaggcggtgtccgg

SEQ ID NO: 679521 - DNA, 25 bp, Mus musculus
gtcaaacctttatggcggtgtccgg

SEQ ID NO: 679522 - DNA, 25 bp, Mus musculus
gtcaaacgaccactgaacattgcta

SEQ ID NO: 679523 - DNA, 25 bp, Mus musculus
gtcaaacgaccagtgaacattgcta

SEQ ID NO: 679524 - DNA, 25 bp, Mus musculus
gtcaaacgaggcatccgttttgcac

SEQ ID NO: 679525 - DNA, 25 bp, Mus musculus
gtcaaacgaggcttccgttttgcac

SEQ ID NO: 679526 - DNA, 25 bp, Mus musculus
gtcaaacgcaaaataaggccagcag

SEQ ID NO: 679527 - DNA, 25 bp, Mus musculus
gtcaaacgcaaattaaggccagcag

SEQ ID NO: 679528 - DNA, 25 bp, Mus musculus
gtcaaacgctccacaataaaggcac

SEQ ID NO: 679529 - DNA, 25 bp, Mus musculus
gtcaaacgctcctcaataaaggcac

SEQ ID NO: 679530 - DNA, 25 bp, Mus musculus
gtcaaactgcacagaaacttttaac

SEQ ID NO: 679531 - DNA, 25 bp, Mus musculus
gtcaaactgcactgaaacttttaac

SEQ ID NO: 679532 - DNA, 25 bp, Mus musculus
gtcaaactggtaaagattgctctag

SEQ ID NO: 679533 - DNA, 25 bp, Mus musculus
gtcaaactggtatagattgctctag

SEQ ID NO: 679534 - DNA, 25 bp, Mus musculus
gtcaaactggtcagtgtaactccaa

SEQ ID NO: 679535 - DNA, 25 bp, Mus musculus
gtcaaactggtctgtgtaactccaa

SEQ ID NO: 679536 - DNA, 25 bp, Mus musculus
gtcaaactggtgcaggccctttgtt

SEQ ID NO: 679537 - DNA, 25 bp, Mus musculus
gtcaaactggtggaggccctttgtt

SEQ ID NO: 679538 - DNA, 25 bp, Mus musculus
gtcaaacttattcgtcttctctcag

SEQ ID NO: 679539 - DNA, 25 bp, Mus musculus
gtcaaacttattggtcttctctcag

SEQ ID NO: 679540 - DNA, 25 bp, Mus musculus
gtcaaacttggacagctgccgagct

SEQ ID NO: 679541 - DNA, 25 bp, Mus musculus
gtcaaacttggagagctgccgagct

SEQ ID NO: 679542 - DNA, 25 bp, Mus musculus
gtcaaacttggtatacccaggatca

SEQ ID NO: 679543 - DNA, 25 bp, Mus musculus
gtcaaacttggtttacccaggatca

SEQ ID NO: 679544 - DNA, 25 bp, Mus musculus
gtcaaagaaccacctgtcacaactg

SEQ ID NO: 679545 - DNA, 25 bp, Mus musculus
gtcaaagaaccagctgtcacaactg

SEQ ID NO: 679546 - DNA, 25 bp, Mus musculus
gtcaaagaagttatacaggccttag

SEQ ID NO: 679547 - DNA, 25 bp, Mus musculus
gtcaaagaagttttacaggccttag

SEQ ID NO: 679548 - DNA, 25 bp, Mus musculus
gtcaaagaatagctcaattcttact

SEQ ID NO: 679549 - DNA, 25 bp, Mus musculus
gtcaaagaataggtcaattcttact

SEQ ID NO: 679550 - DNA, 25 bp, Mus musculus
gtcaaagacaagagccttctatggc

SEQ ID NO: 679551 - DNA, 25 bp, Mus musculus
gtcaaagacaagtgccttctatggc

SEQ ID NO: 679552 - DNA, 25 bp, Mus musculus
gtcaaagaccgcagagactccagct

SEQ ID NO: 679553 - DNA, 25 bp, Mus musculus
gtcaaagaccgctgagactccagct

SEQ ID NO: 679554 - DNA, 25 bp, Mus musculus
gtcaaagaccggagcccaacagtaa

SEQ ID NO: 679555 - DNA, 25 bp, Mus musculus
gtcaaagaccggtgcccaacagtaa

SEQ ID NO: 679556 - DNA, 25 bp, Mus musculus
gtcaaagacggcaaaccctgccagg

SEQ ID NO: 679557 - DNA, 25 bp, Mus musculus
gtcaaagacggctaaccctgccagg

SEQ ID NO: 679558 - DNA, 25 bp, Mus musculus
gtcaaagactatactgttacttggg

SEQ ID NO: 679559 - DNA, 25 bp, Mus musculus
gtcaaagactattctgttacttggg

SEQ ID NO: 679560 - DNA, 25 bp, Mus musculus
gtcaaagagcccctaagcatggtaa

SEQ ID NO: 679561 - DNA, 25 bp, Mus musculus
gtcaaagagcccgtaagcatggtaa

SEQ ID NO: 679562 - DNA, 25 bp, Mus musculus
gtcaaagatctgcagctgccctggg

SEQ ID NO: 679563 - DNA, 25 bp, Mus musculus
gtcaaagatctggagctgccctggg

SEQ ID NO: 679564 - DNA, 25 bp, Mus musculus
gtcaaagcacaaaccgcatgcacac

SEQ ID NO: 679565 - DNA, 25 bp, Mus musculus
gtcaaagcacaatccgcatgcacac

SEQ ID NO: 679566 - DNA, 25 bp, Mus musculus
gtcaaagcagaacgctacagtgata

SEQ ID NO: 679567 - DNA, 25 bp, Mus musculus
gtcaaagcagaaggctacagtgata

SEQ ID NO: 679568 - DNA, 25 bp, Mus musculus
gtcaaagcagtgactccgtggaagt

SEQ ID NO: 679569 - DNA, 25 bp, Mus musculus
gtcaaagcagtgtctccgtggaagt

SEQ ID NO: 679570 - DNA, 25 bp, Mus musculus
gtcaaagccacgatgtacgagatgt

SEQ ID NO: 679571 - DNA, 25 bp, Mus musculus
gtcaaagccacgttgtacgagatgt

SEQ ID NO: 679572 - DNA, 25 bp, Mus musculus
gtcaaagcctaaagtccacagctgc

SEQ ID NO: 679573 - DNA, 25 bp, Mus musculus
gtcaaagcctaatgtccacagctgc

SEQ ID NO: 679574 - DNA, 25 bp, Mus musculus
gtcaaagcgagactatctgcagact

SEQ ID NO: 679575 - DNA, 25 bp, Mus musculus
gtcaaagcgagagtatctgcagact

SEQ ID NO: 679576 - DNA, 25 bp, Mus musculus
gtcaaagcggatcatagaggagcct

SEQ ID NO: 679577 - DNA, 25 bp, Mus musculus
gtcaaagcggatgatagaggagcct

SEQ ID NO: 679578 - DNA, 25 bp, Mus musculus
gtcaaagcttgaacaatagggctct

SEQ ID NO: 679579 - DNA, 25 bp, Mus musculus
gtcaaagcttgatcaatagggctct

SEQ ID NO: 679580 - DNA, 25 bp, Mus musculus
gtcaaaggatccagaaggccttcgt

SEQ ID NO: 679581 - DNA, 25 bp, Mus musculus
gtcaaaggatcctgaaggccttcgt

SEQ ID NO: 679582 - DNA, 25 bp, Mus musculus
gtcaaaggatgtaccacagtaacaa

SEQ ID NO: 679583 - DNA, 25 bp, Mus musculus
gtcaaaggatgttccacagtaacaa

SEQ ID NO: 679584 - DNA, 25 bp, Mus musculus
gtcaaaggcagtacctaaaccagga

SEQ ID NO: 679585 - DNA, 25 bp, Mus musculus
gtcaaaggcagttcctaaaccagga

SEQ ID NO: 679586 - DNA, 25 bp, Mus musculus
gtcaaaggctacagtctctactttt

SEQ ID NO: 679587 - DNA, 25 bp, Mus musculus
gtcaaaggctactgtctctactttt

SEQ ID NO: 679588 - DNA, 25 bp, Mus musculus
gtcaaaggcttgatagcatccataa

SEQ ID NO: 679589 - DNA, 25 bp, Mus musculus
gtcaaaggcttgttagcatccataa

SEQ ID NO: 679590 - DNA, 25 bp, Mus musculus
gtcaaagggcaccttcagagccagt

SEQ ID NO: 679591 - DNA, 25 bp, Mus musculus
gtcaaagggcacgttcagagccagt

SEQ ID NO: 679592 - DNA, 25 bp, Mus musculus
gtcaaagggcttcgtgtcgccatag

SEQ ID NO: 679593 - DNA, 25 bp, Mus musculus
gtcaaagggcttggtgtcgccatag

SEQ ID NO: 679594 - DNA, 25 bp, Mus musculus
gtcaaaggtcagctgagtcttctaa

SEQ ID NO: 679595 - DNA, 25 bp, Mus musculus
gtcaaaggtcaggtgagtcttctaa

SEQ ID NO: 679596 - DNA, 25 bp, Mus musculus
gtcaaaggtcctatgtttttatcaa

SEQ ID NO: 679597 - DNA, 25 bp, Mus musculus
gtcaaaggtcctttgtttttatcaa

SEQ ID NO: 679598 - DNA, 25 bp, Mus musculus
gtcaaaggtgacaacttagcccagg

SEQ ID NO: 679599 - DNA, 25 bp, Mus musculus
gtcaaaggtgactacttagcccagg

SEQ ID NO: 679600 - DNA, 25 bp, Mus musculus
gtcaaagtaggcagtccctcggatt

SEQ ID NO: 679601 - DNA, 25 bp, Mus musculus
gtcaaagtaggctgtccctcggatt

SEQ ID NO: 679602 - DNA, 25 bp, Mus musculus
gtcaaagtcatactgcagtgggaca

SEQ ID NO: 679603 - DNA, 25 bp, Mus musculus
gtcaaagtcatagtgcagtgggaca

SEQ ID NO: 679604 - DNA, 25 bp, Mus musculus
gtcaaagtcgacatttagttgggct

SEQ ID NO: 679605 - DNA, 25 bp, Mus musculus
gtcaaagtcgacttttagttgggct

SEQ ID NO: 679606 - DNA, 25 bp, Mus musculus
gtcaaagtgcctataacacctgcca

SEQ ID NO: 679607 - DNA, 25 bp, Mus musculus
gtcaaagtgcctttaacacctgcca

SEQ ID NO: 679608 - DNA, 25 bp, Mus musculus
gtcaaatacgtcacatacttcattt

SEQ ID NO: 679609 - DNA, 25 bp, Mus musculus
gtcaaatacgtctcatacttcattt

SEQ ID NO: 679610 - DNA, 25 bp, Mus musculus
gtcaaatatcctacattttccaaaa

SEQ ID NO: 679611 - DNA, 25 bp, Mus musculus
gtcaaatatccttcattttccaaaa

SEQ ID NO: 679612 - DNA, 25 bp, Mus musculus
gtcaaatcaattactagcctctaaa

SEQ ID NO: 679613 - DNA, 25 bp, Mus musculus
gtcaaatcaatttctagcctctaaa

SEQ ID NO: 679614 - DNA, 25 bp, Mus musculus
gtcaaatcacggattgccatcagga

SEQ ID NO: 679615 - DNA, 25 bp, Mus musculus
gtcaaatcacggtttgccatcagga

SEQ ID NO: 679616 - DNA, 25 bp, Mus musculus
gtcaaatcatcactcaagcccagga

SEQ ID NO: 679617 - DNA, 25 bp, Mus musculus
gtcaaatcatcagtcaagcccagga

SEQ ID NO: 679618 - DNA, 25 bp, Mus musculus
gtcaaatccactagctgttttttgg

SEQ ID NO: 679619 - DNA, 25 bp, Mus musculus
gtcaaatccacttgctgttttttgg

SEQ ID NO: 679620 - DNA, 25 bp, Mus musculus
gtcaaatgcctcagggaggagcctg

SEQ ID NO: 679621 - DNA, 25 bp, Mus musculus
gtcaaatgcctctgggaggagcctg

SEQ ID NO: 679622 - DNA, 25 bp, Mus musculus
gtcaaatggacaagtgcccggtagt

SEQ ID NO: 679623 - DNA, 25 bp, Mus musculus
gtcaaatggacatgtgcccggtagt

SEQ ID NO: 679624 - DNA, 25 bp, Mus musculus
gtcaaatggactactcagcaggtat

SEQ ID NO: 679625 - DNA, 25 bp, Mus musculus
gtcaaatggacttctcagcaggtat

SEQ ID NO: 679626 - DNA, 25 bp, Mus musculus
gtcaaatggcctcgattttatgaca

SEQ ID NO: 679627 - DNA, 25 bp, Mus musculus
gtcaaatggcctggattttatgaca

SEQ ID NO: 679628 - DNA, 25 bp, Mus musculus
gtcaaatggtttcgctccgggcgtt

SEQ ID NO: 679629 - DNA, 25 bp, Mus musculus
gtcaaatggtttggctccgggcgtt

SEQ ID NO: 679630 - DNA, 25 bp, Mus musculus
gtcaaatgtcttatgtcattggctg

SEQ ID NO: 679631 - DNA, 25 bp, Mus musculus
gtcaaatgtcttttgtcattggctg

SEQ ID NO: 679632 - DNA, 25 bp, Mus musculus
gtcaaattacctactttgtgttcaa

SEQ ID NO: 679633 - DNA, 25 bp, Mus musculus
gtcaaattaccttctttgtgttcaa

SEQ ID NO: 679634 - DNA, 25 bp, Mus musculus
gtcaaattacgtacatcagctccag

SEQ ID NO: 679635 - DNA, 25 bp, Mus musculus
gtcaaattacgttcatcagctccag

SEQ ID NO: 679636 - DNA, 25 bp, Mus musculus
gtcaaattatgcacacttttgtgct

SEQ ID NO: 679637 - DNA, 25 bp, Mus musculus
gtcaaattatgctcacttttgtgct

SEQ ID NO: 679638 - DNA, 25 bp, Mus musculus
gtcaaattccaaagcccatgttcaa

SEQ ID NO: 679639 - DNA, 25 bp, Mus musculus
gtcaaattccaatgcccatgttcaa

SEQ ID NO: 679640 - DNA, 25 bp, Mus musculus
gtcaaattcctgatgttctgcaata

SEQ ID NO: 679641 - DNA, 25 bp, Mus musculus
gtcaaattcctgttgttctgcaata

SEQ ID NO: 679642 - DNA, 25 bp, Mus musculus
gtcaaattgcagacccaagctgtta

SEQ ID NO: 679643 - DNA, 25 bp, Mus musculus
gtcaaattgcagtcccaagctgtta

SEQ ID NO: 679644 - DNA, 25 bp, Mus musculus
gtcaaattgctacttctattgtgga

SEQ ID NO: 679645 - DNA, 25 bp, Mus musculus
gtcaaattgctagttctattgtgga

SEQ ID NO: 679646 - DNA, 25 bp, Mus musculus
gtcaaatttaatactgcatttatag

SEQ ID NO: 679647 - DNA, 25 bp, Mus musculus
gtcaaatttaattctgcatttatag

SEQ ID NO: 679648 - DNA, 25 bp, Mus musculus
gtcaaatttctgagcatcccggttg

SEQ ID NO: 679649 - DNA, 25 bp, Mus musculus
gtcaaatttctgtgcatcccggttg

SEQ ID NO: 679650 - DNA, 25 bp, Mus musculus
gtcaaatttcttcaaactcactctg

SEQ ID NO: 679651 - DNA, 25 bp, Mus musculus
gtcaaatttcttgaaactcactctg

SEQ ID NO: 679652 - DNA, 25 bp, Mus musculus
gtcaaatttgacaagtgccctaata

SEQ ID NO: 679653 - DNA, 25 bp, Mus musculus
gtcaaatttgactagtgccctaata

SEQ ID NO: 679654 - DNA, 25 bp, Mus musculus
gtcaaatttttgcaaggcgagctta

SEQ ID NO: 679655 - DNA, 25 bp, Mus musculus
gtcaaatttttggaaggcgagctta

SEQ ID NO: 679656 - DNA, 25 bp, Mus musculus
gtcaaattttttctcattcttataa

SEQ ID NO: 679657 - DNA, 25 bp, Mus musculus
gtcaaattttttgtcattcttataa

SEQ ID NO: 679658 - DNA, 25 bp, Mus musculus
gtcaacaacacgcatcactaccttt

SEQ ID NO: 679659 - DNA, 25 bp, Mus musculus
gtcaacaacacggatcactaccttt

SEQ ID NO: 679660 - DNA, 25 bp, Mus musculus
gtcaacaacctacaactacctggga

SEQ ID NO: 679661 - DNA, 25 bp, Mus musculus
gtcaacaacctagaactacctggga

SEQ ID NO: 679662 - DNA, 25 bp, Mus musculus
gtcaacaagataaccaaaattacat

SEQ ID NO: 679663 - DNA, 25 bp, Mus musculus
gtcaacaagatatccaaaattacat

SEQ ID NO: 679664 - DNA, 25 bp, Mus musculus
gtcaacaaggacagcttggtgtccc

SEQ ID NO: 679665 - DNA, 25 bp, Mus musculus
gtcaacaaggactgcttggtgtccc

SEQ ID NO: 679666 - DNA, 25 bp, Mus musculus
gtcaacaatggtagcccagtcgcaa

SEQ ID NO: 679667 - DNA, 25 bp, Mus musculus
gtcaacaatggttgcccagtcgcaa

SEQ ID NO: 679668 - DNA, 25 bp, Mus musculus
gtcaacaccagcaattcatgtctca

SEQ ID NO: 679669 - DNA, 25 bp, Mus musculus
gtcaacaccagctattcatgtctca

SEQ ID NO: 679670 - DNA, 25 bp, Mus musculus
gtcaacacccggactgcagagttct

SEQ ID NO: 679671 - DNA, 25 bp, Mus musculus
gtcaacacccggtctgcagagttct

SEQ ID NO: 679672 - DNA, 25 bp, Mus musculus
gtcaacacgtggcaacctgctgctg

SEQ ID NO: 679673 - DNA, 25 bp, Mus musculus
gtcaacacgtgggaacctgctgctg

SEQ ID NO: 679674 - DNA, 25 bp, Mus musculus
gtcaacactatacgccattggcatc

SEQ ID NO: 679675 - DNA, 25 bp, Mus musculus
gtcaacactataggccattggcatc

SEQ ID NO: 679676 - DNA, 25 bp, Mus musculus
gtcaacactatcactgaagcgatcg

SEQ ID NO: 679677 - DNA, 25 bp, Mus musculus
gtcaacactatctctgaagcgatcg

SEQ ID NO: 679678 - DNA, 25 bp, Mus musculus
gtcaacactcagcatgctttaggct

SEQ ID NO: 679679 - DNA, 25 bp, Mus musculus
gtcaacactcaggatgctttaggct

SEQ ID NO: 679680 - DNA, 25 bp, Mus musculus
gtcaacactcttatgtttaagtagt

SEQ ID NO: 679681 - DNA, 25 bp, Mus musculus
gtcaacactcttttgtttaagtagt

SEQ ID NO: 679682 - DNA, 25 bp, Mus musculus
gtcaacactgacaatgcctatggaa

SEQ ID NO: 679683 - DNA, 25 bp, Mus musculus
gtcaacactgactatgcctatggaa

SEQ ID NO: 679684 - DNA, 25 bp, Mus musculus
gtcaacacttggacttcgggacagt

SEQ ID NO: 679685 - DNA, 25 bp, Mus musculus
gtcaacacttggtcttcgggacagt

SEQ ID NO: 679686 - DNA, 25 bp, Mus musculus
gtcaacagagagatcaaggtccttc

SEQ ID NO: 679687 - DNA, 25 bp, Mus musculus
gtcaacagagagttcaaggtccttc

SEQ ID NO: 679688 - DNA, 25 bp, Mus musculus
gtcaacagagcacaggccaggcagt

SEQ ID NO: 679689 - DNA, 25 bp, Mus musculus
gtcaacagagcagaggccaggcagt

SEQ ID NO: 679690 - DNA, 25 bp, Mus musculus
gtcaacaggcttcgaggcagcactt

SEQ ID NO: 679691 - DNA, 25 bp, Mus musculus
gtcaacaggcttggaggcagcactt

SEQ ID NO: 679692 - DNA, 25 bp, Mus musculus
gtcaacaggtaacacttccgctgct

SEQ ID NO: 679693 - DNA, 25 bp, Mus musculus
gtcaacaggtaagacttccgctgct

SEQ ID NO: 679694 - DNA, 25 bp, Mus musculus
gtcaacaggttactctgaactcgtc

SEQ ID NO: 679695 - DNA, 25 bp, Mus musculus
gtcaacaggttagtctgaactcgtc

SEQ ID NO: 679696 - DNA, 25 bp, Mus musculus
gtcaacagtcatacgccctacagga

SEQ ID NO: 679697 - DNA, 25 bp, Mus musculus
gtcaacagtcattcgccctacagga

SEQ ID NO: 679698 - DNA, 25 bp, Mus musculus
gtcaacagtgtgctaaaatcttcag

SEQ ID NO: 679699 - DNA, 25 bp, Mus musculus
gtcaacagtgtggtaaaatcttcag

SEQ ID NO: 679700 - DNA, 25 bp, Mus musculus
gtcaacagttgcagtttttagctat

SEQ ID NO: 679701 - DNA, 25 bp, Mus musculus
gtcaacagttgctgtttttagctat

SEQ ID NO: 679702 - DNA, 25 bp, Mus musculus
gtcaacatcacaactgtctttctga

SEQ ID NO: 679703 - DNA, 25 bp, Mus musculus
gtcaacatcacatctgtctttctga

SEQ ID NO: 679704 - DNA, 25 bp, Mus musculus
gtcaacatgaagatcaacctctccg

SEQ ID NO: 679705 - DNA, 25 bp, Mus musculus
gtcaacatgaagttcaacctctccg

SEQ ID NO: 679706 - DNA, 25 bp, Mus musculus
gtcaacatgaccactgttccagagg

SEQ ID NO: 679707 - DNA, 25 bp, Mus musculus
gtcaacatgacctctgttccagagg

SEQ ID NO: 679708 - DNA, 25 bp, Mus musculus
gtcaacattaagatggctctgtcaa

SEQ ID NO: 679709 - DNA, 25 bp, Mus musculus
gtcaacattaagttggctctgtcaa

SEQ ID NO: 679710 - DNA, 25 bp, Mus musculus
gtcaacattccacttgtagcaggac

SEQ ID NO: 679711 - DNA, 25 bp, Mus musculus
gtcaacattccagttgtagcaggac

SEQ ID NO: 679712 - DNA, 25 bp, Mus musculus
gtcaacatttacacagcagggctct

SEQ ID NO: 679713 - DNA, 25 bp, Mus musculus
gtcaacatttactcagcagggctct

SEQ ID NO: 679714 - DNA, 25 bp, Mus musculus
gtcaaccaaattcataccatctaat

SEQ ID NO: 679715 - DNA, 25 bp, Mus musculus
gtcaaccaaattgataccatctaat

SEQ ID NO: 679716 - DNA, 25 bp, Mus musculus
gtcaaccacctacacaagtcaaaga

SEQ ID NO: 679717 - DNA, 25 bp, Mus musculus
gtcaaccacctagacaagtcaaaga

SEQ ID NO: 679718 - DNA, 25 bp, Mus musculus
gtcaaccactgaccttcaaacctta

SEQ ID NO: 679719 - DNA, 25 bp, Mus musculus
gtcaaccactgagcttcaaacctta

SEQ ID NO: 679720 - DNA, 25 bp, Mus musculus
gtcaaccacttcaggtgccaggagg

SEQ ID NO: 679721 - DNA, 25 bp, Mus musculus
gtcaaccacttctggtgccaggagg

SEQ ID NO: 679722 - DNA, 25 bp, Mus musculus
gtcaaccagagcctctactggactt

SEQ ID NO: 679723 - DNA, 25 bp, Mus musculus
gtcaaccagagcgtctactggactt

SEQ ID NO: 679724 - DNA, 25 bp, Mus musculus
gtcaaccagctccttgaactggatc

SEQ ID NO: 679725 - DNA, 25 bp, Mus musculus
gtcaaccagctcgttgaactggatc

SEQ ID NO: 679726 - DNA, 25 bp, Mus musculus
gtcaaccaggacaagtcagccacag

SEQ ID NO: 679727 - DNA, 25 bp, Mus musculus
gtcaaccaggactagtcagccacag

SEQ ID NO: 679728 - DNA, 25 bp, Mus musculus
gtcaaccaggctatctgacgtcagt

SEQ ID NO: 679729 - DNA, 25 bp, Mus musculus
gtcaaccaggctttctgacgtcagt

SEQ ID NO: 679730 - DNA, 25 bp, Mus musculus
gtcaaccagggtccttatggccaag

SEQ ID NO: 679731 - DNA, 25 bp, Mus musculus
gtcaaccagggtgcttatggccaag

SEQ ID NO: 679732 - DNA, 25 bp, Mus musculus
gtcaaccagttaatgctgctttctt

SEQ ID NO: 679733 - DNA, 25 bp, Mus musculus
gtcaaccagttattgctgctttctt

SEQ ID NO: 679734 - DNA, 25 bp, Mus musculus
gtcaaccatagcaatacacgcctag

SEQ ID NO: 679735 - DNA, 25 bp, Mus musculus
gtcaaccatagctatacacgcctag

SEQ ID NO: 679736 - DNA, 25 bp, Mus musculus
gtcaaccatcaaatagaatccatcc

SEQ ID NO: 679737 - DNA, 25 bp, Mus musculus
gtcaaccatcaattagaatccatcc

SEQ ID NO: 679738 - DNA, 25 bp, Mus musculus
gtcaaccatccaaaactctgtttgt

SEQ ID NO: 679739 - DNA, 25 bp, Mus musculus
gtcaaccatccataactctgtttgt

SEQ ID NO: 679740 - DNA, 25 bp, Mus musculus
gtcaaccattgacctgaagtccagg

SEQ ID NO: 679741 - DNA, 25 bp, Mus musculus
gtcaaccattgagctgaagtccagg

SEQ ID NO: 679742 - DNA, 25 bp, Mus musculus
gtcaaccatttaatcctcaaagtct

SEQ ID NO: 679743 - DNA, 25 bp, Mus musculus
gtcaaccatttattcctcaaagtct

SEQ ID NO: 679744 - DNA, 25 bp, Mus musculus
gtcaacccagcgctaaaccagtgta

SEQ ID NO: 679745 - DNA, 25 bp, Mus musculus
gtcaacccagcggtaaaccagtgta

SEQ ID NO: 679746 - DNA, 25 bp, Mus musculus
gtcaacccagtgactctgtggagta

SEQ ID NO: 679747 - DNA, 25 bp, Mus musculus
gtcaacccagtgtctctgtggagta

SEQ ID NO: 679748 - DNA, 25 bp, Mus musculus
gtcaacccatggcagaagatttgtt

SEQ ID NO: 679749 - DNA, 25 bp, Mus musculus
gtcaacccatgggagaagatttgtt

SEQ ID NO: 679750 - DNA, 25 bp, Mus musculus
gtcaacccttaccgcattgaaggcc

SEQ ID NO: 679751 - DNA, 25 bp, Mus musculus
gtcaacccttacggcattgaaggcc

SEQ ID NO: 679752 - DNA, 25 bp, Mus musculus
gtcaaccggttcagtgttaatagtt

SEQ ID NO: 679753 - DNA, 25 bp, Mus musculus
gtcaaccggttctgtgttaatagtt

SEQ ID NO: 679754 - DNA, 25 bp, Mus musculus
gtcaaccgtgttactatactctgtg

SEQ ID NO: 679755 - DNA, 25 bp, Mus musculus
gtcaaccgtgtttctatactctgtg

SEQ ID NO: 679756 - DNA, 25 bp, Mus musculus
gtcaacctacagacttactgattat

SEQ ID NO: 679757 - DNA, 25 bp, Mus musculus
gtcaacctacagtcttactgattat

SEQ ID NO: 679758 - DNA, 25 bp, Mus musculus
gtcaacctactgatagtggagattt

SEQ ID NO: 679759 - DNA, 25 bp, Mus musculus
gtcaacctactgttagtggagattt

SEQ ID NO: 679760 - DNA, 25 bp, Mus musculus
gtcaacctagagcaggcaatgccct

SEQ ID NO: 679761 - DNA, 25 bp, Mus musculus
gtcaacctagaggaggcaatgccct

SEQ ID NO: 679762 - DNA, 25 bp, Mus musculus
gtcaacctctagctgatatcagcat

SEQ ID NO: 679763 - DNA, 25 bp, Mus musculus
gtcaacctctaggtgatatcagcat

SEQ ID NO: 679764 - DNA, 25 bp, Mus musculus
gtcaacctgaggctttgatttggtt

SEQ ID NO: 679765 - DNA, 25 bp, Mus musculus
gtcaacctgagggtttgatttggtt

SEQ ID NO: 679766 - DNA, 25 bp, Mus musculus
gtcaacctgctactgtcttgttagt

SEQ ID NO: 679767 - DNA, 25 bp, Mus musculus
gtcaacctgctagtgtcttgttagt

SEQ ID NO: 679768 - DNA, 25 bp, Mus musculus
gtcaacctgtctcacatgtcgggac

SEQ ID NO: 679769 - DNA, 25 bp, Mus musculus
gtcaacctgtctgacatgtcgggac

SEQ ID NO: 679770 - DNA, 25 bp, Mus musculus
gtcaaccttggaccttgtgaaaact

SEQ ID NO: 679771 - DNA, 25 bp, Mus musculus
gtcaaccttggagcttgtgaaaact

SEQ ID NO: 679772 - DNA, 25 bp, Mus musculus
gtcaacgaatgcaccgagggtaccc

SEQ ID NO: 679773 - DNA, 25 bp, Mus musculus
gtcaacgaatgctccgagggtaccc

SEQ ID NO: 679774 - DNA, 25 bp, Mus musculus
gtcaacgacaacaatctggcctatc

SEQ ID NO: 679775 - DNA, 25 bp, Mus musculus
gtcaacgacaactatctggcctatc

SEQ ID NO: 679776 - DNA, 25 bp, Mus musculus
gtcaacgagagcattatctcaagca

SEQ ID NO: 679777 - DNA, 25 bp, Mus musculus
gtcaacgagagctttatctcaagca

SEQ ID NO: 679778 - DNA, 25 bp, Mus musculus
gtcaacgagcggaagtcagagcagc

SEQ ID NO: 679779 - DNA, 25 bp, Mus musculus
gtcaacgagcggtagtcagagcagc

SEQ ID NO: 679780 - DNA, 25 bp, Mus musculus
gtcaacgatgccagttccaaaatgg

SEQ ID NO: 679781 - DNA, 25 bp, Mus musculus
gtcaacgatgcctgttccaaaatgg

SEQ ID NO: 679782 - DNA, 25 bp, Mus musculus
gtcaacgccagcatgttaccacagt

SEQ ID NO: 679783 - DNA, 25 bp, Mus musculus
gtcaacgccagcttgttaccacagt

SEQ ID NO: 679784 - DNA, 25 bp, Mus musculus
gtcaacgctgaacagtgcactactc

SEQ ID NO: 679785 - DNA, 25 bp, Mus musculus
gtcaacgctgaagagtgcactactc

SEQ ID NO: 679786 - DNA, 25 bp, Mus musculus
gtcaacgctgcacaagtgctctcag

SEQ ID NO: 679787 - DNA, 25 bp, Mus musculus
gtcaacgctgcagaagtgctctcag

SEQ ID NO: 679788 - DNA, 25 bp, Mus musculus
gtcaacggacacactttgttattag

SEQ ID NO: 679789 - DNA, 25 bp, Mus musculus
gtcaacggacactctttgttattag

SEQ ID NO: 679790 - DNA, 25 bp, Mus musculus
gtcaacgtccagacacttctaatta

SEQ ID NO: 679791 - DNA, 25 bp, Mus musculus
gtcaacgtccagtcacttctaatta

SEQ ID NO: 679792 - DNA, 25 bp, Mus musculus
gtcaacgtcctccaggagcgagtag

SEQ ID NO: 679793 - DNA, 25 bp, Mus musculus
gtcaacgtcctcgaggagcgagtag

SEQ ID NO: 679794 - DNA, 25 bp, Mus musculus
gtcaacgtgacaagggtaccttaat

SEQ ID NO: 679795 - DNA, 25 bp, Mus musculus
gtcaacgtgacatgggtaccttaat

SEQ ID NO: 679796 - DNA, 25 bp, Mus musculus
gtcaacgtggccatacgcaaaatcg

SEQ ID NO: 679797 - DNA, 25 bp, Mus musculus
gtcaacgtggccttacgcaaaatcg

SEQ ID NO: 679798 - DNA, 25 bp, Mus musculus
gtcaacgtgggtagcatacccaaga

SEQ ID NO: 679799 - DNA, 25 bp, Mus musculus
gtcaacgtgggttgcatacccaaga

SEQ ID NO: 679800 - DNA, 25 bp, Mus musculus
gtcaacgttcaaaagaatactgatt

SEQ ID NO: 679801 - DNA, 25 bp, Mus musculus
gtcaacgttcaatagaatactgatt

SEQ ID NO: 679802 - DNA, 25 bp, Mus musculus
gtcaactacccaagatcaattctgt

SEQ ID NO: 679803 - DNA, 25 bp, Mus musculus
gtcaactacccatgatcaattctgt

SEQ ID NO: 679804 - DNA, 25 bp, Mus musculus
gtcaactacttgcatctcctaaata

SEQ ID NO: 679805 - DNA, 25 bp, Mus musculus
gtcaactacttggatctcctaaata

SEQ ID NO: 679806 - DNA, 25 bp, Mus musculus
gtcaactagctcattcatttttata

SEQ ID NO: 679807 - DNA, 25 bp, Mus musculus
gtcaactagctctttcatttttata

SEQ ID NO: 679808 - DNA, 25 bp, Mus musculus
gtcaactaggtcacacctcctaggt

SEQ ID NO: 679809 - DNA, 25 bp, Mus musculus
gtcaactaggtctcacctcctaggt

SEQ ID NO: 679810 - DNA, 25 bp, Mus musculus
gtcaactatggtagctattttctct

SEQ ID NO: 679811 - DNA, 25 bp, Mus musculus
gtcaactatggttgctattttctct

SEQ ID NO: 679812 - DNA, 25 bp, Mus musculus
gtcaactatttaagctgtgagaaac

SEQ ID NO: 679813 - DNA, 25 bp, Mus musculus
gtcaactatttatgctgtgagaaac

SEQ ID NO: 679814 - DNA, 25 bp, Mus musculus
gtcaactcaaggacgaggccatcgt

SEQ ID NO: 679815 - DNA, 25 bp, Mus musculus
gtcaactcaaggtcgaggccatcgt

SEQ ID NO: 679816 - DNA, 25 bp, Mus musculus
gtcaactcagtcatgtttactcttg

SEQ ID NO: 679817 - DNA, 25 bp, Mus musculus
gtcaactcagtcttgtttactcttg

SEQ ID NO: 679818 - DNA, 25 bp, Mus musculus
gtcaactccattactttgtgtgctg

SEQ ID NO: 679819 - DNA, 25 bp, Mus musculus
gtcaactccatttctttgtgtgctg

SEQ ID NO: 679820 - DNA, 25 bp, Mus musculus
gtcaactcctttatgagcaccctgg

SEQ ID NO: 679821 - DNA, 25 bp, Mus musculus
gtcaactcctttttgagcaccctgg

SEQ ID NO: 679822 - DNA, 25 bp, Mus musculus
gtcaactctaggatggagacctgag

SEQ ID NO: 679823 - DNA, 25 bp, Mus musculus
gtcaactctaggttggagacctgag

SEQ ID NO: 679824 - DNA, 25 bp, Mus musculus
gtcaactcttcaatctattacactc

SEQ ID NO: 679825 - DNA, 25 bp, Mus musculus
gtcaactcttcattctattacactc

SEQ ID NO: 679826 - DNA, 25 bp, Mus musculus
gtcaactcttgacatggtgcacgta

SEQ ID NO: 679827 - DNA, 25 bp, Mus musculus
gtcaactcttgagatggtgcacgta

SEQ ID NO: 679828 - DNA, 25 bp, Mus musculus
gtcaactgaaggactgccatgtgat

SEQ ID NO: 679829 - DNA, 25 bp, Mus musculus
gtcaactgaaggtctgccatgtgat

SEQ ID NO: 679830 - DNA, 25 bp, Mus musculus
gtcaactgaggaactagggtcacgt

SEQ ID NO: 679831 - DNA, 25 bp, Mus musculus
gtcaactgaggatctagggtcacgt

SEQ ID NO: 679832 - DNA, 25 bp, Mus musculus
gtcaactgatgtaccactgagcaca

SEQ ID NO: 679833 - DNA, 25 bp, Mus musculus
gtcaactgatgttccactgagcaca

SEQ ID NO: 679834 - DNA, 25 bp, Mus musculus
gtcaactgattgaggaacgctcggg

SEQ ID NO: 679835 - DNA, 25 bp, Mus musculus
gtcaactgattgtggaacgctcggg

SEQ ID NO: 679836 - DNA, 25 bp, Mus musculus
gtcaactgccttatgggtcacagag

SEQ ID NO: 679837 - DNA, 25 bp, Mus musculus
gtcaactgccttttgggtcacagag

SEQ ID NO: 679838 - DNA, 25 bp, Mus musculus
gtcaactgcttgacctggaagggtt

SEQ ID NO: 679839 - DNA, 25 bp, Mus musculus
gtcaactgcttgtcctggaagggtt

SEQ ID NO: 679840 - DNA, 25 bp, Mus musculus
gtcaactggaggagcagccctgatt

SEQ ID NO: 679841 - DNA, 25 bp, Mus musculus
gtcaactggaggtgcagccctgatt

SEQ ID NO: 679842 - DNA, 25 bp, Mus musculus
gtcaactggatcatctaggctcaaa

SEQ ID NO: 679843 - DNA, 25 bp, Mus musculus
gtcaactggatcttctaggctcaaa

SEQ ID NO: 679844 - DNA, 25 bp, Mus musculus
gtcaactgtagtaccatcttctcta

SEQ ID NO: 679845 - DNA, 25 bp, Mus musculus
gtcaactgtagttccatcttctcta

SEQ ID NO: 679846 - DNA, 25 bp, Mus musculus
gtcaactgtatactattcttctgaa

SEQ ID NO: 679847 - DNA, 25 bp, Mus musculus
gtcaactgtatagtattcttctgaa

SEQ ID NO: 679848 - DNA, 25 bp, Mus musculus
gtcaactgtgacctgaagtccacgc

SEQ ID NO: 679849 - DNA, 25 bp, Mus musculus
gtcaactgtgacgtgaagtccacgc

SEQ ID NO: 679850 - DNA, 25 bp, Mus musculus
gtcaactgtgtacagcagccgtttc

SEQ ID NO: 679851 - DNA, 25 bp, Mus musculus
gtcaactgtgtagagcagccgtttc

SEQ ID NO: 679852 - DNA, 25 bp, Mus musculus
gtcaactgttaccttgtgccttaga

SEQ ID NO: 679853 - DNA, 25 bp, Mus musculus
gtcaactgttacgttgtgccttaga

SEQ ID NO: 679854 - DNA, 25 bp, Mus musculus
gtcaactgttttcaagttcagcatt

SEQ ID NO: 679855 - DNA, 25 bp, Mus musculus
gtcaactgttttgaagttcagcatt

SEQ ID NO: 679856 - DNA, 25 bp, Mus musculus
gtcaacttcacaagtactgctcttc

SEQ ID NO: 679857 - DNA, 25 bp, Mus musculus
gtcaacttcacatgtactgctcttc

SEQ ID NO: 679858 - DNA, 25 bp, Mus musculus
gtcaacttcagtaaaagcctgcatg

SEQ ID NO: 679859 - DNA, 25 bp, Mus musculus
gtcaacttcagtaacagggcccagt

SEQ ID NO: 679860 - DNA, 25 bp, Mus musculus
gtcaacttcagttaaagcctgcatg

SEQ ID NO: 679861 - DNA, 25 bp, Mus musculus
gtcaacttcagttacagggcccagt

SEQ ID NO: 679862 - DNA, 25 bp, Mus musculus
gtcaacttcatgctcaatgactttc

SEQ ID NO: 679863 - DNA, 25 bp, Mus musculus
gtcaacttcatggtcaatgactttc

SEQ ID NO: 679864 - DNA, 25 bp, Mus musculus
gtcaacttctaaacatgtttctagg

SEQ ID NO: 679865 - DNA, 25 bp, Mus musculus
gtcaacttctaatcatgtttctagg

SEQ ID NO: 679866 - DNA, 25 bp, Mus musculus
gtcaacttctacaatgtcagttcaa

SEQ ID NO: 679867 - DNA, 25 bp, Mus musculus
gtcaacttctactatgtcagttcaa

SEQ ID NO: 679868 - DNA, 25 bp, Mus musculus
gtcaacttctctcctgtaaacttaa

SEQ ID NO: 679869 - DNA, 25 bp, Mus musculus
gtcaacttctctgctgtaaacttaa

SEQ ID NO: 679870 - DNA, 25 bp, Mus musculus
gtcaacttgaccatcaacttgcttg

SEQ ID NO: 679871 - DNA, 25 bp, Mus musculus
gtcaacttgaccttcaacttgcttg

SEQ ID NO: 679872 - DNA, 25 bp, Mus musculus
gtcaacttgattcacctgggaaagg

SEQ ID NO: 679873 - DNA, 25 bp, Mus musculus
gtcaacttgattgacctgggaaagg

SEQ ID NO: 679874 - DNA, 25 bp, Mus musculus
gtcaacttgggcaactgtggctaga

SEQ ID NO: 679875 - DNA, 25 bp, Mus musculus
gtcaacttgggctactgtggctaga

SEQ ID NO: 679876 - DNA, 25 bp, Mus musculus
gtcaacttgtgcatacatatctcac

SEQ ID NO: 679877 - DNA, 25 bp, Mus musculus
gtcaacttgtgcttacatatctcac

SEQ ID NO: 679878 - DNA, 25 bp, Mus musculus
gtcaactttctcatcatgatggctg

SEQ ID NO: 679879 - DNA, 25 bp, Mus musculus
gtcaactttctcttcatgatggctg

SEQ ID NO: 679880 - DNA, 25 bp, Mus musculus
gtcaactttcttcggacattggcag

SEQ ID NO: 679881 - DNA, 25 bp, Mus musculus
gtcaactttcttgggacattggcag

SEQ ID NO: 679882 - DNA, 25 bp, Mus musculus
gtcaactttgtgactcggcaacaca

SEQ ID NO: 679883 - DNA, 25 bp, Mus musculus
gtcaactttgtgtctcggcaacaca

SEQ ID NO: 679884 - DNA, 25 bp, Mus musculus
gtcaactttgttacttctcacttaa

SEQ ID NO: 679885 - DNA, 25 bp, Mus musculus
gtcaactttgtttcttctcacttaa

SEQ ID NO: 679886 - DNA, 25 bp, Mus musculus
gtcaactttttaaattgccagaact

SEQ ID NO: 679887 - DNA, 25 bp, Mus musculus
gtcaactttttatattgccagaact

SEQ ID NO: 679888 - DNA, 25 bp, Mus musculus
gtcaagaaacagagccatttgagta

SEQ ID NO: 679889 - DNA, 25 bp, Mus musculus
gtcaagaaacagtgccatttgagta

SEQ ID NO: 679890 - DNA, 25 bp, Mus musculus
gtcaagaaagccctggccaacgcta

SEQ ID NO: 679891 - DNA, 25 bp, Mus musculus
gtcaagaaagccgtggccaacgcta

SEQ ID NO: 679892 - DNA, 25 bp, Mus musculus
gtcaagaaagtacgtccaaacatgg

SEQ ID NO: 679893 - DNA, 25 bp, Mus musculus
gtcaagaaagtaggtccaaacatgg

SEQ ID NO: 679894 - DNA, 25 bp, Mus musculus
gtcaagaaataccagtggaatcccc

SEQ ID NO: 679895 - DNA, 25 bp, Mus musculus
gtcaagaaatacgagtggaatcccc

SEQ ID NO: 679896 - DNA, 25 bp, Mus musculus
gtcaagaacagcatgggtacacaat

SEQ ID NO: 679897 - DNA, 25 bp, Mus musculus
gtcaagaacagcttgggtacacaat

SEQ ID NO: 679898 - DNA, 25 bp, Mus musculus
gtcaagaactacagagtcccaacct

SEQ ID NO: 679899 - DNA, 25 bp, Mus musculus
gtcaagaactactgagtcccaacct

SEQ ID NO: 679900 - DNA, 25 bp, Mus musculus
gtcaagaactcaagggacctggaag

SEQ ID NO: 679901 - DNA, 25 bp, Mus musculus
gtcaagaactcatgggacctggaag

SEQ ID NO: 679902 - DNA, 25 bp, Mus musculus
gtcaagaaggttaaagactacgtct

SEQ ID NO: 679903 - DNA, 25 bp, Mus musculus
gtcaagaaggttagtcctgcacatt

SEQ ID NO: 679904 - DNA, 25 bp, Mus musculus
gtcaagaaggtttaagactacgtct

SEQ ID NO: 679905 - DNA, 25 bp, Mus musculus
gtcaagaaggtttgtcctgcacatt

SEQ ID NO: 679906 - DNA, 25 bp, Mus musculus
gtcaagaagttgagaccctcccagt

SEQ ID NO: 679907 - DNA, 25 bp, Mus musculus
gtcaagaagttgtgaccctcccagt

SEQ ID NO: 679908 - DNA, 25 bp, Mus musculus
gtcaagaatgagatcccctctgtta

SEQ ID NO: 679909 - DNA, 25 bp, Mus musculus
gtcaagaatgagttcccctctgtta

SEQ ID NO: 679910 - DNA, 25 bp, Mus musculus
gtcaagacaagaatgaggcttcacc

SEQ ID NO: 679911 - DNA, 25 bp, Mus musculus
gtcaagacaagattgaggcttcacc

SEQ ID NO: 679912 - DNA, 25 bp, Mus musculus
gtcaagacacacaggtaaatttctg

SEQ ID NO: 679913 - DNA, 25 bp, Mus musculus
gtcaagacacactggtaaatttctg

SEQ ID NO: 679914 - DNA, 25 bp, Mus musculus
gtcaagacacctatctggaaagcat

SEQ ID NO: 679915 - DNA, 25 bp, Mus musculus
gtcaagacacctttctggaaagcat

SEQ ID NO: 679916 - DNA, 25 bp, Mus musculus
gtcaagacaggtcagaaaatcctta

SEQ ID NO: 679917 - DNA, 25 bp, Mus musculus
gtcaagacaggtgagaaaatcctta

SEQ ID NO: 679918 - DNA, 25 bp, Mus musculus
gtcaagacagttcagtgcatacttc

SEQ ID NO: 679919 - DNA, 25 bp, Mus musculus
gtcaagacagttgagtgcatacttc

SEQ ID NO: 679920 - DNA, 25 bp, Mus musculus
gtcaagaccgcaagggatccagtct

SEQ ID NO: 679921 - DNA, 25 bp, Mus musculus
gtcaagaccgcatgggatccagtct

SEQ ID NO: 679922 - DNA, 25 bp, Mus musculus
gtcaagactagacttgccgatgttc

SEQ ID NO: 679923 - DNA, 25 bp, Mus musculus
gtcaagactagagttgccgatgttc

SEQ ID NO: 679924 - DNA, 25 bp, Mus musculus
gtcaagactatccatcacagtgtgt

SEQ ID NO: 679925 - DNA, 25 bp, Mus musculus
gtcaagactatcgatcacagtgtgt

SEQ ID NO: 679926 - DNA, 25 bp, Mus musculus
gtcaagactcgtcatcttagccact

SEQ ID NO: 679927 - DNA, 25 bp, Mus musculus
gtcaagactcgtgatcttagccact

SEQ ID NO: 679928 - DNA, 25 bp, Mus musculus
gtcaagactgccaggcctagcactc

SEQ ID NO: 679929 - DNA, 25 bp, Mus musculus
gtcaagactgcctggcctagcactc

SEQ ID NO: 679930 - DNA, 25 bp, Mus musculus
gtcaagactttaaagctgctctcca

SEQ ID NO: 679931 - DNA, 25 bp, Mus musculus
gtcaagactttatagctgctctcca

SEQ ID NO: 679932 - DNA, 25 bp, Mus musculus
gtcaagagacgcactcagctgactt

SEQ ID NO: 679933 - DNA, 25 bp, Mus musculus
gtcaagagacgctctcagctgactt

SEQ ID NO: 679934 - DNA, 25 bp, Mus musculus
gtcaagagagctattacccctatgt

SEQ ID NO: 679935 - DNA, 25 bp, Mus musculus
gtcaagagagcttttacccctatgt

SEQ ID NO: 679936 - DNA, 25 bp, Mus musculus
gtcaagagcatgcagtgcacttcct

SEQ ID NO: 679937 - DNA, 25 bp, Mus musculus
gtcaagagcatggagtgcacttcct

SEQ ID NO: 679938 - DNA, 25 bp, Mus musculus
gtcaagagccagcttcaatcccagt

SEQ ID NO: 679939 - DNA, 25 bp, Mus musculus
gtcaagagccaggttcaatcccagt

SEQ ID NO: 679940 - DNA, 25 bp, Mus musculus
gtcaagagcttacacatccgtatgt

SEQ ID NO: 679941 - DNA, 25 bp, Mus musculus
gtcaagagcttagacatccgtatgt

SEQ ID NO: 679942 - DNA, 25 bp, Mus musculus
gtcaagagtatgcaggcacacacct

SEQ ID NO: 679943 - DNA, 25 bp, Mus musculus
gtcaagagtatggaggcacacacct

SEQ ID NO: 679944 - DNA, 25 bp, Mus musculus
gtcaagatacttcagcccagtggtg

SEQ ID NO: 679945 - DNA, 25 bp, Mus musculus
gtcaagatacttgagcccagtggtg

SEQ ID NO: 679946 - DNA, 25 bp, Mus musculus
gtcaagatcaacacgaaagccaacg

SEQ ID NO: 679947 - DNA, 25 bp, Mus musculus
gtcaagatcaactcgaaagccaacg

SEQ ID NO: 679948 - DNA, 25 bp, Mus musculus
gtcaagatccaacatgctcaccggc

SEQ ID NO: 679949 - DNA, 25 bp, Mus musculus
gtcaagatccaagatgctcaccggc

SEQ ID NO: 679950 - DNA, 25 bp, Mus musculus
gtcaagatccttacttggatccgaa

SEQ ID NO: 679951 - DNA, 25 bp, Mus musculus
gtcaagatcctttcttggatccgaa

SEQ ID NO: 679952 - DNA, 20 bp, Mus musculus
gtcaagatgctaccgttcag

SEQ ID NO: 679953 - DNA, 25 bp, Mus musculus
gtcaagattaagacataccagcaaa

SEQ ID NO: 679954 - DNA, 25 bp, Mus musculus
gtcaagattaagtcataccagcaaa

SEQ ID NO: 679955 - DNA, 25 bp, Mus musculus
gtcaagattatgcattttacaggta

SEQ ID NO: 679956 - DNA, 25 bp, Mus musculus
gtcaagattatggattttacaggta

SEQ ID NO: 679957 - DNA, 25 bp, Mus musculus
gtcaagattcaaacagttgcagcca

SEQ ID NO: 679958 - DNA, 25 bp, Mus musculus
gtcaagattcaatcagttgcagcca

SEQ ID NO: 679959 - DNA, 25 bp, Mus musculus
gtcaagcaaatgagtcacagacata

SEQ ID NO: 679960 - DNA, 25 bp, Mus musculus
gtcaagcaaatgtgtcacagacata

SEQ ID NO: 679961 - DNA, 25 bp, Mus musculus
gtcaagcaaattagcatccagcaat

SEQ ID NO: 679962 - DNA, 25 bp, Mus musculus
gtcaagcaaatttgcatccagcaat

SEQ ID NO: 679963 - DNA, 25 bp, Mus musculus
gtcaagcaatgcagggacatggtct

SEQ ID NO: 679964 - DNA, 25 bp, Mus musculus
gtcaagcaatgctgggacatggtct

SEQ ID NO: 679965 - DNA, 25 bp, Mus musculus
gtcaagcaccccagaataattcagt

SEQ ID NO: 679966 - DNA, 25 bp, Mus musculus
gtcaagcacccctgaataattcagt

SEQ ID NO: 679967 - DNA, 25 bp, Mus musculus
gtcaagcacggcatggttttcagat

SEQ ID NO: 679968 - DNA, 25 bp, Mus musculus
gtcaagcacggcttggttttcagat

SEQ ID NO: 679969 - DNA, 25 bp, Mus musculus
gtcaagcactctaatgttattcaat

SEQ ID NO: 679970 - DNA, 25 bp, Mus musculus
gtcaagcactcttatgttattcaat

SEQ ID NO: 679971 - DNA, 25 bp, Mus musculus
gtcaagcacttaataggtcaacaac

SEQ ID NO: 679972 - DNA, 25 bp, Mus musculus
gtcaagcacttattaggtcaacaac

SEQ ID NO: 679973 - DNA, 25 bp, Mus musculus
gtcaagcacttgacactgggctcaa

SEQ ID NO: 679974 - DNA, 25 bp, Mus musculus
gtcaagcacttgtcactgggctcaa

SEQ ID NO: 679975 - DNA, 25 bp, Mus musculus
gtcaagcagagaccaacctcaggtt

SEQ ID NO: 679976 - DNA, 25 bp, Mus musculus
gtcaagcagagagcaacctcaggtt

SEQ ID NO: 679977 - DNA, 25 bp, Mus musculus
gtcaagcaggagattgtttgcaaat

SEQ ID NO: 679978 - DNA, 25 bp, Mus musculus
gtcaagcaggagtttgtttgcaaat

SEQ ID NO: 679979 - DNA, 25 bp, Mus musculus
gtcaagcagggactacaagccagcc

SEQ ID NO: 679980 - DNA, 25 bp, Mus musculus
gtcaagcagggagtacaagccagcc

SEQ ID NO: 679981 - DNA, 25 bp, Mus musculus
gtcaagcatgcgacagcatcgccag

SEQ ID NO: 679982 - DNA, 25 bp, Mus musculus
gtcaagcatgcgtcagcatcgccag

SEQ ID NO: 679983 - DNA, 25 bp, Mus musculus
gtcaagcattggataaagggacacc

SEQ ID NO: 679984 - DNA, 25 bp, Mus musculus
gtcaagcattggttaaagggacacc

SEQ ID NO: 679985 - DNA, 25 bp, Mus musculus
gtcaagccaaggactagctacggag

SEQ ID NO: 679986 - DNA, 25 bp, Mus musculus
gtcaagccaaggtctagctacggag

SEQ ID NO: 679987 - DNA, 25 bp, Mus musculus
gtcaagccactaattgtttgcatta

SEQ ID NO: 679988 - DNA, 25 bp, Mus musculus
gtcaagccactatttgtttgcatta

SEQ ID NO: 679989 - DNA, 25 bp, Mus musculus
gtcaagcccatgaggttgtacatcc

SEQ ID NO: 679990 - DNA, 25 bp, Mus musculus
gtcaagcccatgtggttgtacatcc

SEQ ID NO: 679991 - DNA, 25 bp, Mus musculus
gtcaagccccaaaacatggtgggca

SEQ ID NO: 679992 - DNA, 25 bp, Mus musculus
gtcaagccccaatacatggtgggca

SEQ ID NO: 679993 - DNA, 25 bp, Mus musculus
gtcaagccctgtcgtgtatcagcaa

SEQ ID NO: 679994 - DNA, 25 bp, Mus musculus
gtcaagccctgtggtgtatcagcaa

SEQ ID NO: 679995 - DNA, 25 bp, Mus musculus
gtcaagccctttcccagagactggg

SEQ ID NO: 679996 - DNA, 25 bp, Mus musculus
gtcaagccctttgccagagactggg

SEQ ID NO: 679997 - DNA, 25 bp, Mus musculus
gtcaagcctgcaatatattttccaa

SEQ ID NO: 679998 - DNA, 25 bp, Mus musculus
gtcaagcctgcattatattttccaa

SEQ ID NO: 679999 - DNA, 25 bp, Mus musculus
gtcaagcgccttcgtgagacatcac

SEQ ID NO: 680000 - DNA, 25 bp, Mus musculus
gtcaagcgccttggtgagacatcac

SEQ ID NO: 680001 - DNA, 25 bp, Mus musculus
gtcaagcgggttacaaaggaagcct

SEQ ID NO: 680002 - DNA, 25 bp, Mus musculus
gtcaagcgggtttcaaaggaagcct

SEQ ID NO: 680003 - DNA, 25 bp, Mus musculus
gtcaagcgttccctcacgagaataa

SEQ ID NO: 680004 - DNA, 25 bp, Mus musculus
gtcaagcgttccgtcacgagaataa

SEQ ID NO: 680005 - DNA, 25 bp, Mus musculus
gtcaagcgttgcatttctacccaca

SEQ ID NO: 680006 - DNA, 25 bp, Mus musculus
gtcaagcgttgcttttctacccaca

SEQ ID NO: 680007 - DNA, 25 bp, Mus musculus
gtcaagctcataaggtctgaacaca

SEQ ID NO: 680008 - DNA, 25 bp, Mus musculus
gtcaagctcatatggtctgaacaca

SEQ ID NO: 680009 - DNA, 25 bp, Mus musculus
gtcaagctctttcctatagttctca

SEQ ID NO: 680010 - DNA, 25 bp, Mus musculus
gtcaagctctttctgttttgttcaa

SEQ ID NO: 680011 - DNA, 25 bp, Mus musculus
gtcaagctctttgctatagttctca

SEQ ID NO: 680012 - DNA, 25 bp, Mus musculus
gtcaagctctttgtgttttgttcaa

SEQ ID NO: 680013 - DNA, 25 bp, Mus musculus
gtcaagctgaggcacatccatgctc

SEQ ID NO: 680014 - DNA, 25 bp, Mus musculus
gtcaagctgagggacatccatgctc

SEQ ID NO: 680015 - DNA, 25 bp, Mus musculus
gtcaagctgctcatgggccgaagat

SEQ ID NO: 680016 - DNA, 25 bp, Mus musculus
gtcaagctgctcttgggccgaagat

SEQ ID NO: 680017 - DNA, 25 bp, Mus musculus
gtcaagctggaaaactgtgagaact

SEQ ID NO: 680018 - DNA, 25 bp, Mus musculus
gtcaagctggaatactgtgagaact

SEQ ID NO: 680019 - DNA, 25 bp, Mus musculus
gtcaagctggtgaagcctgcagtcg

SEQ ID NO: 680020 - DNA, 25 bp, Mus musculus
gtcaagctggtgtagcctgcagtcg

SEQ ID NO: 680021 - DNA, 25 bp, Mus musculus
gtcaagctgtttcctctatcctggt

SEQ ID NO: 680022 - DNA, 25 bp, Mus musculus
gtcaagctgtttgctctatcctggt

SEQ ID NO: 680023 - DNA, 25 bp, Mus musculus
gtcaagcttgctcatttaatttttt

SEQ ID NO: 680024 - DNA, 25 bp, Mus musculus
gtcaagcttgctgatttaatttttt

SEQ ID NO: 680025 - DNA, 25 bp, Mus musculus
gtcaagcttggtcttggcactcaag

SEQ ID NO: 680026 - DNA, 25 bp, Mus musculus
gtcaagcttggtgttggcactcaag

SEQ ID NO: 680027 - DNA, 25 bp, Mus musculus
gtcaagctttttctctgtcacttat

SEQ ID NO: 680028 - DNA, 25 bp, Mus musculus
gtcaagctttttgtctgtcacttat

SEQ ID NO: 680029 - DNA, 25 bp, Mus musculus
gtcaaggaaactaagaaaccagtgt

SEQ ID NO: 680030 - DNA, 25 bp, Mus musculus
gtcaaggaaactaccctatgtttga

SEQ ID NO: 680031 - DNA, 25 bp, Mus musculus
gtcaaggaaacttagaaaccagtgt

SEQ ID NO: 680032 - DNA, 25 bp, Mus musculus
gtcaaggaaacttccctatgtttga

SEQ ID NO: 680033 - DNA, 25 bp, Mus musculus
gtcaaggacagccatatctcaatag

SEQ ID NO: 680034 - DNA, 25 bp, Mus musculus
gtcaaggacagcgatatctcaatag

SEQ ID NO: 680035 - DNA, 25 bp, Mus musculus
gtcaaggaggacacaggctggtact

SEQ ID NO: 680036 - DNA, 25 bp, Mus musculus
gtcaaggaggactcaggctggtact

SEQ ID NO: 680037 - DNA, 25 bp, Mus musculus
gtcaaggattccaactcagagacat

SEQ ID NO: 680038 - DNA, 25 bp, Mus musculus
gtcaaggattcctactcagagacat

SEQ ID NO: 680039 - DNA, 25 bp, Mus musculus
gtcaaggattttctttgggccaaat

SEQ ID NO: 680040 - DNA, 25 bp, Mus musculus
gtcaaggattttgtttgggccaaat

SEQ ID NO: 680041 - DNA, 25 bp, Mus musculus
gtcaaggcaaggagcacaacccatt

SEQ ID NO: 680042 - DNA, 25 bp, Mus musculus
gtcaaggcaaggtgcacaacccatt

SEQ ID NO: 680043 - DNA, 25 bp, Mus musculus
gtcaaggcacccctggctgcaagga

SEQ ID NO: 680044 - DNA, 25 bp, Mus musculus
gtcaaggcacccgtggctgcaagga

SEQ ID NO: 680045 - DNA, 25 bp, Mus musculus
gtcaaggcagccaagaatcccattc

SEQ ID NO: 680046 - DNA, 25 bp, Mus musculus
gtcaaggcagcctagaatcccattc

SEQ ID NO: 680047 - DNA, 25 bp, Mus musculus
gtcaaggcatatctggcctccggga

SEQ ID NO: 680048 - DNA, 25 bp, Mus musculus
gtcaaggcatatgtggcctccggga

SEQ ID NO: 680049 - DNA, 25 bp, Mus musculus
gtcaaggcatgtatactagatattt

SEQ ID NO: 680050 - DNA, 25 bp, Mus musculus
gtcaaggcatgtttactagatattt

SEQ ID NO: 680051 - DNA, 25 bp, Mus musculus
gtcaaggcctacagacttgtggcat

SEQ ID NO: 680052 - DNA, 25 bp, Mus musculus
gtcaaggcctactgacttgtggcat

SEQ ID NO: 680053 - DNA, 25 bp, Mus musculus
gtcaaggcctttaacactcgatgct

SEQ ID NO: 680054 - DNA, 25 bp, Mus musculus
gtcaaggccttttacactcgatgct

SEQ ID NO: 680055 - DNA, 25 bp, Mus musculus
gtcaaggctcagcttggcaacagct

SEQ ID NO: 680056 - DNA, 25 bp, Mus musculus
gtcaaggctcaggttggcaacagct

SEQ ID NO: 680057 - DNA, 25 bp, Mus musculus
gtcaaggctcgcctggagatggaga

SEQ ID NO: 680058 - DNA, 25 bp, Mus musculus
gtcaaggctcgcgtggagatggaga

SEQ ID NO: 680059 - DNA, 25 bp, Mus musculus
gtcaaggctgcactgtgtgacctgc

SEQ ID NO: 680060 - DNA, 25 bp, Mus musculus
gtcaaggctgcagtgtgtgacctgc

SEQ ID NO: 680061 - DNA, 25 bp, Mus musculus
gtcaaggctggaccttacaatgtct

SEQ ID NO: 680062 - DNA, 25 bp, Mus musculus
gtcaaggctggagcttacaatgtct

SEQ ID NO: 680063 - DNA, 25 bp, Mus musculus
gtcaaggctgtaaacgtgcgcaaag

SEQ ID NO: 680064 - DNA, 25 bp, Mus musculus
gtcaaggctgtatacgtgcgcaaag

SEQ ID NO: 680065 - DNA, 25 bp, Mus musculus
gtcaagggaagccaggccagaaccc

SEQ ID NO: 680066 - DNA, 25 bp, Mus musculus
gtcaagggaagcgaggccagaaccc

SEQ ID NO: 680067 - DNA, 25 bp, Mus musculus
gtcaagggacaaccgggacatcttt

SEQ ID NO: 680068 - DNA, 25 bp, Mus musculus
gtcaagggacaagcgggacatcttt

SEQ ID NO: 680069 - DNA, 25 bp, Mus musculus
gtcaagggaggccaccagcttttat

SEQ ID NO: 680070 - DNA, 25 bp, Mus musculus
gtcaagggaggcgaccagcttttat

SEQ ID NO: 680071 - DNA, 25 bp, Mus musculus
gtcaagggcaataacgtaagcaaca

SEQ ID NO: 680072 - DNA, 25 bp, Mus musculus
gtcaagggcaattacgtaagcaaca

SEQ ID NO: 680073 - DNA, 25 bp, Mus musculus
gtcaagggctaacaattattccata

SEQ ID NO: 680074 - DNA, 25 bp, Mus musculus
gtcaagggctaagaattattccata

SEQ ID NO: 680075 - DNA, 25 bp, Mus musculus
gtcaagggcttacgtcaggcctgtt

SEQ ID NO: 680076 - DNA, 25 bp, Mus musculus
gtcaagggcttaggtcaggcctgtt

SEQ ID NO: 680077 - DNA, 25 bp, Mus musculus
gtcaagggtcacattaaaaggctct

SEQ ID NO: 680078 - DNA, 25 bp, Mus musculus
gtcaagggtcactttaaaaggctct

SEQ ID NO: 680079 - DNA, 25 bp, Mus musculus
gtcaagggttatatgttgcgcacca

SEQ ID NO: 680080 - DNA, 25 bp, Mus musculus
gtcaagggttatttgttgcgcacca

SEQ ID NO: 680081 - DNA, 25 bp, Mus musculus
gtcaaggtaaggaacagatgcacat

SEQ ID NO: 680082 - DNA, 25 bp, Mus musculus
gtcaaggtaaggtacagatgcacat

SEQ ID NO: 680083 - DNA, 25 bp, Mus musculus
gtcaaggtcctgatagttccgaggg

SEQ ID NO: 680084 - DNA, 25 bp, Mus musculus
gtcaaggtcctgttagttccgaggg

SEQ ID NO: 680085 - DNA, 25 bp, Mus musculus
gtcaaggtgaataactggaactcca

SEQ ID NO: 680086 - DNA, 25 bp, Mus musculus
gtcaaggtgaattactggaactcca

SEQ ID NO: 680087 - DNA, 25 bp, Mus musculus
gtcaaggtggtcatcctggagaagc

SEQ ID NO: 680088 - DNA, 25 bp, Mus musculus
gtcaaggtggtcttcctggagaagc

SEQ ID NO: 680089 - DNA, 25 bp, Mus musculus
gtcaaggtggtgacctccacagatg

SEQ ID NO: 680090 - DNA, 25 bp, Mus musculus
gtcaaggtggtgtcctccacagatg

SEQ ID NO: 680091 - DNA, 25 bp, Mus musculus
gtcaaggtgtatcctccgagtatct

SEQ ID NO: 680092 - DNA, 25 bp, Mus musculus
gtcaaggtgtatgctccgagtatct

SEQ ID NO: 680093 - DNA, 25 bp, Mus musculus
gtcaaggttaatagcccaattttga

SEQ ID NO: 680094 - DNA, 25 bp, Mus musculus
gtcaaggttaattgcccaattttga

SEQ ID NO: 680095 - DNA, 25 bp, Mus musculus
gtcaaggttgacacgctgagccagc

SEQ ID NO: 680096 - DNA, 25 bp, Mus musculus
gtcaaggttgactcgctgagccagc

SEQ ID NO: 680097 - DNA, 25 bp, Mus musculus
gtcaaggttgagctagtttcctcca

SEQ ID NO: 680098 - DNA, 25 bp, Mus musculus
gtcaaggttgaggtagtttcctcca

SEQ ID NO: 680099 - DNA, 25 bp, Mus musculus
gtcaaggttggaccgcatacaccaa

SEQ ID NO: 680100 - DNA, 25 bp, Mus musculus
gtcaaggttggagcgcatacaccaa

SEQ ID NO: 680101 - DNA, 25 bp, Mus musculus
gtcaagtacctaacaatgaagtatg

SEQ ID NO: 680102 - DNA, 25 bp, Mus musculus
gtcaagtacctatcaatgaagtatg

SEQ ID NO: 680103 - DNA, 25 bp, Mus musculus
gtcaagtacttgatgtatgttcata

SEQ ID NO: 680104 - DNA, 25 bp, Mus musculus
gtcaagtacttgttgtatgttcata

SEQ ID NO: 680105 - DNA, 25 bp, Mus musculus
gtcaagtagagcagcaaaccaccac

SEQ ID NO: 680106 - DNA, 25 bp, Mus musculus
gtcaagtagagctgcaaaccaccac

SEQ ID NO: 680107 - DNA, 25 bp, Mus musculus
gtcaagtagggtcttgttgctccta

SEQ ID NO: 680108 - DNA, 25 bp, Mus musculus
gtcaagtagggtgttgttgctccta

SEQ ID NO: 680109 - DNA, 25 bp, Mus musculus
gtcaagtatatgaactggcccctct

SEQ ID NO: 680110 - DNA, 25 bp, Mus musculus
gtcaagtatatgtactggcccctct

SEQ ID NO: 680111 - DNA, 25 bp, Mus musculus
gtcaagtccagtcgatatatccata

SEQ ID NO: 680112 - DNA, 25 bp, Mus musculus
gtcaagtccagtggatatatccata

SEQ ID NO: 680113 - DNA, 25 bp, Mus musculus
gtcaagtcctacaagaggcaggctg

SEQ ID NO: 680114 - DNA, 25 bp, Mus musculus
gtcaagtcctactagaggcaggctg

SEQ ID NO: 680115 - DNA, 25 bp, Mus musculus
gtcaagtcctctcgctcatttaaac

SEQ ID NO: 680116 - DNA, 25 bp, Mus musculus
gtcaagtcctctggctcatttaaac

SEQ ID NO: 680117 - DNA, 25 bp, Mus musculus
gtcaagtcctgacaaccagaggtga

SEQ ID NO: 680118 - DNA, 25 bp, Mus musculus
gtcaagtcctgagaaccagaggtga

SEQ ID NO: 680119 - DNA, 25 bp, Mus musculus
gtcaagtccttaacagatcattgct

SEQ ID NO: 680120 - DNA, 25 bp, Mus musculus
gtcaagtccttatcagatcattgct

SEQ ID NO: 680121 - DNA, 25 bp, Mus musculus
gtcaagtctagcccatgattataca

SEQ ID NO: 680122 - DNA, 25 bp, Mus musculus
gtcaagtctagcgcatgattataca

SEQ ID NO: 680123 - DNA, 25 bp, Mus musculus
gtcaagtctcaaattatttttccac

SEQ ID NO: 680124 - DNA, 25 bp, Mus musculus
gtcaagtctcaatttatttttccac

SEQ ID NO: 680125 - DNA, 25 bp, Mus musculus
gtcaagtctgacacactgtcttggt

SEQ ID NO: 680126 - DNA, 25 bp, Mus musculus
gtcaagtctgactcactgtcttggt

SEQ ID NO: 680127 - DNA, 25 bp, Mus musculus
gtcaagtcttcccaggttcagtggc

SEQ ID NO: 680128 - DNA, 25 bp, Mus musculus
gtcaagtcttccgaggttcagtggc

SEQ ID NO: 680129 - DNA, 25 bp, Mus musculus
gtcaagtcttgaacagtacagtatg

SEQ ID NO: 680130 - DNA, 25 bp, Mus musculus
gtcaagtcttgatcagtacagtatg

SEQ ID NO: 680131 - DNA, 25 bp, Mus musculus
gtcaagtcttggcttatagatcaaa

SEQ ID NO: 680132 - DNA, 25 bp, Mus musculus
gtcaagtcttgggttatagatcaaa

SEQ ID NO: 680133 - DNA, 25 bp, Mus musculus
gtcaagtgacccaatgcctgatcct

SEQ ID NO: 680134 - DNA, 25 bp, Mus musculus
gtcaagtgaccctatgcctgatcct

SEQ ID NO: 680135 - DNA, 25 bp, Mus musculus
gtcaagtgagccatgttttctctcc

SEQ ID NO: 680136 - DNA, 25 bp, Mus musculus
gtcaagtgagccttgttttctctcc

SEQ ID NO: 680137 - DNA, 25 bp, Mus musculus
gtcaagtgataaatgtctttttctt

SEQ ID NO: 680138 - DNA, 25 bp, Mus musculus
gtcaagtgataattgtctttttctt

SEQ ID NO: 680139 - DNA, 25 bp, Mus musculus
gtcaagtgcgctaatttatcttcag

SEQ ID NO: 680140 - DNA, 25 bp, Mus musculus
gtcaagtgcgcttatttatcttcag

SEQ ID NO: 680141 - DNA, 25 bp, Mus musculus
gtcaagtggctcactactaactcca

SEQ ID NO: 680142 - DNA, 25 bp, Mus musculus
gtcaagtggctctctactaactcca

SEQ ID NO: 680143 - DNA, 25 bp, Mus musculus
gtcaagtgggcaatcctttttcatg

SEQ ID NO: 680144 - DNA, 25 bp, Mus musculus
gtcaagtgggcattcctttttcatg

SEQ ID NO: 680145 - DNA, 25 bp, Mus musculus
gtcaagtgtaacaaactcctaaggg

SEQ ID NO: 680146 - DNA, 25 bp, Mus musculus
gtcaagtgtaactaactcctaaggg

SEQ ID NO: 680147 - DNA, 25 bp, Mus musculus
gtcaagtgtagtcttgcatgcctta

SEQ ID NO: 680148 - DNA, 25 bp, Mus musculus
gtcaagtgtagtgttgcatgcctta

SEQ ID NO: 680149 - DNA, 25 bp, Mus musculus
gtcaagtgtgggaaagagcaagcac

SEQ ID NO: 680150 - DNA, 25 bp, Mus musculus
gtcaagtgtgggtaagagcaagcac

SEQ ID NO: 680151 - DNA, 25 bp, Mus musculus
gtcaagtgtggtctcatggtgaaca

SEQ ID NO: 680152 - DNA, 25 bp, Mus musculus
gtcaagtgtggtgtcatggtgaaca

SEQ ID NO: 680153 - DNA, 25 bp, Mus musculus
gtcaagtgttgcagtttgatccgcc

SEQ ID NO: 680154 - DNA, 25 bp, Mus musculus
gtcaagtgttgctgtttgatccgcc

SEQ ID NO: 680155 - DNA, 25 bp, Mus musculus
gtcaagttagataccatttcccctg

SEQ ID NO: 680156 - DNA, 25 bp, Mus musculus
gtcaagttagattccatttcccctg

SEQ ID NO: 680157 - DNA, 25 bp, Mus musculus
gtcaagttagcaagctttctcctgc

SEQ ID NO: 680158 - DNA, 25 bp, Mus musculus
gtcaagttagcatgctttctcctgc

SEQ ID NO: 680159 - DNA, 25 bp, Mus musculus
gtcaagttatttaccttgccgcttc

SEQ ID NO: 680160 - DNA, 25 bp, Mus musculus
gtcaagttattttccttgccgcttc

SEQ ID NO: 680161 - DNA, 25 bp, Mus musculus
gtcaagttcaaaatcactgcctcaa

SEQ ID NO: 680162 - DNA, 25 bp, Mus musculus
gtcaagttcaaattcactgcctcaa

SEQ ID NO: 680163 - DNA, 25 bp, Mus musculus
gtcaagttcaagatgtgctcttcat

SEQ ID NO: 680164 - DNA, 25 bp, Mus musculus
gtcaagttcaagttgtgctcttcat

SEQ ID NO: 680165 - DNA, 25 bp, Mus musculus
gtcaagttcatgaatacggttcaga

SEQ ID NO: 680166 - DNA, 25 bp, Mus musculus
gtcaagttcatgtatacggttcaga

SEQ ID NO: 680167 - DNA, 25 bp, Mus musculus
gtcaagttcccacaaatgttccaga

SEQ ID NO: 680168 - DNA, 25 bp, Mus musculus
gtcaagttcccagaaatgttccaga

SEQ ID NO: 680169 - DNA, 25 bp, Mus musculus
gtcaagttcttccaggccatagcca

SEQ ID NO: 680170 - DNA, 25 bp, Mus musculus
gtcaagttcttcgaggccatagcca

SEQ ID NO: 680171 - DNA, 25 bp, Mus musculus
gtcaagttgaatctttgtcctgggc

SEQ ID NO: 680172 - DNA, 25 bp, Mus musculus
gtcaagttgaatgtttgtcctgggc

SEQ ID NO: 680173 - DNA, 25 bp, Mus musculus
gtcaagttgatcagtacagtctctt

SEQ ID NO: 680174 - DNA, 25 bp, Mus musculus
gtcaagttgatctgtacagtctctt

SEQ ID NO: 680175 - DNA, 25 bp, Mus musculus
gtcaagttgccaaaaatcaaccggt

SEQ ID NO: 680176 - DNA, 25 bp, Mus musculus
gtcaagttgccataaatcaaccggt

SEQ ID NO: 680177 - DNA, 25 bp, Mus musculus
gtcaagttgctcattactgcctatg

SEQ ID NO: 680178 - DNA, 25 bp, Mus musculus
gtcaagttgctctttactgcctatg

SEQ ID NO: 680179 - DNA, 25 bp, Mus musculus
gtcaagttgtaccactcctcctaaa

SEQ ID NO: 680180 - DNA, 25 bp, Mus musculus
gtcaagttgtacgactcctcctaaa

SEQ ID NO: 680181 - DNA, 25 bp, Mus musculus
gtcaagtttattagcaccgcctttc

SEQ ID NO: 680182 - DNA, 25 bp, Mus musculus
gtcaagtttatttgcaccgcctttc

SEQ ID NO: 680183 - DNA, 25 bp, Mus musculus
gtcaagtttcttagcaatgctaaca

SEQ ID NO: 680184 - DNA, 25 bp, Mus musculus
gtcaagtttctttgcaatgctaaca

SEQ ID NO: 680185 - DNA, 25 bp, Mus musculus
gtcaagtttgagatccacaggagtt

SEQ ID NO: 680186 - DNA, 25 bp, Mus musculus
gtcaagtttgagttccacaggagtt

SEQ ID NO: 680187 - DNA, 25 bp, Mus musculus
gtcaagtttttgattactcatgtct

SEQ ID NO: 680188 - DNA, 25 bp, Mus musculus
gtcaagtttttgtttactcatgtct

SEQ ID NO: 680189 - DNA, 25 bp, Mus musculus
gtcaataaacacagaggcctgccct

SEQ ID NO: 680190 - DNA, 25 bp, Mus musculus
gtcaataaacactgaggcctgccct

SEQ ID NO: 680191 - DNA, 25 bp, Mus musculus
gtcaataaagtcctttgtgattatt

SEQ ID NO: 680192 - DNA, 25 bp, Mus musculus
gtcaataaagtcgtttgtgattatt

SEQ ID NO: 680193 - DNA, 25 bp, Mus musculus
gtcaataactaaacatatccttact

SEQ ID NO: 680194 - DNA, 25 bp, Mus musculus
gtcaataactaatcatatccttact

SEQ ID NO: 680195 - DNA, 25 bp, Mus musculus
gtcaatacaaaacagccgtccacag

SEQ ID NO: 680196 - DNA, 25 bp, Mus musculus
gtcaatacaaaagagccgtccacag

SEQ ID NO: 680197 - DNA, 25 bp, Mus musculus
gtcaatacagttccagatctcgtcg

SEQ ID NO: 680198 - DNA, 25 bp, Mus musculus
gtcaatacagttgcagatctcgtcg

SEQ ID NO: 680199 - DNA, 25 bp, Mus musculus
gtcaatacattgatgatgtggctaa

SEQ ID NO: 680200 - DNA, 25 bp, Mus musculus
gtcaatacattgttgatgtggctaa

SEQ ID NO: 680201 - DNA, 25 bp, Mus musculus
gtcaatacatttacatagtttcttt

SEQ ID NO: 680202 - DNA, 25 bp, Mus musculus
gtcaatacattttcatagtttcttt

SEQ ID NO: 680203 - DNA, 25 bp, Mus musculus
gtcaatactacacttaacagttatg

SEQ ID NO: 680204 - DNA, 25 bp, Mus musculus
gtcaatactacagttaacagttatg

SEQ ID NO: 680205 - DNA, 25 bp, Mus musculus
gtcaataggcctaatcttcgtacac

SEQ ID NO: 680206 - DNA, 25 bp, Mus musculus
gtcaataggccttatcttcgtacac

SEQ ID NO: 680207 - DNA, 25 bp, Mus musculus
gtcaatatatgcagtttcacggtaa

SEQ ID NO: 680208 - DNA, 25 bp, Mus musculus
gtcaatatatgctgtttcacggtaa

SEQ ID NO: 680209 - DNA, 25 bp, Mus musculus
gtcaatattcaacagccaatggtca

SEQ ID NO: 680210 - DNA, 25 bp, Mus musculus
gtcaatattcaagagccaatggtca

SEQ ID NO: 680211 - DNA, 25 bp, Mus musculus
gtcaatattccgaatacatttctgt

SEQ ID NO: 680212 - DNA, 25 bp, Mus musculus
gtcaatattccgtatacatttctgt

SEQ ID NO: 680213 - DNA, 25 bp, Mus musculus
gtcaatattcttagttgtctataaa

SEQ ID NO: 680214 - DNA, 25 bp, Mus musculus
gtcaatattctttgttgtctataaa

SEQ ID NO: 680215 - DNA, 25 bp, Mus musculus
gtcaatatttccagctggtacacta

SEQ ID NO: 680216 - DNA, 25 bp, Mus musculus
gtcaatatttcctgctggtacacta

SEQ ID NO: 680217 - DNA, 25 bp, Mus musculus
gtcaatcaatccacaacaccaagca

SEQ ID NO: 680218 - DNA, 25 bp, Mus musculus
gtcaatcaatcctcaacaccaagca

SEQ ID NO: 680219 - DNA, 25 bp, Mus musculus
gtcaatcacagaagtatgtcttctc

SEQ ID NO: 680220 - DNA, 25 bp, Mus musculus
gtcaatcacagatgtatgtcttctc

SEQ ID NO: 680221 - DNA, 25 bp, Mus musculus
gtcaatcacgatacatctagatggt

SEQ ID NO: 680222 - DNA, 25 bp, Mus musculus
gtcaatcacgattcatctagatggt

SEQ ID NO: 680223 - DNA, 25 bp, Mus musculus
gtcaatcagatgcaggtggtaccca

SEQ ID NO: 680224 - DNA, 25 bp, Mus musculus
gtcaatcagatggaggtggtaccca

SEQ ID NO: 680225 - DNA, 25 bp, Mus musculus
gtcaatcatcacctgggtctggtta

SEQ ID NO: 680226 - DNA, 25 bp, Mus musculus
gtcaatcatcacgtgggtctggtta

SEQ ID NO: 680227 - DNA, 25 bp, Mus musculus
gtcaatcatgataccaaggttctga

SEQ ID NO: 680228 - DNA, 25 bp, Mus musculus
gtcaatcatgattccaaggttctga

SEQ ID NO: 680229 - DNA, 25 bp, Mus musculus
gtcaatcatgtaaaggtctgagata

SEQ ID NO: 680230 - DNA, 25 bp, Mus musculus
gtcaatcatgtataggtctgagata

SEQ ID NO: 680231 - DNA, 25 bp, Mus musculus
gtcaatcgcagtcacctcagcaagg

SEQ ID NO: 680232 - DNA, 25 bp, Mus musculus
gtcaatcgcagtgacctcagcaagg

SEQ ID NO: 680233 - DNA, 25 bp, Mus musculus
gtcaatctacagctgtggttgtcca

SEQ ID NO: 680234 - DNA, 25 bp, Mus musculus
gtcaatctacaggtgtggttgtcca

SEQ ID NO: 680235 - DNA, 25 bp, Mus musculus
gtcaatctaccaagtgtaacttcag

SEQ ID NO: 680236 - DNA, 25 bp, Mus musculus
gtcaatctaccatgtgtaacttcag

SEQ ID NO: 680237 - DNA, 25 bp, Mus musculus
gtcaatctatacatctgaggccggg

SEQ ID NO: 680238 - DNA, 25 bp, Mus musculus
gtcaatctatacttctgaggccggg

SEQ ID NO: 680239 - DNA, 25 bp, Mus musculus
gtcaatctcatgacaggcgtcagct

SEQ ID NO: 680240 - DNA, 25 bp, Mus musculus
gtcaatctcatgtcaggcgtcagct

SEQ ID NO: 680241 - DNA, 25 bp, Mus musculus
gtcaatctccgtaaacaagttttca

SEQ ID NO: 680242 - DNA, 25 bp, Mus musculus
gtcaatctccgttaacaagttttca

SEQ ID NO: 680243 - DNA, 25 bp, Mus musculus
gtcaatctcgtaaatcatcaactct

SEQ ID NO: 680244 - DNA, 25 bp, Mus musculus
gtcaatctcgtatatcatcaactct

SEQ ID NO: 680245 - DNA, 25 bp, Mus musculus
gtcaatctgtacatttgggctattt

SEQ ID NO: 680246 - DNA, 25 bp, Mus musculus
gtcaatctgtacttttgggctattt

SEQ ID NO: 680247 - DNA, 25 bp, Mus musculus
gtcaatctttggatacattcactgg

SEQ ID NO: 680248 - DNA, 25 bp, Mus musculus
gtcaatctttggttacattcactgg

SEQ ID NO: 680249 - DNA, 25 bp, Mus musculus
gtcaatgaagtcaacatctccctgc

SEQ ID NO: 680250 - DNA, 25 bp, Mus musculus
gtcaatgaagtctacatctccctgc

SEQ ID NO: 680251 - DNA, 25 bp, Mus musculus
gtcaatgacagacttctcaacagta

SEQ ID NO: 680252 - DNA, 25 bp, Mus musculus
gtcaatgacagagttctcaacagta

SEQ ID NO: 680253 - DNA, 25 bp, Mus musculus
gtcaatgacccacagtagtctttag

SEQ ID NO: 680254 - DNA, 25 bp, Mus musculus
gtcaatgacccagagtagtctttag

SEQ ID NO: 680255 - DNA, 25 bp, Mus musculus
gtcaatgaccggaaggagcagctca

SEQ ID NO: 680256 - DNA, 25 bp, Mus musculus
gtcaatgaccggtaggagcagctca

SEQ ID NO: 680257 - DNA, 25 bp, Mus musculus
gtcaatgactggcttggaccaccaa

SEQ ID NO: 680258 - DNA, 25 bp, Mus musculus
gtcaatgactgggttggaccaccaa

SEQ ID NO: 680259 - DNA, 25 bp, Mus musculus
gtcaatgagaagctaagtctgcagt

SEQ ID NO: 680260 - DNA, 25 bp, Mus musculus
gtcaatgagaaggtaagtctgcagt

SEQ ID NO: 680261 - DNA, 25 bp, Mus musculus
gtcaatgagctcatcagtaagacca

SEQ ID NO: 680262 - DNA, 25 bp, Mus musculus
gtcaatgagctcttcagtaagacca

SEQ ID NO: 680263 - DNA, 25 bp, Mus musculus
gtcaatgagcttcttggtcgctccc

SEQ ID NO: 680264 - DNA, 25 bp, Mus musculus
gtcaatgagcttgttggtcgctccc

SEQ ID NO: 680265 - DNA, 25 bp, Mus musculus
gtcaatgcacatagggatctccctg

SEQ ID NO: 680266 - DNA, 25 bp, Mus musculus
gtcaatgcacattgggatctccctg

SEQ ID NO: 680267 - DNA, 25 bp, Mus musculus
gtcaatgcaccacatgaatgaactt

SEQ ID NO: 680268 - DNA, 25 bp, Mus musculus
gtcaatgcaccagatgaatgaactt

SEQ ID NO: 680269 - DNA, 25 bp, Mus musculus
gtcaatgccactaacactttgctag

SEQ ID NO: 680270 - DNA, 25 bp, Mus musculus
gtcaatgccacttacactttgctag

SEQ ID NO: 680271 - DNA, 25 bp, Mus musculus
gtcaatggcatgactactttaatta

SEQ ID NO: 680272 - DNA, 25 bp, Mus musculus
gtcaatggcatgtctactttaatta

SEQ ID NO: 680273 - DNA, 25 bp, Mus musculus
gtcaatggctctctggctgtatcga

SEQ ID NO: 680274 - DNA, 25 bp, Mus musculus
gtcaatggctctgtggctgtatcga

SEQ ID NO: 680275 - DNA, 25 bp, Mus musculus
gtcaatggtgccaaatattttttgt

SEQ ID NO: 680276 - DNA, 25 bp, Mus musculus
gtcaatggtgcctaatattttttgt

SEQ ID NO: 680277 - DNA, 25 bp, Mus musculus
gtcaatgtaaacactgtggtcagca

SEQ ID NO: 680278 - DNA, 25 bp, Mus musculus
gtcaatgtaaactctgtggtcagca

SEQ ID NO: 680279 - DNA, 25 bp, Mus musculus
gtcaatgtaggtaaccccacagcca

SEQ ID NO: 680280 - DNA, 25 bp, Mus musculus
gtcaatgtaggttaccccacagcca

SEQ ID NO: 680281 - DNA, 25 bp, Mus musculus
gtcaatgtagttctgctaggattac

SEQ ID NO: 680282 - DNA, 25 bp, Mus musculus
gtcaatgtagttgtgctaggattac

SEQ ID NO: 680283 - DNA, 25 bp, Mus musculus
gtcaatgtccttcaatcagtcagtc

SEQ ID NO: 680284 - DNA, 25 bp, Mus musculus
gtcaatgtccttgaatcagtcagtc

SEQ ID NO: 680285 - DNA, 25 bp, Mus musculus
gtcaatgtctatcgtgtgcctgtgc

SEQ ID NO: 680286 - DNA, 25 bp, Mus musculus
gtcaatgtctatggtgtgcctgtgc

SEQ ID NO: 680287 - DNA, 25 bp, Mus musculus
gtcaatgtcttcattctttggaccc

SEQ ID NO: 680288 - DNA, 25 bp, Mus musculus
gtcaatgtcttctttctttggaccc

SEQ ID NO: 680289 - DNA, 25 bp, Mus musculus
gtcaatgtgaaacctatatctggaa

SEQ ID NO: 680290 - DNA, 25 bp, Mus musculus
gtcaatgtgaaagctatatctggaa

SEQ ID NO: 680291 - DNA, 25 bp, Mus musculus
gtcaatgtgattcgaactttgagta

SEQ ID NO: 680292 - DNA, 25 bp, Mus musculus
gtcaatgtgattggaactttgagta

SEQ ID NO: 680293 - DNA, 25 bp, Mus musculus
gtcaatgtgttcatcagactgcttg

SEQ ID NO: 680294 - DNA, 25 bp, Mus musculus
gtcaatgtgttcttcagactgcttg

SEQ ID NO: 680295 - DNA, 25 bp, Mus musculus
gtcaatgttctaataccaaggctaa

SEQ ID NO: 680296 - DNA, 25 bp, Mus musculus
gtcaatgttctattaccaaggctaa

SEQ ID NO: 680297 - DNA, 25 bp, Mus musculus
gtcaatgttgaaaatctctcctggt

SEQ ID NO: 680298 - DNA, 25 bp, Mus musculus
gtcaatgttgaatatctctcctggt

SEQ ID NO: 680299 - DNA, 25 bp, Mus musculus
gtcaatgttgtaattcccctatgtg

SEQ ID NO: 680300 - DNA, 25 bp, Mus musculus
gtcaatgttgtatttcccctatgtg

SEQ ID NO: 680301 - DNA, 25 bp, Mus musculus
gtcaattaacaaccccacaactata

SEQ ID NO: 680302 - DNA, 25 bp, Mus musculus
gtcaattaacaagcccacaactata

SEQ ID NO: 680303 - DNA, 25 bp, Mus musculus
gtcaattacacaactctgccaatat

SEQ ID NO: 680304 - DNA, 25 bp, Mus musculus
gtcaattacacatctctgccaatat

SEQ ID NO: 680305 - DNA, 25 bp, Mus musculus
gtcaattatcatctgttctcttctg

SEQ ID NO: 680306 - DNA, 25 bp, Mus musculus
gtcaattatcatgtgttctcttctg

SEQ ID NO: 680307 - DNA, 25 bp, Mus musculus
gtcaattatctaacaagccctcggt

SEQ ID NO: 680308 - DNA, 25 bp, Mus musculus
gtcaattatctatcaagccctcggt

SEQ ID NO: 680309 - DNA, 25 bp, Mus musculus
gtcaattatgtaaccagctcctagt

SEQ ID NO: 680310 - DNA, 25 bp, Mus musculus
gtcaattatgtatccagctcctagt

SEQ ID NO: 680311 - DNA, 25 bp, Mus musculus
gtcaattatttcatcctatagggag

SEQ ID NO: 680312 - DNA, 25 bp, Mus musculus
gtcaattatttcttcctatagggag

SEQ ID NO: 680313 - DNA, 25 bp, Mus musculus
gtcaattcctagcacacagctctgt

SEQ ID NO: 680314 - DNA, 25 bp, Mus musculus
gtcaattcctaggacacagctctgt

SEQ ID NO: 680315 - DNA, 25 bp, Mus musculus
gtcaattgctcacaaagtcccttcc

SEQ ID NO: 680316 - DNA, 25 bp, Mus musculus
gtcaattgctcagaaagtcccttcc

SEQ ID NO: 680317 - DNA, 25 bp, Mus musculus
gtcaattgctttcgcagcacttgct

SEQ ID NO: 680318 - DNA, 25 bp, Mus musculus
gtcaattgctttggcagcacttgct

SEQ ID NO: 680319 - DNA, 25 bp, Mus musculus
gtcaatttcaagattcgcttttgtt

SEQ ID NO: 680320 - DNA, 25 bp, Mus musculus
gtcaatttcaagtttcgcttttgtt

SEQ ID NO: 680321 - DNA, 25 bp, Mus musculus
gtcaatttcagcaggaatttcccag

SEQ ID NO: 680322 - DNA, 25 bp, Mus musculus
gtcaatttcagctggaatttcccag

SEQ ID NO: 680323 - DNA, 25 bp, Mus musculus
gtcaatttcatcaacatgggacgaa

SEQ ID NO: 680324 - DNA, 25 bp, Mus musculus
gtcaatttcatctacatgggacgaa

SEQ ID NO: 680325 - DNA, 25 bp, Mus musculus
gtcaatttcattacctgtctagcga

SEQ ID NO: 680326 - DNA, 25 bp, Mus musculus
gtcaatttcatttcctgtctagcga

SEQ ID NO: 680327 - DNA, 25 bp, Mus musculus
gtcaatttccatcgccagacttgaa

SEQ ID NO: 680328 - DNA, 25 bp, Mus musculus
gtcaatttccatggccagacttgaa

SEQ ID NO: 680329 - DNA, 25 bp, Mus musculus
gtcaatttgaaaactacatctactg

SEQ ID NO: 680330 - DNA, 25 bp, Mus musculus
gtcaatttgaaatctacatctactg

SEQ ID NO: 680331 - DNA, 25 bp, Mus musculus
gtcaatttgggaagcttcatcggcc

SEQ ID NO: 680332 - DNA, 25 bp, Mus musculus
gtcaatttgggatgcttcatcggcc

SEQ ID NO: 680333 - DNA, 25 bp, Mus musculus
gtcaatttgggtagctcttgtggac

SEQ ID NO: 680334 - DNA, 25 bp, Mus musculus
gtcaatttgggttgctcttgtggac

SEQ ID NO: 680335 - DNA, 25 bp, Mus musculus
gtcaattttagacagatcccctcac

SEQ ID NO: 680336 - DNA, 25 bp, Mus musculus
gtcaattttagagagatcccctcac

SEQ ID NO: 680337 - DNA, 25 bp, Mus musculus
gtcaattttgctatactatagtatc

SEQ ID NO: 680338 - DNA, 25 bp, Mus musculus
gtcaattttgctttactatagtatc

SEQ ID NO: 680339 - DNA, 25 bp, Mus musculus
gtcaatttttgtcataccttttcaa

SEQ ID NO: 680340 - DNA, 25 bp, Mus musculus
gtcaatttttgtgataccttttcaa

SEQ ID NO: 680341 - DNA, 25 bp, Mus musculus
gtcacaaaaagtaccgtcgccaagc

SEQ ID NO: 680342 - DNA, 25 bp, Mus musculus
gtcacaaaaagttccgtcgccaagc

SEQ ID NO: 680343 - DNA, 25 bp, Mus musculus
gtcacaaaaccacgaggcaccgaat

SEQ ID NO: 680344 - DNA, 25 bp, Mus musculus
gtcacaaaaccaggaggcaccgaat

SEQ ID NO: 680345 - DNA, 25 bp, Mus musculus
gtcacaaaatagctctgggcctggg

SEQ ID NO: 680346 - DNA, 25 bp, Mus musculus
gtcacaaaataggtctgggcctggg

SEQ ID NO: 680347 - DNA, 25 bp, Mus musculus
gtcacaaacttcagcttgctacaaa

SEQ ID NO: 680348 - DNA, 25 bp, Mus musculus
gtcacaaacttctgcttgctacaaa

SEQ ID NO: 680349 - DNA, 25 bp, Mus musculus
gtcacaaagatacagctgccacact

SEQ ID NO: 680350 - DNA, 25 bp, Mus musculus
gtcacaaagatagagctgccacact

SEQ ID NO: 680351 - DNA, 25 bp, Mus musculus
gtcacaaagcagcacgctggaggta

SEQ ID NO: 680352 - DNA, 25 bp, Mus musculus
gtcacaaagcaggacgctggaggta

SEQ ID NO: 680353 - DNA, 25 bp, Mus musculus
gtcacaaagccaatacaaatcttct

SEQ ID NO: 680354 - DNA, 25 bp, Mus musculus
gtcacaaagccattacaaatcttct

SEQ ID NO: 680355 - DNA, 25 bp, Mus musculus
gtcacaaaggacatactctgccaca

SEQ ID NO: 680356 - DNA, 25 bp, Mus musculus
gtcacaaaggacttactctgccaca

SEQ ID NO: 680357 - DNA, 25 bp, Mus musculus
gtcacaaaggttacccttaggatga

SEQ ID NO: 680358 - DNA, 25 bp, Mus musculus
gtcacaaaggtttcccttaggatga

SEQ ID NO: 680359 - DNA, 25 bp, Mus musculus
gtcacaaatttgcaacccgtgctcc

SEQ ID NO: 680360 - DNA, 25 bp, Mus musculus
gtcacaaatttggaacccgtgctcc

SEQ ID NO: 680361 - DNA, 25 bp, Mus musculus
gtcacaacatgcattgagactgtag

SEQ ID NO: 680362 - DNA, 25 bp, Mus musculus
gtcacaacatgctttgagactgtag

SEQ ID NO: 680363 - DNA, 25 bp, Mus musculus
gtcacaacccgaatattcatctgca

SEQ ID NO: 680364 - DNA, 25 bp, Mus musculus
gtcacaacccgattattcatctgca

SEQ ID NO: 680365 - DNA, 25 bp, Mus musculus
gtcacaacccgtcacttgaagtaga

SEQ ID NO: 680366 - DNA, 25 bp, Mus musculus
gtcacaacccgtgacttgaagtaga

SEQ ID NO: 680367 - DNA, 25 bp, Mus musculus
gtcacaacccttcggtttcttgata

SEQ ID NO: 680368 - DNA, 25 bp, Mus musculus
gtcacaacccttgggtttcttgata

SEQ ID NO: 680369 - DNA, 25 bp, Mus musculus
gtcacaaccggtctctgttttattg

SEQ ID NO: 680370 - DNA, 25 bp, Mus musculus
gtcacaaccggtgtctgttttattg

SEQ ID NO: 680371 - DNA, 25 bp, Mus musculus
gtcacaacctttagcggtgtcttag

SEQ ID NO: 680372 - DNA, 25 bp, Mus musculus
gtcacaacctttagtcagccatttt

SEQ ID NO: 680373 - DNA, 25 bp, Mus musculus
gtcacaaccttttgcggtgtcttag

SEQ ID NO: 680374 - DNA, 25 bp, Mus musculus
gtcacaaccttttgtcagccatttt

SEQ ID NO: 680375 - DNA, 25 bp, Mus musculus
gtcacaactagaccaactctctctg

SEQ ID NO: 680376 - DNA, 25 bp, Mus musculus
gtcacaactagagcaactctctctg

SEQ ID NO: 680377 - DNA, 25 bp, Mus musculus
gtcacaactcagctatttaactggc

SEQ ID NO: 680378 - DNA, 25 bp, Mus musculus
gtcacaactcaggtatttaactggc

SEQ ID NO: 680379 - DNA, 25 bp, Mus musculus
gtcacaactgacactgggaatccca

SEQ ID NO: 680380 - DNA, 25 bp, Mus musculus
gtcacaactgactctgggaatccca

SEQ ID NO: 680381 - DNA, 25 bp, Mus musculus
gtcacaactggtcattctcacagga

SEQ ID NO: 680382 - DNA, 25 bp, Mus musculus
gtcacaactggtgattctcacagga

SEQ ID NO: 680383 - DNA, 25 bp, Mus musculus
gtcacaagacaaaatctggcttttt

SEQ ID NO: 680384 - DNA, 25 bp, Mus musculus
gtcacaagacaatatctggcttttt

SEQ ID NO: 680385 - DNA, 25 bp, Mus musculus
gtcacaagactaacctattcctggg

SEQ ID NO: 680386 - DNA, 25 bp, Mus musculus
gtcacaagactatcctattcctggg

SEQ ID NO: 680387 - DNA, 25 bp, Mus musculus
gtcacaagcagacacagggttgttt

SEQ ID NO: 680388 - DNA, 25 bp, Mus musculus
gtcacaagcagagacagggttgttt

SEQ ID NO: 680389 - DNA, 25 bp, Mus musculus
gtcacaagcagtacttcagccatct

SEQ ID NO: 680390 - DNA, 25 bp, Mus musculus
gtcacaagcagttcttcagccatct

SEQ ID NO: 680391 - DNA, 25 bp, Mus musculus
gtcacaagcccacgtcacaaacaga

SEQ ID NO: 680392 - DNA, 25 bp, Mus musculus
gtcacaagcccaggtcacaaacaga

SEQ ID NO: 680393 - DNA, 25 bp, Mus musculus
gtcacaagctacatttacagagtct

SEQ ID NO: 680394 - DNA, 25 bp, Mus musculus
gtcacaagctacttttacagagtct

SEQ ID NO: 680395 - DNA, 25 bp, Mus musculus
gtcacaagctgcctctatttcagtt

SEQ ID NO: 680396 - DNA, 25 bp, Mus musculus
gtcacaagctgcgtctatttcagtt

SEQ ID NO: 680397 - DNA, 25 bp, Mus musculus
gtcacaagctgtccaacaattacta

SEQ ID NO: 680398 - DNA, 25 bp, Mus musculus
gtcacaagctgtgcaacaattacta

SEQ ID NO: 680399 - DNA, 25 bp, Mus musculus
gtcacaagggaccagttccactttg

SEQ ID NO: 680400 - DNA, 25 bp, Mus musculus
gtcacaagggacgagttccactttg

SEQ ID NO: 680401 - DNA, 25 bp, Mus musculus
gtcacaaggtgactgctgctgccca

SEQ ID NO: 680402 - DNA, 25 bp, Mus musculus
gtcacaaggtgagtgctgctgccca

SEQ ID NO: 680403 - DNA, 25 bp, Mus musculus
gtcacaaggtgcagcttccacaggg

SEQ ID NO: 680404 - DNA, 25 bp, Mus musculus
gtcacaaggtgctgcttccacaggg

SEQ ID NO: 680405 - DNA, 25 bp, Mus musculus
gtcacaagtcttcaaaaggtggtag

SEQ ID NO: 680406 - DNA, 25 bp, Mus musculus
gtcacaagtcttgaaaaggtggtag

SEQ ID NO: 680407 - DNA, 25 bp, Mus musculus
gtcacaagttagatccataattcca

SEQ ID NO: 680408 - DNA, 25 bp, Mus musculus
gtcacaagttagttccataattcca

SEQ ID NO: 680409 - DNA, 25 bp, Mus musculus
gtcacaataaagagatcctcccctc

SEQ ID NO: 680410 - DNA, 25 bp, Mus musculus
gtcacaataaagtgatcctcccctc

SEQ ID NO: 680411 - DNA, 25 bp, Mus musculus
gtcacaatacttccagacagctgcg

SEQ ID NO: 680412 - DNA, 25 bp, Mus musculus
gtcacaatacttgcagacagctgcg

SEQ ID NO: 680413 - DNA, 25 bp, Mus musculus
gtcacaatccacatgttgagaacga

SEQ ID NO: 680414 - DNA, 25 bp, Mus musculus
gtcacaatccacttgttgagaacga

SEQ ID NO: 680415 - DNA, 25 bp, Mus musculus
gtcacaatccctatggaggttgaat

SEQ ID NO: 680416 - DNA, 25 bp, Mus musculus
gtcacaatccctttggaggttgaat

SEQ ID NO: 680417 - DNA, 25 bp, Mus musculus
gtcacaatctccatccttactgatg

SEQ ID NO: 680418 - DNA, 25 bp, Mus musculus
gtcacaatctccttccttactgatg

SEQ ID NO: 680419 - DNA, 25 bp, Mus musculus
gtcacaatctgactccgagttcaaa

SEQ ID NO: 680420 - DNA, 25 bp, Mus musculus
gtcacaatctgagtccgagttcaaa

SEQ ID NO: 680421 - DNA, 25 bp, Mus musculus
gtcacaatctttatgaactgctaac

SEQ ID NO: 680422 - DNA, 25 bp, Mus musculus
gtcacaatctttttgaactgctaac

SEQ ID NO: 680423 - DNA, 25 bp, Mus musculus
gtcacaatgaaaccaaattccatgt

SEQ ID NO: 680424 - DNA, 25 bp, Mus musculus
gtcacaatgaaagcaaattccatgt

SEQ ID NO: 680425 - DNA, 25 bp, Mus musculus
gtcacaatgatcatgcagtgtctgg

SEQ ID NO: 680426 - DNA, 25 bp, Mus musculus
gtcacaatgatcttgcagtgtctgg

SEQ ID NO: 680427 - DNA, 25 bp, Mus musculus
gtcacaatgatgatgaatggtccaa

SEQ ID NO: 680428 - DNA, 25 bp, Mus musculus
gtcacaatgatgttgaatggtccaa

SEQ ID NO: 680429 - DNA, 25 bp, Mus musculus
gtcacaatgctccatttgtggctaa

SEQ ID NO: 680430 - DNA, 25 bp, Mus musculus
gtcacaatgctcgatttgtggctaa

SEQ ID NO: 680431 - DNA, 25 bp, Mus musculus
gtcacaattcacagcgggatgctgc

SEQ ID NO: 680432 - DNA, 25 bp, Mus musculus
gtcacaattcactgcgggatgctgc

SEQ ID NO: 680433 - DNA, 25 bp, Mus musculus
gtcacaatttgtcctactcctttga

SEQ ID NO: 680434 - DNA, 25 bp, Mus musculus
gtcacaatttgtgctactcctttga

SEQ ID NO: 680435 - DNA, 25 bp, Mus musculus
gtcacacaaactattcatctaaact

SEQ ID NO: 680436 - DNA, 25 bp, Mus musculus
gtcacacaaacttttcatctaaact

SEQ ID NO: 680437 - DNA, 25 bp, Mus musculus
gtcacacaagagcaatagcatctat

SEQ ID NO: 680438 - DNA, 25 bp, Mus musculus
gtcacacaagaggaatagcatctat

SEQ ID NO: 680439 - DNA, 25 bp, Mus musculus
gtcacacaagcacactttttagctg

SEQ ID NO: 680440 - DNA, 25 bp, Mus musculus
gtcacacaagcagactttttagctg

SEQ ID NO: 680441 - DNA, 25 bp, Mus musculus
gtcacacactgccagaagcttctgt

SEQ ID NO: 680442 - DNA, 25 bp, Mus musculus
gtcacacactgcgagaagcttctgt

SEQ ID NO: 680443 - DNA, 25 bp, Mus musculus
gtcacacacttaaccagcaagctga

SEQ ID NO: 680444 - DNA, 25 bp, Mus musculus
gtcacacacttatccagcaagctga

SEQ ID NO: 680445 - DNA, 25 bp, Mus musculus
gtcacacagatgatcttacccttaa

SEQ ID NO: 680446 - DNA, 25 bp, Mus musculus
gtcacacagatgttcttacccttaa

SEQ ID NO: 680447 - DNA, 25 bp, Mus musculus
gtcacacagtagcaattgttcacag

SEQ ID NO: 680448 - DNA, 25 bp, Mus musculus
gtcacacagtaggaattgttcacag

SEQ ID NO: 680449 - DNA, 25 bp, Mus musculus
gtcacacagtatatattgttcctaa

SEQ ID NO: 680450 - DNA, 25 bp, Mus musculus
gtcacacagtatttattgttcctaa

SEQ ID NO: 680451 - DNA, 25 bp, Mus musculus
gtcacacatacaccctttcaaaagt

SEQ ID NO: 680452 - DNA, 25 bp, Mus musculus
gtcacacatacagcctttcaaaagt

SEQ ID NO: 680453 - DNA, 25 bp, Mus musculus
gtcacacatagtcggtttggccagt

SEQ ID NO: 680454 - DNA, 25 bp, Mus musculus
gtcacacatagtgggtttggccagt

SEQ ID NO: 680455 - DNA, 25 bp, Mus musculus
gtcacacatgctcagaccggtacat

SEQ ID NO: 680456 - DNA, 25 bp, Mus musculus
gtcacacatgctgagaccggtacat

SEQ ID NO: 680457 - DNA, 25 bp, Mus musculus
gtcacaccaaatagatgccaccttg

SEQ ID NO: 680458 - DNA, 25 bp, Mus musculus
gtcacaccaaattgatgccaccttg

SEQ ID NO: 680459 - DNA, 25 bp, Mus musculus
gtcacaccaacgacttattctcaag

SEQ ID NO: 680460 - DNA, 25 bp, Mus musculus
gtcacaccaacgtcttattctcaag

SEQ ID NO: 680461 - DNA, 25 bp, Mus musculus
gtcacaccagctactaaaactcttt

SEQ ID NO: 680462 - DNA, 25 bp, Mus musculus
gtcacaccagcttctaaaactcttt

SEQ ID NO: 680463 - DNA, 25 bp, Mus musculus
gtcacaccagtaaccagtgcaatca

SEQ ID NO: 680464 - DNA, 25 bp, Mus musculus
gtcacaccagtatccagtgcaatca

SEQ ID NO: 680465 - DNA, 25 bp, Mus musculus
gtcacaccgaccagagttgcaaatt

SEQ ID NO: 680466 - DNA, 25 bp, Mus musculus
gtcacaccgacctgagttgcaaatt

SEQ ID NO: 680467 - DNA, 25 bp, Mus musculus
gtcacaccgagaagtcacaaccaag

SEQ ID NO: 680468 - DNA, 25 bp, Mus musculus
gtcacaccgagatgtcacaaccaag

SEQ ID NO: 680469 - DNA, 25 bp, Mus musculus
gtcacacctcacaggagagatttcc

SEQ ID NO: 680470 - DNA, 25 bp, Mus musculus
gtcacacctcactggagagatttcc

SEQ ID NO: 680471 - DNA, 25 bp, Mus musculus
gtcacacctctgagaagtctcctag

SEQ ID NO: 680472 - DNA, 25 bp, Mus musculus
gtcacacctctgtgaagtctcctag

SEQ ID NO: 680473 - DNA, 25 bp, Mus musculus
gtcacaccttgtagccaggtctaaa

SEQ ID NO: 680474 - DNA, 25 bp, Mus musculus
gtcacaccttgttgccaggtctaaa

SEQ ID NO: 680475 - DNA, 25 bp, Mus musculus
gtcacacgaacgagggtaattacca

SEQ ID NO: 680476 - DNA, 25 bp, Mus musculus
gtcacacgaacgtgggtaattacca

SEQ ID NO: 680477 - DNA, 25 bp, Mus musculus
gtcacacgacttactttgagtggtg

SEQ ID NO: 680478 - DNA, 25 bp, Mus musculus
gtcacacgactttctttgagtggtg

SEQ ID NO: 680479 - DNA, 25 bp, Mus musculus
gtcacacgccacatcaagatcagag

SEQ ID NO: 680480 - DNA, 25 bp, Mus musculus
gtcacacgccacttcaagatcagag

SEQ ID NO: 680481 - DNA, 25 bp, Mus musculus
gtcacacggttaacctcacagaagg

SEQ ID NO: 680482 - DNA, 25 bp, Mus musculus
gtcacacggttatcctcacagaagg

SEQ ID NO: 680483 - DNA, 25 bp, Mus musculus
gtcacactacatctcaggttcggga

SEQ ID NO: 680484 - DNA, 25 bp, Mus musculus
gtcacactacatgtcaggttcggga

SEQ ID NO: 680485 - DNA, 25 bp, Mus musculus
gtcacactactacaaggcaggcact

SEQ ID NO: 680486 - DNA, 25 bp, Mus musculus
gtcacactactagaaggcaggcact

SEQ ID NO: 680487 - DNA, 25 bp, Mus musculus
gtcacactcatcaccaagtacatga

SEQ ID NO: 680488 - DNA, 25 bp, Mus musculus
gtcacactcatctccaagtacatga

SEQ ID NO: 680489 - DNA, 25 bp, Mus musculus
gtcacactcggcagttaaaattcta

SEQ ID NO: 680490 - DNA, 25 bp, Mus musculus
gtcacactcggctgttaaaattcta

SEQ ID NO: 680491 - DNA, 25 bp, Mus musculus
gtcacactcttgaataagcactctg

SEQ ID NO: 680492 - DNA, 25 bp, Mus musculus
gtcacactcttgtataagcactctg

SEQ ID NO: 680493 - DNA, 25 bp, Mus musculus
gtcacactgaagctcgcactggaca

SEQ ID NO: 680494 - DNA, 25 bp, Mus musculus
gtcacactgaaggtcgcactggaca

SEQ ID NO: 680495 - DNA, 25 bp, Mus musculus
gtcacactgagaaacctctcttacc

SEQ ID NO: 680496 - DNA, 25 bp, Mus musculus
gtcacactgagatacctctcttacc

SEQ ID NO: 680497 - DNA, 25 bp, Mus musculus
gtcacactgggcacgggaggttctc

SEQ ID NO: 680498 - DNA, 25 bp, Mus musculus
gtcacactgggctcgggaggttctc

SEQ ID NO: 680499 - DNA, 25 bp, Mus musculus
gtcacactgtctattctatatttgg

SEQ ID NO: 680500 - DNA, 25 bp, Mus musculus
gtcacactgtcttttctatatttgg

SEQ ID NO: 680501 - DNA, 25 bp, Mus musculus
gtcacacttaagagcctgcttaggg

SEQ ID NO: 680502 - DNA, 25 bp, Mus musculus
gtcacacttaagtgcctgcttaggg

SEQ ID NO: 680503 - DNA, 25 bp, Mus musculus
gtcacacttatgaatttcttactga

SEQ ID NO: 680504 - DNA, 25 bp, Mus musculus
gtcacacttatgtatttcttactga

SEQ ID NO: 680505 - DNA, 25 bp, Mus musculus
gtcacacttggcaaattctatctgg

SEQ ID NO: 680506 - DNA, 25 bp, Mus musculus
gtcacacttggctaattctatctgg

SEQ ID NO: 680507 - DNA, 25 bp, Mus musculus
gtcacagaacgtatatgatgcatac

SEQ ID NO: 680508 - DNA, 25 bp, Mus musculus
gtcacagaacgtttatgatgcatac

SEQ ID NO: 680509 - DNA, 25 bp, Mus musculus
gtcacagaacttcgttgttgttcca

SEQ ID NO: 680510 - DNA, 25 bp, Mus musculus
gtcacagaacttggttgttgttcca

SEQ ID NO: 680511 - DNA, 25 bp, Mus musculus
gtcacagaagagatcctggagttca

SEQ ID NO: 680512 - DNA, 25 bp, Mus musculus
gtcacagaagagttcctggagttca

SEQ ID NO: 680513 - DNA, 25 bp, Mus musculus
gtcacagaagcacttccgcccaggg

SEQ ID NO: 680514 - DNA, 25 bp, Mus musculus
gtcacagaagcagttccgcccaggg

SEQ ID NO: 680515 - DNA, 25 bp, Mus musculus
gtcacagacacgctatgatttcagt

SEQ ID NO: 680516 - DNA, 25 bp, Mus musculus
gtcacagacacggtatgatttcagt

SEQ ID NO: 680517 - DNA, 25 bp, Mus musculus
gtcacagacatcacaggaggctgcg

SEQ ID NO: 680518 - DNA, 25 bp, Mus musculus
gtcacagacatctcaggaggctgcg

SEQ ID NO: 680519 - DNA, 25 bp, Mus musculus
gtcacagagacccttccattgcaat

SEQ ID NO: 680520 - DNA, 25 bp, Mus musculus
gtcacagagaccgttccattgcaat

SEQ ID NO: 680521 - DNA, 25 bp, Mus musculus
gtcacagagcctcagatagctggga

SEQ ID NO: 680522 - DNA, 25 bp, Mus musculus
gtcacagagcctgagatagctggga

SEQ ID NO: 680523 - DNA, 25 bp, Mus musculus
gtcacagaggagaggtccagatgtt

SEQ ID NO: 680524 - DNA, 25 bp, Mus musculus
gtcacagaggagtggtccagatgtt

SEQ ID NO: 680525 - DNA, 25 bp, Mus musculus
gtcacagaggctcaggacccagctt

SEQ ID NO: 680526 - DNA, 25 bp, Mus musculus
gtcacagaggctctgcttacaaagt

SEQ ID NO: 680527 - DNA, 25 bp, Mus musculus
gtcacagaggctgaggacccagctt

SEQ ID NO: 680528 - DNA, 25 bp, Mus musculus
gtcacagaggctgtgcttacaaagt

SEQ ID NO: 680529 - DNA, 25 bp, Mus musculus
gtcacagagggacgccacaggtcct

SEQ ID NO: 680530 - DNA, 25 bp, Mus musculus
gtcacagagggaggccacaggtcct

SEQ ID NO: 680531 - DNA, 25 bp, Mus musculus
gtcacagaggtgcaggagaccaaat

SEQ ID NO: 680532 - DNA, 25 bp, Mus musculus
gtcacagaggtggaggagaccaaat

SEQ ID NO: 680533 - DNA, 25 bp, Mus musculus
gtcacagagtctccagctgaggaaa

SEQ ID NO: 680534 - DNA, 25 bp, Mus musculus
gtcacagagtctgcagctgaggaaa

SEQ ID NO: 680535 - DNA, 25 bp, Mus musculus
gtcacagattccattatatttagtt

SEQ ID NO: 680536 - DNA, 25 bp, Mus musculus
gtcacagattcctttatatttagtt

SEQ ID NO: 680537 - DNA, 25 bp, Mus musculus
gtcacagattgtacggagctgcgat

SEQ ID NO: 680538 - DNA, 25 bp, Mus musculus
gtcacagattgttcggagctgcgat

SEQ ID NO: 680539 - DNA, 25 bp, Mus musculus
gtcacagcaagaagctttgtcccct

SEQ ID NO: 680540 - DNA, 25 bp, Mus musculus
gtcacagcaagatgctttgtcccct

SEQ ID NO: 680541 - DNA, 25 bp, Mus musculus
gtcacagcagcaaagctttccaggg

SEQ ID NO: 680542 - DNA, 25 bp, Mus musculus
gtcacagcagcatagctttccaggg

SEQ ID NO: 680543 - DNA, 25 bp, Mus musculus
gtcacagcaggccactgatggtgca

SEQ ID NO: 680544 - DNA, 25 bp, Mus musculus
gtcacagcaggcgactgatggtgca

SEQ ID NO: 680545 - DNA, 25 bp, Mus musculus
gtcacagcaggtatacacaggcggc

SEQ ID NO: 680546 - DNA, 25 bp, Mus musculus
gtcacagcaggtttacacaggcggc

SEQ ID NO: 680547 - DNA, 25 bp, Mus musculus
gtcacagcagtccttgtggctgtaa

SEQ ID NO: 680548 - DNA, 25 bp, Mus musculus
gtcacagcagtcgttgtggctgtaa

SEQ ID NO: 680549 - DNA, 25 bp, Mus musculus
gtcacagcatatatcttattaatgt

SEQ ID NO: 680550 - DNA, 25 bp, Mus musculus
gtcacagcatatttcttattaatgt

SEQ ID NO: 680551 - DNA, 25 bp, Mus musculus
gtcacagccatgactatggaatcgc

SEQ ID NO: 680552 - DNA, 25 bp, Mus musculus
gtcacagccatgtctatggaatcgc

SEQ ID NO: 680553 - DNA, 25 bp, Mus musculus
gtcacagcccaaaggcactttctgg

SEQ ID NO: 680554 - DNA, 25 bp, Mus musculus
gtcacagcccaatggcactttctgg

SEQ ID NO: 680555 - DNA, 25 bp, Mus musculus
gtcacagcccagaaatccagcagga

SEQ ID NO: 680556 - DNA, 25 bp, Mus musculus
gtcacagcccagtaatccagcagga

SEQ ID NO: 680557 - DNA, 25 bp, Mus musculus
gtcacagcccttctggttcaagctt

SEQ ID NO: 680558 - DNA, 25 bp, Mus musculus
gtcacagcccttgtggttcaagctt

SEQ ID NO: 680559 - DNA, 25 bp, Mus musculus
gtcacagcctagaacttaagccctt

SEQ ID NO: 680560 - DNA, 25 bp, Mus musculus
gtcacagcctagtacttaagccctt

SEQ ID NO: 680561 - DNA, 25 bp, Mus musculus
gtcacagcctatataattaatgcac

SEQ ID NO: 680562 - DNA, 25 bp, Mus musculus
gtcacagcctatttaattaatgcac

SEQ ID NO: 680563 - DNA, 25 bp, Mus musculus
gtcacagcgcggagttggaatccca

SEQ ID NO: 680564 - DNA, 25 bp, Mus musculus
gtcacagcgcggtgttggaatccca

SEQ ID NO: 680565 - DNA, 25 bp, Mus musculus
gtcacagctaagcttctcacaggac

SEQ ID NO: 680566 - DNA, 25 bp, Mus musculus
gtcacagctaaggttctcacaggac

SEQ ID NO: 680567 - DNA, 25 bp, Mus musculus
gtcacagctacaatttgaacctcct

SEQ ID NO: 680568 - DNA, 25 bp, Mus musculus
gtcacagctacattttgaacctcct

SEQ ID NO: 680569 - DNA, 25 bp, Mus musculus
gtcacagctactagcagggtgcttt

SEQ ID NO: 680570 - DNA, 25 bp, Mus musculus
gtcacagctacttgcagggtgcttt

SEQ ID NO: 680571 - DNA, 25 bp, Mus musculus
gtcacagctgagacgggtgtaccac

SEQ ID NO: 680572 - DNA, 25 bp, Mus musculus
gtcacagctgagtcgggtgtaccac

SEQ ID NO: 680573 - DNA, 25 bp, Mus musculus
gtcacagctgttacacttctatttt

SEQ ID NO: 680574 - DNA, 25 bp, Mus musculus
gtcacagctgtttcacttctatttt

SEQ ID NO: 680575 - DNA, 25 bp, Mus musculus
gtcacagcttctaagagtcacaagt

SEQ ID NO: 680576 - DNA, 25 bp, Mus musculus
gtcacagcttctaccaccaagtaga

SEQ ID NO: 680577 - DNA, 25 bp, Mus musculus
gtcacagcttctactgacaacctag

SEQ ID NO: 680578 - DNA, 25 bp, Mus musculus
gtcacagcttcttagagtcacaagt

SEQ ID NO: 680579 - DNA, 25 bp, Mus musculus
gtcacagcttcttccaccaagtaga

SEQ ID NO: 680580 - DNA, 25 bp, Mus musculus
gtcacagcttcttctgacaacctag

SEQ ID NO: 680581 - DNA, 25 bp, Mus musculus
gtcacaggaatacggttccatttct

SEQ ID NO: 680582 - DNA, 25 bp, Mus musculus
gtcacaggaatagggttccatttct

SEQ ID NO: 680583 - DNA, 25 bp, Mus musculus
gtcacaggacttattgttgatttca

SEQ ID NO: 680584 - DNA, 25 bp, Mus musculus
gtcacaggactttttgttgatttca

SEQ ID NO: 680585 - DNA, 25 bp, Mus musculus
gtcacaggatgcaagacctacctaa

SEQ ID NO: 680586 - DNA, 25 bp, Mus musculus
gtcacaggatgctagacctacctaa

SEQ ID NO: 680587 - DNA, 25 bp, Mus musculus
gtcacaggcagtaccccaggaaaag

SEQ ID NO: 680588 - DNA, 25 bp, Mus musculus
gtcacaggcagttccccaggaaaag

SEQ ID NO: 680589 - DNA, 25 bp, Mus musculus
gtcacaggcccgaaaacaaccgaga

SEQ ID NO: 680590 - DNA, 25 bp, Mus musculus
gtcacaggcccgtaaacaaccgaga

SEQ ID NO: 680591 - DNA, 25 bp, Mus musculus
gtcacaggcgttaccagaaggcttt

SEQ ID NO: 680592 - DNA, 25 bp, Mus musculus
gtcacaggcgtttccagaaggcttt

SEQ ID NO: 680593 - DNA, 25 bp, Mus musculus
gtcacaggctgtaactttccatata

SEQ ID NO: 680594 - DNA, 25 bp, Mus musculus
gtcacaggctgttactttccatata

SEQ ID NO: 680595 - DNA, 25 bp, Mus musculus
gtcacaggcttgagccgggaagaac

SEQ ID NO: 680596 - DNA, 25 bp, Mus musculus
gtcacaggcttgtgccgggaagaac

SEQ ID NO: 680597 - DNA, 25 bp, Mus musculus
gtcacagggaataatctctattcga

SEQ ID NO: 680598 - DNA, 25 bp, Mus musculus
gtcacagggaattatctctattcga

SEQ ID NO: 680599 - DNA, 25 bp, Mus musculus
gtcacagggatgactgaacacagct

SEQ ID NO: 680600 - DNA, 25 bp, Mus musculus
gtcacagggatgtctgaacacagct

SEQ ID NO: 680601 - DNA, 25 bp, Mus musculus
gtcacagggccacctgagtgtccaa

SEQ ID NO: 680602 - DNA, 25 bp, Mus musculus
gtcacagggccagctgagtgtccaa

SEQ ID NO: 680603 - DNA, 25 bp, Mus musculus
gtcacagggcgcactgcttgttgaa

SEQ ID NO: 680604 - DNA, 25 bp, Mus musculus
gtcacagggcgctctgcttgttgaa

SEQ ID NO: 680605 - DNA, 25 bp, Mus musculus
gtcacagggttaattggaattggtt

SEQ ID NO: 680606 - DNA, 25 bp, Mus musculus
gtcacagggttatttggaattggtt

SEQ ID NO: 680607 - DNA, 25 bp, Mus musculus
gtcacaggtatgaagcagaagctct

SEQ ID NO: 680608 - DNA, 25 bp, Mus musculus
gtcacaggtatgtagcagaagctct

SEQ ID NO: 680609 - DNA, 25 bp, Mus musculus
gtcacaggtgacattcaaatcttag

SEQ ID NO: 680610 - DNA, 25 bp, Mus musculus
gtcacaggtgactttcaaatcttag

SEQ ID NO: 680611 - DNA, 25 bp, Mus musculus
gtcacaggtggcaatgaacaaaatt

SEQ ID NO: 680612 - DNA, 25 bp, Mus musculus
gtcacaggtggctatgaacaaaatt

SEQ ID NO: 680613 - DNA, 25 bp, Mus musculus
gtcacagtacagagaagatcttcat

SEQ ID NO: 680614 - DNA, 25 bp, Mus musculus
gtcacagtacagtgaagatcttcat

SEQ ID NO: 680615 - DNA, 25 bp, Mus musculus
gtcacagtacatctgcggaggtcca

SEQ ID NO: 680616 - DNA, 25 bp, Mus musculus
gtcacagtacatgtgcggaggtcca

SEQ ID NO: 680617 - DNA, 25 bp, Mus musculus
gtcacagtacgtaattggtccaaaa

SEQ ID NO: 680618 - DNA, 25 bp, Mus musculus
gtcacagtacgttattggtccaaaa

SEQ ID NO: 680619 - DNA, 25 bp, Mus musculus
gtcacagtactccatgaattcataa

SEQ ID NO: 680620 - DNA, 25 bp, Mus musculus
gtcacagtactcgatgaattcataa

SEQ ID NO: 680621 - DNA, 25 bp, Mus musculus
gtcacagtattacaagtttgcccca

SEQ ID NO: 680622 - DNA, 25 bp, Mus musculus
gtcacagtattactggtattacatc

SEQ ID NO: 680623 - DNA, 25 bp, Mus musculus
gtcacagtattagaagtttgcccca

SEQ ID NO: 680624 - DNA, 25 bp, Mus musculus
gtcacagtattagtggtattacatc

SEQ ID NO: 680625 - DNA, 25 bp, Mus musculus
gtcacagtcactaggaggaaagcaa

SEQ ID NO: 680626 - DNA, 25 bp, Mus musculus
gtcacagtcacttggaggaaagcaa

SEQ ID NO: 680627 - DNA, 25 bp, Mus musculus
gtcacagtcagacgcacaggtacag

SEQ ID NO: 680628 - DNA, 25 bp, Mus musculus
gtcacagtcagaggcacaggtacag

SEQ ID NO: 680629 - DNA, 25 bp, Mus musculus
gtcacagtcctgacttagagcagca

SEQ ID NO: 680630 - DNA, 25 bp, Mus musculus
gtcacagtcctgtcttagagcagca

SEQ ID NO: 680631 - DNA, 25 bp, Mus musculus
gtcacagtcttacaaattatcctca

SEQ ID NO: 680632 - DNA, 25 bp, Mus musculus
gtcacagtcttagaaattatcctca

SEQ ID NO: 680633 - DNA, 25 bp, Mus musculus
gtcacagtctttcggctctaaccca

SEQ ID NO: 680634 - DNA, 25 bp, Mus musculus
gtcacagtctttgggctctaaccca

SEQ ID NO: 680635 - DNA, 25 bp, Mus musculus
gtcacagtgaccacagacaccagaa

SEQ ID NO: 680636 - DNA, 25 bp, Mus musculus
gtcacagtgacctcagacaccagaa

SEQ ID NO: 680637 - DNA, 25 bp, Mus musculus
gtcacagtgactccagcatttacat

SEQ ID NO: 680638 - DNA, 25 bp, Mus musculus
gtcacagtgactgcagcatttacat

SEQ ID NO: 680639 - DNA, 25 bp, Mus musculus
gtcacagtgatcaggtggctcggaa

SEQ ID NO: 680640 - DNA, 25 bp, Mus musculus
gtcacagtgatctggtggctcggaa

SEQ ID NO: 680641 - DNA, 25 bp, Mus musculus
gtcacagtggaaaccctaagcgttc

SEQ ID NO: 680642 - DNA, 25 bp, Mus musculus
gtcacagtggaatccctaagcgttc

SEQ ID NO: 680643 - DNA, 25 bp, Mus musculus
gtcacagtggaccagaggttttcct

SEQ ID NO: 680644 - DNA, 25 bp, Mus musculus
gtcacagtggacgagaggttttcct

SEQ ID NO: 680645 - DNA, 25 bp, Mus musculus
gtcacagtggccacaataggagcaa

SEQ ID NO: 680646 - DNA, 25 bp, Mus musculus
gtcacagtggcctcaataggagcaa

SEQ ID NO: 680647 - DNA, 25 bp, Mus musculus
gtcacagttgaactgtctcctttaa

SEQ ID NO: 680648 - DNA, 25 bp, Mus musculus
gtcacagttgaagtgtctcctttaa

SEQ ID NO: 680649 - DNA, 25 bp, Mus musculus
gtcacagttgagagctgggcttcct

SEQ ID NO: 680650 - DNA, 25 bp, Mus musculus
gtcacagttgagtgctgggcttcct

SEQ ID NO: 680651 - DNA, 25 bp, Mus musculus
gtcacagttgataacttgcttgaaa

SEQ ID NO: 680652 - DNA, 25 bp, Mus musculus
gtcacagttgattacttgcttgaaa

SEQ ID NO: 680653 - DNA, 25 bp, Mus musculus
gtcacagttgtcatctcaccaacaa

SEQ ID NO: 680654 - DNA, 25 bp, Mus musculus
gtcacagttgtcttctcaccaacaa

SEQ ID NO: 680655 - DNA, 25 bp, Mus musculus
gtcacagtttaaattcatagggctt

SEQ ID NO: 680656 - DNA, 25 bp, Mus musculus
gtcacagtttaatttcatagggctt

SEQ ID NO: 680657 - DNA, 25 bp, Mus musculus
gtcacagttttacaagaacaatact

SEQ ID NO: 680658 - DNA, 25 bp, Mus musculus
gtcacagttttagaagaacaatact

SEQ ID NO: 680659 - DNA, 25 bp, Mus musculus
gtcacataaaaaccttgttgccatt

SEQ ID NO: 680660 - DNA, 25 bp, Mus musculus
gtcacataaaaagcttgttgccatt

SEQ ID NO: 680661 - DNA, 25 bp, Mus musculus
gtcacataattccaaacatcagcct

SEQ ID NO: 680662 - DNA, 25 bp, Mus musculus
gtcacataattcgaaacatcagcct

SEQ ID NO: 680663 - DNA, 25 bp, Mus musculus
gtcacatacacacacctcttggatc

SEQ ID NO: 680664 - DNA, 25 bp, Mus musculus
gtcacatacacagacctcttggatc

SEQ ID NO: 680665 - DNA, 25 bp, Mus musculus
gtcacatacccaactcctaagataa

SEQ ID NO: 680666 - DNA, 25 bp, Mus musculus
gtcacatacccatctcctaagataa

SEQ ID NO: 680667 - DNA, 25 bp, Mus musculus
gtcacatactgcatactgggttact

SEQ ID NO: 680668 - DNA, 25 bp, Mus musculus
gtcacatactgcatgctgatgttta

SEQ ID NO: 680669 - DNA, 25 bp, Mus musculus
gtcacatactgcttactgggttact

SEQ ID NO: 680670 - DNA, 25 bp, Mus musculus
gtcacatactgcttgctgatgttta

SEQ ID NO: 680671 - DNA, 25 bp, Mus musculus
gtcacatatcacacatcctgcatgt

SEQ ID NO: 680672 - DNA, 25 bp, Mus musculus
gtcacatatcactcatcctgcatgt

SEQ ID NO: 680673 - DNA, 25 bp, Mus musculus
gtcacatatgccatggaagctgtca

SEQ ID NO: 680674 - DNA, 25 bp, Mus musculus
gtcacatatgccttggaagctgtca

SEQ ID NO: 680675 - DNA, 25 bp, Mus musculus
gtcacatcaaaccagaaaacctatt

SEQ ID NO: 680676 - DNA, 25 bp, Mus musculus
gtcacatcaaacgagaaaacctatt

SEQ ID NO: 680677 - DNA, 25 bp, Mus musculus
gtcacatcaagaaatttccccttct

SEQ ID NO: 680678 - DNA, 25 bp, Mus musculus
gtcacatcaagatatttccccttct

SEQ ID NO: 680679 - DNA, 25 bp, Mus musculus
gtcacatcatcccaggaagactttg

SEQ ID NO: 680680 - DNA, 25 bp, Mus musculus
gtcacatcatccgaggaagactttg

SEQ ID NO: 680681 - DNA, 25 bp, Mus musculus
gtcacatcatttcgtagcagccttt

SEQ ID NO: 680682 - DNA, 25 bp, Mus musculus
gtcacatcatttggtagcagccttt

SEQ ID NO: 680683 - DNA, 25 bp, Mus musculus
gtcacatccaaaagactacagtttt

SEQ ID NO: 680684 - DNA, 25 bp, Mus musculus
gtcacatccaaatgactacagtttt

SEQ ID NO: 680685 - DNA, 25 bp, Mus musculus
gtcacatccctgaatagttctctgg

SEQ ID NO: 680686 - DNA, 25 bp, Mus musculus
gtcacatccctgtatagttctctgg

SEQ ID NO: 680687 - DNA, 25 bp, Mus musculus
gtcacatcccttacttcaaactgaa

SEQ ID NO: 680688 - DNA, 25 bp, Mus musculus
gtcacatccctttcttcaaactgaa

SEQ ID NO: 680689 - DNA, 25 bp, Mus musculus
gtcacatcctgacttgtaatgcttc

SEQ ID NO: 680690 - DNA, 25 bp, Mus musculus
gtcacatcctgagttgtaatgcttc

SEQ ID NO: 680691 - DNA, 25 bp, Mus musculus
gtcacatcggtcatagttgtggcct

SEQ ID NO: 680692 - DNA, 25 bp, Mus musculus
gtcacatcggtcttagttgtggcct

SEQ ID NO: 680693 - DNA, 25 bp, Mus musculus
gtcacatctaccaaaatattgcact

SEQ ID NO: 680694 - DNA, 25 bp, Mus musculus
gtcacatctacctaaatattgcact

SEQ ID NO: 680695 - DNA, 25 bp, Mus musculus
gtcacatctcctagacatgctgatg

SEQ ID NO: 680696 - DNA, 25 bp, Mus musculus
gtcacatctccttgacatgctgatg

SEQ ID NO: 680697 - DNA, 25 bp, Mus musculus
gtcacatctcttcagggacatcgag

SEQ ID NO: 680698 - DNA, 25 bp, Mus musculus
gtcacatctcttgagggacatcgag

SEQ ID NO: 680699 - DNA, 25 bp, Mus musculus
gtcacatctgtgcttcagcttggaa

SEQ ID NO: 680700 - DNA, 25 bp, Mus musculus
gtcacatctgtggttcagcttggaa

SEQ ID NO: 680701 - DNA, 25 bp, Mus musculus
gtcacatcttaactaattctgatac

SEQ ID NO: 680702 - DNA, 25 bp, Mus musculus
gtcacatcttaagtaattctgatac

SEQ ID NO: 680703 - DNA, 25 bp, Mus musculus
gtcacatcttgccaggctagtctat

SEQ ID NO: 680704 - DNA, 25 bp, Mus musculus
gtcacatcttgcgaggctagtctat

SEQ ID NO: 680705 - DNA, 25 bp, Mus musculus
gtcacatgacctacgtgcaaggcgg

SEQ ID NO: 680706 - DNA, 25 bp, Mus musculus
gtcacatgaccttcgtgcaaggcgg

SEQ ID NO: 680707 - DNA, 25 bp, Mus musculus
gtcacatgatatactatgttggtgg

SEQ ID NO: 680708 - DNA, 25 bp, Mus musculus
gtcacatgatattctatgttggtgg

SEQ ID NO: 680709 - DNA, 25 bp, Mus musculus
gtcacatgcctaattgttctctttt

SEQ ID NO: 680710 - DNA, 25 bp, Mus musculus
gtcacatgcctatttgttctctttt

SEQ ID NO: 680711 - DNA, 25 bp, Mus musculus
gtcacatgctacatatcagtgctgg

SEQ ID NO: 680712 - DNA, 25 bp, Mus musculus
gtcacatgctacttatcagtgctgg

SEQ ID NO: 680713 - DNA, 25 bp, Mus musculus
gtcacatggctgctcccagggccag

SEQ ID NO: 680714 - DNA, 25 bp, Mus musculus
gtcacatggctggtcccagggccag

SEQ ID NO: 680715 - DNA, 25 bp, Mus musculus
gtcacatggttccttctgaccaagg

SEQ ID NO: 680716 - DNA, 25 bp, Mus musculus
gtcacatggttcgttctgaccaagg

SEQ ID NO: 680717 - DNA, 25 bp, Mus musculus
gtcacatgtagcagatctgtagact

SEQ ID NO: 680718 - DNA, 25 bp, Mus musculus
gtcacatgtagctgatctgtagact

SEQ ID NO: 680719 - DNA, 25 bp, Mus musculus
gtcacatgtgacatctgtactcagt

SEQ ID NO: 680720 - DNA, 25 bp, Mus musculus
gtcacatgtgacttctgtactcagt

SEQ ID NO: 680721 - DNA, 25 bp, Mus musculus
gtcacatgtttcagaattcctcctg

SEQ ID NO: 680722 - DNA, 25 bp, Mus musculus
gtcacatgtttctgaattcctcctg

SEQ ID NO: 680723 - DNA, 25 bp, Mus musculus
gtcacattacaaagccagacacaag

SEQ ID NO: 680724 - DNA, 25 bp, Mus musculus
gtcacattacaatgccagacacaag

SEQ ID NO: 680725 - DNA, 25 bp, Mus musculus
gtcacattagtaagtcttcatcaag

SEQ ID NO: 680726 - DNA, 25 bp, Mus musculus
gtcacattagtatgtcttcatcaag

SEQ ID NO: 680727 - DNA, 25 bp, Mus musculus
gtcacattagtgaatccttggcttg

SEQ ID NO: 680728 - DNA, 25 bp, Mus musculus
gtcacattagtgtatccttggcttg

SEQ ID NO: 680729 - DNA, 25 bp, Mus musculus
gtcacattatatctaagttggtctg

SEQ ID NO: 680730 - DNA, 25 bp, Mus musculus
gtcacattatatgtaagttggtctg

SEQ ID NO: 680731 - DNA, 25 bp, Mus musculus
gtcacattattcagtaagaacttac

SEQ ID NO: 680732 - DNA, 25 bp, Mus musculus
gtcacattattctgtaagaacttac

SEQ ID NO: 680733 - DNA, 25 bp, Mus musculus
gtcacattcactatgttctttggaa

SEQ ID NO: 680734 - DNA, 25 bp, Mus musculus
gtcacattcactttgttctttggaa

SEQ ID NO: 680735 - DNA, 25 bp, Mus musculus
gtcacattcatgagccatgcgttca

SEQ ID NO: 680736 - DNA, 25 bp, Mus musculus
gtcacattcatgtgccatgcgttca

SEQ ID NO: 680737 - DNA, 25 bp, Mus musculus
gtcacattctgccaatcacgttgtg

SEQ ID NO: 680738 - DNA, 25 bp, Mus musculus
gtcacattctgcgaatcacgttgtg

SEQ ID NO: 680739 - DNA, 25 bp, Mus musculus
gtcacattcttgactttctccttgg

SEQ ID NO: 680740 - DNA, 25 bp, Mus musculus
gtcacattcttgaggagtttgctac

SEQ ID NO: 680741 - DNA, 25 bp, Mus musculus
gtcacattcttgtctttctccttgg

SEQ ID NO: 680742 - DNA, 25 bp, Mus musculus
gtcacattcttgtggagtttgctac

SEQ ID NO: 680743 - DNA, 25 bp, Mus musculus
gtcacattgcatactattgccttct

SEQ ID NO: 680744 - DNA, 25 bp, Mus musculus
gtcacattgcattctattgccttct

SEQ ID NO: 680745 - DNA, 25 bp, Mus musculus
gtcacattgggaatgccgttcctga

SEQ ID NO: 680746 - DNA, 25 bp, Mus musculus
gtcacattgggattgccgttcctga

SEQ ID NO: 680747 - DNA, 25 bp, Mus musculus
gtcacattgttaagccaatataata

SEQ ID NO: 680748 - DNA, 25 bp, Mus musculus
gtcacattgttatgccaatataata

SEQ ID NO: 680749 - DNA, 25 bp, Mus musculus
gtcacattgttccatgttttcaata

SEQ ID NO: 680750 - DNA, 25 bp, Mus musculus
gtcacattgttcgatgttttcaata

SEQ ID NO: 680751 - DNA, 25 bp, Mus musculus
gtcacattgttgcagtggctacacc

SEQ ID NO: 680752 - DNA, 25 bp, Mus musculus
gtcacattgttggagtggctacacc

SEQ ID NO: 680753 - DNA, 25 bp, Mus musculus
gtcacatttccaaaacatcaagcca

SEQ ID NO: 680754 - DNA, 25 bp, Mus musculus
gtcacatttccataacatcaagcca

SEQ ID NO: 680755 - DNA, 25 bp, Mus musculus
gtcacatttcctacgattccattaa

SEQ ID NO: 680756 - DNA, 25 bp, Mus musculus
gtcacatttcctctctacttactaa

SEQ ID NO: 680757 - DNA, 25 bp, Mus musculus
gtcacatttcctgtctacttactaa

SEQ ID NO: 680758 - DNA, 25 bp, Mus musculus
gtcacatttccttcgattccattaa

SEQ ID NO: 680759 - DNA, 25 bp, Mus musculus
gtcacatttcttaggattagctaag

SEQ ID NO: 680760 - DNA, 25 bp, Mus musculus
gtcacatttctttggattagctaag

SEQ ID NO: 680761 - DNA, 25 bp, Mus musculus
gtcaccaaaagaccactttgcctga

SEQ ID NO: 680762 - DNA, 25 bp, Mus musculus
gtcaccaaaagagcactttgcctga

SEQ ID NO: 680763 - DNA, 25 bp, Mus musculus
gtcaccaaaccacatgtgatcttca

SEQ ID NO: 680764 - DNA, 25 bp, Mus musculus
gtcaccaaaccagatgtgatcttca

SEQ ID NO: 680765 - DNA, 25 bp, Mus musculus
gtcaccaaacgcaacatcctagatg

SEQ ID NO: 680766 - DNA, 25 bp, Mus musculus
gtcaccaaacgctacatcctagatg

SEQ ID NO: 680767 - DNA, 25 bp, Mus musculus
gtcaccaaagcaatacacctacaca

SEQ ID NO: 680768 - DNA, 25 bp, Mus musculus
gtcaccaaagcattacacctacaca

SEQ ID NO: 680769 - DNA, 25 bp, Mus musculus
gtcaccaaataaccacaacttctat

SEQ ID NO: 680770 - DNA, 25 bp, Mus musculus
gtcaccaaataagcacaacttctat

SEQ ID NO: 680771 - DNA, 25 bp, Mus musculus
gtcaccaaatggctctgttaactct

SEQ ID NO: 680772 - DNA, 25 bp, Mus musculus
gtcaccaaatgggtctgttaactct

SEQ ID NO: 680773 - DNA, 25 bp, Mus musculus
gtcaccaacagacttctgactgcat

SEQ ID NO: 680774 - DNA, 25 bp, Mus musculus
gtcaccaacagagttctgactgcat

SEQ ID NO: 680775 - DNA, 25 bp, Mus musculus
gtcaccaacagccttctcgagaaat

SEQ ID NO: 680776 - DNA, 25 bp, Mus musculus
gtcaccaacagcgttctcgagaaat

SEQ ID NO: 680777 - DNA, 25 bp, Mus musculus
gtcaccaacatcaaacgctttacat

SEQ ID NO: 680778 - DNA, 25 bp, Mus musculus
gtcaccaacatctaacgctttacat

SEQ ID NO: 680779 - DNA, 25 bp, Mus musculus
gtcaccaagacacgattcgaactcg

SEQ ID NO: 680780 - DNA, 25 bp, Mus musculus
gtcaccaagacaggattcgaactcg

SEQ ID NO: 680781 - DNA, 25 bp, Mus musculus
gtcaccaagagcacttttttccagt

SEQ ID NO: 680782 - DNA, 25 bp, Mus musculus
gtcaccaagagctcttttttccagt

SEQ ID NO: 680783 - DNA, 25 bp, Mus musculus
gtcaccaagcgcatccatctggaag

SEQ ID NO: 680784 - DNA, 25 bp, Mus musculus
gtcaccaagcgcttccatctggaag

SEQ ID NO: 680785 - DNA, 25 bp, Mus musculus
gtcaccaagctcaaccctgaaattt

SEQ ID NO: 680786 - DNA, 25 bp, Mus musculus
gtcaccaagctcaggaagttcctta

SEQ ID NO: 680787 - DNA, 25 bp, Mus musculus
gtcaccaagctctaccctgaaattt

SEQ ID NO: 680788 - DNA, 25 bp, Mus musculus
gtcaccaagctctggaagttcctta

SEQ ID NO: 680789 - DNA, 25 bp, Mus musculus
gtcaccaaggagctccactgtgcaa

SEQ ID NO: 680790 - DNA, 25 bp, Mus musculus
gtcaccaaggaggtccactgtgcaa

SEQ ID NO: 680791 - DNA, 25 bp, Mus musculus
gtcaccaaggcccaaaagaaggatg

SEQ ID NO: 680792 - DNA, 25 bp, Mus musculus
gtcaccaaggccgaaaagaaggatg

SEQ ID NO: 680793 - DNA, 25 bp, Mus musculus
gtcaccaagggtcagctcctgtgcc

SEQ ID NO: 680794 - DNA, 25 bp, Mus musculus
gtcaccaagggtgagctcctgtgcc

SEQ ID NO: 680795 - DNA, 25 bp, Mus musculus
gtcaccaatattctggaccctttca

SEQ ID NO: 680796 - DNA, 25 bp, Mus musculus
gtcaccaatattgtggaccctttca

SEQ ID NO: 680797 - DNA, 25 bp, Mus musculus
gtcaccaatttcacttagtgctgaa

SEQ ID NO: 680798 - DNA, 25 bp, Mus musculus
gtcaccaatttctcttagtgctgaa

SEQ ID NO: 680799 - DNA, 25 bp, Mus musculus
gtcaccacaaccaacaccaggtttg

SEQ ID NO: 680800 - DNA, 25 bp, Mus musculus
gtcaccacaacctacaccaggtttg

SEQ ID NO: 680801 - DNA, 25 bp, Mus musculus
gtcaccacaatgcaaaactcgtact

SEQ ID NO: 680802 - DNA, 25 bp, Mus musculus
gtcaccacaatggaaaactcgtact

SEQ ID NO: 680803 - DNA, 25 bp, Mus musculus
gtcaccacaggcagtagctccaggg

SEQ ID NO: 680804 - DNA, 25 bp, Mus musculus
gtcaccacaggctgtagctccaggg

SEQ ID NO: 680805 - DNA, 25 bp, Mus musculus
gtcaccacatttaaggcatccatta

SEQ ID NO: 680806 - DNA, 25 bp, Mus musculus
gtcaccacattttaggcatccatta

SEQ ID NO: 680807 - DNA, 25 bp, Mus musculus
gtcaccaccgtactcacagacatag

SEQ ID NO: 680808 - DNA, 25 bp, Mus musculus
gtcaccaccgtagtcacagacatag

SEQ ID NO: 680809 - DNA, 25 bp, Mus musculus
gtcaccacctgacagagggcgacac

SEQ ID NO: 680810 - DNA, 25 bp, Mus musculus
gtcaccacctgagagagggcgacac

SEQ ID NO: 680811 - DNA, 25 bp, Mus musculus
gtcaccacctggacctaatttatgt

SEQ ID NO: 680812 - DNA, 25 bp, Mus musculus
gtcaccacctggtcctaatttatgt

SEQ ID NO: 680813 - DNA, 25 bp, Mus musculus
gtcaccacgggtcctgagctttgag

SEQ ID NO: 680814 - DNA, 25 bp, Mus musculus
gtcaccacgggtgctgagctttgag

SEQ ID NO: 680815 - DNA, 25 bp, Mus musculus
gtcaccacgtggctgttcttagttg

SEQ ID NO: 680816 - DNA, 25 bp, Mus musculus
gtcaccacgtgggtgttcttagttg

SEQ ID NO: 680817 - DNA, 25 bp, Mus musculus
gtcaccactaccagcagtcgatgaa

SEQ ID NO: 680818 - DNA, 25 bp, Mus musculus
gtcaccactacctgcagtcgatgaa

SEQ ID NO: 680819 - DNA, 25 bp, Mus musculus
gtcaccactagccatgtgccagtag

SEQ ID NO: 680820 - DNA, 25 bp, Mus musculus
gtcaccactagcgatgtgccagtag

SEQ ID NO: 680821 - DNA, 25 bp, Mus musculus
gtcaccactagtcactgtgagtaat

SEQ ID NO: 680822 - DNA, 25 bp, Mus musculus
gtcaccactagtgactgtgagtaat

SEQ ID NO: 680823 - DNA, 25 bp, Mus musculus
gtcaccacttaacagtttactccct

SEQ ID NO: 680824 - DNA, 25 bp, Mus musculus
gtcaccacttaagagtttactccct

SEQ ID NO: 680825 - DNA, 25 bp, Mus musculus
gtcaccacttgtagcaagacagtga

SEQ ID NO: 680826 - DNA, 25 bp, Mus musculus
gtcaccacttgttgcaagacagtga

SEQ ID NO: 680827 - DNA, 25 bp, Mus musculus
gtcaccagaaaaagctttcttccac

SEQ ID NO: 680828 - DNA, 25 bp, Mus musculus
gtcaccagaaaatgctttcttccac

SEQ ID NO: 680829 - DNA, 25 bp, Mus musculus
gtcaccagacagaagtccttcctct

SEQ ID NO: 680830 - DNA, 25 bp, Mus musculus
gtcaccagacagtagtccttcctct

SEQ ID NO: 680831 - DNA, 25 bp, Mus musculus
gtcaccagacggagccgagtgtcaa

SEQ ID NO: 680832 - DNA, 25 bp, Mus musculus
gtcaccagacggtgccgagtgtcaa

SEQ ID NO: 680833 - DNA, 25 bp, Mus musculus
gtcaccagagctaggacacaagacc

SEQ ID NO: 680834 - DNA, 25 bp, Mus musculus
gtcaccagagctcctgtaggcggaa

SEQ ID NO: 680835 - DNA, 25 bp, Mus musculus
gtcaccagagctgctgtaggcggaa

SEQ ID NO: 680836 - DNA, 25 bp, Mus musculus
gtcaccagagcttggacacaagacc

SEQ ID NO: 680837 - DNA, 25 bp, Mus musculus
gtcaccagagtaaacaaccgcacaa

SEQ ID NO: 680838 - DNA, 25 bp, Mus musculus
gtcaccagagtatacaaccgcacaa

SEQ ID NO: 680839 - DNA, 25 bp, Mus musculus
gtcaccagatggaggtcttaccttt

SEQ ID NO: 680840 - DNA, 25 bp, Mus musculus
gtcaccagatggtggtcttaccttt

SEQ ID NO: 680841 - DNA, 25 bp, Mus musculus
gtcaccagcagcctgtggacagaca

SEQ ID NO: 680842 - DNA, 25 bp, Mus musculus
gtcaccagcagcgtgtggacagaca

SEQ ID NO: 680843 - DNA, 25 bp, Mus musculus
gtcaccagcataattttaccttagg

SEQ ID NO: 680844 - DNA, 25 bp, Mus musculus
gtcaccagcatatttttaccttagg

SEQ ID NO: 680845 - DNA, 25 bp, Mus musculus
gtcaccagccatcgttgtcatcagc

SEQ ID NO: 680846 - DNA, 25 bp, Mus musculus
gtcaccagccatggttgtcatcagc

SEQ ID NO: 680847 - DNA, 25 bp, Mus musculus
gtcaccagcctaaggaattccactg

SEQ ID NO: 680848 - DNA, 25 bp, Mus musculus
gtcaccagcctatggaattccactg

SEQ ID NO: 680849 - DNA, 25 bp, Mus musculus
gtcaccagctcaaaaactcatctaa

SEQ ID NO: 680850 - DNA, 25 bp, Mus musculus
gtcaccagctcataaactcatctaa

SEQ ID NO: 680851 - DNA, 25 bp, Mus musculus
gtcaccaggaacagtctgtgtccct

SEQ ID NO: 680852 - DNA, 25 bp, Mus musculus
gtcaccaggaactgtctgtgtccct

SEQ ID NO: 680853 - DNA, 25 bp, Mus musculus
gtcaccaggactcattagcactaaa

SEQ ID NO: 680854 - DNA, 25 bp, Mus musculus
gtcaccaggactgattagcactaaa

SEQ ID NO: 680855 - DNA, 25 bp, Mus musculus
gtcaccaggccaaacttacttactt

SEQ ID NO: 680856 - DNA, 25 bp, Mus musculus
gtcaccaggccatacttacttactt

SEQ ID NO: 680857 - DNA, 25 bp, Mus musculus
gtcaccagggacaagaaagcagaga

SEQ ID NO: 680858 - DNA, 25 bp, Mus musculus
gtcaccagggactagaaagcagaga

SEQ ID NO: 680859 - DNA, 25 bp, Mus musculus
gtcaccagggttcgagtacctctcg

SEQ ID NO: 680860 - DNA, 25 bp, Mus musculus
gtcaccagggttggagtacctctcg

SEQ ID NO: 680861 - DNA, 25 bp, Mus musculus
gtcaccaggtgactctcagtcatgt

SEQ ID NO: 680862 - DNA, 25 bp, Mus musculus
gtcaccaggtgagtctcagtcatgt

SEQ ID NO: 680863 - DNA, 25 bp, Mus musculus
gtcaccagtcaaagttatctcatca

SEQ ID NO: 680864 - DNA, 25 bp, Mus musculus
gtcaccagtcaatgttatctcatca

SEQ ID NO: 680865 - DNA, 25 bp, Mus musculus
gtcaccatacccagtttgttctttt

SEQ ID NO: 680866 - DNA, 25 bp, Mus musculus
gtcaccataccctgtttgttctttt

SEQ ID NO: 680867 - DNA, 25 bp, Mus musculus
gtcaccatcccaaaaagacttgagt

SEQ ID NO: 680868 - DNA, 25 bp, Mus musculus
gtcaccatcccataaagacttgagt

SEQ ID NO: 680869 - DNA, 25 bp, Mus musculus
gtcaccatccctcctgagctaagga

SEQ ID NO: 680870 - DNA, 25 bp, Mus musculus
gtcaccatccctgctgagctaagga

SEQ ID NO: 680871 - DNA, 25 bp, Mus musculus
gtcaccatcgaccacttcaaggagg

SEQ ID NO: 680872 - DNA, 25 bp, Mus musculus
gtcaccatcgacgacttcaaggagg

SEQ ID NO: 680873 - DNA, 25 bp, Mus musculus
gtcaccatcggacgccagaaaaagg

SEQ ID NO: 680874 - DNA, 25 bp, Mus musculus
gtcaccatcggaggccagaaaaagg

SEQ ID NO: 680875 - DNA, 25 bp, Mus musculus
gtcaccatctccacaaatggatcat

SEQ ID NO: 680876 - DNA, 25 bp, Mus musculus
gtcaccatctcctcaaatggatcat

SEQ ID NO: 680877 - DNA, 25 bp, Mus musculus
gtcaccatctggaccatcgtgaaga

SEQ ID NO: 680878 - DNA, 25 bp, Mus musculus
gtcaccatctggtccatcgtgaaga

SEQ ID NO: 680879 - DNA, 25 bp, Mus musculus
gtcaccatcttacttcatccaagaa

SEQ ID NO: 680880 - DNA, 25 bp, Mus musculus
gtcaccatcttagttcatccaagaa

SEQ ID NO: 680881 - DNA, 25 bp, Mus musculus
gtcaccatgactcccaagacgctag

SEQ ID NO: 680882 - DNA, 25 bp, Mus musculus
gtcaccatgactgccaagacgctag

SEQ ID NO: 680883 - DNA, 25 bp, Mus musculus
gtcaccatgattatccagggccaga

SEQ ID NO: 680884 - DNA, 25 bp, Mus musculus
gtcaccatgattttccagggccaga

SEQ ID NO: 680885 - DNA, 25 bp, Mus musculus
gtcaccatggaaaccagccactggg

SEQ ID NO: 680886 - DNA, 25 bp, Mus musculus
gtcaccatggaatccagccactggg

SEQ ID NO: 680887 - DNA, 25 bp, Mus musculus
gtcaccatggacctgagatctggcc

SEQ ID NO: 680888 - DNA, 25 bp, Mus musculus
gtcaccatggacgtgagatctggcc

SEQ ID NO: 680889 - DNA, 25 bp, Mus musculus
gtcaccatggagactgggtcaccaa

SEQ ID NO: 680890 - DNA, 25 bp, Mus musculus
gtcaccatggagtctgggtcaccaa

SEQ ID NO: 680891 - DNA, 25 bp, Mus musculus
gtcaccatgtctccagagagagctt

SEQ ID NO: 680892 - DNA, 25 bp, Mus musculus
gtcaccatgtctgcagagagagctt

SEQ ID NO: 680893 - DNA, 25 bp, Mus musculus
gtcaccatgtgaactgtatcaataa

SEQ ID NO: 680894 - DNA, 25 bp, Mus musculus
gtcaccatgtgatctgtatcaataa

SEQ ID NO: 680895 - DNA, 25 bp, Mus musculus
gtcaccattatgaacaaggacctga

SEQ ID NO: 680896 - DNA, 25 bp, Mus musculus
gtcaccattatgtacaaggacctga

SEQ ID NO: 680897 - DNA, 25 bp, Mus musculus
gtcaccattcatacatacagcttat

SEQ ID NO: 680898 - DNA, 25 bp, Mus musculus
gtcaccattcattcatacagcttat

SEQ ID NO: 680899 - DNA, 25 bp, Mus musculus
gtcaccattgcacaggcggagtttt

SEQ ID NO: 680900 - DNA, 25 bp, Mus musculus
gtcaccattgcagaggcggagtttt

SEQ ID NO: 680901 - DNA, 25 bp, Mus musculus
gtcaccatttggaggctatataatg

SEQ ID NO: 680902 - DNA, 25 bp, Mus musculus
gtcaccatttggtggctatataatg

SEQ ID NO: 680903 - DNA, 25 bp, Mus musculus
gtcaccatttgtatgtttttgctgg

SEQ ID NO: 680904 - DNA, 25 bp, Mus musculus
gtcaccatttgtttgtttttgctgg

SEQ ID NO: 680905 - DNA, 25 bp, Mus musculus
gtcacccaatagacattggctctgg

SEQ ID NO: 680906 - DNA, 25 bp, Mus musculus
gtcacccaatagtcattggctctgg

SEQ ID NO: 680907 - DNA, 25 bp, Mus musculus
gtcacccacagacaagtcgggccag

SEQ ID NO: 680908 - DNA, 25 bp, Mus musculus
gtcacccacagagaagtcgggccag

SEQ ID NO: 680909 - DNA, 25 bp, Mus musculus
gtcacccacatcactttacttttct

SEQ ID NO: 680910 - DNA, 25 bp, Mus musculus
gtcacccacatctctttacttttct

SEQ ID NO: 680911 - DNA, 25 bp, Mus musculus
gtcacccacgagatcttgcgaagtc

SEQ ID NO: 680912 - DNA, 25 bp, Mus musculus
gtcacccacgagttcttgcgaagtc

SEQ ID NO: 680913 - DNA, 25 bp, Mus musculus
gtcacccactgacaagagtctcatg

SEQ ID NO: 680914 - DNA, 25 bp, Mus musculus
gtcacccactgagaagagtctcatg

SEQ ID NO: 680915 - DNA, 25 bp, Mus musculus
gtcacccagcttaacacgctattgg

SEQ ID NO: 680916 - DNA, 25 bp, Mus musculus
gtcacccagctttacacgctattgg

SEQ ID NO: 680917 - DNA, 25 bp, Mus musculus
gtcacccagtgaatccttagagcct

SEQ ID NO: 680918 - DNA, 25 bp, Mus musculus
gtcacccagtgattccttagagcct

SEQ ID NO: 680919 - DNA, 25 bp, Mus musculus
gtcacccatcaaatgcttcatggtc

SEQ ID NO: 680920 - DNA, 25 bp, Mus musculus
gtcacccatcaactcgcagattcaa

SEQ ID NO: 680921 - DNA, 25 bp, Mus musculus
gtcacccatcaagtcgcagattcaa

SEQ ID NO: 680922 - DNA, 25 bp, Mus musculus
gtcacccatcaattgcttcatggtc

SEQ ID NO: 680923 - DNA, 25 bp, Mus musculus
gtcacccatcggatgtgagcgcatt

SEQ ID NO: 680924 - DNA, 25 bp, Mus musculus
gtcacccatcggttgtgagcgcatt

SEQ ID NO: 680925 - DNA, 25 bp, Mus musculus
gtcacccatgtcatctgcattctga

SEQ ID NO: 680926 - DNA, 25 bp, Mus musculus
gtcacccatgtcttctgcattctga

SEQ ID NO: 680927 - DNA, 25 bp, Mus musculus
gtcaccccaatacagtacttctaag

SEQ ID NO: 680928 - DNA, 25 bp, Mus musculus
gtcaccccaatagagtacttctaag

SEQ ID NO: 680929 - DNA, 25 bp, Mus musculus
gtcaccccaatcattggtctgatgt

SEQ ID NO: 680930 - DNA, 25 bp, Mus musculus
gtcaccccaatctttggtctgatgt

SEQ ID NO: 680931 - DNA, 25 bp, Mus musculus
gtcaccccagagacagcaattggct

SEQ ID NO: 680932 - DNA, 25 bp, Mus musculus
gtcaccccagagtcagcaattggct

SEQ ID NO: 680933 - DNA, 25 bp, Mus musculus
gtcaccccagtgacttatcaagaga

SEQ ID NO: 680934 - DNA, 25 bp, Mus musculus
gtcaccccagtgtcttatcaagaga

SEQ ID NO: 680935 - DNA, 25 bp, Mus musculus
gtcacccctgtaacagctaagcaga

SEQ ID NO: 680936 - DNA, 25 bp, Mus musculus
gtcacccctgtatcagctaagcaga

SEQ ID NO: 680937 - DNA, 25 bp, Mus musculus
gtcaccccttcgagaaaggaccatt

SEQ ID NO: 680938 - DNA, 25 bp, Mus musculus
gtcaccccttcgtgaaaggaccatt

SEQ ID NO: 680939 - DNA, 25 bp, Mus musculus
gtcacccgaagtaagcttgatctgc

SEQ ID NO: 680940 - DNA, 25 bp, Mus musculus
gtcacccgaagttagcttgatctgc

SEQ ID NO: 680941 - DNA, 25 bp, Mus musculus
gtcacccgaggacctcaggtccgaa

SEQ ID NO: 680942 - DNA, 25 bp, Mus musculus
gtcacccgaggagctcaggtccgaa

SEQ ID NO: 680943 - DNA, 25 bp, Mus musculus
gtcacccgcaacacatgcacctgtg

SEQ ID NO: 680944 - DNA, 25 bp, Mus musculus
gtcacccgcaactcatgcacctgtg

SEQ ID NO: 680945 - DNA, 25 bp, Mus musculus
gtcacccgctgcatgctggatagat

SEQ ID NO: 680946 - DNA, 25 bp, Mus musculus
gtcacccgctgcttgctggatagat

SEQ ID NO: 680947 - DNA, 25 bp, Mus musculus
gtcacccgtgagcaatgaagtgcct

SEQ ID NO: 680948 - DNA, 25 bp, Mus musculus
gtcacccgtgaggaatgaagtgcct

SEQ ID NO: 680949 - DNA, 25 bp, Mus musculus
gtcaccctagacctctaatgtcaag

SEQ ID NO: 680950 - DNA, 25 bp, Mus musculus
gtcaccctagacgtctaatgtcaag

SEQ ID NO: 680951 - DNA, 25 bp, Mus musculus
gtcaccctagctacagggccaagga

SEQ ID NO: 680952 - DNA, 25 bp, Mus musculus
gtcaccctagcttcagggccaagga

SEQ ID NO: 680953 - DNA, 25 bp, Mus musculus
gtcaccctcatcaccaaatggaacc

SEQ ID NO: 680954 - DNA, 25 bp, Mus musculus
gtcaccctcatctccaaatggaacc

SEQ ID NO: 680955 - DNA, 25 bp, Mus musculus
gtcaccctcctaaacacgcaagtgg

SEQ ID NO: 680956 - DNA, 25 bp, Mus musculus
gtcaccctcctatacacgcaagtgg

SEQ ID NO: 680957 - DNA, 25 bp, Mus musculus
gtcaccctcgataaaaggacactgt

SEQ ID NO: 680958 - DNA, 25 bp, Mus musculus
gtcaccctcgattaaaggacactgt

SEQ ID NO: 680959 - DNA, 25 bp, Mus musculus
gtcaccctcttgattgcttatgaaa

SEQ ID NO: 680960 - DNA, 25 bp, Mus musculus
gtcaccctcttgtttgcttatgaaa

SEQ ID NO: 680961 - DNA, 25 bp, Mus musculus
gtcaccctgaatactctgagtggtt

SEQ ID NO: 680962 - DNA, 25 bp, Mus musculus
gtcaccctgaattctctgagtggtt

SEQ ID NO: 680963 - DNA, 25 bp, Mus musculus
gtcaccctgagacaagttcttggaa

SEQ ID NO: 680964 - DNA, 25 bp, Mus musculus
gtcaccctgagagaagttcttggaa

SEQ ID NO: 680965 - DNA, 25 bp, Mus musculus
gtcaccctgccaaacaagctaatat

SEQ ID NO: 680966 - DNA, 25 bp, Mus musculus
gtcaccctgccatacaagctaatat

SEQ ID NO: 680967 - DNA, 25 bp, Mus musculus
gtcaccctgcctcttggtgggagta

SEQ ID NO: 680968 - DNA, 25 bp, Mus musculus
gtcaccctgcctgttggtgggagta

SEQ ID NO: 680969 - DNA, 25 bp, Mus musculus
gtcaccctgggcattccaagattga

SEQ ID NO: 680970 - DNA, 25 bp, Mus musculus
gtcaccctgggctttccaagattga

SEQ ID NO: 680971 - DNA, 25 bp, Mus musculus
gtcaccctgttactagaaattacca

SEQ ID NO: 680972 - DNA, 25 bp, Mus musculus
gtcaccctgttagtagaaattacca

SEQ ID NO: 680973 - DNA, 25 bp, Mus musculus
gtcaccctgttcagctgcatttaat

SEQ ID NO: 680974 - DNA, 25 bp, Mus musculus
gtcaccctgttctgctgcatttaat

SEQ ID NO: 680975 - DNA, 25 bp, Mus musculus
gtcacccttaatctgatctctgtgg

SEQ ID NO: 680976 - DNA, 25 bp, Mus musculus
gtcacccttaatgtgatctctgtgg

SEQ ID NO: 680977 - DNA, 25 bp, Mus musculus
gtcacccttaggacgagagaagcaa

SEQ ID NO: 680978 - DNA, 25 bp, Mus musculus
gtcacccttaggtcgagagaagcaa

SEQ ID NO: 680979 - DNA, 25 bp, Mus musculus
gtcacccttcagattatcacaggca

SEQ ID NO: 680980 - DNA, 25 bp, Mus musculus
gtcacccttcagtttatcacaggca

SEQ ID NO: 680981 - DNA, 25 bp, Mus musculus
gtcacccttctgagctgtatagcaa

SEQ ID NO: 680982 - DNA, 25 bp, Mus musculus
gtcacccttctgtgctgtatagcaa

SEQ ID NO: 680983 - DNA, 25 bp, Mus musculus
gtcacccttgttcgttttacagaag

SEQ ID NO: 680984 - DNA, 25 bp, Mus musculus
gtcacccttgttggttttacagaag

SEQ ID NO: 680985 - DNA, 25 bp, Mus musculus
gtcaccgaatcactttctttcagag

SEQ ID NO: 680986 - DNA, 25 bp, Mus musculus
gtcaccgaatcagtttctttcagag

SEQ ID NO: 680987 - DNA, 25 bp, Mus musculus
gtcaccgacagcctaagtcttttgt

SEQ ID NO: 680988 - DNA, 25 bp, Mus musculus
gtcaccgacagcgtaagtcttttgt

SEQ ID NO: 680989 - DNA, 25 bp, Mus musculus
gtcaccgaccggcttctagaaattg

SEQ ID NO: 680990 - DNA, 25 bp, Mus musculus
gtcaccgaccgggttctagaaattg

SEQ ID NO: 680991 - DNA, 25 bp, Mus musculus
gtcaccgacgctattgttgctggag

SEQ ID NO: 680992 - DNA, 25 bp, Mus musculus
gtcaccgacgcttttgttgctggag

SEQ ID NO: 680993 - DNA, 25 bp, Mus musculus
gtcaccgagaggcttcattaacaaa

SEQ ID NO: 680994 - DNA, 25 bp, Mus musculus
gtcaccgagagggttcattaacaaa

SEQ ID NO: 680995 - DNA, 25 bp, Mus musculus
gtcaccgagatacaccctgagacca

SEQ ID NO: 680996 - DNA, 25 bp, Mus musculus
gtcaccgagatagaccctgagacca

SEQ ID NO: 680997 - DNA, 25 bp, Mus musculus
gtcaccgaggagaacacttgtagct

SEQ ID NO: 680998 - DNA, 25 bp, Mus musculus
gtcaccgaggagtacacttgtagct

SEQ ID NO: 680999 - DNA, 25 bp, Mus musculus
gtcaccgaggtgaaggtctcttcct

SEQ ID NO: 681000 - DNA, 25 bp, Mus musculus
gtcaccgaggtgtaggtctcttcct

SEQ ID NO: 681001 - DNA, 25 bp, Mus musculus
gtcaccgagtaactcttgtcagcat

SEQ ID NO: 681002 - DNA, 25 bp, Mus musculus
gtcaccgagtaagtcttgtcagcat

SEQ ID NO: 681003 - DNA, 25 bp, Mus musculus
gtcaccgatcagcttcatgtaccat

SEQ ID NO: 681004 - DNA, 25 bp, Mus musculus
gtcaccgatcaggttcatgtaccat

SEQ ID NO: 681005 - DNA, 25 bp, Mus musculus
gtcaccgccatgcacgtggtctacg

SEQ ID NO: 681006 - DNA, 25 bp, Mus musculus
gtcaccgccatggacgtggtctacg

SEQ ID NO: 681007 - DNA, 25 bp, Mus musculus
gtcaccgcgaggaatttgcagctat

SEQ ID NO: 681008 - DNA, 25 bp, Mus musculus
gtcaccgcgaggtatttgcagctat

SEQ ID NO: 681009 - DNA, 25 bp, Mus musculus
gtcaccgctcaactggcaggcgtga

SEQ ID NO: 681010 - DNA, 25 bp, Mus musculus
gtcaccgctcaagtggcaggcgtga

SEQ ID NO: 681011 - DNA, 25 bp, Mus musculus
gtcaccggaattccaactgtagcct

SEQ ID NO: 681012 - DNA, 25 bp, Mus musculus
gtcaccggaattgcaactgtagcct

SEQ ID NO: 681013 - DNA, 25 bp, Mus musculus
gtcaccggacacaatcctacagaag

SEQ ID NO: 681014 - DNA, 25 bp, Mus musculus
gtcaccggacactatcctacagaag

SEQ ID NO: 681015 - DNA, 25 bp, Mus musculus
gtcaccggctagagtgactgactcc

SEQ ID NO: 681016 - DNA, 25 bp, Mus musculus
gtcaccggctagtgtgactgactcc

SEQ ID NO: 681017 - DNA, 25 bp, Mus musculus
gtcaccgggttgcaacggagacaac

SEQ ID NO: 681018 - DNA, 25 bp, Mus musculus
gtcaccgggttggaacggagacaac

SEQ ID NO: 681019 - DNA, 25 bp, Mus musculus
gtcaccggttacactggttatagta

SEQ ID NO: 681020 - DNA, 25 bp, Mus musculus
gtcaccggttactctggttatagta

SEQ ID NO: 681021 - DNA, 25 bp, Mus musculus
gtcaccgtcacccaagagagagtct

SEQ ID NO: 681022 - DNA, 25 bp, Mus musculus
gtcaccgtcaccgaagagagagtct

SEQ ID NO: 681023 - DNA, 25 bp, Mus musculus
gtcaccgtcataaatcagattgtca

SEQ ID NO: 681024 - DNA, 25 bp, Mus musculus
gtcaccgtcatatatcagattgtca

SEQ ID NO: 681025 - DNA, 25 bp, Mus musculus
gtcaccgtcctgacatgtgtatgta

SEQ ID NO: 681026 - DNA, 25 bp, Mus musculus
gtcaccgtcctgtcatgtgtatgta

SEQ ID NO: 681027 - DNA, 25 bp, Mus musculus
gtcaccgtctctctgcctggtcggg

SEQ ID NO: 681028 - DNA, 25 bp, Mus musculus
gtcaccgtctctgtgcctggtcggg

SEQ ID NO: 681029 - DNA, 25 bp, Mus musculus
gtcaccgtgaaccaaccagttttca

SEQ ID NO: 681030 - DNA, 25 bp, Mus musculus
gtcaccgtgaacgaaccagttttca

SEQ ID NO: 681031 - DNA, 25 bp, Mus musculus
gtcaccgtgacaaaagcaagagtta

SEQ ID NO: 681032 - DNA, 25 bp, Mus musculus
gtcaccgtgacataagcaagagtta

SEQ ID NO: 681033 - DNA, 25 bp, Mus musculus
gtcaccgtggacatgaaaacacctg

SEQ ID NO: 681034 - DNA, 25 bp, Mus musculus
gtcaccgtggacttgaaaacacctg

SEQ ID NO: 681035 - DNA, 25 bp, Mus musculus
gtcaccgtgtttcctgtgatgctaa

SEQ ID NO: 681036 - DNA, 25 bp, Mus musculus
gtcaccgtgtttgctgtgatgctaa

SEQ ID NO: 681037 - DNA, 25 bp, Mus musculus
gtcaccgttagacaagcaaatgcat

SEQ ID NO: 681038 - DNA, 25 bp, Mus musculus
gtcaccgttagagaagcaaatgcat

SEQ ID NO: 681039 - DNA, 25 bp, Mus musculus
gtcaccgttcccattgatgccaaaa

SEQ ID NO: 681040 - DNA, 25 bp, Mus musculus
gtcaccgttccctttgatgccaaaa

SEQ ID NO: 681041 - DNA, 25 bp, Mus musculus
gtcacctacaataacttcatccagc

SEQ ID NO: 681042 - DNA, 25 bp, Mus musculus
gtcacctacaattacttcatccagc

SEQ ID NO: 681043 - DNA, 25 bp, Mus musculus
gtcacctacttcatcacgtacggaa

SEQ ID NO: 681044 - DNA, 25 bp, Mus musculus
gtcacctacttccagtcttgaaact

SEQ ID NO: 681045 - DNA, 25 bp, Mus musculus
gtcacctacttcgagtcttgaaact

SEQ ID NO: 681046 - DNA, 25 bp, Mus musculus
gtcacctacttcttcacgtacggaa

SEQ ID NO: 681047 - DNA, 25 bp, Mus musculus
gtcacctagcaacggatttggctgg

SEQ ID NO: 681048 - DNA, 25 bp, Mus musculus
gtcacctagcaagggatttggctgg

SEQ ID NO: 681049 - DNA, 25 bp, Mus musculus
gtcacctaggacatttgatttccaa

SEQ ID NO: 681050 - DNA, 25 bp, Mus musculus
gtcacctaggaccactggagaacat

SEQ ID NO: 681051 - DNA, 25 bp, Mus musculus
gtcacctaggacgactggagaacat

SEQ ID NO: 681052 - DNA, 25 bp, Mus musculus
gtcacctaggacttttgatttccaa

SEQ ID NO: 681053 - DNA, 25 bp, Mus musculus
gtcacctattctctttctatctggt

SEQ ID NO: 681054 - DNA, 25 bp, Mus musculus
gtcacctattctgtttctatctggt

SEQ ID NO: 681055 - DNA, 25 bp, Mus musculus
gtcacctatttaatatccttgaggg

SEQ ID NO: 681056 - DNA, 25 bp, Mus musculus
gtcacctatttattatccttgaggg

SEQ ID NO: 681057 - DNA, 25 bp, Mus musculus
gtcacctcaacgactgtagctttag

SEQ ID NO: 681058 - DNA, 25 bp, Mus musculus
gtcacctcaacgtctgtagctttag

SEQ ID NO: 681059 - DNA, 25 bp, Mus musculus
gtcacctcaataaactctgtgcctg

SEQ ID NO: 681060 - DNA, 25 bp, Mus musculus
gtcacctcaatatactctgtgcctg

SEQ ID NO: 681061 - DNA, 25 bp, Mus musculus
gtcacctcagtacctgatgtccatg

SEQ ID NO: 681062 - DNA, 25 bp, Mus musculus
gtcacctcagtagctgatgtccatg

SEQ ID NO: 681063 - DNA, 25 bp, Mus musculus
gtcacctcagtgacaatgtccctta

SEQ ID NO: 681064 - DNA, 25 bp, Mus musculus
gtcacctcagtgtcaatgtccctta

SEQ ID NO: 681065 - DNA, 25 bp, Mus musculus
gtcacctcattaccataaactcatg

SEQ ID NO: 681066 - DNA, 25 bp, Mus musculus
gtcacctcattagcataaactcatg

SEQ ID NO: 681067 - DNA, 25 bp, Mus musculus
gtcacctcccagcaaccagtgttgt

SEQ ID NO: 681068 - DNA, 25 bp, Mus musculus
gtcacctcccagcatttgctgatga

SEQ ID NO: 681069 - DNA, 25 bp, Mus musculus
gtcacctcccaggaaccagtgttgt

SEQ ID NO: 681070 - DNA, 25 bp, Mus musculus
gtcacctcccaggatttgctgatga

SEQ ID NO: 681071 - DNA, 25 bp, Mus musculus
gtcacctccgatactgggatgccag

SEQ ID NO: 681072 - DNA, 25 bp, Mus musculus
gtcacctccgattctgggatgccag

SEQ ID NO: 681073 - DNA, 25 bp, Mus musculus
gtcacctccggtcgaaatttgagac

SEQ ID NO: 681074 - DNA, 25 bp, Mus musculus
gtcacctccggtggaaatttgagac

SEQ ID NO: 681075 - DNA, 25 bp, Mus musculus
gtcacctcctagcttatattgagag

SEQ ID NO: 681076 - DNA, 25 bp, Mus musculus
gtcacctcctaggttatattgagag

SEQ ID NO: 681077 - DNA, 25 bp, Mus musculus
gtcacctcctccagtagaaattaag

SEQ ID NO: 681078 - DNA, 25 bp, Mus musculus
gtcacctcctcctgtagaaattaag

SEQ ID NO: 681079 - DNA, 25 bp, Mus musculus
gtcacctctgagactgacaccaggt

SEQ ID NO: 681080 - DNA, 25 bp, Mus musculus
gtcacctctgagtctgacaccaggt

SEQ ID NO: 681081 - DNA, 25 bp, Mus musculus
gtcacctctggacctgacatactgt

SEQ ID NO: 681082 - DNA, 25 bp, Mus musculus
gtcacctctggagctgacatactgt

SEQ ID NO: 681083 - DNA, 25 bp, Mus musculus
gtcacctctggcagttacaaagtag

SEQ ID NO: 681084 - DNA, 25 bp, Mus musculus
gtcacctctggctgttacaaagtag

SEQ ID NO: 681085 - DNA, 25 bp, Mus musculus
gtcacctctgtaatcgatgtacata

SEQ ID NO: 681086 - DNA, 25 bp, Mus musculus
gtcacctctgtattcgatgtacata

SEQ ID NO: 681087 - DNA, 25 bp, Mus musculus
gtcacctcttagaaatgcggccaga

SEQ ID NO: 681088 - DNA, 25 bp, Mus musculus
gtcacctcttagtaatgcggccaga

SEQ ID NO: 681089 - DNA, 25 bp, Mus musculus
gtcacctcttcacagatcattgtca

SEQ ID NO: 681090 - DNA, 25 bp, Mus musculus
gtcacctcttcagagatcattgtca

SEQ ID NO: 681091 - DNA, 25 bp, Mus musculus
gtcacctcttggcactgctgatcaa

SEQ ID NO: 681092 - DNA, 25 bp, Mus musculus
gtcacctcttgggactgctgatcaa

SEQ ID NO: 681093 - DNA, 25 bp, Mus musculus
gtcacctgacccaggatgagatgga

SEQ ID NO: 681094 - DNA, 25 bp, Mus musculus
gtcacctgaccctggatgagatgga

SEQ ID NO: 681095 - DNA, 25 bp, Mus musculus
gtcacctgaggacaacacggcactg

SEQ ID NO: 681096 - DNA, 25 bp, Mus musculus
gtcacctgaggagaacacggcactg

SEQ ID NO: 681097 - DNA, 25 bp, Mus musculus
gtcacctgaggtatctgcatgtact

SEQ ID NO: 681098 - DNA, 25 bp, Mus musculus
gtcacctgaggtttctgcatgtact

SEQ ID NO: 681099 - DNA, 25 bp, Mus musculus
gtcacctgagtcaaggaaacatgtt

SEQ ID NO: 681100 - DNA, 25 bp, Mus musculus
gtcacctgagtctaggaaacatgtt

SEQ ID NO: 681101 - DNA, 25 bp, Mus musculus
gtcacctgagtgactgttgctcgtc

SEQ ID NO: 681102 - DNA, 25 bp, Mus musculus
gtcacctgagtgtctgttgctcgtc

SEQ ID NO: 681103 - DNA, 25 bp, Mus musculus
gtcacctgatgaaggagaggtcaat

SEQ ID NO: 681104 - DNA, 25 bp, Mus musculus
gtcacctgatgatggagaggtcaat

SEQ ID NO: 681105 - DNA, 25 bp, Mus musculus
gtcacctgatgtcttaggaactcaa

SEQ ID NO: 681106 - DNA, 25 bp, Mus musculus
gtcacctgatgtgttaggaactcaa

SEQ ID NO: 681107 - DNA, 25 bp, Mus musculus
gtcacctgattgcatagttgctact

SEQ ID NO: 681108 - DNA, 25 bp, Mus musculus
gtcacctgattggatagttgctact

SEQ ID NO: 681109 - DNA, 25 bp, Mus musculus
gtcacctgcagtaccagccaaaaag

SEQ ID NO: 681110 - DNA, 25 bp, Mus musculus
gtcacctgcagttccagccaaaaag

SEQ ID NO: 681111 - DNA, 25 bp, Mus musculus
gtcacctgcatcattcatgctagaa

SEQ ID NO: 681112 - DNA, 25 bp, Mus musculus
gtcacctgcatctttcatgctagaa

SEQ ID NO: 681113 - DNA, 25 bp, Mus musculus
gtcacctgctacagccaggaagacg

SEQ ID NO: 681114 - DNA, 25 bp, Mus musculus
gtcacctgctactgccaggaagacg

SEQ ID NO: 681115 - DNA, 25 bp, Mus musculus
gtcacctggtgaatctgtttttaag

SEQ ID NO: 681116 - DNA, 25 bp, Mus musculus
gtcacctggtgattctgtttttaag

SEQ ID NO: 681117 - DNA, 25 bp, Mus musculus
gtcacctgtcaaagtcaccagtcaa

SEQ ID NO: 681118 - DNA, 25 bp, Mus musculus
gtcacctgtcaactgatcagacttc

SEQ ID NO: 681119 - DNA, 25 bp, Mus musculus
gtcacctgtcaagtgatcagacttc

SEQ ID NO: 681120 - DNA, 25 bp, Mus musculus
gtcacctgtcaatgtcaccagtcaa

SEQ ID NO: 681121 - DNA, 25 bp, Mus musculus
gtcacctgtcagctgtgtcaggcag

SEQ ID NO: 681122 - DNA, 25 bp, Mus musculus
gtcacctgtcaggtgtgtcaggcag

SEQ ID NO: 681123 - DNA, 25 bp, Mus musculus
gtcacctgtgagatgtcttctccct

SEQ ID NO: 681124 - DNA, 25 bp, Mus musculus
gtcacctgtgagttgtcttctccct

SEQ ID NO: 681125 - DNA, 25 bp, Mus musculus
gtcacctgttggagcacgggccatg

SEQ ID NO: 681126 - DNA, 25 bp, Mus musculus
gtcacctgttggtgcacgggccatg

SEQ ID NO: 681127 - DNA, 25 bp, Mus musculus
gtcaccttaaaaagcgatcatccac

SEQ ID NO: 681128 - DNA, 25 bp, Mus musculus
gtcaccttaaaatgcgatcatccac

SEQ ID NO: 681129 - DNA, 25 bp, Mus musculus
gtcaccttaactattctagcattgt

SEQ ID NO: 681130 - DNA, 25 bp, Mus musculus
gtcaccttaacttttctagcattgt

SEQ ID NO: 681131 - DNA, 25 bp, Mus musculus
gtcaccttacagagatggctgtgcc

SEQ ID NO: 681132 - DNA, 25 bp, Mus musculus
gtcaccttacagtgatggctgtgcc

SEQ ID NO: 681133 - DNA, 25 bp, Mus musculus
gtcaccttacatactagtgtttcct

SEQ ID NO: 681134 - DNA, 25 bp, Mus musculus
gtcaccttacattctagtgtttcct

SEQ ID NO: 681135 - DNA, 25 bp, Mus musculus
gtcaccttactaaatgatacagccc

SEQ ID NO: 681136 - DNA, 25 bp, Mus musculus
gtcaccttactatatgatacagccc

SEQ ID NO: 681137 - DNA, 25 bp, Mus musculus
gtcaccttagtcagatcaatgttgt

SEQ ID NO: 681138 - DNA, 25 bp, Mus musculus
gtcaccttagtctgatcaatgttgt

SEQ ID NO: 681139 - DNA, 25 bp, Mus musculus
gtcaccttattgctgcagattctag

SEQ ID NO: 681140 - DNA, 25 bp, Mus musculus
gtcaccttattggtgcagattctag

SEQ ID NO: 681141 - DNA, 25 bp, Mus musculus
gtcaccttatttaatcgattattgc

SEQ ID NO: 681142 - DNA, 25 bp, Mus musculus
gtcaccttattttatcgattattgc

SEQ ID NO: 681143 - DNA, 25 bp, Mus musculus
gtcaccttcgttcctgttaggacaa

SEQ ID NO: 681144 - DNA, 25 bp, Mus musculus
gtcaccttcgttgctgttaggacaa

SEQ ID NO: 681145 - DNA, 25 bp, Mus musculus
gtcaccttctggctcaatacagtca

SEQ ID NO: 681146 - DNA, 25 bp, Mus musculus
gtcaccttctgggtcaatacagtca

SEQ ID NO: 681147 - DNA, 25 bp, Mus musculus
gtcaccttgaaaatgattccccaga

SEQ ID NO: 681148 - DNA, 25 bp, Mus musculus
gtcaccttgaaattgattccccaga

SEQ ID NO: 681149 - DNA, 25 bp, Mus musculus
gtcaccttgacactggtaccatggt

SEQ ID NO: 681150 - DNA, 25 bp, Mus musculus
gtcaccttgacagtggtaccatggt

SEQ ID NO: 681151 - DNA, 25 bp, Mus musculus
gtcaccttgagacctgctgaggaga

SEQ ID NO: 681152 - DNA, 25 bp, Mus musculus
gtcaccttgagagctgctgaggaga

SEQ ID NO: 681153 - DNA, 25 bp, Mus musculus
gtcaccttgcctcattaacaggttt

SEQ ID NO: 681154 - DNA, 25 bp, Mus musculus
gtcaccttgcctgattaacaggttt

SEQ ID NO: 681155 - DNA, 25 bp, Mus musculus
gtcaccttggccaaaattcctgaaa

SEQ ID NO: 681156 - DNA, 25 bp, Mus musculus
gtcaccttggcctaaattcctgaaa

SEQ ID NO: 681157 - DNA, 25 bp, Mus musculus
gtcaccttgggaccagtgcttactt

SEQ ID NO: 681158 - DNA, 25 bp, Mus musculus
gtcaccttgggagcagtgcttactt

SEQ ID NO: 681159 - DNA, 25 bp, Mus musculus
gtcaccttgggtaaggacctgtcat

SEQ ID NO: 681160 - DNA, 25 bp, Mus musculus
gtcaccttgggttaggacctgtcat

SEQ ID NO: 681161 - DNA, 25 bp, Mus musculus
gtcaccttgtcaacatgtctactac

SEQ ID NO: 681162 - DNA, 25 bp, Mus musculus
gtcaccttgtcatcatgtctactac

SEQ ID NO: 681163 - DNA, 25 bp, Mus musculus
gtcacctttaggaagccatgttggt

SEQ ID NO: 681164 - DNA, 25 bp, Mus musculus
gtcacctttaggtagccatgttggt

SEQ ID NO: 681165 - DNA, 25 bp, Mus musculus
gtcacctttcgtcggttacatccat

SEQ ID NO: 681166 - DNA, 25 bp, Mus musculus
gtcacctttcgtgggttacatccat

SEQ ID NO: 681167 - DNA, 25 bp, Mus musculus
gtcaccttttttccagaattcagag

SEQ ID NO: 681168 - DNA, 25 bp, Mus musculus
gtcaccttttttgcagaattcagag

SEQ ID NO: 681169 - DNA, 25 bp, Mus musculus
gtcacgaagttcaacttccaggaag

SEQ ID NO: 681170 - DNA, 25 bp, Mus musculus
gtcacgaagttctacttccaggaag

SEQ ID NO: 681171 - DNA, 25 bp, Mus musculus
gtcacgaatgtgaccatggcccggg

SEQ ID NO: 681172 - DNA, 25 bp, Mus musculus
gtcacgaatgtgtccatggcccggg

SEQ ID NO: 681173 - DNA, 25 bp, Mus musculus
gtcacgacaataaaggtggcccaga

SEQ ID NO: 681174 - DNA, 25 bp, Mus musculus
gtcacgacaatataggtggcccaga

SEQ ID NO: 681175 - DNA, 25 bp, Mus musculus
gtcacgacctccatactctgtgatt

SEQ ID NO: 681176 - DNA, 25 bp, Mus musculus
gtcacgacctccttactctgtgatt

SEQ ID NO: 681177 - DNA, 25 bp, Mus musculus
gtcacgagcccaatgaattcttcat

SEQ ID NO: 681178 - DNA, 25 bp, Mus musculus
gtcacgagcccattgaattcttcat

SEQ ID NO: 681179 - DNA, 25 bp, Mus musculus
gtcacgagtaaaatctcagttctct

SEQ ID NO: 681180 - DNA, 25 bp, Mus musculus
gtcacgagtaaattctcagttctct

SEQ ID NO: 681181 - DNA, 25 bp, Mus musculus
gtcacgagtctcagctgactgagag

SEQ ID NO: 681182 - DNA, 25 bp, Mus musculus
gtcacgagtctctgctgactgagag

SEQ ID NO: 681183 - DNA, 25 bp, Mus musculus
gtcacgagtggcaatcagacaccaa

SEQ ID NO: 681184 - DNA, 25 bp, Mus musculus
gtcacgagtggctatcagacaccaa

SEQ ID NO: 681185 - DNA, 25 bp, Mus musculus
gtcacgataatgacctgccagctct

SEQ ID NO: 681186 - DNA, 25 bp, Mus musculus
gtcacgataatgtcctgccagctct

SEQ ID NO: 681187 - DNA, 25 bp, Mus musculus
gtcacgatatccaccaagtttatga

SEQ ID NO: 681188 - DNA, 25 bp, Mus musculus
gtcacgatatcctccaagtttatga

SEQ ID NO: 681189 - DNA, 25 bp, Mus musculus
gtcacgatgctcctggctaaagttt

SEQ ID NO: 681190 - DNA, 25 bp, Mus musculus
gtcacgatgctcgtggctaaagttt

SEQ ID NO: 681191 - DNA, 25 bp, Mus musculus
gtcacgatgtatcaggttctagttt

SEQ ID NO: 681192 - DNA, 25 bp, Mus musculus
gtcacgatgtatgaggttctagttt

SEQ ID NO: 681193 - DNA, 25 bp, Mus musculus
gtcacgattcccctcatgataatga

SEQ ID NO: 681194 - DNA, 25 bp, Mus musculus
gtcacgattcccgtcatgataatga

SEQ ID NO: 681195 - DNA, 25 bp, Mus musculus
gtcacgcaatagacttaaaccctta

SEQ ID NO: 681196 - DNA, 25 bp, Mus musculus
gtcacgcaatagtcttaaaccctta

SEQ ID NO: 681197 - DNA, 25 bp, Mus musculus
gtcacgcacgccacaggcagaaggg

SEQ ID NO: 681198 - DNA, 25 bp, Mus musculus
gtcacgcacgcctcaggcagaaggg

SEQ ID NO: 681199 - DNA, 25 bp, Mus musculus
gtcacgcactaaagcactctgatgt

SEQ ID NO: 681200 - DNA, 25 bp, Mus musculus
gtcacgcactaatgcactctgatgt

SEQ ID NO: 681201 - DNA, 25 bp, Mus musculus
gtcacgcactgaaacatgttctctg

SEQ ID NO: 681202 - DNA, 25 bp, Mus musculus
gtcacgcactgatacatgttctctg

SEQ ID NO: 681203 - DNA, 25 bp, Mus musculus
gtcacgcaggttaattacagtggca

SEQ ID NO: 681204 - DNA, 25 bp, Mus musculus
gtcacgcaggtttattacagtggca

SEQ ID NO: 681205 - DNA, 25 bp, Mus musculus
gtcacgcccctaacaagtagccaag

SEQ ID NO: 681206 - DNA, 25 bp, Mus musculus
gtcacgcccctatcaagtagccaag

SEQ ID NO: 681207 - DNA, 25 bp, Mus musculus
gtcacgcccttcatcaaaaggcatg

SEQ ID NO: 681208 - DNA, 25 bp, Mus musculus
gtcacgcccttcttcaaaaggcatg

SEQ ID NO: 681209 - DNA, 25 bp, Mus musculus
gtcacgccgtagctcactgaagcag

SEQ ID NO: 681210 - DNA, 25 bp, Mus musculus
gtcacgccgtaggtcactgaagcag

SEQ ID NO: 681211 - DNA, 25 bp, Mus musculus
gtcacgcctgtgacagtttactgaa

SEQ ID NO: 681212 - DNA, 25 bp, Mus musculus
gtcacgcctgtgtcagtttactgaa

SEQ ID NO: 681213 - DNA, 25 bp, Mus musculus
gtcacgctaagaagaccgaggctga

SEQ ID NO: 681214 - DNA, 25 bp, Mus musculus
gtcacgctaagatgaccgaggctga

SEQ ID NO: 681215 - DNA, 25 bp, Mus musculus
gtcacgctaagtagcttttccaaaa

SEQ ID NO: 681216 - DNA, 25 bp, Mus musculus
gtcacgctaagttgcttttccaaaa

SEQ ID NO: 681217 - DNA, 25 bp, Mus musculus
gtcacgctacggagccagcggatga

SEQ ID NO: 681218 - DNA, 25 bp, Mus musculus
gtcacgctacggtgccagcggatga

SEQ ID NO: 681219 - DNA, 25 bp, Mus musculus
gtcacgctactcaatgaactgaagc

SEQ ID NO: 681220 - DNA, 25 bp, Mus musculus
gtcacgctactctatgaactgaagc

SEQ ID NO: 681221 - DNA, 25 bp, Mus musculus
gtcacgctgaatatatgaccacgct

SEQ ID NO: 681222 - DNA, 25 bp, Mus musculus
gtcacgctgaatttatgaccacgct

SEQ ID NO: 681223 - DNA, 25 bp, Mus musculus
gtcacgctggctccatcaatgaagt

SEQ ID NO: 681224 - DNA, 25 bp, Mus musculus
gtcacgctggctgcatcaatgaagt

SEQ ID NO: 681225 - DNA, 25 bp, Mus musculus
gtcacgctgtctattattgtcacgg

SEQ ID NO: 681226 - DNA, 25 bp, Mus musculus
gtcacgctgtcttttattgtcacgg

SEQ ID NO: 681227 - DNA, 25 bp, Mus musculus
gtcacggagctgatccaagtgtctc

SEQ ID NO: 681228 - DNA, 25 bp, Mus musculus
gtcacggagctgttccaagtgtctc

SEQ ID NO: 681229 - DNA, 25 bp, Mus musculus
gtcacggcaactaaaatgatcttag

SEQ ID NO: 681230 - DNA, 25 bp, Mus musculus
gtcacggcaacttaaatgatcttag

SEQ ID NO: 681231 - DNA, 25 bp, Mus musculus
gtcacggctatcatcagaactgctt

SEQ ID NO: 681232 - DNA, 25 bp, Mus musculus
gtcacggctatcttcagaactgctt

SEQ ID NO: 681233 - DNA, 25 bp, Mus musculus
gtcacggcttcaatggagccctaaa

SEQ ID NO: 681234 - DNA, 25 bp, Mus musculus
gtcacggcttcattggagccctaaa

SEQ ID NO: 681235 - DNA, 25 bp, Mus musculus
gtcacggcttgcaactgtcatacag

SEQ ID NO: 681236 - DNA, 25 bp, Mus musculus
gtcacggcttgctactgtcatacag

SEQ ID NO: 681237 - DNA, 25 bp, Mus musculus
gtcacgggaaccagtaaggctcctt

SEQ ID NO: 681238 - DNA, 25 bp, Mus musculus
gtcacgggaacctgtaaggctcctt

SEQ ID NO: 681239 - DNA, 25 bp, Mus musculus
gtcacgggacccacagtatgatggg

SEQ ID NO: 681240 - DNA, 25 bp, Mus musculus
gtcacgggaccctcagtatgatggg

SEQ ID NO: 681241 - DNA, 25 bp, Mus musculus
gtcacgggaggtaactatcgcgaga

SEQ ID NO: 681242 - DNA, 25 bp, Mus musculus
gtcacgggaggttactatcgcgaga

SEQ ID NO: 681243 - DNA, 25 bp, Mus musculus
gtcacgggcactccttggatagcag

SEQ ID NO: 681244 - DNA, 25 bp, Mus musculus
gtcacgggcactgcttggatagcag

SEQ ID NO: 681245 - DNA, 25 bp, Mus musculus
gtcacgggcatgagtgtttcagtgc

SEQ ID NO: 681246 - DNA, 25 bp, Mus musculus
gtcacgggcatgtgtgtttcagtgc

SEQ ID NO: 681247 - DNA, 25 bp, Mus musculus
gtcacgggccaaaaggtacataatc

SEQ ID NO: 681248 - DNA, 25 bp, Mus musculus
gtcacgggccaataggtacataatc

SEQ ID NO: 681249 - DNA, 25 bp, Mus musculus
gtcacgggccctctggaattcgaga

SEQ ID NO: 681250 - DNA, 25 bp, Mus musculus
gtcacgggccctgtggaattcgaga

SEQ ID NO: 681251 - DNA, 25 bp, Mus musculus
gtcacgggctttctgaacgtccaat

SEQ ID NO: 681252 - DNA, 25 bp, Mus musculus
gtcacgggctttgtgaacgtccaat

SEQ ID NO: 681253 - DNA, 25 bp, Mus musculus
gtcacggtacaacctagacctcagc

SEQ ID NO: 681254 - DNA, 25 bp, Mus musculus
gtcacggtacaagctagacctcagc

SEQ ID NO: 681255 - DNA, 25 bp, Mus musculus
gtcacggtcaccatgatgttcatga

SEQ ID NO: 681256 - DNA, 25 bp, Mus musculus
gtcacggtcaccttgatgttcatga

SEQ ID NO: 681257 - DNA, 25 bp, Mus musculus
gtcacggtcagacagcaatcctaat

SEQ ID NO: 681258 - DNA, 25 bp, Mus musculus
gtcacggtcagagagcaatcctaat

SEQ ID NO: 681259 - DNA, 25 bp, Mus musculus
gtcacggtgggcagaatgagggctg

SEQ ID NO: 681260 - DNA, 25 bp, Mus musculus
gtcacggtgggctgaatgagggctg

SEQ ID NO: 681261 - DNA, 25 bp, Mus musculus
gtcacggtgtgcaagaacaggtttc

SEQ ID NO: 681262 - DNA, 25 bp, Mus musculus
gtcacggtgtgctagaacaggtttc

SEQ ID NO: 681263 - DNA, 25 bp, Mus musculus
gtcacgtaccatattaacattcact

SEQ ID NO: 681264 - DNA, 25 bp, Mus musculus
gtcacgtaccattttaacattcact

SEQ ID NO: 681265 - DNA, 25 bp, Mus musculus
gtcacgtaccgactgggcagtgtca

SEQ ID NO: 681266 - DNA, 25 bp, Mus musculus
gtcacgtaccgagtgggcagtgtca

SEQ ID NO: 681267 - DNA, 25 bp, Mus musculus
gtcacgtagagcacctagggcatta

SEQ ID NO: 681268 - DNA, 25 bp, Mus musculus
gtcacgtagagctcctagggcatta

SEQ ID NO: 681269 - DNA, 25 bp, Mus musculus
gtcacgtaggttaaggctggcctta

SEQ ID NO: 681270 - DNA, 25 bp, Mus musculus
gtcacgtaggtttaggctggcctta

SEQ ID NO: 681271 - DNA, 25 bp, Mus musculus
gtcacgtatcacattgaactgctga

SEQ ID NO: 681272 - DNA, 25 bp, Mus musculus
gtcacgtatcactttgaactgctga

SEQ ID NO: 681273 - DNA, 25 bp, Mus musculus
gtcacgtatcgactagagttcattt

SEQ ID NO: 681274 - DNA, 25 bp, Mus musculus
gtcacgtatcgagtagagttcattt

SEQ ID NO: 681275 - DNA, 25 bp, Mus musculus
gtcacgtcagctccctaaagttagg

SEQ ID NO: 681276 - DNA, 25 bp, Mus musculus
gtcacgtcagctgcctaaagttagg

SEQ ID NO: 681277 - DNA, 25 bp, Mus musculus
gtcacgtcatggacaattccaattc

SEQ ID NO: 681278 - DNA, 25 bp, Mus musculus
gtcacgtcatggtcaattccaattc

SEQ ID NO: 681279 - DNA, 25 bp, Mus musculus
gtcacgtcattgcagccgcagaaga

SEQ ID NO: 681280 - DNA, 25 bp, Mus musculus
gtcacgtcattggagccgcagaaga

SEQ ID NO: 681281 - DNA, 25 bp, Mus musculus
gtcacgtcctgacaaagccctggat

SEQ ID NO: 681282 - DNA, 25 bp, Mus musculus
gtcacgtcctgagaaagccctggat

SEQ ID NO: 681283 - DNA, 25 bp, Mus musculus
gtcacgtcgcacactgcctattggt

SEQ ID NO: 681284 - DNA, 25 bp, Mus musculus
gtcacgtcgcactctgcctattggt

SEQ ID NO: 681285 - DNA, 25 bp, Mus musculus
gtcacgtcgtatcttcaggcaggaa

SEQ ID NO: 681286 - DNA, 25 bp, Mus musculus
gtcacgtcgtatgttcaggcaggaa

SEQ ID NO: 681287 - DNA, 25 bp, Mus musculus
gtcacgtcttagatggcgatgttaa

SEQ ID NO: 681288 - DNA, 25 bp, Mus musculus
gtcacgtcttagttggcgatgttaa

SEQ ID NO: 681289 - DNA, 25 bp, Mus musculus
gtcacgtgaaaacgcactcggccga

SEQ ID NO: 681290 - DNA, 25 bp, Mus musculus
gtcacgtgaaaaggcactcggccga

SEQ ID NO: 681291 - DNA, 25 bp, Mus musculus
gtcacgtgacgcattaggtttcaaa

SEQ ID NO: 681292 - DNA, 25 bp, Mus musculus
gtcacgtgacgctttaggtttcaaa

SEQ ID NO: 681293 - DNA, 25 bp, Mus musculus
gtcacgtgaggcaatgaacaaccga

SEQ ID NO: 681294 - DNA, 25 bp, Mus musculus
gtcacgtgaggctatgaacaaccga

SEQ ID NO: 681295 - DNA, 25 bp, Mus musculus
gtcacgtgcagtatgttgggtcata

SEQ ID NO: 681296 - DNA, 25 bp, Mus musculus
gtcacgtgcagtttgttgggtcata

SEQ ID NO: 681297 - DNA, 25 bp, Mus musculus
gtcacgtgccatcactctgtgaagg

SEQ ID NO: 681298 - DNA, 25 bp, Mus musculus
gtcacgtgccatgactctgtgaagg

SEQ ID NO: 681299 - DNA, 25 bp, Mus musculus
gtcacgtgccttcagagtatcaaca

SEQ ID NO: 681300 - DNA, 25 bp, Mus musculus
gtcacgtgccttgagagtatcaaca

SEQ ID NO: 681301 - DNA, 25 bp, Mus musculus
gtcacgtggaaaacttccttttggg

SEQ ID NO: 681302 - DNA, 25 bp, Mus musculus
gtcacgtggaaatcttccttttggg

SEQ ID NO: 681303 - DNA, 25 bp, Mus musculus
gtcacgtgtccaagtggcctgcaca

SEQ ID NO: 681304 - DNA, 25 bp, Mus musculus
gtcacgtgtccatgtggcctgcaca

SEQ ID NO: 681305 - DNA, 25 bp, Mus musculus
gtcacgtgtgtcatctccatgaaat

SEQ ID NO: 681306 - DNA, 25 bp, Mus musculus
gtcacgtgtgtcttctccatgaaat

SEQ ID NO: 681307 - DNA, 25 bp, Mus musculus
gtcacgttagcgacagagcatttga

SEQ ID NO: 681308 - DNA, 25 bp, Mus musculus
gtcacgttagcgtcagagcatttga

SEQ ID NO: 681309 - DNA, 25 bp, Mus musculus
gtcacgttcatgagtactgcctctc

SEQ ID NO: 681310 - DNA, 25 bp, Mus musculus
gtcacgttcatgtgtactgcctctc

SEQ ID NO: 681311 - DNA, 25 bp, Mus musculus
gtcacgttgctcagacagacaaagt

SEQ ID NO: 681312 - DNA, 25 bp, Mus musculus
gtcacgttgctctgacagacaaagt

SEQ ID NO: 681313 - DNA, 25 bp, Mus musculus
gtcacgtttggcagaatactccgtt

SEQ ID NO: 681314 - DNA, 25 bp, Mus musculus
gtcacgtttggctgaatactccgtt

SEQ ID NO: 681315 - DNA, 25 bp, Mus musculus
gtcacgttttaacacttctcaacta

SEQ ID NO: 681316 - DNA, 25 bp, Mus musculus
gtcacgttttaagacttctcaacta

SEQ ID NO: 681317 - DNA, 25 bp, Mus musculus
gtcactaaaggaattgcagcttgcg

SEQ ID NO: 681318 - DNA, 25 bp, Mus musculus
gtcactaaaggatttgcagcttgcg

SEQ ID NO: 681319 - DNA, 25 bp, Mus musculus
gtcactaaatgaaccagcctgttgt

SEQ ID NO: 681320 - DNA, 25 bp, Mus musculus
gtcactaaatgatccagcctgttgt

SEQ ID NO: 681321 - DNA, 25 bp, Mus musculus
gtcactaacactacttcttctctga

SEQ ID NO: 681322 - DNA, 25 bp, Mus musculus
gtcactaacacttcttcttctctga

SEQ ID NO: 681323 - DNA, 25 bp, Mus musculus
gtcactaaggttaaggtcactttgt

SEQ ID NO: 681324 - DNA, 25 bp, Mus musculus
gtcactaaggtttaggtcactttgt

SEQ ID NO: 681325 - DNA, 25 bp, Mus musculus
gtcactaatcgtctgtttctttaac

SEQ ID NO: 681326 - DNA, 25 bp, Mus musculus
gtcactaatcgtgtgtttctttaac

SEQ ID NO: 681327 - DNA, 25 bp, Mus musculus
gtcactaatcttaactaccttcact

SEQ ID NO: 681328 - DNA, 25 bp, Mus musculus
gtcactaatctttactaccttcact

SEQ ID NO: 681329 - DNA, 25 bp, Mus musculus
gtcactaatgagctgagcgagcatc

SEQ ID NO: 681330 - DNA, 25 bp, Mus musculus
gtcactaatgaggtgagcgagcatc

SEQ ID NO: 681331 - DNA, 25 bp, Mus musculus
gtcactacaaatagcattcctgagg

SEQ ID NO: 681332 - DNA, 25 bp, Mus musculus
gtcactacaaattgcattcctgagg

SEQ ID NO: 681333 - DNA, 25 bp, Mus musculus
gtcactacacatattgctctagctc

SEQ ID NO: 681334 - DNA, 25 bp, Mus musculus
gtcactacacattttgctctagctc

SEQ ID NO: 681335 - DNA, 25 bp, Mus musculus
gtcactacaccaattctgtttggga

SEQ ID NO: 681336 - DNA, 25 bp, Mus musculus
gtcactacaccatttctgtttggga

SEQ ID NO: 681337 - DNA, 25 bp, Mus musculus
gtcactacatggcaagactgtatag

SEQ ID NO: 681338 - DNA, 25 bp, Mus musculus
gtcactacatgggaagactgtatag

SEQ ID NO: 681339 - DNA, 25 bp, Mus musculus
gtcactacatttacatcattctttg

SEQ ID NO: 681340 - DNA, 25 bp, Mus musculus
gtcactacattttcatcattctttg

SEQ ID NO: 681341 - DNA, 25 bp, Mus musculus
gtcactacccgcagctacagtaggg

SEQ ID NO: 681342 - DNA, 25 bp, Mus musculus
gtcactacccgctgctacagtaggg

SEQ ID NO: 681343 - DNA, 25 bp, Mus musculus
gtcactactattcagcagttttcta

SEQ ID NO: 681344 - DNA, 25 bp, Mus musculus
gtcactactattgagcagttttcta

SEQ ID NO: 681345 - DNA, 25 bp, Mus musculus
gtcactactgaccaggacttccatg

SEQ ID NO: 681346 - DNA, 25 bp, Mus musculus
gtcactactgacgaggacttccatg

SEQ ID NO: 681347 - DNA, 25 bp, Mus musculus
gtcactactttaagagcccaggtcc

SEQ ID NO: 681348 - DNA, 25 bp, Mus musculus
gtcactactttacgcggattcgcga

SEQ ID NO: 681349 - DNA, 25 bp, Mus musculus
gtcactactttaggcggattcgcga

SEQ ID NO: 681350 - DNA, 25 bp, Mus musculus
gtcactactttatgagcccaggtcc

SEQ ID NO: 681351 - DNA, 25 bp, Mus musculus
gtcactagaagcctactgcaaacac

SEQ ID NO: 681352 - DNA, 25 bp, Mus musculus
gtcactagaagcgtactgcaaacac

SEQ ID NO: 681353 - DNA, 25 bp, Mus musculus
gtcactagacaacttatattttgga

SEQ ID NO: 681354 - DNA, 25 bp, Mus musculus
gtcactagacaagttatattttgga

SEQ ID NO: 681355 - DNA, 25 bp, Mus musculus
gtcactagacccctgccaagactgt

SEQ ID NO: 681356 - DNA, 25 bp, Mus musculus
gtcactagacccgtgccaagactgt

SEQ ID NO: 681357 - DNA, 25 bp, Mus musculus
gtcactagacgcctaccaggagaaa

SEQ ID NO: 681358 - DNA, 25 bp, Mus musculus
gtcactagacgcgtaccaggagaaa

SEQ ID NO: 681359 - DNA, 25 bp, Mus musculus
gtcactagcaggatgtgtttatagc

SEQ ID NO: 681360 - DNA, 25 bp, Mus musculus
gtcactagcaggttgtgtttatagc

SEQ ID NO: 681361 - DNA, 25 bp, Mus musculus
gtcactagccataacatacttttaa

SEQ ID NO: 681362 - DNA, 25 bp, Mus musculus
gtcactagccattacatacttttaa

SEQ ID NO: 681363 - DNA, 25 bp, Mus musculus
gtcactagcctgctgctgatgtcgt

SEQ ID NO: 681364 - DNA, 25 bp, Mus musculus
gtcactagcctggtgctgatgtcgt

SEQ ID NO: 681365 - DNA, 25 bp, Mus musculus
gtcactaggagtatctgcttccaaa

SEQ ID NO: 681366 - DNA, 25 bp, Mus musculus
gtcactaggagtttctgcttccaaa

SEQ ID NO: 681367 - DNA, 25 bp, Mus musculus
gtcactaggcttagcattcgtatgt

SEQ ID NO: 681368 - DNA, 25 bp, Mus musculus
gtcactaggctttgcattcgtatgt

SEQ ID NO: 681369 - DNA, 25 bp, Mus musculus
gtcactagggtcagtccagcagcac

SEQ ID NO: 681370 - DNA, 25 bp, Mus musculus
gtcactagggtctgtccagcagcac

SEQ ID NO: 681371 - DNA, 25 bp, Mus musculus
gtcactagtgtacggctttagcata

SEQ ID NO: 681372 - DNA, 25 bp, Mus musculus
gtcactagtgtagggctttagcata

SEQ ID NO: 681373 - DNA, 25 bp, Mus musculus
gtcactatagccaagcttgcggata

SEQ ID NO: 681374 - DNA, 25 bp, Mus musculus
gtcactatagcctagcttgcggata

SEQ ID NO: 681375 - DNA, 25 bp, Mus musculus
gtcactatagtgcatctcctggttc

SEQ ID NO: 681376 - DNA, 25 bp, Mus musculus
gtcactatagtggatctcctggttc

SEQ ID NO: 681377 - DNA, 25 bp, Mus musculus
gtcactatcacgactttacagctga

SEQ ID NO: 681378 - DNA, 25 bp, Mus musculus
gtcactatcacgtctttacagctga

SEQ ID NO: 681379 - DNA, 25 bp, Mus musculus
gtcactatctggaaaggactgtcag

SEQ ID NO: 681380 - DNA, 25 bp, Mus musculus
gtcactatctggtaaggactgtcag

SEQ ID NO: 681381 - DNA, 25 bp, Mus musculus
gtcactatctgtcagatggcctgat

SEQ ID NO: 681382 - DNA, 25 bp, Mus musculus
gtcactatctgtgagatggcctgat

SEQ ID NO: 681383 - DNA, 25 bp, Mus musculus
gtcactatgacgcaagttcagcttt

SEQ ID NO: 681384 - DNA, 25 bp, Mus musculus
gtcactatgacggaagttcagcttt

SEQ ID NO: 681385 - DNA, 25 bp, Mus musculus
gtcactatgatcatcgtggcaatca

SEQ ID NO: 681386 - DNA, 25 bp, Mus musculus
gtcactatgatcttcgtggcaatca

SEQ ID NO: 681387 - DNA, 25 bp, Mus musculus
gtcactatgctgaggtttggtccat

SEQ ID NO: 681388 - DNA, 25 bp, Mus musculus
gtcactatgctgtggtttggtccat

SEQ ID NO: 681389 - DNA, 25 bp, Mus musculus
gtcactatgttcactgtcactaagc

SEQ ID NO: 681390 - DNA, 25 bp, Mus musculus
gtcactatgttctctgtcactaagc

SEQ ID NO: 681391 - DNA, 25 bp, Mus musculus
gtcactattgttatgaagtcttgat

SEQ ID NO: 681392 - DNA, 25 bp, Mus musculus
gtcactattgttttgaagtcttgat

SEQ ID NO: 681393 - DNA, 25 bp, Mus musculus
gtcactcaaaggattcttattcaaa

SEQ ID NO: 681394 - DNA, 25 bp, Mus musculus
gtcactcaaaggtttcttattcaaa

SEQ ID NO: 681395 - DNA, 25 bp, Mus musculus
gtcactcaagtcaggaaggtatctg

SEQ ID NO: 681396 - DNA, 25 bp, Mus musculus
gtcactcaagtcctccagctaagga

SEQ ID NO: 681397 - DNA, 25 bp, Mus musculus
gtcactcaagtcgtccagctaagga

SEQ ID NO: 681398 - DNA, 25 bp, Mus musculus
gtcactcaagtctggaaggtatctg

SEQ ID NO: 681399 - DNA, 25 bp, Mus musculus
gtcactcaagttatagatggcacat

SEQ ID NO: 681400 - DNA, 25 bp, Mus musculus
gtcactcaagttcgcttcctgtgga

SEQ ID NO: 681401 - DNA, 25 bp, Mus musculus
gtcactcaagttggcttcctgtgga

SEQ ID NO: 681402 - DNA, 25 bp, Mus musculus
gtcactcaagttttagatggcacat

SEQ ID NO: 681403 - DNA, 25 bp, Mus musculus
gtcactcacacaatggaagctgagg

SEQ ID NO: 681404 - DNA, 25 bp, Mus musculus
gtcactcacacattggaagctgagg

SEQ ID NO: 681405 - DNA, 25 bp, Mus musculus
gtcactcacagcacagttatggtct

SEQ ID NO: 681406 - DNA, 25 bp, Mus musculus
gtcactcacagctcagttatggtct

SEQ ID NO: 681407 - DNA, 25 bp, Mus musculus
gtcactcacaggcaattatttccca

SEQ ID NO: 681408 - DNA, 25 bp, Mus musculus
gtcactcacagggaattatttccca

SEQ ID NO: 681409 - DNA, 25 bp, Mus musculus
gtcactcacatcaggtgcaaagggt

SEQ ID NO: 681410 - DNA, 25 bp, Mus musculus
gtcactcacatctggtgcaaagggt

SEQ ID NO: 681411 - DNA, 25 bp, Mus musculus
gtcactcacccaaccttgtacatga

SEQ ID NO: 681412 - DNA, 25 bp, Mus musculus
gtcactcacccatccttgtacatga

SEQ ID NO: 681413 - DNA, 25 bp, Mus musculus
gtcactcacgtgaatagcaagggcc

SEQ ID NO: 681414 - DNA, 25 bp, Mus musculus
gtcactcacgtgtatagcaagggcc

SEQ ID NO: 681415 - DNA, 25 bp, Mus musculus
gtcactcactcactcgtggtctgag

SEQ ID NO: 681416 - DNA, 25 bp, Mus musculus
gtcactcactcagtcgtggtctgag

SEQ ID NO: 681417 - DNA, 25 bp, Mus musculus
gtcactcactctcagcctcatttat

SEQ ID NO: 681418 - DNA, 25 bp, Mus musculus
gtcactcactctgagcctcatttat

SEQ ID NO: 681419 - DNA, 25 bp, Mus musculus
gtcactcactgtagttattgctgca

SEQ ID NO: 681420 - DNA, 25 bp, Mus musculus
gtcactcactgttgttattgctgca

SEQ ID NO: 681421 - DNA, 25 bp, Mus musculus
gtcactcagacaataactacagttt

SEQ ID NO: 681422 - DNA, 25 bp, Mus musculus
gtcactcagacattaactacagttt

SEQ ID NO: 681423 - DNA, 25 bp, Mus musculus
gtcactcagatgagtcactggctca

SEQ ID NO: 681424 - DNA, 25 bp, Mus musculus
gtcactcagatgtgtcactggctca

SEQ ID NO: 681425 - DNA, 25 bp, Mus musculus
gtcactcagcctatatttttaacgg

SEQ ID NO: 681426 - DNA, 25 bp, Mus musculus
gtcactcagcctttatttttaacgg

SEQ ID NO: 681427 - DNA, 25 bp, Mus musculus
gtcactcaggatacaaattcactat

SEQ ID NO: 681428 - DNA, 25 bp, Mus musculus
gtcactcaggattcaaattcactat

SEQ ID NO: 681429 - DNA, 25 bp, Mus musculus
gtcactcagtaaacattgctccaac

SEQ ID NO: 681430 - DNA, 25 bp, Mus musculus
gtcactcagtaatcattgctccaac

SEQ ID NO: 681431 - DNA, 25 bp, Mus musculus
gtcactcagtgaagctttcttacat

SEQ ID NO: 681432 - DNA, 25 bp, Mus musculus
gtcactcagtgatgctttcttacat

SEQ ID NO: 681433 - DNA, 25 bp, Mus musculus
gtcactcatccaaacattgatccat

SEQ ID NO: 681434 - DNA, 25 bp, Mus musculus
gtcactcatccatacattgatccat

SEQ ID NO: 681435 - DNA, 25 bp, Mus musculus
gtcactcattaaaagcggcgggata

SEQ ID NO: 681436 - DNA, 25 bp, Mus musculus
gtcactcattaatagcggcgggata

SEQ ID NO: 681437 - DNA, 25 bp, Mus musculus
gtcactcatttcatgcacttaacac

SEQ ID NO: 681438 - DNA, 25 bp, Mus musculus
gtcactcatttcttgcacttaacac

SEQ ID NO: 681439 - DNA, 25 bp, Mus musculus
gtcactccaaatcaggtcatggtct

SEQ ID NO: 681440 - DNA, 25 bp, Mus musculus
gtcactccaaatgaggtcatggtct

SEQ ID NO: 681441 - DNA, 25 bp, Mus musculus
gtcactccaatactagcccaacaga

SEQ ID NO: 681442 - DNA, 25 bp, Mus musculus
gtcactccaatagtagcccaacaga

SEQ ID NO: 681443 - DNA, 25 bp, Mus musculus
gtcactccagacaaacttccaaaat

SEQ ID NO: 681444 - DNA, 25 bp, Mus musculus
gtcactccagactaacttccaaaat

SEQ ID NO: 681445 - DNA, 25 bp, Mus musculus
gtcactccataccacagtcaaagaa

SEQ ID NO: 681446 - DNA, 25 bp, Mus musculus
gtcactccatacgacagtcaaagaa

SEQ ID NO: 681447 - DNA, 25 bp, Mus musculus
gtcactccatcacctcgatgaaagg

SEQ ID NO: 681448 - DNA, 25 bp, Mus musculus
gtcactccatcagctcgatgaaagg

SEQ ID NO: 681449 - DNA, 25 bp, Mus musculus
gtcactccatcgatgttcttcttcg

SEQ ID NO: 681450 - DNA, 25 bp, Mus musculus
gtcactccatcgttgttcttcttcg

SEQ ID NO: 681451 - DNA, 25 bp, Mus musculus
gtcactccgatgaatgggatcccag

SEQ ID NO: 681452 - DNA, 25 bp, Mus musculus
gtcactccgatgtatgggatcccag

SEQ ID NO: 681453 - DNA, 25 bp, Mus musculus
gtcactcctctgactaagaactggg

SEQ ID NO: 681454 - DNA, 25 bp, Mus musculus
gtcactcctctgtctaagaactggg

SEQ ID NO: 681455 - DNA, 25 bp, Mus musculus
gtcactcctgatactattcttttgg

SEQ ID NO: 681456 - DNA, 25 bp, Mus musculus
gtcactcctgatcgtctcattctgt

SEQ ID NO: 681457 - DNA, 25 bp, Mus musculus
gtcactcctgatggtctcattctgt

SEQ ID NO: 681458 - DNA, 25 bp, Mus musculus
gtcactcctgattctattcttttgg

SEQ ID NO: 681459 - DNA, 25 bp, Mus musculus
gtcactcctggcaccaccgcgctta

SEQ ID NO: 681460 - DNA, 25 bp, Mus musculus
gtcactcctggctccaccgcgctta

SEQ ID NO: 681461 - DNA, 25 bp, Mus musculus
gtcactccttttaatggtgaacatt

SEQ ID NO: 681462 - DNA, 25 bp, Mus musculus
gtcactcctttttatggtgaacatt

SEQ ID NO: 681463 - DNA, 25 bp, Mus musculus
gtcactcgacttaaagagcgttaaa

SEQ ID NO: 681464 - DNA, 25 bp, Mus musculus
gtcactcgactttaagagcgttaaa

SEQ ID NO: 681465 - DNA, 25 bp, Mus musculus
gtcactcgccttctccaaaaaggaa

SEQ ID NO: 681466 - DNA, 25 bp, Mus musculus
gtcactcgccttgtccaaaaaggaa

SEQ ID NO: 681467 - DNA, 25 bp, Mus musculus
gtcactcggcggcttagtaaagaat

SEQ ID NO: 681468 - DNA, 25 bp, Mus musculus
gtcactcggcgggttagtaaagaat

SEQ ID NO: 681469 - DNA, 25 bp, Mus musculus
gtcactcgtacaagcgcagccttca

SEQ ID NO: 681470 - DNA, 25 bp, Mus musculus
gtcactcgtacatgcgcagccttca

SEQ ID NO: 681471 - DNA, 25 bp, Mus musculus
gtcactcgtatactaaggttattca

SEQ ID NO: 681472 - DNA, 25 bp, Mus musculus
gtcactcgtatagtaaggttattca

SEQ ID NO: 681473 - DNA, 25 bp, Mus musculus
gtcactcgtgaacgtgtggcctcaa

SEQ ID NO: 681474 - DNA, 25 bp, Mus musculus
gtcactcgtgaaggtgtggcctcaa

SEQ ID NO: 681475 - DNA, 25 bp, Mus musculus
gtcactctaataattgagactatgc

SEQ ID NO: 681476 - DNA, 25 bp, Mus musculus
gtcactctaatatttgagactatgc

SEQ ID NO: 681477 - DNA, 25 bp, Mus musculus
gtcactctagagcagcggtgagtaa

SEQ ID NO: 681478 - DNA, 25 bp, Mus musculus
gtcactctagaggagcggtgagtaa

SEQ ID NO: 681479 - DNA, 25 bp, Mus musculus
gtcactctatctctgccgtctggga

SEQ ID NO: 681480 - DNA, 25 bp, Mus musculus
gtcactctatctgtgccgtctggga

SEQ ID NO: 681481 - DNA, 25 bp, Mus musculus
gtcactctcagtatatttaatggtt

SEQ ID NO: 681482 - DNA, 25 bp, Mus musculus
gtcactctcagtttatttaatggtt

SEQ ID NO: 681483 - DNA, 25 bp, Mus musculus
gtcactctcccaattaccatagtgg

SEQ ID NO: 681484 - DNA, 25 bp, Mus musculus
gtcactctcccatttaccatagtgg

SEQ ID NO: 681485 - DNA, 25 bp, Mus musculus
gtcactctctagagttcagtgctga

SEQ ID NO: 681486 - DNA, 25 bp, Mus musculus
gtcactctctagtgttcagtgctga

SEQ ID NO: 681487 - DNA, 25 bp, Mus musculus
gtcactctgaagaagtttcttcatg

SEQ ID NO: 681488 - DNA, 25 bp, Mus musculus
gtcactctgaagtagtttcttcatg

SEQ ID NO: 681489 - DNA, 25 bp, Mus musculus
gtcactctgatcaacgtggtccatg

SEQ ID NO: 681490 - DNA, 25 bp, Mus musculus
gtcactctgatctacgtggtccatg

SEQ ID NO: 681491 - DNA, 25 bp, Mus musculus
gtcactctgcagcaggctgatggaa

SEQ ID NO: 681492 - DNA, 25 bp, Mus musculus
gtcactctgcaggaggctgatggaa

SEQ ID NO: 681493 - DNA, 25 bp, Mus musculus
gtcactctgtcgagttaggcattgt

SEQ ID NO: 681494 - DNA, 25 bp, Mus musculus
gtcactctgtcgtgttaggcattgt

SEQ ID NO: 681495 - DNA, 25 bp, Mus musculus
gtcactctgttgctctgtggaaaga

SEQ ID NO: 681496 - DNA, 25 bp, Mus musculus
gtcactctgttggtctgtggaaaga

SEQ ID NO: 681497 - DNA, 25 bp, Mus musculus
gtcactctgtttagtactcataact

SEQ ID NO: 681498 - DNA, 25 bp, Mus musculus
gtcactctgttttgtactcataact

SEQ ID NO: 681499 - DNA, 25 bp, Mus musculus
gtcactcttcacaatgagaccacat

SEQ ID NO: 681500 - DNA, 25 bp, Mus musculus
gtcactcttcaccatttgtatatta

SEQ ID NO: 681501 - DNA, 25 bp, Mus musculus
gtcactcttcacgatttgtatatta

SEQ ID NO: 681502 - DNA, 25 bp, Mus musculus
gtcactcttcactatgagaccacat

SEQ ID NO: 681503 - DNA, 25 bp, Mus musculus
gtcactcttccccttaaaatagctt

SEQ ID NO: 681504 - DNA, 25 bp, Mus musculus
gtcactcttcccgttaaaatagctt

SEQ ID NO: 681505 - DNA, 25 bp, Mus musculus
gtcactcttgctctgaagcctacat

SEQ ID NO: 681506 - DNA, 25 bp, Mus musculus
gtcactcttgctgtgaagcctacat

SEQ ID NO: 681507 - DNA, 25 bp, Mus musculus
gtcactcttgtcatcctgaaatggt

SEQ ID NO: 681508 - DNA, 25 bp, Mus musculus
gtcactcttgtcttcctgaaatggt

SEQ ID NO: 681509 - DNA, 25 bp, Mus musculus
gtcactgaaactagtgctcttcctc

SEQ ID NO: 681510 - DNA, 25 bp, Mus musculus
gtcactgaaactccattattcatcg

SEQ ID NO: 681511 - DNA, 25 bp, Mus musculus
gtcactgaaactgcattattcatcg

SEQ ID NO: 681512 - DNA, 25 bp, Mus musculus
gtcactgaaacttgtgctcttcctc

SEQ ID NO: 681513 - DNA, 25 bp, Mus musculus
gtcactgaaataccgggacctgtca

SEQ ID NO: 681514 - DNA, 25 bp, Mus musculus
gtcactgaaatagcgggacctgtca

SEQ ID NO: 681515 - DNA, 25 bp, Mus musculus
gtcactgaagaccttgcccagaaag

SEQ ID NO: 681516 - DNA, 25 bp, Mus musculus
gtcactgaagacgttgcccagaaag

SEQ ID NO: 681517 - DNA, 25 bp, Mus musculus
gtcactgaagttaaccacatgctct

SEQ ID NO: 681518 - DNA, 25 bp, Mus musculus
gtcactgaagtttaccacatgctct

SEQ ID NO: 681519 - DNA, 25 bp, Mus musculus
gtcactgaatttccagtccattctc

SEQ ID NO: 681520 - DNA, 25 bp, Mus musculus
gtcactgaatttgcagtccattctc

SEQ ID NO: 681521 - DNA, 25 bp, Mus musculus
gtcactgacaagctctccgtgtgag

SEQ ID NO: 681522 - DNA, 25 bp, Mus musculus
gtcactgacaaggtctccgtgtgag

SEQ ID NO: 681523 - DNA, 25 bp, Mus musculus
gtcactgacggtaggaagccccgga

SEQ ID NO: 681524 - DNA, 25 bp, Mus musculus
gtcactgacggttggaagccccgga

SEQ ID NO: 681525 - DNA, 25 bp, Mus musculus
gtcactgactagaaagcaacttctt

SEQ ID NO: 681526 - DNA, 25 bp, Mus musculus
gtcactgactagtaagcaacttctt

SEQ ID NO: 681527 - DNA, 25 bp, Mus musculus
gtcactgagcagcatcaacacttgg

SEQ ID NO: 681528 - DNA, 25 bp, Mus musculus
gtcactgagcaggatcaacacttgg

SEQ ID NO: 681529 - DNA, 25 bp, Mus musculus
gtcactgagcccattagatgtttat

SEQ ID NO: 681530 - DNA, 25 bp, Mus musculus
gtcactgagccctttagatgtttat

SEQ ID NO: 681531 - DNA, 25 bp, Mus musculus
gtcactgagtctctttcctgaggat

SEQ ID NO: 681532 - DNA, 25 bp, Mus musculus
gtcactgagtctgtttcctgaggat

SEQ ID NO: 681533 - DNA, 25 bp, Mus musculus
gtcactgatcggcaaactggttctt

SEQ ID NO: 681534 - DNA, 25 bp, Mus musculus
gtcactgatcgggaaactggttctt

SEQ ID NO: 681535 - DNA, 25 bp, Mus musculus
gtcactgatgaccaggatactgtct

SEQ ID NO: 681536 - DNA, 25 bp, Mus musculus
gtcactgatgacgaggatactgtct

SEQ ID NO: 681537 - DNA, 25 bp, Mus musculus
gtcactgattctagcaccttagacc

SEQ ID NO: 681538 - DNA, 25 bp, Mus musculus
gtcactgattcttgcaccttagacc

SEQ ID NO: 681539 - DNA, 25 bp, Mus musculus
gtcactgatttaaactgtggcctag

SEQ ID NO: 681540 - DNA, 25 bp, Mus musculus
gtcactgatttatactgtggcctag

SEQ ID NO: 681541 - DNA, 25 bp, Mus musculus
gtcactgcaactagaaatactgtaa

SEQ ID NO: 681542 - DNA, 25 bp, Mus musculus
gtcactgcaacttgaaatactgtaa

SEQ ID NO: 681543 - DNA, 25 bp, Mus musculus
gtcactgcaagactagaaacttacc

SEQ ID NO: 681544 - DNA, 25 bp, Mus musculus
gtcactgcaagagtagaaacttacc

SEQ ID NO: 681545 - DNA, 25 bp, Mus musculus
gtcactgcagatagtttctgttgtt

SEQ ID NO: 681546 - DNA, 25 bp, Mus musculus
gtcactgcagattgtttctgttgtt

SEQ ID NO: 681547 - DNA, 25 bp, Mus musculus
gtcactgcagtcactatcaaggaga

SEQ ID NO: 681548 - DNA, 25 bp, Mus musculus
gtcactgcagtctctatcaaggaga

SEQ ID NO: 681549 - DNA, 25 bp, Mus musculus
gtcactgcatttccacattcattta

SEQ ID NO: 681550 - DNA, 25 bp, Mus musculus
gtcactgcatttgcacattcattta

SEQ ID NO: 681551 - DNA, 25 bp, Mus musculus
gtcactgccaaacaaaggaactact

SEQ ID NO: 681552 - DNA, 25 bp, Mus musculus
gtcactgccaaagaaaggaactact

SEQ ID NO: 681553 - DNA, 25 bp, Mus musculus
gtcactgcccgactatcagtttgaa

SEQ ID NO: 681554 - DNA, 25 bp, Mus musculus
gtcactgcccgagtatcagtttgaa

SEQ ID NO: 681555 - DNA, 25 bp, Mus musculus
gtcactgccggtcaccgcgaggtca

SEQ ID NO: 681556 - DNA, 25 bp, Mus musculus
gtcactgccggtgaccgcgaggtca

SEQ ID NO: 681557 - DNA, 25 bp, Mus musculus
gtcactgcctatctggtaatgcttg

SEQ ID NO: 681558 - DNA, 25 bp, Mus musculus
gtcactgcctatgtggtaatgcttg

SEQ ID NO: 681559 - DNA, 25 bp, Mus musculus
gtcactgcctcacaaactgacaacg

SEQ ID NO: 681560 - DNA, 25 bp, Mus musculus
gtcactgcctcagaaactgacaacg

SEQ ID NO: 681561 - DNA, 25 bp, Mus musculus
gtcactgcctctataggtctggtat

SEQ ID NO: 681562 - DNA, 25 bp, Mus musculus
gtcactgcctctttaggtctggtat

SEQ ID NO: 681563 - DNA, 25 bp, Mus musculus
gtcactgcctgacaataactgatgt

SEQ ID NO: 681564 - DNA, 25 bp, Mus musculus
gtcactgcctgacccgaagcatgta

SEQ ID NO: 681565 - DNA, 25 bp, Mus musculus
gtcactgcctgagaataactgatgt

SEQ ID NO: 681566 - DNA, 25 bp, Mus musculus
gtcactgcctgagccgaagcatgta

SEQ ID NO: 681567 - DNA, 25 bp, Mus musculus
gtcactgccttgctaattttgctgt

SEQ ID NO: 681568 - DNA, 25 bp, Mus musculus
gtcactgccttggtaattttgctgt

SEQ ID NO: 681569 - DNA, 25 bp, Mus musculus
gtcactgcctttccggaagtcacat

SEQ ID NO: 681570 - DNA, 25 bp, Mus musculus
gtcactgcctttgcggaagtcacat

SEQ ID NO: 681571 - DNA, 25 bp, Mus musculus
gtcactgctaggaatggcactgcaa

SEQ ID NO: 681572 - DNA, 25 bp, Mus musculus
gtcactgctaggtatggcactgcaa

SEQ ID NO: 681573 - DNA, 25 bp, Mus musculus
gtcactgctatcagagttcctgtgt

SEQ ID NO: 681574 - DNA, 25 bp, Mus musculus
gtcactgctatctgagttcctgtgt

SEQ ID NO: 681575 - DNA, 25 bp, Mus musculus
gtcactgctattatactcattgtgt

SEQ ID NO: 681576 - DNA, 25 bp, Mus musculus
gtcactgctattttactcattgtgt

SEQ ID NO: 681577 - DNA, 25 bp, Mus musculus
gtcactgctcaaagataatcctcaa

SEQ ID NO: 681578 - DNA, 25 bp, Mus musculus
gtcactgctcaatgataatcctcaa

SEQ ID NO: 681579 - DNA, 25 bp, Mus musculus
gtcactgctcctacatgtatttttt

SEQ ID NO: 681580 - DNA, 25 bp, Mus musculus
gtcactgctcctcgcttgtgtggtg

SEQ ID NO: 681581 - DNA, 25 bp, Mus musculus
gtcactgctcctggcttgtgtggtg

SEQ ID NO: 681582 - DNA, 25 bp, Mus musculus
gtcactgctccttcatgtatttttt

SEQ ID NO: 681583 - DNA, 25 bp, Mus musculus
gtcactgctcttatattctgctatt

SEQ ID NO: 681584 - DNA, 25 bp, Mus musculus
gtcactgctcttttattctgctatt

SEQ ID NO: 681585 - DNA, 25 bp, Mus musculus
gtcactgctgctattgagtgttgtt

SEQ ID NO: 681586 - DNA, 25 bp, Mus musculus
gtcactgctgcttttgagtgttgtt

SEQ ID NO: 681587 - DNA, 25 bp, Mus musculus
gtcactgctgtacggactggttgca

SEQ ID NO: 681588 - DNA, 25 bp, Mus musculus
gtcactgctgtagggactggttgca

SEQ ID NO: 681589 - DNA, 25 bp, Mus musculus
gtcactgctgtcacaaacggatcac

SEQ ID NO: 681590 - DNA, 25 bp, Mus musculus
gtcactgctgtctcaaacggatcac

SEQ ID NO: 681591 - DNA, 25 bp, Mus musculus
gtcactgctgttatttagcattctc

SEQ ID NO: 681592 - DNA, 25 bp, Mus musculus
gtcactgctgttttttagcattctc

SEQ ID NO: 681593 - DNA, 25 bp, Mus musculus
gtcactggaagtatcacttgctgag

SEQ ID NO: 681594 - DNA, 25 bp, Mus musculus
gtcactggaagtttcacttgctgag

SEQ ID NO: 681595 - DNA, 25 bp, Mus musculus
gtcactggacaaccactgactgtgg

SEQ ID NO: 681596 - DNA, 25 bp, Mus musculus
gtcactggacaagcactgactgtgg

SEQ ID NO: 681597 - DNA, 25 bp, Mus musculus
gtcactggactacgatgcatccctt

SEQ ID NO: 681598 - DNA, 25 bp, Mus musculus
gtcactggactaggatgcatccctt

SEQ ID NO: 681599 - DNA, 25 bp, Mus musculus
gtcactggagaccttgatggccaca

SEQ ID NO: 681600 - DNA, 25 bp, Mus musculus
gtcactggagacgttgatggccaca

SEQ ID NO: 681601 - DNA, 25 bp, Mus musculus
gtcactggagggacttagatcccca

SEQ ID NO: 681602 - DNA, 25 bp, Mus musculus
gtcactggagggtcttagatcccca

SEQ ID NO: 681603 - DNA, 25 bp, Mus musculus
gtcactggattcataatttgaaagt

SEQ ID NO: 681604 - DNA, 25 bp, Mus musculus
gtcactggattcttaatttgaaagt

SEQ ID NO: 681605 - DNA, 25 bp, Mus musculus
gtcactggcccactaaaggcagtat

SEQ ID NO: 681606 - DNA, 25 bp, Mus musculus
gtcactggcccagtaaaggcagtat

SEQ ID NO: 681607 - DNA, 25 bp, Mus musculus
gtcactggccccagtttaaatgaag

SEQ ID NO: 681608 - DNA, 25 bp, Mus musculus
gtcactggcccctgtttaaatgaag

SEQ ID NO: 681609 - DNA, 25 bp, Mus musculus
gtcactggcctcaatattcaactat

SEQ ID NO: 681610 - DNA, 25 bp, Mus musculus
gtcactggcctctatattcaactat

SEQ ID NO: 681611 - DNA, 25 bp, Mus musculus
gtcactggctatcatacccagctct

SEQ ID NO: 681612 - DNA, 25 bp, Mus musculus
gtcactggctatgatacccagctct

SEQ ID NO: 681613 - DNA, 25 bp, Mus musculus
gtcactgggacaccactgtggctca

SEQ ID NO: 681614 - DNA, 25 bp, Mus musculus
gtcactgggacagcactgtggctca

SEQ ID NO: 681615 - DNA, 25 bp, Mus musculus
gtcactgggattcctgtcgcagcca

SEQ ID NO: 681616 - DNA, 25 bp, Mus musculus
gtcactgggattgctgtcgcagcca

SEQ ID NO: 681617 - DNA, 25 bp, Mus musculus
gtcactgggcaaaatttagctatat

SEQ ID NO: 681618 - DNA, 25 bp, Mus musculus
gtcactgggcaatatttagctatat

SEQ ID NO: 681619 - DNA, 25 bp, Mus musculus
gtcactgggctgacctatccaaaaa

SEQ ID NO: 681620 - DNA, 25 bp, Mus musculus
gtcactgggctgcagtagtctgcct

SEQ ID NO: 681621 - DNA, 25 bp, Mus musculus
gtcactgggctggagtagtctgcct

SEQ ID NO: 681622 - DNA, 25 bp, Mus musculus
gtcactgggctgtcctatccaaaaa

SEQ ID NO: 681623 - DNA, 25 bp, Mus musculus
gtcactgggtacaagacagctattt

SEQ ID NO: 681624 - DNA, 25 bp, Mus musculus
gtcactgggtactagacagctattt

SEQ ID NO: 681625 - DNA, 25 bp, Mus musculus
gtcactggtaagaacaagactcttt

SEQ ID NO: 681626 - DNA, 25 bp, Mus musculus
gtcactggtaagtacaagactcttt

SEQ ID NO: 681627 - DNA, 25 bp, Mus musculus
gtcactggtcagcatgtacttctct

SEQ ID NO: 681628 - DNA, 25 bp, Mus musculus
gtcactggtcaggatgtacttctct

SEQ ID NO: 681629 - DNA, 25 bp, Mus musculus
gtcactggtgccctattacaccgat

SEQ ID NO: 681630 - DNA, 25 bp, Mus musculus
gtcactggtgccgtattacaccgat

SEQ ID NO: 681631 - DNA, 25 bp, Mus musculus
gtcactgtacaacccagacccagaa

SEQ ID NO: 681632 - DNA, 25 bp, Mus musculus
gtcactgtacaagccagacccagaa

SEQ ID NO: 681633 - DNA, 25 bp, Mus musculus
gtcactgtagctatagtagttgctt

SEQ ID NO: 681634 - DNA, 25 bp, Mus musculus
gtcactgtagctttagtagttgctt

SEQ ID NO: 681635 - DNA, 25 bp, Mus musculus
gtcactgtagttctgctgccttaaa

SEQ ID NO: 681636 - DNA, 25 bp, Mus musculus
gtcactgtagttgtgctgccttaaa

SEQ ID NO: 681637 - DNA, 25 bp, Mus musculus
gtcactgtatccaaatctctgtgtt

SEQ ID NO: 681638 - DNA, 25 bp, Mus musculus
gtcactgtatcctaatctctgtgtt

SEQ ID NO: 681639 - DNA, 25 bp, Mus musculus
gtcactgtatgaccagaagcgataa

SEQ ID NO: 681640 - DNA, 25 bp, Mus musculus
gtcactgtatgagcagaagcgataa

SEQ ID NO: 681641 - DNA, 25 bp, Mus musculus
gtcactgtcaagctccagacgtgga

SEQ ID NO: 681642 - DNA, 25 bp, Mus musculus
gtcactgtcaaggtccagacgtgga

SEQ ID NO: 681643 - DNA, 25 bp, Mus musculus
gtcactgtcactcttttattctcca

SEQ ID NO: 681644 - DNA, 25 bp, Mus musculus
gtcactgtcactgttttattctcca

SEQ ID NO: 681645 - DNA, 25 bp, Mus musculus
gtcactgtcagtccgaaggatcact

SEQ ID NO: 681646 - DNA, 25 bp, Mus musculus
gtcactgtcagtctgtacaaacacg

SEQ ID NO: 681647 - DNA, 25 bp, Mus musculus
gtcactgtcagtgcgaaggatcact

SEQ ID NO: 681648 - DNA, 25 bp, Mus musculus
gtcactgtcagtgtgtacaaacacg

SEQ ID NO: 681649 - DNA, 25 bp, Mus musculus
gtcactgtcatcagaatctgtcggc

SEQ ID NO: 681650 - DNA, 25 bp, Mus musculus
gtcactgtcatctgaatctgtcggc

SEQ ID NO: 681651 - DNA, 25 bp, Mus musculus
gtcactgtcatgattatgggcatac

SEQ ID NO: 681652 - DNA, 25 bp, Mus musculus
gtcactgtcatgtttatgggcatac

SEQ ID NO: 681653 - DNA, 25 bp, Mus musculus
gtcactgtcctgaatatcacggaaa

SEQ ID NO: 681654 - DNA, 25 bp, Mus musculus
gtcactgtcctgagaatggccaggg

SEQ ID NO: 681655 - DNA, 25 bp, Mus musculus
gtcactgtcctgtatatcacggaaa

SEQ ID NO: 681656 - DNA, 25 bp, Mus musculus
gtcactgtcctgtgaatggccaggg

SEQ ID NO: 681657 - DNA, 25 bp, Mus musculus
gtcactgtccttacaccttaagttt

SEQ ID NO: 681658 - DNA, 25 bp, Mus musculus
gtcactgtcctttcaccttaagttt

SEQ ID NO: 681659 - DNA, 25 bp, Mus musculus
gtcactgtctgaacatggcaaggct

SEQ ID NO: 681660 - DNA, 25 bp, Mus musculus
gtcactgtctgaatctaatggagca

SEQ ID NO: 681661 - DNA, 25 bp, Mus musculus
gtcactgtctgatcatggcaaggct

SEQ ID NO: 681662 - DNA, 25 bp, Mus musculus
gtcactgtctgattctaatggagca

SEQ ID NO: 681663 - DNA, 25 bp, Mus musculus
gtcactgtctttattatctgctgga

SEQ ID NO: 681664 - DNA, 25 bp, Mus musculus
gtcactgtcttttttatctgctgga

SEQ ID NO: 681665 - DNA, 25 bp, Mus musculus
gtcactgtgaacaccccactgttaa

SEQ ID NO: 681666 - DNA, 25 bp, Mus musculus
gtcactgtgaactccccactgttaa

SEQ ID NO: 681667 - DNA, 25 bp, Mus musculus
gtcactgtgaccacctttagtatat

SEQ ID NO: 681668 - DNA, 25 bp, Mus musculus
gtcactgtgaccatctctgaaaaaa

SEQ ID NO: 681669 - DNA, 25 bp, Mus musculus
gtcactgtgacctcctttagtatat

SEQ ID NO: 681670 - DNA, 25 bp, Mus musculus
gtcactgtgaccttctctgaaaaaa

SEQ ID NO: 681671 - DNA, 25 bp, Mus musculus
gtcactgtgactatgggtggtcccc

SEQ ID NO: 681672 - DNA, 25 bp, Mus musculus
gtcactgtgactttgggtggtcccc

SEQ ID NO: 681673 - DNA, 25 bp, Mus musculus
gtcactgtgcagcatggagacctct

SEQ ID NO: 681674 - DNA, 25 bp, Mus musculus
gtcactgtgcaggatggagacctct

SEQ ID NO: 681675 - DNA, 25 bp, Mus musculus
gtcactgtgctgagagagccggaac

SEQ ID NO: 681676 - DNA, 25 bp, Mus musculus
gtcactgtgctgtgagagccggaac

SEQ ID NO: 681677 - DNA, 25 bp, Mus musculus
gtcactgtggctaatcagtcaccag

SEQ ID NO: 681678 - DNA, 25 bp, Mus musculus
gtcactgtggcttatcagtcaccag

SEQ ID NO: 681679 - DNA, 25 bp, Mus musculus
gtcactgtgggtatatcttatgcat

SEQ ID NO: 681680 - DNA, 25 bp, Mus musculus
gtcactgtgggtttatcttatgcat

SEQ ID NO: 681681 - DNA, 25 bp, Mus musculus
gtcactgtgtacctcttaaatgcaa

SEQ ID NO: 681682 - DNA, 25 bp, Mus musculus
gtcactgtgtacgtcttaaatgcaa

SEQ ID NO: 681683 - DNA, 25 bp, Mus musculus
gtcactgtgtccaacccacataaga

SEQ ID NO: 681684 - DNA, 25 bp, Mus musculus
gtcactgtgtcctacccacataaga

SEQ ID NO: 681685 - DNA, 25 bp, Mus musculus
gtcactgtgtctcgtatgtagtgct

SEQ ID NO: 681686 - DNA, 25 bp, Mus musculus
gtcactgtgtctggtatgtagtgct

SEQ ID NO: 681687 - DNA, 25 bp, Mus musculus
gtcactgtgtgaacacccggctgat

SEQ ID NO: 681688 - DNA, 25 bp, Mus musculus
gtcactgtgtgacgcacgaaccaaa

SEQ ID NO: 681689 - DNA, 25 bp, Mus musculus
gtcactgtgtgaggcacgaaccaaa

SEQ ID NO: 681690 - DNA, 25 bp, Mus musculus
gtcactgtgtgatcacccggctgat

SEQ ID NO: 681691 - DNA, 25 bp, Mus musculus
gtcactgtgtttatcattgctctgt

SEQ ID NO: 681692 - DNA, 25 bp, Mus musculus
gtcactgtgtttttcattgctctgt

SEQ ID NO: 681693 - DNA, 25 bp, Mus musculus
gtcactgttaatatagcttggcttc

SEQ ID NO: 681694 - DNA, 25 bp, Mus musculus
gtcactgttaatttagcttggcttc

SEQ ID NO: 681695 - DNA, 25 bp, Mus musculus
gtcactgttcccaattaaaagcctt

SEQ ID NO: 681696 - DNA, 25 bp, Mus musculus
gtcactgttccctattaaaagcctt

SEQ ID NO: 681697 - DNA, 25 bp, Mus musculus
gtcactgttctcagacacaaagagg

SEQ ID NO: 681698 - DNA, 25 bp, Mus musculus
gtcactgttctctgacacaaagagg

SEQ ID NO: 681699 - DNA, 25 bp, Mus musculus
gtcactgttgagacctttctcaaga

SEQ ID NO: 681700 - DNA, 25 bp, Mus musculus
gtcactgttgagtcctttctcaaga

SEQ ID NO: 681701 - DNA, 25 bp, Mus musculus
gtcactgttgggaaaatatgtaact

SEQ ID NO: 681702 - DNA, 25 bp, Mus musculus
gtcactgttgggtaaatatgtaact

SEQ ID NO: 681703 - DNA, 25 bp, Mus musculus
gtcactgtttagagattttcctttt

SEQ ID NO: 681704 - DNA, 25 bp, Mus musculus
gtcactgtttagtgattttcctttt

SEQ ID NO: 681705 - DNA, 25 bp, Mus musculus
gtcactgtttctaactgtgtagagt

SEQ ID NO: 681706 - DNA, 25 bp, Mus musculus
gtcactgtttcttactgtgtagagt

SEQ ID NO: 681707 - DNA, 25 bp, Mus musculus
gtcactgtttggaactgtgtatcag

SEQ ID NO: 681708 - DNA, 25 bp, Mus musculus
gtcactgtttggtactgtgtatcag

SEQ ID NO: 681709 - DNA, 25 bp, Mus musculus
gtcacttaaatgatatatctgcatg

SEQ ID NO: 681710 - DNA, 25 bp, Mus musculus
gtcacttaaatgttatatctgcatg

SEQ ID NO: 681711 - DNA, 25 bp, Mus musculus
gtcacttaaattcttactacgcata

SEQ ID NO: 681712 - DNA, 25 bp, Mus musculus
gtcacttaaattgttactacgcata

SEQ ID NO: 681713 - DNA, 25 bp, Mus musculus
gtcacttaacatagcatgctcctct

SEQ ID NO: 681714 - DNA, 25 bp, Mus musculus
gtcacttaacattgcatgctcctct

SEQ ID NO: 681715 - DNA, 25 bp, Mus musculus
gtcacttaacctattgtagcctaca

SEQ ID NO: 681716 - DNA, 25 bp, Mus musculus
gtcacttaaccttttgtagcctaca

SEQ ID NO: 681717 - DNA, 25 bp, Mus musculus
gtcacttaagccaaaccagatgtca

SEQ ID NO: 681718 - DNA, 25 bp, Mus musculus
gtcacttaagcctaaccagatgtca

SEQ ID NO: 681719 - DNA, 25 bp, Mus musculus
gtcacttacagtagcatttgccaag

SEQ ID NO: 681720 - DNA, 25 bp, Mus musculus
gtcacttacagttgcatttgccaag

SEQ ID NO: 681721 - DNA, 25 bp, Mus musculus
gtcacttaccggcaacggctacata

SEQ ID NO: 681722 - DNA, 25 bp, Mus musculus
gtcacttaccgggaacggctacata

SEQ ID NO: 681723 - DNA, 25 bp, Mus musculus
gtcacttactccctttaattttgct

SEQ ID NO: 681724 - DNA, 25 bp, Mus musculus
gtcacttactccgtttaattttgct

SEQ ID NO: 681725 - DNA, 25 bp, Mus musculus
gtcacttagctcacgtagatactgt

SEQ ID NO: 681726 - DNA, 25 bp, Mus musculus
gtcacttagctctcgtagatactgt

SEQ ID NO: 681727 - DNA, 25 bp, Mus musculus
gtcacttaggctcttgtgatgcaca

SEQ ID NO: 681728 - DNA, 25 bp, Mus musculus
gtcacttaggctgttgtgatgcaca

SEQ ID NO: 681729 - DNA, 25 bp, Mus musculus
gtcacttatgacattctcacggcaa

SEQ ID NO: 681730 - DNA, 25 bp, Mus musculus
gtcacttatgactttctcacggcaa

SEQ ID NO: 681731 - DNA, 25 bp, Mus musculus
gtcacttatgtcagtgttctctgaa

SEQ ID NO: 681732 - DNA, 25 bp, Mus musculus
gtcacttatgtctgtgttctctgaa

SEQ ID NO: 681733 - DNA, 25 bp, Mus musculus
gtcacttcagaccttaggcttcaga

SEQ ID NO: 681734 - DNA, 25 bp, Mus musculus
gtcacttcagacgttaggcttcaga

SEQ ID NO: 681735 - DNA, 25 bp, Mus musculus
gtcacttcagtgaatggtgctacat

SEQ ID NO: 681736 - DNA, 25 bp, Mus musculus
gtcacttcagtgtatggtgctacat

SEQ ID NO: 681737 - DNA, 25 bp, Mus musculus
gtcacttcagttccactcaagcatt

SEQ ID NO: 681738 - DNA, 25 bp, Mus musculus
gtcacttcagttgcactcaagcatt

SEQ ID NO: 681739 - DNA, 25 bp, Mus musculus
gtcacttcatccacatgctataatg

SEQ ID NO: 681740 - DNA, 25 bp, Mus musculus
gtcacttcatcctcatgctataatg

SEQ ID NO: 681741 - DNA, 25 bp, Mus musculus
gtcacttcatctctttagaacacct

SEQ ID NO: 681742 - DNA, 25 bp, Mus musculus
gtcacttcatctgtttagaacacct

SEQ ID NO: 681743 - DNA, 25 bp, Mus musculus
gtcacttccagtaaatttgcttccg

SEQ ID NO: 681744 - DNA, 25 bp, Mus musculus
gtcacttccagttaatttgcttccg

SEQ ID NO: 681745 - DNA, 25 bp, Mus musculus
gtcacttccatgcttctcagtataa

SEQ ID NO: 681746 - DNA, 25 bp, Mus musculus
gtcacttccatggttctcagtataa

SEQ ID NO: 681747 - DNA, 25 bp, Mus musculus
gtcacttcctgaaatctatgctgct

SEQ ID NO: 681748 - DNA, 25 bp, Mus musculus
gtcacttcctgatatctatgctgct

SEQ ID NO: 681749 - DNA, 25 bp, Mus musculus
gtcacttccttaatgagccagaggt

SEQ ID NO: 681750 - DNA, 25 bp, Mus musculus
gtcacttccttactaaacgctggtc

SEQ ID NO: 681751 - DNA, 25 bp, Mus musculus
gtcacttccttagtaaacgctggtc

SEQ ID NO: 681752 - DNA, 25 bp, Mus musculus
gtcacttccttattgagccagaggt

SEQ ID NO: 681753 - DNA, 25 bp, Mus musculus
gtcacttcgctgaatgtgtttcata

SEQ ID NO: 681754 - DNA, 25 bp, Mus musculus
gtcacttcgctgtatgtgtttcata

SEQ ID NO: 681755 - DNA, 25 bp, Mus musculus
gtcacttctatcattacaacccaag

SEQ ID NO: 681756 - DNA, 25 bp, Mus musculus
gtcacttctatctttacaacccaag

SEQ ID NO: 681757 - DNA, 25 bp, Mus musculus
gtcacttctattctttacagaacct

SEQ ID NO: 681758 - DNA, 25 bp, Mus musculus
gtcacttctattgtttacagaacct

SEQ ID NO: 681759 - DNA, 25 bp, Mus musculus
gtcacttcttatctctaaagctctc

SEQ ID NO: 681760 - DNA, 25 bp, Mus musculus
gtcacttcttatgtctaaagctctc

SEQ ID NO: 681761 - DNA, 25 bp, Mus musculus
gtcacttgagtaacttggccgctaa

SEQ ID NO: 681762 - DNA, 25 bp, Mus musculus
gtcacttgagtatcttggccgctaa

SEQ ID NO: 681763 - DNA, 25 bp, Mus musculus
gtcacttgagttctctttattctct

SEQ ID NO: 681764 - DNA, 25 bp, Mus musculus
gtcacttgagttgtctttattctct

SEQ ID NO: 681765 - DNA, 25 bp, Mus musculus
gtcacttgatgcaatgtgaaccaca

SEQ ID NO: 681766 - DNA, 25 bp, Mus musculus
gtcacttgatgctatgtgaaccaca

SEQ ID NO: 681767 - DNA, 25 bp, Mus musculus
gtcacttgatttaatggtacctatc

SEQ ID NO: 681768 - DNA, 25 bp, Mus musculus
gtcacttgattttatggtacctatc

SEQ ID NO: 681769 - DNA, 25 bp, Mus musculus
gtcacttgcaaacgtgagggctcac

SEQ ID NO: 681770 - DNA, 25 bp, Mus musculus
gtcacttgcaaaggtgagggctcac

SEQ ID NO: 681771 - DNA, 25 bp, Mus musculus
gtcacttgcattataaacttacctg

SEQ ID NO: 681772 - DNA, 25 bp, Mus musculus
gtcacttgcattttaaacttacctg

SEQ ID NO: 681773 - DNA, 25 bp, Mus musculus
gtcacttgcccactgtaaacacagg

SEQ ID NO: 681774 - DNA, 25 bp, Mus musculus
gtcacttgcccagtgtaaacacagg

SEQ ID NO: 681775 - DNA, 25 bp, Mus musculus
gtcacttgcgtgagactgtgtcttg

SEQ ID NO: 681776 - DNA, 25 bp, Mus musculus
gtcacttgcgtgtgactgtgtcttg

SEQ ID NO: 681777 - DNA, 25 bp, Mus musculus
gtcacttgctgcataatagcggttt

SEQ ID NO: 681778 - DNA, 25 bp, Mus musculus
gtcacttgctgcttaatagcggttt

SEQ ID NO: 681779 - DNA, 25 bp, Mus musculus
gtcacttgggaaacatctgggagat

SEQ ID NO: 681780 - DNA, 25 bp, Mus musculus
gtcacttgggaatcatctgggagat

SEQ ID NO: 681781 - DNA, 25 bp, Mus musculus
gtcacttggtacatttctcgatcat

SEQ ID NO: 681782 - DNA, 25 bp, Mus musculus
gtcacttggtacttttctcgatcat

SEQ ID NO: 681783 - DNA, 25 bp, Mus musculus
gtcacttggtgtatcctatctttaa

SEQ ID NO: 681784 - DNA, 25 bp, Mus musculus
gtcacttggtgtttcctatctttaa

SEQ ID NO: 681785 - DNA, 25 bp, Mus musculus
gtcacttggtttaaggcaaattgca

SEQ ID NO: 681786 - DNA, 25 bp, Mus musculus
gtcacttggttttaggcaaattgca

SEQ ID NO: 681787 - DNA, 25 bp, Mus musculus
gtcacttgtatcaagaatttcgtcc

SEQ ID NO: 681788 - DNA, 25 bp, Mus musculus
gtcacttgtatctagaatttcgtcc

SEQ ID NO: 681789 - DNA, 25 bp, Mus musculus
gtcacttgtcacacatgccggtcac

SEQ ID NO: 681790 - DNA, 25 bp, Mus musculus
gtcacttgtcactcatgccggtcac

SEQ ID NO: 681791 - DNA, 25 bp, Mus musculus
gtcacttgtgcaataagaggtcttc

SEQ ID NO: 681792 - DNA, 25 bp, Mus musculus
gtcacttgtgcattaagaggtcttc

SEQ ID NO: 681793 - DNA, 25 bp, Mus musculus
gtcacttgtgtaacttgagaactcg

SEQ ID NO: 681794 - DNA, 25 bp, Mus musculus
gtcacttgtgtatcttgagaactcg

SEQ ID NO: 681795 - DNA, 25 bp, Mus musculus
gtcacttgtgtgagaactgcccact

SEQ ID NO: 681796 - DNA, 25 bp, Mus musculus
gtcacttgtgtgagctgctggccca

SEQ ID NO: 681797 - DNA, 25 bp, Mus musculus
gtcacttgtgtgtgaactgcccact

SEQ ID NO: 681798 - DNA, 25 bp, Mus musculus
gtcacttgtgtgtgctgctggccca

SEQ ID NO: 681799 - DNA, 25 bp, Mus musculus
gtcactttacagaagccagcatgga

SEQ ID NO: 681800 - DNA, 25 bp, Mus musculus
gtcactttacagtagccagcatgga

SEQ ID NO: 681801 - DNA, 25 bp, Mus musculus
gtcactttacccataactacagcat

SEQ ID NO: 681802 - DNA, 25 bp, Mus musculus
gtcactttacccttaactacagcat

SEQ ID NO: 681803 - DNA, 25 bp, Mus musculus
gtcactttaggacattctcagaagg

SEQ ID NO: 681804 - DNA, 25 bp, Mus musculus
gtcactttaggagattctcagaagg

SEQ ID NO: 681805 - DNA, 25 bp, Mus musculus
gtcactttaggtacagggttcctga

SEQ ID NO: 681806 - DNA, 25 bp, Mus musculus
gtcactttaggttcagggttcctga

SEQ ID NO: 681807 - DNA, 25 bp, Mus musculus
gtcactttatagaacttcacctcag

SEQ ID NO: 681808 - DNA, 25 bp, Mus musculus
gtcactttatagtacttcacctcag

SEQ ID NO: 681809 - DNA, 25 bp, Mus musculus
gtcactttattgcacactaagatat

SEQ ID NO: 681810 - DNA, 25 bp, Mus musculus
gtcactttattggacactaagatat

SEQ ID NO: 681811 - DNA, 25 bp, Mus musculus
gtcactttcaaaacgttggaggctt

SEQ ID NO: 681812 - DNA, 25 bp, Mus musculus
gtcactttcaaatcgttggaggctt

SEQ ID NO: 681813 - DNA, 25 bp, Mus musculus
gtcactttcaccaagacaagtctgt

SEQ ID NO: 681814 - DNA, 25 bp, Mus musculus
gtcactttcacctagacaagtctgt

SEQ ID NO: 681815 - DNA, 25 bp, Mus musculus
gtcactttccagctctgtggtcaaa

SEQ ID NO: 681816 - DNA, 25 bp, Mus musculus
gtcactttccaggtctgtggtcaaa

SEQ ID NO: 681817 - DNA, 25 bp, Mus musculus
gtcactttccgtcggagcagacagc

SEQ ID NO: 681818 - DNA, 25 bp, Mus musculus
gtcactttccgtgggagcagacagc

SEQ ID NO: 681819 - DNA, 25 bp, Mus musculus
gtcactttcctgaagcatattgctt

SEQ ID NO: 681820 - DNA, 25 bp, Mus musculus
gtcactttcctgcacttggatcaat

SEQ ID NO: 681821 - DNA, 25 bp, Mus musculus
gtcactttcctggacttggatcaat

SEQ ID NO: 681822 - DNA, 25 bp, Mus musculus
gtcactttcctgtagcatattgctt

SEQ ID NO: 681823 - DNA, 25 bp, Mus musculus
gtcactttcgaccataacactgtct

SEQ ID NO: 681824 - DNA, 25 bp, Mus musculus
gtcactttcgacgataacactgtct

SEQ ID NO: 681825 - DNA, 25 bp, Mus musculus
gtcactttcgatactgtacttcaga

SEQ ID NO: 681826 - DNA, 25 bp, Mus musculus
gtcactttcgattctgtacttcaga

SEQ ID NO: 681827 - DNA, 25 bp, Mus musculus
gtcactttctttcactttccaagag

SEQ ID NO: 681828 - DNA, 25 bp, Mus musculus
gtcactttctttgactttccaagag

SEQ ID NO: 681829 - DNA, 25 bp, Mus musculus
gtcactttgattagagctgactcat

SEQ ID NO: 681830 - DNA, 25 bp, Mus musculus
gtcactttgatttgagctgactcat

SEQ ID NO: 681831 - DNA, 25 bp, Mus musculus
gtcactttgcacctgcagccaggaa

SEQ ID NO: 681832 - DNA, 25 bp, Mus musculus
gtcactttgcacgtgcagccaggaa

SEQ ID NO: 681833 - DNA, 25 bp, Mus musculus
gtcactttgcccattacgtcagaag

SEQ ID NO: 681834 - DNA, 25 bp, Mus musculus
gtcactttgccctttacgtcagaag

SEQ ID NO: 681835 - DNA, 25 bp, Mus musculus
gtcactttgcgcatctgtgtatata

SEQ ID NO: 681836 - DNA, 25 bp, Mus musculus
gtcactttgcgcttctgtgtatata

SEQ ID NO: 681837 - DNA, 25 bp, Mus musculus
gtcactttgcttagggtattctcat

SEQ ID NO: 681838 - DNA, 25 bp, Mus musculus
gtcactttgctttgggtattctcat

SEQ ID NO: 681839 - DNA, 25 bp, Mus musculus
gtcactttggttcaaccccctacat

SEQ ID NO: 681840 - DNA, 25 bp, Mus musculus
gtcactttggttgaaccccctacat

SEQ ID NO: 681841 - DNA, 25 bp, Mus musculus
gtcacttttgctaccacaactacat

SEQ ID NO: 681842 - DNA, 25 bp, Mus musculus
gtcacttttgcttccacaactacat

SEQ ID NO: 681843 - DNA, 25 bp, Mus musculus
gtcactttttagcacactggtacct

SEQ ID NO: 681844 - DNA, 25 bp, Mus musculus
gtcactttttaggacactggtacct

SEQ ID NO: 681845 - DNA, 25 bp, Mus musculus
gtcagaaaacctatgtgggcccagt

SEQ ID NO: 681846 - DNA, 25 bp, Mus musculus
gtcagaaaacctttgtgggcccagt

SEQ ID NO: 681847 - DNA, 25 bp, Mus musculus
gtcagaaaagccaagctctagaatg

SEQ ID NO: 681848 - DNA, 25 bp, Mus musculus
gtcagaaaagcctagctctagaatg

SEQ ID NO: 681849 - DNA, 25 bp, Mus musculus
gtcagaaaccccagattattatttt

SEQ ID NO: 681850 - DNA, 25 bp, Mus musculus
gtcagaaacccctgattattatttt

SEQ ID NO: 681851 - DNA, 25 bp, Mus musculus
gtcagaaacctcatggttgtagaaa

SEQ ID NO: 681852 - DNA, 25 bp, Mus musculus
gtcagaaacctcttggttgtagaaa

SEQ ID NO: 681853 - DNA, 25 bp, Mus musculus
gtcagaaactcaaacagtcacacag

SEQ ID NO: 681854 - DNA, 25 bp, Mus musculus
gtcagaaactcatacagtcacacag

SEQ ID NO: 681855 - DNA, 25 bp, Mus musculus
gtcagaaagactccctggtaccagt

SEQ ID NO: 681856 - DNA, 25 bp, Mus musculus
gtcagaaagactgcctggtaccagt

SEQ ID NO: 681857 - DNA, 25 bp, Mus musculus
gtcagaaagagccatttccaggttt

SEQ ID NO: 681858 - DNA, 25 bp, Mus musculus
gtcagaaagagcgatttccaggttt

SEQ ID NO: 681859 - DNA, 25 bp, Mus musculus
gtcagaaagccactcactaactaat

SEQ ID NO: 681860 - DNA, 25 bp, Mus musculus
gtcagaaagccagtcactaactaat

SEQ ID NO: 681861 - DNA, 25 bp, Mus musculus
gtcagaaagctacaggcagcggccc

SEQ ID NO: 681862 - DNA, 25 bp, Mus musculus
gtcagaaagctagaggcagcggccc

SEQ ID NO: 681863 - DNA, 25 bp, Mus musculus
gtcagaaagctgcaaactcaatcac

SEQ ID NO: 681864 - DNA, 25 bp, Mus musculus
gtcagaaagctggaaactcaatcac

SEQ ID NO: 681865 - DNA, 25 bp, Mus musculus
gtcagaaaggaacatgaattcaact

SEQ ID NO: 681866 - DNA, 25 bp, Mus musculus
gtcagaaaggaagatgaattcaact

SEQ ID NO: 681867 - DNA, 25 bp, Mus musculus
gtcagaaattcactgttgatgtaat

SEQ ID NO: 681868 - DNA, 25 bp, Mus musculus
gtcagaaattcagtgttgatgtaat

SEQ ID NO: 681869 - DNA, 25 bp, Mus musculus
gtcagaacaaacacaattaccaatg

SEQ ID NO: 681870 - DNA, 25 bp, Mus musculus
gtcagaacaaactcaattaccaatg

SEQ ID NO: 681871 - DNA, 25 bp, Mus musculus
gtcagaacaaggctgttggcttata

SEQ ID NO: 681872 - DNA, 25 bp, Mus musculus
gtcagaacaagggtgttggcttata

SEQ ID NO: 681873 - DNA, 25 bp, Mus musculus
gtcagaacaggtatttcacaccgcc

SEQ ID NO: 681874 - DNA, 25 bp, Mus musculus
gtcagaacaggtttttcacaccgcc

SEQ ID NO: 681875 - DNA, 25 bp, Mus musculus
gtcagaacagtcaggctttgagtaa

SEQ ID NO: 681876 - DNA, 25 bp, Mus musculus
gtcagaacagtctggctttgagtaa

SEQ ID NO: 681877 - DNA, 25 bp, Mus musculus
gtcagaaccgtacacaaacagcttt

SEQ ID NO: 681878 - DNA, 25 bp, Mus musculus
gtcagaaccgtagacaaacagcttt

SEQ ID NO: 681879 - DNA, 25 bp, Mus musculus
gtcagaactcaacaaaattgtcata

SEQ ID NO: 681880 - DNA, 25 bp, Mus musculus
gtcagaactcaagaaaattgtcata

SEQ ID NO: 681881 - DNA, 25 bp, Mus musculus
gtcagaactccaacataattccacc

SEQ ID NO: 681882 - DNA, 25 bp, Mus musculus
gtcagaactccatcataattccacc

SEQ ID NO: 681883 - DNA, 25 bp, Mus musculus
gtcagaactccgagctgagcgagat

SEQ ID NO: 681884 - DNA, 25 bp, Mus musculus
gtcagaactccgtgctgagcgagat

SEQ ID NO: 681885 - DNA, 25 bp, Mus musculus
gtcagaactgccaggaggtgcgcac

SEQ ID NO: 681886 - DNA, 25 bp, Mus musculus
gtcagaactgcctggaggtgcgcac

SEQ ID NO: 681887 - DNA, 25 bp, Mus musculus
gtcagaagagtccaggtttttcaag

SEQ ID NO: 681888 - DNA, 25 bp, Mus musculus
gtcagaagagtcgaggtttttcaag

SEQ ID NO: 681889 - DNA, 25 bp, Mus musculus
gtcagaagatgacttacggccagat

SEQ ID NO: 681890 - DNA, 25 bp, Mus musculus
gtcagaagatgagttacggccagat

SEQ ID NO: 681891 - DNA, 25 bp, Mus musculus
gtcagaagcaccagggagcatcctt

SEQ ID NO: 681892 - DNA, 25 bp, Mus musculus
gtcagaagcacctgggagcatcctt

SEQ ID NO: 681893 - DNA, 25 bp, Mus musculus
gtcagaagcaggctatagagaaaac

SEQ ID NO: 681894 - DNA, 25 bp, Mus musculus
gtcagaagcagggtatagagaaaac

SEQ ID NO: 681895 - DNA, 25 bp, Mus musculus
gtcagaagcccgcacttagaacatg

SEQ ID NO: 681896 - DNA, 25 bp, Mus musculus
gtcagaagcccggacttagaacatg

SEQ ID NO: 681897 - DNA, 25 bp, Mus musculus
gtcagaagccgtatgctggccagat

SEQ ID NO: 681898 - DNA, 25 bp, Mus musculus
gtcagaagccgtttgctggccagat

SEQ ID NO: 681899 - DNA, 25 bp, Mus musculus
gtcagaagctaactggtttgtgttt

SEQ ID NO: 681900 - DNA, 25 bp, Mus musculus
gtcagaagctaagtggtttgtgttt

SEQ ID NO: 681901 - DNA, 25 bp, Mus musculus
gtcagaagggacattatctctcttt

SEQ ID NO: 681902 - DNA, 25 bp, Mus musculus
gtcagaagggactttatctctcttt

SEQ ID NO: 681903 - DNA, 25 bp, Mus musculus
gtcagaagtctgatcccaaactggc

SEQ ID NO: 681904 - DNA, 25 bp, Mus musculus
gtcagaagtctgttcccaaactggc

SEQ ID NO: 681905 - DNA, 25 bp, Mus musculus
gtcagaatacacacggaatccagat

SEQ ID NO: 681906 - DNA, 25 bp, Mus musculus
gtcagaatacactcggaatccagat

SEQ ID NO: 681907 - DNA, 25 bp, Mus musculus
gtcagaatagacatcttccagctcc

SEQ ID NO: 681908 - DNA, 25 bp, Mus musculus
gtcagaatagacttcttccagctcc

SEQ ID NO: 681909 - DNA, 25 bp, Mus musculus
gtcagaataggccatcaggtcccca

SEQ ID NO: 681910 - DNA, 25 bp, Mus musculus
gtcagaataggcgatcaggtcccca

SEQ ID NO: 681911 - DNA, 25 bp, Mus musculus
gtcagaatattcacacttgggagaa

SEQ ID NO: 681912 - DNA, 25 bp, Mus musculus
gtcagaatattctcacttgggagaa

SEQ ID NO: 681913 - DNA, 25 bp, Mus musculus
gtcagaatcctacccaggcagaggt

SEQ ID NO: 681914 - DNA, 25 bp, Mus musculus
gtcagaatcctagccaggcagaggt

SEQ ID NO: 681915 - DNA, 25 bp, Mus musculus
gtcagaatcctgctttgagtccagc

SEQ ID NO: 681916 - DNA, 25 bp, Mus musculus
gtcagaatcctggtttgagtccagc

SEQ ID NO: 681917 - DNA, 25 bp, Mus musculus
gtcagaatcgagctaattcccttct

SEQ ID NO: 681918 - DNA, 25 bp, Mus musculus
gtcagaatcgaggtaattcccttct

SEQ ID NO: 681919 - DNA, 25 bp, Mus musculus
gtcagaatctctaaccatgagtaaa

SEQ ID NO: 681920 - DNA, 25 bp, Mus musculus
gtcagaatctcttaccatgagtaaa

SEQ ID NO: 681921 - DNA, 25 bp, Mus musculus
gtcagaatctgactgtacctccggg

SEQ ID NO: 681922 - DNA, 25 bp, Mus musculus
gtcagaatctgagtgtacctccggg

SEQ ID NO: 681923 - DNA, 25 bp, Mus musculus
gtcagaatctgcaggcccgctggaa

SEQ ID NO: 681924 - DNA, 25 bp, Mus musculus
gtcagaatctgctggcccgctggaa

SEQ ID NO: 681925 - DNA, 25 bp, Mus musculus
gtcagaatgcagaccagctgccggg

SEQ ID NO: 681926 - DNA, 25 bp, Mus musculus
gtcagaatgcagtccagctgccggg

SEQ ID NO: 681927 - DNA, 25 bp, Mus musculus
gtcagaatgctgagggtcaaaccat

SEQ ID NO: 681928 - DNA, 25 bp, Mus musculus
gtcagaatgctgtgggtcaaaccat

SEQ ID NO: 681929 - DNA, 25 bp, Mus musculus
gtcagaatgtgtcggctttggttta

SEQ ID NO: 681930 - DNA, 25 bp, Mus musculus
gtcagaatgtgtgggctttggttta

SEQ ID NO: 681931 - DNA, 25 bp, Mus musculus
gtcagaattactcccttgtctttta

SEQ ID NO: 681932 - DNA, 25 bp, Mus musculus
gtcagaattactgccttgtctttta

SEQ ID NO: 681933 - DNA, 25 bp, Mus musculus
gtcagaattctcagacgttagtctt

SEQ ID NO: 681934 - DNA, 25 bp, Mus musculus
gtcagaattctctgacgttagtctt

SEQ ID NO: 681935 - DNA, 25 bp, Mus musculus
gtcagaattgttaaacccttcttgt

SEQ ID NO: 681936 - DNA, 25 bp, Mus musculus
gtcagaattgtttaacccttcttgt

SEQ ID NO: 681937 - DNA, 25 bp, Mus musculus
gtcagaatttcaattttcacacaca

SEQ ID NO: 681938 - DNA, 25 bp, Mus musculus
gtcagaatttcatttttcacacaca

SEQ ID NO: 681939 - DNA, 25 bp, Mus musculus
gtcagacaacagatgaggcccctga

SEQ ID NO: 681940 - DNA, 25 bp, Mus musculus
gtcagacaacagttgaggcccctga

SEQ ID NO: 681941 - DNA, 25 bp, Mus musculus
gtcagacaacgtctcctggaggact

SEQ ID NO: 681942 - DNA, 25 bp, Mus musculus
gtcagacaacgtgtcctggaggact

SEQ ID NO: 681943 - DNA, 25 bp, Mus musculus
gtcagacaccccaatttttcaggtt

SEQ ID NO: 681944 - DNA, 25 bp, Mus musculus
gtcagacacccctatttttcaggtt

SEQ ID NO: 681945 - DNA, 25 bp, Mus musculus
gtcagacacgtgcaaagtgctttca

SEQ ID NO: 681946 - DNA, 25 bp, Mus musculus
gtcagacacgtggaaagtgctttca

SEQ ID NO: 681947 - DNA, 25 bp, Mus musculus
gtcagacactcgagccttgtaagcg

SEQ ID NO: 681948 - DNA, 25 bp, Mus musculus
gtcagacactcgtgccttgtaagcg

SEQ ID NO: 681949 - DNA, 25 bp, Mus musculus
gtcagacactttcttgataggagct

SEQ ID NO: 681950 - DNA, 25 bp, Mus musculus
gtcagacactttgttgataggagct

SEQ ID NO: 681951 - DNA, 25 bp, Mus musculus
gtcagacagcagatattaccaataa

SEQ ID NO: 681952 - DNA, 25 bp, Mus musculus
gtcagacagcagttattaccaataa

SEQ ID NO: 681953 - DNA, 25 bp, Mus musculus
gtcagacagcgccaacaatatccac

SEQ ID NO: 681954 - DNA, 25 bp, Mus musculus
gtcagacagcgcgaacaatatccac

SEQ ID NO: 681955 - DNA, 25 bp, Mus musculus
gtcagacagctgactagctttttca

SEQ ID NO: 681956 - DNA, 25 bp, Mus musculus
gtcagacagctgtctagctttttca

SEQ ID NO: 681957 - DNA, 25 bp, Mus musculus
gtcagacaggtgcttggctacttta

SEQ ID NO: 681958 - DNA, 25 bp, Mus musculus
gtcagacaggtggttggctacttta

SEQ ID NO: 681959 - DNA, 25 bp, Mus musculus
gtcagacaggttagtcagccaatgt

SEQ ID NO: 681960 - DNA, 25 bp, Mus musculus
gtcagacaggtttgtcagccaatgt

SEQ ID NO: 681961 - DNA, 25 bp, Mus musculus
gtcagacagtaaacagctttgtatc

SEQ ID NO: 681962 - DNA, 25 bp, Mus musculus
gtcagacagtaatcagctttgtatc

SEQ ID NO: 681963 - DNA, 25 bp, Mus musculus
gtcagaccacacaacacgcagcagt

SEQ ID NO: 681964 - DNA, 25 bp, Mus musculus
gtcagaccacactacacgcagcagt

SEQ ID NO: 681965 - DNA, 25 bp, Mus musculus
gtcagaccacagctgttggattcaa

SEQ ID NO: 681966 - DNA, 25 bp, Mus musculus
gtcagaccacaggtgttggattcaa

SEQ ID NO: 681967 - DNA, 25 bp, Mus musculus
gtcagaccagagagggacccagact

SEQ ID NO: 681968 - DNA, 25 bp, Mus musculus
gtcagaccagagcaccgtgaagaaa

SEQ ID NO: 681969 - DNA, 25 bp, Mus musculus
gtcagaccagaggaccgtgaagaaa

SEQ ID NO: 681970 - DNA, 25 bp, Mus musculus
gtcagaccagagtgggacccagact

SEQ ID NO: 681971 - DNA, 25 bp, Mus musculus
gtcagaccaggcaatccagtcaagt

SEQ ID NO: 681972 - DNA, 25 bp, Mus musculus
gtcagaccaggctatccagtcaagt

SEQ ID NO: 681973 - DNA, 25 bp, Mus musculus
gtcagaccatccatggtgtttctcc

SEQ ID NO: 681974 - DNA, 25 bp, Mus musculus
gtcagaccatccttggtgtttctcc

SEQ ID NO: 681975 - DNA, 25 bp, Mus musculus
gtcagaccattaccgtgcacacgtt

SEQ ID NO: 681976 - DNA, 25 bp, Mus musculus
gtcagaccattagcgtgcacacgtt

SEQ ID NO: 681977 - DNA, 25 bp, Mus musculus
gtcagacccttacttattgcaggtt

SEQ ID NO: 681978 - DNA, 25 bp, Mus musculus
gtcagacccttagttattgcaggtt

SEQ ID NO: 681979 - DNA, 25 bp, Mus musculus
gtcagacctatcaaatttacaccag

SEQ ID NO: 681980 - DNA, 25 bp, Mus musculus
gtcagacctatcattctgtctctca

SEQ ID NO: 681981 - DNA, 25 bp, Mus musculus
gtcagacctatctaatttacaccag

SEQ ID NO: 681982 - DNA, 25 bp, Mus musculus
gtcagacctatctttctgtctctca

SEQ ID NO: 681983 - DNA, 25 bp, Mus musculus
gtcagacctattattctagttccag

SEQ ID NO: 681984 - DNA, 25 bp, Mus musculus
gtcagacctatttttctagttccag

SEQ ID NO: 681985 - DNA, 25 bp, Mus musculus
gtcagacctctgcttgaagagcaaa

SEQ ID NO: 681986 - DNA, 25 bp, Mus musculus
gtcagacctctggttgaagagcaaa

SEQ ID NO: 681987 - DNA, 25 bp, Mus musculus
gtcagacctggacgctcacctgaat

SEQ ID NO: 681988 - DNA, 25 bp, Mus musculus
gtcagacctggaggctcacctgaat

SEQ ID NO: 681989 - DNA, 25 bp, Mus musculus
gtcagacctggtcagctggttcaag

SEQ ID NO: 681990 - DNA, 25 bp, Mus musculus
gtcagacctggtgagctggttcaag

SEQ ID NO: 681991 - DNA, 25 bp, Mus musculus
gtcagacctgtcatcagatggtaga

SEQ ID NO: 681992 - DNA, 25 bp, Mus musculus
gtcagacctgtcttcagatggtaga

SEQ ID NO: 681993 - DNA, 25 bp, Mus musculus
gtcagacgagaactgcatctcccac

SEQ ID NO: 681994 - DNA, 25 bp, Mus musculus
gtcagacgagaagtgcatctcccac

SEQ ID NO: 681995 - DNA, 25 bp, Mus musculus
gtcagacgagcccaggttctgcaca

SEQ ID NO: 681996 - DNA, 25 bp, Mus musculus
gtcagacgagccgaggttctgcaca

SEQ ID NO: 681997 - DNA, 25 bp, Mus musculus
gtcagacgatgacggcagataccta

SEQ ID NO: 681998 - DNA, 25 bp, Mus musculus
gtcagacgatgagggcagataccta

SEQ ID NO: 681999 - DNA, 25 bp, Mus musculus
gtcagacgccagagtcctaggacag

SEQ ID NO: 682000 - DNA, 25 bp, Mus musculus
gtcagacgccagtgtcctaggacag

SEQ ID NO: 682001 - DNA, 25 bp, Mus musculus
gtcagacgctcgagggcgagttcat

SEQ ID NO: 682002 - DNA, 25 bp, Mus musculus
gtcagacgctcgtgggcgagttcat

SEQ ID NO: 682003 - DNA, 25 bp, Mus musculus
gtcagacggccaacaagagttctct

SEQ ID NO: 682004 - DNA, 25 bp, Mus musculus
gtcagacggccatcaagagttctct

SEQ ID NO: 682005 - DNA, 25 bp, Mus musculus
gtcagacgtcatatccttggactga

SEQ ID NO: 682006 - DNA, 25 bp, Mus musculus
gtcagacgtcatttccttggactga

SEQ ID NO: 682007 - DNA, 25 bp, Mus musculus
gtcagacgtgaaagtctggcccctt

SEQ ID NO: 682008 - DNA, 25 bp, Mus musculus
gtcagacgtgaatgtctggcccctt

SEQ ID NO: 682009 - DNA, 25 bp, Mus musculus
gtcagactaacactacccagaggct

SEQ ID NO: 682010 - DNA, 25 bp, Mus musculus
gtcagactaacagtacccagaggct

SEQ ID NO: 682011 - DNA, 25 bp, Mus musculus
gtcagactacctctccagagtgtac

SEQ ID NO: 682012 - DNA, 25 bp, Mus musculus
gtcagactacctgtccagagtgtac

SEQ ID NO: 682013 - DNA, 25 bp, Mus musculus
gtcagactcactatctgttgtcagc

SEQ ID NO: 682014 - DNA, 25 bp, Mus musculus
gtcagactcactttctgttgtcagc

SEQ ID NO: 682015 - DNA, 25 bp, Mus musculus
gtcagactcattccccgaacggagg

SEQ ID NO: 682016 - DNA, 25 bp, Mus musculus
gtcagactcattgcccgaacggagg

SEQ ID NO: 682017 - DNA, 25 bp, Mus musculus
gtcagactcgacagatggtgatggt

SEQ ID NO: 682018 - DNA, 25 bp, Mus musculus
gtcagactcgactgatggtgatggt

SEQ ID NO: 682019 - DNA, 25 bp, Mus musculus
gtcagactctgcctaggtgttgcaa

SEQ ID NO: 682020 - DNA, 25 bp, Mus musculus
gtcagactctgcgtaggtgttgcaa

SEQ ID NO: 682021 - DNA, 25 bp, Mus musculus
gtcagactctgtaacaaccacaagg

SEQ ID NO: 682022 - DNA, 25 bp, Mus musculus
gtcagactctgttacaaccacaagg

SEQ ID NO: 682023 - DNA, 25 bp, Mus musculus
gtcagactgtagagcagatgccttc

SEQ ID NO: 682024 - DNA, 25 bp, Mus musculus
gtcagactgtagtgcagatgccttc

SEQ ID NO: 682025 - DNA, 25 bp, Mus musculus
gtcagactgtgtcattagtgccctt

SEQ ID NO: 682026 - DNA, 25 bp, Mus musculus
gtcagactgtgtgattagtgccctt

SEQ ID NO: 682027 - DNA, 25 bp, Mus musculus
gtcagacttaatatgaggcatccag

SEQ ID NO: 682028 - DNA, 25 bp, Mus musculus
gtcagacttaatttgaggcatccag

SEQ ID NO: 682029 - DNA, 25 bp, Mus musculus
gtcagacttcatctttactttcctg

SEQ ID NO: 682030 - DNA, 25 bp, Mus musculus
gtcagacttcatgtttactttcctg

SEQ ID NO: 682031 - DNA, 25 bp, Mus musculus
gtcagacttggaactcttatgtcct

SEQ ID NO: 682032 - DNA, 25 bp, Mus musculus
gtcagacttggatctcttatgtcct

SEQ ID NO: 682033 - DNA, 25 bp, Mus musculus
gtcagacttgtcattgtggagttca

SEQ ID NO: 682034 - DNA, 25 bp, Mus musculus
gtcagacttgtctttgtggagttca

SEQ ID NO: 682035 - DNA, 25 bp, Mus musculus
gtcagactttcacaacttttcggta

SEQ ID NO: 682036 - DNA, 25 bp, Mus musculus
gtcagactttcagaacttttcggta

SEQ ID NO: 682037 - DNA, 25 bp, Mus musculus
gtcagagaaagaaccctgcctgtgt

SEQ ID NO: 682038 - DNA, 25 bp, Mus musculus
gtcagagaaagatccctgcctgtgt

SEQ ID NO: 682039 - DNA, 25 bp, Mus musculus
gtcagagaactgaacctaggagggt

SEQ ID NO: 682040 - DNA, 25 bp, Mus musculus
gtcagagaactgtacctaggagggt

SEQ ID NO: 682041 - DNA, 25 bp, Mus musculus
gtcagagaatcactttgaacccagg

SEQ ID NO: 682042 - DNA, 25 bp, Mus musculus
gtcagagaatcagtttgaacccagg

SEQ ID NO: 682043 - DNA, 25 bp, Mus musculus
gtcagagacaggaacactcccattt

SEQ ID NO: 682044 - DNA, 25 bp, Mus musculus
gtcagagacaggtacactcccattt

SEQ ID NO: 682045 - DNA, 25 bp, Mus musculus
gtcagagacattaaaccgtgctcat

SEQ ID NO: 682046 - DNA, 25 bp, Mus musculus
gtcagagacatttaaccgtgctcat

SEQ ID NO: 682047 - DNA, 25 bp, Mus musculus
gtcagagaccataccagatcctagg

SEQ ID NO: 682048 - DNA, 25 bp, Mus musculus
gtcagagaccatcgctgtgtgctca

SEQ ID NO: 682049 - DNA, 25 bp, Mus musculus
gtcagagaccatggctgtgtgctca

SEQ ID NO: 682050 - DNA, 25 bp, Mus musculus
gtcagagaccattccagatcctagg

SEQ ID NO: 682051 - DNA, 25 bp, Mus musculus
gtcagagacgccaccgcaagatgct

SEQ ID NO: 682052 - DNA, 25 bp, Mus musculus
gtcagagacgcctccgcaagatgct

SEQ ID NO: 682053 - DNA, 25 bp, Mus musculus
gtcagagactttaactccgttcgtt

SEQ ID NO: 682054 - DNA, 25 bp, Mus musculus
gtcagagactttactacctcagtaa

SEQ ID NO: 682055 - DNA, 25 bp, Mus musculus
gtcagagacttttactccgttcgtt

SEQ ID NO: 682056 - DNA, 25 bp, Mus musculus
gtcagagacttttctacctcagtaa

SEQ ID NO: 682057 - DNA, 25 bp, Mus musculus
gtcagagagatccagggcccctagt

SEQ ID NO: 682058 - DNA, 25 bp, Mus musculus
gtcagagagatcgagggcccctagt

SEQ ID NO: 682059 - DNA, 25 bp, Mus musculus
gtcagagagatgacactagggaagt

SEQ ID NO: 682060 - DNA, 25 bp, Mus musculus
gtcagagagatgtcactagggaagt

SEQ ID NO: 682061 - DNA, 25 bp, Mus musculus
gtcagagagcaacatcaccatgcag

SEQ ID NO: 682062 - DNA, 25 bp, Mus musculus
gtcagagagcaagatcaccatgcag

SEQ ID NO: 682063 - DNA, 25 bp, Mus musculus
gtcagagagccacatgcctggatta

SEQ ID NO: 682064 - DNA, 25 bp, Mus musculus
gtcagagagccagatgcctggatta

SEQ ID NO: 682065 - DNA, 25 bp, Mus musculus
gtcagagagccgcagtcagatgttc

SEQ ID NO: 682066 - DNA, 25 bp, Mus musculus
gtcagagagccggagtcagatgttc

SEQ ID NO: 682067 - DNA, 25 bp, Mus musculus
gtcagagagcttcgagaccgaccca

SEQ ID NO: 682068 - DNA, 25 bp, Mus musculus
gtcagagagcttggagaccgaccca

SEQ ID NO: 682069 - DNA, 25 bp, Mus musculus
gtcagagagtttctacctacagccg

SEQ ID NO: 682070 - DNA, 25 bp, Mus musculus
gtcagagagtttgtacctacagccg

SEQ ID NO: 682071 - DNA, 25 bp, Mus musculus
gtcagagatacaaccctaagccaaa

SEQ ID NO: 682072 - DNA, 25 bp, Mus musculus
gtcagagatacatccctaagccaaa

SEQ ID NO: 682073 - DNA, 25 bp, Mus musculus
gtcagagatcacatcttgtcttcca

SEQ ID NO: 682074 - DNA, 25 bp, Mus musculus
gtcagagatcacttcttgtcttcca

SEQ ID NO: 682075 - DNA, 25 bp, Mus musculus
gtcagagatgctagcctaaagtgtt

SEQ ID NO: 682076 - DNA, 25 bp, Mus musculus
gtcagagatgcttgcctaaagtgtt

SEQ ID NO: 682077 - DNA, 25 bp, Mus musculus
gtcagagcaagaacaggcgatggtt

SEQ ID NO: 682078 - DNA, 25 bp, Mus musculus
gtcagagcaagatcaggcgatggtt

SEQ ID NO: 682079 - DNA, 25 bp, Mus musculus
gtcagagcacaccatgggctacagt

SEQ ID NO: 682080 - DNA, 25 bp, Mus musculus
gtcagagcacacgatgggctacagt

SEQ ID NO: 682081 - DNA, 25 bp, Mus musculus
gtcagagcactcacaaccataggta

SEQ ID NO: 682082 - DNA, 25 bp, Mus musculus
gtcagagcactctcaaccataggta

SEQ ID NO: 682083 - DNA, 25 bp, Mus musculus
gtcagagcatgaatctatccacagt

SEQ ID NO: 682084 - DNA, 25 bp, Mus musculus
gtcagagcatgattctatccacagt

SEQ ID NO: 682085 - DNA, 25 bp, Mus musculus
gtcagagcccacctagaagcaggct

SEQ ID NO: 682086 - DNA, 25 bp, Mus musculus
gtcagagcccacgtagaagcaggct

SEQ ID NO: 682087 - DNA, 25 bp, Mus musculus
gtcagagcctcaatttgagtcccag

SEQ ID NO: 682088 - DNA, 25 bp, Mus musculus
gtcagagcctcattttgagtcccag

SEQ ID NO: 682089 - DNA, 25 bp, Mus musculus
gtcagagccttcctgtagtgccaat

SEQ ID NO: 682090 - DNA, 25 bp, Mus musculus
gtcagagccttcgtgtagtgccaat

SEQ ID NO: 682091 - DNA, 25 bp, Mus musculus
gtcagagccttgattgttttcctgt

SEQ ID NO: 682092 - DNA, 25 bp, Mus musculus
gtcagagccttgtttgttttcctgt

SEQ ID NO: 682093 - DNA, 25 bp, Mus musculus
gtcagagcctttcttctcagactta

SEQ ID NO: 682094 - DNA, 25 bp, Mus musculus
gtcagagcctttgttctcagactta

SEQ ID NO: 682095 - DNA, 25 bp, Mus musculus
gtcagagcgactcctgtgtcaccaa

SEQ ID NO: 682096 - DNA, 25 bp, Mus musculus
gtcagagcgactgctgtgtcaccaa

SEQ ID NO: 682097 - DNA, 25 bp, Mus musculus
gtcagagcgcatcattccccaggaa

SEQ ID NO: 682098 - DNA, 25 bp, Mus musculus
gtcagagcgcatgattccccaggaa

SEQ ID NO: 682099 - DNA, 25 bp, Mus musculus
gtcagagcggccagaacacacgggc

SEQ ID NO: 682100 - DNA, 25 bp, Mus musculus
gtcagagcggcctgaacacacgggc

SEQ ID NO: 682101 - DNA, 25 bp, Mus musculus
gtcagagctacccatggacagcaca

SEQ ID NO: 682102 - DNA, 25 bp, Mus musculus
gtcagagctaccgatggacagcaca

SEQ ID NO: 682103 - DNA, 25 bp, Mus musculus
gtcagagctcagattaagtgatgtc

SEQ ID NO: 682104 - DNA, 25 bp, Mus musculus
gtcagagctcagtttaagtgatgtc

SEQ ID NO: 682105 - DNA, 25 bp, Mus musculus
gtcagagctccactatcccatctga

SEQ ID NO: 682106 - DNA, 25 bp, Mus musculus
gtcagagctccagtatcccatctga

SEQ ID NO: 682107 - DNA, 25 bp, Mus musculus
gtcagagctcccaaaggcaccaagg

SEQ ID NO: 682108 - DNA, 25 bp, Mus musculus
gtcagagctccctaaggcaccaagg

SEQ ID NO: 682109 - DNA, 25 bp, Mus musculus
gtcagagctgaaaagggacatcctt

SEQ ID NO: 682110 - DNA, 25 bp, Mus musculus
gtcagagctgaatagggacatcctt

SEQ ID NO: 682111 - DNA, 25 bp, Mus musculus
gtcagaggaaatcttgcttgctact

SEQ ID NO: 682112 - DNA, 25 bp, Mus musculus
gtcagaggaaatgttgcttgctact

SEQ ID NO: 682113 - DNA, 25 bp, Mus musculus
gtcagaggaaccagagcagtaacca

SEQ ID NO: 682114 - DNA, 25 bp, Mus musculus
gtcagaggaacctgagcagtaacca

SEQ ID NO: 682115 - DNA, 25 bp, Mus musculus
gtcagaggagacatgagtgcccact

SEQ ID NO: 682116 - DNA, 25 bp, Mus musculus
gtcagaggagacttgagtgcccact

SEQ ID NO: 682117 - DNA, 25 bp, Mus musculus
gtcagaggccagagttcaggagtca

SEQ ID NO: 682118 - DNA, 25 bp, Mus musculus
gtcagaggccagtgttcaggagtca

SEQ ID NO: 682119 - DNA, 25 bp, Mus musculus
gtcagaggccatcggtttatttcat

SEQ ID NO: 682120 - DNA, 25 bp, Mus musculus
gtcagaggccatgggtttatttcat

SEQ ID NO: 682121 - DNA, 25 bp, Mus musculus
gtcagaggccctccagacaaaacag

SEQ ID NO: 682122 - DNA, 25 bp, Mus musculus
gtcagaggccctcttggatccccta

SEQ ID NO: 682123 - DNA, 25 bp, Mus musculus
gtcagaggccctgcagacaaaacag

SEQ ID NO: 682124 - DNA, 25 bp, Mus musculus
gtcagaggccctgttggatccccta

SEQ ID NO: 682125 - DNA, 25 bp, Mus musculus
gtcagaggcgcacactgtgtatcct

SEQ ID NO: 682126 - DNA, 25 bp, Mus musculus
gtcagaggcgcagactgtgtatcct

SEQ ID NO: 682127 - DNA, 25 bp, Mus musculus
gtcagaggcgggaccagacttacat

SEQ ID NO: 682128 - DNA, 25 bp, Mus musculus
gtcagaggcgggtccagacttacat

SEQ ID NO: 682129 - DNA, 25 bp, Mus musculus
gtcagaggctagactgagcaacagt

SEQ ID NO: 682130 - DNA, 25 bp, Mus musculus
gtcagaggctagtctgagcaacagt

SEQ ID NO: 682131 - DNA, 25 bp, Mus musculus
gtcagagggaacaagttttggtgat

SEQ ID NO: 682132 - DNA, 25 bp, Mus musculus
gtcagagggaactagttttggtgat

SEQ ID NO: 682133 - DNA, 25 bp, Mus musculus
gtcagagggcgcatgttgccagcca

SEQ ID NO: 682134 - DNA, 25 bp, Mus musculus
gtcagagggcgcttgttgccagcca

SEQ ID NO: 682135 - DNA, 25 bp, Mus musculus
gtcagagggtgaatttgaggatttt

SEQ ID NO: 682136 - DNA, 25 bp, Mus musculus
gtcagagggtgattttgaggatttt

SEQ ID NO: 682137 - DNA, 25 bp, Mus musculus
gtcagaggtcaacaccgggtgcttt

SEQ ID NO: 682138 - DNA, 25 bp, Mus musculus
gtcagaggtcaagaccgggtgcttt

SEQ ID NO: 682139 - DNA, 25 bp, Mus musculus
gtcagaggtcagcactccatgagtc

SEQ ID NO: 682140 - DNA, 25 bp, Mus musculus
gtcagaggtcaggactccatgagtc

SEQ ID NO: 682141 - DNA, 25 bp, Mus musculus
gtcagaggttaaacagaaacaccat

SEQ ID NO: 682142 - DNA, 25 bp, Mus musculus
gtcagaggttaatcagaaacaccat

SEQ ID NO: 682143 - DNA, 25 bp, Mus musculus
gtcagagtacagctccgtaagcagt

SEQ ID NO: 682144 - DNA, 25 bp, Mus musculus
gtcagagtacaggtccgtaagcagt

SEQ ID NO: 682145 - DNA, 25 bp, Mus musculus
gtcagagtaccaattgcatttcaaa

SEQ ID NO: 682146 - DNA, 25 bp, Mus musculus
gtcagagtaccacataaagcaattg

SEQ ID NO: 682147 - DNA, 25 bp, Mus musculus
gtcagagtaccagataaagcaattg

SEQ ID NO: 682148 - DNA, 25 bp, Mus musculus
gtcagagtaccatttgcatttcaaa

SEQ ID NO: 682149 - DNA, 25 bp, Mus musculus
gtcagagtagctacagccccacggc

SEQ ID NO: 682150 - DNA, 25 bp, Mus musculus
gtcagagtagcttcagccccacggc

SEQ ID NO: 682151 - DNA, 25 bp, Mus musculus
gtcagagtatgtaccttagtagtat

SEQ ID NO: 682152 - DNA, 25 bp, Mus musculus
gtcagagtatgttccttagtagtat

SEQ ID NO: 682153 - DNA, 25 bp, Mus musculus
gtcagagtcaagacaccctggacag

SEQ ID NO: 682154 - DNA, 25 bp, Mus musculus
gtcagagtcaagtcaccctggacag

SEQ ID NO: 682155 - DNA, 25 bp, Mus musculus
gtcagagtcaatcgatgatgcttcc

SEQ ID NO: 682156 - DNA, 25 bp, Mus musculus
gtcagagtcaatggatgatgcttcc

SEQ ID NO: 682157 - DNA, 25 bp, Mus musculus
gtcagagtccacagagggtgtcctg

SEQ ID NO: 682158 - DNA, 25 bp, Mus musculus
gtcagagtccactgagggtgtcctg

SEQ ID NO: 682159 - DNA, 25 bp, Mus musculus
gtcagagtcctaaggtctccagcag

SEQ ID NO: 682160 - DNA, 25 bp, Mus musculus
gtcagagtcctatggtctccagcag

SEQ ID NO: 682161 - DNA, 25 bp, Mus musculus
gtcagagtgattagaactcatcttt

SEQ ID NO: 682162 - DNA, 25 bp, Mus musculus
gtcagagtgatttgaactcatcttt

SEQ ID NO: 682163 - DNA, 25 bp, Mus musculus
gtcagagtggacagtggctacccct

SEQ ID NO: 682164 - DNA, 25 bp, Mus musculus
gtcagagtggactgtggctacccct

SEQ ID NO: 682165 - DNA, 25 bp, Mus musculus
gtcagagtgtgtcttcgccaagtta

SEQ ID NO: 682166 - DNA, 25 bp, Mus musculus
gtcagagtgtgtgttcgccaagtta

SEQ ID NO: 682167 - DNA, 25 bp, Mus musculus
gtcagagttaacagaggcaccaggt

SEQ ID NO: 682168 - DNA, 25 bp, Mus musculus
gtcagagttaactgaggcaccaggt

SEQ ID NO: 682169 - DNA, 25 bp, Mus musculus
gtcagagttattatagggacctgct

SEQ ID NO: 682170 - DNA, 25 bp, Mus musculus
gtcagagttattttagggacctgct

SEQ ID NO: 682171 - DNA, 25 bp, Mus musculus
gtcagagttccaaattaactttctt

SEQ ID NO: 682172 - DNA, 25 bp, Mus musculus
gtcagagttccatattaactttctt

SEQ ID NO: 682173 - DNA, 25 bp, Mus musculus
gtcagagttcggacagttcctgcct

SEQ ID NO: 682174 - DNA, 25 bp, Mus musculus
gtcagagttcggtcagttcctgcct

SEQ ID NO: 682175 - DNA, 25 bp, Mus musculus
gtcagagttctccaaatccacaacg

SEQ ID NO: 682176 - DNA, 25 bp, Mus musculus
gtcagagttctcgaaatccacaacg

SEQ ID NO: 682177 - DNA, 25 bp, Mus musculus
gtcagagttgcgacatgggacagac

SEQ ID NO: 682178 - DNA, 25 bp, Mus musculus
gtcagagttgcgtcatgggacagac

SEQ ID NO: 682179 - DNA, 25 bp, Mus musculus
gtcagatacatcattctctttggaa

SEQ ID NO: 682180 - DNA, 25 bp, Mus musculus
gtcagatacatctttctctttggaa

SEQ ID NO: 682181 - DNA, 25 bp, Mus musculus
gtcagatactgtaaaggccttacca

SEQ ID NO: 682182 - DNA, 25 bp, Mus musculus
gtcagatactgttaaggccttacca

SEQ ID NO: 682183 - DNA, 25 bp, Mus musculus
gtcagatagcttccgatgcaggcgc

SEQ ID NO: 682184 - DNA, 25 bp, Mus musculus
gtcagatagcttgcgatgcaggcgc

SEQ ID NO: 682185 - DNA, 25 bp, Mus musculus
gtcagatagtttacaaagatccatt

SEQ ID NO: 682186 - DNA, 25 bp, Mus musculus
gtcagatagttttcaaagatccatt

SEQ ID NO: 682187 - DNA, 25 bp, Mus musculus
gtcagatatctacattataatccac

SEQ ID NO: 682188 - DNA, 25 bp, Mus musculus
gtcagatatctagattataatccac

SEQ ID NO: 682189 - DNA, 25 bp, Mus musculus
gtcagatatgtcacccaagtaaatg

SEQ ID NO: 682190 - DNA, 25 bp, Mus musculus
gtcagatatgtctcccaagtaaatg

SEQ ID NO: 682191 - DNA, 25 bp, Mus musculus
gtcagatcactaattgcaatattgc

SEQ ID NO: 682192 - DNA, 25 bp, Mus musculus
gtcagatcactatttgcaatattgc

SEQ ID NO: 682193 - DNA, 25 bp, Mus musculus
gtcagatcaggacctgtggctccct

SEQ ID NO: 682194 - DNA, 25 bp, Mus musculus
gtcagatcaggagctgtggctccct

SEQ ID NO: 682195 - DNA, 25 bp, Mus musculus
gtcagatcatctccaataccaatta

SEQ ID NO: 682196 - DNA, 25 bp, Mus musculus
gtcagatcatctgcaataccaatta

SEQ ID NO: 682197 - DNA, 25 bp, Mus musculus
gtcagatcatggacctgcacaggat

SEQ ID NO: 682198 - DNA, 25 bp, Mus musculus
gtcagatcatggtcctgcacaggat

SEQ ID NO: 682199 - DNA, 25 bp, Mus musculus
gtcagatcattccaaagtcagaagt

SEQ ID NO: 682200 - DNA, 25 bp, Mus musculus
gtcagatcattcgaaagtcagaagt

SEQ ID NO: 682201 - DNA, 25 bp, Mus musculus
gtcagatccacacataactcgatag

SEQ ID NO: 682202 - DNA, 25 bp, Mus musculus
gtcagatccacagataactcgatag

SEQ ID NO: 682203 - DNA, 25 bp, Mus musculus
gtcagatccagcctgggctagcaac

SEQ ID NO: 682204 - DNA, 25 bp, Mus musculus
gtcagatccagcgtgggctagcaac

SEQ ID NO: 682205 - DNA, 25 bp, Mus musculus
gtcagatcccctaggactaagttac

SEQ ID NO: 682206 - DNA, 25 bp, Mus musculus
gtcagatcccctagggtacacgcag

SEQ ID NO: 682207 - DNA, 25 bp, Mus musculus
gtcagatccccttggactaagttac

SEQ ID NO: 682208 - DNA, 25 bp, Mus musculus
gtcagatccccttgggtacacgcag

SEQ ID NO: 682209 - DNA, 25 bp, Mus musculus
gtcagatccttcaaccgggcttcag

SEQ ID NO: 682210 - DNA, 25 bp, Mus musculus
gtcagatccttctaccgggcttcag

SEQ ID NO: 682211 - DNA, 25 bp, Mus musculus
gtcagatcgaatccatgctctcagc

SEQ ID NO: 682212 - DNA, 25 bp, Mus musculus
gtcagatcgaatgcatgctctcagc

SEQ ID NO: 682213 - DNA, 25 bp, Mus musculus
gtcagatcgatgaattgagcaggtc

SEQ ID NO: 682214 - DNA, 25 bp, Mus musculus
gtcagatcgatgtattgagcaggtc

SEQ ID NO: 682215 - DNA, 25 bp, Mus musculus
gtcagatcggaaagtcagtactcaa

SEQ ID NO: 682216 - DNA, 25 bp, Mus musculus
gtcagatcggaatgtcagtactcaa

SEQ ID NO: 682217 - DNA, 25 bp, Mus musculus
gtcagatctctgctgccagactcaa

SEQ ID NO: 682218 - DNA, 25 bp, Mus musculus
gtcagatctctggtgccagactcaa

SEQ ID NO: 682219 - DNA, 25 bp, Mus musculus
gtcagatctcttaagctcaaggaca

SEQ ID NO: 682220 - DNA, 25 bp, Mus musculus
gtcagatctctttagctcaaggaca

SEQ ID NO: 682221 - DNA, 25 bp, Mus musculus
gtcagatcttctcgccatttggctc

SEQ ID NO: 682222 - DNA, 25 bp, Mus musculus
gtcagatcttctggccatttggctc

SEQ ID NO: 682223 - DNA, 25 bp, Mus musculus
gtcagatgaataagagcaactctct

SEQ ID NO: 682224 - DNA, 25 bp, Mus musculus
gtcagatgaatatgagcaactctct

SEQ ID NO: 682225 - DNA, 25 bp, Mus musculus
gtcagatgacctccaatggtggctg

SEQ ID NO: 682226 - DNA, 25 bp, Mus musculus
gtcagatgacctgcaatggtggctg

SEQ ID NO: 682227 - DNA, 25 bp, Mus musculus
gtcagatgagctacctggacccttg

SEQ ID NO: 682228 - DNA, 25 bp, Mus musculus
gtcagatgagcttcctggacccttg

SEQ ID NO: 682229 - DNA, 25 bp, Mus musculus
gtcagatgagtcaccttggtagcct

SEQ ID NO: 682230 - DNA, 25 bp, Mus musculus
gtcagatgagtctccttggtagcct

SEQ ID NO: 682231 - DNA, 25 bp, Mus musculus
gtcagatgatttaattttccgattg

SEQ ID NO: 682232 - DNA, 25 bp, Mus musculus
gtcagatgatttcttggtaagccac

SEQ ID NO: 682233 - DNA, 25 bp, Mus musculus
gtcagatgatttgttggtaagccac

SEQ ID NO: 682234 - DNA, 25 bp, Mus musculus
gtcagatgattttattttccgattg

SEQ ID NO: 682235 - DNA, 25 bp, Mus musculus
gtcagatgcacacgccttattctaa

SEQ ID NO: 682236 - DNA, 25 bp, Mus musculus
gtcagatgcacaggccttattctaa

SEQ ID NO: 682237 - DNA, 25 bp, Mus musculus
gtcagatgcaccatcactaatgttt

SEQ ID NO: 682238 - DNA, 25 bp, Mus musculus
gtcagatgcaccttcactaatgttt

SEQ ID NO: 682239 - DNA, 25 bp, Mus musculus
gtcagatgcactagtggacggcaga

SEQ ID NO: 682240 - DNA, 25 bp, Mus musculus
gtcagatgcacttgtggacggcaga

SEQ ID NO: 682241 - DNA, 25 bp, Mus musculus
gtcagatgcaggactggcagtgtac

SEQ ID NO: 682242 - DNA, 25 bp, Mus musculus
gtcagatgcaggtctggcagtgtac

SEQ ID NO: 682243 - DNA, 25 bp, Mus musculus
gtcagatgccagacagtggttccca

SEQ ID NO: 682244 - DNA, 25 bp, Mus musculus
gtcagatgccagtcagtggttccca

SEQ ID NO: 682245 - DNA, 25 bp, Mus musculus
gtcagatgccggacatggatttata

SEQ ID NO: 682246 - DNA, 25 bp, Mus musculus
gtcagatgccggtcatggatttata

SEQ ID NO: 682247 - DNA, 25 bp, Mus musculus
gtcagatgtacaattcactgggaca

SEQ ID NO: 682248 - DNA, 25 bp, Mus musculus
gtcagatgtacatttcactgggaca

SEQ ID NO: 682249 - DNA, 25 bp, Mus musculus
gtcagatgtcatacttaccttccat

SEQ ID NO: 682250 - DNA, 25 bp, Mus musculus
gtcagatgtcattcttaccttccat

SEQ ID NO: 682251 - DNA, 25 bp, Mus musculus
gtcagatgtgccatgtagacttctc

SEQ ID NO: 682252 - DNA, 25 bp, Mus musculus
gtcagatgtgccttgtagacttctc

SEQ ID NO: 682253 - DNA, 25 bp, Mus musculus
gtcagattaaaccaccaagtcaccc

SEQ ID NO: 682254 - DNA, 25 bp, Mus musculus
gtcagattaaacgaccaagtcaccc

SEQ ID NO: 682255 - DNA, 25 bp, Mus musculus
gtcagattaagtatcctccctggta

SEQ ID NO: 682256 - DNA, 25 bp, Mus musculus
gtcagattaagtttcctccctggta

SEQ ID NO: 682257 - DNA, 25 bp, Mus musculus
gtcagattattaccagcaagcgcgt

SEQ ID NO: 682258 - DNA, 25 bp, Mus musculus
gtcagattattagcagcaagcgcgt

SEQ ID NO: 682259 - DNA, 25 bp, Mus musculus
gtcagattattccaggcttgttcat

SEQ ID NO: 682260 - DNA, 25 bp, Mus musculus
gtcagattattcgaggcttgttcat

SEQ ID NO: 682261 - DNA, 25 bp, Mus musculus
gtcagattcactcggtcttgagtta

SEQ ID NO: 682262 - DNA, 25 bp, Mus musculus
gtcagattcactgggtcttgagtta

SEQ ID NO: 682263 - DNA, 25 bp, Mus musculus
gtcagattccttcctagtttttact

SEQ ID NO: 682264 - DNA, 25 bp, Mus musculus
gtcagattccttgctagtttttact

SEQ ID NO: 682265 - DNA, 25 bp, Mus musculus
gtcagattctacagtgagcagccct

SEQ ID NO: 682266 - DNA, 25 bp, Mus musculus
gtcagattctactgtgagcagccct

SEQ ID NO: 682267 - DNA, 25 bp, Mus musculus
gtcagattgcataaaaaagggccac

SEQ ID NO: 682268 - DNA, 25 bp, Mus musculus
gtcagattgcattaaaaagggccac

SEQ ID NO: 682269 - DNA, 25 bp, Mus musculus
gtcagattgcttacagggatcaggg

SEQ ID NO: 682270 - DNA, 25 bp, Mus musculus
gtcagattgctttcagggatcaggg

SEQ ID NO: 682271 - DNA, 25 bp, Mus musculus
gtcagattggtcacaagatattcct

SEQ ID NO: 682272 - DNA, 25 bp, Mus musculus
gtcagattggtctcaagatattcct

SEQ ID NO: 682273 - DNA, 25 bp, Mus musculus
gtcagattggttaggttcatttttc

SEQ ID NO: 682274 - DNA, 25 bp, Mus musculus
gtcagattggtttggttcatttttc

SEQ ID NO: 682275 - DNA, 25 bp, Mus musculus
gtcagatttaaacaactataccaat

SEQ ID NO: 682276 - DNA, 25 bp, Mus musculus
gtcagatttaaagaactataccaat

SEQ ID NO: 682277 - DNA, 25 bp, Mus musculus
gtcagatttggactccctgaagtca

SEQ ID NO: 682278 - DNA, 25 bp, Mus musculus
gtcagatttggagtccctgaagtca

SEQ ID NO: 682279 - DNA, 25 bp, Mus musculus
gtcagatttgtgacagggtcagtta

SEQ ID NO: 682280 - DNA, 25 bp, Mus musculus
gtcagatttgtgtcagggtcagtta

SEQ ID NO: 682281 - DNA, 25 bp, Mus musculus
gtcagattttacagctatatcacat

SEQ ID NO: 682282 - DNA, 25 bp, Mus musculus
gtcagattttactgctatatcacat

SEQ ID NO: 682283 - DNA, 25 bp, Mus musculus
gtcagatttttcagttcactggctg

SEQ ID NO: 682284 - DNA, 25 bp, Mus musculus
gtcagatttttctgttcactggctg

SEQ ID NO: 682285 - DNA, 25 bp, Mus musculus
gtcagcaaaaacaactcttaccaag

SEQ ID NO: 682286 - DNA, 25 bp, Mus musculus
gtcagcaaaaactactcttaccaag

SEQ ID NO: 682287 - DNA, 25 bp, Mus musculus
gtcagcaaaaggacttgggttttcg

SEQ ID NO: 682288 - DNA, 25 bp, Mus musculus
gtcagcaaaaggtcttgggttttcg

SEQ ID NO: 682289 - DNA, 25 bp, Mus musculus
gtcagcaaatctccaagtcaaaccc

SEQ ID NO: 682290 - DNA, 25 bp, Mus musculus
gtcagcaaatctgcaagtcaaaccc

SEQ ID NO: 682291 - DNA, 25 bp, Mus musculus
gtcagcaacattatagcactccgct

SEQ ID NO: 682292 - DNA, 25 bp, Mus musculus
gtcagcaacattttagcactccgct

SEQ ID NO: 682293 - DNA, 25 bp, Mus musculus
gtcagcaaccacagacagacctgtc

SEQ ID NO: 682294 - DNA, 25 bp, Mus musculus
gtcagcaaccactgacagacctgtc

SEQ ID NO: 682295 - DNA, 25 bp, Mus musculus
gtcagcaacttaaacacagcacttg

SEQ ID NO: 682296 - DNA, 25 bp, Mus musculus
gtcagcaacttatacacagcacttg

SEQ ID NO: 682297 - DNA, 25 bp, Mus musculus
gtcagcaacttgagcggcccgcgcg

SEQ ID NO: 682298 - DNA, 25 bp, Mus musculus
gtcagcaacttgtgcggcccgcgcg

SEQ ID NO: 682299 - DNA, 25 bp, Mus musculus
gtcagcaactttacaactatctcaa

SEQ ID NO: 682300 - DNA, 25 bp, Mus musculus
gtcagcaacttttcaactatctcaa

SEQ ID NO: 682301 - DNA, 25 bp, Mus musculus
gtcagcaagcaccaattcttcatgt

SEQ ID NO: 682302 - DNA, 25 bp, Mus musculus
gtcagcaagcacgaattcttcatgt

SEQ ID NO: 682303 - DNA, 25 bp, Mus musculus
gtcagcaagtctcttctggtaagta

SEQ ID NO: 682304 - DNA, 25 bp, Mus musculus
gtcagcaagtctgttctggtaagta

SEQ ID NO: 682305 - DNA, 25 bp, Mus musculus
gtcagcaataaccatgtcttgattt

SEQ ID NO: 682306 - DNA, 25 bp, Mus musculus
gtcagcaataacgatgtcttgattt

SEQ ID NO: 682307 - DNA, 25 bp, Mus musculus
gtcagcaatgcgctaaaggactttg

SEQ ID NO: 682308 - DNA, 25 bp, Mus musculus
gtcagcaatgcggtaaaggactttg

SEQ ID NO: 682309 - DNA, 25 bp, Mus musculus
gtcagcaatgtcacgttctatttgt

SEQ ID NO: 682310 - DNA, 25 bp, Mus musculus
gtcagcaatgtctcgttctatttgt

SEQ ID NO: 682311 - DNA, 25 bp, Mus musculus
gtcagcacacgtagcacatcacgat

SEQ ID NO: 682312 - DNA, 25 bp, Mus musculus
gtcagcacacgttgcacatcacgat

SEQ ID NO: 682313 - DNA, 25 bp, Mus musculus
gtcagcacagggatcccgttaagat

SEQ ID NO: 682314 - DNA, 25 bp, Mus musculus
gtcagcacagggttcccgttaagat

SEQ ID NO: 682315 - DNA, 25 bp, Mus musculus
gtcagcacagtacggagcttccgct

SEQ ID NO: 682316 - DNA, 25 bp, Mus musculus
gtcagcacagtagggagcttccgct

SEQ ID NO: 682317 - DNA, 25 bp, Mus musculus
gtcagcacagtgatttatggtgtaa

SEQ ID NO: 682318 - DNA, 25 bp, Mus musculus
gtcagcacagtgttttatggtgtaa

SEQ ID NO: 682319 - DNA, 25 bp, Mus musculus
gtcagcacatccaaagtgaggcttt

SEQ ID NO: 682320 - DNA, 25 bp, Mus musculus
gtcagcacatcctaagtgaggcttt

SEQ ID NO: 682321 - DNA, 25 bp, Mus musculus
gtcagcaccaagaaatctacccaga

SEQ ID NO: 682322 - DNA, 25 bp, Mus musculus
gtcagcaccaagtaatctacccaga

SEQ ID NO: 682323 - DNA, 25 bp, Mus musculus
gtcagcaccagacttgcccaagtga

SEQ ID NO: 682324 - DNA, 25 bp, Mus musculus
gtcagcaccagagttgcccaagtga

SEQ ID NO: 682325 - DNA, 25 bp, Mus musculus
gtcagcaccgacattccataaaaag

SEQ ID NO: 682326 - DNA, 25 bp, Mus musculus
gtcagcaccgactttccataaaaag

SEQ ID NO: 682327 - DNA, 25 bp, Mus musculus
gtcagcaccgagatcttaagccaga

SEQ ID NO: 682328 - DNA, 25 bp, Mus musculus
gtcagcaccgagttcttaagccaga

SEQ ID NO: 682329 - DNA, 25 bp, Mus musculus
gtcagcaccgcacaaggttctggag

SEQ ID NO: 682330 - DNA, 25 bp, Mus musculus
gtcagcaccgcagaaggttctggag

SEQ ID NO: 682331 - DNA, 25 bp, Mus musculus
gtcagcacctttatcttatcatcat

SEQ ID NO: 682332 - DNA, 25 bp, Mus musculus
gtcagcacctttttcttatcatcat

SEQ ID NO: 682333 - DNA, 25 bp, Mus musculus
gtcagcacgttccacaagcttatta

SEQ ID NO: 682334 - DNA, 25 bp, Mus musculus
gtcagcacgttcgacaagcttatta

SEQ ID NO: 682335 - DNA, 25 bp, Mus musculus
gtcagcactgccaatttgcagatca

SEQ ID NO: 682336 - DNA, 25 bp, Mus musculus
gtcagcactgcctatttgcagatca

SEQ ID NO: 682337 - DNA, 25 bp, Mus musculus
gtcagcagacaaccaggagtacttt

SEQ ID NO: 682338 - DNA, 25 bp, Mus musculus
gtcagcagacaagcaggagtacttt

SEQ ID NO: 682339 - DNA, 25 bp, Mus musculus
gtcagcagaccaattccaaatccag

SEQ ID NO: 682340 - DNA, 25 bp, Mus musculus
gtcagcagaccatttccaaatccag

SEQ ID NO: 682341 - DNA, 25 bp, Mus musculus
gtcagcagacctcctctaaaagaga

SEQ ID NO: 682342 - DNA, 25 bp, Mus musculus
gtcagcagacctgctctaaaagaga

SEQ ID NO: 682343 - DNA, 25 bp, Mus musculus
gtcagcagactcactattctctgag

SEQ ID NO: 682344 - DNA, 25 bp, Mus musculus
gtcagcagactctctattctctgag

SEQ ID NO: 682345 - DNA, 25 bp, Mus musculus
gtcagcagagctaaactgagcccca

SEQ ID NO: 682346 - DNA, 25 bp, Mus musculus
gtcagcagagcttaactgagcccca

SEQ ID NO: 682347 - DNA, 25 bp, Mus musculus
gtcagcagcactcggtgtctagaga

SEQ ID NO: 682348 - DNA, 25 bp, Mus musculus
gtcagcagcactgggtgtctagaga

SEQ ID NO: 682349 - DNA, 25 bp, Mus musculus
gtcagcagcagaaaaggcagcaatt

SEQ ID NO: 682350 - DNA, 25 bp, Mus musculus
gtcagcagcagataaggcagcaatt

SEQ ID NO: 682351 - DNA, 25 bp, Mus musculus
gtcagcagcagcacagcattttctt

SEQ ID NO: 682352 - DNA, 25 bp, Mus musculus
gtcagcagcagctcagcattttctt

SEQ ID NO: 682353 - DNA, 25 bp, Mus musculus
gtcagcagcagtctctttagcgtaa

SEQ ID NO: 682354 - DNA, 25 bp, Mus musculus
gtcagcagcagtgtctttagcgtaa

SEQ ID NO: 682355 - DNA, 25 bp, Mus musculus
gtcagcagcataactatttcttttt

SEQ ID NO: 682356 - DNA, 25 bp, Mus musculus
gtcagcagcatatctatttcttttt

SEQ ID NO: 682357 - DNA, 25 bp, Mus musculus
gtcagcagccagacatttattctct

SEQ ID NO: 682358 - DNA, 25 bp, Mus musculus
gtcagcagccagattactgcaagca

SEQ ID NO: 682359 - DNA, 25 bp, Mus musculus
gtcagcagccagtcatttattctct

SEQ ID NO: 682360 - DNA, 25 bp, Mus musculus
gtcagcagccagtttactgcaagca

SEQ ID NO: 682361 - DNA, 25 bp, Mus musculus
gtcagcagcgccattctgagcagag

SEQ ID NO: 682362 - DNA, 25 bp, Mus musculus
gtcagcagcgcctttctgagcagag

SEQ ID NO: 682363 - DNA, 25 bp, Mus musculus
gtcagcagctctcctattgctggta

SEQ ID NO: 682364 - DNA, 25 bp, Mus musculus
gtcagcagctctgctattgctggta

SEQ ID NO: 682365 - DNA, 25 bp, Mus musculus
gtcagcaggcagagcattgcagttt

SEQ ID NO: 682366 - DNA, 25 bp, Mus musculus
gtcagcaggcagtgcattgcagttt

SEQ ID NO: 682367 - DNA, 25 bp, Mus musculus
gtcagcaggcctcaggaatccttaa

SEQ ID NO: 682368 - DNA, 25 bp, Mus musculus
gtcagcaggcctgaggaatccttaa

SEQ ID NO: 682369 - DNA, 25 bp, Mus musculus
gtcagcagtagaaaagttaactcca

SEQ ID NO: 682370 - DNA, 25 bp, Mus musculus
gtcagcagtagataagttaactcca

SEQ ID NO: 682371 - DNA, 25 bp, Mus musculus
gtcagcagtaggctctgtgctccat

SEQ ID NO: 682372 - DNA, 25 bp, Mus musculus
gtcagcagtagggtctgtgctccat

SEQ ID NO: 682373 - DNA, 25 bp, Mus musculus
gtcagcagtatcactaggaccttca

SEQ ID NO: 682374 - DNA, 25 bp, Mus musculus
gtcagcagtatctctaggaccttca

SEQ ID NO: 682375 - DNA, 25 bp, Mus musculus
gtcagcagtattagtatccaactta

SEQ ID NO: 682376 - DNA, 25 bp, Mus musculus
gtcagcagtattcagtctgttcaca

SEQ ID NO: 682377 - DNA, 25 bp, Mus musculus
gtcagcagtattgagtctgttcaca

SEQ ID NO: 682378 - DNA, 25 bp, Mus musculus
gtcagcagtatttgtatccaactta

SEQ ID NO: 682379 - DNA, 25 bp, Mus musculus
gtcagcagtgagacacatggttgtt

SEQ ID NO: 682380 - DNA, 25 bp, Mus musculus
gtcagcagtgagatatgcccgggct

SEQ ID NO: 682381 - DNA, 25 bp, Mus musculus
gtcagcagtgagtcacatggttgtt

SEQ ID NO: 682382 - DNA, 25 bp, Mus musculus
gtcagcagtgagttatgcccgggct

SEQ ID NO: 682383 - DNA, 25 bp, Mus musculus
gtcagcagtgctaggtttgaaaggt

SEQ ID NO: 682384 - DNA, 25 bp, Mus musculus
gtcagcagtgcttggtttgaaaggt

SEQ ID NO: 682385 - DNA, 25 bp, Mus musculus
gtcagcagtgggacttcagaaggaa

SEQ ID NO: 682386 - DNA, 25 bp, Mus musculus
gtcagcagtgggtcttcagaaggaa

SEQ ID NO: 682387 - DNA, 25 bp, Mus musculus
gtcagcagttcacactttttttcca

SEQ ID NO: 682388 - DNA, 25 bp, Mus musculus
gtcagcagttcagactttttttcca

SEQ ID NO: 682389 - DNA, 25 bp, Mus musculus
gtcagcataaaaagcccatctccag

SEQ ID NO: 682390 - DNA, 25 bp, Mus musculus
gtcagcataaaatgcccatctccag

SEQ ID NO: 682391 - DNA, 25 bp, Mus musculus
gtcagcataaggatttgggagcccc

SEQ ID NO: 682392 - DNA, 25 bp, Mus musculus
gtcagcataaggttttgggagcccc

SEQ ID NO: 682393 - DNA, 25 bp, Mus musculus
gtcagcatacagacttcctgtgtgt

SEQ ID NO: 682394 - DNA, 25 bp, Mus musculus
gtcagcatacagtcttcctgtgtgt

SEQ ID NO: 682395 - DNA, 25 bp, Mus musculus
gtcagcatactcaaagcctcaatct

SEQ ID NO: 682396 - DNA, 25 bp, Mus musculus
gtcagcatactctaagcctcaatct

SEQ ID NO: 682397 - DNA, 25 bp, Mus musculus
gtcagcatagttccttacccaggaa

SEQ ID NO: 682398 - DNA, 25 bp, Mus musculus
gtcagcatagttgcttacccaggaa

SEQ ID NO: 682399 - DNA, 25 bp, Mus musculus
gtcagcatcaaccacaacatagcag

SEQ ID NO: 682400 - DNA, 25 bp, Mus musculus
gtcagcatcaacgacaacatagcag

SEQ ID NO: 682401 - DNA, 25 bp, Mus musculus
gtcagcatcacacccaaacgagaag

SEQ ID NO: 682402 - DNA, 25 bp, Mus musculus
gtcagcatcacagccaaacgagaag

SEQ ID NO: 682403 - DNA, 25 bp, Mus musculus
gtcagcatccttacagagtcactaa

SEQ ID NO: 682404 - DNA, 25 bp, Mus musculus
gtcagcatcctttcagagtcactaa

SEQ ID NO: 682405 - DNA, 25 bp, Mus musculus
gtcagcatcgccattgcgctcaagt

SEQ ID NO: 682406 - DNA, 25 bp, Mus musculus
gtcagcatcgcctttgcgctcaagt

SEQ ID NO: 682407 - DNA, 25 bp, Mus musculus
gtcagcatctcccaggtaaatcaca

SEQ ID NO: 682408 - DNA, 25 bp, Mus musculus
gtcagcatctccgaggtaaatcaca

SEQ ID NO: 682409 - DNA, 25 bp, Mus musculus
gtcagcatgcacagcacttggatga

SEQ ID NO: 682410 - DNA, 25 bp, Mus musculus
gtcagcatgcactgcacttggatga

SEQ ID NO: 682411 - DNA, 25 bp, Mus musculus
gtcagcatggaacagcgtcctcaca

SEQ ID NO: 682412 - DNA, 25 bp, Mus musculus
gtcagcatggaagagcgtcctcaca

SEQ ID NO: 682413 - DNA, 25 bp, Mus musculus
gtcagcatgggcactagcgttcttg

SEQ ID NO: 682414 - DNA, 25 bp, Mus musculus
gtcagcatgggctctagcgttcttg

SEQ ID NO: 682415 - DNA, 25 bp, Mus musculus
gtcagcatgtgtacagacataccgc

SEQ ID NO: 682416 - DNA, 25 bp, Mus musculus
gtcagcatgtgttcagacataccgc

SEQ ID NO: 682417 - DNA, 25 bp, Mus musculus
gtcagcattagtccatcattactac

SEQ ID NO: 682418 - DNA, 25 bp, Mus musculus
gtcagcattagtgcatcattactac

SEQ ID NO: 682419 - DNA, 25 bp, Mus musculus
gtcagcattccaattccaacatggt

SEQ ID NO: 682420 - DNA, 25 bp, Mus musculus
gtcagcattccatttccaacatggt

SEQ ID NO: 682421 - DNA, 25 bp, Mus musculus
gtcagcattgaaatctacttactaa

SEQ ID NO: 682422 - DNA, 25 bp, Mus musculus
gtcagcattgaattctacttactaa

SEQ ID NO: 682423 - DNA, 25 bp, Mus musculus
gtcagcatttcacagtccacacaag

SEQ ID NO: 682424 - DNA, 25 bp, Mus musculus
gtcagcatttcagagtccacacaag

SEQ ID NO: 682425 - DNA, 25 bp, Mus musculus
gtcagcatttcgcaagggtcatgta

SEQ ID NO: 682426 - DNA, 25 bp, Mus musculus
gtcagcatttcggaagggtcatgta

SEQ ID NO: 682427 - DNA, 25 bp, Mus musculus
gtcagcatttgcaatgaatcattaa

SEQ ID NO: 682428 - DNA, 25 bp, Mus musculus
gtcagcatttgctatgaatcattaa

SEQ ID NO: 682429 - DNA, 25 bp, Mus musculus
gtcagcattttccaactttttataa

SEQ ID NO: 682430 - DNA, 25 bp, Mus musculus
gtcagcattttcgaactttttataa

SEQ ID NO: 682431 - DNA, 25 bp, Mus musculus
gtcagcatttttaactactgaaaat

SEQ ID NO: 682432 - DNA, 25 bp, Mus musculus
gtcagcatttttcgccacctattat

SEQ ID NO: 682433 - DNA, 25 bp, Mus musculus
gtcagcatttttggccacctattat

SEQ ID NO: 682434 - DNA, 25 bp, Mus musculus
gtcagcattttttactactgaaaat

SEQ ID NO: 682435 - DNA, 25 bp, Mus musculus
gtcagccaacctcctgaaatgggca

SEQ ID NO: 682436 - DNA, 25 bp, Mus musculus
gtcagccaacctgctgaaatgggca

SEQ ID NO: 682437 - DNA, 25 bp, Mus musculus
gtcagccaacttaaagtgttctaat

SEQ ID NO: 682438 - DNA, 25 bp, Mus musculus
gtcagccaactttaagtgttctaat

SEQ ID NO: 682439 - DNA, 25 bp, Mus musculus
gtcagccaagagacacattcagata

SEQ ID NO: 682440 - DNA, 25 bp, Mus musculus
gtcagccaagagtcacattcagata

SEQ ID NO: 682441 - DNA, 25 bp, Mus musculus
gtcagccaaggcagtggccactcca

SEQ ID NO: 682442 - DNA, 25 bp, Mus musculus
gtcagccaaggctgtggccactcca

SEQ ID NO: 682443 - DNA, 25 bp, Mus musculus
gtcagccacgtgaggctattaaaat

SEQ ID NO: 682444 - DNA, 25 bp, Mus musculus
gtcagccacgtgtggctattaaaat

SEQ ID NO: 682445 - DNA, 25 bp, Mus musculus
gtcagccagcaaatgtcatatgtca

SEQ ID NO: 682446 - DNA, 25 bp, Mus musculus
gtcagccagcaattgtcatatgtca

SEQ ID NO: 682447 - DNA, 25 bp, Mus musculus
gtcagccagccactagagccttggg

SEQ ID NO: 682448 - DNA, 25 bp, Mus musculus
gtcagccagccagtagagccttggg

SEQ ID NO: 682449 - DNA, 25 bp, Mus musculus
gtcagccagcgccacgaaggagatc

SEQ ID NO: 682450 - DNA, 25 bp, Mus musculus
gtcagccagcgcgacgaaggagatc

SEQ ID NO: 682451 - DNA, 25 bp, Mus musculus
gtcagccatacgcacacatgtgctg

SEQ ID NO: 682452 - DNA, 25 bp, Mus musculus
gtcagccatacgcagtgagcctgtg

SEQ ID NO: 682453 - DNA, 25 bp, Mus musculus
gtcagccatacggacacatgtgctg

SEQ ID NO: 682454 - DNA, 25 bp, Mus musculus
gtcagccatacggagtgagcctgtg

SEQ ID NO: 682455 - DNA, 25 bp, Mus musculus
gtcagccatgcactctggttttgaa

SEQ ID NO: 682456 - DNA, 25 bp, Mus musculus
gtcagccatgcagtctggttttgaa

SEQ ID NO: 682457 - DNA, 25 bp, Mus musculus
gtcagccatgctaggatacaatctt

SEQ ID NO: 682458 - DNA, 25 bp, Mus musculus
gtcagccatgcttggatacaatctt

SEQ ID NO: 682459 - DNA, 25 bp, Mus musculus
gtcagccatggccatgtttcttttc

SEQ ID NO: 682460 - DNA, 25 bp, Mus musculus
gtcagccatggcgatgtttcttttc

SEQ ID NO: 682461 - DNA, 25 bp, Mus musculus
gtcagccatgttcctcttaagtagt

SEQ ID NO: 682462 - DNA, 25 bp, Mus musculus
gtcagccatgttgctcttaagtagt

SEQ ID NO: 682463 - DNA, 25 bp, Mus musculus
gtcagccattgcagatttgccatct

SEQ ID NO: 682464 - DNA, 25 bp, Mus musculus
gtcagccattgctgatttgccatct

SEQ ID NO: 682465 - DNA, 25 bp, Mus musculus
gtcagcccaatgctaatatcagcta

SEQ ID NO: 682466 - DNA, 25 bp, Mus musculus
gtcagcccaatggtaatatcagcta

SEQ ID NO: 682467 - DNA, 25 bp, Mus musculus
gtcagcccacgcaacggccatgtaa

SEQ ID NO: 682468 - DNA, 25 bp, Mus musculus
gtcagcccacgctacggccatgtaa

SEQ ID NO: 682469 - DNA, 25 bp, Mus musculus
gtcagcccagatccttagctgagag

SEQ ID NO: 682470 - DNA, 25 bp, Mus musculus
gtcagcccagatgcttagctgagag

SEQ ID NO: 682471 - DNA, 25 bp, Mus musculus
gtcagcccaggcaacacagcaggac

SEQ ID NO: 682472 - DNA, 25 bp, Mus musculus
gtcagcccaggctacacagcaggac

SEQ ID NO: 682473 - DNA, 25 bp, Mus musculus
gtcagccccaggctcagtacttcag

SEQ ID NO: 682474 - DNA, 25 bp, Mus musculus
gtcagccccagggtcagtacttcag

SEQ ID NO: 682475 - DNA, 25 bp, Mus musculus
gtcagcccgagtacggactggcaag

SEQ ID NO: 682476 - DNA, 25 bp, Mus musculus
gtcagcccgagttcggactggcaag

SEQ ID NO: 682477 - DNA, 25 bp, Mus musculus
gtcagccctagcacagcatcagaga

SEQ ID NO: 682478 - DNA, 25 bp, Mus musculus
gtcagccctagctcagcatcagaga

SEQ ID NO: 682479 - DNA, 25 bp, Mus musculus
gtcagccctcagaagtcttcactat

SEQ ID NO: 682480 - DNA, 25 bp, Mus musculus
gtcagccctcagtagtcttcactat

SEQ ID NO: 682481 - DNA, 25 bp, Mus musculus
gtcagccctcgacctttgtgctcag

SEQ ID NO: 682482 - DNA, 25 bp, Mus musculus
gtcagccctcgagctttgtgctcag

SEQ ID NO: 682483 - DNA, 25 bp, Mus musculus
gtcagccctgctcagacagtgattg

SEQ ID NO: 682484 - DNA, 25 bp, Mus musculus
gtcagccctgctgagacagtgattg

SEQ ID NO: 682485 - DNA, 25 bp, Mus musculus
gtcagccgccatataacatttcaga

SEQ ID NO: 682486 - DNA, 25 bp, Mus musculus
gtcagccgccatttaacatttcaga

SEQ ID NO: 682487 - DNA, 25 bp, Mus musculus
gtcagccgggtccttagatctggaa

SEQ ID NO: 682488 - DNA, 25 bp, Mus musculus
gtcagccgggtcgttagatctggaa

SEQ ID NO: 682489 - DNA, 25 bp, Mus musculus
gtcagccggtgtaggatgtaaatgt

SEQ ID NO: 682490 - DNA, 25 bp, Mus musculus
gtcagccggtgttggatgtaaatgt

SEQ ID NO: 682491 - DNA, 25 bp, Mus musculus
gtcagccgtgagaccatatacacac

SEQ ID NO: 682492 - DNA, 25 bp, Mus musculus
gtcagccgtgagtccatatacacac

SEQ ID NO: 682493 - DNA, 25 bp, Mus musculus
gtcagccgtgtgatagtgcaccgat

SEQ ID NO: 682494 - DNA, 25 bp, Mus musculus
gtcagccgtgtgttagtgcaccgat

SEQ ID NO: 682495 - DNA, 25 bp, Mus musculus
gtcagcctaagacttttatatcaag

SEQ ID NO: 682496 - DNA, 25 bp, Mus musculus
gtcagcctaagagttttatatcaag

SEQ ID NO: 682497 - DNA, 25 bp, Mus musculus
gtcagcctagctacaggctcattga

SEQ ID NO: 682498 - DNA, 25 bp, Mus musculus
gtcagcctagcttcaggctcattga

SEQ ID NO: 682499 - DNA, 25 bp, Mus musculus
gtcagcctaggaagcatagtgaatc

SEQ ID NO: 682500 - DNA, 25 bp, Mus musculus
gtcagcctaggaagctattaagatc

SEQ ID NO: 682501 - DNA, 25 bp, Mus musculus
gtcagcctaggatgcatagtgaatc

SEQ ID NO: 682502 - DNA, 25 bp, Mus musculus
gtcagcctaggatgctattaagatc

SEQ ID NO: 682503 - DNA, 25 bp, Mus musculus
gtcagcctcacaatttcacagactg

SEQ ID NO: 682504 - DNA, 25 bp, Mus musculus
gtcagcctcacattttcacagactg

SEQ ID NO: 682505 - DNA, 25 bp, Mus musculus
gtcagcctcagcaactgaaaccgat

SEQ ID NO: 682506 - DNA, 25 bp, Mus musculus
gtcagcctcagctactgaaaccgat

SEQ ID NO: 682507 - DNA, 25 bp, Mus musculus
gtcagcctcattatctcagtgatta

SEQ ID NO: 682508 - DNA, 25 bp, Mus musculus
gtcagcctcattttctcagtgatta

SEQ ID NO: 682509 - DNA, 25 bp, Mus musculus
gtcagcctccagctctgattaaagg

SEQ ID NO: 682510 - DNA, 25 bp, Mus musculus
gtcagcctccaggtctgattaaagg

SEQ ID NO: 682511 - DNA, 25 bp, Mus musculus
gtcagcctccatatctatagtttct

SEQ ID NO: 682512 - DNA, 25 bp, Mus musculus
gtcagcctccatttctatagtttct

SEQ ID NO: 682513 - DNA, 25 bp, Mus musculus
gtcagcctccctcgatttaaaatag

SEQ ID NO: 682514 - DNA, 25 bp, Mus musculus
gtcagcctccctggatttaaaatag

SEQ ID NO: 682515 - DNA, 25 bp, Mus musculus
gtcagcctctcaaatcgtggttagg

SEQ ID NO: 682516 - DNA, 25 bp, Mus musculus
gtcagcctctcatatcgtggttagg

SEQ ID NO: 682517 - DNA, 25 bp, Mus musculus
gtcagcctctgaatctttgagcttt

SEQ ID NO: 682518 - DNA, 25 bp, Mus musculus
gtcagcctctgattctttgagcttt

SEQ ID NO: 682519 - DNA, 25 bp, Mus musculus
gtcagcctgcatctgcgcctttggt

SEQ ID NO: 682520 - DNA, 25 bp, Mus musculus
gtcagcctgcatgtgcgcctttggt

SEQ ID NO: 682521 - DNA, 25 bp, Mus musculus
gtcagcctgctcacagttagcattt

SEQ ID NO: 682522 - DNA, 25 bp, Mus musculus
gtcagcctgctctcagttagcattt

SEQ ID NO: 682523 - DNA, 25 bp, Mus musculus
gtcagcctgctgcttatatcacaag

SEQ ID NO: 682524 - DNA, 25 bp, Mus musculus
gtcagcctgctggttatatcacaag

SEQ ID NO: 682525 - DNA, 25 bp, Mus musculus
gtcagcctggaaattcattgccaca

SEQ ID NO: 682526 - DNA, 25 bp, Mus musculus
gtcagcctggaatttcattgccaca

SEQ ID NO: 682527 - DNA, 25 bp, Mus musculus
gtcagcctggccacgtctgggaagc

SEQ ID NO: 682528 - DNA, 25 bp, Mus musculus
gtcagcctggcctcgtctgggaagc

SEQ ID NO: 682529 - DNA, 25 bp, Mus musculus
gtcagcctggctaagtggccacggt

SEQ ID NO: 682530 - DNA, 25 bp, Mus musculus
gtcagcctggcttagtggccacggt

SEQ ID NO: 682531 - DNA, 25 bp, Mus musculus
gtcagcctgggaattttcggttcca

SEQ ID NO: 682532 - DNA, 25 bp, Mus musculus
gtcagcctgggatttttcggttcca

SEQ ID NO: 682533 - DNA, 25 bp, Mus musculus
gtcagcctgggtaacctatcacaac

SEQ ID NO: 682534 - DNA, 25 bp, Mus musculus
gtcagcctgggttacctatcacaac

SEQ ID NO: 682535 - DNA, 25 bp, Mus musculus
gtcagcctggtgcaacggagaacaa

SEQ ID NO: 682536 - DNA, 25 bp, Mus musculus
gtcagcctggtggaacggagaacaa

SEQ ID NO: 682537 - DNA, 25 bp, Mus musculus
gtcagcctgtacatcttaacttatt

SEQ ID NO: 682538 - DNA, 25 bp, Mus musculus
gtcagcctgtacttcttaacttatt

SEQ ID NO: 682539 - DNA, 25 bp, Mus musculus
gtcagcctgtttcttggcgtggcca

SEQ ID NO: 682540 - DNA, 25 bp, Mus musculus
gtcagcctgtttgttggcgtggcca

SEQ ID NO: 682541 - DNA, 25 bp, Mus musculus
gtcagccttctgaaaagtcggatag

SEQ ID NO: 682542 - DNA, 25 bp, Mus musculus
gtcagccttctgtaaagtcggatag

SEQ ID NO: 682543 - DNA, 25 bp, Mus musculus
gtcagccttgctcaactatgaacac

SEQ ID NO: 682544 - DNA, 25 bp, Mus musculus
gtcagccttgctgaactatgaacac

SEQ ID NO: 682545 - DNA, 25 bp, Mus musculus
gtcagccttggacattagcagagcc

SEQ ID NO: 682546 - DNA, 25 bp, Mus musculus
gtcagccttggagattagcagagcc

SEQ ID NO: 682547 - DNA, 25 bp, Mus musculus
gtcagccttggcaatagtaagccca

SEQ ID NO: 682548 - DNA, 25 bp, Mus musculus
gtcagccttggctatagtaagccca

SEQ ID NO: 682549 - DNA, 25 bp, Mus musculus
gtcagcctttataaggcttcaccgt

SEQ ID NO: 682550 - DNA, 25 bp, Mus musculus
gtcagcctttattaggcttcaccgt

SEQ ID NO: 682551 - DNA, 25 bp, Mus musculus
gtcagcctttggcaggaaccagtat

SEQ ID NO: 682552 - DNA, 25 bp, Mus musculus
gtcagcctttgggaggaaccagtat

SEQ ID NO: 682553 - DNA, 25 bp, Mus musculus
gtcagccttttccatatcttcaaat

SEQ ID NO: 682554 - DNA, 25 bp, Mus musculus
gtcagccttttcgatatcttcaaat

SEQ ID NO: 682555 - DNA, 25 bp, Mus musculus
gtcagcgacaagcaagtgattccta

SEQ ID NO: 682556 - DNA, 25 bp, Mus musculus
gtcagcgacaaggaagtgattccta

SEQ ID NO: 682557 - DNA, 25 bp, Mus musculus
gtcagcgaggacatgcttgggcctt

SEQ ID NO: 682558 - DNA, 25 bp, Mus musculus
gtcagcgaggacttgcttgggcctt

SEQ ID NO: 682559 - DNA, 25 bp, Mus musculus
gtcagcgagttgaattaccaagcct

SEQ ID NO: 682560 - DNA, 25 bp, Mus musculus
gtcagcgagttgtattaccaagcct

SEQ ID NO: 682561 - DNA, 25 bp, Mus musculus
gtcagcgcaagtcgaatttcgactt

SEQ ID NO: 682562 - DNA, 25 bp, Mus musculus
gtcagcgcaagtggaatttcgactt

SEQ ID NO: 682563 - DNA, 25 bp, Mus musculus
gtcagcgcacacacatctgaacatc

SEQ ID NO: 682564 - DNA, 25 bp, Mus musculus
gtcagcgcacacaggacgtggtgaa

SEQ ID NO: 682565 - DNA, 25 bp, Mus musculus
gtcagcgcacactcatctgaacatc

SEQ ID NO: 682566 - DNA, 25 bp, Mus musculus
gtcagcgcacactggacgtggtgaa

SEQ ID NO: 682567 - DNA, 25 bp, Mus musculus
gtcagcgcatcacaagatccactaa

SEQ ID NO: 682568 - DNA, 25 bp, Mus musculus
gtcagcgcatcagaagatccactaa

SEQ ID NO: 682569 - DNA, 25 bp, Mus musculus
gtcagcgcctctacgtcgatgagct

SEQ ID NO: 682570 - DNA, 25 bp, Mus musculus
gtcagcgcctcttcgtcgatgagct

SEQ ID NO: 682571 - DNA, 25 bp, Mus musculus
gtcagcgcgtgaccttctgcacaga

SEQ ID NO: 682572 - DNA, 25 bp, Mus musculus
gtcagcgcgtgagcttctgcacaga

SEQ ID NO: 682573 - DNA, 25 bp, Mus musculus
gtcagcgctagaaacaaactttgtg

SEQ ID NO: 682574 - DNA, 25 bp, Mus musculus
gtcagcgctagatacaaactttgtg

SEQ ID NO: 682575 - DNA, 25 bp, Mus musculus
gtcagcgctgttctgtgatgcgtat

SEQ ID NO: 682576 - DNA, 25 bp, Mus musculus
gtcagcgctgttgtgtgatgcgtat

SEQ ID NO: 682577 - DNA, 25 bp, Mus musculus
gtcagcggagacatttactacctgg

SEQ ID NO: 682578 - DNA, 25 bp, Mus musculus
gtcagcggagacctcagagaaaacg

SEQ ID NO: 682579 - DNA, 25 bp, Mus musculus
gtcagcggagacgtcagagaaaacg

SEQ ID NO: 682580 - DNA, 25 bp, Mus musculus
gtcagcggagacttttactacctgg

SEQ ID NO: 682581 - DNA, 25 bp, Mus musculus
gtcagcggcgccatggcaaccagaa

SEQ ID NO: 682582 - DNA, 25 bp, Mus musculus
gtcagcggcgccttggcaaccagaa

SEQ ID NO: 682583 - DNA, 25 bp, Mus musculus
gtcagcgggagacgaacagattaaa

SEQ ID NO: 682584 - DNA, 25 bp, Mus musculus
gtcagcgggagaggaacagattaaa

SEQ ID NO: 682585 - DNA, 25 bp, Mus musculus
gtcagcgtcctcaaagtctttataa

SEQ ID NO: 682586 - DNA, 25 bp, Mus musculus
gtcagcgtcctctaagtctttataa

SEQ ID NO: 682587 - DNA, 25 bp, Mus musculus
gtcagcgtcctgcattgtgtcgtca

SEQ ID NO: 682588 - DNA, 25 bp, Mus musculus
gtcagcgtcctggattgtgtcgtca

SEQ ID NO: 682589 - DNA, 25 bp, Mus musculus
gtcagcgtctgtctacttgtgggaa

SEQ ID NO: 682590 - DNA, 25 bp, Mus musculus
gtcagcgtctgtgtacttgtgggaa

SEQ ID NO: 682591 - DNA, 25 bp, Mus musculus
gtcagcgtgacaagtaccgaatttt

SEQ ID NO: 682592 - DNA, 25 bp, Mus musculus
gtcagcgtgacatgtaccgaatttt

SEQ ID NO: 682593 - DNA, 25 bp, Mus musculus
gtcagcgtggacaaaagtctcccgg

SEQ ID NO: 682594 - DNA, 25 bp, Mus musculus
gtcagcgtggactaaagtctcccgg

SEQ ID NO: 682595 - DNA, 25 bp, Mus musculus
gtcagcgttgccacaacttaaagtg

SEQ ID NO: 682596 - DNA, 25 bp, Mus musculus
gtcagcgttgcctcaacttaaagtg

SEQ ID NO: 682597 - DNA, 25 bp, Mus musculus
gtcagctaagctatggatgttttcg

SEQ ID NO: 682598 - DNA, 25 bp, Mus musculus
gtcagctaagctttggatgttttcg

SEQ ID NO: 682599 - DNA, 25 bp, Mus musculus
gtcagctaattgctcagatgcctct

SEQ ID NO: 682600 - DNA, 25 bp, Mus musculus
gtcagctaattggtcagatgcctct

SEQ ID NO: 682601 - DNA, 25 bp, Mus musculus
gtcagctacatcctacttatgaata

SEQ ID NO: 682602 - DNA, 25 bp, Mus musculus
gtcagctacatcgtacttatgaata

SEQ ID NO: 682603 - DNA, 25 bp, Mus musculus
gtcagctactatctggagtcgtatg

SEQ ID NO: 682604 - DNA, 25 bp, Mus musculus
gtcagctactatgtggagtcgtatg

SEQ ID NO: 682605 - DNA, 25 bp, Mus musculus
gtcagctactgccacaactaggtgg

SEQ ID NO: 682606 - DNA, 25 bp, Mus musculus
gtcagctactgcgacaactaggtgg

SEQ ID NO: 682607 - DNA, 25 bp, Mus musculus
gtcagctagtcaactttccttgaat

SEQ ID NO: 682608 - DNA, 25 bp, Mus musculus
gtcagctagtcatctttccttgaat

SEQ ID NO: 682609 - DNA, 25 bp, Mus musculus
gtcagctatcgcaggatctgcgaaa

SEQ ID NO: 682610 - DNA, 25 bp, Mus musculus
gtcagctatcgctggatctgcgaaa

SEQ ID NO: 682611 - DNA, 25 bp, Mus musculus
gtcagctatgtgagtaaagttgcca

SEQ ID NO: 682612 - DNA, 25 bp, Mus musculus
gtcagctatgtgtgtaaagttgcca

SEQ ID NO: 682613 - DNA, 25 bp, Mus musculus
gtcagctcaggacctcacagattat

SEQ ID NO: 682614 - DNA, 25 bp, Mus musculus
gtcagctcaggagctcacagattat

SEQ ID NO: 682615 - DNA, 25 bp, Mus musculus
gtcagctcatccaaagcacgtttta

SEQ ID NO: 682616 - DNA, 25 bp, Mus musculus
gtcagctcatcctaagcacgtttta

SEQ ID NO: 682617 - DNA, 25 bp, Mus musculus
gtcagctccaacacatactgggcag

SEQ ID NO: 682618 - DNA, 25 bp, Mus musculus
gtcagctccaactcatactgggcag

SEQ ID NO: 682619 - DNA, 25 bp, Mus musculus
gtcagctccagccaagaagcacttg

SEQ ID NO: 682620 - DNA, 25 bp, Mus musculus
gtcagctccagcgaagaagcacttg

SEQ ID NO: 682621 - DNA, 25 bp, Mus musculus
gtcagctccagtcacgttcacagaa

SEQ ID NO: 682622 - DNA, 25 bp, Mus musculus
gtcagctccagtgacgttcacagaa

SEQ ID NO: 682623 - DNA, 25 bp, Mus musculus
gtcagctcctgcatatgtgtataaa

SEQ ID NO: 682624 - DNA, 25 bp, Mus musculus
gtcagctcctgcttatgtgtataaa

SEQ ID NO: 682625 - DNA, 25 bp, Mus musculus
gtcagctcgacaatgttggcttgaa

SEQ ID NO: 682626 - DNA, 25 bp, Mus musculus
gtcagctcgacattgttggcttgaa

SEQ ID NO: 682627 - DNA, 25 bp, Mus musculus
gtcagctcggcacgacagaatccat

SEQ ID NO: 682628 - DNA, 25 bp, Mus musculus
gtcagctcggcaggacagaatccat

SEQ ID NO: 682629 - DNA, 25 bp, Mus musculus
gtcagctctatgatccaggatactc

SEQ ID NO: 682630 - DNA, 25 bp, Mus musculus
gtcagctctatgttccaggatactc

SEQ ID NO: 682631 - DNA, 25 bp, Mus musculus
gtcagctctctcaactatgagggtc

SEQ ID NO: 682632 - DNA, 25 bp, Mus musculus
gtcagctctctccttgagaaacgat

SEQ ID NO: 682633 - DNA, 25 bp, Mus musculus
gtcagctctctcgttgagaaacgat

SEQ ID NO: 682634 - DNA, 25 bp, Mus musculus
gtcagctctctctactatgagggtc

SEQ ID NO: 682635 - DNA, 25 bp, Mus musculus
gtcagctctgccctgtgcacatggt

SEQ ID NO: 682636 - DNA, 25 bp, Mus musculus
gtcagctctgccgtgtgcacatggt

SEQ ID NO: 682637 - DNA, 25 bp, Mus musculus
gtcagctctgctctgctcggtggat

SEQ ID NO: 682638 - DNA, 25 bp, Mus musculus
gtcagctctgctgtgctcggtggat

SEQ ID NO: 682639 - DNA, 25 bp, Mus musculus
gtcagctctgttcttatagatacca

SEQ ID NO: 682640 - DNA, 25 bp, Mus musculus
gtcagctctgttgttatagatacca

SEQ ID NO: 682641 - DNA, 25 bp, Mus musculus
gtcagctgaagaaattgggccaaca

SEQ ID NO: 682642 - DNA, 25 bp, Mus musculus
gtcagctgaagatattgggccaaca

SEQ ID NO: 682643 - DNA, 25 bp, Mus musculus
gtcagctgacagagactggcgtcgt

SEQ ID NO: 682644 - DNA, 25 bp, Mus musculus
gtcagctgacagtgactggcgtcgt

SEQ ID NO: 682645 - DNA, 25 bp, Mus musculus
gtcagctgacttatcaactaacagt

SEQ ID NO: 682646 - DNA, 25 bp, Mus musculus
gtcagctgacttttcaactaacagt

SEQ ID NO: 682647 - DNA, 25 bp, Mus musculus
gtcagctgagcaaaaaccaccacac

SEQ ID NO: 682648 - DNA, 25 bp, Mus musculus
gtcagctgagcataaaccaccacac

SEQ ID NO: 682649 - DNA, 25 bp, Mus musculus
gtcagctgatgcaaattcacgtggt

SEQ ID NO: 682650 - DNA, 25 bp, Mus musculus
gtcagctgatgctaattcacgtggt

SEQ ID NO: 682651 - DNA, 25 bp, Mus musculus
gtcagctgcagaccaacagagttcg

SEQ ID NO: 682652 - DNA, 25 bp, Mus musculus
gtcagctgcagacctgggcttagaa

SEQ ID NO: 682653 - DNA, 25 bp, Mus musculus
gtcagctgcagagcaacagagttcg

SEQ ID NO: 682654 - DNA, 25 bp, Mus musculus
gtcagctgcagagctgggcttagaa

SEQ ID NO: 682655 - DNA, 25 bp, Mus musculus
gtcagctgcaggatctgtactccag

SEQ ID NO: 682656 - DNA, 25 bp, Mus musculus
gtcagctgcaggttctgtactccag

SEQ ID NO: 682657 - DNA, 25 bp, Mus musculus
gtcagctgcagtccaaaagtaagta

SEQ ID NO: 682658 - DNA, 25 bp, Mus musculus
gtcagctgcagtgcaaaagtaagta

SEQ ID NO: 682659 - DNA, 25 bp, Mus musculus
gtcagctgcatactttatacttgga

SEQ ID NO: 682660 - DNA, 25 bp, Mus musculus
gtcagctgcatagtttatacttgga

SEQ ID NO: 682661 - DNA, 25 bp, Mus musculus
gtcagctgcctgctttccagtataa

SEQ ID NO: 682662 - DNA, 25 bp, Mus musculus
gtcagctgcctggtttccagtataa

SEQ ID NO: 682663 - DNA, 25 bp, Mus musculus
gtcagctgcggtacaaatgtgcaag

SEQ ID NO: 682664 - DNA, 25 bp, Mus musculus
gtcagctgcggttcaaatgtgcaag

SEQ ID NO: 682665 - DNA, 25 bp, Mus musculus
gtcagctggaccaagatgcagacga

SEQ ID NO: 682666 - DNA, 25 bp, Mus musculus
gtcagctggacctagatgcagacga

SEQ ID NO: 682667 - DNA, 25 bp, Mus musculus
gtcagctgggtcctaaactccaaag

SEQ ID NO: 682668 - DNA, 25 bp, Mus musculus
gtcagctgggtcgtaaactccaaag

SEQ ID NO: 682669 - DNA, 25 bp, Mus musculus
gtcagctgtcccactaagtatttca

SEQ ID NO: 682670 - DNA, 25 bp, Mus musculus
gtcagctgtccctctaagtatttca

SEQ ID NO: 682671 - DNA, 25 bp, Mus musculus
gtcagctgtgccctactttcaggct

SEQ ID NO: 682672 - DNA, 25 bp, Mus musculus
gtcagctgtgccgtactttcaggct

SEQ ID NO: 682673 - DNA, 25 bp, Mus musculus
gtcagctgttatattgcatatccca

SEQ ID NO: 682674 - DNA, 25 bp, Mus musculus
gtcagctgttattttgcatatccca

SEQ ID NO: 682675 - DNA, 25 bp, Mus musculus
gtcagctgtttgacacgccaataaa

SEQ ID NO: 682676 - DNA, 25 bp, Mus musculus
gtcagctgtttgtcacgccaataaa

SEQ ID NO: 682677 - DNA, 25 bp, Mus musculus
gtcagcttacaactcacagaacaga

SEQ ID NO: 682678 - DNA, 25 bp, Mus musculus
gtcagcttacaagtcacagaacaga

SEQ ID NO: 682679 - DNA, 25 bp, Mus musculus
gtcagcttataacgtgcatcattat

SEQ ID NO: 682680 - DNA, 25 bp, Mus musculus
gtcagcttataaggtgcatcattat

SEQ ID NO: 682681 - DNA, 25 bp, Mus musculus
gtcagcttcactaccggattgagaa

SEQ ID NO: 682682 - DNA, 25 bp, Mus musculus
gtcagcttcacttccggattgagaa

SEQ ID NO: 682683 - DNA, 25 bp, Mus musculus
gtcagcttcaggctctggatcatca

SEQ ID NO: 682684 - DNA, 25 bp, Mus musculus
gtcagcttcagggtctggatcatca

SEQ ID NO: 682685 - DNA, 25 bp, Mus musculus
gtcagcttcccaaggcacatgtgat

SEQ ID NO: 682686 - DNA, 25 bp, Mus musculus
gtcagcttcccatggcacatgtgat

SEQ ID NO: 682687 - DNA, 25 bp, Mus musculus
gtcagcttcctgacattctcggatg

SEQ ID NO: 682688 - DNA, 25 bp, Mus musculus
gtcagcttcctgtcattctcggatg

SEQ ID NO: 682689 - DNA, 25 bp, Mus musculus
gtcagcttgaccagtcagcatgtct

SEQ ID NO: 682690 - DNA, 25 bp, Mus musculus
gtcagcttgacctgtcagcatgtct

SEQ ID NO: 682691 - DNA, 25 bp, Mus musculus
gtcagcttgcacacacgtcttcttt

SEQ ID NO: 682692 - DNA, 25 bp, Mus musculus
gtcagcttgcactcacgtcttcttt

SEQ ID NO: 682693 - DNA, 25 bp, Mus musculus
gtcagcttgcctacaaaacatttgt

SEQ ID NO: 682694 - DNA, 25 bp, Mus musculus
gtcagcttgccttcaaaacatttgt

SEQ ID NO: 682695 - DNA, 25 bp, Mus musculus
gtcagcttggacaaagcgagctcag

SEQ ID NO: 682696 - DNA, 25 bp, Mus musculus
gtcagcttggactaagcgagctcag

SEQ ID NO: 682697 - DNA, 25 bp, Mus musculus
gtcagcttggcccaggatcatcaag

SEQ ID NO: 682698 - DNA, 25 bp, Mus musculus
gtcagcttggccgaggatcatcaag

SEQ ID NO: 682699 - DNA, 25 bp, Mus musculus
gtcagcttgggcaacctatcaatac

SEQ ID NO: 682700 - DNA, 25 bp, Mus musculus
gtcagcttgggctacctatcaatac

SEQ ID NO: 682701 - DNA, 25 bp, Mus musculus
gtcagcttgtgacgatgaactccaa

SEQ ID NO: 682702 - DNA, 25 bp, Mus musculus
gtcagcttgtgaggatgaactccaa

SEQ ID NO: 682703 - DNA, 25 bp, Mus musculus
gtcagctttaagctatagtttattt

SEQ ID NO: 682704 - DNA, 25 bp, Mus musculus
gtcagctttaaggtatagtttattt

SEQ ID NO: 682705 - DNA, 25 bp, Mus musculus
gtcagctttagactccttttttgtt

SEQ ID NO: 682706 - DNA, 25 bp, Mus musculus
gtcagctttagagtccttttttgtt

SEQ ID NO: 682707 - DNA, 25 bp, Mus musculus
gtcagctttcacagctattcagaag

SEQ ID NO: 682708 - DNA, 25 bp, Mus musculus
gtcagctttcactgctattcagaag

SEQ ID NO: 682709 - DNA, 25 bp, Mus musculus
gtcagcttttacctcttgcgtataa

SEQ ID NO: 682710 - DNA, 25 bp, Mus musculus
gtcagcttttacgtcttgcgtataa

SEQ ID NO: 682711 - DNA, 25 bp, Mus musculus
gtcagcttttgacattaccagaaag

SEQ ID NO: 682712 - DNA, 25 bp, Mus musculus
gtcagcttttgagattaccagaaag

SEQ ID NO: 682713 - DNA, 25 bp, Mus musculus
gtcaggaaacttagccctacgcagt

SEQ ID NO: 682714 - DNA, 25 bp, Mus musculus
gtcaggaaactttgccctacgcagt

SEQ ID NO: 682715 - DNA, 25 bp, Mus musculus
gtcaggaaagtcagtgcccgtggct

SEQ ID NO: 682716 - DNA, 25 bp, Mus musculus
gtcaggaaagtctgtgcccgtggct

SEQ ID NO: 682717 - DNA, 25 bp, Mus musculus
gtcaggaaggcacatcatattcttg

SEQ ID NO: 682718 - DNA, 25 bp, Mus musculus
gtcaggaaggcagatcatattcttg

SEQ ID NO: 682719 - DNA, 25 bp, Mus musculus
gtcaggaaggtgcagtttccctcct

SEQ ID NO: 682720 - DNA, 25 bp, Mus musculus
gtcaggaaggtggagtttccctcct

SEQ ID NO: 682721 - DNA, 25 bp, Mus musculus
gtcaggaaggttacggtggccctct

SEQ ID NO: 682722 - DNA, 25 bp, Mus musculus
gtcaggaaggtttcggtggccctct

SEQ ID NO: 682723 - DNA, 25 bp, Mus musculus
gtcaggaagtacactcagttcatca

SEQ ID NO: 682724 - DNA, 25 bp, Mus musculus
gtcaggaagtactctcagttcatca

SEQ ID NO: 682725 - DNA, 25 bp, Mus musculus
gtcaggaatggtaccttctcatcca

SEQ ID NO: 682726 - DNA, 25 bp, Mus musculus
gtcaggaatggttccttctcatcca

SEQ ID NO: 682727 - DNA, 25 bp, Mus musculus
gtcaggaattgtccctggagccaat

SEQ ID NO: 682728 - DNA, 25 bp, Mus musculus
gtcaggaattgtgcctggagccaat

SEQ ID NO: 682729 - DNA, 25 bp, Mus musculus
gtcaggacaagaagcccagctgggc

SEQ ID NO: 682730 - DNA, 25 bp, Mus musculus
gtcaggacaagatgcccagctgggc

SEQ ID NO: 682731 - DNA, 25 bp, Mus musculus
gtcaggacagaacgccggtacccca

SEQ ID NO: 682732 - DNA, 25 bp, Mus musculus
gtcaggacagaaggccggtacccca

SEQ ID NO: 682733 - DNA, 25 bp, Mus musculus
gtcaggacagcaaacacttttcagt

SEQ ID NO: 682734 - DNA, 25 bp, Mus musculus
gtcaggacagcatacacttttcagt

SEQ ID NO: 682735 - DNA, 25 bp, Mus musculus
gtcaggacaggaacactcagcagat

SEQ ID NO: 682736 - DNA, 25 bp, Mus musculus
gtcaggacaggatcactcagcagat

SEQ ID NO: 682737 - DNA, 25 bp, Mus musculus
gtcaggacatatcaaccacctctgt

SEQ ID NO: 682738 - DNA, 25 bp, Mus musculus
gtcaggacatatgaaccacctctgt

SEQ ID NO: 682739 - DNA, 25 bp, Mus musculus
gtcaggaccacgatgagaacaccca

SEQ ID NO: 682740 - DNA, 25 bp, Mus musculus
gtcaggaccacgttgagaacaccca

SEQ ID NO: 682741 - DNA, 25 bp, Mus musculus
gtcaggacccggagatgtaatcatt

SEQ ID NO: 682742 - DNA, 25 bp, Mus musculus
gtcaggacccggtgatgtaatcatt

SEQ ID NO: 682743 - DNA, 25 bp, Mus musculus
gtcaggacctccagttgagcaggac

SEQ ID NO: 682744 - DNA, 25 bp, Mus musculus
gtcaggacctcctgttgagcaggac

SEQ ID NO: 682745 - DNA, 25 bp, Mus musculus
gtcaggacggatctcagttgtccag

SEQ ID NO: 682746 - DNA, 25 bp, Mus musculus
gtcaggacggatgtcagttgtccag

SEQ ID NO: 682747 - DNA, 25 bp, Mus musculus
gtcaggacggggaactccacctcca

SEQ ID NO: 682748 - DNA, 25 bp, Mus musculus
gtcaggacggggtactccacctcca

SEQ ID NO: 682749 - DNA, 25 bp, Mus musculus
gtcaggactgtcagccaaagctgga

SEQ ID NO: 682750 - DNA, 25 bp, Mus musculus
gtcaggactgtctgccaaagctgga

SEQ ID NO: 682751 - DNA, 25 bp, Mus musculus
gtcaggacttagctgctttagcgga

SEQ ID NO: 682752 - DNA, 25 bp, Mus musculus
gtcaggacttaggtgctttagcgga

SEQ ID NO: 682753 - DNA, 25 bp, Mus musculus
gtcaggacttgaccctgaggactat

SEQ ID NO: 682754 - DNA, 25 bp, Mus musculus
gtcaggacttgagcctgaggactat

SEQ ID NO: 682755 - DNA, 25 bp, Mus musculus
gtcaggactttgcttgtattcgaga

SEQ ID NO: 682756 - DNA, 25 bp, Mus musculus
gtcaggactttggttgtattcgaga

SEQ ID NO: 682757 - DNA, 25 bp, Mus musculus
gtcaggagaatgatctatctgcttt

SEQ ID NO: 682758 - DNA, 25 bp, Mus musculus
gtcaggagaatgttctatctgcttt

SEQ ID NO: 682759 - DNA, 25 bp, Mus musculus
gtcaggagaccacaaggcagaagca

SEQ ID NO: 682760 - DNA, 25 bp, Mus musculus
gtcaggagaccagaaggcagaagca

SEQ ID NO: 682761 - DNA, 25 bp, Mus musculus
gtcaggagacctcataccttcttct

SEQ ID NO: 682762 - DNA, 25 bp, Mus musculus
gtcaggagacctgataccttcttct

SEQ ID NO: 682763 - DNA, 25 bp, Mus musculus
gtcaggagatccacacctcgctgga

SEQ ID NO: 682764 - DNA, 25 bp, Mus musculus
gtcaggagatcctcacctcgctgga

SEQ ID NO: 682765 - DNA, 25 bp, Mus musculus
gtcaggagatgacccacatggtgaa

SEQ ID NO: 682766 - DNA, 25 bp, Mus musculus
gtcaggagatgagccacatggtgaa

SEQ ID NO: 682767 - DNA, 25 bp, Mus musculus
gtcaggagcagtcagtcacttcttg

SEQ ID NO: 682768 - DNA, 25 bp, Mus musculus
gtcaggagcagtgagtcacttcttg

SEQ ID NO: 682769 - DNA, 25 bp, Mus musculus
gtcaggagctctcgactcgagaacg

SEQ ID NO: 682770 - DNA, 25 bp, Mus musculus
gtcaggagctctggactcgagaacg

SEQ ID NO: 682771 - DNA, 25 bp, Mus musculus
gtcaggaggcctcggatactattcc

SEQ ID NO: 682772 - DNA, 25 bp, Mus musculus
gtcaggaggcctgggatactattcc

SEQ ID NO: 682773 - DNA, 25 bp, Mus musculus
gtcaggagtctccaactacttcaaa

SEQ ID NO: 682774 - DNA, 25 bp, Mus musculus
gtcaggagtctcgaactacttcaaa

SEQ ID NO: 682775 - DNA, 25 bp, Mus musculus
gtcaggagtggcaaaaaatagtctt

SEQ ID NO: 682776 - DNA, 25 bp, Mus musculus
gtcaggagtggctaaaaatagtctt

SEQ ID NO: 682777 - DNA, 25 bp, Mus musculus
gtcaggatacccaatgccaaataaa

SEQ ID NO: 682778 - DNA, 25 bp, Mus musculus
gtcaggataccctatgccaaataaa

SEQ ID NO: 682779 - DNA, 25 bp, Mus musculus
gtcaggatagagacccgcccttcgc

SEQ ID NO: 682780 - DNA, 25 bp, Mus musculus
gtcaggatagagtcccgcccttcgc

SEQ ID NO: 682781 - DNA, 25 bp, Mus musculus
gtcaggatagttacctgagcttggg

SEQ ID NO: 682782 - DNA, 25 bp, Mus musculus
gtcaggatagtttcctgagcttggg

SEQ ID NO: 682783 - DNA, 25 bp, Mus musculus
gtcaggatatatctccagccagcag

SEQ ID NO: 682784 - DNA, 25 bp, Mus musculus
gtcaggatatatgtccagccagcag

SEQ ID NO: 682785 - DNA, 25 bp, Mus musculus
gtcaggatcatcacagttttaaccg

SEQ ID NO: 682786 - DNA, 25 bp, Mus musculus
gtcaggatcatctcagttttaaccg

SEQ ID NO: 682787 - DNA, 25 bp, Mus musculus
gtcaggatcctcattctggatgaca

SEQ ID NO: 682788 - DNA, 25 bp, Mus musculus
gtcaggatcctctttctggatgaca

SEQ ID NO: 682789 - DNA, 25 bp, Mus musculus
gtcaggatctgtcattatatttgtg

SEQ ID NO: 682790 - DNA, 25 bp, Mus musculus
gtcaggatctgtgattatatttgtg

SEQ ID NO: 682791 - DNA, 25 bp, Mus musculus
gtcaggatggaaattccctctgctc

SEQ ID NO: 682792 - DNA, 25 bp, Mus musculus
gtcaggatggaatttccctctgctc

SEQ ID NO: 682793 - DNA, 25 bp, Mus musculus
gtcaggatgtttactctcgtgttca

SEQ ID NO: 682794 - DNA, 25 bp, Mus musculus
gtcaggatgttttctctcgtgttca

SEQ ID NO: 682795 - DNA, 25 bp, Mus musculus
gtcaggattagaagatgcatgccgt

SEQ ID NO: 682796 - DNA, 25 bp, Mus musculus
gtcaggattagatgatgcatgccgt

SEQ ID NO: 682797 - DNA, 25 bp, Mus musculus
gtcaggattcacattaatcagtcca

SEQ ID NO: 682798 - DNA, 25 bp, Mus musculus
gtcaggattcactttaatcagtcca

SEQ ID NO: 682799 - DNA, 25 bp, Mus musculus
gtcaggattctgatcatactaagct

SEQ ID NO: 682800 - DNA, 25 bp, Mus musculus
gtcaggattctgttcatactaagct

SEQ ID NO: 682801 - DNA, 25 bp, Mus musculus
gtcaggattgctcgaatcgctctca

SEQ ID NO: 682802 - DNA, 25 bp, Mus musculus
gtcaggattgctggaatcgctctca

SEQ ID NO: 682803 - DNA, 25 bp, Mus musculus
gtcaggatttagaccgcgtcggtac

SEQ ID NO: 682804 - DNA, 25 bp, Mus musculus
gtcaggatttagtccgcgtcggtac

SEQ ID NO: 682805 - DNA, 25 bp, Mus musculus
gtcaggatttctacgagttccaggc

SEQ ID NO: 682806 - DNA, 25 bp, Mus musculus
gtcaggatttctattcctttacaaa

SEQ ID NO: 682807 - DNA, 25 bp, Mus musculus
gtcaggatttcttcgagttccaggc

SEQ ID NO: 682808 - DNA, 25 bp, Mus musculus
gtcaggatttcttttcctttacaaa

SEQ ID NO: 682809 - DNA, 25 bp, Mus musculus
gtcaggcaacatcagatttgaatgg

SEQ ID NO: 682810 - DNA, 25 bp, Mus musculus
gtcaggcaacatgagatttgaatgg

SEQ ID NO: 682811 - DNA, 25 bp, Mus musculus
gtcaggcacaggctccagcaatggt

SEQ ID NO: 682812 - DNA, 25 bp, Mus musculus
gtcaggcacagggtccagcaatggt

SEQ ID NO: 682813 - DNA, 25 bp, Mus musculus
gtcaggcacgtgctagggcaactat

SEQ ID NO: 682814 - DNA, 25 bp, Mus musculus
gtcaggcacgtggtagggcaactat

SEQ ID NO: 682815 - DNA, 25 bp, Mus musculus
gtcaggcactccatgggtttacgtg

SEQ ID NO: 682816 - DNA, 25 bp, Mus musculus
gtcaggcactccttgggtttacgtg

SEQ ID NO: 682817 - DNA, 25 bp, Mus musculus
gtcaggcactttcaatttgatccct

SEQ ID NO: 682818 - DNA, 25 bp, Mus musculus
gtcaggcactttgaatttgatccct

SEQ ID NO: 682819 - DNA, 25 bp, Mus musculus
gtcaggcagaagataccatgtccaa

SEQ ID NO: 682820 - DNA, 25 bp, Mus musculus
gtcaggcagaagttaccatgtccaa

SEQ ID NO: 682821 - DNA, 25 bp, Mus musculus
gtcaggcagagcaataagcttccat

SEQ ID NO: 682822 - DNA, 25 bp, Mus musculus
gtcaggcagagctataagcttccat

SEQ ID NO: 682823 - DNA, 25 bp, Mus musculus
gtcaggcagaggaagggtttggctt

SEQ ID NO: 682824 - DNA, 25 bp, Mus musculus
gtcaggcagaggtagggtttggctt

SEQ ID NO: 682825 - DNA, 25 bp, Mus musculus
gtcaggcagcacaaccaaggagagg

SEQ ID NO: 682826 - DNA, 25 bp, Mus musculus
gtcaggcagcactaccaaggagagg

SEQ ID NO: 682827 - DNA, 25 bp, Mus musculus
gtcaggcagctaacagcccatctgt

SEQ ID NO: 682828 - DNA, 25 bp, Mus musculus
gtcaggcagctatcagcccatctgt

SEQ ID NO: 682829 - DNA, 25 bp, Mus musculus
gtcaggcagctcaggaacacctcat

SEQ ID NO: 682830 - DNA, 25 bp, Mus musculus
gtcaggcagctctggaacacctcat

SEQ ID NO: 682831 - DNA, 25 bp, Mus musculus
gtcaggcaggcactaaaccagatgt

SEQ ID NO: 682832 - DNA, 25 bp, Mus musculus
gtcaggcaggcagtaaaccagatgt

SEQ ID NO: 682833 - DNA, 25 bp, Mus musculus
gtcaggcagggaaccagagcccaat

SEQ ID NO: 682834 - DNA, 25 bp, Mus musculus
gtcaggcagggatccagagcccaat

SEQ ID NO: 682835 - DNA, 25 bp, Mus musculus
gtcaggcatagtcgcgtatgcattt

SEQ ID NO: 682836 - DNA, 25 bp, Mus musculus
gtcaggcatagtggcgtatgcattt

SEQ ID NO: 682837 - DNA, 25 bp, Mus musculus
gtcaggcatattcttgcagtttcat

SEQ ID NO: 682838 - DNA, 25 bp, Mus musculus
gtcaggcatattgttgcagtttcat

SEQ ID NO: 682839 - DNA, 25 bp, Mus musculus
gtcaggcatctgaggtgtacacaga

SEQ ID NO: 682840 - DNA, 25 bp, Mus musculus
gtcaggcatctgtggtgtacacaga

SEQ ID NO: 682841 - DNA, 25 bp, Mus musculus
gtcaggcattcaatgctggttgtct

SEQ ID NO: 682842 - DNA, 25 bp, Mus musculus
gtcaggcattcattgctggttgtct

SEQ ID NO: 682843 - DNA, 25 bp, Mus musculus
gtcaggccaaagatgctccttcaag

SEQ ID NO: 682844 - DNA, 25 bp, Mus musculus
gtcaggccaaagttgctccttcaag

SEQ ID NO: 682845 - DNA, 25 bp, Mus musculus
gtcaggccccaaactgtgtttgtgt

SEQ ID NO: 682846 - DNA, 25 bp, Mus musculus
gtcaggccccaatctgtgtttgtgt

SEQ ID NO: 682847 - DNA, 25 bp, Mus musculus
gtcaggcccggtactgaagagtttt

SEQ ID NO: 682848 - DNA, 25 bp, Mus musculus
gtcaggcccggttctgaagagtttt

SEQ ID NO: 682849 - DNA, 25 bp, Mus musculus
gtcaggccgtctactgtgtggagaa

SEQ ID NO: 682850 - DNA, 25 bp, Mus musculus
gtcaggccgtcttctgtgtggagaa

SEQ ID NO: 682851 - DNA, 25 bp, Mus musculus
gtcaggcctcaaataccataacaga

SEQ ID NO: 682852 - DNA, 25 bp, Mus musculus
gtcaggcctcaattaccataacaga

SEQ ID NO: 682853 - DNA, 25 bp, Mus musculus
gtcaggcctcatatttccatatgca

SEQ ID NO: 682854 - DNA, 25 bp, Mus musculus
gtcaggcctcatttttccatatgca

SEQ ID NO: 682855 - DNA, 25 bp, Mus musculus
gtcaggcctcgaagcagatcttgaa

SEQ ID NO: 682856 - DNA, 25 bp, Mus musculus
gtcaggcctcgatgcagatcttgaa

SEQ ID NO: 682857 - DNA, 25 bp, Mus musculus
gtcaggcctctcagaaggcaatagt

SEQ ID NO: 682858 - DNA, 25 bp, Mus musculus
gtcaggcctctctgaaggcaatagt

SEQ ID NO: 682859 - DNA, 25 bp, Mus musculus
gtcaggcctgatcctgctcagcttg

SEQ ID NO: 682860 - DNA, 25 bp, Mus musculus
gtcaggcctgatgctgctcagcttg

SEQ ID NO: 682861 - DNA, 25 bp, Mus musculus
gtcaggcctggcattgcaaggaagt

SEQ ID NO: 682862 - DNA, 25 bp, Mus musculus
gtcaggcctggctttgcaaggaagt

SEQ ID NO: 682863 - DNA, 25 bp, Mus musculus
gtcaggccttaactttagtctcaga

SEQ ID NO: 682864 - DNA, 25 bp, Mus musculus
gtcaggccttaagtttagtctcaga

SEQ ID NO: 682865 - DNA, 25 bp, Mus musculus
gtcaggcctttccatacccaggaag

SEQ ID NO: 682866 - DNA, 25 bp, Mus musculus
gtcaggcctttcgatacccaggaag

SEQ ID NO: 682867 - DNA, 25 bp, Mus musculus
gtcaggcgattaaactatacatttt

SEQ ID NO: 682868 - DNA, 25 bp, Mus musculus
gtcaggcgattatactatacatttt

SEQ ID NO: 682869 - DNA, 25 bp, Mus musculus
gtcaggctaattaacgtatcaataa

SEQ ID NO: 682870 - DNA, 25 bp, Mus musculus
gtcaggctaatttacgtatcaataa

SEQ ID NO: 682871 - DNA, 25 bp, Mus musculus
gtcaggctatttagattacctctag

SEQ ID NO: 682872 - DNA, 25 bp, Mus musculus
gtcaggctattttgattacctctag

SEQ ID NO: 682873 - DNA, 25 bp, Mus musculus
gtcaggctcagacgtcattctgcag

SEQ ID NO: 682874 - DNA, 25 bp, Mus musculus
gtcaggctcagaggtcattctgcag

SEQ ID NO: 682875 - DNA, 25 bp, Mus musculus
gtcaggctccagaaggtaggcacct

SEQ ID NO: 682876 - DNA, 25 bp, Mus musculus
gtcaggctccagtaggtaggcacct

SEQ ID NO: 682877 - DNA, 25 bp, Mus musculus
gtcaggctcggcaacagaaggaaca

SEQ ID NO: 682878 - DNA, 25 bp, Mus musculus
gtcaggctcggctacagaaggaaca

SEQ ID NO: 682879 - DNA, 25 bp, Mus musculus
gtcaggctcgggagtggctgaaact

SEQ ID NO: 682880 - DNA, 25 bp, Mus musculus
gtcaggctcgggtgtggctgaaact

SEQ ID NO: 682881 - DNA, 25 bp, Mus musculus
gtcaggctctccacagcagcaaagg

SEQ ID NO: 682882 - DNA, 25 bp, Mus musculus
gtcaggctctcctcagcagcaaagg

SEQ ID NO: 682883 - DNA, 25 bp, Mus musculus
gtcaggctctgcagtgcatggatga

SEQ ID NO: 682884 - DNA, 25 bp, Mus musculus
gtcaggctctgctgtgcatggatga

SEQ ID NO: 682885 - DNA, 25 bp, Mus musculus
gtcaggctgaggactggccattcag

SEQ ID NO: 682886 - DNA, 25 bp, Mus musculus
gtcaggctgaggtctggccattcag

SEQ ID NO: 682887 - DNA, 25 bp, Mus musculus
gtcaggctgcaccatggacatgctg

SEQ ID NO: 682888 - DNA, 25 bp, Mus musculus
gtcaggctgcacgatggacatgctg

SEQ ID NO: 682889 - DNA, 25 bp, Mus musculus
gtcaggctgcagatggatcccagaa

SEQ ID NO: 682890 - DNA, 25 bp, Mus musculus
gtcaggctgcagttggatcccagaa

SEQ ID NO: 682891 - DNA, 25 bp, Mus musculus
gtcaggctgctcctatcagtgagtg

SEQ ID NO: 682892 - DNA, 25 bp, Mus musculus
gtcaggctgctcgtatcagtgagtg

SEQ ID NO: 682893 - DNA, 25 bp, Mus musculus
gtcaggctgtcaaaacccagagtgc

SEQ ID NO: 682894 - DNA, 25 bp, Mus musculus
gtcaggctgtcataacccagagtgc

SEQ ID NO: 682895 - DNA, 25 bp, Mus musculus
gtcaggctgtgacagtaaaacttca

SEQ ID NO: 682896 - DNA, 25 bp, Mus musculus
gtcaggctgtgagagtaaaacttca

SEQ ID NO: 682897 - DNA, 25 bp, Mus musculus
gtcaggctgtttaacgtcagactgt

SEQ ID NO: 682898 - DNA, 25 bp, Mus musculus
gtcaggctgttttacgtcagactgt

SEQ ID NO: 682899 - DNA, 25 bp, Mus musculus
gtcaggcttagacaccagggcattt

SEQ ID NO: 682900 - DNA, 25 bp, Mus musculus
gtcaggcttagagaccagggcattt

SEQ ID NO: 682901 - DNA, 25 bp, Mus musculus
gtcaggcttaggctacttcgagaaa

SEQ ID NO: 682902 - DNA, 25 bp, Mus musculus
gtcaggcttagggtacttcgagaaa

SEQ ID NO: 682903 - DNA, 25 bp, Mus musculus
gtcaggcttcaacaaattttaatct

SEQ ID NO: 682904 - DNA, 25 bp, Mus musculus
gtcaggcttcaagaaattttaatct

SEQ ID NO: 682905 - DNA, 25 bp, Mus musculus
gtcaggcttcacatcctattcaata

SEQ ID NO: 682906 - DNA, 25 bp, Mus musculus
gtcaggcttcacttcctattcaata

SEQ ID NO: 682907 - DNA, 25 bp, Mus musculus
gtcaggcttcataaacgaggttgtt

SEQ ID NO: 682908 - DNA, 25 bp, Mus musculus
gtcaggcttcattaacgaggttgtt

SEQ ID NO: 682909 - DNA, 25 bp, Mus musculus
gtcaggcttggcattaagcaccctt

SEQ ID NO: 682910 - DNA, 25 bp, Mus musculus
gtcaggcttggctttaagcaccctt

SEQ ID NO: 682911 - DNA, 25 bp, Mus musculus
gtcaggcttttcctctaagtacaag

SEQ ID NO: 682912 - DNA, 25 bp, Mus musculus
gtcaggcttttcgtctaagtacaag

SEQ ID NO: 682913 - DNA, 25 bp, Mus musculus
gtcaggcttttgctgatccagtcac

SEQ ID NO: 682914 - DNA, 25 bp, Mus musculus
gtcaggcttttggtgatccagtcac

SEQ ID NO: 682915 - DNA, 25 bp, Mus musculus
gtcaggctttttaggcttgtcacaa

SEQ ID NO: 682916 - DNA, 25 bp, Mus musculus
gtcaggcttttttggcttgtcacaa

SEQ ID NO: 682917 - DNA, 25 bp, Mus musculus
gtcagggaaaacagaacactaaacg

SEQ ID NO: 682918 - DNA, 25 bp, Mus musculus
gtcagggaaaactgaacactaaacg

SEQ ID NO: 682919 - DNA, 25 bp, Mus musculus
gtcagggaacacatgcagtcaacat

SEQ ID NO: 682920 - DNA, 25 bp, Mus musculus
gtcagggaacacttgcagtcaacat

SEQ ID NO: 682921 - DNA, 25 bp, Mus musculus
gtcagggaacgaccttgggaatatt

SEQ ID NO: 682922 - DNA, 25 bp, Mus musculus
gtcagggaacgagcttgggaatatt

SEQ ID NO: 682923 - DNA, 25 bp, Mus musculus
gtcagggaagccagcttctataatt

SEQ ID NO: 682924 - DNA, 25 bp, Mus musculus
gtcagggaagcctgcttctataatt

SEQ ID NO: 682925 - DNA, 25 bp, Mus musculus
gtcagggacaacagcacaaactctt

SEQ ID NO: 682926 - DNA, 25 bp, Mus musculus
gtcagggacaactgcacaaactctt

SEQ ID NO: 682927 - DNA, 25 bp, Mus musculus
gtcagggacgagatctctctgtcgg

SEQ ID NO: 682928 - DNA, 25 bp, Mus musculus
gtcagggacgagttctctctgtcgg

SEQ ID NO: 682929 - DNA, 25 bp, Mus musculus
gtcagggacttgcacataggacctt

SEQ ID NO: 682930 - DNA, 25 bp, Mus musculus
gtcagggacttggacataggacctt

SEQ ID NO: 682931 - DNA, 25 bp, Mus musculus
gtcagggagagtacccagggtcctc

SEQ ID NO: 682932 - DNA, 25 bp, Mus musculus
gtcagggagagttcccagggtcctc

SEQ ID NO: 682933 - DNA, 25 bp, Mus musculus
gtcagggagcacctttaactggccc

SEQ ID NO: 682934 - DNA, 25 bp, Mus musculus
gtcagggagcacgtttaactggccc

SEQ ID NO: 682935 - DNA, 25 bp, Mus musculus
gtcagggatatcacgcttctatagc

SEQ ID NO: 682936 - DNA, 25 bp, Mus musculus
gtcagggatatctcgcttctatagc

SEQ ID NO: 682937 - DNA, 25 bp, Mus musculus
gtcagggatcccataacagtgtctt

SEQ ID NO: 682938 - DNA, 25 bp, Mus musculus
gtcagggatcccttaacagtgtctt

SEQ ID NO: 682939 - DNA, 25 bp, Mus musculus
gtcagggatctcattgcacattttg

SEQ ID NO: 682940 - DNA, 25 bp, Mus musculus
gtcagggatctctttgcacattttg

SEQ ID NO: 682941 - DNA, 25 bp, Mus musculus
gtcagggattacaataactatctcc

SEQ ID NO: 682942 - DNA, 25 bp, Mus musculus
gtcagggattactataactatctcc

SEQ ID NO: 682943 - DNA, 25 bp, Mus musculus
gtcagggcagctagtggaaatcatt

SEQ ID NO: 682944 - DNA, 25 bp, Mus musculus
gtcagggcagcttgtggaaatcatt

SEQ ID NO: 682945 - DNA, 25 bp, Mus musculus
gtcagggcatccagccactgaggaa

SEQ ID NO: 682946 - DNA, 25 bp, Mus musculus
gtcagggcatcctgccactgaggaa

SEQ ID NO: 682947 - DNA, 25 bp, Mus musculus
gtcagggcattcagcttaaatggtt

SEQ ID NO: 682948 - DNA, 25 bp, Mus musculus
gtcagggcattctgcttaaatggtt

SEQ ID NO: 682949 - DNA, 25 bp, Mus musculus
gtcagggcattgattctgcgtatct

SEQ ID NO: 682950 - DNA, 25 bp, Mus musculus
gtcagggcattgtttctgcgtatct

SEQ ID NO: 682951 - DNA, 25 bp, Mus musculus
gtcagggccccaagggaacaagcat

SEQ ID NO: 682952 - DNA, 25 bp, Mus musculus
gtcagggccccatgggaacaagcat

SEQ ID NO: 682953 - DNA, 25 bp, Mus musculus
gtcagggcccctaatatactcaaga

SEQ ID NO: 682954 - DNA, 25 bp, Mus musculus
gtcagggccccttatatactcaaga

SEQ ID NO: 682955 - DNA, 25 bp, Mus musculus
gtcagggcgagcaggtaacatgcat

SEQ ID NO: 682956 - DNA, 25 bp, Mus musculus
gtcagggcgagctggtaacatgcat

SEQ ID NO: 682957 - DNA, 25 bp, Mus musculus
gtcagggctgacatagctagtccca

SEQ ID NO: 682958 - DNA, 25 bp, Mus musculus
gtcagggctgacttagctagtccca

SEQ ID NO: 682959 - DNA, 25 bp, Mus musculus
gtcaggggacgcatttagcagcctt

SEQ ID NO: 682960 - DNA, 25 bp, Mus musculus
gtcaggggacgcttttagcagcctt

SEQ ID NO: 682961 - DNA, 25 bp, Mus musculus
gtcaggggccagaaaaacgaactat

SEQ ID NO: 682962 - DNA, 25 bp, Mus musculus
gtcaggggccagtaaaacgaactat

SEQ ID NO: 682963 - DNA, 25 bp, Mus musculus
gtcagggtaaagattctccccatca

SEQ ID NO: 682964 - DNA, 25 bp, Mus musculus
gtcagggtaaagtttctccccatca

SEQ ID NO: 682965 - DNA, 25 bp, Mus musculus
gtcagggtaataaccatgccctctg

SEQ ID NO: 682966 - DNA, 25 bp, Mus musculus
gtcagggtaatatccatgccctctg

SEQ ID NO: 682967 - DNA, 25 bp, Mus musculus
gtcagggtaatgagcatggtccaaa

SEQ ID NO: 682968 - DNA, 25 bp, Mus musculus
gtcagggtaatgtgcatggtccaaa

SEQ ID NO: 682969 - DNA, 25 bp, Mus musculus
gtcagggtactacctcagtgctcaa

SEQ ID NO: 682970 - DNA, 25 bp, Mus musculus
gtcagggtactagctcagtgctcaa

SEQ ID NO: 682971 - DNA, 25 bp, Mus musculus
gtcagggtagcaagtataagcttct

SEQ ID NO: 682972 - DNA, 25 bp, Mus musculus
gtcagggtagcatgtataagcttct

SEQ ID NO: 682973 - DNA, 25 bp, Mus musculus
gtcagggtatttacagacctccctc

SEQ ID NO: 682974 - DNA, 25 bp, Mus musculus
gtcagggtattttcagacctccctc

SEQ ID NO: 682975 - DNA, 25 bp, Mus musculus
gtcagggtcaatctaacttcaagat

SEQ ID NO: 682976 - DNA, 25 bp, Mus musculus
gtcagggtcaatgtaacttcaagat

SEQ ID NO: 682977 - DNA, 25 bp, Mus musculus
gtcagggtcctgagggaacctagtc

SEQ ID NO: 682978 - DNA, 25 bp, Mus musculus
gtcagggtcctgtgggaacctagtc

SEQ ID NO: 682979 - DNA, 25 bp, Mus musculus
gtcagggtcttgcagcaccatccca

SEQ ID NO: 682980 - DNA, 25 bp, Mus musculus
gtcagggtcttggagcaccatccca

SEQ ID NO: 682981 - DNA, 25 bp, Mus musculus
gtcagggttcacaggaggtcttgaa

SEQ ID NO: 682982 - DNA, 25 bp, Mus musculus
gtcagggttcactggaggtcttgaa

SEQ ID NO: 682983 - DNA, 25 bp, Mus musculus
gtcagggttcagcactcttctggga

SEQ ID NO: 682984 - DNA, 25 bp, Mus musculus
gtcagggttcaggactcttctggga

SEQ ID NO: 682985 - DNA, 25 bp, Mus musculus
gtcagggttcccaagaggatttctt

SEQ ID NO: 682986 - DNA, 25 bp, Mus musculus
gtcagggttccctagaggatttctt

SEQ ID NO: 682987 - DNA, 25 bp, Mus musculus
gtcaggtaatcccagcagctcttag

SEQ ID NO: 682988 - DNA, 25 bp, Mus musculus
gtcaggtaatccgagcagctcttag

SEQ ID NO: 682989 - DNA, 25 bp, Mus musculus
gtcaggtacagtcgatatgaggctc

SEQ ID NO: 682990 - DNA, 25 bp, Mus musculus
gtcaggtacagtggatatgaggctc

SEQ ID NO: 682991 - DNA, 25 bp, Mus musculus
gtcaggtaccgtctgcaaaggctac

SEQ ID NO: 682992 - DNA, 25 bp, Mus musculus
gtcaggtaccgtgtgcaaaggctac

SEQ ID NO: 682993 - DNA, 25 bp, Mus musculus
gtcaggtagtttctccattttgcaa

SEQ ID NO: 682994 - DNA, 25 bp, Mus musculus
gtcaggtagtttgtccattttgcaa

SEQ ID NO: 682995 - DNA, 25 bp, Mus musculus
gtcaggtatagaatttgccaggttt

SEQ ID NO: 682996 - DNA, 25 bp, Mus musculus
gtcaggtatagattttgccaggttt

SEQ ID NO: 682997 - DNA, 25 bp, Mus musculus
gtcaggtatatcagtttccaaacac

SEQ ID NO: 682998 - DNA, 25 bp, Mus musculus
gtcaggtatatctgtttccaaacac

SEQ ID NO: 682999 - DNA, 25 bp, Mus musculus
gtcaggtattgaacgtggcacacca

SEQ ID NO: 683000 - DNA, 25 bp, Mus musculus
gtcaggtattgatcgtggcacacca

SEQ ID NO: 683001 - DNA, 25 bp, Mus musculus
gtcaggtcaactatctagatcccaa

SEQ ID NO: 683002 - DNA, 25 bp, Mus musculus
gtcaggtcaactttctagatcccaa

SEQ ID NO: 683003 - DNA, 25 bp, Mus musculus
gtcaggtcaattacctaaataagct

SEQ ID NO: 683004 - DNA, 25 bp, Mus musculus
gtcaggtcaatttcctaaataagct

SEQ ID NO: 683005 - DNA, 25 bp, Mus musculus
gtcaggtcagttcttagttcagtac

SEQ ID NO: 683006 - DNA, 25 bp, Mus musculus
gtcaggtcagttgttagttcagtac

SEQ ID NO: 683007 - DNA, 25 bp, Mus musculus
gtcaggtcctggcaatattcaattc

SEQ ID NO: 683008 - DNA, 25 bp, Mus musculus
gtcaggtcctgggaatattcaattc

SEQ ID NO: 683009 - DNA, 25 bp, Mus musculus
gtcaggtcgcaactcttttaatctt

SEQ ID NO: 683010 - DNA, 25 bp, Mus musculus
gtcaggtcgcaagtcttttaatctt

SEQ ID NO: 683011 - DNA, 25 bp, Mus musculus
gtcaggtcttgcaggccaaagccaa

SEQ ID NO: 683012 - DNA, 25 bp, Mus musculus
gtcaggtcttgctggccaaagccaa

SEQ ID NO: 683013 - DNA, 25 bp, Mus musculus
gtcaggtgaaccatggtacccatgg

SEQ ID NO: 683014 - DNA, 25 bp, Mus musculus
gtcaggtgaaccttggtacccatgg

SEQ ID NO: 683015 - DNA, 25 bp, Mus musculus
gtcaggtgacacagagctggtgttt

SEQ ID NO: 683016 - DNA, 25 bp, Mus musculus
gtcaggtgacactgagctggtgttt

SEQ ID NO: 683017 - DNA, 25 bp, Mus musculus
gtcaggtgatacctattttttagct

SEQ ID NO: 683018 - DNA, 25 bp, Mus musculus
gtcaggtgatacgtattttttagct

SEQ ID NO: 683019 - DNA, 25 bp, Mus musculus
gtcaggtgcagcagcttatctcgct

SEQ ID NO: 683020 - DNA, 25 bp, Mus musculus
gtcaggtgcagctgcttatctcgct

SEQ ID NO: 683021 - DNA, 25 bp, Mus musculus
gtcaggtgccatcccggctaagaag

SEQ ID NO: 683022 - DNA, 25 bp, Mus musculus
gtcaggtgccatgccggctaagaag

SEQ ID NO: 683023 - DNA, 25 bp, Mus musculus
gtcaggtgcccactagtggacttgt

SEQ ID NO: 683024 - DNA, 25 bp, Mus musculus
gtcaggtgcccagtagtggacttgt

SEQ ID NO: 683025 - DNA, 25 bp, Mus musculus
gtcaggtgctatcagctgctcacgc

SEQ ID NO: 683026 - DNA, 25 bp, Mus musculus
gtcaggtgctatgagctgctcacgc

SEQ ID NO: 683027 - DNA, 25 bp, Mus musculus
gtcaggtggcctataccttcaagga

SEQ ID NO: 683028 - DNA, 25 bp, Mus musculus
gtcaggtggcctttaccttcaagga

SEQ ID NO: 683029 - DNA, 25 bp, Mus musculus
gtcaggtgttggacagcaggaatca

SEQ ID NO: 683030 - DNA, 25 bp, Mus musculus
gtcaggtgttggtcagcaggaatca

SEQ ID NO: 683031 - DNA, 25 bp, Mus musculus
gtcaggtgttttccaagtccagttc

SEQ ID NO: 683032 - DNA, 25 bp, Mus musculus
gtcaggtgttttgcaagtccagttc

SEQ ID NO: 683033 - DNA, 25 bp, Mus musculus
gtcaggttaccacagacctgtttgt

SEQ ID NO: 683034 - DNA, 25 bp, Mus musculus
gtcaggttaccagagacctgtttgt

SEQ ID NO: 683035 - DNA, 25 bp, Mus musculus
gtcaggttactgagctcaccttatg

SEQ ID NO: 683036 - DNA, 25 bp, Mus musculus
gtcaggttactgtgctcaccttatg

SEQ ID NO: 683037 - DNA, 25 bp, Mus musculus
gtcaggttagcaattcccattggaa

SEQ ID NO: 683038 - DNA, 25 bp, Mus musculus
gtcaggttagcatttcccattggaa

SEQ ID NO: 683039 - DNA, 25 bp, Mus musculus
gtcaggttatcaaagcggatcccca

SEQ ID NO: 683040 - DNA, 25 bp, Mus musculus
gtcaggttatcatagcggatcccca

SEQ ID NO: 683041 - DNA, 25 bp, Mus musculus
gtcaggttatctatgcacctatcaa

SEQ ID NO: 683042 - DNA, 25 bp, Mus musculus
gtcaggttatctttgcacctatcaa

SEQ ID NO: 683043 - DNA, 25 bp, Mus musculus
gtcaggttatgaatcttttcccatt

SEQ ID NO: 683044 - DNA, 25 bp, Mus musculus
gtcaggttatgattcttttcccatt

SEQ ID NO: 683045 - DNA, 25 bp, Mus musculus
gtcaggttcaagagctagtccaaaa

SEQ ID NO: 683046 - DNA, 25 bp, Mus musculus
gtcaggttcaagtgctagtccaaaa

SEQ ID NO: 683047 - DNA, 25 bp, Mus musculus
gtcaggttcactctttaactgcatc

SEQ ID NO: 683048 - DNA, 25 bp, Mus musculus
gtcaggttcactgtttaactgcatc

SEQ ID NO: 683049 - DNA, 25 bp, Mus musculus
gtcaggttcaggattctccctgtgc

SEQ ID NO: 683050 - DNA, 25 bp, Mus musculus
gtcaggttcaggtttctccctgtgc

SEQ ID NO: 683051 - DNA, 25 bp, Mus musculus
gtcaggttcatcagaacagccccaa

SEQ ID NO: 683052 - DNA, 25 bp, Mus musculus
gtcaggttcatctgaacagccccaa

SEQ ID NO: 683053 - DNA, 25 bp, Mus musculus
gtcaggttccaaaagtcttagttct

SEQ ID NO: 683054 - DNA, 25 bp, Mus musculus
gtcaggttccaatagtcttagttct

SEQ ID NO: 683055 - DNA, 25 bp, Mus musculus
gtcaggttgaacagttagtcagtaa

SEQ ID NO: 683056 - DNA, 25 bp, Mus musculus
gtcaggttgaactgttagtcagtaa

SEQ ID NO: 683057 - DNA, 25 bp, Mus musculus
gtcaggttgattatgagtttccttt

SEQ ID NO: 683058 - DNA, 25 bp, Mus musculus
gtcaggttgattttgagtttccttt

SEQ ID NO: 683059 - DNA, 25 bp, Mus musculus
gtcaggttgcggagacattctcaac

SEQ ID NO: 683060 - DNA, 25 bp, Mus musculus
gtcaggttgcggtgacattctcaac

SEQ ID NO: 683061 - DNA, 25 bp, Mus musculus
gtcaggttgctaactggccagtaca

SEQ ID NO: 683062 - DNA, 25 bp, Mus musculus
gtcaggttgctatctggccagtaca

SEQ ID NO: 683063 - DNA, 25 bp, Mus musculus
gtcaggtttcgtagcttatctttag

SEQ ID NO: 683064 - DNA, 25 bp, Mus musculus
gtcaggtttcgttgcttatctttag

SEQ ID NO: 683065 - DNA, 25 bp, Mus musculus
gtcaggtttggaaactttgcagctc

SEQ ID NO: 683066 - DNA, 25 bp, Mus musculus
gtcaggtttggacaccctaggtctt

SEQ ID NO: 683067 - DNA, 25 bp, Mus musculus
gtcaggtttggagaccctaggtctt

SEQ ID NO: 683068 - DNA, 25 bp, Mus musculus
gtcaggtttggatactttgcagctc

SEQ ID NO: 683069 - DNA, 25 bp, Mus musculus
gtcaggtttggtagcagtttgatgt

SEQ ID NO: 683070 - DNA, 25 bp, Mus musculus
gtcaggtttggttgcagtttgatgt

SEQ ID NO: 683071 - DNA, 25 bp, Mus musculus
gtcagtaaacatccacctgcctaat

SEQ ID NO: 683072 - DNA, 25 bp, Mus musculus
gtcagtaaacatgcacctgcctaat

SEQ ID NO: 683073 - DNA, 25 bp, Mus musculus
gtcagtaaacgacctcatctacaag

SEQ ID NO: 683074 - DNA, 25 bp, Mus musculus
gtcagtaaacgagctcatctacaag

SEQ ID NO: 683075 - DNA, 25 bp, Mus musculus
gtcagtaaacttcgctctcctaagg

SEQ ID NO: 683076 - DNA, 25 bp, Mus musculus
gtcagtaaacttggctctcctaagg

SEQ ID NO: 683077 - DNA, 25 bp, Mus musculus
gtcagtaaatctatggtttgcatac

SEQ ID NO: 683078 - DNA, 25 bp, Mus musculus
gtcagtaaatctttggtttgcatac

SEQ ID NO: 683079 - DNA, 25 bp, Mus musculus
gtcagtaacaatatgtatccctttc

SEQ ID NO: 683080 - DNA, 25 bp, Mus musculus
gtcagtaacaatttgtatccctttc

SEQ ID NO: 683081 - DNA, 25 bp, Mus musculus
gtcagtaagttcctctgtttaataa

SEQ ID NO: 683082 - DNA, 25 bp, Mus musculus
gtcagtaagttcgtctgtttaataa

SEQ ID NO: 683083 - DNA, 25 bp, Mus musculus
gtcagtaatcacatactgctctatg

SEQ ID NO: 683084 - DNA, 25 bp, Mus musculus
gtcagtaatcacttactgctctatg

SEQ ID NO: 683085 - DNA, 25 bp, Mus musculus
gtcagtaatcctaccagcaaatggt

SEQ ID NO: 683086 - DNA, 25 bp, Mus musculus
gtcagtaatccttccagcaaatggt

SEQ ID NO: 683087 - DNA, 25 bp, Mus musculus
gtcagtacacacacccaaacagtta

SEQ ID NO: 683088 - DNA, 25 bp, Mus musculus
gtcagtacacactcccaaacagtta

SEQ ID NO: 683089 - DNA, 25 bp, Mus musculus
gtcagtacaccaccatttaacctct

SEQ ID NO: 683090 - DNA, 25 bp, Mus musculus
gtcagtacaccagcatttaacctct

SEQ ID NO: 683091 - DNA, 25 bp, Mus musculus
gtcagtacagcaagactctcaggct

SEQ ID NO: 683092 - DNA, 25 bp, Mus musculus
gtcagtacagcatgactctcaggct

SEQ ID NO: 683093 - DNA, 25 bp, Mus musculus
gtcagtacatacatgtcagctgtga

SEQ ID NO: 683094 - DNA, 25 bp, Mus musculus
gtcagtacatacttgtcagctgtga

SEQ ID NO: 683095 - DNA, 25 bp, Mus musculus
gtcagtactagcagacttccttggg

SEQ ID NO: 683096 - DNA, 25 bp, Mus musculus
gtcagtactagctgacttccttggg

SEQ ID NO: 683097 - DNA, 25 bp, Mus musculus
gtcagtactattattctagcacagt

SEQ ID NO: 683098 - DNA, 25 bp, Mus musculus
gtcagtactatttttctagcacagt

SEQ ID NO: 683099 - DNA, 25 bp, Mus musculus
gtcagtactgacactaatgcaccat

SEQ ID NO: 683100 - DNA, 25 bp, Mus musculus
gtcagtactgactctaatgcaccat

SEQ ID NO: 683101 - DNA, 25 bp, Mus musculus
gtcagtactgcgagagctcaccaag

SEQ ID NO: 683102 - DNA, 25 bp, Mus musculus
gtcagtactgcgtgagctcaccaag

SEQ ID NO: 683103 - DNA, 25 bp, Mus musculus
gtcagtacttaacatagtcagttga

SEQ ID NO: 683104 - DNA, 25 bp, Mus musculus
gtcagtacttaagatagtcagttga

SEQ ID NO: 683105 - DNA, 25 bp, Mus musculus
gtcagtacttgtcacaacacagtca

SEQ ID NO: 683106 - DNA, 25 bp, Mus musculus
gtcagtacttgtgacaacacagtca

SEQ ID NO: 683107 - DNA, 25 bp, Mus musculus
gtcagtactttcaactgtcaggtac

SEQ ID NO: 683108 - DNA, 25 bp, Mus musculus
gtcagtactttctactgtcaggtac

SEQ ID NO: 683109 - DNA, 25 bp, Mus musculus
gtcagtagaccccaaaatgtagcga

SEQ ID NO: 683110 - DNA, 25 bp, Mus musculus
gtcagtagacccgaaaatgtagcga

SEQ ID NO: 683111 - DNA, 25 bp, Mus musculus
gtcagtagatctctgcccactcatt

SEQ ID NO: 683112 - DNA, 25 bp, Mus musculus
gtcagtagatctgtgcccactcatt

SEQ ID NO: 683113 - DNA, 25 bp, Mus musculus
gtcagtagcagtacgtttggatcaa

SEQ ID NO: 683114 - DNA, 25 bp, Mus musculus
gtcagtagcagtcttaaactcctca

SEQ ID NO: 683115 - DNA, 25 bp, Mus musculus
gtcagtagcagtgttaaactcctca

SEQ ID NO: 683116 - DNA, 25 bp, Mus musculus
gtcagtagcagttcgtttggatcaa

SEQ ID NO: 683117 - DNA, 25 bp, Mus musculus
gtcagtagccgactgtcaggagcat

SEQ ID NO: 683118 - DNA, 25 bp, Mus musculus
gtcagtagccgagtgtcaggagcat

SEQ ID NO: 683119 - DNA, 25 bp, Mus musculus
gtcagtaggcacctctgtggtttca

SEQ ID NO: 683120 - DNA, 25 bp, Mus musculus
gtcagtaggcacgtctgtggtttca

SEQ ID NO: 683121 - DNA, 25 bp, Mus musculus
gtcagtaggtcccagagcctccagg

SEQ ID NO: 683122 - DNA, 25 bp, Mus musculus
gtcagtaggtccgagagcctccagg

SEQ ID NO: 683123 - DNA, 25 bp, Mus musculus
gtcagtagtgagacagggatccctt

SEQ ID NO: 683124 - DNA, 25 bp, Mus musculus
gtcagtagtgagtcagggatccctt

SEQ ID NO: 683125 - DNA, 25 bp, Mus musculus
gtcagtagttaaagctgtattacat

SEQ ID NO: 683126 - DNA, 25 bp, Mus musculus
gtcagtagttaatgctgtattacat

SEQ ID NO: 683127 - DNA, 25 bp, Mus musculus
gtcagtatcaagatgaaccgttttt

SEQ ID NO: 683128 - DNA, 25 bp, Mus musculus
gtcagtatcaagttgaaccgttttt

SEQ ID NO: 683129 - DNA, 25 bp, Mus musculus
gtcagtatctcaagtctatccttta

SEQ ID NO: 683130 - DNA, 25 bp, Mus musculus
gtcagtatctcatgtctatccttta

SEQ ID NO: 683131 - DNA, 25 bp, Mus musculus
gtcagtatctggcttaagagcataa

SEQ ID NO: 683132 - DNA, 25 bp, Mus musculus
gtcagtatctgggttaagagcataa

SEQ ID NO: 683133 - DNA, 25 bp, Mus musculus
gtcagtatctttctaatggagtgtg

SEQ ID NO: 683134 - DNA, 25 bp, Mus musculus
gtcagtatctttgtaatggagtgtg

SEQ ID NO: 683135 - DNA, 25 bp, Mus musculus
gtcagtatgctactatacttcggtt

SEQ ID NO: 683136 - DNA, 25 bp, Mus musculus
gtcagtatgctagtatacttcggtt

SEQ ID NO: 683137 - DNA, 25 bp, Mus musculus
gtcagtatggaaatctatttgacag

SEQ ID NO: 683138 - DNA, 25 bp, Mus musculus
gtcagtatggaattctatttgacag

SEQ ID NO: 683139 - DNA, 25 bp, Mus musculus
gtcagtatggttcgtctcttgatat

SEQ ID NO: 683140 - DNA, 25 bp, Mus musculus
gtcagtatggttggtctcttgatat

SEQ ID NO: 683141 - DNA, 25 bp, Mus musculus
gtcagtatgtttacggagtcctgtt

SEQ ID NO: 683142 - DNA, 25 bp, Mus musculus
gtcagtatgtttacgttagcaggtt

SEQ ID NO: 683143 - DNA, 25 bp, Mus musculus
gtcagtatgttttcggagtcctgtt

SEQ ID NO: 683144 - DNA, 25 bp, Mus musculus
gtcagtatgttttcgttagcaggtt

SEQ ID NO: 683145 - DNA, 25 bp, Mus musculus
gtcagtattactcgtatttttcaat

SEQ ID NO: 683146 - DNA, 25 bp, Mus musculus
gtcagtattactggtatttttcaat

SEQ ID NO: 683147 - DNA, 25 bp, Mus musculus
gtcagtattctcaatagatacctac

SEQ ID NO: 683148 - DNA, 25 bp, Mus musculus
gtcagtattctctatagatacctac

SEQ ID NO: 683149 - DNA, 25 bp, Mus musculus
gtcagtattctgagggagcgaccca

SEQ ID NO: 683150 - DNA, 25 bp, Mus musculus
gtcagtattctgtgggagcgaccca

SEQ ID NO: 683151 - DNA, 25 bp, Mus musculus
gtcagtatttctacataagtctcag

SEQ ID NO: 683152 - DNA, 25 bp, Mus musculus
gtcagtatttcttcataagtctcag

SEQ ID NO: 683153 - DNA, 25 bp, Mus musculus
gtcagtatttgactctttacccatt

SEQ ID NO: 683154 - DNA, 25 bp, Mus musculus
gtcagtatttgagtctttacccatt

SEQ ID NO: 683155 - DNA, 25 bp, Mus musculus
gtcagtatttgcataccagccttga

SEQ ID NO: 683156 - DNA, 25 bp, Mus musculus
gtcagtatttgcttaccagccttga

SEQ ID NO: 683157 - DNA, 25 bp, Mus musculus
gtcagtattttcaacttgggctgaa

SEQ ID NO: 683158 - DNA, 25 bp, Mus musculus
gtcagtattttctacttgggctgaa

SEQ ID NO: 683159 - DNA, 25 bp, Mus musculus
gtcagtcaactaagtacacacaggt

SEQ ID NO: 683160 - DNA, 25 bp, Mus musculus
gtcagtcaactacaggtggcaatta

SEQ ID NO: 683161 - DNA, 25 bp, Mus musculus
gtcagtcaactagaggtggcaatta

SEQ ID NO: 683162 - DNA, 25 bp, Mus musculus
gtcagtcaactatgtacacacaggt

SEQ ID NO: 683163 - DNA, 25 bp, Mus musculus
gtcagtcacagaaggcaaaattaaa

SEQ ID NO: 683164 - DNA, 25 bp, Mus musculus
gtcagtcacagactcactagagttg

SEQ ID NO: 683165 - DNA, 25 bp, Mus musculus
gtcagtcacagagtcactagagttg

SEQ ID NO: 683166 - DNA, 25 bp, Mus musculus
gtcagtcacagatggcaaaattaaa

SEQ ID NO: 683167 - DNA, 25 bp, Mus musculus
gtcagtcaccagaagctgttgggat

SEQ ID NO: 683168 - DNA, 25 bp, Mus musculus
gtcagtcaccagtagctgttgggat

SEQ ID NO: 683169 - DNA, 25 bp, Mus musculus
gtcagtcaccgcctttgtgcaattc

SEQ ID NO: 683170 - DNA, 25 bp, Mus musculus
gtcagtcaccgcgtttgtgcaattc

SEQ ID NO: 683171 - DNA, 25 bp, Mus musculus
gtcagtcactgaatcacaacttaag

SEQ ID NO: 683172 - DNA, 25 bp, Mus musculus
gtcagtcactgattcacaacttaag

SEQ ID NO: 683173 - DNA, 25 bp, Mus musculus
gtcagtcactttattactctctcag

SEQ ID NO: 683174 - DNA, 25 bp, Mus musculus
gtcagtcacttttttactctctcag

SEQ ID NO: 683175 - DNA, 25 bp, Mus musculus
gtcagtcagattagtcagctcagat

SEQ ID NO: 683176 - DNA, 25 bp, Mus musculus
gtcagtcagatttgtcagctcagat

SEQ ID NO: 683177 - DNA, 25 bp, Mus musculus
gtcagtcagcaacagaccatgcata

SEQ ID NO: 683178 - DNA, 25 bp, Mus musculus
gtcagtcagcaagagaccatgcata

SEQ ID NO: 683179 - DNA, 25 bp, Mus musculus
gtcagtcagctccttatagcagtag

SEQ ID NO: 683180 - DNA, 25 bp, Mus musculus
gtcagtcagctcgttatagcagtag

SEQ ID NO: 683181 - DNA, 25 bp, Mus musculus
gtcagtcaggacatgctacaggtca

SEQ ID NO: 683182 - DNA, 25 bp, Mus musculus
gtcagtcaggacttgctacaggtca

SEQ ID NO: 683183 - DNA, 25 bp, Mus musculus
gtcagtcagtatcatcaagcagaac

SEQ ID NO: 683184 - DNA, 25 bp, Mus musculus
gtcagtcagtatgatcaagcagaac

SEQ ID NO: 683185 - DNA, 25 bp, Mus musculus
gtcagtcatctcattaatataccga

SEQ ID NO: 683186 - DNA, 25 bp, Mus musculus
gtcagtcatctctttaatataccga

SEQ ID NO: 683187 - DNA, 25 bp, Mus musculus
gtcagtcatgcccaagcacgagttc

SEQ ID NO: 683188 - DNA, 25 bp, Mus musculus
gtcagtcatgccgaagcacgagttc

SEQ ID NO: 683189 - DNA, 25 bp, Mus musculus
gtcagtcatgtgcaaagctccaggt

SEQ ID NO: 683190 - DNA, 25 bp, Mus musculus
gtcagtcatgtggaaagctccaggt

SEQ ID NO: 683191 - DNA, 25 bp, Mus musculus
gtcagtcattccctctatcaaattc

SEQ ID NO: 683192 - DNA, 25 bp, Mus musculus
gtcagtcattccgtctatcaaattc

SEQ ID NO: 683193 - DNA, 25 bp, Mus musculus
gtcagtcattgaccagcaagcaatt

SEQ ID NO: 683194 - DNA, 25 bp, Mus musculus
gtcagtcattgagcagcaagcaatt

SEQ ID NO: 683195 - DNA, 25 bp, Mus musculus
gtcagtcatttgagtgttccaggtg

SEQ ID NO: 683196 - DNA, 25 bp, Mus musculus
gtcagtcatttgtgtgttccaggtg

SEQ ID NO: 683197 - DNA, 25 bp, Mus musculus
gtcagtccactacgtttcatcttaa

SEQ ID NO: 683198 - DNA, 25 bp, Mus musculus
gtcagtccactaggtttcatcttaa

SEQ ID NO: 683199 - DNA, 25 bp, Mus musculus
gtcagtccagccacctatataaaca

SEQ ID NO: 683200 - DNA, 25 bp, Mus musculus
gtcagtccagcctcctatataaaca

SEQ ID NO: 683201 - DNA, 25 bp, Mus musculus
gtcagtccaggcattccggtaagga

SEQ ID NO: 683202 - DNA, 25 bp, Mus musculus
gtcagtccaggctttccggtaagga

SEQ ID NO: 683203 - DNA, 25 bp, Mus musculus
gtcagtccataaagattgcgctaat

SEQ ID NO: 683204 - DNA, 25 bp, Mus musculus
gtcagtccataatgattgcgctaat

SEQ ID NO: 683205 - DNA, 25 bp, Mus musculus
gtcagtccattactgtatctcgttt

SEQ ID NO: 683206 - DNA, 25 bp, Mus musculus
gtcagtccattagtgtatctcgttt

SEQ ID NO: 683207 - DNA, 25 bp, Mus musculus
gtcagtccctacagctaatatttat

SEQ ID NO: 683208 - DNA, 25 bp, Mus musculus
gtcagtccctactgctaatatttat

SEQ ID NO: 683209 - DNA, 25 bp, Mus musculus
gtcagtccctagcatttgtgttaaa

SEQ ID NO: 683210 - DNA, 25 bp, Mus musculus
gtcagtccctaggatttgtgttaaa

SEQ ID NO: 683211 - DNA, 25 bp, Mus musculus
gtcagtcccttccttgttcgatgat

SEQ ID NO: 683212 - DNA, 25 bp, Mus musculus
gtcagtcccttcgttgttcgatgat

SEQ ID NO: 683213 - DNA, 25 bp, Mus musculus
gtcagtccggacagtgtgagaccct

SEQ ID NO: 683214 - DNA, 25 bp, Mus musculus
gtcagtccggactgtgtgagaccct

SEQ ID NO: 683215 - DNA, 25 bp, Mus musculus
gtcagtcctggaaaacatgctcacg

SEQ ID NO: 683216 - DNA, 25 bp, Mus musculus
gtcagtcctggaagtctttctttta

SEQ ID NO: 683217 - DNA, 25 bp, Mus musculus
gtcagtcctggaatttcgagatcat

SEQ ID NO: 683218 - DNA, 25 bp, Mus musculus
gtcagtcctggataacatgctcacg

SEQ ID NO: 683219 - DNA, 25 bp, Mus musculus
gtcagtcctggatgtctttctttta

SEQ ID NO: 683220 - DNA, 25 bp, Mus musculus
gtcagtcctggattttcgagatcat

SEQ ID NO: 683221 - DNA, 25 bp, Mus musculus
gtcagtcctggtccacaacaattta

SEQ ID NO: 683222 - DNA, 25 bp, Mus musculus
gtcagtcctggtgcacaacaattta

SEQ ID NO: 683223 - DNA, 25 bp, Mus musculus
gtcagtcctttaaagcaatctcaca

SEQ ID NO: 683224 - DNA, 25 bp, Mus musculus
gtcagtcctttatagcaatctcaca

SEQ ID NO: 683225 - DNA, 25 bp, Mus musculus
gtcagtcctttgaatatttaggtcc

SEQ ID NO: 683226 - DNA, 25 bp, Mus musculus
gtcagtcctttgtatatttaggtcc

SEQ ID NO: 683227 - DNA, 25 bp, Mus musculus
gtcagtcgatggaagtacagcctat

SEQ ID NO: 683228 - DNA, 25 bp, Mus musculus
gtcagtcgatggtagtacagcctat

SEQ ID NO: 683229 - DNA, 25 bp, Mus musculus
gtcagtcgttgaagtctcctttaaa

SEQ ID NO: 683230 - DNA, 25 bp, Mus musculus
gtcagtcgttgatgtctcctttaaa

SEQ ID NO: 683231 - DNA, 25 bp, Mus musculus
gtcagtctaacgacaggtgcttcaa

SEQ ID NO: 683232 - DNA, 25 bp, Mus musculus
gtcagtctaacgtcaggtgcttcaa

SEQ ID NO: 683233 - DNA, 25 bp, Mus musculus
gtcagtctacctcacattttgttta

SEQ ID NO: 683234 - DNA, 25 bp, Mus musculus
gtcagtctacctgacattttgttta

SEQ ID NO: 683235 - DNA, 25 bp, Mus musculus
gtcagtctagctctaggctcaatga

SEQ ID NO: 683236 - DNA, 25 bp, Mus musculus
gtcagtctagctgtaggctcaatga

SEQ ID NO: 683237 - DNA, 25 bp, Mus musculus
gtcagtctatagcagttatggcaaa

SEQ ID NO: 683238 - DNA, 25 bp, Mus musculus
gtcagtctataggagttatggcaaa

SEQ ID NO: 683239 - DNA, 25 bp, Mus musculus
gtcagtctcaccaaatctgaatttg

SEQ ID NO: 683240 - DNA, 25 bp, Mus musculus
gtcagtctcacctaatctgaatttg

SEQ ID NO: 683241 - DNA, 25 bp, Mus musculus
gtcagtctcataagatggtgcggct

SEQ ID NO: 683242 - DNA, 25 bp, Mus musculus
gtcagtctcatatgatggtgcggct

SEQ ID NO: 683243 - DNA, 25 bp, Mus musculus
gtcagtctccctaaaatgcttggct

SEQ ID NO: 683244 - DNA, 25 bp, Mus musculus
gtcagtctcccttaaatgcttggct

SEQ ID NO: 683245 - DNA, 25 bp, Mus musculus
gtcagtctccttcctacagaccaag

SEQ ID NO: 683246 - DNA, 25 bp, Mus musculus
gtcagtctccttcgtgtctacaaaa

SEQ ID NO: 683247 - DNA, 25 bp, Mus musculus
gtcagtctccttgctacagaccaag

SEQ ID NO: 683248 - DNA, 25 bp, Mus musculus
gtcagtctccttggtgtctacaaaa

SEQ ID NO: 683249 - DNA, 25 bp, Mus musculus
gtcagtctctggcttccaaacaaaa

SEQ ID NO: 683250 - DNA, 25 bp, Mus musculus
gtcagtctctgggttccaaacaaaa

SEQ ID NO: 683251 - DNA, 25 bp, Mus musculus
gtcagtctctgtaaggaagtttttc

SEQ ID NO: 683252 - DNA, 25 bp, Mus musculus
gtcagtctctgttaggaagtttttc

SEQ ID NO: 683253 - DNA, 25 bp, Mus musculus
gtcagtctcttcattgagctttcta

SEQ ID NO: 683254 - DNA, 25 bp, Mus musculus
gtcagtctcttctttgagctttcta

SEQ ID NO: 683255 - DNA, 25 bp, Mus musculus
gtcagtctggcacgttttatcagtt

SEQ ID NO: 683256 - DNA, 25 bp, Mus musculus
gtcagtctggcaggttttatcagtt

SEQ ID NO: 683257 - DNA, 25 bp, Mus musculus
gtcagtctgggaatctgaccttggg

SEQ ID NO: 683258 - DNA, 25 bp, Mus musculus
gtcagtctgggattctgaccttggg

SEQ ID NO: 683259 - DNA, 25 bp, Mus musculus
gtcagtctggtacccttgaattaca

SEQ ID NO: 683260 - DNA, 25 bp, Mus musculus
gtcagtctggtagccttgaattaca

SEQ ID NO: 683261 - DNA, 25 bp, Mus musculus
gtcagtctggtgatagtgataacct

SEQ ID NO: 683262 - DNA, 25 bp, Mus musculus
gtcagtctggtgttagtgataacct

SEQ ID NO: 683263 - DNA, 25 bp, Mus musculus
gtcagtcttatcagcaagtgtcctg

SEQ ID NO: 683264 - DNA, 25 bp, Mus musculus
gtcagtcttatctgcaagtgtcctg

SEQ ID NO: 683265 - DNA, 25 bp, Mus musculus
gtcagtcttggcagctgtacctttt

SEQ ID NO: 683266 - DNA, 25 bp, Mus musculus
gtcagtcttggctgctgtacctttt

SEQ ID NO: 683267 - DNA, 25 bp, Mus musculus
gtcagtctttccaagctggagtttt

SEQ ID NO: 683268 - DNA, 25 bp, Mus musculus
gtcagtctttcctagctggagtttt

SEQ ID NO: 683269 - DNA, 25 bp, Mus musculus
gtcagtgaaaccaggcaatactctt

SEQ ID NO: 683270 - DNA, 25 bp, Mus musculus
gtcagtgaaacctggcaatactctt

SEQ ID NO: 683271 - DNA, 25 bp, Mus musculus
gtcagtgaacaccttcaaggcctgc

SEQ ID NO: 683272 - DNA, 25 bp, Mus musculus
gtcagtgaacacgttcaaggcctgc

SEQ ID NO: 683273 - DNA, 25 bp, Mus musculus
gtcagtgaaggcagagcccagctct

SEQ ID NO: 683274 - DNA, 25 bp, Mus musculus
gtcagtgaaggcctcttgcttgtca

SEQ ID NO: 683275 - DNA, 25 bp, Mus musculus
gtcagtgaaggcgtcttgcttgtca

SEQ ID NO: 683276 - DNA, 25 bp, Mus musculus
gtcagtgaaggctgagcccagctct

SEQ ID NO: 683277 - DNA, 25 bp, Mus musculus
gtcagtgaagtgcttgccacataag

SEQ ID NO: 683278 - DNA, 25 bp, Mus musculus
gtcagtgaagtggttgccacataag

SEQ ID NO: 683279 - DNA, 25 bp, Mus musculus
gtcagtgacagcaagacatctgcct

SEQ ID NO: 683280 - DNA, 25 bp, Mus musculus
gtcagtgacagctagacatctgcct

SEQ ID NO: 683281 - DNA, 25 bp, Mus musculus
gtcagtgacagtctcccaccaagtc

SEQ ID NO: 683282 - DNA, 25 bp, Mus musculus
gtcagtgacagtgtcccaccaagtc

SEQ ID NO: 683283 - DNA, 25 bp, Mus musculus
gtcagtgacattcctatgcgcagta

SEQ ID NO: 683284 - DNA, 25 bp, Mus musculus
gtcagtgacattgctatgcgcagta

SEQ ID NO: 683285 - DNA, 25 bp, Mus musculus
gtcagtgaccatcccgagctgaata

SEQ ID NO: 683286 - DNA, 25 bp, Mus musculus
gtcagtgaccatgccgagctgaata

SEQ ID NO: 683287 - DNA, 25 bp, Mus musculus
gtcagtgacccactcaatactgtgg

SEQ ID NO: 683288 - DNA, 25 bp, Mus musculus
gtcagtgacccagtcaatactgtgg

SEQ ID NO: 683289 - DNA, 25 bp, Mus musculus
gtcagtgaccctccaggtggtgcca

SEQ ID NO: 683290 - DNA, 25 bp, Mus musculus
gtcagtgaccctgcaggtggtgcca

SEQ ID NO: 683291 - DNA, 25 bp, Mus musculus
gtcagtgactgtcggaatggcttta

SEQ ID NO: 683292 - DNA, 25 bp, Mus musculus
gtcagtgactgtgggaatggcttta

SEQ ID NO: 683293 - DNA, 25 bp, Mus musculus
gtcagtgacttcatttaggtgatca

SEQ ID NO: 683294 - DNA, 25 bp, Mus musculus
gtcagtgacttcttttaggtgatca

SEQ ID NO: 683295 - DNA, 25 bp, Mus musculus
gtcagtgagatcaaggttcagtgag

SEQ ID NO: 683296 - DNA, 25 bp, Mus musculus
gtcagtgagatctaggttcagtgag

SEQ ID NO: 683297 - DNA, 25 bp, Mus musculus
gtcagtgagcaactgctgaaaggtt

SEQ ID NO: 683298 - DNA, 25 bp, Mus musculus
gtcagtgagcaagtgctgaaaggtt

SEQ ID NO: 683299 - DNA, 25 bp, Mus musculus
gtcagtgaggctccggttcagccaa

SEQ ID NO: 683300 - DNA, 25 bp, Mus musculus
gtcagtgaggctgcggttcagccaa

SEQ ID NO: 683301 - DNA, 25 bp, Mus musculus
gtcagtgatcacattccagttgagt

SEQ ID NO: 683302 - DNA, 25 bp, Mus musculus
gtcagtgatcactttccagttgagt

SEQ ID NO: 683303 - DNA, 25 bp, Mus musculus
gtcagtgattggcaactactttgta

SEQ ID NO: 683304 - DNA, 25 bp, Mus musculus
gtcagtgattgggaactactttgta

SEQ ID NO: 683305 - DNA, 25 bp, Mus musculus
gtcagtgatttccataaccttatac

SEQ ID NO: 683306 - DNA, 25 bp, Mus musculus
gtcagtgatttcgataaccttatac

SEQ ID NO: 683307 - DNA, 25 bp, Mus musculus
gtcagtgcaagcactgggaactctc

SEQ ID NO: 683308 - DNA, 25 bp, Mus musculus
gtcagtgcaagctctgggaactctc

SEQ ID NO: 683309 - DNA, 25 bp, Mus musculus
gtcagtgcatgcatcatttgagcaa

SEQ ID NO: 683310 - DNA, 25 bp, Mus musculus
gtcagtgcatgcttcatttgagcaa

SEQ ID NO: 683311 - DNA, 25 bp, Mus musculus
gtcagtgcatttccccgtgttcaca

SEQ ID NO: 683312 - DNA, 25 bp, Mus musculus
gtcagtgcatttgcccgtgttcaca

SEQ ID NO: 683313 - DNA, 25 bp, Mus musculus
gtcagtgccaagagaaggtccctgt

SEQ ID NO: 683314 - DNA, 25 bp, Mus musculus
gtcagtgccaagtgaaggtccctgt

SEQ ID NO: 683315 - DNA, 25 bp, Mus musculus
gtcagtgcccaactatgttttctaa

SEQ ID NO: 683316 - DNA, 25 bp, Mus musculus
gtcagtgcccaagtatgttttctaa

SEQ ID NO: 683317 - DNA, 25 bp, Mus musculus
gtcagtgccttgagtttttgcaact

SEQ ID NO: 683318 - DNA, 25 bp, Mus musculus
gtcagtgccttgtgtttttgcaact

SEQ ID NO: 683319 - DNA, 25 bp, Mus musculus
gtcagtgcgaatagcttaggacttt

SEQ ID NO: 683320 - DNA, 25 bp, Mus musculus
gtcagtgcgaattgcttaggacttt

SEQ ID NO: 683321 - DNA, 25 bp, Mus musculus
gtcagtgcgcttaccgggcacacag

SEQ ID NO: 683322 - DNA, 25 bp, Mus musculus
gtcagtgcgctttccgggcacacag

SEQ ID NO: 683323 - DNA, 25 bp, Mus musculus
gtcagtgcggaaatatgtgctggta

SEQ ID NO: 683324 - DNA, 25 bp, Mus musculus
gtcagtgcggaattatgtgctggta

SEQ ID NO: 683325 - DNA, 25 bp, Mus musculus
gtcagtgctactcgagctcaggcag

SEQ ID NO: 683326 - DNA, 25 bp, Mus musculus
gtcagtgctactggagctcaggcag

SEQ ID NO: 683327 - DNA, 25 bp, Mus musculus
gtcagtgctctgattgggttacata

SEQ ID NO: 683328 - DNA, 25 bp, Mus musculus
gtcagtgctctgtttgggttacata

SEQ ID NO: 683329 - DNA, 25 bp, Mus musculus
gtcagtgctggtcttccgtgtgaaa

SEQ ID NO: 683330 - DNA, 25 bp, Mus musculus
gtcagtgctggtgttccgtgtgaaa

SEQ ID NO: 683331 - DNA, 25 bp, Mus musculus
gtcagtgcttaaatctgtgcgcggt

SEQ ID NO: 683332 - DNA, 25 bp, Mus musculus
gtcagtgcttaattctgtgcgcggt

SEQ ID NO: 683333 - DNA, 25 bp, Mus musculus
gtcagtgctttaaaaggaagtccaa

SEQ ID NO: 683334 - DNA, 25 bp, Mus musculus
gtcagtgctttataaggaagtccaa

SEQ ID NO: 683335 - DNA, 25 bp, Mus musculus
gtcagtgctttgaccttagcaactg

SEQ ID NO: 683336 - DNA, 25 bp, Mus musculus
gtcagtgctttgtccttagcaactg

SEQ ID NO: 683337 - DNA, 25 bp, Mus musculus
gtcagtggatctattctcctaggta

SEQ ID NO: 683338 - DNA, 25 bp, Mus musculus
gtcagtggatcttttctcctaggta

SEQ ID NO: 683339 - DNA, 25 bp, Mus musculus
gtcagtggatggcacatcagcccaa

SEQ ID NO: 683340 - DNA, 25 bp, Mus musculus
gtcagtggatgggacatcagcccaa

SEQ ID NO: 683341 - DNA, 25 bp, Mus musculus
gtcagtggcaagcaatccagctcaa

SEQ ID NO: 683342 - DNA, 25 bp, Mus musculus
gtcagtggcaaggaatccagctcaa

SEQ ID NO: 683343 - DNA, 25 bp, Mus musculus
gtcagtggcattcctgttattctta

SEQ ID NO: 683344 - DNA, 25 bp, Mus musculus
gtcagtggcattgctgttattctta

SEQ ID NO: 683345 - DNA, 25 bp, Mus musculus
gtcagtggcctcagatttactacag

SEQ ID NO: 683346 - DNA, 25 bp, Mus musculus
gtcagtggcctctgatttactacag

SEQ ID NO: 683347 - DNA, 25 bp, Mus musculus
gtcagtggccttctagcatgatgtt

SEQ ID NO: 683348 - DNA, 25 bp, Mus musculus
gtcagtggccttgtagcatgatgtt

SEQ ID NO: 683349 - DNA, 25 bp, Mus musculus
gtcagtggtcttaaaggaacttgcc

SEQ ID NO: 683350 - DNA, 25 bp, Mus musculus
gtcagtggtctttaaggaacttgcc

SEQ ID NO: 683351 - DNA, 25 bp, Mus musculus
gtcagtgtaaaaccagaagatccat

SEQ ID NO: 683352 - DNA, 25 bp, Mus musculus
gtcagtgtaaaagcagaagatccat

SEQ ID NO: 683353 - DNA, 25 bp, Mus musculus
gtcagtgtcaacagacggcagtgtt

SEQ ID NO: 683354 - DNA, 25 bp, Mus musculus
gtcagtgtcaactgacggcagtgtt

SEQ ID NO: 683355 - DNA, 25 bp, Mus musculus
gtcagtgtcagtccgtgtttatgtt

SEQ ID NO: 683356 - DNA, 25 bp, Mus musculus
gtcagtgtcagtgcgtgtttatgtt

SEQ ID NO: 683357 - DNA, 25 bp, Mus musculus
gtcagtgtcatacccatctgggtaa

SEQ ID NO: 683358 - DNA, 25 bp, Mus musculus
gtcagtgtcatagccatctgggtaa

SEQ ID NO: 683359 - DNA, 25 bp, Mus musculus
gtcagtgtcatgcaagacctggttt

SEQ ID NO: 683360 - DNA, 25 bp, Mus musculus
gtcagtgtcatggaagacctggttt

SEQ ID NO: 683361 - DNA, 25 bp, Mus musculus
gtcagtgtcattacctggaatgctt

SEQ ID NO: 683362 - DNA, 25 bp, Mus musculus
gtcagtgtcatttcctggaatgctt

SEQ ID NO: 683363 - DNA, 25 bp, Mus musculus
gtcagtgtccacaatttgtctgaat

SEQ ID NO: 683364 - DNA, 25 bp, Mus musculus
gtcagtgtccactatttgtctgaat

SEQ ID NO: 683365 - DNA, 25 bp, Mus musculus
gtcagtgtccgtatggtacgtatca

SEQ ID NO: 683366 - DNA, 25 bp, Mus musculus
gtcagtgtccgtttggtacgtatca

SEQ ID NO: 683367 - DNA, 25 bp, Mus musculus
gtcagtgtgaacctccaccagggac

SEQ ID NO: 683368 - DNA, 25 bp, Mus musculus
gtcagtgtgaacgtccaccagggac

SEQ ID NO: 683369 - DNA, 25 bp, Mus musculus
gtcagtgtgactacacctccaggaa

SEQ ID NO: 683370 - DNA, 25 bp, Mus musculus
gtcagtgtgacttcacctccaggaa

SEQ ID NO: 683371 - DNA, 25 bp, Mus musculus
gtcagtgtgtggagaatgcatcctt

SEQ ID NO: 683372 - DNA, 25 bp, Mus musculus
gtcagtgtgtggtgaatgcatcctt

SEQ ID NO: 683373 - DNA, 25 bp, Mus musculus
gtcagtgtgtttaatttcattatcc

SEQ ID NO: 683374 - DNA, 25 bp, Mus musculus
gtcagtgtgttttatttcattatcc

SEQ ID NO: 683375 - DNA, 25 bp, Mus musculus
gtcagtgttagtccgttttcccaga

SEQ ID NO: 683376 - DNA, 25 bp, Mus musculus
gtcagtgttagtcgtagcgtgctct

SEQ ID NO: 683377 - DNA, 25 bp, Mus musculus
gtcagtgttagtgcgttttcccaga

SEQ ID NO: 683378 - DNA, 25 bp, Mus musculus
gtcagtgttagtggtagcgtgctct

SEQ ID NO: 683379 - DNA, 25 bp, Mus musculus
gtcagtgttcaactgagttcctacc

SEQ ID NO: 683380 - DNA, 25 bp, Mus musculus
gtcagtgttcaagtgagttcctacc

SEQ ID NO: 683381 - DNA, 25 bp, Mus musculus
gtcagtgttcacctaagacatgcaa

SEQ ID NO: 683382 - DNA, 25 bp, Mus musculus
gtcagtgttcacgtaagacatgcaa

SEQ ID NO: 683383 - DNA, 25 bp, Mus musculus
gtcagtgttcccaatttcggcagga

SEQ ID NO: 683384 - DNA, 25 bp, Mus musculus
gtcagtgttccctatttcggcagga

SEQ ID NO: 683385 - DNA, 25 bp, Mus musculus
gtcagtgttcggcacttcaaaggaa

SEQ ID NO: 683386 - DNA, 25 bp, Mus musculus
gtcagtgttcgggacttcaaaggaa

SEQ ID NO: 683387 - DNA, 25 bp, Mus musculus
gtcagtgttctgcatactgtaattt

SEQ ID NO: 683388 - DNA, 25 bp, Mus musculus
gtcagtgttctggatactgtaattt

SEQ ID NO: 683389 - DNA, 25 bp, Mus musculus
gtcagtgttggacactcagtgccca

SEQ ID NO: 683390 - DNA, 25 bp, Mus musculus
gtcagtgttggagactcagtgccca

SEQ ID NO: 683391 - DNA, 25 bp, Mus musculus
gtcagtgttttgaaccagggtctat

SEQ ID NO: 683392 - DNA, 25 bp, Mus musculus
gtcagtgttttgtaccagggtctat

SEQ ID NO: 683393 - DNA, 25 bp, Mus musculus
gtcagttaaaccctctcaaattact

SEQ ID NO: 683394 - DNA, 25 bp, Mus musculus
gtcagttaaaccgtctcaaattact

SEQ ID NO: 683395 - DNA, 25 bp, Mus musculus
gtcagttaagtcatacagagcctgt

SEQ ID NO: 683396 - DNA, 25 bp, Mus musculus
gtcagttaagtcttacagagcctgt

SEQ ID NO: 683397 - DNA, 25 bp, Mus musculus
gtcagttacactcagcagaaaaagt

SEQ ID NO: 683398 - DNA, 25 bp, Mus musculus
gtcagttacactgagcagaaaaagt

SEQ ID NO: 683399 - DNA, 25 bp, Mus musculus
gtcagttacatgatgatctttcttt

SEQ ID NO: 683400 - DNA, 25 bp, Mus musculus
gtcagttacatgctttgtccacatt

SEQ ID NO: 683401 - DNA, 25 bp, Mus musculus
gtcagttacatggtttgtccacatt

SEQ ID NO: 683402 - DNA, 25 bp, Mus musculus
gtcagttacatgttgatctttcttt

SEQ ID NO: 683403 - DNA, 25 bp, Mus musculus
gtcagttaccaaattcagaccagta

SEQ ID NO: 683404 - DNA, 25 bp, Mus musculus
gtcagttaccaatttcagaccagta

SEQ ID NO: 683405 - DNA, 25 bp, Mus musculus
gtcagttaccacacaggtacagcca

SEQ ID NO: 683406 - DNA, 25 bp, Mus musculus
gtcagttaccacatttcacagtagt

SEQ ID NO: 683407 - DNA, 25 bp, Mus musculus
gtcagttaccactcaggtacagcca

SEQ ID NO: 683408 - DNA, 25 bp, Mus musculus
gtcagttaccacttttcacagtagt

SEQ ID NO: 683409 - DNA, 25 bp, Mus musculus
gtcagttacccaagctacttcaggt

SEQ ID NO: 683410 - DNA, 25 bp, Mus musculus
gtcagttacccatgctacttcaggt

SEQ ID NO: 683411 - DNA, 25 bp, Mus musculus
gtcagttactagcaagcctccttca

SEQ ID NO: 683412 - DNA, 25 bp, Mus musculus
gtcagttactaggaagcctccttca

SEQ ID NO: 683413 - DNA, 25 bp, Mus musculus
gtcagttactccatggtacctttgt

SEQ ID NO: 683414 - DNA, 25 bp, Mus musculus
gtcagttactccttggtacctttgt

SEQ ID NO: 683415 - DNA, 25 bp, Mus musculus
gtcagttagtaaactttttgtcatt

SEQ ID NO: 683416 - DNA, 25 bp, Mus musculus
gtcagttagtaatctttttgtcatt

SEQ ID NO: 683417 - DNA, 25 bp, Mus musculus
gtcagttatgggactccgaatcctc

SEQ ID NO: 683418 - DNA, 25 bp, Mus musculus
gtcagttatgggtctccgaatcctc

SEQ ID NO: 683419 - DNA, 25 bp, Mus musculus
gtcagttatgttccaacctaatttt

SEQ ID NO: 683420 - DNA, 25 bp, Mus musculus
gtcagttatgttgcaacctaatttt

SEQ ID NO: 683421 - DNA, 25 bp, Mus musculus
gtcagttattgcactgggatccaac

SEQ ID NO: 683422 - DNA, 25 bp, Mus musculus
gtcagttattgctctgggatccaac

SEQ ID NO: 683423 - DNA, 25 bp, Mus musculus
gtcagttcaacaatgatagcccctt

SEQ ID NO: 683424 - DNA, 25 bp, Mus musculus
gtcagttcaacattgatagcccctt

SEQ ID NO: 683425 - DNA, 25 bp, Mus musculus
gtcagttcagcgactgtttgtctaa

SEQ ID NO: 683426 - DNA, 25 bp, Mus musculus
gtcagttcagcgtctgtttgtctaa

SEQ ID NO: 683427 - DNA, 25 bp, Mus musculus
gtcagttcagctaaggttctgggac

SEQ ID NO: 683428 - DNA, 25 bp, Mus musculus
gtcagttcagcttaggttctgggac

SEQ ID NO: 683429 - DNA, 25 bp, Mus musculus
gtcagttcagggatcccagagctct

SEQ ID NO: 683430 - DNA, 25 bp, Mus musculus
gtcagttcagggttcccagagctct

SEQ ID NO: 683431 - DNA, 25 bp, Mus musculus
gtcagttcatctcatgttcctactt

SEQ ID NO: 683432 - DNA, 25 bp, Mus musculus
gtcagttcatctgatgttcctactt

SEQ ID NO: 683433 - DNA, 25 bp, Mus musculus
gtcagttcattaactctgcggtgcc

SEQ ID NO: 683434 - DNA, 25 bp, Mus musculus
gtcagttcattatctctgcggtgcc

SEQ ID NO: 683435 - DNA, 25 bp, Mus musculus
gtcagttccaccattgttaaataag

SEQ ID NO: 683436 - DNA, 25 bp, Mus musculus
gtcagttccacctttgttaaataag

SEQ ID NO: 683437 - DNA, 25 bp, Mus musculus
gtcagttcctggaaccgtagagtga

SEQ ID NO: 683438 - DNA, 25 bp, Mus musculus
gtcagttcctggacctaagttaaca

SEQ ID NO: 683439 - DNA, 25 bp, Mus musculus
gtcagttcctggtaccgtagagtga

SEQ ID NO: 683440 - DNA, 25 bp, Mus musculus
gtcagttcctggtcctaagttaaca

SEQ ID NO: 683441 - DNA, 25 bp, Mus musculus
gtcagttcctttatctattgtgtgt

SEQ ID NO: 683442 - DNA, 25 bp, Mus musculus
gtcagttcctttttctattgtgtgt

SEQ ID NO: 683443 - DNA, 25 bp, Mus musculus
gtcagttctctccatgtgctaagga

SEQ ID NO: 683444 - DNA, 25 bp, Mus musculus
gtcagttctctcgatgtgctaagga

SEQ ID NO: 683445 - DNA, 25 bp, Mus musculus
gtcagttctcttaatacctctcagt

SEQ ID NO: 683446 - DNA, 25 bp, Mus musculus
gtcagttctctttatacctctcagt

SEQ ID NO: 683447 - DNA, 25 bp, Mus musculus
gtcagttctggactagtctcgtttt

SEQ ID NO: 683448 - DNA, 25 bp, Mus musculus
gtcagttctggagtagtctcgtttt

SEQ ID NO: 683449 - DNA, 25 bp, Mus musculus
gtcagttcttctacgatttgagtga

SEQ ID NO: 683450 - DNA, 25 bp, Mus musculus
gtcagttcttcttcgatttgagtga

SEQ ID NO: 683451 - DNA, 25 bp, Mus musculus
gtcagttgacagaatgctacccctt

SEQ ID NO: 683452 - DNA, 25 bp, Mus musculus
gtcagttgacagtatgctacccctt

SEQ ID NO: 683453 - DNA, 25 bp, Mus musculus
gtcagttgagacatttgccagggtg

SEQ ID NO: 683454 - DNA, 25 bp, Mus musculus
gtcagttgagacttttgccagggtg

SEQ ID NO: 683455 - DNA, 25 bp, Mus musculus
gtcagttgatgcaggtatcgcctca

SEQ ID NO: 683456 - DNA, 25 bp, Mus musculus
gtcagttgatgctggtatcgcctca

SEQ ID NO: 683457 - DNA, 25 bp, Mus musculus
gtcagttgattcagatccgagctca

SEQ ID NO: 683458 - DNA, 25 bp, Mus musculus
gtcagttgattctgatccgagctca

SEQ ID NO: 683459 - DNA, 25 bp, Mus musculus
gtcagttgcaccaagtgaactccga

SEQ ID NO: 683460 - DNA, 25 bp, Mus musculus
gtcagttgcacctagtgaactccga

SEQ ID NO: 683461 - DNA, 25 bp, Mus musculus
gtcagttgctctaacattgcctata

SEQ ID NO: 683462 - DNA, 25 bp, Mus musculus
gtcagttgctcttacattgcctata

SEQ ID NO: 683463 - DNA, 25 bp, Mus musculus
gtcagttggaaactcgtcctcctac

SEQ ID NO: 683464 - DNA, 25 bp, Mus musculus
gtcagttggaaagtcgtcctcctac

SEQ ID NO: 683465 - DNA, 25 bp, Mus musculus
gtcagttggattcctttacgagcta

SEQ ID NO: 683466 - DNA, 25 bp, Mus musculus
gtcagttggattgctttacgagcta

SEQ ID NO: 683467 - DNA, 25 bp, Mus musculus
gtcagttggtccctgtccaaatccc

SEQ ID NO: 683468 - DNA, 25 bp, Mus musculus
gtcagttggtccgtgtccaaatccc

SEQ ID NO: 683469 - DNA, 25 bp, Mus musculus
gtcagttgtactagtggcacgtgtt

SEQ ID NO: 683470 - DNA, 25 bp, Mus musculus
gtcagttgtacttgtggcacgtgtt

SEQ ID NO: 683471 - DNA, 25 bp, Mus musculus
gtcagttgttatcttttgctttgct

SEQ ID NO: 683472 - DNA, 25 bp, Mus musculus
gtcagttgttatgttttgctttgct

SEQ ID NO: 683473 - DNA, 25 bp, Mus musculus
gtcagtttaatacacgagctcttgt

SEQ ID NO: 683474 - DNA, 25 bp, Mus musculus
gtcagtttaatagacgagctcttgt
